United States Patent 7,314,750 (ADDRESSABLE OLIGONUCLEOTIDE ARRAY OF THE RAT GENOME) - sequence listing, part 17

SEQ ID NO: 604162 - DNA, 25 bp, Rattus norvegicus
tgaaggaggctttcccggaagccaa

SEQ ID NO: 604163 - DNA, 25 bp, Rattus norvegicus
tgaaggagggacactgagctcacct

SEQ ID NO: 604164 - DNA, 25 bp, Rattus norvegicus
tgaaggagggactctgagctcacct

SEQ ID NO: 604165 - DNA, 25 bp, Rattus norvegicus
tgaaggaggtgtacgactcggccat

SEQ ID NO: 604166 - DNA, 25 bp, Rattus norvegicus
tgaaggaggtgttcgactcggccat

SEQ ID NO: 604167 - DNA, 25 bp, Rattus norvegicus
tgaaggagtacacccagctcaaact

SEQ ID NO: 604168 - DNA, 25 bp, Rattus norvegicus
tgaaggagtacacccgtccggcagc

SEQ ID NO: 604169 - DNA, 25 bp, Rattus norvegicus
tgaaggagtacagccagctcaaact

SEQ ID NO: 604170 - DNA, 25 bp, Rattus norvegicus
tgaaggagtacagccgtccggcagc

SEQ ID NO: 604171 - DNA, 25 bp, Rattus norvegicus
tgaaggagtccaccaccagtgagca

SEQ ID NO: 604172 - DNA, 25 bp, Rattus norvegicus
tgaaggagtccagcaccagtgagca

SEQ ID NO: 604173 - DNA, 25 bp, Rattus norvegicus
tgaaggagtgggatctgctccctgt

SEQ ID NO: 604174 - DNA, 25 bp, Rattus norvegicus
tgaaggagtgggttctgctccctgt

SEQ ID NO: 604175 - DNA, 25 bp, Rattus norvegicus
tgaaggagtggtaggtttcctccct

SEQ ID NO: 604176 - DNA, 25 bp, Rattus norvegicus
tgaaggagtggttggtttcctccct

SEQ ID NO: 604177 - DNA, 25 bp, Rattus norvegicus
tgaaggagttcaaggcaccccgaca

SEQ ID NO: 604178 - DNA, 25 bp, Rattus norvegicus
tgaaggagttcatggcaccccgaca

SEQ ID NO: 604179 - DNA, 25 bp, Rattus norvegicus
tgaaggatccatctctgtgtgttga

SEQ ID NO: 604180 - DNA, 25 bp, Rattus norvegicus
tgaaggatccatgtctgtgtgttga

SEQ ID NO: 604181 - DNA, 25 bp, Rattus norvegicus
tgaaggatcctacccagagatcgca

SEQ ID NO: 604182 - DNA, 25 bp, Rattus norvegicus
tgaaggatcctagccagagatcgca

SEQ ID NO: 604183 - DNA, 25 bp, Rattus norvegicus
tgaaggatctgcaccggatgtgatt

SEQ ID NO: 604184 - DNA, 25 bp, Rattus norvegicus
tgaaggatctgctccggatgtgatt

SEQ ID NO: 604185 - DNA, 25 bp, Rattus norvegicus
tgaaggatgcacacaggacccaccc

SEQ ID NO: 604186 - DNA, 25 bp, Rattus norvegicus
tgaaggatgcactcaggacccaccc

SEQ ID NO: 604187 - DNA, 25 bp, Rattus norvegicus
tgaaggattactcctttgcccggga

SEQ ID NO: 604188 - DNA, 25 bp, Rattus norvegicus
tgaaggattactgctttgcccggga

SEQ ID NO: 604189 - DNA, 25 bp, Rattus norvegicus
tgaaggattcgtccttgccatggcc

SEQ ID NO: 604190 - DNA, 25 bp, Rattus norvegicus
tgaaggattcgtgcttgccatggcc

SEQ ID NO: 604191 - DNA, 25 bp, Rattus norvegicus
tgaaggcaacccacttgaagaaacc

SEQ ID NO: 604192 - DNA, 25 bp, Rattus norvegicus
tgaaggcaaccctcttgaagaaacc

SEQ ID NO: 604193 - DNA, 25 bp, Rattus norvegicus
tgaaggcaacgacagccaaccggct

SEQ ID NO: 604194 - DNA, 25 bp, Rattus norvegicus
tgaaggcaacgagagccaaccggct

SEQ ID NO: 604195 - DNA, 25 bp, Rattus norvegicus
tgaaggcaagcacctttacacatta

SEQ ID NO: 604196 - DNA, 25 bp, Rattus norvegicus
tgaaggcaagcagctttacacatta

SEQ ID NO: 604197 - DNA, 25 bp, Rattus norvegicus
tgaaggcaagccctactgcaaccat

SEQ ID NO: 604198 - DNA, 25 bp, Rattus norvegicus
tgaaggcaagccgtactgcaaccat

SEQ ID NO: 604199 - DNA, 25 bp, Rattus norvegicus
tgaaggcaccagaggactcctcagc

SEQ ID NO: 604200 - DNA, 25 bp, Rattus norvegicus
tgaaggcaccagtggactcctcagc

SEQ ID NO: 604201 - DNA, 25 bp, Rattus norvegicus
tgaaggcaccgaatgcagccttttt

SEQ ID NO: 604202 - DNA, 25 bp, Rattus norvegicus
tgaaggcaccgattgcagccttttt

SEQ ID NO: 604203 - DNA, 25 bp, Rattus norvegicus
tgaaggcacggccacactgtggaca

SEQ ID NO: 604204 - DNA, 25 bp, Rattus norvegicus
tgaaggcacggcgacactgtggaca

SEQ ID NO: 604205 - DNA, 25 bp, Rattus norvegicus
tgaaggcagctgattctgggtcttt

SEQ ID NO: 604206 - DNA, 25 bp, Rattus norvegicus
tgaaggcagctgtttctgggtcttt

SEQ ID NO: 604207 - DNA, 25 bp, Rattus norvegicus
tgaaggcagggactcttggtcacaa

SEQ ID NO: 604208 - DNA, 25 bp, Rattus norvegicus
tgaaggcagggagtcttggtcacaa

SEQ ID NO: 604209 - DNA, 25 bp, Rattus norvegicus
tgaaggcatcgcatggctttgtagc

SEQ ID NO: 604210 - DNA, 25 bp, Rattus norvegicus
tgaaggcatcgcttggctttgtagc

SEQ ID NO: 604211 - DNA, 25 bp, Rattus norvegicus
tgaaggcatcttatggaccaactgt

SEQ ID NO: 604212 - DNA, 25 bp, Rattus norvegicus
tgaaggcatcttttggaccaactgt

SEQ ID NO: 604213 - DNA, 25 bp, Rattus norvegicus
tgaaggcatggcaagctccacacaa

SEQ ID NO: 604214 - DNA, 25 bp, Rattus norvegicus
tgaaggcatggctagctccacacaa

SEQ ID NO: 604215 - DNA, 25 bp, Rattus norvegicus
tgaaggcattctacagccgagtcgc

SEQ ID NO: 604216 - DNA, 25 bp, Rattus norvegicus
tgaaggcattcttcagccgagtcgc

SEQ ID NO: 604217 - DNA, 25 bp, Rattus norvegicus
tgaaggccaagtactgcagcaccgt

SEQ ID NO: 604218 - DNA, 25 bp, Rattus norvegicus
tgaaggccaagttctgcagcaccgt

SEQ ID NO: 604219 - DNA, 25 bp, Rattus norvegicus
tgaaggccaataacatgtccaacta

SEQ ID NO: 604220 - DNA, 25 bp, Rattus norvegicus
tgaaggccaatatcatgtccaacta

SEQ ID NO: 604221 - DNA, 25 bp, Rattus norvegicus
tgaaggccacctacctgggtgctga

SEQ ID NO: 604222 - DNA, 25 bp, Rattus norvegicus
tgaaggccaccttcctgggtgctga

SEQ ID NO: 604223 - DNA, 25 bp, Rattus norvegicus
tgaaggccagatcccagtgtttatt

SEQ ID NO: 604224 - DNA, 25 bp, Rattus norvegicus
tgaaggccagatgccagtgtttatt

SEQ ID NO: 604225 - DNA, 25 bp, Rattus norvegicus
tgaaggccagtcacgggttcagaat

SEQ ID NO: 604226 - DNA, 25 bp, Rattus norvegicus
tgaaggccagtctcgggttcagaat

SEQ ID NO: 604227 - DNA, 25 bp, Rattus norvegicus
tgaaggccatggaccttgtcctagt

SEQ ID NO: 604228 - DNA, 25 bp, Rattus norvegicus
tgaaggccatggtccttgtcctagt

SEQ ID NO: 604229 - DNA, 25 bp, Rattus norvegicus
tgaaggcccagtcttcccagacgtg

SEQ ID NO: 604230 - DNA, 25 bp, Rattus norvegicus
tgaaggcccagtgttcccagacgtg

SEQ ID NO: 604231 - DNA, 25 bp, Rattus norvegicus
tgaaggcccgttaggcctcagcagg

SEQ ID NO: 604232 - DNA, 25 bp, Rattus norvegicus
tgaaggcccgtttggcctcagcagg

SEQ ID NO: 604233 - DNA, 25 bp, Rattus norvegicus
tgaaggccctctcaggctgatgcct

SEQ ID NO: 604234 - DNA, 25 bp, Rattus norvegicus
tgaaggccctctcttcaacttgttg

SEQ ID NO: 604235 - DNA, 25 bp, Rattus norvegicus
tgaaggccctctgaggctgatgcct

SEQ ID NO: 604236 - DNA, 25 bp, Rattus norvegicus
tgaaggccctctgttcaacttgttg

SEQ ID NO: 604237 - DNA, 25 bp, Rattus norvegicus
tgaaggccgcatactcactaaagga

SEQ ID NO: 604238 - DNA, 25 bp, Rattus norvegicus
tgaaggccgcattctcactaaagga

SEQ ID NO: 604239 - DNA, 25 bp, Rattus norvegicus
tgaaggccgtccctctggcatcagg

SEQ ID NO: 604240 - DNA, 25 bp, Rattus norvegicus
tgaaggccgtccgtctggcatcagg

SEQ ID NO: 604241 - DNA, 25 bp, Rattus norvegicus
tgaaggccgtgtcctgctcactgga

SEQ ID NO: 604242 - DNA, 25 bp, Rattus norvegicus
tgaaggccgtgtgctgctcactgga

SEQ ID NO: 604243 - DNA, 25 bp, Rattus norvegicus
tgaaggcctacaagcgccaggctga

SEQ ID NO: 604244 - DNA, 25 bp, Rattus norvegicus
tgaaggcctacatgcgccaggctga

SEQ ID NO: 604245 - DNA, 25 bp, Rattus norvegicus
tgaaggcctctcacacaaaaccaga

SEQ ID NO: 604246 - DNA, 25 bp, Rattus norvegicus
tgaaggcctctctcacaaaaccaga

SEQ ID NO: 604247 - DNA, 25 bp, Rattus norvegicus
tgaaggcctgctccatggcatctaa

SEQ ID NO: 604248 - DNA, 25 bp, Rattus norvegicus
tgaaggcctgctgcatggcatctaa

SEQ ID NO: 604249 - DNA, 25 bp, Rattus norvegicus
tgaaggcctgggagggattggagct

SEQ ID NO: 604250 - DNA, 25 bp, Rattus norvegicus
tgaaggcctgggtgggattggagct

SEQ ID NO: 604251 - DNA, 25 bp, Rattus norvegicus
tgaaggccttccactgcatacagta

SEQ ID NO: 604252 - DNA, 25 bp, Rattus norvegicus
tgaaggccttcctctgcatacagta

SEQ ID NO: 604253 - DNA, 25 bp, Rattus norvegicus
tgaaggccttcgagtgtttgacaaa

SEQ ID NO: 604254 - DNA, 25 bp, Rattus norvegicus
tgaaggccttcgtgtgtttgacaaa

SEQ ID NO: 604255 - DNA, 25 bp, Rattus norvegicus
tgaaggcgcctgagacccgagacaa

SEQ ID NO: 604256 - DNA, 25 bp, Rattus norvegicus
tgaaggcgcctgtgacccgagacaa

SEQ ID NO: 604257 - DNA, 25 bp, Rattus norvegicus
tgaaggcgcgcgaacagcagctccg

SEQ ID NO: 604258 - DNA, 25 bp, Rattus norvegicus
tgaaggcgcgcgtacagcagctccg

SEQ ID NO: 604259 - DNA, 25 bp, Rattus norvegicus
tgaaggcgctgcagggctctaagca

SEQ ID NO: 604260 - DNA, 25 bp, Rattus norvegicus
tgaaggcgctgctgggctctaagca

SEQ ID NO: 604261 - DNA, 25 bp, Rattus norvegicus
tgaaggcggctgacctgttgttctc

SEQ ID NO: 604262 - DNA, 25 bp, Rattus norvegicus
tgaaggcggctgtcctgttgttctc

SEQ ID NO: 604263 - DNA, 25 bp, Rattus norvegicus
tgaaggcgttgactcgagtcaccgt

SEQ ID NO: 604264 - DNA, 25 bp, Rattus norvegicus
tgaaggcgttgagtcgagtcaccgt

SEQ ID NO: 604265 - DNA, 25 bp, Rattus norvegicus
tgaaggctaccaaacggtttcctcg

SEQ ID NO: 604266 - DNA, 25 bp, Rattus norvegicus
tgaaggctaccatacggtttcctcg

SEQ ID NO: 604267 - DNA, 25 bp, Rattus norvegicus
tgaaggctagctccccttgtatata

SEQ ID NO: 604268 - DNA, 25 bp, Rattus norvegicus
tgaaggctagctgcccttgtatata

SEQ ID NO: 604269 - DNA, 25 bp, Rattus norvegicus
tgaaggctcagcacgggatctgcga

SEQ ID NO: 604270 - DNA, 25 bp, Rattus norvegicus
tgaaggctcagctcgggatctgcga

SEQ ID NO: 604271 - DNA, 25 bp, Rattus norvegicus
tgaaggctcctcattgtgactgcag

SEQ ID NO: 604272 - DNA, 25 bp, Rattus norvegicus
tgaaggctcctctttgtgactgcag

SEQ ID NO: 604273 - DNA, 25 bp, Rattus norvegicus
tgaaggctccttacctctagagggt

SEQ ID NO: 604274 - DNA, 25 bp, Rattus norvegicus
tgaaggctcctttcctctagagggt

SEQ ID NO: 604275 - DNA, 25 bp, Rattus norvegicus
tgaaggctcgatacttaccaagtcc

SEQ ID NO: 604276 - DNA, 25 bp, Rattus norvegicus
tgaaggctcgattcttaccaagtcc

SEQ ID NO: 604277 - DNA, 25 bp, Rattus norvegicus
tgaaggctctgcagaccgccacgaa

SEQ ID NO: 604278 - DNA, 25 bp, Rattus norvegicus
tgaaggctctgctgaccgccacgaa

SEQ ID NO: 604279 - DNA, 25 bp, Rattus norvegicus
tgaaggctctggaagccccagtggc

SEQ ID NO: 604280 - DNA, 25 bp, Rattus norvegicus
tgaaggctctggtagccccagtggc

SEQ ID NO: 604281 - DNA, 25 bp, Rattus norvegicus
tgaaggctgaacattttcccgtaag

SEQ ID NO: 604282 - DNA, 25 bp, Rattus norvegicus
tgaaggctgaactttttcccgtaag

SEQ ID NO: 604283 - DNA, 25 bp, Rattus norvegicus
tgaaggctgaggactcggccagaac

SEQ ID NO: 604284 - DNA, 25 bp, Rattus norvegicus
tgaaggctgaggtctcggccagaac

SEQ ID NO: 604285 - DNA, 25 bp, Rattus norvegicus
tgaaggctgccaacacgatgtcacc

SEQ ID NO: 604286 - DNA, 25 bp, Rattus norvegicus
tgaaggctgccatcacgatgtcacc

SEQ ID NO: 604287 - DNA, 25 bp, Rattus norvegicus
tgaaggctgggaaagcaccctctgt

SEQ ID NO: 604288 - DNA, 25 bp, Rattus norvegicus
tgaaggctgggacctcctcattctg

SEQ ID NO: 604289 - DNA, 25 bp, Rattus norvegicus
tgaaggctgggagctcctcattctg

SEQ ID NO: 604290 - DNA, 25 bp, Rattus norvegicus
tgaaggctgggatagcaccctctgt

SEQ ID NO: 604291 - DNA, 25 bp, Rattus norvegicus
tgaaggctggttcctcctgtcaggt

SEQ ID NO: 604292 - DNA, 25 bp, Rattus norvegicus
tgaaggctggttgctcctgtcaggt

SEQ ID NO: 604293 - DNA, 25 bp, Rattus norvegicus
tgaaggctgttaccgcactgtatgg

SEQ ID NO: 604294 - DNA, 25 bp, Rattus norvegicus
tgaaggctgttagcgcactgtatgg

SEQ ID NO: 604295 - DNA, 25 bp, Rattus norvegicus
tgaaggctgttcagttggctgacac

SEQ ID NO: 604296 - DNA, 25 bp, Rattus norvegicus
tgaaggctgttctgttggctgacac

SEQ ID NO: 604297 - DNA, 25 bp, Rattus norvegicus
tgaaggcttaatatgggcaccagaa

SEQ ID NO: 604298 - DNA, 25 bp, Rattus norvegicus
tgaaggcttaatttgggcaccagaa

SEQ ID NO: 604299 - DNA, 25 bp, Rattus norvegicus
tgaaggcttctccagtgacagtgac

SEQ ID NO: 604300 - DNA, 25 bp, Rattus norvegicus
tgaaggcttctcgagtgacagtgac

SEQ ID NO: 604301 - DNA, 25 bp, Rattus norvegicus
tgaaggcttctgagtctttgacttt

SEQ ID NO: 604302 - DNA, 25 bp, Rattus norvegicus
tgaaggcttctgcaataacctctcc

SEQ ID NO: 604303 - DNA, 25 bp, Rattus norvegicus
tgaaggcttctggaataacctctcc

SEQ ID NO: 604304 - DNA, 25 bp, Rattus norvegicus
tgaaggcttctgtgtctttgacttt

SEQ ID NO: 604305 - DNA, 25 bp, Rattus norvegicus
tgaaggcttgacacttgagctctct

SEQ ID NO: 604306 - DNA, 25 bp, Rattus norvegicus
tgaaggcttgactcttgagctctct

SEQ ID NO: 604307 - DNA, 25 bp, Rattus norvegicus
tgaaggctttaaaccggaccctgga

SEQ ID NO: 604308 - DNA, 25 bp, Rattus norvegicus
tgaaggctttaatccggaccctgga

SEQ ID NO: 604309 - DNA, 25 bp, Rattus norvegicus
tgaaggcttttcattcagccaagaa

SEQ ID NO: 604310 - DNA, 25 bp, Rattus norvegicus
tgaaggcttttctttcagccaagaa

SEQ ID NO: 604311 - DNA, 25 bp, Rattus norvegicus
tgaagggaacgtcttcttttcttct

SEQ ID NO: 604312 - DNA, 25 bp, Rattus norvegicus
tgaagggaacgtgttcttttcttct

SEQ ID NO: 604313 - DNA, 25 bp, Rattus norvegicus
tgaagggactgactgtacacacatg

SEQ ID NO: 604314 - DNA, 25 bp, Rattus norvegicus
tgaagggactgagtgtacacacatg

SEQ ID NO: 604315 - DNA, 25 bp, Rattus norvegicus
tgaagggaggtacttctgccagctc

SEQ ID NO: 604316 - DNA, 25 bp, Rattus norvegicus
tgaagggaggtagttctgccagctc

SEQ ID NO: 604317 - DNA, 25 bp, Rattus norvegicus
tgaagggataccctttcccagaagt

SEQ ID NO: 604318 - DNA, 25 bp, Rattus norvegicus
tgaagggataccgtttcccagaagt

SEQ ID NO: 604319 - DNA, 25 bp, Rattus norvegicus
tgaagggatcaacctgacgactcag

SEQ ID NO: 604320 - DNA, 25 bp, Rattus norvegicus
tgaagggatcaagctgacgactcag

SEQ ID NO: 604321 - DNA, 25 bp, Rattus norvegicus
tgaagggatgctcccctagggttaa

SEQ ID NO: 604322 - DNA, 25 bp, Rattus norvegicus
tgaagggatgctgccctagggttaa

SEQ ID NO: 604323 - DNA, 25 bp, Rattus norvegicus
tgaagggattaacagacgggaacat

SEQ ID NO: 604324 - DNA, 25 bp, Rattus norvegicus
tgaagggattaagagacgggaacat

SEQ ID NO: 604325 - DNA, 25 bp, Rattus norvegicus
tgaagggcaacgagagcaatgcaga

SEQ ID NO: 604326 - DNA, 25 bp, Rattus norvegicus
tgaagggcaacgtgagcaatgcaga

SEQ ID NO: 604327 - DNA, 25 bp, Rattus norvegicus
tgaagggcagctaccgcttggtgac

SEQ ID NO: 604328 - DNA, 25 bp, Rattus norvegicus
tgaagggcagcttccgcttggtgac

SEQ ID NO: 604329 - DNA, 25 bp, Rattus norvegicus
tgaagggcaggacccacccgaagca

SEQ ID NO: 604330 - DNA, 25 bp, Rattus norvegicus
tgaagggcaggagccacccgaagca

SEQ ID NO: 604331 - DNA, 25 bp, Rattus norvegicus
tgaagggcatttactccgtgagcaa

SEQ ID NO: 604332 - DNA, 25 bp, Rattus norvegicus
tgaagggcattttctccgtgagcaa

SEQ ID NO: 604333 - DNA, 25 bp, Rattus norvegicus
tgaagggccaccagaacgggtctat

SEQ ID NO: 604334 - DNA, 25 bp, Rattus norvegicus
tgaagggccacctgaacgggtctat

SEQ ID NO: 604335 - DNA, 25 bp, Rattus norvegicus
tgaagggcccaaccatgacatcaga

SEQ ID NO: 604336 - DNA, 25 bp, Rattus norvegicus
tgaagggcccaagcatgacatcaga

SEQ ID NO: 604337 - DNA, 25 bp, Rattus norvegicus
tgaagggcgctgagccccatcaggt

SEQ ID NO: 604338 - DNA, 25 bp, Rattus norvegicus
tgaagggcgctgtgccccatcaggt

SEQ ID NO: 604339 - DNA, 25 bp, Rattus norvegicus
tgaagggcggtactcagcgtttcca

SEQ ID NO: 604340 - DNA, 25 bp, Rattus norvegicus
tgaagggcggtagtcagcgtttcca

SEQ ID NO: 604341 - DNA, 25 bp, Rattus norvegicus
tgaagggcgtatcatcatcgatggc

SEQ ID NO: 604342 - DNA, 25 bp, Rattus norvegicus
tgaagggcgtatgatcatcgatggc

SEQ ID NO: 604343 - DNA, 25 bp, Rattus norvegicus
tgaagggctatacctcttgggccat

SEQ ID NO: 604344 - DNA, 25 bp, Rattus norvegicus
tgaagggctatagctcttgggccat

SEQ ID NO: 604345 - DNA, 25 bp, Rattus norvegicus
tgaagggctcgtagctgctggaatt

SEQ ID NO: 604346 - DNA, 25 bp, Rattus norvegicus
tgaagggctcgttgctgctggaatt

SEQ ID NO: 604347 - DNA, 25 bp, Rattus norvegicus
tgaagggctctgaactcctggcggt

SEQ ID NO: 604348 - DNA, 25 bp, Rattus norvegicus
tgaagggctctgtactcctggcggt

SEQ ID NO: 604349 - DNA, 25 bp, Rattus norvegicus
tgaagggctcttccctcattaacaa

SEQ ID NO: 604350 - DNA, 25 bp, Rattus norvegicus
tgaagggctcttgcctcattaacaa

SEQ ID NO: 604351 - DNA, 25 bp, Rattus norvegicus
tgaagggctggcatcttccaggctt

SEQ ID NO: 604352 - DNA, 25 bp, Rattus norvegicus
tgaagggctggcttcttccaggctt

SEQ ID NO: 604353 - DNA, 25 bp, Rattus norvegicus
tgaagggctttcaactggcctggca

SEQ ID NO: 604354 - DNA, 25 bp, Rattus norvegicus
tgaagggctttctactggcctggca

SEQ ID NO: 604355 - DNA, 25 bp, Rattus norvegicus
tgaagggtatcacgccccagagctg

SEQ ID NO: 604356 - DNA, 25 bp, Rattus norvegicus
tgaagggtatcaggccccagagctg

SEQ ID NO: 604357 - DNA, 25 bp, Rattus norvegicus
tgaagggtccaacgagccaccacgg

SEQ ID NO: 604358 - DNA, 25 bp, Rattus norvegicus
tgaagggtccaaggagccaccacgg

SEQ ID NO: 604359 - DNA, 25 bp, Rattus norvegicus
tgaagggtccagctatccacaactg

SEQ ID NO: 604360 - DNA, 25 bp, Rattus norvegicus
tgaagggtccaggtatccacaactg

SEQ ID NO: 604361 - DNA, 25 bp, Rattus norvegicus
tgaagggtcctcaactctggctgga

SEQ ID NO: 604362 - DNA, 25 bp, Rattus norvegicus
tgaagggtcctctactctggctgga

SEQ ID NO: 604363 - DNA, 25 bp, Rattus norvegicus
tgaagggtctctagctcaaactggc

SEQ ID NO: 604364 - DNA, 25 bp, Rattus norvegicus
tgaagggtctcttgctcaaactggc

SEQ ID NO: 604365 - DNA, 25 bp, Rattus norvegicus
tgaagggtgctgcaactcgccataa

SEQ ID NO: 604366 - DNA, 25 bp, Rattus norvegicus
tgaagggtgctggaactcgccataa

SEQ ID NO: 604367 - DNA, 25 bp, Rattus norvegicus
tgaagggttaccaaactgctctggg

SEQ ID NO: 604368 - DNA, 25 bp, Rattus norvegicus
tgaagggttacctaactgctctggg

SEQ ID NO: 604369 - DNA, 25 bp, Rattus norvegicus
tgaagggttctcaaggttgcatttc

SEQ ID NO: 604370 - DNA, 25 bp, Rattus norvegicus
tgaagggttctccatgtgcatgtct

SEQ ID NO: 604371 - DNA, 25 bp, Rattus norvegicus
tgaagggttctcgatgtgcatgtct

SEQ ID NO: 604372 - DNA, 25 bp, Rattus norvegicus
tgaagggttctctaggttgcatttc

SEQ ID NO: 604373 - DNA, 25 bp, Rattus norvegicus
tgaagggttttcctgctttcagcag

SEQ ID NO: 604374 - DNA, 25 bp, Rattus norvegicus
tgaagggttttcgtgctttcagcag

SEQ ID NO: 604375 - DNA, 25 bp, Rattus norvegicus
tgaaggtactttctcactcctatgt

SEQ ID NO: 604376 - DNA, 25 bp, Rattus norvegicus
tgaaggtactttgtcactcctatgt

SEQ ID NO: 604377 - DNA, 25 bp, Rattus norvegicus
tgaaggtatctgattgccgctcact

SEQ ID NO: 604378 - DNA, 25 bp, Rattus norvegicus
tgaaggtatctgcacagttgtctgc

SEQ ID NO: 604379 - DNA, 25 bp, Rattus norvegicus
tgaaggtatctggacagttgtctgc

SEQ ID NO: 604380 - DNA, 25 bp, Rattus norvegicus
tgaaggtatctgtttgccgctcact

SEQ ID NO: 604381 - DNA, 25 bp, Rattus norvegicus
tgaaggtcaagcagtcctcagtgcc

SEQ ID NO: 604382 - DNA, 25 bp, Rattus norvegicus
tgaaggtcaagctgtcctcagtgcc

SEQ ID NO: 604383 - DNA, 25 bp, Rattus norvegicus
tgaaggtcacttctcatcctgaatc

SEQ ID NO: 604384 - DNA, 25 bp, Rattus norvegicus
tgaaggtcacttgtcatcctgaatc

SEQ ID NO: 604385 - DNA, 25 bp, Rattus norvegicus
tgaaggtcaggccacatctcatcca

SEQ ID NO: 604386 - DNA, 25 bp, Rattus norvegicus
tgaaggtcaggcgacatctcatcca

SEQ ID NO: 604387 - DNA, 25 bp, Rattus norvegicus
tgaaggtcataaccttaccctccaa

SEQ ID NO: 604388 - DNA, 25 bp, Rattus norvegicus
tgaaggtcataagcttaccctccaa

SEQ ID NO: 604389 - DNA, 25 bp, Rattus norvegicus
tgaaggtcatagagcgtgcggcctt

SEQ ID NO: 604390 - DNA, 25 bp, Rattus norvegicus
tgaaggtcatagtgcgtgcggcctt

SEQ ID NO: 604391 - DNA, 25 bp, Rattus norvegicus
tgaaggtcatttccctcctttgtga

SEQ ID NO: 604392 - DNA, 25 bp, Rattus norvegicus
tgaaggtcatttgcctcctttgtga

SEQ ID NO: 604393 - DNA, 25 bp, Rattus norvegicus
tgaaggtccactctttctctatggc

SEQ ID NO: 604394 - DNA, 25 bp, Rattus norvegicus
tgaaggtccactgtttctctatggc

SEQ ID NO: 604395 - DNA, 25 bp, Rattus norvegicus
tgaaggtccctgcatagattccatc

SEQ ID NO: 604396 - DNA, 25 bp, Rattus norvegicus
tgaaggtccctggatagattccatc

SEQ ID NO: 604397 - DNA, 25 bp, Rattus norvegicus
tgaaggtccttcaagagctctcaca

SEQ ID NO: 604398 - DNA, 25 bp, Rattus norvegicus
tgaaggtccttctagagctctcaca

SEQ ID NO: 604399 - DNA, 25 bp, Rattus norvegicus
tgaaggtcgggtcccgcctgtttca

SEQ ID NO: 604400 - DNA, 25 bp, Rattus norvegicus
tgaaggtcgggtgccgcctgtttca

SEQ ID NO: 604401 - DNA, 25 bp, Rattus norvegicus
tgaaggtctatcctggttgctcagt

SEQ ID NO: 604402 - DNA, 25 bp, Rattus norvegicus
tgaaggtctatcgtggttgctcagt

SEQ ID NO: 604403 - DNA, 25 bp, Rattus norvegicus
tgaaggtctcgaaacagctgttatg

SEQ ID NO: 604404 - DNA, 25 bp, Rattus norvegicus
tgaaggtctcgatacagctgttatg

SEQ ID NO: 604405 - DNA, 25 bp, Rattus norvegicus
tgaaggtctcggcaaactcgctgac

SEQ ID NO: 604406 - DNA, 25 bp, Rattus norvegicus
tgaaggtctcgggaaactcgctgac

SEQ ID NO: 604407 - DNA, 25 bp, Rattus norvegicus
tgaaggtcttctatggtggccagga

SEQ ID NO: 604408 - DNA, 25 bp, Rattus norvegicus
tgaaggtcttctcatcaatttggaa

SEQ ID NO: 604409 - DNA, 25 bp, Rattus norvegicus
tgaaggtcttctcctttacctgtgg

SEQ ID NO: 604410 - DNA, 25 bp, Rattus norvegicus
tgaaggtcttctgatcaatttggaa

SEQ ID NO: 604411 - DNA, 25 bp, Rattus norvegicus
tgaaggtcttctgctttacctgtgg

SEQ ID NO: 604412 - DNA, 25 bp, Rattus norvegicus
tgaaggtcttctttggtggccagga

SEQ ID NO: 604413 - DNA, 25 bp, Rattus norvegicus
tgaaggtcttgtccgggctcctgaa

SEQ ID NO: 604414 - DNA, 25 bp, Rattus norvegicus
tgaaggtcttgtgcgggctcctgaa

SEQ ID NO: 604415 - DNA, 25 bp, Rattus norvegicus
tgaaggtgacttcccacatggagag

SEQ ID NO: 604416 - DNA, 25 bp, Rattus norvegicus
tgaaggtgacttgccacatggagag

SEQ ID NO: 604417 - DNA, 25 bp, Rattus norvegicus
tgaaggtgagtccagggtccctcct

SEQ ID NO: 604418 - DNA, 25 bp, Rattus norvegicus
tgaaggtgagtcgagggtccctcct

SEQ ID NO: 604419 - DNA, 25 bp, Rattus norvegicus
tgaaggtgattgacagctccctggg

SEQ ID NO: 604420 - DNA, 25 bp, Rattus norvegicus
tgaaggtgattgtcagctccctggg

SEQ ID NO: 604421 - DNA, 25 bp, Rattus norvegicus
tgaaggtgcctccatcgactgtgga

SEQ ID NO: 604422 - DNA, 25 bp, Rattus norvegicus
tgaaggtgcctcgatcgactgtgga

SEQ ID NO: 604423 - DNA, 25 bp, Rattus norvegicus
tgaaggtggcgcaggcactaacact

SEQ ID NO: 604424 - DNA, 25 bp, Rattus norvegicus
tgaaggtggcgctggcactaacact

SEQ ID NO: 604425 - DNA, 25 bp, Rattus norvegicus
tgaaggtggctgatcctgctaatgc

SEQ ID NO: 604426 - DNA, 25 bp, Rattus norvegicus
tgaaggtggctgttcctgctaatgc

SEQ ID NO: 604427 - DNA, 25 bp, Rattus norvegicus
tgaaggtggtggaacgcactcgcac

SEQ ID NO: 604428 - DNA, 25 bp, Rattus norvegicus
tgaaggtggtggtacgcactcgcac

SEQ ID NO: 604429 - DNA, 25 bp, Rattus norvegicus
tgaaggtgtggcagtaatctgatac

SEQ ID NO: 604430 - DNA, 25 bp, Rattus norvegicus
tgaaggtgtggctgtaatctgatac

SEQ ID NO: 604431 - DNA, 25 bp, Rattus norvegicus
tgaaggtgtgggacatcggttatac

SEQ ID NO: 604432 - DNA, 25 bp, Rattus norvegicus
tgaaggtgtgggtcatcggttatac

SEQ ID NO: 604433 - DNA, 25 bp, Rattus norvegicus
tgaaggttaccccaagagcaagaag

SEQ ID NO: 604434 - DNA, 25 bp, Rattus norvegicus
tgaaggttacccgaagagcaagaag

SEQ ID NO: 604435 - DNA, 25 bp, Rattus norvegicus
tgaaggttactaagaggcccaggtt

SEQ ID NO: 604436 - DNA, 25 bp, Rattus norvegicus
tgaaggttactatgaggcccaggtt

SEQ ID NO: 604437 - DNA, 25 bp, Rattus norvegicus
tgaaggttcacactctgcctccgag

SEQ ID NO: 604438 - DNA, 25 bp, Rattus norvegicus
tgaaggttcacagtctgcctccgag

SEQ ID NO: 604439 - DNA, 25 bp, Rattus norvegicus
tgaaggttcccaaactgaagccagg

SEQ ID NO: 604440 - DNA, 25 bp, Rattus norvegicus
tgaaggttcccatactgaagccagg

SEQ ID NO: 604441 - DNA, 25 bp, Rattus norvegicus
tgaaggttcctcctgtcggctcgtg

SEQ ID NO: 604442 - DNA, 25 bp, Rattus norvegicus
tgaaggttcctcgtgtcggctcgtg

SEQ ID NO: 604443 - DNA, 25 bp, Rattus norvegicus
tgaaggttctccactggttggtcct

SEQ ID NO: 604444 - DNA, 25 bp, Rattus norvegicus
tgaaggttctcctctggttggtcct

SEQ ID NO: 604445 - DNA, 25 bp, Rattus norvegicus
tgaaggttgcttcaactgctttccc

SEQ ID NO: 604446 - DNA, 25 bp, Rattus norvegicus
tgaaggttgcttgaactgctttccc

SEQ ID NO: 604447 - DNA, 25 bp, Rattus norvegicus
tgaaggtttcccaggcagctgcaga

SEQ ID NO: 604448 - DNA, 25 bp, Rattus norvegicus
tgaaggtttccctggcagctgcaga

SEQ ID NO: 604449 - DNA, 25 bp, Rattus norvegicus
tgaaggtttgctactttcctcctgg

SEQ ID NO: 604450 - DNA, 25 bp, Rattus norvegicus
tgaaggtttgcttctttcctcctgg

SEQ ID NO: 604451 - DNA, 25 bp, Rattus norvegicus
tgaaggttttttcagcctttgcata

SEQ ID NO: 604452 - DNA, 25 bp, Rattus norvegicus
tgaaggttttttgagcctttgcata

SEQ ID NO: 604453 - DNA, 25 bp, Rattus norvegicus
tgaagtaaacgcagagatcaatcag

SEQ ID NO: 604454 - DNA, 25 bp, Rattus norvegicus
tgaagtaaacgctgagatcaatcag

SEQ ID NO: 604455 - DNA, 25 bp, Rattus norvegicus
tgaagtaactcacacccaaagggac

SEQ ID NO: 604456 - DNA, 25 bp, Rattus norvegicus
tgaagtaactcagacccaaagggac

SEQ ID NO: 604457 - DNA, 25 bp, Rattus norvegicus
tgaagtaactggatccctcggccag

SEQ ID NO: 604458 - DNA, 25 bp, Rattus norvegicus
tgaagtaactggttccctcggccag

SEQ ID NO: 604459 - DNA, 25 bp, Rattus norvegicus
tgaagtaatggcaggtcctgcatca

SEQ ID NO: 604460 - DNA, 25 bp, Rattus norvegicus
tgaagtaatggctggtcctgcatca

SEQ ID NO: 604461 - DNA, 25 bp, Rattus norvegicus
tgaagtacagccagactctcaggcc

SEQ ID NO: 604462 - DNA, 25 bp, Rattus norvegicus
tgaagtacagcctgactctcaggcc

SEQ ID NO: 604463 - DNA, 25 bp, Rattus norvegicus
tgaagtacatgcactcaggaccggt

SEQ ID NO: 604464 - DNA, 25 bp, Rattus norvegicus
tgaagtacatgctctcaggaccggt

SEQ ID NO: 604465 - DNA, 25 bp, Rattus norvegicus
tgaagtactcagacctctgttgctg

SEQ ID NO: 604466 - DNA, 25 bp, Rattus norvegicus
tgaagtactcagtcctctgttgctg

SEQ ID NO: 604467 - DNA, 25 bp, Rattus norvegicus
tgaagtagcattcctgtgttccgtg

SEQ ID NO: 604468 - DNA, 25 bp, Rattus norvegicus
tgaagtagcattgctgtgttccgtg

SEQ ID NO: 604469 - DNA, 25 bp, Rattus norvegicus
tgaagtagggccctttggcgtcctc

SEQ ID NO: 604470 - DNA, 25 bp, Rattus norvegicus
tgaagtagggccgtttggcgtcctc

SEQ ID NO: 604471 - DNA, 25 bp, Rattus norvegicus
tgaagtagtggtaccttggctggcc

SEQ ID NO: 604472 - DNA, 25 bp, Rattus norvegicus
tgaagtagtggttccttggctggcc

SEQ ID NO: 604473 - DNA, 25 bp, Rattus norvegicus
tgaagtatatccaggaccgcgtctg

SEQ ID NO: 604474 - DNA, 25 bp, Rattus norvegicus
tgaagtatatcctggaccgcgtctg

SEQ ID NO: 604475 - DNA, 25 bp, Rattus norvegicus
tgaagtatcccactgctgctgggac

SEQ ID NO: 604476 - DNA, 25 bp, Rattus norvegicus
tgaagtatcccagtgctgctgggac

SEQ ID NO: 604477 - DNA, 25 bp, Rattus norvegicus
tgaagtatcgtgacctttctcactg

SEQ ID NO: 604478 - DNA, 25 bp, Rattus norvegicus
tgaagtatcgtgtcctttctcactg

SEQ ID NO: 604479 - DNA, 25 bp, Rattus norvegicus
tgaagtatgcagctaccccaagtgt

SEQ ID NO: 604480 - DNA, 25 bp, Rattus norvegicus
tgaagtatgcaggtaccccaagtgt

SEQ ID NO: 604481 - DNA, 25 bp, Rattus norvegicus
tgaagtatgcctaccagacccatga

SEQ ID NO: 604482 - DNA, 25 bp, Rattus norvegicus
tgaagtatgccttccagacccatga

SEQ ID NO: 604483 - DNA, 25 bp, Rattus norvegicus
tgaagtatggccacacagtgttcct

SEQ ID NO: 604484 - DNA, 25 bp, Rattus norvegicus
tgaagtatggcctcacagtgttcct

SEQ ID NO: 604485 - DNA, 25 bp, Rattus norvegicus
tgaagtattaccacttaacctttgt

SEQ ID NO: 604486 - DNA, 25 bp, Rattus norvegicus
tgaagtattacctcttaacctttgt

SEQ ID NO: 604487 - DNA, 25 bp, Rattus norvegicus
tgaagtcaagcgactttcattccca

SEQ ID NO: 604488 - DNA, 25 bp, Rattus norvegicus
tgaagtcaagcgtctttcattccca

SEQ ID NO: 604489 - DNA, 25 bp, Rattus norvegicus
tgaagtcaatccacatttggccact

SEQ ID NO: 604490 - DNA, 25 bp, Rattus norvegicus
tgaagtcaatcctcatttggccact

SEQ ID NO: 604491 - DNA, 25 bp, Rattus norvegicus
tgaagtcaccaaacttgatcgcagt

SEQ ID NO: 604492 - DNA, 25 bp, Rattus norvegicus
tgaagtcaccaatcttgatcgcagt

SEQ ID NO: 604493 - DNA, 25 bp, Rattus norvegicus
tgaagtcacccaaaatccaatttaa

SEQ ID NO: 604494 - DNA, 25 bp, Rattus norvegicus
tgaagtcacccacaagcagctgcag

SEQ ID NO: 604495 - DNA, 25 bp, Rattus norvegicus
tgaagtcacccagaagcagctgcag

SEQ ID NO: 604496 - DNA, 25 bp, Rattus norvegicus
tgaagtcacccataatccaatttaa

SEQ ID NO: 604497 - DNA, 25 bp, Rattus norvegicus
tgaagtcactcgatgcttctgccgg

SEQ ID NO: 604498 - DNA, 25 bp, Rattus norvegicus
tgaagtcactcgttgcttctgccgg

SEQ ID NO: 604499 - DNA, 25 bp, Rattus norvegicus
tgaagtcagtagctgaccgtcagct

SEQ ID NO: 604500 - DNA, 25 bp, Rattus norvegicus
tgaagtcagtaggtgaccgtcagct

SEQ ID NO: 604501 - DNA, 25 bp, Rattus norvegicus
tgaagtcatacacctgcccaatcac

SEQ ID NO: 604502 - DNA, 25 bp, Rattus norvegicus
tgaagtcatacagctgcccaatcac

SEQ ID NO: 604503 - DNA, 25 bp, Rattus norvegicus
tgaagtcatagcaggaccacaccgc

SEQ ID NO: 604504 - DNA, 25 bp, Rattus norvegicus
tgaagtcatagctggaccacaccgc

SEQ ID NO: 604505 - DNA, 25 bp, Rattus norvegicus
tgaagtcatcagaggcgagggctat

SEQ ID NO: 604506 - DNA, 25 bp, Rattus norvegicus
tgaagtcatcagtggcgagggctat

SEQ ID NO: 604507 - DNA, 25 bp, Rattus norvegicus
tgaagtcatgccactgcaggacagt

SEQ ID NO: 604508 - DNA, 25 bp, Rattus norvegicus
tgaagtcatgcctctgcaggacagt

SEQ ID NO: 604509 - DNA, 25 bp, Rattus norvegicus
tgaagtcatgggaactgctgtagcc

SEQ ID NO: 604510 - DNA, 25 bp, Rattus norvegicus
tgaagtcatgggtactgctgtagcc

SEQ ID NO: 604511 - DNA, 25 bp, Rattus norvegicus
tgaagtcatgtgaggcgctctgcag

SEQ ID NO: 604512 - DNA, 25 bp, Rattus norvegicus
tgaagtcatgtgtggcgctctgcag

SEQ ID NO: 604513 - DNA, 25 bp, Rattus norvegicus
tgaagtcattccaggattcgtccac

SEQ ID NO: 604514 - DNA, 25 bp, Rattus norvegicus
tgaagtcattcctggattcgtccac

SEQ ID NO: 604515 - DNA, 25 bp, Rattus norvegicus
tgaagtccacctctgtctaacattt

SEQ ID NO: 604516 - DNA, 25 bp, Rattus norvegicus
tgaagtccacctgtgtctaacattt

SEQ ID NO: 604517 - DNA, 25 bp, Rattus norvegicus
tgaagtccagtgctttactgagact

SEQ ID NO: 604518 - DNA, 25 bp, Rattus norvegicus
tgaagtccagtggtttactgagact

SEQ ID NO: 604519 - DNA, 25 bp, Rattus norvegicus
tgaagtccatgacccttatggttga

SEQ ID NO: 604520 - DNA, 25 bp, Rattus norvegicus
tgaagtccatgagccttatggttga

SEQ ID NO: 604521 - DNA, 25 bp, Rattus norvegicus
tgaagtccccttctgactgtgaaaa

SEQ ID NO: 604522 - DNA, 25 bp, Rattus norvegicus
tgaagtccccttgtgactgtgaaaa

SEQ ID NO: 604523 - DNA, 25 bp, Rattus norvegicus
tgaagtcccgctctctggctcagca

SEQ ID NO: 604524 - DNA, 25 bp, Rattus norvegicus
tgaagtcccgctgtctggctcagca

SEQ ID NO: 604525 - DNA, 25 bp, Rattus norvegicus
tgaagtcccttgcaagaacaccact

SEQ ID NO: 604526 - DNA, 25 bp, Rattus norvegicus
tgaagtcccttggaagaacaccact

SEQ ID NO: 604527 - DNA, 25 bp, Rattus norvegicus
tgaagtccgccacaaactccgtgat

SEQ ID NO: 604528 - DNA, 25 bp, Rattus norvegicus
tgaagtccgccagaaactccgtgat

SEQ ID NO: 604529 - DNA, 25 bp, Rattus norvegicus
tgaagtccggtcagtggatggccac

SEQ ID NO: 604530 - DNA, 25 bp, Rattus norvegicus
tgaagtccggtctgtggatggccac

SEQ ID NO: 604531 - DNA, 25 bp, Rattus norvegicus
tgaagtccgtgaccagccttgggcc

SEQ ID NO: 604532 - DNA, 25 bp, Rattus norvegicus
tgaagtccgtgagcagccttgggcc

SEQ ID NO: 604533 - DNA, 25 bp, Rattus norvegicus
tgaagtcctcctactagtgccctat

SEQ ID NO: 604534 - DNA, 25 bp, Rattus norvegicus
tgaagtcctccttctagtgccctat

SEQ ID NO: 604535 - DNA, 25 bp, Rattus norvegicus
tgaagtcctcggagtggaacccggt

SEQ ID NO: 604536 - DNA, 25 bp, Rattus norvegicus
tgaagtcctcggtgtggaacccggt

SEQ ID NO: 604537 - DNA, 25 bp, Rattus norvegicus
tgaagtcctggaaaacctcttggcc

SEQ ID NO: 604538 - DNA, 25 bp, Rattus norvegicus
tgaagtcctggataacctcttggcc

SEQ ID NO: 604539 - DNA, 25 bp, Rattus norvegicus
tgaagtcctggcacaatccccagta

SEQ ID NO: 604540 - DNA, 25 bp, Rattus norvegicus
tgaagtcctggcctaatatcctttt

SEQ ID NO: 604541 - DNA, 25 bp, Rattus norvegicus
tgaagtcctggcgtaatatcctttt

SEQ ID NO: 604542 - DNA, 25 bp, Rattus norvegicus
tgaagtcctggctcaatccccagta

SEQ ID NO: 604543 - DNA, 25 bp, Rattus norvegicus
tgaagtcctgttcagaccatcggat

SEQ ID NO: 604544 - DNA, 25 bp, Rattus norvegicus
tgaagtcctgttgagaccatcggat

SEQ ID NO: 604545 - DNA, 25 bp, Rattus norvegicus
tgaagtcctttacgaagactcccca

SEQ ID NO: 604546 - DNA, 25 bp, Rattus norvegicus
tgaagtcctttaggaagactcccca

SEQ ID NO: 604547 - DNA, 25 bp, Rattus norvegicus
tgaagtcgcgcgcaggagcaacccc

SEQ ID NO: 604548 - DNA, 25 bp, Rattus norvegicus
tgaagtcgcgcggaggagcaacccc

SEQ ID NO: 604549 - DNA, 25 bp, Rattus norvegicus
tgaagtcgctgtcccttaagtgagg

SEQ ID NO: 604550 - DNA, 25 bp, Rattus norvegicus
tgaagtcgctgtgccttaagtgagg

SEQ ID NO: 604551 - DNA, 25 bp, Rattus norvegicus
tgaagtcggagcacagttcctcagc

SEQ ID NO: 604552 - DNA, 25 bp, Rattus norvegicus
tgaagtcggagctcagttcctcagc

SEQ ID NO: 604553 - DNA, 25 bp, Rattus norvegicus
tgaagtcggcctcatcattggcaca

SEQ ID NO: 604554 - DNA, 25 bp, Rattus norvegicus
tgaagtcggcctgatcattggcaca

SEQ ID NO: 604555 - DNA, 25 bp, Rattus norvegicus
tgaagtcggtgacgttacttaccct

SEQ ID NO: 604556 - DNA, 25 bp, Rattus norvegicus
tgaagtcggtgaggttacttaccct

SEQ ID NO: 604557 - DNA, 25 bp, Rattus norvegicus
tgaagtcgtccgcattttgcttttt

SEQ ID NO: 604558 - DNA, 25 bp, Rattus norvegicus
tgaagtcgtccggattttgcttttt

SEQ ID NO: 604559 - DNA, 25 bp, Rattus norvegicus
tgaagtcgttttcctactgacgctc

SEQ ID NO: 604560 - DNA, 25 bp, Rattus norvegicus
tgaagtcgttttgctactgacgctc

SEQ ID NO: 604561 - DNA, 25 bp, Rattus norvegicus
tgaagtctatgtcctggtttcccag

SEQ ID NO: 604562 - DNA, 25 bp, Rattus norvegicus
tgaagtctatgtgctggtttcccag

SEQ ID NO: 604563 - DNA, 25 bp, Rattus norvegicus
tgaagtctcaatccagctttcccat

SEQ ID NO: 604564 - DNA, 25 bp, Rattus norvegicus
tgaagtctcaatgcagctttcccat

SEQ ID NO: 604565 - DNA, 25 bp, Rattus norvegicus
tgaagtctcaggcagtcctggcaga

SEQ ID NO: 604566 - DNA, 25 bp, Rattus norvegicus
tgaagtctcagggagtcctggcaga

SEQ ID NO: 604567 - DNA, 25 bp, Rattus norvegicus
tgaagtctcagtctctcctgcttgg

SEQ ID NO: 604568 - DNA, 25 bp, Rattus norvegicus
tgaagtctcagtgtctcctgcttgg

SEQ ID NO: 604569 - DNA, 25 bp, Rattus norvegicus
tgaagtctcgcgatgctaccacatg

SEQ ID NO: 604570 - DNA, 25 bp, Rattus norvegicus
tgaagtctcgcgttgctaccacatg

SEQ ID NO: 604571 - DNA, 25 bp, Rattus norvegicus
tgaagtctctgtagtggagccctta

SEQ ID NO: 604572 - DNA, 25 bp, Rattus norvegicus
tgaagtctctgttgtggagccctta

SEQ ID NO: 604573 - DNA, 25 bp, Rattus norvegicus
tgaagtctgaacactctgagcaact

SEQ ID NO: 604574 - DNA, 25 bp, Rattus norvegicus
tgaagtctgaactctctgagcaact

SEQ ID NO: 604575 - DNA, 25 bp, Rattus norvegicus
tgaagtctgataacggaagctggca

SEQ ID NO: 604576 - DNA, 25 bp, Rattus norvegicus
tgaagtctgatatcggaagctggca

SEQ ID NO: 604577 - DNA, 25 bp, Rattus norvegicus
tgaagtctgccacattctctggctc

SEQ ID NO: 604578 - DNA, 25 bp, Rattus norvegicus
tgaagtctgccagattctctggctc

SEQ ID NO: 604579 - DNA, 25 bp, Rattus norvegicus
tgaagtctggttatcttggctcaca

SEQ ID NO: 604580 - DNA, 25 bp, Rattus norvegicus
tgaagtctggttccccactcctgtt

SEQ ID NO: 604581 - DNA, 25 bp, Rattus norvegicus
tgaagtctggttgcccactcctgtt

SEQ ID NO: 604582 - DNA, 25 bp, Rattus norvegicus
tgaagtctggttttcttggctcaca

SEQ ID NO: 604583 - DNA, 25 bp, Rattus norvegicus
tgaagtctgtccagttctcggctcg

SEQ ID NO: 604584 - DNA, 25 bp, Rattus norvegicus
tgaagtctgtcctgttctcggctcg

SEQ ID NO: 604585 - DNA, 25 bp, Rattus norvegicus
tgaagtcttcacacaggctatccag

SEQ ID NO: 604586 - DNA, 25 bp, Rattus norvegicus
tgaagtcttcactcaggctatccag

SEQ ID NO: 604587 - DNA, 25 bp, Rattus norvegicus
tgaagtcttcctagtcaactcttag

SEQ ID NO: 604588 - DNA, 25 bp, Rattus norvegicus
tgaagtcttccttgtcaactcttag

SEQ ID NO: 604589 - DNA, 25 bp, Rattus norvegicus
tgaagtgaaagtcctcacagacttt

SEQ ID NO: 604590 - DNA, 25 bp, Rattus norvegicus
tgaagtgaaagtgctcacagacttt

SEQ ID NO: 604591 - DNA, 25 bp, Rattus norvegicus
tgaagtgaatgtatccttcctttcc

SEQ ID NO: 604592 - DNA, 25 bp, Rattus norvegicus
tgaagtgaatgtttccttcctttcc

SEQ ID NO: 604593 - DNA, 25 bp, Rattus norvegicus
tgaagtgactaaccccagttcctgg

SEQ ID NO: 604594 - DNA, 25 bp, Rattus norvegicus
tgaagtgactaagcccagttcctgg

SEQ ID NO: 604595 - DNA, 25 bp, Rattus norvegicus
tgaagtgagttcctttccctagcta

SEQ ID NO: 604596 - DNA, 25 bp, Rattus norvegicus
tgaagtgagttcgtttccctagcta

SEQ ID NO: 604597 - DNA, 25 bp, Rattus norvegicus
tgaagtgatggtctcgcgtctgata

SEQ ID NO: 604598 - DNA, 25 bp, Rattus norvegicus
tgaagtgatggtgtcgcgtctgata

SEQ ID NO: 604599 - DNA, 25 bp, Rattus norvegicus
tgaagtgcagtacccatccagaaac

SEQ ID NO: 604600 - DNA, 25 bp, Rattus norvegicus
tgaagtgcagtagccatccagaaac

SEQ ID NO: 604601 - DNA, 25 bp, Rattus norvegicus
tgaagtgcccaccaaatggctgtgc

SEQ ID NO: 604602 - DNA, 25 bp, Rattus norvegicus
tgaagtgcccacgaaatggctgtgc

SEQ ID NO: 604603 - DNA, 25 bp, Rattus norvegicus
tgaagtgcccgacggacatcacaga

SEQ ID NO: 604604 - DNA, 25 bp, Rattus norvegicus
tgaagtgcccgagggacatcacaga

SEQ ID NO: 604605 - DNA, 25 bp, Rattus norvegicus
tgaagtgccgacaggaccacgaggt

SEQ ID NO: 604606 - DNA, 25 bp, Rattus norvegicus
tgaagtgccgactggaccacgaggt

SEQ ID NO: 604607 - DNA, 25 bp, Rattus norvegicus
tgaagtgccttacactcttgccata

SEQ ID NO: 604608 - DNA, 25 bp, Rattus norvegicus
tgaagtgccttagactcttgccata

SEQ ID NO: 604609 - DNA, 25 bp, Rattus norvegicus
tgaagtgctgacaagagacgcgaga

SEQ ID NO: 604610 - DNA, 25 bp, Rattus norvegicus
tgaagtgctgactagagacgcgaga

SEQ ID NO: 604611 - DNA, 25 bp, Rattus norvegicus
tgaagtgctgcactggcatcctcaa

SEQ ID NO: 604612 - DNA, 25 bp, Rattus norvegicus
tgaagtgctgcagtggcatcctcaa

SEQ ID NO: 604613 - DNA, 25 bp, Rattus norvegicus
tgaagtgctttgcaggccctagact

SEQ ID NO: 604614 - DNA, 25 bp, Rattus norvegicus
tgaagtgctttggaggccctagact

SEQ ID NO: 604615 - DNA, 25 bp, Rattus norvegicus
tgaagtggaaatacgttccccttga

SEQ ID NO: 604616 - DNA, 25 bp, Rattus norvegicus
tgaagtggaaattcgttccccttga

SEQ ID NO: 604617 - DNA, 25 bp, Rattus norvegicus
tgaagtggaacaagttgtcacccca

SEQ ID NO: 604618 - DNA, 25 bp, Rattus norvegicus
tgaagtggaacatgttgtcacccca

SEQ ID NO: 604619 - DNA, 25 bp, Rattus norvegicus
tgaagtggacagacctggccttgca

SEQ ID NO: 604620 - DNA, 25 bp, Rattus norvegicus
tgaagtggacagtcctggccttgca

SEQ ID NO: 604621 - DNA, 25 bp, Rattus norvegicus
tgaagtggacggctggctcatcatt

SEQ ID NO: 604622 - DNA, 25 bp, Rattus norvegicus
tgaagtggacgggtggctcatcatt

SEQ ID NO: 604623 - DNA, 25 bp, Rattus norvegicus
tgaagtggagccctcagtcatgccc

SEQ ID NO: 604624 - DNA, 25 bp, Rattus norvegicus
tgaagtggagccgtcagtcatgccc

SEQ ID NO: 604625 - DNA, 25 bp, Rattus norvegicus
tgaagtggagtgaaggcccctgctc

SEQ ID NO: 604626 - DNA, 25 bp, Rattus norvegicus
tgaagtggagtgtaggcccctgctc

SEQ ID NO: 604627 - DNA, 25 bp, Rattus norvegicus
tgaagtggccgcagatttctcctag

SEQ ID NO: 604628 - DNA, 25 bp, Rattus norvegicus
tgaagtggccgctgatttctcctag

SEQ ID NO: 604629 - DNA, 25 bp, Rattus norvegicus
tgaagtggcctcagccagtagcatt

SEQ ID NO: 604630 - DNA, 25 bp, Rattus norvegicus
tgaagtggcctctgccagtagcatt

SEQ ID NO: 604631 - DNA, 25 bp, Rattus norvegicus
tgaagtggcttccatgcgttctcgg

SEQ ID NO: 604632 - DNA, 25 bp, Rattus norvegicus
tgaagtggcttcgatgcgttctcgg

SEQ ID NO: 604633 - DNA, 25 bp, Rattus norvegicus
tgaagtgggcctctattcggttgtc

SEQ ID NO: 604634 - DNA, 25 bp, Rattus norvegicus
tgaagtgggcctgtattcggttgtc

SEQ ID NO: 604635 - DNA, 25 bp, Rattus norvegicus
tgaagtgggcttaactcctgggcaa

SEQ ID NO: 604636 - DNA, 25 bp, Rattus norvegicus
tgaagtgggctttactcctgggcaa

SEQ ID NO: 604637 - DNA, 25 bp, Rattus norvegicus
tgaagtggtgacagtgtgcgccctt

SEQ ID NO: 604638 - DNA, 25 bp, Rattus norvegicus
tgaagtggtgactgtgtgcgccctt

SEQ ID NO: 604639 - DNA, 25 bp, Rattus norvegicus
tgaagtgtaaacatggagaaaccag

SEQ ID NO: 604640 - DNA, 25 bp, Rattus norvegicus
tgaagtgtaaacttggagaaaccag

SEQ ID NO: 604641 - DNA, 25 bp, Rattus norvegicus
tgaagtgtaacccagtgcagcgcat

SEQ ID NO: 604642 - DNA, 25 bp, Rattus norvegicus
tgaagtgtaaccgagtgcagcgcat

SEQ ID NO: 604643 - DNA, 25 bp, Rattus norvegicus
tgaagtgtagacactggtccgtgcg

SEQ ID NO: 604644 - DNA, 25 bp, Rattus norvegicus
tgaagtgtagactctggtccgtgcg

SEQ ID NO: 604645 - DNA, 25 bp, Rattus norvegicus
tgaagtgtcccacgtttgttttgtt

SEQ ID NO: 604646 - DNA, 25 bp, Rattus norvegicus
tgaagtgtcccaggtttgttttgtt

SEQ ID NO: 604647 - DNA, 25 bp, Rattus norvegicus
tgaagtgtccttagcccgctggctg

SEQ ID NO: 604648 - DNA, 25 bp, Rattus norvegicus
tgaagtgtcctttgcccgctggctg

SEQ ID NO: 604649 - DNA, 25 bp, Rattus norvegicus
tgaagtgtcttgatcaagccctgga

SEQ ID NO: 604650 - DNA, 25 bp, Rattus norvegicus
tgaagtgtcttgttcaagccctgga

SEQ ID NO: 604651 - DNA, 25 bp, Rattus norvegicus
tgaagtgtgcagatgcctctgccat

SEQ ID NO: 604652 - DNA, 25 bp, Rattus norvegicus
tgaagtgtgcagttgcctctgccat

SEQ ID NO: 604653 - DNA, 25 bp, Rattus norvegicus
tgaagtgtgccaagaccaagatcct

SEQ ID NO: 604654 - DNA, 25 bp, Rattus norvegicus
tgaagtgtgccacccttatgtggtg

SEQ ID NO: 604655 - DNA, 25 bp, Rattus norvegicus
tgaagtgtgccagccttatgtggtg

SEQ ID NO: 604656 - DNA, 25 bp, Rattus norvegicus
tgaagtgtgccatgaccaagatcct

SEQ ID NO: 604657 - DNA, 25 bp, Rattus norvegicus
tgaagtgtggacactggtgcctcca

SEQ ID NO: 604658 - DNA, 25 bp, Rattus norvegicus
tgaagtgtggactctggtgcctcca

SEQ ID NO: 604659 - DNA, 25 bp, Rattus norvegicus
tgaagtgtgttcatttccctccaga

SEQ ID NO: 604660 - DNA, 25 bp, Rattus norvegicus
tgaagtgtgttcttttccctccaga

SEQ ID NO: 604661 - DNA, 25 bp, Rattus norvegicus
tgaagtgttaccatactattttgtt

SEQ ID NO: 604662 - DNA, 25 bp, Rattus norvegicus
tgaagtgttaccttactattttgtt

SEQ ID NO: 604663 - DNA, 25 bp, Rattus norvegicus
tgaagtgttccgaccttgttatcag

SEQ ID NO: 604664 - DNA, 25 bp, Rattus norvegicus
tgaagtgttccgtccttgttatcag

SEQ ID NO: 604665 - DNA, 25 bp, Rattus norvegicus
tgaagtgttgtcacagcccatcaca

SEQ ID NO: 604666 - DNA, 25 bp, Rattus norvegicus
tgaagtgttgtctcagcccatcaca

SEQ ID NO: 604667 - DNA, 25 bp, Rattus norvegicus
tgaagtgtttatactgccctctact

SEQ ID NO: 604668 - DNA, 25 bp, Rattus norvegicus
tgaagtgtttattctgccctctact

SEQ ID NO: 604669 - DNA, 25 bp, Rattus norvegicus
tgaagtgttttaatctccgcggtca

SEQ ID NO: 604670 - DNA, 25 bp, Rattus norvegicus
tgaagtgttttattctccgcggtca

SEQ ID NO: 604671 - DNA, 25 bp, Rattus norvegicus
tgaagttacaacagacagaggcgga

SEQ ID NO: 604672 - DNA, 25 bp, Rattus norvegicus
tgaagttacaactgacagaggcgga

SEQ ID NO: 604673 - DNA, 25 bp, Rattus norvegicus
tgaagttacctcacccagctgatgg

SEQ ID NO: 604674 - DNA, 25 bp, Rattus norvegicus
tgaagttacctctcccagctgatgg

SEQ ID NO: 604675 - DNA, 25 bp, Rattus norvegicus
tgaagttaccttccgagtactctgt

SEQ ID NO: 604676 - DNA, 25 bp, Rattus norvegicus
tgaagttaccttgcgagtactctgt

SEQ ID NO: 604677 - DNA, 25 bp, Rattus norvegicus
tgaagttacgacaagctgcaggcac

SEQ ID NO: 604678 - DNA, 25 bp, Rattus norvegicus
tgaagttacgactagctgcaggcac

SEQ ID NO: 604679 - DNA, 25 bp, Rattus norvegicus
tgaagttacgttcttgggaccattt

SEQ ID NO: 604680 - DNA, 25 bp, Rattus norvegicus
tgaagttacgttgttgggaccattt

SEQ ID NO: 604681 - DNA, 25 bp, Rattus norvegicus
tgaagttactggctcctcatgtgtc

SEQ ID NO: 604682 - DNA, 25 bp, Rattus norvegicus
tgaagttactgggtcctcatgtgtc

SEQ ID NO: 604683 - DNA, 25 bp, Rattus norvegicus
tgaagttactgtatctgcctttctc

SEQ ID NO: 604684 - DNA, 25 bp, Rattus norvegicus
tgaagttactgtttctgcctttctc

SEQ ID NO: 604685 - DNA, 25 bp, Rattus norvegicus
tgaagttactttcgtctcggtccct

SEQ ID NO: 604686 - DNA, 25 bp, Rattus norvegicus
tgaagttactttggtctcggtccct

SEQ ID NO: 604687 - DNA, 25 bp, Rattus norvegicus
tgaagttagtcgaccggtacacacc

SEQ ID NO: 604688 - DNA, 25 bp, Rattus norvegicus
tgaagttagtcgtccggtacacacc

SEQ ID NO: 604689 - DNA, 25 bp, Rattus norvegicus
tgaagttcacgtctatcaaagccaa

SEQ ID NO: 604690 - DNA, 25 bp, Rattus norvegicus
tgaagttcacgtgtatcaaagccaa

SEQ ID NO: 604691 - DNA, 25 bp, Rattus norvegicus
tgaagttcagaaatggcctcacact

SEQ ID NO: 604692 - DNA, 25 bp, Rattus norvegicus
tgaagttcagaacacggcatcccac

SEQ ID NO: 604693 - DNA, 25 bp, Rattus norvegicus
tgaagttcagaagacggcatcccac

SEQ ID NO: 604694 - DNA, 25 bp, Rattus norvegicus
tgaagttcagaattggcctcacact

SEQ ID NO: 604695 - DNA, 25 bp, Rattus norvegicus
tgaagttcagtgaccacgtgggtgt

SEQ ID NO: 604696 - DNA, 25 bp, Rattus norvegicus
tgaagttcagtgtccacgtgggtgt

SEQ ID NO: 604697 - DNA, 25 bp, Rattus norvegicus
tgaagttcatgtccccagcattggc

SEQ ID NO: 604698 - DNA, 25 bp, Rattus norvegicus
tgaagttcatgtgcccagcattggc

SEQ ID NO: 604699 - DNA, 25 bp, Rattus norvegicus
tgaagttccacccaccggcttttgc

SEQ ID NO: 604700 - DNA, 25 bp, Rattus norvegicus
tgaagttccaccgaccggcttttgc

SEQ ID NO: 604701 - DNA, 25 bp, Rattus norvegicus
tgaagttccctgatttaggtcagta

SEQ ID NO: 604702 - DNA, 25 bp, Rattus norvegicus
tgaagttccctgttttaggtcagta

SEQ ID NO: 604703 - DNA, 25 bp, Rattus norvegicus
tgaagttctggaccaagactctgcc

SEQ ID NO: 604704 - DNA, 25 bp, Rattus norvegicus
tgaagttctggagcaagactctgcc

SEQ ID NO: 604705 - DNA, 25 bp, Rattus norvegicus
tgaagttctgtactgctgaccctgg

SEQ ID NO: 604706 - DNA, 25 bp, Rattus norvegicus
tgaagttctgtagtgctgaccctgg

SEQ ID NO: 604707 - DNA, 25 bp, Rattus norvegicus
tgaagttcttctccaccaggatgtt

SEQ ID NO: 604708 - DNA, 25 bp, Rattus norvegicus
tgaagttcttctgcaccaggatgtt

SEQ ID NO: 604709 - DNA, 25 bp, Rattus norvegicus
tgaagttctttaactccatggcact

SEQ ID NO: 604710 - DNA, 25 bp, Rattus norvegicus
tgaagttctttatctccatggcact

SEQ ID NO: 604711 - DNA, 25 bp, Rattus norvegicus
tgaagttctttcacatcttttcccc

SEQ ID NO: 604712 - DNA, 25 bp, Rattus norvegicus
tgaagttctttccacatgtcctgac

SEQ ID NO: 604713 - DNA, 25 bp, Rattus norvegicus
tgaagttctttcgacatgtcctgac

SEQ ID NO: 604714 - DNA, 25 bp, Rattus norvegicus
tgaagttctttctcatcttttcccc

SEQ ID NO: 604715 - DNA, 25 bp, Rattus norvegicus
tgaagttcttttaccaaagtctcct

SEQ ID NO: 604716 - DNA, 25 bp, Rattus norvegicus
tgaagttcttttctattcttgtggg

SEQ ID NO: 604717 - DNA, 25 bp, Rattus norvegicus
tgaagttcttttgtattcttgtggg

SEQ ID NO: 604718 - DNA, 25 bp, Rattus norvegicus
tgaagttctttttccaaagtctcct

SEQ ID NO: 604719 - DNA, 25 bp, Rattus norvegicus
tgaagttgataaacagcccgctcac

SEQ ID NO: 604720 - DNA, 25 bp, Rattus norvegicus
tgaagttgataatcagcccgctcac

SEQ ID NO: 604721 - DNA, 25 bp, Rattus norvegicus
tgaagttgcactctagctgcacctc

SEQ ID NO: 604722 - DNA, 25 bp, Rattus norvegicus
tgaagttgcactgtagctgcacctc

SEQ ID NO: 604723 - DNA, 25 bp, Rattus norvegicus
tgaagttgcccaacagacagtgctt

SEQ ID NO: 604724 - DNA, 25 bp, Rattus norvegicus
tgaagttgcccatcagacagtgctt

SEQ ID NO: 604725 - DNA, 25 bp, Rattus norvegicus
tgaagttgctcaaacccagccttaa

SEQ ID NO: 604726 - DNA, 25 bp, Rattus norvegicus
tgaagttgctcatacccagccttaa

SEQ ID NO: 604727 - DNA, 25 bp, Rattus norvegicus
tgaagttgtccaccctcaatggaat

SEQ ID NO: 604728 - DNA, 25 bp, Rattus norvegicus
tgaagttgtccagcctcaatggaat

SEQ ID NO: 604729 - DNA, 25 bp, Rattus norvegicus
tgaagttgtttcctgagcgtcacct

SEQ ID NO: 604730 - DNA, 25 bp, Rattus norvegicus
tgaagttgtttcgtgagcgtcacct

SEQ ID NO: 604731 - DNA, 25 bp, Rattus norvegicus
tgaagtttagatcctcctgccagat

SEQ ID NO: 604732 - DNA, 25 bp, Rattus norvegicus
tgaagtttagatgctcctgccagat

SEQ ID NO: 604733 - DNA, 25 bp, Rattus norvegicus
tgaagtttcacaccttctggctggg

SEQ ID NO: 604734 - DNA, 25 bp, Rattus norvegicus
tgaagtttcacagcttctggctggg

SEQ ID NO: 604735 - DNA, 25 bp, Rattus norvegicus
tgaagtttcattcaattctcttact

SEQ ID NO: 604736 - DNA, 25 bp, Rattus norvegicus
tgaagtttcattgaattctcttact

SEQ ID NO: 604737 - DNA, 25 bp, Rattus norvegicus
tgaagtttgagaacggccaggccct

SEQ ID NO: 604738 - DNA, 25 bp, Rattus norvegicus
tgaagtttgagatcggccaggccct

SEQ ID NO: 604739 - DNA, 25 bp, Rattus norvegicus
tgaagtttggcccttttgcttagta

SEQ ID NO: 604740 - DNA, 25 bp, Rattus norvegicus
tgaagtttggccgttttgcttagta

SEQ ID NO: 604741 - DNA, 25 bp, Rattus norvegicus
tgaagtttggtcctgtggacagcac

SEQ ID NO: 604742 - DNA, 25 bp, Rattus norvegicus
tgaagtttggtcgtgtggacagcac

SEQ ID NO: 604743 - DNA, 25 bp, Rattus norvegicus
tgaagtttggttatgctttctttat

SEQ ID NO: 604744 - DNA, 25 bp, Rattus norvegicus
tgaagtttggttttgctttctttat

SEQ ID NO: 604745 - DNA, 25 bp, Rattus norvegicus
tgaagtttgtttccaccacttactc

SEQ ID NO: 604746 - DNA, 25 bp, Rattus norvegicus
tgaagtttgtttgcaccacttactc

SEQ ID NO: 604747 - DNA, 25 bp, Rattus norvegicus
tgaagttttcaacggctctctgcat

SEQ ID NO: 604748 - DNA, 25 bp, Rattus norvegicus
tgaagttttcaagggctctctgcat

SEQ ID NO: 604749 - DNA, 25 bp, Rattus norvegicus
tgaagttttccaaagcagctgccaa

SEQ ID NO: 604750 - DNA, 25 bp, Rattus norvegicus
tgaagttttccacatttgtgagcat

SEQ ID NO: 604751 - DNA, 25 bp, Rattus norvegicus
tgaagttttccagatttgtgagcat

SEQ ID NO: 604752 - DNA, 25 bp, Rattus norvegicus
tgaagttttccatagcagctgccaa

SEQ ID NO: 604753 - DNA, 25 bp, Rattus norvegicus
tgaagttttcccagcttgagagcat

SEQ ID NO: 604754 - DNA, 25 bp, Rattus norvegicus
tgaagttttccctgcttgagagcat

SEQ ID NO: 604755 - DNA, 25 bp, Rattus norvegicus
tgaagttttgctagttcttttctat

SEQ ID NO: 604756 - DNA, 25 bp, Rattus norvegicus
tgaagttttgcttgttcttttctat

SEQ ID NO: 604757 - DNA, 25 bp, Rattus norvegicus
tgaagttttttgagtggtcacccct

SEQ ID NO: 604758 - DNA, 25 bp, Rattus norvegicus
tgaagttttttgtgtggtcacccct

SEQ ID NO: 604759 - DNA, 25 bp, Rattus norvegicus
tgaataaacaccaacaccatgctgc

SEQ ID NO: 604760 - DNA, 25 bp, Rattus norvegicus
tgaataaacacctacaccatgctgc

SEQ ID NO: 604761 - DNA, 25 bp, Rattus norvegicus
tgaataaaccttctaccactgagct

SEQ ID NO: 604762 - DNA, 25 bp, Rattus norvegicus
tgaataaaccttgtaccactgagct

SEQ ID NO: 604763 - DNA, 25 bp, Rattus norvegicus
tgaataaataccacagactccctct

SEQ ID NO: 604764 - DNA, 25 bp, Rattus norvegicus
tgaataaatacctcagactccctct

SEQ ID NO: 604765 - DNA, 25 bp, Rattus norvegicus
tgaataaatgccactgctttgctcc

SEQ ID NO: 604766 - DNA, 25 bp, Rattus norvegicus
tgaataaatgcctctgctttgctcc

SEQ ID NO: 604767 - DNA, 25 bp, Rattus norvegicus
tgaataacagctactcacctctttg

SEQ ID NO: 604768 - DNA, 25 bp, Rattus norvegicus
tgaataacagcttctcacctctttg

SEQ ID NO: 604769 - DNA, 25 bp, Rattus norvegicus
tgaataacattccaacccagggcca

SEQ ID NO: 604770 - DNA, 25 bp, Rattus norvegicus
tgaataacattcgaacccagggcca

SEQ ID NO: 604771 - DNA, 25 bp, Rattus norvegicus
tgaataaccaacaactccatacctt

SEQ ID NO: 604772 - DNA, 25 bp, Rattus norvegicus
tgaataaccaactactccatacctt

SEQ ID NO: 604773 - DNA, 25 bp, Rattus norvegicus
tgaataactgggaccccgctggtgg

SEQ ID NO: 604774 - DNA, 25 bp, Rattus norvegicus
tgaataactgggtccccgctggtgg

SEQ ID NO: 604775 - DNA, 25 bp, Rattus norvegicus
tgaataacttcacaaagctgctttg

SEQ ID NO: 604776 - DNA, 25 bp, Rattus norvegicus
tgaataacttcagaaagctgctttg

SEQ ID NO: 604777 - DNA, 25 bp, Rattus norvegicus
tgaataagccagatccttgcctctc

SEQ ID NO: 604778 - DNA, 25 bp, Rattus norvegicus
tgaataagccagttccttgcctctc

SEQ ID NO: 604779 - DNA, 25 bp, Rattus norvegicus
tgaataagctctcccattttctata

SEQ ID NO: 604780 - DNA, 25 bp, Rattus norvegicus
tgaataagctctgccattttctata

SEQ ID NO: 604781 - DNA, 25 bp, Rattus norvegicus
tgaataagctgaacccgtcacccaa

SEQ ID NO: 604782 - DNA, 25 bp, Rattus norvegicus
tgaataagctgatcccgtcacccaa

SEQ ID NO: 604783 - DNA, 25 bp, Rattus norvegicus
tgaataatcgctcacgtctttcttc

SEQ ID NO: 604784 - DNA, 25 bp, Rattus norvegicus
tgaataatcgctgacgtctttcttc

SEQ ID NO: 604785 - DNA, 25 bp, Rattus norvegicus
tgaataattagtccaccagtgagct

SEQ ID NO: 604786 - DNA, 25 bp, Rattus norvegicus
tgaataattagtgcaccagtgagct

SEQ ID NO: 604787 - DNA, 25 bp, Rattus norvegicus
tgaataattcccaatttctcctgtc

SEQ ID NO: 604788 - DNA, 25 bp, Rattus norvegicus
tgaataattccctatttctcctgtc

SEQ ID NO: 604789 - DNA, 25 bp, Rattus norvegicus
tgaatacaaattccaggtctgcgtg

SEQ ID NO: 604790 - DNA, 25 bp, Rattus norvegicus
tgaatacaaattgcaggtctgcgtg

SEQ ID NO: 604791 - DNA, 25 bp, Rattus norvegicus
tgaatacactctatcagagcccgac

SEQ ID NO: 604792 - DNA, 25 bp, Rattus norvegicus
tgaatacactctttcagagcccgac

SEQ ID NO: 604793 - DNA, 25 bp, Rattus norvegicus
tgaatacagctcagggcgttcgtac

SEQ ID NO: 604794 - DNA, 25 bp, Rattus norvegicus
tgaatacagctctgggcgttcgtac

SEQ ID NO: 604795 - DNA, 25 bp, Rattus norvegicus
tgaatacattccctcttgcagctag

SEQ ID NO: 604796 - DNA, 25 bp, Rattus norvegicus
tgaatacattccgtcttgcagctag

SEQ ID NO: 604797 - DNA, 25 bp, Rattus norvegicus
tgaatacattttcaaagacccaatg

SEQ ID NO: 604798 - DNA, 25 bp, Rattus norvegicus
tgaatacattttgaaagacccaatg

SEQ ID NO: 604799 - DNA, 25 bp, Rattus norvegicus
tgaataccaactactagtccagcca

SEQ ID NO: 604800 - DNA, 25 bp, Rattus norvegicus
tgaataccaacttctagtccagcca

SEQ ID NO: 604801 - DNA, 25 bp, Rattus norvegicus
tgaataccaagcacggatccctgaa

SEQ ID NO: 604802 - DNA, 25 bp, Rattus norvegicus
tgaataccaagctcggatccctgaa

SEQ ID NO: 604803 - DNA, 25 bp, Rattus norvegicus
tgaataccatgcatagccggcactg

SEQ ID NO: 604804 - DNA, 25 bp, Rattus norvegicus
tgaataccatgcttagccggcactg

SEQ ID NO: 604805 - DNA, 25 bp, Rattus norvegicus
tgaatacccacaaatctgctgccat

SEQ ID NO: 604806 - DNA, 25 bp, Rattus norvegicus
tgaatacccacatatctgctgccat

SEQ ID NO: 604807 - DNA, 25 bp, Rattus norvegicus
tgaataccctccaggagctgcagct

SEQ ID NO: 604808 - DNA, 25 bp, Rattus norvegicus
tgaataccctcctggagctgcagct

SEQ ID NO: 604809 - DNA, 25 bp, Rattus norvegicus
tgaataccttgtatgcctgagtggg

SEQ ID NO: 604810 - DNA, 25 bp, Rattus norvegicus
tgaataccttgtttgcctgagtggg

SEQ ID NO: 604811 - DNA, 25 bp, Rattus norvegicus
tgaatacgtatgaaccggcaggctg

SEQ ID NO: 604812 - DNA, 25 bp, Rattus norvegicus
tgaatacgtatgtaccggcaggctg

SEQ ID NO: 604813 - DNA, 25 bp, Rattus norvegicus
tgaatactgaacctgcctgctgaac

SEQ ID NO: 604814 - DNA, 25 bp, Rattus norvegicus
tgaatactgaacgtgcctgctgaac

SEQ ID NO: 604815 - DNA, 25 bp, Rattus norvegicus
tgaatactgactagggcgtgggccc

SEQ ID NO: 604816 - DNA, 25 bp, Rattus norvegicus
tgaatactgacttgggcgtgggccc

SEQ ID NO: 604817 - DNA, 25 bp, Rattus norvegicus
tgaatacttagaactctgctcagag

SEQ ID NO: 604818 - DNA, 25 bp, Rattus norvegicus
tgaatacttagatctctgctcagag

SEQ ID NO: 604819 - DNA, 25 bp, Rattus norvegicus
tgaatagatattaccctccaaaggg

SEQ ID NO: 604820 - DNA, 25 bp, Rattus norvegicus
tgaatagatatttccctccaaaggg

SEQ ID NO: 604821 - DNA, 25 bp, Rattus norvegicus
tgaatagcaggaaaccctcttcctc

SEQ ID NO: 604822 - DNA, 25 bp, Rattus norvegicus
tgaatagcaggataccctcttcctc

SEQ ID NO: 604823 - DNA, 25 bp, Rattus norvegicus
tgaatagccagtccagcagtgccaa

SEQ ID NO: 604824 - DNA, 25 bp, Rattus norvegicus
tgaatagccagtgcagcagtgccaa

SEQ ID NO: 604825 - DNA, 25 bp, Rattus norvegicus
tgaatagctactctagacatcctag

SEQ ID NO: 604826 - DNA, 25 bp, Rattus norvegicus
tgaatagctactgtagacatcctag

SEQ ID NO: 604827 - DNA, 25 bp, Rattus norvegicus
tgaatagcttgcacactttgctggc

SEQ ID NO: 604828 - DNA, 25 bp, Rattus norvegicus
tgaatagcttgcctcaggagccgta

SEQ ID NO: 604829 - DNA, 25 bp, Rattus norvegicus
tgaatagcttgcgtcaggagccgta

SEQ ID NO: 604830 - DNA, 25 bp, Rattus norvegicus
tgaatagcttgctcactttgctggc

SEQ ID NO: 604831 - DNA, 25 bp, Rattus norvegicus
tgaatagtcatgaccttgctttccc

SEQ ID NO: 604832 - DNA, 25 bp, Rattus norvegicus
tgaatagtcatgtccttgctttccc

SEQ ID NO: 604833 - DNA, 25 bp, Rattus norvegicus
tgaatagtgtctcgagtgtccttgg

SEQ ID NO: 604834 - DNA, 25 bp, Rattus norvegicus
tgaatagtgtctggagtgtccttgg

SEQ ID NO: 604835 - DNA, 25 bp, Rattus norvegicus
tgaatagttctccacctctgacaca

SEQ ID NO: 604836 - DNA, 25 bp, Rattus norvegicus
tgaatagttctcgacctctgacaca

SEQ ID NO: 604837 - DNA, 25 bp, Rattus norvegicus
tgaatataacccacacccagcgtag

SEQ ID NO: 604838 - DNA, 25 bp, Rattus norvegicus
tgaatataaccctcacccagcgtag

SEQ ID NO: 604839 - DNA, 25 bp, Rattus norvegicus
tgaatataatgcctaactcgccctc

SEQ ID NO: 604840 - DNA, 25 bp, Rattus norvegicus
tgaatataatgcgtaactcgccctc

SEQ ID NO: 604841 - DNA, 25 bp, Rattus norvegicus
tgaatatactttactcctggtcacc

SEQ ID NO: 604842 - DNA, 25 bp, Rattus norvegicus
tgaatatacttttctcctggtcacc

SEQ ID NO: 604843 - DNA, 25 bp, Rattus norvegicus
tgaatatatcatccctgttccttag

SEQ ID NO: 604844 - DNA, 25 bp, Rattus norvegicus
tgaatatatcatgcctgttccttag

SEQ ID NO: 604845 - DNA, 25 bp, Rattus norvegicus
tgaatatatgtactctgtccaggaa

SEQ ID NO: 604846 - DNA, 25 bp, Rattus norvegicus
tgaatatatgtagtctgtccaggaa

SEQ ID NO: 604847 - DNA, 25 bp, Rattus norvegicus
tgaatatcaaacacgcaaggccatg

SEQ ID NO: 604848 - DNA, 25 bp, Rattus norvegicus
tgaatatcaaactcgcaaggccatg

SEQ ID NO: 604849 - DNA, 25 bp, Rattus norvegicus
tgaatatcaggtcaggtcagccatt

SEQ ID NO: 604850 - DNA, 25 bp, Rattus norvegicus
tgaatatcaggtgaggtcagccatt

SEQ ID NO: 604851 - DNA, 25 bp, Rattus norvegicus
tgaatatccctcagcttgctgatgt

SEQ ID NO: 604852 - DNA, 25 bp, Rattus norvegicus
tgaatatccctctgcttgctgatgt

SEQ ID NO: 604853 - DNA, 25 bp, Rattus norvegicus
tgaatatccgagataggcgtacata

SEQ ID NO: 604854 - DNA, 25 bp, Rattus norvegicus
tgaatatccgagttaggcgtacata

SEQ ID NO: 604855 - DNA, 25 bp, Rattus norvegicus
tgaatatcctccacactatgaatcc

SEQ ID NO: 604856 - DNA, 25 bp, Rattus norvegicus
tgaatatcctcctcactatgaatcc

SEQ ID NO: 604857 - DNA, 25 bp, Rattus norvegicus
tgaatatcctctatacgcctttgtt

SEQ ID NO: 604858 - DNA, 25 bp, Rattus norvegicus
tgaatatcctctttacgcctttgtt

SEQ ID NO: 604859 - DNA, 25 bp, Rattus norvegicus
tgaatatccttaatctgaaatctgc

SEQ ID NO: 604860 - DNA, 25 bp, Rattus norvegicus
tgaatatccttattctgaaatctgc

SEQ ID NO: 604861 - DNA, 25 bp, Rattus norvegicus
tgaatatctctacttctgtctccta

SEQ ID NO: 604862 - DNA, 25 bp, Rattus norvegicus
tgaatatctctagttctgtctccta

SEQ ID NO: 604863 - DNA, 25 bp, Rattus norvegicus
tgaatattagacacctccagccatg

SEQ ID NO: 604864 - DNA, 25 bp, Rattus norvegicus
tgaatattagactcctccagccatg

SEQ ID NO: 604865 - DNA, 25 bp, Rattus norvegicus
tgaatattaggcaaccccattttcc

SEQ ID NO: 604866 - DNA, 25 bp, Rattus norvegicus
tgaatattaggctaccccattttcc

SEQ ID NO: 604867 - DNA, 25 bp, Rattus norvegicus
tgaatattatccctaacacctgcca

SEQ ID NO: 604868 - DNA, 25 bp, Rattus norvegicus
tgaatattatccgtaacacctgcca

SEQ ID NO: 604869 - DNA, 25 bp, Rattus norvegicus
tgaatattccaaaacacgctcttgt

SEQ ID NO: 604870 - DNA, 25 bp, Rattus norvegicus
tgaatattccaatacacgctcttgt

SEQ ID NO: 604871 - DNA, 25 bp, Rattus norvegicus
tgaatattgctccatgctgccatct

SEQ ID NO: 604872 - DNA, 25 bp, Rattus norvegicus
tgaatattgctcgatgctgccatct

SEQ ID NO: 604873 - DNA, 25 bp, Rattus norvegicus
tgaatattgtctactctcctgctga

SEQ ID NO: 604874 - DNA, 25 bp, Rattus norvegicus
tgaatattgtcttctctcctgctga

SEQ ID NO: 604875 - DNA, 25 bp, Rattus norvegicus
tgaatattgtgccaaccccatctgt

SEQ ID NO: 604876 - DNA, 25 bp, Rattus norvegicus
tgaatattgtgcgaaccccatctgt

SEQ ID NO: 604877 - DNA, 25 bp, Rattus norvegicus
tgaatatttggcatcctccagacag

SEQ ID NO: 604878 - DNA, 25 bp, Rattus norvegicus
tgaatatttggcttcctccagacag

SEQ ID NO: 604879 - DNA, 25 bp, Rattus norvegicus
tgaatcaaagacagcgtccaccctg

SEQ ID NO: 604880 - DNA, 25 bp, Rattus norvegicus
tgaatcaaagactgcgtccaccctg

SEQ ID NO: 604881 - DNA, 25 bp, Rattus norvegicus
tgaatcaactcaaggaagcgctgga

SEQ ID NO: 604882 - DNA, 25 bp, Rattus norvegicus
tgaatcaactcatggaagcgctgga

SEQ ID NO: 604883 - DNA, 25 bp, Rattus norvegicus
tgaatcacagccacaacgtagtctt

SEQ ID NO: 604884 - DNA, 25 bp, Rattus norvegicus
tgaatcacagcctcaacgtagtctt

SEQ ID NO: 604885 - DNA, 25 bp, Rattus norvegicus
tgaatcacaggactttacctgcagc

SEQ ID NO: 604886 - DNA, 25 bp, Rattus norvegicus
tgaatcacaggagtttacctgcagc

SEQ ID NO: 604887 - DNA, 25 bp, Rattus norvegicus
tgaatcacatcaccacaaaacatat

SEQ ID NO: 604888 - DNA, 25 bp, Rattus norvegicus
tgaatcacatcagcacaaaacatat

SEQ ID NO: 604889 - DNA, 25 bp, Rattus norvegicus
tgaatcacccataagcccaggatgg

SEQ ID NO: 604890 - DNA, 25 bp, Rattus norvegicus
tgaatcacccattagcccaggatgg

SEQ ID NO: 604891 - DNA, 25 bp, Rattus norvegicus
tgaatcaccctgagtgcgcatggca

SEQ ID NO: 604892 - DNA, 25 bp, Rattus norvegicus
tgaatcaccctgtgtgcgcatggca

SEQ ID NO: 604893 - DNA, 25 bp, Rattus norvegicus
tgaatcaccgccccgggtgagacgt

SEQ ID NO: 604894 - DNA, 25 bp, Rattus norvegicus
tgaatcaccgccgcgggtgagacgt

SEQ ID NO: 604895 - DNA, 25 bp, Rattus norvegicus
tgaatcagcatcatgttcccatggt

SEQ ID NO: 604896 - DNA, 25 bp, Rattus norvegicus
tgaatcagcatcttgttcccatggt

SEQ ID NO: 604897 - DNA, 25 bp, Rattus norvegicus
tgaatcagccttattcatcccaaag

SEQ ID NO: 604898 - DNA, 25 bp, Rattus norvegicus
tgaatcagcctttttcatcccaaag

SEQ ID NO: 604899 - DNA, 25 bp, Rattus norvegicus
tgaatcagggaacccatgctgtctc

SEQ ID NO: 604900 - DNA, 25 bp, Rattus norvegicus
tgaatcagggaagccatgctgtctc

SEQ ID NO: 604901 - DNA, 25 bp, Rattus norvegicus
tgaatcagggtcactaacataggct

SEQ ID NO: 604902 - DNA, 25 bp, Rattus norvegicus
tgaatcagggtctctaacataggct

SEQ ID NO: 604903 - DNA, 25 bp, Rattus norvegicus
tgaatcatatcccagctgaccgtct

SEQ ID NO: 604904 - DNA, 25 bp, Rattus norvegicus
tgaatcatatccgagctgaccgtct

SEQ ID NO: 604905 - DNA, 25 bp, Rattus norvegicus
tgaatcatctttcactaccagacct

SEQ ID NO: 604906 - DNA, 25 bp, Rattus norvegicus
tgaatcatctttgactaccagacct

SEQ ID NO: 604907 - DNA, 25 bp, Rattus norvegicus
tgaatcatgcctaggacctctacaa

SEQ ID NO: 604908 - DNA, 25 bp, Rattus norvegicus
tgaatcatgccttggacctctacaa

SEQ ID NO: 604909 - DNA, 25 bp, Rattus norvegicus
tgaatccaatccatgcatggcctcc

SEQ ID NO: 604910 - DNA, 25 bp, Rattus norvegicus
tgaatccaatccttgcatggcctcc

SEQ ID NO: 604911 - DNA, 25 bp, Rattus norvegicus
tgaatccacaggacctattgagcgc

SEQ ID NO: 604912 - DNA, 25 bp, Rattus norvegicus
tgaatccacaggtcctattgagcgc

SEQ ID NO: 604913 - DNA, 25 bp, Rattus norvegicus
tgaatccacatccagcaccttaggg

SEQ ID NO: 604914 - DNA, 25 bp, Rattus norvegicus
tgaatccacatcgagcaccttaggg

SEQ ID NO: 604915 - DNA, 25 bp, Rattus norvegicus
tgaatccaccatagtctgtaacacc

SEQ ID NO: 604916 - DNA, 25 bp, Rattus norvegicus
tgaatccaccattgtctgtaacacc

SEQ ID NO: 604917 - DNA, 25 bp, Rattus norvegicus
tgaatccagaacaggtccaccaggg

SEQ ID NO: 604918 - DNA, 25 bp, Rattus norvegicus
tgaatccagaactggtccaccaggg

SEQ ID NO: 604919 - DNA, 25 bp, Rattus norvegicus
tgaatccagcggcagcaacacagtt

SEQ ID NO: 604920 - DNA, 25 bp, Rattus norvegicus
tgaatccagcgggagcaacacagtt

SEQ ID NO: 604921 - DNA, 25 bp, Rattus norvegicus
tgaatccagctaaatctgcccaaag

SEQ ID NO: 604922 - DNA, 25 bp, Rattus norvegicus
tgaatccagctatatctgcccaaag

SEQ ID NO: 604923 - DNA, 25 bp, Rattus norvegicus
tgaatccagggccacagagctgtgc

SEQ ID NO: 604924 - DNA, 25 bp, Rattus norvegicus
tgaatccagggcgacagagctgtgc

SEQ ID NO: 604925 - DNA, 25 bp, Rattus norvegicus
tgaatccatgctatagaactgtgtg

SEQ ID NO: 604926 - DNA, 25 bp, Rattus norvegicus
tgaatccatgctttagaactgtgtg

SEQ ID NO: 604927 - DNA, 25 bp, Rattus norvegicus
tgaatcccaaatacatctctagttt

SEQ ID NO: 604928 - DNA, 25 bp, Rattus norvegicus
tgaatcccaaattcatctctagttt

SEQ ID NO: 604929 - DNA, 25 bp, Rattus norvegicus
tgaatcccaagcacagtccgttgag

SEQ ID NO: 604930 - DNA, 25 bp, Rattus norvegicus
tgaatcccaagctcagtccgttgag

SEQ ID NO: 604931 - DNA, 25 bp, Rattus norvegicus
tgaatcccacatcacttagcttttc

SEQ ID NO: 604932 - DNA, 25 bp, Rattus norvegicus
tgaatcccacatgacttagcttttc

SEQ ID NO: 604933 - DNA, 25 bp, Rattus norvegicus
tgaatcccactccaaaaggctttgc

SEQ ID NO: 604934 - DNA, 25 bp, Rattus norvegicus
tgaatcccactcgaaaaggctttgc

SEQ ID NO: 604935 - DNA, 25 bp, Rattus norvegicus
tgaatcccagcaatattcactgcct

SEQ ID NO: 604936 - DNA, 25 bp, Rattus norvegicus
tgaatcccagcaattacttctccag

SEQ ID NO: 604937 - DNA, 25 bp, Rattus norvegicus
tgaatcccagcattattcactgcct

SEQ ID NO: 604938 - DNA, 25 bp, Rattus norvegicus
tgaatcccagcatttacttctccag

SEQ ID NO: 604939 - DNA, 25 bp, Rattus norvegicus
tgaatcccatctctactgtaacaga

SEQ ID NO: 604940 - DNA, 25 bp, Rattus norvegicus
tgaatcccatctgtactgtaacaga

SEQ ID NO: 604941 - DNA, 25 bp, Rattus norvegicus
tgaatcccatttaaccagatcctgc

SEQ ID NO: 604942 - DNA, 25 bp, Rattus norvegicus
tgaatcccattttaccagatcctgc

SEQ ID NO: 604943 - DNA, 25 bp, Rattus norvegicus
tgaatcccgctgcaggtttccttgg

SEQ ID NO: 604944 - DNA, 25 bp, Rattus norvegicus
tgaatcccgctggaggtttccttgg

SEQ ID NO: 604945 - DNA, 25 bp, Rattus norvegicus
tgaatcccgggacgcacccttttga

SEQ ID NO: 604946 - DNA, 25 bp, Rattus norvegicus
tgaatcccgggaggcacccttttga

SEQ ID NO: 604947 - DNA, 25 bp, Rattus norvegicus
tgaatccctagaaccagtatttgta

SEQ ID NO: 604948 - DNA, 25 bp, Rattus norvegicus
tgaatccctagatccagtatttgta

SEQ ID NO: 604949 - DNA, 25 bp, Rattus norvegicus
tgaatccctgtcaggactgagcctc

SEQ ID NO: 604950 - DNA, 25 bp, Rattus norvegicus
tgaatccctgtctggactgagcctc

SEQ ID NO: 604951 - DNA, 25 bp, Rattus norvegicus
tgaatccctgttaggaatgagcctt

SEQ ID NO: 604952 - DNA, 25 bp, Rattus norvegicus
tgaatccctgttcgagaggccctac

SEQ ID NO: 604953 - DNA, 25 bp, Rattus norvegicus
tgaatccctgttggagaggccctac

SEQ ID NO: 604954 - DNA, 25 bp, Rattus norvegicus
tgaatccctgtttggaatgagcctt

SEQ ID NO: 604955 - DNA, 25 bp, Rattus norvegicus
tgaatccgggtcaggctagaaggcc

SEQ ID NO: 604956 - DNA, 25 bp, Rattus norvegicus
tgaatccgggtctggctagaaggcc

SEQ ID NO: 604957 - DNA, 25 bp, Rattus norvegicus
tgaatcctacagaccaaaacccact

SEQ ID NO: 604958 - DNA, 25 bp, Rattus norvegicus
tgaatcctacagtccaaaacccact

SEQ ID NO: 604959 - DNA, 25 bp, Rattus norvegicus
tgaatcctatttcttgccaagccta

SEQ ID NO: 604960 - DNA, 25 bp, Rattus norvegicus
tgaatcctatttgttgccaagccta

SEQ ID NO: 604961 - DNA, 25 bp, Rattus norvegicus
tgaatcctcaggaatccatggcaac

SEQ ID NO: 604962 - DNA, 25 bp, Rattus norvegicus
tgaatcctcaggtatccatggcaac

SEQ ID NO: 604963 - DNA, 25 bp, Rattus norvegicus
tgaatcctccagataactgctttgt

SEQ ID NO: 604964 - DNA, 25 bp, Rattus norvegicus
tgaatcctccagttaactgctttgt

SEQ ID NO: 604965 - DNA, 25 bp, Rattus norvegicus
tgaatcctccttccctcatattttg

SEQ ID NO: 604966 - DNA, 25 bp, Rattus norvegicus
tgaatcctccttgcctcatattttg

SEQ ID NO: 604967 - DNA, 25 bp, Rattus norvegicus
tgaatcctctctacggtgggcaagc

SEQ ID NO: 604968 - DNA, 25 bp, Rattus norvegicus
tgaatcctctcttcggtgggcaagc

SEQ ID NO: 604969 - DNA, 25 bp, Rattus norvegicus
tgaatcctgctacctcggtgggaag

SEQ ID NO: 604970 - DNA, 25 bp, Rattus norvegicus
tgaatcctgctagctcggtgggaag

SEQ ID NO: 604971 - DNA, 25 bp, Rattus norvegicus
tgaatcctgctgagcccatgtagaa

SEQ ID NO: 604972 - DNA, 25 bp, Rattus norvegicus
tgaatcctgctgtgcccatgtagaa

SEQ ID NO: 604973 - DNA, 25 bp, Rattus norvegicus
tgaatccttcagcttacacactgcc

SEQ ID NO: 604974 - DNA, 25 bp, Rattus norvegicus
tgaatccttcaggttacacactgcc

SEQ ID NO: 604975 - DNA, 25 bp, Rattus norvegicus
tgaatccttggtcttccagatctcc

SEQ ID NO: 604976 - DNA, 25 bp, Rattus norvegicus
tgaatccttggtgttccagatctcc

SEQ ID NO: 604977 - DNA, 25 bp, Rattus norvegicus
tgaatccttttcattgctgtgccaa

SEQ ID NO: 604978 - DNA, 25 bp, Rattus norvegicus
tgaatccttttctttgctgtgccaa

SEQ ID NO: 604979 - DNA, 25 bp, Rattus norvegicus
tgaatcgaggagatgacttctgacc

SEQ ID NO: 604980 - DNA, 25 bp, Rattus norvegicus
tgaatcgaggagttgacttctgacc

SEQ ID NO: 604981 - DNA, 25 bp, Rattus norvegicus
tgaatcgatccaaatctccaacaca

SEQ ID NO: 604982 - DNA, 25 bp, Rattus norvegicus
tgaatcgatccatatctccaacaca

SEQ ID NO: 604983 - DNA, 25 bp, Rattus norvegicus
tgaatcgcatgacccgtttccagaa

SEQ ID NO: 604984 - DNA, 25 bp, Rattus norvegicus
tgaatcgcatgagccgtttccagaa

SEQ ID NO: 604985 - DNA, 25 bp, Rattus norvegicus
tgaatcgtggttactcaaatctaga

SEQ ID NO: 604986 - DNA, 25 bp, Rattus norvegicus
tgaatcgtggtttctcaaatctaga

SEQ ID NO: 604987 - DNA, 25 bp, Rattus norvegicus
tgaatctacttaactgcctgtcctg

SEQ ID NO: 604988 - DNA, 25 bp, Rattus norvegicus
tgaatctacttatctgcctgtcctg

SEQ ID NO: 604989 - DNA, 25 bp, Rattus norvegicus
tgaatctactttctgtgaccttaag

SEQ ID NO: 604990 - DNA, 25 bp, Rattus norvegicus
tgaatctactttgtgtgaccttaag

SEQ ID NO: 604991 - DNA, 25 bp, Rattus norvegicus
tgaatctatcctagcctactgagtt

SEQ ID NO: 604992 - DNA, 25 bp, Rattus norvegicus
tgaatctatccttgcctactgagtt

SEQ ID NO: 604993 - DNA, 25 bp, Rattus norvegicus
tgaatctattttaatgtggcccttg

SEQ ID NO: 604994 - DNA, 25 bp, Rattus norvegicus
tgaatctatttttatgtggcccttg

SEQ ID NO: 604995 - DNA, 25 bp, Rattus norvegicus
tgaatctcaggccaatcactttgct

SEQ ID NO: 604996 - DNA, 25 bp, Rattus norvegicus
tgaatctcaggcgaatcactttgct

SEQ ID NO: 604997 - DNA, 25 bp, Rattus norvegicus
tgaatctcagggagccgtggacaga

SEQ ID NO: 604998 - DNA, 25 bp, Rattus norvegicus
tgaatctcagggtgccgtggacaga

SEQ ID NO: 604999 - DNA, 25 bp, Rattus norvegicus
tgaatctcaggtctcacagcagtag

SEQ ID NO: 605000 - DNA, 25 bp, Rattus norvegicus
tgaatctcaggtgtcacagcagtag

SEQ ID NO: 605001 - DNA, 25 bp, Rattus norvegicus
tgaatctcattgacctcatcgtgga

SEQ ID NO: 605002 - DNA, 25 bp, Rattus norvegicus
tgaatctcattgtcctcatcgtgga

SEQ ID NO: 605003 - DNA, 25 bp, Rattus norvegicus
tgaatctccaacattttaacactta

SEQ ID NO: 605004 - DNA, 25 bp, Rattus norvegicus
tgaatctccaactttttaacactta

SEQ ID NO: 605005 - DNA, 25 bp, Rattus norvegicus
tgaatctcgacaatgaatcccttgc

SEQ ID NO: 605006 - DNA, 25 bp, Rattus norvegicus
tgaatctcgacattgaatcccttgc

SEQ ID NO: 605007 - DNA, 25 bp, Rattus norvegicus
tgaatctctcttcatctctaaccat

SEQ ID NO: 605008 - DNA, 25 bp, Rattus norvegicus
tgaatctctcttgatctctaaccat

SEQ ID NO: 605009 - DNA, 25 bp, Rattus norvegicus
tgaatctgcctaccagcaaggctgg

SEQ ID NO: 605010 - DNA, 25 bp, Rattus norvegicus
tgaatctgcctagcagcaaggctgg

SEQ ID NO: 605011 - DNA, 25 bp, Rattus norvegicus
tgaatctggttcaggtgttcctccc

SEQ ID NO: 605012 - DNA, 25 bp, Rattus norvegicus
tgaatctggttctggtgttcctccc

SEQ ID NO: 605013 - DNA, 25 bp, Rattus norvegicus
tgaatctgttagacccaattccgtc

SEQ ID NO: 605014 - DNA, 25 bp, Rattus norvegicus
tgaatctgttagtcccaattccgtc

SEQ ID NO: 605015 - DNA, 25 bp, Rattus norvegicus
tgaatcttacccagaactcaaccag

SEQ ID NO: 605016 - DNA, 25 bp, Rattus norvegicus
tgaatcttaccctgaactcaaccag

SEQ ID NO: 605017 - DNA, 25 bp, Rattus norvegicus
tgaatcttagagacacccgaccttt

SEQ ID NO: 605018 - DNA, 25 bp, Rattus norvegicus
tgaatcttagagtcacccgaccttt

SEQ ID NO: 605019 - DNA, 25 bp, Rattus norvegicus
tgaatcttcacgacaggtgtacctg

SEQ ID NO: 605020 - DNA, 25 bp, Rattus norvegicus
tgaatcttcacgtcaggtgtacctg

SEQ ID NO: 605021 - DNA, 25 bp, Rattus norvegicus
tgaatcttctatctaaatgcatgtt

SEQ ID NO: 605022 - DNA, 25 bp, Rattus norvegicus
tgaatcttctatgtaaatgcatgtt

SEQ ID NO: 605023 - DNA, 25 bp, Rattus norvegicus
tgaatcttctgtatagcttgcctcc

SEQ ID NO: 605024 - DNA, 25 bp, Rattus norvegicus
tgaatcttctgtttagcttgcctcc

SEQ ID NO: 605025 - DNA, 25 bp, Rattus norvegicus
tgaatcttctttaagtcccagcgag

SEQ ID NO: 605026 - DNA, 25 bp, Rattus norvegicus
tgaatcttcttttagtcccagcgag

SEQ ID NO: 605027 - DNA, 25 bp, Rattus norvegicus
tgaatcttgcttctttccacaatgc

SEQ ID NO: 605028 - DNA, 25 bp, Rattus norvegicus
tgaatcttgcttgtttccacaatgc

SEQ ID NO: 605029 - DNA, 25 bp, Rattus norvegicus
tgaatcttttagaggttacattgcc

SEQ ID NO: 605030 - DNA, 25 bp, Rattus norvegicus
tgaatcttttagtggttacattgcc

SEQ ID NO: 605031 - DNA, 25 bp, Rattus norvegicus
tgaatcttttgtctactggccaaca

SEQ ID NO: 605032 - DNA, 25 bp, Rattus norvegicus
tgaatcttttgtgtactggccaaca

SEQ ID NO: 605033 - DNA, 25 bp, Rattus norvegicus
tgaatgaaaacccagccccagcagt

SEQ ID NO: 605034 - DNA, 25 bp, Rattus norvegicus
tgaatgaaaaccgagccccagcagt

SEQ ID NO: 605035 - DNA, 25 bp, Rattus norvegicus
tgaatgaaattcaccagtgttctgg

SEQ ID NO: 605036 - DNA, 25 bp, Rattus norvegicus
tgaatgaaattctccagtgttctgg

SEQ ID NO: 605037 - DNA, 25 bp, Rattus norvegicus
tgaatgaagcccctgagacttcatg

SEQ ID NO: 605038 - DNA, 25 bp, Rattus norvegicus
tgaatgaagcccgtgagacttcatg

SEQ ID NO: 605039 - DNA, 25 bp, Rattus norvegicus
tgaatgacacctcctgactgtactc

SEQ ID NO: 605040 - DNA, 25 bp, Rattus norvegicus
tgaatgacacctgctgactgtactc

SEQ ID NO: 605041 - DNA, 25 bp, Rattus norvegicus
tgaatgacacttcgacactgctctc

SEQ ID NO: 605042 - DNA, 25 bp, Rattus norvegicus
tgaatgacacttggacactgctctc

SEQ ID NO: 605043 - DNA, 25 bp, Rattus norvegicus
tgaatgacaggcaacaccaccaaga

SEQ ID NO: 605044 - DNA, 25 bp, Rattus norvegicus
tgaatgacaggctacaccaccaaga

SEQ ID NO: 605045 - DNA, 25 bp, Rattus norvegicus
tgaatgaccccaagttctactctta

SEQ ID NO: 605046 - DNA, 25 bp, Rattus norvegicus
tgaatgaccccatgttctactctta

SEQ ID NO: 605047 - DNA, 25 bp, Rattus norvegicus
tgaatgacctcaccagcaaccgttt

SEQ ID NO: 605048 - DNA, 25 bp, Rattus norvegicus
tgaatgacctcagcagcaaccgttt

SEQ ID NO: 605049 - DNA, 25 bp, Rattus norvegicus
tgaatgacctctattttaactttat

SEQ ID NO: 605050 - DNA, 25 bp, Rattus norvegicus
tgaatgacctcttttttaactttat

SEQ ID NO: 605051 - DNA, 25 bp, Rattus norvegicus
tgaatgacgtctaccaagccaaagc

SEQ ID NO: 605052 - DNA, 25 bp, Rattus norvegicus
tgaatgacgtcttccaagccaaagc

SEQ ID NO: 605053 - DNA, 25 bp, Rattus norvegicus
tgaatgactcccaaaccacttggtg

SEQ ID NO: 605054 - DNA, 25 bp, Rattus norvegicus
tgaatgactccctaaccacttggtg

SEQ ID NO: 605055 - DNA, 25 bp, Rattus norvegicus
tgaatgactggtaatacgcctttaa

SEQ ID NO: 605056 - DNA, 25 bp, Rattus norvegicus
tgaatgactggttatacgcctttaa

SEQ ID NO: 605057 - DNA, 25 bp, Rattus norvegicus
tgaatgacttcacaagccctggtct

SEQ ID NO: 605058 - DNA, 25 bp, Rattus norvegicus
tgaatgacttcagaagccctggtct

SEQ ID NO: 605059 - DNA, 25 bp, Rattus norvegicus
tgaatgagacgcatccttgagaccc

SEQ ID NO: 605060 - DNA, 25 bp, Rattus norvegicus
tgaatgagacgcttccttgagaccc

SEQ ID NO: 605061 - DNA, 25 bp, Rattus norvegicus
tgaatgagcactacctgaacaccac

SEQ ID NO: 605062 - DNA, 25 bp, Rattus norvegicus
tgaatgagcacttcctgaacaccac

SEQ ID NO: 605063 - DNA, 25 bp, Rattus norvegicus
tgaatgagccgcagactgctgccat

SEQ ID NO: 605064 - DNA, 25 bp, Rattus norvegicus
tgaatgagccgctgactgctgccat

SEQ ID NO: 605065 - DNA, 25 bp, Rattus norvegicus
tgaatgagctgaacgctgcgggcca

SEQ ID NO: 605066 - DNA, 25 bp, Rattus norvegicus
tgaatgagctgatcgctgcgggcca

SEQ ID NO: 605067 - DNA, 25 bp, Rattus norvegicus
tgaatgaggaccacactgcgcctgc

SEQ ID NO: 605068 - DNA, 25 bp, Rattus norvegicus
tgaatgaggacctcactgcgcctgc

SEQ ID NO: 605069 - DNA, 25 bp, Rattus norvegicus
tgaatgaggcctcgaagcgacaact

SEQ ID NO: 605070 - DNA, 25 bp, Rattus norvegicus
tgaatgaggcctggaagcgacaact

SEQ ID NO: 605071 - DNA, 25 bp, Rattus norvegicus
tgaatgagtgtgaagtgccagcaga

SEQ ID NO: 605072 - DNA, 25 bp, Rattus norvegicus
tgaatgagtgtgtagtgccagcaga

SEQ ID NO: 605073 - DNA, 25 bp, Rattus norvegicus
tgaatgatcaccaactcccttaata

SEQ ID NO: 605074 - DNA, 25 bp, Rattus norvegicus
tgaatgatcacctactcccttaata

SEQ ID NO: 605075 - DNA, 25 bp, Rattus norvegicus
tgaatgatcactctgtaaacacata

SEQ ID NO: 605076 - DNA, 25 bp, Rattus norvegicus
tgaatgatcactgtgtaaacacata

SEQ ID NO: 605077 - DNA, 25 bp, Rattus norvegicus
tgaatgatgcctatggtgacaccaa

SEQ ID NO: 605078 - DNA, 25 bp, Rattus norvegicus
tgaatgatgcctttggtgacaccaa

SEQ ID NO: 605079 - DNA, 25 bp, Rattus norvegicus
tgaatgatgctaacttccttttgga

SEQ ID NO: 605080 - DNA, 25 bp, Rattus norvegicus
tgaatgatgctatcttccttttgga

SEQ ID NO: 605081 - DNA, 25 bp, Rattus norvegicus
tgaatgattgttacttgtacttaac

SEQ ID NO: 605082 - DNA, 25 bp, Rattus norvegicus
tgaatgattgtttcttgtacttaac

SEQ ID NO: 605083 - DNA, 25 bp, Rattus norvegicus
tgaatgcaacggaaagaaaacccac

SEQ ID NO: 605084 - DNA, 25 bp, Rattus norvegicus
tgaatgcaacggtaagaaaacccac

SEQ ID NO: 605085 - DNA, 25 bp, Rattus norvegicus
tgaatgcacctgacgagatcccaag

SEQ ID NO: 605086 - DNA, 25 bp, Rattus norvegicus
tgaatgcacctgtcgagatcccaag

SEQ ID NO: 605087 - DNA, 25 bp, Rattus norvegicus
tgaatgcagccgaggcctgaataaa

SEQ ID NO: 605088 - DNA, 25 bp, Rattus norvegicus
tgaatgcagccgtggcctgaataaa

SEQ ID NO: 605089 - DNA, 25 bp, Rattus norvegicus
tgaatgcagggtacttccctggcag

SEQ ID NO: 605090 - DNA, 25 bp, Rattus norvegicus
tgaatgcagggttcttccctggcag

SEQ ID NO: 605091 - DNA, 25 bp, Rattus norvegicus
tgaatgcatttcctagctctttata

SEQ ID NO: 605092 - DNA, 25 bp, Rattus norvegicus
tgaatgcatttcgtagctctttata

SEQ ID NO: 605093 - DNA, 25 bp, Rattus norvegicus
tgaatgcatttgacacagcctcttg

SEQ ID NO: 605094 - DNA, 25 bp, Rattus norvegicus
tgaatgcatttgtcacagcctcttg

SEQ ID NO: 605095 - DNA, 25 bp, Rattus norvegicus
tgaatgccaccgaggatgagataat

SEQ ID NO: 605096 - DNA, 25 bp, Rattus norvegicus
tgaatgccaccgtggatgagataat

SEQ ID NO: 605097 - DNA, 25 bp, Rattus norvegicus
tgaatgccagcccattgagatgccc

SEQ ID NO: 605098 - DNA, 25 bp, Rattus norvegicus
tgaatgccagccgattgagatgccc

SEQ ID NO: 605099 - DNA, 25 bp, Rattus norvegicus
tgaatgccagtccatcatgaagctg

SEQ ID NO: 605100 - DNA, 25 bp, Rattus norvegicus
tgaatgccagtcgatcatgaagctg

SEQ ID NO: 605101 - DNA, 25 bp, Rattus norvegicus
tgaatgccatctccctatttaacag

SEQ ID NO: 605102 - DNA, 25 bp, Rattus norvegicus
tgaatgccatctgcctatttaacag

SEQ ID NO: 605103 - DNA, 25 bp, Rattus norvegicus
tgaatgcccatcacgactgaccata

SEQ ID NO: 605104 - DNA, 25 bp, Rattus norvegicus
tgaatgcccatctcgactgaccata

SEQ ID NO: 605105 - DNA, 25 bp, Rattus norvegicus
tgaatgcccattactcatacacaga

SEQ ID NO: 605106 - DNA, 25 bp, Rattus norvegicus
tgaatgcccatttctcatacacaga

SEQ ID NO: 605107 - DNA, 25 bp, Rattus norvegicus
tgaatgccctgtaagtgctacctgc

SEQ ID NO: 605108 - DNA, 25 bp, Rattus norvegicus
tgaatgccctgttagtgctacctgc

SEQ ID NO: 605109 - DNA, 25 bp, Rattus norvegicus
tgaatgccgcgccaccagtaaatgc

SEQ ID NO: 605110 - DNA, 25 bp, Rattus norvegicus
tgaatgccgcgcgaccagtaaatgc

SEQ ID NO: 605111 - DNA, 25 bp, Rattus norvegicus
tgaatgcgctttactgcccatggga

SEQ ID NO: 605112 - DNA, 25 bp, Rattus norvegicus
tgaatgcgcttttctgcccatggga

SEQ ID NO: 605113 - DNA, 25 bp, Rattus norvegicus
tgaatgctcacacgcttcgagggta

SEQ ID NO: 605114 - DNA, 25 bp, Rattus norvegicus
tgaatgctcacaggcttcgagggta

SEQ ID NO: 605115 - DNA, 25 bp, Rattus norvegicus
tgaatgctgccaaggtacccttgat

SEQ ID NO: 605116 - DNA, 25 bp, Rattus norvegicus
tgaatgctgccatggtacccttgat

SEQ ID NO: 605117 - DNA, 25 bp, Rattus norvegicus
tgaatgctggtacttctctcagttc

SEQ ID NO: 605118 - DNA, 25 bp, Rattus norvegicus
tgaatgctggtagttctctcagttc

SEQ ID NO: 605119 - DNA, 25 bp, Rattus norvegicus
tgaatgctgtccagtgtcacccact

SEQ ID NO: 605120 - DNA, 25 bp, Rattus norvegicus
tgaatgctgtcctgtgtcacccact

SEQ ID NO: 605121 - DNA, 25 bp, Rattus norvegicus
tgaatgcttgccaacttatgcccta

SEQ ID NO: 605122 - DNA, 25 bp, Rattus norvegicus
tgaatgcttgcctacttatgcccta

SEQ ID NO: 605123 - DNA, 25 bp, Rattus norvegicus
tgaatgcttggtactgttaacggaa

SEQ ID NO: 605124 - DNA, 25 bp, Rattus norvegicus
tgaatgcttggttctgttaacggaa

SEQ ID NO: 605125 - DNA, 25 bp, Rattus norvegicus
tgaatggaacgaagtcccctgcaat

SEQ ID NO: 605126 - DNA, 25 bp, Rattus norvegicus
tgaatggaacgatgtcccctgcaat

SEQ ID NO: 605127 - DNA, 25 bp, Rattus norvegicus
tgaatggaccacagcaagctatctg

SEQ ID NO: 605128 - DNA, 25 bp, Rattus norvegicus
tgaatggaccactgcaagctatctg

SEQ ID NO: 605129 - DNA, 25 bp, Rattus norvegicus
tgaatggaccctaattccttcccct

SEQ ID NO: 605130 - DNA, 25 bp, Rattus norvegicus
tgaatggacccttattccttcccct

SEQ ID NO: 605131 - DNA, 25 bp, Rattus norvegicus
tgaatggactatccactggctcagt

SEQ ID NO: 605132 - DNA, 25 bp, Rattus norvegicus
tgaatggactatgcactggctcagt

SEQ ID NO: 605133 - DNA, 25 bp, Rattus norvegicus
tgaatggactttccagccatacccc

SEQ ID NO: 605134 - DNA, 25 bp, Rattus norvegicus
tgaatggactttgcagccatacccc

SEQ ID NO: 605135 - DNA, 25 bp, Rattus norvegicus
tgaatggagacgacccttttctctt

SEQ ID NO: 605136 - DNA, 25 bp, Rattus norvegicus
tgaatggagacgtcccttttctctt

SEQ ID NO: 605137 - DNA, 25 bp, Rattus norvegicus
tgaatggagcatctgtacccctggg

SEQ ID NO: 605138 - DNA, 25 bp, Rattus norvegicus
tgaatggagcatgtgtacccctggg

SEQ ID NO: 605139 - DNA, 25 bp, Rattus norvegicus
tgaatggcacatctcgctggcactt

SEQ ID NO: 605140 - DNA, 25 bp, Rattus norvegicus
tgaatggcacatgtcgctggcactt

SEQ ID NO: 605141 - DNA, 25 bp, Rattus norvegicus
tgaatggcaccgctggcttcactgc

SEQ ID NO: 605142 - DNA, 25 bp, Rattus norvegicus
tgaatggcaccggtggcttcactgc

SEQ ID NO: 605143 - DNA, 25 bp, Rattus norvegicus
tgaatggcagccactgctcctgcgg

SEQ ID NO: 605144 - DNA, 25 bp, Rattus norvegicus
tgaatggcagcctctgctcctgcgg

SEQ ID NO: 605145 - DNA, 25 bp, Rattus norvegicus
tgaatggcatgtactggtctgctgt

SEQ ID NO: 605146 - DNA, 25 bp, Rattus norvegicus
tgaatggcatgttctggtctgctgt

SEQ ID NO: 605147 - DNA, 25 bp, Rattus norvegicus
tgaatggcccctactgcaagcagaa

SEQ ID NO: 605148 - DNA, 25 bp, Rattus norvegicus
tgaatggccccttctgcaagcagaa

SEQ ID NO: 605149 - DNA, 25 bp, Rattus norvegicus
tgaatggccgccctttttggttttg

SEQ ID NO: 605150 - DNA, 25 bp, Rattus norvegicus
tgaatggccgccgtttttggttttg

SEQ ID NO: 605151 - DNA, 25 bp, Rattus norvegicus
tgaatggccgtgagcttccttgatt

SEQ ID NO: 605152 - DNA, 25 bp, Rattus norvegicus
tgaatggccgtgtgcttccttgatt

SEQ ID NO: 605153 - DNA, 25 bp, Rattus norvegicus
tgaatggcggctcaacttcacccag

SEQ ID NO: 605154 - DNA, 25 bp, Rattus norvegicus
tgaatggcggctgaacttcacccag

SEQ ID NO: 605155 - DNA, 25 bp, Rattus norvegicus
tgaatggctcatccgaggaccttga

SEQ ID NO: 605156 - DNA, 25 bp, Rattus norvegicus
tgaatggctcatgcgaggaccttga

SEQ ID NO: 605157 - DNA, 25 bp, Rattus norvegicus
tgaatggctcggatcatagctgtcc

SEQ ID NO: 605158 - DNA, 25 bp, Rattus norvegicus
tgaatggctcggttcatagctgtcc

SEQ ID NO: 605159 - DNA, 25 bp, Rattus norvegicus
tgaatggcttctatctgaccctgag

SEQ ID NO: 605160 - DNA, 25 bp, Rattus norvegicus
tgaatggcttctttctgaccctgag

SEQ ID NO: 605161 - DNA, 25 bp, Rattus norvegicus
tgaatggctttcattgacctctgac

SEQ ID NO: 605162 - DNA, 25 bp, Rattus norvegicus
tgaatggctttctttgacctctgac

SEQ ID NO: 605163 - DNA, 25 bp, Rattus norvegicus
tgaatgggacatcgctgccttcgtg

SEQ ID NO: 605164 - DNA, 25 bp, Rattus norvegicus
tgaatgggacatggctgccttcgtg

SEQ ID NO: 605165 - DNA, 25 bp, Rattus norvegicus
tgaatgggagccctgcttctgcact

SEQ ID NO: 605166 - DNA, 25 bp, Rattus norvegicus
tgaatgggagccgtgcttctgcact

SEQ ID NO: 605167 - DNA, 25 bp, Rattus norvegicus
tgaatgggatcaccgtcctgcacaa

SEQ ID NO: 605168 - DNA, 25 bp, Rattus norvegicus
tgaatgggatcagcgtcctgcacaa

SEQ ID NO: 605169 - DNA, 25 bp, Rattus norvegicus
tgaatgggcaacaatctcccagctg

SEQ ID NO: 605170 - DNA, 25 bp, Rattus norvegicus
tgaatgggcaactatctcccagctg

SEQ ID NO: 605171 - DNA, 25 bp, Rattus norvegicus
tgaatgggccccagagatgacctgg

SEQ ID NO: 605172 - DNA, 25 bp, Rattus norvegicus
tgaatgggcccctgagatgacctgg

SEQ ID NO: 605173 - DNA, 25 bp, Rattus norvegicus
tgaatgggcgctactcctggagagt

SEQ ID NO: 605174 - DNA, 25 bp, Rattus norvegicus
tgaatgggcgcttctcctggagagt

SEQ ID NO: 605175 - DNA, 25 bp, Rattus norvegicus
tgaatgggcgtcacacgaccgacag

SEQ ID NO: 605176 - DNA, 25 bp, Rattus norvegicus
tgaatgggcgtctcacgaccgacag

SEQ ID NO: 605177 - DNA, 25 bp, Rattus norvegicus
tgaatggtccttatggtctgcgtac

SEQ ID NO: 605178 - DNA, 25 bp, Rattus norvegicus
tgaatggtccttttggtctgcgtac

SEQ ID NO: 605179 - DNA, 25 bp, Rattus norvegicus
tgaatggtgcccctttgcagagctt

SEQ ID NO: 605180 - DNA, 25 bp, Rattus norvegicus
tgaatggtgcccgtttgcagagctt

SEQ ID NO: 605181 - DNA, 25 bp, Rattus norvegicus
tgaatggtgtccagcctggtgcccg

SEQ ID NO: 605182 - DNA, 25 bp, Rattus norvegicus
tgaatggtgtcctgcctggtgcccg

SEQ ID NO: 605183 - DNA, 25 bp, Rattus norvegicus
tgaatggtgtttctgtcggtctgcc

SEQ ID NO: 605184 - DNA, 25 bp, Rattus norvegicus
tgaatggtgtttgtgtcggtctgcc

SEQ ID NO: 605185 - DNA, 25 bp, Rattus norvegicus
tgaatgtaagggacactctcccctc

SEQ ID NO: 605186 - DNA, 25 bp, Rattus norvegicus
tgaatgtaagggtcactctcccctc

SEQ ID NO: 605187 - DNA, 25 bp, Rattus norvegicus
tgaatgtacactcaagccttttctt

SEQ ID NO: 605188 - DNA, 25 bp, Rattus norvegicus
tgaatgtacactgaagccttttctt

SEQ ID NO: 605189 - DNA, 25 bp, Rattus norvegicus
tgaatgtacagcaccatcccagcgc

SEQ ID NO: 605190 - DNA, 25 bp, Rattus norvegicus
tgaatgtacagctccatcccagcgc

SEQ ID NO: 605191 - DNA, 25 bp, Rattus norvegicus
tgaatgtagcaccttcaccagttac

SEQ ID NO: 605192 - DNA, 25 bp, Rattus norvegicus
tgaatgtagcacgttcaccagttac

SEQ ID NO: 605193 - DNA, 25 bp, Rattus norvegicus
tgaatgtatattcttgccactccct

SEQ ID NO: 605194 - DNA, 25 bp, Rattus norvegicus
tgaatgtatattgttgccactccct

SEQ ID NO: 605195 - DNA, 25 bp, Rattus norvegicus
tgaatgtcacatctgcagcctctgg

SEQ ID NO: 605196 - DNA, 25 bp, Rattus norvegicus
tgaatgtcacatgtgcagcctctgg

SEQ ID NO: 605197 - DNA, 25 bp, Rattus norvegicus
tgaatgtcacccaagagtcccagaa

SEQ ID NO: 605198 - DNA, 25 bp, Rattus norvegicus
tgaatgtcaccctagagtcccagaa

SEQ ID NO: 605199 - DNA, 25 bp, Rattus norvegicus
tgaatgtcatttaccccgctcctga

SEQ ID NO: 605200 - DNA, 25 bp, Rattus norvegicus
tgaatgtcatttctccaggctttgt

SEQ ID NO: 605201 - DNA, 25 bp, Rattus norvegicus
tgaatgtcatttgtccaggctttgt

SEQ ID NO: 605202 - DNA, 25 bp, Rattus norvegicus
tgaatgtcattttccccgctcctga

SEQ ID NO: 605203 - DNA, 25 bp, Rattus norvegicus
tgaatgtccactcaggaacttccta

SEQ ID NO: 605204 - DNA, 25 bp, Rattus norvegicus
tgaatgtccactgaggaacttccta

SEQ ID NO: 605205 - DNA, 25 bp, Rattus norvegicus
tgaatgtccagacacagcccgccat

SEQ ID NO: 605206 - DNA, 25 bp, Rattus norvegicus
tgaatgtccagagacagcccgccat

SEQ ID NO: 605207 - DNA, 25 bp, Rattus norvegicus
tgaatgtcccctcagctgtcagaga

SEQ ID NO: 605208 - DNA, 25 bp, Rattus norvegicus
tgaatgtcccctgagctgtcagaga

SEQ ID NO: 605209 - DNA, 25 bp, Rattus norvegicus
tgaatgtcctgtctacatatctgcc

SEQ ID NO: 605210 - DNA, 25 bp, Rattus norvegicus
tgaatgtcctgtgtacatatctgcc

SEQ ID NO: 605211 - DNA, 25 bp, Rattus norvegicus
tgaatgtcgaccagacagggtgccc

SEQ ID NO: 605212 - DNA, 25 bp, Rattus norvegicus
tgaatgtcgacctgacagggtgccc

SEQ ID NO: 605213 - DNA, 25 bp, Rattus norvegicus
tgaatgtctggaaccatgcgctgac

SEQ ID NO: 605214 - DNA, 25 bp, Rattus norvegicus
tgaatgtctggatccatgcgctgac

SEQ ID NO: 605215 - DNA, 25 bp, Rattus norvegicus
tgaatgtcttaaaagccttcctgct

SEQ ID NO: 605216 - DNA, 25 bp, Rattus norvegicus
tgaatgtcttaatagccttcctgct

SEQ ID NO: 605217 - DNA, 25 bp, Rattus norvegicus
tgaatgtgaacaactctcctgcttg

SEQ ID NO: 605218 - DNA, 25 bp, Rattus norvegicus
tgaatgtgaacatctctcctgcttg

SEQ ID NO: 605219 - DNA, 25 bp, Rattus norvegicus
tgaatgtgactgactttccctgccc

SEQ ID NO: 605220 - DNA, 25 bp, Rattus norvegicus
tgaatgtgactgtctttccctgccc

SEQ ID NO: 605221 - DNA, 25 bp, Rattus norvegicus
tgaatgtgattcagttgatggactt

SEQ ID NO: 605222 - DNA, 25 bp, Rattus norvegicus
tgaatgtgattctgttgatggactt

SEQ ID NO: 605223 - DNA, 25 bp, Rattus norvegicus
tgaatgtgcgagaccaggtgcccta

SEQ ID NO: 605224 - DNA, 25 bp, Rattus norvegicus
tgaatgtgcgagtccaggtgcccta

SEQ ID NO: 605225 - DNA, 25 bp, Rattus norvegicus
tgaatgtgctcaccctatagcccat

SEQ ID NO: 605226 - DNA, 25 bp, Rattus norvegicus
tgaatgtgctcagcctatagcccat

SEQ ID NO: 605227 - DNA, 25 bp, Rattus norvegicus
tgaatgtgctgaagaaccctccatg

SEQ ID NO: 605228 - DNA, 25 bp, Rattus norvegicus
tgaatgtgctgatgaaccctccatg

SEQ ID NO: 605229 - DNA, 25 bp, Rattus norvegicus
tgaatgtggatgacgcccaggcctt

SEQ ID NO: 605230 - DNA, 25 bp, Rattus norvegicus
tgaatgtggatgtcgcccaggcctt

SEQ ID NO: 605231 - DNA, 25 bp, Rattus norvegicus
tgaatgtggcctctgttgttaccgc

SEQ ID NO: 605232 - DNA, 25 bp, Rattus norvegicus
tgaatgtggcctgtgttgttaccgc

SEQ ID NO: 605233 - DNA, 25 bp, Rattus norvegicus
tgaatgtggctcactggaactctat

SEQ ID NO: 605234 - DNA, 25 bp, Rattus norvegicus
tgaatgtggctctctggaactctat

SEQ ID NO: 605235 - DNA, 25 bp, Rattus norvegicus
tgaatgtgggccaccattggtgcga

SEQ ID NO: 605236 - DNA, 25 bp, Rattus norvegicus
tgaatgtgggcctccattggtgcga

SEQ ID NO: 605237 - DNA, 25 bp, Rattus norvegicus
tgaatgtgtctacccttctctaatg

SEQ ID NO: 605238 - DNA, 25 bp, Rattus norvegicus
tgaatgtgtctagccttctctaatg

SEQ ID NO: 605239 - DNA, 25 bp, Rattus norvegicus
tgaatgtgtctgacgggcttgtctc

SEQ ID NO: 605240 - DNA, 25 bp, Rattus norvegicus
tgaatgtgtctgtcgggcttgtctc

SEQ ID NO: 605241 - DNA, 25 bp, Rattus norvegicus
tgaatgtgtgacatccagtccgcat

SEQ ID NO: 605242 - DNA, 25 bp, Rattus norvegicus
tgaatgtgtgacttccagtccgcat

SEQ ID NO: 605243 - DNA, 25 bp, Rattus norvegicus
tgaatgtgtgtgatttcgcaccacc

SEQ ID NO: 605244 - DNA, 25 bp, Rattus norvegicus
tgaatgtgtgtgttttcgcaccacc

SEQ ID NO: 605245 - DNA, 25 bp, Rattus norvegicus
tgaatgtgttcgcacccaacggtac

SEQ ID NO: 605246 - DNA, 25 bp, Rattus norvegicus
tgaatgtgttcggacccaacggtac

SEQ ID NO: 605247 - DNA, 25 bp, Rattus norvegicus
tgaatgttgaggacccagtgactct

SEQ ID NO: 605248 - DNA, 25 bp, Rattus norvegicus
tgaatgttgaggtcccagtgactct

SEQ ID NO: 605249 - DNA, 25 bp, Rattus norvegicus
tgaatgttgcgtactgtccagatga

SEQ ID NO: 605250 - DNA, 25 bp, Rattus norvegicus
tgaatgttgcgttctgtccagatga

SEQ ID NO: 605251 - DNA, 25 bp, Rattus norvegicus
tgaatgtttacacactggctgtcct

SEQ ID NO: 605252 - DNA, 25 bp, Rattus norvegicus
tgaatgtttacagactggctgtcct

SEQ ID NO: 605253 - DNA, 25 bp, Rattus norvegicus
tgaatgtttcacatccagtgtccct

SEQ ID NO: 605254 - DNA, 25 bp, Rattus norvegicus
tgaatgtttcacttccagtgtccct

SEQ ID NO: 605255 - DNA, 25 bp, Rattus norvegicus
tgaatgtttcagctatcgagttgga

SEQ ID NO: 605256 - DNA, 25 bp, Rattus norvegicus
tgaatgtttcaggtatcgagttgga

SEQ ID NO: 605257 - DNA, 25 bp, Rattus norvegicus
tgaatgtttgcgcacggctgccact

SEQ ID NO: 605258 - DNA, 25 bp, Rattus norvegicus
tgaatgtttgcggacggctgccact

SEQ ID NO: 605259 - DNA, 25 bp, Rattus norvegicus
tgaattaaattgatctcccgcctgc

SEQ ID NO: 605260 - DNA, 25 bp, Rattus norvegicus
tgaattaaattgttctcccgcctgc

SEQ ID NO: 605261 - DNA, 25 bp, Rattus norvegicus
tgaattaagcctcttctcctttact

SEQ ID NO: 605262 - DNA, 25 bp, Rattus norvegicus
tgaattaagcctgttctcctttact

SEQ ID NO: 605263 - DNA, 25 bp, Rattus norvegicus
tgaattacaaatccacccagttctc

SEQ ID NO: 605264 - DNA, 25 bp, Rattus norvegicus
tgaattacaaatgcacccagttctc

SEQ ID NO: 605265 - DNA, 25 bp, Rattus norvegicus
tgaattacaatgatgttcttcccag

SEQ ID NO: 605266 - DNA, 25 bp, Rattus norvegicus
tgaattacaatgttgttcttcccag

SEQ ID NO: 605267 - DNA, 25 bp, Rattus norvegicus
tgaattacggccaaccagggatctc

SEQ ID NO: 605268 - DNA, 25 bp, Rattus norvegicus
tgaattacggcctaccagggatctc

SEQ ID NO: 605269 - DNA, 25 bp, Rattus norvegicus
tgaattactgctcttatcttgacta

SEQ ID NO: 605270 - DNA, 25 bp, Rattus norvegicus
tgaattactgctgttatcttgacta

SEQ ID NO: 605271 - DNA, 25 bp, Rattus norvegicus
tgaattacttcaaactccctggtgg

SEQ ID NO: 605272 - DNA, 25 bp, Rattus norvegicus
tgaattacttcaagccactgactga

SEQ ID NO: 605273 - DNA, 25 bp, Rattus norvegicus
tgaattacttcatactccctggtgg

SEQ ID NO: 605274 - DNA, 25 bp, Rattus norvegicus
tgaattacttcatgccactgactga

SEQ ID NO: 605275 - DNA, 25 bp, Rattus norvegicus
tgaattagactaatacaaggcctac

SEQ ID NO: 605276 - DNA, 25 bp, Rattus norvegicus
tgaattagactattacaaggcctac

SEQ ID NO: 605277 - DNA, 25 bp, Rattus norvegicus
tgaattagtgaacccagtttccctg

SEQ ID NO: 605278 - DNA, 25 bp, Rattus norvegicus
tgaattagtgaagccagtttccctg

SEQ ID NO: 605279 - DNA, 25 bp, Rattus norvegicus
tgaattagttccctgagcctgaccc

SEQ ID NO: 605280 - DNA, 25 bp, Rattus norvegicus
tgaattagttccgtgagcctgaccc

SEQ ID NO: 605281 - DNA, 25 bp, Rattus norvegicus
tgaattatggttatccccttctctt

SEQ ID NO: 605282 - DNA, 25 bp, Rattus norvegicus
tgaattatggttttccccttctctt

SEQ ID NO: 605283 - DNA, 25 bp, Rattus norvegicus
tgaattcaaggcctctggtgctctc

SEQ ID NO: 605284 - DNA, 25 bp, Rattus norvegicus
tgaattcaaggcgtctggtgctctc

SEQ ID NO: 605285 - DNA, 25 bp, Rattus norvegicus
tgaattcacagaccaaaagccggag

SEQ ID NO: 605286 - DNA, 25 bp, Rattus norvegicus
tgaattcacagagcaaaagccggag

SEQ ID NO: 605287 - DNA, 25 bp, Rattus norvegicus
tgaattcacccacgttccgagtgat

SEQ ID NO: 605288 - DNA, 25 bp, Rattus norvegicus
tgaattcacccaggttccgagtgat

SEQ ID NO: 605289 - DNA, 25 bp, Rattus norvegicus
tgaattcaccccaatgttggagcac

SEQ ID NO: 605290 - DNA, 25 bp, Rattus norvegicus
tgaattcacccctatgttggagcac

SEQ ID NO: 605291 - DNA, 25 bp, Rattus norvegicus
tgaattcactatacctcaggagcgt

SEQ ID NO: 605292 - DNA, 25 bp, Rattus norvegicus
tgaattcactattcctcaggagcgt

SEQ ID NO: 605293 - DNA, 25 bp, Rattus norvegicus
tgaattcagaagagcctatggctct

SEQ ID NO: 605294 - DNA, 25 bp, Rattus norvegicus
tgaattcagaagatccccagtggct

SEQ ID NO: 605295 - DNA, 25 bp, Rattus norvegicus
tgaattcagaagtgcctatggctct

SEQ ID NO: 605296 - DNA, 25 bp, Rattus norvegicus
tgaattcagaagttccccagtggct

SEQ ID NO: 605297 - DNA, 25 bp, Rattus norvegicus
tgaattcagcccacctcagagtgag

SEQ ID NO: 605298 - DNA, 25 bp, Rattus norvegicus
tgaattcagccctcctcagagtgag

SEQ ID NO: 605299 - DNA, 25 bp, Rattus norvegicus
tgaattcagggccaacattgtctac

SEQ ID NO: 605300 - DNA, 25 bp, Rattus norvegicus
tgaattcagggcgaacattgtctac

SEQ ID NO: 605301 - DNA, 25 bp, Rattus norvegicus
tgaattcagtccctgggatccacgt

SEQ ID NO: 605302 - DNA, 25 bp, Rattus norvegicus
tgaattcagtccgtgggatccacgt

SEQ ID NO: 605303 - DNA, 25 bp, Rattus norvegicus
tgaattcagtgtagctcggactcca

SEQ ID NO: 605304 - DNA, 25 bp, Rattus norvegicus
tgaattcagtgttgctcggactcca

SEQ ID NO: 605305 - DNA, 25 bp, Rattus norvegicus
tgaattcatcgcagtgtgtcttccc

SEQ ID NO: 605306 - DNA, 25 bp, Rattus norvegicus
tgaattcatcgctgtgtgtcttccc

SEQ ID NO: 605307 - DNA, 25 bp, Rattus norvegicus
tgaattcatttgacaccctgtcaca

SEQ ID NO: 605308 - DNA, 25 bp, Rattus norvegicus
tgaattcatttgtcaccctgtcaca

SEQ ID NO: 605309 - DNA, 25 bp, Rattus norvegicus
tgaattccaacgactgcttgtccaa

SEQ ID NO: 605310 - DNA, 25 bp, Rattus norvegicus
tgaattccaacgtctgcttgtccaa

SEQ ID NO: 605311 - DNA, 25 bp, Rattus norvegicus
tgaattccaagaccatccgttctaa

SEQ ID NO: 605312 - DNA, 25 bp, Rattus norvegicus
tgaattccaagagcatccgttctaa

SEQ ID NO: 605313 - DNA, 25 bp, Rattus norvegicus
tgaattccagtgaagccatgtccca

SEQ ID NO: 605314 - DNA, 25 bp, Rattus norvegicus
tgaattccagtgtagccatgtccca

SEQ ID NO: 605315 - DNA, 25 bp, Rattus norvegicus
tgaattcccagaaaccatccagtgt

SEQ ID NO: 605316 - DNA, 25 bp, Rattus norvegicus
tgaattcccagataccatccagtgt

SEQ ID NO: 605317 - DNA, 25 bp, Rattus norvegicus
tgaattcccatgcacgttctgctca

SEQ ID NO: 605318 - DNA, 25 bp, Rattus norvegicus
tgaattcccatggacgttctgctca

SEQ ID NO: 605319 - DNA, 25 bp, Rattus norvegicus
tgaattcccctgaaacttgctagct

SEQ ID NO: 605320 - DNA, 25 bp, Rattus norvegicus
tgaattcccctgtaacttgctagct

SEQ ID NO: 605321 - DNA, 25 bp, Rattus norvegicus
tgaattccctcaagtatgtccgacc

SEQ ID NO: 605322 - DNA, 25 bp, Rattus norvegicus
tgaattccctcatgtatgtccgacc

SEQ ID NO: 605323 - DNA, 25 bp, Rattus norvegicus
tgaattcccttcagtctcattgtaa

SEQ ID NO: 605324 - DNA, 25 bp, Rattus norvegicus
tgaattcccttctgtctcattgtaa

SEQ ID NO: 605325 - DNA, 25 bp, Rattus norvegicus
tgaattccgtatagcccaacctgga

SEQ ID NO: 605326 - DNA, 25 bp, Rattus norvegicus
tgaattccgtattgcccaacctgga

SEQ ID NO: 605327 - DNA, 25 bp, Rattus norvegicus
tgaattcctactcttttctgcttgc

SEQ ID NO: 605328 - DNA, 25 bp, Rattus norvegicus
tgaattcctactgttttctgcttgc

SEQ ID NO: 605329 - DNA, 25 bp, Rattus norvegicus
tgaattcctcctaccggctttactt

SEQ ID NO: 605330 - DNA, 25 bp, Rattus norvegicus
tgaattcctccttccggctttactt

SEQ ID NO: 605331 - DNA, 25 bp, Rattus norvegicus
tgaattcggtccaggctgtgtttca

SEQ ID NO: 605332 - DNA, 25 bp, Rattus norvegicus
tgaattcggtcctggctgtgtttca

SEQ ID NO: 605333 - DNA, 25 bp, Rattus norvegicus
tgaattctaaggagagcagggcctg

SEQ ID NO: 605334 - DNA, 25 bp, Rattus norvegicus
tgaattctaaggtgagcagggcctg

SEQ ID NO: 605335 - DNA, 25 bp, Rattus norvegicus
tgaattctacttaaaggaccttagc

SEQ ID NO: 605336 - DNA, 25 bp, Rattus norvegicus
tgaattctactttaaggaccttagc

SEQ ID NO: 605337 - DNA, 25 bp, Rattus norvegicus
tgaattctagataccaggccagcct

SEQ ID NO: 605338 - DNA, 25 bp, Rattus norvegicus
tgaattctagattccaggccagcct

SEQ ID NO: 605339 - DNA, 25 bp, Rattus norvegicus
tgaattctatcaactctcttgctgc

SEQ ID NO: 605340 - DNA, 25 bp, Rattus norvegicus
tgaattctatcatctctcttgctgc

SEQ ID NO: 605341 - DNA, 25 bp, Rattus norvegicus
tgaattctcttgaacttcccaaagc

SEQ ID NO: 605342 - DNA, 25 bp, Rattus norvegicus
tgaattctcttgtacttcccaaagc

SEQ ID NO: 605343 - DNA, 25 bp, Rattus norvegicus
tgaattctgaacctgtgatccctcg

SEQ ID NO: 605344 - DNA, 25 bp, Rattus norvegicus
tgaattctgaacgtgtgatccctcg

SEQ ID NO: 605345 - DNA, 25 bp, Rattus norvegicus
tgaattctgctcaaccctatggtgc

SEQ ID NO: 605346 - DNA, 25 bp, Rattus norvegicus
tgaattctgctctaccctatggtgc

SEQ ID NO: 605347 - DNA, 25 bp, Rattus norvegicus
tgaattctgttgacccgcactttaa

SEQ ID NO: 605348 - DNA, 25 bp, Rattus norvegicus
tgaattctgttgtcccgcactttaa

SEQ ID NO: 605349 - DNA, 25 bp, Rattus norvegicus
tgaattgaccccagggccttgggca

SEQ ID NO: 605350 - DNA, 25 bp, Rattus norvegicus
tgaattgacccctgggccttgggca

SEQ ID NO: 605351 - DNA, 25 bp, Rattus norvegicus
tgaattgacctccatcctaaacatc

SEQ ID NO: 605352 - DNA, 25 bp, Rattus norvegicus
tgaattgacctcgatcctaaacatc

SEQ ID NO: 605353 - DNA, 25 bp, Rattus norvegicus
tgaattgatgcacttccctctacag

SEQ ID NO: 605354 - DNA, 25 bp, Rattus norvegicus
tgaattgatgcagttccctctacag

SEQ ID NO: 605355 - DNA, 25 bp, Rattus norvegicus
tgaattgcctggaggtgacaaggaa

SEQ ID NO: 605356 - DNA, 25 bp, Rattus norvegicus
tgaattgcctggtggtgacaaggaa

SEQ ID NO: 605357 - DNA, 25 bp, Rattus norvegicus
tgaattgcgaaactctaccctgcca

SEQ ID NO: 605358 - DNA, 25 bp, Rattus norvegicus
tgaattgcgaaagtctaccctgcca

SEQ ID NO: 605359 - DNA, 25 bp, Rattus norvegicus
tgaattgctccccttggtctgtatc

SEQ ID NO: 605360 - DNA, 25 bp, Rattus norvegicus
tgaattgctcccgttggtctgtatc

SEQ ID NO: 605361 - DNA, 25 bp, Rattus norvegicus
tgaattgctttcacgtcccggtgac

SEQ ID NO: 605362 - DNA, 25 bp, Rattus norvegicus
tgaattgctttctcgtcccggtgac

SEQ ID NO: 605363 - DNA, 25 bp, Rattus norvegicus
tgaattggagtaacccccctgcagg

SEQ ID NO: 605364 - DNA, 25 bp, Rattus norvegicus
tgaattggagtatcccccctgcagg

SEQ ID NO: 605365 - DNA, 25 bp, Rattus norvegicus
tgaattggattcagggtacccacgc

SEQ ID NO: 605366 - DNA, 25 bp, Rattus norvegicus
tgaattggattctgggtacccacgc

SEQ ID NO: 605367 - DNA, 25 bp, Rattus norvegicus
tgaattggccaaccacgccgtttcc

SEQ ID NO: 605368 - DNA, 25 bp, Rattus norvegicus
tgaattggccaagcacgccgtttcc

SEQ ID NO: 605369 - DNA, 25 bp, Rattus norvegicus
tgaattgggaataacctgatgatct

SEQ ID NO: 605370 - DNA, 25 bp, Rattus norvegicus
tgaattgggaattacctgatgatct

SEQ ID NO: 605371 - DNA, 25 bp, Rattus norvegicus
tgaattgggactcagcccttcaaat

SEQ ID NO: 605372 - DNA, 25 bp, Rattus norvegicus
tgaattgggactgagcccttcaaat

SEQ ID NO: 605373 - DNA, 25 bp, Rattus norvegicus
tgaattggtcctaccttgcactcta

SEQ ID NO: 605374 - DNA, 25 bp, Rattus norvegicus
tgaattggtccttccttgcactcta

SEQ ID NO: 605375 - DNA, 25 bp, Rattus norvegicus
tgaattggtcttcctgtatgttcta

SEQ ID NO: 605376 - DNA, 25 bp, Rattus norvegicus
tgaattggtcttgctgtatgttcta

SEQ ID NO: 605377 - DNA, 25 bp, Rattus norvegicus
tgaattggtttgctttctgtgaccc

SEQ ID NO: 605378 - DNA, 25 bp, Rattus norvegicus
tgaattggtttggtttctgtgaccc

SEQ ID NO: 605379 - DNA, 25 bp, Rattus norvegicus
tgaattgtaacccagtctccagtgt

SEQ ID NO: 605380 - DNA, 25 bp, Rattus norvegicus
tgaattgtaaccgagtctccagtgt

SEQ ID NO: 605381 - DNA, 25 bp, Rattus norvegicus
tgaattgttattatggtccagtttc

SEQ ID NO: 605382 - DNA, 25 bp, Rattus norvegicus
tgaattgttattttggtccagtttc

SEQ ID NO: 605383 - DNA, 25 bp, Rattus norvegicus
tgaattgttcctaccatgcctgcac

SEQ ID NO: 605384 - DNA, 25 bp, Rattus norvegicus
tgaattgttccttccatgcctgcac

SEQ ID NO: 605385 - DNA, 25 bp, Rattus norvegicus
tgaattgttttgcttggcctcacac

SEQ ID NO: 605386 - DNA, 25 bp, Rattus norvegicus
tgaattgttttggttggcctcacac

SEQ ID NO: 605387 - DNA, 25 bp, Rattus norvegicus
tgaatttattagcaagcctcccctg

SEQ ID NO: 605388 - DNA, 25 bp, Rattus norvegicus
tgaatttattaggaagcctcccctg

SEQ ID NO: 605389 - DNA, 25 bp, Rattus norvegicus
tgaatttattccaattgcgagccaa

SEQ ID NO: 605390 - DNA, 25 bp, Rattus norvegicus
tgaatttattccacgaaccgtgttt

SEQ ID NO: 605391 - DNA, 25 bp, Rattus norvegicus
tgaatttattcctattgcgagccaa

SEQ ID NO: 605392 - DNA, 25 bp, Rattus norvegicus
tgaatttattcctcgaaccgtgttt

SEQ ID NO: 605393 - DNA, 25 bp, Rattus norvegicus
tgaatttcaagcctgtgactcctgt

SEQ ID NO: 605394 - DNA, 25 bp, Rattus norvegicus
tgaatttcaagcgtgtgactcctgt

SEQ ID NO: 605395 - DNA, 25 bp, Rattus norvegicus
tgaatttcagcaactagttggacat

SEQ ID NO: 605396 - DNA, 25 bp, Rattus norvegicus
tgaatttcagcatctagttggacat

SEQ ID NO: 605397 - DNA, 25 bp, Rattus norvegicus
tgaatttcatctcattacataagga

SEQ ID NO: 605398 - DNA, 25 bp, Rattus norvegicus
tgaatttcatctgattacataagga

SEQ ID NO: 605399 - DNA, 25 bp, Rattus norvegicus
tgaatttccataccctggctgttga

SEQ ID NO: 605400 - DNA, 25 bp, Rattus norvegicus
tgaatttccatagcctggctgttga

SEQ ID NO: 605401 - DNA, 25 bp, Rattus norvegicus
tgaatttccgacatgcttcttgcaa

SEQ ID NO: 605402 - DNA, 25 bp, Rattus norvegicus
tgaatttccgacttgcttcttgcaa

SEQ ID NO: 605403 - DNA, 25 bp, Rattus norvegicus
tgaatttctggtactcagcgttcgt

SEQ ID NO: 605404 - DNA, 25 bp, Rattus norvegicus
tgaatttctggttctcagcgttcgt

SEQ ID NO: 605405 - DNA, 25 bp, Rattus norvegicus
tgaatttctgttacctgcccataaa

SEQ ID NO: 605406 - DNA, 25 bp, Rattus norvegicus
tgaatttctgtttcctgcccataaa

SEQ ID NO: 605407 - DNA, 25 bp, Rattus norvegicus
tgaatttgactcctggtcccaccaa

SEQ ID NO: 605408 - DNA, 25 bp, Rattus norvegicus
tgaatttgactcgtggtcccaccaa

SEQ ID NO: 605409 - DNA, 25 bp, Rattus norvegicus
tgaatttgccaaagagccaccacag

SEQ ID NO: 605410 - DNA, 25 bp, Rattus norvegicus
tgaatttgccaatgagccaccacag

SEQ ID NO: 605411 - DNA, 25 bp, Rattus norvegicus
tgaatttgctccctcctattagcta

SEQ ID NO: 605412 - DNA, 25 bp, Rattus norvegicus
tgaatttgctccgtcctattagcta

SEQ ID NO: 605413 - DNA, 25 bp, Rattus norvegicus
tgaatttggaccacaggctttcttc

SEQ ID NO: 605414 - DNA, 25 bp, Rattus norvegicus
tgaatttggacctcaggctttcttc

SEQ ID NO: 605415 - DNA, 25 bp, Rattus norvegicus
tgaatttggcttcgactgaacccca

SEQ ID NO: 605416 - DNA, 25 bp, Rattus norvegicus
tgaatttggcttggactgaacccca

SEQ ID NO: 605417 - DNA, 25 bp, Rattus norvegicus
tgaatttgggccacctaaaaagtct

SEQ ID NO: 605418 - DNA, 25 bp, Rattus norvegicus
tgaatttgggcctcctaaaaagtct

SEQ ID NO: 605419 - DNA, 25 bp, Rattus norvegicus
tgaatttgtattaccttgggttagt

SEQ ID NO: 605420 - DNA, 25 bp, Rattus norvegicus
tgaatttgtatttccttgggttagt

SEQ ID NO: 605421 - DNA, 25 bp, Rattus norvegicus
tgaatttgtctgcaggtgtaatcct

SEQ ID NO: 605422 - DNA, 25 bp, Rattus norvegicus
tgaatttgtctggaggtgtaatcct

SEQ ID NO: 605423 - DNA, 25 bp, Rattus norvegicus
tgaatttgtgatccttactgctaat

SEQ ID NO: 605424 - DNA, 25 bp, Rattus norvegicus
tgaatttgtgatgcttactgctaat

SEQ ID NO: 605425 - DNA, 25 bp, Rattus norvegicus
tgaatttgttttaacctgtcctctg

SEQ ID NO: 605426 - DNA, 25 bp, Rattus norvegicus
tgaatttgtttttacctgtcctctg

SEQ ID NO: 605427 - DNA, 25 bp, Rattus norvegicus
tgaattttaaccacctacttttgct

SEQ ID NO: 605428 - DNA, 25 bp, Rattus norvegicus
tgaattttaacctcctacttttgct

SEQ ID NO: 605429 - DNA, 25 bp, Rattus norvegicus
tgaattttaccccttccagtctgca

SEQ ID NO: 605430 - DNA, 25 bp, Rattus norvegicus
tgaattttacccgttccagtctgca

SEQ ID NO: 605431 - DNA, 25 bp, Rattus norvegicus
tgaattttatcaaactcctccacct

SEQ ID NO: 605432 - DNA, 25 bp, Rattus norvegicus
tgaattttatcatactcctccacct

SEQ ID NO: 605433 - DNA, 25 bp, Rattus norvegicus
tgaattttcaagctcctcattggat

SEQ ID NO: 605434 - DNA, 25 bp, Rattus norvegicus
tgaattttcaaggtcctcattggat

SEQ ID NO: 605435 - DNA, 25 bp, Rattus norvegicus
tgaattttccaaagccaacccactt

SEQ ID NO: 605436 - DNA, 25 bp, Rattus norvegicus
tgaattttccaatgccaacccactt

SEQ ID NO: 605437 - DNA, 25 bp, Rattus norvegicus
tgaattttccttctccacaaagcat

SEQ ID NO: 605438 - DNA, 25 bp, Rattus norvegicus
tgaattttccttgtccacaaagcat

SEQ ID NO: 605439 - DNA, 25 bp, Rattus norvegicus
tgaattttcgtaacctgtcttccga

SEQ ID NO: 605440 - DNA, 25 bp, Rattus norvegicus
tgaattttcgtatcctgtcttccga

SEQ ID NO: 605441 - DNA, 25 bp, Rattus norvegicus
tgaattttgcctaccagttgtttcc

SEQ ID NO: 605442 - DNA, 25 bp, Rattus norvegicus
tgaattttgccttccagttgtttcc

SEQ ID NO: 605443 - DNA, 25 bp, Rattus norvegicus
tgaattttggccacaggcccatcag

SEQ ID NO: 605444 - DNA, 25 bp, Rattus norvegicus
tgaattttggcctcaggcccatcag

SEQ ID NO: 605445 - DNA, 25 bp, Rattus norvegicus
tgaattttgtgacctgttctgaaac

SEQ ID NO: 605446 - DNA, 25 bp, Rattus norvegicus
tgaattttgtgagctgttctgaaac

SEQ ID NO: 605447 - DNA, 25 bp, Rattus norvegicus
tgaatttttgcaccctcagtctggt

SEQ ID NO: 605448 - DNA, 25 bp, Rattus norvegicus
tgaatttttgcagcctcagtctggt

SEQ ID NO: 605449 - DNA, 25 bp, Rattus norvegicus
tgacaaaaaattatagccccagtct

SEQ ID NO: 605450 - DNA, 25 bp, Rattus norvegicus
tgacaaaaaattttagccccagtct

SEQ ID NO: 605451 - DNA, 25 bp, Rattus norvegicus
tgacaaaactgtctaccttttactt

SEQ ID NO: 605452 - DNA, 25 bp, Rattus norvegicus
tgacaaaactgtgtaccttttactt

SEQ ID NO: 605453 - DNA, 25 bp, Rattus norvegicus
tgacaaaagccgagtgggtccctcc

SEQ ID NO: 605454 - DNA, 25 bp, Rattus norvegicus
tgacaaaagccgtgtgggtccctcc

SEQ ID NO: 605455 - DNA, 25 bp, Rattus norvegicus
tgacaaaatgccacctgctgattgg

SEQ ID NO: 605456 - DNA, 25 bp, Rattus norvegicus
tgacaaaatgcctcctgctgattgg

SEQ ID NO: 605457 - DNA, 25 bp, Rattus norvegicus
tgacaaaatgctctgactcctagtg

SEQ ID NO: 605458 - DNA, 25 bp, Rattus norvegicus
tgacaaaatgctgtgactcctagtg

SEQ ID NO: 605459 - DNA, 25 bp, Rattus norvegicus
tgacaaacagagctctgtcccacag

SEQ ID NO: 605460 - DNA, 25 bp, Rattus norvegicus
tgacaaacagaggtctgtcccacag

SEQ ID NO: 605461 - DNA, 25 bp, Rattus norvegicus
tgacaaacagtgaccggacctcctc

SEQ ID NO: 605462 - DNA, 25 bp, Rattus norvegicus
tgacaaacagtgtccggacctcctc

SEQ ID NO: 605463 - DNA, 25 bp, Rattus norvegicus
tgacaaacccgaaatggctgagatc

SEQ ID NO: 605464 - DNA, 25 bp, Rattus norvegicus
tgacaaacccgatatggctgagatc

SEQ ID NO: 605465 - DNA, 25 bp, Rattus norvegicus
tgacaaacccttcgatggctttcat

SEQ ID NO: 605466 - DNA, 25 bp, Rattus norvegicus
tgacaaacccttggatggctttcat

SEQ ID NO: 605467 - DNA, 25 bp, Rattus norvegicus
tgacaaaccttgacctcatctcggc

SEQ ID NO: 605468 - DNA, 25 bp, Rattus norvegicus
tgacaaaccttgtcctcatctcggc

SEQ ID NO: 605469 - DNA, 25 bp, Rattus norvegicus
tgacaaacctttcagcactgtggat

SEQ ID NO: 605470 - DNA, 25 bp, Rattus norvegicus
tgacaaacctttgagcactgtggat

SEQ ID NO: 605471 - DNA, 25 bp, Rattus norvegicus
tgacaaagtaatcgaccttccacct

SEQ ID NO: 605472 - DNA, 25 bp, Rattus norvegicus
tgacaaagtaatggaccttccacct

SEQ ID NO: 605473 - DNA, 25 bp, Rattus norvegicus
tgacaaatggtcactcctgagagga

SEQ ID NO: 605474 - DNA, 25 bp, Rattus norvegicus
tgacaaatggtctctcctgagagga

SEQ ID NO: 605475 - DNA, 25 bp, Rattus norvegicus
tgacaaatgtcccttcttcagacgg

SEQ ID NO: 605476 - DNA, 25 bp, Rattus norvegicus
tgacaaatgtccgttcttcagacgg

SEQ ID NO: 605477 - DNA, 25 bp, Rattus norvegicus
tgacaaatgtgccaaagatcatcaa

SEQ ID NO: 605478 - DNA, 25 bp, Rattus norvegicus
tgacaaatgtgcgaaagatcatcaa

SEQ ID NO: 605479 - DNA, 25 bp, Rattus norvegicus
tgacaacaatgtcctcatgggcctt

SEQ ID NO: 605480 - DNA, 25 bp, Rattus norvegicus
tgacaacaatgtgctcatgggcctt

SEQ ID NO: 605481 - DNA, 25 bp, Rattus norvegicus
tgacaacacactataccttatacct

SEQ ID NO: 605482 - DNA, 25 bp, Rattus norvegicus
tgacaacacactttaccttatacct

SEQ ID NO: 605483 - DNA, 25 bp, Rattus norvegicus
tgacaacacagtaggccgcttcttg

SEQ ID NO: 605484 - DNA, 25 bp, Rattus norvegicus
tgacaacacagttggccgcttcttg

SEQ ID NO: 605485 - DNA, 25 bp, Rattus norvegicus
tgacaacactcaaaagccagccata

SEQ ID NO: 605486 - DNA, 25 bp, Rattus norvegicus
tgacaacactcataagccagccata

SEQ ID NO: 605487 - DNA, 25 bp, Rattus norvegicus
tgacaacactgcacatggaaagaga

SEQ ID NO: 605488 - DNA, 25 bp, Rattus norvegicus
tgacaacactgctcatggaaagaga

SEQ ID NO: 605489 - DNA, 25 bp, Rattus norvegicus
tgacaacaggacctacctccctgga

SEQ ID NO: 605490 - DNA, 25 bp, Rattus norvegicus
tgacaacaggacgtacctccctgga

SEQ ID NO: 605491 - DNA, 25 bp, Rattus norvegicus
tgacaacatcccaactgattccaag

SEQ ID NO: 605492 - DNA, 25 bp, Rattus norvegicus
tgacaacatccctactgattccaag

SEQ ID NO: 605493 - DNA, 25 bp, Rattus norvegicus
tgacaacatctaactgcatgtccag

SEQ ID NO: 605494 - DNA, 25 bp, Rattus norvegicus
tgacaacatctatctgcatgtccag

SEQ ID NO: 605495 - DNA, 25 bp, Rattus norvegicus
tgacaacatgagcaacacttaagag

SEQ ID NO: 605496 - DNA, 25 bp, Rattus norvegicus
tgacaacatgaggaacacttaagag

SEQ ID NO: 605497 - DNA, 25 bp, Rattus norvegicus
tgacaacattagcaccacctccgag

SEQ ID NO: 605498 - DNA, 25 bp, Rattus norvegicus
tgacaacattaggaccacctccgag

SEQ ID NO: 605499 - DNA, 25 bp, Rattus norvegicus
tgacaacattgacatcatccaaccc

SEQ ID NO: 605500 - DNA, 25 bp, Rattus norvegicus
tgacaacattgagatcatccaaccc

SEQ ID NO: 605501 - DNA, 25 bp, Rattus norvegicus
tgacaaccacaaagaggcctctcta

SEQ ID NO: 605502 - DNA, 25 bp, Rattus norvegicus
tgacaaccacaatgaggcctctcta

SEQ ID NO: 605503 - DNA, 25 bp, Rattus norvegicus
tgacaaccagacacgggacaggctg

SEQ ID NO: 605504 - DNA, 25 bp, Rattus norvegicus
tgacaaccagactcgggacaggctg

SEQ ID NO: 605505 - DNA, 25 bp, Rattus norvegicus
tgacaacccacaatacctgaatacc

SEQ ID NO: 605506 - DNA, 25 bp, Rattus norvegicus
tgacaacccacattacctgaatacc

SEQ ID NO: 605507 - DNA, 25 bp, Rattus norvegicus
tgacaacccattcttctgactcaga

SEQ ID NO: 605508 - DNA, 25 bp, Rattus norvegicus
tgacaacccattgttctgactcaga

SEQ ID NO: 605509 - DNA, 25 bp, Rattus norvegicus
tgacaacccccaatcagtgtttgag

SEQ ID NO: 605510 - DNA, 25 bp, Rattus norvegicus
tgacaacccccattcagtgtttgag

SEQ ID NO: 605511 - DNA, 25 bp, Rattus norvegicus
tgacaaccccgaattcctatttaat

SEQ ID NO: 605512 - DNA, 25 bp, Rattus norvegicus
tgacaaccccgatttcctatttaat

SEQ ID NO: 605513 - DNA, 25 bp, Rattus norvegicus
tgacaacccgatcaaccagcgtgcg

SEQ ID NO: 605514 - DNA, 25 bp, Rattus norvegicus
tgacaacccgatgaaccagcgtgcg

SEQ ID NO: 605515 - DNA, 25 bp, Rattus norvegicus
tgacaaccctagctgggtccgtgga

SEQ ID NO: 605516 - DNA, 25 bp, Rattus norvegicus
tgacaaccctaggtgggtccgtgga

SEQ ID NO: 605517 - DNA, 25 bp, Rattus norvegicus
tgacaaccctctcaaggtttcctgg

SEQ ID NO: 605518 - DNA, 25 bp, Rattus norvegicus
tgacaaccctctgaaggtttcctgg

SEQ ID NO: 605519 - DNA, 25 bp, Rattus norvegicus
tgacaaccgggactttgccatcctg

SEQ ID NO: 605520 - DNA, 25 bp, Rattus norvegicus
tgacaaccgggagtttgccatcctg

SEQ ID NO: 605521 - DNA, 25 bp, Rattus norvegicus
tgacaacctggaaacattcaactag

SEQ ID NO: 605522 - DNA, 25 bp, Rattus norvegicus
tgacaacctggatacattcaactag

SEQ ID NO: 605523 - DNA, 25 bp, Rattus norvegicus
tgacaaccttttcttcttctactcc

SEQ ID NO: 605524 - DNA, 25 bp, Rattus norvegicus
tgacaaccttttgttcttctactcc

SEQ ID NO: 605525 - DNA, 25 bp, Rattus norvegicus
tgacaacgaactccctttgtaaaag

SEQ ID NO: 605526 - DNA, 25 bp, Rattus norvegicus
tgacaacgaactgcctttgtaaaag

SEQ ID NO: 605527 - DNA, 25 bp, Rattus norvegicus
tgacaacgctgaagattggctcccg

SEQ ID NO: 605528 - DNA, 25 bp, Rattus norvegicus
tgacaacgctgatgattggctcccg

SEQ ID NO: 605529 - DNA, 25 bp, Rattus norvegicus
tgacaactctttcagcttcttcgtg

SEQ ID NO: 605530 - DNA, 25 bp, Rattus norvegicus
tgacaactctttgagcttcttcgtg

SEQ ID NO: 605531 - DNA, 25 bp, Rattus norvegicus
tgacaactgcacagtggcctcgaga

SEQ ID NO: 605532 - DNA, 25 bp, Rattus norvegicus
tgacaactgcactgtggcctcgaga

SEQ ID NO: 605533 - DNA, 25 bp, Rattus norvegicus
tgacaactggttacccattcggagt

SEQ ID NO: 605534 - DNA, 25 bp, Rattus norvegicus
tgacaactggtttcccattcggagt

SEQ ID NO: 605535 - DNA, 25 bp, Rattus norvegicus
tgacaactgtacaggccccttatga

SEQ ID NO: 605536 - DNA, 25 bp, Rattus norvegicus
tgacaactgtactggccccttatga

SEQ ID NO: 605537 - DNA, 25 bp, Rattus norvegicus
tgacaacttgcaagatgcccgtgcc

SEQ ID NO: 605538 - DNA, 25 bp, Rattus norvegicus
tgacaacttgcatgatgcccgtgcc

SEQ ID NO: 605539 - DNA, 25 bp, Rattus norvegicus
tgacaagaagtacaaccccacctgg

SEQ ID NO: 605540 - DNA, 25 bp, Rattus norvegicus
tgacaagaagtagaaccccacctgg

SEQ ID NO: 605541 - DNA, 25 bp, Rattus norvegicus
tgacaagacataccccagtgaacgt

SEQ ID NO: 605542 - DNA, 25 bp, Rattus norvegicus
tgacaagacatagcccagtgaacgt

SEQ ID NO: 605543 - DNA, 25 bp, Rattus norvegicus
tgacaagacttgaccgtagcctcct

SEQ ID NO: 605544 - DNA, 25 bp, Rattus norvegicus
tgacaagacttgtccgtagcctcct

SEQ ID NO: 605545 - DNA, 25 bp, Rattus norvegicus
tgacaagactttcctctgatctggt

SEQ ID NO: 605546 - DNA, 25 bp, Rattus norvegicus
tgacaagactttgctctgatctggt

SEQ ID NO: 605547 - DNA, 25 bp, Rattus norvegicus
tgacaagagcccaggagaccgcctg

SEQ ID NO: 605548 - DNA, 25 bp, Rattus norvegicus
tgacaagagccctggagaccgcctg

SEQ ID NO: 605549 - DNA, 25 bp, Rattus norvegicus
tgacaagatcttcagctcagaggaa

SEQ ID NO: 605550 - DNA, 25 bp, Rattus norvegicus
tgacaagatcttgagctcagaggaa

SEQ ID NO: 605551 - DNA, 25 bp, Rattus norvegicus
tgacaagattcaccgggccagagca

SEQ ID NO: 605552 - DNA, 25 bp, Rattus norvegicus
tgacaagattcagcgggccagagca

SEQ ID NO: 605553 - DNA, 25 bp, Rattus norvegicus
tgacaagcacaacgcctctgtggaa

SEQ ID NO: 605554 - DNA, 25 bp, Rattus norvegicus
tgacaagcacaaggcctctgtggaa

SEQ ID NO: 605555 - DNA, 25 bp, Rattus norvegicus
tgacaagcacacacataagccaatg

SEQ ID NO: 605556 - DNA, 25 bp, Rattus norvegicus
tgacaagcacactcataagccaatg

SEQ ID NO: 605557 - DNA, 25 bp, Rattus norvegicus
tgacaagcagctccggttttcacct

SEQ ID NO: 605558 - DNA, 25 bp, Rattus norvegicus
tgacaagcagctgcggttttcacct

SEQ ID NO: 605559 - DNA, 25 bp, Rattus norvegicus
tgacaagccgctctagaacctgcca

SEQ ID NO: 605560 - DNA, 25 bp, Rattus norvegicus
tgacaagccgctgtagaacctgcca

SEQ ID NO: 605561 - DNA, 25 bp, Rattus norvegicus
tgacaagccttacagccctttagag

SEQ ID NO: 605562 - DNA, 25 bp, Rattus norvegicus
tgacaagccttagagccctttagag

SEQ ID NO: 605563 - DNA, 25 bp, Rattus norvegicus
tgacaagcgcatcaacagcctcaag

SEQ ID NO: 605564 - DNA, 25 bp, Rattus norvegicus
tgacaagcgcatgaacagcctcaag

SEQ ID NO: 605565 - DNA, 25 bp, Rattus norvegicus
tgacaagctgacagtctcctcagaa

SEQ ID NO: 605566 - DNA, 25 bp, Rattus norvegicus
tgacaagctgactgtctcctcagaa

SEQ ID NO: 605567 - DNA, 25 bp, Rattus norvegicus
tgacaagctgtcacactctccagga

SEQ ID NO: 605568 - DNA, 25 bp, Rattus norvegicus
tgacaagctgtcacttcactcctaa

SEQ ID NO: 605569 - DNA, 25 bp, Rattus norvegicus
tgacaagctgtctcactctccagga

SEQ ID NO: 605570 - DNA, 25 bp, Rattus norvegicus
tgacaagctgtctcttcactcctaa

SEQ ID NO: 605571 - DNA, 25 bp, Rattus norvegicus
tgacaagctttgaacccctctggtg

SEQ ID NO: 605572 - DNA, 25 bp, Rattus norvegicus
tgacaagctttgtacccctctggtg

SEQ ID NO: 605573 - DNA, 25 bp, Rattus norvegicus
tgacaaggagtcacagcctgccgaa

SEQ ID NO: 605574 - DNA, 25 bp, Rattus norvegicus
tgacaaggagtctcagcctgccgaa

SEQ ID NO: 605575 - DNA, 25 bp, Rattus norvegicus
tgacaagggttaagcaggaccctcc

SEQ ID NO: 605576 - DNA, 25 bp, Rattus norvegicus
tgacaagggttatgcaggaccctcc

SEQ ID NO: 605577 - DNA, 25 bp, Rattus norvegicus
tgacaaggtgttcttcacagctcag

SEQ ID NO: 605578 - DNA, 25 bp, Rattus norvegicus
tgacaaggtgttgttcacagctcag

SEQ ID NO: 605579 - DNA, 25 bp, Rattus norvegicus
tgacaaggttacatgtagcacaggg

SEQ ID NO: 605580 - DNA, 25 bp, Rattus norvegicus
tgacaaggttacttgtagcacaggg

SEQ ID NO: 605581 - DNA, 25 bp, Rattus norvegicus
tgacaaggtttgagtgcccattgct

SEQ ID NO: 605582 - DNA, 25 bp, Rattus norvegicus
tgacaaggtttgtgtgcccattgct

SEQ ID NO: 605583 - DNA, 25 bp, Rattus norvegicus
tgacaagtaccaacgctgccaagat

SEQ ID NO: 605584 - DNA, 25 bp, Rattus norvegicus
tgacaagtaccatcgctgccaagat

SEQ ID NO: 605585 - DNA, 25 bp, Rattus norvegicus
tgacaagtccagctgagctgggaaa

SEQ ID NO: 605586 - DNA, 25 bp, Rattus norvegicus
tgacaagtccaggtgagctgggaaa

SEQ ID NO: 605587 - DNA, 25 bp, Rattus norvegicus
tgacaagtccccatcgttgaagtga

SEQ ID NO: 605588 - DNA, 25 bp, Rattus norvegicus
tgacaagtccccttcgttgaagtga

SEQ ID NO: 605589 - DNA, 25 bp, Rattus norvegicus
tgacaagttatcctccgcagatgtt

SEQ ID NO: 605590 - DNA, 25 bp, Rattus norvegicus
tgacaagttatcgtccgcagatgtt

SEQ ID NO: 605591 - DNA, 25 bp, Rattus norvegicus
tgacaagttcacatggagcagcctg

SEQ ID NO: 605592 - DNA, 25 bp, Rattus norvegicus
tgacaagttcacttggagcagcctg

SEQ ID NO: 605593 - DNA, 25 bp, Rattus norvegicus
tgacaagttggtaccctttagctaa

SEQ ID NO: 605594 - DNA, 25 bp, Rattus norvegicus
tgacaagttggttccctttagctaa

SEQ ID NO: 605595 - DNA, 25 bp, Rattus norvegicus
tgacaagtttctcagggttctgcct

SEQ ID NO: 605596 - DNA, 25 bp, Rattus norvegicus
tgacaagtttctcttactgcctttc

SEQ ID NO: 605597 - DNA, 25 bp, Rattus norvegicus
tgacaagtttctgagggttctgcct

SEQ ID NO: 605598 - DNA, 25 bp, Rattus norvegicus
tgacaagtttctgttactgcctttc

SEQ ID NO: 605599 - DNA, 25 bp, Rattus norvegicus
tgacaagtttttaagtcccaaatag

SEQ ID NO: 605600 - DNA, 25 bp, Rattus norvegicus
tgacaagtttttcacatcccacaac

SEQ ID NO: 605601 - DNA, 25 bp, Rattus norvegicus
tgacaagtttttgacatcccacaac

SEQ ID NO: 605602 - DNA, 25 bp, Rattus norvegicus
tgacaagttttttagtcccaaatag

SEQ ID NO: 605603 - DNA, 25 bp, Rattus norvegicus
tgacaatacactacctcgtgaggcg

SEQ ID NO: 605604 - DNA, 25 bp, Rattus norvegicus
tgacaatacacttcctcgtgaggcg

SEQ ID NO: 605605 - DNA, 25 bp, Rattus norvegicus
tgacaataccatcggatagctgatt

SEQ ID NO: 605606 - DNA, 25 bp, Rattus norvegicus
tgacaataccatgggatagctgatt

SEQ ID NO: 605607 - DNA, 25 bp, Rattus norvegicus
tgacaatcccacatcagtcctatct

SEQ ID NO: 605608 - DNA, 25 bp, Rattus norvegicus
tgacaatcccacttcagtcctatct

SEQ ID NO: 605609 - DNA, 25 bp, Rattus norvegicus
tgacaatgaagccacctctgccttg

SEQ ID NO: 605610 - DNA, 25 bp, Rattus norvegicus
tgacaatgaagcgacctctgccttg

SEQ ID NO: 605611 - DNA, 25 bp, Rattus norvegicus
tgacaatgagagatcccacggcggg

SEQ ID NO: 605612 - DNA, 25 bp, Rattus norvegicus
tgacaatgagagttcccacggcggg

SEQ ID NO: 605613 - DNA, 25 bp, Rattus norvegicus
tgacaatgcatcatcctacagacag

SEQ ID NO: 605614 - DNA, 25 bp, Rattus norvegicus
tgacaatgcatcttcctacagacag

SEQ ID NO: 605615 - DNA, 25 bp, Rattus norvegicus
tgacaatgcttcctacctcaaggag

SEQ ID NO: 605616 - DNA, 25 bp, Rattus norvegicus
tgacaatgcttcgtacctcaaggag

SEQ ID NO: 605617 - DNA, 25 bp, Rattus norvegicus
tgacaatgtgagctcttctgtgtgt

SEQ ID NO: 605618 - DNA, 25 bp, Rattus norvegicus
tgacaatgtgaggtcttctgtgtgt

SEQ ID NO: 605619 - DNA, 25 bp, Rattus norvegicus
tgacaattctctagctcatccaaat

SEQ ID NO: 605620 - DNA, 25 bp, Rattus norvegicus
tgacaattctcttgctcatccaaat

SEQ ID NO: 605621 - DNA, 25 bp, Rattus norvegicus
tgacaattgcagcactgtctgtccg

SEQ ID NO: 605622 - DNA, 25 bp, Rattus norvegicus
tgacaattgcaggactgtctgtccg

SEQ ID NO: 605623 - DNA, 25 bp, Rattus norvegicus
tgacaattttgtccttctctctgac

SEQ ID NO: 605624 - DNA, 25 bp, Rattus norvegicus
tgacaattttgtgcttctctctgac

SEQ ID NO: 605625 - DNA, 25 bp, Rattus norvegicus
tgacacaaacaacacctctgacaat

SEQ ID NO: 605626 - DNA, 25 bp, Rattus norvegicus
tgacacaaacaagacctctgacaat

SEQ ID NO: 605627 - DNA, 25 bp, Rattus norvegicus
tgacacaacgttaagcaatggccat

SEQ ID NO: 605628 - DNA, 25 bp, Rattus norvegicus
tgacacaacgtttagcaatggccat

SEQ ID NO: 605629 - DNA, 25 bp, Rattus norvegicus
tgacacaagctgactttacaccagt

SEQ ID NO: 605630 - DNA, 25 bp, Rattus norvegicus
tgacacaagctgtctttacaccagt

SEQ ID NO: 605631 - DNA, 25 bp, Rattus norvegicus
tgacacaagtcaccggccgtgcaaa

SEQ ID NO: 605632 - DNA, 25 bp, Rattus norvegicus
tgacacaagtcagcggccgtgcaaa

SEQ ID NO: 605633 - DNA, 25 bp, Rattus norvegicus
tgacacaatcgtaaggctgttcctg

SEQ ID NO: 605634 - DNA, 25 bp, Rattus norvegicus
tgacacaatcgttaggctgttcctg

SEQ ID NO: 605635 - DNA, 25 bp, Rattus norvegicus
tgacacaatgccaaaccactctgaa

SEQ ID NO: 605636 - DNA, 25 bp, Rattus norvegicus
tgacacaatgccctcaagcctggtc

SEQ ID NO: 605637 - DNA, 25 bp, Rattus norvegicus
tgacacaatgccgtcaagcctggtc

SEQ ID NO: 605638 - DNA, 25 bp, Rattus norvegicus
tgacacaatgcctaaccactctgaa

SEQ ID NO: 605639 - DNA, 25 bp, Rattus norvegicus
tgacacacacacagctagtactgga

SEQ ID NO: 605640 - DNA, 25 bp, Rattus norvegicus
tgacacacacactgctagtactgga

SEQ ID NO: 605641 - DNA, 25 bp, Rattus norvegicus
tgacacacccacaactgctaggatg

SEQ ID NO: 605642 - DNA, 25 bp, Rattus norvegicus
tgacacacccactactgctaggatg

SEQ ID NO: 605643 - DNA, 25 bp, Rattus norvegicus
tgacacaccggcctgagtgctcatg

SEQ ID NO: 605644 - DNA, 25 bp, Rattus norvegicus
tgacacaccggcgtgagtgctcatg

SEQ ID NO: 605645 - DNA, 25 bp, Rattus norvegicus
tgacacacctttcagctttcccatt

SEQ ID NO: 605646 - DNA, 25 bp, Rattus norvegicus
tgacacacctttgagctttcccatt

SEQ ID NO: 605647 - DNA, 25 bp, Rattus norvegicus
tgacacacgtctctgtggactccat

SEQ ID NO: 605648 - DNA, 25 bp, Rattus norvegicus
tgacacacgtctgtgtggactccat

SEQ ID NO: 605649 - DNA, 25 bp, Rattus norvegicus
tgacacacgtgtaaaacctgcaagt

SEQ ID NO: 605650 - DNA, 25 bp, Rattus norvegicus
tgacacacgtgttaaacctgcaagt

SEQ ID NO: 605651 - DNA, 25 bp, Rattus norvegicus
tgacacactgttcctatccttgcct

SEQ ID NO: 605652 - DNA, 25 bp, Rattus norvegicus
tgacacactgttgctatccttgcct

SEQ ID NO: 605653 - DNA, 25 bp, Rattus norvegicus
tgacacactttcagcttcttcttga

SEQ ID NO: 605654 - DNA, 25 bp, Rattus norvegicus
tgacacactttcctcttatacagat

SEQ ID NO: 605655 - DNA, 25 bp, Rattus norvegicus
tgacacactttcgtcttatacagat

SEQ ID NO: 605656 - DNA, 25 bp, Rattus norvegicus
tgacacactttctgcttcttcttga

SEQ ID NO: 605657 - DNA, 25 bp, Rattus norvegicus
tgacacagacctagaagagcaggga

SEQ ID NO: 605658 - DNA, 25 bp, Rattus norvegicus
tgacacagaccttgaagagcaggga

SEQ ID NO: 605659 - DNA, 25 bp, Rattus norvegicus
tgacacagacgcacatggtccactt

SEQ ID NO: 605660 - DNA, 25 bp, Rattus norvegicus
tgacacagacgctcatggtccactt

SEQ ID NO: 605661 - DNA, 25 bp, Rattus norvegicus
tgacacagagaccaccgaggtgcat

SEQ ID NO: 605662 - DNA, 25 bp, Rattus norvegicus
tgacacagagacgaccgaggtgcat

SEQ ID NO: 605663 - DNA, 25 bp, Rattus norvegicus
tgacacagcagtatctctttgaccg

SEQ ID NO: 605664 - DNA, 25 bp, Rattus norvegicus
tgacacagcagtttctctttgaccg

SEQ ID NO: 605665 - DNA, 25 bp, Rattus norvegicus
tgacacagccaacttccaaagttct

SEQ ID NO: 605666 - DNA, 25 bp, Rattus norvegicus
tgacacagccaagttccaaagttct

SEQ ID NO: 605667 - DNA, 25 bp, Rattus norvegicus
tgacacagcgagccctgagttcagt

SEQ ID NO: 605668 - DNA, 25 bp, Rattus norvegicus
tgacacagcgaggcctgagttcagt

SEQ ID NO: 605669 - DNA, 25 bp, Rattus norvegicus
tgacacagcggcatcaccagagcat

SEQ ID NO: 605670 - DNA, 25 bp, Rattus norvegicus
tgacacagcggcttcaccagagcat

SEQ ID NO: 605671 - DNA, 25 bp, Rattus norvegicus
tgacacagctgcctctgcaaggagt

SEQ ID NO: 605672 - DNA, 25 bp, Rattus norvegicus
tgacacagctgcgtctgcaaggagt

SEQ ID NO: 605673 - DNA, 25 bp, Rattus norvegicus
tgacacaggaaaatgcaactcggca

SEQ ID NO: 605674 - DNA, 25 bp, Rattus norvegicus
tgacacaggaaattgcaactcggca

SEQ ID NO: 605675 - DNA, 25 bp, Rattus norvegicus
tgacacaggagcatgtaccctcttc

SEQ ID NO: 605676 - DNA, 25 bp, Rattus norvegicus
tgacacaggagcttgtaccctcttc

SEQ ID NO: 605677 - DNA, 25 bp, Rattus norvegicus
tgacacaggatcaccccagagtcct

SEQ ID NO: 605678 - DNA, 25 bp, Rattus norvegicus
tgacacaggatctccccagagtcct

SEQ ID NO: 605679 - DNA, 25 bp, Rattus norvegicus
tgacacagggctcctttccccaaag

SEQ ID NO: 605680 - DNA, 25 bp, Rattus norvegicus
tgacacagggctgctttccccaaag

SEQ ID NO: 605681 - DNA, 25 bp, Rattus norvegicus
tgacacaggtgaaaccttcaccatg

SEQ ID NO: 605682 - DNA, 25 bp, Rattus norvegicus
tgacacaggtgataccttcaccatg

SEQ ID NO: 605683 - DNA, 25 bp, Rattus norvegicus
tgacacagtagcagtctgctgcact

SEQ ID NO: 605684 - DNA, 25 bp, Rattus norvegicus
tgacacagtagccagaggtccctgt

SEQ ID NO: 605685 - DNA, 25 bp, Rattus norvegicus
tgacacagtagcgagaggtccctgt

SEQ ID NO: 605686 - DNA, 25 bp, Rattus norvegicus
tgacacagtagctgtctgctgcact

SEQ ID NO: 605687 - DNA, 25 bp, Rattus norvegicus
tgacacagtcaacccagcatggagt

SEQ ID NO: 605688 - DNA, 25 bp, Rattus norvegicus
tgacacagtcaagccagcatggagt

SEQ ID NO: 605689 - DNA, 25 bp, Rattus norvegicus
tgacacagtgaccttgctaacctaa

SEQ ID NO: 605690 - DNA, 25 bp, Rattus norvegicus
tgacacagtgacgttgctaacctaa

SEQ ID NO: 605691 - DNA, 25 bp, Rattus norvegicus
tgacacagtgatagccccttcaggg

SEQ ID NO: 605692 - DNA, 25 bp, Rattus norvegicus
tgacacagtgattgccccttcaggg

SEQ ID NO: 605693 - DNA, 25 bp, Rattus norvegicus
tgacacatagaaacctacgaagaag

SEQ ID NO: 605694 - DNA, 25 bp, Rattus norvegicus
tgacacatagaatcctacgaagaag

SEQ ID NO: 605695 - DNA, 25 bp, Rattus norvegicus
tgacacatcgctatctgactctgac

SEQ ID NO: 605696 - DNA, 25 bp, Rattus norvegicus
tgacacatcgctttctgactctgac

SEQ ID NO: 605697 - DNA, 25 bp, Rattus norvegicus
tgacacatctagctcagtctatcct

SEQ ID NO: 605698 - DNA, 25 bp, Rattus norvegicus
tgacacatctaggtcagtctatcct

SEQ ID NO: 605699 - DNA, 25 bp, Rattus norvegicus
tgacacatctatcagggaccctgtt

SEQ ID NO: 605700 - DNA, 25 bp, Rattus norvegicus
tgacacatctatgagggaccctgtt

SEQ ID NO: 605701 - DNA, 25 bp, Rattus norvegicus
tgacacatctgtcccctgagagtaa

SEQ ID NO: 605702 - DNA, 25 bp, Rattus norvegicus
tgacacatctgtgccctgagagtaa

SEQ ID NO: 605703 - DNA, 25 bp, Rattus norvegicus
tgacacatgagtacttcttacccgg

SEQ ID NO: 605704 - DNA, 25 bp, Rattus norvegicus
tgacacatgagttcttcttacccgg

SEQ ID NO: 605705 - DNA, 25 bp, Rattus norvegicus
tgacacatgcacagggacttctctc

SEQ ID NO: 605706 - DNA, 25 bp, Rattus norvegicus
tgacacatgcactgggacttctctc

SEQ ID NO: 605707 - DNA, 25 bp, Rattus norvegicus
tgacacattaaaatgcgaggcatgc

SEQ ID NO: 605708 - DNA, 25 bp, Rattus norvegicus
tgacacattaaattgcgaggcatgc

SEQ ID NO: 605709 - DNA, 25 bp, Rattus norvegicus
tgacacattaccactctgacttaag

SEQ ID NO: 605710 - DNA, 25 bp, Rattus norvegicus
tgacacattacctctctgacttaag

SEQ ID NO: 605711 - DNA, 25 bp, Rattus norvegicus
tgacacatttctagcccttttatac

SEQ ID NO: 605712 - DNA, 25 bp, Rattus norvegicus
tgacacatttcttgcccttttatac

SEQ ID NO: 605713 - DNA, 25 bp, Rattus norvegicus
tgacaccaagctcatttgctagaag

SEQ ID NO: 605714 - DNA, 25 bp, Rattus norvegicus
tgacaccaagctgatttgctagaag

SEQ ID NO: 605715 - DNA, 25 bp, Rattus norvegicus
tgacaccacaccaacttgatagcaa

SEQ ID NO: 605716 - DNA, 25 bp, Rattus norvegicus
tgacaccacacctacttgatagcaa

SEQ ID NO: 605717 - DNA, 25 bp, Rattus norvegicus
tgacaccacctaagtttgcatgcat

SEQ ID NO: 605718 - DNA, 25 bp, Rattus norvegicus
tgacaccacctatgtttgcatgcat

SEQ ID NO: 605719 - DNA, 25 bp, Rattus norvegicus
tgacaccacctccaaatttggccat

SEQ ID NO: 605720 - DNA, 25 bp, Rattus norvegicus
tgacaccacctcgaaatttggccat

SEQ ID NO: 605721 - DNA, 25 bp, Rattus norvegicus
tgacaccacttcaaagtttggccac

SEQ ID NO: 605722 - DNA, 25 bp, Rattus norvegicus
tgacaccacttctaagtttggccac

SEQ ID NO: 605723 - DNA, 25 bp, Rattus norvegicus
tgacaccagagaacatggctcccat

SEQ ID NO: 605724 - DNA, 25 bp, Rattus norvegicus
tgacaccagagatcatggctcccat

SEQ ID NO: 605725 - DNA, 25 bp, Rattus norvegicus
tgacaccagtttaagaggcttcttc

SEQ ID NO: 605726 - DNA, 25 bp, Rattus norvegicus
tgacaccagttttagaggcttcttc

SEQ ID NO: 605727 - DNA, 25 bp, Rattus norvegicus
tgacaccatgacagctgtcctccaa

SEQ ID NO: 605728 - DNA, 25 bp, Rattus norvegicus
tgacaccatgactgctgtcctccaa

SEQ ID NO: 605729 - DNA, 25 bp, Rattus norvegicus
tgacaccatggtcagagtacagagc

SEQ ID NO: 605730 - DNA, 25 bp, Rattus norvegicus
tgacaccatggtgagagtacagagc

SEQ ID NO: 605731 - DNA, 25 bp, Rattus norvegicus
tgacaccatttaatgaccacctcca

SEQ ID NO: 605732 - DNA, 25 bp, Rattus norvegicus
tgacaccatttattgaccacctcca

SEQ ID NO: 605733 - DNA, 25 bp, Rattus norvegicus
tgacacccaacaagtggctccaatt

SEQ ID NO: 605734 - DNA, 25 bp, Rattus norvegicus
tgacacccaacatgtggctccaatt

SEQ ID NO: 605735 - DNA, 25 bp, Rattus norvegicus
tgacacccacatatgcaaagtattg

SEQ ID NO: 605736 - DNA, 25 bp, Rattus norvegicus
tgacacccacatttgcaaagtattg

SEQ ID NO: 605737 - DNA, 25 bp, Rattus norvegicus
tgacacccagctcctcagaacagag

SEQ ID NO: 605738 - DNA, 25 bp, Rattus norvegicus
tgacacccagctgctcagaacagag

SEQ ID NO: 605739 - DNA, 25 bp, Rattus norvegicus
tgacacccaggcactgcaggagtga

SEQ ID NO: 605740 - DNA, 25 bp, Rattus norvegicus
tgacacccaggctctgcaggagtga

SEQ ID NO: 605741 - DNA, 25 bp, Rattus norvegicus
tgacaccccactctgaacgaggatt

SEQ ID NO: 605742 - DNA, 25 bp, Rattus norvegicus
tgacaccccactgtgaacgaggatt

SEQ ID NO: 605743 - DNA, 25 bp, Rattus norvegicus
tgacaccccatcactgcaagaaaga

SEQ ID NO: 605744 - DNA, 25 bp, Rattus norvegicus
tgacaccccatctctgcaagaaaga

SEQ ID NO: 605745 - DNA, 25 bp, Rattus norvegicus
tgacaccctaacacctggcatgata

SEQ ID NO: 605746 - DNA, 25 bp, Rattus norvegicus
tgacaccctaactcctggcatgata

SEQ ID NO: 605747 - DNA, 25 bp, Rattus norvegicus
tgacaccctgatagtattcctggct

SEQ ID NO: 605748 - DNA, 25 bp, Rattus norvegicus
tgacaccctgattgtattcctggct

SEQ ID NO: 605749 - DNA, 25 bp, Rattus norvegicus
tgacacccttccattctgtgagtga

SEQ ID NO: 605750 - DNA, 25 bp, Rattus norvegicus
tgacacccttcctttctgtgagtga

SEQ ID NO: 605751 - DNA, 25 bp, Rattus norvegicus
tgacaccctttgcacagcagcttta

SEQ ID NO: 605752 - DNA, 25 bp, Rattus norvegicus
tgacaccctttggacagcagcttta

SEQ ID NO: 605753 - DNA, 25 bp, Rattus norvegicus
tgacaccgacgcaatgattctctgc

SEQ ID NO: 605754 - DNA, 25 bp, Rattus norvegicus
tgacaccgacgctatgattctctgc

SEQ ID NO: 605755 - DNA, 25 bp, Rattus norvegicus
tgacaccgatgaagccagcactgtg

SEQ ID NO: 605756 - DNA, 25 bp, Rattus norvegicus
tgacaccgatgatgccagcactgtg

SEQ ID NO: 605757 - DNA, 25 bp, Rattus norvegicus
tgacaccgcctcatattcatcttga

SEQ ID NO: 605758 - DNA, 25 bp, Rattus norvegicus
tgacaccgcctcttattcatcttga

SEQ ID NO: 605759 - DNA, 25 bp, Rattus norvegicus
tgacaccgtagacaggcttagcctg

SEQ ID NO: 605760 - DNA, 25 bp, Rattus norvegicus
tgacaccgtagagaggcttagcctg

SEQ ID NO: 605761 - DNA, 25 bp, Rattus norvegicus
tgacaccgtctcaggattgaactgt

SEQ ID NO: 605762 - DNA, 25 bp, Rattus norvegicus
tgacaccgtctctggattgaactgt

SEQ ID NO: 605763 - DNA, 25 bp, Rattus norvegicus
tgacaccgttagactgtttcagagc

SEQ ID NO: 605764 - DNA, 25 bp, Rattus norvegicus
tgacaccgttagtctgtttcagagc

SEQ ID NO: 605765 - DNA, 25 bp, Rattus norvegicus
tgacacctacagcacggatctttgt

SEQ ID NO: 605766 - DNA, 25 bp, Rattus norvegicus
tgacacctacaggacggatctttgt

SEQ ID NO: 605767 - DNA, 25 bp, Rattus norvegicus
tgacacctagtccttggtatgcctg

SEQ ID NO: 605768 - DNA, 25 bp, Rattus norvegicus
tgacacctagtcgttggtatgcctg

SEQ ID NO: 605769 - DNA, 25 bp, Rattus norvegicus
tgacacctctctagacttctaagaa

SEQ ID NO: 605770 - DNA, 25 bp, Rattus norvegicus
tgacacctctcttgacttctaagaa

SEQ ID NO: 605771 - DNA, 25 bp, Rattus norvegicus
tgacacctctggcacttgagcaagc

SEQ ID NO: 605772 - DNA, 25 bp, Rattus norvegicus
tgacacctctgggacttgagcaagc

SEQ ID NO: 605773 - DNA, 25 bp, Rattus norvegicus
tgacacctgaacaccaaacttgctg

SEQ ID NO: 605774 - DNA, 25 bp, Rattus norvegicus
tgacacctgaactccaaacttgctg

SEQ ID NO: 605775 - DNA, 25 bp, Rattus norvegicus
tgacacctgaggaatactatctgag

SEQ ID NO: 605776 - DNA, 25 bp, Rattus norvegicus
tgacacctgaggctagagtcctttc

SEQ ID NO: 605777 - DNA, 25 bp, Rattus norvegicus
tgacacctgagggtagagtcctttc

SEQ ID NO: 605778 - DNA, 25 bp, Rattus norvegicus
tgacacctgaggtatactatctgag

SEQ ID NO: 605779 - DNA, 25 bp, Rattus norvegicus
tgacaccttggaaaactctgtatgg

SEQ ID NO: 605780 - DNA, 25 bp, Rattus norvegicus
tgacaccttggataactctgtatgg

SEQ ID NO: 605781 - DNA, 25 bp, Rattus norvegicus
tgacacctttctactgatctcagag

SEQ ID NO: 605782 - DNA, 25 bp, Rattus norvegicus
tgacacctttcttctgatctcagag

SEQ ID NO: 605783 - DNA, 25 bp, Rattus norvegicus
tgacacgcacttagattgactggca

SEQ ID NO: 605784 - DNA, 25 bp, Rattus norvegicus
tgacacgcactttgattgactggca

SEQ ID NO: 605785 - DNA, 25 bp, Rattus norvegicus
tgacacgctgtgctggcttctgttc

SEQ ID NO: 605786 - DNA, 25 bp, Rattus norvegicus
tgacacgctgtggtggcttctgttc

SEQ ID NO: 605787 - DNA, 25 bp, Rattus norvegicus
tgacacggcctgacctatgcggaac

SEQ ID NO: 605788 - DNA, 25 bp, Rattus norvegicus
tgacacggcctgtcctatgcggaac

SEQ ID NO: 605789 - DNA, 25 bp, Rattus norvegicus
tgacacgggagccacatacagcaca

SEQ ID NO: 605790 - DNA, 25 bp, Rattus norvegicus
tgacacgggagcgacatacagcaca

SEQ ID NO: 605791 - DNA, 25 bp, Rattus norvegicus
tgacacgggcagaagaaggcgtcca

SEQ ID NO: 605792 - DNA, 25 bp, Rattus norvegicus
tgacacgggcagtagaaggcgtcca

SEQ ID NO: 605793 - DNA, 25 bp, Rattus norvegicus
tgacacggtttcagccgagaagcac

SEQ ID NO: 605794 - DNA, 25 bp, Rattus norvegicus
tgacacggtttctgccgagaagcac

SEQ ID NO: 605795 - DNA, 25 bp, Rattus norvegicus
tgacacgtctcaaagttttacttaa

SEQ ID NO: 605796 - DNA, 25 bp, Rattus norvegicus
tgacacgtctcatagttttacttaa

SEQ ID NO: 605797 - DNA, 25 bp, Rattus norvegicus
tgacacgtcttccttttttactgac

SEQ ID NO: 605798 - DNA, 25 bp, Rattus norvegicus
tgacacgtcttcgttttttactgac

SEQ ID NO: 605799 - DNA, 25 bp, Rattus norvegicus
tgacacgtgtgactgacagcctgcg

SEQ ID NO: 605800 - DNA, 25 bp, Rattus norvegicus
tgacacgtgtgagtgacagcctgcg

SEQ ID NO: 605801 - DNA, 25 bp, Rattus norvegicus
tgacacgttattatctggcttgcaa

SEQ ID NO: 605802 - DNA, 25 bp, Rattus norvegicus
tgacacgttattttctggcttgcaa

SEQ ID NO: 605803 - DNA, 25 bp, Rattus norvegicus
tgacacgttcctactgtggactggg

SEQ ID NO: 605804 - DNA, 25 bp, Rattus norvegicus
tgacacgttccttctgtggactggg

SEQ ID NO: 605805 - DNA, 25 bp, Rattus norvegicus
tgacactaccatccctgatttttgt

SEQ ID NO: 605806 - DNA, 25 bp, Rattus norvegicus
tgacactaccatgcctgatttttgt

SEQ ID NO: 605807 - DNA, 25 bp, Rattus norvegicus
tgacactacgtcatttgagatctag

SEQ ID NO: 605808 - DNA, 25 bp, Rattus norvegicus
tgacactacgtcttttgagatctag

SEQ ID NO: 605809 - DNA, 25 bp, Rattus norvegicus
tgacactacttgacaatcgcactcc

SEQ ID NO: 605810 - DNA, 25 bp, Rattus norvegicus
tgacactacttgtcaatcgcactcc

SEQ ID NO: 605811 - DNA, 25 bp, Rattus norvegicus
tgacactatgggaacctcagtggat

SEQ ID NO: 605812 - DNA, 25 bp, Rattus norvegicus
tgacactatgggtacctcagtggat

SEQ ID NO: 605813 - DNA, 25 bp, Rattus norvegicus
tgacactcccggacgtgcagtaggg

SEQ ID NO: 605814 - DNA, 25 bp, Rattus norvegicus
tgacactcccggtcgtgcagtaggg

SEQ ID NO: 605815 - DNA, 25 bp, Rattus norvegicus
tgacactccgaaatccaggtttgac

SEQ ID NO: 605816 - DNA, 25 bp, Rattus norvegicus
tgacactccgaattccaggtttgac

SEQ ID NO: 605817 - DNA, 25 bp, Rattus norvegicus
tgacactcctgacctgggaagcttg

SEQ ID NO: 605818 - DNA, 25 bp, Rattus norvegicus
tgacactcctgagctgggaagcttg

SEQ ID NO: 605819 - DNA, 25 bp, Rattus norvegicus
tgacactcgactatactctgcaaat

SEQ ID NO: 605820 - DNA, 25 bp, Rattus norvegicus
tgacactcgactttactctgcaaat

SEQ ID NO: 605821 - DNA, 25 bp, Rattus norvegicus
tgacactcgagtcagggtttccgtc

SEQ ID NO: 605822 - DNA, 25 bp, Rattus norvegicus
tgacactcgagtgagggtttccgtc

SEQ ID NO: 605823 - DNA, 25 bp, Rattus norvegicus
tgacactctacacagaacgccacag

SEQ ID NO: 605824 - DNA, 25 bp, Rattus norvegicus
tgacactctacagagaacgccacag

SEQ ID NO: 605825 - DNA, 25 bp, Rattus norvegicus
tgacactcttaacactactcatggg

SEQ ID NO: 605826 - DNA, 25 bp, Rattus norvegicus
tgacactcttaagactactcatggg

SEQ ID NO: 605827 - DNA, 25 bp, Rattus norvegicus
tgacactgaattcttgatcctcctg

SEQ ID NO: 605828 - DNA, 25 bp, Rattus norvegicus
tgacactgaattgttgatcctcctg

SEQ ID NO: 605829 - DNA, 25 bp, Rattus norvegicus
tgacactgacatcaaggcaagcatt

SEQ ID NO: 605830 - DNA, 25 bp, Rattus norvegicus
tgacactgacatgaaggcaagcatt

SEQ ID NO: 605831 - DNA, 25 bp, Rattus norvegicus
tgacactgacctattccatttccaa

SEQ ID NO: 605832 - DNA, 25 bp, Rattus norvegicus
tgacactgaccttttccatttccaa

SEQ ID NO: 605833 - DNA, 25 bp, Rattus norvegicus
tgacactgactgacctccgattttg

SEQ ID NO: 605834 - DNA, 25 bp, Rattus norvegicus
tgacactgactgtcctccgattttg

SEQ ID NO: 605835 - DNA, 25 bp, Rattus norvegicus
tgacactgctccatgtgatccttac

SEQ ID NO: 605836 - DNA, 25 bp, Rattus norvegicus
tgacactgctccttgtgatccttac

SEQ ID NO: 605837 - DNA, 25 bp, Rattus norvegicus
tgacactgctctagtttgcttcttt

SEQ ID NO: 605838 - DNA, 25 bp, Rattus norvegicus
tgacactgctcttgtttgcttcttt

SEQ ID NO: 605839 - DNA, 25 bp, Rattus norvegicus
tgacactgctgcagcctacaaagag

SEQ ID NO: 605840 - DNA, 25 bp, Rattus norvegicus
tgacactgctgctgcctacaaagag

SEQ ID NO: 605841 - DNA, 25 bp, Rattus norvegicus
tgacactgggcactccatctgggac

SEQ ID NO: 605842 - DNA, 25 bp, Rattus norvegicus
tgacactgggcagtccatctgggac

SEQ ID NO: 605843 - DNA, 25 bp, Rattus norvegicus
tgacactgggctcggacacatacct

SEQ ID NO: 605844 - DNA, 25 bp, Rattus norvegicus
tgacactgggctgggacacatacct

SEQ ID NO: 605845 - DNA, 25 bp, Rattus norvegicus
tgacactgtatacggctttcacggt

SEQ ID NO: 605846 - DNA, 25 bp, Rattus norvegicus
tgacactgtatagggctttcacggt

SEQ ID NO: 605847 - DNA, 25 bp, Rattus norvegicus
tgacactgtcacctgtgttgcacac

SEQ ID NO: 605848 - DNA, 25 bp, Rattus norvegicus
tgacactgtcacgtgtgttgcacac

SEQ ID NO: 605849 - DNA, 25 bp, Rattus norvegicus
tgacactgtctaacagtacgtcggc

SEQ ID NO: 605850 - DNA, 25 bp, Rattus norvegicus
tgacactgtctatcagtacgtcggc

SEQ ID NO: 605851 - DNA, 25 bp, Rattus norvegicus
tgacactgtgtcactcttcagaact

SEQ ID NO: 605852 - DNA, 25 bp, Rattus norvegicus
tgacactgtgtctctcttcagaact

SEQ ID NO: 605853 - DNA, 25 bp, Rattus norvegicus
tgacacttaacaacactcccgttgg

SEQ ID NO: 605854 - DNA, 25 bp, Rattus norvegicus
tgacacttaacatcactcccgttgg

SEQ ID NO: 605855 - DNA, 25 bp, Rattus norvegicus
tgacacttaataaacgcctgcttta

SEQ ID NO: 605856 - DNA, 25 bp, Rattus norvegicus
tgacacttaatatacgcctgcttta

SEQ ID NO: 605857 - DNA, 25 bp, Rattus norvegicus
tgacacttacccagaattccgtata

SEQ ID NO: 605858 - DNA, 25 bp, Rattus norvegicus
tgacacttaccctgaattccgtata

SEQ ID NO: 605859 - DNA, 25 bp, Rattus norvegicus
tgacacttctggctttctcttaaaa

SEQ ID NO: 605860 - DNA, 25 bp, Rattus norvegicus
tgacacttctgggtttctcttaaaa

SEQ ID NO: 605861 - DNA, 25 bp, Rattus norvegicus
tgacactttcacatttgcagattgg

SEQ ID NO: 605862 - DNA, 25 bp, Rattus norvegicus
tgacactttcacttttgcagattgg

SEQ ID NO: 605863 - DNA, 25 bp, Rattus norvegicus
tgacactttctacatcaaaacctcc

SEQ ID NO: 605864 - DNA, 25 bp, Rattus norvegicus
tgacactttctagatcaaaacctcc

SEQ ID NO: 605865 - DNA, 25 bp, Rattus norvegicus
tgacactttgatatgtgactgtaaa

SEQ ID NO: 605866 - DNA, 25 bp, Rattus norvegicus
tgacactttgatttgtgactgtaaa

SEQ ID NO: 605867 - DNA, 25 bp, Rattus norvegicus
tgacagaaacgcactgggctcacag

SEQ ID NO: 605868 - DNA, 25 bp, Rattus norvegicus
tgacagaaacgctctgggctcacag

SEQ ID NO: 605869 - DNA, 25 bp, Rattus norvegicus
tgacagaaatgcatcccagcatcct

SEQ ID NO: 605870 - DNA, 25 bp, Rattus norvegicus
tgacagaaatgcttcccagcatcct

SEQ ID NO: 605871 - DNA, 25 bp, Rattus norvegicus
tgacagaacaatccctatgcttcaa

SEQ ID NO: 605872 - DNA, 25 bp, Rattus norvegicus
tgacagaacaatgcctatgcttcaa

SEQ ID NO: 605873 - DNA, 25 bp, Rattus norvegicus
tgacagaagcgacctgcagcacagc

SEQ ID NO: 605874 - DNA, 25 bp, Rattus norvegicus
tgacagaagcgagctgcagcacagc

SEQ ID NO: 605875 - DNA, 25 bp, Rattus norvegicus
tgacagaatcccatagcctcattgg

SEQ ID NO: 605876 - DNA, 25 bp, Rattus norvegicus
tgacagaatcccttagcctcattgg

SEQ ID NO: 605877 - DNA, 25 bp, Rattus norvegicus
tgacagacacacactgggtgcctca

SEQ ID NO: 605878 - DNA, 25 bp, Rattus norvegicus
tgacagacacactctgggtgcctca

SEQ ID NO: 605879 - DNA, 25 bp, Rattus norvegicus
tgacagacacagaccatggacaatg

SEQ ID NO: 605880 - DNA, 25 bp, Rattus norvegicus
tgacagacacagtccatggacaatg

SEQ ID NO: 605881 - DNA, 25 bp, Rattus norvegicus
tgacagacacctaggctggccttac

SEQ ID NO: 605882 - DNA, 25 bp, Rattus norvegicus
tgacagacaccttggctggccttac

SEQ ID NO: 605883 - DNA, 25 bp, Rattus norvegicus
tgacagacacttcgccatttcaggg

SEQ ID NO: 605884 - DNA, 25 bp, Rattus norvegicus
tgacagacacttggccatttcaggg

SEQ ID NO: 605885 - DNA, 25 bp, Rattus norvegicus
tgacagacattaaccagctccctga

SEQ ID NO: 605886 - DNA, 25 bp, Rattus norvegicus
tgacagacattatccagctccctga

SEQ ID NO: 605887 - DNA, 25 bp, Rattus norvegicus
tgacagaccacaccccaatggagat

SEQ ID NO: 605888 - DNA, 25 bp, Rattus norvegicus
tgacagaccacagcccaatggagat

SEQ ID NO: 605889 - DNA, 25 bp, Rattus norvegicus
tgacagacccctacagtcactgagg

SEQ ID NO: 605890 - DNA, 25 bp, Rattus norvegicus
tgacagaccccttcagtcactgagg

SEQ ID NO: 605891 - DNA, 25 bp, Rattus norvegicus
tgacagacgtgcaagcagctaccca

SEQ ID NO: 605892 - DNA, 25 bp, Rattus norvegicus
tgacagacgtgctagcagctaccca

SEQ ID NO: 605893 - DNA, 25 bp, Rattus norvegicus
tgacagagaactcgccaggcttcct

SEQ ID NO: 605894 - DNA, 25 bp, Rattus norvegicus
tgacagagaactggccaggcttcct

SEQ ID NO: 605895 - DNA, 25 bp, Rattus norvegicus
tgacagagacaacaaggaggcccct

SEQ ID NO: 605896 - DNA, 25 bp, Rattus norvegicus
tgacagagacaagaaggaggcccct

SEQ ID NO: 605897 - DNA, 25 bp, Rattus norvegicus
tgacagagagataccaccagccatc

SEQ ID NO: 605898 - DNA, 25 bp, Rattus norvegicus
tgacagagagattccaccagccatc

SEQ ID NO: 605899 - DNA, 25 bp, Rattus norvegicus
tgacagagatgccagccgagcgcta

SEQ ID NO: 605900 - DNA, 25 bp, Rattus norvegicus
tgacagagatgcgagccgagcgcta

SEQ ID NO: 605901 - DNA, 25 bp, Rattus norvegicus
tgacagagatggctccactccctgc

SEQ ID NO: 605902 - DNA, 25 bp, Rattus norvegicus
tgacagagatgggtccactccctgc

SEQ ID NO: 605903 - DNA, 25 bp, Rattus norvegicus
tgacagagcattacccacaaggcct

SEQ ID NO: 605904 - DNA, 25 bp, Rattus norvegicus
tgacagagcatttcccacaaggcct

SEQ ID NO: 605905 - DNA, 25 bp, Rattus norvegicus
tgacagagccatcggaaacctgact

SEQ ID NO: 605906 - DNA, 25 bp, Rattus norvegicus
tgacagagccatgggaaacctgact

SEQ ID NO: 605907 - DNA, 25 bp, Rattus norvegicus
tgacagagctggaggccttcccctt

SEQ ID NO: 605908 - DNA, 25 bp, Rattus norvegicus
tgacagagctggtggccttcccctt

SEQ ID NO: 605909 - DNA, 25 bp, Rattus norvegicus
tgacagaggcaaccccagacacgtt

SEQ ID NO: 605910 - DNA, 25 bp, Rattus norvegicus
tgacagaggcaagcccagacacgtt

SEQ ID NO: 605911 - DNA, 25 bp, Rattus norvegicus
tgacagaggcctacctttatcccag

SEQ ID NO: 605912 - DNA, 25 bp, Rattus norvegicus
tgacagaggccttcctttatcccag

SEQ ID NO: 605913 - DNA, 25 bp, Rattus norvegicus
tgacagataaacaacggcgcgagtg

SEQ ID NO: 605914 - DNA, 25 bp, Rattus norvegicus
tgacagataaactacggcgcgagtg

SEQ ID NO: 605915 - DNA, 25 bp, Rattus norvegicus
tgacagataactccagctcgctgta

SEQ ID NO: 605916 - DNA, 25 bp, Rattus norvegicus
tgacagataactgcagctcgctgta

SEQ ID NO: 605917 - DNA, 25 bp, Rattus norvegicus
tgacagatcttgatctagtcctctc

SEQ ID NO: 605918 - DNA, 25 bp, Rattus norvegicus
tgacagatcttgttctagtcctctc

SEQ ID NO: 605919 - DNA, 25 bp, Rattus norvegicus
tgacagatgcctccttgggccttaa

SEQ ID NO: 605920 - DNA, 25 bp, Rattus norvegicus
tgacagatgcctgcttgggccttaa

SEQ ID NO: 605921 - DNA, 25 bp, Rattus norvegicus
tgacagatgctacccaaaggattct

SEQ ID NO: 605922 - DNA, 25 bp, Rattus norvegicus
tgacagatgctagccaaaggattct

SEQ ID NO: 605923 - DNA, 25 bp, Rattus norvegicus
tgacagatggcaatctttcccaact

SEQ ID NO: 605924 - DNA, 25 bp, Rattus norvegicus
tgacagatggcattctttcccaact

SEQ ID NO: 605925 - DNA, 25 bp, Rattus norvegicus
tgacagatgtcgcagccagatcgcc

SEQ ID NO: 605926 - DNA, 25 bp, Rattus norvegicus
tgacagatgtcggagccagatcgcc

SEQ ID NO: 605927 - DNA, 25 bp, Rattus norvegicus
tgacagattctacggtcaccgtgaa

SEQ ID NO: 605928 - DNA, 25 bp, Rattus norvegicus
tgacagattctagggtcaccgtgaa

SEQ ID NO: 605929 - DNA, 25 bp, Rattus norvegicus
tgacagatttcaccagagccatcct

SEQ ID NO: 605930 - DNA, 25 bp, Rattus norvegicus
tgacagatttcagcagagccatcct

SEQ ID NO: 605931 - DNA, 25 bp, Rattus norvegicus
tgacagcacagaaggacgctctcct

SEQ ID NO: 605932 - DNA, 25 bp, Rattus norvegicus
tgacagcacagatggacgctctcct

SEQ ID NO: 605933 - DNA, 25 bp, Rattus norvegicus
tgacagcaccacagggcactgccgt

SEQ ID NO: 605934 - DNA, 25 bp, Rattus norvegicus
tgacagcaccactgggcactgccgt

SEQ ID NO: 605935 - DNA, 25 bp, Rattus norvegicus
tgacagcagcagagatagttcctct

SEQ ID NO: 605936 - DNA, 25 bp, Rattus norvegicus
tgacagcagcagtgatagttcctct

SEQ ID NO: 605937 - DNA, 25 bp, Rattus norvegicus
tgacagcagcctaccacagaaccag

SEQ ID NO: 605938 - DNA, 25 bp, Rattus norvegicus
tgacagcagccttccacagaaccag

SEQ ID NO: 605939 - DNA, 25 bp, Rattus norvegicus
tgacagcaggcaacaccgagcgagg

SEQ ID NO: 605940 - DNA, 25 bp, Rattus norvegicus
tgacagcaggcatcaccgagcgagg

SEQ ID NO: 605941 - DNA, 25 bp, Rattus norvegicus
tgacagcaggttagccagccccacg

SEQ ID NO: 605942 - DNA, 25 bp, Rattus norvegicus
tgacagcaggtttgccagccccacg

SEQ ID NO: 605943 - DNA, 25 bp, Rattus norvegicus
tgacagcagttcctttggaggccct

SEQ ID NO: 605944 - DNA, 25 bp, Rattus norvegicus
tgacagcagttcgtttggaggccct

SEQ ID NO: 605945 - DNA, 25 bp, Rattus norvegicus
tgacagccactgaagtccaggatca

SEQ ID NO: 605946 - DNA, 25 bp, Rattus norvegicus
tgacagccactgtagtccaggatca

SEQ ID NO: 605947 - DNA, 25 bp, Rattus norvegicus
tgacagccagcaacgaacatgagac

SEQ ID NO: 605948 - DNA, 25 bp, Rattus norvegicus
tgacagccagcatcgaacatgagac

SEQ ID NO: 605949 - DNA, 25 bp, Rattus norvegicus
tgacagccagtgcacagcatgccct

SEQ ID NO: 605950 - DNA, 25 bp, Rattus norvegicus
tgacagccagtggacagcatgccct

SEQ ID NO: 605951 - DNA, 25 bp, Rattus norvegicus
tgacagccagttattgagccctact

SEQ ID NO: 605952 - DNA, 25 bp, Rattus norvegicus
tgacagccagtttttgagccctact

SEQ ID NO: 605953 - DNA, 25 bp, Rattus norvegicus
tgacagcccaaacctttacacttgt

SEQ ID NO: 605954 - DNA, 25 bp, Rattus norvegicus
tgacagcccaaagctttacacttgt

SEQ ID NO: 605955 - DNA, 25 bp, Rattus norvegicus
tgacagcccgagagcgcttccagaa

SEQ ID NO: 605956 - DNA, 25 bp, Rattus norvegicus
tgacagcccgagtgcgcttccagaa

SEQ ID NO: 605957 - DNA, 25 bp, Rattus norvegicus
tgacagcccgttaccaggaggatgg

SEQ ID NO: 605958 - DNA, 25 bp, Rattus norvegicus
tgacagcccgtttccaggaggatgg

SEQ ID NO: 605959 - DNA, 25 bp, Rattus norvegicus
tgacagccctcaaactttcaatgac

SEQ ID NO: 605960 - DNA, 25 bp, Rattus norvegicus
tgacagccctcaatgacgtacatga

SEQ ID NO: 605961 - DNA, 25 bp, Rattus norvegicus
tgacagccctcatactttcaatgac

SEQ ID NO: 605962 - DNA, 25 bp, Rattus norvegicus
tgacagccctcattgacgtacatga

SEQ ID NO: 605963 - DNA, 25 bp, Rattus norvegicus
tgacagccgctgacttttgaagttt

SEQ ID NO: 605964 - DNA, 25 bp, Rattus norvegicus
tgacagccgctgtcttttgaagttt

SEQ ID NO: 605965 - DNA, 25 bp, Rattus norvegicus
tgacagccgtcaattctcagccctc

SEQ ID NO: 605966 - DNA, 25 bp, Rattus norvegicus
tgacagccgtcatttctcagccctc

SEQ ID NO: 605967 - DNA, 25 bp, Rattus norvegicus
tgacagcctaatacgggtgttacaa

SEQ ID NO: 605968 - DNA, 25 bp, Rattus norvegicus
tgacagcctaattcgggtgttacaa

SEQ ID NO: 605969 - DNA, 25 bp, Rattus norvegicus
tgacagcctggaattgatcccacga

SEQ ID NO: 605970 - DNA, 25 bp, Rattus norvegicus
tgacagcctggatttgatcccacga

SEQ ID NO: 605971 - DNA, 25 bp, Rattus norvegicus
tgacagcgaaggcacagaagcacaa

SEQ ID NO: 605972 - DNA, 25 bp, Rattus norvegicus
tgacagcgaagggacagaagcacaa

SEQ ID NO: 605973 - DNA, 25 bp, Rattus norvegicus
tgacagcgaatacccttccagagtg

SEQ ID NO: 605974 - DNA, 25 bp, Rattus norvegicus
tgacagcgaatagccttccagagtg

SEQ ID NO: 605975 - DNA, 25 bp, Rattus norvegicus
tgacagcgacacactaaccgtgggt

SEQ ID NO: 605976 - DNA, 25 bp, Rattus norvegicus
tgacagcgacactctaaccgtgggt

SEQ ID NO: 605977 - DNA, 25 bp, Rattus norvegicus
tgacagcgacctagtcatctgggat

SEQ ID NO: 605978 - DNA, 25 bp, Rattus norvegicus
tgacagcgaccttgtcatctgggat

SEQ ID NO: 605979 - DNA, 25 bp, Rattus norvegicus
tgacagcgatggaccctcttcttgt

SEQ ID NO: 605980 - DNA, 25 bp, Rattus norvegicus
tgacagcgatggtccctcttcttgt

SEQ ID NO: 605981 - DNA, 25 bp, Rattus norvegicus
tgacagcgcattccccagagcggga

SEQ ID NO: 605982 - DNA, 25 bp, Rattus norvegicus
tgacagcgcattgcccagagcggga

SEQ ID NO: 605983 - DNA, 25 bp, Rattus norvegicus
tgacagcggatgaacacaccaagtt

SEQ ID NO: 605984 - DNA, 25 bp, Rattus norvegicus
tgacagcggatgtacacaccaagtt

SEQ ID NO: 605985 - DNA, 25 bp, Rattus norvegicus
tgacagcgtcagcaccccatgggaa

SEQ ID NO: 605986 - DNA, 25 bp, Rattus norvegicus
tgacagcgtcaggaccccatgggaa

SEQ ID NO: 605987 - DNA, 25 bp, Rattus norvegicus
tgacagcgtcttctctggtttccta

SEQ ID NO: 605988 - DNA, 25 bp, Rattus norvegicus
tgacagcgtcttgtctggtttccta

SEQ ID NO: 605989 - DNA, 25 bp, Rattus norvegicus
tgacagcgtgtccaagaagccgcgc

SEQ ID NO: 605990 - DNA, 25 bp, Rattus norvegicus
tgacagcgtgtcgaagaagccgcgc

SEQ ID NO: 605991 - DNA, 25 bp, Rattus norvegicus
tgacagctaagcactggtctcctag

SEQ ID NO: 605992 - DNA, 25 bp, Rattus norvegicus
tgacagctaagctctggtctcctag

SEQ ID NO: 605993 - DNA, 25 bp, Rattus norvegicus
tgacagctcagaagacctttccgtg

SEQ ID NO: 605994 - DNA, 25 bp, Rattus norvegicus
tgacagctcagatgacctttccgtg

SEQ ID NO: 605995 - DNA, 25 bp, Rattus norvegicus
tgacagctccagagactcttctagc

SEQ ID NO: 605996 - DNA, 25 bp, Rattus norvegicus
tgacagctccagtgactcttctagc

SEQ ID NO: 605997 - DNA, 25 bp, Rattus norvegicus
tgacagctcctgattgggtatgttc

SEQ ID NO: 605998 - DNA, 25 bp, Rattus norvegicus
tgacagctcctgtttgggtatgttc

SEQ ID NO: 605999 - DNA, 25 bp, Rattus norvegicus
tgacagctccttctaactacgcagg

SEQ ID NO: 606000 - DNA, 25 bp, Rattus norvegicus
tgacagctccttgtaactacgcagg

SEQ ID NO: 606001 - DNA, 25 bp, Rattus norvegicus
tgacagctgagactccgcttaagag

SEQ ID NO: 606002 - DNA, 25 bp, Rattus norvegicus
tgacagctgagagtccgcttaagag

SEQ ID NO: 606003 - DNA, 25 bp, Rattus norvegicus
tgacagctgcatctcccaggcggga

SEQ ID NO: 606004 - DNA, 25 bp, Rattus norvegicus
tgacagctgcatgtcccaggcggga

SEQ ID NO: 606005 - DNA, 25 bp, Rattus norvegicus
tgacagctggaccacaccaatttgg

SEQ ID NO: 606006 - DNA, 25 bp, Rattus norvegicus
tgacagctggacgacaccaatttgg

SEQ ID NO: 606007 - DNA, 25 bp, Rattus norvegicus
tgacagctgtgacgaccttggccct

SEQ ID NO: 606008 - DNA, 25 bp, Rattus norvegicus
tgacagctgtgaggaccttggccct

SEQ ID NO: 606009 - DNA, 25 bp, Rattus norvegicus
tgacagcttctgagggcaggccaac

SEQ ID NO: 606010 - DNA, 25 bp, Rattus norvegicus
tgacagcttctgtgggcaggccaac

SEQ ID NO: 606011 - DNA, 25 bp, Rattus norvegicus
tgacagcttgagattgtctttcccc

SEQ ID NO: 606012 - DNA, 25 bp, Rattus norvegicus
tgacagcttgagtttgtctttcccc

SEQ ID NO: 606013 - DNA, 25 bp, Rattus norvegicus
tgacagcttggaaggccaggatctt

SEQ ID NO: 606014 - DNA, 25 bp, Rattus norvegicus
tgacagcttggatggccaggatctt

SEQ ID NO: 606015 - DNA, 25 bp, Rattus norvegicus
tgacaggaagcaccagcaacaagtt

SEQ ID NO: 606016 - DNA, 25 bp, Rattus norvegicus
tgacaggaagcagcagcaacaagtt

SEQ ID NO: 606017 - DNA, 25 bp, Rattus norvegicus
tgacaggacgctccctaaccttgtt

SEQ ID NO: 606018 - DNA, 25 bp, Rattus norvegicus
tgacaggacgctgcctaaccttgtt

SEQ ID NO: 606019 - DNA, 25 bp, Rattus norvegicus
tgacaggagccaatgcagcatactt

SEQ ID NO: 606020 - DNA, 25 bp, Rattus norvegicus
tgacaggagccattgcagcatactt

SEQ ID NO: 606021 - DNA, 25 bp, Rattus norvegicus
tgacaggatgacattgtcccagaaa

SEQ ID NO: 606022 - DNA, 25 bp, Rattus norvegicus
tgacaggatgactttgtcccagaaa

SEQ ID NO: 606023 - DNA, 25 bp, Rattus norvegicus
tgacaggatgctcgcttagtcctat

SEQ ID NO: 606024 - DNA, 25 bp, Rattus norvegicus
tgacaggatgctggcttagtcctat

SEQ ID NO: 606025 - DNA, 25 bp, Rattus norvegicus
tgacaggattttactccccgtggaa

SEQ ID NO: 606026 - DNA, 25 bp, Rattus norvegicus
tgacaggatttttctccccgtggaa

SEQ ID NO: 606027 - DNA, 25 bp, Rattus norvegicus
tgacaggcaaggacaggcacgcgtc

SEQ ID NO: 606028 - DNA, 25 bp, Rattus norvegicus
tgacaggcaaggcacagccacccaa

SEQ ID NO: 606029 - DNA, 25 bp, Rattus norvegicus
tgacaggcaagggacagccacccaa

SEQ ID NO: 606030 - DNA, 25 bp, Rattus norvegicus
tgacaggcaaggtcaggcacgcgtc

SEQ ID NO: 606031 - DNA, 25 bp, Rattus norvegicus
tgacaggcaggcactagttgctttc

SEQ ID NO: 606032 - DNA, 25 bp, Rattus norvegicus
tgacaggcaggctctagttgctttc

SEQ ID NO: 606033 - DNA, 25 bp, Rattus norvegicus
tgacaggccaaaagctgcccctctt

SEQ ID NO: 606034 - DNA, 25 bp, Rattus norvegicus
tgacaggccaaatgctgcccctctt

SEQ ID NO: 606035 - DNA, 25 bp, Rattus norvegicus
tgacaggccacgctgaactcagtgt

SEQ ID NO: 606036 - DNA, 25 bp, Rattus norvegicus
tgacaggccacggtgaactcagtgt

SEQ ID NO: 606037 - DNA, 25 bp, Rattus norvegicus
tgacaggccagcaccgtttgagttg

SEQ ID NO: 606038 - DNA, 25 bp, Rattus norvegicus
tgacaggccagctccgtttgagttg

SEQ ID NO: 606039 - DNA, 25 bp, Rattus norvegicus
tgacaggcccatcgaatgcagagag

SEQ ID NO: 606040 - DNA, 25 bp, Rattus norvegicus
tgacaggcccatggaatgcagagag

SEQ ID NO: 606041 - DNA, 25 bp, Rattus norvegicus
tgacaggcctcaatactgagcgctt

SEQ ID NO: 606042 - DNA, 25 bp, Rattus norvegicus
tgacaggcctcattactgagcgctt

SEQ ID NO: 606043 - DNA, 25 bp, Rattus norvegicus
tgacaggcctctaggaccgggagac

SEQ ID NO: 606044 - DNA, 25 bp, Rattus norvegicus
tgacaggcctcttggaccgggagac

SEQ ID NO: 606045 - DNA, 25 bp, Rattus norvegicus
tgacaggcgataacgtgggtcctct

SEQ ID NO: 606046 - DNA, 25 bp, Rattus norvegicus
tgacaggcgatatcgtgggtcctct

SEQ ID NO: 606047 - DNA, 25 bp, Rattus norvegicus
tgacaggcgtcacactcacgggcac

SEQ ID NO: 606048 - DNA, 25 bp, Rattus norvegicus
tgacaggcgtcagactcacgggcac

SEQ ID NO: 606049 - DNA, 25 bp, Rattus norvegicus
tgacaggctgcgcaacaggttcgct

SEQ ID NO: 606050 - DNA, 25 bp, Rattus norvegicus
tgacaggctgcggaacaggttcgct

SEQ ID NO: 606051 - DNA, 25 bp, Rattus norvegicus
tgacaggctgctctgactctgtaca

SEQ ID NO: 606052 - DNA, 25 bp, Rattus norvegicus
tgacaggctgctgtgactctgtaca

SEQ ID NO: 606053 - DNA, 25 bp, Rattus norvegicus
tgacagggaaccaactaccatcctc

SEQ ID NO: 606054 - DNA, 25 bp, Rattus norvegicus
tgacagggaacctactaccatcctc

SEQ ID NO: 606055 - DNA, 25 bp, Rattus norvegicus
tgacagggacctctatccagaagcc

SEQ ID NO: 606056 - DNA, 25 bp, Rattus norvegicus
tgacagggacctgtatccagaagcc

SEQ ID NO: 606057 - DNA, 25 bp, Rattus norvegicus
tgacagggtgatctgctcccagacc

SEQ ID NO: 606058 - DNA, 25 bp, Rattus norvegicus
tgacagggtgatgtgctcccagacc

SEQ ID NO: 606059 - DNA, 25 bp, Rattus norvegicus
tgacagggtttcatcctattgccca

SEQ ID NO: 606060 - DNA, 25 bp, Rattus norvegicus
tgacagggtttcttcctattgccca

SEQ ID NO: 606061 - DNA, 25 bp, Rattus norvegicus
tgacaggtacttcccaggcattgcc

SEQ ID NO: 606062 - DNA, 25 bp, Rattus norvegicus
tgacaggtacttgccaggcattgcc

SEQ ID NO: 606063 - DNA, 25 bp, Rattus norvegicus
tgacaggtagatcgcagaagtacca

SEQ ID NO: 606064 - DNA, 25 bp, Rattus norvegicus
tgacaggtagatggcagaagtacca

SEQ ID NO: 606065 - DNA, 25 bp, Rattus norvegicus
tgacaggtccacaccatggaaggat

SEQ ID NO: 606066 - DNA, 25 bp, Rattus norvegicus
tgacaggtccactccatggaaggat

SEQ ID NO: 606067 - DNA, 25 bp, Rattus norvegicus
tgacaggtccctcatggtgacggta

SEQ ID NO: 606068 - DNA, 25 bp, Rattus norvegicus
tgacaggtccctgatggtgacggta

SEQ ID NO: 606069 - DNA, 25 bp, Rattus norvegicus
tgacaggtcctgagttacttctcca

SEQ ID NO: 606070 - DNA, 25 bp, Rattus norvegicus
tgacaggtcctgtgttacttctcca

SEQ ID NO: 606071 - DNA, 25 bp, Rattus norvegicus
tgacaggtctgtccaaccggtcgtc

SEQ ID NO: 606072 - DNA, 25 bp, Rattus norvegicus
tgacaggtctgtgcaaccggtcgtc

SEQ ID NO: 606073 - DNA, 25 bp, Rattus norvegicus
tgacaggtgatacgcttacatttcc

SEQ ID NO: 606074 - DNA, 25 bp, Rattus norvegicus
tgacaggtgataggcttacatttcc

SEQ ID NO: 606075 - DNA, 25 bp, Rattus norvegicus
tgacaggtgccaattagattgcccc

SEQ ID NO: 606076 - DNA, 25 bp, Rattus norvegicus
tgacaggtgccatttagattgcccc

SEQ ID NO: 606077 - DNA, 25 bp, Rattus norvegicus
tgacaggtgtttcccaggaccatat

SEQ ID NO: 606078 - DNA, 25 bp, Rattus norvegicus
tgacaggtgtttgccaggaccatat

SEQ ID NO: 606079 - DNA, 25 bp, Rattus norvegicus
tgacaggttcttcttgcagaggcct

SEQ ID NO: 606080 - DNA, 25 bp, Rattus norvegicus
tgacaggttcttgttgcagaggcct

SEQ ID NO: 606081 - DNA, 25 bp, Rattus norvegicus
tgacagtacaccctctgtatacctg

SEQ ID NO: 606082 - DNA, 25 bp, Rattus norvegicus
tgacagtacaccgtctgtatacctg

SEQ ID NO: 606083 - DNA, 25 bp, Rattus norvegicus
tgacagtaccccattatttttatat

SEQ ID NO: 606084 - DNA, 25 bp, Rattus norvegicus
tgacagtacccctttatttttatat

SEQ ID NO: 606085 - DNA, 25 bp, Rattus norvegicus
tgacagtactcgctcatcagagccc

SEQ ID NO: 606086 - DNA, 25 bp, Rattus norvegicus
tgacagtactcggtcatcagagccc

SEQ ID NO: 606087 - DNA, 25 bp, Rattus norvegicus
tgacagtagcctcactttctctact

SEQ ID NO: 606088 - DNA, 25 bp, Rattus norvegicus
tgacagtagcctgactttctctact

SEQ ID NO: 606089 - DNA, 25 bp, Rattus norvegicus
tgacagtagctcatgagtcagcccc

SEQ ID NO: 606090 - DNA, 25 bp, Rattus norvegicus
tgacagtagctcttgagtcagcccc

SEQ ID NO: 606091 - DNA, 25 bp, Rattus norvegicus
tgacagtatcatctatgccccagct

SEQ ID NO: 606092 - DNA, 25 bp, Rattus norvegicus
tgacagtatcatgtatgccccagct

SEQ ID NO: 606093 - DNA, 25 bp, Rattus norvegicus
tgacagtattccaggtggctctgat

SEQ ID NO: 606094 - DNA, 25 bp, Rattus norvegicus
tgacagtattcctggtggctctgat

SEQ ID NO: 606095 - DNA, 25 bp, Rattus norvegicus
tgacagtattctccaactccacaga

SEQ ID NO: 606096 - DNA, 25 bp, Rattus norvegicus
tgacagtattctgcaactccacaga

SEQ ID NO: 606097 - DNA, 25 bp, Rattus norvegicus
tgacagtccaggagtcttcgcttca

SEQ ID NO: 606098 - DNA, 25 bp, Rattus norvegicus
tgacagtccaggtgtcttcgcttca

SEQ ID NO: 606099 - DNA, 25 bp, Rattus norvegicus
tgacagtcccctccctttgaaagac

SEQ ID NO: 606100 - DNA, 25 bp, Rattus norvegicus
tgacagtcccctgcctttgaaagac

SEQ ID NO: 606101 - DNA, 25 bp, Rattus norvegicus
tgacagtccctgaacaagtctttgt

SEQ ID NO: 606102 - DNA, 25 bp, Rattus norvegicus
tgacagtccctgtacaagtctttgt

SEQ ID NO: 606103 - DNA, 25 bp, Rattus norvegicus
tgacagtccgagacgccgctctcag

SEQ ID NO: 606104 - DNA, 25 bp, Rattus norvegicus
tgacagtccgagtcgccgctctcag

SEQ ID NO: 606105 - DNA, 25 bp, Rattus norvegicus
tgacagtcctggcacgtcagcttgt

SEQ ID NO: 606106 - DNA, 25 bp, Rattus norvegicus
tgacagtcctgggacgtcagcttgt

SEQ ID NO: 606107 - DNA, 25 bp, Rattus norvegicus
tgacagtcctttcctgtagctcagg

SEQ ID NO: 606108 - DNA, 25 bp, Rattus norvegicus
tgacagtcctttgctgtagctcagg

SEQ ID NO: 606109 - DNA, 25 bp, Rattus norvegicus
tgacagtctaatatgatccccagga

SEQ ID NO: 606110 - DNA, 25 bp, Rattus norvegicus
tgacagtctaatcaccggtcctggc

SEQ ID NO: 606111 - DNA, 25 bp, Rattus norvegicus
tgacagtctaatgaccggtcctggc

SEQ ID NO: 606112 - DNA, 25 bp, Rattus norvegicus
tgacagtctaatttgatccccagga

SEQ ID NO: 606113 - DNA, 25 bp, Rattus norvegicus
tgacagtctgctactggttacctta

SEQ ID NO: 606114 - DNA, 25 bp, Rattus norvegicus
tgacagtctgcttctggttacctta

SEQ ID NO: 606115 - DNA, 25 bp, Rattus norvegicus
tgacagtcttcaatcaggccctgta

SEQ ID NO: 606116 - DNA, 25 bp, Rattus norvegicus
tgacagtcttcattcaggccctgta

SEQ ID NO: 606117 - DNA, 25 bp, Rattus norvegicus
tgacagtgacacctaccacagtggg

SEQ ID NO: 606118 - DNA, 25 bp, Rattus norvegicus
tgacagtgacacgtaccacagtggg

SEQ ID NO: 606119 - DNA, 25 bp, Rattus norvegicus
tgacagtgacctcctgcggctggaa

SEQ ID NO: 606120 - DNA, 25 bp, Rattus norvegicus
tgacagtgacctgctgcggctggaa

SEQ ID NO: 606121 - DNA, 25 bp, Rattus norvegicus
tgacagtgagcgacggctggatcta

SEQ ID NO: 606122 - DNA, 25 bp, Rattus norvegicus
tgacagtgagcgtcggctggatcta

SEQ ID NO: 606123 - DNA, 25 bp, Rattus norvegicus
tgacagtgaggtcagtcctgccacc

SEQ ID NO: 606124 - DNA, 25 bp, Rattus norvegicus
tgacagtgaggtgagtcctgccacc

SEQ ID NO: 606125 - DNA, 25 bp, Rattus norvegicus
tgacagtgattgctacacctcccga

SEQ ID NO: 606126 - DNA, 25 bp, Rattus norvegicus
tgacagtgattggtacacctcccga

SEQ ID NO: 606127 - DNA, 25 bp, Rattus norvegicus
tgacagtgcacccagtggcagattt

SEQ ID NO: 606128 - DNA, 25 bp, Rattus norvegicus
tgacagtgcaccgagtggcagattt

SEQ ID NO: 606129 - DNA, 25 bp, Rattus norvegicus
tgacagtgcactagtggcagtcctc

SEQ ID NO: 606130 - DNA, 25 bp, Rattus norvegicus
tgacagtgcacttgtggcagtcctc

SEQ ID NO: 606131 - DNA, 25 bp, Rattus norvegicus
tgacagtgcagaagccttgttcctg

SEQ ID NO: 606132 - DNA, 25 bp, Rattus norvegicus
tgacagtgcagatgccttgttcctg

SEQ ID NO: 606133 - DNA, 25 bp, Rattus norvegicus
tgacagtgccaacaacatccagttc

SEQ ID NO: 606134 - DNA, 25 bp, Rattus norvegicus
tgacagtgccaagaacatccagttc

SEQ ID NO: 606135 - DNA, 25 bp, Rattus norvegicus
tgacagtgccccaacacacaggtgg

SEQ ID NO: 606136 - DNA, 25 bp, Rattus norvegicus
tgacagtgcccctacacacaggtgg

SEQ ID NO: 606137 - DNA, 25 bp, Rattus norvegicus
tgacagtgccctacgatatgccctt

SEQ ID NO: 606138 - DNA, 25 bp, Rattus norvegicus
tgacagtgcccttcgatatgccctt

SEQ ID NO: 606139 - DNA, 25 bp, Rattus norvegicus
tgacagtgctttccctcccacagat

SEQ ID NO: 606140 - DNA, 25 bp, Rattus norvegicus
tgacagtgctttgcctcccacagat

SEQ ID NO: 606141 - DNA, 25 bp, Rattus norvegicus
tgacagtggcaaccagcaacgggct

SEQ ID NO: 606142 - DNA, 25 bp, Rattus norvegicus
tgacagtggcaagcagcaacgggct

SEQ ID NO: 606143 - DNA, 25 bp, Rattus norvegicus
tgacagtggcccaggatggtgcttc

SEQ ID NO: 606144 - DNA, 25 bp, Rattus norvegicus
tgacagtggccctggatggtgcttc

SEQ ID NO: 606145 - DNA, 25 bp, Rattus norvegicus
tgacagtggccgacattactgggaa

SEQ ID NO: 606146 - DNA, 25 bp, Rattus norvegicus
tgacagtggccgtcattactgggaa

SEQ ID NO: 606147 - DNA, 25 bp, Rattus norvegicus
tgacagtggcctcttgctttgtttt

SEQ ID NO: 606148 - DNA, 25 bp, Rattus norvegicus
tgacagtggcctgttgctttgtttt

SEQ ID NO: 606149 - DNA, 25 bp, Rattus norvegicus
tgacagtggttacgaactctcccct

SEQ ID NO: 606150 - DNA, 25 bp, Rattus norvegicus
tgacagtggttaggaactctcccct

SEQ ID NO: 606151 - DNA, 25 bp, Rattus norvegicus
tgacagtgtatcaccttcaaagggc

SEQ ID NO: 606152 - DNA, 25 bp, Rattus norvegicus
tgacagtgtatctccttcaaagggc

SEQ ID NO: 606153 - DNA, 25 bp, Rattus norvegicus
tgacagttaaggctgcagcagccgc

SEQ ID NO: 606154 - DNA, 25 bp, Rattus norvegicus
tgacagttaagggtgcagcagccgc

SEQ ID NO: 606155 - DNA, 25 bp, Rattus norvegicus
tgacagttatcgatcagcctggcta

SEQ ID NO: 606156 - DNA, 25 bp, Rattus norvegicus
tgacagttatcgttcagcctggcta

SEQ ID NO: 606157 - DNA, 25 bp, Rattus norvegicus
tgacagttcctgatgtggatggtgt

SEQ ID NO: 606158 - DNA, 25 bp, Rattus norvegicus
tgacagttcctgttgtggatggtgt

SEQ ID NO: 606159 - DNA, 25 bp, Rattus norvegicus
tgacagttctcaactcgtcctttgt

SEQ ID NO: 606160 - DNA, 25 bp, Rattus norvegicus
tgacagttctcatctcgtcctttgt

SEQ ID NO: 606161 - DNA, 25 bp, Rattus norvegicus
tgacagttcttgaccagtgtcttca

SEQ ID NO: 606162 - DNA, 25 bp, Rattus norvegicus
tgacagttcttgtccagtgtcttca

SEQ ID NO: 606163 - DNA, 25 bp, Rattus norvegicus
tgacagttggagaccagagctcttt

SEQ ID NO: 606164 - DNA, 25 bp, Rattus norvegicus
tgacagttggagtccagagctcttt

SEQ ID NO: 606165 - DNA, 25 bp, Rattus norvegicus
tgacagttgtggattttaccctggc

SEQ ID NO: 606166 - DNA, 25 bp, Rattus norvegicus
tgacagttgtggtttttaccctggc

SEQ ID NO: 606167 - DNA, 25 bp, Rattus norvegicus
tgacagtttaaacccattcctacct

SEQ ID NO: 606168 - DNA, 25 bp, Rattus norvegicus
tgacagtttaaagccattcctacct

SEQ ID NO: 606169 - DNA, 25 bp, Rattus norvegicus
tgacagttttcacagcacagcacgc

SEQ ID NO: 606170 - DNA, 25 bp, Rattus norvegicus
tgacagttttcagagcacagcacgc

SEQ ID NO: 606171 - DNA, 25 bp, Rattus norvegicus
tgacagttttggaatttgttgcaac

SEQ ID NO: 606172 - DNA, 25 bp, Rattus norvegicus
tgacagttttggtatttgttgcaac

SEQ ID NO: 606173 - DNA, 25 bp, Rattus norvegicus
tgacataaatcacggctctcactgg

SEQ ID NO: 606174 - DNA, 25 bp, Rattus norvegicus
tgacataaatcagggctctcactgg

SEQ ID NO: 606175 - DNA, 25 bp, Rattus norvegicus
tgacataacgtactgggcaagaaga

SEQ ID NO: 606176 - DNA, 25 bp, Rattus norvegicus
tgacataacgtagtgggcaagaaga

SEQ ID NO: 606177 - DNA, 25 bp, Rattus norvegicus
tgacataactagacttccttcctat

SEQ ID NO: 606178 - DNA, 25 bp, Rattus norvegicus
tgacataactagtcttccttcctat

SEQ ID NO: 606179 - DNA, 25 bp, Rattus norvegicus
tgacataaggatccacagggcgtta

SEQ ID NO: 606180 - DNA, 25 bp, Rattus norvegicus
tgacataaggatgcacagggcgtta

SEQ ID NO: 606181 - DNA, 25 bp, Rattus norvegicus
tgacataatttgaggccatcttggc

SEQ ID NO: 606182 - DNA, 25 bp, Rattus norvegicus
tgacataatttgtggccatcttggc

SEQ ID NO: 606183 - DNA, 25 bp, Rattus norvegicus
tgacataccgtcctaggctttccta

SEQ ID NO: 606184 - DNA, 25 bp, Rattus norvegicus
tgacataccgtcgtaggctttccta

SEQ ID NO: 606185 - DNA, 25 bp, Rattus norvegicus
tgacatacctcaaggccacacctaa

SEQ ID NO: 606186 - DNA, 25 bp, Rattus norvegicus
tgacatacctcatggccacacctaa

SEQ ID NO: 606187 - DNA, 25 bp, Rattus norvegicus
tgacatactcatacgtcggcccaca

SEQ ID NO: 606188 - DNA, 25 bp, Rattus norvegicus
tgacatactcattcgtcggcccaca

SEQ ID NO: 606189 - DNA, 25 bp, Rattus norvegicus
tgacatactgctaggtcctttagat

SEQ ID NO: 606190 - DNA, 25 bp, Rattus norvegicus
tgacatactgcttggtcctttagat

SEQ ID NO: 606191 - DNA, 25 bp, Rattus norvegicus
tgacatagaaagaaggccctcccca

SEQ ID NO: 606192 - DNA, 25 bp, Rattus norvegicus
tgacatagaaagtaggccctcccca

SEQ ID NO: 606193 - DNA, 25 bp, Rattus norvegicus
tgacatagggctctctgtcggtcac

SEQ ID NO: 606194 - DNA, 25 bp, Rattus norvegicus
tgacatagggctgtctgtcggtcac

SEQ ID NO: 606195 - DNA, 25 bp, Rattus norvegicus
tgacatatcactattgccttgcatc

SEQ ID NO: 606196 - DNA, 25 bp, Rattus norvegicus
tgacatatcacttttgccttgcatc

SEQ ID NO: 606197 - DNA, 25 bp, Rattus norvegicus
tgacatatctgaacaccttccttat

SEQ ID NO: 606198 - DNA, 25 bp, Rattus norvegicus
tgacatatctgatcaccttccttat

SEQ ID NO: 606199 - DNA, 25 bp, Rattus norvegicus
tgacatcaacctctggcttccctat

SEQ ID NO: 606200 - DNA, 25 bp, Rattus norvegicus
tgacatcaacctgtggcttccctat

SEQ ID NO: 606201 - DNA, 25 bp, Rattus norvegicus
tgacatcacctaccaggaccttcaa

SEQ ID NO: 606202 - DNA, 25 bp, Rattus norvegicus
tgacatcacctagcaggaccttcaa

SEQ ID NO: 606203 - DNA, 25 bp, Rattus norvegicus
tgacatcacgctctcatatcctatc

SEQ ID NO: 606204 - DNA, 25 bp, Rattus norvegicus
tgacatcacgctgtcatatcctatc

SEQ ID NO: 606205 - DNA, 25 bp, Rattus norvegicus
tgacatcacggccaagctctgcgac

SEQ ID NO: 606206 - DNA, 25 bp, Rattus norvegicus
tgacatcacggcgaagctctgcgac

SEQ ID NO: 606207 - DNA, 25 bp, Rattus norvegicus
tgacatcacttaccaggagcctcag

SEQ ID NO: 606208 - DNA, 25 bp, Rattus norvegicus
tgacatcacttagcaggagcctcag

SEQ ID NO: 606209 - DNA, 25 bp, Rattus norvegicus
tgacatcagagtcaccctctggtga

SEQ ID NO: 606210 - DNA, 25 bp, Rattus norvegicus
tgacatcagagtgaccctctggtga

SEQ ID NO: 606211 - DNA, 25 bp, Rattus norvegicus
tgacatcagctcctggttcatggaa

SEQ ID NO: 606212 - DNA, 25 bp, Rattus norvegicus
tgacatcagctcgtggttcatggaa

SEQ ID NO: 606213 - DNA, 25 bp, Rattus norvegicus
tgacatcagggcaaaggaactattg

SEQ ID NO: 606214 - DNA, 25 bp, Rattus norvegicus
tgacatcagggctaaggaactattg

SEQ ID NO: 606215 - DNA, 25 bp, Rattus norvegicus
tgacatccagacacctagcccagaa

SEQ ID NO: 606216 - DNA, 25 bp, Rattus norvegicus
tgacatccagacatgagatttctca

SEQ ID NO: 606217 - DNA, 25 bp, Rattus norvegicus
tgacatccagactcctagcccagaa

SEQ ID NO: 606218 - DNA, 25 bp, Rattus norvegicus
tgacatccagacttgagatttctca

SEQ ID NO: 606219 - DNA, 25 bp, Rattus norvegicus
tgacatccagatccctatagagtat

SEQ ID NO: 606220 - DNA, 25 bp, Rattus norvegicus
tgacatccagatgcctatagagtat

SEQ ID NO: 606221 - DNA, 25 bp, Rattus norvegicus
tgacatccattcagcattgcctatg

SEQ ID NO: 606222 - DNA, 25 bp, Rattus norvegicus
tgacatccattctgcattgcctatg

SEQ ID NO: 606223 - DNA, 25 bp, Rattus norvegicus
tgacatccatttaccacagagcaac

SEQ ID NO: 606224 - DNA, 25 bp, Rattus norvegicus
tgacatccattttccacagagcaac

SEQ ID NO: 606225 - DNA, 25 bp, Rattus norvegicus
tgacatccgtccagctttgctttat

SEQ ID NO: 606226 - DNA, 25 bp, Rattus norvegicus
tgacatccgtcctgctttgctttat

SEQ ID NO: 606227 - DNA, 25 bp, Rattus norvegicus
tgacatcctaagctcagtgtggcag

SEQ ID NO: 606228 - DNA, 25 bp, Rattus norvegicus
tgacatcctaaggtcagtgtggcag

SEQ ID NO: 606229 - DNA, 25 bp, Rattus norvegicus
tgacatcctcaaatacacacatgca

SEQ ID NO: 606230 - DNA, 25 bp, Rattus norvegicus
tgacatcctcaattacacacatgca

SEQ ID NO: 606231 - DNA, 25 bp, Rattus norvegicus
tgacatcctcacaggggcactggca

SEQ ID NO: 606232 - DNA, 25 bp, Rattus norvegicus
tgacatcctcactggggcactggca

SEQ ID NO: 606233 - DNA, 25 bp, Rattus norvegicus
tgacatcctcagacagacagacgtg

SEQ ID NO: 606234 - DNA, 25 bp, Rattus norvegicus
tgacatcctcagtcagacagacgtg

SEQ ID NO: 606235 - DNA, 25 bp, Rattus norvegicus
tgacatcctcctcaagaatggccct

SEQ ID NO: 606236 - DNA, 25 bp, Rattus norvegicus
tgacatcctcctgaagaatggccct

SEQ ID NO: 606237 - DNA, 25 bp, Rattus norvegicus
tgacatcctcttctaggttcctggg

SEQ ID NO: 606238 - DNA, 25 bp, Rattus norvegicus
tgacatcctcttgtaggttcctggg

SEQ ID NO: 606239 - DNA, 25 bp, Rattus norvegicus
tgacatcctggccttgtcttcagaa

SEQ ID NO: 606240 - DNA, 25 bp, Rattus norvegicus
tgacatcctggcgttgtcttcagaa

SEQ ID NO: 606241 - DNA, 25 bp, Rattus norvegicus
tgacatccttcccttgtctgtgaag

SEQ ID NO: 606242 - DNA, 25 bp, Rattus norvegicus
tgacatccttccgttgtctgtgaag

SEQ ID NO: 606243 - DNA, 25 bp, Rattus norvegicus
tgacatccttttagcctcttctagg

SEQ ID NO: 606244 - DNA, 25 bp, Rattus norvegicus
tgacatcctttttgcctcttctagg

SEQ ID NO: 606245 - DNA, 25 bp, Rattus norvegicus
tgacatcgagggaagtggctcctga

SEQ ID NO: 606246 - DNA, 25 bp, Rattus norvegicus
tgacatcgagggtagtggctcctga

SEQ ID NO: 606247 - DNA, 25 bp, Rattus norvegicus
tgacatcgcctgagttttactcata

SEQ ID NO: 606248 - DNA, 25 bp, Rattus norvegicus
tgacatcgcctgtgttttactcata

SEQ ID NO: 606249 - DNA, 25 bp, Rattus norvegicus
tgacatcggcatcattctcatcaac

SEQ ID NO: 606250 - DNA, 25 bp, Rattus norvegicus
tgacatcggcatgattctcatcaac

SEQ ID NO: 606251 - DNA, 25 bp, Rattus norvegicus
tgacatcgggaacgagttcctctcc

SEQ ID NO: 606252 - DNA, 25 bp, Rattus norvegicus
tgacatcgggaaggagttcctctcc

SEQ ID NO: 606253 - DNA, 25 bp, Rattus norvegicus
tgacatcgtgatcgatcctccttac

SEQ ID NO: 606254 - DNA, 25 bp, Rattus norvegicus
tgacatcgtgatggatcctccttac

SEQ ID NO: 606255 - DNA, 25 bp, Rattus norvegicus
tgacatctaagtacagtgacactgc

SEQ ID NO: 606256 - DNA, 25 bp, Rattus norvegicus
tgacatctaagttcagtgacactgc

SEQ ID NO: 606257 - DNA, 25 bp, Rattus norvegicus
tgacatctacccatagtgtttgcac

SEQ ID NO: 606258 - DNA, 25 bp, Rattus norvegicus
tgacatctacccttagtgtttgcac

SEQ ID NO: 606259 - DNA, 25 bp, Rattus norvegicus
tgacatctatcccatctgtgagcga

SEQ ID NO: 606260 - DNA, 25 bp, Rattus norvegicus
tgacatctatccgatctgtgagcga

SEQ ID NO: 606261 - DNA, 25 bp, Rattus norvegicus
tgacatctcaaacgacttgtccggg

SEQ ID NO: 606262 - DNA, 25 bp, Rattus norvegicus
tgacatctcaaaggacttgtccggg

SEQ ID NO: 606263 - DNA, 25 bp, Rattus norvegicus
tgacatctcaccatgtgtgtggcca

SEQ ID NO: 606264 - DNA, 25 bp, Rattus norvegicus
tgacatctcaccttgtgtgtggcca

SEQ ID NO: 606265 - DNA, 25 bp, Rattus norvegicus
tgacatctcagtcgtagcccatgtt

SEQ ID NO: 606266 - DNA, 25 bp, Rattus norvegicus
tgacatctcagtggtagcccatgtt

SEQ ID NO: 606267 - DNA, 25 bp, Rattus norvegicus
tgacatctccagaagcccataatag

SEQ ID NO: 606268 - DNA, 25 bp, Rattus norvegicus
tgacatctccagtagcccataatag

SEQ ID NO: 606269 - DNA, 25 bp, Rattus norvegicus
tgacatctctctcggattacggtct

SEQ ID NO: 606270 - DNA, 25 bp, Rattus norvegicus
tgacatctctctgggattacggtct

SEQ ID NO: 606271 - DNA, 25 bp, Rattus norvegicus
tgacatctgcaaacacattcccaag

SEQ ID NO: 606272 - DNA, 25 bp, Rattus norvegicus
tgacatctgcaatcacattcccaag

SEQ ID NO: 606273 - DNA, 25 bp, Rattus norvegicus
tgacatctggatcgctgtttgcctg

SEQ ID NO: 606274 - DNA, 25 bp, Rattus norvegicus
tgacatctggatggctgtttgcctg

SEQ ID NO: 606275 - DNA, 25 bp, Rattus norvegicus
tgacatctgggcaaaccctcgggtt

SEQ ID NO: 606276 - DNA, 25 bp, Rattus norvegicus
tgacatctgggcagtccatgcactg

SEQ ID NO: 606277 - DNA, 25 bp, Rattus norvegicus
tgacatctgggctaaccctcgggtt

SEQ ID NO: 606278 - DNA, 25 bp, Rattus norvegicus
tgacatctgggctgtccatgcactg

SEQ ID NO: 606279 - DNA, 25 bp, Rattus norvegicus
tgacatctggttacactctcatcag

SEQ ID NO: 606280 - DNA, 25 bp, Rattus norvegicus
tgacatctggtttcactctcatcag

SEQ ID NO: 606281 - DNA, 25 bp, Rattus norvegicus
tgacatctgttcctgcatgtgacaa

SEQ ID NO: 606282 - DNA, 25 bp, Rattus norvegicus
tgacatctgttcgtgcatgtgacaa

SEQ ID NO: 606283 - DNA, 25 bp, Rattus norvegicus
tgacatcttcacagacatcgagaac

SEQ ID NO: 606284 - DNA, 25 bp, Rattus norvegicus
tgacatcttcactgacatcgagaac

SEQ ID NO: 606285 - DNA, 25 bp, Rattus norvegicus
tgacatcttcctagataacgtggga

SEQ ID NO: 606286 - DNA, 25 bp, Rattus norvegicus
tgacatcttccttgataacgtggga

SEQ ID NO: 606287 - DNA, 25 bp, Rattus norvegicus
tgacatcttcttacctcttatattg

SEQ ID NO: 606288 - DNA, 25 bp, Rattus norvegicus
tgacatcttctttcctcttatattg

SEQ ID NO: 606289 - DNA, 25 bp, Rattus norvegicus
tgacatcttgccagagaccctaaag

SEQ ID NO: 606290 - DNA, 25 bp, Rattus norvegicus
tgacatcttgcctgagaccctaaag

SEQ ID NO: 606291 - DNA, 25 bp, Rattus norvegicus
tgacatcttttgagccctccagcta

SEQ ID NO: 606292 - DNA, 25 bp, Rattus norvegicus
tgacatcttttgtgccctccagcta

SEQ ID NO: 606293 - DNA, 25 bp, Rattus norvegicus
tgacatgaaatcacaaccctccggg

SEQ ID NO: 606294 - DNA, 25 bp, Rattus norvegicus
tgacatgaaatctcaaccctccggg

SEQ ID NO: 606295 - DNA, 25 bp, Rattus norvegicus
tgacatgaaggtacagggccacctc

SEQ ID NO: 606296 - DNA, 25 bp, Rattus norvegicus
tgacatgaaggttcagggccacctc

SEQ ID NO: 606297 - DNA, 25 bp, Rattus norvegicus
tgacatgaccatcacgttcctaagg

SEQ ID NO: 606298 - DNA, 25 bp, Rattus norvegicus
tgacatgaccatgacgttcctaagg

SEQ ID NO: 606299 - DNA, 25 bp, Rattus norvegicus
tgacatgacgtcatcaaactgccgg

SEQ ID NO: 606300 - DNA, 25 bp, Rattus norvegicus
tgacatgacgtcttcaaactgccgg

SEQ ID NO: 606301 - DNA, 25 bp, Rattus norvegicus
tgacatgacttgagttggcatcaat

SEQ ID NO: 606302 - DNA, 25 bp, Rattus norvegicus
tgacatgacttgtgttggcatcaat

SEQ ID NO: 606303 - DNA, 25 bp, Rattus norvegicus
tgacatgatgacacggccccagatg

SEQ ID NO: 606304 - DNA, 25 bp, Rattus norvegicus
tgacatgatgactcggccccagatg

SEQ ID NO: 606305 - DNA, 25 bp, Rattus norvegicus
tgacatgcaaacatgaacccttgaa

SEQ ID NO: 606306 - DNA, 25 bp, Rattus norvegicus
tgacatgcaaacttgaacccttgaa

SEQ ID NO: 606307 - DNA, 25 bp, Rattus norvegicus
tgacatgcagctctcttcaggctcc

SEQ ID NO: 606308 - DNA, 25 bp, Rattus norvegicus
tgacatgcagctgtcttcaggctcc

SEQ ID NO: 606309 - DNA, 25 bp, Rattus norvegicus
tgacatgccaacataccagatccga

SEQ ID NO: 606310 - DNA, 25 bp, Rattus norvegicus
tgacatgccaacttaccagatccga

SEQ ID NO: 606311 - DNA, 25 bp, Rattus norvegicus
tgacatgccgccaggagaaacctgc

SEQ ID NO: 606312 - DNA, 25 bp, Rattus norvegicus
tgacatgccgcctggagaaacctgc

SEQ ID NO: 606313 - DNA, 25 bp, Rattus norvegicus
tgacatgcgtggacactcctgagtc

SEQ ID NO: 606314 - DNA, 25 bp, Rattus norvegicus
tgacatgcgtggtcactcctgagtc

SEQ ID NO: 606315 - DNA, 25 bp, Rattus norvegicus
tgacatgctcagaatgccagccttg

SEQ ID NO: 606316 - DNA, 25 bp, Rattus norvegicus
tgacatgctcagtatgccagccttg

SEQ ID NO: 606317 - DNA, 25 bp, Rattus norvegicus
tgacatgctgcactctgtaacacgg

SEQ ID NO: 606318 - DNA, 25 bp, Rattus norvegicus
tgacatgctgcagtctgtaacacgg

SEQ ID NO: 606319 - DNA, 25 bp, Rattus norvegicus
tgacatgcttaaactgcccttgaga

SEQ ID NO: 606320 - DNA, 25 bp, Rattus norvegicus
tgacatgcttaatctgcccttgaga

SEQ ID NO: 606321 - DNA, 25 bp, Rattus norvegicus
tgacatgctttacccaatgagctcc

SEQ ID NO: 606322 - DNA, 25 bp, Rattus norvegicus
tgacatgctttagccaatgagctcc

SEQ ID NO: 606323 - DNA, 25 bp, Rattus norvegicus
tgacatggaacccttgttttcctgg

SEQ ID NO: 606324 - DNA, 25 bp, Rattus norvegicus
tgacatggaaccgttgttttcctgg

SEQ ID NO: 606325 - DNA, 25 bp, Rattus norvegicus
tgacatggacgcacagttcccacgt

SEQ ID NO: 606326 - DNA, 25 bp, Rattus norvegicus
tgacatggacgctcagttcccacgt

SEQ ID NO: 606327 - DNA, 25 bp, Rattus norvegicus
tgacatggatggcaccttgactgcc

SEQ ID NO: 606328 - DNA, 25 bp, Rattus norvegicus
tgacatggatgggaccttgactgcc

SEQ ID NO: 606329 - DNA, 25 bp, Rattus norvegicus
tgacatggcatcaagggtacatcta

SEQ ID NO: 606330 - DNA, 25 bp, Rattus norvegicus
tgacatggcatctagggtacatcta

SEQ ID NO: 606331 - DNA, 25 bp, Rattus norvegicus
tgacatggccatctctgacaacaac

SEQ ID NO: 606332 - DNA, 25 bp, Rattus norvegicus
tgacatggccatgtctgacaacaac

SEQ ID NO: 606333 - DNA, 25 bp, Rattus norvegicus
tgacatggcccacatccgctgaggg

SEQ ID NO: 606334 - DNA, 25 bp, Rattus norvegicus
tgacatggcccagatccgctgaggg

SEQ ID NO: 606335 - DNA, 25 bp, Rattus norvegicus
tgacatgggcacagttcatgcacat

SEQ ID NO: 606336 - DNA, 25 bp, Rattus norvegicus
tgacatgggcactgttcatgcacat

SEQ ID NO: 606337 - DNA, 25 bp, Rattus norvegicus
tgacatgggcttagagtccttccag

SEQ ID NO: 606338 - DNA, 25 bp, Rattus norvegicus
tgacatgggctttgagtccttccag

SEQ ID NO: 606339 - DNA, 25 bp, Rattus norvegicus
tgacatggtagacaatcgtgttggc

SEQ ID NO: 606340 - DNA, 25 bp, Rattus norvegicus
tgacatggtagagaatcgtgttggc

SEQ ID NO: 606341 - DNA, 25 bp, Rattus norvegicus
tgacatggtctcattacaatctcat

SEQ ID NO: 606342 - DNA, 25 bp, Rattus norvegicus
tgacatggtctctttacaatctcat

SEQ ID NO: 606343 - DNA, 25 bp, Rattus norvegicus
tgacatggttcacatagccttgggt

SEQ ID NO: 606344 - DNA, 25 bp, Rattus norvegicus
tgacatggttcagatagccttgggt

SEQ ID NO: 606345 - DNA, 25 bp, Rattus norvegicus
tgacatgtacttaacgtgccctaag

SEQ ID NO: 606346 - DNA, 25 bp, Rattus norvegicus
tgacatgtactttacgtgccctaag

SEQ ID NO: 606347 - DNA, 25 bp, Rattus norvegicus
tgacatgtatgactacctgcacctg

SEQ ID NO: 606348 - DNA, 25 bp, Rattus norvegicus
tgacatgtatgagtacctgcacctg

SEQ ID NO: 606349 - DNA, 25 bp, Rattus norvegicus
tgacatgtcctcaggaaatccaaac

SEQ ID NO: 606350 - DNA, 25 bp, Rattus norvegicus
tgacatgtcctctggaaatccaaac

SEQ ID NO: 606351 - DNA, 25 bp, Rattus norvegicus
tgacatgtgagtagggtaccaccca

SEQ ID NO: 606352 - DNA, 25 bp, Rattus norvegicus
tgacatgtgagttgggtaccaccca

SEQ ID NO: 606353 - DNA, 25 bp, Rattus norvegicus
tgacatgtgcacagatacctaccga

SEQ ID NO: 606354 - DNA, 25 bp, Rattus norvegicus
tgacatgtgcactgatacctaccga

SEQ ID NO: 606355 - DNA, 25 bp, Rattus norvegicus
tgacatgtgcccagcctggagtctg

SEQ ID NO: 606356 - DNA, 25 bp, Rattus norvegicus
tgacatgtgccctgcctggagtctg

SEQ ID NO: 606357 - DNA, 25 bp, Rattus norvegicus
tgacatgtgtccactgaagctcgat

SEQ ID NO: 606358 - DNA, 25 bp, Rattus norvegicus
tgacatgtgtcctctgaagctcgat

SEQ ID NO: 606359 - DNA, 25 bp, Rattus norvegicus
tgacatgtgtctctgcttacttaat

SEQ ID NO: 606360 - DNA, 25 bp, Rattus norvegicus
tgacatgtgtctgtgcttacttaat

SEQ ID NO: 606361 - DNA, 25 bp, Rattus norvegicus
tgacatgttggccaaccctaggcgg

SEQ ID NO: 606362 - DNA, 25 bp, Rattus norvegicus
tgacatgttggcgaaccctaggcgg

SEQ ID NO: 606363 - DNA, 25 bp, Rattus norvegicus
tgacatgtttgaactctttttccca

SEQ ID NO: 606364 - DNA, 25 bp, Rattus norvegicus
tgacatgtttgatctctttttccca

SEQ ID NO: 606365 - DNA, 25 bp, Rattus norvegicus
tgacattaaagtcttgtgccaccac

SEQ ID NO: 606366 - DNA, 25 bp, Rattus norvegicus
tgacattaaagtgttgtgccaccac

SEQ ID NO: 606367 - DNA, 25 bp, Rattus norvegicus
tgacattaactaccaagaccagatc

SEQ ID NO: 606368 - DNA, 25 bp, Rattus norvegicus
tgacattaactagcaagaccagatc

SEQ ID NO: 606369 - DNA, 25 bp, Rattus norvegicus
tgacattacacgctgataacctgcc

SEQ ID NO: 606370 - DNA, 25 bp, Rattus norvegicus
tgacattacacggtgataacctgcc

SEQ ID NO: 606371 - DNA, 25 bp, Rattus norvegicus
tgacattagcttcttcttgccttgc

SEQ ID NO: 606372 - DNA, 25 bp, Rattus norvegicus
tgacattagcttgttcttgccttgc

SEQ ID NO: 606373 - DNA, 25 bp, Rattus norvegicus
tgacattcagcccatatagccttcc

SEQ ID NO: 606374 - DNA, 25 bp, Rattus norvegicus
tgacattcagccgatatagccttcc

SEQ ID NO: 606375 - DNA, 25 bp, Rattus norvegicus
tgacattccactagttgcccgaaat

SEQ ID NO: 606376 - DNA, 25 bp, Rattus norvegicus
tgacattccacttgttgcccgaaat

SEQ ID NO: 606377 - DNA, 25 bp, Rattus norvegicus
tgacattcgcacaggccggcatcaa

SEQ ID NO: 606378 - DNA, 25 bp, Rattus norvegicus
tgacattcgcactggccggcatcaa

SEQ ID NO: 606379 - DNA, 25 bp, Rattus norvegicus
tgacattcggaacgcaagtgggttt

SEQ ID NO: 606380 - DNA, 25 bp, Rattus norvegicus
tgacattcggaaggcaagtgggttt

SEQ ID NO: 606381 - DNA, 25 bp, Rattus norvegicus
tgacattctcccatgagtctgacag

SEQ ID NO: 606382 - DNA, 25 bp, Rattus norvegicus
tgacattctcccttgagtctgacag

SEQ ID NO: 606383 - DNA, 25 bp, Rattus norvegicus
tgacattctcctagggcacacgcat

SEQ ID NO: 606384 - DNA, 25 bp, Rattus norvegicus
tgacattctccttgggcacacgcat

SEQ ID NO: 606385 - DNA, 25 bp, Rattus norvegicus
tgacattgatgtccagctcagctct

SEQ ID NO: 606386 - DNA, 25 bp, Rattus norvegicus
tgacattgatgtgcagctcagctct

SEQ ID NO: 606387 - DNA, 25 bp, Rattus norvegicus
tgacattgcagtcttccgtcatctg

SEQ ID NO: 606388 - DNA, 25 bp, Rattus norvegicus
tgacattgcagtgttccgtcatctg

SEQ ID NO: 606389 - DNA, 25 bp, Rattus norvegicus
tgacattgtggccttcacggacggc

SEQ ID NO: 606390 - DNA, 25 bp, Rattus norvegicus
tgacattgtggcgttcacggacggc

SEQ ID NO: 606391 - DNA, 25 bp, Rattus norvegicus
tgacattgttccatgggttgtttcc

SEQ ID NO: 606392 - DNA, 25 bp, Rattus norvegicus
tgacattgttccttgggttgtttcc

SEQ ID NO: 606393 - DNA, 25 bp, Rattus norvegicus
tgacattgtttaacttggcccggga

SEQ ID NO: 606394 - DNA, 25 bp, Rattus norvegicus
tgacattgtttatcttggcccggga

SEQ ID NO: 606395 - DNA, 25 bp, Rattus norvegicus
tgacatttaaaaccccttggtatca

SEQ ID NO: 606396 - DNA, 25 bp, Rattus norvegicus
tgacatttaaaagcccttggtatca

SEQ ID NO: 606397 - DNA, 25 bp, Rattus norvegicus
tgacatttacaaccctcgagaactg

SEQ ID NO: 606398 - DNA, 25 bp, Rattus norvegicus
tgacatttacaagcctcgagaactg

SEQ ID NO: 606399 - DNA, 25 bp, Rattus norvegicus
tgacatttccaaagcacaccgtcgg

SEQ ID NO: 606400 - DNA, 25 bp, Rattus norvegicus
tgacatttccaatgcacaccgtcgg

SEQ ID NO: 606401 - DNA, 25 bp, Rattus norvegicus
tgacatttctccacaggtgacctgg

SEQ ID NO: 606402 - DNA, 25 bp, Rattus norvegicus
tgacatttctccctccaggtggagc

SEQ ID NO: 606403 - DNA, 25 bp, Rattus norvegicus
tgacatttctccgtccaggtggagc

SEQ ID NO: 606404 - DNA, 25 bp, Rattus norvegicus
tgacatttctcctcaggtgacctgg

SEQ ID NO: 606405 - DNA, 25 bp, Rattus norvegicus
tgacatttctgtatcctacgtagtg

SEQ ID NO: 606406 - DNA, 25 bp, Rattus norvegicus
tgacatttctgtttcctacgtagtg

SEQ ID NO: 606407 - DNA, 25 bp, Rattus norvegicus
tgacatttgaggactacccttctgg

SEQ ID NO: 606408 - DNA, 25 bp, Rattus norvegicus
tgacatttgaggtctacccttctgg

SEQ ID NO: 606409 - DNA, 25 bp, Rattus norvegicus
tgacatttggatccagggcgtgaac

SEQ ID NO: 606410 - DNA, 25 bp, Rattus norvegicus
tgacatttggatgcagggcgtgaac

SEQ ID NO: 606411 - DNA, 25 bp, Rattus norvegicus
tgacatttggctcctgaaagacagt

SEQ ID NO: 606412 - DNA, 25 bp, Rattus norvegicus
tgacatttggctgctgaaagacagt

SEQ ID NO: 606413 - DNA, 25 bp, Rattus norvegicus
tgacatttgggtcagctgcagacct

SEQ ID NO: 606414 - DNA, 25 bp, Rattus norvegicus
tgacatttgggtgagctgcagacct

SEQ ID NO: 606415 - DNA, 25 bp, Rattus norvegicus
tgacattttcacacacgtgttagag

SEQ ID NO: 606416 - DNA, 25 bp, Rattus norvegicus
tgacattttcactcacgtgttagag

SEQ ID NO: 606417 - DNA, 25 bp, Rattus norvegicus
tgacattttcttccgatggccacca

SEQ ID NO: 606418 - DNA, 25 bp, Rattus norvegicus
tgacattttcttgcgatggccacca

SEQ ID NO: 606419 - DNA, 25 bp, Rattus norvegicus
tgacattttgctagaggttgagctc

SEQ ID NO: 606420 - DNA, 25 bp, Rattus norvegicus
tgacattttgcttgaggttgagctc

SEQ ID NO: 606421 - DNA, 25 bp, Rattus norvegicus
tgaccaaacactcttaaccgttcca

SEQ ID NO: 606422 - DNA, 25 bp, Rattus norvegicus
tgaccaaacactgttaaccgttcca

SEQ ID NO: 606423 - DNA, 25 bp, Rattus norvegicus
tgaccaaacagtagttccctttcca

SEQ ID NO: 606424 - DNA, 25 bp, Rattus norvegicus
tgaccaaacagttgttccctttcca

SEQ ID NO: 606425 - DNA, 25 bp, Rattus norvegicus
tgaccaaacccgactctgagtgaga

SEQ ID NO: 606426 - DNA, 25 bp, Rattus norvegicus
tgaccaaacccgtctctgagtgaga

SEQ ID NO: 606427 - DNA, 25 bp, Rattus norvegicus
tgaccaaaccttacatagttgcccc

SEQ ID NO: 606428 - DNA, 25 bp, Rattus norvegicus
tgaccaaacctttcatagttgcccc

SEQ ID NO: 606429 - DNA, 25 bp, Rattus norvegicus
tgaccaaactgtcatcttgctccag

SEQ ID NO: 606430 - DNA, 25 bp, Rattus norvegicus
tgaccaaactgtgatcttgctccag

SEQ ID NO: 606431 - DNA, 25 bp, Rattus norvegicus
tgaccaaattcacttctcatcctct

SEQ ID NO: 606432 - DNA, 25 bp, Rattus norvegicus
tgaccaaattcagttctcatcctct

SEQ ID NO: 606433 - DNA, 25 bp, Rattus norvegicus
tgaccaaattgcatgtctacagttg

SEQ ID NO: 606434 - DNA, 25 bp, Rattus norvegicus
tgaccaaattgcttgtctacagttg

SEQ ID NO: 606435 - DNA, 25 bp, Rattus norvegicus
tgaccaacaccccattgatcaagat

SEQ ID NO: 606436 - DNA, 25 bp, Rattus norvegicus
tgaccaacacccgattgatcaagat

SEQ ID NO: 606437 - DNA, 25 bp, Rattus norvegicus
tgaccaacagtcataatctaaagga

SEQ ID NO: 606438 - DNA, 25 bp, Rattus norvegicus
tgaccaacagtcttaatctaaagga

SEQ ID NO: 606439 - DNA, 25 bp, Rattus norvegicus
tgaccaacatcacctgggatcagaa

SEQ ID NO: 606440 - DNA, 25 bp, Rattus norvegicus
tgaccaacatcagctgggatcagaa

SEQ ID NO: 606441 - DNA, 25 bp, Rattus norvegicus
tgaccaacatctacctactgcaaat

SEQ ID NO: 606442 - DNA, 25 bp, Rattus norvegicus
tgaccaacatcttcctactgcaaat

SEQ ID NO: 606443 - DNA, 25 bp, Rattus norvegicus
tgaccaacgcaaccactgttcctgg

SEQ ID NO: 606444 - DNA, 25 bp, Rattus norvegicus
tgaccaacgcaagcactgttcctgg

SEQ ID NO: 606445 - DNA, 25 bp, Rattus norvegicus
tgaccaactgggagtcccttgggaa

SEQ ID NO: 606446 - DNA, 25 bp, Rattus norvegicus
tgaccaactgggtgtcccttgggaa

SEQ ID NO: 606447 - DNA, 25 bp, Rattus norvegicus
tgaccaacttcgacatctaggcaat

SEQ ID NO: 606448 - DNA, 25 bp, Rattus norvegicus
tgaccaacttcgtcatctaggcaat

SEQ ID NO: 606449 - DNA, 25 bp, Rattus norvegicus
tgaccaagacacctggccgtggtat

SEQ ID NO: 606450 - DNA, 25 bp, Rattus norvegicus
tgaccaagacacgtggccgtggtat

SEQ ID NO: 606451 - DNA, 25 bp, Rattus norvegicus
tgaccaagacatctttctccgtttc

SEQ ID NO: 606452 - DNA, 25 bp, Rattus norvegicus
tgaccaagacatgtttctccgtttc

SEQ ID NO: 606453 - DNA, 25 bp, Rattus norvegicus
tgaccaagatgacttccctttcctt

SEQ ID NO: 606454 - DNA, 25 bp, Rattus norvegicus
tgaccaagatgagttccctttcctt

SEQ ID NO: 606455 - DNA, 25 bp, Rattus norvegicus
tgaccaagcacacctttgctacaaa

SEQ ID NO: 606456 - DNA, 25 bp, Rattus norvegicus
tgaccaagcacagctttgctacaaa

SEQ ID NO: 606457 - DNA, 25 bp, Rattus norvegicus
tgaccaagcagtatagccaatctat

SEQ ID NO: 606458 - DNA, 25 bp, Rattus norvegicus
tgaccaagcagtttagccaatctat

SEQ ID NO: 606459 - DNA, 25 bp, Rattus norvegicus
tgaccaagccacacccgggttctat

SEQ ID NO: 606460 - DNA, 25 bp, Rattus norvegicus
tgaccaagccactcccgggttctat

SEQ ID NO: 606461 - DNA, 25 bp, Rattus norvegicus
tgaccaagccttacttctggatggg

SEQ ID NO: 606462 - DNA, 25 bp, Rattus norvegicus
tgaccaagcctttcttctggatggg

SEQ ID NO: 606463 - DNA, 25 bp, Rattus norvegicus
tgaccaagcgaaagcaggacccctt

SEQ ID NO: 606464 - DNA, 25 bp, Rattus norvegicus
tgaccaagcgaatgcaggacccctt

SEQ ID NO: 606465 - DNA, 25 bp, Rattus norvegicus
tgaccaagcgccatcttgttcagaa

SEQ ID NO: 606466 - DNA, 25 bp, Rattus norvegicus
tgaccaagcgccttcttgttcagaa

SEQ ID NO: 606467 - DNA, 25 bp, Rattus norvegicus
tgaccaaggcctaacaagaaaccca

SEQ ID NO: 606468 - DNA, 25 bp, Rattus norvegicus
tgaccaaggccttacaagaaaccca

SEQ ID NO: 606469 - DNA, 25 bp, Rattus norvegicus
tgaccaaggtcaacgtgtccatcac

SEQ ID NO: 606470 - DNA, 25 bp, Rattus norvegicus
tgaccaaggtcatcgtgtccatcac

SEQ ID NO: 606471 - DNA, 25 bp, Rattus norvegicus
tgaccaaggtctcttccacactgga

SEQ ID NO: 606472 - DNA, 25 bp, Rattus norvegicus
tgaccaaggtctgttccacactgga

SEQ ID NO: 606473 - DNA, 25 bp, Rattus norvegicus
tgaccaagtaatccagtccctcata

SEQ ID NO: 606474 - DNA, 25 bp, Rattus norvegicus
tgaccaagtaatgcagtccctcata

SEQ ID NO: 606475 - DNA, 25 bp, Rattus norvegicus
tgaccaagtacgagcgagcccgagt

SEQ ID NO: 606476 - DNA, 25 bp, Rattus norvegicus
tgaccaagtacgtgcgagcccgagt

SEQ ID NO: 606477 - DNA, 25 bp, Rattus norvegicus
tgaccaagttccactcaggctggga

SEQ ID NO: 606478 - DNA, 25 bp, Rattus norvegicus
tgaccaagttcctctcaggctggga

SEQ ID NO: 606479 - DNA, 25 bp, Rattus norvegicus
tgaccaagttctcgcgttcttaaga

SEQ ID NO: 606480 - DNA, 25 bp, Rattus norvegicus
tgaccaagttctggcgttcttaaga

SEQ ID NO: 606481 - DNA, 25 bp, Rattus norvegicus
tgaccaatacaaaaccagagccatc

SEQ ID NO: 606482 - DNA, 25 bp, Rattus norvegicus
tgaccaatacaataccagagccatc

SEQ ID NO: 606483 - DNA, 25 bp, Rattus norvegicus
tgaccaatcacacctgacctagtag

SEQ ID NO: 606484 - DNA, 25 bp, Rattus norvegicus
tgaccaatcacagctgacctagtag

SEQ ID NO: 606485 - DNA, 25 bp, Rattus norvegicus
tgaccaatcatgctgcagctccaat

SEQ ID NO: 606486 - DNA, 25 bp, Rattus norvegicus
tgaccaatcatggtgcagctccaat

SEQ ID NO: 606487 - DNA, 25 bp, Rattus norvegicus
tgaccaatcctcagtggctggctgt

SEQ ID NO: 606488 - DNA, 25 bp, Rattus norvegicus
tgaccaatcctctgtggctggctgt

SEQ ID NO: 606489 - DNA, 25 bp, Rattus norvegicus
tgaccaatcttgattcaccctatac

SEQ ID NO: 606490 - DNA, 25 bp, Rattus norvegicus
tgaccaatcttgtttcaccctatac

SEQ ID NO: 606491 - DNA, 25 bp, Rattus norvegicus
tgaccaatgctgcaagccacctcga

SEQ ID NO: 606492 - DNA, 25 bp, Rattus norvegicus
tgaccaatgctggaagccacctcga

SEQ ID NO: 606493 - DNA, 25 bp, Rattus norvegicus
tgaccaatggtccagctcttcaccg

SEQ ID NO: 606494 - DNA, 25 bp, Rattus norvegicus
tgaccaatggtcgagctcttcaccg

SEQ ID NO: 606495 - DNA, 25 bp, Rattus norvegicus
tgaccaattgcgctgtatttttaac

SEQ ID NO: 606496 - DNA, 25 bp, Rattus norvegicus
tgaccaattgcggtgtatttttaac

SEQ ID NO: 606497 - DNA, 25 bp, Rattus norvegicus
tgaccacaaacccagccccattagg

SEQ ID NO: 606498 - DNA, 25 bp, Rattus norvegicus
tgaccacaaaccgagccccattagg

SEQ ID NO: 606499 - DNA, 25 bp, Rattus norvegicus
tgaccacaacccatctgcaataaag

SEQ ID NO: 606500 - DNA, 25 bp, Rattus norvegicus
tgaccacaacccttctgcaataaag

SEQ ID NO: 606501 - DNA, 25 bp, Rattus norvegicus
tgaccacaactactgctggcactct

SEQ ID NO: 606502 - DNA, 25 bp, Rattus norvegicus
tgaccacaactagtgctggcactct

SEQ ID NO: 606503 - DNA, 25 bp, Rattus norvegicus
tgaccacaagctccctggcaaatgt

SEQ ID NO: 606504 - DNA, 25 bp, Rattus norvegicus
tgaccacaagctgcctggcaaatgt

SEQ ID NO: 606505 - DNA, 25 bp, Rattus norvegicus
tgaccacaaggacctcctggttctt

SEQ ID NO: 606506 - DNA, 25 bp, Rattus norvegicus
tgaccacaaggagctcctggttctt

SEQ ID NO: 606507 - DNA, 25 bp, Rattus norvegicus
tgaccacacacactagctgctgctg

SEQ ID NO: 606508 - DNA, 25 bp, Rattus norvegicus
tgaccacacacagtagctgctgctg

SEQ ID NO: 606509 - DNA, 25 bp, Rattus norvegicus
tgaccacactgaacccttgaattca

SEQ ID NO: 606510 - DNA, 25 bp, Rattus norvegicus
tgaccacactgatcccttgaattca

SEQ ID NO: 606511 - DNA, 25 bp, Rattus norvegicus
tgaccacactggagatgcagtcttt

SEQ ID NO: 606512 - DNA, 25 bp, Rattus norvegicus
tgaccacactggtgatgcagtcttt

SEQ ID NO: 606513 - DNA, 25 bp, Rattus norvegicus
tgaccacactgtagagacactccat

SEQ ID NO: 606514 - DNA, 25 bp, Rattus norvegicus
tgaccacactgttgagacactccat

SEQ ID NO: 606515 - DNA, 25 bp, Rattus norvegicus
tgaccacagagccttgtgacctttg

SEQ ID NO: 606516 - DNA, 25 bp, Rattus norvegicus
tgaccacagagcgttgtgacctttg

SEQ ID NO: 606517 - DNA, 25 bp, Rattus norvegicus
tgaccacagatcctgtagggctgaa

SEQ ID NO: 606518 - DNA, 25 bp, Rattus norvegicus
tgaccacagatcgtgtagggctgaa

SEQ ID NO: 606519 - DNA, 25 bp, Rattus norvegicus
tgaccacagcacactcagcagaaat

SEQ ID NO: 606520 - DNA, 25 bp, Rattus norvegicus
tgaccacagcactctcagcagaaat

SEQ ID NO: 606521 - DNA, 25 bp, Rattus norvegicus
tgaccacaggcaccgagatcacagt

SEQ ID NO: 606522 - DNA, 25 bp, Rattus norvegicus
tgaccacaggcagcgagatcacagt

SEQ ID NO: 606523 - DNA, 25 bp, Rattus norvegicus
tgaccacagggacagtctccttgaa

SEQ ID NO: 606524 - DNA, 25 bp, Rattus norvegicus
tgaccacagggagagtctccttgaa

SEQ ID NO: 606525 - DNA, 25 bp, Rattus norvegicus
tgaccacagtccatgccatcactgc

SEQ ID NO: 606526 - DNA, 25 bp, Rattus norvegicus
tgaccacagtccttgccatcactgc

SEQ ID NO: 606527 - DNA, 25 bp, Rattus norvegicus
tgaccacagtcgaaacacagctctt

SEQ ID NO: 606528 - DNA, 25 bp, Rattus norvegicus
tgaccacagtcgtaacacagctctt

SEQ ID NO: 606529 - DNA, 25 bp, Rattus norvegicus
tgaccacagtgccatctttaagagt

SEQ ID NO: 606530 - DNA, 25 bp, Rattus norvegicus
tgaccacagtgcgatctttaagagt

SEQ ID NO: 606531 - DNA, 25 bp, Rattus norvegicus
tgaccacagtggctatgctggagaa

SEQ ID NO: 606532 - DNA, 25 bp, Rattus norvegicus
tgaccacagtgggtatgctggagaa

SEQ ID NO: 606533 - DNA, 25 bp, Rattus norvegicus
tgaccacatacaaccaaactgctat

SEQ ID NO: 606534 - DNA, 25 bp, Rattus norvegicus
tgaccacatacatccaaactgctat

SEQ ID NO: 606535 - DNA, 25 bp, Rattus norvegicus
tgaccacatgccacagctgtgggaa

SEQ ID NO: 606536 - DNA, 25 bp, Rattus norvegicus
tgaccacatgcctcagctgtgggaa

SEQ ID NO: 606537 - DNA, 25 bp, Rattus norvegicus
tgaccacatggccattcacagctgt

SEQ ID NO: 606538 - DNA, 25 bp, Rattus norvegicus
tgaccacatggcgattcacagctgt

SEQ ID NO: 606539 - DNA, 25 bp, Rattus norvegicus
tgaccaccaacaacgtcctgttata

SEQ ID NO: 606540 - DNA, 25 bp, Rattus norvegicus
tgaccaccaacatcgtcctgttata

SEQ ID NO: 606541 - DNA, 25 bp, Rattus norvegicus
tgaccaccaaggacagctcacgact

SEQ ID NO: 606542 - DNA, 25 bp, Rattus norvegicus
tgaccaccaaggtcagctcacgact

SEQ ID NO: 606543 - DNA, 25 bp, Rattus norvegicus
tgaccaccaagtcccactgtaataa

SEQ ID NO: 606544 - DNA, 25 bp, Rattus norvegicus
tgaccaccaagtgccactgtaataa

SEQ ID NO: 606545 - DNA, 25 bp, Rattus norvegicus
tgaccaccacagatgtatttctatg

SEQ ID NO: 606546 - DNA, 25 bp, Rattus norvegicus
tgaccaccacagttgtatttctatg

SEQ ID NO: 606547 - DNA, 25 bp, Rattus norvegicus
tgaccaccacctactacagtgagga

SEQ ID NO: 606548 - DNA, 25 bp, Rattus norvegicus
tgaccaccaccttctacagtgagga

SEQ ID NO: 606549 - DNA, 25 bp, Rattus norvegicus
tgaccaccatcgcttgttagttgcc

SEQ ID NO: 606550 - DNA, 25 bp, Rattus norvegicus
tgaccaccatcggttgttagttgcc

SEQ ID NO: 606551 - DNA, 25 bp, Rattus norvegicus
tgaccaccatgtattcccatatttg

SEQ ID NO: 606552 - DNA, 25 bp, Rattus norvegicus
tgaccaccatgttttcccatatttg

SEQ ID NO: 606553 - DNA, 25 bp, Rattus norvegicus
tgaccaccatttataactcatccac

SEQ ID NO: 606554 - DNA, 25 bp, Rattus norvegicus
tgaccaccatttttaactcatccac

SEQ ID NO: 606555 - DNA, 25 bp, Rattus norvegicus
tgaccaccctcacatttggtaatga

SEQ ID NO: 606556 - DNA, 25 bp, Rattus norvegicus
tgaccaccctcagatttggtaatga

SEQ ID NO: 606557 - DNA, 25 bp, Rattus norvegicus
tgaccaccgtagaacttccatctgg

SEQ ID NO: 606558 - DNA, 25 bp, Rattus norvegicus
tgaccaccgtagtacttccatctgg

SEQ ID NO: 606559 - DNA, 25 bp, Rattus norvegicus
tgaccacctaacactctggtttgat

SEQ ID NO: 606560 - DNA, 25 bp, Rattus norvegicus
tgaccacctaactctctggtttgat

SEQ ID NO: 606561 - DNA, 25 bp, Rattus norvegicus
tgaccacctatcaagagtttccatc

SEQ ID NO: 606562 - DNA, 25 bp, Rattus norvegicus
tgaccacctatctagagtttccatc

SEQ ID NO: 606563 - DNA, 25 bp, Rattus norvegicus
tgaccacctgccaactgtggcatga

SEQ ID NO: 606564 - DNA, 25 bp, Rattus norvegicus
tgaccacctgccatcatatataggg

SEQ ID NO: 606565 - DNA, 25 bp, Rattus norvegicus
tgaccacctgcctactgtggcatga

SEQ ID NO: 606566 - DNA, 25 bp, Rattus norvegicus
tgaccacctgccttcatatataggg

SEQ ID NO: 606567 - DNA, 25 bp, Rattus norvegicus
tgaccacctggaccacatcaagaag

SEQ ID NO: 606568 - DNA, 25 bp, Rattus norvegicus
tgaccacctggagcacatcaagaag

SEQ ID NO: 606569 - DNA, 25 bp, Rattus norvegicus
tgaccacctttgacttatgcaatga

SEQ ID NO: 606570 - DNA, 25 bp, Rattus norvegicus
tgaccacctttgtcttatgcaatga

SEQ ID NO: 606571 - DNA, 25 bp, Rattus norvegicus
tgaccacgagttcatgcagcagcca

SEQ ID NO: 606572 - DNA, 25 bp, Rattus norvegicus
tgaccacgagttgatgcagcagcca

SEQ ID NO: 606573 - DNA, 25 bp, Rattus norvegicus
tgaccacgatggagacggcttcatt

SEQ ID NO: 606574 - DNA, 25 bp, Rattus norvegicus
tgaccacgatggtgacggcttcatt

SEQ ID NO: 606575 - DNA, 25 bp, Rattus norvegicus
tgaccacgcccaattgtaaacagtt

SEQ ID NO: 606576 - DNA, 25 bp, Rattus norvegicus
tgaccacgcccatttgtaaacagtt

SEQ ID NO: 606577 - DNA, 25 bp, Rattus norvegicus
tgaccacgctgcaggaccctgcatt

SEQ ID NO: 606578 - DNA, 25 bp, Rattus norvegicus
tgaccacgctgctggaccctgcatt

SEQ ID NO: 606579 - DNA, 25 bp, Rattus norvegicus
tgaccacggcccattgaagccatgg

SEQ ID NO: 606580 - DNA, 25 bp, Rattus norvegicus
tgaccacggccctttgaagccatgg

SEQ ID NO: 606581 - DNA, 25 bp, Rattus norvegicus
tgaccacgtgagaaagattatctta

SEQ ID NO: 606582 - DNA, 25 bp, Rattus norvegicus
tgaccacgtgagtaagattatctta

SEQ ID NO: 606583 - DNA, 25 bp, Rattus norvegicus
tgaccactaacaagcttttcttcgc

SEQ ID NO: 606584 - DNA, 25 bp, Rattus norvegicus
tgaccactaacatgcttttcttcgc

SEQ ID NO: 606585 - DNA, 25 bp, Rattus norvegicus
tgaccactaggacgacgctgagcct

SEQ ID NO: 606586 - DNA, 25 bp, Rattus norvegicus
tgaccactaggaggacgctgagcct

SEQ ID NO: 606587 - DNA, 25 bp, Rattus norvegicus
tgaccactcaggatcacgaaggttt

SEQ ID NO: 606588 - DNA, 25 bp, Rattus norvegicus
tgaccactcaggttcacgaaggttt

SEQ ID NO: 606589 - DNA, 25 bp, Rattus norvegicus
tgaccactctgtaccttttttgaat

SEQ ID NO: 606590 - DNA, 25 bp, Rattus norvegicus
tgaccactctgttccttttttgaat

SEQ ID NO: 606591 - DNA, 25 bp, Rattus norvegicus
tgaccactcttaatcaatctacaga

SEQ ID NO: 606592 - DNA, 25 bp, Rattus norvegicus
tgaccactcttattcaatctacaga

SEQ ID NO: 606593 - DNA, 25 bp, Rattus norvegicus
tgaccactgctacaatcaggccaag

SEQ ID NO: 606594 - DNA, 25 bp, Rattus norvegicus
tgaccactgctagaatcaggccaag

SEQ ID NO: 606595 - DNA, 25 bp, Rattus norvegicus
tgaccactggagcaatagaaactgt

SEQ ID NO: 606596 - DNA, 25 bp, Rattus norvegicus
tgaccactggaggaatagaaactgt

SEQ ID NO: 606597 - DNA, 25 bp, Rattus norvegicus
tgaccactggccatagcggctgaac

SEQ ID NO: 606598 - DNA, 25 bp, Rattus norvegicus
tgaccactggccttagcggctgaac

SEQ ID NO: 606599 - DNA, 25 bp, Rattus norvegicus
tgaccactgttgacatccgatcatg

SEQ ID NO: 606600 - DNA, 25 bp, Rattus norvegicus
tgaccactgttgtcatccgatcatg

SEQ ID NO: 606601 - DNA, 25 bp, Rattus norvegicus
tgaccacttagtccacattcatagt

SEQ ID NO: 606602 - DNA, 25 bp, Rattus norvegicus
tgaccacttagtgcacattcatagt

SEQ ID NO: 606603 - DNA, 25 bp, Rattus norvegicus
tgaccacttattagcattctccatg

SEQ ID NO: 606604 - DNA, 25 bp, Rattus norvegicus
tgaccacttatttgcattctccatg

SEQ ID NO: 606605 - DNA, 25 bp, Rattus norvegicus
tgaccacttcctaagcaatttgctg

SEQ ID NO: 606606 - DNA, 25 bp, Rattus norvegicus
tgaccacttcctatcagatcctcag

SEQ ID NO: 606607 - DNA, 25 bp, Rattus norvegicus
tgaccacttccttagcaatttgctg

SEQ ID NO: 606608 - DNA, 25 bp, Rattus norvegicus
tgaccacttcctttcagatcctcag

SEQ ID NO: 606609 - DNA, 25 bp, Rattus norvegicus
tgaccacttgctcatttcaattatc

SEQ ID NO: 606610 - DNA, 25 bp, Rattus norvegicus
tgaccacttgctgatttcaattatc

SEQ ID NO: 606611 - DNA, 25 bp, Rattus norvegicus
tgaccagaacccctaaatgtgattg

SEQ ID NO: 606612 - DNA, 25 bp, Rattus norvegicus
tgaccagaacccgtaaatgtgattg

SEQ ID NO: 606613 - DNA, 25 bp, Rattus norvegicus
tgaccagaagagcttgatccctgtg

SEQ ID NO: 606614 - DNA, 25 bp, Rattus norvegicus
tgaccagaagaggttgatccctgtg

SEQ ID NO: 606615 - DNA, 25 bp, Rattus norvegicus
tgaccagaccccagatgctaacatt

SEQ ID NO: 606616 - DNA, 25 bp, Rattus norvegicus
tgaccagacccctgatgctaacatt

SEQ ID NO: 606617 - DNA, 25 bp, Rattus norvegicus
tgaccagacgtcagcacaacaacaa

SEQ ID NO: 606618 - DNA, 25 bp, Rattus norvegicus
tgaccagacgtctgcacaacaacaa

SEQ ID NO: 606619 - DNA, 25 bp, Rattus norvegicus
tgaccagactttcatgctgttctct

SEQ ID NO: 606620 - DNA, 25 bp, Rattus norvegicus
tgaccagactttgatgctgttctct

SEQ ID NO: 606621 - DNA, 25 bp, Rattus norvegicus
tgaccagagacaagcatgcggctgt

SEQ ID NO: 606622 - DNA, 25 bp, Rattus norvegicus
tgaccagagacatgcatgcggctgt

SEQ ID NO: 606623 - DNA, 25 bp, Rattus norvegicus
tgaccagagctgattctaagagctt

SEQ ID NO: 606624 - DNA, 25 bp, Rattus norvegicus
tgaccagagctgtttctaagagctt

SEQ ID NO: 606625 - DNA, 25 bp, Rattus norvegicus
tgaccagaggacaccccaggacttg

SEQ ID NO: 606626 - DNA, 25 bp, Rattus norvegicus
tgaccagaggactccccaggacttg

SEQ ID NO: 606627 - DNA, 25 bp, Rattus norvegicus
tgaccagatacacttgccacacaag

SEQ ID NO: 606628 - DNA, 25 bp, Rattus norvegicus
tgaccagatacagttgccacacaag

SEQ ID NO: 606629 - DNA, 25 bp, Rattus norvegicus
tgaccagcaggacacaggcacgcag

SEQ ID NO: 606630 - DNA, 25 bp, Rattus norvegicus
tgaccagcaggagacaggcacgcag

SEQ ID NO: 606631 - DNA, 25 bp, Rattus norvegicus
tgaccagcaggcatgttactgtcaa

SEQ ID NO: 606632 - DNA, 25 bp, Rattus norvegicus
tgaccagcaggcttgttactgtcaa

SEQ ID NO: 606633 - DNA, 25 bp, Rattus norvegicus
tgaccagcatgtcgaacgtcgccca

SEQ ID NO: 606634 - DNA, 25 bp, Rattus norvegicus
tgaccagcatgtggaacgtcgccca

SEQ ID NO: 606635 - DNA, 25 bp, Rattus norvegicus
tgaccagccatgctctggactgtga

SEQ ID NO: 606636 - DNA, 25 bp, Rattus norvegicus
tgaccagccatggtctggactgtga

SEQ ID NO: 606637 - DNA, 25 bp, Rattus norvegicus
tgaccagcccttaggagccgagaat

SEQ ID NO: 606638 - DNA, 25 bp, Rattus norvegicus
tgaccagccctttggagccgagaat

SEQ ID NO: 606639 - DNA, 25 bp, Rattus norvegicus
tgaccagcctgcatagttacgcata

SEQ ID NO: 606640 - DNA, 25 bp, Rattus norvegicus
tgaccagcctgcttagttacgcata

SEQ ID NO: 606641 - DNA, 25 bp, Rattus norvegicus
tgaccagccttgagcgcctagaggt

SEQ ID NO: 606642 - DNA, 25 bp, Rattus norvegicus
tgaccagccttgtgcgcctagaggt

SEQ ID NO: 606643 - DNA, 25 bp, Rattus norvegicus
tgaccagctaatcctcttggaacgg

SEQ ID NO: 606644 - DNA, 25 bp, Rattus norvegicus
tgaccagctaatgctcttggaacgg

SEQ ID NO: 606645 - DNA, 25 bp, Rattus norvegicus
tgaccagctcagattcagctttggt

SEQ ID NO: 606646 - DNA, 25 bp, Rattus norvegicus
tgaccagctcagtttcagctttggt

SEQ ID NO: 606647 - DNA, 25 bp, Rattus norvegicus
tgaccagctccacgttccgtgagag

SEQ ID NO: 606648 - DNA, 25 bp, Rattus norvegicus
tgaccagctccaggttccgtgagag

SEQ ID NO: 606649 - DNA, 25 bp, Rattus norvegicus
tgaccagctcttcaggatcttcaga

SEQ ID NO: 606650 - DNA, 25 bp, Rattus norvegicus
tgaccagctcttgaggatcttcaga

SEQ ID NO: 606651 - DNA, 25 bp, Rattus norvegicus
tgaccaggaagaactccaccacgat

SEQ ID NO: 606652 - DNA, 25 bp, Rattus norvegicus
tgaccaggaagatctccaccacgat

SEQ ID NO: 606653 - DNA, 25 bp, Rattus norvegicus
tgaccaggaatcaagctcactcttc

SEQ ID NO: 606654 - DNA, 25 bp, Rattus norvegicus
tgaccaggaatctagctcactcttc

SEQ ID NO: 606655 - DNA, 25 bp, Rattus norvegicus
tgaccaggagccaggtgttccttga

SEQ ID NO: 606656 - DNA, 25 bp, Rattus norvegicus
tgaccaggagcctggtgttccttga

SEQ ID NO: 606657 - DNA, 25 bp, Rattus norvegicus
tgaccaggccccattatactcttag

SEQ ID NO: 606658 - DNA, 25 bp, Rattus norvegicus
tgaccaggcccctttatactcttag

SEQ ID NO: 606659 - DNA, 25 bp, Rattus norvegicus
tgaccaggcctaaaaaggagacctc

SEQ ID NO: 606660 - DNA, 25 bp, Rattus norvegicus
tgaccaggcctataaaggagacctc

SEQ ID NO: 606661 - DNA, 25 bp, Rattus norvegicus
tgaccaggccttatctgatctgcat

SEQ ID NO: 606662 - DNA, 25 bp, Rattus norvegicus
tgaccaggccttttctgatctgcat

SEQ ID NO: 606663 - DNA, 25 bp, Rattus norvegicus
tgaccagggccacttcatgcttctg

SEQ ID NO: 606664 - DNA, 25 bp, Rattus norvegicus
tgaccagggccagttcatgcttctg

SEQ ID NO: 606665 - DNA, 25 bp, Rattus norvegicus
tgaccaggtagacccaacttaattt

SEQ ID NO: 606666 - DNA, 25 bp, Rattus norvegicus
tgaccaggtagagccaacttaattt

SEQ ID NO: 606667 - DNA, 25 bp, Rattus norvegicus
tgaccaggtcatcgtcatccaactg

SEQ ID NO: 606668 - DNA, 25 bp, Rattus norvegicus
tgaccaggtcatggtcatccaactg

SEQ ID NO: 606669 - DNA, 25 bp, Rattus norvegicus
tgaccagtaactcccttcttccatg

SEQ ID NO: 606670 - DNA, 25 bp, Rattus norvegicus
tgaccagtaactgccttcttccatg

SEQ ID NO: 606671 - DNA, 25 bp, Rattus norvegicus
tgaccagtaattccggctgcttggg

SEQ ID NO: 606672 - DNA, 25 bp, Rattus norvegicus
tgaccagtaattgcggctgcttggg

SEQ ID NO: 606673 - DNA, 25 bp, Rattus norvegicus
tgaccagtaccacatttttgagccc

SEQ ID NO: 606674 - DNA, 25 bp, Rattus norvegicus
tgaccagtaccagatttttgagccc

SEQ ID NO: 606675 - DNA, 25 bp, Rattus norvegicus
tgaccagtatcactaggtttccact

SEQ ID NO: 606676 - DNA, 25 bp, Rattus norvegicus
tgaccagtatcagtaggtttccact

SEQ ID NO: 606677 - DNA, 25 bp, Rattus norvegicus
tgaccagtgaaacaggatcaacctt

SEQ ID NO: 606678 - DNA, 25 bp, Rattus norvegicus
tgaccagtgaaagaggatcaacctt

SEQ ID NO: 606679 - DNA, 25 bp, Rattus norvegicus
tgaccagtgacaatcttatttgggt

SEQ ID NO: 606680 - DNA, 25 bp, Rattus norvegicus
tgaccagtgacattcttatttgggt

SEQ ID NO: 606681 - DNA, 25 bp, Rattus norvegicus
tgaccagtgacgatttcagcctctg

SEQ ID NO: 606682 - DNA, 25 bp, Rattus norvegicus
tgaccagtgacgttttcagcctctg

SEQ ID NO: 606683 - DNA, 25 bp, Rattus norvegicus
tgaccagtgagcaccatgttagctt

SEQ ID NO: 606684 - DNA, 25 bp, Rattus norvegicus
tgaccagtgagctccatgttagctt

SEQ ID NO: 606685 - DNA, 25 bp, Rattus norvegicus
tgaccagtgcccagacagcgatgga

SEQ ID NO: 606686 - DNA, 25 bp, Rattus norvegicus
tgaccagtgccctgacagcgatgga

SEQ ID NO: 606687 - DNA, 25 bp, Rattus norvegicus
tgaccagtgtccacagccaaggaaa

SEQ ID NO: 606688 - DNA, 25 bp, Rattus norvegicus
tgaccagtgtcctcagccaaggaaa

SEQ ID NO: 606689 - DNA, 25 bp, Rattus norvegicus
tgaccagtgtctctgccttttggac

SEQ ID NO: 606690 - DNA, 25 bp, Rattus norvegicus
tgaccagtgtctgtgccttttggac

SEQ ID NO: 606691 - DNA, 25 bp, Rattus norvegicus
tgaccagtttatacagcttcctgtt

SEQ ID NO: 606692 - DNA, 25 bp, Rattus norvegicus
tgaccagtttattcagcttcctgtt

SEQ ID NO: 606693 - DNA, 25 bp, Rattus norvegicus
tgaccagttttcacttaaagccatt

SEQ ID NO: 606694 - DNA, 25 bp, Rattus norvegicus
tgaccagttttctcttaaagccatt

SEQ ID NO: 606695 - DNA, 25 bp, Rattus norvegicus
tgaccatacagcctggtgttcctca

SEQ ID NO: 606696 - DNA, 25 bp, Rattus norvegicus
tgaccatacagcgtggtgttcctca

SEQ ID NO: 606697 - DNA, 25 bp, Rattus norvegicus
tgaccatatgccagaccgctaaggg

SEQ ID NO: 606698 - DNA, 25 bp, Rattus norvegicus
tgaccatatgcctgaccgctaaggg

SEQ ID NO: 606699 - DNA, 25 bp, Rattus norvegicus
tgaccatattggagcgctgctggca

SEQ ID NO: 606700 - DNA, 25 bp, Rattus norvegicus
tgaccatattggtgcgctgctggca

SEQ ID NO: 606701 - DNA, 25 bp, Rattus norvegicus
tgaccatcaaccacatccttaggag

SEQ ID NO: 606702 - DNA, 25 bp, Rattus norvegicus
tgaccatcaacctcatccttaggag

SEQ ID NO: 606703 - DNA, 25 bp, Rattus norvegicus
tgaccatcaagtccctgctgatcca

SEQ ID NO: 606704 - DNA, 25 bp, Rattus norvegicus
tgaccatcaagtgcctgctgatcca

SEQ ID NO: 606705 - DNA, 25 bp, Rattus norvegicus
tgaccatcacttaagccaggcagtt

SEQ ID NO: 606706 - DNA, 25 bp, Rattus norvegicus
tgaccatcactttagccaggcagtt

SEQ ID NO: 606707 - DNA, 25 bp, Rattus norvegicus
tgaccatcatcaagaaggcctgcct

SEQ ID NO: 606708 - DNA, 25 bp, Rattus norvegicus
tgaccatcatcatgaaggcctgcct

SEQ ID NO: 606709 - DNA, 25 bp, Rattus norvegicus
tgaccatccaatcccattgactcaa

SEQ ID NO: 606710 - DNA, 25 bp, Rattus norvegicus
tgaccatccaatgccattgactcaa

SEQ ID NO: 606711 - DNA, 25 bp, Rattus norvegicus
tgaccatccatcatgcagtgggtgg

SEQ ID NO: 606712 - DNA, 25 bp, Rattus norvegicus
tgaccatccatcttgcagtgggtgg

SEQ ID NO: 606713 - DNA, 25 bp, Rattus norvegicus
tgaccatcgccaatcctggaattga

SEQ ID NO: 606714 - DNA, 25 bp, Rattus norvegicus
tgaccatcgccattcctggaattga

SEQ ID NO: 606715 - DNA, 25 bp, Rattus norvegicus
tgaccatcggtgatcaaaactccct

SEQ ID NO: 606716 - DNA, 25 bp, Rattus norvegicus
tgaccatcggtgttcaaaactccct

SEQ ID NO: 606717 - DNA, 25 bp, Rattus norvegicus
tgaccatctggaccacgtgtccagg

SEQ ID NO: 606718 - DNA, 25 bp, Rattus norvegicus
tgaccatctggagcacgtgtccagg

SEQ ID NO: 606719 - DNA, 25 bp, Rattus norvegicus
tgaccatctttactgtctttgcctg

SEQ ID NO: 606720 - DNA, 25 bp, Rattus norvegicus
tgaccatctttagtgtctttgcctg

SEQ ID NO: 606721 - DNA, 25 bp, Rattus norvegicus
tgaccatgacacatcccattattgt

SEQ ID NO: 606722 - DNA, 25 bp, Rattus norvegicus
tgaccatgacacttcccattattgt

SEQ ID NO: 606723 - DNA, 25 bp, Rattus norvegicus
tgaccatgacccacgggaagctggt

SEQ ID NO: 606724 - DNA, 25 bp, Rattus norvegicus
tgaccatgaccctcgggaagctggt

SEQ ID NO: 606725 - DNA, 25 bp, Rattus norvegicus
tgaccatgataaccactgccacttt

SEQ ID NO: 606726 - DNA, 25 bp, Rattus norvegicus
tgaccatgataagcactgccacttt

SEQ ID NO: 606727 - DNA, 25 bp, Rattus norvegicus
tgaccatgatctcctccgaaaccga

SEQ ID NO: 606728 - DNA, 25 bp, Rattus norvegicus
tgaccatgatctgctccgaaaccga

SEQ ID NO: 606729 - DNA, 25 bp, Rattus norvegicus
tgaccatgcatacaacacacagctc

SEQ ID NO: 606730 - DNA, 25 bp, Rattus norvegicus
tgaccatgcatagaacacacagctc

SEQ ID NO: 606731 - DNA, 25 bp, Rattus norvegicus
tgaccatgcccgatggacagcaagt

SEQ ID NO: 606732 - DNA, 25 bp, Rattus norvegicus
tgaccatgcccgttggacagcaagt

SEQ ID NO: 606733 - DNA, 25 bp, Rattus norvegicus
tgaccatgctgacccaggcagtgca

SEQ ID NO: 606734 - DNA, 25 bp, Rattus norvegicus
tgaccatgctgagccaggcagtgca

SEQ ID NO: 606735 - DNA, 25 bp, Rattus norvegicus
tgaccatggactagctgtcatttga

SEQ ID NO: 606736 - DNA, 25 bp, Rattus norvegicus
tgaccatggacttgctgtcatttga

SEQ ID NO: 606737 - DNA, 25 bp, Rattus norvegicus
tgaccatggcacacgatggctgtga

SEQ ID NO: 606738 - DNA, 25 bp, Rattus norvegicus
tgaccatggcactcgatggctgtga

SEQ ID NO: 606739 - DNA, 25 bp, Rattus norvegicus
tgaccatggtcacctccgtgggagt

SEQ ID NO: 606740 - DNA, 25 bp, Rattus norvegicus
tgaccatggtcagctccgtgggagt

SEQ ID NO: 606741 - DNA, 25 bp, Rattus norvegicus
tgaccattagcgcaatagcaattag

SEQ ID NO: 606742 - DNA, 25 bp, Rattus norvegicus
tgaccattagcggaatagcaattag

SEQ ID NO: 606743 - DNA, 25 bp, Rattus norvegicus
tgaccattatcacaggccttcattt

SEQ ID NO: 606744 - DNA, 25 bp, Rattus norvegicus
tgaccattatcagaggccttcattt

SEQ ID NO: 606745 - DNA, 25 bp, Rattus norvegicus
tgaccattccttccacaagatggct

SEQ ID NO: 606746 - DNA, 25 bp, Rattus norvegicus
tgaccattccttgcacaagatggct

SEQ ID NO: 606747 - DNA, 25 bp, Rattus norvegicus
tgaccattctatcctgatgccgtgt

SEQ ID NO: 606748 - DNA, 25 bp, Rattus norvegicus
tgaccattctatgctgatgccgtgt

SEQ ID NO: 606749 - DNA, 25 bp, Rattus norvegicus
tgaccattgtgcctcttgaacatat

SEQ ID NO: 606750 - DNA, 25 bp, Rattus norvegicus
tgaccattgtgcgtcttgaacatat

SEQ ID NO: 606751 - DNA, 25 bp, Rattus norvegicus
tgaccattgttcatcatctcttggg

SEQ ID NO: 606752 - DNA, 25 bp, Rattus norvegicus
tgaccattgttcttcatctcttggg

SEQ ID NO: 606753 - DNA, 25 bp, Rattus norvegicus
tgaccatttaggcttgtcctctttg

SEQ ID NO: 606754 - DNA, 25 bp, Rattus norvegicus
tgaccatttagggttgtcctctttg

SEQ ID NO: 606755 - DNA, 25 bp, Rattus norvegicus
tgaccatttcccatctgtggtgcta

SEQ ID NO: 606756 - DNA, 25 bp, Rattus norvegicus
tgaccatttcccttctgtggtgcta

SEQ ID NO: 606757 - DNA, 25 bp, Rattus norvegicus
tgaccatttcctactggaatcccta

SEQ ID NO: 606758 - DNA, 25 bp, Rattus norvegicus
tgaccatttccttctggaatcccta

SEQ ID NO: 606759 - DNA, 25 bp, Rattus norvegicus
tgaccatttggtatacgagtattct

SEQ ID NO: 606760 - DNA, 25 bp, Rattus norvegicus
tgaccatttggtttacgagtattct

SEQ ID NO: 606761 - DNA, 25 bp, Rattus norvegicus
tgaccatttttcacagtgcacataa

SEQ ID NO: 606762 - DNA, 25 bp, Rattus norvegicus
tgaccatttttctcagtgcacataa

SEQ ID NO: 606763 - DNA, 25 bp, Rattus norvegicus
tgacccaaaactagcccatatgact

SEQ ID NO: 606764 - DNA, 25 bp, Rattus norvegicus
tgacccaaaacttgcccatatgact

SEQ ID NO: 606765 - DNA, 25 bp, Rattus norvegicus
tgacccaacagccatcgagtactgt

SEQ ID NO: 606766 - DNA, 25 bp, Rattus norvegicus
tgacccaacagcgatcgagtactgt

SEQ ID NO: 606767 - DNA, 25 bp, Rattus norvegicus
tgacccaacgacacctaaagcgagg

SEQ ID NO: 606768 - DNA, 25 bp, Rattus norvegicus
tgacccaacgactcctaaagcgagg

SEQ ID NO: 606769 - DNA, 25 bp, Rattus norvegicus
tgacccaacgcgaggcctgcggcga

SEQ ID NO: 606770 - DNA, 25 bp, Rattus norvegicus
tgacccaacgcgtggcctgcggcga

SEQ ID NO: 606771 - DNA, 25 bp, Rattus norvegicus
tgacccaagaccatcactatgaaaa

SEQ ID NO: 606772 - DNA, 25 bp, Rattus norvegicus
tgacccaagaccttcactatgaaaa

SEQ ID NO: 606773 - DNA, 25 bp, Rattus norvegicus
tgacccaagtccaaatgtttacagg

SEQ ID NO: 606774 - DNA, 25 bp, Rattus norvegicus
tgacccaagtcctaatgtttacagg

SEQ ID NO: 606775 - DNA, 25 bp, Rattus norvegicus
tgacccacaaaaatccacatatctc

SEQ ID NO: 606776 - DNA, 25 bp, Rattus norvegicus
tgacccacaaaattccacatatctc

SEQ ID NO: 606777 - DNA, 25 bp, Rattus norvegicus
tgacccacaagcaccgttgataaag

SEQ ID NO: 606778 - DNA, 25 bp, Rattus norvegicus
tgacccacaagctccgttgataaag

SEQ ID NO: 606779 - DNA, 25 bp, Rattus norvegicus
tgacccacagcgagctcttatgaag

SEQ ID NO: 606780 - DNA, 25 bp, Rattus norvegicus
tgacccacagcgtgctcttatgaag

SEQ ID NO: 606781 - DNA, 25 bp, Rattus norvegicus
tgacccacagctcgagtgactgaga

SEQ ID NO: 606782 - DNA, 25 bp, Rattus norvegicus
tgacccacagctggagtgactgaga

SEQ ID NO: 606783 - DNA, 25 bp, Rattus norvegicus
tgacccaccataatctgggaccgag

SEQ ID NO: 606784 - DNA, 25 bp, Rattus norvegicus
tgacccaccatattctgggaccgag

SEQ ID NO: 606785 - DNA, 25 bp, Rattus norvegicus
tgacccaccccaaaatttataccat

SEQ ID NO: 606786 - DNA, 25 bp, Rattus norvegicus
tgacccaccccataatttataccat

SEQ ID NO: 606787 - DNA, 25 bp, Rattus norvegicus
tgacccacctaaaaaagtcctccag

SEQ ID NO: 606788 - DNA, 25 bp, Rattus norvegicus
tgacccacctaataaagtcctccag

SEQ ID NO: 606789 - DNA, 25 bp, Rattus norvegicus
tgacccacctacctcagctgggatg

SEQ ID NO: 606790 - DNA, 25 bp, Rattus norvegicus
tgacccacctacgtcagctgggatg

SEQ ID NO: 606791 - DNA, 25 bp, Rattus norvegicus
tgacccacgtggctttgcagtgctc

SEQ ID NO: 606792 - DNA, 25 bp, Rattus norvegicus
tgacccacgtgggtttgcagtgctc

SEQ ID NO: 606793 - DNA, 25 bp, Rattus norvegicus
tgacccactgggaaggcccagagcc

SEQ ID NO: 606794 - DNA, 25 bp, Rattus norvegicus
tgacccactgggtaggcccagagcc

SEQ ID NO: 606795 - DNA, 25 bp, Rattus norvegicus
tgacccacttgaagaaaaccaactg

SEQ ID NO: 606796 - DNA, 25 bp, Rattus norvegicus
tgacccacttgatgaaaaccaactg

SEQ ID NO: 606797 - DNA, 25 bp, Rattus norvegicus
tgacccacttgtctcaactctaaga

SEQ ID NO: 606798 - DNA, 25 bp, Rattus norvegicus
tgacccacttgtgtcaactctaaga

SEQ ID NO: 606799 - DNA, 25 bp, Rattus norvegicus
tgacccagaatgaggagcggatctt

SEQ ID NO: 606800 - DNA, 25 bp, Rattus norvegicus
tgacccagaatgtggagcggatctt

SEQ ID NO: 606801 - DNA, 25 bp, Rattus norvegicus
tgacccagagcaacttcttccggat

SEQ ID NO: 606802 - DNA, 25 bp, Rattus norvegicus
tgacccagagcacccagcgaagaat

SEQ ID NO: 606803 - DNA, 25 bp, Rattus norvegicus
tgacccagagcagccagcgaagaat

SEQ ID NO: 606804 - DNA, 25 bp, Rattus norvegicus
tgacccagagcatcttcttccggat

SEQ ID NO: 606805 - DNA, 25 bp, Rattus norvegicus
tgacccagaggtcttcattcctatc

SEQ ID NO: 606806 - DNA, 25 bp, Rattus norvegicus
tgacccagaggtgttcattcctatc

SEQ ID NO: 606807 - DNA, 25 bp, Rattus norvegicus
tgacccagatatcctcagcatctag

SEQ ID NO: 606808 - DNA, 25 bp, Rattus norvegicus
tgacccagatatgctcagcatctag

SEQ ID NO: 606809 - DNA, 25 bp, Rattus norvegicus
tgacccagatccaattctgaacaga

SEQ ID NO: 606810 - DNA, 25 bp, Rattus norvegicus
tgacccagatcctattctgaacaga

SEQ ID NO: 606811 - DNA, 25 bp, Rattus norvegicus
tgacccagatctacattccttgttc

SEQ ID NO: 606812 - DNA, 25 bp, Rattus norvegicus
tgacccagatcttcattccttgttc

SEQ ID NO: 606813 - DNA, 25 bp, Rattus norvegicus
tgacccagatggaggagaggctcca

SEQ ID NO: 606814 - DNA, 25 bp, Rattus norvegicus
tgacccagatggtggagaggctcca

SEQ ID NO: 606815 - DNA, 25 bp, Rattus norvegicus
tgacccagcactcactggtacgcat

SEQ ID NO: 606816 - DNA, 25 bp, Rattus norvegicus
tgacccagcactgactggtacgcat

SEQ ID NO: 606817 - DNA, 25 bp, Rattus norvegicus
tgacccagcatcactgcaagatttc

SEQ ID NO: 606818 - DNA, 25 bp, Rattus norvegicus
tgacccagcatccaagcagttcaga

SEQ ID NO: 606819 - DNA, 25 bp, Rattus norvegicus
tgacccagcatcgaagcagttcaga

SEQ ID NO: 606820 - DNA, 25 bp, Rattus norvegicus
tgacccagcatctctgcaagatttc

SEQ ID NO: 606821 - DNA, 25 bp, Rattus norvegicus
tgacccagcccgctgcatggaagaa

SEQ ID NO: 606822 - DNA, 25 bp, Rattus norvegicus
tgacccagcccggtgcatggaagaa

SEQ ID NO: 606823 - DNA, 25 bp, Rattus norvegicus
tgacccagcggtatctcacttgtag

SEQ ID NO: 606824 - DNA, 25 bp, Rattus norvegicus
tgacccagcggtttctcacttgtag

SEQ ID NO: 606825 - DNA, 25 bp, Rattus norvegicus
tgacccagctttacggttctttccg

SEQ ID NO: 606826 - DNA, 25 bp, Rattus norvegicus
tgacccagcttttcggttctttccg

SEQ ID NO: 606827 - DNA, 25 bp, Rattus norvegicus
tgacccaggaggacagaggactttg

SEQ ID NO: 606828 - DNA, 25 bp, Rattus norvegicus
tgacccaggaggtcagaggactttg

SEQ ID NO: 606829 - DNA, 25 bp, Rattus norvegicus
tgacccaggattaaaaccacccatc

SEQ ID NO: 606830 - DNA, 25 bp, Rattus norvegicus
tgacccaggatttaaaccacccatc

SEQ ID NO: 606831 - DNA, 25 bp, Rattus norvegicus
tgacccaggccaagcatttgcattt

SEQ ID NO: 606832 - DNA, 25 bp, Rattus norvegicus
tgacccaggccatgcatttgcattt

SEQ ID NO: 606833 - DNA, 25 bp, Rattus norvegicus
tgacccaggctcatgtagtgagcat

SEQ ID NO: 606834 - DNA, 25 bp, Rattus norvegicus
tgacccaggctcttgtagtgagcat

SEQ ID NO: 606835 - DNA, 25 bp, Rattus norvegicus
tgacccagggaccttggacagtcat

SEQ ID NO: 606836 - DNA, 25 bp, Rattus norvegicus
tgacccagggacgttggacagtcat

SEQ ID NO: 606837 - DNA, 25 bp, Rattus norvegicus
tgacccagggctactagggactctt

SEQ ID NO: 606838 - DNA, 25 bp, Rattus norvegicus
tgacccagggcttctagggactctt

SEQ ID NO: 606839 - DNA, 25 bp, Rattus norvegicus
tgacccagtaggctcttaccagaga

SEQ ID NO: 606840 - DNA, 25 bp, Rattus norvegicus
tgacccagtagggtcttaccagaga

SEQ ID NO: 606841 - DNA, 25 bp, Rattus norvegicus
tgacccatacagagagccactttgg

SEQ ID NO: 606842 - DNA, 25 bp, Rattus norvegicus
tgacccatacagtgagccactttgg

SEQ ID NO: 606843 - DNA, 25 bp, Rattus norvegicus
tgacccatacttccagagtccttat

SEQ ID NO: 606844 - DNA, 25 bp, Rattus norvegicus
tgacccatacttgcagagtccttat

SEQ ID NO: 606845 - DNA, 25 bp, Rattus norvegicus
tgacccatagagcttttcacccata

SEQ ID NO: 606846 - DNA, 25 bp, Rattus norvegicus
tgacccatagaggttttcacccata

SEQ ID NO: 606847 - DNA, 25 bp, Rattus norvegicus
tgacccatcattaaggcggaacagg

SEQ ID NO: 606848 - DNA, 25 bp, Rattus norvegicus
tgacccatcatttaggcggaacagg

SEQ ID NO: 606849 - DNA, 25 bp, Rattus norvegicus
tgacccatccaacgacatgcaggtt

SEQ ID NO: 606850 - DNA, 25 bp, Rattus norvegicus
tgacccatccaaggacatgcaggtt

SEQ ID NO: 606851 - DNA, 25 bp, Rattus norvegicus
tgacccatgacaccaccttttattt

SEQ ID NO: 606852 - DNA, 25 bp, Rattus norvegicus
tgacccatgacagcaccttttattt

SEQ ID NO: 606853 - DNA, 25 bp, Rattus norvegicus
tgacccatgatgcattccttatctt

SEQ ID NO: 606854 - DNA, 25 bp, Rattus norvegicus
tgacccatgatggattccttatctt

SEQ ID NO: 606855 - DNA, 25 bp, Rattus norvegicus
tgacccatgcttccagagagactga

SEQ ID NO: 606856 - DNA, 25 bp, Rattus norvegicus
tgacccatgcttgcagagagactga

SEQ ID NO: 606857 - DNA, 25 bp, Rattus norvegicus
tgacccatggtaattgtcctggaga

SEQ ID NO: 606858 - DNA, 25 bp, Rattus norvegicus
tgacccatggtatttgtcctggaga

SEQ ID NO: 606859 - DNA, 25 bp, Rattus norvegicus
tgacccatgtgcaattctccatatt

SEQ ID NO: 606860 - DNA, 25 bp, Rattus norvegicus
tgacccatgtgctattctccatatt

SEQ ID NO: 606861 - DNA, 25 bp, Rattus norvegicus
tgacccattttccacgtttatcttt

SEQ ID NO: 606862 - DNA, 25 bp, Rattus norvegicus
tgacccattttcgacgtttatcttt

SEQ ID NO: 606863 - DNA, 25 bp, Rattus norvegicus
tgacccatttttagtaccttcttag

SEQ ID NO: 606864 - DNA, 25 bp, Rattus norvegicus
tgacccattttttgtaccttcttag

SEQ ID NO: 606865 - DNA, 25 bp, Rattus norvegicus
tgaccccaaactctattcagtgctg

SEQ ID NO: 606866 - DNA, 25 bp, Rattus norvegicus
tgaccccaaactgtattcagtgctg

SEQ ID NO: 606867 - DNA, 25 bp, Rattus norvegicus
tgaccccaaatacagctgtacagtt

SEQ ID NO: 606868 - DNA, 25 bp, Rattus norvegicus
tgaccccaaatagagctgtacagtt

SEQ ID NO: 606869 - DNA, 25 bp, Rattus norvegicus
tgaccccaaggaccactgacagcaa

SEQ ID NO: 606870 - DNA, 25 bp, Rattus norvegicus
tgaccccaaggagcactgacagcaa

SEQ ID NO: 606871 - DNA, 25 bp, Rattus norvegicus
tgaccccaataaagtgcactccatg

SEQ ID NO: 606872 - DNA, 25 bp, Rattus norvegicus
tgaccccaataatgtgcactccatg

SEQ ID NO: 606873 - DNA, 25 bp, Rattus norvegicus
tgaccccaatctattacctgaggaa

SEQ ID NO: 606874 - DNA, 25 bp, Rattus norvegicus
tgaccccaatcttttacctgaggaa

SEQ ID NO: 606875 - DNA, 25 bp, Rattus norvegicus
tgaccccacagcagcgagaagacct

SEQ ID NO: 606876 - DNA, 25 bp, Rattus norvegicus
tgaccccacagctgcgagaagacct

SEQ ID NO: 606877 - DNA, 25 bp, Rattus norvegicus
tgaccccactccatgtattattgag

SEQ ID NO: 606878 - DNA, 25 bp, Rattus norvegicus
tgaccccactccttgtattattgag

SEQ ID NO: 606879 - DNA, 25 bp, Rattus norvegicus
tgaccccactgactggtcgacagtg

SEQ ID NO: 606880 - DNA, 25 bp, Rattus norvegicus
tgaccccactgagtggtcgacagtg

SEQ ID NO: 606881 - DNA, 25 bp, Rattus norvegicus
tgaccccactgtaacttaaaccttg

SEQ ID NO: 606882 - DNA, 25 bp, Rattus norvegicus
tgaccccactgtctgctgcaggatg

SEQ ID NO: 606883 - DNA, 25 bp, Rattus norvegicus
tgaccccactgtgtgctgcaggatg

SEQ ID NO: 606884 - DNA, 25 bp, Rattus norvegicus
tgaccccactgttacttaaaccttg

SEQ ID NO: 606885 - DNA, 25 bp, Rattus norvegicus
tgaccccagaatctgcttcgaccat

SEQ ID NO: 606886 - DNA, 25 bp, Rattus norvegicus
tgaccccagaatgtgcttcgaccat

SEQ ID NO: 606887 - DNA, 25 bp, Rattus norvegicus
tgaccccagaccatagagacttaga

SEQ ID NO: 606888 - DNA, 25 bp, Rattus norvegicus
tgaccccagaccttagagacttaga

SEQ ID NO: 606889 - DNA, 25 bp, Rattus norvegicus
tgaccccagagacttctacaggtat

SEQ ID NO: 606890 - DNA, 25 bp, Rattus norvegicus
tgaccccagagagttctacaggtat

SEQ ID NO: 606891 - DNA, 25 bp, Rattus norvegicus
tgaccccagagcaccagactgtggt

SEQ ID NO: 606892 - DNA, 25 bp, Rattus norvegicus
tgaccccagagctccagactgtggt

SEQ ID NO: 606893 - DNA, 25 bp, Rattus norvegicus
tgaccccagctactcagatggatgt

SEQ ID NO: 606894 - DNA, 25 bp, Rattus norvegicus
tgaccccagctagtcagatggatgt

SEQ ID NO: 606895 - DNA, 25 bp, Rattus norvegicus
tgaccccaggcacctgctctgaaga

SEQ ID NO: 606896 - DNA, 25 bp, Rattus norvegicus
tgaccccaggcagctgctctgaaga

SEQ ID NO: 606897 - DNA, 25 bp, Rattus norvegicus
tgaccccaggttacaggagtggcgt

SEQ ID NO: 606898 - DNA, 25 bp, Rattus norvegicus
tgaccccaggttccagcgacaagtg

SEQ ID NO: 606899 - DNA, 25 bp, Rattus norvegicus
tgaccccaggttgcagcgacaagtg

SEQ ID NO: 606900 - DNA, 25 bp, Rattus norvegicus
tgaccccaggtttcaggagtggcgt

SEQ ID NO: 606901 - DNA, 25 bp, Rattus norvegicus
tgaccccagtaaccctgatgaggac

SEQ ID NO: 606902 - DNA, 25 bp, Rattus norvegicus
tgaccccagtaagcctgatgaggac

SEQ ID NO: 606903 - DNA, 25 bp, Rattus norvegicus
tgaccccatcccacaaggaaggtgg

SEQ ID NO: 606904 - DNA, 25 bp, Rattus norvegicus
tgaccccatccctcaaggaaggtgg

SEQ ID NO: 606905 - DNA, 25 bp, Rattus norvegicus
tgaccccatgggacaacagacttgc

SEQ ID NO: 606906 - DNA, 25 bp, Rattus norvegicus
tgaccccatgggtcaacagacttgc

SEQ ID NO: 606907 - DNA, 25 bp, Rattus norvegicus
tgaccccattgtatggattctgccc

SEQ ID NO: 606908 - DNA, 25 bp, Rattus norvegicus
tgaccccattgtttggattctgccc

SEQ ID NO: 606909 - DNA, 25 bp, Rattus norvegicus
tgaccccattttatcctagaaggct

SEQ ID NO: 606910 - DNA, 25 bp, Rattus norvegicus
tgaccccattttttcctagaaggct

SEQ ID NO: 606911 - DNA, 25 bp, Rattus norvegicus
tgaccccgaacaccaagtatgtgaa

SEQ ID NO: 606912 - DNA, 25 bp, Rattus norvegicus
tgaccccgaacagcaagtatgtgaa

SEQ ID NO: 606913 - DNA, 25 bp, Rattus norvegicus
tgaccccgaccacgattttgacaaa

SEQ ID NO: 606914 - DNA, 25 bp, Rattus norvegicus
tgaccccgaccaggattttgacaaa

SEQ ID NO: 606915 - DNA, 25 bp, Rattus norvegicus
tgaccccgaggcaaagtggataagt

SEQ ID NO: 606916 - DNA, 25 bp, Rattus norvegicus
tgaccccgaggctaagtggataagt

SEQ ID NO: 606917 - DNA, 25 bp, Rattus norvegicus
tgaccccggaatatccagagctgga

SEQ ID NO: 606918 - DNA, 25 bp, Rattus norvegicus
tgaccccggaatttccagagctgga

SEQ ID NO: 606919 - DNA, 25 bp, Rattus norvegicus
tgacccctaaacaaagcacatgcat

SEQ ID NO: 606920 - DNA, 25 bp, Rattus norvegicus
tgacccctaaactaagcacatgcat

SEQ ID NO: 606921 - DNA, 25 bp, Rattus norvegicus
tgacccctacaaccctgaaagtgtt

SEQ ID NO: 606922 - DNA, 25 bp, Rattus norvegicus
tgacccctacaagcctgaaagtgtt

SEQ ID NO: 606923 - DNA, 25 bp, Rattus norvegicus
tgacccctagctatgaaggtgttag

SEQ ID NO: 606924 - DNA, 25 bp, Rattus norvegicus
tgacccctagctttgaaggtgttag

SEQ ID NO: 606925 - DNA, 25 bp, Rattus norvegicus
tgacccctcaagctctgttggaaga

SEQ ID NO: 606926 - DNA, 25 bp, Rattus norvegicus
tgacccctcaaggtctgttggaaga

SEQ ID NO: 606927 - DNA, 25 bp, Rattus norvegicus
tgacccctcatgaccaaacaaagtc

SEQ ID NO: 606928 - DNA, 25 bp, Rattus norvegicus
tgacccctcatgtccaaacaaagtc

SEQ ID NO: 606929 - DNA, 25 bp, Rattus norvegicus
tgacccctccagagtgtgacaagtg

SEQ ID NO: 606930 - DNA, 25 bp, Rattus norvegicus
tgacccctccagtgtgtgacaagtg

SEQ ID NO: 606931 - DNA, 25 bp, Rattus norvegicus
tgacccctctcaatggagcacagtt

SEQ ID NO: 606932 - DNA, 25 bp, Rattus norvegicus
tgacccctctcattggagcacagtt

SEQ ID NO: 606933 - DNA, 25 bp, Rattus norvegicus
tgacccctctgcatctaagaattgg

SEQ ID NO: 606934 - DNA, 25 bp, Rattus norvegicus
tgacccctctgcttctaagaattgg

SEQ ID NO: 606935 - DNA, 25 bp, Rattus norvegicus
tgacccctgaagctgtcttgaccta

SEQ ID NO: 606936 - DNA, 25 bp, Rattus norvegicus
tgacccctgaaggtgtcttgaccta

SEQ ID NO: 606937 - DNA, 25 bp, Rattus norvegicus
tgacccctgagcacagatccaagca

SEQ ID NO: 606938 - DNA, 25 bp, Rattus norvegicus
tgacccctgagctcagatccaagca

SEQ ID NO: 606939 - DNA, 25 bp, Rattus norvegicus
tgacccctgcagattgagatggact

SEQ ID NO: 606940 - DNA, 25 bp, Rattus norvegicus
tgacccctgcagcagtctgaggtaa

SEQ ID NO: 606941 - DNA, 25 bp, Rattus norvegicus
tgacccctgcaggagtctgaggtaa

SEQ ID NO: 606942 - DNA, 25 bp, Rattus norvegicus
tgacccctgcagtttgagatggact

SEQ ID NO: 606943 - DNA, 25 bp, Rattus norvegicus
tgaccccttccacatcaaacagtaa

SEQ ID NO: 606944 - DNA, 25 bp, Rattus norvegicus
tgaccccttccagatcaaacagtaa

SEQ ID NO: 606945 - DNA, 25 bp, Rattus norvegicus
tgaccccttctgatattccatttca

SEQ ID NO: 606946 - DNA, 25 bp, Rattus norvegicus
tgaccccttctgttattccatttca

SEQ ID NO: 606947 - DNA, 25 bp, Rattus norvegicus
tgaccccttgtgatctctctgaaaa

SEQ ID NO: 606948 - DNA, 25 bp, Rattus norvegicus
tgaccccttgtgttctctctgaaaa

SEQ ID NO: 606949 - DNA, 25 bp, Rattus norvegicus
tgaccccttgttcgcatacagcagt

SEQ ID NO: 606950 - DNA, 25 bp, Rattus norvegicus
tgaccccttgttggcatacagcagt

SEQ ID NO: 606951 - DNA, 25 bp, Rattus norvegicus
tgacccctttaactccatcgggaat

SEQ ID NO: 606952 - DNA, 25 bp, Rattus norvegicus
tgacccctttaagtccatcgggaat

SEQ ID NO: 606953 - DNA, 25 bp, Rattus norvegicus
tgacccgaagcgactcacgccttaa

SEQ ID NO: 606954 - DNA, 25 bp, Rattus norvegicus
tgacccgaagcgtctcacgccttaa

SEQ ID NO: 606955 - DNA, 25 bp, Rattus norvegicus
tgacccgaagtgctgactcacccat

SEQ ID NO: 606956 - DNA, 25 bp, Rattus norvegicus
tgacccgaagtggtgactcacccat

SEQ ID NO: 606957 - DNA, 25 bp, Rattus norvegicus
tgacccgactcacccttatggaaga

SEQ ID NO: 606958 - DNA, 25 bp, Rattus norvegicus
tgacccgactcagccttatggaaga

SEQ ID NO: 606959 - DNA, 25 bp, Rattus norvegicus
tgacccgaggcaagctcacgtatac

SEQ ID NO: 606960 - DNA, 25 bp, Rattus norvegicus
tgacccgaggcatgctcacgtatac

SEQ ID NO: 606961 - DNA, 25 bp, Rattus norvegicus
tgacccgccgcgaggtcgtcggcta

SEQ ID NO: 606962 - DNA, 25 bp, Rattus norvegicus
tgacccgccgcgtggtcgtcggcta

SEQ ID NO: 606963 - DNA, 25 bp, Rattus norvegicus
tgacccgcgagcaccagtcggatga

SEQ ID NO: 606964 - DNA, 25 bp, Rattus norvegicus
tgacccgcgagctccagtcggatga

SEQ ID NO: 606965 - DNA, 25 bp, Rattus norvegicus
tgacccgctcggctatgaaatccag

SEQ ID NO: 606966 - DNA, 25 bp, Rattus norvegicus
tgacccgctcgggtatgaaatccag

SEQ ID NO: 606967 - DNA, 25 bp, Rattus norvegicus
tgacccgctgaccaggcagccaaga

SEQ ID NO: 606968 - DNA, 25 bp, Rattus norvegicus
tgacccgctgacgaggcagccaaga

SEQ ID NO: 606969 - DNA, 25 bp, Rattus norvegicus
tgacccgctggcagatgaggtattg

SEQ ID NO: 606970 - DNA, 25 bp, Rattus norvegicus
tgacccgctggctgatgaggtattg

SEQ ID NO: 606971 - DNA, 25 bp, Rattus norvegicus
tgacccgctgttaggacatcaacaa

SEQ ID NO: 606972 - DNA, 25 bp, Rattus norvegicus
tgacccgctgtttggacatcaacaa

SEQ ID NO: 606973 - DNA, 25 bp, Rattus norvegicus
tgacccggaagacgatttatcagaa

SEQ ID NO: 606974 - DNA, 25 bp, Rattus norvegicus
tgacccggaagaggatttatcagaa

SEQ ID NO: 606975 - DNA, 25 bp, Rattus norvegicus
tgacccggagacattgccgtagctg

SEQ ID NO: 606976 - DNA, 25 bp, Rattus norvegicus
tgacccggagactttgccgtagctg

SEQ ID NO: 606977 - DNA, 25 bp, Rattus norvegicus
tgacccggatccaggttatacgaga

SEQ ID NO: 606978 - DNA, 25 bp, Rattus norvegicus
tgacccggatcctggttatacgaga

SEQ ID NO: 606979 - DNA, 25 bp, Rattus norvegicus
tgacccgggaacaagctgactactg

SEQ ID NO: 606980 - DNA, 25 bp, Rattus norvegicus
tgacccgggaactagctgactactg

SEQ ID NO: 606981 - DNA, 25 bp, Rattus norvegicus
tgacccggtcttagcatgtctctgg

SEQ ID NO: 606982 - DNA, 25 bp, Rattus norvegicus
tgacccggtctttgcatgtctctgg

SEQ ID NO: 606983 - DNA, 25 bp, Rattus norvegicus
tgacccgtcttgaatatcctttgca

SEQ ID NO: 606984 - DNA, 25 bp, Rattus norvegicus
tgacccgtcttgtatatcctttgca

SEQ ID NO: 606985 - DNA, 25 bp, Rattus norvegicus
tgacccgtgcgaaggcactgagtgt

SEQ ID NO: 606986 - DNA, 25 bp, Rattus norvegicus
tgacccgtgcgatggcactgagtgt

SEQ ID NO: 606987 - DNA, 25 bp, Rattus norvegicus
tgacccgtgctgcaacattatcgac

SEQ ID NO: 606988 - DNA, 25 bp, Rattus norvegicus
tgacccgtgctggaacattatcgac

SEQ ID NO: 606989 - DNA, 25 bp, Rattus norvegicus
tgaccctaaacacctgtatcccaga

SEQ ID NO: 606990 - DNA, 25 bp, Rattus norvegicus
tgaccctaaacagctgtatcccaga

SEQ ID NO: 606991 - DNA, 25 bp, Rattus norvegicus
tgaccctaacacatggatccttatc

SEQ ID NO: 606992 - DNA, 25 bp, Rattus norvegicus
tgaccctaacacttggatccttatc

SEQ ID NO: 606993 - DNA, 25 bp, Rattus norvegicus
tgaccctaacatatgacgcctggag

SEQ ID NO: 606994 - DNA, 25 bp, Rattus norvegicus
tgaccctaacatttgacgcctggag

SEQ ID NO: 606995 - DNA, 25 bp, Rattus norvegicus
tgaccctacatcagtcctggaaata

SEQ ID NO: 606996 - DNA, 25 bp, Rattus norvegicus
tgaccctacatctgtcctggaaata

SEQ ID NO: 606997 - DNA, 25 bp, Rattus norvegicus
tgaccctactagatttggccatgtg

SEQ ID NO: 606998 - DNA, 25 bp, Rattus norvegicus
tgaccctactagttttggccatgtg

SEQ ID NO: 606999 - DNA, 25 bp, Rattus norvegicus
tgaccctagcttattggcgattgca

SEQ ID NO: 607000 - DNA, 25 bp, Rattus norvegicus
tgaccctagctttttggcgattgca

SEQ ID NO: 607001 - DNA, 25 bp, Rattus norvegicus
tgaccctaggccagagggcacagga

SEQ ID NO: 607002 - DNA, 25 bp, Rattus norvegicus
tgaccctaggcctgagggcacagga

SEQ ID NO: 607003 - DNA, 25 bp, Rattus norvegicus
tgaccctcaactcattgtttattgt

SEQ ID NO: 607004 - DNA, 25 bp, Rattus norvegicus
tgaccctcaactgattgtttattgt

SEQ ID NO: 607005 - DNA, 25 bp, Rattus norvegicus
tgaccctcaagacatacctgcatac

SEQ ID NO: 607006 - DNA, 25 bp, Rattus norvegicus
tgaccctcaagagatacctgcatac

SEQ ID NO: 607007 - DNA, 25 bp, Rattus norvegicus
tgaccctcagataggcttcctagaa

SEQ ID NO: 607008 - DNA, 25 bp, Rattus norvegicus
tgaccctcagatccaggaacccgga

SEQ ID NO: 607009 - DNA, 25 bp, Rattus norvegicus
tgaccctcagatgcaggaacccgga

SEQ ID NO: 607010 - DNA, 25 bp, Rattus norvegicus
tgaccctcagattggcttcctagaa

SEQ ID NO: 607011 - DNA, 25 bp, Rattus norvegicus
tgaccctcatccagcacttaaatat

SEQ ID NO: 607012 - DNA, 25 bp, Rattus norvegicus
tgaccctcatcctgcacttaaatat

SEQ ID NO: 607013 - DNA, 25 bp, Rattus norvegicus
tgaccctcatgaagtctggtgacaa

SEQ ID NO: 607014 - DNA, 25 bp, Rattus norvegicus
tgaccctcatgacccacatgataga

SEQ ID NO: 607015 - DNA, 25 bp, Rattus norvegicus
tgaccctcatgagccacatgataga

SEQ ID NO: 607016 - DNA, 25 bp, Rattus norvegicus
tgaccctcatgatgtctggtgacaa

SEQ ID NO: 607017 - DNA, 25 bp, Rattus norvegicus
tgaccctcccacattcatgctggaa

SEQ ID NO: 607018 - DNA, 25 bp, Rattus norvegicus
tgaccctcccactttcatgctggaa

SEQ ID NO: 607019 - DNA, 25 bp, Rattus norvegicus
tgaccctcccagatgacgcagcgag

SEQ ID NO: 607020 - DNA, 25 bp, Rattus norvegicus
tgaccctcccagttgacgcagcgag

SEQ ID NO: 607021 - DNA, 25 bp, Rattus norvegicus
tgaccctcctgtacctaagaaacat

SEQ ID NO: 607022 - DNA, 25 bp, Rattus norvegicus
tgaccctcctgttcctaagaaacat

SEQ ID NO: 607023 - DNA, 25 bp, Rattus norvegicus
tgaccctcgggaagatctggcttta

SEQ ID NO: 607024 - DNA, 25 bp, Rattus norvegicus
tgaccctcgggatgatctggcttta

SEQ ID NO: 607025 - DNA, 25 bp, Rattus norvegicus
tgaccctcgtacacatgcttgcgta

SEQ ID NO: 607026 - DNA, 25 bp, Rattus norvegicus
tgaccctcgtactcatgcttgcgta

SEQ ID NO: 607027 - DNA, 25 bp, Rattus norvegicus
tgaccctcgtccaggcaagcaataa

SEQ ID NO: 607028 - DNA, 25 bp, Rattus norvegicus
tgaccctcgtcctggcaagcaataa

SEQ ID NO: 607029 - DNA, 25 bp, Rattus norvegicus
tgaccctcgtttcgttgactgtgat

SEQ ID NO: 607030 - DNA, 25 bp, Rattus norvegicus
tgaccctcgtttggttgactgtgat

SEQ ID NO: 607031 - DNA, 25 bp, Rattus norvegicus
tgaccctctctacatactggacaac

SEQ ID NO: 607032 - DNA, 25 bp, Rattus norvegicus
tgaccctctctagatactggacaac

SEQ ID NO: 607033 - DNA, 25 bp, Rattus norvegicus
tgaccctgagtgatttcccaagaga

SEQ ID NO: 607034 - DNA, 25 bp, Rattus norvegicus
tgaccctgagtgttttcccaagaga

SEQ ID NO: 607035 - DNA, 25 bp, Rattus norvegicus
tgaccctgcacacgtttctgttatt

SEQ ID NO: 607036 - DNA, 25 bp, Rattus norvegicus
tgaccctgcacaggtttctgttatt

SEQ ID NO: 607037 - DNA, 25 bp, Rattus norvegicus
tgaccctgccaacagaactggtgat

SEQ ID NO: 607038 - DNA, 25 bp, Rattus norvegicus
tgaccctgccaagagaactggtgat

SEQ ID NO: 607039 - DNA, 25 bp, Rattus norvegicus
tgaccctgccatcaccctgaagaga

SEQ ID NO: 607040 - DNA, 25 bp, Rattus norvegicus
tgaccctgccatgaccctgaagaga

SEQ ID NO: 607041 - DNA, 25 bp, Rattus norvegicus
tgaccctgcgatagtatggaccttt

SEQ ID NO: 607042 - DNA, 25 bp, Rattus norvegicus
tgaccctgcgattgtatggaccttt

SEQ ID NO: 607043 - DNA, 25 bp, Rattus norvegicus
tgaccctgctgtcgaagactcattc

SEQ ID NO: 607044 - DNA, 25 bp, Rattus norvegicus
tgaccctgctgtggaagactcattc

SEQ ID NO: 607045 - DNA, 25 bp, Rattus norvegicus
tgaccctgctttatggactgtttaa

SEQ ID NO: 607046 - DNA, 25 bp, Rattus norvegicus
tgaccctgctttcccaagagtcctt

SEQ ID NO: 607047 - DNA, 25 bp, Rattus norvegicus
tgaccctgctttgccaagagtcctt

SEQ ID NO: 607048 - DNA, 25 bp, Rattus norvegicus
tgaccctgctttttggactgtttaa

SEQ ID NO: 607049 - DNA, 25 bp, Rattus norvegicus
tgaccctggaacactccatgaagga

SEQ ID NO: 607050 - DNA, 25 bp, Rattus norvegicus
tgaccctggaactctccatgaagga

SEQ ID NO: 607051 - DNA, 25 bp, Rattus norvegicus
tgaccctggacaagctcactgtgaa

SEQ ID NO: 607052 - DNA, 25 bp, Rattus norvegicus
tgaccctggacatgctcactgtgaa

SEQ ID NO: 607053 - DNA, 25 bp, Rattus norvegicus
tgaccctggaccatagcagcctgaa

SEQ ID NO: 607054 - DNA, 25 bp, Rattus norvegicus
tgaccctggaccttagcagcctgaa

SEQ ID NO: 607055 - DNA, 25 bp, Rattus norvegicus
tgaccctggactctttgttctgttc

SEQ ID NO: 607056 - DNA, 25 bp, Rattus norvegicus
tgaccctggactgtttgttctgttc

SEQ ID NO: 607057 - DNA, 25 bp, Rattus norvegicus
tgaccctggcggacttgctgttgtt

SEQ ID NO: 607058 - DNA, 25 bp, Rattus norvegicus
tgaccctggcggtcttgctgttgtt

SEQ ID NO: 607059 - DNA, 25 bp, Rattus norvegicus
tgaccctggctcaatttctgtgttc

SEQ ID NO: 607060 - DNA, 25 bp, Rattus norvegicus
tgaccctggctctatttctgtgttc

SEQ ID NO: 607061 - DNA, 25 bp, Rattus norvegicus
tgaccctgtaggaacccaatctagg

SEQ ID NO: 607062 - DNA, 25 bp, Rattus norvegicus
tgaccctgtaggtacccaatctagg

SEQ ID NO: 607063 - DNA, 25 bp, Rattus norvegicus
tgaccctgtcacataactggccatg

SEQ ID NO: 607064 - DNA, 25 bp, Rattus norvegicus
tgaccctgtcacttaactggccatg

SEQ ID NO: 607065 - DNA, 25 bp, Rattus norvegicus
tgaccctgtttcattccactcaaga

SEQ ID NO: 607066 - DNA, 25 bp, Rattus norvegicus
tgaccctgtttctttccactcaaga

SEQ ID NO: 607067 - DNA, 25 bp, Rattus norvegicus
tgacccttaagtaacccacacaagt

SEQ ID NO: 607068 - DNA, 25 bp, Rattus norvegicus
tgacccttaagttacccacacaagt

SEQ ID NO: 607069 - DNA, 25 bp, Rattus norvegicus
tgacccttatcaaggacactctctc

SEQ ID NO: 607070 - DNA, 25 bp, Rattus norvegicus
tgacccttatcatggacactctctc

SEQ ID NO: 607071 - DNA, 25 bp, Rattus norvegicus
tgacccttcccgctagggctgatgg

SEQ ID NO: 607072 - DNA, 25 bp, Rattus norvegicus
tgacccttcccggtagggctgatgg

SEQ ID NO: 607073 - DNA, 25 bp, Rattus norvegicus
tgacccttctgactgattctggcaa

SEQ ID NO: 607074 - DNA, 25 bp, Rattus norvegicus
tgacccttctgagtgattctggcaa

SEQ ID NO: 607075 - DNA, 25 bp, Rattus norvegicus
tgacccttctgcactatgatccaat

SEQ ID NO: 607076 - DNA, 25 bp, Rattus norvegicus
tgacccttctgctctatgatccaat

SEQ ID NO: 607077 - DNA, 25 bp, Rattus norvegicus
tgacccttgaccattcaactggatt

SEQ ID NO: 607078 - DNA, 25 bp, Rattus norvegicus
tgacccttgacctttcaactggatt

SEQ ID NO: 607079 - DNA, 25 bp, Rattus norvegicus
tgacccttgcacacgtgatccagac

SEQ ID NO: 607080 - DNA, 25 bp, Rattus norvegicus
tgacccttgcactcgtgatccagac

SEQ ID NO: 607081 - DNA, 25 bp, Rattus norvegicus
tgacccttgccaacttttgcagaac

SEQ ID NO: 607082 - DNA, 25 bp, Rattus norvegicus
tgacccttgccatcttttgcagaac

SEQ ID NO: 607083 - DNA, 25 bp, Rattus norvegicus
tgacccttgctgaagcttactgtag

SEQ ID NO: 607084 - DNA, 25 bp, Rattus norvegicus
tgacccttgctgtagcttactgtag

SEQ ID NO: 607085 - DNA, 25 bp, Rattus norvegicus
tgacccttggtaccagacagcaatt

SEQ ID NO: 607086 - DNA, 25 bp, Rattus norvegicus
tgacccttggtagcagacagcaatt

SEQ ID NO: 607087 - DNA, 25 bp, Rattus norvegicus
tgacccttgtcacccaagggtgtgt

SEQ ID NO: 607088 - DNA, 25 bp, Rattus norvegicus
tgacccttgtcagccaagggtgtgt

SEQ ID NO: 607089 - DNA, 25 bp, Rattus norvegicus
tgacccttgtgtaatttccatgtcc

SEQ ID NO: 607090 - DNA, 25 bp, Rattus norvegicus
tgacccttgtgtccctagagtggca

SEQ ID NO: 607091 - DNA, 25 bp, Rattus norvegicus
tgacccttgtgtgcctagagtggca

SEQ ID NO: 607092 - DNA, 25 bp, Rattus norvegicus
tgacccttgtgttatttccatgtcc

SEQ ID NO: 607093 - DNA, 25 bp, Rattus norvegicus
tgaccctttattacagttcatgttg

SEQ ID NO: 607094 - DNA, 25 bp, Rattus norvegicus
tgaccctttatttcagttcatgttg

SEQ ID NO: 607095 - DNA, 25 bp, Rattus norvegicus
tgaccctttcgaattttctttcact

SEQ ID NO: 607096 - DNA, 25 bp, Rattus norvegicus
tgaccctttcgatttttctttcact

SEQ ID NO: 607097 - DNA, 25 bp, Rattus norvegicus
tgacccttttgactgctctcaggac

SEQ ID NO: 607098 - DNA, 25 bp, Rattus norvegicus
tgacccttttgagtgctctcaggac

SEQ ID NO: 607099 - DNA, 25 bp, Rattus norvegicus
tgaccgaaagctactatttacttaa

SEQ ID NO: 607100 - DNA, 25 bp, Rattus norvegicus
tgaccgaaagcttctatttacttaa

SEQ ID NO: 607101 - DNA, 25 bp, Rattus norvegicus
tgaccgaagtatcacgacacacatt

SEQ ID NO: 607102 - DNA, 25 bp, Rattus norvegicus
tgaccgaagtatgacgacacacatt

SEQ ID NO: 607103 - DNA, 25 bp, Rattus norvegicus
tgaccgaatcggaaggctggctctc

SEQ ID NO: 607104 - DNA, 25 bp, Rattus norvegicus
tgaccgaatcggtaggctggctctc

SEQ ID NO: 607105 - DNA, 25 bp, Rattus norvegicus
tgaccgacaccactgagaacacatt

SEQ ID NO: 607106 - DNA, 25 bp, Rattus norvegicus
tgaccgacaccagtgagaacacatt

SEQ ID NO: 607107 - DNA, 25 bp, Rattus norvegicus
tgaccgacacccagcaggcggaaac

SEQ ID NO: 607108 - DNA, 25 bp, Rattus norvegicus
tgaccgacaccctgcaggcggaaac

SEQ ID NO: 607109 - DNA, 25 bp, Rattus norvegicus
tgaccgagatcgacaacagcgccga

SEQ ID NO: 607110 - DNA, 25 bp, Rattus norvegicus
tgaccgagatcgtcaacagcgccga

SEQ ID NO: 607111 - DNA, 25 bp, Rattus norvegicus
tgaccgagatgtcttcctcatttat

SEQ ID NO: 607112 - DNA, 25 bp, Rattus norvegicus
tgaccgagatgtgttcctcatttat

SEQ ID NO: 607113 - DNA, 25 bp, Rattus norvegicus
tgaccgaggcatctcaggccaagac

SEQ ID NO: 607114 - DNA, 25 bp, Rattus norvegicus
tgaccgaggcatgtcaggccaagac

SEQ ID NO: 607115 - DNA, 25 bp, Rattus norvegicus
tgaccgagtctcagcaggcgtgtaa

SEQ ID NO: 607116 - DNA, 25 bp, Rattus norvegicus
tgaccgagtctctgcaggcgtgtaa

SEQ ID NO: 607117 - DNA, 25 bp, Rattus norvegicus
tgaccgatgcctcctgcctaaggaa

SEQ ID NO: 607118 - DNA, 25 bp, Rattus norvegicus
tgaccgatgcctgctgcctaaggaa

SEQ ID NO: 607119 - DNA, 25 bp, Rattus norvegicus
tgaccgatggtgaggtttctgtttc

SEQ ID NO: 607120 - DNA, 25 bp, Rattus norvegicus
tgaccgatggtgtggtttctgtttc

SEQ ID NO: 607121 - DNA, 25 bp, Rattus norvegicus
tgaccgattcctcggcttctttatg

SEQ ID NO: 607122 - DNA, 25 bp, Rattus norvegicus
tgaccgattcctgggcttctttatg

SEQ ID NO: 607123 - DNA, 25 bp, Rattus norvegicus
tgaccgcctgggatttatgtgtgtg

SEQ ID NO: 607124 - DNA, 25 bp, Rattus norvegicus
tgaccgcctgggttttatgtgtgtg

SEQ ID NO: 607125 - DNA, 25 bp, Rattus norvegicus
tgaccgccttgaagggttttgctta

SEQ ID NO: 607126 - DNA, 25 bp, Rattus norvegicus
tgaccgccttgatgggttttgctta

SEQ ID NO: 607127 - DNA, 25 bp, Rattus norvegicus
tgaccgcgcaatacaccagtgaggg

SEQ ID NO: 607128 - DNA, 25 bp, Rattus norvegicus
tgaccgcgcaattcaccagtgaggg

SEQ ID NO: 607129 - DNA, 25 bp, Rattus norvegicus
tgaccgctcccgaaaagcccgtgaa

SEQ ID NO: 607130 - DNA, 25 bp, Rattus norvegicus
tgaccgctcccgtaaagcccgtgaa

SEQ ID NO: 607131 - DNA, 25 bp, Rattus norvegicus
tgaccgctgcttcaagatgccaatc

SEQ ID NO: 607132 - DNA, 25 bp, Rattus norvegicus
tgaccgctgcttgaagatgccaatc

SEQ ID NO: 607133 - DNA, 25 bp, Rattus norvegicus
tgaccgcttactcggagtctcttta

SEQ ID NO: 607134 - DNA, 25 bp, Rattus norvegicus
tgaccgcttactgggagtctcttta

SEQ ID NO: 607135 - DNA, 25 bp, Rattus norvegicus
tgaccgcttgcacaacgagggtcca

SEQ ID NO: 607136 - DNA, 25 bp, Rattus norvegicus
tgaccgcttgcagaacgagggtcca

SEQ ID NO: 607137 - DNA, 25 bp, Rattus norvegicus
tgaccgctttccatttgttctaacg

SEQ ID NO: 607138 - DNA, 25 bp, Rattus norvegicus
tgaccgctttccttttgttctaacg

SEQ ID NO: 607139 - DNA, 25 bp, Rattus norvegicus
tgaccggaacatagatctgaccctg

SEQ ID NO: 607140 - DNA, 25 bp, Rattus norvegicus
tgaccggaacattgatctgaccctg

SEQ ID NO: 607141 - DNA, 25 bp, Rattus norvegicus
tgaccggaacccactgcaaaaacag

SEQ ID NO: 607142 - DNA, 25 bp, Rattus norvegicus
tgaccggaaccctctgcaaaaacag

SEQ ID NO: 607143 - DNA, 25 bp, Rattus norvegicus
tgaccggaactcagtatacccaagt

SEQ ID NO: 607144 - DNA, 25 bp, Rattus norvegicus
tgaccggaactctgtatacccaagt

SEQ ID NO: 607145 - DNA, 25 bp, Rattus norvegicus
tgaccggaacttcccaggctgacaa

SEQ ID NO: 607146 - DNA, 25 bp, Rattus norvegicus
tgaccggaacttgccaggctgacaa

SEQ ID NO: 607147 - DNA, 25 bp, Rattus norvegicus
tgaccggacacaagagaccaaatgg

SEQ ID NO: 607148 - DNA, 25 bp, Rattus norvegicus
tgaccggacacatgagaccaaatgg

SEQ ID NO: 607149 - DNA, 25 bp, Rattus norvegicus
tgaccggaccagcaagccacgctgt

SEQ ID NO: 607150 - DNA, 25 bp, Rattus norvegicus
tgaccggaccaggaagccacgctgt

SEQ ID NO: 607151 - DNA, 25 bp, Rattus norvegicus
tgaccggagatcaactcagactgcc

SEQ ID NO: 607152 - DNA, 25 bp, Rattus norvegicus
tgaccggagatctactcagactgcc

SEQ ID NO: 607153 - DNA, 25 bp, Rattus norvegicus
tgaccggccacacaagtgtccttgt

SEQ ID NO: 607154 - DNA, 25 bp, Rattus norvegicus
tgaccggccacagaagtgtccttgt

SEQ ID NO: 607155 - DNA, 25 bp, Rattus norvegicus
tgaccggccaccctgtgaatgcagc

SEQ ID NO: 607156 - DNA, 25 bp, Rattus norvegicus
tgaccggccaccgtgtgaatgcagc

SEQ ID NO: 607157 - DNA, 25 bp, Rattus norvegicus
tgaccggcctgaagcccagttggaa

SEQ ID NO: 607158 - DNA, 25 bp, Rattus norvegicus
tgaccggcctgatgcccagttggaa

SEQ ID NO: 607159 - DNA, 25 bp, Rattus norvegicus
tgaccggcgtgacagatggcttctt

SEQ ID NO: 607160 - DNA, 25 bp, Rattus norvegicus
tgaccggcgtgagagatggcttctt

SEQ ID NO: 607161 - DNA, 25 bp, Rattus norvegicus
tgaccggctaccagattgacgtgac

SEQ ID NO: 607162 - DNA, 25 bp, Rattus norvegicus
tgaccggctacctgattgacgtgac

SEQ ID NO: 607163 - DNA, 25 bp, Rattus norvegicus
tgaccggctgtaagactccatgaag

SEQ ID NO: 607164 - DNA, 25 bp, Rattus norvegicus
tgaccggctgtatgactccatgaag

SEQ ID NO: 607165 - DNA, 25 bp, Rattus norvegicus
tgaccgggaaaacctggccattcag

SEQ ID NO: 607166 - DNA, 25 bp, Rattus norvegicus
tgaccgggaaaagctggccattcag

SEQ ID NO: 607167 - DNA, 25 bp, Rattus norvegicus
tgaccgggtgctcgtgctccaagcc

SEQ ID NO: 607168 - DNA, 25 bp, Rattus norvegicus
tgaccgggtgctggtgctccaagcc

SEQ ID NO: 607169 - DNA, 25 bp, Rattus norvegicus
tgaccggtgactatggacagggctc

SEQ ID NO: 607170 - DNA, 25 bp, Rattus norvegicus
tgaccggtgactttggacagggctc

SEQ ID NO: 607171 - DNA, 25 bp, Rattus norvegicus
tgaccggttctccacacttttttct

SEQ ID NO: 607172 - DNA, 25 bp, Rattus norvegicus
tgaccggttctcgacacttttttct

SEQ ID NO: 607173 - DNA, 25 bp, Rattus norvegicus
tgaccgtacgcacagccagaggcag

SEQ ID NO: 607174 - DNA, 25 bp, Rattus norvegicus
tgaccgtacgcagagccagaggcag

SEQ ID NO: 607175 - DNA, 25 bp, Rattus norvegicus
tgaccgtagtcgactttgtgcgctt

SEQ ID NO: 607176 - DNA, 25 bp, Rattus norvegicus
tgaccgtagtcgtctttgtgcgctt

SEQ ID NO: 607177 - DNA, 25 bp, Rattus norvegicus
tgaccgtcatcgcaccagaggacaa

SEQ ID NO: 607178 - DNA, 25 bp, Rattus norvegicus
tgaccgtcatcggaccagaggacaa

SEQ ID NO: 607179 - DNA, 25 bp, Rattus norvegicus
tgaccgtccatccattcaatgtcag

SEQ ID NO: 607180 - DNA, 25 bp, Rattus norvegicus
tgaccgtccatcgattcaatgtcag

SEQ ID NO: 607181 - DNA, 25 bp, Rattus norvegicus
tgaccgtcgctcaggcaagaagctg

SEQ ID NO: 607182 - DNA, 25 bp, Rattus norvegicus
tgaccgtcgctctggcaagaagctg

SEQ ID NO: 607183 - DNA, 25 bp, Rattus norvegicus
tgaccgtctttgaaagcgacaaatg

SEQ ID NO: 607184 - DNA, 25 bp, Rattus norvegicus
tgaccgtctttgtaagcgacaaatg

SEQ ID NO: 607185 - DNA, 25 bp, Rattus norvegicus
tgaccgtgaatactctggaccgttt

SEQ ID NO: 607186 - DNA, 25 bp, Rattus norvegicus
tgaccgtgaatagtctggaccgttt

SEQ ID NO: 607187 - DNA, 25 bp, Rattus norvegicus
tgaccgtgaccgagggacctttccg

SEQ ID NO: 607188 - DNA, 25 bp, Rattus norvegicus
tgaccgtgaccgtgggacctttccg

SEQ ID NO: 607189 - DNA, 25 bp, Rattus norvegicus
tgaccgtgacttccactagtgtgag

SEQ ID NO: 607190 - DNA, 25 bp, Rattus norvegicus
tgaccgtgacttgcactagtgtgag

SEQ ID NO: 607191 - DNA, 25 bp, Rattus norvegicus
tgaccgtgatttccaccaagagctg

SEQ ID NO: 607192 - DNA, 25 bp, Rattus norvegicus
tgaccgtgatttgcaccaagagctg

SEQ ID NO: 607193 - DNA, 25 bp, Rattus norvegicus
tgaccgtgccggctgagaaatttgt

SEQ ID NO: 607194 - DNA, 25 bp, Rattus norvegicus
tgaccgtgccgggtgagaaatttgt

SEQ ID NO: 607195 - DNA, 25 bp, Rattus norvegicus
tgaccgtggaggacccagtgactgt

SEQ ID NO: 607196 - DNA, 25 bp, Rattus norvegicus
tgaccgtggaggtcccagtgactgt

SEQ ID NO: 607197 - DNA, 25 bp, Rattus norvegicus
tgaccgtgtctgagttttaagccca

SEQ ID NO: 607198 - DNA, 25 bp, Rattus norvegicus
tgaccgtgtctgtgttttaagccca

SEQ ID NO: 607199 - DNA, 25 bp, Rattus norvegicus
tgaccgttaggtcccttatctttca

SEQ ID NO: 607200 - DNA, 25 bp, Rattus norvegicus
tgaccgttaggtgccttatctttca

SEQ ID NO: 607201 - DNA, 25 bp, Rattus norvegicus
tgaccgtttgctatgtaccactaaa

SEQ ID NO: 607202 - DNA, 25 bp, Rattus norvegicus
tgaccgtttgctttgtaccactaaa

SEQ ID NO: 607203 - DNA, 25 bp, Rattus norvegicus
tgacctaaccagacctcagaatgtt

SEQ ID NO: 607204 - DNA, 25 bp, Rattus norvegicus
tgacctaaccagtcctcagaatgtt

SEQ ID NO: 607205 - DNA, 25 bp, Rattus norvegicus
tgacctaacctgctgctgtgcacag

SEQ ID NO: 607206 - DNA, 25 bp, Rattus norvegicus
tgacctaacctggtgctgtgcacag

SEQ ID NO: 607207 - DNA, 25 bp, Rattus norvegicus
tgacctaacggcatgtcatcttctg

SEQ ID NO: 607208 - DNA, 25 bp, Rattus norvegicus
tgacctaacggcttgtcatcttctg

SEQ ID NO: 607209 - DNA, 25 bp, Rattus norvegicus
tgacctaaggccactctgcacatgt

SEQ ID NO: 607210 - DNA, 25 bp, Rattus norvegicus
tgacctaaggcctctctgcacatgt

SEQ ID NO: 607211 - DNA, 25 bp, Rattus norvegicus
tgacctacagctcctgccttctgga

SEQ ID NO: 607212 - DNA, 25 bp, Rattus norvegicus
tgacctacagctgctgccttctgga

SEQ ID NO: 607213 - DNA, 25 bp, Rattus norvegicus
tgacctacattcacaggcttctttt

SEQ ID NO: 607214 - DNA, 25 bp, Rattus norvegicus
tgacctacattctcaggcttctttt

SEQ ID NO: 607215 - DNA, 25 bp, Rattus norvegicus
tgacctaccagcattatacaacttt

SEQ ID NO: 607216 - DNA, 25 bp, Rattus norvegicus
tgacctaccagctttatacaacttt

SEQ ID NO: 607217 - DNA, 25 bp, Rattus norvegicus
tgacctacctcaagatccagctata

SEQ ID NO: 607218 - DNA, 25 bp, Rattus norvegicus
tgacctacctcatgatccagctata

SEQ ID NO: 607219 - DNA, 25 bp, Rattus norvegicus
tgacctactgtcatgcatcaggctg

SEQ ID NO: 607220 - DNA, 25 bp, Rattus norvegicus
tgacctactgtcttgcatcaggctg

SEQ ID NO: 607221 - DNA, 25 bp, Rattus norvegicus
tgacctagaattaccctctgatgag

SEQ ID NO: 607222 - DNA, 25 bp, Rattus norvegicus
tgacctagaatttccctctgatgag

SEQ ID NO: 607223 - DNA, 25 bp, Rattus norvegicus
tgacctagcaccacgtagagttgtt

SEQ ID NO: 607224 - DNA, 25 bp, Rattus norvegicus
tgacctagcaccagagccatgcatg

SEQ ID NO: 607225 - DNA, 25 bp, Rattus norvegicus
tgacctagcacctcgtagagttgtt

SEQ ID NO: 607226 - DNA, 25 bp, Rattus norvegicus
tgacctagcacctgagccatgcatg

SEQ ID NO: 607227 - DNA, 25 bp, Rattus norvegicus
tgacctaggaggcaccttaccctga

SEQ ID NO: 607228 - DNA, 25 bp, Rattus norvegicus
tgacctaggagggaccttaccctga

SEQ ID NO: 607229 - DNA, 25 bp, Rattus norvegicus
tgacctaggatcactatagcccagg

SEQ ID NO: 607230 - DNA, 25 bp, Rattus norvegicus
tgacctaggatctctatagcccagg

SEQ ID NO: 607231 - DNA, 25 bp, Rattus norvegicus
tgacctaggatgagaccctgactgc

SEQ ID NO: 607232 - DNA, 25 bp, Rattus norvegicus
tgacctaggatgtgaccctgactgc

SEQ ID NO: 607233 - DNA, 25 bp, Rattus norvegicus
tgacctaggctcagctgccttgcac

SEQ ID NO: 607234 - DNA, 25 bp, Rattus norvegicus
tgacctaggctctgctgccttgcac

SEQ ID NO: 607235 - DNA, 25 bp, Rattus norvegicus
tgacctagggcacttcatactcacc

SEQ ID NO: 607236 - DNA, 25 bp, Rattus norvegicus
tgacctagggcagttcatactcacc

SEQ ID NO: 607237 - DNA, 25 bp, Rattus norvegicus
tgacctagtccacaatgcactgtag

SEQ ID NO: 607238 - DNA, 25 bp, Rattus norvegicus
tgacctagtccagaatgcactgtag

SEQ ID NO: 607239 - DNA, 25 bp, Rattus norvegicus
tgacctagttccactgtgtacatgc

SEQ ID NO: 607240 - DNA, 25 bp, Rattus norvegicus
tgacctagttcctctgtgtacatgc

SEQ ID NO: 607241 - DNA, 25 bp, Rattus norvegicus
tgacctagttttcctgcattgtgag

SEQ ID NO: 607242 - DNA, 25 bp, Rattus norvegicus
tgacctagttttgctgcattgtgag

SEQ ID NO: 607243 - DNA, 25 bp, Rattus norvegicus
tgacctatactacacatcacaagtt

SEQ ID NO: 607244 - DNA, 25 bp, Rattus norvegicus
tgacctatactagacatcacaagtt

SEQ ID NO: 607245 - DNA, 25 bp, Rattus norvegicus
tgacctataggtccatctacactgg

SEQ ID NO: 607246 - DNA, 25 bp, Rattus norvegicus
tgacctataggtgcatctacactgg

SEQ ID NO: 607247 - DNA, 25 bp, Rattus norvegicus
tgacctatagtcatgaaaaatgata

SEQ ID NO: 607248 - DNA, 25 bp, Rattus norvegicus
tgacctatagtcttgaaaaatgata

SEQ ID NO: 607249 - DNA, 25 bp, Rattus norvegicus
tgacctatcaacatggatccaccat

SEQ ID NO: 607250 - DNA, 25 bp, Rattus norvegicus
tgacctatcaacttggatccaccat

SEQ ID NO: 607251 - DNA, 25 bp, Rattus norvegicus
tgacctatgatcatgttctctttcc

SEQ ID NO: 607252 - DNA, 25 bp, Rattus norvegicus
tgacctatgatcttgttctctttcc

SEQ ID NO: 607253 - DNA, 25 bp, Rattus norvegicus
tgacctatggcgagcacccggtgga

SEQ ID NO: 607254 - DNA, 25 bp, Rattus norvegicus
tgacctatggcgtgcacccggtgga

SEQ ID NO: 607255 - DNA, 25 bp, Rattus norvegicus
tgacctcaaactagctatcttcctg

SEQ ID NO: 607256 - DNA, 25 bp, Rattus norvegicus
tgacctcaaacttgctatcttcctg

SEQ ID NO: 607257 - DNA, 25 bp, Rattus norvegicus
tgacctcaaatcacacctgtatgca

SEQ ID NO: 607258 - DNA, 25 bp, Rattus norvegicus
tgacctcaaatctcacctgtatgca

SEQ ID NO: 607259 - DNA, 25 bp, Rattus norvegicus
tgacctcaacagcacaatccaggaa

SEQ ID NO: 607260 - DNA, 25 bp, Rattus norvegicus
tgacctcaacaggacaatccaggaa

SEQ ID NO: 607261 - DNA, 25 bp, Rattus norvegicus
tgacctcaactacatggtctacatg

SEQ ID NO: 607262 - DNA, 25 bp, Rattus norvegicus
tgacctcaactagatggtctacatg

SEQ ID NO: 607263 - DNA, 25 bp, Rattus norvegicus
tgacctcaatcacgacctcatggac

SEQ ID NO: 607264 - DNA, 25 bp, Rattus norvegicus
tgacctcaatcaggacctcatggac

SEQ ID NO: 607265 - DNA, 25 bp, Rattus norvegicus
tgacctcacacaagacctgactgtt

SEQ ID NO: 607266 - DNA, 25 bp, Rattus norvegicus
tgacctcacacatgacctgactgtt

SEQ ID NO: 607267 - DNA, 25 bp, Rattus norvegicus
tgacctcaccctaacttttatactt

SEQ ID NO: 607268 - DNA, 25 bp, Rattus norvegicus
tgacctcacccttacttttatactt

SEQ ID NO: 607269 - DNA, 25 bp, Rattus norvegicus
tgacctcacctacagctgggatgta

SEQ ID NO: 607270 - DNA, 25 bp, Rattus norvegicus
tgacctcacctagagctgggatgta

SEQ ID NO: 607271 - DNA, 25 bp, Rattus norvegicus
tgacctcactagacctcatgtgaag

SEQ ID NO: 607272 - DNA, 25 bp, Rattus norvegicus
tgacctcactagtcctcatgtgaag

SEQ ID NO: 607273 - DNA, 25 bp, Rattus norvegicus
tgacctcactgaaggcctgggttta

SEQ ID NO: 607274 - DNA, 25 bp, Rattus norvegicus
tgacctcactgatggcctgggttta

SEQ ID NO: 607275 - DNA, 25 bp, Rattus norvegicus
tgacctcactgcagagtgcgcacgc

SEQ ID NO: 607276 - DNA, 25 bp, Rattus norvegicus
tgacctcactgctgagtgcgcacgc

SEQ ID NO: 607277 - DNA, 25 bp, Rattus norvegicus
tgacctcagcctctgtgagcagtga

SEQ ID NO: 607278 - DNA, 25 bp, Rattus norvegicus
tgacctcagcctgtgtgagcagtga

SEQ ID NO: 607279 - DNA, 25 bp, Rattus norvegicus
tgacctcagctgcacacagtgggta

SEQ ID NO: 607280 - DNA, 25 bp, Rattus norvegicus
tgacctcagctggacacagtgggta

SEQ ID NO: 607281 - DNA, 25 bp, Rattus norvegicus
tgacctcagcttacctagtggtgtg

SEQ ID NO: 607282 - DNA, 25 bp, Rattus norvegicus
tgacctcagctttcctagtggtgtg

SEQ ID NO: 607283 - DNA, 25 bp, Rattus norvegicus
tgacctcaggagacagggtctcaga

SEQ ID NO: 607284 - DNA, 25 bp, Rattus norvegicus
tgacctcaggagtcagggtctcaga

SEQ ID NO: 607285 - DNA, 25 bp, Rattus norvegicus
tgacctcaggtgactagcctctgga

SEQ ID NO: 607286 - DNA, 25 bp, Rattus norvegicus
tgacctcaggtgtctagcctctgga

SEQ ID NO: 607287 - DNA, 25 bp, Rattus norvegicus
tgacctcagtaaatacagccctcct

SEQ ID NO: 607288 - DNA, 25 bp, Rattus norvegicus
tgacctcagtaattacagccctcct

SEQ ID NO: 607289 - DNA, 25 bp, Rattus norvegicus
tgacctcatcctaacgttgccgaag

SEQ ID NO: 607290 - DNA, 25 bp, Rattus norvegicus
tgacctcatccttacgttgccgaag

SEQ ID NO: 607291 - DNA, 25 bp, Rattus norvegicus
tgacctcatcgaatccatgctgaaa

SEQ ID NO: 607292 - DNA, 25 bp, Rattus norvegicus
tgacctcatcgattccatgctgaaa

SEQ ID NO: 607293 - DNA, 25 bp, Rattus norvegicus
tgacctcatcttaccagtgagctgg

SEQ ID NO: 607294 - DNA, 25 bp, Rattus norvegicus
tgacctcatctttccagtgagctgg

SEQ ID NO: 607295 - DNA, 25 bp, Rattus norvegicus
tgacctcatgagaaagagcgttcct

SEQ ID NO: 607296 - DNA, 25 bp, Rattus norvegicus
tgacctcatgagtaagagcgttcct

SEQ ID NO: 607297 - DNA, 25 bp, Rattus norvegicus
tgacctcatgccaagtagatccaat

SEQ ID NO: 607298 - DNA, 25 bp, Rattus norvegicus
tgacctcatgcctagtagatccaat

SEQ ID NO: 607299 - DNA, 25 bp, Rattus norvegicus
tgacctcatgctctggatggaagat

SEQ ID NO: 607300 - DNA, 25 bp, Rattus norvegicus
tgacctcatgctgtggatggaagat

SEQ ID NO: 607301 - DNA, 25 bp, Rattus norvegicus
tgacctcattgcatgtggcttccaa

SEQ ID NO: 607302 - DNA, 25 bp, Rattus norvegicus
tgacctcattgcttgtggcttccaa

SEQ ID NO: 607303 - DNA, 25 bp, Rattus norvegicus
tgacctccaaacagacccgaagggt

SEQ ID NO: 607304 - DNA, 25 bp, Rattus norvegicus
tgacctccaaactgacccgaagggt

SEQ ID NO: 607305 - DNA, 25 bp, Rattus norvegicus
tgacctccaagtccaagagtcccaa

SEQ ID NO: 607306 - DNA, 25 bp, Rattus norvegicus
tgacctccaagtgcaagagtcccaa

SEQ ID NO: 607307 - DNA, 25 bp, Rattus norvegicus
tgacctccacacaaacatcatagca

SEQ ID NO: 607308 - DNA, 25 bp, Rattus norvegicus
tgacctccacacaactgagccatct

SEQ ID NO: 607309 - DNA, 25 bp, Rattus norvegicus
tgacctccacactaacatcatagca

SEQ ID NO: 607310 - DNA, 25 bp, Rattus norvegicus
tgacctccacactactgagccatct

SEQ ID NO: 607311 - DNA, 25 bp, Rattus norvegicus
tgacctccacatctgggctgtagtg

SEQ ID NO: 607312 - DNA, 25 bp, Rattus norvegicus
tgacctccacatgtgggctgtagtg

SEQ ID NO: 607313 - DNA, 25 bp, Rattus norvegicus
tgacctccagatatgtgccatcagc

SEQ ID NO: 607314 - DNA, 25 bp, Rattus norvegicus
tgacctccagatttgtgccatcagc

SEQ ID NO: 607315 - DNA, 25 bp, Rattus norvegicus
tgacctccagcacgtgtgtccggat

SEQ ID NO: 607316 - DNA, 25 bp, Rattus norvegicus
tgacctccagcaggtgtgtccggat

SEQ ID NO: 607317 - DNA, 25 bp, Rattus norvegicus
tgacctccatggcttgttacttgcc

SEQ ID NO: 607318 - DNA, 25 bp, Rattus norvegicus
tgacctccatgggttgttacttgcc

SEQ ID NO: 607319 - DNA, 25 bp, Rattus norvegicus
tgacctccattgcagaccgattgaa

SEQ ID NO: 607320 - DNA, 25 bp, Rattus norvegicus
tgacctccattggagaccgattgaa

SEQ ID NO: 607321 - DNA, 25 bp, Rattus norvegicus
tgacctcccaccagtggtctttttt

SEQ ID NO: 607322 - DNA, 25 bp, Rattus norvegicus
tgacctcccacctgtggtctttttt

SEQ ID NO: 607323 - DNA, 25 bp, Rattus norvegicus
tgacctccccacatcataaggagag

SEQ ID NO: 607324 - DNA, 25 bp, Rattus norvegicus
tgacctccccacttcataaggagag

SEQ ID NO: 607325 - DNA, 25 bp, Rattus norvegicus
tgacctccctgtaggatcagtacgt

SEQ ID NO: 607326 - DNA, 25 bp, Rattus norvegicus
tgacctccctgtcctacatggatgc

SEQ ID NO: 607327 - DNA, 25 bp, Rattus norvegicus
tgacctccctgtgctacatggatgc

SEQ ID NO: 607328 - DNA, 25 bp, Rattus norvegicus
tgacctccctgttggatcagtacgt

SEQ ID NO: 607329 - DNA, 25 bp, Rattus norvegicus
tgacctcccttgcatgtaacatgtt

SEQ ID NO: 607330 - DNA, 25 bp, Rattus norvegicus
tgacctcccttggatgtaacatgtt

SEQ ID NO: 607331 - DNA, 25 bp, Rattus norvegicus
tgacctcctcccagtgttctgggaa

SEQ ID NO: 607332 - DNA, 25 bp, Rattus norvegicus
tgacctcctccctgtgttctgggaa

SEQ ID NO: 607333 - DNA, 25 bp, Rattus norvegicus
tgacctcctcctatagtgtgtgtgg

SEQ ID NO: 607334 - DNA, 25 bp, Rattus norvegicus
tgacctcctcctttagtgtgtgtgg

SEQ ID NO: 607335 - DNA, 25 bp, Rattus norvegicus
tgacctcctcttcgctgaagttgac

SEQ ID NO: 607336 - DNA, 25 bp, Rattus norvegicus
tgacctcctcttggctgaagttgac

SEQ ID NO: 607337 - DNA, 25 bp, Rattus norvegicus
tgacctcctgtccagattggtggag

SEQ ID NO: 607338 - DNA, 25 bp, Rattus norvegicus
tgacctcctgtcgagattggtggag

SEQ ID NO: 607339 - DNA, 25 bp, Rattus norvegicus
tgacctcgatgtcgccgacagaacc

SEQ ID NO: 607340 - DNA, 25 bp, Rattus norvegicus
tgacctcgatgtggccgacagaacc

SEQ ID NO: 607341 - DNA, 25 bp, Rattus norvegicus
tgacctcgcactctactttgggaac

SEQ ID NO: 607342 - DNA, 25 bp, Rattus norvegicus
tgacctcgcactgtactttgggaac

SEQ ID NO: 607343 - DNA, 25 bp, Rattus norvegicus
tgacctcgctagatactactacagt

SEQ ID NO: 607344 - DNA, 25 bp, Rattus norvegicus
tgacctcgctagttactactacagt

SEQ ID NO: 607345 - DNA, 25 bp, Rattus norvegicus
tgacctcggagcattggactctgaa

SEQ ID NO: 607346 - DNA, 25 bp, Rattus norvegicus
tgacctcggagctttggactctgaa

SEQ ID NO: 607347 - DNA, 25 bp, Rattus norvegicus
tgacctcggcatccatgctatgaca

SEQ ID NO: 607348 - DNA, 25 bp, Rattus norvegicus
tgacctcggcatgcatgctatgaca

SEQ ID NO: 607349 - DNA, 25 bp, Rattus norvegicus
tgacctcggccacggaggaatcctt

SEQ ID NO: 607350 - DNA, 25 bp, Rattus norvegicus
tgacctcggccagggaggaatcctt

SEQ ID NO: 607351 - DNA, 25 bp, Rattus norvegicus
tgacctcgggacattggagtctgaa

SEQ ID NO: 607352 - DNA, 25 bp, Rattus norvegicus
tgacctcgggactttggagtctgaa

SEQ ID NO: 607353 - DNA, 25 bp, Rattus norvegicus
tgacctctatataaactgacaccgt

SEQ ID NO: 607354 - DNA, 25 bp, Rattus norvegicus
tgacctctatataagctgaagtgca

SEQ ID NO: 607355 - DNA, 25 bp, Rattus norvegicus
tgacctctatattaactgacaccgt

SEQ ID NO: 607356 - DNA, 25 bp, Rattus norvegicus
tgacctctatattagctgaagtgca

SEQ ID NO: 607357 - DNA, 25 bp, Rattus norvegicus
tgacctctatgccttacacggtgtt

SEQ ID NO: 607358 - DNA, 25 bp, Rattus norvegicus
tgacctctatgcgttacacggtgtt

SEQ ID NO: 607359 - DNA, 25 bp, Rattus norvegicus
tgacctctcacacgcaaatcaggga

SEQ ID NO: 607360 - DNA, 25 bp, Rattus norvegicus
tgacctctcacacgccaatcagtta

SEQ ID NO: 607361 - DNA, 25 bp, Rattus norvegicus
tgacctctcacaggcaaatcaggga

SEQ ID NO: 607362 - DNA, 25 bp, Rattus norvegicus
tgacctctcacaggccaatcagtta

SEQ ID NO: 607363 - DNA, 25 bp, Rattus norvegicus
tgacctctcagcaggtgtcaactgc

SEQ ID NO: 607364 - DNA, 25 bp, Rattus norvegicus
tgacctctcagctggtgtcaactgc

SEQ ID NO: 607365 - DNA, 25 bp, Rattus norvegicus
tgacctctcaggcagcatcaatgat

SEQ ID NO: 607366 - DNA, 25 bp, Rattus norvegicus
tgacctctcagggagcatcaatgat

SEQ ID NO: 607367 - DNA, 25 bp, Rattus norvegicus
tgacctctccatatacagaacgcaa

SEQ ID NO: 607368 - DNA, 25 bp, Rattus norvegicus
tgacctctccatttacagaacgcaa

SEQ ID NO: 607369 - DNA, 25 bp, Rattus norvegicus
tgacctctcctgagtgataggcttt

SEQ ID NO: 607370 - DNA, 25 bp, Rattus norvegicus
tgacctctcctgtgtgataggcttt

SEQ ID NO: 607371 - DNA, 25 bp, Rattus norvegicus
tgacctctcggcacagtgagacact

SEQ ID NO: 607372 - DNA, 25 bp, Rattus norvegicus
tgacctctcggctcagtgagacact

SEQ ID NO: 607373 - DNA, 25 bp, Rattus norvegicus
tgacctctgaaaatgcactttccct

SEQ ID NO: 607374 - DNA, 25 bp, Rattus norvegicus
tgacctctgaaattgcactttccct

SEQ ID NO: 607375 - DNA, 25 bp, Rattus norvegicus
tgacctctgaccactcagtaaataa

SEQ ID NO: 607376 - DNA, 25 bp, Rattus norvegicus
tgacctctgacctctcagtaaataa

SEQ ID NO: 607377 - DNA, 25 bp, Rattus norvegicus
tgacctctgcacctacatgcagaac

SEQ ID NO: 607378 - DNA, 25 bp, Rattus norvegicus
tgacctctgcacgtacatgcagaac

SEQ ID NO: 607379 - DNA, 25 bp, Rattus norvegicus
tgacctctgcagattcttgaattaa

SEQ ID NO: 607380 - DNA, 25 bp, Rattus norvegicus
tgacctctgcagtttcttgaattaa

SEQ ID NO: 607381 - DNA, 25 bp, Rattus norvegicus
tgacctctgcctacaagtactgaga

SEQ ID NO: 607382 - DNA, 25 bp, Rattus norvegicus
tgacctctgccttcaagtactgaga

SEQ ID NO: 607383 - DNA, 25 bp, Rattus norvegicus
tgacctctgctcctgtagtgggtaa

SEQ ID NO: 607384 - DNA, 25 bp, Rattus norvegicus
tgacctctgctcgtgtagtgggtaa

SEQ ID NO: 607385 - DNA, 25 bp, Rattus norvegicus
tgacctctggcaccaggctcacatg

SEQ ID NO: 607386 - DNA, 25 bp, Rattus norvegicus
tgacctctggcagcaggctcacatg

SEQ ID NO: 607387 - DNA, 25 bp, Rattus norvegicus
tgacctctgtcgcttgctatctttc

SEQ ID NO: 607388 - DNA, 25 bp, Rattus norvegicus
tgacctctgtcggttgctatctttc

SEQ ID NO: 607389 - DNA, 25 bp, Rattus norvegicus
tgacctctgtgccatctgtatgact

SEQ ID NO: 607390 - DNA, 25 bp, Rattus norvegicus
tgacctctgtgcgatctgtatgact

SEQ ID NO: 607391 - DNA, 25 bp, Rattus norvegicus
tgacctctgtttatagtccattcct

SEQ ID NO: 607392 - DNA, 25 bp, Rattus norvegicus
tgacctctgtttttagtccattcct

SEQ ID NO: 607393 - DNA, 25 bp, Rattus norvegicus
tgacctcttaatcctgcacttccaa

SEQ ID NO: 607394 - DNA, 25 bp, Rattus norvegicus
tgacctcttaatgctgcacttccaa

SEQ ID NO: 607395 - DNA, 25 bp, Rattus norvegicus
tgacctcttcctattaggttgattt

SEQ ID NO: 607396 - DNA, 25 bp, Rattus norvegicus
tgacctcttccttttaggttgattt

SEQ ID NO: 607397 - DNA, 25 bp, Rattus norvegicus
tgacctcttgcaacatggctggaat

SEQ ID NO: 607398 - DNA, 25 bp, Rattus norvegicus
tgacctcttgcatcatggctggaat

SEQ ID NO: 607399 - DNA, 25 bp, Rattus norvegicus
tgacctcttggacccacacaaatgt

SEQ ID NO: 607400 - DNA, 25 bp, Rattus norvegicus
tgacctcttggagccacacaaatgt

SEQ ID NO: 607401 - DNA, 25 bp, Rattus norvegicus
tgacctcttgttccctgtgatttaa

SEQ ID NO: 607402 - DNA, 25 bp, Rattus norvegicus
tgacctcttgttgcctgtgatttaa

SEQ ID NO: 607403 - DNA, 25 bp, Rattus norvegicus
tgacctctttccacacctaaaaata

SEQ ID NO: 607404 - DNA, 25 bp, Rattus norvegicus
tgacctctttcctcacctaaaaata

SEQ ID NO: 607405 - DNA, 25 bp, Rattus norvegicus
tgacctctttctccctgaggacaca

SEQ ID NO: 607406 - DNA, 25 bp, Rattus norvegicus
tgacctctttctgcctgaggacaca

SEQ ID NO: 607407 - DNA, 25 bp, Rattus norvegicus
tgacctctttttccatctttagcag

SEQ ID NO: 607408 - DNA, 25 bp, Rattus norvegicus
tgacctctttttgcatctttagcag

SEQ ID NO: 607409 - DNA, 25 bp, Rattus norvegicus
tgacctgaaggcagctccctaaaga

SEQ ID NO: 607410 - DNA, 25 bp, Rattus norvegicus
tgacctgaaggctgctccctaaaga

SEQ ID NO: 607411 - DNA, 25 bp, Rattus norvegicus
tgacctgacatcaaacctgcaatgg

SEQ ID NO: 607412 - DNA, 25 bp, Rattus norvegicus
tgacctgacatctaacctgcaatgg

SEQ ID NO: 607413 - DNA, 25 bp, Rattus norvegicus
tgacctgaccatcaagctgccagac

SEQ ID NO: 607414 - DNA, 25 bp, Rattus norvegicus
tgacctgaccatgaagctgccagac

SEQ ID NO: 607415 - DNA, 25 bp, Rattus norvegicus
tgacctgagactacaaacatccaag

SEQ ID NO: 607416 - DNA, 25 bp, Rattus norvegicus
tgacctgagacttcaaacatccaag

SEQ ID NO: 607417 - DNA, 25 bp, Rattus norvegicus
tgacctgaggtcacacagcattagc

SEQ ID NO: 607418 - DNA, 25 bp, Rattus norvegicus
tgacctgaggtctcacagcattagc

SEQ ID NO: 607419 - DNA, 25 bp, Rattus norvegicus
tgacctgaggttagacagatggctc

SEQ ID NO: 607420 - DNA, 25 bp, Rattus norvegicus
tgacctgaggtttgacagatggctc

SEQ ID NO: 607421 - DNA, 25 bp, Rattus norvegicus
tgacctgagtcacctgtgtcacttg

SEQ ID NO: 607422 - DNA, 25 bp, Rattus norvegicus
tgacctgagtcagctgtgtcacttg

SEQ ID NO: 607423 - DNA, 25 bp, Rattus norvegicus
tgacctgagttcacttcccagaata

SEQ ID NO: 607424 - DNA, 25 bp, Rattus norvegicus
tgacctgagttctcttcccagaata

SEQ ID NO: 607425 - DNA, 25 bp, Rattus norvegicus
tgacctgagttgaacacactcggtg

SEQ ID NO: 607426 - DNA, 25 bp, Rattus norvegicus
tgacctgagttgtacacactcggtg

SEQ ID NO: 607427 - DNA, 25 bp, Rattus norvegicus
tgacctgataggatccatgctcgtt

SEQ ID NO: 607428 - DNA, 25 bp, Rattus norvegicus
tgacctgataggttccatgctcgtt

SEQ ID NO: 607429 - DNA, 25 bp, Rattus norvegicus
tgacctgattccactcactgtaaag

SEQ ID NO: 607430 - DNA, 25 bp, Rattus norvegicus
tgacctgattcctctcactgtaaag

SEQ ID NO: 607431 - DNA, 25 bp, Rattus norvegicus
tgacctgcacacatacctagggaag

SEQ ID NO: 607432 - DNA, 25 bp, Rattus norvegicus
tgacctgcacacttacctagggaag

SEQ ID NO: 607433 - DNA, 25 bp, Rattus norvegicus
tgacctgcagaacagtatacttttg

SEQ ID NO: 607434 - DNA, 25 bp, Rattus norvegicus
tgacctgcagaactgctctagctca

SEQ ID NO: 607435 - DNA, 25 bp, Rattus norvegicus
tgacctgcagaagagtatacttttg

SEQ ID NO: 607436 - DNA, 25 bp, Rattus norvegicus
tgacctgcagaagtgctctagctca

SEQ ID NO: 607437 - DNA, 25 bp, Rattus norvegicus
tgacctgcagggatacagaccttcc

SEQ ID NO: 607438 - DNA, 25 bp, Rattus norvegicus
tgacctgcagggttacagaccttcc

SEQ ID NO: 607439 - DNA, 25 bp, Rattus norvegicus
tgacctgcagtcaatactaacccac

SEQ ID NO: 607440 - DNA, 25 bp, Rattus norvegicus
tgacctgcagtctatactaacccac

SEQ ID NO: 607441 - DNA, 25 bp, Rattus norvegicus
tgacctgcagttcgctcacaaactt

SEQ ID NO: 607442 - DNA, 25 bp, Rattus norvegicus
tgacctgcagttggctcacaaactt

SEQ ID NO: 607443 - DNA, 25 bp, Rattus norvegicus
tgacctgcatggctcagggccctcg

SEQ ID NO: 607444 - DNA, 25 bp, Rattus norvegicus
tgacctgcatgggtcagggccctcg

SEQ ID NO: 607445 - DNA, 25 bp, Rattus norvegicus
tgacctgcatgtactcagaggccca

SEQ ID NO: 607446 - DNA, 25 bp, Rattus norvegicus
tgacctgcatgttctcagaggccca

SEQ ID NO: 607447 - DNA, 25 bp, Rattus norvegicus
tgacctgcattaccttggtaaccat

SEQ ID NO: 607448 - DNA, 25 bp, Rattus norvegicus
tgacctgcattagcttggtaaccat

SEQ ID NO: 607449 - DNA, 25 bp, Rattus norvegicus
tgacctgccactctgtctctgtgga

SEQ ID NO: 607450 - DNA, 25 bp, Rattus norvegicus
tgacctgccactgtgtctctgtgga

SEQ ID NO: 607451 - DNA, 25 bp, Rattus norvegicus
tgacctgcccatcagagacttgtct

SEQ ID NO: 607452 - DNA, 25 bp, Rattus norvegicus
tgacctgcccatgagagacttgtct

SEQ ID NO: 607453 - DNA, 25 bp, Rattus norvegicus
tgacctgcctgcagcagtgtgagct

SEQ ID NO: 607454 - DNA, 25 bp, Rattus norvegicus
tgacctgcctgctgcagtgtgagct

SEQ ID NO: 607455 - DNA, 25 bp, Rattus norvegicus
tgacctgcgctcagacctttgctga

SEQ ID NO: 607456 - DNA, 25 bp, Rattus norvegicus
tgacctgcgctctgacctttgctga

SEQ ID NO: 607457 - DNA, 25 bp, Rattus norvegicus
tgacctgctcagactgctgattggg

SEQ ID NO: 607458 - DNA, 25 bp, Rattus norvegicus
tgacctgctcagtctgctgattggg

SEQ ID NO: 607459 - DNA, 25 bp, Rattus norvegicus
tgacctgctccgagctggaaagagt

SEQ ID NO: 607460 - DNA, 25 bp, Rattus norvegicus
tgacctgctccgtgctggaaagagt

SEQ ID NO: 607461 - DNA, 25 bp, Rattus norvegicus
tgacctgctgcacaagtaccgagag

SEQ ID NO: 607462 - DNA, 25 bp, Rattus norvegicus
tgacctgctgcagaagtaccgagag

SEQ ID NO: 607463 - DNA, 25 bp, Rattus norvegicus
tgacctgctgctccagagggctgtt

SEQ ID NO: 607464 - DNA, 25 bp, Rattus norvegicus
tgacctgctgctgcagagggctgtt

SEQ ID NO: 607465 - DNA, 25 bp, Rattus norvegicus
tgacctgcttcacccagctttgctg

SEQ ID NO: 607466 - DNA, 25 bp, Rattus norvegicus
tgacctgcttcagccagctttgctg

SEQ ID NO: 607467 - DNA, 25 bp, Rattus norvegicus
tgacctgctttgactcctgaataag

SEQ ID NO: 607468 - DNA, 25 bp, Rattus norvegicus
tgacctgctttgtctcctgaataag

SEQ ID NO: 607469 - DNA, 25 bp, Rattus norvegicus
tgacctgcttttaggttcccaagga

SEQ ID NO: 607470 - DNA, 25 bp, Rattus norvegicus
tgacctgctttttggttcccaagga

SEQ ID NO: 607471 - DNA, 25 bp, Rattus norvegicus
tgacctggaactagggctttcgccc

SEQ ID NO: 607472 - DNA, 25 bp, Rattus norvegicus
tgacctggaacttgggctttcgccc

SEQ ID NO: 607473 - DNA, 25 bp, Rattus norvegicus
tgacctggaattattgtgactgctg

SEQ ID NO: 607474 - DNA, 25 bp, Rattus norvegicus
tgacctggaatttttgtgactgctg

SEQ ID NO: 607475 - DNA, 25 bp, Rattus norvegicus
tgacctggacttaagggctctcagc

SEQ ID NO: 607476 - DNA, 25 bp, Rattus norvegicus
tgacctggactttagggctctcagc

SEQ ID NO: 607477 - DNA, 25 bp, Rattus norvegicus
tgacctggagctccctacatatata

SEQ ID NO: 607478 - DNA, 25 bp, Rattus norvegicus
tgacctggagctgcctacatatata

SEQ ID NO: 607479 - DNA, 25 bp, Rattus norvegicus
tgacctggatgaccttgaggcctcc

SEQ ID NO: 607480 - DNA, 25 bp, Rattus norvegicus
tgacctggatgagcttgaggcctcc

SEQ ID NO: 607481 - DNA, 25 bp, Rattus norvegicus
tgacctggattcagccctggcacgg

SEQ ID NO: 607482 - DNA, 25 bp, Rattus norvegicus
tgacctggattctgccctggcacgg

SEQ ID NO: 607483 - DNA, 25 bp, Rattus norvegicus
tgacctggatttccttctgcttcag

SEQ ID NO: 607484 - DNA, 25 bp, Rattus norvegicus
tgacctggatttgcttctgcttcag

SEQ ID NO: 607485 - DNA, 25 bp, Rattus norvegicus
tgacctggcacaagttcaccataaa

SEQ ID NO: 607486 - DNA, 25 bp, Rattus norvegicus
tgacctggcacatgttcaccataaa

SEQ ID NO: 607487 - DNA, 25 bp, Rattus norvegicus
tgacctggccaaccaagaccgttgt

SEQ ID NO: 607488 - DNA, 25 bp, Rattus norvegicus
tgacctggccaagcaagaccgttgt

SEQ ID NO: 607489 - DNA, 25 bp, Rattus norvegicus
tgacctggcgcgaattggcatcacc

SEQ ID NO: 607490 - DNA, 25 bp, Rattus norvegicus
tgacctggcgcgtattggcatcacc

SEQ ID NO: 607491 - DNA, 25 bp, Rattus norvegicus
tgacctggctgtaaactttgccctc

SEQ ID NO: 607492 - DNA, 25 bp, Rattus norvegicus
tgacctggctgttaactttgccctc

SEQ ID NO: 607493 - DNA, 25 bp, Rattus norvegicus
tgacctgggacacgtgtgcacctcg

SEQ ID NO: 607494 - DNA, 25 bp, Rattus norvegicus
tgacctgggacaggtgtgcacctcg

SEQ ID NO: 607495 - DNA, 25 bp, Rattus norvegicus
tgacctgggagactttcctgggatt

SEQ ID NO: 607496 - DNA, 25 bp, Rattus norvegicus
tgacctgggagagtttcctgggatt

SEQ ID NO: 607497 - DNA, 25 bp, Rattus norvegicus
tgacctgggaggaggcattcacata

SEQ ID NO: 607498 - DNA, 25 bp, Rattus norvegicus
tgacctgggaggtggcattcacata

SEQ ID NO: 607499 - DNA, 25 bp, Rattus norvegicus
tgacctgggatgatcccgacggaag

SEQ ID NO: 607500 - DNA, 25 bp, Rattus norvegicus
tgacctgggatgttcccgacggaag

SEQ ID NO: 607501 - DNA, 25 bp, Rattus norvegicus
tgacctgggcagacccttaggtgta

SEQ ID NO: 607502 - DNA, 25 bp, Rattus norvegicus
tgacctgggcagtcccttaggtgta

SEQ ID NO: 607503 - DNA, 25 bp, Rattus norvegicus
tgacctgggccgcattgtctggacc

SEQ ID NO: 607504 - DNA, 25 bp, Rattus norvegicus
tgacctgggccggattgtctggacc

SEQ ID NO: 607505 - DNA, 25 bp, Rattus norvegicus
tgacctggtataccttcagcgcatc

SEQ ID NO: 607506 - DNA, 25 bp, Rattus norvegicus
tgacctggtatagcttcagcgcatc

SEQ ID NO: 607507 - DNA, 25 bp, Rattus norvegicus
tgacctggtcatcctggacaacttc

SEQ ID NO: 607508 - DNA, 25 bp, Rattus norvegicus
tgacctggtcatgctggacaacttc

SEQ ID NO: 607509 - DNA, 25 bp, Rattus norvegicus
tgacctggttaaatactgtcttaaa

SEQ ID NO: 607510 - DNA, 25 bp, Rattus norvegicus
tgacctggttaattactgtcttaaa

SEQ ID NO: 607511 - DNA, 25 bp, Rattus norvegicus
tgacctggtttgaattccctatgct

SEQ ID NO: 607512 - DNA, 25 bp, Rattus norvegicus
tgacctggtttgtattccctatgct

SEQ ID NO: 607513 - DNA, 25 bp, Rattus norvegicus
tgacctgtaaacagtctccagacgg

SEQ ID NO: 607514 - DNA, 25 bp, Rattus norvegicus
tgacctgtaaactgtctccagacgg

SEQ ID NO: 607515 - DNA, 25 bp, Rattus norvegicus
tgacctgtacccaacattcatgaac

SEQ ID NO: 607516 - DNA, 25 bp, Rattus norvegicus
tgacctgtaccctacattcatgaac

SEQ ID NO: 607517 - DNA, 25 bp, Rattus norvegicus
tgacctgtcaccaaacaaactacgt

SEQ ID NO: 607518 - DNA, 25 bp, Rattus norvegicus
tgacctgtcacctaacaaactacgt

SEQ ID NO: 607519 - DNA, 25 bp, Rattus norvegicus
tgacctgtcatcatcccattaaaaa

SEQ ID NO: 607520 - DNA, 25 bp, Rattus norvegicus
tgacctgtcatcttcccattaaaaa

SEQ ID NO: 607521 - DNA, 25 bp, Rattus norvegicus
tgacctgtccacacaggcagtgtat

SEQ ID NO: 607522 - DNA, 25 bp, Rattus norvegicus
tgacctgtccactcaggcagtgtat

SEQ ID NO: 607523 - DNA, 25 bp, Rattus norvegicus
tgacctgtctataatatcccgcaag

SEQ ID NO: 607524 - DNA, 25 bp, Rattus norvegicus
tgacctgtctattatatcccgcaag

SEQ ID NO: 607525 - DNA, 25 bp, Rattus norvegicus
tgacctgtctgtattctttcctctt

SEQ ID NO: 607526 - DNA, 25 bp, Rattus norvegicus
tgacctgtctgttttctttcctctt

SEQ ID NO: 607527 - DNA, 25 bp, Rattus norvegicus
tgacctgtgaggacatcctgtgtct

SEQ ID NO: 607528 - DNA, 25 bp, Rattus norvegicus
tgacctgtgaggtcatcctgtgtct

SEQ ID NO: 607529 - DNA, 25 bp, Rattus norvegicus
tgacctgtgatgctgcagacaccac

SEQ ID NO: 607530 - DNA, 25 bp, Rattus norvegicus
tgacctgtgatggtgcagacaccac

SEQ ID NO: 607531 - DNA, 25 bp, Rattus norvegicus
tgacctgtggccaagagtccactaa

SEQ ID NO: 607532 - DNA, 25 bp, Rattus norvegicus
tgacctgtggcctagagtccactaa

SEQ ID NO: 607533 - DNA, 25 bp, Rattus norvegicus
tgacctgttactacacatgcaatgg

SEQ ID NO: 607534 - DNA, 25 bp, Rattus norvegicus
tgacctgttacttcacatgcaatgg

SEQ ID NO: 607535 - DNA, 25 bp, Rattus norvegicus
tgacctgttccccactgatattggc

SEQ ID NO: 607536 - DNA, 25 bp, Rattus norvegicus
tgacctgttcccgactgatattggc

SEQ ID NO: 607537 - DNA, 25 bp, Rattus norvegicus
tgacctgttcgacgcagctatctta

SEQ ID NO: 607538 - DNA, 25 bp, Rattus norvegicus
tgacctgttcgaggcagctatctta

SEQ ID NO: 607539 - DNA, 25 bp, Rattus norvegicus
tgacctgttctgagcacctgttagt

SEQ ID NO: 607540 - DNA, 25 bp, Rattus norvegicus
tgacctgttctgtgcacctgttagt

SEQ ID NO: 607541 - DNA, 25 bp, Rattus norvegicus
tgacctgttttgattgggctgcata

SEQ ID NO: 607542 - DNA, 25 bp, Rattus norvegicus
tgacctgttttgtttgggctgcata

SEQ ID NO: 607543 - DNA, 25 bp, Rattus norvegicus
tgaccttaaaacatccccgttgcat

SEQ ID NO: 607544 - DNA, 25 bp, Rattus norvegicus
tgaccttaaaacttccccgttgcat

SEQ ID NO: 607545 - DNA, 25 bp, Rattus norvegicus
tgaccttaactgcatgtttcttgtt

SEQ ID NO: 607546 - DNA, 25 bp, Rattus norvegicus
tgaccttaactggatgtttcttgtt

SEQ ID NO: 607547 - DNA, 25 bp, Rattus norvegicus
tgaccttatagaccgcattcgggca

SEQ ID NO: 607548 - DNA, 25 bp, Rattus norvegicus
tgaccttatagagcgcattcgggca

SEQ ID NO: 607549 - DNA, 25 bp, Rattus norvegicus
tgaccttcaactacacagcatggag

SEQ ID NO: 607550 - DNA, 25 bp, Rattus norvegicus
tgaccttcaacttcacagcatggag

SEQ ID NO: 607551 - DNA, 25 bp, Rattus norvegicus
tgaccttcacataactttattggag

SEQ ID NO: 607552 - DNA, 25 bp, Rattus norvegicus
tgaccttcacattactttattggag

SEQ ID NO: 607553 - DNA, 25 bp, Rattus norvegicus
tgaccttcaggacatcatgcaccat

SEQ ID NO: 607554 - DNA, 25 bp, Rattus norvegicus
tgaccttcaggagatcatgcaccat

SEQ ID NO: 607555 - DNA, 25 bp, Rattus norvegicus
tgaccttcatgaccttacatagctc

SEQ ID NO: 607556 - DNA, 25 bp, Rattus norvegicus
tgaccttcatgagcttacatagctc

SEQ ID NO: 607557 - DNA, 25 bp, Rattus norvegicus
tgaccttcattacaagccacaccta

SEQ ID NO: 607558 - DNA, 25 bp, Rattus norvegicus
tgaccttcattagaagccacaccta

SEQ ID NO: 607559 - DNA, 25 bp, Rattus norvegicus
tgaccttccattactgctgtttgac

SEQ ID NO: 607560 - DNA, 25 bp, Rattus norvegicus
tgaccttccatttctgctgtttgac

SEQ ID NO: 607561 - DNA, 25 bp, Rattus norvegicus
tgaccttccctcaaatcatattcag

SEQ ID NO: 607562 - DNA, 25 bp, Rattus norvegicus
tgaccttccctctaatcatattcag

SEQ ID NO: 607563 - DNA, 25 bp, Rattus norvegicus
tgaccttcctgaccttggcaatagc

SEQ ID NO: 607564 - DNA, 25 bp, Rattus norvegicus
tgaccttcctgagcttggcaatagc

SEQ ID NO: 607565 - DNA, 25 bp, Rattus norvegicus
tgaccttcgaaccatgtctcatttt

SEQ ID NO: 607566 - DNA, 25 bp, Rattus norvegicus
tgaccttcgaacgatgtctcatttt

SEQ ID NO: 607567 - DNA, 25 bp, Rattus norvegicus
tgaccttcgacaatcctggtggcca

SEQ ID NO: 607568 - DNA, 25 bp, Rattus norvegicus
tgaccttcgacattcctggtggcca

SEQ ID NO: 607569 - DNA, 25 bp, Rattus norvegicus
tgaccttcggaaatatttttacact

SEQ ID NO: 607570 - DNA, 25 bp, Rattus norvegicus
tgaccttcggaattatttttacact

SEQ ID NO: 607571 - DNA, 25 bp, Rattus norvegicus
tgaccttctcaactgattgttcaag

SEQ ID NO: 607572 - DNA, 25 bp, Rattus norvegicus
tgaccttctcaagtgattgttcaag

SEQ ID NO: 607573 - DNA, 25 bp, Rattus norvegicus
tgaccttctctcatgggatcgggat

SEQ ID NO: 607574 - DNA, 25 bp, Rattus norvegicus
tgaccttctctcttgggatcgggat

SEQ ID NO: 607575 - DNA, 25 bp, Rattus norvegicus
tgaccttgaaagcaaccttaggcgt

SEQ ID NO: 607576 - DNA, 25 bp, Rattus norvegicus
tgaccttgaaaggaaccttaggcgt

SEQ ID NO: 607577 - DNA, 25 bp, Rattus norvegicus
tgaccttgaaatcaccacctgtgtt

SEQ ID NO: 607578 - DNA, 25 bp, Rattus norvegicus
tgaccttgaaatgaccacctgtgtt

SEQ ID NO: 607579 - DNA, 25 bp, Rattus norvegicus
tgaccttgaagacctgcctactcaa

SEQ ID NO: 607580 - DNA, 25 bp, Rattus norvegicus
tgaccttgaagagctgcctactcaa

SEQ ID NO: 607581 - DNA, 25 bp, Rattus norvegicus
tgaccttgactgatcttccttcctc

SEQ ID NO: 607582 - DNA, 25 bp, Rattus norvegicus
tgaccttgactgttcttccttcctc

SEQ ID NO: 607583 - DNA, 25 bp, Rattus norvegicus
tgaccttgagctactcctgacacca

SEQ ID NO: 607584 - DNA, 25 bp, Rattus norvegicus
tgaccttgagcttctcctgacacca

SEQ ID NO: 607585 - DNA, 25 bp, Rattus norvegicus
tgaccttgctgcagggttctggata

SEQ ID NO: 607586 - DNA, 25 bp, Rattus norvegicus
tgaccttgctgctgggttctggata

SEQ ID NO: 607587 - DNA, 25 bp, Rattus norvegicus
tgaccttggccactttgtcccaaca

SEQ ID NO: 607588 - DNA, 25 bp, Rattus norvegicus
tgaccttggccagtttgtcccaaca

SEQ ID NO: 607589 - DNA, 25 bp, Rattus norvegicus
tgaccttggctcacgaaactacagt

SEQ ID NO: 607590 - DNA, 25 bp, Rattus norvegicus
tgaccttggctctcgaaactacagt

SEQ ID NO: 607591 - DNA, 25 bp, Rattus norvegicus
tgaccttggcttcctatagtttttc

SEQ ID NO: 607592 - DNA, 25 bp, Rattus norvegicus
tgaccttggcttgctatagtttttc

SEQ ID NO: 607593 - DNA, 25 bp, Rattus norvegicus
tgaccttgggcacacagcagttgct

SEQ ID NO: 607594 - DNA, 25 bp, Rattus norvegicus
tgaccttgggcagacagcagttgct

SEQ ID NO: 607595 - DNA, 25 bp, Rattus norvegicus
tgaccttgggtcatgggagtatgta

SEQ ID NO: 607596 - DNA, 25 bp, Rattus norvegicus
tgaccttgggtcttgggagtatgta

SEQ ID NO: 607597 - DNA, 25 bp, Rattus norvegicus
tgaccttggtttctcctgttactta

SEQ ID NO: 607598 - DNA, 25 bp, Rattus norvegicus
tgaccttggtttgtcctgttactta

SEQ ID NO: 607599 - DNA, 25 bp, Rattus norvegicus
tgaccttgtactcattgccactgta

SEQ ID NO: 607600 - DNA, 25 bp, Rattus norvegicus
tgaccttgtactgattgccactgta

SEQ ID NO: 607601 - DNA, 25 bp, Rattus norvegicus
tgaccttgtagcctttctgaacaca

SEQ ID NO: 607602 - DNA, 25 bp, Rattus norvegicus
tgaccttgtagcgtttctgaacaca

SEQ ID NO: 607603 - DNA, 25 bp, Rattus norvegicus
tgaccttgtcacacagtgccaggaa

SEQ ID NO: 607604 - DNA, 25 bp, Rattus norvegicus
tgaccttgtcactcagtgccaggaa

SEQ ID NO: 607605 - DNA, 25 bp, Rattus norvegicus
tgaccttgtctcaaatgccgtgcgg

SEQ ID NO: 607606 - DNA, 25 bp, Rattus norvegicus
tgaccttgtctctaatgccgtgcgg

SEQ ID NO: 607607 - DNA, 25 bp, Rattus norvegicus
tgaccttgtgacatcctgtggacat

SEQ ID NO: 607608 - DNA, 25 bp, Rattus norvegicus
tgaccttgtgacttcctgtggacat

SEQ ID NO: 607609 - DNA, 25 bp, Rattus norvegicus
tgaccttgtgtcatacctatcagaa

SEQ ID NO: 607610 - DNA, 25 bp, Rattus norvegicus
tgaccttgtgtcttacctatcagaa

SEQ ID NO: 607611 - DNA, 25 bp, Rattus norvegicus
tgacctttaccaaacttctgagctc

SEQ ID NO: 607612 - DNA, 25 bp, Rattus norvegicus
tgacctttaccatacttctgagctc

SEQ ID NO: 607613 - DNA, 25 bp, Rattus norvegicus
tgacctttcccaactgttcagactg

SEQ ID NO: 607614 - DNA, 25 bp, Rattus norvegicus
tgacctttcccatctgttcagactg

SEQ ID NO: 607615 - DNA, 25 bp, Rattus norvegicus
tgacctttccccatgaattttgtct

SEQ ID NO: 607616 - DNA, 25 bp, Rattus norvegicus
tgacctttccccttgaattttgtct

SEQ ID NO: 607617 - DNA, 25 bp, Rattus norvegicus
tgacctttctccaaggctggtgtct

SEQ ID NO: 607618 - DNA, 25 bp, Rattus norvegicus
tgacctttctcctaggctggtgtct

SEQ ID NO: 607619 - DNA, 25 bp, Rattus norvegicus
tgacctttctctcttaccttatgtt

SEQ ID NO: 607620 - DNA, 25 bp, Rattus norvegicus
tgacctttctctgttaccttatgtt

SEQ ID NO: 607621 - DNA, 25 bp, Rattus norvegicus
tgacctttctgcagattccttggac

SEQ ID NO: 607622 - DNA, 25 bp, Rattus norvegicus
tgacctttctgcataggcctgagag

SEQ ID NO: 607623 - DNA, 25 bp, Rattus norvegicus
tgacctttctgcattccattctgta

SEQ ID NO: 607624 - DNA, 25 bp, Rattus norvegicus
tgacctttctgctgattccttggac

SEQ ID NO: 607625 - DNA, 25 bp, Rattus norvegicus
tgacctttctgcttaggcctgagag

SEQ ID NO: 607626 - DNA, 25 bp, Rattus norvegicus
tgacctttctgctttccattctgta

SEQ ID NO: 607627 - DNA, 25 bp, Rattus norvegicus
tgacctttctggattctgggctctc

SEQ ID NO: 607628 - DNA, 25 bp, Rattus norvegicus
tgacctttctggtttctgggctctc

SEQ ID NO: 607629 - DNA, 25 bp, Rattus norvegicus
tgacctttgcaccttagaactgact

SEQ ID NO: 607630 - DNA, 25 bp, Rattus norvegicus
tgacctttgcacgttagaactgact

SEQ ID NO: 607631 - DNA, 25 bp, Rattus norvegicus
tgacctttgggacttctgctaattt

SEQ ID NO: 607632 - DNA, 25 bp, Rattus norvegicus
tgacctttgggagttctgctaattt

SEQ ID NO: 607633 - DNA, 25 bp, Rattus norvegicus
tgacctttggttaccctgatatttg

SEQ ID NO: 607634 - DNA, 25 bp, Rattus norvegicus
tgacctttggtttccctgatatttg

SEQ ID NO: 607635 - DNA, 25 bp, Rattus norvegicus
tgaccttttggcaacaatcaagagt

SEQ ID NO: 607636 - DNA, 25 bp, Rattus norvegicus
tgaccttttggctacaatcaagagt

SEQ ID NO: 607637 - DNA, 25 bp, Rattus norvegicus
tgaccttttgttatccataccacct

SEQ ID NO: 607638 - DNA, 25 bp, Rattus norvegicus
tgaccttttgttttccataccacct

SEQ ID NO: 607639 - DNA, 25 bp, Rattus norvegicus
tgacgaaaacaaatgaatacctcca

SEQ ID NO: 607640 - DNA, 25 bp, Rattus norvegicus
tgacgaaaacaattgaatacctcca

SEQ ID NO: 607641 - DNA, 25 bp, Rattus norvegicus
tgacgaaatcgcagcgttccgctgt

SEQ ID NO: 607642 - DNA, 25 bp, Rattus norvegicus
tgacgaaatcgctgcgttccgctgt

SEQ ID NO: 607643 - DNA, 25 bp, Rattus norvegicus
tgacgaaatctccaatccgcagact

SEQ ID NO: 607644 - DNA, 25 bp, Rattus norvegicus
tgacgaaatctcgaatccgcagact

SEQ ID NO: 607645 - DNA, 25 bp, Rattus norvegicus
tgacgaaatgccagtgccggactct

SEQ ID NO: 607646 - DNA, 25 bp, Rattus norvegicus
tgacgaaatgcctgtgccggactct

SEQ ID NO: 607647 - DNA, 25 bp, Rattus norvegicus
tgacgaacagccaacttatggttat

SEQ ID NO: 607648 - DNA, 25 bp, Rattus norvegicus
tgacgaacagcctacttatggttat

SEQ ID NO: 607649 - DNA, 25 bp, Rattus norvegicus
tgacgaacgccacggcccagggtct

SEQ ID NO: 607650 - DNA, 25 bp, Rattus norvegicus
tgacgaacgccagggcccagggtct

SEQ ID NO: 607651 - DNA, 25 bp, Rattus norvegicus
tgacgaacgtgactgagccttgaat

SEQ ID NO: 607652 - DNA, 25 bp, Rattus norvegicus
tgacgaacgtgagtgagccttgaat

SEQ ID NO: 607653 - DNA, 25 bp, Rattus norvegicus
tgacgaacttggacaccagacccgg

SEQ ID NO: 607654 - DNA, 25 bp, Rattus norvegicus
tgacgaacttggtcaccagacccgg

SEQ ID NO: 607655 - DNA, 25 bp, Rattus norvegicus
tgacgaagcatcacccttttgtgat

SEQ ID NO: 607656 - DNA, 25 bp, Rattus norvegicus
tgacgaagcatctcccttttgtgat

SEQ ID NO: 607657 - DNA, 25 bp, Rattus norvegicus
tgacgaatgacactgaacaacctgt

SEQ ID NO: 607658 - DNA, 25 bp, Rattus norvegicus
tgacgaatgacagtgaacaacctgt

SEQ ID NO: 607659 - DNA, 25 bp, Rattus norvegicus
tgacgaattcatccgtgcatacaat

SEQ ID NO: 607660 - DNA, 25 bp, Rattus norvegicus
tgacgaattcatgcgtgcatacaat

SEQ ID NO: 607661 - DNA, 25 bp, Rattus norvegicus
tgacgacaagtcattcagccggcga

SEQ ID NO: 607662 - DNA, 25 bp, Rattus norvegicus
tgacgacaagtctttcagccggcga

SEQ ID NO: 607663 - DNA, 25 bp, Rattus norvegicus
tgacgacaggtaacagaacggtgcc

SEQ ID NO: 607664 - DNA, 25 bp, Rattus norvegicus
tgacgacaggtatcagaacggtgcc

SEQ ID NO: 607665 - DNA, 25 bp, Rattus norvegicus
tgacgacatgggatttggcctgttt

SEQ ID NO: 607666 - DNA, 25 bp, Rattus norvegicus
tgacgacatgggttttggcctgttt

SEQ ID NO: 607667 - DNA, 25 bp, Rattus norvegicus
tgacgacccaagatcatctcatggt

SEQ ID NO: 607668 - DNA, 25 bp, Rattus norvegicus
tgacgacccaagttcatctcatggt

SEQ ID NO: 607669 - DNA, 25 bp, Rattus norvegicus
tgacgacctgcccacagctgaggag

SEQ ID NO: 607670 - DNA, 25 bp, Rattus norvegicus
tgacgacctgccgacagctgaggag

SEQ ID NO: 607671 - DNA, 25 bp, Rattus norvegicus
tgacgaccttgaccctttggtcctc

SEQ ID NO: 607672 - DNA, 25 bp, Rattus norvegicus
tgacgaccttgagcctttggtcctc

SEQ ID NO: 607673 - DNA, 25 bp, Rattus norvegicus
tgacgactcaccaaattgttaatgt

SEQ ID NO: 607674 - DNA, 25 bp, Rattus norvegicus
tgacgactcacctaattgttaatgt

SEQ ID NO: 607675 - DNA, 25 bp, Rattus norvegicus
tgacgactcgctcgcaattctcact

SEQ ID NO: 607676 - DNA, 25 bp, Rattus norvegicus
tgacgactcgctggcaattctcact

SEQ ID NO: 607677 - DNA, 25 bp, Rattus norvegicus
tgacgactctctatgcagttgttgc

SEQ ID NO: 607678 - DNA, 25 bp, Rattus norvegicus
tgacgactctctttgcagttgttgc

SEQ ID NO: 607679 - DNA, 25 bp, Rattus norvegicus
tgacgactggctctgtgtggacttc

SEQ ID NO: 607680 - DNA, 25 bp, Rattus norvegicus
tgacgactggctgtgtgtggacttc

SEQ ID NO: 607681 - DNA, 25 bp, Rattus norvegicus
tgacgactgggcaccggagtatgac

SEQ ID NO: 607682 - DNA, 25 bp, Rattus norvegicus
tgacgactgggctccggagtatgac

SEQ ID NO: 607683 - DNA, 25 bp, Rattus norvegicus
tgacgagagccaattgaacaagtac

SEQ ID NO: 607684 - DNA, 25 bp, Rattus norvegicus
tgacgagagccatttgaacaagtac

SEQ ID NO: 607685 - DNA, 25 bp, Rattus norvegicus
tgacgagaggccacagcctgaagga

SEQ ID NO: 607686 - DNA, 25 bp, Rattus norvegicus
tgacgagaggcctcagcctgaagga

SEQ ID NO: 607687 - DNA, 25 bp, Rattus norvegicus
tgacgagcagggacatgcccttcag

SEQ ID NO: 607688 - DNA, 25 bp, Rattus norvegicus
tgacgagcagggtcatgcccttcag

SEQ ID NO: 607689 - DNA, 25 bp, Rattus norvegicus
tgacgagcctccagtggctcttcac

SEQ ID NO: 607690 - DNA, 25 bp, Rattus norvegicus
tgacgagcctcctgtggctcttcac

SEQ ID NO: 607691 - DNA, 25 bp, Rattus norvegicus
tgacgagcctgaccgcattgaggaa

SEQ ID NO: 607692 - DNA, 25 bp, Rattus norvegicus
tgacgagcctgagcgcattgaggaa

SEQ ID NO: 607693 - DNA, 25 bp, Rattus norvegicus
tgacgagccttcagctgtatcccaa

SEQ ID NO: 607694 - DNA, 25 bp, Rattus norvegicus
tgacgagccttctgctgtatcccaa

SEQ ID NO: 607695 - DNA, 25 bp, Rattus norvegicus
tgacgagctcgccagacttgacctg

SEQ ID NO: 607696 - DNA, 25 bp, Rattus norvegicus
tgacgagctcgcgagacttgacctg

SEQ ID NO: 607697 - DNA, 25 bp, Rattus norvegicus
tgacgaggccgacttgcagtctgca

SEQ ID NO: 607698 - DNA, 25 bp, Rattus norvegicus
tgacgaggccgagttgcagtctgca

SEQ ID NO: 607699 - DNA, 25 bp, Rattus norvegicus
tgacgagggccaagcctgacagcac

SEQ ID NO: 607700 - DNA, 25 bp, Rattus norvegicus
tgacgagggccatgcctgacagcac

SEQ ID NO: 607701 - DNA, 25 bp, Rattus norvegicus
tgacgaggtgcccaaatctgttttc

SEQ ID NO: 607702 - DNA, 25 bp, Rattus norvegicus
tgacgaggtgccgaaatctgttttc

SEQ ID NO: 607703 - DNA, 25 bp, Rattus norvegicus
tgacgaggttaacttcgctcagctc

SEQ ID NO: 607704 - DNA, 25 bp, Rattus norvegicus
tgacgaggttaagttcgctcagctc

SEQ ID NO: 607705 - DNA, 25 bp, Rattus norvegicus
tgacgagtgggcacttggctcaaga

SEQ ID NO: 607706 - DNA, 25 bp, Rattus norvegicus
tgacgagtgggctcttggctcaaga

SEQ ID NO: 607707 - DNA, 25 bp, Rattus norvegicus
tgacgagtgttcaaaacccaacgga

SEQ ID NO: 607708 - DNA, 25 bp, Rattus norvegicus
tgacgagtgttctaaacccaacgga

SEQ ID NO: 607709 - DNA, 25 bp, Rattus norvegicus
tgacgagttcatctgcccaataacc

SEQ ID NO: 607710 - DNA, 25 bp, Rattus norvegicus
tgacgagttcatgtgcccaataacc

SEQ ID NO: 607711 - DNA, 25 bp, Rattus norvegicus
tgacgagttcctcgatgcaggcatt

SEQ ID NO: 607712 - DNA, 25 bp, Rattus norvegicus
tgacgagttcctggatgcaggcatt

SEQ ID NO: 607713 - DNA, 25 bp, Rattus norvegicus
tgacgagttcgcctgtgtggacaac

SEQ ID NO: 607714 - DNA, 25 bp, Rattus norvegicus
tgacgagttcgcgtgtgtggacaac

SEQ ID NO: 607715 - DNA, 25 bp, Rattus norvegicus
tgacgatcacagaagccaaggcctc

SEQ ID NO: 607716 - DNA, 25 bp, Rattus norvegicus
tgacgatcacagtagccaaggcctc

SEQ ID NO: 607717 - DNA, 25 bp, Rattus norvegicus
tgacgatcgatcctcaggtccagaa

SEQ ID NO: 607718 - DNA, 25 bp, Rattus norvegicus
tgacgatcgatcgtcaggtccagaa

SEQ ID NO: 607719 - DNA, 25 bp, Rattus norvegicus
tgacgatctgctcgacctgactgta

SEQ ID NO: 607720 - DNA, 25 bp, Rattus norvegicus
tgacgatctgctggacctgactgta

SEQ ID NO: 607721 - DNA, 25 bp, Rattus norvegicus
tgacgatgacagatttcctaccagc

SEQ ID NO: 607722 - DNA, 25 bp, Rattus norvegicus
tgacgatgacagttttcctaccagc

SEQ ID NO: 607723 - DNA, 25 bp, Rattus norvegicus
tgacgatgactcctgtctaaactcc

SEQ ID NO: 607724 - DNA, 25 bp, Rattus norvegicus
tgacgatgactcgtgtctaaactcc

SEQ ID NO: 607725 - DNA, 25 bp, Rattus norvegicus
tgacgatgacttatctttgcttcct

SEQ ID NO: 607726 - DNA, 25 bp, Rattus norvegicus
tgacgatgacttttctttgcttcct

SEQ ID NO: 607727 - DNA, 25 bp, Rattus norvegicus
tgacgatgagtcatgcggcgagtca

SEQ ID NO: 607728 - DNA, 25 bp, Rattus norvegicus
tgacgatgagtcttgcggcgagtca

SEQ ID NO: 607729 - DNA, 25 bp, Rattus norvegicus
tgacgatgccacctgctaaaagagt

SEQ ID NO: 607730 - DNA, 25 bp, Rattus norvegicus
tgacgatgccacgtgctaaaagagt

SEQ ID NO: 607731 - DNA, 25 bp, Rattus norvegicus
tgacgatgctagagacaaggtattc

SEQ ID NO: 607732 - DNA, 25 bp, Rattus norvegicus
tgacgatgctagtgacaaggtattc

SEQ ID NO: 607733 - DNA, 25 bp, Rattus norvegicus
tgacgatgctccaggacggaggtcc

SEQ ID NO: 607734 - DNA, 25 bp, Rattus norvegicus
tgacgatgctcctggacggaggtcc

SEQ ID NO: 607735 - DNA, 25 bp, Rattus norvegicus
tgacgatgctggagcacttcggacc

SEQ ID NO: 607736 - DNA, 25 bp, Rattus norvegicus
tgacgatgctggtgcacttcggacc

SEQ ID NO: 607737 - DNA, 25 bp, Rattus norvegicus
tgacgatgtactagtgacggccctc

SEQ ID NO: 607738 - DNA, 25 bp, Rattus norvegicus
tgacgatgtacttgtgacggccctc

SEQ ID NO: 607739 - DNA, 25 bp, Rattus norvegicus
tgacgcaaatacaacggcgcgcgaa

SEQ ID NO: 607740 - DNA, 25 bp, Rattus norvegicus
tgacgcaaatactacggcgcgcgaa

SEQ ID NO: 607741 - DNA, 25 bp, Rattus norvegicus
tgacgcaaatagatgagcctccctc

SEQ ID NO: 607742 - DNA, 25 bp, Rattus norvegicus
tgacgcaaatagttgagcctccctc

SEQ ID NO: 607743 - DNA, 25 bp, Rattus norvegicus
tgacgcacatgtatagagaccactt

SEQ ID NO: 607744 - DNA, 25 bp, Rattus norvegicus
tgacgcacatgtttagagaccactt

SEQ ID NO: 607745 - DNA, 25 bp, Rattus norvegicus
tgacgcaggagcacttggtgtgacc

SEQ ID NO: 607746 - DNA, 25 bp, Rattus norvegicus
tgacgcaggagctcttggtgtgacc

SEQ ID NO: 607747 - DNA, 25 bp, Rattus norvegicus
tgacgcattacgcaacactgttagt

SEQ ID NO: 607748 - DNA, 25 bp, Rattus norvegicus
tgacgcattacggaacactgttagt

SEQ ID NO: 607749 - DNA, 25 bp, Rattus norvegicus
tgacgccaaattaccaccagagatg

SEQ ID NO: 607750 - DNA, 25 bp, Rattus norvegicus
tgacgccaaatttccaccagagatg

SEQ ID NO: 607751 - DNA, 25 bp, Rattus norvegicus
tgacgccacttcatcaggtgctgaa

SEQ ID NO: 607752 - DNA, 25 bp, Rattus norvegicus
tgacgccacttcttcaggtgctgaa

SEQ ID NO: 607753 - DNA, 25 bp, Rattus norvegicus
tgacgccaggatcctacagttagag

SEQ ID NO: 607754 - DNA, 25 bp, Rattus norvegicus
tgacgccaggatgctacagttagag

SEQ ID NO: 607755 - DNA, 25 bp, Rattus norvegicus
tgacgcccacaaatccattttctgt

SEQ ID NO: 607756 - DNA, 25 bp, Rattus norvegicus
tgacgcccacaattccattttctgt

SEQ ID NO: 607757 - DNA, 25 bp, Rattus norvegicus
tgacgcccagccagaaggtctggta

SEQ ID NO: 607758 - DNA, 25 bp, Rattus norvegicus
tgacgcccagcctgaaggtctggta

SEQ ID NO: 607759 - DNA, 25 bp, Rattus norvegicus
tgacgcccatgtcaggcacactttg

SEQ ID NO: 607760 - DNA, 25 bp, Rattus norvegicus
tgacgcccatgtgaggcacactttg

SEQ ID NO: 607761 - DNA, 25 bp, Rattus norvegicus
tgacgcccgtttagcagcagctatt

SEQ ID NO: 607762 - DNA, 25 bp, Rattus norvegicus
tgacgcccgttttgcagcagctatt

SEQ ID NO: 607763 - DNA, 25 bp, Rattus norvegicus
tgacgccgttaacacctttgtttct

SEQ ID NO: 607764 - DNA, 25 bp, Rattus norvegicus
tgacgccgttaagacctttgtttct

SEQ ID NO: 607765 - DNA, 25 bp, Rattus norvegicus
tgacgcctacctatttacatgactg

SEQ ID NO: 607766 - DNA, 25 bp, Rattus norvegicus
tgacgcctacctttttacatgactg

SEQ ID NO: 607767 - DNA, 25 bp, Rattus norvegicus
tgacgcctgcctcagagaccagaag

SEQ ID NO: 607768 - DNA, 25 bp, Rattus norvegicus
tgacgcctgcctgagagaccagaag

SEQ ID NO: 607769 - DNA, 25 bp, Rattus norvegicus
tgacgcggaactccaggagcagctt

SEQ ID NO: 607770 - DNA, 25 bp, Rattus norvegicus
tgacgcggaactgcaggagcagctt

SEQ ID NO: 607771 - DNA, 25 bp, Rattus norvegicus
tgacgcggagggagctgcggacgcc

SEQ ID NO: 607772 - DNA, 25 bp, Rattus norvegicus
tgacgcggagggtgctgcggacgcc

SEQ ID NO: 607773 - DNA, 25 bp, Rattus norvegicus
tgacgcggcagcatgaagtccagct

SEQ ID NO: 607774 - DNA, 25 bp, Rattus norvegicus
tgacgcggcagcttgaagtccagct

SEQ ID NO: 607775 - DNA, 25 bp, Rattus norvegicus
tgacgcgtccccataaggtgttcag

SEQ ID NO: 607776 - DNA, 25 bp, Rattus norvegicus
tgacgcgtccccttaaggtgttcag

SEQ ID NO: 607777 - DNA, 25 bp, Rattus norvegicus
tgacgctaagcactttcctcctgta

SEQ ID NO: 607778 - DNA, 25 bp, Rattus norvegicus
tgacgctaagcagtttcctcctgta

SEQ ID NO: 607779 - DNA, 25 bp, Rattus norvegicus
tgacgctaaggaagccatgatggct

SEQ ID NO: 607780 - DNA, 25 bp, Rattus norvegicus
tgacgctaaggatgccatgatggct

SEQ ID NO: 607781 - DNA, 25 bp, Rattus norvegicus
tgacgctccacaacagaacggtgaa

SEQ ID NO: 607782 - DNA, 25 bp, Rattus norvegicus
tgacgctccacatcagaacggtgaa

SEQ ID NO: 607783 - DNA, 25 bp, Rattus norvegicus
tgacgctcctggctaaacctgttgt

SEQ ID NO: 607784 - DNA, 25 bp, Rattus norvegicus
tgacgctcctgggtaaacctgttgt

SEQ ID NO: 607785 - DNA, 25 bp, Rattus norvegicus
tgacgctctgggaacactctgtaca

SEQ ID NO: 607786 - DNA, 25 bp, Rattus norvegicus
tgacgctctgggtacactctgtaca

SEQ ID NO: 607787 - DNA, 25 bp, Rattus norvegicus
tgacgctgacgtcgtccaggaacaa

SEQ ID NO: 607788 - DNA, 25 bp, Rattus norvegicus
tgacgctgacgtggtccaggaacaa

SEQ ID NO: 607789 - DNA, 25 bp, Rattus norvegicus
tgacgctggagacaggctccttgaa

SEQ ID NO: 607790 - DNA, 25 bp, Rattus norvegicus
tgacgctggagagaggctccttgaa

SEQ ID NO: 607791 - DNA, 25 bp, Rattus norvegicus
tgacgctggctgatgatgtaacctt

SEQ ID NO: 607792 - DNA, 25 bp, Rattus norvegicus
tgacgctggctgttgatgtaacctt

SEQ ID NO: 607793 - DNA, 25 bp, Rattus norvegicus
tgacgctggtagcagcagcaatagt

SEQ ID NO: 607794 - DNA, 25 bp, Rattus norvegicus
tgacgctggtaggagcagcaatagt

SEQ ID NO: 607795 - DNA, 25 bp, Rattus norvegicus
tgacgctgtgttcgctgctacatag

SEQ ID NO: 607796 - DNA, 25 bp, Rattus norvegicus
tgacgctgtgttggctgctacatag

SEQ ID NO: 607797 - DNA, 25 bp, Rattus norvegicus
tgacgcttaccgcattggccaattt

SEQ ID NO: 607798 - DNA, 25 bp, Rattus norvegicus
tgacgcttaccggattggccaattt

SEQ ID NO: 607799 - DNA, 25 bp, Rattus norvegicus
tgacgcttagacacaacgcactgtt

SEQ ID NO: 607800 - DNA, 25 bp, Rattus norvegicus
tgacgcttagactcaacgcactgtt

SEQ ID NO: 607801 - DNA, 25 bp, Rattus norvegicus
tgacgcttcacacaagcctcaatga

SEQ ID NO: 607802 - DNA, 25 bp, Rattus norvegicus
tgacgcttcacagaagcctcaatga

SEQ ID NO: 607803 - DNA, 25 bp, Rattus norvegicus
tgacgcttctcaccataacccaagt

SEQ ID NO: 607804 - DNA, 25 bp, Rattus norvegicus
tgacgcttctcagcataacccaagt

SEQ ID NO: 607805 - DNA, 25 bp, Rattus norvegicus
tgacgctttcgcagctcttgagaat

SEQ ID NO: 607806 - DNA, 25 bp, Rattus norvegicus
tgacgctttcgctgctcttgagaat

SEQ ID NO: 607807 - DNA, 25 bp, Rattus norvegicus
tgacgctttcgtatcttatctgtag

SEQ ID NO: 607808 - DNA, 25 bp, Rattus norvegicus
tgacgctttcgtttcttatctgtag

SEQ ID NO: 607809 - DNA, 25 bp, Rattus norvegicus
tgacgctttgacactgggactgaat

SEQ ID NO: 607810 - DNA, 25 bp, Rattus norvegicus
tgacgctttgactctgggactgaat

SEQ ID NO: 607811 - DNA, 25 bp, Rattus norvegicus
tgacggaaatagaccagagagacca

SEQ ID NO: 607812 - DNA, 25 bp, Rattus norvegicus
tgacggaaatagtccagagagacca

SEQ ID NO: 607813 - DNA, 25 bp, Rattus norvegicus
tgacggaactacaaccttgctatgg

SEQ ID NO: 607814 - DNA, 25 bp, Rattus norvegicus
tgacggaactactaccttgctatgg

SEQ ID NO: 607815 - DNA, 25 bp, Rattus norvegicus
tgacggacacctctttctgtgaaac

SEQ ID NO: 607816 - DNA, 25 bp, Rattus norvegicus
tgacggacacctgtttctgtgaaac

SEQ ID NO: 607817 - DNA, 25 bp, Rattus norvegicus
tgacggacgaggagatggcggcgct

SEQ ID NO: 607818 - DNA, 25 bp, Rattus norvegicus
tgacggacgaggtgatggcggcgct

SEQ ID NO: 607819 - DNA, 25 bp, Rattus norvegicus
tgacggacgcatcactcagaaactt

SEQ ID NO: 607820 - DNA, 25 bp, Rattus norvegicus
tgacggacgcatgactcagaaactt

SEQ ID NO: 607821 - DNA, 25 bp, Rattus norvegicus
tgacggacttgaaaaggccccttgt

SEQ ID NO: 607822 - DNA, 25 bp, Rattus norvegicus
tgacggacttgataaggccccttgt

SEQ ID NO: 607823 - DNA, 25 bp, Rattus norvegicus
tgacggagatgcagcgcgcagccct

SEQ ID NO: 607824 - DNA, 25 bp, Rattus norvegicus
tgacggagatgctgcgcgcagccct

SEQ ID NO: 607825 - DNA, 25 bp, Rattus norvegicus
tgacggagcaccagtttcctggcta

SEQ ID NO: 607826 - DNA, 25 bp, Rattus norvegicus
tgacggagcacctgtttcctggcta

SEQ ID NO: 607827 - DNA, 25 bp, Rattus norvegicus
tgacggagctcaactttctaatggc

SEQ ID NO: 607828 - DNA, 25 bp, Rattus norvegicus
tgacggagctcatctttctaatggc

SEQ ID NO: 607829 - DNA, 25 bp, Rattus norvegicus
tgacggaggcacctactgctgcaaa

SEQ ID NO: 607830 - DNA, 25 bp, Rattus norvegicus
tgacggaggcacgtactgctgcaaa

SEQ ID NO: 607831 - DNA, 25 bp, Rattus norvegicus
tgacggatcaatctgctgcagtagc

SEQ ID NO: 607832 - DNA, 25 bp, Rattus norvegicus
tgacggatcaatgtgctgcagtagc

SEQ ID NO: 607833 - DNA, 25 bp, Rattus norvegicus
tgacggatggcactcctttggtgaa

SEQ ID NO: 607834 - DNA, 25 bp, Rattus norvegicus
tgacggatggcagtcctttggtgaa

SEQ ID NO: 607835 - DNA, 25 bp, Rattus norvegicus
tgacggcagatccagtttcctttag

SEQ ID NO: 607836 - DNA, 25 bp, Rattus norvegicus
tgacggcagatcgagtttcctttag

SEQ ID NO: 607837 - DNA, 25 bp, Rattus norvegicus
tgacggccaccaaagcagggacggt

SEQ ID NO: 607838 - DNA, 25 bp, Rattus norvegicus
tgacggccaccatagcagggacggt

SEQ ID NO: 607839 - DNA, 25 bp, Rattus norvegicus
tgacggccctgaagaggtacaccag

SEQ ID NO: 607840 - DNA, 25 bp, Rattus norvegicus
tgacggccctgatgaggtacaccag

SEQ ID NO: 607841 - DNA, 25 bp, Rattus norvegicus
tgacggccgccccaaagaacacgga

SEQ ID NO: 607842 - DNA, 25 bp, Rattus norvegicus
tgacggccgcccgaaagaacacgga

SEQ ID NO: 607843 - DNA, 25 bp, Rattus norvegicus
tgacggcctcagacacaaatcactg

SEQ ID NO: 607844 - DNA, 25 bp, Rattus norvegicus
tgacggcctcagtcacaaatcactg

SEQ ID NO: 607845 - DNA, 25 bp, Rattus norvegicus
tgacggccttttcctgattcagtat

SEQ ID NO: 607846 - DNA, 25 bp, Rattus norvegicus
tgacggccttttgctgattcagtat

SEQ ID NO: 607847 - DNA, 25 bp, Rattus norvegicus
tgacggcgaggacatcactcagaaa

SEQ ID NO: 607848 - DNA, 25 bp, Rattus norvegicus
tgacggcgaggagatcactcagaaa

SEQ ID NO: 607849 - DNA, 25 bp, Rattus norvegicus
tgacggcgtaccatcacaacaggtc

SEQ ID NO: 607850 - DNA, 25 bp, Rattus norvegicus
tgacggcgtaccttcacaacaggtc

SEQ ID NO: 607851 - DNA, 25 bp, Rattus norvegicus
tgacggcgtccaagcagctgtgtgc

SEQ ID NO: 607852 - DNA, 25 bp, Rattus norvegicus
tgacggcgtccatgcagctgtgtgc

SEQ ID NO: 607853 - DNA, 25 bp, Rattus norvegicus
tgacggctaagactagtgtggaaac

SEQ ID NO: 607854 - DNA, 25 bp, Rattus norvegicus
tgacggctaagagtagtgtggaaac

SEQ ID NO: 607855 - DNA, 25 bp, Rattus norvegicus
tgacggctaagcctctgtttccatc

SEQ ID NO: 607856 - DNA, 25 bp, Rattus norvegicus
tgacggctaagcgtctgtttccatc

SEQ ID NO: 607857 - DNA, 25 bp, Rattus norvegicus
tgacggctatccagcagaagttctc

SEQ ID NO: 607858 - DNA, 25 bp, Rattus norvegicus
tgacggctatcctgcagaagttctc

SEQ ID NO: 607859 - DNA, 25 bp, Rattus norvegicus
tgacggctcctccttcgtggaagag

SEQ ID NO: 607860 - DNA, 25 bp, Rattus norvegicus
tgacggctcctcgttcgtggaagag

SEQ ID NO: 607861 - DNA, 25 bp, Rattus norvegicus
tgacggctcgtaatgaggcccctgg

SEQ ID NO: 607862 - DNA, 25 bp, Rattus norvegicus
tgacggctcgtattgaggcccctgg

SEQ ID NO: 607863 - DNA, 25 bp, Rattus norvegicus
tgacggctgcttacgcgagaaggtt

SEQ ID NO: 607864 - DNA, 25 bp, Rattus norvegicus
tgacggctgctttcgcgagaaggtt

SEQ ID NO: 607865 - DNA, 25 bp, Rattus norvegicus
tgacggctgtggcaagtgtcaccat

SEQ ID NO: 607866 - DNA, 25 bp, Rattus norvegicus
tgacggctgtgggaagtgtcaccat

SEQ ID NO: 607867 - DNA, 25 bp, Rattus norvegicus
tgacggcttacaatggcggtacatc

SEQ ID NO: 607868 - DNA, 25 bp, Rattus norvegicus
tgacggcttacattggcggtacatc

SEQ ID NO: 607869 - DNA, 25 bp, Rattus norvegicus
tgacggcttctcaatgccttcctgt

SEQ ID NO: 607870 - DNA, 25 bp, Rattus norvegicus
tgacggcttctctatgccttcctgt

SEQ ID NO: 607871 - DNA, 25 bp, Rattus norvegicus
tgacgggaacttaaatttgaccttg

SEQ ID NO: 607872 - DNA, 25 bp, Rattus norvegicus
tgacgggaactttaatttgaccttg

SEQ ID NO: 607873 - DNA, 25 bp, Rattus norvegicus
tgacgggaatccagaaaccttttgg

SEQ ID NO: 607874 - DNA, 25 bp, Rattus norvegicus
tgacgggaatcctgaaaccttttgg

SEQ ID NO: 607875 - DNA, 25 bp, Rattus norvegicus
tgacgggaatttcacctcttctgac

SEQ ID NO: 607876 - DNA, 25 bp, Rattus norvegicus
tgacgggaatttgacctcttctgac

SEQ ID NO: 607877 - DNA, 25 bp, Rattus norvegicus
tgacgggagataaggcacagtaact

SEQ ID NO: 607878 - DNA, 25 bp, Rattus norvegicus
tgacgggagatatggcacagtaact

SEQ ID NO: 607879 - DNA, 25 bp, Rattus norvegicus
tgacgggcaactacccttctaccta

SEQ ID NO: 607880 - DNA, 25 bp, Rattus norvegicus
tgacgggcaacttcccttctaccta

SEQ ID NO: 607881 - DNA, 25 bp, Rattus norvegicus
tgacgggccctaatgcactgtgggt

SEQ ID NO: 607882 - DNA, 25 bp, Rattus norvegicus
tgacgggccctattgcactgtgggt

SEQ ID NO: 607883 - DNA, 25 bp, Rattus norvegicus
tgacgggcgagccagctcctttgca

SEQ ID NO: 607884 - DNA, 25 bp, Rattus norvegicus
tgacgggcgagcgagctcctttgca

SEQ ID NO: 607885 - DNA, 25 bp, Rattus norvegicus
tgacgggcgctactttattgctttt

SEQ ID NO: 607886 - DNA, 25 bp, Rattus norvegicus
tgacgggcgctagtttattgctttt

SEQ ID NO: 607887 - DNA, 25 bp, Rattus norvegicus
tgacgggtcccacaataagcacaat

SEQ ID NO: 607888 - DNA, 25 bp, Rattus norvegicus
tgacgggtcccagaataagcacaat

SEQ ID NO: 607889 - DNA, 25 bp, Rattus norvegicus
tgacgggtcttgatcttcctcggct

SEQ ID NO: 607890 - DNA, 25 bp, Rattus norvegicus
tgacgggtcttgttcttcctcggct

SEQ ID NO: 607891 - DNA, 25 bp, Rattus norvegicus
tgacggtaggttacctgttctttga

SEQ ID NO: 607892 - DNA, 25 bp, Rattus norvegicus
tgacggtaggtttcctgttctttga

SEQ ID NO: 607893 - DNA, 25 bp, Rattus norvegicus
tgacggtagtgtctccacctcaatt

SEQ ID NO: 607894 - DNA, 25 bp, Rattus norvegicus
tgacggtagtgtgtccacctcaatt

SEQ ID NO: 607895 - DNA, 25 bp, Rattus norvegicus
tgacggtcagctctacttcattgat

SEQ ID NO: 607896 - DNA, 25 bp, Rattus norvegicus
tgacggtcagctgtacttcattgat

SEQ ID NO: 607897 - DNA, 25 bp, Rattus norvegicus
tgacggtcagtcataagcactttga

SEQ ID NO: 607898 - DNA, 25 bp, Rattus norvegicus
tgacggtcagtcttaagcactttga

SEQ ID NO: 607899 - DNA, 25 bp, Rattus norvegicus
tgacggtggcttagtttttccttct

SEQ ID NO: 607900 - DNA, 25 bp, Rattus norvegicus
tgacggtggctttgtttttccttct

SEQ ID NO: 607901 - DNA, 25 bp, Rattus norvegicus
tgacggttaaatcccaactcccagc

SEQ ID NO: 607902 - DNA, 25 bp, Rattus norvegicus
tgacggttaaatgccaactcccagc

SEQ ID NO: 607903 - DNA, 25 bp, Rattus norvegicus
tgacggttttacctcaagggcctgg

SEQ ID NO: 607904 - DNA, 25 bp, Rattus norvegicus
tgacggttttacgtcaagggcctgg

SEQ ID NO: 607905 - DNA, 25 bp, Rattus norvegicus
tgacgtaaccaaactttctacccct

SEQ ID NO: 607906 - DNA, 25 bp, Rattus norvegicus
tgacgtaaccaatctttctacccct

SEQ ID NO: 607907 - DNA, 25 bp, Rattus norvegicus
tgacgtaaggtgatctgtgcccggc

SEQ ID NO: 607908 - DNA, 25 bp, Rattus norvegicus
tgacgtaaggtgttctgtgcccggc

SEQ ID NO: 607909 - DNA, 25 bp, Rattus norvegicus
tgacgtacaacgctgctaggcttgt

SEQ ID NO: 607910 - DNA, 25 bp, Rattus norvegicus
tgacgtacaacggtgctaggcttgt

SEQ ID NO: 607911 - DNA, 25 bp, Rattus norvegicus
tgacgtacagaccagggcgacagca

SEQ ID NO: 607912 - DNA, 25 bp, Rattus norvegicus
tgacgtacagacgagggcgacagca

SEQ ID NO: 607913 - DNA, 25 bp, Rattus norvegicus
tgacgtacgtccctgttctcagaag

SEQ ID NO: 607914 - DNA, 25 bp, Rattus norvegicus
tgacgtacgtccgtgttctcagaag

SEQ ID NO: 607915 - DNA, 25 bp, Rattus norvegicus
tgacgtactagaaatgatctgtgta

SEQ ID NO: 607916 - DNA, 25 bp, Rattus norvegicus
tgacgtactagatatgatctgtgta

SEQ ID NO: 607917 - DNA, 25 bp, Rattus norvegicus
tgacgtagtatgaaacccaccccga

SEQ ID NO: 607918 - DNA, 25 bp, Rattus norvegicus
tgacgtagtatgtaacccaccccga

SEQ ID NO: 607919 - DNA, 25 bp, Rattus norvegicus
tgacgtcaccaaaactactcggaag

SEQ ID NO: 607920 - DNA, 25 bp, Rattus norvegicus
tgacgtcaccaatactactcggaag

SEQ ID NO: 607921 - DNA, 25 bp, Rattus norvegicus
tgacgtcaccttaagccatgtttct

SEQ ID NO: 607922 - DNA, 25 bp, Rattus norvegicus
tgacgtcaccttccctttagataga

SEQ ID NO: 607923 - DNA, 25 bp, Rattus norvegicus
tgacgtcaccttgcctttagataga

SEQ ID NO: 607924 - DNA, 25 bp, Rattus norvegicus
tgacgtcacctttagccatgtttct

SEQ ID NO: 607925 - DNA, 25 bp, Rattus norvegicus
tgacgtcacgccaccatcagggtag

SEQ ID NO: 607926 - DNA, 25 bp, Rattus norvegicus
tgacgtcacgcctccatcagggtag

SEQ ID NO: 607927 - DNA, 25 bp, Rattus norvegicus
tgacgtcactggactgtagcttctc

SEQ ID NO: 607928 - DNA, 25 bp, Rattus norvegicus
tgacgtcactggtctgtagcttctc

SEQ ID NO: 607929 - DNA, 25 bp, Rattus norvegicus
tgacgtcagcctcctctacgggaca

SEQ ID NO: 607930 - DNA, 25 bp, Rattus norvegicus
tgacgtcagcctgctctacgggaca

SEQ ID NO: 607931 - DNA, 25 bp, Rattus norvegicus
tgacgtcagtccaggaccacgcgtt

SEQ ID NO: 607932 - DNA, 25 bp, Rattus norvegicus
tgacgtcagtccaggtgggaagcac

SEQ ID NO: 607933 - DNA, 25 bp, Rattus norvegicus
tgacgtcagtcctggaccacgcgtt

SEQ ID NO: 607934 - DNA, 25 bp, Rattus norvegicus
tgacgtcagtcctggtgggaagcac

SEQ ID NO: 607935 - DNA, 25 bp, Rattus norvegicus
tgacgtcataaaccgacgacgctac

SEQ ID NO: 607936 - DNA, 25 bp, Rattus norvegicus
tgacgtcataaagcgacgacgctac

SEQ ID NO: 607937 - DNA, 25 bp, Rattus norvegicus
tgacgtcatatcagcatttgttgta

SEQ ID NO: 607938 - DNA, 25 bp, Rattus norvegicus
tgacgtcatatctgcatttgttgta

SEQ ID NO: 607939 - DNA, 25 bp, Rattus norvegicus
tgacgtcatcttaccaaatgggctc

SEQ ID NO: 607940 - DNA, 25 bp, Rattus norvegicus
tgacgtcatctttccaaatgggctc

SEQ ID NO: 607941 - DNA, 25 bp, Rattus norvegicus
tgacgtcatgaccactgtgttcaaa

SEQ ID NO: 607942 - DNA, 25 bp, Rattus norvegicus
tgacgtcatgacgactgtgttcaaa

SEQ ID NO: 607943 - DNA, 25 bp, Rattus norvegicus
tgacgtcattgtacacatcaccgtg

SEQ ID NO: 607944 - DNA, 25 bp, Rattus norvegicus
tgacgtcattgttcacatcaccgtg

SEQ ID NO: 607945 - DNA, 25 bp, Rattus norvegicus
tgacgtccacgtagccaagcactgt

SEQ ID NO: 607946 - DNA, 25 bp, Rattus norvegicus
tgacgtccacgttgccaagcactgt

SEQ ID NO: 607947 - DNA, 25 bp, Rattus norvegicus
tgacgtccaggtctgttgtttgtct

SEQ ID NO: 607948 - DNA, 25 bp, Rattus norvegicus
tgacgtccaggtgtgttgtttgtct

SEQ ID NO: 607949 - DNA, 25 bp, Rattus norvegicus
tgacgtctccgtctgcgagtggtac

SEQ ID NO: 607950 - DNA, 25 bp, Rattus norvegicus
tgacgtctccgtgtgcgagtggtac

SEQ ID NO: 607951 - DNA, 25 bp, Rattus norvegicus
tgacgtctgaagctgtgcctatgaa

SEQ ID NO: 607952 - DNA, 25 bp, Rattus norvegicus
tgacgtctgaaggtgtgcctatgaa

SEQ ID NO: 607953 - DNA, 25 bp, Rattus norvegicus
tgacgtctgattctttgttgattaa

SEQ ID NO: 607954 - DNA, 25 bp, Rattus norvegicus
tgacgtctgattgtttgttgattaa

SEQ ID NO: 607955 - DNA, 25 bp, Rattus norvegicus
tgacgtctgtgcatcactgttagga

SEQ ID NO: 607956 - DNA, 25 bp, Rattus norvegicus
tgacgtctgtgcttcactgttagga

SEQ ID NO: 607957 - DNA, 25 bp, Rattus norvegicus
tgacgtctgttcatgttgtaaaggt

SEQ ID NO: 607958 - DNA, 25 bp, Rattus norvegicus
tgacgtctgttcttgttgtaaaggt

SEQ ID NO: 607959 - DNA, 25 bp, Rattus norvegicus
tgacgtcttcagatcactggccaga

SEQ ID NO: 607960 - DNA, 25 bp, Rattus norvegicus
tgacgtcttcagttcactggccaga

SEQ ID NO: 607961 - DNA, 25 bp, Rattus norvegicus
tgacgtcttcgaagagtccctcgtg

SEQ ID NO: 607962 - DNA, 25 bp, Rattus norvegicus
tgacgtcttcgatgagtccctcgtg

SEQ ID NO: 607963 - DNA, 25 bp, Rattus norvegicus
tgacgtcttctcagggcttcagaaa

SEQ ID NO: 607964 - DNA, 25 bp, Rattus norvegicus
tgacgtcttctctgggcttcagaaa

SEQ ID NO: 607965 - DNA, 25 bp, Rattus norvegicus
tgacgtcttcttactgtatcagtga

SEQ ID NO: 607966 - DNA, 25 bp, Rattus norvegicus
tgacgtcttctttctgtatcagtga

SEQ ID NO: 607967 - DNA, 25 bp, Rattus norvegicus
tgacgtctttctatatacctggatc

SEQ ID NO: 607968 - DNA, 25 bp, Rattus norvegicus
tgacgtctttctttatacctggatc

SEQ ID NO: 607969 - DNA, 25 bp, Rattus norvegicus
tgacgtctttttaacccagtagcaa

SEQ ID NO: 607970 - DNA, 25 bp, Rattus norvegicus
tgacgtcttttttacccagtagcaa

SEQ ID NO: 607971 - DNA, 25 bp, Rattus norvegicus
tgacgtgaacacatgcagcctgcat

SEQ ID NO: 607972 - DNA, 25 bp, Rattus norvegicus
tgacgtgaacacttgcagcctgcat

SEQ ID NO: 607973 - DNA, 25 bp, Rattus norvegicus
tgacgtgaacctagaagcctgctac

SEQ ID NO: 607974 - DNA, 25 bp, Rattus norvegicus
tgacgtgaaccttgaagcctgctac

SEQ ID NO: 607975 - DNA, 25 bp, Rattus norvegicus
tgacgtgaccacagagagccaatac

SEQ ID NO: 607976 - DNA, 25 bp, Rattus norvegicus
tgacgtgaccactgagagccaatac

SEQ ID NO: 607977 - DNA, 25 bp, Rattus norvegicus
tgacgtgaccggagccgcggaccac

SEQ ID NO: 607978 - DNA, 25 bp, Rattus norvegicus
tgacgtgaccggtgccgcggaccac

SEQ ID NO: 607979 - DNA, 25 bp, Rattus norvegicus
tgacgtgactgccaacactctgctg

SEQ ID NO: 607980 - DNA, 25 bp, Rattus norvegicus
tgacgtgactgcgaacactctgctg

SEQ ID NO: 607981 - DNA, 25 bp, Rattus norvegicus
tgacgtgagcacctcaagcattgct

SEQ ID NO: 607982 - DNA, 25 bp, Rattus norvegicus
tgacgtgagcacgtcaagcattgct

SEQ ID NO: 607983 - DNA, 25 bp, Rattus norvegicus
tgacgtgcgattcccggtgatcctc

SEQ ID NO: 607984 - DNA, 25 bp, Rattus norvegicus
tgacgtgcgattgccggtgatcctc

SEQ ID NO: 607985 - DNA, 25 bp, Rattus norvegicus
tgacgtgcggagacttccaggtgaa

SEQ ID NO: 607986 - DNA, 25 bp, Rattus norvegicus
tgacgtgcggagtcttccaggtgaa

SEQ ID NO: 607987 - DNA, 25 bp, Rattus norvegicus
tgacgtggaacaaaacccattccgt

SEQ ID NO: 607988 - DNA, 25 bp, Rattus norvegicus
tgacgtggaacataacccattccgt

SEQ ID NO: 607989 - DNA, 25 bp, Rattus norvegicus
tgacgtggatgactacgccccagaa

SEQ ID NO: 607990 - DNA, 25 bp, Rattus norvegicus
tgacgtggatgagtacgccccagaa

SEQ ID NO: 607991 - DNA, 25 bp, Rattus norvegicus
tgacgtgggtcacatttcaccatct

SEQ ID NO: 607992 - DNA, 25 bp, Rattus norvegicus
tgacgtgggtcagatttcaccatct

SEQ ID NO: 607993 - DNA, 25 bp, Rattus norvegicus
tgacgtggtcagagctaagagcaga

SEQ ID NO: 607994 - DNA, 25 bp, Rattus norvegicus
tgacgtggtcagtgctaagagcaga

SEQ ID NO: 607995 - DNA, 25 bp, Rattus norvegicus
tgacgtggtggcagctcttaccttg

SEQ ID NO: 607996 - DNA, 25 bp, Rattus norvegicus
tgacgtggtggcagtatatcccaat

SEQ ID NO: 607997 - DNA, 25 bp, Rattus norvegicus
tgacgtggtggctgctcttaccttg

SEQ ID NO: 607998 - DNA, 25 bp, Rattus norvegicus
tgacgtggtggctgtatatcccaat

SEQ ID NO: 607999 - DNA, 25 bp, Rattus norvegicus
tgacgtggtttcaggagggaataaa

SEQ ID NO: 608000 - DNA, 25 bp, Rattus norvegicus
tgacgtggtttctggagggaataaa

SEQ ID NO: 608001 - DNA, 25 bp, Rattus norvegicus
tgacgtgtagcccttatcctagcag

SEQ ID NO: 608002 - DNA, 25 bp, Rattus norvegicus
tgacgtgtagccgttatcctagcag

SEQ ID NO: 608003 - DNA, 25 bp, Rattus norvegicus
tgacgtgtgccaacagcgagcagcg

SEQ ID NO: 608004 - DNA, 25 bp, Rattus norvegicus
tgacgtgtgccatcagcgagcagcg

SEQ ID NO: 608005 - DNA, 25 bp, Rattus norvegicus
tgacgttacttccttacagttgttt

SEQ ID NO: 608006 - DNA, 25 bp, Rattus norvegicus
tgacgttacttcgttacagttgttt

SEQ ID NO: 608007 - DNA, 25 bp, Rattus norvegicus
tgacgttatacaacagtgccgacaa

SEQ ID NO: 608008 - DNA, 25 bp, Rattus norvegicus
tgacgttatacatcagtgccgacaa

SEQ ID NO: 608009 - DNA, 25 bp, Rattus norvegicus
tgacgttattcgaagagctctcctg

SEQ ID NO: 608010 - DNA, 25 bp, Rattus norvegicus
tgacgttattcgtagagctctcctg

SEQ ID NO: 608011 - DNA, 25 bp, Rattus norvegicus
tgacgttcagtcaaggattcaagga

SEQ ID NO: 608012 - DNA, 25 bp, Rattus norvegicus
tgacgttcagtctaggattcaagga

SEQ ID NO: 608013 - DNA, 25 bp, Rattus norvegicus
tgacgttcgtgcagggaaggaccct

SEQ ID NO: 608014 - DNA, 25 bp, Rattus norvegicus
tgacgttcgtgctgggaaggaccct

SEQ ID NO: 608015 - DNA, 25 bp, Rattus norvegicus
tgacgttcttaacgttacgccagaa

SEQ ID NO: 608016 - DNA, 25 bp, Rattus norvegicus
tgacgttcttaaggttacgccagaa

SEQ ID NO: 608017 - DNA, 25 bp, Rattus norvegicus
tgacgtttagtcatgctctaggcag

SEQ ID NO: 608018 - DNA, 25 bp, Rattus norvegicus
tgacgtttagtcttgctctaggcag

SEQ ID NO: 608019 - DNA, 25 bp, Rattus norvegicus
tgacgtttatgtctgtactttctcc

SEQ ID NO: 608020 - DNA, 25 bp, Rattus norvegicus
tgacgtttatgtgtgtactttctcc

SEQ ID NO: 608021 - DNA, 25 bp, Rattus norvegicus
tgacgtttctccagcatgtttttac

SEQ ID NO: 608022 - DNA, 25 bp, Rattus norvegicus
tgacgtttctcctgcatgtttttac

SEQ ID NO: 608023 - DNA, 25 bp, Rattus norvegicus
tgacgtttttatcatgactcctccc

SEQ ID NO: 608024 - DNA, 25 bp, Rattus norvegicus
tgacgtttttatgatgactcctccc

SEQ ID NO: 608025 - DNA, 25 bp, Rattus norvegicus
tgactaaacacgaccggtctgaagt

SEQ ID NO: 608026 - DNA, 25 bp, Rattus norvegicus
tgactaaacacgtccggtctgaagt

SEQ ID NO: 608027 - DNA, 25 bp, Rattus norvegicus
tgactaaaccccaacagcttcttca

SEQ ID NO: 608028 - DNA, 25 bp, Rattus norvegicus
tgactaaaccccagctatggagcca

SEQ ID NO: 608029 - DNA, 25 bp, Rattus norvegicus
tgactaaacccctacagcttcttca

SEQ ID NO: 608030 - DNA, 25 bp, Rattus norvegicus
tgactaaacccctgctatggagcca

SEQ ID NO: 608031 - DNA, 25 bp, Rattus norvegicus
tgactaaagctgacccaaatgggcc

SEQ ID NO: 608032 - DNA, 25 bp, Rattus norvegicus
tgactaaagctgtcccaaatgggcc

SEQ ID NO: 608033 - DNA, 25 bp, Rattus norvegicus
tgactaaatgctaatcttgcccaag

SEQ ID NO: 608034 - DNA, 25 bp, Rattus norvegicus
tgactaaatgcttatcttgcccaag

SEQ ID NO: 608035 - DNA, 25 bp, Rattus norvegicus
tgactaacagaaatggaggagggct

SEQ ID NO: 608036 - DNA, 25 bp, Rattus norvegicus
tgactaacagaattggaggagggct

SEQ ID NO: 608037 - DNA, 25 bp, Rattus norvegicus
tgactaacccagagggagttctcat

SEQ ID NO: 608038 - DNA, 25 bp, Rattus norvegicus
tgactaacccagtgggagttctcat

SEQ ID NO: 608039 - DNA, 25 bp, Rattus norvegicus
tgactaacctgcctcttgatgtttc

SEQ ID NO: 608040 - DNA, 25 bp, Rattus norvegicus
tgactaacctgcgtcttgatgtttc

SEQ ID NO: 608041 - DNA, 25 bp, Rattus norvegicus
tgactaagacttcgcgggaatcgac

SEQ ID NO: 608042 - DNA, 25 bp, Rattus norvegicus
tgactaagacttggcgggaatcgac

SEQ ID NO: 608043 - DNA, 25 bp, Rattus norvegicus
tgactaagcgacacacaggagaggt

SEQ ID NO: 608044 - DNA, 25 bp, Rattus norvegicus
tgactaagcgactcacaggagaggt

SEQ ID NO: 608045 - DNA, 25 bp, Rattus norvegicus
tgactaagggtcacctccaactcca

SEQ ID NO: 608046 - DNA, 25 bp, Rattus norvegicus
tgactaagggtctcctccaactcca

SEQ ID NO: 608047 - DNA, 25 bp, Rattus norvegicus
tgactacagccaagactacagccgt

SEQ ID NO: 608048 - DNA, 25 bp, Rattus norvegicus
tgactacagccatgactacagccgt

SEQ ID NO: 608049 - DNA, 25 bp, Rattus norvegicus
tgactacaggagacgacagggcctt

SEQ ID NO: 608050 - DNA, 25 bp, Rattus norvegicus
tgactacaggagtcgacagggcctt

SEQ ID NO: 608051 - DNA, 25 bp, Rattus norvegicus
tgactacattacaacgggccaggaa

SEQ ID NO: 608052 - DNA, 25 bp, Rattus norvegicus
tgactacattactacgggccaggaa

SEQ ID NO: 608053 - DNA, 25 bp, Rattus norvegicus
tgactaccagcacgcgttgctgctg

SEQ ID NO: 608054 - DNA, 25 bp, Rattus norvegicus
tgactaccagcaggcgttgctgctg

SEQ ID NO: 608055 - DNA, 25 bp, Rattus norvegicus
tgactaccagctagttcgaaaatta

SEQ ID NO: 608056 - DNA, 25 bp, Rattus norvegicus
tgactaccagcttgttcgaaaatta

SEQ ID NO: 608057 - DNA, 25 bp, Rattus norvegicus
tgactaccattgaccctgttctaac

SEQ ID NO: 608058 - DNA, 25 bp, Rattus norvegicus
tgactaccattgtccctgttctaac

SEQ ID NO: 608059 - DNA, 25 bp, Rattus norvegicus
tgactacccaaaagctcatctagga

SEQ ID NO: 608060 - DNA, 25 bp, Rattus norvegicus
tgactacccaaatgctcatctagga

SEQ ID NO: 608061 - DNA, 25 bp, Rattus norvegicus
tgactaccctgaccgatactgctgt

SEQ ID NO: 608062 - DNA, 25 bp, Rattus norvegicus
tgactaccctgagcgatactgctgt

SEQ ID NO: 608063 - DNA, 25 bp, Rattus norvegicus
tgactacctactcagcaaccaggag

SEQ ID NO: 608064 - DNA, 25 bp, Rattus norvegicus
tgactacctactgagcaaccaggag

SEQ ID NO: 608065 - DNA, 25 bp, Rattus norvegicus
tgactacctcagctgatcggaggac

SEQ ID NO: 608066 - DNA, 25 bp, Rattus norvegicus
tgactacctcaggtgatcggaggac

SEQ ID NO: 608067 - DNA, 25 bp, Rattus norvegicus
tgactacctggcaagtttgagatat

SEQ ID NO: 608068 - DNA, 25 bp, Rattus norvegicus
tgactacctggctagtttgagatat

SEQ ID NO: 608069 - DNA, 25 bp, Rattus norvegicus
tgactaccttagctttcctttgtga

SEQ ID NO: 608070 - DNA, 25 bp, Rattus norvegicus
tgactaccttaggtttcctttgtga

SEQ ID NO: 608071 - DNA, 25 bp, Rattus norvegicus
tgactacgagctaaagtacccacca

SEQ ID NO: 608072 - DNA, 25 bp, Rattus norvegicus
tgactacgagcttaagtacccacca

SEQ ID NO: 608073 - DNA, 25 bp, Rattus norvegicus
tgactacggtgaaccatgtcagccc

SEQ ID NO: 608074 - DNA, 25 bp, Rattus norvegicus
tgactacggtgatccatgtcagccc

SEQ ID NO: 608075 - DNA, 25 bp, Rattus norvegicus
tgactactactgcagcccaggcatt

SEQ ID NO: 608076 - DNA, 25 bp, Rattus norvegicus
tgactactactggagcccaggcatt

SEQ ID NO: 608077 - DNA, 25 bp, Rattus norvegicus
tgactactccttagcttcccagagt

SEQ ID NO: 608078 - DNA, 25 bp, Rattus norvegicus
tgactactccttcaagagcgtccaa

SEQ ID NO: 608079 - DNA, 25 bp, Rattus norvegicus
tgactactccttgaagagcgtccaa

SEQ ID NO: 608080 - DNA, 25 bp, Rattus norvegicus
tgactactcctttgcttcccagagt

SEQ ID NO: 608081 - DNA, 25 bp, Rattus norvegicus
tgactactctcacctggcctctggg

SEQ ID NO: 608082 - DNA, 25 bp, Rattus norvegicus
tgactactctcagctggcctctggg

SEQ ID NO: 608083 - DNA, 25 bp, Rattus norvegicus
tgactactgggcatttagctctttt

SEQ ID NO: 608084 - DNA, 25 bp, Rattus norvegicus
tgactactgggcttttagctctttt

SEQ ID NO: 608085 - DNA, 25 bp, Rattus norvegicus
tgactactgtgtctcccacatgaag

SEQ ID NO: 608086 - DNA, 25 bp, Rattus norvegicus
tgactactgtgtgtcccacatgaag

SEQ ID NO: 608087 - DNA, 25 bp, Rattus norvegicus
tgactacttcctctggcatgggcat

SEQ ID NO: 608088 - DNA, 25 bp, Rattus norvegicus
tgactacttcctgtggcatgggcat

SEQ ID NO: 608089 - DNA, 25 bp, Rattus norvegicus
tgactagaaggacctaccacctctt

SEQ ID NO: 608090 - DNA, 25 bp, Rattus norvegicus
tgactagaaggagctaccacctctt

SEQ ID NO: 608091 - DNA, 25 bp, Rattus norvegicus
tgactagagaagaccctgcatgcag

SEQ ID NO: 608092 - DNA, 25 bp, Rattus norvegicus
tgactagagaagtccctgcatgcag

SEQ ID NO: 608093 - DNA, 25 bp, Rattus norvegicus
tgactagagattcccctgatgagct

SEQ ID NO: 608094 - DNA, 25 bp, Rattus norvegicus
tgactagagattgccctgatgagct

SEQ ID NO: 608095 - DNA, 25 bp, Rattus norvegicus
tgactagatcctcccacagaaatgt

SEQ ID NO: 608096 - DNA, 25 bp, Rattus norvegicus
tgactagatcctgccacagaaatgt

SEQ ID NO: 608097 - DNA, 25 bp, Rattus norvegicus
tgactagatctcctgtaattttgta

SEQ ID NO: 608098 - DNA, 25 bp, Rattus norvegicus
tgactagatctcgtgtaattttgta

SEQ ID NO: 608099 - DNA, 25 bp, Rattus norvegicus
tgactagcaaggcagtgacgcactg

SEQ ID NO: 608100 - DNA, 25 bp, Rattus norvegicus
tgactagcaagggagtgacgcactg

SEQ ID NO: 608101 - DNA, 25 bp, Rattus norvegicus
tgactagcacctacttcgattcctg

SEQ ID NO: 608102 - DNA, 25 bp, Rattus norvegicus
tgactagcaccttcttcgattcctg

SEQ ID NO: 608103 - DNA, 25 bp, Rattus norvegicus
tgactagcagtgatggctatctgtg

SEQ ID NO: 608104 - DNA, 25 bp, Rattus norvegicus
tgactagcagtgttggctatctgtg

SEQ ID NO: 608105 - DNA, 25 bp, Rattus norvegicus
tgactagcttctcacccggagacgt

SEQ ID NO: 608106 - DNA, 25 bp, Rattus norvegicus
tgactagcttctgacccggagacgt

SEQ ID NO: 608107 - DNA, 25 bp, Rattus norvegicus
tgactaggcctcatgtagactctcc

SEQ ID NO: 608108 - DNA, 25 bp, Rattus norvegicus
tgactaggcctcttgtagactctcc

SEQ ID NO: 608109 - DNA, 25 bp, Rattus norvegicus
tgactaggtgacactgggctgtttg

SEQ ID NO: 608110 - DNA, 25 bp, Rattus norvegicus
tgactaggtgactctgggctgtttg

SEQ ID NO: 608111 - DNA, 25 bp, Rattus norvegicus
tgactagtaggccacttcagtgctt

SEQ ID NO: 608112 - DNA, 25 bp, Rattus norvegicus
tgactagtaggcgacttcagtgctt

SEQ ID NO: 608113 - DNA, 25 bp, Rattus norvegicus
tgactagtcgctcaatacatttatc

SEQ ID NO: 608114 - DNA, 25 bp, Rattus norvegicus
tgactagtcgctgaatacatttatc

SEQ ID NO: 608115 - DNA, 25 bp, Rattus norvegicus
tgactagtgcctcagtgccgcttca

SEQ ID NO: 608116 - DNA, 25 bp, Rattus norvegicus
tgactagtgcctgagtgccgcttca

SEQ ID NO: 608117 - DNA, 25 bp, Rattus norvegicus
tgactagtggtcacatttgccctta

SEQ ID NO: 608118 - DNA, 25 bp, Rattus norvegicus
tgactagtggtctcatttgccctta

SEQ ID NO: 608119 - DNA, 25 bp, Rattus norvegicus
tgactagttaatcggcgctggcaca

SEQ ID NO: 608120 - DNA, 25 bp, Rattus norvegicus
tgactagttaatgggcgctggcaca

SEQ ID NO: 608121 - DNA, 25 bp, Rattus norvegicus
tgactagttatcactaaagctgcta

SEQ ID NO: 608122 - DNA, 25 bp, Rattus norvegicus
tgactagttatctctaaagctgcta

SEQ ID NO: 608123 - DNA, 25 bp, Rattus norvegicus
tgactatagggccacctaggcagac

SEQ ID NO: 608124 - DNA, 25 bp, Rattus norvegicus
tgactatagggcgacctaggcagac

SEQ ID NO: 608125 - DNA, 25 bp, Rattus norvegicus
tgactatatagcctggccctgtgag

SEQ ID NO: 608126 - DNA, 25 bp, Rattus norvegicus
tgactatatagcgtggccctgtgag

SEQ ID NO: 608127 - DNA, 25 bp, Rattus norvegicus
tgactatatcccactcatcgtgacg

SEQ ID NO: 608128 - DNA, 25 bp, Rattus norvegicus
tgactatatccctctcatcgtgacg

SEQ ID NO: 608129 - DNA, 25 bp, Rattus norvegicus
tgactatcaacgaacaccacagcaa

SEQ ID NO: 608130 - DNA, 25 bp, Rattus norvegicus
tgactatcaacgtacaccacagcaa

SEQ ID NO: 608131 - DNA, 25 bp, Rattus norvegicus
tgactatcacagatgctcgatgccc

SEQ ID NO: 608132 - DNA, 25 bp, Rattus norvegicus
tgactatcacagttgctcgatgccc

SEQ ID NO: 608133 - DNA, 25 bp, Rattus norvegicus
tgactatccaacattcagggctgtg

SEQ ID NO: 608134 - DNA, 25 bp, Rattus norvegicus
tgactatccaactttcagggctgtg

SEQ ID NO: 608135 - DNA, 25 bp, Rattus norvegicus
tgactatctcagaataaagcagaca

SEQ ID NO: 608136 - DNA, 25 bp, Rattus norvegicus
tgactatctcagatcatatttgctg

SEQ ID NO: 608137 - DNA, 25 bp, Rattus norvegicus
tgactatctcagtataaagcagaca

SEQ ID NO: 608138 - DNA, 25 bp, Rattus norvegicus
tgactatctcagttcatatttgctg

SEQ ID NO: 608139 - DNA, 25 bp, Rattus norvegicus
tgactatctctcagcacgttcacgt

SEQ ID NO: 608140 - DNA, 25 bp, Rattus norvegicus
tgactatctctctgcacgttcacgt

SEQ ID NO: 608141 - DNA, 25 bp, Rattus norvegicus
tgactatgggttataccttcccggg

SEQ ID NO: 608142 - DNA, 25 bp, Rattus norvegicus
tgactatgggttttaccttcccggg

SEQ ID NO: 608143 - DNA, 25 bp, Rattus norvegicus
tgactatgtctgaggcattcctgcc

SEQ ID NO: 608144 - DNA, 25 bp, Rattus norvegicus
tgactatgtctgtggcattcctgcc

SEQ ID NO: 608145 - DNA, 25 bp, Rattus norvegicus
tgactattacctcagaatattctgt

SEQ ID NO: 608146 - DNA, 25 bp, Rattus norvegicus
tgactattacctgagaatattctgt

SEQ ID NO: 608147 - DNA, 25 bp, Rattus norvegicus
tgactatttcctctgactccttggc

SEQ ID NO: 608148 - DNA, 25 bp, Rattus norvegicus
tgactatttcctgtgactccttggc

SEQ ID NO: 608149 - DNA, 25 bp, Rattus norvegicus
tgactcaaagtccactgcagcctag

SEQ ID NO: 608150 - DNA, 25 bp, Rattus norvegicus
tgactcaaagtcgactgcagcctag

SEQ ID NO: 608151 - DNA, 25 bp, Rattus norvegicus
tgactcaaatacaaaggaactccgt

SEQ ID NO: 608152 - DNA, 25 bp, Rattus norvegicus
tgactcaaatactaaggaactccgt

SEQ ID NO: 608153 - DNA, 25 bp, Rattus norvegicus
tgactcaaccaaaggcagcctcata

SEQ ID NO: 608154 - DNA, 25 bp, Rattus norvegicus
tgactcaaccaatggcagcctcata

SEQ ID NO: 608155 - DNA, 25 bp, Rattus norvegicus
tgactcaactcacaaggtggacatc

SEQ ID NO: 608156 - DNA, 25 bp, Rattus norvegicus
tgactcaactcagaaggtggacatc

SEQ ID NO: 608157 - DNA, 25 bp, Rattus norvegicus
tgactcaaggtaacacgcagcacga

SEQ ID NO: 608158 - DNA, 25 bp, Rattus norvegicus
tgactcaaggtatcacgcagcacga

SEQ ID NO: 608159 - DNA, 25 bp, Rattus norvegicus
tgactcacacttcacatctcagcaa

SEQ ID NO: 608160 - DNA, 25 bp, Rattus norvegicus
tgactcacacttgacatctcagcaa

SEQ ID NO: 608161 - DNA, 25 bp, Rattus norvegicus
tgactcacagcaccattcattcatg

SEQ ID NO: 608162 - DNA, 25 bp, Rattus norvegicus
tgactcacagcagcattcattcatg

SEQ ID NO: 608163 - DNA, 25 bp, Rattus norvegicus
tgactcaccagcaggatcaaatcct

SEQ ID NO: 608164 - DNA, 25 bp, Rattus norvegicus
tgactcaccagctggatcaaatcct

SEQ ID NO: 608165 - DNA, 25 bp, Rattus norvegicus
tgactcacccatagcctgcataagt

SEQ ID NO: 608166 - DNA, 25 bp, Rattus norvegicus
tgactcacccattgcctgcataagt

SEQ ID NO: 608167 - DNA, 25 bp, Rattus norvegicus
tgactcaccctgcatggagtgctgc

SEQ ID NO: 608168 - DNA, 25 bp, Rattus norvegicus
tgactcaccctggatggagtgctgc

SEQ ID NO: 608169 - DNA, 25 bp, Rattus norvegicus
tgactcactcacatctttccagaaa

SEQ ID NO: 608170 - DNA, 25 bp, Rattus norvegicus
tgactcactcacttctttccagaaa

SEQ ID NO: 608171 - DNA, 25 bp, Rattus norvegicus
tgactcacttgcagcacaagcatgc

SEQ ID NO: 608172 - DNA, 25 bp, Rattus norvegicus
tgactcacttgctgcacaagcatgc

SEQ ID NO: 608173 - DNA, 25 bp, Rattus norvegicus
tgactcactttcagatttccatgaa

SEQ ID NO: 608174 - DNA, 25 bp, Rattus norvegicus
tgactcactttctgatttccatgaa

SEQ ID NO: 608175 - DNA, 25 bp, Rattus norvegicus
tgactcagactccacgtgtaaaagc

SEQ ID NO: 608176 - DNA, 25 bp, Rattus norvegicus
tgactcagactcgacgtgtaaaagc

SEQ ID NO: 608177 - DNA, 25 bp, Rattus norvegicus
tgactcagagcacccgttggtttgc

SEQ ID NO: 608178 - DNA, 25 bp, Rattus norvegicus
tgactcagagcagccgttggtttgc

SEQ ID NO: 608179 - DNA, 25 bp, Rattus norvegicus
tgactcagagttaacctttccaggg

SEQ ID NO: 608180 - DNA, 25 bp, Rattus norvegicus
tgactcagagtttacctttccaggg

SEQ ID NO: 608181 - DNA, 25 bp, Rattus norvegicus
tgactcagcactactgagctcatct

SEQ ID NO: 608182 - DNA, 25 bp, Rattus norvegicus
tgactcagcactataccgcataggt

SEQ ID NO: 608183 - DNA, 25 bp, Rattus norvegicus
tgactcagcacttctgagctcatct

SEQ ID NO: 608184 - DNA, 25 bp, Rattus norvegicus
tgactcagcactttaccgcataggt

SEQ ID NO: 608185 - DNA, 25 bp, Rattus norvegicus
tgactcagcaggcagacagctcaga

SEQ ID NO: 608186 - DNA, 25 bp, Rattus norvegicus
tgactcagcagggagacagctcaga

SEQ ID NO: 608187 - DNA, 25 bp, Rattus norvegicus
tgactcaggagtactgggctaacct

SEQ ID NO: 608188 - DNA, 25 bp, Rattus norvegicus
tgactcaggagttctgggctaacct

SEQ ID NO: 608189 - DNA, 25 bp, Rattus norvegicus
tgactcaggctgagcacaggacact

SEQ ID NO: 608190 - DNA, 25 bp, Rattus norvegicus
tgactcaggctgtgcacaggacact

SEQ ID NO: 608191 - DNA, 25 bp, Rattus norvegicus
tgactcagtaataatgtgcctccta

SEQ ID NO: 608192 - DNA, 25 bp, Rattus norvegicus
tgactcagtaattatgtgcctccta

SEQ ID NO: 608193 - DNA, 25 bp, Rattus norvegicus
tgactcagtcatacagacacttagt

SEQ ID NO: 608194 - DNA, 25 bp, Rattus norvegicus
tgactcagtcattcagacacttagt

SEQ ID NO: 608195 - DNA, 25 bp, Rattus norvegicus
tgactcatcctgagggtgttctaag

SEQ ID NO: 608196 - DNA, 25 bp, Rattus norvegicus
tgactcatcctgtgggtgttctaag

SEQ ID NO: 608197 - DNA, 25 bp, Rattus norvegicus
tgactcatcgccaaactgggcaggg

SEQ ID NO: 608198 - DNA, 25 bp, Rattus norvegicus
tgactcatcgcctaactgggcaggg

SEQ ID NO: 608199 - DNA, 25 bp, Rattus norvegicus
tgactcatgatgacggaagccacaa

SEQ ID NO: 608200 - DNA, 25 bp, Rattus norvegicus
tgactcatgatgtcggaagccacaa

SEQ ID NO: 608201 - DNA, 25 bp, Rattus norvegicus
tgactcatggacactgttgggcaat

SEQ ID NO: 608202 - DNA, 25 bp, Rattus norvegicus
tgactcatggactctgttgggcaat

SEQ ID NO: 608203 - DNA, 25 bp, Rattus norvegicus
tgactcattagcatacctgtttctg

SEQ ID NO: 608204 - DNA, 25 bp, Rattus norvegicus
tgactcattagcttacctgtttctg

SEQ ID NO: 608205 - DNA, 25 bp, Rattus norvegicus
tgactcattggccaaacttatcctg

SEQ ID NO: 608206 - DNA, 25 bp, Rattus norvegicus
tgactcattggcgaaacttatcctg

SEQ ID NO: 608207 - DNA, 25 bp, Rattus norvegicus
tgactcatttcgacctggagctggt

SEQ ID NO: 608208 - DNA, 25 bp, Rattus norvegicus
tgactcatttcgtcctggagctggt

SEQ ID NO: 608209 - DNA, 25 bp, Rattus norvegicus
tgactcattttcataactgcctctg

SEQ ID NO: 608210 - DNA, 25 bp, Rattus norvegicus
tgactcattttcttaactgcctctg

SEQ ID NO: 608211 - DNA, 25 bp, Rattus norvegicus
tgactcatttttctacttcccaagt

SEQ ID NO: 608212 - DNA, 25 bp, Rattus norvegicus
tgactcatttttgtacttcccaagt

SEQ ID NO: 608213 - DNA, 25 bp, Rattus norvegicus
tgactccaaggaaccgtgggtgcct

SEQ ID NO: 608214 - DNA, 25 bp, Rattus norvegicus
tgactccaaggacgctgtgggatcc

SEQ ID NO: 608215 - DNA, 25 bp, Rattus norvegicus
tgactccaaggaggctgtgggatcc

SEQ ID NO: 608216 - DNA, 25 bp, Rattus norvegicus
tgactccaaggatccgtgggtgcct

SEQ ID NO: 608217 - DNA, 25 bp, Rattus norvegicus
tgactccaagtacccaccaaggttc

SEQ ID NO: 608218 - DNA, 25 bp, Rattus norvegicus
tgactccaagtagccaccaaggttc

SEQ ID NO: 608219 - DNA, 25 bp, Rattus norvegicus
tgactccaataaacagtgtttcctg

SEQ ID NO: 608220 - DNA, 25 bp, Rattus norvegicus
tgactccaataatcagtgtttcctg

SEQ ID NO: 608221 - DNA, 25 bp, Rattus norvegicus
tgactccaatccatactgcttagca

SEQ ID NO: 608222 - DNA, 25 bp, Rattus norvegicus
tgactccaatccttactgcttagca

SEQ ID NO: 608223 - DNA, 25 bp, Rattus norvegicus
tgactccaccatcaaggtcttgctt

SEQ ID NO: 608224 - DNA, 25 bp, Rattus norvegicus
tgactccaccatgaaggtcttgctt

SEQ ID NO: 608225 - DNA, 25 bp, Rattus norvegicus
tgactccagatacgcagcgttcacg

SEQ ID NO: 608226 - DNA, 25 bp, Rattus norvegicus
tgactccagataggcagcgttcacg

SEQ ID NO: 608227 - DNA, 25 bp, Rattus norvegicus
tgactccaggtcattaaggcacaag

SEQ ID NO: 608228 - DNA, 25 bp, Rattus norvegicus
tgactccaggtctttaaggcacaag

SEQ ID NO: 608229 - DNA, 25 bp, Rattus norvegicus
tgactccataaacctgccctttgac

SEQ ID NO: 608230 - DNA, 25 bp, Rattus norvegicus
tgactccataaagctgccctttgac

SEQ ID NO: 608231 - DNA, 25 bp, Rattus norvegicus
tgactccatccaaacgatcacagat

SEQ ID NO: 608232 - DNA, 25 bp, Rattus norvegicus
tgactccatccatacgatcacagat

SEQ ID NO: 608233 - DNA, 25 bp, Rattus norvegicus
tgactccatctcacaggactgggta

SEQ ID NO: 608234 - DNA, 25 bp, Rattus norvegicus
tgactccatctctcaggactgggta

SEQ ID NO: 608235 - DNA, 25 bp, Rattus norvegicus
tgactccatcttagtctgaatgcag

SEQ ID NO: 608236 - DNA, 25 bp, Rattus norvegicus
tgactccatctttgtctgaatgcag

SEQ ID NO: 608237 - DNA, 25 bp, Rattus norvegicus
tgactccatgagcagcgatctatgt

SEQ ID NO: 608238 - DNA, 25 bp, Rattus norvegicus
tgactccatgaggagcgatctatgt

SEQ ID NO: 608239 - DNA, 25 bp, Rattus norvegicus
tgactccattggaattctgttctaa

SEQ ID NO: 608240 - DNA, 25 bp, Rattus norvegicus
tgactccattggtattctgttctaa

SEQ ID NO: 608241 - DNA, 25 bp, Rattus norvegicus
tgactccatttccaggtcacgggaa

SEQ ID NO: 608242 - DNA, 25 bp, Rattus norvegicus
tgactccatttcgaggtcacgggaa

SEQ ID NO: 608243 - DNA, 25 bp, Rattus norvegicus
tgactcccaaatactacccttttga

SEQ ID NO: 608244 - DNA, 25 bp, Rattus norvegicus
tgactcccaaattctacccttttga

SEQ ID NO: 608245 - DNA, 25 bp, Rattus norvegicus
tgactcccacataggttgatcacac

SEQ ID NO: 608246 - DNA, 25 bp, Rattus norvegicus
tgactcccacattggttgatcacac

SEQ ID NO: 608247 - DNA, 25 bp, Rattus norvegicus
tgactcccatgcatgacaagccaaa

SEQ ID NO: 608248 - DNA, 25 bp, Rattus norvegicus
tgactcccatgcttgacaagccaaa

SEQ ID NO: 608249 - DNA, 25 bp, Rattus norvegicus
tgactccccaggactacaatctgag

SEQ ID NO: 608250 - DNA, 25 bp, Rattus norvegicus
tgactccccaggtctacaatctgag

SEQ ID NO: 608251 - DNA, 25 bp, Rattus norvegicus
tgactcccctaactatggcaactct

SEQ ID NO: 608252 - DNA, 25 bp, Rattus norvegicus
tgactcccctaagtatggcaactct

SEQ ID NO: 608253 - DNA, 25 bp, Rattus norvegicus
tgactcccctgccttaaactaattg

SEQ ID NO: 608254 - DNA, 25 bp, Rattus norvegicus
tgactcccctgcgttaaactaattg

SEQ ID NO: 608255 - DNA, 25 bp, Rattus norvegicus
tgactcccgaatcattctctggaag

SEQ ID NO: 608256 - DNA, 25 bp, Rattus norvegicus
tgactcccgaatgattctctggaag

SEQ ID NO: 608257 - DNA, 25 bp, Rattus norvegicus
tgactccctaaaaccacacagcaga

SEQ ID NO: 608258 - DNA, 25 bp, Rattus norvegicus
tgactccctaaatccacacagcaga

SEQ ID NO: 608259 - DNA, 25 bp, Rattus norvegicus
tgactccctaggatggaaagctgaa

SEQ ID NO: 608260 - DNA, 25 bp, Rattus norvegicus
tgactccctaggttggaaagctgaa

SEQ ID NO: 608261 - DNA, 25 bp, Rattus norvegicus
tgactccctgaacccataatttcaa

SEQ ID NO: 608262 - DNA, 25 bp, Rattus norvegicus
tgactccctgaagccataatttcaa

SEQ ID NO: 608263 - DNA, 25 bp, Rattus norvegicus
tgactccctggaccagcagaatgca

SEQ ID NO: 608264 - DNA, 25 bp, Rattus norvegicus
tgactccctggagcagcagaatgca

SEQ ID NO: 608265 - DNA, 25 bp, Rattus norvegicus
tgactccctggccagaaactgacca

SEQ ID NO: 608266 - DNA, 25 bp, Rattus norvegicus
tgactccctggcgagaaactgacca

SEQ ID NO: 608267 - DNA, 25 bp, Rattus norvegicus
tgactccctgtcatgagtggaccta

SEQ ID NO: 608268 - DNA, 25 bp, Rattus norvegicus
tgactccctgtcttgagtggaccta

SEQ ID NO: 608269 - DNA, 25 bp, Rattus norvegicus
tgactcccttgcatgatggctgtgg

SEQ ID NO: 608270 - DNA, 25 bp, Rattus norvegicus
tgactcccttgcttgatggctgtgg

SEQ ID NO: 608271 - DNA, 25 bp, Rattus norvegicus
tgactccgagcacgaggcgcacaag

SEQ ID NO: 608272 - DNA, 25 bp, Rattus norvegicus
tgactccgagcaggaggcgcacaag

SEQ ID NO: 608273 - DNA, 25 bp, Rattus norvegicus
tgactccgggccatgggttcctgta

SEQ ID NO: 608274 - DNA, 25 bp, Rattus norvegicus
tgactccgggccttgggttcctgta

SEQ ID NO: 608275 - DNA, 25 bp, Rattus norvegicus
tgactccgggctagtgcgtaaggac

SEQ ID NO: 608276 - DNA, 25 bp, Rattus norvegicus
tgactccgggcttgtgcgtaaggac

SEQ ID NO: 608277 - DNA, 25 bp, Rattus norvegicus
tgactcctaactacagctctacatt

SEQ ID NO: 608278 - DNA, 25 bp, Rattus norvegicus
tgactcctaacttcagctctacatt

SEQ ID NO: 608279 - DNA, 25 bp, Rattus norvegicus
tgactcctacataatcccaaccaat

SEQ ID NO: 608280 - DNA, 25 bp, Rattus norvegicus
tgactcctacattatcccaaccaat

SEQ ID NO: 608281 - DNA, 25 bp, Rattus norvegicus
tgactcctctaaatcatctagcaag

SEQ ID NO: 608282 - DNA, 25 bp, Rattus norvegicus
tgactcctctaattcatctagcaag

SEQ ID NO: 608283 - DNA, 25 bp, Rattus norvegicus
tgactcctctctatgcatgcataca

SEQ ID NO: 608284 - DNA, 25 bp, Rattus norvegicus
tgactcctctctttgcatgcataca

SEQ ID NO: 608285 - DNA, 25 bp, Rattus norvegicus
tgactcctgaacattccccatgagc

SEQ ID NO: 608286 - DNA, 25 bp, Rattus norvegicus
tgactcctgaactttccccatgagc

SEQ ID NO: 608287 - DNA, 25 bp, Rattus norvegicus
tgactcctgagcagctttggcacgt

SEQ ID NO: 608288 - DNA, 25 bp, Rattus norvegicus
tgactcctgagctgctttggcacgt

SEQ ID NO: 608289 - DNA, 25 bp, Rattus norvegicus
tgactcctgatcagactcactggtg

SEQ ID NO: 608290 - DNA, 25 bp, Rattus norvegicus
tgactcctgatctgactcactggtg

SEQ ID NO: 608291 - DNA, 25 bp, Rattus norvegicus
tgactcctgatgaagcacaactccc

SEQ ID NO: 608292 - DNA, 25 bp, Rattus norvegicus
tgactcctgatgtagcacaactccc

SEQ ID NO: 608293 - DNA, 25 bp, Rattus norvegicus
tgactcctgattatgatcctcggga

SEQ ID NO: 608294 - DNA, 25 bp, Rattus norvegicus
tgactcctgattttgatcctcggga

SEQ ID NO: 608295 - DNA, 25 bp, Rattus norvegicus
tgactcctgccaccggctgctgaat

SEQ ID NO: 608296 - DNA, 25 bp, Rattus norvegicus
tgactcctgccagcggctgctgaat

SEQ ID NO: 608297 - DNA, 25 bp, Rattus norvegicus
tgactcctgctgaggttgacagtgt

SEQ ID NO: 608298 - DNA, 25 bp, Rattus norvegicus
tgactcctgctgtggttgacagtgt

SEQ ID NO: 608299 - DNA, 25 bp, Rattus norvegicus
tgactcctgcttcgcacagtgcatt

SEQ ID NO: 608300 - DNA, 25 bp, Rattus norvegicus
tgactcctgcttggcacagtgcatt

SEQ ID NO: 608301 - DNA, 25 bp, Rattus norvegicus
tgactcctgggcctatgaagtgtga

SEQ ID NO: 608302 - DNA, 25 bp, Rattus norvegicus
tgactcctgggcgtatgaagtgtga

SEQ ID NO: 608303 - DNA, 25 bp, Rattus norvegicus
tgactccttcccatgttgaactgga

SEQ ID NO: 608304 - DNA, 25 bp, Rattus norvegicus
tgactccttcccttgttgaactgga

SEQ ID NO: 608305 - DNA, 25 bp, Rattus norvegicus
tgactcctttccattggtcccagct

SEQ ID NO: 608306 - DNA, 25 bp, Rattus norvegicus
tgactcctttcctttggtcccagct

SEQ ID NO: 608307 - DNA, 25 bp, Rattus norvegicus
tgactcgaggtgatggctggacccc

SEQ ID NO: 608308 - DNA, 25 bp, Rattus norvegicus
tgactcgaggtgttggctggacccc

SEQ ID NO: 608309 - DNA, 25 bp, Rattus norvegicus
tgactcgcataaacacgccgtactt

SEQ ID NO: 608310 - DNA, 25 bp, Rattus norvegicus
tgactcgcataatcacgccgtactt

SEQ ID NO: 608311 - DNA, 25 bp, Rattus norvegicus
tgactcggactgcacaatggacatc

SEQ ID NO: 608312 - DNA, 25 bp, Rattus norvegicus
tgactcggactggacaatggacatc

SEQ ID NO: 608313 - DNA, 25 bp, Rattus norvegicus
tgactcggcttcaccatttctctaa

SEQ ID NO: 608314 - DNA, 25 bp, Rattus norvegicus
tgactcggcttctccatttctctaa

SEQ ID NO: 608315 - DNA, 25 bp, Rattus norvegicus
tgactcggtttccttctgcaggcct

SEQ ID NO: 608316 - DNA, 25 bp, Rattus norvegicus
tgactcggtttcgttctgcaggcct

SEQ ID NO: 608317 - DNA, 25 bp, Rattus norvegicus
tgactcgtcgccagcataggagccg

SEQ ID NO: 608318 - DNA, 25 bp, Rattus norvegicus
tgactcgtcgcctgcataggagccg

SEQ ID NO: 608319 - DNA, 25 bp, Rattus norvegicus
tgactcgtctacatgtacactcggg

SEQ ID NO: 608320 - DNA, 25 bp, Rattus norvegicus
tgactcgtctacttgtacactcggg

SEQ ID NO: 608321 - DNA, 25 bp, Rattus norvegicus
tgactcgttgggagacttcttccat

SEQ ID NO: 608322 - DNA, 25 bp, Rattus norvegicus
tgactcgttgggtgacttcttccat

SEQ ID NO: 608323 - DNA, 25 bp, Rattus norvegicus
tgactctaactccaacatccataat

SEQ ID NO: 608324 - DNA, 25 bp, Rattus norvegicus
tgactctaactcgaacatccataat

SEQ ID NO: 608325 - DNA, 25 bp, Rattus norvegicus
tgactctacaccagtgacttccgag

SEQ ID NO: 608326 - DNA, 25 bp, Rattus norvegicus
tgactctacacctgtgacttccgag

SEQ ID NO: 608327 - DNA, 25 bp, Rattus norvegicus
tgactctacctactcgcagtataaa

SEQ ID NO: 608328 - DNA, 25 bp, Rattus norvegicus
tgactctacctagtcgcagtataaa

SEQ ID NO: 608329 - DNA, 25 bp, Rattus norvegicus
tgactctacggtaatgcacgatcct

SEQ ID NO: 608330 - DNA, 25 bp, Rattus norvegicus
tgactctacggttatgcacgatcct

SEQ ID NO: 608331 - DNA, 25 bp, Rattus norvegicus
tgactctagacaacatggacccttt

SEQ ID NO: 608332 - DNA, 25 bp, Rattus norvegicus
tgactctagacatcatggacccttt

SEQ ID NO: 608333 - DNA, 25 bp, Rattus norvegicus
tgactctagaggcttccgtgtattc

SEQ ID NO: 608334 - DNA, 25 bp, Rattus norvegicus
tgactctagagggttccgtgtattc

SEQ ID NO: 608335 - DNA, 25 bp, Rattus norvegicus
tgactctagtcaactgcaatctgcc

SEQ ID NO: 608336 - DNA, 25 bp, Rattus norvegicus
tgactctagtcatctgcaatctgcc

SEQ ID NO: 608337 - DNA, 25 bp, Rattus norvegicus
tgactctcacccatggcaatgtggt

SEQ ID NO: 608338 - DNA, 25 bp, Rattus norvegicus
tgactctcacccttggcaatgtggt

SEQ ID NO: 608339 - DNA, 25 bp, Rattus norvegicus
tgactctcagtcactcacagaggct

SEQ ID NO: 608340 - DNA, 25 bp, Rattus norvegicus
tgactctcagtctctcacagaggct

SEQ ID NO: 608341 - DNA, 25 bp, Rattus norvegicus
tgactctccctacgttttgggtgta

SEQ ID NO: 608342 - DNA, 25 bp, Rattus norvegicus
tgactctccctaggttttgggtgta

SEQ ID NO: 608343 - DNA, 25 bp, Rattus norvegicus
tgactctcctttctggtttcggtac

SEQ ID NO: 608344 - DNA, 25 bp, Rattus norvegicus
tgactctcctttgtggtttcggtac

SEQ ID NO: 608345 - DNA, 25 bp, Rattus norvegicus
tgactctcggtcatcccacatggat

SEQ ID NO: 608346 - DNA, 25 bp, Rattus norvegicus
tgactctcggtcttcccacatggat

SEQ ID NO: 608347 - DNA, 25 bp, Rattus norvegicus
tgactctctggaaatcacggctccc

SEQ ID NO: 608348 - DNA, 25 bp, Rattus norvegicus
tgactctctggaactgggattacgg

SEQ ID NO: 608349 - DNA, 25 bp, Rattus norvegicus
tgactctctggatatcacggctccc

SEQ ID NO: 608350 - DNA, 25 bp, Rattus norvegicus
tgactctctggatctgggattacgg

SEQ ID NO: 608351 - DNA, 25 bp, Rattus norvegicus
tgactctgagcaactggccgccagt

SEQ ID NO: 608352 - DNA, 25 bp, Rattus norvegicus
tgactctgagcatctggccgccagt

SEQ ID NO: 608353 - DNA, 25 bp, Rattus norvegicus
tgactctgagccagatctggttatc

SEQ ID NO: 608354 - DNA, 25 bp, Rattus norvegicus
tgactctgagcctgatctggttatc

SEQ ID NO: 608355 - DNA, 25 bp, Rattus norvegicus
tgactctgaggaaagccactccaca

SEQ ID NO: 608356 - DNA, 25 bp, Rattus norvegicus
tgactctgaggatagccactccaca

SEQ ID NO: 608357 - DNA, 25 bp, Rattus norvegicus
tgactctgagtacacctgccattta

SEQ ID NO: 608358 - DNA, 25 bp, Rattus norvegicus
tgactctgagtagacctgccattta

SEQ ID NO: 608359 - DNA, 25 bp, Rattus norvegicus
tgactctgatgtcccttgctgaaga

SEQ ID NO: 608360 - DNA, 25 bp, Rattus norvegicus
tgactctgatgtgccttgctgaaga

SEQ ID NO: 608361 - DNA, 25 bp, Rattus norvegicus
tgactctgcgctccagcaataatgg

SEQ ID NO: 608362 - DNA, 25 bp, Rattus norvegicus
tgactctgcgctgcagcaataatgg

SEQ ID NO: 608363 - DNA, 25 bp, Rattus norvegicus
tgactctgctcaaccttaggtatgt

SEQ ID NO: 608364 - DNA, 25 bp, Rattus norvegicus
tgactctgctcatccttaggtatgt

SEQ ID NO: 608365 - DNA, 25 bp, Rattus norvegicus
tgactctggcacaacgtgtctattc

SEQ ID NO: 608366 - DNA, 25 bp, Rattus norvegicus
tgactctggcactacgtgtctattc

SEQ ID NO: 608367 - DNA, 25 bp, Rattus norvegicus
tgactctgtaatcacatcgccacac

SEQ ID NO: 608368 - DNA, 25 bp, Rattus norvegicus
tgactctgtaatgacatcgccacac

SEQ ID NO: 608369 - DNA, 25 bp, Rattus norvegicus
tgactctgtcccattgcaacattgc

SEQ ID NO: 608370 - DNA, 25 bp, Rattus norvegicus
tgactctgtccctttgcaacattgc

SEQ ID NO: 608371 - DNA, 25 bp, Rattus norvegicus
tgactctgtcttaagtgcacccgtg

SEQ ID NO: 608372 - DNA, 25 bp, Rattus norvegicus
tgactctgtctttagtgcacccgtg

SEQ ID NO: 608373 - DNA, 25 bp, Rattus norvegicus
tgactctgtgtaaggttctaccctt

SEQ ID NO: 608374 - DNA, 25 bp, Rattus norvegicus
tgactctgtgtatggttctaccctt

SEQ ID NO: 608375 - DNA, 25 bp, Rattus norvegicus
tgactctgtgtgcccctgggtccct

SEQ ID NO: 608376 - DNA, 25 bp, Rattus norvegicus
tgactctgtgtggccctgggtccct

SEQ ID NO: 608377 - DNA, 25 bp, Rattus norvegicus
tgactcttacttaacccttgaattc

SEQ ID NO: 608378 - DNA, 25 bp, Rattus norvegicus
tgactcttactttacccttgaattc

SEQ ID NO: 608379 - DNA, 25 bp, Rattus norvegicus
tgactcttagtaaagctgcctccgt

SEQ ID NO: 608380 - DNA, 25 bp, Rattus norvegicus
tgactcttagtatagctgcctccgt

SEQ ID NO: 608381 - DNA, 25 bp, Rattus norvegicus
tgactcttatcccaagctattcgct

SEQ ID NO: 608382 - DNA, 25 bp, Rattus norvegicus
tgactcttatccgaagctattcgct

SEQ ID NO: 608383 - DNA, 25 bp, Rattus norvegicus
tgactcttattactctgtccctgca

SEQ ID NO: 608384 - DNA, 25 bp, Rattus norvegicus
tgactcttattagtctgtccctgca

SEQ ID NO: 608385 - DNA, 25 bp, Rattus norvegicus
tgactcttccttatggtcctgggaa

SEQ ID NO: 608386 - DNA, 25 bp, Rattus norvegicus
tgactcttccttttggtcctgggaa

SEQ ID NO: 608387 - DNA, 25 bp, Rattus norvegicus
tgactcttctatactgggcttttga

SEQ ID NO: 608388 - DNA, 25 bp, Rattus norvegicus
tgactcttctattctgggcttttga

SEQ ID NO: 608389 - DNA, 25 bp, Rattus norvegicus
tgactcttctccctaagctagaacg

SEQ ID NO: 608390 - DNA, 25 bp, Rattus norvegicus
tgactcttctccgtaagctagaacg

SEQ ID NO: 608391 - DNA, 25 bp, Rattus norvegicus
tgactcttgcctcatgctcaattat

SEQ ID NO: 608392 - DNA, 25 bp, Rattus norvegicus
tgactcttgcctgatgctcaattat

SEQ ID NO: 608393 - DNA, 25 bp, Rattus norvegicus
tgactcttggcccaactactttaag

SEQ ID NO: 608394 - DNA, 25 bp, Rattus norvegicus
tgactcttggccgaactactttaag

SEQ ID NO: 608395 - DNA, 25 bp, Rattus norvegicus
tgactcttgtgacccattctgtatt

SEQ ID NO: 608396 - DNA, 25 bp, Rattus norvegicus
tgactcttgtgagccattctgtatt

SEQ ID NO: 608397 - DNA, 25 bp, Rattus norvegicus
tgactcttgtgtatgtatctccttt

SEQ ID NO: 608398 - DNA, 25 bp, Rattus norvegicus
tgactcttgtgtttgtatctccttt

SEQ ID NO: 608399 - DNA, 25 bp, Rattus norvegicus
tgactctttcctacttagtttgtgc

SEQ ID NO: 608400 - DNA, 25 bp, Rattus norvegicus
tgactctttccttcttagtttgtgc

SEQ ID NO: 608401 - DNA, 25 bp, Rattus norvegicus
tgactctttctgactgcatgggatt

SEQ ID NO: 608402 - DNA, 25 bp, Rattus norvegicus
tgactctttctgtctgcatgggatt

SEQ ID NO: 608403 - DNA, 25 bp, Rattus norvegicus
tgactctttgggagagttgctggca

SEQ ID NO: 608404 - DNA, 25 bp, Rattus norvegicus
tgactctttgggtgagttgctggca

SEQ ID NO: 608405 - DNA, 25 bp, Rattus norvegicus
tgactgaaaggtcgcatggtgactc

SEQ ID NO: 608406 - DNA, 25 bp, Rattus norvegicus
tgactgaaaggtggcatggtgactc

SEQ ID NO: 608407 - DNA, 25 bp, Rattus norvegicus
tgactgaaccgtagatgctgccctg

SEQ ID NO: 608408 - DNA, 25 bp, Rattus norvegicus
tgactgaaccgttgatgctgccctg

SEQ ID NO: 608409 - DNA, 25 bp, Rattus norvegicus
tgactgaacgtaccacatctcgtcc

SEQ ID NO: 608410 - DNA, 25 bp, Rattus norvegicus
tgactgaacgtagcacatctcgtcc

SEQ ID NO: 608411 - DNA, 25 bp, Rattus norvegicus
tgactgaagcgacggccagtcccag

SEQ ID NO: 608412 - DNA, 25 bp, Rattus norvegicus
tgactgaagcgagggccagtcccag

SEQ ID NO: 608413 - DNA, 25 bp, Rattus norvegicus
tgactgaagttcctgtttccttggg

SEQ ID NO: 608414 - DNA, 25 bp, Rattus norvegicus
tgactgaagttcgtgtttccttggg

SEQ ID NO: 608415 - DNA, 25 bp, Rattus norvegicus
tgactgaattccatatacctataga

SEQ ID NO: 608416 - DNA, 25 bp, Rattus norvegicus
tgactgaattccttatacctataga

SEQ ID NO: 608417 - DNA, 25 bp, Rattus norvegicus
tgactgacagacagcatcaccttct

SEQ ID NO: 608418 - DNA, 25 bp, Rattus norvegicus
tgactgacagactgcatcaccttct

SEQ ID NO: 608419 - DNA, 25 bp, Rattus norvegicus
tgactgacagtgagccctcccaaaa

SEQ ID NO: 608420 - DNA, 25 bp, Rattus norvegicus
tgactgacagtgtgccctcccaaaa

SEQ ID NO: 608421 - DNA, 25 bp, Rattus norvegicus
tgactgacatgaccaacaatgcctt

SEQ ID NO: 608422 - DNA, 25 bp, Rattus norvegicus
tgactgacatgagcaacaatgcctt

SEQ ID NO: 608423 - DNA, 25 bp, Rattus norvegicus
tgactgacccgcacagagccggtga

SEQ ID NO: 608424 - DNA, 25 bp, Rattus norvegicus
tgactgacccgctcagagccggtga

SEQ ID NO: 608425 - DNA, 25 bp, Rattus norvegicus
tgactgaccgaaccgagcggcctag

SEQ ID NO: 608426 - DNA, 25 bp, Rattus norvegicus
tgactgaccgaagcgagcggcctag

SEQ ID NO: 608427 - DNA, 25 bp, Rattus norvegicus
tgactgacctaaaaaccctaagcct

SEQ ID NO: 608428 - DNA, 25 bp, Rattus norvegicus
tgactgacctaataaccctaagcct

SEQ ID NO: 608429 - DNA, 25 bp, Rattus norvegicus
tgactgacctcacagggcaagtggt

SEQ ID NO: 608430 - DNA, 25 bp, Rattus norvegicus
tgactgacctcagagggcaagtggt

SEQ ID NO: 608431 - DNA, 25 bp, Rattus norvegicus
tgactgactgcgactagttatctca

SEQ ID NO: 608432 - DNA, 25 bp, Rattus norvegicus
tgactgactgcgtctagttatctca

SEQ ID NO: 608433 - DNA, 25 bp, Rattus norvegicus
tgactgacttctctctgctgtggaa

SEQ ID NO: 608434 - DNA, 25 bp, Rattus norvegicus
tgactgacttctgtctgctgtggaa

SEQ ID NO: 608435 - DNA, 25 bp, Rattus norvegicus
tgactgactttaagtcctcccgtaa

SEQ ID NO: 608436 - DNA, 25 bp, Rattus norvegicus
tgactgactttatgtcctcccgtaa

SEQ ID NO: 608437 - DNA, 25 bp, Rattus norvegicus
tgactgagagaaaccgagcactgca

SEQ ID NO: 608438 - DNA, 25 bp, Rattus norvegicus
tgactgagagaatccgagcactgca

SEQ ID NO: 608439 - DNA, 25 bp, Rattus norvegicus
tgactgagatacaagggttccctct

SEQ ID NO: 608440 - DNA, 25 bp, Rattus norvegicus
tgactgagatactagggttccctct

SEQ ID NO: 608441 - DNA, 25 bp, Rattus norvegicus
tgactgagcaccctgtcgatcgagt

SEQ ID NO: 608442 - DNA, 25 bp, Rattus norvegicus
tgactgagcaccgtgtcgatcgagt

SEQ ID NO: 608443 - DNA, 25 bp, Rattus norvegicus
tgactgagccccaaataaatcctct

SEQ ID NO: 608444 - DNA, 25 bp, Rattus norvegicus
tgactgagcccctaataaatcctct

SEQ ID NO: 608445 - DNA, 25 bp, Rattus norvegicus
tgactgagtcaccagatgtctctgt

SEQ ID NO: 608446 - DNA, 25 bp, Rattus norvegicus
tgactgagtcacgagatgtctctgt

SEQ ID NO: 608447 - DNA, 25 bp, Rattus norvegicus
tgactgatatcccaagaacatgcca

SEQ ID NO: 608448 - DNA, 25 bp, Rattus norvegicus
tgactgatatccgaagaacatgcca

SEQ ID NO: 608449 - DNA, 25 bp, Rattus norvegicus
tgactgatgagcatgcccagggcac

SEQ ID NO: 608450 - DNA, 25 bp, Rattus norvegicus
tgactgatgagcttgcccagggcac

SEQ ID NO: 608451 - DNA, 25 bp, Rattus norvegicus
tgactgatgcatcggtattgggtac

SEQ ID NO: 608452 - DNA, 25 bp, Rattus norvegicus
tgactgatgcatgggtattgggtac

SEQ ID NO: 608453 - DNA, 25 bp, Rattus norvegicus
tgactgatgcctccctagtgttata

SEQ ID NO: 608454 - DNA, 25 bp, Rattus norvegicus
tgactgatgcctgcctagtgttata

SEQ ID NO: 608455 - DNA, 25 bp, Rattus norvegicus
tgactgcaagcactgacgtctctga

SEQ ID NO: 608456 - DNA, 25 bp, Rattus norvegicus
tgactgcaagcagtgacgtctctga

SEQ ID NO: 608457 - DNA, 25 bp, Rattus norvegicus
tgactgcactcaccctgtagaagat

SEQ ID NO: 608458 - DNA, 25 bp, Rattus norvegicus
tgactgcactcagcctgtagaagat

SEQ ID NO: 608459 - DNA, 25 bp, Rattus norvegicus
tgactgcactgacatgctcccttgg

SEQ ID NO: 608460 - DNA, 25 bp, Rattus norvegicus
tgactgcactgagatgctcccttgg

SEQ ID NO: 608461 - DNA, 25 bp, Rattus norvegicus
tgactgcagactatccgtccaccaa

SEQ ID NO: 608462 - DNA, 25 bp, Rattus norvegicus
tgactgcagactttccgtccaccaa

SEQ ID NO: 608463 - DNA, 25 bp, Rattus norvegicus
tgactgcagcccaccagaaagacaa

SEQ ID NO: 608464 - DNA, 25 bp, Rattus norvegicus
tgactgcagccctccagaaagacaa

SEQ ID NO: 608465 - DNA, 25 bp, Rattus norvegicus
tgactgcaggctcaggttcccagcg

SEQ ID NO: 608466 - DNA, 25 bp, Rattus norvegicus
tgactgcaggctgaggttcccagcg

SEQ ID NO: 608467 - DNA, 25 bp, Rattus norvegicus
tgactgcatcctcgcagagcaggat

SEQ ID NO: 608468 - DNA, 25 bp, Rattus norvegicus
tgactgcatcctggcagagcaggat

SEQ ID NO: 608469 - DNA, 25 bp, Rattus norvegicus
tgactgccaaggagttccgtaccta

SEQ ID NO: 608470 - DNA, 25 bp, Rattus norvegicus
tgactgccaaggtgttccgtaccta

SEQ ID NO: 608471 - DNA, 25 bp, Rattus norvegicus
tgactgccaccaccgaacgaaattt

SEQ ID NO: 608472 - DNA, 25 bp, Rattus norvegicus
tgactgccaccagcgaacgaaattt

SEQ ID NO: 608473 - DNA, 25 bp, Rattus norvegicus
tgactgccacctctggactggtgag

SEQ ID NO: 608474 - DNA, 25 bp, Rattus norvegicus
tgactgccacctgtggactggtgag

SEQ ID NO: 608475 - DNA, 25 bp, Rattus norvegicus
tgactgccagctacagaactcctaa

SEQ ID NO: 608476 - DNA, 25 bp, Rattus norvegicus
tgactgccagcttcagaactcctaa

SEQ ID NO: 608477 - DNA, 25 bp, Rattus norvegicus
tgactgccaggtccctgaggactgt

SEQ ID NO: 608478 - DNA, 25 bp, Rattus norvegicus
tgactgccaggtgcctgaggactgt

SEQ ID NO: 608479 - DNA, 25 bp, Rattus norvegicus
tgactgccagtcacacgtttgggct

SEQ ID NO: 608480 - DNA, 25 bp, Rattus norvegicus
tgactgccagtctcacgtttgggct

SEQ ID NO: 608481 - DNA, 25 bp, Rattus norvegicus
tgactgccatcaaccaagcctgatg

SEQ ID NO: 608482 - DNA, 25 bp, Rattus norvegicus
tgactgccatcatccaagcctgatg

SEQ ID NO: 608483 - DNA, 25 bp, Rattus norvegicus
tgactgccccgcaaagggactggat

SEQ ID NO: 608484 - DNA, 25 bp, Rattus norvegicus
tgactgccccgctaagggactggat

SEQ ID NO: 608485 - DNA, 25 bp, Rattus norvegicus
tgactgcccgttagccaatgagcaa

SEQ ID NO: 608486 - DNA, 25 bp, Rattus norvegicus
tgactgcccgtttgccaatgagcaa

SEQ ID NO: 608487 - DNA, 25 bp, Rattus norvegicus
tgactgccgcggacagagcccagat

SEQ ID NO: 608488 - DNA, 25 bp, Rattus norvegicus
tgactgccgcggtcagagcccagat

SEQ ID NO: 608489 - DNA, 25 bp, Rattus norvegicus
tgactgcctcaacttccagcgggag

SEQ ID NO: 608490 - DNA, 25 bp, Rattus norvegicus
tgactgcctcaagttccagcgggag

SEQ ID NO: 608491 - DNA, 25 bp, Rattus norvegicus
tgactgcctcagaattaacccctaa

SEQ ID NO: 608492 - DNA, 25 bp, Rattus norvegicus
tgactgcctcagtattaacccctaa

SEQ ID NO: 608493 - DNA, 25 bp, Rattus norvegicus
tgactgccttaaacccagagaccta

SEQ ID NO: 608494 - DNA, 25 bp, Rattus norvegicus
tgactgccttaatcccagagaccta

SEQ ID NO: 608495 - DNA, 25 bp, Rattus norvegicus
tgactgccttgaccccacatgtgtg

SEQ ID NO: 608496 - DNA, 25 bp, Rattus norvegicus
tgactgccttgagcccacatgtgtg

SEQ ID NO: 608497 - DNA, 25 bp, Rattus norvegicus
tgactgcgagctaaccgttctgttt

SEQ ID NO: 608498 - DNA, 25 bp, Rattus norvegicus
tgactgcgagcttaccgttctgttt

SEQ ID NO: 608499 - DNA, 25 bp, Rattus norvegicus
tgactgcgagttcggacgctgggtg

SEQ ID NO: 608500 - DNA, 25 bp, Rattus norvegicus
tgactgcgagttgggacgctgggtg

SEQ ID NO: 608501 - DNA, 25 bp, Rattus norvegicus
tgactgcggccaacgtttctgccgg

SEQ ID NO: 608502 - DNA, 25 bp, Rattus norvegicus
tgactgcggccatcgtttctgccgg

SEQ ID NO: 608503 - DNA, 25 bp, Rattus norvegicus
tgactgcgtctgaacacttgtgcga

SEQ ID NO: 608504 - DNA, 25 bp, Rattus norvegicus
tgactgcgtctgtacacttgtgcga

SEQ ID NO: 608505 - DNA, 25 bp, Rattus norvegicus
tgactgcgtggcaggctttgcaaca

SEQ ID NO: 608506 - DNA, 25 bp, Rattus norvegicus
tgactgcgtggctggctttgcaaca

SEQ ID NO: 608507 - DNA, 25 bp, Rattus norvegicus
tgactgctctgcaccaacggtctgt

SEQ ID NO: 608508 - DNA, 25 bp, Rattus norvegicus
tgactgctctgctccaacggtctgt

SEQ ID NO: 608509 - DNA, 25 bp, Rattus norvegicus
tgactgctcttgatgcatggttaaa

SEQ ID NO: 608510 - DNA, 25 bp, Rattus norvegicus
tgactgctcttgttgcatggttaaa

SEQ ID NO: 608511 - DNA, 25 bp, Rattus norvegicus
tgactgctgcacatgtcggtgacgt

SEQ ID NO: 608512 - DNA, 25 bp, Rattus norvegicus
tgactgctgcacttgtcggtgacgt

SEQ ID NO: 608513 - DNA, 25 bp, Rattus norvegicus
tgactgctgcttatgtctagtgggc

SEQ ID NO: 608514 - DNA, 25 bp, Rattus norvegicus
tgactgctgcttttgtctagtgggc

SEQ ID NO: 608515 - DNA, 25 bp, Rattus norvegicus
tgactgctggcaagcttaggaccaa

SEQ ID NO: 608516 - DNA, 25 bp, Rattus norvegicus
tgactgctggcaccgcgcggtagag

SEQ ID NO: 608517 - DNA, 25 bp, Rattus norvegicus
tgactgctggcagcgcgcggtagag

SEQ ID NO: 608518 - DNA, 25 bp, Rattus norvegicus
tgactgctggcatgcttaggaccaa

SEQ ID NO: 608519 - DNA, 25 bp, Rattus norvegicus
tgactgctggctcggcctgtttctt

SEQ ID NO: 608520 - DNA, 25 bp, Rattus norvegicus
tgactgctggctgggcctgtttctt

SEQ ID NO: 608521 - DNA, 25 bp, Rattus norvegicus
tgactgctgtctaccttgactttgg

SEQ ID NO: 608522 - DNA, 25 bp, Rattus norvegicus
tgactgctgtcttccttgactttgg

SEQ ID NO: 608523 - DNA, 25 bp, Rattus norvegicus
tgactgcttagcattcacgtccagg

SEQ ID NO: 608524 - DNA, 25 bp, Rattus norvegicus
tgactgcttagctttcacgtccagg

SEQ ID NO: 608525 - DNA, 25 bp, Rattus norvegicus
tgactgcttcccatgtccagaagaa

SEQ ID NO: 608526 - DNA, 25 bp, Rattus norvegicus
tgactgcttcccttgtccagaagaa

SEQ ID NO: 608527 - DNA, 25 bp, Rattus norvegicus
tgactgcttcctcatctacccaaat

SEQ ID NO: 608528 - DNA, 25 bp, Rattus norvegicus
tgactgcttcctgatctacccaaat

SEQ ID NO: 608529 - DNA, 25 bp, Rattus norvegicus
tgactgcttgatcaggtttgggaat

SEQ ID NO: 608530 - DNA, 25 bp, Rattus norvegicus
tgactgcttgatgaggtttgggaat

SEQ ID NO: 608531 - DNA, 25 bp, Rattus norvegicus
tgactgctttccactgggaactgtt

SEQ ID NO: 608532 - DNA, 25 bp, Rattus norvegicus
tgactgctttcctctgggaactgtt

SEQ ID NO: 608533 - DNA, 25 bp, Rattus norvegicus
tgactgctttgcattttgggctctt

SEQ ID NO: 608534 - DNA, 25 bp, Rattus norvegicus
tgactgctttgccatagactgcaca

SEQ ID NO: 608535 - DNA, 25 bp, Rattus norvegicus
tgactgctttgcgatagactgcaca

SEQ ID NO: 608536 - DNA, 25 bp, Rattus norvegicus
tgactgctttgctttttgggctctt

SEQ ID NO: 608537 - DNA, 25 bp, Rattus norvegicus
tgactggaactacagcatcggcttc

SEQ ID NO: 608538 - DNA, 25 bp, Rattus norvegicus
tgactggaactagagcatcggcttc

SEQ ID NO: 608539 - DNA, 25 bp, Rattus norvegicus
tgactggagactagtttcgatttaa

SEQ ID NO: 608540 - DNA, 25 bp, Rattus norvegicus
tgactggagacttgtttcgatttaa

SEQ ID NO: 608541 - DNA, 25 bp, Rattus norvegicus
tgactggccaatcgttaaaccattt

SEQ ID NO: 608542 - DNA, 25 bp, Rattus norvegicus
tgactggccaatggttaaaccattt

SEQ ID NO: 608543 - DNA, 25 bp, Rattus norvegicus
tgactggccggtcgaatctaatctc

SEQ ID NO: 608544 - DNA, 25 bp, Rattus norvegicus
tgactggccggtggaatctaatctc

SEQ ID NO: 608545 - DNA, 25 bp, Rattus norvegicus
tgactggcctacacacagggagtgt

SEQ ID NO: 608546 - DNA, 25 bp, Rattus norvegicus
tgactggcctactcacagggagtgt

SEQ ID NO: 608547 - DNA, 25 bp, Rattus norvegicus
tgactggctacaacgggagggtctt

SEQ ID NO: 608548 - DNA, 25 bp, Rattus norvegicus
tgactggctacatcgggagggtctt

SEQ ID NO: 608549 - DNA, 25 bp, Rattus norvegicus
tgactggctcacagtgaaggatgat

SEQ ID NO: 608550 - DNA, 25 bp, Rattus norvegicus
tgactggctcactgtgaaggatgat

SEQ ID NO: 608551 - DNA, 25 bp, Rattus norvegicus
tgactggctgcgcactaatggaaag

SEQ ID NO: 608552 - DNA, 25 bp, Rattus norvegicus
tgactggctgcggactaatggaaag

SEQ ID NO: 608553 - DNA, 25 bp, Rattus norvegicus
tgactggctgtacacgcatgaccta

SEQ ID NO: 608554 - DNA, 25 bp, Rattus norvegicus
tgactggctgtagacgcatgaccta

SEQ ID NO: 608555 - DNA, 25 bp, Rattus norvegicus
tgactggctgttcctaaattcttag

SEQ ID NO: 608556 - DNA, 25 bp, Rattus norvegicus
tgactggctgttgctaaattcttag

SEQ ID NO: 608557 - DNA, 25 bp, Rattus norvegicus
tgactggcttccatcactggattct

SEQ ID NO: 608558 - DNA, 25 bp, Rattus norvegicus
tgactggcttccttcactggattct

SEQ ID NO: 608559 - DNA, 25 bp, Rattus norvegicus
tgactgggaaacaggcactgtctcc

SEQ ID NO: 608560 - DNA, 25 bp, Rattus norvegicus
tgactgggaaactggcactgtctcc

SEQ ID NO: 608561 - DNA, 25 bp, Rattus norvegicus
tgactgggaattctgtggacacatc

SEQ ID NO: 608562 - DNA, 25 bp, Rattus norvegicus
tgactgggaattgtgtggacacatc

SEQ ID NO: 608563 - DNA, 25 bp, Rattus norvegicus
tgactgggcaacatggacctcattc

SEQ ID NO: 608564 - DNA, 25 bp, Rattus norvegicus
tgactgggcaacttggacctcattc

SEQ ID NO: 608565 - DNA, 25 bp, Rattus norvegicus
tgactgggccatcatttcaagagag

SEQ ID NO: 608566 - DNA, 25 bp, Rattus norvegicus
tgactgggccatgatttcaagagag

SEQ ID NO: 608567 - DNA, 25 bp, Rattus norvegicus
tgactgggcttactacagggccaat

SEQ ID NO: 608568 - DNA, 25 bp, Rattus norvegicus
tgactgggcttagtacagggccaat

SEQ ID NO: 608569 - DNA, 25 bp, Rattus norvegicus
tgactgggtggtccctttaatctac

SEQ ID NO: 608570 - DNA, 25 bp, Rattus norvegicus
tgactgggtggtgcctttaatctac

SEQ ID NO: 608571 - DNA, 25 bp, Rattus norvegicus
tgactggtaaatccactcccaaggt

SEQ ID NO: 608572 - DNA, 25 bp, Rattus norvegicus
tgactggtaaatgcactcccaaggt

SEQ ID NO: 608573 - DNA, 25 bp, Rattus norvegicus
tgactggtacatcgagacttctcat

SEQ ID NO: 608574 - DNA, 25 bp, Rattus norvegicus
tgactggtacatggagacttctcat

SEQ ID NO: 608575 - DNA, 25 bp, Rattus norvegicus
tgactggtacctcgcctggtcctat

SEQ ID NO: 608576 - DNA, 25 bp, Rattus norvegicus
tgactggtacctggcctggtcctat

SEQ ID NO: 608577 - DNA, 25 bp, Rattus norvegicus
tgactggtatccatgcttgattgaa

SEQ ID NO: 608578 - DNA, 25 bp, Rattus norvegicus
tgactggtatccttgcttgattgaa

SEQ ID NO: 608579 - DNA, 25 bp, Rattus norvegicus
tgactggtcctgacagacttctatt

SEQ ID NO: 608580 - DNA, 25 bp, Rattus norvegicus
tgactggtcctgtcagacttctatt

SEQ ID NO: 608581 - DNA, 25 bp, Rattus norvegicus
tgactggtcttgaccatgatgcgcc

SEQ ID NO: 608582 - DNA, 25 bp, Rattus norvegicus
tgactggtcttgtccatgatgcgcc

SEQ ID NO: 608583 - DNA, 25 bp, Rattus norvegicus
tgactggtgaccactcttgtcactg

SEQ ID NO: 608584 - DNA, 25 bp, Rattus norvegicus
tgactggtgacctctcttgtcactg

SEQ ID NO: 608585 - DNA, 25 bp, Rattus norvegicus
tgactggtggcccagccggaaccaa

SEQ ID NO: 608586 - DNA, 25 bp, Rattus norvegicus
tgactggtggccgagccggaaccaa

SEQ ID NO: 608587 - DNA, 25 bp, Rattus norvegicus
tgactggttatgacttcttcctcat

SEQ ID NO: 608588 - DNA, 25 bp, Rattus norvegicus
tgactggttatgtcttcttcctcat

SEQ ID NO: 608589 - DNA, 25 bp, Rattus norvegicus
tgactgtaaaccacttttggattag

SEQ ID NO: 608590 - DNA, 25 bp, Rattus norvegicus
tgactgtaaacctcttttggattag

SEQ ID NO: 608591 - DNA, 25 bp, Rattus norvegicus
tgactgtaacctcaacctcaagcag

SEQ ID NO: 608592 - DNA, 25 bp, Rattus norvegicus
tgactgtaacctgaacctcaagcag

SEQ ID NO: 608593 - DNA, 25 bp, Rattus norvegicus
tgactgtaagtcagcctgctgtttc

SEQ ID NO: 608594 - DNA, 25 bp, Rattus norvegicus
tgactgtaagtccagctcacctttg

SEQ ID NO: 608595 - DNA, 25 bp, Rattus norvegicus
tgactgtaagtcgagctcacctttg

SEQ ID NO: 608596 - DNA, 25 bp, Rattus norvegicus
tgactgtaagtctgcctgctgtttc

SEQ ID NO: 608597 - DNA, 25 bp, Rattus norvegicus
tgactgtaatatccacacttccatg

SEQ ID NO: 608598 - DNA, 25 bp, Rattus norvegicus
tgactgtaatatgcacacttccatg

SEQ ID NO: 608599 - DNA, 25 bp, Rattus norvegicus
tgactgtaccgcacaatacacttct

SEQ ID NO: 608600 - DNA, 25 bp, Rattus norvegicus
tgactgtaccgctcaatacacttct

SEQ ID NO: 608601 - DNA, 25 bp, Rattus norvegicus
tgactgtagtgcctcctttgaggag

SEQ ID NO: 608602 - DNA, 25 bp, Rattus norvegicus
tgactgtagtgcgtcctttgaggag

SEQ ID NO: 608603 - DNA, 25 bp, Rattus norvegicus
tgactgtatcccattttcacactgc

SEQ ID NO: 608604 - DNA, 25 bp, Rattus norvegicus
tgactgtatccctttttcacactgc

SEQ ID NO: 608605 - DNA, 25 bp, Rattus norvegicus
tgactgtcacacactatccatggtt

SEQ ID NO: 608606 - DNA, 25 bp, Rattus norvegicus
tgactgtcacactctatccatggtt

SEQ ID NO: 608607 - DNA, 25 bp, Rattus norvegicus
tgactgtccaggagctatctcactt

SEQ ID NO: 608608 - DNA, 25 bp, Rattus norvegicus
tgactgtccaggtgctatctcactt

SEQ ID NO: 608609 - DNA, 25 bp, Rattus norvegicus
tgactgtccccaagctgaagctgag

SEQ ID NO: 608610 - DNA, 25 bp, Rattus norvegicus
tgactgtccccatgctgaagctgag

SEQ ID NO: 608611 - DNA, 25 bp, Rattus norvegicus
tgactgtccgtgaagcctgttgaga

SEQ ID NO: 608612 - DNA, 25 bp, Rattus norvegicus
tgactgtccgtgtagcctgttgaga

SEQ ID NO: 608613 - DNA, 25 bp, Rattus norvegicus
tgactgtcctcaagtctgtaccttt

SEQ ID NO: 608614 - DNA, 25 bp, Rattus norvegicus
tgactgtcctcatgtctgtaccttt

SEQ ID NO: 608615 - DNA, 25 bp, Rattus norvegicus
tgactgtgaattatcgaaaactgtt

SEQ ID NO: 608616 - DNA, 25 bp, Rattus norvegicus
tgactgtgaattttcgaaaactgtt

SEQ ID NO: 608617 - DNA, 25 bp, Rattus norvegicus
tgactgtgaccaacgttttccaaac

SEQ ID NO: 608618 - DNA, 25 bp, Rattus norvegicus
tgactgtgaccatcgttttccaaac

SEQ ID NO: 608619 - DNA, 25 bp, Rattus norvegicus
tgactgtgacctaccctaacaggag

SEQ ID NO: 608620 - DNA, 25 bp, Rattus norvegicus
tgactgtgaccttccctaacaggag

SEQ ID NO: 608621 - DNA, 25 bp, Rattus norvegicus
tgactgtgagaaaagcgtctaaaca

SEQ ID NO: 608622 - DNA, 25 bp, Rattus norvegicus
tgactgtgagaatagcgtctaaaca

SEQ ID NO: 608623 - DNA, 25 bp, Rattus norvegicus
tgactgtgatgccaggccactgtca

SEQ ID NO: 608624 - DNA, 25 bp, Rattus norvegicus
tgactgtgatgcgaggccactgtca

SEQ ID NO: 608625 - DNA, 25 bp, Rattus norvegicus
tgactgtggagtacatcacccgcta

SEQ ID NO: 608626 - DNA, 25 bp, Rattus norvegicus
tgactgtggagttcatcacccgcta

SEQ ID NO: 608627 - DNA, 25 bp, Rattus norvegicus
tgactgtggcaacagctaccgctcc

SEQ ID NO: 608628 - DNA, 25 bp, Rattus norvegicus
tgactgtggcaagagctaccgctcc

SEQ ID NO: 608629 - DNA, 25 bp, Rattus norvegicus
tgactgtggtacatctggccatcgg

SEQ ID NO: 608630 - DNA, 25 bp, Rattus norvegicus
tgactgtggtacttctggccatcgg

SEQ ID NO: 608631 - DNA, 25 bp, Rattus norvegicus
tgactgtggtcaaactggaggctcg

SEQ ID NO: 608632 - DNA, 25 bp, Rattus norvegicus
tgactgtggtcatactggaggctcg

SEQ ID NO: 608633 - DNA, 25 bp, Rattus norvegicus
tgactgtggtccctcagcacaggaa

SEQ ID NO: 608634 - DNA, 25 bp, Rattus norvegicus
tgactgtggtccgtcagcacaggaa

SEQ ID NO: 608635 - DNA, 25 bp, Rattus norvegicus
tgactgtgtacacctgtgcgcccat

SEQ ID NO: 608636 - DNA, 25 bp, Rattus norvegicus
tgactgtgtacagctgtgcgcccat

SEQ ID NO: 608637 - DNA, 25 bp, Rattus norvegicus
tgactgtgtctactgccaaccttta

SEQ ID NO: 608638 - DNA, 25 bp, Rattus norvegicus
tgactgtgtctagtgccaaccttta

SEQ ID NO: 608639 - DNA, 25 bp, Rattus norvegicus
tgactgtgtgacaccctgtcgggtc

SEQ ID NO: 608640 - DNA, 25 bp, Rattus norvegicus
tgactgtgtgactccctgtcgggtc

SEQ ID NO: 608641 - DNA, 25 bp, Rattus norvegicus
tgactgtgtgtcctgcgtgtatttc

SEQ ID NO: 608642 - DNA, 25 bp, Rattus norvegicus
tgactgtgtgtcgtgcgtgtatttc

SEQ ID NO: 608643 - DNA, 25 bp, Rattus norvegicus
tgactgttaatgcagctccttgccc

SEQ ID NO: 608644 - DNA, 25 bp, Rattus norvegicus
tgactgttaatggagctccttgccc

SEQ ID NO: 608645 - DNA, 25 bp, Rattus norvegicus
tgactgttacagacttcctactacc

SEQ ID NO: 608646 - DNA, 25 bp, Rattus norvegicus
tgactgttacagtcttcctactacc

SEQ ID NO: 608647 - DNA, 25 bp, Rattus norvegicus
tgactgttacctacgaccaggctat

SEQ ID NO: 608648 - DNA, 25 bp, Rattus norvegicus
tgactgttaccttcgaccaggctat

SEQ ID NO: 608649 - DNA, 25 bp, Rattus norvegicus
tgactgttataccactgtttatcca

SEQ ID NO: 608650 - DNA, 25 bp, Rattus norvegicus
tgactgttatacgactgtttatcca

SEQ ID NO: 608651 - DNA, 25 bp, Rattus norvegicus
tgactgttatccaggccatccggag

SEQ ID NO: 608652 - DNA, 25 bp, Rattus norvegicus
tgactgttatcctggccatccggag

SEQ ID NO: 608653 - DNA, 25 bp, Rattus norvegicus
tgactgttcagtaccaaggtcctgc

SEQ ID NO: 608654 - DNA, 25 bp, Rattus norvegicus
tgactgttcagttccaaggtcctgc

SEQ ID NO: 608655 - DNA, 25 bp, Rattus norvegicus
tgactgttcatacctcgcttaagat

SEQ ID NO: 608656 - DNA, 25 bp, Rattus norvegicus
tgactgttcatagctcgcttaagat

SEQ ID NO: 608657 - DNA, 25 bp, Rattus norvegicus
tgactgttctttagtcaccgcaatc

SEQ ID NO: 608658 - DNA, 25 bp, Rattus norvegicus
tgactgttcttttgtcaccgcaatc

SEQ ID NO: 608659 - DNA, 25 bp, Rattus norvegicus
tgactgttgactacaatgcccctga

SEQ ID NO: 608660 - DNA, 25 bp, Rattus norvegicus
tgactgttgacttcaatgcccctga

SEQ ID NO: 608661 - DNA, 25 bp, Rattus norvegicus
tgactgtttctcactagcacacttt

SEQ ID NO: 608662 - DNA, 25 bp, Rattus norvegicus
tgactgtttctctctagcacacttt

SEQ ID NO: 608663 - DNA, 25 bp, Rattus norvegicus
tgactgtttgtgctgagcatcgccc

SEQ ID NO: 608664 - DNA, 25 bp, Rattus norvegicus
tgactgtttgtggtgagcatcgccc

SEQ ID NO: 608665 - DNA, 25 bp, Rattus norvegicus
tgacttaacacaacctggctgcctg

SEQ ID NO: 608666 - DNA, 25 bp, Rattus norvegicus
tgacttaacacatcctggctgcctg

SEQ ID NO: 608667 - DNA, 25 bp, Rattus norvegicus
tgacttacagtcactgcagaatctg

SEQ ID NO: 608668 - DNA, 25 bp, Rattus norvegicus
tgacttacagtctctgcagaatctg

SEQ ID NO: 608669 - DNA, 25 bp, Rattus norvegicus
tgacttacctcacgcttccaggaag

SEQ ID NO: 608670 - DNA, 25 bp, Rattus norvegicus
tgacttacctcaggcttccaggaag

SEQ ID NO: 608671 - DNA, 25 bp, Rattus norvegicus
tgacttaccttgctttccccaaata

SEQ ID NO: 608672 - DNA, 25 bp, Rattus norvegicus
tgacttaccttggtttccccaaata

SEQ ID NO: 608673 - DNA, 25 bp, Rattus norvegicus
tgacttagttctactttgcactggg

SEQ ID NO: 608674 - DNA, 25 bp, Rattus norvegicus
tgacttagttcttctttgcactggg

SEQ ID NO: 608675 - DNA, 25 bp, Rattus norvegicus
tgacttagttgcatggttttccata

SEQ ID NO: 608676 - DNA, 25 bp, Rattus norvegicus
tgacttagttgcttggttttccata

SEQ ID NO: 608677 - DNA, 25 bp, Rattus norvegicus
tgacttatctctcctgagcagacga

SEQ ID NO: 608678 - DNA, 25 bp, Rattus norvegicus
tgacttatctctgctgagcagacga

SEQ ID NO: 608679 - DNA, 25 bp, Rattus norvegicus
tgacttatgttccacctactatcta

SEQ ID NO: 608680 - DNA, 25 bp, Rattus norvegicus
tgacttatgttcgacctactatcta

SEQ ID NO: 608681 - DNA, 25 bp, Rattus norvegicus
tgacttatttcactgccatgcaacg

SEQ ID NO: 608682 - DNA, 25 bp, Rattus norvegicus
tgacttatttcagtgccatgcaacg

SEQ ID NO: 608683 - DNA, 25 bp, Rattus norvegicus
tgacttcaaagtaactgctcggctt

SEQ ID NO: 608684 - DNA, 25 bp, Rattus norvegicus
tgacttcaaagttactgctcggctt

SEQ ID NO: 608685 - DNA, 25 bp, Rattus norvegicus
tgacttcaagccagggttgtgcctt

SEQ ID NO: 608686 - DNA, 25 bp, Rattus norvegicus
tgacttcaagcctgggttgtgcctt

SEQ ID NO: 608687 - DNA, 25 bp, Rattus norvegicus
tgacttcaagggacgcctgggcaca

SEQ ID NO: 608688 - DNA, 25 bp, Rattus norvegicus
tgacttcaagggtcgcctgggcaca

SEQ ID NO: 608689 - DNA, 25 bp, Rattus norvegicus
tgacttcactcacacagcgttactt

SEQ ID NO: 608690 - DNA, 25 bp, Rattus norvegicus
tgacttcactcagacagcgttactt

SEQ ID NO: 608691 - DNA, 25 bp, Rattus norvegicus
tgacttcagcaaaaaccttcaccgg

SEQ ID NO: 608692 - DNA, 25 bp, Rattus norvegicus
tgacttcagcaataaccttcaccgg

SEQ ID NO: 608693 - DNA, 25 bp, Rattus norvegicus
tgacttcagcctatttgaccaggtt

SEQ ID NO: 608694 - DNA, 25 bp, Rattus norvegicus
tgacttcagcctttttgaccaggtt

SEQ ID NO: 608695 - DNA, 25 bp, Rattus norvegicus
tgacttcagtataggtacccgggtt

SEQ ID NO: 608696 - DNA, 25 bp, Rattus norvegicus
tgacttcagtattggtacccgggtt

SEQ ID NO: 608697 - DNA, 25 bp, Rattus norvegicus
tgacttcatctcagtggcttactca

SEQ ID NO: 608698 - DNA, 25 bp, Rattus norvegicus
tgacttcatctccttgggtttttct

SEQ ID NO: 608699 - DNA, 25 bp, Rattus norvegicus
tgacttcatctcgttgggtttttct

SEQ ID NO: 608700 - DNA, 25 bp, Rattus norvegicus
tgacttcatctctgtggcttactca

SEQ ID NO: 608701 - DNA, 25 bp, Rattus norvegicus
tgacttccaactaatggtcgtcctg

SEQ ID NO: 608702 - DNA, 25 bp, Rattus norvegicus
tgacttccaacttatggtcgtcctg

SEQ ID NO: 608703 - DNA, 25 bp, Rattus norvegicus
tgacttccacacatgtaactctggc

SEQ ID NO: 608704 - DNA, 25 bp, Rattus norvegicus
tgacttccacacttgtaactctggc

SEQ ID NO: 608705 - DNA, 25 bp, Rattus norvegicus
tgacttccagaaccttaaccacatt

SEQ ID NO: 608706 - DNA, 25 bp, Rattus norvegicus
tgacttccagaagcttaaccacatt

SEQ ID NO: 608707 - DNA, 25 bp, Rattus norvegicus
tgacttccagacatggcccgtgtca

SEQ ID NO: 608708 - DNA, 25 bp, Rattus norvegicus
tgacttccagacttggcccgtgtca

SEQ ID NO: 608709 - DNA, 25 bp, Rattus norvegicus
tgacttccagagaggcctaccaaga

SEQ ID NO: 608710 - DNA, 25 bp, Rattus norvegicus
tgacttccagagtggcctaccaaga

SEQ ID NO: 608711 - DNA, 25 bp, Rattus norvegicus
tgacttccagctaagaccgttgtgc

SEQ ID NO: 608712 - DNA, 25 bp, Rattus norvegicus
tgacttccagctcagtgtgctagga

SEQ ID NO: 608713 - DNA, 25 bp, Rattus norvegicus
tgacttccagctgagtgtgctagga

SEQ ID NO: 608714 - DNA, 25 bp, Rattus norvegicus
tgacttccagcttagaccgttgtgc

SEQ ID NO: 608715 - DNA, 25 bp, Rattus norvegicus
tgacttccagtgaggcagcttgtaa

SEQ ID NO: 608716 - DNA, 25 bp, Rattus norvegicus
tgacttccagtgtggcagcttgtaa

SEQ ID NO: 608717 - DNA, 25 bp, Rattus norvegicus
tgacttccagttcagcgaccaggag

SEQ ID NO: 608718 - DNA, 25 bp, Rattus norvegicus
tgacttccagttgagcgaccaggag

SEQ ID NO: 608719 - DNA, 25 bp, Rattus norvegicus
tgacttccatgcacccattttgaaa

SEQ ID NO: 608720 - DNA, 25 bp, Rattus norvegicus
tgacttccatgctcccattttgaaa

SEQ ID NO: 608721 - DNA, 25 bp, Rattus norvegicus
tgacttcccaacacacaaagggtga

SEQ ID NO: 608722 - DNA, 25 bp, Rattus norvegicus
tgacttcccaactcacaaagggtga

SEQ ID NO: 608723 - DNA, 25 bp, Rattus norvegicus
tgacttccccgacatggaatagtgt

SEQ ID NO: 608724 - DNA, 25 bp, Rattus norvegicus
tgacttccccgagatggaatagtgt

SEQ ID NO: 608725 - DNA, 25 bp, Rattus norvegicus
tgacttcccctcctagtcttattta

SEQ ID NO: 608726 - DNA, 25 bp, Rattus norvegicus
tgacttcccctcgtagtcttattta

SEQ ID NO: 608727 - DNA, 25 bp, Rattus norvegicus
tgacttccccttaagagcaggtggt

SEQ ID NO: 608728 - DNA, 25 bp, Rattus norvegicus
tgacttcccctttagagcaggtggt

SEQ ID NO: 608729 - DNA, 25 bp, Rattus norvegicus
tgacttccctgaatttcttacaatg

SEQ ID NO: 608730 - DNA, 25 bp, Rattus norvegicus
tgacttccctgattttcttacaatg

SEQ ID NO: 608731 - DNA, 25 bp, Rattus norvegicus
tgacttccctgtaggatggatgagt

SEQ ID NO: 608732 - DNA, 25 bp, Rattus norvegicus
tgacttccctgttggatggatgagt

SEQ ID NO: 608733 - DNA, 25 bp, Rattus norvegicus
tgacttcccttcagccaggttaata

SEQ ID NO: 608734 - DNA, 25 bp, Rattus norvegicus
tgacttcccttctgccaggttaata

SEQ ID NO: 608735 - DNA, 25 bp, Rattus norvegicus
tgacttcccttgaggtgggcgtcta

SEQ ID NO: 608736 - DNA, 25 bp, Rattus norvegicus
tgacttcccttgtggtgggcgtcta

SEQ ID NO: 608737 - DNA, 25 bp, Rattus norvegicus
tgacttccgagtcgcgccagatgta

SEQ ID NO: 608738 - DNA, 25 bp, Rattus norvegicus
tgacttccgagtggcgccagatgta

SEQ ID NO: 608739 - DNA, 25 bp, Rattus norvegicus
tgacttccggatccagaagcagcag

SEQ ID NO: 608740 - DNA, 25 bp, Rattus norvegicus
tgacttccggatgcagaagcagcag

SEQ ID NO: 608741 - DNA, 25 bp, Rattus norvegicus
tgacttccggctctagggagtcgaa

SEQ ID NO: 608742 - DNA, 25 bp, Rattus norvegicus
tgacttccggctgtagggagtcgaa

SEQ ID NO: 608743 - DNA, 25 bp, Rattus norvegicus
tgacttccgggacgtgacgcacaaa

SEQ ID NO: 608744 - DNA, 25 bp, Rattus norvegicus
tgacttccgggaggtgacgcacaaa

SEQ ID NO: 608745 - DNA, 25 bp, Rattus norvegicus
tgacttccggttcaagggctacaca

SEQ ID NO: 608746 - DNA, 25 bp, Rattus norvegicus
tgacttccggttgaagggctacaca

SEQ ID NO: 608747 - DNA, 25 bp, Rattus norvegicus
tgacttccgtacagtgaatctgccc

SEQ ID NO: 608748 - DNA, 25 bp, Rattus norvegicus
tgacttccgtactgtgaatctgccc

SEQ ID NO: 608749 - DNA, 25 bp, Rattus norvegicus
tgacttcctcagaggagaatgagat

SEQ ID NO: 608750 - DNA, 25 bp, Rattus norvegicus
tgacttcctcagagggtcctttgtt

SEQ ID NO: 608751 - DNA, 25 bp, Rattus norvegicus
tgacttcctcagtggagaatgagat

SEQ ID NO: 608752 - DNA, 25 bp, Rattus norvegicus
tgacttcctcagtgggtcctttgtt

SEQ ID NO: 608753 - DNA, 25 bp, Rattus norvegicus
tgacttcctccccttaaattctttg

SEQ ID NO: 608754 - DNA, 25 bp, Rattus norvegicus
tgacttcctcccgttaaattctttg

SEQ ID NO: 608755 - DNA, 25 bp, Rattus norvegicus
tgacttcctgtgctcttactgacag

SEQ ID NO: 608756 - DNA, 25 bp, Rattus norvegicus
tgacttcctgtggtcttactgacag

SEQ ID NO: 608757 - DNA, 25 bp, Rattus norvegicus
tgacttcctgttcttcctccagaat

SEQ ID NO: 608758 - DNA, 25 bp, Rattus norvegicus
tgacttcctgttgttcctccagaat

SEQ ID NO: 608759 - DNA, 25 bp, Rattus norvegicus
tgacttccttcaaatttttccagct

SEQ ID NO: 608760 - DNA, 25 bp, Rattus norvegicus
tgacttccttcatatttttccagct

SEQ ID NO: 608761 - DNA, 25 bp, Rattus norvegicus
tgacttccttctcctggcttatgca

SEQ ID NO: 608762 - DNA, 25 bp, Rattus norvegicus
tgacttccttctgctggcttatgca

SEQ ID NO: 608763 - DNA, 25 bp, Rattus norvegicus
tgacttcgcgtgatctcggaagatc

SEQ ID NO: 608764 - DNA, 25 bp, Rattus norvegicus
tgacttcgcgtgttctcggaagatc

SEQ ID NO: 608765 - DNA, 25 bp, Rattus norvegicus
tgacttcgctcgcagacacatcggc

SEQ ID NO: 608766 - DNA, 25 bp, Rattus norvegicus
tgacttcgctcggagacacatcggc

SEQ ID NO: 608767 - DNA, 25 bp, Rattus norvegicus
tgacttcgtccaaagctgcttgtaa

SEQ ID NO: 608768 - DNA, 25 bp, Rattus norvegicus
tgacttcgtccatagctgcttgtaa

SEQ ID NO: 608769 - DNA, 25 bp, Rattus norvegicus
tgacttctactacatggattacctg

SEQ ID NO: 608770 - DNA, 25 bp, Rattus norvegicus
tgacttctactagatggattacctg

SEQ ID NO: 608771 - DNA, 25 bp, Rattus norvegicus
tgacttctactcatcctctgttcat

SEQ ID NO: 608772 - DNA, 25 bp, Rattus norvegicus
tgacttctactcttcctctgttcat

SEQ ID NO: 608773 - DNA, 25 bp, Rattus norvegicus
tgacttctattcacttcctgtggag

SEQ ID NO: 608774 - DNA, 25 bp, Rattus norvegicus
tgacttctattctcttcctgtggag

SEQ ID NO: 608775 - DNA, 25 bp, Rattus norvegicus
tgacttctcagcagctctgatcttg

SEQ ID NO: 608776 - DNA, 25 bp, Rattus norvegicus
tgacttctcagctgctctgatcttg

SEQ ID NO: 608777 - DNA, 25 bp, Rattus norvegicus
tgacttctcgctcgccagcttgtca

SEQ ID NO: 608778 - DNA, 25 bp, Rattus norvegicus
tgacttctcgctggccagcttgtca

SEQ ID NO: 608779 - DNA, 25 bp, Rattus norvegicus
tgacttctctccagtagaacgggcc

SEQ ID NO: 608780 - DNA, 25 bp, Rattus norvegicus
tgacttctctcctgtagaacgggcc

SEQ ID NO: 608781 - DNA, 25 bp, Rattus norvegicus
tgacttctgatacatccgttctcaa

SEQ ID NO: 608782 - DNA, 25 bp, Rattus norvegicus
tgacttctgatagatccgttctcaa

SEQ ID NO: 608783 - DNA, 25 bp, Rattus norvegicus
tgacttctgcctcgagcaagcctag

SEQ ID NO: 608784 - DNA, 25 bp, Rattus norvegicus
tgacttctgcctggagcaagcctag

SEQ ID NO: 608785 - DNA, 25 bp, Rattus norvegicus
tgacttctgtatctacactggcaca

SEQ ID NO: 608786 - DNA, 25 bp, Rattus norvegicus
tgacttctgtatgtacactggcaca

SEQ ID NO: 608787 - DNA, 25 bp, Rattus norvegicus
tgacttctgtcaactcttttgaaag

SEQ ID NO: 608788 - DNA, 25 bp, Rattus norvegicus
tgacttctgtcatctcttttgaaag

SEQ ID NO: 608789 - DNA, 25 bp, Rattus norvegicus
tgacttctgtggcatacgggcatac

SEQ ID NO: 608790 - DNA, 25 bp, Rattus norvegicus
tgacttctgtgggatacgggcatac

SEQ ID NO: 608791 - DNA, 25 bp, Rattus norvegicus
tgacttcttcaaccaaaggcggtgt

SEQ ID NO: 608792 - DNA, 25 bp, Rattus norvegicus
tgacttcttcaagcaaaggcggtgt

SEQ ID NO: 608793 - DNA, 25 bp, Rattus norvegicus
tgacttcttcgacactgagggcaat

SEQ ID NO: 608794 - DNA, 25 bp, Rattus norvegicus
tgacttcttcgagactgagggcaat

SEQ ID NO: 608795 - DNA, 25 bp, Rattus norvegicus
tgacttcttggaaagccacttcctg

SEQ ID NO: 608796 - DNA, 25 bp, Rattus norvegicus
tgacttcttggatagccacttcctg

SEQ ID NO: 608797 - DNA, 25 bp, Rattus norvegicus
tgacttctttttcgacattgatacg

SEQ ID NO: 608798 - DNA, 25 bp, Rattus norvegicus
tgacttctttttggacattgatacg

SEQ ID NO: 608799 - DNA, 25 bp, Rattus norvegicus
tgacttgaatcactaaactccatca

SEQ ID NO: 608800 - DNA, 25 bp, Rattus norvegicus
tgacttgaatcagtaaactccatca

SEQ ID NO: 608801 - DNA, 25 bp, Rattus norvegicus
tgacttgactgacgtccaccacatt

SEQ ID NO: 608802 - DNA, 25 bp, Rattus norvegicus
tgacttgactgaggtccaccacatt

SEQ ID NO: 608803 - DNA, 25 bp, Rattus norvegicus
tgacttgaggacactggatgccgct

SEQ ID NO: 608804 - DNA, 25 bp, Rattus norvegicus
tgacttgaggactctggatgccgct

SEQ ID NO: 608805 - DNA, 25 bp, Rattus norvegicus
tgacttgatggtactcctggagctc

SEQ ID NO: 608806 - DNA, 25 bp, Rattus norvegicus
tgacttgatggttctcctggagctc

SEQ ID NO: 608807 - DNA, 25 bp, Rattus norvegicus
tgacttgattctacagttgccgcag

SEQ ID NO: 608808 - DNA, 25 bp, Rattus norvegicus
tgacttgattcttcagttgccgcag

SEQ ID NO: 608809 - DNA, 25 bp, Rattus norvegicus
tgacttgcagcaagatcacctactg

SEQ ID NO: 608810 - DNA, 25 bp, Rattus norvegicus
tgacttgcagcatgatcacctactg

SEQ ID NO: 608811 - DNA, 25 bp, Rattus norvegicus
tgacttgccaaacccttcagcagga

SEQ ID NO: 608812 - DNA, 25 bp, Rattus norvegicus
tgacttgccaaagccttcagcagga

SEQ ID NO: 608813 - DNA, 25 bp, Rattus norvegicus
tgacttgccaagcacggagctctta

SEQ ID NO: 608814 - DNA, 25 bp, Rattus norvegicus
tgacttgccaaggacggagctctta

SEQ ID NO: 608815 - DNA, 25 bp, Rattus norvegicus
tgacttgccctgaccctaagggaag

SEQ ID NO: 608816 - DNA, 25 bp, Rattus norvegicus
tgacttgccctgtccctaagggaag

SEQ ID NO: 608817 - DNA, 25 bp, Rattus norvegicus
tgacttgccgatcatgaccgtattt

SEQ ID NO: 608818 - DNA, 25 bp, Rattus norvegicus
tgacttgccgatgatgaccgtattt

SEQ ID NO: 608819 - DNA, 25 bp, Rattus norvegicus
tgacttgctcacaacatgttttggg

SEQ ID NO: 608820 - DNA, 25 bp, Rattus norvegicus
tgacttgctcactacatgttttggg

SEQ ID NO: 608821 - DNA, 25 bp, Rattus norvegicus
tgacttgctccccaataatgtggct

SEQ ID NO: 608822 - DNA, 25 bp, Rattus norvegicus
tgacttgctcccgaataatgtggct

SEQ ID NO: 608823 - DNA, 25 bp, Rattus norvegicus
tgacttggaagaagagctctatgcc

SEQ ID NO: 608824 - DNA, 25 bp, Rattus norvegicus
tgacttggaagatgagctctatgcc

SEQ ID NO: 608825 - DNA, 25 bp, Rattus norvegicus
tgacttggactaacacagcctcaat

SEQ ID NO: 608826 - DNA, 25 bp, Rattus norvegicus
tgacttggactatcacagcctcaat

SEQ ID NO: 608827 - DNA, 25 bp, Rattus norvegicus
tgacttggacttaaccatcgacctg

SEQ ID NO: 608828 - DNA, 25 bp, Rattus norvegicus
tgacttggactttaccatcgacctg

SEQ ID NO: 608829 - DNA, 25 bp, Rattus norvegicus
tgacttggaggacggctcacagcac

SEQ ID NO: 608830 - DNA, 25 bp, Rattus norvegicus
tgacttggaggagggctcacagcac

SEQ ID NO: 608831 - DNA, 25 bp, Rattus norvegicus
tgacttggaggcactaatctctgcc

SEQ ID NO: 608832 - DNA, 25 bp, Rattus norvegicus
tgacttggaggctctaatctctgcc

SEQ ID NO: 608833 - DNA, 25 bp, Rattus norvegicus
tgacttggctgcctttagtttccac

SEQ ID NO: 608834 - DNA, 25 bp, Rattus norvegicus
tgacttggctgcgtttagtttccac

SEQ ID NO: 608835 - DNA, 25 bp, Rattus norvegicus
tgacttggcttcaaagcccaggcca

SEQ ID NO: 608836 - DNA, 25 bp, Rattus norvegicus
tgacttggcttctaagcccaggcca

SEQ ID NO: 608837 - DNA, 25 bp, Rattus norvegicus
tgacttgggaatcagtacagtacct

SEQ ID NO: 608838 - DNA, 25 bp, Rattus norvegicus
tgacttgggaatgagtacagtacct

SEQ ID NO: 608839 - DNA, 25 bp, Rattus norvegicus
tgacttgggtgactacagtacgaca

SEQ ID NO: 608840 - DNA, 25 bp, Rattus norvegicus
tgacttgggtgagtacagtacgaca

SEQ ID NO: 608841 - DNA, 25 bp, Rattus norvegicus
tgacttggtctcaggttgctgtaaa

SEQ ID NO: 608842 - DNA, 25 bp, Rattus norvegicus
tgacttggtctctggttgctgtaaa

SEQ ID NO: 608843 - DNA, 25 bp, Rattus norvegicus
tgacttggtggcagaaatcactcca

SEQ ID NO: 608844 - DNA, 25 bp, Rattus norvegicus
tgacttggtggctgaaatcactcca

SEQ ID NO: 608845 - DNA, 25 bp, Rattus norvegicus
tgacttgtccttagctttcagctgt

SEQ ID NO: 608846 - DNA, 25 bp, Rattus norvegicus
tgacttgtccttccatctagatgag

SEQ ID NO: 608847 - DNA, 25 bp, Rattus norvegicus
tgacttgtccttgcatctagatgag

SEQ ID NO: 608848 - DNA, 25 bp, Rattus norvegicus
tgacttgtcctttgctttcagctgt

SEQ ID NO: 608849 - DNA, 25 bp, Rattus norvegicus
tgacttgtcgtcacatggaaaccag

SEQ ID NO: 608850 - DNA, 25 bp, Rattus norvegicus
tgacttgtcgtctcatggaaaccag

SEQ ID NO: 608851 - DNA, 25 bp, Rattus norvegicus
tgacttgtctacagttatacaaatt

SEQ ID NO: 608852 - DNA, 25 bp, Rattus norvegicus
tgacttgtctactgttatacaaatt

SEQ ID NO: 608853 - DNA, 25 bp, Rattus norvegicus
tgacttgtctcacatttctctgtag

SEQ ID NO: 608854 - DNA, 25 bp, Rattus norvegicus
tgacttgtctcagatttctctgtag

SEQ ID NO: 608855 - DNA, 25 bp, Rattus norvegicus
tgacttgtgtttaacctctactgcc

SEQ ID NO: 608856 - DNA, 25 bp, Rattus norvegicus
tgacttgtgttttacctctactgcc

SEQ ID NO: 608857 - DNA, 25 bp, Rattus norvegicus
tgacttgttctcacgggtctataac

SEQ ID NO: 608858 - DNA, 25 bp, Rattus norvegicus
tgacttgttctctcgggtctataac

SEQ ID NO: 608859 - DNA, 25 bp, Rattus norvegicus
tgacttgttggtcgctcttatttct

SEQ ID NO: 608860 - DNA, 25 bp, Rattus norvegicus
tgacttgttggtggctcttatttct

SEQ ID NO: 608861 - DNA, 25 bp, Rattus norvegicus
tgactttaaaaaatgtccttcccag

SEQ ID NO: 608862 - DNA, 25 bp, Rattus norvegicus
tgactttaaaaattgtccttcccag

SEQ ID NO: 608863 - DNA, 25 bp, Rattus norvegicus
tgactttaaacaatcagccttccct

SEQ ID NO: 608864 - DNA, 25 bp, Rattus norvegicus
tgactttaaacattcagccttccct

SEQ ID NO: 608865 - DNA, 25 bp, Rattus norvegicus
tgactttaaagtcgacccgtgcggt

SEQ ID NO: 608866 - DNA, 25 bp, Rattus norvegicus
tgactttaaagtggacccgtgcggt

SEQ ID NO: 608867 - DNA, 25 bp, Rattus norvegicus
tgactttacaccacagtattgctcc

SEQ ID NO: 608868 - DNA, 25 bp, Rattus norvegicus
tgactttacacctcagtattgctcc

SEQ ID NO: 608869 - DNA, 25 bp, Rattus norvegicus
tgactttacgtgactctttgccagc

SEQ ID NO: 608870 - DNA, 25 bp, Rattus norvegicus
tgactttacgtgtctctttgccagc

SEQ ID NO: 608871 - DNA, 25 bp, Rattus norvegicus
tgactttatacactggtcccaagac

SEQ ID NO: 608872 - DNA, 25 bp, Rattus norvegicus
tgactttatacagtggtcccaagac

SEQ ID NO: 608873 - DNA, 25 bp, Rattus norvegicus
tgactttattacctttgatgaccat

SEQ ID NO: 608874 - DNA, 25 bp, Rattus norvegicus
tgactttattacgtttgatgaccat

SEQ ID NO: 608875 - DNA, 25 bp, Rattus norvegicus
tgactttcaatgatgacctgccatc

SEQ ID NO: 608876 - DNA, 25 bp, Rattus norvegicus
tgactttcaatgttgacctgccatc

SEQ ID NO: 608877 - DNA, 25 bp, Rattus norvegicus
tgactttcaccactatcctttcggt

SEQ ID NO: 608878 - DNA, 25 bp, Rattus norvegicus
tgactttcaccagtatcctttcggt

SEQ ID NO: 608879 - DNA, 25 bp, Rattus norvegicus
tgactttcaggcaccatatcttcta

SEQ ID NO: 608880 - DNA, 25 bp, Rattus norvegicus
tgactttcaggctccatatcttcta

SEQ ID NO: 608881 - DNA, 25 bp, Rattus norvegicus
tgactttcatctaacccacagagac

SEQ ID NO: 608882 - DNA, 25 bp, Rattus norvegicus
tgactttcatcttacccacagagac

SEQ ID NO: 608883 - DNA, 25 bp, Rattus norvegicus
tgactttcattcctggtcctaaaca

SEQ ID NO: 608884 - DNA, 25 bp, Rattus norvegicus
tgactttcattcgtggtcctaaaca

SEQ ID NO: 608885 - DNA, 25 bp, Rattus norvegicus
tgactttcccacacactgcagtaaa

SEQ ID NO: 608886 - DNA, 25 bp, Rattus norvegicus
tgactttcccactcactgcagtaaa

SEQ ID NO: 608887 - DNA, 25 bp, Rattus norvegicus
tgactttcctggcagtctgctgctt

SEQ ID NO: 608888 - DNA, 25 bp, Rattus norvegicus
tgactttcctgggagtctgctgctt

SEQ ID NO: 608889 - DNA, 25 bp, Rattus norvegicus
tgactttcgtctctgtgcacgactg

SEQ ID NO: 608890 - DNA, 25 bp, Rattus norvegicus
tgactttcgtctgtgtgcacgactg

SEQ ID NO: 608891 - DNA, 25 bp, Rattus norvegicus
tgactttctaccactttgatttggg

SEQ ID NO: 608892 - DNA, 25 bp, Rattus norvegicus
tgactttctacctctttgatttggg

SEQ ID NO: 608893 - DNA, 25 bp, Rattus norvegicus
tgactttctcctctgattggctttt

SEQ ID NO: 608894 - DNA, 25 bp, Rattus norvegicus
tgactttctcctgtgattggctttt

SEQ ID NO: 608895 - DNA, 25 bp, Rattus norvegicus
tgactttctgggatgctcgactcta

SEQ ID NO: 608896 - DNA, 25 bp, Rattus norvegicus
tgactttctgggttgctcgactcta

SEQ ID NO: 608897 - DNA, 25 bp, Rattus norvegicus
tgactttgaccactttgacaagcct

SEQ ID NO: 608898 - DNA, 25 bp, Rattus norvegicus
tgactttgaccagtttgacaagcct

SEQ ID NO: 608899 - DNA, 25 bp, Rattus norvegicus
tgactttgagcaacaggccagactg

SEQ ID NO: 608900 - DNA, 25 bp, Rattus norvegicus
tgactttgagcatcaggccagactg

SEQ ID NO: 608901 - DNA, 25 bp, Rattus norvegicus
tgactttgagtcatcagctgccagt

SEQ ID NO: 608902 - DNA, 25 bp, Rattus norvegicus
tgactttgagtcttcagctgccagt

SEQ ID NO: 608903 - DNA, 25 bp, Rattus norvegicus
tgactttgatgcactgtcttcctca

SEQ ID NO: 608904 - DNA, 25 bp, Rattus norvegicus
tgactttgatgctctgtcttcctca

SEQ ID NO: 608905 - DNA, 25 bp, Rattus norvegicus
tgactttgcaatctctgcctgtgat

SEQ ID NO: 608906 - DNA, 25 bp, Rattus norvegicus
tgactttgcaatgtctgcctgtgat

SEQ ID NO: 608907 - DNA, 25 bp, Rattus norvegicus
tgactttgcagtatgggtgggtatt

SEQ ID NO: 608908 - DNA, 25 bp, Rattus norvegicus
tgactttgcagtttgggtgggtatt

SEQ ID NO: 608909 - DNA, 25 bp, Rattus norvegicus
tgactttgccacatagctgaactgt

SEQ ID NO: 608910 - DNA, 25 bp, Rattus norvegicus
tgactttgccacttagctgaactgt

SEQ ID NO: 608911 - DNA, 25 bp, Rattus norvegicus
tgactttgctctctctgaggccaga

SEQ ID NO: 608912 - DNA, 25 bp, Rattus norvegicus
tgactttgctctgtctgaggccaga

SEQ ID NO: 608913 - DNA, 25 bp, Rattus norvegicus
tgactttgctgaagacatctccctg

SEQ ID NO: 608914 - DNA, 25 bp, Rattus norvegicus
tgactttgctgatgacatctccctg

SEQ ID NO: 608915 - DNA, 25 bp, Rattus norvegicus
tgactttggactaggctccgtcgaa

SEQ ID NO: 608916 - DNA, 25 bp, Rattus norvegicus
tgactttggacttggctccgtcgaa

SEQ ID NO: 608917 - DNA, 25 bp, Rattus norvegicus
tgactttggagcacagtctgtgtcc

SEQ ID NO: 608918 - DNA, 25 bp, Rattus norvegicus
tgactttggagctcagtctgtgtcc

SEQ ID NO: 608919 - DNA, 25 bp, Rattus norvegicus
tgactttggatgaggacccttctca

SEQ ID NO: 608920 - DNA, 25 bp, Rattus norvegicus
tgactttggatgtggacccttctca

SEQ ID NO: 608921 - DNA, 25 bp, Rattus norvegicus
tgactttggcaacggcatccgctat

SEQ ID NO: 608922 - DNA, 25 bp, Rattus norvegicus
tgactttggcaagggcatccgctat

SEQ ID NO: 608923 - DNA, 25 bp, Rattus norvegicus
tgactttggcggcttttgtgagtaa

SEQ ID NO: 608924 - DNA, 25 bp, Rattus norvegicus
tgactttggcgggttttgtgagtaa

SEQ ID NO: 608925 - DNA, 25 bp, Rattus norvegicus
tgactttgggccacgagctttacac

SEQ ID NO: 608926 - DNA, 25 bp, Rattus norvegicus
tgactttgggcctcgagctttacac

SEQ ID NO: 608927 - DNA, 25 bp, Rattus norvegicus
tgactttgtcaaaatggtgttggaa

SEQ ID NO: 608928 - DNA, 25 bp, Rattus norvegicus
tgactttgtcaatatggtgttggaa

SEQ ID NO: 608929 - DNA, 25 bp, Rattus norvegicus
tgactttgttgcagttcaccctcag

SEQ ID NO: 608930 - DNA, 25 bp, Rattus norvegicus
tgactttgttgctgttcaccctcag

SEQ ID NO: 608931 - DNA, 25 bp, Rattus norvegicus
tgacttttaaaaaagcaggcaccaa

SEQ ID NO: 608932 - DNA, 25 bp, Rattus norvegicus
tgacttttaaaatagcaggcaccaa

SEQ ID NO: 608933 - DNA, 25 bp, Rattus norvegicus
tgacttttagtcacaggccagcaca

SEQ ID NO: 608934 - DNA, 25 bp, Rattus norvegicus
tgacttttagtctcaggccagcaca

SEQ ID NO: 608935 - DNA, 25 bp, Rattus norvegicus
tgacttttcatcatcagcctttcct

SEQ ID NO: 608936 - DNA, 25 bp, Rattus norvegicus
tgacttttcatcttcagcctttcct

SEQ ID NO: 608937 - DNA, 25 bp, Rattus norvegicus
tgacttttcctacttgtcctggtgc

SEQ ID NO: 608938 - DNA, 25 bp, Rattus norvegicus
tgacttttcctagttgtcctggtgc

SEQ ID NO: 608939 - DNA, 25 bp, Rattus norvegicus
tgacttttcctccactactgcagca

SEQ ID NO: 608940 - DNA, 25 bp, Rattus norvegicus
tgacttttcctcgactactgcagca

SEQ ID NO: 608941 - DNA, 25 bp, Rattus norvegicus
tgacttttctgacagcgctacactc

SEQ ID NO: 608942 - DNA, 25 bp, Rattus norvegicus
tgacttttctgagagcgctacactc

SEQ ID NO: 608943 - DNA, 25 bp, Rattus norvegicus
tgacttttcttaccctttgagactc

SEQ ID NO: 608944 - DNA, 25 bp, Rattus norvegicus
tgacttttcttagcctttgagactc

SEQ ID NO: 608945 - DNA, 25 bp, Rattus norvegicus
tgacttttgattaccagcagcccat

SEQ ID NO: 608946 - DNA, 25 bp, Rattus norvegicus
tgacttttgatttccagcagcccat

SEQ ID NO: 608947 - DNA, 25 bp, Rattus norvegicus
tgacttttgctgaaagccctttgtt

SEQ ID NO: 608948 - DNA, 25 bp, Rattus norvegicus
tgacttttgctgtaagccctttgtt

SEQ ID NO: 608949 - DNA, 25 bp, Rattus norvegicus
tgacttttgtcaaccagtgagctgg

SEQ ID NO: 608950 - DNA, 25 bp, Rattus norvegicus
tgacttttgtcatccagtgagctgg

SEQ ID NO: 608951 - DNA, 25 bp, Rattus norvegicus
tgactttttaacagtttgacttcag

SEQ ID NO: 608952 - DNA, 25 bp, Rattus norvegicus
tgactttttaactgtttgacttcag

SEQ ID NO: 608953 - DNA, 25 bp, Rattus norvegicus
tgactttttataacgtggatttcct

SEQ ID NO: 608954 - DNA, 25 bp, Rattus norvegicus
tgactttttatatcgtggatttcct

SEQ ID NO: 608955 - DNA, 25 bp, Rattus norvegicus
tgactttttcaacatcaccacgcgc

SEQ ID NO: 608956 - DNA, 25 bp, Rattus norvegicus
tgactttttcaagatcaccacgcgc

SEQ ID NO: 608957 - DNA, 25 bp, Rattus norvegicus
tgactttttcttcggcaggtttgca

SEQ ID NO: 608958 - DNA, 25 bp, Rattus norvegicus
tgactttttcttgggcaggtttgca

SEQ ID NO: 608959 - DNA, 25 bp, Rattus norvegicus
tgacttttttatatacccgcccaag

SEQ ID NO: 608960 - DNA, 25 bp, Rattus norvegicus
tgacttttttatttacccgcccaag

SEQ ID NO: 608961 - DNA, 25 bp, Rattus norvegicus
tgagaaaaatgtctgttttgttacc

SEQ ID NO: 608962 - DNA, 25 bp, Rattus norvegicus
tgagaaaaatgtgtgttttgttacc

SEQ ID NO: 608963 - DNA, 25 bp, Rattus norvegicus
tgagaaaaccctctgtgatcccctt

SEQ ID NO: 608964 - DNA, 25 bp, Rattus norvegicus
tgagaaaaccctgtgtgatcccctt

SEQ ID NO: 608965 - DNA, 25 bp, Rattus norvegicus
tgagaaaacgctcctcacaactttt

SEQ ID NO: 608966 - DNA, 25 bp, Rattus norvegicus
tgagaaaacgctgctcacaactttt

SEQ ID NO: 608967 - DNA, 25 bp, Rattus norvegicus
tgagaaaagagtataccacatcggg

SEQ ID NO: 608968 - DNA, 25 bp, Rattus norvegicus
tgagaaaagagtttaccacatcggg

SEQ ID NO: 608969 - DNA, 25 bp, Rattus norvegicus
tgagaaaaggcaacctgcttggtcc

SEQ ID NO: 608970 - DNA, 25 bp, Rattus norvegicus
tgagaaaaggcatcctgcttggtcc

SEQ ID NO: 608971 - DNA, 25 bp, Rattus norvegicus
tgagaaaattccactctctctggcc

SEQ ID NO: 608972 - DNA, 25 bp, Rattus norvegicus
tgagaaaattcctctctctctggcc

SEQ ID NO: 608973 - DNA, 25 bp, Rattus norvegicus
tgagaaacaccccagcctgattaac

SEQ ID NO: 608974 - DNA, 25 bp, Rattus norvegicus
tgagaaacacccgagcctgattaac

SEQ ID NO: 608975 - DNA, 25 bp, Rattus norvegicus
tgagaaacatctccctacttatcct

SEQ ID NO: 608976 - DNA, 25 bp, Rattus norvegicus
tgagaaacatctgcctacttatcct

SEQ ID NO: 608977 - DNA, 25 bp, Rattus norvegicus
tgagaaacattcagccaccggaggg

SEQ ID NO: 608978 - DNA, 25 bp, Rattus norvegicus
tgagaaacattctgccaccggaggg

SEQ ID NO: 608979 - DNA, 25 bp, Rattus norvegicus
tgagaaaccacactgtgtccagggt

SEQ ID NO: 608980 - DNA, 25 bp, Rattus norvegicus
tgagaaaccacagtgtgtccagggt

SEQ ID NO: 608981 - DNA, 25 bp, Rattus norvegicus
tgagaaacccggagtctacaccaaa

SEQ ID NO: 608982 - DNA, 25 bp, Rattus norvegicus
tgagaaacccggtgtctacaccaaa

SEQ ID NO: 608983 - DNA, 25 bp, Rattus norvegicus
tgagaaacccttactagactcactc

SEQ ID NO: 608984 - DNA, 25 bp, Rattus norvegicus
tgagaaaccctttctagactcactc

SEQ ID NO: 608985 - DNA, 25 bp, Rattus norvegicus
tgagaaacctgtccccactgtagga

SEQ ID NO: 608986 - DNA, 25 bp, Rattus norvegicus
tgagaaacctgtgcccactgtagga

SEQ ID NO: 608987 - DNA, 25 bp, Rattus norvegicus
tgagaaactactaatgacattgtgt

SEQ ID NO: 608988 - DNA, 25 bp, Rattus norvegicus
tgagaaactacttatgacattgtgt

SEQ ID NO: 608989 - DNA, 25 bp, Rattus norvegicus
tgagaaactcaaactgccatacagt

SEQ ID NO: 608990 - DNA, 25 bp, Rattus norvegicus
tgagaaactcaacagcagcttcccg

SEQ ID NO: 608991 - DNA, 25 bp, Rattus norvegicus
tgagaaactcaagagcagcttcccg

SEQ ID NO: 608992 - DNA, 25 bp, Rattus norvegicus
tgagaaactcaatctgccatacagt

SEQ ID NO: 608993 - DNA, 25 bp, Rattus norvegicus
tgagaaactcctcgtggcacaagat

SEQ ID NO: 608994 - DNA, 25 bp, Rattus norvegicus
tgagaaactcctggtggcacaagat

SEQ ID NO: 608995 - DNA, 25 bp, Rattus norvegicus
tgagaaagccaaacccgcgctggat

SEQ ID NO: 608996 - DNA, 25 bp, Rattus norvegicus
tgagaaagccaatcccgcgctggat

SEQ ID NO: 608997 - DNA, 25 bp, Rattus norvegicus
tgagaaagtcatccctatctgcctg

SEQ ID NO: 608998 - DNA, 25 bp, Rattus norvegicus
tgagaaagtcatgcctatctgcctg

SEQ ID NO: 608999 - DNA, 25 bp, Rattus norvegicus
tgagaaatacgaccccaccatcgag

SEQ ID NO: 609000 - DNA, 25 bp, Rattus norvegicus
tgagaaatacgagcccaccatcgag

SEQ ID NO: 609001 - DNA, 25 bp, Rattus norvegicus
tgagaaatcagaccgggacccacct

SEQ ID NO: 609002 - DNA, 25 bp, Rattus norvegicus
tgagaaatcagagcgggacccacct

SEQ ID NO: 609003 - DNA, 25 bp, Rattus norvegicus
tgagaaatcatgacttcccactgct

SEQ ID NO: 609004 - DNA, 25 bp, Rattus norvegicus
tgagaaatcatgtcttcccactgct

SEQ ID NO: 609005 - DNA, 25 bp, Rattus norvegicus
tgagaaatcccaccccatgaatgtt

SEQ ID NO: 609006 - DNA, 25 bp, Rattus norvegicus
tgagaaatcccagcccatgaatgtt

SEQ ID NO: 609007 - DNA, 25 bp, Rattus norvegicus
tgagaaatcccgctatggcacctac

SEQ ID NO: 609008 - DNA, 25 bp, Rattus norvegicus
tgagaaatcccggtatggcacctac

SEQ ID NO: 609009 - DNA, 25 bp, Rattus norvegicus
tgagaaatctatacaggtgctgcct

SEQ ID NO: 609010 - DNA, 25 bp, Rattus norvegicus
tgagaaatctattcaggtgctgcct

SEQ ID NO: 609011 - DNA, 25 bp, Rattus norvegicus
tgagaaatcttgctgcctagccttc

SEQ ID NO: 609012 - DNA, 25 bp, Rattus norvegicus
tgagaaatcttggtgcctagccttc

SEQ ID NO: 609013 - DNA, 25 bp, Rattus norvegicus
tgagaaattacacaaaccttccaac

SEQ ID NO: 609014 - DNA, 25 bp, Rattus norvegicus
tgagaaattacagaaaccttccaac

SEQ ID NO: 609015 - DNA, 25 bp, Rattus norvegicus
tgagaacaacccatcttaaagattt

SEQ ID NO: 609016 - DNA, 25 bp, Rattus norvegicus
tgagaacaacccttcttaaagattt

SEQ ID NO: 609017 - DNA, 25 bp, Rattus norvegicus
tgagaacaatctctagcccctgtct

SEQ ID NO: 609018 - DNA, 25 bp, Rattus norvegicus
tgagaacaatctgtagcccctgtct

SEQ ID NO: 609019 - DNA, 25 bp, Rattus norvegicus
tgagaacaatgcacatcacccacat

SEQ ID NO: 609020 - DNA, 25 bp, Rattus norvegicus
tgagaacaatgctcatcacccacat

SEQ ID NO: 609021 - DNA, 25 bp, Rattus norvegicus
tgagaacacagaagagcgtccgccc

SEQ ID NO: 609022 - DNA, 25 bp, Rattus norvegicus
tgagaacacagatgagcgtccgccc

SEQ ID NO: 609023 - DNA, 25 bp, Rattus norvegicus
tgagaacaccgtcctttccagtggt

SEQ ID NO: 609024 - DNA, 25 bp, Rattus norvegicus
tgagaacaccgtgctttccagtggt

SEQ ID NO: 609025 - DNA, 25 bp, Rattus norvegicus
tgagaacacggaactgaacagcccc

SEQ ID NO: 609026 - DNA, 25 bp, Rattus norvegicus
tgagaacacggatctgaacagcccc

SEQ ID NO: 609027 - DNA, 25 bp, Rattus norvegicus
tgagaacactgcacagcaccctgga

SEQ ID NO: 609028 - DNA, 25 bp, Rattus norvegicus
tgagaacactgctcagcaccctgga

SEQ ID NO: 609029 - DNA, 25 bp, Rattus norvegicus
tgagaacagaaccaagccacttgtg

SEQ ID NO: 609030 - DNA, 25 bp, Rattus norvegicus
tgagaacagaacgaagccacttgtg

SEQ ID NO: 609031 - DNA, 25 bp, Rattus norvegicus
tgagaacagattccctgaccacagc

SEQ ID NO: 609032 - DNA, 25 bp, Rattus norvegicus
tgagaacagattgcctgaccacagc

SEQ ID NO: 609033 - DNA, 25 bp, Rattus norvegicus
tgagaacagcaaactacccaagcac

SEQ ID NO: 609034 - DNA, 25 bp, Rattus norvegicus
tgagaacagcaatctacccaagcac

SEQ ID NO: 609035 - DNA, 25 bp, Rattus norvegicus
tgagaacaggtaccagccccaccaa

SEQ ID NO: 609036 - DNA, 25 bp, Rattus norvegicus
tgagaacaggtagcagccccaccaa

SEQ ID NO: 609037 - DNA, 25 bp, Rattus norvegicus
tgagaacaggttatgcccagaaagc

SEQ ID NO: 609038 - DNA, 25 bp, Rattus norvegicus
tgagaacaggttttgcccagaaagc

SEQ ID NO: 609039 - DNA, 25 bp, Rattus norvegicus
tgagaacagtgacccctactatgac

SEQ ID NO: 609040 - DNA, 25 bp, Rattus norvegicus
tgagaacagtgagccctactatgac

SEQ ID NO: 609041 - DNA, 25 bp, Rattus norvegicus
tgagaacagtgtagggcccatcctg

SEQ ID NO: 609042 - DNA, 25 bp, Rattus norvegicus
tgagaacagtgttgggcccatcctg

SEQ ID NO: 609043 - DNA, 25 bp, Rattus norvegicus
tgagaacattgtcccatatccctgg

SEQ ID NO: 609044 - DNA, 25 bp, Rattus norvegicus
tgagaacattgtgccatatccctgg

SEQ ID NO: 609045 - DNA, 25 bp, Rattus norvegicus
tgagaaccaacacactgcctatagt

SEQ ID NO: 609046 - DNA, 25 bp, Rattus norvegicus
tgagaaccaacagactgcctatagt

SEQ ID NO: 609047 - DNA, 25 bp, Rattus norvegicus
tgagaaccactgctccagaatcact

SEQ ID NO: 609048 - DNA, 25 bp, Rattus norvegicus
tgagaaccactgcttgacaccaaat

SEQ ID NO: 609049 - DNA, 25 bp, Rattus norvegicus
tgagaaccactggtccagaatcact

SEQ ID NO: 609050 - DNA, 25 bp, Rattus norvegicus
tgagaaccactggttgacaccaaat

SEQ ID NO: 609051 - DNA, 25 bp, Rattus norvegicus
tgagaaccaggccttgcccaaacta

SEQ ID NO: 609052 - DNA, 25 bp, Rattus norvegicus
tgagaaccaggcgttgcccaaacta

SEQ ID NO: 609053 - DNA, 25 bp, Rattus norvegicus
tgagaacccaagcaggacagccccg

SEQ ID NO: 609054 - DNA, 25 bp, Rattus norvegicus
tgagaacccaaggaggacagccccg

SEQ ID NO: 609055 - DNA, 25 bp, Rattus norvegicus
tgagaaccccaactttacgggcaag

SEQ ID NO: 609056 - DNA, 25 bp, Rattus norvegicus
tgagaaccccaagtttacgggcaag

SEQ ID NO: 609057 - DNA, 25 bp, Rattus norvegicus
tgagaaccccatcgacaccgtataa

SEQ ID NO: 609058 - DNA, 25 bp, Rattus norvegicus
tgagaaccccatggacaccgtataa

SEQ ID NO: 609059 - DNA, 25 bp, Rattus norvegicus
tgagaacccgcacaacgtggtgaat

SEQ ID NO: 609060 - DNA, 25 bp, Rattus norvegicus
tgagaacccgcagaacgtggtgaat

SEQ ID NO: 609061 - DNA, 25 bp, Rattus norvegicus
tgagaacccttcctggccaaatctg

SEQ ID NO: 609062 - DNA, 25 bp, Rattus norvegicus
tgagaacccttcgtggccaaatctg

SEQ ID NO: 609063 - DNA, 25 bp, Rattus norvegicus
tgagaaccgagaccagagcccttct

SEQ ID NO: 609064 - DNA, 25 bp, Rattus norvegicus
tgagaaccgagagcagagcccttct

SEQ ID NO: 609065 - DNA, 25 bp, Rattus norvegicus
tgagaaccgagtcccttccccgtag

SEQ ID NO: 609066 - DNA, 25 bp, Rattus norvegicus
tgagaaccgagtgccttccccgtag

SEQ ID NO: 609067 - DNA, 25 bp, Rattus norvegicus
tgagaaccgtggagtccgggcccca

SEQ ID NO: 609068 - DNA, 25 bp, Rattus norvegicus
tgagaaccgtggtgtccgggcccca

SEQ ID NO: 609069 - DNA, 25 bp, Rattus norvegicus
tgagaaccgtgtaagcatcagctgg

SEQ ID NO: 609070 - DNA, 25 bp, Rattus norvegicus
tgagaaccgtgttagcatcagctgg

SEQ ID NO: 609071 - DNA, 25 bp, Rattus norvegicus
tgagaacctaagagcccagcaggaa

SEQ ID NO: 609072 - DNA, 25 bp, Rattus norvegicus
tgagaacctaagtgcccagcaggaa

SEQ ID NO: 609073 - DNA, 25 bp, Rattus norvegicus
tgagaacctcacatcagccctgtgg

SEQ ID NO: 609074 - DNA, 25 bp, Rattus norvegicus
tgagaacctcacttcagccctgtgg

SEQ ID NO: 609075 - DNA, 25 bp, Rattus norvegicus
tgagaacctgagattcgatccctct

SEQ ID NO: 609076 - DNA, 25 bp, Rattus norvegicus
tgagaacctgagtttcgatccctct

SEQ ID NO: 609077 - DNA, 25 bp, Rattus norvegicus
tgagaacctgggaaagctgagccat

SEQ ID NO: 609078 - DNA, 25 bp, Rattus norvegicus
tgagaacctgggtaagctgagccat

SEQ ID NO: 609079 - DNA, 25 bp, Rattus norvegicus
tgagaaccttttccgtttcgagcat

SEQ ID NO: 609080 - DNA, 25 bp, Rattus norvegicus
tgagaaccttttgcgtttcgagcat

SEQ ID NO: 609081 - DNA, 25 bp, Rattus norvegicus
tgagaacgagttcgccctcatgagc

SEQ ID NO: 609082 - DNA, 25 bp, Rattus norvegicus
tgagaacgagttggccctcatgagc

SEQ ID NO: 609083 - DNA, 25 bp, Rattus norvegicus
tgagaacgcttcatggtaccatctg

SEQ ID NO: 609084 - DNA, 25 bp, Rattus norvegicus
tgagaacgcttcttggtaccatctg

SEQ ID NO: 609085 - DNA, 25 bp, Rattus norvegicus
tgagaacgtaccagggaagccctgg

SEQ ID NO: 609086 - DNA, 25 bp, Rattus norvegicus
tgagaacgtacctgggaagccctgg

SEQ ID NO: 609087 - DNA, 25 bp, Rattus norvegicus
tgagaacgtgggaaggatgtcctct

SEQ ID NO: 609088 - DNA, 25 bp, Rattus norvegicus
tgagaacgtgggtaggatgtcctct

SEQ ID NO: 609089 - DNA, 25 bp, Rattus norvegicus
tgagaacgttaacgctcctttttgc

SEQ ID NO: 609090 - DNA, 25 bp, Rattus norvegicus
tgagaacgttaaggctcctttttgc

SEQ ID NO: 609091 - DNA, 25 bp, Rattus norvegicus
tgagaactaacaccggttacctctg

SEQ ID NO: 609092 - DNA, 25 bp, Rattus norvegicus
tgagaactaacagcggttacctctg

SEQ ID NO: 609093 - DNA, 25 bp, Rattus norvegicus
tgagaactacacatccctctttagg

SEQ ID NO: 609094 - DNA, 25 bp, Rattus norvegicus
tgagaactacacttccctctttagg

SEQ ID NO: 609095 - DNA, 25 bp, Rattus norvegicus
tgagaactacgtcgccaagcgcatc

SEQ ID NO: 609096 - DNA, 25 bp, Rattus norvegicus
tgagaactacgtggccaagcgcatc

SEQ ID NO: 609097 - DNA, 25 bp, Rattus norvegicus
tgagaactatcacactgcgcatgaa

SEQ ID NO: 609098 - DNA, 25 bp, Rattus norvegicus
tgagaactatcagactgcgcatgaa

SEQ ID NO: 609099 - DNA, 25 bp, Rattus norvegicus
tgagaactcaaaagtgtgccaccag

SEQ ID NO: 609100 - DNA, 25 bp, Rattus norvegicus
tgagaactcaaatgtgtgccaccag

SEQ ID NO: 609101 - DNA, 25 bp, Rattus norvegicus
tgagaactcagtaccagggtcctga

SEQ ID NO: 609102 - DNA, 25 bp, Rattus norvegicus
tgagaactcagttccagggtcctga

SEQ ID NO: 609103 - DNA, 25 bp, Rattus norvegicus
tgagaactccacagcagtgacaggt

SEQ ID NO: 609104 - DNA, 25 bp, Rattus norvegicus
tgagaactccactgcagtgacaggt

SEQ ID NO: 609105 - DNA, 25 bp, Rattus norvegicus
tgagaactccatagtgttccgtgga

SEQ ID NO: 609106 - DNA, 25 bp, Rattus norvegicus
tgagaactccattgtgttccgtgga

SEQ ID NO: 609107 - DNA, 25 bp, Rattus norvegicus
tgagaactcgccctgcagtgcatcc

SEQ ID NO: 609108 - DNA, 25 bp, Rattus norvegicus
tgagaactcgccgtgcagtgcatcc

SEQ ID NO: 609109 - DNA, 25 bp, Rattus norvegicus
tgagaactctatcctgtaccccagc

SEQ ID NO: 609110 - DNA, 25 bp, Rattus norvegicus
tgagaactctatgctgtaccccagc

SEQ ID NO: 609111 - DNA, 25 bp, Rattus norvegicus
tgagaactctccattttgctgtgaa

SEQ ID NO: 609112 - DNA, 25 bp, Rattus norvegicus
tgagaactctcctttttgctgtgaa

SEQ ID NO: 609113 - DNA, 25 bp, Rattus norvegicus
tgagaactgctgacttagcagcaat

SEQ ID NO: 609114 - DNA, 25 bp, Rattus norvegicus
tgagaactgctgtcttagcagcaat

SEQ ID NO: 609115 - DNA, 25 bp, Rattus norvegicus
tgagaactggaaacaccctgagtgt

SEQ ID NO: 609116 - DNA, 25 bp, Rattus norvegicus
tgagaactggaatcaccctgagtgt

SEQ ID NO: 609117 - DNA, 25 bp, Rattus norvegicus
tgagaactggacacctatcgcatca

SEQ ID NO: 609118 - DNA, 25 bp, Rattus norvegicus
tgagaactggactcctatcgcatca

SEQ ID NO: 609119 - DNA, 25 bp, Rattus norvegicus
tgagaactgtctctccctggcggag

SEQ ID NO: 609120 - DNA, 25 bp, Rattus norvegicus
tgagaactgtctgtccctggcggag

SEQ ID NO: 609121 - DNA, 25 bp, Rattus norvegicus
tgagaactgtggaaggcggtaccat

SEQ ID NO: 609122 - DNA, 25 bp, Rattus norvegicus
tgagaactgtggtaggcggtaccat

SEQ ID NO: 609123 - DNA, 25 bp, Rattus norvegicus
tgagaacttagtctgtctatcccca

SEQ ID NO: 609124 - DNA, 25 bp, Rattus norvegicus
tgagaacttagtgtgtctatcccca

SEQ ID NO: 609125 - DNA, 25 bp, Rattus norvegicus
tgagaacttcatccaaacctacttt

SEQ ID NO: 609126 - DNA, 25 bp, Rattus norvegicus
tgagaacttcatgcaaacctacttt

SEQ ID NO: 609127 - DNA, 25 bp, Rattus norvegicus
tgagaacttgatcccaaatcgcacg

SEQ ID NO: 609128 - DNA, 25 bp, Rattus norvegicus
tgagaacttgatgccaaatcgcacg

SEQ ID NO: 609129 - DNA, 25 bp, Rattus norvegicus
tgagaactttggctcatttccgacc

SEQ ID NO: 609130 - DNA, 25 bp, Rattus norvegicus
tgagaactttgggtcatttccgacc

SEQ ID NO: 609131 - DNA, 25 bp, Rattus norvegicus
tgagaagaaagcatgtcccctgccg

SEQ ID NO: 609132 - DNA, 25 bp, Rattus norvegicus
tgagaagaaagccattccccagcgc

SEQ ID NO: 609133 - DNA, 25 bp, Rattus norvegicus
tgagaagaaagcgattccccagcgc

SEQ ID NO: 609134 - DNA, 25 bp, Rattus norvegicus
tgagaagaaagcttgtcccctgccg

SEQ ID NO: 609135 - DNA, 25 bp, Rattus norvegicus
tgagaagaacaaccagctctcttaa

SEQ ID NO: 609136 - DNA, 25 bp, Rattus norvegicus
tgagaagaacaagcagctctcttaa

SEQ ID NO: 609137 - DNA, 25 bp, Rattus norvegicus
tgagaagaacgcagccttagcaccc

SEQ ID NO: 609138 - DNA, 25 bp, Rattus norvegicus
tgagaagaacgctgccttagcaccc

SEQ ID NO: 609139 - DNA, 25 bp, Rattus norvegicus
tgagaagacaaaccgcgctcgcaag

SEQ ID NO: 609140 - DNA, 25 bp, Rattus norvegicus
tgagaagacaaagcgcgctcgcaag

SEQ ID NO: 609141 - DNA, 25 bp, Rattus norvegicus
tgagaagacattacaaggagcagac

SEQ ID NO: 609142 - DNA, 25 bp, Rattus norvegicus
tgagaagacatttcaaggagcagac

SEQ ID NO: 609143 - DNA, 25 bp, Rattus norvegicus
tgagaagactctatttgcctgtgct

SEQ ID NO: 609144 - DNA, 25 bp, Rattus norvegicus
tgagaagactctttttgcctgtgct

SEQ ID NO: 609145 - DNA, 25 bp, Rattus norvegicus
tgagaagactgacccaaacacacaa

SEQ ID NO: 609146 - DNA, 25 bp, Rattus norvegicus
tgagaagactgagccaaacacacaa

SEQ ID NO: 609147 - DNA, 25 bp, Rattus norvegicus
tgagaagatcaaacggccccgaagc

SEQ ID NO: 609148 - DNA, 25 bp, Rattus norvegicus
tgagaagatcaatcggccccgaagc

SEQ ID NO: 609149 - DNA, 25 bp, Rattus norvegicus
tgagaagatgacaatctcgctaggg

SEQ ID NO: 609150 - DNA, 25 bp, Rattus norvegicus
tgagaagatgactatctcgctaggg

SEQ ID NO: 609151 - DNA, 25 bp, Rattus norvegicus
tgagaagcaagcagttctcgccatc

SEQ ID NO: 609152 - DNA, 25 bp, Rattus norvegicus
tgagaagcaagctgttctcgccatc

SEQ ID NO: 609153 - DNA, 25 bp, Rattus norvegicus
tgagaagcatccaccggagctccgt

SEQ ID NO: 609154 - DNA, 25 bp, Rattus norvegicus
tgagaagcatcctccggagctccgt

SEQ ID NO: 609155 - DNA, 25 bp, Rattus norvegicus
tgagaagccaccacctgctacagag

SEQ ID NO: 609156 - DNA, 25 bp, Rattus norvegicus
tgagaagccacctcctgctacagag

SEQ ID NO: 609157 - DNA, 25 bp, Rattus norvegicus
tgagaagccagtactccgggcgtaa

SEQ ID NO: 609158 - DNA, 25 bp, Rattus norvegicus
tgagaagccagttctccgggcgtaa

SEQ ID NO: 609159 - DNA, 25 bp, Rattus norvegicus
tgagaagcccatatcgaacccacct

SEQ ID NO: 609160 - DNA, 25 bp, Rattus norvegicus
tgagaagcccatttcgaacccacct

SEQ ID NO: 609161 - DNA, 25 bp, Rattus norvegicus
tgagaagccccaagcctgcaagtgg

SEQ ID NO: 609162 - DNA, 25 bp, Rattus norvegicus
tgagaagccccaccagcctttgtca

SEQ ID NO: 609163 - DNA, 25 bp, Rattus norvegicus
tgagaagccccagcagcctttgtca

SEQ ID NO: 609164 - DNA, 25 bp, Rattus norvegicus
tgagaagccccatgcctgcaagtgg

SEQ ID NO: 609165 - DNA, 25 bp, Rattus norvegicus
tgagaagcctcaccattttgctctt

SEQ ID NO: 609166 - DNA, 25 bp, Rattus norvegicus
tgagaagcctcagcattttgctctt

SEQ ID NO: 609167 - DNA, 25 bp, Rattus norvegicus
tgagaagccttcagcactttgcagt

SEQ ID NO: 609168 - DNA, 25 bp, Rattus norvegicus
tgagaagccttctgcactttgcagt

SEQ ID NO: 609169 - DNA, 25 bp, Rattus norvegicus
tgagaagcgagcctacatctgtgcc

SEQ ID NO: 609170 - DNA, 25 bp, Rattus norvegicus
tgagaagcgagcgtacatctgtgcc

SEQ ID NO: 609171 - DNA, 25 bp, Rattus norvegicus
tgagaagcgcagatcctgattccca

SEQ ID NO: 609172 - DNA, 25 bp, Rattus norvegicus
tgagaagcgcagttcctgattccca

SEQ ID NO: 609173 - DNA, 25 bp, Rattus norvegicus
tgagaagctacacggcgttctccga

SEQ ID NO: 609174 - DNA, 25 bp, Rattus norvegicus
tgagaagctacagggcgttctccga

SEQ ID NO: 609175 - DNA, 25 bp, Rattus norvegicus
tgagaagctatacccttttcttttt

SEQ ID NO: 609176 - DNA, 25 bp, Rattus norvegicus
tgagaagctatagccttttcttttt

SEQ ID NO: 609177 - DNA, 25 bp, Rattus norvegicus
tgagaagctcaactctgtgcagccc

SEQ ID NO: 609178 - DNA, 25 bp, Rattus norvegicus
tgagaagctcaagtctgtgcagccc

SEQ ID NO: 609179 - DNA, 25 bp, Rattus norvegicus
tgagaagctcagaatgctctccctg

SEQ ID NO: 609180 - DNA, 25 bp, Rattus norvegicus
tgagaagctcagtatgctctccctg

SEQ ID NO: 609181 - DNA, 25 bp, Rattus norvegicus
tgagaagctcttcaaccaatccctg

SEQ ID NO: 609182 - DNA, 25 bp, Rattus norvegicus
tgagaagctcttgaaccaatccctg

SEQ ID NO: 609183 - DNA, 25 bp, Rattus norvegicus
tgagaagctgcacacaccgaggcac

SEQ ID NO: 609184 - DNA, 25 bp, Rattus norvegicus
tgagaagctgcagacaccgaggcac

SEQ ID NO: 609185 - DNA, 25 bp, Rattus norvegicus
tgagaaggaagcatcacccctgacc

SEQ ID NO: 609186 - DNA, 25 bp, Rattus norvegicus
tgagaaggaagcttcacccctgacc

SEQ ID NO: 609187 - DNA, 25 bp, Rattus norvegicus
tgagaaggcatgactcctcccaata

SEQ ID NO: 609188 - DNA, 25 bp, Rattus norvegicus
tgagaaggcatgtctcctcccaata

SEQ ID NO: 609189 - DNA, 25 bp, Rattus norvegicus
tgagaaggcccaactcactgtgggc

SEQ ID NO: 609190 - DNA, 25 bp, Rattus norvegicus
tgagaaggcccatctcactgtgggc

SEQ ID NO: 609191 - DNA, 25 bp, Rattus norvegicus
tgagaaggccctctcattcctattc

SEQ ID NO: 609192 - DNA, 25 bp, Rattus norvegicus
tgagaaggccctgtcattcctattc

SEQ ID NO: 609193 - DNA, 25 bp, Rattus norvegicus
tgagaaggccggctcacaccagtgc

SEQ ID NO: 609194 - DNA, 25 bp, Rattus norvegicus
tgagaaggccgggtcacaccagtgc

SEQ ID NO: 609195 - DNA, 25 bp, Rattus norvegicus
tgagaaggccttaacctcagtgcct

SEQ ID NO: 609196 - DNA, 25 bp, Rattus norvegicus
tgagaaggccttacatgcaccaatt

SEQ ID NO: 609197 - DNA, 25 bp, Rattus norvegicus
tgagaaggccttcttcgatgtgaag

SEQ ID NO: 609198 - DNA, 25 bp, Rattus norvegicus
tgagaaggccttgttcgatgtgaag

SEQ ID NO: 609199 - DNA, 25 bp, Rattus norvegicus
tgagaaggcctttacctcagtgcct

SEQ ID NO: 609200 - DNA, 25 bp, Rattus norvegicus
tgagaaggcctttcatgcaccaatt

SEQ ID NO: 609201 - DNA, 25 bp, Rattus norvegicus
tgagaagggctccaccaaaacccag

SEQ ID NO: 609202 - DNA, 25 bp, Rattus norvegicus
tgagaagggctcgaccaaaacccag

SEQ ID NO: 609203 - DNA, 25 bp, Rattus norvegicus
tgagaagggtgtacctagcctctgt

SEQ ID NO: 609204 - DNA, 25 bp, Rattus norvegicus
tgagaagggtgttcctagcctctgt

SEQ ID NO: 609205 - DNA, 25 bp, Rattus norvegicus
tgagaaggtcccacatgctctagac

SEQ ID NO: 609206 - DNA, 25 bp, Rattus norvegicus
tgagaaggtccctcatgctctagac

SEQ ID NO: 609207 - DNA, 25 bp, Rattus norvegicus
tgagaaggtcttccaccctagcaag

SEQ ID NO: 609208 - DNA, 25 bp, Rattus norvegicus
tgagaaggtcttgcaccctagcaag

SEQ ID NO: 609209 - DNA, 25 bp, Rattus norvegicus
tgagaaggtgctccactacctggcc

SEQ ID NO: 609210 - DNA, 25 bp, Rattus norvegicus
tgagaaggtgctgcactacctggcc

SEQ ID NO: 609211 - DNA, 25 bp, Rattus norvegicus
tgagaagtagccacccaatgggttc

SEQ ID NO: 609212 - DNA, 25 bp, Rattus norvegicus
tgagaagtagcctcccaatgggttc

SEQ ID NO: 609213 - DNA, 25 bp, Rattus norvegicus
tgagaagtcagcatgtcccgaggct

SEQ ID NO: 609214 - DNA, 25 bp, Rattus norvegicus
tgagaagtcagcttgtcccgaggct

SEQ ID NO: 609215 - DNA, 25 bp, Rattus norvegicus
tgagaagtcattatccacactgcct

SEQ ID NO: 609216 - DNA, 25 bp, Rattus norvegicus
tgagaagtcattttccacactgcct

SEQ ID NO: 609217 - DNA, 25 bp, Rattus norvegicus
tgagaagtcccgctgcctctggcca

SEQ ID NO: 609218 - DNA, 25 bp, Rattus norvegicus
tgagaagtcccggtgcctctggcca

SEQ ID NO: 609219 - DNA, 25 bp, Rattus norvegicus
tgagaagtcctccatgtccccaagg

SEQ ID NO: 609220 - DNA, 25 bp, Rattus norvegicus
tgagaagtcctcgatgtccccaagg

SEQ ID NO: 609221 - DNA, 25 bp, Rattus norvegicus
tgagaagtctcaaaatgtgctaatc

SEQ ID NO: 609222 - DNA, 25 bp, Rattus norvegicus
tgagaagtctcataatgtgctaatc

SEQ ID NO: 609223 - DNA, 25 bp, Rattus norvegicus
tgagaagtgtgactccctggtccca

SEQ ID NO: 609224 - DNA, 25 bp, Rattus norvegicus
tgagaagtgtgagtccctggtccca

SEQ ID NO: 609225 - DNA, 25 bp, Rattus norvegicus
tgagaagttcccagtaaccaccatg

SEQ ID NO: 609226 - DNA, 25 bp, Rattus norvegicus
tgagaagttccctgtaaccaccatg

SEQ ID NO: 609227 - DNA, 25 bp, Rattus norvegicus
tgagaagttcgacatgccgctgact

SEQ ID NO: 609228 - DNA, 25 bp, Rattus norvegicus
tgagaagttcgagatgccgctgact

SEQ ID NO: 609229 - DNA, 25 bp, Rattus norvegicus
tgagaagttgagagtcccttcccag

SEQ ID NO: 609230 - DNA, 25 bp, Rattus norvegicus
tgagaagttgagtgtcccttcccag

SEQ ID NO: 609231 - DNA, 25 bp, Rattus norvegicus
tgagaagtttctcctttcatttggg

SEQ ID NO: 609232 - DNA, 25 bp, Rattus norvegicus
tgagaagtttctgctttcatttggg

SEQ ID NO: 609233 - DNA, 25 bp, Rattus norvegicus
tgagaatatactaatgccactgaat

SEQ ID NO: 609234 - DNA, 25 bp, Rattus norvegicus
tgagaatatacttatgccactgaat

SEQ ID NO: 609235 - DNA, 25 bp, Rattus norvegicus
tgagaatatcaccttaccccacagt

SEQ ID NO: 609236 - DNA, 25 bp, Rattus norvegicus
tgagaatatcacgttaccccacagt

SEQ ID NO: 609237 - DNA, 25 bp, Rattus norvegicus
tgagaatcaaaaagccccattccct

SEQ ID NO: 609238 - DNA, 25 bp, Rattus norvegicus
tgagaatcaaaatgccccattccct

SEQ ID NO: 609239 - DNA, 25 bp, Rattus norvegicus
tgagaatcacgaacaagcacatggt

SEQ ID NO: 609240 - DNA, 25 bp, Rattus norvegicus
tgagaatcacgatcaagcacatggt

SEQ ID NO: 609241 - DNA, 25 bp, Rattus norvegicus
tgagaatcagctagtggccgtcact

SEQ ID NO: 609242 - DNA, 25 bp, Rattus norvegicus
tgagaatcagcttgtggccgtcact

SEQ ID NO: 609243 - DNA, 25 bp, Rattus norvegicus
tgagaatcatcaccacagccgtgga

SEQ ID NO: 609244 - DNA, 25 bp, Rattus norvegicus
tgagaatcatcagcacagccgtgga

SEQ ID NO: 609245 - DNA, 25 bp, Rattus norvegicus
tgagaatctgaacccacatcctata

SEQ ID NO: 609246 - DNA, 25 bp, Rattus norvegicus
tgagaatctgaagccacatcctata

SEQ ID NO: 609247 - DNA, 25 bp, Rattus norvegicus
tgagaatctgatcatcaccctgcag

SEQ ID NO: 609248 - DNA, 25 bp, Rattus norvegicus
tgagaatctgatgatcaccctgcag

SEQ ID NO: 609249 - DNA, 25 bp, Rattus norvegicus
tgagaatcttgtatgtcccaggcaa

SEQ ID NO: 609250 - DNA, 25 bp, Rattus norvegicus
tgagaatcttgtttgtcccaggcaa

SEQ ID NO: 609251 - DNA, 25 bp, Rattus norvegicus
tgagaatgaaatagccgggctacct

SEQ ID NO: 609252 - DNA, 25 bp, Rattus norvegicus
tgagaatgaaattgccgggctacct

SEQ ID NO: 609253 - DNA, 25 bp, Rattus norvegicus
tgagaatgccatagctatccacagt

SEQ ID NO: 609254 - DNA, 25 bp, Rattus norvegicus
tgagaatgccattgctatccacagt

SEQ ID NO: 609255 - DNA, 25 bp, Rattus norvegicus
tgagaatgccctaactggtgaccac

SEQ ID NO: 609256 - DNA, 25 bp, Rattus norvegicus
tgagaatgcccttactggtgaccac

SEQ ID NO: 609257 - DNA, 25 bp, Rattus norvegicus
tgagaatggactcagccacacccat

SEQ ID NO: 609258 - DNA, 25 bp, Rattus norvegicus
tgagaatggactgagccacacccat

SEQ ID NO: 609259 - DNA, 25 bp, Rattus norvegicus
tgagaatggagcagcctgtccccga

SEQ ID NO: 609260 - DNA, 25 bp, Rattus norvegicus
tgagaatggagctgcctgtccccga

SEQ ID NO: 609261 - DNA, 25 bp, Rattus norvegicus
tgagaattcagtcccggagctcact

SEQ ID NO: 609262 - DNA, 25 bp, Rattus norvegicus
tgagaattcagtgccggagctcact

SEQ ID NO: 609263 - DNA, 25 bp, Rattus norvegicus
tgagaattccttaccccagaacctg

SEQ ID NO: 609264 - DNA, 25 bp, Rattus norvegicus
tgagaattcctttccccagaacctg

SEQ ID NO: 609265 - DNA, 25 bp, Rattus norvegicus
tgagaattctcgctcgcctggtcat

SEQ ID NO: 609266 - DNA, 25 bp, Rattus norvegicus
tgagaattctcggtcgcctggtcat

SEQ ID NO: 609267 - DNA, 25 bp, Rattus norvegicus
tgagaattctgaccctcggcgtctg

SEQ ID NO: 609268 - DNA, 25 bp, Rattus norvegicus
tgagaattctgagcctcggcgtctg

SEQ ID NO: 609269 - DNA, 25 bp, Rattus norvegicus
tgagacaaacacattcctgactgcg

SEQ ID NO: 609270 - DNA, 25 bp, Rattus norvegicus
tgagacaaacactttcctgactgcg

SEQ ID NO: 609271 - DNA, 25 bp, Rattus norvegicus
tgagacaactcaagactcccatctt

SEQ ID NO: 609272 - DNA, 25 bp, Rattus norvegicus
tgagacaactcatgactcccatctt

SEQ ID NO: 609273 - DNA, 25 bp, Rattus norvegicus
tgagacaactgacggatgaagattc

SEQ ID NO: 609274 - DNA, 25 bp, Rattus norvegicus
tgagacaactgagggatgaagattc

SEQ ID NO: 609275 - DNA, 25 bp, Rattus norvegicus
tgagacaagatacacttcccaccat

SEQ ID NO: 609276 - DNA, 25 bp, Rattus norvegicus
tgagacaagatagacttcccaccat

SEQ ID NO: 609277 - DNA, 25 bp, Rattus norvegicus
tgagacaatctcctggacacctggc

SEQ ID NO: 609278 - DNA, 25 bp, Rattus norvegicus
tgagacaatctcgtggacacctggc

SEQ ID NO: 609279 - DNA, 25 bp, Rattus norvegicus
tgagacacacgtcatgtttgctcct

SEQ ID NO: 609280 - DNA, 25 bp, Rattus norvegicus
tgagacacacgtgatgtttgctcct

SEQ ID NO: 609281 - DNA, 25 bp, Rattus norvegicus
tgagacaccagtactcaactcacac

SEQ ID NO: 609282 - DNA, 25 bp, Rattus norvegicus
tgagacaccagttctcaactcacac

SEQ ID NO: 609283 - DNA, 25 bp, Rattus norvegicus
tgagacaccatcagagcccaggctc

SEQ ID NO: 609284 - DNA, 25 bp, Rattus norvegicus
tgagacaccatctgagcccaggctc

SEQ ID NO: 609285 - DNA, 25 bp, Rattus norvegicus
tgagacaccccgacttcagggagtc

SEQ ID NO: 609286 - DNA, 25 bp, Rattus norvegicus
tgagacaccccgtcttcagggagtc

SEQ ID NO: 609287 - DNA, 25 bp, Rattus norvegicus
tgagacactctaccttctccatgag

SEQ ID NO: 609288 - DNA, 25 bp, Rattus norvegicus
tgagacactctagcttctccatgag

SEQ ID NO: 609289 - DNA, 25 bp, Rattus norvegicus
tgagacacttttaactctgccttct

SEQ ID NO: 609290 - DNA, 25 bp, Rattus norvegicus
tgagacacttttaccaaacctacag

SEQ ID NO: 609291 - DNA, 25 bp, Rattus norvegicus
tgagacactttttactctgccttct

SEQ ID NO: 609292 - DNA, 25 bp, Rattus norvegicus
tgagacactttttccaaacctacag

SEQ ID NO: 609293 - DNA, 25 bp, Rattus norvegicus
tgagacagaccaactgccagtcatg

SEQ ID NO: 609294 - DNA, 25 bp, Rattus norvegicus
tgagacagaccatctgccagtcatg

SEQ ID NO: 609295 - DNA, 25 bp, Rattus norvegicus
tgagacagattaagtagaccaaact

SEQ ID NO: 609296 - DNA, 25 bp, Rattus norvegicus
tgagacagattatgtagaccaaact

SEQ ID NO: 609297 - DNA, 25 bp, Rattus norvegicus
tgagacagcccgattgtgtgagcca

SEQ ID NO: 609298 - DNA, 25 bp, Rattus norvegicus
tgagacagcccgtttgtgtgagcca

SEQ ID NO: 609299 - DNA, 25 bp, Rattus norvegicus
tgagacaggaagaactggtggcttt

SEQ ID NO: 609300 - DNA, 25 bp, Rattus norvegicus
tgagacaggaagtactggtggcttt

SEQ ID NO: 609301 - DNA, 25 bp, Rattus norvegicus
tgagacaggaatcacaacagacctc

SEQ ID NO: 609302 - DNA, 25 bp, Rattus norvegicus
tgagacaggaatgacaacagacctc

SEQ ID NO: 609303 - DNA, 25 bp, Rattus norvegicus
tgagacaggcatcaactcctcctag

SEQ ID NO: 609304 - DNA, 25 bp, Rattus norvegicus
tgagacaggcatgaactcctcctag

SEQ ID NO: 609305 - DNA, 25 bp, Rattus norvegicus
tgagacagggtaactggccagcata

SEQ ID NO: 609306 - DNA, 25 bp, Rattus norvegicus
tgagacagggtatctggccagcata

SEQ ID NO: 609307 - DNA, 25 bp, Rattus norvegicus
tgagacagggttatcacagtggagc

SEQ ID NO: 609308 - DNA, 25 bp, Rattus norvegicus
tgagacagggttttcacagtggagc

SEQ ID NO: 609309 - DNA, 25 bp, Rattus norvegicus
tgagacagtaccacggccagcatga

SEQ ID NO: 609310 - DNA, 25 bp, Rattus norvegicus
tgagacagtacctcggccagcatga

SEQ ID NO: 609311 - DNA, 25 bp, Rattus norvegicus
tgagacagtgaacgcctggctccag

SEQ ID NO: 609312 - DNA, 25 bp, Rattus norvegicus
tgagacagtgaaggcctggctccag

SEQ ID NO: 609313 - DNA, 25 bp, Rattus norvegicus
tgagacagtggtagttcttcccgct

SEQ ID NO: 609314 - DNA, 25 bp, Rattus norvegicus
tgagacagtggttgttcttcccgct

SEQ ID NO: 609315 - DNA, 25 bp, Rattus norvegicus
tgagacagttgaacttccgggctct

SEQ ID NO: 609316 - DNA, 25 bp, Rattus norvegicus
tgagacagttgatcttccgggctct

SEQ ID NO: 609317 - DNA, 25 bp, Rattus norvegicus
tgagacatcgtcctaaccagaacat

SEQ ID NO: 609318 - DNA, 25 bp, Rattus norvegicus
tgagacatcgtcgtaaccagaacat

SEQ ID NO: 609319 - DNA, 25 bp, Rattus norvegicus
tgagacatgacaccctgatggcagg

SEQ ID NO: 609320 - DNA, 25 bp, Rattus norvegicus
tgagacatgacagcctgatggcagg

SEQ ID NO: 609321 - DNA, 25 bp, Rattus norvegicus
tgagacatgatcaggccacaccttt

SEQ ID NO: 609322 - DNA, 25 bp, Rattus norvegicus
tgagacatgatctggccacaccttt

SEQ ID NO: 609323 - DNA, 25 bp, Rattus norvegicus
tgagacatgcagctgccgtggacat

SEQ ID NO: 609324 - DNA, 25 bp, Rattus norvegicus
tgagacatgcaggtgccgtggacat

SEQ ID NO: 609325 - DNA, 25 bp, Rattus norvegicus
tgagacatgcccctgctttatgaaa

SEQ ID NO: 609326 - DNA, 25 bp, Rattus norvegicus
tgagacatgcccgtgctttatgaaa

SEQ ID NO: 609327 - DNA, 25 bp, Rattus norvegicus
tgagacatgggcactccagggctga

SEQ ID NO: 609328 - DNA, 25 bp, Rattus norvegicus
tgagacatgggcagttttcctggtc

SEQ ID NO: 609329 - DNA, 25 bp, Rattus norvegicus
tgagacatgggctctccagggctga

SEQ ID NO: 609330 - DNA, 25 bp, Rattus norvegicus
tgagacatgggctgttttcctggtc

SEQ ID NO: 609331 - DNA, 25 bp, Rattus norvegicus
tgagaccaagaacttaccaccaagt

SEQ ID NO: 609332 - DNA, 25 bp, Rattus norvegicus
tgagaccaagaagttaccaccaagt

SEQ ID NO: 609333 - DNA, 25 bp, Rattus norvegicus
tgagaccaagtccacgctgatgttt

SEQ ID NO: 609334 - DNA, 25 bp, Rattus norvegicus
tgagaccaagtcgacgctgatgttt

SEQ ID NO: 609335 - DNA, 25 bp, Rattus norvegicus
tgagaccaagtgacatcctctctta

SEQ ID NO: 609336 - DNA, 25 bp, Rattus norvegicus
tgagaccaagtgtcatcctctctta

SEQ ID NO: 609337 - DNA, 25 bp, Rattus norvegicus
tgagaccacctcaaagatgcttctc

SEQ ID NO: 609338 - DNA, 25 bp, Rattus norvegicus
tgagaccacctctaagatgcttctc

SEQ ID NO: 609339 - DNA, 25 bp, Rattus norvegicus
tgagaccacggcacaggagtccatg

SEQ ID NO: 609340 - DNA, 25 bp, Rattus norvegicus
tgagaccacggctcaggagtccatg

SEQ ID NO: 609341 - DNA, 25 bp, Rattus norvegicus
tgagaccacgtgattattgctttcc

SEQ ID NO: 609342 - DNA, 25 bp, Rattus norvegicus
tgagaccacgtgtttattgctttcc

SEQ ID NO: 609343 - DNA, 25 bp, Rattus norvegicus
tgagaccactctctctcttgcaagt

SEQ ID NO: 609344 - DNA, 25 bp, Rattus norvegicus
tgagaccactctgtctcttgcaagt

SEQ ID NO: 609345 - DNA, 25 bp, Rattus norvegicus
tgagaccagaccaggtctaggcaat

SEQ ID NO: 609346 - DNA, 25 bp, Rattus norvegicus
tgagaccagacctggtctaggcaat

SEQ ID NO: 609347 - DNA, 25 bp, Rattus norvegicus
tgagaccaggagacacaccagctgc

SEQ ID NO: 609348 - DNA, 25 bp, Rattus norvegicus
tgagaccaggagtcacaccagctgc

SEQ ID NO: 609349 - DNA, 25 bp, Rattus norvegicus
tgagaccatccacctcatggagaga

SEQ ID NO: 609350 - DNA, 25 bp, Rattus norvegicus
tgagaccatccagctcatggagaga

SEQ ID NO: 609351 - DNA, 25 bp, Rattus norvegicus
tgagaccatgttaacttttgttact

SEQ ID NO: 609352 - DNA, 25 bp, Rattus norvegicus
tgagaccatgtttacttttgttact

SEQ ID NO: 609353 - DNA, 25 bp, Rattus norvegicus
tgagaccattctatcttgcccatct

SEQ ID NO: 609354 - DNA, 25 bp, Rattus norvegicus
tgagaccattctttcttgcccatct

SEQ ID NO: 609355 - DNA, 25 bp, Rattus norvegicus
tgagacccacacagcctttcaaatg

SEQ ID NO: 609356 - DNA, 25 bp, Rattus norvegicus
tgagacccacactgcctttcaaatg

SEQ ID NO: 609357 - DNA, 25 bp, Rattus norvegicus
tgagacccagacctcacagtgtgtt

SEQ ID NO: 609358 - DNA, 25 bp, Rattus norvegicus
tgagacccagacgtcacagtgtgtt

SEQ ID NO: 609359 - DNA, 25 bp, Rattus norvegicus
tgagacccagtcaagtgaagaagcc

SEQ ID NO: 609360 - DNA, 25 bp, Rattus norvegicus
tgagacccagtctagtgaagaagcc

SEQ ID NO: 609361 - DNA, 25 bp, Rattus norvegicus
tgagacccatatcttttcactgcac

SEQ ID NO: 609362 - DNA, 25 bp, Rattus norvegicus
tgagacccatatgttttcactgcac

SEQ ID NO: 609363 - DNA, 25 bp, Rattus norvegicus
tgagacccatctccttagaacatgg

SEQ ID NO: 609364 - DNA, 25 bp, Rattus norvegicus
tgagacccatctgcttagaacatgg

SEQ ID NO: 609365 - DNA, 25 bp, Rattus norvegicus
tgagaccccaccaccaaaggttaag

SEQ ID NO: 609366 - DNA, 25 bp, Rattus norvegicus
tgagaccccacctccaaaggttaag

SEQ ID NO: 609367 - DNA, 25 bp, Rattus norvegicus
tgagaccccttgaaccaatttttat

SEQ ID NO: 609368 - DNA, 25 bp, Rattus norvegicus
tgagaccccttgtaccaatttttat

SEQ ID NO: 609369 - DNA, 25 bp, Rattus norvegicus
tgagacccgccgaaaaacactggtg

SEQ ID NO: 609370 - DNA, 25 bp, Rattus norvegicus
tgagacccgccgtaaaacactggtg

SEQ ID NO: 609371 - DNA, 25 bp, Rattus norvegicus
tgagacccgtgcatgcgcatctcta

SEQ ID NO: 609372 - DNA, 25 bp, Rattus norvegicus
tgagacccgtgcttgcgcatctcta

SEQ ID NO: 609373 - DNA, 25 bp, Rattus norvegicus
tgagaccctagcacctgtatatttg

SEQ ID NO: 609374 - DNA, 25 bp, Rattus norvegicus
tgagaccctagctcctgtatatttg

SEQ ID NO: 609375 - DNA, 25 bp, Rattus norvegicus
tgagaccctcaaaaataccttcctg

SEQ ID NO: 609376 - DNA, 25 bp, Rattus norvegicus
tgagaccctcaataataccttcctg

SEQ ID NO: 609377 - DNA, 25 bp, Rattus norvegicus
tgagaccctcttccggattgcggtt

SEQ ID NO: 609378 - DNA, 25 bp, Rattus norvegicus
tgagaccctcttgcggattgcggtt

SEQ ID NO: 609379 - DNA, 25 bp, Rattus norvegicus
tgagaccctggcacggacagaagga

SEQ ID NO: 609380 - DNA, 25 bp, Rattus norvegicus
tgagaccctggctcggacagaagga

SEQ ID NO: 609381 - DNA, 25 bp, Rattus norvegicus
tgagaccctgttaccctggttccta

SEQ ID NO: 609382 - DNA, 25 bp, Rattus norvegicus
tgagaccctgtttccctggttccta

SEQ ID NO: 609383 - DNA, 25 bp, Rattus norvegicus
tgagaccctttcagtacaacacgag

SEQ ID NO: 609384 - DNA, 25 bp, Rattus norvegicus
tgagaccctttcatgatgctccaga

SEQ ID NO: 609385 - DNA, 25 bp, Rattus norvegicus
tgagaccctttctgtacaacacgag

SEQ ID NO: 609386 - DNA, 25 bp, Rattus norvegicus
tgagaccctttcttgatgctccaga

SEQ ID NO: 609387 - DNA, 25 bp, Rattus norvegicus
tgagaccgaaacaaccccgacttca

SEQ ID NO: 609388 - DNA, 25 bp, Rattus norvegicus
tgagaccgaaactaccccgacttca

SEQ ID NO: 609389 - DNA, 25 bp, Rattus norvegicus
tgagaccgacctcgctaagcacgat

SEQ ID NO: 609390 - DNA, 25 bp, Rattus norvegicus
tgagaccgacctggctaagcacgat

SEQ ID NO: 609391 - DNA, 25 bp, Rattus norvegicus
tgagaccggttcaggcttagccatt

SEQ ID NO: 609392 - DNA, 25 bp, Rattus norvegicus
tgagaccggttctggcttagccatt

SEQ ID NO: 609393 - DNA, 25 bp, Rattus norvegicus
tgagaccgtgcacaatcttggagaa

SEQ ID NO: 609394 - DNA, 25 bp, Rattus norvegicus
tgagaccgtgcagaatcttggagaa

SEQ ID NO: 609395 - DNA, 25 bp, Rattus norvegicus
tgagacctacctccaccgcattggg

SEQ ID NO: 609396 - DNA, 25 bp, Rattus norvegicus
tgagacctacctgcaccgcattggg

SEQ ID NO: 609397 - DNA, 25 bp, Rattus norvegicus
tgagacctactgaggactttaccct

SEQ ID NO: 609398 - DNA, 25 bp, Rattus norvegicus
tgagacctactgtggactttaccct

SEQ ID NO: 609399 - DNA, 25 bp, Rattus norvegicus
tgagacctagagacggtcacgcttc

SEQ ID NO: 609400 - DNA, 25 bp, Rattus norvegicus
tgagacctagagtcggtcacgcttc

SEQ ID NO: 609401 - DNA, 25 bp, Rattus norvegicus
tgagacctagttacagacccaccgg

SEQ ID NO: 609402 - DNA, 25 bp, Rattus norvegicus
tgagacctagtttcagacccaccgg

SEQ ID NO: 609403 - DNA, 25 bp, Rattus norvegicus
tgagacctccatcttccagatgtgt

SEQ ID NO: 609404 - DNA, 25 bp, Rattus norvegicus
tgagacctccatgttccagatgtgt

SEQ ID NO: 609405 - DNA, 25 bp, Rattus norvegicus
tgagacctcctgacttcagagggaa

SEQ ID NO: 609406 - DNA, 25 bp, Rattus norvegicus
tgagacctcctgtcttcagagggaa

SEQ ID NO: 609407 - DNA, 25 bp, Rattus norvegicus
tgagacctcgaaagtaccccaacag

SEQ ID NO: 609408 - DNA, 25 bp, Rattus norvegicus
tgagacctcgaacccaaggctggaa

SEQ ID NO: 609409 - DNA, 25 bp, Rattus norvegicus
tgagacctcgaagccaaggctggaa

SEQ ID NO: 609410 - DNA, 25 bp, Rattus norvegicus
tgagacctcgaatgtaccccaacag

SEQ ID NO: 609411 - DNA, 25 bp, Rattus norvegicus
tgagacctgaggacgccttattctt

SEQ ID NO: 609412 - DNA, 25 bp, Rattus norvegicus
tgagacctgaggtcgccttattctt

SEQ ID NO: 609413 - DNA, 25 bp, Rattus norvegicus
tgagacctgctcctccgcggaacgg

SEQ ID NO: 609414 - DNA, 25 bp, Rattus norvegicus
tgagacctgctcgtccgcggaacgg

SEQ ID NO: 609415 - DNA, 25 bp, Rattus norvegicus
tgagacctgcttcgtttacatagtg

SEQ ID NO: 609416 - DNA, 25 bp, Rattus norvegicus
tgagacctgcttggtttacatagtg

SEQ ID NO: 609417 - DNA, 25 bp, Rattus norvegicus
tgagacctgtctcaggaggcgctct

SEQ ID NO: 609418 - DNA, 25 bp, Rattus norvegicus
tgagacctgtctgaggaggcgctct

SEQ ID NO: 609419 - DNA, 25 bp, Rattus norvegicus
tgagaccttcacagagggcctctat

SEQ ID NO: 609420 - DNA, 25 bp, Rattus norvegicus
tgagaccttcactgagggcctctat

SEQ ID NO: 609421 - DNA, 25 bp, Rattus norvegicus
tgagaccttctccatgtaacaccaa

SEQ ID NO: 609422 - DNA, 25 bp, Rattus norvegicus
tgagaccttctcgatgtaacaccaa

SEQ ID NO: 609423 - DNA, 25 bp, Rattus norvegicus
tgagaccttgaaaggccttccctct

SEQ ID NO: 609424 - DNA, 25 bp, Rattus norvegicus
tgagaccttgaatggccttccctct

SEQ ID NO: 609425 - DNA, 25 bp, Rattus norvegicus
tgagaccttgagatcaaccctacct

SEQ ID NO: 609426 - DNA, 25 bp, Rattus norvegicus
tgagaccttgagttcaaccctacct

SEQ ID NO: 609427 - DNA, 25 bp, Rattus norvegicus
tgagaccttttgataccatgtgtaa

SEQ ID NO: 609428 - DNA, 25 bp, Rattus norvegicus
tgagaccttttgttaccatgtgtaa

SEQ ID NO: 609429 - DNA, 25 bp, Rattus norvegicus
tgagacgcacagacacctcctcagg

SEQ ID NO: 609430 - DNA, 25 bp, Rattus norvegicus
tgagacgcacagtcacctcctcagg

SEQ ID NO: 609431 - DNA, 25 bp, Rattus norvegicus
tgagacgcattccttctgaaggcca

SEQ ID NO: 609432 - DNA, 25 bp, Rattus norvegicus
tgagacgcattcgttctgaaggcca

SEQ ID NO: 609433 - DNA, 25 bp, Rattus norvegicus
tgagacgccaaacacacaacctgtt

SEQ ID NO: 609434 - DNA, 25 bp, Rattus norvegicus
tgagacgccaaagacacaacctgtt

SEQ ID NO: 609435 - DNA, 25 bp, Rattus norvegicus
tgagacgccatgcattgaatgacaa

SEQ ID NO: 609436 - DNA, 25 bp, Rattus norvegicus
tgagacgccatggattgaatgacaa

SEQ ID NO: 609437 - DNA, 25 bp, Rattus norvegicus
tgagacgctttaatactgggctccc

SEQ ID NO: 609438 - DNA, 25 bp, Rattus norvegicus
tgagacgctttattactgggctccc

SEQ ID NO: 609439 - DNA, 25 bp, Rattus norvegicus
tgagacggagctcaggaccctccag

SEQ ID NO: 609440 - DNA, 25 bp, Rattus norvegicus
tgagacggagctgaggaccctccag

SEQ ID NO: 609441 - DNA, 25 bp, Rattus norvegicus
tgagacgtcgcacgctttggccaca

SEQ ID NO: 609442 - DNA, 25 bp, Rattus norvegicus
tgagacgtcgcaggctttggccaca

SEQ ID NO: 609443 - DNA, 25 bp, Rattus norvegicus
tgagacgtctcacagttcctagtga

SEQ ID NO: 609444 - DNA, 25 bp, Rattus norvegicus
tgagacgtctcagagttcctagtga

SEQ ID NO: 609445 - DNA, 25 bp, Rattus norvegicus
tgagacgtgcagagccagctcacct

SEQ ID NO: 609446 - DNA, 25 bp, Rattus norvegicus
tgagacgtgcagtgccagctcacct

SEQ ID NO: 609447 - DNA, 25 bp, Rattus norvegicus
tgagacgtggctagcttctatctac

SEQ ID NO: 609448 - DNA, 25 bp, Rattus norvegicus
tgagacgtggcttgcttctatctac

SEQ ID NO: 609449 - DNA, 25 bp, Rattus norvegicus
tgagacgtggtcctcaccattggag

SEQ ID NO: 609450 - DNA, 25 bp, Rattus norvegicus
tgagacgtggtcgtcaccattggag

SEQ ID NO: 609451 - DNA, 25 bp, Rattus norvegicus
tgagacgtgtttaaccttttcccat

SEQ ID NO: 609452 - DNA, 25 bp, Rattus norvegicus
tgagacgtgttttaccttttcccat

SEQ ID NO: 609453 - DNA, 25 bp, Rattus norvegicus
tgagacgtttgaacaactcctccaa

SEQ ID NO: 609454 - DNA, 25 bp, Rattus norvegicus
tgagacgtttgatcaactcctccaa

SEQ ID NO: 609455 - DNA, 25 bp, Rattus norvegicus
tgagactaagatatgtttcgggttt

SEQ ID NO: 609456 - DNA, 25 bp, Rattus norvegicus
tgagactaagatttgtttcgggttt

SEQ ID NO: 609457 - DNA, 25 bp, Rattus norvegicus
tgagactagcaccatgcagataggt

SEQ ID NO: 609458 - DNA, 25 bp, Rattus norvegicus
tgagactagcacgatgcagataggt

SEQ ID NO: 609459 - DNA, 25 bp, Rattus norvegicus
tgagactcaccgactttgtgggagc

SEQ ID NO: 609460 - DNA, 25 bp, Rattus norvegicus
tgagactcaccgtctttgtgggagc

SEQ ID NO: 609461 - DNA, 25 bp, Rattus norvegicus
tgagactcactaccagggttccacg

SEQ ID NO: 609462 - DNA, 25 bp, Rattus norvegicus
tgagactcactagcagggttccacg

SEQ ID NO: 609463 - DNA, 25 bp, Rattus norvegicus
tgagactcagttccagggatcagat

SEQ ID NO: 609464 - DNA, 25 bp, Rattus norvegicus
tgagactcagttgcagggatcagat

SEQ ID NO: 609465 - DNA, 25 bp, Rattus norvegicus
tgagactccccaacgaggattacgc

SEQ ID NO: 609466 - DNA, 25 bp, Rattus norvegicus
tgagactccccatcgaggattacgc

SEQ ID NO: 609467 - DNA, 25 bp, Rattus norvegicus
tgagactcccgaacttgtgttcagg

SEQ ID NO: 609468 - DNA, 25 bp, Rattus norvegicus
tgagactcccgatcttgtgttcagg

SEQ ID NO: 609469 - DNA, 25 bp, Rattus norvegicus
tgagactccctgctgtgctgcatac

SEQ ID NO: 609470 - DNA, 25 bp, Rattus norvegicus
tgagactccctggtgtgctgcatac

SEQ ID NO: 609471 - DNA, 25 bp, Rattus norvegicus
tgagactcctatagccttgaactct

SEQ ID NO: 609472 - DNA, 25 bp, Rattus norvegicus
tgagactcctattgccttgaactct

SEQ ID NO: 609473 - DNA, 25 bp, Rattus norvegicus
tgagactcgcccatctgttgttgct

SEQ ID NO: 609474 - DNA, 25 bp, Rattus norvegicus
tgagactcgcccttctgttgttgct

SEQ ID NO: 609475 - DNA, 25 bp, Rattus norvegicus
tgagactctcttcctgctagggtac

SEQ ID NO: 609476 - DNA, 25 bp, Rattus norvegicus
tgagactctcttgctgctagggtac

SEQ ID NO: 609477 - DNA, 25 bp, Rattus norvegicus
tgagactctgccatagccagcaaga

SEQ ID NO: 609478 - DNA, 25 bp, Rattus norvegicus
tgagactctgccttagccagcaaga

SEQ ID NO: 609479 - DNA, 25 bp, Rattus norvegicus
tgagactctgttctgtggctttgca

SEQ ID NO: 609480 - DNA, 25 bp, Rattus norvegicus
tgagactctgttgtgtggctttgca

SEQ ID NO: 609481 - DNA, 25 bp, Rattus norvegicus
tgagactcttcacgaacggccaggg

SEQ ID NO: 609482 - DNA, 25 bp, Rattus norvegicus
tgagactcttcaggaacggccaggg

SEQ ID NO: 609483 - DNA, 25 bp, Rattus norvegicus
tgagactcttggctttgcacactcc

SEQ ID NO: 609484 - DNA, 25 bp, Rattus norvegicus
tgagactcttgggtttgcacactcc

SEQ ID NO: 609485 - DNA, 25 bp, Rattus norvegicus
tgagactgaagacgcccagctttct

SEQ ID NO: 609486 - DNA, 25 bp, Rattus norvegicus
tgagactgaagaggcccagctttct

SEQ ID NO: 609487 - DNA, 25 bp, Rattus norvegicus
tgagactgacagctttgcaggtagt

SEQ ID NO: 609488 - DNA, 25 bp, Rattus norvegicus
tgagactgacaggtttgcaggtagt

SEQ ID NO: 609489 - DNA, 25 bp, Rattus norvegicus
tgagactgactccttgacatagcct

SEQ ID NO: 609490 - DNA, 25 bp, Rattus norvegicus
tgagactgactcgttgacatagcct

SEQ ID NO: 609491 - DNA, 25 bp, Rattus norvegicus
tgagactgaggcagatgtcactgtg

SEQ ID NO: 609492 - DNA, 25 bp, Rattus norvegicus
tgagactgaggctgatgtcactgtg

SEQ ID NO: 609493 - DNA, 25 bp, Rattus norvegicus
tgagactgagtcctcatcctgatct

SEQ ID NO: 609494 - DNA, 25 bp, Rattus norvegicus
tgagactgagtcgtcatcctgatct

SEQ ID NO: 609495 - DNA, 25 bp, Rattus norvegicus
tgagactgatcacaccacacaaagc

SEQ ID NO: 609496 - DNA, 25 bp, Rattus norvegicus
tgagactgatcagaccacacaaagc

SEQ ID NO: 609497 - DNA, 25 bp, Rattus norvegicus
tgagactgctggactctgtttacca

SEQ ID NO: 609498 - DNA, 25 bp, Rattus norvegicus
tgagactgctggtctctgtttacca

SEQ ID NO: 609499 - DNA, 25 bp, Rattus norvegicus
tgagactggattagggctgcttact

SEQ ID NO: 609500 - DNA, 25 bp, Rattus norvegicus
tgagactggatttgggctgcttact

SEQ ID NO: 609501 - DNA, 25 bp, Rattus norvegicus
tgagactgggttctttcatccatcc

SEQ ID NO: 609502 - DNA, 25 bp, Rattus norvegicus
tgagactgggttgtttcatccatcc

SEQ ID NO: 609503 - DNA, 25 bp, Rattus norvegicus
tgagactggtacaccctactagaca

SEQ ID NO: 609504 - DNA, 25 bp, Rattus norvegicus
tgagactggtactccctactagaca

SEQ ID NO: 609505 - DNA, 25 bp, Rattus norvegicus
tgagactgtccacccggcatcttca

SEQ ID NO: 609506 - DNA, 25 bp, Rattus norvegicus
tgagactgtccagccggcatcttca

SEQ ID NO: 609507 - DNA, 25 bp, Rattus norvegicus
tgagactgtgttaggccaggcccat

SEQ ID NO: 609508 - DNA, 25 bp, Rattus norvegicus
tgagactgtgtttggccaggcccat

SEQ ID NO: 609509 - DNA, 25 bp, Rattus norvegicus
tgagactgttgtcaaaactggaact

SEQ ID NO: 609510 - DNA, 25 bp, Rattus norvegicus
tgagactgttgtgaaaactggaact

SEQ ID NO: 609511 - DNA, 25 bp, Rattus norvegicus
tgagacttaaccaggcgtggccgtt

SEQ ID NO: 609512 - DNA, 25 bp, Rattus norvegicus
tgagacttaacctggcgtggccgtt

SEQ ID NO: 609513 - DNA, 25 bp, Rattus norvegicus
tgagacttccttctgacagtcacag

SEQ ID NO: 609514 - DNA, 25 bp, Rattus norvegicus
tgagacttccttgtgacagtcacag

SEQ ID NO: 609515 - DNA, 25 bp, Rattus norvegicus
tgagacttcgtacatccgggtgtat

SEQ ID NO: 609516 - DNA, 25 bp, Rattus norvegicus
tgagacttcgtagatccgggtgtat

SEQ ID NO: 609517 - DNA, 25 bp, Rattus norvegicus
tgagacttcgttcagactagcccac

SEQ ID NO: 609518 - DNA, 25 bp, Rattus norvegicus
tgagacttcgttgagactagcccac

SEQ ID NO: 609519 - DNA, 25 bp, Rattus norvegicus
tgagacttctaacaccttggacaac

SEQ ID NO: 609520 - DNA, 25 bp, Rattus norvegicus
tgagacttctaagaccttggacaac

SEQ ID NO: 609521 - DNA, 25 bp, Rattus norvegicus
tgagacttctggaccctgagacatc

SEQ ID NO: 609522 - DNA, 25 bp, Rattus norvegicus
tgagacttctggtccctgagacatc

SEQ ID NO: 609523 - DNA, 25 bp, Rattus norvegicus
tgagacttgacaccatcagcttttc

SEQ ID NO: 609524 - DNA, 25 bp, Rattus norvegicus
tgagacttgacagcatcagcttttc

SEQ ID NO: 609525 - DNA, 25 bp, Rattus norvegicus
tgagacttgactaccaagcctgttt

SEQ ID NO: 609526 - DNA, 25 bp, Rattus norvegicus
tgagacttgacttccaagcctgttt

SEQ ID NO: 609527 - DNA, 25 bp, Rattus norvegicus
tgagactttaacagttgtatataat

SEQ ID NO: 609528 - DNA, 25 bp, Rattus norvegicus
tgagactttaactgttgtatataat

SEQ ID NO: 609529 - DNA, 25 bp, Rattus norvegicus
tgagactttagtatccatggagacc

SEQ ID NO: 609530 - DNA, 25 bp, Rattus norvegicus
tgagactttagtttccatggagacc

SEQ ID NO: 609531 - DNA, 25 bp, Rattus norvegicus
tgagactttctacaacacctccatt

SEQ ID NO: 609532 - DNA, 25 bp, Rattus norvegicus
tgagactttctagaacacctccatt

SEQ ID NO: 609533 - DNA, 25 bp, Rattus norvegicus
tgagactttgtcacttacaagaaag

SEQ ID NO: 609534 - DNA, 25 bp, Rattus norvegicus
tgagactttgtctcttacaagaaag

SEQ ID NO: 609535 - DNA, 25 bp, Rattus norvegicus
tgagactttttcctctttccaggga

SEQ ID NO: 609536 - DNA, 25 bp, Rattus norvegicus
tgagactttttcgtctttccaggga

SEQ ID NO: 609537 - DNA, 25 bp, Rattus norvegicus
tgagagaaacatctgccttccatct

SEQ ID NO: 609538 - DNA, 25 bp, Rattus norvegicus
tgagagaaacatgtgccttccatct

SEQ ID NO: 609539 - DNA, 25 bp, Rattus norvegicus
tgagagaaccaaccctctgccagag

SEQ ID NO: 609540 - DNA, 25 bp, Rattus norvegicus
tgagagaaccaagcctctgccagag

SEQ ID NO: 609541 - DNA, 25 bp, Rattus norvegicus
tgagagaagctactgccacctcttc

SEQ ID NO: 609542 - DNA, 25 bp, Rattus norvegicus
tgagagaagctagtgccacctcttc

SEQ ID NO: 609543 - DNA, 25 bp, Rattus norvegicus
tgagagaatcccatgagcacctgcg

SEQ ID NO: 609544 - DNA, 25 bp, Rattus norvegicus
tgagagaatcccttgagcacctgcg

SEQ ID NO: 609545 - DNA, 25 bp, Rattus norvegicus
tgagagaattagcaccttcggccct

SEQ ID NO: 609546 - DNA, 25 bp, Rattus norvegicus
tgagagaattaggaccttcggccct

SEQ ID NO: 609547 - DNA, 25 bp, Rattus norvegicus
tgagagacaggaacttaggtagccc

SEQ ID NO: 609548 - DNA, 25 bp, Rattus norvegicus
tgagagacaggatcttaggtagccc

SEQ ID NO: 609549 - DNA, 25 bp, Rattus norvegicus
tgagagacatggacagcctgctgct

SEQ ID NO: 609550 - DNA, 25 bp, Rattus norvegicus
tgagagacatggtcagcctgctgct

SEQ ID NO: 609551 - DNA, 25 bp, Rattus norvegicus
tgagagactccgctgacctctgcat

SEQ ID NO: 609552 - DNA, 25 bp, Rattus norvegicus
tgagagactccggtgacctctgcat

SEQ ID NO: 609553 - DNA, 25 bp, Rattus norvegicus
tgagagactgacaatccggctacat

SEQ ID NO: 609554 - DNA, 25 bp, Rattus norvegicus
tgagagactgactatccggctacat

SEQ ID NO: 609555 - DNA, 25 bp, Rattus norvegicus
tgagagacttcacacactatggcct

SEQ ID NO: 609556 - DNA, 25 bp, Rattus norvegicus
tgagagacttcagacactatggcct

SEQ ID NO: 609557 - DNA, 25 bp, Rattus norvegicus
tgagagacttgcaggcctaggacct

SEQ ID NO: 609558 - DNA, 25 bp, Rattus norvegicus
tgagagacttgctggcctaggacct

SEQ ID NO: 609559 - DNA, 25 bp, Rattus norvegicus
tgagagagcattccttcccagtgta

SEQ ID NO: 609560 - DNA, 25 bp, Rattus norvegicus
tgagagagcattgcttcccagtgta

SEQ ID NO: 609561 - DNA, 25 bp, Rattus norvegicus
tgagagagccggaactcgccaggac

SEQ ID NO: 609562 - DNA, 25 bp, Rattus norvegicus
tgagagagccggtactcgccaggac

SEQ ID NO: 609563 - DNA, 25 bp, Rattus norvegicus
tgagagagcctcagcgtacaacaac

SEQ ID NO: 609564 - DNA, 25 bp, Rattus norvegicus
tgagagagcctccatgcagtcctgt

SEQ ID NO: 609565 - DNA, 25 bp, Rattus norvegicus
tgagagagcctcgatgcagtcctgt

SEQ ID NO: 609566 - DNA, 25 bp, Rattus norvegicus
tgagagagcctctgcgtacaacaac

SEQ ID NO: 609567 - DNA, 25 bp, Rattus norvegicus
tgagagagctcgagcagaggccctg

SEQ ID NO: 609568 - DNA, 25 bp, Rattus norvegicus
tgagagagctcgtgcagaggccctg

SEQ ID NO: 609569 - DNA, 25 bp, Rattus norvegicus
tgagagagggagatcccggcctcac

SEQ ID NO: 609570 - DNA, 25 bp, Rattus norvegicus
tgagagagggagttcccggcctcac

SEQ ID NO: 609571 - DNA, 25 bp, Rattus norvegicus
tgagagaggtttccttcaagttcaa

SEQ ID NO: 609572 - DNA, 25 bp, Rattus norvegicus
tgagagaggtttgcttcaagttcaa

SEQ ID NO: 609573 - DNA, 25 bp, Rattus norvegicus
tgagagagtcaacccagaaccgtcg

SEQ ID NO: 609574 - DNA, 25 bp, Rattus norvegicus
tgagagagtcaagccagaaccgtcg

SEQ ID NO: 609575 - DNA, 25 bp, Rattus norvegicus
tgagagatcatcatactatgcacaa

SEQ ID NO: 609576 - DNA, 25 bp, Rattus norvegicus
tgagagatcatcttactatgcacaa

SEQ ID NO: 609577 - DNA, 25 bp, Rattus norvegicus
tgagagatggcccagcacccgtgtc

SEQ ID NO: 609578 - DNA, 25 bp, Rattus norvegicus
tgagagatggccgagcacccgtgtc

SEQ ID NO: 609579 - DNA, 25 bp, Rattus norvegicus
tgagagatgtccattcaacttggga

SEQ ID NO: 609580 - DNA, 25 bp, Rattus norvegicus
tgagagatgtcctttcaacttggga

SEQ ID NO: 609581 - DNA, 25 bp, Rattus norvegicus
tgagagcaagcaccctaagactcca

SEQ ID NO: 609582 - DNA, 25 bp, Rattus norvegicus
tgagagcaagcagcctaagactcca

SEQ ID NO: 609583 - DNA, 25 bp, Rattus norvegicus
tgagagcaagctcccgggtatcctg

SEQ ID NO: 609584 - DNA, 25 bp, Rattus norvegicus
tgagagcaagctgccgggtatcctg

SEQ ID NO: 609585 - DNA, 25 bp, Rattus norvegicus
tgagagcaagtactggcaagaccat

SEQ ID NO: 609586 - DNA, 25 bp, Rattus norvegicus
tgagagcaagtagtggcaagaccat

SEQ ID NO: 609587 - DNA, 25 bp, Rattus norvegicus
tgagagcaatatcgtccgcactata

SEQ ID NO: 609588 - DNA, 25 bp, Rattus norvegicus
tgagagcaatatggtccgcactata

SEQ ID NO: 609589 - DNA, 25 bp, Rattus norvegicus
tgagagcacacaccgtgcacctgga

SEQ ID NO: 609590 - DNA, 25 bp, Rattus norvegicus
tgagagcacacagcgtgcacctgga

SEQ ID NO: 609591 - DNA, 25 bp, Rattus norvegicus
tgagagcacagaccacacgctgtcc

SEQ ID NO: 609592 - DNA, 25 bp, Rattus norvegicus
tgagagcacagagcacacgctgtcc

SEQ ID NO: 609593 - DNA, 25 bp, Rattus norvegicus
tgagagcacctcatcaggcaccctt

SEQ ID NO: 609594 - DNA, 25 bp, Rattus norvegicus
tgagagcacctcttcaggcaccctt

SEQ ID NO: 609595 - DNA, 25 bp, Rattus norvegicus
tgagagcagaatacaccggctggct

SEQ ID NO: 609596 - DNA, 25 bp, Rattus norvegicus
tgagagcagaattcaccggctggct

SEQ ID NO: 609597 - DNA, 25 bp, Rattus norvegicus
tgagagcagccacttcctattgttc

SEQ ID NO: 609598 - DNA, 25 bp, Rattus norvegicus
tgagagcagccagttcctattgttc

SEQ ID NO: 609599 - DNA, 25 bp, Rattus norvegicus
tgagagcagctgagctacgcaacca

SEQ ID NO: 609600 - DNA, 25 bp, Rattus norvegicus
tgagagcagctgtgctacgcaacca

SEQ ID NO: 609601 - DNA, 25 bp, Rattus norvegicus
tgagagcaggcaattcccagaggaa

SEQ ID NO: 609602 - DNA, 25 bp, Rattus norvegicus
tgagagcaggcatttcccagaggaa

SEQ ID NO: 609603 - DNA, 25 bp, Rattus norvegicus
tgagagcatctcactgacctctgag

SEQ ID NO: 609604 - DNA, 25 bp, Rattus norvegicus
tgagagcatctctctgacctctgag

SEQ ID NO: 609605 - DNA, 25 bp, Rattus norvegicus
tgagagcatggacccaaggaccctt

SEQ ID NO: 609606 - DNA, 25 bp, Rattus norvegicus
tgagagcatggagccaaggaccctt

SEQ ID NO: 609607 - DNA, 25 bp, Rattus norvegicus
tgagagccaactacagcccttgagg

SEQ ID NO: 609608 - DNA, 25 bp, Rattus norvegicus
tgagagccaacttcagcccttgagg

SEQ ID NO: 609609 - DNA, 25 bp, Rattus norvegicus
tgagagccacggcaccctggaatac

SEQ ID NO: 609610 - DNA, 25 bp, Rattus norvegicus
tgagagccacgggaccctggaatac

SEQ ID NO: 609611 - DNA, 25 bp, Rattus norvegicus
tgagagccagaacttttgccttccc

SEQ ID NO: 609612 - DNA, 25 bp, Rattus norvegicus
tgagagccagaagttttgccttccc

SEQ ID NO: 609613 - DNA, 25 bp, Rattus norvegicus
tgagagccagagacaacagccgggt

SEQ ID NO: 609614 - DNA, 25 bp, Rattus norvegicus
tgagagccagagtcaacagccgggt

SEQ ID NO: 609615 - DNA, 25 bp, Rattus norvegicus
tgagagccaggactgtggccttcca

SEQ ID NO: 609616 - DNA, 25 bp, Rattus norvegicus
tgagagccaggagtgtggccttcca

SEQ ID NO: 609617 - DNA, 25 bp, Rattus norvegicus
tgagagccaggtctgttcagccaat

SEQ ID NO: 609618 - DNA, 25 bp, Rattus norvegicus
tgagagccaggtgtgttcagccaat

SEQ ID NO: 609619 - DNA, 25 bp, Rattus norvegicus
tgagagccagttctcatagcccagc

SEQ ID NO: 609620 - DNA, 25 bp, Rattus norvegicus
tgagagccagttgtcatagcccagc

SEQ ID NO: 609621 - DNA, 25 bp, Rattus norvegicus
tgagagccatatatccttggactga

SEQ ID NO: 609622 - DNA, 25 bp, Rattus norvegicus
tgagagccatatttccttggactga

SEQ ID NO: 609623 - DNA, 25 bp, Rattus norvegicus
tgagagccatttaaaactgcactgc

SEQ ID NO: 609624 - DNA, 25 bp, Rattus norvegicus
tgagagccattttaaactgcactgc

SEQ ID NO: 609625 - DNA, 25 bp, Rattus norvegicus
tgagagcccgtcatgctaaataaac

SEQ ID NO: 609626 - DNA, 25 bp, Rattus norvegicus
tgagagcccgtcttgctaaataaac

SEQ ID NO: 609627 - DNA, 25 bp, Rattus norvegicus
tgagagccctgaatgctgggaccat

SEQ ID NO: 609628 - DNA, 25 bp, Rattus norvegicus
tgagagccctgattgctgggaccat

SEQ ID NO: 609629 - DNA, 25 bp, Rattus norvegicus
tgagagcccttcactttctgacaca

SEQ ID NO: 609630 - DNA, 25 bp, Rattus norvegicus
tgagagcccttctctttctgacaca

SEQ ID NO: 609631 - DNA, 25 bp, Rattus norvegicus
tgagagccgcgcacacctggagccg

SEQ ID NO: 609632 - DNA, 25 bp, Rattus norvegicus
tgagagccgcgctcacctggagccg

SEQ ID NO: 609633 - DNA, 25 bp, Rattus norvegicus
tgagagcctcctcaagtaacttaac

SEQ ID NO: 609634 - DNA, 25 bp, Rattus norvegicus
tgagagcctcctgaagtaacttaac

SEQ ID NO: 609635 - DNA, 25 bp, Rattus norvegicus
tgagagcctgacagtgcttgctgtt

SEQ ID NO: 609636 - DNA, 25 bp, Rattus norvegicus
tgagagcctgactgtgcttgctgtt

SEQ ID NO: 609637 - DNA, 25 bp, Rattus norvegicus
tgagagcctggcagtcattctagac

SEQ ID NO: 609638 - DNA, 25 bp, Rattus norvegicus
tgagagcctggctgtcattctagac

SEQ ID NO: 609639 - DNA, 25 bp, Rattus norvegicus
tgagagccttcacggccgcagcaag

SEQ ID NO: 609640 - DNA, 25 bp, Rattus norvegicus
tgagagccttcagggccgcagcaag

SEQ ID NO: 609641 - DNA, 25 bp, Rattus norvegicus
tgagagccttgtcctgcagattgtc

SEQ ID NO: 609642 - DNA, 25 bp, Rattus norvegicus
tgagagccttgtgctgcagattgtc

SEQ ID NO: 609643 - DNA, 25 bp, Rattus norvegicus
tgagagcgtccaacggcaagtttgt

SEQ ID NO: 609644 - DNA, 25 bp, Rattus norvegicus
tgagagcgtccatcggcaagtttgt

SEQ ID NO: 609645 - DNA, 25 bp, Rattus norvegicus
tgagagctatatcgcctgctccctc

SEQ ID NO: 609646 - DNA, 25 bp, Rattus norvegicus
tgagagctatatggcctgctccctc

SEQ ID NO: 609647 - DNA, 25 bp, Rattus norvegicus
tgagagctatctcaacaagtacctg

SEQ ID NO: 609648 - DNA, 25 bp, Rattus norvegicus
tgagagctatctgaacaagtacctg

SEQ ID NO: 609649 - DNA, 25 bp, Rattus norvegicus
tgagagctccaaaacactttcttcc

SEQ ID NO: 609650 - DNA, 25 bp, Rattus norvegicus
tgagagctccaatacactttcttcc

SEQ ID NO: 609651 - DNA, 25 bp, Rattus norvegicus
tgagagctcccaaggctgtgtagga

SEQ ID NO: 609652 - DNA, 25 bp, Rattus norvegicus
tgagagctcccatggctgtgtagga

SEQ ID NO: 609653 - DNA, 25 bp, Rattus norvegicus
tgagagctccgacgacaatctgttc

SEQ ID NO: 609654 - DNA, 25 bp, Rattus norvegicus
tgagagctccgaggacaatctgttc

SEQ ID NO: 609655 - DNA, 25 bp, Rattus norvegicus
tgagagctccttccagaagctggcg

SEQ ID NO: 609656 - DNA, 25 bp, Rattus norvegicus
tgagagctccttgcagaagctggcg

SEQ ID NO: 609657 - DNA, 25 bp, Rattus norvegicus
tgagagctcgccaggtcacctgtac

SEQ ID NO: 609658 - DNA, 25 bp, Rattus norvegicus
tgagagctcgcctggtcacctgtac

SEQ ID NO: 609659 - DNA, 25 bp, Rattus norvegicus
tgagagctctctccaacagcataca

SEQ ID NO: 609660 - DNA, 25 bp, Rattus norvegicus
tgagagctctctgcaacagcataca

SEQ ID NO: 609661 - DNA, 25 bp, Rattus norvegicus
tgagagctcttgatcctagtcacta

SEQ ID NO: 609662 - DNA, 25 bp, Rattus norvegicus
tgagagctcttgttcctagtcacta

SEQ ID NO: 609663 - DNA, 25 bp, Rattus norvegicus
tgagagctgaaaacaccggcctgtg

SEQ ID NO: 609664 - DNA, 25 bp, Rattus norvegicus
tgagagctgaaatcaccggcctgtg

SEQ ID NO: 609665 - DNA, 25 bp, Rattus norvegicus
tgagagctgcagaatccctgttagc

SEQ ID NO: 609666 - DNA, 25 bp, Rattus norvegicus
tgagagctgcagtatccctgttagc

SEQ ID NO: 609667 - DNA, 25 bp, Rattus norvegicus
tgagagctgcggcacacctgttaat

SEQ ID NO: 609668 - DNA, 25 bp, Rattus norvegicus
tgagagctgcgggacacctgttaat

SEQ ID NO: 609669 - DNA, 25 bp, Rattus norvegicus
tgagagctttgaatcctccactctg

SEQ ID NO: 609670 - DNA, 25 bp, Rattus norvegicus
tgagagctttgattcctccactctg

SEQ ID NO: 609671 - DNA, 25 bp, Rattus norvegicus
tgagaggaaacactttctttcaacc

SEQ ID NO: 609672 - DNA, 25 bp, Rattus norvegicus
tgagaggaaacagtttctttcaacc

SEQ ID NO: 609673 - DNA, 25 bp, Rattus norvegicus
tgagaggaccatcaccatcagccac

SEQ ID NO: 609674 - DNA, 25 bp, Rattus norvegicus
tgagaggaccatgaccatcagccac

SEQ ID NO: 609675 - DNA, 25 bp, Rattus norvegicus
tgagaggactacagcccatgccatg

SEQ ID NO: 609676 - DNA, 25 bp, Rattus norvegicus
tgagaggactactgcccatgccatg

SEQ ID NO: 609677 - DNA, 25 bp, Rattus norvegicus
tgagaggactcgacaggacccagac

SEQ ID NO: 609678 - DNA, 25 bp, Rattus norvegicus
tgagaggactcgtcaggacccagac

SEQ ID NO: 609679 - DNA, 25 bp, Rattus norvegicus
tgagaggagaagagcccacctcttg

SEQ ID NO: 609680 - DNA, 25 bp, Rattus norvegicus
tgagaggagaagtgcccacctcttg

SEQ ID NO: 609681 - DNA, 25 bp, Rattus norvegicus
tgagaggagttaatccctgcacccc

SEQ ID NO: 609682 - DNA, 25 bp, Rattus norvegicus
tgagaggagttattccctgcacccc

SEQ ID NO: 609683 - DNA, 25 bp, Rattus norvegicus
tgagaggcaacaactgaagcagtct

SEQ ID NO: 609684 - DNA, 25 bp, Rattus norvegicus
tgagaggcaacatctgaagcagtct

SEQ ID NO: 609685 - DNA, 25 bp, Rattus norvegicus
tgagaggccacacggagacctccat

SEQ ID NO: 609686 - DNA, 25 bp, Rattus norvegicus
tgagaggccacagggagacctccat

SEQ ID NO: 609687 - DNA, 25 bp, Rattus norvegicus
tgagaggccaccctgagtcccatct

SEQ ID NO: 609688 - DNA, 25 bp, Rattus norvegicus
tgagaggccaccgtgagtcccatct

SEQ ID NO: 609689 - DNA, 25 bp, Rattus norvegicus
tgagaggccctgacatctgcagtga

SEQ ID NO: 609690 - DNA, 25 bp, Rattus norvegicus
tgagaggccctgtcatctgcagtga

SEQ ID NO: 609691 - DNA, 25 bp, Rattus norvegicus
tgagaggcctgacctggcagcatct

SEQ ID NO: 609692 - DNA, 25 bp, Rattus norvegicus
tgagaggcctgagctggcagcatct

SEQ ID NO: 609693 - DNA, 25 bp, Rattus norvegicus
tgagaggcctggcatagccctgtcc

SEQ ID NO: 609694 - DNA, 25 bp, Rattus norvegicus
tgagaggcctgggatagccctgtcc

SEQ ID NO: 609695 - DNA, 25 bp, Rattus norvegicus
tgagaggcgcagagctccaactctt

SEQ ID NO: 609696 - DNA, 25 bp, Rattus norvegicus
tgagaggcgcagtgctccaactctt

SEQ ID NO: 609697 - DNA, 25 bp, Rattus norvegicus
tgagaggctacccatgctgtacacc

SEQ ID NO: 609698 - DNA, 25 bp, Rattus norvegicus
tgagaggctaccgatgctgtacacc

SEQ ID NO: 609699 - DNA, 25 bp, Rattus norvegicus
tgagaggctcacatgtatttggaac

SEQ ID NO: 609700 - DNA, 25 bp, Rattus norvegicus
tgagaggctcacttgtatttggaac

SEQ ID NO: 609701 - DNA, 25 bp, Rattus norvegicus
tgagagggatacagtccggtcccac

SEQ ID NO: 609702 - DNA, 25 bp, Rattus norvegicus
tgagagggatactgtccggtcccac

SEQ ID NO: 609703 - DNA, 25 bp, Rattus norvegicus
tgagagggccagacacttccactga

SEQ ID NO: 609704 - DNA, 25 bp, Rattus norvegicus
tgagagggccagtcacttccactga

SEQ ID NO: 609705 - DNA, 25 bp, Rattus norvegicus
tgagagggcgaaagcggtccatggt

SEQ ID NO: 609706 - DNA, 25 bp, Rattus norvegicus
tgagagggcgaatgcggtccatggt

SEQ ID NO: 609707 - DNA, 25 bp, Rattus norvegicus
tgagagggttcacatgctcctgtct

SEQ ID NO: 609708 - DNA, 25 bp, Rattus norvegicus
tgagagggttcagatgctcctgtct

SEQ ID NO: 609709 - DNA, 25 bp, Rattus norvegicus
tgagaggtcaatcccaggtatccct

SEQ ID NO: 609710 - DNA, 25 bp, Rattus norvegicus
tgagaggtcaatgccaggtatccct

SEQ ID NO: 609711 - DNA, 25 bp, Rattus norvegicus
tgagaggtcgcccacttttgttttt

SEQ ID NO: 609712 - DNA, 25 bp, Rattus norvegicus
tgagaggtcgccgacttttgttttt

SEQ ID NO: 609713 - DNA, 25 bp, Rattus norvegicus
tgagaggtctatcccagtctggcaa

SEQ ID NO: 609714 - DNA, 25 bp, Rattus norvegicus
tgagaggtctatgccagtctggcaa

SEQ ID NO: 609715 - DNA, 25 bp, Rattus norvegicus
tgagaggtctcactttccatggcgc

SEQ ID NO: 609716 - DNA, 25 bp, Rattus norvegicus
tgagaggtctcagtttccatggcgc

SEQ ID NO: 609717 - DNA, 25 bp, Rattus norvegicus
tgagaggtctgcaggcctttcctac

SEQ ID NO: 609718 - DNA, 25 bp, Rattus norvegicus
tgagaggtctgctggcctttcctac

SEQ ID NO: 609719 - DNA, 25 bp, Rattus norvegicus
tgagaggtcttcagtagccccagta

SEQ ID NO: 609720 - DNA, 25 bp, Rattus norvegicus
tgagaggtcttctgtagccccagta

SEQ ID NO: 609721 - DNA, 25 bp, Rattus norvegicus
tgagaggtgcagcaagttccatact

SEQ ID NO: 609722 - DNA, 25 bp, Rattus norvegicus
tgagaggtgcaggaagttccatact

SEQ ID NO: 609723 - DNA, 25 bp, Rattus norvegicus
tgagaggttctactccggcctgtca

SEQ ID NO: 609724 - DNA, 25 bp, Rattus norvegicus
tgagaggttctagtccggcctgtca

SEQ ID NO: 609725 - DNA, 25 bp, Rattus norvegicus
tgagaggttctgactcgagccacaa

SEQ ID NO: 609726 - DNA, 25 bp, Rattus norvegicus
tgagaggttctgtctcgagccacaa

SEQ ID NO: 609727 - DNA, 25 bp, Rattus norvegicus
tgagaggtttttctaattctagttt

SEQ ID NO: 609728 - DNA, 25 bp, Rattus norvegicus
tgagaggtttttgtaattctagttt

SEQ ID NO: 609729 - DNA, 25 bp, Rattus norvegicus
tgagagtacctgcaagcttggagca

SEQ ID NO: 609730 - DNA, 25 bp, Rattus norvegicus
tgagagtacctggaagcttggagca

SEQ ID NO: 609731 - DNA, 25 bp, Rattus norvegicus
tgagagtcaagtcgatctctatgag

SEQ ID NO: 609732 - DNA, 25 bp, Rattus norvegicus
tgagagtcaagtggatctctatgag

SEQ ID NO: 609733 - DNA, 25 bp, Rattus norvegicus
tgagagtcaccaacagaacagtcag

SEQ ID NO: 609734 - DNA, 25 bp, Rattus norvegicus
tgagagtcaccatcagaacagtcag

SEQ ID NO: 609735 - DNA, 25 bp, Rattus norvegicus
tgagagtcactcagctgcagtccag

SEQ ID NO: 609736 - DNA, 25 bp, Rattus norvegicus
tgagagtcactctgctgcagtccag

SEQ ID NO: 609737 - DNA, 25 bp, Rattus norvegicus
tgagagtcccacaaacactatccat

SEQ ID NO: 609738 - DNA, 25 bp, Rattus norvegicus
tgagagtcccactaacactatccat

SEQ ID NO: 609739 - DNA, 25 bp, Rattus norvegicus
tgagagtccggacaagtcttcgtaa

SEQ ID NO: 609740 - DNA, 25 bp, Rattus norvegicus
tgagagtccggagaagtcttcgtaa

SEQ ID NO: 609741 - DNA, 25 bp, Rattus norvegicus
tgagagtcgcttaaatcatctgcgt

SEQ ID NO: 609742 - DNA, 25 bp, Rattus norvegicus
tgagagtcgctttaatcatctgcgt

SEQ ID NO: 609743 - DNA, 25 bp, Rattus norvegicus
tgagagtctcgtactcttcccgcag

SEQ ID NO: 609744 - DNA, 25 bp, Rattus norvegicus
tgagagtctcgttctcttcccgcag

SEQ ID NO: 609745 - DNA, 25 bp, Rattus norvegicus
tgagagtctcttctcatgcttaaaa

SEQ ID NO: 609746 - DNA, 25 bp, Rattus norvegicus
tgagagtctcttgtcatgcttaaaa

SEQ ID NO: 609747 - DNA, 25 bp, Rattus norvegicus
tgagagtgaccgcaatttcttcctg

SEQ ID NO: 609748 - DNA, 25 bp, Rattus norvegicus
tgagagtgaccggaatttcttcctg

SEQ ID NO: 609749 - DNA, 25 bp, Rattus norvegicus
tgagagtgactcactgcagtcctca

SEQ ID NO: 609750 - DNA, 25 bp, Rattus norvegicus
tgagagtgactctctgcagtcctca

SEQ ID NO: 609751 - DNA, 25 bp, Rattus norvegicus
tgagagtgtcccatggcaactgctt

SEQ ID NO: 609752 - DNA, 25 bp, Rattus norvegicus
tgagagtgtcccttggcaactgctt

SEQ ID NO: 609753 - DNA, 25 bp, Rattus norvegicus
tgagagtgtggcctgcttctcacac

SEQ ID NO: 609754 - DNA, 25 bp, Rattus norvegicus
tgagagtgtggcgtgcttctcacac

SEQ ID NO: 609755 - DNA, 25 bp, Rattus norvegicus
tgagagttcacacactgggcatctt

SEQ ID NO: 609756 - DNA, 25 bp, Rattus norvegicus
tgagagttcacagactgggcatctt

SEQ ID NO: 609757 - DNA, 25 bp, Rattus norvegicus
tgagagttccagctgctaccctgaa

SEQ ID NO: 609758 - DNA, 25 bp, Rattus norvegicus
tgagagttccaggtgctaccctgaa

SEQ ID NO: 609759 - DNA, 25 bp, Rattus norvegicus
tgagagttcgcccagattctgacct

SEQ ID NO: 609760 - DNA, 25 bp, Rattus norvegicus
tgagagttcgccgagattctgacct

SEQ ID NO: 609761 - DNA, 25 bp, Rattus norvegicus
tgagagttctaaatccagccaccca

SEQ ID NO: 609762 - DNA, 25 bp, Rattus norvegicus
tgagagttctaattccagccaccca

SEQ ID NO: 609763 - DNA, 25 bp, Rattus norvegicus
tgagagttcttacccagtgcttact

SEQ ID NO: 609764 - DNA, 25 bp, Rattus norvegicus
tgagagttcttagccagtgcttact

SEQ ID NO: 609765 - DNA, 25 bp, Rattus norvegicus
tgagagtttagaactagccccgccc

SEQ ID NO: 609766 - DNA, 25 bp, Rattus norvegicus
tgagagtttagatctagccccgccc

SEQ ID NO: 609767 - DNA, 25 bp, Rattus norvegicus
tgagagttttacattccttgctgct

SEQ ID NO: 609768 - DNA, 25 bp, Rattus norvegicus
tgagagttttactttccttgctgct

SEQ ID NO: 609769 - DNA, 25 bp, Rattus norvegicus
tgagagttttcaaaacctcaacaag

SEQ ID NO: 609770 - DNA, 25 bp, Rattus norvegicus
tgagagttttcataacctcaacaag

SEQ ID NO: 609771 - DNA, 25 bp, Rattus norvegicus
tgagagttttccattttctgcacca

SEQ ID NO: 609772 - DNA, 25 bp, Rattus norvegicus
tgagagttttcctttttctgcacca

SEQ ID NO: 609773 - DNA, 25 bp, Rattus norvegicus
tgagataaagtcaccctgtgcaccc

SEQ ID NO: 609774 - DNA, 25 bp, Rattus norvegicus
tgagataaagtctccctgtgcaccc

SEQ ID NO: 609775 - DNA, 25 bp, Rattus norvegicus
tgagataacctccattcttgtcact

SEQ ID NO: 609776 - DNA, 25 bp, Rattus norvegicus
tgagataacctcgattcttgtcact

SEQ ID NO: 609777 - DNA, 25 bp, Rattus norvegicus
tgagataaccttagctgtaccctta

SEQ ID NO: 609778 - DNA, 25 bp, Rattus norvegicus
tgagataacctttgctgtaccctta

SEQ ID NO: 609779 - DNA, 25 bp, Rattus norvegicus
tgagataaggccatgctttcgtcaa

SEQ ID NO: 609780 - DNA, 25 bp, Rattus norvegicus
tgagataaggccttgctttcgtcaa

SEQ ID NO: 609781 - DNA, 25 bp, Rattus norvegicus
tgagataatcctcttctccacactc

SEQ ID NO: 609782 - DNA, 25 bp, Rattus norvegicus
tgagataatcctgttctccacactc

SEQ ID NO: 609783 - DNA, 25 bp, Rattus norvegicus
tgagataatcttcctatgtaaccca

SEQ ID NO: 609784 - DNA, 25 bp, Rattus norvegicus
tgagataatcttgctatgtaaccca

SEQ ID NO: 609785 - DNA, 25 bp, Rattus norvegicus
tgagatacaccactgtcttttacat

SEQ ID NO: 609786 - DNA, 25 bp, Rattus norvegicus
tgagatacaccagtgtcttttacat

SEQ ID NO: 609787 - DNA, 25 bp, Rattus norvegicus
tgagatactcagctgaaatcctcag

SEQ ID NO: 609788 - DNA, 25 bp, Rattus norvegicus
tgagatactcaggtgaaatcctcag

SEQ ID NO: 609789 - DNA, 25 bp, Rattus norvegicus
tgagatagccctcagcatttatttt

SEQ ID NO: 609790 - DNA, 25 bp, Rattus norvegicus
tgagatagccctcggcatcggcctg

SEQ ID NO: 609791 - DNA, 25 bp, Rattus norvegicus
tgagatagccctgagcatttatttt

SEQ ID NO: 609792 - DNA, 25 bp, Rattus norvegicus
tgagatagccctgggcatcggcctg

SEQ ID NO: 609793 - DNA, 25 bp, Rattus norvegicus
tgagatagcctgaactccatggtga

SEQ ID NO: 609794 - DNA, 25 bp, Rattus norvegicus
tgagatagcctgtactccatggtga

SEQ ID NO: 609795 - DNA, 25 bp, Rattus norvegicus
tgagatagctgtccacgcccacgtg

SEQ ID NO: 609796 - DNA, 25 bp, Rattus norvegicus
tgagatagctgtgcacgcccacgtg

SEQ ID NO: 609797 - DNA, 25 bp, Rattus norvegicus
tgagatagggtcaggtttttgtaac

SEQ ID NO: 609798 - DNA, 25 bp, Rattus norvegicus
tgagatagggtctggtttttgtaac

SEQ ID NO: 609799 - DNA, 25 bp, Rattus norvegicus
tgagatatcataagccacccaggag

SEQ ID NO: 609800 - DNA, 25 bp, Rattus norvegicus
tgagatatcatatgccacccaggag

SEQ ID NO: 609801 - DNA, 25 bp, Rattus norvegicus
tgagatatccctatagcccgtaaac

SEQ ID NO: 609802 - DNA, 25 bp, Rattus norvegicus
tgagatatccctttagcccgtaaac

SEQ ID NO: 609803 - DNA, 25 bp, Rattus norvegicus
tgagatatgggccttgccccagcat

SEQ ID NO: 609804 - DNA, 25 bp, Rattus norvegicus
tgagatatgggcgttgccccagcat

SEQ ID NO: 609805 - DNA, 25 bp, Rattus norvegicus
tgagatcaaactacttagcccatcg

SEQ ID NO: 609806 - DNA, 25 bp, Rattus norvegicus
tgagatcaaacttcttagcccatcg

SEQ ID NO: 609807 - DNA, 25 bp, Rattus norvegicus
tgagatcaaccaccgtttccttaat

SEQ ID NO: 609808 - DNA, 25 bp, Rattus norvegicus
tgagatcaaccagcgtttccttaat

SEQ ID NO: 609809 - DNA, 25 bp, Rattus norvegicus
tgagatcaatctccacgtcccattt

SEQ ID NO: 609810 - DNA, 25 bp, Rattus norvegicus
tgagatcaatctgcacgtcccattt

SEQ ID NO: 609811 - DNA, 25 bp, Rattus norvegicus
tgagatcaccctccggcacaaagga

SEQ ID NO: 609812 - DNA, 25 bp, Rattus norvegicus
tgagatcaccctgcggcacaaagga

SEQ ID NO: 609813 - DNA, 25 bp, Rattus norvegicus
tgagatcacttcacacatggccagt

SEQ ID NO: 609814 - DNA, 25 bp, Rattus norvegicus
tgagatcacttctcacatggccagt

SEQ ID NO: 609815 - DNA, 25 bp, Rattus norvegicus
tgagatcatcacacagtcgccaagc

SEQ ID NO: 609816 - DNA, 25 bp, Rattus norvegicus
tgagatcatcactcagtcgccaagc

SEQ ID NO: 609817 - DNA, 25 bp, Rattus norvegicus
tgagatcatccgctgtctgcagaac

SEQ ID NO: 609818 - DNA, 25 bp, Rattus norvegicus
tgagatcatccggtgtctgcagaac

SEQ ID NO: 609819 - DNA, 25 bp, Rattus norvegicus
tgagatcatgatccactttccaacc

SEQ ID NO: 609820 - DNA, 25 bp, Rattus norvegicus
tgagatcatgatgcactttccaacc

SEQ ID NO: 609821 - DNA, 25 bp, Rattus norvegicus
tgagatccacctaaggcccataggc

SEQ ID NO: 609822 - DNA, 25 bp, Rattus norvegicus
tgagatccaccttaggcccataggc

SEQ ID NO: 609823 - DNA, 25 bp, Rattus norvegicus
tgagatcccaatactgttctaatct

SEQ ID NO: 609824 - DNA, 25 bp, Rattus norvegicus
tgagatcccaattctgttctaatct

SEQ ID NO: 609825 - DNA, 25 bp, Rattus norvegicus
tgagatccccagagccagtaaggca

SEQ ID NO: 609826 - DNA, 25 bp, Rattus norvegicus
tgagatccccagtgccagtaaggca

SEQ ID NO: 609827 - DNA, 25 bp, Rattus norvegicus
tgagatccctgaagagaccttttca

SEQ ID NO: 609828 - DNA, 25 bp, Rattus norvegicus
tgagatccctgatgagaccttttca

SEQ ID NO: 609829 - DNA, 25 bp, Rattus norvegicus
tgagatcctgagaagttcgctggcc

SEQ ID NO: 609830 - DNA, 25 bp, Rattus norvegicus
tgagatcctgagtagttcgctggcc

SEQ ID NO: 609831 - DNA, 25 bp, Rattus norvegicus
tgagatcctggaagagcagcccagc

SEQ ID NO: 609832 - DNA, 25 bp, Rattus norvegicus
tgagatcctggatgagcagcccagc

SEQ ID NO: 609833 - DNA, 25 bp, Rattus norvegicus
tgagatcctgttcggacagtcagtt

SEQ ID NO: 609834 - DNA, 25 bp, Rattus norvegicus
tgagatcctgttgggacagtcagtt

SEQ ID NO: 609835 - DNA, 25 bp, Rattus norvegicus
tgagatcgagtacgccatggcctac

SEQ ID NO: 609836 - DNA, 25 bp, Rattus norvegicus
tgagatcgagtaggccatggcctac

SEQ ID NO: 609837 - DNA, 25 bp, Rattus norvegicus
tgagatcgggtcacaggctctagct

SEQ ID NO: 609838 - DNA, 25 bp, Rattus norvegicus
tgagatcgggtctcaggctctagct

SEQ ID NO: 609839 - DNA, 25 bp, Rattus norvegicus
tgagatcgtcacactgtccctgata

SEQ ID NO: 609840 - DNA, 25 bp, Rattus norvegicus
tgagatcgtcactctgtccctgata

SEQ ID NO: 609841 - DNA, 25 bp, Rattus norvegicus
tgagatctcatacctcttcataaag

SEQ ID NO: 609842 - DNA, 25 bp, Rattus norvegicus
tgagatctcatagctcttcataaag

SEQ ID NO: 609843 - DNA, 25 bp, Rattus norvegicus
tgagatctctcccttgatttatcag

SEQ ID NO: 609844 - DNA, 25 bp, Rattus norvegicus
tgagatctctccgttgatttatcag

SEQ ID NO: 609845 - DNA, 25 bp, Rattus norvegicus
tgagatctgaagctacagccctgga

SEQ ID NO: 609846 - DNA, 25 bp, Rattus norvegicus
tgagatctgaaggtacagccctgga

SEQ ID NO: 609847 - DNA, 25 bp, Rattus norvegicus
tgagatctggaaccctgtgggactt

SEQ ID NO: 609848 - DNA, 25 bp, Rattus norvegicus
tgagatctggaagcctgtgggactt

SEQ ID NO: 609849 - DNA, 25 bp, Rattus norvegicus
tgagatcttattcccatttgccaac

SEQ ID NO: 609850 - DNA, 25 bp, Rattus norvegicus
tgagatcttattgccatttgccaac

SEQ ID NO: 609851 - DNA, 25 bp, Rattus norvegicus
tgagatcttctacacactgtctcct

SEQ ID NO: 609852 - DNA, 25 bp, Rattus norvegicus
tgagatcttctagacactgtctcct

SEQ ID NO: 609853 - DNA, 25 bp, Rattus norvegicus
tgagatcttctcacccgtgaagctt

SEQ ID NO: 609854 - DNA, 25 bp, Rattus norvegicus
tgagatcttctctcccgtgaagctt

SEQ ID NO: 609855 - DNA, 25 bp, Rattus norvegicus
tgagatctttctatgtcaacctccc

SEQ ID NO: 609856 - DNA, 25 bp, Rattus norvegicus
tgagatctttctttgtcaacctccc

SEQ ID NO: 609857 - DNA, 25 bp, Rattus norvegicus
tgagatctttgtagtacgcactccc

SEQ ID NO: 609858 - DNA, 25 bp, Rattus norvegicus
tgagatctttgttgtacgcactccc

SEQ ID NO: 609859 - DNA, 25 bp, Rattus norvegicus
tgagatgacagactcaccctacttc

SEQ ID NO: 609860 - DNA, 25 bp, Rattus norvegicus
tgagatgacagagtcaccctacttc

SEQ ID NO: 609861 - DNA, 25 bp, Rattus norvegicus
tgagatgacattacgttttttacac

SEQ ID NO: 609862 - DNA, 25 bp, Rattus norvegicus
tgagatgacatttcgttttttacac

SEQ ID NO: 609863 - DNA, 25 bp, Rattus norvegicus
tgagatgatctaaccctgggtgtgg

SEQ ID NO: 609864 - DNA, 25 bp, Rattus norvegicus
tgagatgatctatccctgggtgtgg

SEQ ID NO: 609865 - DNA, 25 bp, Rattus norvegicus
tgagatgcagcaacaggcccagaag

SEQ ID NO: 609866 - DNA, 25 bp, Rattus norvegicus
tgagatgcagcatcaggcccagaag

SEQ ID NO: 609867 - DNA, 25 bp, Rattus norvegicus
tgagatgcctcacgccctgtgttaa

SEQ ID NO: 609868 - DNA, 25 bp, Rattus norvegicus
tgagatgcctcaggccctgtgttaa

SEQ ID NO: 609869 - DNA, 25 bp, Rattus norvegicus
tgagatgcgggcaaactcggcgttt

SEQ ID NO: 609870 - DNA, 25 bp, Rattus norvegicus
tgagatgcgggctaactcggcgttt

SEQ ID NO: 609871 - DNA, 25 bp, Rattus norvegicus
tgagatgctccacaatctgacccca

SEQ ID NO: 609872 - DNA, 25 bp, Rattus norvegicus
tgagatgctccagaatctgacccca

SEQ ID NO: 609873 - DNA, 25 bp, Rattus norvegicus
tgagatgctcctcgtggctggacct

SEQ ID NO: 609874 - DNA, 25 bp, Rattus norvegicus
tgagatgctcctggtggctggacct

SEQ ID NO: 609875 - DNA, 25 bp, Rattus norvegicus
tgagatgctctaagcaccctaggac

SEQ ID NO: 609876 - DNA, 25 bp, Rattus norvegicus
tgagatgctctatgcaccctaggac

SEQ ID NO: 609877 - DNA, 25 bp, Rattus norvegicus
tgagatgctgaaatccccagggaat

SEQ ID NO: 609878 - DNA, 25 bp, Rattus norvegicus
tgagatgctgaattccccagggaat

SEQ ID NO: 609879 - DNA, 25 bp, Rattus norvegicus
tgagatgctgatcttactccccatt

SEQ ID NO: 609880 - DNA, 25 bp, Rattus norvegicus
tgagatgctgatgttactccccatt

SEQ ID NO: 609881 - DNA, 25 bp, Rattus norvegicus
tgagatggactcagctcggagcacc

SEQ ID NO: 609882 - DNA, 25 bp, Rattus norvegicus
tgagatggactctgctcggagcacc

SEQ ID NO: 609883 - DNA, 25 bp, Rattus norvegicus
tgagatggccccacagctgagccct

SEQ ID NO: 609884 - DNA, 25 bp, Rattus norvegicus
tgagatggcccccagagttgcctag

SEQ ID NO: 609885 - DNA, 25 bp, Rattus norvegicus
tgagatggccccgagagttgcctag

SEQ ID NO: 609886 - DNA, 25 bp, Rattus norvegicus
tgagatggcccctcagctgagccct

SEQ ID NO: 609887 - DNA, 25 bp, Rattus norvegicus
tgagatggccgcatacctgaaagat

SEQ ID NO: 609888 - DNA, 25 bp, Rattus norvegicus
tgagatggccgcttacctgaaagat

SEQ ID NO: 609889 - DNA, 25 bp, Rattus norvegicus
tgagatgggccactcttgcaacacc

SEQ ID NO: 609890 - DNA, 25 bp, Rattus norvegicus
tgagatgggccagtcttgcaacacc

SEQ ID NO: 609891 - DNA, 25 bp, Rattus norvegicus
tgagatggtgcacaacaatttgagc

SEQ ID NO: 609892 - DNA, 25 bp, Rattus norvegicus
tgagatggtgcagaacaatttgagc

SEQ ID NO: 609893 - DNA, 25 bp, Rattus norvegicus
tgagatggttcacttgctgccaagc

SEQ ID NO: 609894 - DNA, 25 bp, Rattus norvegicus
tgagatggttcagttgctgccaagc

SEQ ID NO: 609895 - DNA, 25 bp, Rattus norvegicus
tgagatgtgcttcattgtccttgcc

SEQ ID NO: 609896 - DNA, 25 bp, Rattus norvegicus
tgagatgtgcttgattgtccttgcc

SEQ ID NO: 609897 - DNA, 25 bp, Rattus norvegicus
tgagatgtttcacaccctctaaagt

SEQ ID NO: 609898 - DNA, 25 bp, Rattus norvegicus
tgagatgtttcagaccctctaaagt

SEQ ID NO: 609899 - DNA, 25 bp, Rattus norvegicus
tgagattaacgtcccctgagtcctg

SEQ ID NO: 609900 - DNA, 25 bp, Rattus norvegicus
tgagattaacgtgccctgagtcctg

SEQ ID NO: 609901 - DNA, 25 bp, Rattus norvegicus
tgagattacagtcatccaccaccat

SEQ ID NO: 609902 - DNA, 25 bp, Rattus norvegicus
tgagattacagtgatccaccaccat

SEQ ID NO: 609903 - DNA, 25 bp, Rattus norvegicus
tgagattaccttctctttccattca

SEQ ID NO: 609904 - DNA, 25 bp, Rattus norvegicus
tgagattaccttgtctttccattca

SEQ ID NO: 609905 - DNA, 25 bp, Rattus norvegicus
tgagattaggtcatccctcctttag

SEQ ID NO: 609906 - DNA, 25 bp, Rattus norvegicus
tgagattaggtcttccctcctttag

SEQ ID NO: 609907 - DNA, 25 bp, Rattus norvegicus
tgagattcaaagacccacacacgca

SEQ ID NO: 609908 - DNA, 25 bp, Rattus norvegicus
tgagattcaaagtcccacacacgca

SEQ ID NO: 609909 - DNA, 25 bp, Rattus norvegicus
tgagattccagtcttgccagtccca

SEQ ID NO: 609910 - DNA, 25 bp, Rattus norvegicus
tgagattccagtgttgccagtccca

SEQ ID NO: 609911 - DNA, 25 bp, Rattus norvegicus
tgagattccatcatgtctgtcagaa

SEQ ID NO: 609912 - DNA, 25 bp, Rattus norvegicus
tgagattccatcttgtctgtcagaa

SEQ ID NO: 609913 - DNA, 25 bp, Rattus norvegicus
tgagattcccagcatccatttgaca

SEQ ID NO: 609914 - DNA, 25 bp, Rattus norvegicus
tgagattcccaggatccatttgaca

SEQ ID NO: 609915 - DNA, 25 bp, Rattus norvegicus
tgagattcctccaggcactaacact

SEQ ID NO: 609916 - DNA, 25 bp, Rattus norvegicus
tgagattcctccagggttaactccc

SEQ ID NO: 609917 - DNA, 25 bp, Rattus norvegicus
tgagattcctcctggcactaacact

SEQ ID NO: 609918 - DNA, 25 bp, Rattus norvegicus
tgagattcctcctgggttaactccc

SEQ ID NO: 609919 - DNA, 25 bp, Rattus norvegicus
tgagattctaacagtgagcccacca

SEQ ID NO: 609920 - DNA, 25 bp, Rattus norvegicus
tgagattctaactgtgagcccacca

SEQ ID NO: 609921 - DNA, 25 bp, Rattus norvegicus
tgagattctaccatcccagtaagat

SEQ ID NO: 609922 - DNA, 25 bp, Rattus norvegicus
tgagattctaccttcccagtaagat

SEQ ID NO: 609923 - DNA, 25 bp, Rattus norvegicus
tgagattctcacatgcctttagttg

SEQ ID NO: 609924 - DNA, 25 bp, Rattus norvegicus
tgagattctcacttgcctttagttg

SEQ ID NO: 609925 - DNA, 25 bp, Rattus norvegicus
tgagattctccactttcaccattga

SEQ ID NO: 609926 - DNA, 25 bp, Rattus norvegicus
tgagattctccagtttcaccattga

SEQ ID NO: 609927 - DNA, 25 bp, Rattus norvegicus
tgagattctcccaagagtccgagtc

SEQ ID NO: 609928 - DNA, 25 bp, Rattus norvegicus
tgagattctccctagagtccgagtc

SEQ ID NO: 609929 - DNA, 25 bp, Rattus norvegicus
tgagattctcctctgcttgctgttg

SEQ ID NO: 609930 - DNA, 25 bp, Rattus norvegicus
tgagattctcctgtgcttgctgttg

SEQ ID NO: 609931 - DNA, 25 bp, Rattus norvegicus
tgagattctgtccaggatgctcggc

SEQ ID NO: 609932 - DNA, 25 bp, Rattus norvegicus
tgagattctgtcgaggatgctcggc

SEQ ID NO: 609933 - DNA, 25 bp, Rattus norvegicus
tgagattcttgaagatcccagcact

SEQ ID NO: 609934 - DNA, 25 bp, Rattus norvegicus
tgagattcttgatgatcccagcact

SEQ ID NO: 609935 - DNA, 25 bp, Rattus norvegicus
tgagattctttcctgacttccttga

SEQ ID NO: 609936 - DNA, 25 bp, Rattus norvegicus
tgagattctttcgtgacttccttga

SEQ ID NO: 609937 - DNA, 25 bp, Rattus norvegicus
tgagattgaggtcatgtctgagcca

SEQ ID NO: 609938 - DNA, 25 bp, Rattus norvegicus
tgagattgaggtgatgtctgagcca

SEQ ID NO: 609939 - DNA, 25 bp, Rattus norvegicus
tgagattgatggagtctccacccat

SEQ ID NO: 609940 - DNA, 25 bp, Rattus norvegicus
tgagattgatggtgtctccacccat

SEQ ID NO: 609941 - DNA, 25 bp, Rattus norvegicus
tgagattgcagaactgacccagaag

SEQ ID NO: 609942 - DNA, 25 bp, Rattus norvegicus
tgagattgcagatctgacccagaag

SEQ ID NO: 609943 - DNA, 25 bp, Rattus norvegicus
tgagattgcataagttttcttcaga

SEQ ID NO: 609944 - DNA, 25 bp, Rattus norvegicus
tgagattgcatatgttttcttcaga

SEQ ID NO: 609945 - DNA, 25 bp, Rattus norvegicus
tgagattgcccacgttccgcttgca

SEQ ID NO: 609946 - DNA, 25 bp, Rattus norvegicus
tgagattgcccaggttccgcttgca

SEQ ID NO: 609947 - DNA, 25 bp, Rattus norvegicus
tgagattggcttattccggaaccgc

SEQ ID NO: 609948 - DNA, 25 bp, Rattus norvegicus
tgagattggctttttccggaaccgc

SEQ ID NO: 609949 - DNA, 25 bp, Rattus norvegicus
tgagattgtaccagtactcccagac

SEQ ID NO: 609950 - DNA, 25 bp, Rattus norvegicus
tgagattgtacctgtactcccagac

SEQ ID NO: 609951 - DNA, 25 bp, Rattus norvegicus
tgagattgtctacaacctgctgtcc

SEQ ID NO: 609952 - DNA, 25 bp, Rattus norvegicus
tgagattgtctagaacctgctgtcc

SEQ ID NO: 609953 - DNA, 25 bp, Rattus norvegicus
tgagattgtgttacgctcggcagcc

SEQ ID NO: 609954 - DNA, 25 bp, Rattus norvegicus
tgagattgtgtttcgctcggcagcc

SEQ ID NO: 609955 - DNA, 25 bp, Rattus norvegicus
tgagatttacctccccatcttggtg

SEQ ID NO: 609956 - DNA, 25 bp, Rattus norvegicus
tgagatttacctgcccatcttggtg

SEQ ID NO: 609957 - DNA, 25 bp, Rattus norvegicus
tgagatttagtacagccccggagag

SEQ ID NO: 609958 - DNA, 25 bp, Rattus norvegicus
tgagatttagtagagccccggagag

SEQ ID NO: 609959 - DNA, 25 bp, Rattus norvegicus
tgagatttgatgctgccaccacact

SEQ ID NO: 609960 - DNA, 25 bp, Rattus norvegicus
tgagatttgatggtgccaccacact

SEQ ID NO: 609961 - DNA, 25 bp, Rattus norvegicus
tgagatttgtaactactccctaccc

SEQ ID NO: 609962 - DNA, 25 bp, Rattus norvegicus
tgagatttgtaagtactccctaccc

SEQ ID NO: 609963 - DNA, 25 bp, Rattus norvegicus
tgagattttgccacccttgggttcc

SEQ ID NO: 609964 - DNA, 25 bp, Rattus norvegicus
tgagattttgcctcccttgggttcc

SEQ ID NO: 609965 - DNA, 25 bp, Rattus norvegicus
tgagcaaaccccacaaggttgttcc

SEQ ID NO: 609966 - DNA, 25 bp, Rattus norvegicus
tgagcaaacccctcaaggttgttcc

SEQ ID NO: 609967 - DNA, 25 bp, Rattus norvegicus
tgagcaaacggacaccaggactaaa

SEQ ID NO: 609968 - DNA, 25 bp, Rattus norvegicus
tgagcaaacggagaccaggactaaa

SEQ ID NO: 609969 - DNA, 25 bp, Rattus norvegicus
tgagcaaacggtacccaagggtcca

SEQ ID NO: 609970 - DNA, 25 bp, Rattus norvegicus
tgagcaaacggttcccaagggtcca

SEQ ID NO: 609971 - DNA, 25 bp, Rattus norvegicus
tgagcaaagaccctgacagaaagac

SEQ ID NO: 609972 - DNA, 25 bp, Rattus norvegicus
tgagcaaagaccgtgacagaaagac

SEQ ID NO: 609973 - DNA, 25 bp, Rattus norvegicus
tgagcaaagcctccatctctgagaa

SEQ ID NO: 609974 - DNA, 25 bp, Rattus norvegicus
tgagcaaagcctgcatctctgagaa

SEQ ID NO: 609975 - DNA, 25 bp, Rattus norvegicus
tgagcaacaactcgcatctgataga

SEQ ID NO: 609976 - DNA, 25 bp, Rattus norvegicus
tgagcaacaactggcatctgataga

SEQ ID NO: 609977 - DNA, 25 bp, Rattus norvegicus
tgagcaacacctacgggaaaaccta

SEQ ID NO: 609978 - DNA, 25 bp, Rattus norvegicus
tgagcaacaccttcgggaaaaccta

SEQ ID NO: 609979 - DNA, 25 bp, Rattus norvegicus
tgagcaacagcgcttcagaacagaa

SEQ ID NO: 609980 - DNA, 25 bp, Rattus norvegicus
tgagcaacagcggttcagaacagaa

SEQ ID NO: 609981 - DNA, 25 bp, Rattus norvegicus
tgagcaacatgacccagaatctacg

SEQ ID NO: 609982 - DNA, 25 bp, Rattus norvegicus
tgagcaacatgagccagaatctacg

SEQ ID NO: 609983 - DNA, 25 bp, Rattus norvegicus
tgagcaacctgaagcttctggccgt

SEQ ID NO: 609984 - DNA, 25 bp, Rattus norvegicus
tgagcaacctgatgcttctggccgt

SEQ ID NO: 609985 - DNA, 25 bp, Rattus norvegicus
tgagcaacctgcagtttgcactggg

SEQ ID NO: 609986 - DNA, 25 bp, Rattus norvegicus
tgagcaacctgctgtttgcactggg

SEQ ID NO: 609987 - DNA, 25 bp, Rattus norvegicus
tgagcaacgtagcaggcgtcttcta

SEQ ID NO: 609988 - DNA, 25 bp, Rattus norvegicus
tgagcaacgtaggaggcgtcttcta

SEQ ID NO: 609989 - DNA, 25 bp, Rattus norvegicus
tgagcaactacccaatccatgaagt

SEQ ID NO: 609990 - DNA, 25 bp, Rattus norvegicus
tgagcaactaccgaatccatgaagt

SEQ ID NO: 609991 - DNA, 25 bp, Rattus norvegicus
tgagcaactgatcgattctctccct

SEQ ID NO: 609992 - DNA, 25 bp, Rattus norvegicus
tgagcaactgatggattctctccct

SEQ ID NO: 609993 - DNA, 25 bp, Rattus norvegicus
tgagcaactgctcatccacttaaac

SEQ ID NO: 609994 - DNA, 25 bp, Rattus norvegicus
tgagcaactgctgatccacttaaac

SEQ ID NO: 609995 - DNA, 25 bp, Rattus norvegicus
tgagcaacttagaccttctttaaaa

SEQ ID NO: 609996 - DNA, 25 bp, Rattus norvegicus
tgagcaacttagtccttctttaaaa

SEQ ID NO: 609997 - DNA, 25 bp, Rattus norvegicus
tgagcaagacaacggcggcaccaca

SEQ ID NO: 609998 - DNA, 25 bp, Rattus norvegicus
tgagcaagacaagggcggcaccaca

SEQ ID NO: 609999 - DNA, 25 bp, Rattus norvegicus
tgagcaagaggcaccagtaccacat

SEQ ID NO: 610000 - DNA, 25 bp, Rattus norvegicus
tgagcaagaggctccagtaccacat

SEQ ID NO: 610001 - DNA, 25 bp, Rattus norvegicus
tgagcaagcatcagtgatagccaat

SEQ ID NO: 610002 - DNA, 25 bp, Rattus norvegicus
tgagcaagcatctgtgatagccaat

SEQ ID NO: 610003 - DNA, 25 bp, Rattus norvegicus
tgagcaaggtcaaccgtgagtcagg

SEQ ID NO: 610004 - DNA, 25 bp, Rattus norvegicus
tgagcaaggtcatccgtgagtcagg

SEQ ID NO: 610005 - DNA, 25 bp, Rattus norvegicus
tgagcaataccacttcctctatgac

SEQ ID NO: 610006 - DNA, 25 bp, Rattus norvegicus
tgagcaataccagttcctctatgac

SEQ ID NO: 610007 - DNA, 25 bp, Rattus norvegicus
tgagcaatacgcctatgacggccgc

SEQ ID NO: 610008 - DNA, 25 bp, Rattus norvegicus
tgagcaatacgcgtatgacggccgc

SEQ ID NO: 610009 - DNA, 25 bp, Rattus norvegicus
tgagcaatccagaatcccaacagtg

SEQ ID NO: 610010 - DNA, 25 bp, Rattus norvegicus
tgagcaatccagtatcccaacagtg

SEQ ID NO: 610011 - DNA, 25 bp, Rattus norvegicus
tgagcaatctgtctgttgaccctgt

SEQ ID NO: 610012 - DNA, 25 bp, Rattus norvegicus
tgagcaatctgtgtgttgaccctgt

SEQ ID NO: 610013 - DNA, 25 bp, Rattus norvegicus
tgagcaatcttaagggccctccttt

SEQ ID NO: 610014 - DNA, 25 bp, Rattus norvegicus
tgagcaatcttatgggccctccttt

SEQ ID NO: 610015 - DNA, 25 bp, Rattus norvegicus
tgagcaatgtctccagcctttggac

SEQ ID NO: 610016 - DNA, 25 bp, Rattus norvegicus
tgagcaatgtctgcagcctttggac

SEQ ID NO: 610017 - DNA, 25 bp, Rattus norvegicus
tgagcaattgcacccgcgaaatcgt

SEQ ID NO: 610018 - DNA, 25 bp, Rattus norvegicus
tgagcaattgcagccgcgaaatcgt

SEQ ID NO: 610019 - DNA, 25 bp, Rattus norvegicus
tgagcaatttttagcctccgcaggt

SEQ ID NO: 610020 - DNA, 25 bp, Rattus norvegicus
tgagcaattttttgcctccgcaggt

SEQ ID NO: 610021 - DNA, 25 bp, Rattus norvegicus
tgagcacaaaaacctaccaatccct

SEQ ID NO: 610022 - DNA, 25 bp, Rattus norvegicus
tgagcacaaaaagctaccaatccct

SEQ ID NO: 610023 - DNA, 25 bp, Rattus norvegicus
tgagcacaaaggcagagtccccaaa

SEQ ID NO: 610024 - DNA, 25 bp, Rattus norvegicus
tgagcacaaagggagagtccccaaa

SEQ ID NO: 610025 - DNA, 25 bp, Rattus norvegicus
tgagcacaaggcaggtgtcacttcc

SEQ ID NO: 610026 - DNA, 25 bp, Rattus norvegicus
tgagcacaaggctggtgtcacttcc

SEQ ID NO: 610027 - DNA, 25 bp, Rattus norvegicus
tgagcacaccaacacagagccctgg

SEQ ID NO: 610028 - DNA, 25 bp, Rattus norvegicus
tgagcacaccaagacagagccctgg

SEQ ID NO: 610029 - DNA, 25 bp, Rattus norvegicus
tgagcacacgctaacactatcagca

SEQ ID NO: 610030 - DNA, 25 bp, Rattus norvegicus
tgagcacacgcttacactatcagca

SEQ ID NO: 610031 - DNA, 25 bp, Rattus norvegicus
tgagcacactccacatgccaatgtc

SEQ ID NO: 610032 - DNA, 25 bp, Rattus norvegicus
tgagcacactcctcatgccaatgtc

SEQ ID NO: 610033 - DNA, 25 bp, Rattus norvegicus
tgagcacagaagaccctgccttgga

SEQ ID NO: 610034 - DNA, 25 bp, Rattus norvegicus
tgagcacagaagtccctgccttgga

SEQ ID NO: 610035 - DNA, 25 bp, Rattus norvegicus
tgagcacagatactcccagttgcgc

SEQ ID NO: 610036 - DNA, 25 bp, Rattus norvegicus
tgagcacagatagtcccagttgcgc

SEQ ID NO: 610037 - DNA, 25 bp, Rattus norvegicus
tgagcacagcaaacagcatctgaat

SEQ ID NO: 610038 - DNA, 25 bp, Rattus norvegicus
tgagcacagcaatcagcatctgaat

SEQ ID NO: 610039 - DNA, 25 bp, Rattus norvegicus
tgagcacagcacacctagtttgaat

SEQ ID NO: 610040 - DNA, 25 bp, Rattus norvegicus
tgagcacagcactcctagtttgaat

SEQ ID NO: 610041 - DNA, 25 bp, Rattus norvegicus
tgagcacagggtcagtggcctcttc

SEQ ID NO: 610042 - DNA, 25 bp, Rattus norvegicus
tgagcacagggtgagtggcctcttc

SEQ ID NO: 610043 - DNA, 25 bp, Rattus norvegicus
tgagcacagtagcacccagcaggtt

SEQ ID NO: 610044 - DNA, 25 bp, Rattus norvegicus
tgagcacagtaggacccagcaggtt

SEQ ID NO: 610045 - DNA, 25 bp, Rattus norvegicus
tgagcacagtgtcgccagtagaaac

SEQ ID NO: 610046 - DNA, 25 bp, Rattus norvegicus
tgagcacagtgtggccagtagaaac

SEQ ID NO: 610047 - DNA, 25 bp, Rattus norvegicus
tgagcacatgcaagccaagtctggg

SEQ ID NO: 610048 - DNA, 25 bp, Rattus norvegicus
tgagcacatgcatgccaagtctggg

SEQ ID NO: 610049 - DNA, 25 bp, Rattus norvegicus
tgagcaccaactcgctatacaaagt

SEQ ID NO: 610050 - DNA, 25 bp, Rattus norvegicus
tgagcaccaactggctatacaaagt

SEQ ID NO: 610051 - DNA, 25 bp, Rattus norvegicus
tgagcaccaccacctttgaactgaa

SEQ ID NO: 610052 - DNA, 25 bp, Rattus norvegicus
tgagcaccaccagctttgaactgaa

SEQ ID NO: 610053 - DNA, 25 bp, Rattus norvegicus
tgagcaccaccgagcagcgcagctt

SEQ ID NO: 610054 - DNA, 25 bp, Rattus norvegicus
tgagcaccaccgtgcagcgcagctt

SEQ ID NO: 610055 - DNA, 25 bp, Rattus norvegicus
tgagcaccagacacaaccgagcttc

SEQ ID NO: 610056 - DNA, 25 bp, Rattus norvegicus
tgagcaccagactcaaccgagcttc

SEQ ID NO: 610057 - DNA, 25 bp, Rattus norvegicus
tgagcacccagccaggtcctgttgg

SEQ ID NO: 610058 - DNA, 25 bp, Rattus norvegicus
tgagcacccagcgaggtcctgttgg

SEQ ID NO: 610059 - DNA, 25 bp, Rattus norvegicus
tgagcacccctgacatgcaaagtac

SEQ ID NO: 610060 - DNA, 25 bp, Rattus norvegicus
tgagcacccctgcgaggtcatgcct

SEQ ID NO: 610061 - DNA, 25 bp, Rattus norvegicus
tgagcacccctgggaggtcatgcct

SEQ ID NO: 610062 - DNA, 25 bp, Rattus norvegicus
tgagcacccctgtcatgcaaagtac

SEQ ID NO: 610063 - DNA, 25 bp, Rattus norvegicus
tgagcaccgagcattagagcccgca

SEQ ID NO: 610064 - DNA, 25 bp, Rattus norvegicus
tgagcaccgagctttagagcccgca

SEQ ID NO: 610065 - DNA, 25 bp, Rattus norvegicus
tgagcaccgccaacttagttcattc

SEQ ID NO: 610066 - DNA, 25 bp, Rattus norvegicus
tgagcaccgccatcttagttcattc

SEQ ID NO: 610067 - DNA, 25 bp, Rattus norvegicus
tgagcaccgtaacgcctgctttttt

SEQ ID NO: 610068 - DNA, 25 bp, Rattus norvegicus
tgagcaccgtaaggcctgctttttt

SEQ ID NO: 610069 - DNA, 25 bp, Rattus norvegicus
tgagcaccgtgtaaatatctcccgc

SEQ ID NO: 610070 - DNA, 25 bp, Rattus norvegicus
tgagcaccgtgttaatatctcccgc

SEQ ID NO: 610071 - DNA, 25 bp, Rattus norvegicus
tgagcacctccgactaccaaacttt

SEQ ID NO: 610072 - DNA, 25 bp, Rattus norvegicus
tgagcacctccgtctaccaaacttt

SEQ ID NO: 610073 - DNA, 25 bp, Rattus norvegicus
tgagcacctctactaacatttcttg

SEQ ID NO: 610074 - DNA, 25 bp, Rattus norvegicus
tgagcacctctagtaacatttcttg

SEQ ID NO: 610075 - DNA, 25 bp, Rattus norvegicus
tgagcaccttgtaaccacttttgta

SEQ ID NO: 610076 - DNA, 25 bp, Rattus norvegicus
tgagcaccttgttaccacttttgta

SEQ ID NO: 610077 - DNA, 25 bp, Rattus norvegicus
tgagcacctttccagggtctgaaca

SEQ ID NO: 610078 - DNA, 25 bp, Rattus norvegicus
tgagcacctttcgagggtctgaaca

SEQ ID NO: 610079 - DNA, 25 bp, Rattus norvegicus
tgagcaccttttaaagggtccttca

SEQ ID NO: 610080 - DNA, 25 bp, Rattus norvegicus
tgagcacctttttaagggtccttca

SEQ ID NO: 610081 - DNA, 25 bp, Rattus norvegicus
tgagcacgccatagatgccttccgg

SEQ ID NO: 610082 - DNA, 25 bp, Rattus norvegicus
tgagcacgccattgatgccttccgg

SEQ ID NO: 610083 - DNA, 25 bp, Rattus norvegicus
tgagcacggagcaagaggcgcccca

SEQ ID NO: 610084 - DNA, 25 bp, Rattus norvegicus
tgagcacggagctagaggcgcccca

SEQ ID NO: 610085 - DNA, 25 bp, Rattus norvegicus
tgagcacggcatcgctacactgtga

SEQ ID NO: 610086 - DNA, 25 bp, Rattus norvegicus
tgagcacggcatggctacactgtga

SEQ ID NO: 610087 - DNA, 25 bp, Rattus norvegicus
tgagcacgttggcttctctccaagc

SEQ ID NO: 610088 - DNA, 25 bp, Rattus norvegicus
tgagcacgttgggttctctccaagc

SEQ ID NO: 610089 - DNA, 25 bp, Rattus norvegicus
tgagcactacaccaaaggaccatgt

SEQ ID NO: 610090 - DNA, 25 bp, Rattus norvegicus
tgagcactacacgaaaggaccatgt

SEQ ID NO: 610091 - DNA, 25 bp, Rattus norvegicus
tgagcactagctctggtacccctag

SEQ ID NO: 610092 - DNA, 25 bp, Rattus norvegicus
tgagcactagctgtggtacccctag

SEQ ID NO: 610093 - DNA, 25 bp, Rattus norvegicus
tgagcactcacaatggcttagcctg

SEQ ID NO: 610094 - DNA, 25 bp, Rattus norvegicus
tgagcactcacattggcttagcctg

SEQ ID NO: 610095 - DNA, 25 bp, Rattus norvegicus
tgagcactcacgacaggtagctcac

SEQ ID NO: 610096 - DNA, 25 bp, Rattus norvegicus
tgagcactcacgtcaggtagctcac

SEQ ID NO: 610097 - DNA, 25 bp, Rattus norvegicus
tgagcactctcgactgcaggacatt

SEQ ID NO: 610098 - DNA, 25 bp, Rattus norvegicus
tgagcactctcgtctgcaggacatt

SEQ ID NO: 610099 - DNA, 25 bp, Rattus norvegicus
tgagcactctggaactggtcgacta

SEQ ID NO: 610100 - DNA, 25 bp, Rattus norvegicus
tgagcactctggtactggtcgacta

SEQ ID NO: 610101 - DNA, 25 bp, Rattus norvegicus
tgagcactgccgagatcctctttaa

SEQ ID NO: 610102 - DNA, 25 bp, Rattus norvegicus
tgagcactgccgtgatcctctttaa

SEQ ID NO: 610103 - DNA, 25 bp, Rattus norvegicus
tgagcactgtctctgacttgtttgt

SEQ ID NO: 610104 - DNA, 25 bp, Rattus norvegicus
tgagcactgtctgtgacttgtttgt

SEQ ID NO: 610105 - DNA, 25 bp, Rattus norvegicus
tgagcacttactccttccgacaggg

SEQ ID NO: 610106 - DNA, 25 bp, Rattus norvegicus
tgagcacttactgcttccgacaggg

SEQ ID NO: 610107 - DNA, 25 bp, Rattus norvegicus
tgagcacttgaaacctgccaggtaa

SEQ ID NO: 610108 - DNA, 25 bp, Rattus norvegicus
tgagcacttgaatcctgccaggtaa

SEQ ID NO: 610109 - DNA, 25 bp, Rattus norvegicus
tgagcactttccaagcaggtgggat

SEQ ID NO: 610110 - DNA, 25 bp, Rattus norvegicus
tgagcactttcctagcaggtgggat

SEQ ID NO: 610111 - DNA, 25 bp, Rattus norvegicus
tgagcactttgtatccctgcagaga

SEQ ID NO: 610112 - DNA, 25 bp, Rattus norvegicus
tgagcactttgtttccctgcagaga

SEQ ID NO: 610113 - DNA, 25 bp, Rattus norvegicus
tgagcagaacccacccagttaagga

SEQ ID NO: 610114 - DNA, 25 bp, Rattus norvegicus
tgagcagaaccctcccagttaagga

SEQ ID NO: 610115 - DNA, 25 bp, Rattus norvegicus
tgagcagaactcactgggcctcggc

SEQ ID NO: 610116 - DNA, 25 bp, Rattus norvegicus
tgagcagaactctctgggcctcggc

SEQ ID NO: 610117 - DNA, 25 bp, Rattus norvegicus
tgagcagaacttagagctgcctccc

SEQ ID NO: 610118 - DNA, 25 bp, Rattus norvegicus
tgagcagaactttgagctgcctccc

SEQ ID NO: 610119 - DNA, 25 bp, Rattus norvegicus
tgagcagaatggcagcatcgtcccc

SEQ ID NO: 610120 - DNA, 25 bp, Rattus norvegicus
tgagcagaatgggagcatcgtcccc

SEQ ID NO: 610121 - DNA, 25 bp, Rattus norvegicus
tgagcagaatttctcaacctcaatt

SEQ ID NO: 610122 - DNA, 25 bp, Rattus norvegicus
tgagcagaatttgtcaacctcaatt

SEQ ID NO: 610123 - DNA, 25 bp, Rattus norvegicus
tgagcagacagacttcctttcctgt

SEQ ID NO: 610124 - DNA, 25 bp, Rattus norvegicus
tgagcagacagagttcctttcctgt

SEQ ID NO: 610125 - DNA, 25 bp, Rattus norvegicus
tgagcagacccacaactgagaccag

SEQ ID NO: 610126 - DNA, 25 bp, Rattus norvegicus
tgagcagacccagaactgagaccag

SEQ ID NO: 610127 - DNA, 25 bp, Rattus norvegicus
tgagcagactttcttggtgtttttt

SEQ ID NO: 610128 - DNA, 25 bp, Rattus norvegicus
tgagcagactttgttggtgtttttt

SEQ ID NO: 610129 - DNA, 25 bp, Rattus norvegicus
tgagcagagaggctcctgtaccctc

SEQ ID NO: 610130 - DNA, 25 bp, Rattus norvegicus
tgagcagagagggtcctgtaccctc

SEQ ID NO: 610131 - DNA, 25 bp, Rattus norvegicus
tgagcagataatcgctgaccttcct

SEQ ID NO: 610132 - DNA, 25 bp, Rattus norvegicus
tgagcagataatggctgaccttcct

SEQ ID NO: 610133 - DNA, 25 bp, Rattus norvegicus
tgagcagatccgaccgagactgtgg

SEQ ID NO: 610134 - DNA, 25 bp, Rattus norvegicus
tgagcagatccgtccgagactgtgg

SEQ ID NO: 610135 - DNA, 25 bp, Rattus norvegicus
tgagcagcaagtagcccttctccct

SEQ ID NO: 610136 - DNA, 25 bp, Rattus norvegicus
tgagcagcaagttgcccttctccct

SEQ ID NO: 610137 - DNA, 25 bp, Rattus norvegicus
tgagcagcacaactaggccccaggc

SEQ ID NO: 610138 - DNA, 25 bp, Rattus norvegicus
tgagcagcacaagtaggccccaggc

SEQ ID NO: 610139 - DNA, 25 bp, Rattus norvegicus
tgagcagcactcaccaaggtggcaa

SEQ ID NO: 610140 - DNA, 25 bp, Rattus norvegicus
tgagcagcactctccaaggtggcaa

SEQ ID NO: 610141 - DNA, 25 bp, Rattus norvegicus
tgagcagcagatccagacctaccag

SEQ ID NO: 610142 - DNA, 25 bp, Rattus norvegicus
tgagcagcagatccctcaaccctta

SEQ ID NO: 610143 - DNA, 25 bp, Rattus norvegicus
tgagcagcagatgcagacctaccag

SEQ ID NO: 610144 - DNA, 25 bp, Rattus norvegicus
tgagcagcagatgcctcaaccctta

SEQ ID NO: 610145 - DNA, 25 bp, Rattus norvegicus
tgagcagcagctaccgagtgtggtc

SEQ ID NO: 610146 - DNA, 25 bp, Rattus norvegicus
tgagcagcagctccgtcatcctttc

SEQ ID NO: 610147 - DNA, 25 bp, Rattus norvegicus
tgagcagcagctgcgtcatcctttc

SEQ ID NO: 610148 - DNA, 25 bp, Rattus norvegicus
tgagcagcagcttccgagtgtggtc

SEQ ID NO: 610149 - DNA, 25 bp, Rattus norvegicus
tgagcagcagttcccatggaggctt

SEQ ID NO: 610150 - DNA, 25 bp, Rattus norvegicus
tgagcagcagttgccatggaggctt

SEQ ID NO: 610151 - DNA, 25 bp, Rattus norvegicus
tgagcagcatagagctccctgcagt

SEQ ID NO: 610152 - DNA, 25 bp, Rattus norvegicus
tgagcagcatagtgctccctgcagt

SEQ ID NO: 610153 - DNA, 25 bp, Rattus norvegicus
tgagcagcattgcttccggtcttca

SEQ ID NO: 610154 - DNA, 25 bp, Rattus norvegicus
tgagcagcattggttccggtcttca

SEQ ID NO: 610155 - DNA, 25 bp, Rattus norvegicus
tgagcagccagcagcgagtatggtt

SEQ ID NO: 610156 - DNA, 25 bp, Rattus norvegicus
tgagcagccagctgcgagtatggtt

SEQ ID NO: 610157 - DNA, 25 bp, Rattus norvegicus
tgagcagccccgagtctctttatcc

SEQ ID NO: 610158 - DNA, 25 bp, Rattus norvegicus
tgagcagccccgtgtctctttatcc

SEQ ID NO: 610159 - DNA, 25 bp, Rattus norvegicus
tgagcagcctgacctcctttgtgag

SEQ ID NO: 610160 - DNA, 25 bp, Rattus norvegicus
tgagcagcctgagctcctttgtgag

SEQ ID NO: 610161 - DNA, 25 bp, Rattus norvegicus
tgagcagccttcctggattctgggt

SEQ ID NO: 610162 - DNA, 25 bp, Rattus norvegicus
tgagcagccttcgtggattctgggt

SEQ ID NO: 610163 - DNA, 25 bp, Rattus norvegicus
tgagcagcgagcagacagtgaatgt

SEQ ID NO: 610164 - DNA, 25 bp, Rattus norvegicus
tgagcagcgagctgacagtgaatgt

SEQ ID NO: 610165 - DNA, 25 bp, Rattus norvegicus
tgagcagcgggaaatgctggcccct

SEQ ID NO: 610166 - DNA, 25 bp, Rattus norvegicus
tgagcagcgggatatgctggcccct

SEQ ID NO: 610167 - DNA, 25 bp, Rattus norvegicus
tgagcagctaacaggtacacaccct

SEQ ID NO: 610168 - DNA, 25 bp, Rattus norvegicus
tgagcagctaactggtacacaccct

SEQ ID NO: 610169 - DNA, 25 bp, Rattus norvegicus
tgagcagctcaaaagggccctgatg

SEQ ID NO: 610170 - DNA, 25 bp, Rattus norvegicus
tgagcagctcaatagggccctgatg

SEQ ID NO: 610171 - DNA, 25 bp, Rattus norvegicus
tgagcagctcacactttagcacagg

SEQ ID NO: 610172 - DNA, 25 bp, Rattus norvegicus
tgagcagctcactctttagcacagg

SEQ ID NO: 610173 - DNA, 25 bp, Rattus norvegicus
tgagcagctcctataccaggcaaga

SEQ ID NO: 610174 - DNA, 25 bp, Rattus norvegicus
tgagcagctcctttaccaggcaaga

SEQ ID NO: 610175 - DNA, 25 bp, Rattus norvegicus
tgagcagctggaagactcaaccctc

SEQ ID NO: 610176 - DNA, 25 bp, Rattus norvegicus
tgagcagctggatgactcaaccctc

SEQ ID NO: 610177 - DNA, 25 bp, Rattus norvegicus
tgagcagctggcaacctgtgaccta

SEQ ID NO: 610178 - DNA, 25 bp, Rattus norvegicus
tgagcagctggctacctgtgaccta

SEQ ID NO: 610179 - DNA, 25 bp, Rattus norvegicus
tgagcagctgttcctccagggcccg

SEQ ID NO: 610180 - DNA, 25 bp, Rattus norvegicus
tgagcagctgttgctccagggcccg

SEQ ID NO: 610181 - DNA, 25 bp, Rattus norvegicus
tgagcagcttatcggtgaactaacc

SEQ ID NO: 610182 - DNA, 25 bp, Rattus norvegicus
tgagcagcttatgggtgaactaacc

SEQ ID NO: 610183 - DNA, 25 bp, Rattus norvegicus
tgagcaggaaggaccttgtccaacc

SEQ ID NO: 610184 - DNA, 25 bp, Rattus norvegicus
tgagcaggaaggtccttgtccaacc

SEQ ID NO: 610185 - DNA, 25 bp, Rattus norvegicus
tgagcaggacctctaatgcactgaa

SEQ ID NO: 610186 - DNA, 25 bp, Rattus norvegicus
tgagcaggacctgtaatgcactgaa

SEQ ID NO: 610187 - DNA, 25 bp, Rattus norvegicus
tgagcaggcacaaccacaggtgcat

SEQ ID NO: 610188 - DNA, 25 bp, Rattus norvegicus
tgagcaggcacatccacaggtgcat

SEQ ID NO: 610189 - DNA, 25 bp, Rattus norvegicus
tgagcaggcatcagccaacatacct

SEQ ID NO: 610190 - DNA, 25 bp, Rattus norvegicus
tgagcaggcatctgccaacatacct

SEQ ID NO: 610191 - DNA, 25 bp, Rattus norvegicus
tgagcaggcctcaaccaagaatcta

SEQ ID NO: 610192 - DNA, 25 bp, Rattus norvegicus
tgagcaggcctctaccaagaatcta

SEQ ID NO: 610193 - DNA, 25 bp, Rattus norvegicus
tgagcaggctctcacaatctcctgg

SEQ ID NO: 610194 - DNA, 25 bp, Rattus norvegicus
tgagcaggctctgacaatctcctgg

SEQ ID NO: 610195 - DNA, 25 bp, Rattus norvegicus
tgagcaggctgtccagtcactggac

SEQ ID NO: 610196 - DNA, 25 bp, Rattus norvegicus
tgagcaggctgtgcagtcactggac

SEQ ID NO: 610197 - DNA, 25 bp, Rattus norvegicus
tgagcagggcacataacctctttct

SEQ ID NO: 610198 - DNA, 25 bp, Rattus norvegicus
tgagcagggcacttaacctctttct

SEQ ID NO: 610199 - DNA, 25 bp, Rattus norvegicus
tgagcaggtcagaggcctacaggta

SEQ ID NO: 610200 - DNA, 25 bp, Rattus norvegicus
tgagcaggtcagtggcctacaggta

SEQ ID NO: 610201 - DNA, 25 bp, Rattus norvegicus
tgagcaggttcaaatcagtgtccct

SEQ ID NO: 610202 - DNA, 25 bp, Rattus norvegicus
tgagcaggttcatatcagtgtccct

SEQ ID NO: 610203 - DNA, 25 bp, Rattus norvegicus
tgagcagtaatccttctgtgccatg

SEQ ID NO: 610204 - DNA, 25 bp, Rattus norvegicus
tgagcagtaatcgttctgtgccatg

SEQ ID NO: 610205 - DNA, 25 bp, Rattus norvegicus
tgagcagtccagacagaacacagtg

SEQ ID NO: 610206 - DNA, 25 bp, Rattus norvegicus
tgagcagtccagtcagaacacagtg

SEQ ID NO: 610207 - DNA, 25 bp, Rattus norvegicus
tgagcagtcttgaccttctacggtg

SEQ ID NO: 610208 - DNA, 25 bp, Rattus norvegicus
tgagcagtcttgtccttctacggtg

SEQ ID NO: 610209 - DNA, 25 bp, Rattus norvegicus
tgagcagtgtacatcccaacagctg

SEQ ID NO: 610210 - DNA, 25 bp, Rattus norvegicus
tgagcagtgtacttcccaacagctg

SEQ ID NO: 610211 - DNA, 25 bp, Rattus norvegicus
tgagcagttacaatcccaaaggcag

SEQ ID NO: 610212 - DNA, 25 bp, Rattus norvegicus
tgagcagttacattcccaaaggcag

SEQ ID NO: 610213 - DNA, 25 bp, Rattus norvegicus
tgagcagttgacaaccagccggcca

SEQ ID NO: 610214 - DNA, 25 bp, Rattus norvegicus
tgagcagttgactaccagccggcca

SEQ ID NO: 610215 - DNA, 25 bp, Rattus norvegicus
tgagcagttgctacttgatcctggc

SEQ ID NO: 610216 - DNA, 25 bp, Rattus norvegicus
tgagcagttgcttcttgatcctggc

SEQ ID NO: 610217 - DNA, 25 bp, Rattus norvegicus
tgagcagttgtacactgggtcccct

SEQ ID NO: 610218 - DNA, 25 bp, Rattus norvegicus
tgagcagttgtagactgggtcccct

SEQ ID NO: 610219 - DNA, 25 bp, Rattus norvegicus
tgagcataaggcatcacccttctct

SEQ ID NO: 610220 - DNA, 25 bp, Rattus norvegicus
tgagcataaggcttcacccttctct

SEQ ID NO: 610221 - DNA, 25 bp, Rattus norvegicus
tgagcatacaggaggccacatcttt

SEQ ID NO: 610222 - DNA, 25 bp, Rattus norvegicus
tgagcatacaggtggccacatcttt

SEQ ID NO: 610223 - DNA, 25 bp, Rattus norvegicus
tgagcatacgtgaaggctccggccg

SEQ ID NO: 610224 - DNA, 25 bp, Rattus norvegicus
tgagcatacgtgtaggctccggccg

SEQ ID NO: 610225 - DNA, 25 bp, Rattus norvegicus
tgagcatactgaacatcacccgtcc

SEQ ID NO: 610226 - DNA, 25 bp, Rattus norvegicus
tgagcatactgatcatcacccgtcc

SEQ ID NO: 610227 - DNA, 25 bp, Rattus norvegicus
tgagcatatcttactgtcggagcag

SEQ ID NO: 610228 - DNA, 25 bp, Rattus norvegicus
tgagcatatctttctgtcggagcag

SEQ ID NO: 610229 - DNA, 25 bp, Rattus norvegicus
tgagcatcaccgaagtgcctggttc

SEQ ID NO: 610230 - DNA, 25 bp, Rattus norvegicus
tgagcatcaccgtagtgcctggttc

SEQ ID NO: 610231 - DNA, 25 bp, Rattus norvegicus
tgagcatcatgaactccttcgtgac

SEQ ID NO: 610232 - DNA, 25 bp, Rattus norvegicus
tgagcatcatgatctccttcgtgac

SEQ ID NO: 610233 - DNA, 25 bp, Rattus norvegicus
tgagcatcatggcttcttgtcctaa

SEQ ID NO: 610234 - DNA, 25 bp, Rattus norvegicus
tgagcatcatgggttcttgtcctaa

SEQ ID NO: 610235 - DNA, 25 bp, Rattus norvegicus
tgagcatcatgtaggtgtggtgacc

SEQ ID NO: 610236 - DNA, 25 bp, Rattus norvegicus
tgagcatcatgttggtgtggtgacc

SEQ ID NO: 610237 - DNA, 25 bp, Rattus norvegicus
tgagcatccatacaccttcttatat

SEQ ID NO: 610238 - DNA, 25 bp, Rattus norvegicus
tgagcatccatagaccttcttatat

SEQ ID NO: 610239 - DNA, 25 bp, Rattus norvegicus
tgagcatcccatccatgcagagtta

SEQ ID NO: 610240 - DNA, 25 bp, Rattus norvegicus
tgagcatcccatgcatgcagagtta

SEQ ID NO: 610241 - DNA, 25 bp, Rattus norvegicus
tgagcatcccttattgtttaaactg

SEQ ID NO: 610242 - DNA, 25 bp, Rattus norvegicus
tgagcatccctttttgtttaaactg

SEQ ID NO: 610243 - DNA, 25 bp, Rattus norvegicus
tgagcatcctagactccaaagtgaa

SEQ ID NO: 610244 - DNA, 25 bp, Rattus norvegicus
tgagcatcctagtctccaaagtgaa

SEQ ID NO: 610245 - DNA, 25 bp, Rattus norvegicus
tgagcatcctcccttacagtgtctc

SEQ ID NO: 610246 - DNA, 25 bp, Rattus norvegicus
tgagcatcctccgttacagtgtctc

SEQ ID NO: 610247 - DNA, 25 bp, Rattus norvegicus
tgagcatcgccaacttagtcttcat

SEQ ID NO: 610248 - DNA, 25 bp, Rattus norvegicus
tgagcatcgccatcttagtcttcat

SEQ ID NO: 610249 - DNA, 25 bp, Rattus norvegicus
tgagcatcgtagagtgtcgcttcga

SEQ ID NO: 610250 - DNA, 25 bp, Rattus norvegicus
tgagcatcgtagtgtgtcgcttcga

SEQ ID NO: 610251 - DNA, 25 bp, Rattus norvegicus
tgagcatctcgacaccattgtctgt

SEQ ID NO: 610252 - DNA, 25 bp, Rattus norvegicus
tgagcatctcgagaccattgtctgt

SEQ ID NO: 610253 - DNA, 25 bp, Rattus norvegicus
tgagcatctctcagaggaactggat

SEQ ID NO: 610254 - DNA, 25 bp, Rattus norvegicus
tgagcatctctcagtctttgacttt

SEQ ID NO: 610255 - DNA, 25 bp, Rattus norvegicus
tgagcatctctctgaggaactggat

SEQ ID NO: 610256 - DNA, 25 bp, Rattus norvegicus
tgagcatctctctgtctttgacttt

SEQ ID NO: 610257 - DNA, 25 bp, Rattus norvegicus
tgagcatctctgagttctgacagga

SEQ ID NO: 610258 - DNA, 25 bp, Rattus norvegicus
tgagcatctctgatgtggacacgtc

SEQ ID NO: 610259 - DNA, 25 bp, Rattus norvegicus
tgagcatctctgtgttctgacagga

SEQ ID NO: 610260 - DNA, 25 bp, Rattus norvegicus
tgagcatctctgttgtggacacgtc

SEQ ID NO: 610261 - DNA, 25 bp, Rattus norvegicus
tgagcatctgcccatgccttgaata

SEQ ID NO: 610262 - DNA, 25 bp, Rattus norvegicus
tgagcatctgccgatgccttgaata

SEQ ID NO: 610263 - DNA, 25 bp, Rattus norvegicus
tgagcatgactcctgagcagcttca

SEQ ID NO: 610264 - DNA, 25 bp, Rattus norvegicus
tgagcatgactcgtgagcagcttca

SEQ ID NO: 610265 - DNA, 25 bp, Rattus norvegicus
tgagcatgaggaacaacacccacgc

SEQ ID NO: 610266 - DNA, 25 bp, Rattus norvegicus
tgagcatgaggatcaacacccacgc

SEQ ID NO: 610267 - DNA, 25 bp, Rattus norvegicus
tgagcatgatttccgtcacttggtc

SEQ ID NO: 610268 - DNA, 25 bp, Rattus norvegicus
tgagcatgatttgcgtcacttggtc

SEQ ID NO: 610269 - DNA, 25 bp, Rattus norvegicus
tgagcatgcagtcaagccaacgccg

SEQ ID NO: 610270 - DNA, 25 bp, Rattus norvegicus
tgagcatgcagtgaagccaacgccg

SEQ ID NO: 610271 - DNA, 25 bp, Rattus norvegicus
tgagcatgctcaacgttttcctgaa

SEQ ID NO: 610272 - DNA, 25 bp, Rattus norvegicus
tgagcatgctcatcgttttcctgaa

SEQ ID NO: 610273 - DNA, 25 bp, Rattus norvegicus
tgagcatgctccaggaacctggaac

SEQ ID NO: 610274 - DNA, 25 bp, Rattus norvegicus
tgagcatgctcctggaacctggaac

SEQ ID NO: 610275 - DNA, 25 bp, Rattus norvegicus
tgagcatgcttgacccttgtatgaa

SEQ ID NO: 610276 - DNA, 25 bp, Rattus norvegicus
tgagcatgcttgtcccttgtatgaa

SEQ ID NO: 610277 - DNA, 25 bp, Rattus norvegicus
tgagcatgggttcatccatcctcaa

SEQ ID NO: 610278 - DNA, 25 bp, Rattus norvegicus
tgagcatgggttgatccatcctcaa

SEQ ID NO: 610279 - DNA, 25 bp, Rattus norvegicus
tgagcatgtgggagagcacctctat

SEQ ID NO: 610280 - DNA, 25 bp, Rattus norvegicus
tgagcatgtgggtgagcacctctat

SEQ ID NO: 610281 - DNA, 25 bp, Rattus norvegicus
tgagcattccaactgtcttttctga

SEQ ID NO: 610282 - DNA, 25 bp, Rattus norvegicus
tgagcattccaagtgtcttttctga

SEQ ID NO: 610283 - DNA, 25 bp, Rattus norvegicus
tgagcattcccaacacggaggtgag

SEQ ID NO: 610284 - DNA, 25 bp, Rattus norvegicus
tgagcattcccatcacggaggtgag

SEQ ID NO: 610285 - DNA, 25 bp, Rattus norvegicus
tgagcattctcgcacatttgtagtt

SEQ ID NO: 610286 - DNA, 25 bp, Rattus norvegicus
tgagcattctcggacatttgtagtt

SEQ ID NO: 610287 - DNA, 25 bp, Rattus norvegicus
tgagcattcttcagcccaagggcga

SEQ ID NO: 610288 - DNA, 25 bp, Rattus norvegicus
tgagcattcttctgcccaagggcga

SEQ ID NO: 610289 - DNA, 25 bp, Rattus norvegicus
tgagcattgaacctgttgatgtaat

SEQ ID NO: 610290 - DNA, 25 bp, Rattus norvegicus
tgagcattgaacgtgttgatgtaat

SEQ ID NO: 610291 - DNA, 25 bp, Rattus norvegicus
tgagcattgtatatctcgcatccct

SEQ ID NO: 610292 - DNA, 25 bp, Rattus norvegicus
tgagcattgtatttctcgcatccct

SEQ ID NO: 610293 - DNA, 25 bp, Rattus norvegicus
tgagcatttgcaaagactccacacc

SEQ ID NO: 610294 - DNA, 25 bp, Rattus norvegicus
tgagcatttgcatagactccacacc

SEQ ID NO: 610295 - DNA, 25 bp, Rattus norvegicus
tgagcatttgctccagtccactctg

SEQ ID NO: 610296 - DNA, 25 bp, Rattus norvegicus
tgagcatttgctgcagtccactctg

SEQ ID NO: 610297 - DNA, 25 bp, Rattus norvegicus
tgagccaaatttagttctgttcctg

SEQ ID NO: 610298 - DNA, 25 bp, Rattus norvegicus
tgagccaaattttgttctgttcctg

SEQ ID NO: 610299 - DNA, 25 bp, Rattus norvegicus
tgagccaaccagaatttccacagtt

SEQ ID NO: 610300 - DNA, 25 bp, Rattus norvegicus
tgagccaaccagtatttccacagtt

SEQ ID NO: 610301 - DNA, 25 bp, Rattus norvegicus
tgagccaactggattgaatttgatc

SEQ ID NO: 610302 - DNA, 25 bp, Rattus norvegicus
tgagccaactggtttgaatttgatc

SEQ ID NO: 610303 - DNA, 25 bp, Rattus norvegicus
tgagccaagctaactttgacacctt

SEQ ID NO: 610304 - DNA, 25 bp, Rattus norvegicus
tgagccaagctatctttgacacctt

SEQ ID NO: 610305 - DNA, 25 bp, Rattus norvegicus
tgagccaataagctccctttcccag

SEQ ID NO: 610306 - DNA, 25 bp, Rattus norvegicus
tgagccaataaggtccctttcccag

SEQ ID NO: 610307 - DNA, 25 bp, Rattus norvegicus
tgagccacaaaccagcagcatacac

SEQ ID NO: 610308 - DNA, 25 bp, Rattus norvegicus
tgagccacaaacgagcagcatacac

SEQ ID NO: 610309 - DNA, 25 bp, Rattus norvegicus
tgagccacactcagtgcagggctga

SEQ ID NO: 610310 - DNA, 25 bp, Rattus norvegicus
tgagccacactctgtgcagggctga

SEQ ID NO: 610311 - DNA, 25 bp, Rattus norvegicus
tgagccacactgcagccctgggaag

SEQ ID NO: 610312 - DNA, 25 bp, Rattus norvegicus
tgagccacactggagccctgggaag

SEQ ID NO: 610313 - DNA, 25 bp, Rattus norvegicus
tgagccacagcccttaaaacaacaa

SEQ ID NO: 610314 - DNA, 25 bp, Rattus norvegicus
tgagccacagccgttaaaacaacaa

SEQ ID NO: 610315 - DNA, 25 bp, Rattus norvegicus
tgagccaccagaatgtcatcagcac

SEQ ID NO: 610316 - DNA, 25 bp, Rattus norvegicus
tgagccaccagattgtcatcagcac

SEQ ID NO: 610317 - DNA, 25 bp, Rattus norvegicus
tgagccaccagtcatctacagatac

SEQ ID NO: 610318 - DNA, 25 bp, Rattus norvegicus
tgagccaccagtgatctacagatac

SEQ ID NO: 610319 - DNA, 25 bp, Rattus norvegicus
tgagccaccgcgctggcaccattgt

SEQ ID NO: 610320 - DNA, 25 bp, Rattus norvegicus
tgagccaccgcggtggcaccattgt

SEQ ID NO: 610321 - DNA, 25 bp, Rattus norvegicus
tgagccaccgctccatgttctctta

SEQ ID NO: 610322 - DNA, 25 bp, Rattus norvegicus
tgagccaccgctgcatgttctctta

SEQ ID NO: 610323 - DNA, 25 bp, Rattus norvegicus
tgagccacggagacttggagcggag

SEQ ID NO: 610324 - DNA, 25 bp, Rattus norvegicus
tgagccacggagtcttggagcggag

SEQ ID NO: 610325 - DNA, 25 bp, Rattus norvegicus
tgagccacggtgctacacactagca

SEQ ID NO: 610326 - DNA, 25 bp, Rattus norvegicus
tgagccacggtggtacacactagca

SEQ ID NO: 610327 - DNA, 25 bp, Rattus norvegicus
tgagccactaacaagtcagcctact

SEQ ID NO: 610328 - DNA, 25 bp, Rattus norvegicus
tgagccactaactagtcagcctact

SEQ ID NO: 610329 - DNA, 25 bp, Rattus norvegicus
tgagccactctccatgttgtaggac

SEQ ID NO: 610330 - DNA, 25 bp, Rattus norvegicus
tgagccactctcgatgttgtaggac

SEQ ID NO: 610331 - DNA, 25 bp, Rattus norvegicus
tgagccactctgagggacagcacac

SEQ ID NO: 610332 - DNA, 25 bp, Rattus norvegicus
tgagccactctgtgggacagcacac

SEQ ID NO: 610333 - DNA, 25 bp, Rattus norvegicus
tgagccactcttcctagttactagt

SEQ ID NO: 610334 - DNA, 25 bp, Rattus norvegicus
tgagccactcttgctagttactagt

SEQ ID NO: 610335 - DNA, 25 bp, Rattus norvegicus
tgagccactgccagctggtgacctt

SEQ ID NO: 610336 - DNA, 25 bp, Rattus norvegicus
tgagccactgcctgctggtgacctt

SEQ ID NO: 610337 - DNA, 25 bp, Rattus norvegicus
tgagccactggaaaccccacaaaac

SEQ ID NO: 610338 - DNA, 25 bp, Rattus norvegicus
tgagccactggataccccacaaaac

SEQ ID NO: 610339 - DNA, 25 bp, Rattus norvegicus
tgagccactggtagggtccgtgcca

SEQ ID NO: 610340 - DNA, 25 bp, Rattus norvegicus
tgagccactggttgggtccgtgcca

SEQ ID NO: 610341 - DNA, 25 bp, Rattus norvegicus
tgagccactgtcagtgtcagatgcc

SEQ ID NO: 610342 - DNA, 25 bp, Rattus norvegicus
tgagccactgtctgtgtcagatgcc

SEQ ID NO: 610343 - DNA, 25 bp, Rattus norvegicus
tgagccagaggtacacagcgagccc

SEQ ID NO: 610344 - DNA, 25 bp, Rattus norvegicus
tgagccagaggttcacagcgagccc

SEQ ID NO: 610345 - DNA, 25 bp, Rattus norvegicus
tgagccagatttccaatgcagccgc

SEQ ID NO: 610346 - DNA, 25 bp, Rattus norvegicus
tgagccagatttgcaatgcagccgc

SEQ ID NO: 610347 - DNA, 25 bp, Rattus norvegicus
tgagccagcagaacagcagtctgtt

SEQ ID NO: 610348 - DNA, 25 bp, Rattus norvegicus
tgagccagcagatcagcagtctgtt

SEQ ID NO: 610349 - DNA, 25 bp, Rattus norvegicus
tgagccagcagcagttgcacctgtt

SEQ ID NO: 610350 - DNA, 25 bp, Rattus norvegicus
tgagccagcagctgttgcacctgtt

SEQ ID NO: 610351 - DNA, 25 bp, Rattus norvegicus
tgagccagcctgaatagcacaacat

SEQ ID NO: 610352 - DNA, 25 bp, Rattus norvegicus
tgagccagcctgtatagcacaacat

SEQ ID NO: 610353 - DNA, 25 bp, Rattus norvegicus
tgagccagctgccagcgttggcaat

SEQ ID NO: 610354 - DNA, 25 bp, Rattus norvegicus
tgagccagctgcgagcgttggcaat

SEQ ID NO: 610355 - DNA, 25 bp, Rattus norvegicus
tgagccagctggcagcctgacaaca

SEQ ID NO: 610356 - DNA, 25 bp, Rattus norvegicus
tgagccagctgggagcctgacaaca

SEQ ID NO: 610357 - DNA, 25 bp, Rattus norvegicus
tgagccaggcctatgcaatcagcgc

SEQ ID NO: 610358 - DNA, 25 bp, Rattus norvegicus
tgagccaggcctttgcaatcagcgc

SEQ ID NO: 610359 - DNA, 25 bp, Rattus norvegicus
tgagccaggcttctatacaacccct

SEQ ID NO: 610360 - DNA, 25 bp, Rattus norvegicus
tgagccaggcttgtatacaacccct

SEQ ID NO: 610361 - DNA, 25 bp, Rattus norvegicus
tgagccagggctcttttctgggacc

SEQ ID NO: 610362 - DNA, 25 bp, Rattus norvegicus
tgagccagggctgttttctgggacc

SEQ ID NO: 610363 - DNA, 25 bp, Rattus norvegicus
tgagccaggtaaccttcgaggctgt

SEQ ID NO: 610364 - DNA, 25 bp, Rattus norvegicus
tgagccaggtaagcttcgaggctgt

SEQ ID NO: 610365 - DNA, 25 bp, Rattus norvegicus
tgagccaggtctcccatctgaaaga

SEQ ID NO: 610366 - DNA, 25 bp, Rattus norvegicus
tgagccaggtctgccatctgaaaga

SEQ ID NO: 610367 - DNA, 25 bp, Rattus norvegicus
tgagccagtaaaccgtctaaaccag

SEQ ID NO: 610368 - DNA, 25 bp, Rattus norvegicus
tgagccagtaaagcgtctaaaccag

SEQ ID NO: 610369 - DNA, 25 bp, Rattus norvegicus
tgagccagttcacctaacttttgct

SEQ ID NO: 610370 - DNA, 25 bp, Rattus norvegicus
tgagccagttcagctaacttttgct

SEQ ID NO: 610371 - DNA, 25 bp, Rattus norvegicus
tgagccataatgacagcgccatctg

SEQ ID NO: 610372 - DNA, 25 bp, Rattus norvegicus
tgagccataatgtcagcgccatctg

SEQ ID NO: 610373 - DNA, 25 bp, Rattus norvegicus
tgagccatacccaactgagttcttc

SEQ ID NO: 610374 - DNA, 25 bp, Rattus norvegicus
tgagccataccctactgagttcttc

SEQ ID NO: 610375 - DNA, 25 bp, Rattus norvegicus
tgagccatagctacacacacatcga

SEQ ID NO: 610376 - DNA, 25 bp, Rattus norvegicus
tgagccatagctatacccttcaaac

SEQ ID NO: 610377 - DNA, 25 bp, Rattus norvegicus
tgagccatagcttcacacacatcga

SEQ ID NO: 610378 - DNA, 25 bp, Rattus norvegicus
tgagccatagctttacccttcaaac

SEQ ID NO: 610379 - DNA, 25 bp, Rattus norvegicus
tgagccatatccatagcctcagcta

SEQ ID NO: 610380 - DNA, 25 bp, Rattus norvegicus
tgagccatatccttagcctcagcta

SEQ ID NO: 610381 - DNA, 25 bp, Rattus norvegicus
tgagccatcaggctagcagaacaag

SEQ ID NO: 610382 - DNA, 25 bp, Rattus norvegicus
tgagccatcagggtagcagaacaag

SEQ ID NO: 610383 - DNA, 25 bp, Rattus norvegicus
tgagccatccaccacaaaagagaag

SEQ ID NO: 610384 - DNA, 25 bp, Rattus norvegicus
tgagccatccacgacaaaagagaag

SEQ ID NO: 610385 - DNA, 25 bp, Rattus norvegicus
tgagccatcccaacaccatttataa

SEQ ID NO: 610386 - DNA, 25 bp, Rattus norvegicus
tgagccatcccatcaccatttataa

SEQ ID NO: 610387 - DNA, 25 bp, Rattus norvegicus
tgagccatcctaagcctgtcaggac

SEQ ID NO: 610388 - DNA, 25 bp, Rattus norvegicus
tgagccatcctatgcctgtcaggac

SEQ ID NO: 610389 - DNA, 25 bp, Rattus norvegicus
tgagccatcctgctgattctctgag

SEQ ID NO: 610390 - DNA, 25 bp, Rattus norvegicus
tgagccatcctggtgattctctgag

SEQ ID NO: 610391 - DNA, 25 bp, Rattus norvegicus
tgagccatcttgaagatcccaagga

SEQ ID NO: 610392 - DNA, 25 bp, Rattus norvegicus
tgagccatcttgtagatcccaagga

SEQ ID NO: 610393 - DNA, 25 bp, Rattus norvegicus
tgagccatgggtcggccagaacatc

SEQ ID NO: 610394 - DNA, 25 bp, Rattus norvegicus
tgagccatgggtgggccagaacatc

SEQ ID NO: 610395 - DNA, 25 bp, Rattus norvegicus
tgagccatgtcgcaagcacgtctcc

SEQ ID NO: 610396 - DNA, 25 bp, Rattus norvegicus
tgagccatgtcggaagcacgtctcc

SEQ ID NO: 610397 - DNA, 25 bp, Rattus norvegicus
tgagccatgtgtcgtaacgtttttt

SEQ ID NO: 610398 - DNA, 25 bp, Rattus norvegicus
tgagccatgtgtggtaacgtttttt

SEQ ID NO: 610399 - DNA, 25 bp, Rattus norvegicus
tgagccattaagacgcacagggtga

SEQ ID NO: 610400 - DNA, 25 bp, Rattus norvegicus
tgagccattaagtcgcacagggtga

SEQ ID NO: 610401 - DNA, 25 bp, Rattus norvegicus
tgagccattcaaactaaacctatgt

SEQ ID NO: 610402 - DNA, 25 bp, Rattus norvegicus
tgagccattcaatctaaacctatgt

SEQ ID NO: 610403 - DNA, 25 bp, Rattus norvegicus
tgagccatttaacagttccccttca

SEQ ID NO: 610404 - DNA, 25 bp, Rattus norvegicus
tgagccatttaagagttccccttca

SEQ ID NO: 610405 - DNA, 25 bp, Rattus norvegicus
tgagccatttctctggtgcggatct

SEQ ID NO: 610406 - DNA, 25 bp, Rattus norvegicus
tgagccatttctgtggtgcggatct

SEQ ID NO: 610407 - DNA, 25 bp, Rattus norvegicus
tgagccatttttcagtctcctcaga

SEQ ID NO: 610408 - DNA, 25 bp, Rattus norvegicus
tgagccatttttgagtctcctcaga

SEQ ID NO: 610409 - DNA, 25 bp, Rattus norvegicus
tgagcccaacaacccatgtagtcaa

SEQ ID NO: 610410 - DNA, 25 bp, Rattus norvegicus
tgagcccaacaagccatgtagtcaa

SEQ ID NO: 610411 - DNA, 25 bp, Rattus norvegicus
tgagcccaagatctccttcctgagg

SEQ ID NO: 610412 - DNA, 25 bp, Rattus norvegicus
tgagcccaagatgtccttcctgagg

SEQ ID NO: 610413 - DNA, 25 bp, Rattus norvegicus
tgagcccaatgaacccagcaggtat

SEQ ID NO: 610414 - DNA, 25 bp, Rattus norvegicus
tgagcccaatgatcccagcaggtat

SEQ ID NO: 610415 - DNA, 25 bp, Rattus norvegicus
tgagcccacagtaatcttctgagaa

SEQ ID NO: 610416 - DNA, 25 bp, Rattus norvegicus
tgagcccacagttatcttctgagaa

SEQ ID NO: 610417 - DNA, 25 bp, Rattus norvegicus
tgagcccagatgatcaccacatgac

SEQ ID NO: 610418 - DNA, 25 bp, Rattus norvegicus
tgagcccagatgttcaccacatgac

SEQ ID NO: 610419 - DNA, 25 bp, Rattus norvegicus
tgagcccagcccaaacttgaatttc

SEQ ID NO: 610420 - DNA, 25 bp, Rattus norvegicus
tgagcccagccctaacttgaatttc

SEQ ID NO: 610421 - DNA, 25 bp, Rattus norvegicus
tgagcccagctcagattcacacaat

SEQ ID NO: 610422 - DNA, 25 bp, Rattus norvegicus
tgagcccagctctgattcacacaat

SEQ ID NO: 610423 - DNA, 25 bp, Rattus norvegicus
tgagcccaggccagtgtataaccta

SEQ ID NO: 610424 - DNA, 25 bp, Rattus norvegicus
tgagcccaggcctgtgtataaccta

SEQ ID NO: 610425 - DNA, 25 bp, Rattus norvegicus
tgagcccagtggagcatgtatactt

SEQ ID NO: 610426 - DNA, 25 bp, Rattus norvegicus
tgagcccagtggtgcatgtatactt

SEQ ID NO: 610427 - DNA, 25 bp, Rattus norvegicus
tgagcccatccaccgttttgaaggt

SEQ ID NO: 610428 - DNA, 25 bp, Rattus norvegicus
tgagcccatccagcgttttgaaggt

SEQ ID NO: 610429 - DNA, 25 bp, Rattus norvegicus
tgagcccatgctatactacagacct

SEQ ID NO: 610430 - DNA, 25 bp, Rattus norvegicus
tgagcccatgctttactacagacct

SEQ ID NO: 610431 - DNA, 25 bp, Rattus norvegicus
tgagcccatggtcatctccagagtc

SEQ ID NO: 610432 - DNA, 25 bp, Rattus norvegicus
tgagcccatggtgatctccagagtc

SEQ ID NO: 610433 - DNA, 25 bp, Rattus norvegicus
tgagccccaaacagagcctttgctt

SEQ ID NO: 610434 - DNA, 25 bp, Rattus norvegicus
tgagccccaaaccagggacaggtga

SEQ ID NO: 610435 - DNA, 25 bp, Rattus norvegicus
tgagccccaaacgagggacaggtga

SEQ ID NO: 610436 - DNA, 25 bp, Rattus norvegicus
tgagccccaaactgagcctttgctt

SEQ ID NO: 610437 - DNA, 25 bp, Rattus norvegicus
tgagccccaaagaagttcagtcctt

SEQ ID NO: 610438 - DNA, 25 bp, Rattus norvegicus
tgagccccaaagtagttcagtcctt

SEQ ID NO: 610439 - DNA, 25 bp, Rattus norvegicus
tgagccccaagtaatgcacacagca

SEQ ID NO: 610440 - DNA, 25 bp, Rattus norvegicus
tgagccccaagttatgcacacagca

SEQ ID NO: 610441 - DNA, 25 bp, Rattus norvegicus
tgagccccaatgatcccacagaaca

SEQ ID NO: 610442 - DNA, 25 bp, Rattus norvegicus
tgagccccaatgttcccacagaaca

SEQ ID NO: 610443 - DNA, 25 bp, Rattus norvegicus
tgagccccacataacctggagggag

SEQ ID NO: 610444 - DNA, 25 bp, Rattus norvegicus
tgagccccacattacctggagggag

SEQ ID NO: 610445 - DNA, 25 bp, Rattus norvegicus
tgagccccacctacagcagtgatat

SEQ ID NO: 610446 - DNA, 25 bp, Rattus norvegicus
tgagccccacctatgaatgtacagt

SEQ ID NO: 610447 - DNA, 25 bp, Rattus norvegicus
tgagccccaccttcagcagtgatat

SEQ ID NO: 610448 - DNA, 25 bp, Rattus norvegicus
tgagccccacctttgaatgtacagt

SEQ ID NO: 610449 - DNA, 25 bp, Rattus norvegicus
tgagccccagatcccaagagaagta

SEQ ID NO: 610450 - DNA, 25 bp, Rattus norvegicus
tgagccccagatgccaagagaagta

SEQ ID NO: 610451 - DNA, 25 bp, Rattus norvegicus
tgagccccagtaacatccatcctag

SEQ ID NO: 610452 - DNA, 25 bp, Rattus norvegicus
tgagccccagtaagtccagtttaat

SEQ ID NO: 610453 - DNA, 25 bp, Rattus norvegicus
tgagccccagtacccacattggtaa

SEQ ID NO: 610454 - DNA, 25 bp, Rattus norvegicus
tgagccccagtagccacattggtaa

SEQ ID NO: 610455 - DNA, 25 bp, Rattus norvegicus
tgagccccagtatcatccatcctag

SEQ ID NO: 610456 - DNA, 25 bp, Rattus norvegicus
tgagccccagtatgtccagtttaat

SEQ ID NO: 610457 - DNA, 25 bp, Rattus norvegicus
tgagccccagttacaggccctgtta

SEQ ID NO: 610458 - DNA, 25 bp, Rattus norvegicus
tgagccccagtttcaggccctgtta

SEQ ID NO: 610459 - DNA, 25 bp, Rattus norvegicus
tgagccccatacatgtcaactagag

SEQ ID NO: 610460 - DNA, 25 bp, Rattus norvegicus
tgagccccatacttgtcaactagag

SEQ ID NO: 610461 - DNA, 25 bp, Rattus norvegicus
tgagccccatctacaagctgatcgt

SEQ ID NO: 610462 - DNA, 25 bp, Rattus norvegicus
tgagccccatcttcaagctgatcgt

SEQ ID NO: 610463 - DNA, 25 bp, Rattus norvegicus
tgagccccatggagtacggtgccta

SEQ ID NO: 610464 - DNA, 25 bp, Rattus norvegicus
tgagccccatggtgtacggtgccta

SEQ ID NO: 610465 - DNA, 25 bp, Rattus norvegicus
tgagccccgagaaacactgcaggtc

SEQ ID NO: 610466 - DNA, 25 bp, Rattus norvegicus
tgagccccgagatacactgcaggtc

SEQ ID NO: 610467 - DNA, 25 bp, Rattus norvegicus
tgagccccgagtaccagccttgtag

SEQ ID NO: 610468 - DNA, 25 bp, Rattus norvegicus
tgagccccgagttccagccttgtag

SEQ ID NO: 610469 - DNA, 25 bp, Rattus norvegicus
tgagccccgggaccaatagagttga

SEQ ID NO: 610470 - DNA, 25 bp, Rattus norvegicus
tgagccccgggagcaatagagttga

SEQ ID NO: 610471 - DNA, 25 bp, Rattus norvegicus
tgagccccggtgattggtggattca

SEQ ID NO: 610472 - DNA, 25 bp, Rattus norvegicus
tgagccccggtgtttggtggattca

SEQ ID NO: 610473 - DNA, 25 bp, Rattus norvegicus
tgagcccctaaacccaaacctgaaa

SEQ ID NO: 610474 - DNA, 25 bp, Rattus norvegicus
tgagcccctaaagccaaacctgaaa

SEQ ID NO: 610475 - DNA, 25 bp, Rattus norvegicus
tgagcccctgaaatcaaacctgaaa

SEQ ID NO: 610476 - DNA, 25 bp, Rattus norvegicus
tgagcccctgaattcaaacctgaaa

SEQ ID NO: 610477 - DNA, 25 bp, Rattus norvegicus
tgagccccttgtcagactttgtctc

SEQ ID NO: 610478 - DNA, 25 bp, Rattus norvegicus
tgagccccttgtgagactttgtctc

SEQ ID NO: 610479 - DNA, 25 bp, Rattus norvegicus
tgagccccttttaagtcctttggca

SEQ ID NO: 610480 - DNA, 25 bp, Rattus norvegicus
tgagcccctttttagtcctttggca

SEQ ID NO: 610481 - DNA, 25 bp, Rattus norvegicus
tgagcccgcctaaagattttccatg

SEQ ID NO: 610482 - DNA, 25 bp, Rattus norvegicus
tgagcccgcctatagattttccatg

SEQ ID NO: 610483 - DNA, 25 bp, Rattus norvegicus
tgagcccgctttctgatgatacctt

SEQ ID NO: 610484 - DNA, 25 bp, Rattus norvegicus
tgagcccgctttgtgatgatacctt

SEQ ID NO: 610485 - DNA, 25 bp, Rattus norvegicus
tgagcccgttatcctggacttgaga

SEQ ID NO: 610486 - DNA, 25 bp, Rattus norvegicus
tgagcccgttatgctggacttgaga

SEQ ID NO: 610487 - DNA, 25 bp, Rattus norvegicus
tgagcccgttgtactactgcatcat

SEQ ID NO: 610488 - DNA, 25 bp, Rattus norvegicus
tgagcccgttgttctactgcatcat

SEQ ID NO: 610489 - DNA, 25 bp, Rattus norvegicus
tgagcccgttttacatgcgatgact

SEQ ID NO: 610490 - DNA, 25 bp, Rattus norvegicus
tgagcccgtttttcatgcgatgact

SEQ ID NO: 610491 - DNA, 25 bp, Rattus norvegicus
tgagccctaagaagggtccagccga

SEQ ID NO: 610492 - DNA, 25 bp, Rattus norvegicus
tgagccctaagatgggtccagccga

SEQ ID NO: 610493 - DNA, 25 bp, Rattus norvegicus
tgagccctaaggctagctggtgccc

SEQ ID NO: 610494 - DNA, 25 bp, Rattus norvegicus
tgagccctaagggtagctggtgccc

SEQ ID NO: 610495 - DNA, 25 bp, Rattus norvegicus
tgagccctacagaggaggcccagat

SEQ ID NO: 610496 - DNA, 25 bp, Rattus norvegicus
tgagccctacagatgcacaaacctg

SEQ ID NO: 610497 - DNA, 25 bp, Rattus norvegicus
tgagccctacagtggaggcccagat

SEQ ID NO: 610498 - DNA, 25 bp, Rattus norvegicus
tgagccctacagttgcacaaacctg

SEQ ID NO: 610499 - DNA, 25 bp, Rattus norvegicus
tgagccctacctatggcgttctata

SEQ ID NO: 610500 - DNA, 25 bp, Rattus norvegicus
tgagccctacctttggcgttctata

SEQ ID NO: 610501 - DNA, 25 bp, Rattus norvegicus
tgagccctagctcctgagttggatg

SEQ ID NO: 610502 - DNA, 25 bp, Rattus norvegicus
tgagccctagctgctgagttggatg

SEQ ID NO: 610503 - DNA, 25 bp, Rattus norvegicus
tgagccctcataaagccataagtat

SEQ ID NO: 610504 - DNA, 25 bp, Rattus norvegicus
tgagccctcatatagccataagtat

SEQ ID NO: 610505 - DNA, 25 bp, Rattus norvegicus
tgagccctccacctttatttttgta

SEQ ID NO: 610506 - DNA, 25 bp, Rattus norvegicus
tgagccctccacgtttatttttgta

SEQ ID NO: 610507 - DNA, 25 bp, Rattus norvegicus
tgagccctccctatagatttacttg

SEQ ID NO: 610508 - DNA, 25 bp, Rattus norvegicus
tgagccctccctttagatttacttg

SEQ ID NO: 610509 - DNA, 25 bp, Rattus norvegicus
tgagccctctccaaatgatggtcgt

SEQ ID NO: 610510 - DNA, 25 bp, Rattus norvegicus
tgagccctctcctaatgatggtcgt

SEQ ID NO: 610511 - DNA, 25 bp, Rattus norvegicus
tgagccctgaatccacacggttact

SEQ ID NO: 610512 - DNA, 25 bp, Rattus norvegicus
tgagccctgaatgcacacggttact

SEQ ID NO: 610513 - DNA, 25 bp, Rattus norvegicus
tgagccctgacccagaaaacacaga

SEQ ID NO: 610514 - DNA, 25 bp, Rattus norvegicus
tgagccctgaccgagaaaacacaga

SEQ ID NO: 610515 - DNA, 25 bp, Rattus norvegicus
tgagccctgggtcgctaccaaccat

SEQ ID NO: 610516 - DNA, 25 bp, Rattus norvegicus
tgagccctgggtggctaccaaccat

SEQ ID NO: 610517 - DNA, 25 bp, Rattus norvegicus
tgagccctggtaccactgttcgaga

SEQ ID NO: 610518 - DNA, 25 bp, Rattus norvegicus
tgagccctggtagcactgttcgaga

SEQ ID NO: 610519 - DNA, 25 bp, Rattus norvegicus
tgagccctgtgcacggagcaccaga

SEQ ID NO: 610520 - DNA, 25 bp, Rattus norvegicus
tgagccctgtgctcggagcaccaga

SEQ ID NO: 610521 - DNA, 25 bp, Rattus norvegicus
tgagcccttagtattcaaacctcct

SEQ ID NO: 610522 - DNA, 25 bp, Rattus norvegicus
tgagcccttagttttcaaacctcct

SEQ ID NO: 610523 - DNA, 25 bp, Rattus norvegicus
tgagcccttatcagggtgctaggaa

SEQ ID NO: 610524 - DNA, 25 bp, Rattus norvegicus
tgagcccttatctgggtgctaggaa

SEQ ID NO: 610525 - DNA, 25 bp, Rattus norvegicus
tgagcccttgaaatatactggaaaa

SEQ ID NO: 610526 - DNA, 25 bp, Rattus norvegicus
tgagcccttgaattatactggaaaa

SEQ ID NO: 610527 - DNA, 25 bp, Rattus norvegicus
tgagcccttgtgagcaccagtcctg

SEQ ID NO: 610528 - DNA, 25 bp, Rattus norvegicus
tgagcccttgtgtgcaccagtcctg

SEQ ID NO: 610529 - DNA, 25 bp, Rattus norvegicus
tgagccctttctctgaagttggtct

SEQ ID NO: 610530 - DNA, 25 bp, Rattus norvegicus
tgagccctttctgtgaagttggtct

SEQ ID NO: 610531 - DNA, 25 bp, Rattus norvegicus
tgagcccttttactgtcacagacca

SEQ ID NO: 610532 - DNA, 25 bp, Rattus norvegicus
tgagcccttttagtgtcacagacca

SEQ ID NO: 610533 - DNA, 25 bp, Rattus norvegicus
tgagccgaagcaaggccgactgctg

SEQ ID NO: 610534 - DNA, 25 bp, Rattus norvegicus
tgagccgaagcatggccgactgctg

SEQ ID NO: 610535 - DNA, 25 bp, Rattus norvegicus
tgagccgacacaccagcagctggtt

SEQ ID NO: 610536 - DNA, 25 bp, Rattus norvegicus
tgagccgacacagcagcagctggtt

SEQ ID NO: 610537 - DNA, 25 bp, Rattus norvegicus
tgagccgactgtctcagctccctga

SEQ ID NO: 610538 - DNA, 25 bp, Rattus norvegicus
tgagccgactgtgtcagctccctga

SEQ ID NO: 610539 - DNA, 25 bp, Rattus norvegicus
tgagccgagccgattttaccatgtg

SEQ ID NO: 610540 - DNA, 25 bp, Rattus norvegicus
tgagccgagccgtttttaccatgtg

SEQ ID NO: 610541 - DNA, 25 bp, Rattus norvegicus
tgagccgagcggagcctctttagag

SEQ ID NO: 610542 - DNA, 25 bp, Rattus norvegicus
tgagccgagcggtgcctctttagag

SEQ ID NO: 610543 - DNA, 25 bp, Rattus norvegicus
tgagccgatcagaatttcgcatggc

SEQ ID NO: 610544 - DNA, 25 bp, Rattus norvegicus
tgagccgatcagtatttcgcatggc

SEQ ID NO: 610545 - DNA, 25 bp, Rattus norvegicus
tgagccgcagctccgcagctgctga

SEQ ID NO: 610546 - DNA, 25 bp, Rattus norvegicus
tgagccgcagctgcgcagctgctga

SEQ ID NO: 610547 - DNA, 25 bp, Rattus norvegicus
tgagccgcatgtatctgtgtttgat

SEQ ID NO: 610548 - DNA, 25 bp, Rattus norvegicus
tgagccgcatgtttctgtgtttgat

SEQ ID NO: 610549 - DNA, 25 bp, Rattus norvegicus
tgagccgccactcgagtgtcagaag

SEQ ID NO: 610550 - DNA, 25 bp, Rattus norvegicus
tgagccgccactcgcgggaacgtca

SEQ ID NO: 610551 - DNA, 25 bp, Rattus norvegicus
tgagccgccactggagtgtcagaag

SEQ ID NO: 610552 - DNA, 25 bp, Rattus norvegicus
tgagccgccactggcgggaacgtca

SEQ ID NO: 610553 - DNA, 25 bp, Rattus norvegicus
tgagccgccctcagagtcttggaaa

SEQ ID NO: 610554 - DNA, 25 bp, Rattus norvegicus
tgagccgccctctgagtcttggaaa

SEQ ID NO: 610555 - DNA, 25 bp, Rattus norvegicus
tgagccgcctaacactggatgacat

SEQ ID NO: 610556 - DNA, 25 bp, Rattus norvegicus
tgagccgcctaagactggatgacat

SEQ ID NO: 610557 - DNA, 25 bp, Rattus norvegicus
tgagccgcctgcactggaagaaggt

SEQ ID NO: 610558 - DNA, 25 bp, Rattus norvegicus
tgagccgcctgctctggaagaaggt

SEQ ID NO: 610559 - DNA, 25 bp, Rattus norvegicus
tgagccgcctgtctgtgcgccatgc

SEQ ID NO: 610560 - DNA, 25 bp, Rattus norvegicus
tgagccgcctgtgtgtgcgccatgc

SEQ ID NO: 610561 - DNA, 25 bp, Rattus norvegicus
tgagccgcggatactgcgaatcgcc

SEQ ID NO: 610562 - DNA, 25 bp, Rattus norvegicus
tgagccgcggattctgcgaatcgcc

SEQ ID NO: 610563 - DNA, 25 bp, Rattus norvegicus
tgagccggacacagggcagtctcca

SEQ ID NO: 610564 - DNA, 25 bp, Rattus norvegicus
tgagccggacactgggcagtctcca

SEQ ID NO: 610565 - DNA, 25 bp, Rattus norvegicus
tgagccggctgacaatacaatgaaa

SEQ ID NO: 610566 - DNA, 25 bp, Rattus norvegicus
tgagccggctgagaatacaatgaaa

SEQ ID NO: 610567 - DNA, 25 bp, Rattus norvegicus
tgagccgtatttaccagcagaatgt

SEQ ID NO: 610568 - DNA, 25 bp, Rattus norvegicus
tgagccgtattttccagcagaatgt

SEQ ID NO: 610569 - DNA, 25 bp, Rattus norvegicus
tgagccgtcagcacttttctgtcaa

SEQ ID NO: 610570 - DNA, 25 bp, Rattus norvegicus
tgagccgtcagctcttttctgtcaa

SEQ ID NO: 610571 - DNA, 25 bp, Rattus norvegicus
tgagccgtcatgagagtctccagag

SEQ ID NO: 610572 - DNA, 25 bp, Rattus norvegicus
tgagccgtcatgtgagtctccagag

SEQ ID NO: 610573 - DNA, 25 bp, Rattus norvegicus
tgagccgtcgccaaaataatcttcc

SEQ ID NO: 610574 - DNA, 25 bp, Rattus norvegicus
tgagccgtcgcctaaataatcttcc

SEQ ID NO: 610575 - DNA, 25 bp, Rattus norvegicus
tgagccgtgttcatgtctgtaaatg

SEQ ID NO: 610576 - DNA, 25 bp, Rattus norvegicus
tgagccgtgttcttgtctgtaaatg

SEQ ID NO: 610577 - DNA, 25 bp, Rattus norvegicus
tgagcctaagccaagtcagcagcat

SEQ ID NO: 610578 - DNA, 25 bp, Rattus norvegicus
tgagcctaagcctagtcagcagcat

SEQ ID NO: 610579 - DNA, 25 bp, Rattus norvegicus
tgagcctaatccatccctgaggtta

SEQ ID NO: 610580 - DNA, 25 bp, Rattus norvegicus
tgagcctaatccttccctgaggtta

SEQ ID NO: 610581 - DNA, 25 bp, Rattus norvegicus
tgagcctacgctatctgcagagaca

SEQ ID NO: 610582 - DNA, 25 bp, Rattus norvegicus
tgagcctacgctttctgcagagaca

SEQ ID NO: 610583 - DNA, 25 bp, Rattus norvegicus
tgagcctactgtaagcccagtgaga

SEQ ID NO: 610584 - DNA, 25 bp, Rattus norvegicus
tgagcctactgttagcccagtgaga

SEQ ID NO: 610585 - DNA, 25 bp, Rattus norvegicus
tgagcctagcttaccatgtgcacaa

SEQ ID NO: 610586 - DNA, 25 bp, Rattus norvegicus
tgagcctagcttagccagggtcctg

SEQ ID NO: 610587 - DNA, 25 bp, Rattus norvegicus
tgagcctagctttccatgtgcacaa

SEQ ID NO: 610588 - DNA, 25 bp, Rattus norvegicus
tgagcctagctttgccagggtcctg

SEQ ID NO: 610589 - DNA, 25 bp, Rattus norvegicus
tgagcctataccctggttctctcac

SEQ ID NO: 610590 - DNA, 25 bp, Rattus norvegicus
tgagcctataccgtggttctctcac

SEQ ID NO: 610591 - DNA, 25 bp, Rattus norvegicus
tgagcctcaaagctttcgggcaggt

SEQ ID NO: 610592 - DNA, 25 bp, Rattus norvegicus
tgagcctcaaaggtttcgggcaggt

SEQ ID NO: 610593 - DNA, 25 bp, Rattus norvegicus
tgagcctcaagacctaagttccagc

SEQ ID NO: 610594 - DNA, 25 bp, Rattus norvegicus
tgagcctcaagagctaagttccagc

SEQ ID NO: 610595 - DNA, 25 bp, Rattus norvegicus
tgagcctcaagcctggtctttctga

SEQ ID NO: 610596 - DNA, 25 bp, Rattus norvegicus
tgagcctcaagcgtggtctttctga

SEQ ID NO: 610597 - DNA, 25 bp, Rattus norvegicus
tgagcctcacgcagctggtgttttg

SEQ ID NO: 610598 - DNA, 25 bp, Rattus norvegicus
tgagcctcacgctgctggtgttttg

SEQ ID NO: 610599 - DNA, 25 bp, Rattus norvegicus
tgagcctcagacaaattgtctgtcc

SEQ ID NO: 610600 - DNA, 25 bp, Rattus norvegicus
tgagcctcagactaattgtctgtcc

SEQ ID NO: 610601 - DNA, 25 bp, Rattus norvegicus
tgagcctcaggcacaaaacagaaaa

SEQ ID NO: 610602 - DNA, 25 bp, Rattus norvegicus
tgagcctcaggctcaaaacagaaaa

SEQ ID NO: 610603 - DNA, 25 bp, Rattus norvegicus
tgagcctcaggtagccggaagcaag

SEQ ID NO: 610604 - DNA, 25 bp, Rattus norvegicus
tgagcctcaggtccttggatgccat

SEQ ID NO: 610605 - DNA, 25 bp, Rattus norvegicus
tgagcctcaggtgcttggatgccat

SEQ ID NO: 610606 - DNA, 25 bp, Rattus norvegicus
tgagcctcaggttgccggaagcaag

SEQ ID NO: 610607 - DNA, 25 bp, Rattus norvegicus
tgagcctcagtgcagggattcctcc

SEQ ID NO: 610608 - DNA, 25 bp, Rattus norvegicus
tgagcctcagtggagggattcctcc

SEQ ID NO: 610609 - DNA, 25 bp, Rattus norvegicus
tgagcctcatagactgtaaaacaga

SEQ ID NO: 610610 - DNA, 25 bp, Rattus norvegicus
tgagcctcatagtctgtaaaacaga

SEQ ID NO: 610611 - DNA, 25 bp, Rattus norvegicus
tgagcctcatgtacctcctatagtg

SEQ ID NO: 610612 - DNA, 25 bp, Rattus norvegicus
tgagcctcatgttcctcctatagtg

SEQ ID NO: 610613 - DNA, 25 bp, Rattus norvegicus
tgagcctccaggagggcaatctcca

SEQ ID NO: 610614 - DNA, 25 bp, Rattus norvegicus
tgagcctccaggtgggcaatctcca

SEQ ID NO: 610615 - DNA, 25 bp, Rattus norvegicus
tgagcctcccaacatgacaacgact

SEQ ID NO: 610616 - DNA, 25 bp, Rattus norvegicus
tgagcctcccaagatgacaacgact

SEQ ID NO: 610617 - DNA, 25 bp, Rattus norvegicus
tgagcctcctctacgaaaagcctgg

SEQ ID NO: 610618 - DNA, 25 bp, Rattus norvegicus
tgagcctcctcttcgaaaagcctgg

SEQ ID NO: 610619 - DNA, 25 bp, Rattus norvegicus
tgagcctccttcacagtcacaggat

SEQ ID NO: 610620 - DNA, 25 bp, Rattus norvegicus
tgagcctccttctcagtcacaggat

SEQ ID NO: 610621 - DNA, 25 bp, Rattus norvegicus
tgagcctcgcacctccagtgtggag

SEQ ID NO: 610622 - DNA, 25 bp, Rattus norvegicus
tgagcctcgcacgtccagtgtggag

SEQ ID NO: 610623 - DNA, 25 bp, Rattus norvegicus
tgagcctcggccacttgaatgtgaa

SEQ ID NO: 610624 - DNA, 25 bp, Rattus norvegicus
tgagcctcggcctcttgaatgtgaa

SEQ ID NO: 610625 - DNA, 25 bp, Rattus norvegicus
tgagcctctaacatgcaggcctctt

SEQ ID NO: 610626 - DNA, 25 bp, Rattus norvegicus
tgagcctctaacttgcaggcctctt

SEQ ID NO: 610627 - DNA, 25 bp, Rattus norvegicus
tgagcctctcagcaagcccagggca

SEQ ID NO: 610628 - DNA, 25 bp, Rattus norvegicus
tgagcctctcaggaagcccagggca

SEQ ID NO: 610629 - DNA, 25 bp, Rattus norvegicus
tgagcctctcttaactttgaaccag

SEQ ID NO: 610630 - DNA, 25 bp, Rattus norvegicus
tgagcctctctttactttgaaccag

SEQ ID NO: 610631 - DNA, 25 bp, Rattus norvegicus
tgagcctctgccatccagagtgcaa

SEQ ID NO: 610632 - DNA, 25 bp, Rattus norvegicus
tgagcctctgccttccagagtgcaa

SEQ ID NO: 610633 - DNA, 25 bp, Rattus norvegicus
tgagcctctgctaactcccatgaga

SEQ ID NO: 610634 - DNA, 25 bp, Rattus norvegicus
tgagcctctgcttactcccatgaga

SEQ ID NO: 610635 - DNA, 25 bp, Rattus norvegicus
tgagcctctggtcttcatcactgaa

SEQ ID NO: 610636 - DNA, 25 bp, Rattus norvegicus
tgagcctctggtgttcatcactgaa

SEQ ID NO: 610637 - DNA, 25 bp, Rattus norvegicus
tgagcctctgttcattagccccaag

SEQ ID NO: 610638 - DNA, 25 bp, Rattus norvegicus
tgagcctctgttgattagccccaag

SEQ ID NO: 610639 - DNA, 25 bp, Rattus norvegicus
tgagcctcttgacttgcatgatttc

SEQ ID NO: 610640 - DNA, 25 bp, Rattus norvegicus
tgagcctcttgagttgcatgatttc

SEQ ID NO: 610641 - DNA, 25 bp, Rattus norvegicus
tgagcctcttgccacagagccagtc

SEQ ID NO: 610642 - DNA, 25 bp, Rattus norvegicus
tgagcctcttgcgacagagccagtc

SEQ ID NO: 610643 - DNA, 25 bp, Rattus norvegicus
tgagcctgaattatcctcctggata

SEQ ID NO: 610644 - DNA, 25 bp, Rattus norvegicus
tgagcctgaattttcctcctggata

SEQ ID NO: 610645 - DNA, 25 bp, Rattus norvegicus
tgagcctgaccacctttgtatacaa

SEQ ID NO: 610646 - DNA, 25 bp, Rattus norvegicus
tgagcctgaccagctttgtatacaa

SEQ ID NO: 610647 - DNA, 25 bp, Rattus norvegicus
tgagcctgacccaatagatgcttcg

SEQ ID NO: 610648 - DNA, 25 bp, Rattus norvegicus
tgagcctgaccctatagatgcttcg

SEQ ID NO: 610649 - DNA, 25 bp, Rattus norvegicus
tgagcctgcaagctgtcacccttga

SEQ ID NO: 610650 - DNA, 25 bp, Rattus norvegicus
tgagcctgcaaggtgtcacccttga

SEQ ID NO: 610651 - DNA, 25 bp, Rattus norvegicus
tgagcctgcacacacgtcacatcga

SEQ ID NO: 610652 - DNA, 25 bp, Rattus norvegicus
tgagcctgcacagacgtcacatcga

SEQ ID NO: 610653 - DNA, 25 bp, Rattus norvegicus
tgagcctgcagaccccggtttctat

SEQ ID NO: 610654 - DNA, 25 bp, Rattus norvegicus
tgagcctgcagagcccggtttctat

SEQ ID NO: 610655 - DNA, 25 bp, Rattus norvegicus
tgagcctgcagcagagctctattat

SEQ ID NO: 610656 - DNA, 25 bp, Rattus norvegicus
tgagcctgcagctgagctctattat

SEQ ID NO: 610657 - DNA, 25 bp, Rattus norvegicus
tgagcctgcaggatccagcgaggat

SEQ ID NO: 610658 - DNA, 25 bp, Rattus norvegicus
tgagcctgcaggttccagcgaggat

SEQ ID NO: 610659 - DNA, 25 bp, Rattus norvegicus
tgagcctgcctactttgccttttta

SEQ ID NO: 610660 - DNA, 25 bp, Rattus norvegicus
tgagcctgcctagtttgccttttta

SEQ ID NO: 610661 - DNA, 25 bp, Rattus norvegicus
tgagcctgcctgctctaagtttaga

SEQ ID NO: 610662 - DNA, 25 bp, Rattus norvegicus
tgagcctgcctggtctaagtttaga

SEQ ID NO: 610663 - DNA, 25 bp, Rattus norvegicus
tgagcctgccttccagtgcatgaga

SEQ ID NO: 610664 - DNA, 25 bp, Rattus norvegicus
tgagcctgccttgcagtgcatgaga

SEQ ID NO: 610665 - DNA, 25 bp, Rattus norvegicus
tgagcctgctcaactattagatact

SEQ ID NO: 610666 - DNA, 25 bp, Rattus norvegicus
tgagcctgctcatctattagatact

SEQ ID NO: 610667 - DNA, 25 bp, Rattus norvegicus
tgagcctgctctcagcacatggcgg

SEQ ID NO: 610668 - DNA, 25 bp, Rattus norvegicus
tgagcctgctctgagcacatggcgg

SEQ ID NO: 610669 - DNA, 25 bp, Rattus norvegicus
tgagcctgctgcaccaagggcccat

SEQ ID NO: 610670 - DNA, 25 bp, Rattus norvegicus
tgagcctgctgctccaagggcccat

SEQ ID NO: 610671 - DNA, 25 bp, Rattus norvegicus
tgagcctgcttcagtatacactgag

SEQ ID NO: 610672 - DNA, 25 bp, Rattus norvegicus
tgagcctgcttctgtatacactgag

SEQ ID NO: 610673 - DNA, 25 bp, Rattus norvegicus
tgagcctggaaaacctgagcctgaa

SEQ ID NO: 610674 - DNA, 25 bp, Rattus norvegicus
tgagcctggaaatcctgagcctgaa

SEQ ID NO: 610675 - DNA, 25 bp, Rattus norvegicus
tgagcctggaccagggctgtgaact

SEQ ID NO: 610676 - DNA, 25 bp, Rattus norvegicus
tgagcctggacctgggctgtgaact

SEQ ID NO: 610677 - DNA, 25 bp, Rattus norvegicus
tgagcctggagacgccttaaccctg

SEQ ID NO: 610678 - DNA, 25 bp, Rattus norvegicus
tgagcctggagaggccttaaccctg

SEQ ID NO: 610679 - DNA, 25 bp, Rattus norvegicus
tgagcctggagtattatatcacact

SEQ ID NO: 610680 - DNA, 25 bp, Rattus norvegicus
tgagcctggagttttatatcacact

SEQ ID NO: 610681 - DNA, 25 bp, Rattus norvegicus
tgagcctggcatcggtaagtcccca

SEQ ID NO: 610682 - DNA, 25 bp, Rattus norvegicus
tgagcctggcatgggtaagtcccca

SEQ ID NO: 610683 - DNA, 25 bp, Rattus norvegicus
tgagcctggcccagcataaaatgaa

SEQ ID NO: 610684 - DNA, 25 bp, Rattus norvegicus
tgagcctggccctgcataaaatgaa

SEQ ID NO: 610685 - DNA, 25 bp, Rattus norvegicus
tgagcctggcctattcacagtattt

SEQ ID NO: 610686 - DNA, 25 bp, Rattus norvegicus
tgagcctggccttttcacagtattt

SEQ ID NO: 610687 - DNA, 25 bp, Rattus norvegicus
tgagcctggcgaaggtctcagcagc

SEQ ID NO: 610688 - DNA, 25 bp, Rattus norvegicus
tgagcctggcgatggtctcagcagc

SEQ ID NO: 610689 - DNA, 25 bp, Rattus norvegicus
tgagcctgggaacaccacagcgctg

SEQ ID NO: 610690 - DNA, 25 bp, Rattus norvegicus
tgagcctgggaagaccacagcgctg

SEQ ID NO: 610691 - DNA, 25 bp, Rattus norvegicus
tgagcctgggacatggcgacctgta

SEQ ID NO: 610692 - DNA, 25 bp, Rattus norvegicus
tgagcctgggacttggcgacctgta

SEQ ID NO: 610693 - DNA, 25 bp, Rattus norvegicus
tgagcctgggccacgtaaggacttg

SEQ ID NO: 610694 - DNA, 25 bp, Rattus norvegicus
tgagcctgggccaggattttggaaa

SEQ ID NO: 610695 - DNA, 25 bp, Rattus norvegicus
tgagcctgggcctcgtaaggacttg

SEQ ID NO: 610696 - DNA, 25 bp, Rattus norvegicus
tgagcctgggcctggattttggaaa

SEQ ID NO: 610697 - DNA, 25 bp, Rattus norvegicus
tgagcctgggctacagttctaactg

SEQ ID NO: 610698 - DNA, 25 bp, Rattus norvegicus
tgagcctgggctatcgttgttttta

SEQ ID NO: 610699 - DNA, 25 bp, Rattus norvegicus
tgagcctgggctctgaccactggac

SEQ ID NO: 610700 - DNA, 25 bp, Rattus norvegicus
tgagcctgggctctgtctgagacct

SEQ ID NO: 610701 - DNA, 25 bp, Rattus norvegicus
tgagcctgggctgtgaccactggac

SEQ ID NO: 610702 - DNA, 25 bp, Rattus norvegicus
tgagcctgggctgtgtctgagacct

SEQ ID NO: 610703 - DNA, 25 bp, Rattus norvegicus
tgagcctgggcttcagttctaactg

SEQ ID NO: 610704 - DNA, 25 bp, Rattus norvegicus
tgagcctgggctttcgttgttttta

SEQ ID NO: 610705 - DNA, 25 bp, Rattus norvegicus
tgagcctgtaatcgcacattccaca

SEQ ID NO: 610706 - DNA, 25 bp, Rattus norvegicus
tgagcctgtaatggcacattccaca

SEQ ID NO: 610707 - DNA, 25 bp, Rattus norvegicus
tgagcctgtgtactgccatttgatt

SEQ ID NO: 610708 - DNA, 25 bp, Rattus norvegicus
tgagcctgtgtagtgccatttgatt

SEQ ID NO: 610709 - DNA, 25 bp, Rattus norvegicus
tgagccttatccacgggcagcagga

SEQ ID NO: 610710 - DNA, 25 bp, Rattus norvegicus
tgagccttatcctcgggcagcagga

SEQ ID NO: 610711 - DNA, 25 bp, Rattus norvegicus
tgagccttatttcatctacttcctc

SEQ ID NO: 610712 - DNA, 25 bp, Rattus norvegicus
tgagccttatttgatctacttcctc

SEQ ID NO: 610713 - DNA, 25 bp, Rattus norvegicus
tgagccttcagcatggcctaatagg

SEQ ID NO: 610714 - DNA, 25 bp, Rattus norvegicus
tgagccttcagcttggcctaatagg

SEQ ID NO: 610715 - DNA, 25 bp, Rattus norvegicus
tgagccttccacagcgacggtctga

SEQ ID NO: 610716 - DNA, 25 bp, Rattus norvegicus
tgagccttccactgcgacggtctga

SEQ ID NO: 610717 - DNA, 25 bp, Rattus norvegicus
tgagccttcctgacgtatataccct

SEQ ID NO: 610718 - DNA, 25 bp, Rattus norvegicus
tgagccttcctgtcgtatataccct

SEQ ID NO: 610719 - DNA, 25 bp, Rattus norvegicus
tgagccttccttcccatagattgta

SEQ ID NO: 610720 - DNA, 25 bp, Rattus norvegicus
tgagccttccttgccatagattgta

SEQ ID NO: 610721 - DNA, 25 bp, Rattus norvegicus
tgagccttcgcaagcttctttgaag

SEQ ID NO: 610722 - DNA, 25 bp, Rattus norvegicus
tgagccttcgcacagcaagatgagc

SEQ ID NO: 610723 - DNA, 25 bp, Rattus norvegicus
tgagccttcgcagagcaagatgagc

SEQ ID NO: 610724 - DNA, 25 bp, Rattus norvegicus
tgagccttcgcatgcttctttgaag

SEQ ID NO: 610725 - DNA, 25 bp, Rattus norvegicus
tgagccttctgtagcaagttgcctg

SEQ ID NO: 610726 - DNA, 25 bp, Rattus norvegicus
tgagccttctgttgcaagttgcctg

SEQ ID NO: 610727 - DNA, 25 bp, Rattus norvegicus
tgagccttcttcaccagtttatgga

SEQ ID NO: 610728 - DNA, 25 bp, Rattus norvegicus
tgagccttcttctccagtttatgga

SEQ ID NO: 610729 - DNA, 25 bp, Rattus norvegicus
tgagccttgcgacacagtgcagcag

SEQ ID NO: 610730 - DNA, 25 bp, Rattus norvegicus
tgagccttgcgagacagtgcagcag

SEQ ID NO: 610731 - DNA, 25 bp, Rattus norvegicus
tgagccttgctaaatcttgctatat

SEQ ID NO: 610732 - DNA, 25 bp, Rattus norvegicus
tgagccttgctatatcttgctatat

SEQ ID NO: 610733 - DNA, 25 bp, Rattus norvegicus
tgagccttggccatctacggtaggg

SEQ ID NO: 610734 - DNA, 25 bp, Rattus norvegicus
tgagccttggccttctacggtaggg

SEQ ID NO: 610735 - DNA, 25 bp, Rattus norvegicus
tgagcctttcaacttctgtcaaaat

SEQ ID NO: 610736 - DNA, 25 bp, Rattus norvegicus
tgagcctttcaagttctgtcaaaat

SEQ ID NO: 610737 - DNA, 25 bp, Rattus norvegicus
tgagcctttcctcaaccgtacaggt

SEQ ID NO: 610738 - DNA, 25 bp, Rattus norvegicus
tgagcctttcctgaaccgtacaggt

SEQ ID NO: 610739 - DNA, 25 bp, Rattus norvegicus
tgagcctttgacctttctttagagc

SEQ ID NO: 610740 - DNA, 25 bp, Rattus norvegicus
tgagcctttgacgtttctttagagc

SEQ ID NO: 610741 - DNA, 25 bp, Rattus norvegicus
tgagcctttgccactggataaactg

SEQ ID NO: 610742 - DNA, 25 bp, Rattus norvegicus
tgagcctttgcctctggataaactg

SEQ ID NO: 610743 - DNA, 25 bp, Rattus norvegicus
tgagcctttgtgcttgaccctccta

SEQ ID NO: 610744 - DNA, 25 bp, Rattus norvegicus
tgagcctttgtggttgaccctccta

SEQ ID NO: 610745 - DNA, 25 bp, Rattus norvegicus
tgagccttttaaattctatctgcag

SEQ ID NO: 610746 - DNA, 25 bp, Rattus norvegicus
tgagccttttaatttctatctgcag

SEQ ID NO: 610747 - DNA, 25 bp, Rattus norvegicus
tgagcgactaccagattctcagcct

SEQ ID NO: 610748 - DNA, 25 bp, Rattus norvegicus
tgagcgactacctgattctcagcct

SEQ ID NO: 610749 - DNA, 25 bp, Rattus norvegicus
tgagcgagaacaccagatatcccct

SEQ ID NO: 610750 - DNA, 25 bp, Rattus norvegicus
tgagcgagaacagcagatatcccct

SEQ ID NO: 610751 - DNA, 25 bp, Rattus norvegicus
tgagcgagccttagctgattttctc

SEQ ID NO: 610752 - DNA, 25 bp, Rattus norvegicus
tgagcgagcctttgctgattttctc

SEQ ID NO: 610753 - DNA, 25 bp, Rattus norvegicus
tgagcgagctctaccatcctgacga

SEQ ID NO: 610754 - DNA, 25 bp, Rattus norvegicus
tgagcgagctcttccatcctgacga

SEQ ID NO: 610755 - DNA, 25 bp, Rattus norvegicus
tgagcgaggaaacgcagcacttact

SEQ ID NO: 610756 - DNA, 25 bp, Rattus norvegicus
tgagcgaggaaaggcagcacttact

SEQ ID NO: 610757 - DNA, 25 bp, Rattus norvegicus
tgagcgaggatcatgtctctgccct

SEQ ID NO: 610758 - DNA, 25 bp, Rattus norvegicus
tgagcgaggatcttgtctctgccct

SEQ ID NO: 610759 - DNA, 25 bp, Rattus norvegicus
tgagcgatccctacaagtcaaaaat

SEQ ID NO: 610760 - DNA, 25 bp, Rattus norvegicus
tgagcgatcccttcaagtcaaaaat

SEQ ID NO: 610761 - DNA, 25 bp, Rattus norvegicus
tgagcgattgctaagactggcccat

SEQ ID NO: 610762 - DNA, 25 bp, Rattus norvegicus
tgagcgattgcttagactggcccat

SEQ ID NO: 610763 - DNA, 25 bp, Rattus norvegicus
tgagcgcacgtcaaggagatttaac

SEQ ID NO: 610764 - DNA, 25 bp, Rattus norvegicus
tgagcgcacgtctaggagatttaac

SEQ ID NO: 610765 - DNA, 25 bp, Rattus norvegicus
tgagcgcagggaccaaatcattcaa

SEQ ID NO: 610766 - DNA, 25 bp, Rattus norvegicus
tgagcgcagggagcaaatcattcaa

SEQ ID NO: 610767 - DNA, 25 bp, Rattus norvegicus
tgagcgcagtatccccaagtatagt

SEQ ID NO: 610768 - DNA, 25 bp, Rattus norvegicus
tgagcgcagtatgcccaagtatagt

SEQ ID NO: 610769 - DNA, 25 bp, Rattus norvegicus
tgagcgcatagcaggccaggcccat

SEQ ID NO: 610770 - DNA, 25 bp, Rattus norvegicus
tgagcgcatagctggccaggcccat

SEQ ID NO: 610771 - DNA, 25 bp, Rattus norvegicus
tgagcgccaaggaggactgtctgaa

SEQ ID NO: 610772 - DNA, 25 bp, Rattus norvegicus
tgagcgccaaggtggactgtctgaa

SEQ ID NO: 610773 - DNA, 25 bp, Rattus norvegicus
tgagcgccaagtcgtccgagatgaa

SEQ ID NO: 610774 - DNA, 25 bp, Rattus norvegicus
tgagcgccaagtggtccgagatgaa

SEQ ID NO: 610775 - DNA, 25 bp, Rattus norvegicus
tgagcgccatcacacgaaagttcaa

SEQ ID NO: 610776 - DNA, 25 bp, Rattus norvegicus
tgagcgccatcagacgaaagttcaa

SEQ ID NO: 610777 - DNA, 25 bp, Rattus norvegicus
tgagcgccatcgagcagaaggtaca

SEQ ID NO: 610778 - DNA, 25 bp, Rattus norvegicus
tgagcgccatcgtgcagaaggtaca

SEQ ID NO: 610779 - DNA, 25 bp, Rattus norvegicus
tgagcgccatgaacccggtgggcat

SEQ ID NO: 610780 - DNA, 25 bp, Rattus norvegicus
tgagcgccatgatcccggtgggcat

SEQ ID NO: 610781 - DNA, 25 bp, Rattus norvegicus
tgagcgcctaccaagaacagagcct

SEQ ID NO: 610782 - DNA, 25 bp, Rattus norvegicus
tgagcgcctacctagaacagagcct

SEQ ID NO: 610783 - DNA, 25 bp, Rattus norvegicus
tgagcgccttcgcaagtctggacaa

SEQ ID NO: 610784 - DNA, 25 bp, Rattus norvegicus
tgagcgccttcggaagtctggacaa

SEQ ID NO: 610785 - DNA, 25 bp, Rattus norvegicus
tgagcgcgagttctaccgcgacctg

SEQ ID NO: 610786 - DNA, 25 bp, Rattus norvegicus
tgagcgcgagttgtaccgcgacctg

SEQ ID NO: 610787 - DNA, 25 bp, Rattus norvegicus
tgagcgcgtgatacgtcattggcaa

SEQ ID NO: 610788 - DNA, 25 bp, Rattus norvegicus
tgagcgcgtgattcgtcattggcaa

SEQ ID NO: 610789 - DNA, 25 bp, Rattus norvegicus
tgagcgctactacattctgcacgcc

SEQ ID NO: 610790 - DNA, 25 bp, Rattus norvegicus
tgagcgctactagattctgcacgcc

SEQ ID NO: 610791 - DNA, 25 bp, Rattus norvegicus
tgagcgctcagtcgaggagtctgct

SEQ ID NO: 610792 - DNA, 25 bp, Rattus norvegicus
tgagcgctcagtggaggagtctgct

SEQ ID NO: 610793 - DNA, 25 bp, Rattus norvegicus
tgagcgctgtctcttgcagctctgg

SEQ ID NO: 610794 - DNA, 25 bp, Rattus norvegicus
tgagcgctgtctgttgcagctctgg

SEQ ID NO: 610795 - DNA, 25 bp, Rattus norvegicus
tgagcgcttcaaagcacggctgcag

SEQ ID NO: 610796 - DNA, 25 bp, Rattus norvegicus
tgagcgcttcaatgcacggctgcag

SEQ ID NO: 610797 - DNA, 25 bp, Rattus norvegicus
tgagcgctttgactcggaccaagag

SEQ ID NO: 610798 - DNA, 25 bp, Rattus norvegicus
tgagcgctttgagtcggaccaagag

SEQ ID NO: 610799 - DNA, 25 bp, Rattus norvegicus
tgagcggaagctaccacaagtgtat

SEQ ID NO: 610800 - DNA, 25 bp, Rattus norvegicus
tgagcggaagcttccacaagtgtat

SEQ ID NO: 610801 - DNA, 25 bp, Rattus norvegicus
tgagcggacactactggacctggac

SEQ ID NO: 610802 - DNA, 25 bp, Rattus norvegicus
tgagcggacacttctggacctggac

SEQ ID NO: 610803 - DNA, 25 bp, Rattus norvegicus
tgagcggactgaagtctggtcccta

SEQ ID NO: 610804 - DNA, 25 bp, Rattus norvegicus
tgagcggactgatgtctggtcccta

SEQ ID NO: 610805 - DNA, 25 bp, Rattus norvegicus
tgagcggagaccctatccactgtat

SEQ ID NO: 610806 - DNA, 25 bp, Rattus norvegicus
tgagcggagaccgtatccactgtat

SEQ ID NO: 610807 - DNA, 25 bp, Rattus norvegicus
tgagcggagagcctttcctccttga

SEQ ID NO: 610808 - DNA, 25 bp, Rattus norvegicus
tgagcggagagcgtttcctccttga

SEQ ID NO: 610809 - DNA, 25 bp, Rattus norvegicus
tgagcggatcagcatcctctgaggc

SEQ ID NO: 610810 - DNA, 25 bp, Rattus norvegicus
tgagcggatcaggatcctctgaggc

SEQ ID NO: 610811 - DNA, 25 bp, Rattus norvegicus
tgagcggctctaacacgcgtacggg

SEQ ID NO: 610812 - DNA, 25 bp, Rattus norvegicus
tgagcggctctatcacgcgtacggg

SEQ ID NO: 610813 - DNA, 25 bp, Rattus norvegicus
tgagcggctgtcaggaactccaggc

SEQ ID NO: 610814 - DNA, 25 bp, Rattus norvegicus
tgagcggctgtctggaactccaggc

SEQ ID NO: 610815 - DNA, 25 bp, Rattus norvegicus
tgagcgggacaccttagacagcctg

SEQ ID NO: 610816 - DNA, 25 bp, Rattus norvegicus
tgagcgggacacgttagacagcctg

SEQ ID NO: 610817 - DNA, 25 bp, Rattus norvegicus
tgagcgggagccactgcttttccat

SEQ ID NO: 610818 - DNA, 25 bp, Rattus norvegicus
tgagcgggagcctctgcttttccat

SEQ ID NO: 610819 - DNA, 25 bp, Rattus norvegicus
tgagcgggcctaatcctagacaaat

SEQ ID NO: 610820 - DNA, 25 bp, Rattus norvegicus
tgagcgggcctattcctagacaaat

SEQ ID NO: 610821 - DNA, 25 bp, Rattus norvegicus
tgagcggtaccaagcctgatatttt

SEQ ID NO: 610822 - DNA, 25 bp, Rattus norvegicus
tgagcggtaccatgcctgatatttt

SEQ ID NO: 610823 - DNA, 25 bp, Rattus norvegicus
tgagcggtcggacagcagggagagc

SEQ ID NO: 610824 - DNA, 25 bp, Rattus norvegicus
tgagcggtcggagagcagggagagc

SEQ ID NO: 610825 - DNA, 25 bp, Rattus norvegicus
tgagcggttccgcaagtaccttcgg

SEQ ID NO: 610826 - DNA, 25 bp, Rattus norvegicus
tgagcggttccggaagtaccttcgg

SEQ ID NO: 610827 - DNA, 25 bp, Rattus norvegicus
tgagcgtaactgcacccattgtaaa

SEQ ID NO: 610828 - DNA, 25 bp, Rattus norvegicus
tgagcgtaactggacccattgtaaa

SEQ ID NO: 610829 - DNA, 25 bp, Rattus norvegicus
tgagcgtatccacgccattgccaag

SEQ ID NO: 610830 - DNA, 25 bp, Rattus norvegicus
tgagcgtatccaggccattgccaag

SEQ ID NO: 610831 - DNA, 25 bp, Rattus norvegicus
tgagcgtatgtgatgcttctgcaaa

SEQ ID NO: 610832 - DNA, 25 bp, Rattus norvegicus
tgagcgtatgtgttgcttctgcaaa

SEQ ID NO: 610833 - DNA, 25 bp, Rattus norvegicus
tgagcgtcacctcgaagcaatccag

SEQ ID NO: 610834 - DNA, 25 bp, Rattus norvegicus
tgagcgtcacctggaagcaatccag

SEQ ID NO: 610835 - DNA, 25 bp, Rattus norvegicus
tgagcgtccagcatatctgatgaca

SEQ ID NO: 610836 - DNA, 25 bp, Rattus norvegicus
tgagcgtccagcttatctgatgaca

SEQ ID NO: 610837 - DNA, 25 bp, Rattus norvegicus
tgagcgtcctcaaggccaacagatt

SEQ ID NO: 610838 - DNA, 25 bp, Rattus norvegicus
tgagcgtcctcatggccaacagatt

SEQ ID NO: 610839 - DNA, 25 bp, Rattus norvegicus
tgagcgtcctgaccctggtccaggt

SEQ ID NO: 610840 - DNA, 25 bp, Rattus norvegicus
tgagcgtcctgagcctggtccaggt

SEQ ID NO: 610841 - DNA, 25 bp, Rattus norvegicus
tgagcgtcctggcacaggcagccaa

SEQ ID NO: 610842 - DNA, 25 bp, Rattus norvegicus
tgagcgtcctgggacaggcagccaa

SEQ ID NO: 610843 - DNA, 25 bp, Rattus norvegicus
tgagcgtcgtagcaaaacgtccctt

SEQ ID NO: 610844 - DNA, 25 bp, Rattus norvegicus
tgagcgtcgtaggaaaacgtccctt

SEQ ID NO: 610845 - DNA, 25 bp, Rattus norvegicus
tgagcgtgacgaaacgaccgggcat

SEQ ID NO: 610846 - DNA, 25 bp, Rattus norvegicus
tgagcgtgacgatacgaccgggcat

SEQ ID NO: 610847 - DNA, 25 bp, Rattus norvegicus
tgagcgtgcaagcactgttagtaaa

SEQ ID NO: 610848 - DNA, 25 bp, Rattus norvegicus
tgagcgtgcaaggactgttagtaaa

SEQ ID NO: 610849 - DNA, 25 bp, Rattus norvegicus
tgagcgtgccctctgatcaggacag

SEQ ID NO: 610850 - DNA, 25 bp, Rattus norvegicus
tgagcgtgccctgtgatcaggacag

SEQ ID NO: 610851 - DNA, 25 bp, Rattus norvegicus
tgagcgttcacaccaataggcccgg

SEQ ID NO: 610852 - DNA, 25 bp, Rattus norvegicus
tgagcgttcacagcaataggcccgg

SEQ ID NO: 610853 - DNA, 25 bp, Rattus norvegicus
tgagcgttcccgaggcacttaacca

SEQ ID NO: 610854 - DNA, 25 bp, Rattus norvegicus
tgagcgttcccgtggcacttaacca

SEQ ID NO: 610855 - DNA, 25 bp, Rattus norvegicus
tgagcgttccttaggttgctcacaa

SEQ ID NO: 610856 - DNA, 25 bp, Rattus norvegicus
tgagcgttcctttggttgctcacaa

SEQ ID NO: 610857 - DNA, 25 bp, Rattus norvegicus
tgagctaaaacgaaaacttaatgag

SEQ ID NO: 610858 - DNA, 25 bp, Rattus norvegicus
tgagctaaaacgtaaacttaatgag

SEQ ID NO: 610859 - DNA, 25 bp, Rattus norvegicus
tgagctaaattgcatccccttcctc

SEQ ID NO: 610860 - DNA, 25 bp, Rattus norvegicus
tgagctaaattggatccccttcctc

SEQ ID NO: 610861 - DNA, 25 bp, Rattus norvegicus
tgagctaagattataccggcagtat

SEQ ID NO: 610862 - DNA, 25 bp, Rattus norvegicus
tgagctaagattttaccggcagtat

SEQ ID NO: 610863 - DNA, 25 bp, Rattus norvegicus
tgagctaagccaagaccatctcctc

SEQ ID NO: 610864 - DNA, 25 bp, Rattus norvegicus
tgagctaagccatgaccatctcctc

SEQ ID NO: 610865 - DNA, 25 bp, Rattus norvegicus
tgagctaatgtcaacctccacagtt

SEQ ID NO: 610866 - DNA, 25 bp, Rattus norvegicus
tgagctaatgtctacctccacagtt

SEQ ID NO: 610867 - DNA, 25 bp, Rattus norvegicus
tgagctaattttaatcccctttttg

SEQ ID NO: 610868 - DNA, 25 bp, Rattus norvegicus
tgagctaatttttatcccctttttg

SEQ ID NO: 610869 - DNA, 25 bp, Rattus norvegicus
tgagctacaactactacagcaccgt

SEQ ID NO: 610870 - DNA, 25 bp, Rattus norvegicus
tgagctacaacttctacagcaccgt

SEQ ID NO: 610871 - DNA, 25 bp, Rattus norvegicus
tgagctacacaaccttagtcccaga

SEQ ID NO: 610872 - DNA, 25 bp, Rattus norvegicus
tgagctacacaagcttagtcccaga

SEQ ID NO: 610873 - DNA, 25 bp, Rattus norvegicus
tgagctacagcaccagccatctggt

SEQ ID NO: 610874 - DNA, 25 bp, Rattus norvegicus
tgagctacagcagcagccatctggt

SEQ ID NO: 610875 - DNA, 25 bp, Rattus norvegicus
tgagctacatgacacacacgccatc

SEQ ID NO: 610876 - DNA, 25 bp, Rattus norvegicus
tgagctacatgagacacacgccatc

SEQ ID NO: 610877 - DNA, 25 bp, Rattus norvegicus
tgagctacccagagaccgctttata

SEQ ID NO: 610878 - DNA, 25 bp, Rattus norvegicus
tgagctacccagctatcatggcaga

SEQ ID NO: 610879 - DNA, 25 bp, Rattus norvegicus
tgagctacccaggtatcatggcaga

SEQ ID NO: 610880 - DNA, 25 bp, Rattus norvegicus
tgagctacccagtgaccgctttata

SEQ ID NO: 610881 - DNA, 25 bp, Rattus norvegicus
tgagctaccgctaaacacgcatgaa

SEQ ID NO: 610882 - DNA, 25 bp, Rattus norvegicus
tgagctaccgcttaacacgcatgaa

SEQ ID NO: 610883 - DNA, 25 bp, Rattus norvegicus
tgagctacctcactgaccacagaac

SEQ ID NO: 610884 - DNA, 25 bp, Rattus norvegicus
tgagctacctcagtgaccacagaac

SEQ ID NO: 610885 - DNA, 25 bp, Rattus norvegicus
tgagctacctgtctacgcctgtgtc

SEQ ID NO: 610886 - DNA, 25 bp, Rattus norvegicus
tgagctacctgtgtacgcctgtgtc

SEQ ID NO: 610887 - DNA, 25 bp, Rattus norvegicus
tgagctacgggtcctgactttttaa

SEQ ID NO: 610888 - DNA, 25 bp, Rattus norvegicus
tgagctacgggtgctgactttttaa

SEQ ID NO: 610889 - DNA, 25 bp, Rattus norvegicus
tgagctacgtctctgcttgtgtcaa

SEQ ID NO: 610890 - DNA, 25 bp, Rattus norvegicus
tgagctacgtctgtgcttgtgtcaa

SEQ ID NO: 610891 - DNA, 25 bp, Rattus norvegicus
tgagctagacagacctgcagaggtt

SEQ ID NO: 610892 - DNA, 25 bp, Rattus norvegicus
tgagctagacagtcctgcagaggtt

SEQ ID NO: 610893 - DNA, 25 bp, Rattus norvegicus
tgagctagcaaccactttcacagag

SEQ ID NO: 610894 - DNA, 25 bp, Rattus norvegicus
tgagctagcaacgactttcacagag

SEQ ID NO: 610895 - DNA, 25 bp, Rattus norvegicus
tgagctagccatccattttgaccgc

SEQ ID NO: 610896 - DNA, 25 bp, Rattus norvegicus
tgagctagccatgcattttgaccgc

SEQ ID NO: 610897 - DNA, 25 bp, Rattus norvegicus
tgagctagccttaagaacactgttg

SEQ ID NO: 610898 - DNA, 25 bp, Rattus norvegicus
tgagctagcctttagaacactgttg

SEQ ID NO: 610899 - DNA, 25 bp, Rattus norvegicus
tgagctagcgccagggtcgttcttc

SEQ ID NO: 610900 - DNA, 25 bp, Rattus norvegicus
tgagctagcgcctgggtcgttcttc

SEQ ID NO: 610901 - DNA, 25 bp, Rattus norvegicus
tgagctagttcaagactgtttttaa

SEQ ID NO: 610902 - DNA, 25 bp, Rattus norvegicus
tgagctagttcatgactgtttttaa

SEQ ID NO: 610903 - DNA, 25 bp, Rattus norvegicus
tgagctagttctcagtgtccacatc

SEQ ID NO: 610904 - DNA, 25 bp, Rattus norvegicus
tgagctagttctgagtgtccacatc

SEQ ID NO: 610905 - DNA, 25 bp, Rattus norvegicus
tgagctatgcagagcctttcttcat

SEQ ID NO: 610906 - DNA, 25 bp, Rattus norvegicus
tgagctatgcagtgcctttcttcat

SEQ ID NO: 610907 - DNA, 25 bp, Rattus norvegicus
tgagctatgctcactctacagaact

SEQ ID NO: 610908 - DNA, 25 bp, Rattus norvegicus
tgagctatgctctctctacagaact

SEQ ID NO: 610909 - DNA, 25 bp, Rattus norvegicus
tgagctatttctccagccctaaata

SEQ ID NO: 610910 - DNA, 25 bp, Rattus norvegicus
tgagctatttctgcagccctaaata

SEQ ID NO: 610911 - DNA, 25 bp, Rattus norvegicus
tgagctcaaaggacacacagcacgg

SEQ ID NO: 610912 - DNA, 25 bp, Rattus norvegicus
tgagctcaaaggtcacacagcacgg

SEQ ID NO: 610913 - DNA, 25 bp, Rattus norvegicus
tgagctcaagagagatgcccacgtg

SEQ ID NO: 610914 - DNA, 25 bp, Rattus norvegicus
tgagctcaagagtgatgcccacgtg

SEQ ID NO: 610915 - DNA, 25 bp, Rattus norvegicus
tgagctcaagatagggcagcccact

SEQ ID NO: 610916 - DNA, 25 bp, Rattus norvegicus
tgagctcaagattgggcagcccact

SEQ ID NO: 610917 - DNA, 25 bp, Rattus norvegicus
tgagctcaaggcaagccaacagatt

SEQ ID NO: 610918 - DNA, 25 bp, Rattus norvegicus
tgagctcaaggccagactggctaca

SEQ ID NO: 610919 - DNA, 25 bp, Rattus norvegicus
tgagctcaaggcgagactggctaca

SEQ ID NO: 610920 - DNA, 25 bp, Rattus norvegicus
tgagctcaaggctagccaacagatt

SEQ ID NO: 610921 - DNA, 25 bp, Rattus norvegicus
tgagctcacataatcactttcgctt

SEQ ID NO: 610922 - DNA, 25 bp, Rattus norvegicus
tgagctcacatattcactttcgctt

SEQ ID NO: 610923 - DNA, 25 bp, Rattus norvegicus
tgagctcacgtacctgcactgcaga

SEQ ID NO: 610924 - DNA, 25 bp, Rattus norvegicus
tgagctcacgtagctgcactgcaga

SEQ ID NO: 610925 - DNA, 25 bp, Rattus norvegicus
tgagctcactgcacaaggctgtggg

SEQ ID NO: 610926 - DNA, 25 bp, Rattus norvegicus
tgagctcactgctcaaggctgtggg

SEQ ID NO: 610927 - DNA, 25 bp, Rattus norvegicus
tgagctcagaggaccccatgttgga

SEQ ID NO: 610928 - DNA, 25 bp, Rattus norvegicus
tgagctcagaggtccccatgttgga

SEQ ID NO: 610929 - DNA, 25 bp, Rattus norvegicus
tgagctcagagtcttctccacagtg

SEQ ID NO: 610930 - DNA, 25 bp, Rattus norvegicus
tgagctcagagtgttctccacagtg

SEQ ID NO: 610931 - DNA, 25 bp, Rattus norvegicus
tgagctcagatcaccagcgcctgtg

SEQ ID NO: 610932 - DNA, 25 bp, Rattus norvegicus
tgagctcagatctccagcgcctgtg

SEQ ID NO: 610933 - DNA, 25 bp, Rattus norvegicus
tgagctcagccgattgcccttgaat

SEQ ID NO: 610934 - DNA, 25 bp, Rattus norvegicus
tgagctcagccgtttgcccttgaat

SEQ ID NO: 610935 - DNA, 25 bp, Rattus norvegicus
tgagctcagcctagtgtatgtgccc

SEQ ID NO: 610936 - DNA, 25 bp, Rattus norvegicus
tgagctcagccttgtgtatgtgccc

SEQ ID NO: 610937 - DNA, 25 bp, Rattus norvegicus
tgagctcagtctctggaatccacat

SEQ ID NO: 610938 - DNA, 25 bp, Rattus norvegicus
tgagctcagtctgtggaatccacat

SEQ ID NO: 610939 - DNA, 25 bp, Rattus norvegicus
tgagctcagtttagacttccgcatt

SEQ ID NO: 610940 - DNA, 25 bp, Rattus norvegicus
tgagctcagttttgacttccgcatt

SEQ ID NO: 610941 - DNA, 25 bp, Rattus norvegicus
tgagctcatcagagcatagtgccga

SEQ ID NO: 610942 - DNA, 25 bp, Rattus norvegicus
tgagctcatcagtgcatagtgccga

SEQ ID NO: 610943 - DNA, 25 bp, Rattus norvegicus
tgagctcatgggacaagcctggtgt

SEQ ID NO: 610944 - DNA, 25 bp, Rattus norvegicus
tgagctcatgggtcaagcctggtgt

SEQ ID NO: 610945 - DNA, 25 bp, Rattus norvegicus
tgagctcattgtccttagcttttgt

SEQ ID NO: 610946 - DNA, 25 bp, Rattus norvegicus
tgagctcattgtgcttagcttttgt

SEQ ID NO: 610947 - DNA, 25 bp, Rattus norvegicus
tgagctccagttctgcgttagtttt

SEQ ID NO: 610948 - DNA, 25 bp, Rattus norvegicus
tgagctccagttgtgcgttagtttt

SEQ ID NO: 610949 - DNA, 25 bp, Rattus norvegicus
tgagctccatgacggtcccagtcaa

SEQ ID NO: 610950 - DNA, 25 bp, Rattus norvegicus
tgagctccatgagggtcccagtcaa

SEQ ID NO: 610951 - DNA, 25 bp, Rattus norvegicus
tgagctccatggacacctttatttc

SEQ ID NO: 610952 - DNA, 25 bp, Rattus norvegicus
tgagctccatggtcacctttatttc

SEQ ID NO: 610953 - DNA, 25 bp, Rattus norvegicus
tgagctccatgtccgaagcctagag

SEQ ID NO: 610954 - DNA, 25 bp, Rattus norvegicus
tgagctccatgtgcgaagcctagag

SEQ ID NO: 610955 - DNA, 25 bp, Rattus norvegicus
tgagctcccacaaccacagctttgg

SEQ ID NO: 610956 - DNA, 25 bp, Rattus norvegicus
tgagctcccacatccacagctttgg

SEQ ID NO: 610957 - DNA, 25 bp, Rattus norvegicus
tgagctccccagagaagcaaggctg

SEQ ID NO: 610958 - DNA, 25 bp, Rattus norvegicus
tgagctccccagtgaagcaaggctg

SEQ ID NO: 610959 - DNA, 25 bp, Rattus norvegicus
tgagctccccggaagttgcaaccaa

SEQ ID NO: 610960 - DNA, 25 bp, Rattus norvegicus
tgagctccccggtagttgcaaccaa

SEQ ID NO: 610961 - DNA, 25 bp, Rattus norvegicus
tgagctccctcacacgaatgtgtat

SEQ ID NO: 610962 - DNA, 25 bp, Rattus norvegicus
tgagctccctcagacgaatgtgtat

SEQ ID NO: 610963 - DNA, 25 bp, Rattus norvegicus
tgagctccctgaccttgtgttttat

SEQ ID NO: 610964 - DNA, 25 bp, Rattus norvegicus
tgagctccctgagcttgtgttttat

SEQ ID NO: 610965 - DNA, 25 bp, Rattus norvegicus
tgagctcccttgagagtgcctggaa

SEQ ID NO: 610966 - DNA, 25 bp, Rattus norvegicus
tgagctcccttgtgagtgcctggaa

SEQ ID NO: 610967 - DNA, 25 bp, Rattus norvegicus
tgagctccctttccagtctgaagat

SEQ ID NO: 610968 - DNA, 25 bp, Rattus norvegicus
tgagctccctttgcagtctgaagat

SEQ ID NO: 610969 - DNA, 25 bp, Rattus norvegicus
tgagctccgagcagcgaggagccat

SEQ ID NO: 610970 - DNA, 25 bp, Rattus norvegicus
tgagctccgagctgcgaggagccat

SEQ ID NO: 610971 - DNA, 25 bp, Rattus norvegicus
tgagctccgtccctaccctgagttt

SEQ ID NO: 610972 - DNA, 25 bp, Rattus norvegicus
tgagctccgtccgtaccctgagttt

SEQ ID NO: 610973 - DNA, 25 bp, Rattus norvegicus
tgagctcctaagcaattcccaggtt

SEQ ID NO: 610974 - DNA, 25 bp, Rattus norvegicus
tgagctcctaaggaattcccaggtt

SEQ ID NO: 610975 - DNA, 25 bp, Rattus norvegicus
tgagctcctcaactccaaaatgcac

SEQ ID NO: 610976 - DNA, 25 bp, Rattus norvegicus
tgagctcctcaagtccaaaatgcac

SEQ ID NO: 610977 - DNA, 25 bp, Rattus norvegicus
tgagctcctcgtcggcagggaccat

SEQ ID NO: 610978 - DNA, 25 bp, Rattus norvegicus
tgagctcctcgtgggcagggaccat

SEQ ID NO: 610979 - DNA, 25 bp, Rattus norvegicus
tgagctcctctacaaacagtgcaca

SEQ ID NO: 610980 - DNA, 25 bp, Rattus norvegicus
tgagctcctctagaaacagtgcaca

SEQ ID NO: 610981 - DNA, 25 bp, Rattus norvegicus
tgagctcctcttcctctgacgagga

SEQ ID NO: 610982 - DNA, 25 bp, Rattus norvegicus
tgagctcctcttgctctgacgagga

SEQ ID NO: 610983 - DNA, 25 bp, Rattus norvegicus
tgagctcctgccataacagaggtgt

SEQ ID NO: 610984 - DNA, 25 bp, Rattus norvegicus
tgagctcctgccttaacagaggtgt

SEQ ID NO: 610985 - DNA, 25 bp, Rattus norvegicus
tgagctcctgcgcttaagtcagtct

SEQ ID NO: 610986 - DNA, 25 bp, Rattus norvegicus
tgagctcctgcggttaagtcagtct

SEQ ID NO: 610987 - DNA, 25 bp, Rattus norvegicus
tgagctcctgtcagtttagcatctg

SEQ ID NO: 610988 - DNA, 25 bp, Rattus norvegicus
tgagctcctgtctgtttagcatctg

SEQ ID NO: 610989 - DNA, 25 bp, Rattus norvegicus
tgagctccttgcaacatgggtacag

SEQ ID NO: 610990 - DNA, 25 bp, Rattus norvegicus
tgagctccttgctacatgggtacag

SEQ ID NO: 610991 - DNA, 25 bp, Rattus norvegicus
tgagctccttgtcggtttcgcgttt

SEQ ID NO: 610992 - DNA, 25 bp, Rattus norvegicus
tgagctccttgtgggtttcgcgttt

SEQ ID NO: 610993 - DNA, 25 bp, Rattus norvegicus
tgagctcgaatcagggtccagaaac

SEQ ID NO: 610994 - DNA, 25 bp, Rattus norvegicus
tgagctcgaatctgggtccagaaac

SEQ ID NO: 610995 - DNA, 25 bp, Rattus norvegicus
tgagctcgcccgacacaaagagctt

SEQ ID NO: 610996 - DNA, 25 bp, Rattus norvegicus
tgagctcgcccgtcacaaagagctt

SEQ ID NO: 610997 - DNA, 25 bp, Rattus norvegicus
tgagctcgtcatcatgcaggaggat

SEQ ID NO: 610998 - DNA, 25 bp, Rattus norvegicus
tgagctcgtcatgatgcaggaggat

SEQ ID NO: 610999 - DNA, 25 bp, Rattus norvegicus
tgagctcgtgatcttctggcctcgt

SEQ ID NO: 611000 - DNA, 25 bp, Rattus norvegicus
tgagctcgtgatgttctggcctcgt

SEQ ID NO: 611001 - DNA, 25 bp, Rattus norvegicus
tgagctcgttcacgcaggagtgcca

SEQ ID NO: 611002 - DNA, 25 bp, Rattus norvegicus
tgagctcgttcaggcaggagtgcca

SEQ ID NO: 611003 - DNA, 25 bp, Rattus norvegicus
tgagctctatacagccttgtctaca

SEQ ID NO: 611004 - DNA, 25 bp, Rattus norvegicus
tgagctctatactgccttgtctaca

SEQ ID NO: 611005 - DNA, 25 bp, Rattus norvegicus
tgagctctcagaccctgtcatgctg

SEQ ID NO: 611006 - DNA, 25 bp, Rattus norvegicus
tgagctctcagagcctgtcatgctg

SEQ ID NO: 611007 - DNA, 25 bp, Rattus norvegicus
tgagctctccagcaaaacccagcag

SEQ ID NO: 611008 - DNA, 25 bp, Rattus norvegicus
tgagctctccaggaaaacccagcag

SEQ ID NO: 611009 - DNA, 25 bp, Rattus norvegicus
tgagctctctccagggcaggcagga

SEQ ID NO: 611010 - DNA, 25 bp, Rattus norvegicus
tgagctctctcctgggcaggcagga

SEQ ID NO: 611011 - DNA, 25 bp, Rattus norvegicus
tgagctctctgaatggaaactgcca

SEQ ID NO: 611012 - DNA, 25 bp, Rattus norvegicus
tgagctctctgattggaaactgcca

SEQ ID NO: 611013 - DNA, 25 bp, Rattus norvegicus
tgagctctgagaccttttggcttag

SEQ ID NO: 611014 - DNA, 25 bp, Rattus norvegicus
tgagctctgagagcttttggcttag

SEQ ID NO: 611015 - DNA, 25 bp, Rattus norvegicus
tgagctctgagccaaggctggacat

SEQ ID NO: 611016 - DNA, 25 bp, Rattus norvegicus
tgagctctgagcgaaggctggacat

SEQ ID NO: 611017 - DNA, 25 bp, Rattus norvegicus
tgagctctgcatatacctttataag

SEQ ID NO: 611018 - DNA, 25 bp, Rattus norvegicus
tgagctctgcatttacctttataag

SEQ ID NO: 611019 - DNA, 25 bp, Rattus norvegicus
tgagctctgcttctatacacggtat

SEQ ID NO: 611020 - DNA, 25 bp, Rattus norvegicus
tgagctctgcttgtatacacggtat

SEQ ID NO: 611021 - DNA, 25 bp, Rattus norvegicus
tgagctctggcacgtgctctgataa

SEQ ID NO: 611022 - DNA, 25 bp, Rattus norvegicus
tgagctctggcactcagattgtccc

SEQ ID NO: 611023 - DNA, 25 bp, Rattus norvegicus
tgagctctggcaggtgctctgataa

SEQ ID NO: 611024 - DNA, 25 bp, Rattus norvegicus
tgagctctggcagtcagattgtccc

SEQ ID NO: 611025 - DNA, 25 bp, Rattus norvegicus
tgagctctggccacaggagaggttt

SEQ ID NO: 611026 - DNA, 25 bp, Rattus norvegicus
tgagctctggcctcaggagaggttt

SEQ ID NO: 611027 - DNA, 25 bp, Rattus norvegicus
tgagctctggctactgggacaggtt

SEQ ID NO: 611028 - DNA, 25 bp, Rattus norvegicus
tgagctctggcttctgggacaggtt

SEQ ID NO: 611029 - DNA, 25 bp, Rattus norvegicus
tgagctctgggaagtgctgacgcct

SEQ ID NO: 611030 - DNA, 25 bp, Rattus norvegicus
tgagctctgggatgtgctgacgcct

SEQ ID NO: 611031 - DNA, 25 bp, Rattus norvegicus
tgagctctgtagcttcgtctgcgca

SEQ ID NO: 611032 - DNA, 25 bp, Rattus norvegicus
tgagctctgtaggttcgtctgcgca

SEQ ID NO: 611033 - DNA, 25 bp, Rattus norvegicus
tgagctctgtgaactgtttggtgtc

SEQ ID NO: 611034 - DNA, 25 bp, Rattus norvegicus
tgagctctgtgatctgtttggtgtc

SEQ ID NO: 611035 - DNA, 25 bp, Rattus norvegicus
tgagctctgtgcagctgggatcatc

SEQ ID NO: 611036 - DNA, 25 bp, Rattus norvegicus
tgagctctgtgctgctgggatcatc

SEQ ID NO: 611037 - DNA, 25 bp, Rattus norvegicus
tgagctctgtggaggcccattcagc

SEQ ID NO: 611038 - DNA, 25 bp, Rattus norvegicus
tgagctctgtggtggcccattcagc

SEQ ID NO: 611039 - DNA, 25 bp, Rattus norvegicus
tgagctctgtttacttcagtttaaa

SEQ ID NO: 611040 - DNA, 25 bp, Rattus norvegicus
tgagctctgttttcttcagtttaaa

SEQ ID NO: 611041 - DNA, 25 bp, Rattus norvegicus
tgagctcttccacgtcattgatgac

SEQ ID NO: 611042 - DNA, 25 bp, Rattus norvegicus
tgagctcttccaggtcattgatgac

SEQ ID NO: 611043 - DNA, 25 bp, Rattus norvegicus
tgagctcttcccctcctttaactgt

SEQ ID NO: 611044 - DNA, 25 bp, Rattus norvegicus
tgagctcttcccgtcctttaactgt

SEQ ID NO: 611045 - DNA, 25 bp, Rattus norvegicus
tgagctcttcttctgtagccctgaa

SEQ ID NO: 611046 - DNA, 25 bp, Rattus norvegicus
tgagctcttcttgtgtagccctgaa

SEQ ID NO: 611047 - DNA, 25 bp, Rattus norvegicus
tgagctcttgctacagtcgcctttg

SEQ ID NO: 611048 - DNA, 25 bp, Rattus norvegicus
tgagctcttgctactaactaggtta

SEQ ID NO: 611049 - DNA, 25 bp, Rattus norvegicus
tgagctcttgcttcagtcgcctttg

SEQ ID NO: 611050 - DNA, 25 bp, Rattus norvegicus
tgagctcttgcttctaactaggtta

SEQ ID NO: 611051 - DNA, 25 bp, Rattus norvegicus
tgagctcttgttagtggctgaggaa

SEQ ID NO: 611052 - DNA, 25 bp, Rattus norvegicus
tgagctcttgtttgtggctgaggaa

SEQ ID NO: 611053 - DNA, 25 bp, Rattus norvegicus
tgagctcttttacacattgtccaag

SEQ ID NO: 611054 - DNA, 25 bp, Rattus norvegicus
tgagctcttttagacattgtccaag

SEQ ID NO: 611055 - DNA, 25 bp, Rattus norvegicus
tgagctgaaagcctccatcaagaaa

SEQ ID NO: 611056 - DNA, 25 bp, Rattus norvegicus
tgagctgaaagcgtccatcaagaaa

SEQ ID NO: 611057 - DNA, 25 bp, Rattus norvegicus
tgagctgacaccatcacgagtttgt

SEQ ID NO: 611058 - DNA, 25 bp, Rattus norvegicus
tgagctgacaccttcacgagtttgt

SEQ ID NO: 611059 - DNA, 25 bp, Rattus norvegicus
tgagctgacagccattgactccata

SEQ ID NO: 611060 - DNA, 25 bp, Rattus norvegicus
tgagctgacagcgattgactccata

SEQ ID NO: 611061 - DNA, 25 bp, Rattus norvegicus
tgagctgacatgacggcaaccttaa

SEQ ID NO: 611062 - DNA, 25 bp, Rattus norvegicus
tgagctgacatgtcggcaaccttaa

SEQ ID NO: 611063 - DNA, 25 bp, Rattus norvegicus
tgagctgacattccgtcccagggta

SEQ ID NO: 611064 - DNA, 25 bp, Rattus norvegicus
tgagctgacattgcgtcccagggta

SEQ ID NO: 611065 - DNA, 25 bp, Rattus norvegicus
tgagctgaccgaaggccagatccag

SEQ ID NO: 611066 - DNA, 25 bp, Rattus norvegicus
tgagctgaccgatggccagatccag

SEQ ID NO: 611067 - DNA, 25 bp, Rattus norvegicus
tgagctgacgtgacctgggccttgt

SEQ ID NO: 611068 - DNA, 25 bp, Rattus norvegicus
tgagctgacgtgtcctgggccttgt

SEQ ID NO: 611069 - DNA, 25 bp, Rattus norvegicus
tgagctgagcctcgttcctggctaa

SEQ ID NO: 611070 - DNA, 25 bp, Rattus norvegicus
tgagctgagcctggttcctggctaa

SEQ ID NO: 611071 - DNA, 25 bp, Rattus norvegicus
tgagctgaggtcatgtcttctcctt

SEQ ID NO: 611072 - DNA, 25 bp, Rattus norvegicus
tgagctgaggtcttgtcttctcctt

SEQ ID NO: 611073 - DNA, 25 bp, Rattus norvegicus
tgagctgagtgacgcggctctccca

SEQ ID NO: 611074 - DNA, 25 bp, Rattus norvegicus
tgagctgagtgaggcggctctccca

SEQ ID NO: 611075 - DNA, 25 bp, Rattus norvegicus
tgagctgattggctaacgcacttat

SEQ ID NO: 611076 - DNA, 25 bp, Rattus norvegicus
tgagctgattgggtaacgcacttat

SEQ ID NO: 611077 - DNA, 25 bp, Rattus norvegicus
tgagctgcaacacccatgtccaaca

SEQ ID NO: 611078 - DNA, 25 bp, Rattus norvegicus
tgagctgcaacagccatgtccaaca

SEQ ID NO: 611079 - DNA, 25 bp, Rattus norvegicus
tgagctgcaagcactgtgccgacct

SEQ ID NO: 611080 - DNA, 25 bp, Rattus norvegicus
tgagctgcaagctctgtgccgacct

SEQ ID NO: 611081 - DNA, 25 bp, Rattus norvegicus
tgagctgcagcaagcttggtggccc

SEQ ID NO: 611082 - DNA, 25 bp, Rattus norvegicus
tgagctgcagcacaatccactggtg

SEQ ID NO: 611083 - DNA, 25 bp, Rattus norvegicus
tgagctgcagcagaatccactggtg

SEQ ID NO: 611084 - DNA, 25 bp, Rattus norvegicus
tgagctgcagcatgcttggtggccc

SEQ ID NO: 611085 - DNA, 25 bp, Rattus norvegicus
tgagctgcagctctcctgttcactt

SEQ ID NO: 611086 - DNA, 25 bp, Rattus norvegicus
tgagctgcagctgtcctgttcactt

SEQ ID NO: 611087 - DNA, 25 bp, Rattus norvegicus
tgagctgcatgcattgttcccatta

SEQ ID NO: 611088 - DNA, 25 bp, Rattus norvegicus
tgagctgcatgcctagacctctgga

SEQ ID NO: 611089 - DNA, 25 bp, Rattus norvegicus
tgagctgcatgcgtagacctctgga

SEQ ID NO: 611090 - DNA, 25 bp, Rattus norvegicus
tgagctgcatgctttgttcccatta

SEQ ID NO: 611091 - DNA, 25 bp, Rattus norvegicus
tgagctgccagtagtgcggacctga

SEQ ID NO: 611092 - DNA, 25 bp, Rattus norvegicus
tgagctgccagttgtgcggacctga

SEQ ID NO: 611093 - DNA, 25 bp, Rattus norvegicus
tgagctgcccagaaggtccccaagg

SEQ ID NO: 611094 - DNA, 25 bp, Rattus norvegicus
tgagctgcccagtaggtccccaagg

SEQ ID NO: 611095 - DNA, 25 bp, Rattus norvegicus
tgagctgccctcctggataattaag

SEQ ID NO: 611096 - DNA, 25 bp, Rattus norvegicus
tgagctgccctcgtggataattaag

SEQ ID NO: 611097 - DNA, 25 bp, Rattus norvegicus
tgagctgcctctccaggcaaaagag

SEQ ID NO: 611098 - DNA, 25 bp, Rattus norvegicus
tgagctgcctctgcaggcaaaagag

SEQ ID NO: 611099 - DNA, 25 bp, Rattus norvegicus
tgagctgcctggaggaaacagagac

SEQ ID NO: 611100 - DNA, 25 bp, Rattus norvegicus
tgagctgcctggtggaaacagagac

SEQ ID NO: 611101 - DNA, 25 bp, Rattus norvegicus
tgagctgcgacaactccaggaacaa

SEQ ID NO: 611102 - DNA, 25 bp, Rattus norvegicus
tgagctgcgacatctccaggaacaa

SEQ ID NO: 611103 - DNA, 25 bp, Rattus norvegicus
tgagctgcgatacccagcacagatt

SEQ ID NO: 611104 - DNA, 25 bp, Rattus norvegicus
tgagctgcgatagccagcacagatt

SEQ ID NO: 611105 - DNA, 25 bp, Rattus norvegicus
tgagctgcggtcacgtgcacggcta

SEQ ID NO: 611106 - DNA, 25 bp, Rattus norvegicus
tgagctgcggtctcgtgcacggcta

SEQ ID NO: 611107 - DNA, 25 bp, Rattus norvegicus
tgagctgcgtttaacaccctttctt

SEQ ID NO: 611108 - DNA, 25 bp, Rattus norvegicus
tgagctgcgttttacaccctttctt

SEQ ID NO: 611109 - DNA, 25 bp, Rattus norvegicus
tgagctgctaccaacacatctggag

SEQ ID NO: 611110 - DNA, 25 bp, Rattus norvegicus
tgagctgctacctacacatctggag

SEQ ID NO: 611111 - DNA, 25 bp, Rattus norvegicus
tgagctgctatccttgtccagttca

SEQ ID NO: 611112 - DNA, 25 bp, Rattus norvegicus
tgagctgctatcgttgtccagttca

SEQ ID NO: 611113 - DNA, 25 bp, Rattus norvegicus
tgagctgctctgcttaacctgaact

SEQ ID NO: 611114 - DNA, 25 bp, Rattus norvegicus
tgagctgctctggttaacctgaact

SEQ ID NO: 611115 - DNA, 25 bp, Rattus norvegicus
tgagctgctcttagcaactgaccgg

SEQ ID NO: 611116 - DNA, 25 bp, Rattus norvegicus
tgagctgctctttgcaactgaccgg

SEQ ID NO: 611117 - DNA, 25 bp, Rattus norvegicus
tgagctgctgctaggccgagtcgta

SEQ ID NO: 611118 - DNA, 25 bp, Rattus norvegicus
tgagctgctgcttggccgagtcgta

SEQ ID NO: 611119 - DNA, 25 bp, Rattus norvegicus
tgagctgctgtcatttggtattccc

SEQ ID NO: 611120 - DNA, 25 bp, Rattus norvegicus
tgagctgctgtcttttggtattccc

SEQ ID NO: 611121 - DNA, 25 bp, Rattus norvegicus
tgagctgcttgtccaatgtgaggca

SEQ ID NO: 611122 - DNA, 25 bp, Rattus norvegicus
tgagctgcttgtgcaatgtgaggca

SEQ ID NO: 611123 - DNA, 25 bp, Rattus norvegicus
tgagctggaggaccctgacacatcc

SEQ ID NO: 611124 - DNA, 25 bp, Rattus norvegicus
tgagctggaggagcctgacacatcc

SEQ ID NO: 611125 - DNA, 25 bp, Rattus norvegicus
tgagctggccagaggtgtcgacacc

SEQ ID NO: 611126 - DNA, 25 bp, Rattus norvegicus
tgagctggccagctgagattcagct

SEQ ID NO: 611127 - DNA, 25 bp, Rattus norvegicus
tgagctggccaggtgagattcagct

SEQ ID NO: 611128 - DNA, 25 bp, Rattus norvegicus
tgagctggccagtggtgtcgacacc

SEQ ID NO: 611129 - DNA, 25 bp, Rattus norvegicus
tgagctggcctcaagtgaggacttt

SEQ ID NO: 611130 - DNA, 25 bp, Rattus norvegicus
tgagctggcctctagtgaggacttt

SEQ ID NO: 611131 - DNA, 25 bp, Rattus norvegicus
tgagctggctctagggatccgtcgc

SEQ ID NO: 611132 - DNA, 25 bp, Rattus norvegicus
tgagctggctcttgggatccgtcgc

SEQ ID NO: 611133 - DNA, 25 bp, Rattus norvegicus
tgagctgggactcagcctcacagat

SEQ ID NO: 611134 - DNA, 25 bp, Rattus norvegicus
tgagctgggactgagcctcacagat

SEQ ID NO: 611135 - DNA, 25 bp, Rattus norvegicus
tgagctgggctccatttttcaacaa

SEQ ID NO: 611136 - DNA, 25 bp, Rattus norvegicus
tgagctgggctcgatttttcaacaa

SEQ ID NO: 611137 - DNA, 25 bp, Rattus norvegicus
tgagctgggtcaacaatgctcccat

SEQ ID NO: 611138 - DNA, 25 bp, Rattus norvegicus
tgagctgggtcatcaatgctcccat

SEQ ID NO: 611139 - DNA, 25 bp, Rattus norvegicus
tgagctgggtttctctgttcatttt

SEQ ID NO: 611140 - DNA, 25 bp, Rattus norvegicus
tgagctgggtttgtctgttcatttt

SEQ ID NO: 611141 - DNA, 25 bp, Rattus norvegicus
tgagctggtaacatcctgtcttggg

SEQ ID NO: 611142 - DNA, 25 bp, Rattus norvegicus
tgagctggtaacttcctgtcttggg

SEQ ID NO: 611143 - DNA, 25 bp, Rattus norvegicus
tgagctggtcctccattacagtgcc

SEQ ID NO: 611144 - DNA, 25 bp, Rattus norvegicus
tgagctggtcctgcattacagtgcc

SEQ ID NO: 611145 - DNA, 25 bp, Rattus norvegicus
tgagctggtgaactcccgagactaa

SEQ ID NO: 611146 - DNA, 25 bp, Rattus norvegicus
tgagctggtgaagtcccgagactaa

SEQ ID NO: 611147 - DNA, 25 bp, Rattus norvegicus
tgagctggtggcagatgaccccaat

SEQ ID NO: 611148 - DNA, 25 bp, Rattus norvegicus
tgagctggtggctgatgaccccaat

SEQ ID NO: 611149 - DNA, 25 bp, Rattus norvegicus
tgagctggtgtcactttctaacctt

SEQ ID NO: 611150 - DNA, 25 bp, Rattus norvegicus
tgagctggtgtctctttctaacctt

SEQ ID NO: 611151 - DNA, 25 bp, Rattus norvegicus
tgagctggttccatactagtttttt

SEQ ID NO: 611152 - DNA, 25 bp, Rattus norvegicus
tgagctggttccttactagtttttt

SEQ ID NO: 611153 - DNA, 25 bp, Rattus norvegicus
tgagctgtacagatagcccctttac

SEQ ID NO: 611154 - DNA, 25 bp, Rattus norvegicus
tgagctgtacagttagcccctttac

SEQ ID NO: 611155 - DNA, 25 bp, Rattus norvegicus
tgagctgtaccgcaggcagtccttt

SEQ ID NO: 611156 - DNA, 25 bp, Rattus norvegicus
tgagctgtaccggaggcagtccttt

SEQ ID NO: 611157 - DNA, 25 bp, Rattus norvegicus
tgagctgtactcagggcttcatcac

SEQ ID NO: 611158 - DNA, 25 bp, Rattus norvegicus
tgagctgtactctgggcttcatcac

SEQ ID NO: 611159 - DNA, 25 bp, Rattus norvegicus
tgagctgtatttagcattttgtcta

SEQ ID NO: 611160 - DNA, 25 bp, Rattus norvegicus
tgagctgtattttgcattttgtcta

SEQ ID NO: 611161 - DNA, 25 bp, Rattus norvegicus
tgagctgtcaccaacactccatttt

SEQ ID NO: 611162 - DNA, 25 bp, Rattus norvegicus
tgagctgtcacctacactccatttt

SEQ ID NO: 611163 - DNA, 25 bp, Rattus norvegicus
tgagctgtcagtctgctatcttaat

SEQ ID NO: 611164 - DNA, 25 bp, Rattus norvegicus
tgagctgtcagtgtgctatcttaat

SEQ ID NO: 611165 - DNA, 25 bp, Rattus norvegicus
tgagctgtcattctttggccatgga

SEQ ID NO: 611166 - DNA, 25 bp, Rattus norvegicus
tgagctgtcattgtttggccatgga

SEQ ID NO: 611167 - DNA, 25 bp, Rattus norvegicus
tgagctgtcctgaagtgctgtcact

SEQ ID NO: 611168 - DNA, 25 bp, Rattus norvegicus
tgagctgtcctgtagtgctgtcact

SEQ ID NO: 611169 - DNA, 25 bp, Rattus norvegicus
tgagctgtctccaagctctcggagt

SEQ ID NO: 611170 - DNA, 25 bp, Rattus norvegicus
tgagctgtctcctagctctcggagt

SEQ ID NO: 611171 - DNA, 25 bp, Rattus norvegicus
tgagctgtgaatccgattacccctt

SEQ ID NO: 611172 - DNA, 25 bp, Rattus norvegicus
tgagctgtgaatgcgattacccctt

SEQ ID NO: 611173 - DNA, 25 bp, Rattus norvegicus
tgagctgtgccaatccattgtgccc

SEQ ID NO: 611174 - DNA, 25 bp, Rattus norvegicus
tgagctgtgccattccattgtgccc

SEQ ID NO: 611175 - DNA, 25 bp, Rattus norvegicus
tgagctgtgcccagctgacaagctt

SEQ ID NO: 611176 - DNA, 25 bp, Rattus norvegicus
tgagctgtgccctgctgacaagctt

SEQ ID NO: 611177 - DNA, 25 bp, Rattus norvegicus
tgagctgtggagagtacctacattt

SEQ ID NO: 611178 - DNA, 25 bp, Rattus norvegicus
tgagctgtggagtgtacctacattt

SEQ ID NO: 611179 - DNA, 25 bp, Rattus norvegicus
tgagctgtgtggaaagcctgccctc

SEQ ID NO: 611180 - DNA, 25 bp, Rattus norvegicus
tgagctgtgtggtaagcctgccctc

SEQ ID NO: 611181 - DNA, 25 bp, Rattus norvegicus
tgagctgttcatccttccaggaaac

SEQ ID NO: 611182 - DNA, 25 bp, Rattus norvegicus
tgagctgttcatgcttccaggaaac

SEQ ID NO: 611183 - DNA, 25 bp, Rattus norvegicus
tgagctgttgaccagtagggttcca

SEQ ID NO: 611184 - DNA, 25 bp, Rattus norvegicus
tgagctgttgacgagtagggttcca

SEQ ID NO: 611185 - DNA, 25 bp, Rattus norvegicus
tgagctgtttctccagtcctactct

SEQ ID NO: 611186 - DNA, 25 bp, Rattus norvegicus
tgagctgtttctgcagtcctactct

SEQ ID NO: 611187 - DNA, 25 bp, Rattus norvegicus
tgagctgtttgcattttctctccca

SEQ ID NO: 611188 - DNA, 25 bp, Rattus norvegicus
tgagctgtttgctttttctctccca

SEQ ID NO: 611189 - DNA, 25 bp, Rattus norvegicus
tgagcttaaggccacttccggaaat

SEQ ID NO: 611190 - DNA, 25 bp, Rattus norvegicus
tgagcttaaggcgacttccggaaat

SEQ ID NO: 611191 - DNA, 25 bp, Rattus norvegicus
tgagcttacaggagacttctgccgc

SEQ ID NO: 611192 - DNA, 25 bp, Rattus norvegicus
tgagcttacaggtgacttctgccgc

SEQ ID NO: 611193 - DNA, 25 bp, Rattus norvegicus
tgagcttacccgacttgatctttat

SEQ ID NO: 611194 - DNA, 25 bp, Rattus norvegicus
tgagcttacccgtcttgatctttat

SEQ ID NO: 611195 - DNA, 25 bp, Rattus norvegicus
tgagcttacctaatccagggcagag

SEQ ID NO: 611196 - DNA, 25 bp, Rattus norvegicus
tgagcttacctattccagggcagag

SEQ ID NO: 611197 - DNA, 25 bp, Rattus norvegicus
tgagcttacggcatttcttcgtctt

SEQ ID NO: 611198 - DNA, 25 bp, Rattus norvegicus
tgagcttacggcttttcttcgtctt

SEQ ID NO: 611199 - DNA, 25 bp, Rattus norvegicus
tgagcttactttcgcctaggcatct

SEQ ID NO: 611200 - DNA, 25 bp, Rattus norvegicus
tgagcttactttggcctaggcatct

SEQ ID NO: 611201 - DNA, 25 bp, Rattus norvegicus
tgagcttaggacagtagtgttcaca

SEQ ID NO: 611202 - DNA, 25 bp, Rattus norvegicus
tgagcttaggactgtagtgttcaca

SEQ ID NO: 611203 - DNA, 25 bp, Rattus norvegicus
tgagcttatctcaggtatctagacc

SEQ ID NO: 611204 - DNA, 25 bp, Rattus norvegicus
tgagcttatctctggtatctagacc

SEQ ID NO: 611205 - DNA, 25 bp, Rattus norvegicus
tgagcttatgtcacacaagcagctt

SEQ ID NO: 611206 - DNA, 25 bp, Rattus norvegicus
tgagcttatgtctcacaagcagctt

SEQ ID NO: 611207 - DNA, 25 bp, Rattus norvegicus
tgagcttatgtgatctcagttgaaa

SEQ ID NO: 611208 - DNA, 25 bp, Rattus norvegicus
tgagcttatgtgttctcagttgaaa

SEQ ID NO: 611209 - DNA, 25 bp, Rattus norvegicus
tgagcttatttgatctgatgtctgt

SEQ ID NO: 611210 - DNA, 25 bp, Rattus norvegicus
tgagcttatttgttctgatgtctgt

SEQ ID NO: 611211 - DNA, 25 bp, Rattus norvegicus
tgagcttcagaacctccatggaagc

SEQ ID NO: 611212 - DNA, 25 bp, Rattus norvegicus
tgagcttcagaagctccatggaagc

SEQ ID NO: 611213 - DNA, 25 bp, Rattus norvegicus
tgagcttcagcaatgttggccaaca

SEQ ID NO: 611214 - DNA, 25 bp, Rattus norvegicus
tgagcttcagcactgcctcagtctc

SEQ ID NO: 611215 - DNA, 25 bp, Rattus norvegicus
tgagcttcagcagtgcctcagtctc

SEQ ID NO: 611216 - DNA, 25 bp, Rattus norvegicus
tgagcttcagcattgttggccaaca

SEQ ID NO: 611217 - DNA, 25 bp, Rattus norvegicus
tgagcttcagggatggcgcctatca

SEQ ID NO: 611218 - DNA, 25 bp, Rattus norvegicus
tgagcttcagggttggcgcctatca

SEQ ID NO: 611219 - DNA, 25 bp, Rattus norvegicus
tgagcttcatcacatcatcagcagc

SEQ ID NO: 611220 - DNA, 25 bp, Rattus norvegicus
tgagcttcatcagatcatcagcagc

SEQ ID NO: 611221 - DNA, 25 bp, Rattus norvegicus
tgagcttccaaccatgctgtgacta

SEQ ID NO: 611222 - DNA, 25 bp, Rattus norvegicus
tgagcttccaacgatgctgtgacta

SEQ ID NO: 611223 - DNA, 25 bp, Rattus norvegicus
tgagcttccaccagaaatgaaagac

SEQ ID NO: 611224 - DNA, 25 bp, Rattus norvegicus
tgagcttccacctgaaatgaaagac

SEQ ID NO: 611225 - DNA, 25 bp, Rattus norvegicus
tgagcttccagtccttgttctttct

SEQ ID NO: 611226 - DNA, 25 bp, Rattus norvegicus
tgagcttccagtgcttgttctttct

SEQ ID NO: 611227 - DNA, 25 bp, Rattus norvegicus
tgagcttcccaacccagagcattta

SEQ ID NO: 611228 - DNA, 25 bp, Rattus norvegicus
tgagcttcccaagccagagcattta

SEQ ID NO: 611229 - DNA, 25 bp, Rattus norvegicus
tgagcttccggacactacagaacat

SEQ ID NO: 611230 - DNA, 25 bp, Rattus norvegicus
tgagcttccggagactacagaacat

SEQ ID NO: 611231 - DNA, 25 bp, Rattus norvegicus
tgagcttcctgtatgtggtttgacg

SEQ ID NO: 611232 - DNA, 25 bp, Rattus norvegicus
tgagcttcctgtcattttcaacgcc

SEQ ID NO: 611233 - DNA, 25 bp, Rattus norvegicus
tgagcttcctgtgattttcaacgcc

SEQ ID NO: 611234 - DNA, 25 bp, Rattus norvegicus
tgagcttcctgtttgtggtttgacg

SEQ ID NO: 611235 - DNA, 25 bp, Rattus norvegicus
tgagcttccttgctaagaattccaa

SEQ ID NO: 611236 - DNA, 25 bp, Rattus norvegicus
tgagcttccttggtaagaattccaa

SEQ ID NO: 611237 - DNA, 25 bp, Rattus norvegicus
tgagcttcgctacagcatctacaga

SEQ ID NO: 611238 - DNA, 25 bp, Rattus norvegicus
tgagcttcgctagagcatctacaga

SEQ ID NO: 611239 - DNA, 25 bp, Rattus norvegicus
tgagcttctcacacgactgctggga

SEQ ID NO: 611240 - DNA, 25 bp, Rattus norvegicus
tgagcttctcactcgactgctggga

SEQ ID NO: 611241 - DNA, 25 bp, Rattus norvegicus
tgagcttctccaagcttcaactagt

SEQ ID NO: 611242 - DNA, 25 bp, Rattus norvegicus
tgagcttctccatgcttcaactagt

SEQ ID NO: 611243 - DNA, 25 bp, Rattus norvegicus
tgagcttctcctatttattctctgc

SEQ ID NO: 611244 - DNA, 25 bp, Rattus norvegicus
tgagcttctcctttttattctctgc

SEQ ID NO: 611245 - DNA, 25 bp, Rattus norvegicus
tgagcttctctgagccgcggatact

SEQ ID NO: 611246 - DNA, 25 bp, Rattus norvegicus
tgagcttctctgtgccgcggatact

SEQ ID NO: 611247 - DNA, 25 bp, Rattus norvegicus
tgagcttctgcgaggacacgatctt

SEQ ID NO: 611248 - DNA, 25 bp, Rattus norvegicus
tgagcttctgcgtggacacgatctt

SEQ ID NO: 611249 - DNA, 25 bp, Rattus norvegicus
tgagcttctggtcacatgtggcaaa

SEQ ID NO: 611250 - DNA, 25 bp, Rattus norvegicus
tgagcttctggtgacatgtggcaaa

SEQ ID NO: 611251 - DNA, 25 bp, Rattus norvegicus
tgagcttctgtgctacggtcatcat

SEQ ID NO: 611252 - DNA, 25 bp, Rattus norvegicus
tgagcttctgtggtacggtcatcat

SEQ ID NO: 611253 - DNA, 25 bp, Rattus norvegicus
tgagcttctgttctagggaccactg

SEQ ID NO: 611254 - DNA, 25 bp, Rattus norvegicus
tgagcttctgttgtagggaccactg

SEQ ID NO: 611255 - DNA, 25 bp, Rattus norvegicus
tgagcttcttccaacttaccatggg

SEQ ID NO: 611256 - DNA, 25 bp, Rattus norvegicus
tgagcttcttccaccaacagtaact

SEQ ID NO: 611257 - DNA, 25 bp, Rattus norvegicus
tgagcttcttcccacaagtaatgag

SEQ ID NO: 611258 - DNA, 25 bp, Rattus norvegicus
tgagcttcttccgacaagtaatgag

SEQ ID NO: 611259 - DNA, 25 bp, Rattus norvegicus
tgagcttcttcctacttaccatggg

SEQ ID NO: 611260 - DNA, 25 bp, Rattus norvegicus
tgagcttcttcctccaacagtaact

SEQ ID NO: 611261 - DNA, 25 bp, Rattus norvegicus
tgagcttcttgaacgctagcgcgtc

SEQ ID NO: 611262 - DNA, 25 bp, Rattus norvegicus
tgagcttcttgatcgctagcgcgtc

SEQ ID NO: 611263 - DNA, 25 bp, Rattus norvegicus
tgagcttgaagccacctgggctata

SEQ ID NO: 611264 - DNA, 25 bp, Rattus norvegicus
tgagcttgaagcgacctgggctata

SEQ ID NO: 611265 - DNA, 25 bp, Rattus norvegicus
tgagcttgagctatgtgtcccttct

SEQ ID NO: 611266 - DNA, 25 bp, Rattus norvegicus
tgagcttgagctttgtgtcccttct

SEQ ID NO: 611267 - DNA, 25 bp, Rattus norvegicus
tgagcttgagggagcttcagagcaa

SEQ ID NO: 611268 - DNA, 25 bp, Rattus norvegicus
tgagcttgagggtgcttcagagcaa

SEQ ID NO: 611269 - DNA, 25 bp, Rattus norvegicus
tgagcttgcaaaaatcctgcctcag

SEQ ID NO: 611270 - DNA, 25 bp, Rattus norvegicus
tgagcttgcaaatatcctgcctcag

SEQ ID NO: 611271 - DNA, 25 bp, Rattus norvegicus
tgagcttgcatcaggtcctgcctgt

SEQ ID NO: 611272 - DNA, 25 bp, Rattus norvegicus
tgagcttgcatctggtcctgcctgt

SEQ ID NO: 611273 - DNA, 25 bp, Rattus norvegicus
tgagcttgccggcacacatacatac

SEQ ID NO: 611274 - DNA, 25 bp, Rattus norvegicus
tgagcttgccgggacacatacatac

SEQ ID NO: 611275 - DNA, 25 bp, Rattus norvegicus
tgagcttgctcgagccaaatcttta

SEQ ID NO: 611276 - DNA, 25 bp, Rattus norvegicus
tgagcttgctcgtgccaaatcttta

SEQ ID NO: 611277 - DNA, 25 bp, Rattus norvegicus
tgagcttgctgtagggagcctgttt

SEQ ID NO: 611278 - DNA, 25 bp, Rattus norvegicus
tgagcttgctgttgggagcctgttt

SEQ ID NO: 611279 - DNA, 25 bp, Rattus norvegicus
tgagcttgcttcctaatcagcctaa

SEQ ID NO: 611280 - DNA, 25 bp, Rattus norvegicus
tgagcttgcttcgtaatcagcctaa

SEQ ID NO: 611281 - DNA, 25 bp, Rattus norvegicus
tgagcttggagcaaccaggagccat

SEQ ID NO: 611282 - DNA, 25 bp, Rattus norvegicus
tgagcttggagctaccaggagccat

SEQ ID NO: 611283 - DNA, 25 bp, Rattus norvegicus
tgagcttggctactctacactagtt

SEQ ID NO: 611284 - DNA, 25 bp, Rattus norvegicus
tgagcttggctagtctacactagtt

SEQ ID NO: 611285 - DNA, 25 bp, Rattus norvegicus
tgagcttgtaagaaacaccccatga

SEQ ID NO: 611286 - DNA, 25 bp, Rattus norvegicus
tgagcttgtaagtaacaccccatga

SEQ ID NO: 611287 - DNA, 25 bp, Rattus norvegicus
tgagcttgtctgactgagtcttgtg

SEQ ID NO: 611288 - DNA, 25 bp, Rattus norvegicus
tgagcttgtctgtctgagtcttgtg

SEQ ID NO: 611289 - DNA, 25 bp, Rattus norvegicus
tgagcttgttatccatctccccaaa

SEQ ID NO: 611290 - DNA, 25 bp, Rattus norvegicus
tgagcttgttatgcatctccccaaa

SEQ ID NO: 611291 - DNA, 25 bp, Rattus norvegicus
tgagctttataaccccagtcacaaa

SEQ ID NO: 611292 - DNA, 25 bp, Rattus norvegicus
tgagctttataagcccagtcacaaa

SEQ ID NO: 611293 - DNA, 25 bp, Rattus norvegicus
tgagctttcagtccctggagatgtt

SEQ ID NO: 611294 - DNA, 25 bp, Rattus norvegicus
tgagctttcagtgcctggagatgtt

SEQ ID NO: 611295 - DNA, 25 bp, Rattus norvegicus
tgagctttcattcccaaacccagtg

SEQ ID NO: 611296 - DNA, 25 bp, Rattus norvegicus
tgagctttcattgccaaacccagtg

SEQ ID NO: 611297 - DNA, 25 bp, Rattus norvegicus
tgagctttcctgaagaatccttgcc

SEQ ID NO: 611298 - DNA, 25 bp, Rattus norvegicus
tgagctttcctgtagaatccttgcc

SEQ ID NO: 611299 - DNA, 25 bp, Rattus norvegicus
tgagctttctatcattgtcaatatg

SEQ ID NO: 611300 - DNA, 25 bp, Rattus norvegicus
tgagctttctatccagtcctttctg

SEQ ID NO: 611301 - DNA, 25 bp, Rattus norvegicus
tgagctttctatgattgtcaatatg

SEQ ID NO: 611302 - DNA, 25 bp, Rattus norvegicus
tgagctttctatgcagtcctttctg

SEQ ID NO: 611303 - DNA, 25 bp, Rattus norvegicus
tgagctttctcactctttctctaaa

SEQ ID NO: 611304 - DNA, 25 bp, Rattus norvegicus
tgagctttctcagtctttctctaaa

SEQ ID NO: 611305 - DNA, 25 bp, Rattus norvegicus
tgagctttcttcaggcacaatctgg

SEQ ID NO: 611306 - DNA, 25 bp, Rattus norvegicus
tgagctttcttcaggcctaggacaa

SEQ ID NO: 611307 - DNA, 25 bp, Rattus norvegicus
tgagctttcttctggcacaatctgg

SEQ ID NO: 611308 - DNA, 25 bp, Rattus norvegicus
tgagctttcttctggcctaggacaa

SEQ ID NO: 611309 - DNA, 25 bp, Rattus norvegicus
tgagctttgaacaatgccaccatgc

SEQ ID NO: 611310 - DNA, 25 bp, Rattus norvegicus
tgagctttgaactatgccaccatgc

SEQ ID NO: 611311 - DNA, 25 bp, Rattus norvegicus
tgagctttgcagagggagtctccgt

SEQ ID NO: 611312 - DNA, 25 bp, Rattus norvegicus
tgagctttgcagtgggagtctccgt

SEQ ID NO: 611313 - DNA, 25 bp, Rattus norvegicus
tgagctttggaaagcctgccctaca

SEQ ID NO: 611314 - DNA, 25 bp, Rattus norvegicus
tgagctttggaatgcctgccctaca

SEQ ID NO: 611315 - DNA, 25 bp, Rattus norvegicus
tgagctttggatacagtccccataa

SEQ ID NO: 611316 - DNA, 25 bp, Rattus norvegicus
tgagctttggattcagtccccataa

SEQ ID NO: 611317 - DNA, 25 bp, Rattus norvegicus
tgagctttggccactgttctgtcag

SEQ ID NO: 611318 - DNA, 25 bp, Rattus norvegicus
tgagctttggcctctgttctgtcag

SEQ ID NO: 611319 - DNA, 25 bp, Rattus norvegicus
tgagcttttacacgcgcccacataa

SEQ ID NO: 611320 - DNA, 25 bp, Rattus norvegicus
tgagcttttacaggcgcccacataa

SEQ ID NO: 611321 - DNA, 25 bp, Rattus norvegicus
tgagcttttatgacaagacatgcat

SEQ ID NO: 611322 - DNA, 25 bp, Rattus norvegicus
tgagcttttatgtcaagacatgcat

SEQ ID NO: 611323 - DNA, 25 bp, Rattus norvegicus
tgagcttttctcctccattgctttc

SEQ ID NO: 611324 - DNA, 25 bp, Rattus norvegicus
tgagcttttctcgtccattgctttc

SEQ ID NO: 611325 - DNA, 25 bp, Rattus norvegicus
tgaggaaaacctctcaccagcttag

SEQ ID NO: 611326 - DNA, 25 bp, Rattus norvegicus
tgaggaaaacctgtcaccagcttag

SEQ ID NO: 611327 - DNA, 25 bp, Rattus norvegicus
tgaggaaactacctccttcgtgtct

SEQ ID NO: 611328 - DNA, 25 bp, Rattus norvegicus
tgaggaaactacgtccttcgtgtct

SEQ ID NO: 611329 - DNA, 25 bp, Rattus norvegicus
tgaggaaagaccaaccctggttctt

SEQ ID NO: 611330 - DNA, 25 bp, Rattus norvegicus
tgaggaaagacctaccctggttctt

SEQ ID NO: 611331 - DNA, 25 bp, Rattus norvegicus
tgaggaaagcccagccaacactctg

SEQ ID NO: 611332 - DNA, 25 bp, Rattus norvegicus
tgaggaaagccctgccaacactctg

SEQ ID NO: 611333 - DNA, 25 bp, Rattus norvegicus
tgaggaaagggaccctctccttccg

SEQ ID NO: 611334 - DNA, 25 bp, Rattus norvegicus
tgaggaaagggagcctctccttccg

SEQ ID NO: 611335 - DNA, 25 bp, Rattus norvegicus
tgaggaaagggtacccacagctccc

SEQ ID NO: 611336 - DNA, 25 bp, Rattus norvegicus
tgaggaaagggttcccacagctccc

SEQ ID NO: 611337 - DNA, 25 bp, Rattus norvegicus
tgaggaaattacaactctgtgtccc

SEQ ID NO: 611338 - DNA, 25 bp, Rattus norvegicus
tgaggaaattactactctgtgtccc

SEQ ID NO: 611339 - DNA, 25 bp, Rattus norvegicus
tgaggaacaccaccatctgtttacc

SEQ ID NO: 611340 - DNA, 25 bp, Rattus norvegicus
tgaggaacaccagcatctgtttacc

SEQ ID NO: 611341 - DNA, 25 bp, Rattus norvegicus
tgaggaacactcctcctcactggag

SEQ ID NO: 611342 - DNA, 25 bp, Rattus norvegicus
tgaggaacactcgtcctcactggag

SEQ ID NO: 611343 - DNA, 25 bp, Rattus norvegicus
tgaggaacagctctacaggctctct

SEQ ID NO: 611344 - DNA, 25 bp, Rattus norvegicus
tgaggaacagctgtacaggctctct

SEQ ID NO: 611345 - DNA, 25 bp, Rattus norvegicus
tgaggaacatccatacgcagctcac

SEQ ID NO: 611346 - DNA, 25 bp, Rattus norvegicus
tgaggaacatccttacgcagctcac

SEQ ID NO: 611347 - DNA, 25 bp, Rattus norvegicus
tgaggaaccacaaggccgcactgtc

SEQ ID NO: 611348 - DNA, 25 bp, Rattus norvegicus
tgaggaaccacatggccgcactgtc

SEQ ID NO: 611349 - DNA, 25 bp, Rattus norvegicus
tgaggaaccagaaggactccagccc

SEQ ID NO: 611350 - DNA, 25 bp, Rattus norvegicus
tgaggaaccagatggactccagccc

SEQ ID NO: 611351 - DNA, 25 bp, Rattus norvegicus
tgaggaaccattctgtcgcctgagc

SEQ ID NO: 611352 - DNA, 25 bp, Rattus norvegicus
tgaggaaccattgtgtcgcctgagc

SEQ ID NO: 611353 - DNA, 25 bp, Rattus norvegicus
tgaggaaccgtcaccttcaatttgc

SEQ ID NO: 611354 - DNA, 25 bp, Rattus norvegicus
tgaggaaccgtctccttcaatttgc

SEQ ID NO: 611355 - DNA, 25 bp, Rattus norvegicus
tgaggaacctccatcagtcgggatt

SEQ ID NO: 611356 - DNA, 25 bp, Rattus norvegicus
tgaggaacctccttcagtcgggatt

SEQ ID NO: 611357 - DNA, 25 bp, Rattus norvegicus
tgaggaactgagcttttatgtctaa

SEQ ID NO: 611358 - DNA, 25 bp, Rattus norvegicus
tgaggaactgaggttttatgtctaa

SEQ ID NO: 611359 - DNA, 25 bp, Rattus norvegicus
tgaggaactggactttctctccttc

SEQ ID NO: 611360 - DNA, 25 bp, Rattus norvegicus
tgaggaactggagtttctctccttc

SEQ ID NO: 611361 - DNA, 25 bp, Rattus norvegicus
tgaggaacttccctgcaaaccagca

SEQ ID NO: 611362 - DNA, 25 bp, Rattus norvegicus
tgaggaacttccgtgcaaaccagca

SEQ ID NO: 611363 - DNA, 25 bp, Rattus norvegicus
tgaggaacttgacgtctgactggac

SEQ ID NO: 611364 - DNA, 25 bp, Rattus norvegicus
tgaggaacttgaggtctgactggac

SEQ ID NO: 611365 - DNA, 25 bp, Rattus norvegicus
tgaggaagacttaccaacagtcaaa

SEQ ID NO: 611366 - DNA, 25 bp, Rattus norvegicus
tgaggaagactttccaacagtcaaa

SEQ ID NO: 611367 - DNA, 25 bp, Rattus norvegicus
tgaggaagagcacccgcccatgaaa

SEQ ID NO: 611368 - DNA, 25 bp, Rattus norvegicus
tgaggaagagcagccgcccatgaaa

SEQ ID NO: 611369 - DNA, 25 bp, Rattus norvegicus
tgaggaagagttccgagtcccctgc

SEQ ID NO: 611370 - DNA, 25 bp, Rattus norvegicus
tgaggaagagttgcgagtcccctgc

SEQ ID NO: 611371 - DNA, 25 bp, Rattus norvegicus
tgaggaagccatccgttttgcccga

SEQ ID NO: 611372 - DNA, 25 bp, Rattus norvegicus
tgaggaagccatgcgttttgcccga

SEQ ID NO: 611373 - DNA, 25 bp, Rattus norvegicus
tgaggaagccgaacacctgcagtga

SEQ ID NO: 611374 - DNA, 25 bp, Rattus norvegicus
tgaggaagccgatcacctgcagtga

SEQ ID NO: 611375 - DNA, 25 bp, Rattus norvegicus
tgaggaagccttccatctgttctgc

SEQ ID NO: 611376 - DNA, 25 bp, Rattus norvegicus
tgaggaagccttgcatctgttctgc

SEQ ID NO: 611377 - DNA, 25 bp, Rattus norvegicus
tgaggaagctccagaagcagcccct

SEQ ID NO: 611378 - DNA, 25 bp, Rattus norvegicus
tgaggaagctcctgaagcagcccct

SEQ ID NO: 611379 - DNA, 25 bp, Rattus norvegicus
tgaggaaggcctacaccttgcgcta

SEQ ID NO: 611380 - DNA, 25 bp, Rattus norvegicus
tgaggaaggccttcaccttgcgcta

SEQ ID NO: 611381 - DNA, 25 bp, Rattus norvegicus
tgaggaagtcctctgttcccagctg

SEQ ID NO: 611382 - DNA, 25 bp, Rattus norvegicus
tgaggaagtcctgtgttcccagctg

SEQ ID NO: 611383 - DNA, 25 bp, Rattus norvegicus
tgaggaagttctcctgcgtggcctt

SEQ ID NO: 611384 - DNA, 25 bp, Rattus norvegicus
tgaggaagttctgctgcgtggcctt

SEQ ID NO: 611385 - DNA, 25 bp, Rattus norvegicus
tgaggaataaccagtccagcagaaa

SEQ ID NO: 611386 - DNA, 25 bp, Rattus norvegicus
tgaggaataacctgtccagcagaaa

SEQ ID NO: 611387 - DNA, 25 bp, Rattus norvegicus
tgaggaatacaacccctttgaccag

SEQ ID NO: 611388 - DNA, 25 bp, Rattus norvegicus
tgaggaatacaagccctttgaccag

SEQ ID NO: 611389 - DNA, 25 bp, Rattus norvegicus
tgaggaatctcaacgccatagtgca

SEQ ID NO: 611390 - DNA, 25 bp, Rattus norvegicus
tgaggaatctcatcgccatagtgca

SEQ ID NO: 611391 - DNA, 25 bp, Rattus norvegicus
tgaggaatctttcccctattatggg

SEQ ID NO: 611392 - DNA, 25 bp, Rattus norvegicus
tgaggaatctttgccctattatggg

SEQ ID NO: 611393 - DNA, 25 bp, Rattus norvegicus
tgaggaattctgacccttcggtgat

SEQ ID NO: 611394 - DNA, 25 bp, Rattus norvegicus
tgaggaattctgtcccttcggtgat

SEQ ID NO: 611395 - DNA, 25 bp, Rattus norvegicus
tgaggaattcttctctcctgtttca

SEQ ID NO: 611396 - DNA, 25 bp, Rattus norvegicus
tgaggaattcttgtctcctgtttca

SEQ ID NO: 611397 - DNA, 25 bp, Rattus norvegicus
tgaggaatttaaatccaccctcgtc

SEQ ID NO: 611398 - DNA, 25 bp, Rattus norvegicus
tgaggaatttaattccaccctcgtc

SEQ ID NO: 611399 - DNA, 25 bp, Rattus norvegicus
tgaggacaaactcgcctaaccctgg

SEQ ID NO: 611400 - DNA, 25 bp, Rattus norvegicus
tgaggacaaactggcctaaccctgg

SEQ ID NO: 611401 - DNA, 25 bp, Rattus norvegicus
tgaggacaaatacctcttccttctg

SEQ ID NO: 611402 - DNA, 25 bp, Rattus norvegicus
tgaggacaaatagctcttccttctg

SEQ ID NO: 611403 - DNA, 25 bp, Rattus norvegicus
tgaggacacaatacacccacacaca

SEQ ID NO: 611404 - DNA, 25 bp, Rattus norvegicus
tgaggacacaattcacccacacaca

SEQ ID NO: 611405 - DNA, 25 bp, Rattus norvegicus
tgaggacacagcacagccgttcagt

SEQ ID NO: 611406 - DNA, 25 bp, Rattus norvegicus
tgaggacacagctcagccgttcagt

SEQ ID NO: 611407 - DNA, 25 bp, Rattus norvegicus
tgaggacacaggcaggcttcgcacc

SEQ ID NO: 611408 - DNA, 25 bp, Rattus norvegicus
tgaggacacagggaggcttcgcacc

SEQ ID NO: 611409 - DNA, 25 bp, Rattus norvegicus
tgaggacacagtaaccgacccggtg

SEQ ID NO: 611410 - DNA, 25 bp, Rattus norvegicus
tgaggacacagttaccgacccggtg

SEQ ID NO: 611411 - DNA, 25 bp, Rattus norvegicus
tgaggacacatcaccagctggtgag

SEQ ID NO: 611412 - DNA, 25 bp, Rattus norvegicus
tgaggacacatcatccagtgacagt

SEQ ID NO: 611413 - DNA, 25 bp, Rattus norvegicus
tgaggacacatctccagctggtgag

SEQ ID NO: 611414 - DNA, 25 bp, Rattus norvegicus
tgaggacacatcttccagtgacagt

SEQ ID NO: 611415 - DNA, 25 bp, Rattus norvegicus
tgaggacaccaccagttctgtgtct

SEQ ID NO: 611416 - DNA, 25 bp, Rattus norvegicus
tgaggacaccacgagttctgtgtct

SEQ ID NO: 611417 - DNA, 25 bp, Rattus norvegicus
tgaggacaccatcaccaggctgggt

SEQ ID NO: 611418 - DNA, 25 bp, Rattus norvegicus
tgaggacaccatgaccaggctgggt

SEQ ID NO: 611419 - DNA, 25 bp, Rattus norvegicus
tgaggacacctacttgtaaccccag

SEQ ID NO: 611420 - DNA, 25 bp, Rattus norvegicus
tgaggacacctagttgtaaccccag

SEQ ID NO: 611421 - DNA, 25 bp, Rattus norvegicus
tgaggacacgccattgcctggaagt

SEQ ID NO: 611422 - DNA, 25 bp, Rattus norvegicus
tgaggacacgcctttgcctggaagt

SEQ ID NO: 611423 - DNA, 25 bp, Rattus norvegicus
tgaggacacgtcatggctaccaaac

SEQ ID NO: 611424 - DNA, 25 bp, Rattus norvegicus
tgaggacacgtcttggctaccaaac

SEQ ID NO: 611425 - DNA, 25 bp, Rattus norvegicus
tgaggacactccactcaagtctgtc

SEQ ID NO: 611426 - DNA, 25 bp, Rattus norvegicus
tgaggacactcctctcaagtctgtc

SEQ ID NO: 611427 - DNA, 25 bp, Rattus norvegicus
tgaggacactgaccacctgtgccag

SEQ ID NO: 611428 - DNA, 25 bp, Rattus norvegicus
tgaggacactgagcacctgtgccag

SEQ ID NO: 611429 - DNA, 25 bp, Rattus norvegicus
tgaggacagccaacgcctggccctg

SEQ ID NO: 611430 - DNA, 25 bp, Rattus norvegicus
tgaggacagccatcgcctggccctg

SEQ ID NO: 611431 - DNA, 25 bp, Rattus norvegicus
tgaggacagtgcagcagctcgcccg

SEQ ID NO: 611432 - DNA, 25 bp, Rattus norvegicus
tgaggacagtgctgcagctcgcccg

SEQ ID NO: 611433 - DNA, 25 bp, Rattus norvegicus
tgaggacatcagcaacccggagcgt

SEQ ID NO: 611434 - DNA, 25 bp, Rattus norvegicus
tgaggacatcaggaacccggagcgt

SEQ ID NO: 611435 - DNA, 25 bp, Rattus norvegicus
tgaggacatgtgacctcctgaggcc

SEQ ID NO: 611436 - DNA, 25 bp, Rattus norvegicus
tgaggacatgtgtcctcctgaggcc

SEQ ID NO: 611437 - DNA, 25 bp, Rattus norvegicus
tgaggacattgcatttcccctttga

SEQ ID NO: 611438 - DNA, 25 bp, Rattus norvegicus
tgaggacattgcttttcccctttga

SEQ ID NO: 611439 - DNA, 25 bp, Rattus norvegicus
tgaggaccaaatataactgttaagc

SEQ ID NO: 611440 - DNA, 25 bp, Rattus norvegicus
tgaggaccaaatttaactgttaagc

SEQ ID NO: 611441 - DNA, 25 bp, Rattus norvegicus
tgaggaccaccaccctgtgtctgac

SEQ ID NO: 611442 - DNA, 25 bp, Rattus norvegicus
tgaggaccaccagcctgtgtctgac

SEQ ID NO: 611443 - DNA, 25 bp, Rattus norvegicus
tgaggaccagagagaggctacagct

SEQ ID NO: 611444 - DNA, 25 bp, Rattus norvegicus
tgaggaccagagctggccacacgca

SEQ ID NO: 611445 - DNA, 25 bp, Rattus norvegicus
tgaggaccagaggtggccacacgca

SEQ ID NO: 611446 - DNA, 25 bp, Rattus norvegicus
tgaggaccagagtgaggctacagct

SEQ ID NO: 611447 - DNA, 25 bp, Rattus norvegicus
tgaggaccaggcacttgaggactag

SEQ ID NO: 611448 - DNA, 25 bp, Rattus norvegicus
tgaggaccaggctcttgaggactag

SEQ ID NO: 611449 - DNA, 25 bp, Rattus norvegicus
tgaggaccatctccctcagataacc

SEQ ID NO: 611450 - DNA, 25 bp, Rattus norvegicus
tgaggaccatctgcctcagataacc

SEQ ID NO: 611451 - DNA, 25 bp, Rattus norvegicus
tgaggacccatgcttaagtgactgc

SEQ ID NO: 611452 - DNA, 25 bp, Rattus norvegicus
tgaggacccatggttaagtgactgc

SEQ ID NO: 611453 - DNA, 25 bp, Rattus norvegicus
tgaggaccctctcgattaatcgaat

SEQ ID NO: 611454 - DNA, 25 bp, Rattus norvegicus
tgaggaccctctggattaatcgaat

SEQ ID NO: 611455 - DNA, 25 bp, Rattus norvegicus
tgaggaccggatcctgctggctaac

SEQ ID NO: 611456 - DNA, 25 bp, Rattus norvegicus
tgaggaccggatgctgctggctaac

SEQ ID NO: 611457 - DNA, 25 bp, Rattus norvegicus
tgaggacctaacaggcagggccctg

SEQ ID NO: 611458 - DNA, 25 bp, Rattus norvegicus
tgaggacctaactggcagggccctg

SEQ ID NO: 611459 - DNA, 25 bp, Rattus norvegicus
tgaggacctacaacatcgacgccat

SEQ ID NO: 611460 - DNA, 25 bp, Rattus norvegicus
tgaggacctacatcatcgacgccat

SEQ ID NO: 611461 - DNA, 25 bp, Rattus norvegicus
tgaggacctactcccaggtgggctt

SEQ ID NO: 611462 - DNA, 25 bp, Rattus norvegicus
tgaggacctactgccaggtgggctt

SEQ ID NO: 611463 - DNA, 25 bp, Rattus norvegicus
tgaggacctctacagtcgtttctta

SEQ ID NO: 611464 - DNA, 25 bp, Rattus norvegicus
tgaggacctctagagtcgtttctta

SEQ ID NO: 611465 - DNA, 25 bp, Rattus norvegicus
tgaggacctcttataagtccaggta

SEQ ID NO: 611466 - DNA, 25 bp, Rattus norvegicus
tgaggacctcttctggccagtgtga

SEQ ID NO: 611467 - DNA, 25 bp, Rattus norvegicus
tgaggacctcttgtggccagtgtga

SEQ ID NO: 611468 - DNA, 25 bp, Rattus norvegicus
tgaggacctcttttaagtccaggta

SEQ ID NO: 611469 - DNA, 25 bp, Rattus norvegicus
tgaggaccttggatctcccctaggg

SEQ ID NO: 611470 - DNA, 25 bp, Rattus norvegicus
tgaggaccttggttctcccctaggg

SEQ ID NO: 611471 - DNA, 25 bp, Rattus norvegicus
tgaggacctttgaccctggctgtgg

SEQ ID NO: 611472 - DNA, 25 bp, Rattus norvegicus
tgaggacctttgtccctggctgtgg

SEQ ID NO: 611473 - DNA, 25 bp, Rattus norvegicus
tgaggacgacggctttttaatgaac

SEQ ID NO: 611474 - DNA, 25 bp, Rattus norvegicus
tgaggacgacgggtttttaatgaac

SEQ ID NO: 611475 - DNA, 25 bp, Rattus norvegicus
tgaggacgcagcacctctcagggtc

SEQ ID NO: 611476 - DNA, 25 bp, Rattus norvegicus
tgaggacgcagctcctctcagggtc

SEQ ID NO: 611477 - DNA, 25 bp, Rattus norvegicus
tgaggacgccttcaccctggattac

SEQ ID NO: 611478 - DNA, 25 bp, Rattus norvegicus
tgaggacgccttgaccctggattac

SEQ ID NO: 611479 - DNA, 25 bp, Rattus norvegicus
tgaggacggagaattcacgcaaatg

SEQ ID NO: 611480 - DNA, 25 bp, Rattus norvegicus
tgaggacggagatttcacgcaaatg

SEQ ID NO: 611481 - DNA, 25 bp, Rattus norvegicus
tgaggacggatgagctcacaccagc

SEQ ID NO: 611482 - DNA, 25 bp, Rattus norvegicus
tgaggacggatgtgctcacaccagc

SEQ ID NO: 611483 - DNA, 25 bp, Rattus norvegicus
tgaggactaattcgcctttgctttt

SEQ ID NO: 611484 - DNA, 25 bp, Rattus norvegicus
tgaggactaattggcctttgctttt

SEQ ID NO: 611485 - DNA, 25 bp, Rattus norvegicus
tgaggactagttctcttcttttggg

SEQ ID NO: 611486 - DNA, 25 bp, Rattus norvegicus
tgaggactagttgtcttcttttggg

SEQ ID NO: 611487 - DNA, 25 bp, Rattus norvegicus
tgaggactatgaccgtcaccggctg

SEQ ID NO: 611488 - DNA, 25 bp, Rattus norvegicus
tgaggactatgagcgtcaccggctg

SEQ ID NO: 611489 - DNA, 25 bp, Rattus norvegicus
tgaggactattcagctacactggct

SEQ ID NO: 611490 - DNA, 25 bp, Rattus norvegicus
tgaggactattctgctacactggct

SEQ ID NO: 611491 - DNA, 25 bp, Rattus norvegicus
tgaggactatttcgtttccccttct

SEQ ID NO: 611492 - DNA, 25 bp, Rattus norvegicus
tgaggactatttggtttccccttct

SEQ ID NO: 611493 - DNA, 25 bp, Rattus norvegicus
tgaggactcattctctgacttccag

SEQ ID NO: 611494 - DNA, 25 bp, Rattus norvegicus
tgaggactcattgtctgacttccag

SEQ ID NO: 611495 - DNA, 25 bp, Rattus norvegicus
tgaggactccaaccaaaagcccgat

SEQ ID NO: 611496 - DNA, 25 bp, Rattus norvegicus
tgaggactccaagcaaaagcccgat

SEQ ID NO: 611497 - DNA, 25 bp, Rattus norvegicus
tgaggactccttccttacttagctc

SEQ ID NO: 611498 - DNA, 25 bp, Rattus norvegicus
tgaggactccttgcttacttagctc

SEQ ID NO: 611499 - DNA, 25 bp, Rattus norvegicus
tgaggactcgaaagggcacaacccc

SEQ ID NO: 611500 - DNA, 25 bp, Rattus norvegicus
tgaggactcgaatgggcacaacccc

SEQ ID NO: 611501 - DNA, 25 bp, Rattus norvegicus
tgaggactcggtcttgctggcacaa

SEQ ID NO: 611502 - DNA, 25 bp, Rattus norvegicus
tgaggactcggtgttgctggcacaa

SEQ ID NO: 611503 - DNA, 25 bp, Rattus norvegicus
tgaggactcttcaggctccgaattt

SEQ ID NO: 611504 - DNA, 25 bp, Rattus norvegicus
tgaggactcttctggctccgaattt

SEQ ID NO: 611505 - DNA, 25 bp, Rattus norvegicus
tgaggactgatgactctctgcacac

SEQ ID NO: 611506 - DNA, 25 bp, Rattus norvegicus
tgaggactgatgtctctctgcacac

SEQ ID NO: 611507 - DNA, 25 bp, Rattus norvegicus
tgaggactggtaaggctcctccata

SEQ ID NO: 611508 - DNA, 25 bp, Rattus norvegicus
tgaggactggtatggctcctccata

SEQ ID NO: 611509 - DNA, 25 bp, Rattus norvegicus
tgaggactgttcatgagcccgggac

SEQ ID NO: 611510 - DNA, 25 bp, Rattus norvegicus
tgaggactgttcttgagcccgggac

SEQ ID NO: 611511 - DNA, 25 bp, Rattus norvegicus
tgaggacttcccagtagctgatcgg

SEQ ID NO: 611512 - DNA, 25 bp, Rattus norvegicus
tgaggacttccctgtagctgatcgg

SEQ ID NO: 611513 - DNA, 25 bp, Rattus norvegicus
tgaggacttcctcagtgccattcag

SEQ ID NO: 611514 - DNA, 25 bp, Rattus norvegicus
tgaggacttcctgagtgccattcag

SEQ ID NO: 611515 - DNA, 25 bp, Rattus norvegicus
tgaggacttctcaggaggccagcct

SEQ ID NO: 611516 - DNA, 25 bp, Rattus norvegicus
tgaggacttctctggaggccagcct

SEQ ID NO: 611517 - DNA, 25 bp, Rattus norvegicus
tgaggacttgtcactttttgagcat

SEQ ID NO: 611518 - DNA, 25 bp, Rattus norvegicus
tgaggacttgtctctttttgagcat

SEQ ID NO: 611519 - DNA, 25 bp, Rattus norvegicus
tgaggactttcccacagaccgatag

SEQ ID NO: 611520 - DNA, 25 bp, Rattus norvegicus
tgaggactttccgacagaccgatag

SEQ ID NO: 611521 - DNA, 25 bp, Rattus norvegicus
tgaggacttttccaccaattcaacc

SEQ ID NO: 611522 - DNA, 25 bp, Rattus norvegicus
tgaggacttttcgaccaattcaacc

SEQ ID NO: 611523 - DNA, 25 bp, Rattus norvegicus
tgaggagaacatcccagtgccttta

SEQ ID NO: 611524 - DNA, 25 bp, Rattus norvegicus
tgaggagaacatgccagtgccttta

SEQ ID NO: 611525 - DNA, 25 bp, Rattus norvegicus
tgaggagaacgcactctcacttctg

SEQ ID NO: 611526 - DNA, 25 bp, Rattus norvegicus
tgaggagaacgctctctcacttctg

SEQ ID NO: 611527 - DNA, 25 bp, Rattus norvegicus
tgaggagacacaccgttctgtcaat

SEQ ID NO: 611528 - DNA, 25 bp, Rattus norvegicus
tgaggagacacagcgttctgtcaat

SEQ ID NO: 611529 - DNA, 25 bp, Rattus norvegicus
tgaggagaccacaaatcccactgtc

SEQ ID NO: 611530 - DNA, 25 bp, Rattus norvegicus
tgaggagaccactaatcccactgtc

SEQ ID NO: 611531 - DNA, 25 bp, Rattus norvegicus
tgaggagacccgcgcgtcgcacttc

SEQ ID NO: 611532 - DNA, 25 bp, Rattus norvegicus
tgaggagacccgggcgtcgcacttc

SEQ ID NO: 611533 - DNA, 25 bp, Rattus norvegicus
tgaggagacctaagctctacaccgc

SEQ ID NO: 611534 - DNA, 25 bp, Rattus norvegicus
tgaggagacctatgctctacaccgc

SEQ ID NO: 611535 - DNA, 25 bp, Rattus norvegicus
tgaggagacctcaagcacatctcag

SEQ ID NO: 611536 - DNA, 25 bp, Rattus norvegicus
tgaggagacctctagcacatctcag

SEQ ID NO: 611537 - DNA, 25 bp, Rattus norvegicus
tgaggagactccctatgtgcccagg

SEQ ID NO: 611538 - DNA, 25 bp, Rattus norvegicus
tgaggagactccgtatgtgcccagg

SEQ ID NO: 611539 - DNA, 25 bp, Rattus norvegicus
tgaggagactgtactgcatcccacg

SEQ ID NO: 611540 - DNA, 25 bp, Rattus norvegicus
tgaggagactgtactgtcgcaccca

SEQ ID NO: 611541 - DNA, 25 bp, Rattus norvegicus
tgaggagactgttctgcatcccacg

SEQ ID NO: 611542 - DNA, 25 bp, Rattus norvegicus
tgaggagactgttctgtcgcaccca

SEQ ID NO: 611543 - DNA, 25 bp, Rattus norvegicus
tgaggagagaacatgaccattcccc

SEQ ID NO: 611544 - DNA, 25 bp, Rattus norvegicus
tgaggagagaacttgaccattcccc

SEQ ID NO: 611545 - DNA, 25 bp, Rattus norvegicus
tgaggagagatccactcacgcacgg

SEQ ID NO: 611546 - DNA, 25 bp, Rattus norvegicus
tgaggagagatcgactcacgcacgg

SEQ ID NO: 611547 - DNA, 25 bp, Rattus norvegicus
tgaggagagtcccaccacactgctg

SEQ ID NO: 611548 - DNA, 25 bp, Rattus norvegicus
tgaggagagtccgaccacactgctg

SEQ ID NO: 611549 - DNA, 25 bp, Rattus norvegicus
tgaggagatggcaacccttactggg

SEQ ID NO: 611550 - DNA, 25 bp, Rattus norvegicus
tgaggagatggctacccttactggg

SEQ ID NO: 611551 - DNA, 25 bp, Rattus norvegicus
tgaggagattgcctcctcattcacc

SEQ ID NO: 611552 - DNA, 25 bp, Rattus norvegicus
tgaggagattgcgtcctcattcacc

SEQ ID NO: 611553 - DNA, 25 bp, Rattus norvegicus
tgaggagcacccacagctgtcagta

SEQ ID NO: 611554 - DNA, 25 bp, Rattus norvegicus
tgaggagcacccagacagtctctca

SEQ ID NO: 611555 - DNA, 25 bp, Rattus norvegicus
tgaggagcaccctcagctgtcagta

SEQ ID NO: 611556 - DNA, 25 bp, Rattus norvegicus
tgaggagcaccctgacagtctctca

SEQ ID NO: 611557 - DNA, 25 bp, Rattus norvegicus
tgaggagcactgacaccatcactga

SEQ ID NO: 611558 - DNA, 25 bp, Rattus norvegicus
tgaggagcactgtcaccatcactga

SEQ ID NO: 611559 - DNA, 25 bp, Rattus norvegicus
tgaggagcagcaaccttcctggagc

SEQ ID NO: 611560 - DNA, 25 bp, Rattus norvegicus
tgaggagcagcatccttcctggagc

SEQ ID NO: 611561 - DNA, 25 bp, Rattus norvegicus
tgaggagccattcacctttgacatg

SEQ ID NO: 611562 - DNA, 25 bp, Rattus norvegicus
tgaggagccattgacctttgacatg

SEQ ID NO: 611563 - DNA, 25 bp, Rattus norvegicus
tgaggagccttcaactgcagcagag

SEQ ID NO: 611564 - DNA, 25 bp, Rattus norvegicus
tgaggagccttctactgcagcagag

SEQ ID NO: 611565 - DNA, 25 bp, Rattus norvegicus
tgaggagccttgagtgtgttctgtc

SEQ ID NO: 611566 - DNA, 25 bp, Rattus norvegicus
tgaggagccttgtgtgtgttctgtc

SEQ ID NO: 611567 - DNA, 25 bp, Rattus norvegicus
tgaggagcgattctaaatcccaaag

SEQ ID NO: 611568 - DNA, 25 bp, Rattus norvegicus
tgaggagcgattgtaaatcccaaag

SEQ ID NO: 611569 - DNA, 25 bp, Rattus norvegicus
tgaggagcgcgaagactttgatctt

SEQ ID NO: 611570 - DNA, 25 bp, Rattus norvegicus
tgaggagcgcgatgactttgatctt

SEQ ID NO: 611571 - DNA, 25 bp, Rattus norvegicus
tgaggagcggtccttccacagcagc

SEQ ID NO: 611572 - DNA, 25 bp, Rattus norvegicus
tgaggagcggtcgttccacagcagc

SEQ ID NO: 611573 - DNA, 25 bp, Rattus norvegicus
tgaggagctcatcgcctgtgaccaa

SEQ ID NO: 611574 - DNA, 25 bp, Rattus norvegicus
tgaggagctcatggcctgtgaccaa

SEQ ID NO: 611575 - DNA, 25 bp, Rattus norvegicus
tgaggagctgccctctgaaagctac

SEQ ID NO: 611576 - DNA, 25 bp, Rattus norvegicus
tgaggagctgccgtctgaaagctac

SEQ ID NO: 611577 - DNA, 25 bp, Rattus norvegicus
tgaggagctgctccatttcaggcac

SEQ ID NO: 611578 - DNA, 25 bp, Rattus norvegicus
tgaggagctgctgcatttcaggcac

SEQ ID NO: 611579 - DNA, 25 bp, Rattus norvegicus
tgaggagctggccaagtgacctttc

SEQ ID NO: 611580 - DNA, 25 bp, Rattus norvegicus
tgaggagctggcgaagtgacctttc

SEQ ID NO: 611581 - DNA, 25 bp, Rattus norvegicus
tgaggaggacagctatcttgcccac

SEQ ID NO: 611582 - DNA, 25 bp, Rattus norvegicus
tgaggaggacaggtatcttgcccac

SEQ ID NO: 611583 - DNA, 25 bp, Rattus norvegicus
tgaggaggaggcagccatccacgca

SEQ ID NO: 611584 - DNA, 25 bp, Rattus norvegicus
tgaggaggaggctgccatccacgca

SEQ ID NO: 611585 - DNA, 25 bp, Rattus norvegicus
tgaggaggccaccaagttcctgacc

SEQ ID NO: 611586 - DNA, 25 bp, Rattus norvegicus
tgaggaggccacgaagttcctgacc

SEQ ID NO: 611587 - DNA, 25 bp, Rattus norvegicus
tgaggaggctaacgctcattagctg

SEQ ID NO: 611588 - DNA, 25 bp, Rattus norvegicus
tgaggaggctaaggctcattagctg

SEQ ID NO: 611589 - DNA, 25 bp, Rattus norvegicus
tgaggaggtgcacccagcccactgt

SEQ ID NO: 611590 - DNA, 25 bp, Rattus norvegicus
tgaggaggtgcagccagcccactgt

SEQ ID NO: 611591 - DNA, 25 bp, Rattus norvegicus
tgaggagtacaaagaagcccgcata

SEQ ID NO: 611592 - DNA, 25 bp, Rattus norvegicus
tgaggagtacaatgaagcccgcata

SEQ ID NO: 611593 - DNA, 25 bp, Rattus norvegicus
tgaggagtagcgagaccctccctga

SEQ ID NO: 611594 - DNA, 25 bp, Rattus norvegicus
tgaggagtagcgtgaccctccctga

SEQ ID NO: 611595 - DNA, 25 bp, Rattus norvegicus
tgaggagtatcaccatcaccactgt

SEQ ID NO: 611596 - DNA, 25 bp, Rattus norvegicus
tgaggagtatcagcatcaccactgt

SEQ ID NO: 611597 - DNA, 25 bp, Rattus norvegicus
tgaggagtcccacccgcaggcccct

SEQ ID NO: 611598 - DNA, 25 bp, Rattus norvegicus
tgaggagtcccagccgcaggcccct

SEQ ID NO: 611599 - DNA, 25 bp, Rattus norvegicus
tgaggagtccctacatggctcaggc

SEQ ID NO: 611600 - DNA, 25 bp, Rattus norvegicus
tgaggagtcccttcatggctcaggc

SEQ ID NO: 611601 - DNA, 25 bp, Rattus norvegicus
tgaggagtctcgcagaggcggagga

SEQ ID NO: 611602 - DNA, 25 bp, Rattus norvegicus
tgaggagtctcggagaggcggagga

SEQ ID NO: 611603 - DNA, 25 bp, Rattus norvegicus
tgaggagtgaggacgtcccctttaa

SEQ ID NO: 611604 - DNA, 25 bp, Rattus norvegicus
tgaggagtgaggtcgtcccctttaa

SEQ ID NO: 611605 - DNA, 25 bp, Rattus norvegicus
tgaggagtgcccagactattctttt

SEQ ID NO: 611606 - DNA, 25 bp, Rattus norvegicus
tgaggagtgccctgactattctttt

SEQ ID NO: 611607 - DNA, 25 bp, Rattus norvegicus
tgaggagtgctcaaggccccacaat

SEQ ID NO: 611608 - DNA, 25 bp, Rattus norvegicus
tgaggagtgctctaggccccacaat

SEQ ID NO: 611609 - DNA, 25 bp, Rattus norvegicus
tgaggagtgtgaccccaacaaggac

SEQ ID NO: 611610 - DNA, 25 bp, Rattus norvegicus
tgaggagtgtgagcccaacaaggac

SEQ ID NO: 611611 - DNA, 25 bp, Rattus norvegicus
tgaggagttaggctcccggctccca

SEQ ID NO: 611612 - DNA, 25 bp, Rattus norvegicus
tgaggagttagggtcccggctccca

SEQ ID NO: 611613 - DNA, 25 bp, Rattus norvegicus
tgaggagttattcccagggaacctt

SEQ ID NO: 611614 - DNA, 25 bp, Rattus norvegicus
tgaggagttattgccagggaacctt

SEQ ID NO: 611615 - DNA, 25 bp, Rattus norvegicus
tgaggagttcttaccttgcctggca

SEQ ID NO: 611616 - DNA, 25 bp, Rattus norvegicus
tgaggagttctttccttgcctggca

SEQ ID NO: 611617 - DNA, 25 bp, Rattus norvegicus
tgaggagttgcccactgacagctga

SEQ ID NO: 611618 - DNA, 25 bp, Rattus norvegicus
tgaggagttgccgactgacagctga

SEQ ID NO: 611619 - DNA, 25 bp, Rattus norvegicus
tgaggagttggaccctcccacggac

SEQ ID NO: 611620 - DNA, 25 bp, Rattus norvegicus
tgaggagttggagcctcccacggac

SEQ ID NO: 611621 - DNA, 25 bp, Rattus norvegicus
tgaggagtttctcagctctccctta

SEQ ID NO: 611622 - DNA, 25 bp, Rattus norvegicus
tgaggagtttctgagctctccctta

SEQ ID NO: 611623 - DNA, 25 bp, Rattus norvegicus
tgaggagtttttcttgttgccctgt

SEQ ID NO: 611624 - DNA, 25 bp, Rattus norvegicus
tgaggagtttttgttgttgccctgt

SEQ ID NO: 611625 - DNA, 25 bp, Rattus norvegicus
tgaggataacaaccacgtgctcctt

SEQ ID NO: 611626 - DNA, 25 bp, Rattus norvegicus
tgaggataacaagcacgtgctcctt

SEQ ID NO: 611627 - DNA, 25 bp, Rattus norvegicus
tgaggataatccacgggtctggcta

SEQ ID NO: 611628 - DNA, 25 bp, Rattus norvegicus
tgaggataatcctcgggtctggcta

SEQ ID NO: 611629 - DNA, 25 bp, Rattus norvegicus
tgaggataccccaaatagacagtac

SEQ ID NO: 611630 - DNA, 25 bp, Rattus norvegicus
tgaggatacccctaatagacagtac

SEQ ID NO: 611631 - DNA, 25 bp, Rattus norvegicus
tgaggatatttcaaggaaggtctta

SEQ ID NO: 611632 - DNA, 25 bp, Rattus norvegicus
tgaggatatttctaggaaggtctta

SEQ ID NO: 611633 - DNA, 25 bp, Rattus norvegicus
tgaggatcacgcattgcccaatact

SEQ ID NO: 611634 - DNA, 25 bp, Rattus norvegicus
tgaggatcacgctttgcccaatact

SEQ ID NO: 611635 - DNA, 25 bp, Rattus norvegicus
tgaggatccactattctccagaagt

SEQ ID NO: 611636 - DNA, 25 bp, Rattus norvegicus
tgaggatccacttttctccagaagt

SEQ ID NO: 611637 - DNA, 25 bp, Rattus norvegicus
tgaggatccatcagggccaggcatc

SEQ ID NO: 611638 - DNA, 25 bp, Rattus norvegicus
tgaggatccatctgggccaggcatc

SEQ ID NO: 611639 - DNA, 25 bp, Rattus norvegicus
tgaggatccggaagacgcagcattc

SEQ ID NO: 611640 - DNA, 25 bp, Rattus norvegicus
tgaggatccggatgacgcagcattc

SEQ ID NO: 611641 - DNA, 25 bp, Rattus norvegicus
tgaggatcctgcacagagagcttgg

SEQ ID NO: 611642 - DNA, 25 bp, Rattus norvegicus
tgaggatcctgctcagagagcttgg

SEQ ID NO: 611643 - DNA, 25 bp, Rattus norvegicus
tgaggatctcctcatacttcttcac

SEQ ID NO: 611644 - DNA, 25 bp, Rattus norvegicus
tgaggatctcctgatacttcttcac

SEQ ID NO: 611645 - DNA, 25 bp, Rattus norvegicus
tgaggatctgaacgccaagcttcct

SEQ ID NO: 611646 - DNA, 25 bp, Rattus norvegicus
tgaggatctgaaggccaagcttcct

SEQ ID NO: 611647 - DNA, 25 bp, Rattus norvegicus
tgaggatctttcaagaccaccagtt

SEQ ID NO: 611648 - DNA, 25 bp, Rattus norvegicus
tgaggatctttctagaccaccagtt

SEQ ID NO: 611649 - DNA, 25 bp, Rattus norvegicus
tgaggatgcaagagtccccttgggc

SEQ ID NO: 611650 - DNA, 25 bp, Rattus norvegicus
tgaggatgcaagtgtccccttgggc

SEQ ID NO: 611651 - DNA, 25 bp, Rattus norvegicus
tgaggatgcttcacatggacacaaa

SEQ ID NO: 611652 - DNA, 25 bp, Rattus norvegicus
tgaggatgcttctcatggacacaaa

SEQ ID NO: 611653 - DNA, 25 bp, Rattus norvegicus
tgaggatggctcagcttccaccgag

SEQ ID NO: 611654 - DNA, 25 bp, Rattus norvegicus
tgaggatggctctgcttccaccgag

SEQ ID NO: 611655 - DNA, 25 bp, Rattus norvegicus
tgaggatggcttcactgcactgcac

SEQ ID NO: 611656 - DNA, 25 bp, Rattus norvegicus
tgaggatggcttgactgcactgcac

SEQ ID NO: 611657 - DNA, 25 bp, Rattus norvegicus
tgaggatgggccatgcacactccct

SEQ ID NO: 611658 - DNA, 25 bp, Rattus norvegicus
tgaggatgggccttgcacactccct

SEQ ID NO: 611659 - DNA, 25 bp, Rattus norvegicus
tgaggatgggctcccctccttgtcg

SEQ ID NO: 611660 - DNA, 25 bp, Rattus norvegicus
tgaggatgggctgccctccttgtcg

SEQ ID NO: 611661 - DNA, 25 bp, Rattus norvegicus
tgaggatgtacccaccagctttcag

SEQ ID NO: 611662 - DNA, 25 bp, Rattus norvegicus
tgaggatgtaccgaccagctttcag

SEQ ID NO: 611663 - DNA, 25 bp, Rattus norvegicus
tgaggatgtgtcactggtgtcaaca

SEQ ID NO: 611664 - DNA, 25 bp, Rattus norvegicus
tgaggatgtgtctctggtgtcaaca

SEQ ID NO: 611665 - DNA, 25 bp, Rattus norvegicus
tgaggattacctacctccgggttag

SEQ ID NO: 611666 - DNA, 25 bp, Rattus norvegicus
tgaggattaccttcctccgggttag

SEQ ID NO: 611667 - DNA, 25 bp, Rattus norvegicus
tgaggattccagactcaccaaggcc

SEQ ID NO: 611668 - DNA, 25 bp, Rattus norvegicus
tgaggattccagtctcaccaaggcc

SEQ ID NO: 611669 - DNA, 25 bp, Rattus norvegicus
tgaggattctgaccattcctgtgtc

SEQ ID NO: 611670 - DNA, 25 bp, Rattus norvegicus
tgaggattctgagcattcctgtgtc

SEQ ID NO: 611671 - DNA, 25 bp, Rattus norvegicus
tgaggattctggctgctgcagctct

SEQ ID NO: 611672 - DNA, 25 bp, Rattus norvegicus
tgaggattctgggtgctgcagctct

SEQ ID NO: 611673 - DNA, 25 bp, Rattus norvegicus
tgaggatttgatcccaaggccttgt

SEQ ID NO: 611674 - DNA, 25 bp, Rattus norvegicus
tgaggatttgatgccaaggccttgt

SEQ ID NO: 611675 - DNA, 25 bp, Rattus norvegicus
tgaggcaaagtcaagctcgtctgct

SEQ ID NO: 611676 - DNA, 25 bp, Rattus norvegicus
tgaggcaaagtctagctcgtctgct

SEQ ID NO: 611677 - DNA, 25 bp, Rattus norvegicus
tgaggcaaatcacctgtctttgaaa

SEQ ID NO: 611678 - DNA, 25 bp, Rattus norvegicus
tgaggcaaatcagctgtctttgaaa

SEQ ID NO: 611679 - DNA, 25 bp, Rattus norvegicus
tgaggcaaccttcagtcttcagagc

SEQ ID NO: 611680 - DNA, 25 bp, Rattus norvegicus
tgaggcaaccttgagtcttcagagc

SEQ ID NO: 611681 - DNA, 25 bp, Rattus norvegicus
tgaggcaactgtcgcagggaaaaaa

SEQ ID NO: 611682 - DNA, 25 bp, Rattus norvegicus
tgaggcaactgtggcagggaaaaaa

SEQ ID NO: 611683 - DNA, 25 bp, Rattus norvegicus
tgaggcaagatcagggactccgtat

SEQ ID NO: 611684 - DNA, 25 bp, Rattus norvegicus
tgaggcaagatctgggactccgtat

SEQ ID NO: 611685 - DNA, 25 bp, Rattus norvegicus
tgaggcaagctcagcagccggactt

SEQ ID NO: 611686 - DNA, 25 bp, Rattus norvegicus
tgaggcaagctctgcagccggactt

SEQ ID NO: 611687 - DNA, 25 bp, Rattus norvegicus
tgaggcaaggtcacctgttcctgga

SEQ ID NO: 611688 - DNA, 25 bp, Rattus norvegicus
tgaggcaaggtctcctgttcctgga

SEQ ID NO: 611689 - DNA, 25 bp, Rattus norvegicus
tgaggcaagttccaggtttagtacc

SEQ ID NO: 611690 - DNA, 25 bp, Rattus norvegicus
tgaggcaagttcgaggtttagtacc

SEQ ID NO: 611691 - DNA, 25 bp, Rattus norvegicus
tgaggcaatgccatccttcgggaaa

SEQ ID NO: 611692 - DNA, 25 bp, Rattus norvegicus
tgaggcaatgccttccttcgggaaa

SEQ ID NO: 611693 - DNA, 25 bp, Rattus norvegicus
tgaggcacagagattcaggttgaat

SEQ ID NO: 611694 - DNA, 25 bp, Rattus norvegicus
tgaggcacagagtttcaggttgaat

SEQ ID NO: 611695 - DNA, 25 bp, Rattus norvegicus
tgaggcaccactccgggtacactag

SEQ ID NO: 611696 - DNA, 25 bp, Rattus norvegicus
tgaggcaccactgcgggtacactag

SEQ ID NO: 611697 - DNA, 25 bp, Rattus norvegicus
tgaggcaccattatgtcgattctat

SEQ ID NO: 611698 - DNA, 25 bp, Rattus norvegicus
tgaggcaccattttgtcgattctat

SEQ ID NO: 611699 - DNA, 25 bp, Rattus norvegicus
tgaggcacctggacctagacagaat

SEQ ID NO: 611700 - DNA, 25 bp, Rattus norvegicus
tgaggcacctggtcctagacagaat

SEQ ID NO: 611701 - DNA, 25 bp, Rattus norvegicus
tgaggcacgaccatcactgtttctt

SEQ ID NO: 611702 - DNA, 25 bp, Rattus norvegicus
tgaggcacgaccttcactgtttctt

SEQ ID NO: 611703 - DNA, 25 bp, Rattus norvegicus
tgaggcacgagtcctccctgttcgt

SEQ ID NO: 611704 - DNA, 25 bp, Rattus norvegicus
tgaggcacgagtgctccctgttcgt

SEQ ID NO: 611705 - DNA, 25 bp, Rattus norvegicus
tgaggcacgcttacacgacctgtag

SEQ ID NO: 611706 - DNA, 25 bp, Rattus norvegicus
tgaggcacgctttcacgacctgtag

SEQ ID NO: 611707 - DNA, 25 bp, Rattus norvegicus
tgaggcacttcacagactcgtcact

SEQ ID NO: 611708 - DNA, 25 bp, Rattus norvegicus
tgaggcacttcagagactcgtcact

SEQ ID NO: 611709 - DNA, 25 bp, Rattus norvegicus
tgaggcagactgcaccagctgatac

SEQ ID NO: 611710 - DNA, 25 bp, Rattus norvegicus
tgaggcagactggaccagctgatac

SEQ ID NO: 611711 - DNA, 25 bp, Rattus norvegicus
tgaggcagagtcacatgctgttctg

SEQ ID NO: 611712 - DNA, 25 bp, Rattus norvegicus
tgaggcagagtctcatgctgttctg

SEQ ID NO: 611713 - DNA, 25 bp, Rattus norvegicus
tgaggcagatgactcccctgagaag

SEQ ID NO: 611714 - DNA, 25 bp, Rattus norvegicus
tgaggcagatgagtcccctgagaag

SEQ ID NO: 611715 - DNA, 25 bp, Rattus norvegicus
tgaggcagcaagagaagctcaccaa

SEQ ID NO: 611716 - DNA, 25 bp, Rattus norvegicus
tgaggcagcaagtgaagctcaccaa

SEQ ID NO: 611717 - DNA, 25 bp, Rattus norvegicus
tgaggcagcaccaggatggtgtcct

SEQ ID NO: 611718 - DNA, 25 bp, Rattus norvegicus
tgaggcagcacctggatggtgtcct

SEQ ID NO: 611719 - DNA, 25 bp, Rattus norvegicus
tgaggcagccacagtgtcaaagcaa

SEQ ID NO: 611720 - DNA, 25 bp, Rattus norvegicus
tgaggcagccactgtgtcaaagcaa

SEQ ID NO: 611721 - DNA, 25 bp, Rattus norvegicus
tgaggcagccccaacaccgacagga

SEQ ID NO: 611722 - DNA, 25 bp, Rattus norvegicus
tgaggcagcccctacaccgacagga

SEQ ID NO: 611723 - DNA, 25 bp, Rattus norvegicus
tgaggcagcctcattgagctaggat

SEQ ID NO: 611724 - DNA, 25 bp, Rattus norvegicus
tgaggcagcctctttgagctaggat

SEQ ID NO: 611725 - DNA, 25 bp, Rattus norvegicus
tgaggcagcttcatggtccacgggt

SEQ ID NO: 611726 - DNA, 25 bp, Rattus norvegicus
tgaggcagcttcttggtccacgggt

SEQ ID NO: 611727 - DNA, 25 bp, Rattus norvegicus
tgaggcaggcacaccccaaggagaa

SEQ ID NO: 611728 - DNA, 25 bp, Rattus norvegicus
tgaggcaggcactccccaaggagaa

SEQ ID NO: 611729 - DNA, 25 bp, Rattus norvegicus
tgaggcaggcagacattcgctatgt

SEQ ID NO: 611730 - DNA, 25 bp, Rattus norvegicus
tgaggcaggcagtcattcgctatgt

SEQ ID NO: 611731 - DNA, 25 bp, Rattus norvegicus
tgaggcaggcccacattcaccgcag

SEQ ID NO: 611732 - DNA, 25 bp, Rattus norvegicus
tgaggcaggccctcattcaccgcag

SEQ ID NO: 611733 - DNA, 25 bp, Rattus norvegicus
tgaggcaggctgactcacagcgctt

SEQ ID NO: 611734 - DNA, 25 bp, Rattus norvegicus
tgaggcaggctgtctcacagcgctt

SEQ ID NO: 611735 - DNA, 25 bp, Rattus norvegicus
tgaggcagtaggcacctctctgctc

SEQ ID NO: 611736 - DNA, 25 bp, Rattus norvegicus
tgaggcagtagggacctctctgctc

SEQ ID NO: 611737 - DNA, 25 bp, Rattus norvegicus
tgaggcagtgccatatgcaggtctt

SEQ ID NO: 611738 - DNA, 25 bp, Rattus norvegicus
tgaggcagtgccttatgcaggtctt

SEQ ID NO: 611739 - DNA, 25 bp, Rattus norvegicus
tgaggcatacacaccccttgatctt

SEQ ID NO: 611740 - DNA, 25 bp, Rattus norvegicus
tgaggcatacactccccttgatctt

SEQ ID NO: 611741 - DNA, 25 bp, Rattus norvegicus
tgaggcatcctcctctatgacatcc

SEQ ID NO: 611742 - DNA, 25 bp, Rattus norvegicus
tgaggcatcctcgtctatgacatcc

SEQ ID NO: 611743 - DNA, 25 bp, Rattus norvegicus
tgaggcatcctgcacggaggtccac

SEQ ID NO: 611744 - DNA, 25 bp, Rattus norvegicus
tgaggcatcctggacggaggtccac

SEQ ID NO: 611745 - DNA, 25 bp, Rattus norvegicus
tgaggcatcttcatagcccatgaat

SEQ ID NO: 611746 - DNA, 25 bp, Rattus norvegicus
tgaggcatcttcttagcccatgaat

SEQ ID NO: 611747 - DNA, 25 bp, Rattus norvegicus
tgaggcatgtccctaacagctcctg

SEQ ID NO: 611748 - DNA, 25 bp, Rattus norvegicus
tgaggcatgtccgtaacagctcctg

SEQ ID NO: 611749 - DNA, 25 bp, Rattus norvegicus
tgaggcattccgagtctttgacaag

SEQ ID NO: 611750 - DNA, 25 bp, Rattus norvegicus
tgaggcattccgtgtctttgacaag

SEQ ID NO: 611751 - DNA, 25 bp, Rattus norvegicus
tgaggcattgttagaccggatctac

SEQ ID NO: 611752 - DNA, 25 bp, Rattus norvegicus
tgaggcattgtttgaccggatctac

SEQ ID NO: 611753 - DNA, 25 bp, Rattus norvegicus
tgaggcatttctccaagtctctctt

SEQ ID NO: 611754 - DNA, 25 bp, Rattus norvegicus
tgaggcatttctgcaagtctctctt

SEQ ID NO: 611755 - DNA, 25 bp, Rattus norvegicus
tgaggccaacagctgcctggcaaat

SEQ ID NO: 611756 - DNA, 25 bp, Rattus norvegicus
tgaggccaacaggtgcctggcaaat

SEQ ID NO: 611757 - DNA, 25 bp, Rattus norvegicus
tgaggccaacctatattacaaaatt

SEQ ID NO: 611758 - DNA, 25 bp, Rattus norvegicus
tgaggccaacctttattacaaaatt

SEQ ID NO: 611759 - DNA, 25 bp, Rattus norvegicus
tgaggccaagaaacccatgttgttt

SEQ ID NO: 611760 - DNA, 25 bp, Rattus norvegicus
tgaggccaagaatcccatgttgttt

SEQ ID NO: 611761 - DNA, 25 bp, Rattus norvegicus
tgaggccaagctcccgatgttgctc

SEQ ID NO: 611762 - DNA, 25 bp, Rattus norvegicus
tgaggccaagctgccgatgttgctc

SEQ ID NO: 611763 - DNA, 25 bp, Rattus norvegicus
tgaggccaaggcagcagaagccgct

SEQ ID NO: 611764 - DNA, 25 bp, Rattus norvegicus
tgaggccaaggctgcagaagccgct

SEQ ID NO: 611765 - DNA, 25 bp, Rattus norvegicus
tgaggccacacaatcaaacgctgag

SEQ ID NO: 611766 - DNA, 25 bp, Rattus norvegicus
tgaggccacacattcaaacgctgag

SEQ ID NO: 611767 - DNA, 25 bp, Rattus norvegicus
tgaggccacaggagcccgagtcaag

SEQ ID NO: 611768 - DNA, 25 bp, Rattus norvegicus
tgaggccacaggtgcccgagtcaag

SEQ ID NO: 611769 - DNA, 25 bp, Rattus norvegicus
tgaggccaccatatccctgaggctg

SEQ ID NO: 611770 - DNA, 25 bp, Rattus norvegicus
tgaggccaccatttccctgaggctg

SEQ ID NO: 611771 - DNA, 25 bp, Rattus norvegicus
tgaggccagaagctctgtctttctc

SEQ ID NO: 611772 - DNA, 25 bp, Rattus norvegicus
tgaggccagaaggtctgtctttctc

SEQ ID NO: 611773 - DNA, 25 bp, Rattus norvegicus
tgaggccagagcacccaccaagcat

SEQ ID NO: 611774 - DNA, 25 bp, Rattus norvegicus
tgaggccagagcaccttccttatca

SEQ ID NO: 611775 - DNA, 25 bp, Rattus norvegicus
tgaggccagagcagtcgggttcacc

SEQ ID NO: 611776 - DNA, 25 bp, Rattus norvegicus
tgaggccagagctcccaccaagcat

SEQ ID NO: 611777 - DNA, 25 bp, Rattus norvegicus
tgaggccagagctccttccttatca

SEQ ID NO: 611778 - DNA, 25 bp, Rattus norvegicus
tgaggccagagctgtcgggttcacc

SEQ ID NO: 611779 - DNA, 25 bp, Rattus norvegicus
tgaggccagcaaccagcaaggtctg

SEQ ID NO: 611780 - DNA, 25 bp, Rattus norvegicus
tgaggccagcaagcagcaaggtctg

SEQ ID NO: 611781 - DNA, 25 bp, Rattus norvegicus
tgaggccagcagcacgtgtacttta

SEQ ID NO: 611782 - DNA, 25 bp, Rattus norvegicus
tgaggccagcaggacgtgtacttta

SEQ ID NO: 611783 - DNA, 25 bp, Rattus norvegicus
tgaggccaggaaccatcctctgggc

SEQ ID NO: 611784 - DNA, 25 bp, Rattus norvegicus
tgaggccaggaagcatcctctgggc

SEQ ID NO: 611785 - DNA, 25 bp, Rattus norvegicus
tgaggccagtacatacaccacggtg

SEQ ID NO: 611786 - DNA, 25 bp, Rattus norvegicus
tgaggccagtacttacaccacggtg

SEQ ID NO: 611787 - DNA, 25 bp, Rattus norvegicus
tgaggccatggcagagaagttcctg

SEQ ID NO: 611788 - DNA, 25 bp, Rattus norvegicus
tgaggccatggctgagaagttcctg

SEQ ID NO: 611789 - DNA, 25 bp, Rattus norvegicus
tgaggccattctagatttcaggaat

SEQ ID NO: 611790 - DNA, 25 bp, Rattus norvegicus
tgaggccattcttgatttcaggaat

SEQ ID NO: 611791 - DNA, 25 bp, Rattus norvegicus
tgaggcccactcaaaacacctaaag

SEQ ID NO: 611792 - DNA, 25 bp, Rattus norvegicus
tgaggcccactctaaacacctaaag

SEQ ID NO: 611793 - DNA, 25 bp, Rattus norvegicus
tgaggcccacttctacaaaatccaa

SEQ ID NO: 611794 - DNA, 25 bp, Rattus norvegicus
tgaggcccacttgtacaaaatccaa

SEQ ID NO: 611795 - DNA, 25 bp, Rattus norvegicus
tgaggcccagaaccacgcacttaat

SEQ ID NO: 611796 - DNA, 25 bp, Rattus norvegicus
tgaggcccagaagcacgcacttaat

SEQ ID NO: 611797 - DNA, 25 bp, Rattus norvegicus
tgaggcccagctattaccatcataa

SEQ ID NO: 611798 - DNA, 25 bp, Rattus norvegicus
tgaggcccagcttttaccatcataa

SEQ ID NO: 611799 - DNA, 25 bp, Rattus norvegicus
tgaggcccctccatggaaagcctgt

SEQ ID NO: 611800 - DNA, 25 bp, Rattus norvegicus
tgaggcccctccttggaaagcctgt

SEQ ID NO: 611801 - DNA, 25 bp, Rattus norvegicus
tgaggcccctctactggacggtgat

SEQ ID NO: 611802 - DNA, 25 bp, Rattus norvegicus
tgaggcccctcttctggacggtgat

SEQ ID NO: 611803 - DNA, 25 bp, Rattus norvegicus
tgaggcccgagtacaggtttggttt

SEQ ID NO: 611804 - DNA, 25 bp, Rattus norvegicus
tgaggcccgagttcaggtttggttt

SEQ ID NO: 611805 - DNA, 25 bp, Rattus norvegicus
tgaggcccggtcaaagaagcctgct

SEQ ID NO: 611806 - DNA, 25 bp, Rattus norvegicus
tgaggcccggtctaagaagcctgct

SEQ ID NO: 611807 - DNA, 25 bp, Rattus norvegicus
tgaggccctaccagaacacagagac

SEQ ID NO: 611808 - DNA, 25 bp, Rattus norvegicus
tgaggccctacctgaacacagagac

SEQ ID NO: 611809 - DNA, 25 bp, Rattus norvegicus
tgaggccctgctccagaaataaatg

SEQ ID NO: 611810 - DNA, 25 bp, Rattus norvegicus
tgaggccctgctgcagaaataaatg

SEQ ID NO: 611811 - DNA, 25 bp, Rattus norvegicus
tgaggcccttagcaagaccccagac

SEQ ID NO: 611812 - DNA, 25 bp, Rattus norvegicus
tgaggcccttaggaagaccccagac

SEQ ID NO: 611813 - DNA, 25 bp, Rattus norvegicus
tgaggccctttccatgtctcaggaa

SEQ ID NO: 611814 - DNA, 25 bp, Rattus norvegicus
tgaggccctttcgatgtctcaggaa

SEQ ID NO: 611815 - DNA, 25 bp, Rattus norvegicus
tgaggccgaacccaagatttgctct

SEQ ID NO: 611816 - DNA, 25 bp, Rattus norvegicus
tgaggccgaaccgaagatttgctct

SEQ ID NO: 611817 - DNA, 25 bp, Rattus norvegicus
tgaggccgagctccttcctacgtaa

SEQ ID NO: 611818 - DNA, 25 bp, Rattus norvegicus
tgaggccgagctgcttcctacgtaa

SEQ ID NO: 611819 - DNA, 25 bp, Rattus norvegicus
tgaggccgatcccatcaagcgcatc

SEQ ID NO: 611820 - DNA, 25 bp, Rattus norvegicus
tgaggccgatccgatcaagcgcatc

SEQ ID NO: 611821 - DNA, 25 bp, Rattus norvegicus
tgaggccgcgggacacaacatttga

SEQ ID NO: 611822 - DNA, 25 bp, Rattus norvegicus
tgaggccgcgggtcacaacatttga

SEQ ID NO: 611823 - DNA, 25 bp, Rattus norvegicus
tgaggccgctcaagccatgttagac

SEQ ID NO: 611824 - DNA, 25 bp, Rattus norvegicus
tgaggccgctcatgccatgttagac

SEQ ID NO: 611825 - DNA, 25 bp, Rattus norvegicus
tgaggccgtaacacagtggtccaga

SEQ ID NO: 611826 - DNA, 25 bp, Rattus norvegicus
tgaggccgtaactcagtggtccaga

SEQ ID NO: 611827 - DNA, 25 bp, Rattus norvegicus
tgaggcctacagacaggctcttgtc

SEQ ID NO: 611828 - DNA, 25 bp, Rattus norvegicus
tgaggcctacagctgagactcctgg

SEQ ID NO: 611829 - DNA, 25 bp, Rattus norvegicus
tgaggcctacaggtgagactcctgg

SEQ ID NO: 611830 - DNA, 25 bp, Rattus norvegicus
tgaggcctacagtcaggctcttgtc

SEQ ID NO: 611831 - DNA, 25 bp, Rattus norvegicus
tgaggcctatccaaacccgggaaat

SEQ ID NO: 611832 - DNA, 25 bp, Rattus norvegicus
tgaggcctatcctaacccgggaaat

SEQ ID NO: 611833 - DNA, 25 bp, Rattus norvegicus
tgaggcctcaacaaaggacccttct

SEQ ID NO: 611834 - DNA, 25 bp, Rattus norvegicus
tgaggcctcaactaaggacccttct

SEQ ID NO: 611835 - DNA, 25 bp, Rattus norvegicus
tgaggcctcaagagtaccggcgcta

SEQ ID NO: 611836 - DNA, 25 bp, Rattus norvegicus
tgaggcctcaagtgtaccggcgcta

SEQ ID NO: 611837 - DNA, 25 bp, Rattus norvegicus
tgaggcctcactacaagactgtttg

SEQ ID NO: 611838 - DNA, 25 bp, Rattus norvegicus
tgaggcctcacttcaagactgtttg

SEQ ID NO: 611839 - DNA, 25 bp, Rattus norvegicus
tgaggcctcagtcgagctagcccat

SEQ ID NO: 611840 - DNA, 25 bp, Rattus norvegicus
tgaggcctcagtggagctagcccat

SEQ ID NO: 611841 - DNA, 25 bp, Rattus norvegicus
tgaggcctcctacttgggcttgtaa

SEQ ID NO: 611842 - DNA, 25 bp, Rattus norvegicus
tgaggcctcctagttgggcttgtaa

SEQ ID NO: 611843 - DNA, 25 bp, Rattus norvegicus
tgaggcctctcactttccacaatgt

SEQ ID NO: 611844 - DNA, 25 bp, Rattus norvegicus
tgaggcctctcagtttccacaatgt

SEQ ID NO: 611845 - DNA, 25 bp, Rattus norvegicus
tgaggcctctgcaggatgtctacta

SEQ ID NO: 611846 - DNA, 25 bp, Rattus norvegicus
tgaggcctctgctggatgtctacta

SEQ ID NO: 611847 - DNA, 25 bp, Rattus norvegicus
tgaggcctctttccaagacttgtct

SEQ ID NO: 611848 - DNA, 25 bp, Rattus norvegicus
tgaggcctctttcccaagtggtctg

SEQ ID NO: 611849 - DNA, 25 bp, Rattus norvegicus
tgaggcctctttgcaagacttgtct

SEQ ID NO: 611850 - DNA, 25 bp, Rattus norvegicus
tgaggcctctttgccaagtggtctg

SEQ ID NO: 611851 - DNA, 25 bp, Rattus norvegicus
tgaggcctgactacacggcgcagaa

SEQ ID NO: 611852 - DNA, 25 bp, Rattus norvegicus
tgaggcctgacttcacggcgcagaa

SEQ ID NO: 611853 - DNA, 25 bp, Rattus norvegicus
tgaggcctggtcacaaaaacaagcc

SEQ ID NO: 611854 - DNA, 25 bp, Rattus norvegicus
tgaggcctggtctcaaaaacaagcc

SEQ ID NO: 611855 - DNA, 25 bp, Rattus norvegicus
tgaggcctgtttcagtccagagagt

SEQ ID NO: 611856 - DNA, 25 bp, Rattus norvegicus
tgaggcctgtttgagtccagagagt

SEQ ID NO: 611857 - DNA, 25 bp, Rattus norvegicus
tgaggccttagcattcatccttagc

SEQ ID NO: 611858 - DNA, 25 bp, Rattus norvegicus
tgaggccttagctttcatccttagc

SEQ ID NO: 611859 - DNA, 25 bp, Rattus norvegicus
tgaggccttatgatggacgcatcca

SEQ ID NO: 611860 - DNA, 25 bp, Rattus norvegicus
tgaggccttatgttggacgcatcca

SEQ ID NO: 611861 - DNA, 25 bp, Rattus norvegicus
tgaggccttcctaaagtactttgaa

SEQ ID NO: 611862 - DNA, 25 bp, Rattus norvegicus
tgaggccttccttaagtactttgaa

SEQ ID NO: 611863 - DNA, 25 bp, Rattus norvegicus
tgaggccttctaaagacagcccctg

SEQ ID NO: 611864 - DNA, 25 bp, Rattus norvegicus
tgaggccttctatagacagcccctg

SEQ ID NO: 611865 - DNA, 25 bp, Rattus norvegicus
tgaggccttggacggacacaccaca

SEQ ID NO: 611866 - DNA, 25 bp, Rattus norvegicus
tgaggccttggagggacacaccaca

SEQ ID NO: 611867 - DNA, 25 bp, Rattus norvegicus
tgaggcctttcactctgctttaaga

SEQ ID NO: 611868 - DNA, 25 bp, Rattus norvegicus
tgaggcctttcagtctgctttaaga

SEQ ID NO: 611869 - DNA, 25 bp, Rattus norvegicus
tgaggcctttctcgaatattttgtg

SEQ ID NO: 611870 - DNA, 25 bp, Rattus norvegicus
tgaggcctttctggaatattttgtg

SEQ ID NO: 611871 - DNA, 25 bp, Rattus norvegicus
tgaggccttttaactgtggtaagaa

SEQ ID NO: 611872 - DNA, 25 bp, Rattus norvegicus
tgaggccttttatctgtggtaagaa

SEQ ID NO: 611873 - DNA, 25 bp, Rattus norvegicus
tgaggcgacttgcttgaagccgcac

SEQ ID NO: 611874 - DNA, 25 bp, Rattus norvegicus
tgaggcgacttggttgaagccgcac

SEQ ID NO: 611875 - DNA, 25 bp, Rattus norvegicus
tgaggcgatcgactgcatcacgcag

SEQ ID NO: 611876 - DNA, 25 bp, Rattus norvegicus
tgaggcgatcgagtgcatcacgcag

SEQ ID NO: 611877 - DNA, 25 bp, Rattus norvegicus
tgaggcgatgcccacagatatccat

SEQ ID NO: 611878 - DNA, 25 bp, Rattus norvegicus
tgaggcgatgccgacagatatccat

SEQ ID NO: 611879 - DNA, 25 bp, Rattus norvegicus
tgaggcgcacgacccatggatttaa

SEQ ID NO: 611880 - DNA, 25 bp, Rattus norvegicus
tgaggcgcacgagccatggatttaa

SEQ ID NO: 611881 - DNA, 25 bp, Rattus norvegicus
tgaggcgccgtgaacccttcttagg

SEQ ID NO: 611882 - DNA, 25 bp, Rattus norvegicus
tgaggcgccgtgtacccttcttagg

SEQ ID NO: 611883 - DNA, 25 bp, Rattus norvegicus
tgaggcgcctggagcctgactccga

SEQ ID NO: 611884 - DNA, 25 bp, Rattus norvegicus
tgaggcgcctggtgcctgactccga

SEQ ID NO: 611885 - DNA, 25 bp, Rattus norvegicus
tgaggcgcggccaccacaggagcaa

SEQ ID NO: 611886 - DNA, 25 bp, Rattus norvegicus
tgaggcgcggcctccacaggagcaa

SEQ ID NO: 611887 - DNA, 25 bp, Rattus norvegicus
tgaggcgctgcaagtttacatgaag

SEQ ID NO: 611888 - DNA, 25 bp, Rattus norvegicus
tgaggcgctgcatgtttacatgaag

SEQ ID NO: 611889 - DNA, 25 bp, Rattus norvegicus
tgaggcgctgtaacttcccaaggca

SEQ ID NO: 611890 - DNA, 25 bp, Rattus norvegicus
tgaggcgctgtatcttcccaaggca

SEQ ID NO: 611891 - DNA, 25 bp, Rattus norvegicus
tgaggcggaactccaggacatgatc

SEQ ID NO: 611892 - DNA, 25 bp, Rattus norvegicus
tgaggcggaactgcaggacatgatc

SEQ ID NO: 611893 - DNA, 25 bp, Rattus norvegicus
tgaggcggtgcaacaatcacggagc

SEQ ID NO: 611894 - DNA, 25 bp, Rattus norvegicus
tgaggcggtgcatcaatcacggagc

SEQ ID NO: 611895 - DNA, 25 bp, Rattus norvegicus
tgaggcgtcgggagaaagccaccct

SEQ ID NO: 611896 - DNA, 25 bp, Rattus norvegicus
tgaggcgtcgggtgaaagccaccct

SEQ ID NO: 611897 - DNA, 25 bp, Rattus norvegicus
tgaggcgtcttgcaatctctgaaga

SEQ ID NO: 611898 - DNA, 25 bp, Rattus norvegicus
tgaggcgtcttggaatctctgaaga

SEQ ID NO: 611899 - DNA, 25 bp, Rattus norvegicus
tgaggcgtttggcaaacatccaggt

SEQ ID NO: 611900 - DNA, 25 bp, Rattus norvegicus
tgaggcgtttgggaaacatccaggt

SEQ ID NO: 611901 - DNA, 25 bp, Rattus norvegicus
tgaggctacctaacaccctgagatg

SEQ ID NO: 611902 - DNA, 25 bp, Rattus norvegicus
tgaggctacctatcaccctgagatg

SEQ ID NO: 611903 - DNA, 25 bp, Rattus norvegicus
tgaggctaggaccaccttacttcct

SEQ ID NO: 611904 - DNA, 25 bp, Rattus norvegicus
tgaggctaggacgaccttacttcct

SEQ ID NO: 611905 - DNA, 25 bp, Rattus norvegicus
tgaggctatttacagactcgtctga

SEQ ID NO: 611906 - DNA, 25 bp, Rattus norvegicus
tgaggctatttagagactcgtctga

SEQ ID NO: 611907 - DNA, 25 bp, Rattus norvegicus
tgaggctcactactgtgtttcctgc

SEQ ID NO: 611908 - DNA, 25 bp, Rattus norvegicus
tgaggctcactagtgtgtttcctgc

SEQ ID NO: 611909 - DNA, 25 bp, Rattus norvegicus
tgaggctccacaacaggctttacca

SEQ ID NO: 611910 - DNA, 25 bp, Rattus norvegicus
tgaggctccacatcaggctttacca

SEQ ID NO: 611911 - DNA, 25 bp, Rattus norvegicus
tgaggctccactcctctttttaaag

SEQ ID NO: 611912 - DNA, 25 bp, Rattus norvegicus
tgaggctccactgctctttttaaag

SEQ ID NO: 611913 - DNA, 25 bp, Rattus norvegicus
tgaggctccctcagacaggtttcag

SEQ ID NO: 611914 - DNA, 25 bp, Rattus norvegicus
tgaggctccctctgacaggtttcag

SEQ ID NO: 611915 - DNA, 25 bp, Rattus norvegicus
tgaggctccctgaaagttcacccat

SEQ ID NO: 611916 - DNA, 25 bp, Rattus norvegicus
tgaggctccctgctgaaatgcaatt

SEQ ID NO: 611917 - DNA, 25 bp, Rattus norvegicus
tgaggctccctggtgaaatgcaatt

SEQ ID NO: 611918 - DNA, 25 bp, Rattus norvegicus
tgaggctccctgtaagttcacccat

SEQ ID NO: 611919 - DNA, 25 bp, Rattus norvegicus
tgaggctccttcctcctttgctgct

SEQ ID NO: 611920 - DNA, 25 bp, Rattus norvegicus
tgaggctccttcgtcctttgctgct

SEQ ID NO: 611921 - DNA, 25 bp, Rattus norvegicus
tgaggctctcatactttttggttta

SEQ ID NO: 611922 - DNA, 25 bp, Rattus norvegicus
tgaggctctcattctttttggttta

SEQ ID NO: 611923 - DNA, 25 bp, Rattus norvegicus
tgaggctctgcacatccagtgggcc

SEQ ID NO: 611924 - DNA, 25 bp, Rattus norvegicus
tgaggctctgcagatccagtgggcc

SEQ ID NO: 611925 - DNA, 25 bp, Rattus norvegicus
tgaggctcttcaactgcacagggca

SEQ ID NO: 611926 - DNA, 25 bp, Rattus norvegicus
tgaggctcttcatctgcacagggca

SEQ ID NO: 611927 - DNA, 25 bp, Rattus norvegicus
tgaggctcttgacggctcaccagtg

SEQ ID NO: 611928 - DNA, 25 bp, Rattus norvegicus
tgaggctcttgagggctcaccagtg

SEQ ID NO: 611929 - DNA, 25 bp, Rattus norvegicus
tgaggctgaactactgttttgcaca

SEQ ID NO: 611930 - DNA, 25 bp, Rattus norvegicus
tgaggctgaacttctgttttgcaca

SEQ ID NO: 611931 - DNA, 25 bp, Rattus norvegicus
tgaggctgaagtactttggagtcgt

SEQ ID NO: 611932 - DNA, 25 bp, Rattus norvegicus
tgaggctgaagttctttggagtcgt

SEQ ID NO: 611933 - DNA, 25 bp, Rattus norvegicus
tgaggctgaccactgagttctcttg

SEQ ID NO: 611934 - DNA, 25 bp, Rattus norvegicus
tgaggctgaccagtgagttctcttg

SEQ ID NO: 611935 - DNA, 25 bp, Rattus norvegicus
tgaggctgaccgcaaatctgtttgt

SEQ ID NO: 611936 - DNA, 25 bp, Rattus norvegicus
tgaggctgaccggaaatctgtttgt

SEQ ID NO: 611937 - DNA, 25 bp, Rattus norvegicus
tgaggctgactccatgctgtttgta

SEQ ID NO: 611938 - DNA, 25 bp, Rattus norvegicus
tgaggctgactcgatgctgtttgta

SEQ ID NO: 611939 - DNA, 25 bp, Rattus norvegicus
tgaggctgaggaaccccactatgac

SEQ ID NO: 611940 - DNA, 25 bp, Rattus norvegicus
tgaggctgaggatccccactatgac

SEQ ID NO: 611941 - DNA, 25 bp, Rattus norvegicus
tgaggctgcatgctaccgcacttaa

SEQ ID NO: 611942 - DNA, 25 bp, Rattus norvegicus
tgaggctgcatggtaccgcacttaa

SEQ ID NO: 611943 - DNA, 25 bp, Rattus norvegicus
tgaggctgccaaacatagctgtgaa

SEQ ID NO: 611944 - DNA, 25 bp, Rattus norvegicus
tgaggctgccaatcatagctgtgaa

SEQ ID NO: 611945 - DNA, 25 bp, Rattus norvegicus
tgaggctgcccgagctcagcgagcc

SEQ ID NO: 611946 - DNA, 25 bp, Rattus norvegicus
tgaggctgcccgtgctcagcgagcc

SEQ ID NO: 611947 - DNA, 25 bp, Rattus norvegicus
tgaggctgcggcaagggagggagct

SEQ ID NO: 611948 - DNA, 25 bp, Rattus norvegicus
tgaggctgcggctagggagggagct

SEQ ID NO: 611949 - DNA, 25 bp, Rattus norvegicus
tgaggctggagcatgtgtttcacat

SEQ ID NO: 611950 - DNA, 25 bp, Rattus norvegicus
tgaggctggagcttgtgtttcacat

SEQ ID NO: 611951 - DNA, 25 bp, Rattus norvegicus
tgaggctggtacagcgactgtccca

SEQ ID NO: 611952 - DNA, 25 bp, Rattus norvegicus
tgaggctggtactgcgactgtccca

SEQ ID NO: 611953 - DNA, 25 bp, Rattus norvegicus
tgaggctggtccatcccatggctgg

SEQ ID NO: 611954 - DNA, 25 bp, Rattus norvegicus
tgaggctggtccttcccatggctgg

SEQ ID NO: 611955 - DNA, 25 bp, Rattus norvegicus
tgaggctgtactcatcacgtggaca

SEQ ID NO: 611956 - DNA, 25 bp, Rattus norvegicus
tgaggctgtactgatcacgtggaca

SEQ ID NO: 611957 - DNA, 25 bp, Rattus norvegicus
tgaggctgtcaacctcagctgactc

SEQ ID NO: 611958 - DNA, 25 bp, Rattus norvegicus
tgaggctgtcaagctcagctgactc

SEQ ID NO: 611959 - DNA, 25 bp, Rattus norvegicus
tgaggctgtcagatctccgctttct

SEQ ID NO: 611960 - DNA, 25 bp, Rattus norvegicus
tgaggctgtcagcaaatctctccaa

SEQ ID NO: 611961 - DNA, 25 bp, Rattus norvegicus
tgaggctgtcaggaaatctctccaa

SEQ ID NO: 611962 - DNA, 25 bp, Rattus norvegicus
tgaggctgtcagttctccgctttct

SEQ ID NO: 611963 - DNA, 25 bp, Rattus norvegicus
tgaggctgtctcatgtttggctgca

SEQ ID NO: 611964 - DNA, 25 bp, Rattus norvegicus
tgaggctgtctcttgtttggctgca

SEQ ID NO: 611965 - DNA, 25 bp, Rattus norvegicus
tgaggctgtgacatagggctttttt

SEQ ID NO: 611966 - DNA, 25 bp, Rattus norvegicus
tgaggctgtgacttagggctttttt

SEQ ID NO: 611967 - DNA, 25 bp, Rattus norvegicus
tgaggctgtgcaccactatgggatc

SEQ ID NO: 611968 - DNA, 25 bp, Rattus norvegicus
tgaggctgtgcagcactatgggatc

SEQ ID NO: 611969 - DNA, 25 bp, Rattus norvegicus
tgaggctgtggtacagatgtccttg

SEQ ID NO: 611970 - DNA, 25 bp, Rattus norvegicus
tgaggctgtggttcagatgtccttg

SEQ ID NO: 611971 - DNA, 25 bp, Rattus norvegicus
tgaggctgtgtaatgtccctgactc

SEQ ID NO: 611972 - DNA, 25 bp, Rattus norvegicus
tgaggctgtgtattgtccctgactc

SEQ ID NO: 611973 - DNA, 25 bp, Rattus norvegicus
tgaggctgttccagtgtgcaaacac

SEQ ID NO: 611974 - DNA, 25 bp, Rattus norvegicus
tgaggctgttcctgtgtgcaaacac

SEQ ID NO: 611975 - DNA, 25 bp, Rattus norvegicus
tgaggctgtttcagctcagatggaa

SEQ ID NO: 611976 - DNA, 25 bp, Rattus norvegicus
tgaggctgtttctgctcagatggaa

SEQ ID NO: 611977 - DNA, 25 bp, Rattus norvegicus
tgaggcttcaggacaggccacagat

SEQ ID NO: 611978 - DNA, 25 bp, Rattus norvegicus
tgaggcttcaggtcaggccacagat

SEQ ID NO: 611979 - DNA, 25 bp, Rattus norvegicus
tgaggcttccttccccaaacggtcg

SEQ ID NO: 611980 - DNA, 25 bp, Rattus norvegicus
tgaggcttccttgcccaaacggtcg

SEQ ID NO: 611981 - DNA, 25 bp, Rattus norvegicus
tgaggcttctcaaggctcagtggta

SEQ ID NO: 611982 - DNA, 25 bp, Rattus norvegicus
tgaggcttctcatggctcagtggta

SEQ ID NO: 611983 - DNA, 25 bp, Rattus norvegicus
tgaggcttctccagcaaaacaaaag

SEQ ID NO: 611984 - DNA, 25 bp, Rattus norvegicus
tgaggcttctcctgcaaaacaaaag

SEQ ID NO: 611985 - DNA, 25 bp, Rattus norvegicus
tgaggcttgctccatcactgggtag

SEQ ID NO: 611986 - DNA, 25 bp, Rattus norvegicus
tgaggcttgctcgatcactgggtag

SEQ ID NO: 611987 - DNA, 25 bp, Rattus norvegicus
tgaggcttgggtatcttgaccttta

SEQ ID NO: 611988 - DNA, 25 bp, Rattus norvegicus
tgaggcttgggtttcttgaccttta

SEQ ID NO: 611989 - DNA, 25 bp, Rattus norvegicus
tgaggcttgttgctagttaattctt

SEQ ID NO: 611990 - DNA, 25 bp, Rattus norvegicus
tgaggcttgttggtagttaattctt

SEQ ID NO: 611991 - DNA, 25 bp, Rattus norvegicus
tgagggaaacaccatactcctacgc

SEQ ID NO: 611992 - DNA, 25 bp, Rattus norvegicus
tgagggaaacacgatactcctacgc

SEQ ID NO: 611993 - DNA, 25 bp, Rattus norvegicus
tgagggaacatgaacctactctctc

SEQ ID NO: 611994 - DNA, 25 bp, Rattus norvegicus
tgagggaacatgtacctactctctc

SEQ ID NO: 611995 - DNA, 25 bp, Rattus norvegicus
tgagggaactcaccatcacttattc

SEQ ID NO: 611996 - DNA, 25 bp, Rattus norvegicus
tgagggaactcagcatcacttattc

SEQ ID NO: 611997 - DNA, 25 bp, Rattus norvegicus
tgagggaactgaacctaccccagcg

SEQ ID NO: 611998 - DNA, 25 bp, Rattus norvegicus
tgagggaactgacccgcagtctcaa

SEQ ID NO: 611999 - DNA, 25 bp, Rattus norvegicus
tgagggaactgagccgcagtctcaa

SEQ ID NO: 612000 - DNA, 25 bp, Rattus norvegicus
tgagggaactgatcctaccccagcg

SEQ ID NO: 612001 - DNA, 25 bp, Rattus norvegicus
tgagggaactgcacaacctccacga

SEQ ID NO: 612002 - DNA, 25 bp, Rattus norvegicus
tgagggaactgctcaacctccacga

SEQ ID NO: 612003 - DNA, 25 bp, Rattus norvegicus
tgagggaacttgagctcacacagct

SEQ ID NO: 612004 - DNA, 25 bp, Rattus norvegicus
tgagggaacttgtgctcacacagct

SEQ ID NO: 612005 - DNA, 25 bp, Rattus norvegicus
tgagggaagaaaccgccacgtcaca

SEQ ID NO: 612006 - DNA, 25 bp, Rattus norvegicus
tgagggaagaaagcgccacgtcaca

SEQ ID NO: 612007 - DNA, 25 bp, Rattus norvegicus
tgagggaagcgcaacagtccagcct

SEQ ID NO: 612008 - DNA, 25 bp, Rattus norvegicus
tgagggaagcgctacagtccagcct

SEQ ID NO: 612009 - DNA, 25 bp, Rattus norvegicus
tgagggaagctcaactgaagatctt

SEQ ID NO: 612010 - DNA, 25 bp, Rattus norvegicus
tgagggaagctctactgaagatctt

SEQ ID NO: 612011 - DNA, 25 bp, Rattus norvegicus
tgagggaagggtctccccaccctgt

SEQ ID NO: 612012 - DNA, 25 bp, Rattus norvegicus
tgagggaagggtgtccccaccctgt

SEQ ID NO: 612013 - DNA, 25 bp, Rattus norvegicus
tgagggaagtcgcagctaaaagcat

SEQ ID NO: 612014 - DNA, 25 bp, Rattus norvegicus
tgagggaagtcggagctaaaagcat

SEQ ID NO: 612015 - DNA, 25 bp, Rattus norvegicus
tgagggaatcccagtgctgatcgtg

SEQ ID NO: 612016 - DNA, 25 bp, Rattus norvegicus
tgagggaatccctgtgctgatcgtg

SEQ ID NO: 612017 - DNA, 25 bp, Rattus norvegicus
tgagggacagacatggtgtttacca

SEQ ID NO: 612018 - DNA, 25 bp, Rattus norvegicus
tgagggacagacttggtgtttacca

SEQ ID NO: 612019 - DNA, 25 bp, Rattus norvegicus
tgagggacagcacaccactgttcag

SEQ ID NO: 612020 - DNA, 25 bp, Rattus norvegicus
tgagggacagcagaccactgttcag

SEQ ID NO: 612021 - DNA, 25 bp, Rattus norvegicus
tgagggaccaggattactgcctttt

SEQ ID NO: 612022 - DNA, 25 bp, Rattus norvegicus
tgagggaccaggtttactgcctttt

SEQ ID NO: 612023 - DNA, 25 bp, Rattus norvegicus
tgagggacggctccaaaccatcttt

SEQ ID NO: 612024 - DNA, 25 bp, Rattus norvegicus
tgagggacggctgcaaaccatcttt

SEQ ID NO: 612025 - DNA, 25 bp, Rattus norvegicus
tgagggactacgctgcttccaccat

SEQ ID NO: 612026 - DNA, 25 bp, Rattus norvegicus
tgagggactacggtgcttccaccat

SEQ ID NO: 612027 - DNA, 25 bp, Rattus norvegicus
tgagggactcagagcccgtgccagt

SEQ ID NO: 612028 - DNA, 25 bp, Rattus norvegicus
tgagggactcagtgcccgtgccagt

SEQ ID NO: 612029 - DNA, 25 bp, Rattus norvegicus
tgagggactgacaagacctataagt

SEQ ID NO: 612030 - DNA, 25 bp, Rattus norvegicus
tgagggactgactagacctataagt

SEQ ID NO: 612031 - DNA, 25 bp, Rattus norvegicus
tgagggacttgcatcatctgttccg

SEQ ID NO: 612032 - DNA, 25 bp, Rattus norvegicus
tgagggacttgcttcatctgttccg

SEQ ID NO: 612033 - DNA, 25 bp, Rattus norvegicus
tgagggacttgtctgtccaccgaag

SEQ ID NO: 612034 - DNA, 25 bp, Rattus norvegicus
tgagggacttgtgtgtccaccgaag

SEQ ID NO: 612035 - DNA, 25 bp, Rattus norvegicus
tgagggagaattccagcctgctgtt

SEQ ID NO: 612036 - DNA, 25 bp, Rattus norvegicus
tgagggagaattgcagcctgctgtt

SEQ ID NO: 612037 - DNA, 25 bp, Rattus norvegicus
tgagggagatagctcactctcccac

SEQ ID NO: 612038 - DNA, 25 bp, Rattus norvegicus
tgagggagataggtcactctcccac

SEQ ID NO: 612039 - DNA, 25 bp, Rattus norvegicus
tgagggagcaatcgccccatgtact

SEQ ID NO: 612040 - DNA, 25 bp, Rattus norvegicus
tgagggagcaatggccccatgtact

SEQ ID NO: 612041 - DNA, 25 bp, Rattus norvegicus
tgagggagcacaatccgaatgtgga

SEQ ID NO: 612042 - DNA, 25 bp, Rattus norvegicus
tgagggagcacattccgaatgtgga

SEQ ID NO: 612043 - DNA, 25 bp, Rattus norvegicus
tgagggagcagtcatcgtcttcgcc

SEQ ID NO: 612044 - DNA, 25 bp, Rattus norvegicus
tgagggagcagtgatcgtcttcgcc

SEQ ID NO: 612045 - DNA, 25 bp, Rattus norvegicus
tgagggaggatgactctaccacggt

SEQ ID NO: 612046 - DNA, 25 bp, Rattus norvegicus
tgagggaggatgtctctaccacggt

SEQ ID NO: 612047 - DNA, 25 bp, Rattus norvegicus
tgagggaggctaactatccctggct

SEQ ID NO: 612048 - DNA, 25 bp, Rattus norvegicus
tgagggaggctatctatccctggct

SEQ ID NO: 612049 - DNA, 25 bp, Rattus norvegicus
tgagggaggcttaccagcaactggt

SEQ ID NO: 612050 - DNA, 25 bp, Rattus norvegicus
tgagggaggctttccagcaactggt

SEQ ID NO: 612051 - DNA, 25 bp, Rattus norvegicus
tgagggaggtcaagctgagaatcat

SEQ ID NO: 612052 - DNA, 25 bp, Rattus norvegicus
tgagggaggtcatgctgagaatcat

SEQ ID NO: 612053 - DNA, 25 bp, Rattus norvegicus
tgagggagtgccaattctgtttcct

SEQ ID NO: 612054 - DNA, 25 bp, Rattus norvegicus
tgagggagtgcctattctgtttcct

SEQ ID NO: 612055 - DNA, 25 bp, Rattus norvegicus
tgagggatagttccaccacggctcg

SEQ ID NO: 612056 - DNA, 25 bp, Rattus norvegicus
tgagggatagttgcaccacggctcg

SEQ ID NO: 612057 - DNA, 25 bp, Rattus norvegicus
tgagggatctctatgaaaaattgaa

SEQ ID NO: 612058 - DNA, 25 bp, Rattus norvegicus
tgagggatctctttgaaaaattgaa

SEQ ID NO: 612059 - DNA, 25 bp, Rattus norvegicus
tgagggatggccatttgagcccctc

SEQ ID NO: 612060 - DNA, 25 bp, Rattus norvegicus
tgagggatggccttttgagcccctc

SEQ ID NO: 612061 - DNA, 25 bp, Rattus norvegicus
tgagggcaaagccagtctgccttac

SEQ ID NO: 612062 - DNA, 25 bp, Rattus norvegicus
tgagggcaaagcgagtctgccttac

SEQ ID NO: 612063 - DNA, 25 bp, Rattus norvegicus
tgagggcaacaaacagcgggacttc

SEQ ID NO: 612064 - DNA, 25 bp, Rattus norvegicus
tgagggcaacaatcagcgggacttc

SEQ ID NO: 612065 - DNA, 25 bp, Rattus norvegicus
tgagggcaagatccctggctgcacc

SEQ ID NO: 612066 - DNA, 25 bp, Rattus norvegicus
tgagggcaagatgcctggctgcacc

SEQ ID NO: 612067 - DNA, 25 bp, Rattus norvegicus
tgagggcacagcctttagcattctc

SEQ ID NO: 612068 - DNA, 25 bp, Rattus norvegicus
tgagggcacagcgtttagcattctc

SEQ ID NO: 612069 - DNA, 25 bp, Rattus norvegicus
tgagggcacccaaatggcaaactaa

SEQ ID NO: 612070 - DNA, 25 bp, Rattus norvegicus
tgagggcacccatatggcaaactaa

SEQ ID NO: 612071 - DNA, 25 bp, Rattus norvegicus
tgagggcacctgacagggtcatccc

SEQ ID NO: 612072 - DNA, 25 bp, Rattus norvegicus
tgagggcacctgtcagggtcatccc

SEQ ID NO: 612073 - DNA, 25 bp, Rattus norvegicus
tgagggcactggagtcacctgctat

SEQ ID NO: 612074 - DNA, 25 bp, Rattus norvegicus
tgagggcactggtgtcacctgctat

SEQ ID NO: 612075 - DNA, 25 bp, Rattus norvegicus
tgagggcagcctcaggaacacgcct

SEQ ID NO: 612076 - DNA, 25 bp, Rattus norvegicus
tgagggcagcctgaggaacacgcct

SEQ ID NO: 612077 - DNA, 25 bp, Rattus norvegicus
tgagggcagcgcctgtacaaaccag

SEQ ID NO: 612078 - DNA, 25 bp, Rattus norvegicus
tgagggcagcgcgtgtacaaaccag

SEQ ID NO: 612079 - DNA, 25 bp, Rattus norvegicus
tgagggcagcgtcacccacactact

SEQ ID NO: 612080 - DNA, 25 bp, Rattus norvegicus
tgagggcagcgtgacccacactact

SEQ ID NO: 612081 - DNA, 25 bp, Rattus norvegicus
tgagggcagctaactaaccatcctt

SEQ ID NO: 612082 - DNA, 25 bp, Rattus norvegicus
tgagggcagctatctaaccatcctt

SEQ ID NO: 612083 - DNA, 25 bp, Rattus norvegicus
tgagggcagcttatgcattccaagc

SEQ ID NO: 612084 - DNA, 25 bp, Rattus norvegicus
tgagggcagcttttgcattccaagc

SEQ ID NO: 612085 - DNA, 25 bp, Rattus norvegicus
tgagggcaggcccaagcttcagtcc

SEQ ID NO: 612086 - DNA, 25 bp, Rattus norvegicus
tgagggcaggccgaagcttcagtcc

SEQ ID NO: 612087 - DNA, 25 bp, Rattus norvegicus
tgagggcagtccactgggctcattc

SEQ ID NO: 612088 - DNA, 25 bp, Rattus norvegicus
tgagggcagtcctctgggctcattc

SEQ ID NO: 612089 - DNA, 25 bp, Rattus norvegicus
tgagggcagttgacactattatgta

SEQ ID NO: 612090 - DNA, 25 bp, Rattus norvegicus
tgagggcagttgtcactattatgta

SEQ ID NO: 612091 - DNA, 25 bp, Rattus norvegicus
tgagggcatctacgctaacttactt

SEQ ID NO: 612092 - DNA, 25 bp, Rattus norvegicus
tgagggcatctaggctaacttactt

SEQ ID NO: 612093 - DNA, 25 bp, Rattus norvegicus
tgagggccacggacgagcatcaaga

SEQ ID NO: 612094 - DNA, 25 bp, Rattus norvegicus
tgagggccacggtcgagcatcaaga

SEQ ID NO: 612095 - DNA, 25 bp, Rattus norvegicus
tgagggccaggcagcgcatagaaca

SEQ ID NO: 612096 - DNA, 25 bp, Rattus norvegicus
tgagggccaggctgcgcatagaaca

SEQ ID NO: 612097 - DNA, 25 bp, Rattus norvegicus
tgagggccagttccagcaggttctt

SEQ ID NO: 612098 - DNA, 25 bp, Rattus norvegicus
tgagggccagttgcagcaggttctt

SEQ ID NO: 612099 - DNA, 25 bp, Rattus norvegicus
tgagggccatgcacaggaccacagc

SEQ ID NO: 612100 - DNA, 25 bp, Rattus norvegicus
tgagggccatgctcaggaccacagc

SEQ ID NO: 612101 - DNA, 25 bp, Rattus norvegicus
tgagggcccaccacaagcaggtgaa

SEQ ID NO: 612102 - DNA, 25 bp, Rattus norvegicus
tgagggcccacctcaagcaggtgaa

SEQ ID NO: 612103 - DNA, 25 bp, Rattus norvegicus
tgagggcccagacactgaccttgaa

SEQ ID NO: 612104 - DNA, 25 bp, Rattus norvegicus
tgagggcccagagactgaccttgaa

SEQ ID NO: 612105 - DNA, 25 bp, Rattus norvegicus
tgagggcccattactcaagggtcaa

SEQ ID NO: 612106 - DNA, 25 bp, Rattus norvegicus
tgagggcccatttctcaagggtcaa

SEQ ID NO: 612107 - DNA, 25 bp, Rattus norvegicus
tgagggcccctccagtaagcttgtg

SEQ ID NO: 612108 - DNA, 25 bp, Rattus norvegicus
tgagggcccctcgagtaagcttgtg

SEQ ID NO: 612109 - DNA, 25 bp, Rattus norvegicus
tgagggccctcacccatgctaacaa

SEQ ID NO: 612110 - DNA, 25 bp, Rattus norvegicus
tgagggccctcagccatgctaacaa

SEQ ID NO: 612111 - DNA, 25 bp, Rattus norvegicus
tgagggccggccaatacgatacagg

SEQ ID NO: 612112 - DNA, 25 bp, Rattus norvegicus
tgagggccggcctatacgatacagg

SEQ ID NO: 612113 - DNA, 25 bp, Rattus norvegicus
tgagggccgtacatcggctacacac

SEQ ID NO: 612114 - DNA, 25 bp, Rattus norvegicus
tgagggccgtacttcggctacacac

SEQ ID NO: 612115 - DNA, 25 bp, Rattus norvegicus
tgagggcctcaacttacagaagaat

SEQ ID NO: 612116 - DNA, 25 bp, Rattus norvegicus
tgagggcctcaagttacagaagaat

SEQ ID NO: 612117 - DNA, 25 bp, Rattus norvegicus
tgagggcctgagacaccacgctgtg

SEQ ID NO: 612118 - DNA, 25 bp, Rattus norvegicus
tgagggcctgagtcaccacgctgtg

SEQ ID NO: 612119 - DNA, 25 bp, Rattus norvegicus
tgagggcctgctatattccacagag

SEQ ID NO: 612120 - DNA, 25 bp, Rattus norvegicus
tgagggcctgctttattccacagag

SEQ ID NO: 612121 - DNA, 25 bp, Rattus norvegicus
tgagggcctgttagtccagccttac

SEQ ID NO: 612122 - DNA, 25 bp, Rattus norvegicus
tgagggcctgtttgtccagccttac

SEQ ID NO: 612123 - DNA, 25 bp, Rattus norvegicus
tgagggccttacctggtttccagta

SEQ ID NO: 612124 - DNA, 25 bp, Rattus norvegicus
tgagggccttacgtggtttccagta

SEQ ID NO: 612125 - DNA, 25 bp, Rattus norvegicus
tgagggcgaaccattcctctgcttg

SEQ ID NO: 612126 - DNA, 25 bp, Rattus norvegicus
tgagggcgaacctttcctctgcttg

SEQ ID NO: 612127 - DNA, 25 bp, Rattus norvegicus
tgagggcgtcctagaacttatgatc

SEQ ID NO: 612128 - DNA, 25 bp, Rattus norvegicus
tgagggcgtccttgaacttatgatc

SEQ ID NO: 612129 - DNA, 25 bp, Rattus norvegicus
tgagggcgtgagagttccctgtcct

SEQ ID NO: 612130 - DNA, 25 bp, Rattus norvegicus
tgagggcgtgagtgttccctgtcct

SEQ ID NO: 612131 - DNA, 25 bp, Rattus norvegicus
tgagggcgttgcacaacacagggct

SEQ ID NO: 612132 - DNA, 25 bp, Rattus norvegicus
tgagggcgttgctcaacacagggct

SEQ ID NO: 612133 - DNA, 25 bp, Rattus norvegicus
tgagggctcaagacgcaatgtatct

SEQ ID NO: 612134 - DNA, 25 bp, Rattus norvegicus
tgagggctcaagtcgcaatgtatct

SEQ ID NO: 612135 - DNA, 25 bp, Rattus norvegicus
tgagggctcagcaaagctcctgggt

SEQ ID NO: 612136 - DNA, 25 bp, Rattus norvegicus
tgagggctcagctaagctcctgggt

SEQ ID NO: 612137 - DNA, 25 bp, Rattus norvegicus
tgagggctcaggcacccagacccag

SEQ ID NO: 612138 - DNA, 25 bp, Rattus norvegicus
tgagggctcagggacccagacccag

SEQ ID NO: 612139 - DNA, 25 bp, Rattus norvegicus
tgagggctccttactagaagtccaa

SEQ ID NO: 612140 - DNA, 25 bp, Rattus norvegicus
tgagggctcctttctagaagtccaa

SEQ ID NO: 612141 - DNA, 25 bp, Rattus norvegicus
tgagggctctcacagatagcttccg

SEQ ID NO: 612142 - DNA, 25 bp, Rattus norvegicus
tgagggctctcagagatagcttccg

SEQ ID NO: 612143 - DNA, 25 bp, Rattus norvegicus
tgagggctgaatccttgacaaacag

SEQ ID NO: 612144 - DNA, 25 bp, Rattus norvegicus
tgagggctgaatgcttgacaaacag

SEQ ID NO: 612145 - DNA, 25 bp, Rattus norvegicus
tgagggctgcacacacttcagttga

SEQ ID NO: 612146 - DNA, 25 bp, Rattus norvegicus
tgagggctgcactcacttcagttga

SEQ ID NO: 612147 - DNA, 25 bp, Rattus norvegicus
tgagggctgccgaccacgtgctgta

SEQ ID NO: 612148 - DNA, 25 bp, Rattus norvegicus
tgagggctgccgtccacgtgctgta

SEQ ID NO: 612149 - DNA, 25 bp, Rattus norvegicus
tgagggctgcctacagtcaagtgaa

SEQ ID NO: 612150 - DNA, 25 bp, Rattus norvegicus
tgagggctgcctagtaagtcataat

SEQ ID NO: 612151 - DNA, 25 bp, Rattus norvegicus
tgagggctgccttcagtcaagtgaa

SEQ ID NO: 612152 - DNA, 25 bp, Rattus norvegicus
tgagggctgccttgtaagtcataat

SEQ ID NO: 612153 - DNA, 25 bp, Rattus norvegicus
tgagggctgctccaagagtccagac

SEQ ID NO: 612154 - DNA, 25 bp, Rattus norvegicus
tgagggctgctcgaagagtccagac

SEQ ID NO: 612155 - DNA, 25 bp, Rattus norvegicus
tgagggctgtcgattctaccataca

SEQ ID NO: 612156 - DNA, 25 bp, Rattus norvegicus
tgagggctgtcgtttctaccataca

SEQ ID NO: 612157 - DNA, 25 bp, Rattus norvegicus
tgagggcttcccatggacagagtct

SEQ ID NO: 612158 - DNA, 25 bp, Rattus norvegicus
tgagggcttcccttggacagagtct

SEQ ID NO: 612159 - DNA, 25 bp, Rattus norvegicus
tgagggcttcctactctaagtaatt

SEQ ID NO: 612160 - DNA, 25 bp, Rattus norvegicus
tgagggcttccttctctaagtaatt

SEQ ID NO: 612161 - DNA, 25 bp, Rattus norvegicus
tgagggtaagaaccccacggttatt

SEQ ID NO: 612162 - DNA, 25 bp, Rattus norvegicus
tgagggtaagaagcccacggttatt

SEQ ID NO: 612163 - DNA, 25 bp, Rattus norvegicus
tgagggtaggtcaggctcgacccct

SEQ ID NO: 612164 - DNA, 25 bp, Rattus norvegicus
tgagggtaggtctggctcgacccct

SEQ ID NO: 612165 - DNA, 25 bp, Rattus norvegicus
tgagggtattttccgaggcatcaca

SEQ ID NO: 612166 - DNA, 25 bp, Rattus norvegicus
tgagggtattttgcgaggcatcaca

SEQ ID NO: 612167 - DNA, 25 bp, Rattus norvegicus
tgagggtcaacccacatggtcagtc

SEQ ID NO: 612168 - DNA, 25 bp, Rattus norvegicus
tgagggtcaaccgacatggtcagtc

SEQ ID NO: 612169 - DNA, 25 bp, Rattus norvegicus
tgagggtcaagcagtcaaggtcatc

SEQ ID NO: 612170 - DNA, 25 bp, Rattus norvegicus
tgagggtcaagctgtcaaggtcatc

SEQ ID NO: 612171 - DNA, 25 bp, Rattus norvegicus
tgagggtcacagatgcgctctagta

SEQ ID NO: 612172 - DNA, 25 bp, Rattus norvegicus
tgagggtcacagttgcgctctagta

SEQ ID NO: 612173 - DNA, 25 bp, Rattus norvegicus
tgagggtcaccacagaaggcttctt

SEQ ID NO: 612174 - DNA, 25 bp, Rattus norvegicus
tgagggtcaccagagaaggcttctt

SEQ ID NO: 612175 - DNA, 25 bp, Rattus norvegicus
tgagggtcacccagggttacatggt

SEQ ID NO: 612176 - DNA, 25 bp, Rattus norvegicus
tgagggtcaccctgggttacatggt

SEQ ID NO: 612177 - DNA, 25 bp, Rattus norvegicus
tgagggtcactcactatgccagaga

SEQ ID NO: 612178 - DNA, 25 bp, Rattus norvegicus
tgagggtcactctctatgccagaga

SEQ ID NO: 612179 - DNA, 25 bp, Rattus norvegicus
tgagggtcacttcggcggccgtctg

SEQ ID NO: 612180 - DNA, 25 bp, Rattus norvegicus
tgagggtcacttgggcggccgtctg

SEQ ID NO: 612181 - DNA, 25 bp, Rattus norvegicus
tgagggtcctggagtgtccctcctt

SEQ ID NO: 612182 - DNA, 25 bp, Rattus norvegicus
tgagggtcctggtgtgtccctcctt

SEQ ID NO: 612183 - DNA, 25 bp, Rattus norvegicus
tgagggtctcatctttgcagcaact

SEQ ID NO: 612184 - DNA, 25 bp, Rattus norvegicus
tgagggtctcatgtttgcagcaact

SEQ ID NO: 612185 - DNA, 25 bp, Rattus norvegicus
tgagggtctcctcaaaagaacctaa

SEQ ID NO: 612186 - DNA, 25 bp, Rattus norvegicus
tgagggtctcctgaaaagaacctaa

SEQ ID NO: 612187 - DNA, 25 bp, Rattus norvegicus
tgagggtctgcgagtcttcgacaag

SEQ ID NO: 612188 - DNA, 25 bp, Rattus norvegicus
tgagggtctgcgtgtcttcgacaag

SEQ ID NO: 612189 - DNA, 25 bp, Rattus norvegicus
tgagggtcttaaagtccacagccac

SEQ ID NO: 612190 - DNA, 25 bp, Rattus norvegicus
tgagggtcttaatgtccacagccac

SEQ ID NO: 612191 - DNA, 25 bp, Rattus norvegicus
tgagggtgacgcaattgattaaaac

SEQ ID NO: 612192 - DNA, 25 bp, Rattus norvegicus
tgagggtgacgctattgattaaaac

SEQ ID NO: 612193 - DNA, 25 bp, Rattus norvegicus
tgagggtgagcacgatgcgggttcc

SEQ ID NO: 612194 - DNA, 25 bp, Rattus norvegicus
tgagggtgagcaggatgcgggttcc

SEQ ID NO: 612195 - DNA, 25 bp, Rattus norvegicus
tgagggtgatttaattccagcgtaa

SEQ ID NO: 612196 - DNA, 25 bp, Rattus norvegicus
tgagggtgattttattccagcgtaa

SEQ ID NO: 612197 - DNA, 25 bp, Rattus norvegicus
tgagggtgcacacctccaggcttag

SEQ ID NO: 612198 - DNA, 25 bp, Rattus norvegicus
tgagggtgcacagctccaggcttag

SEQ ID NO: 612199 - DNA, 25 bp, Rattus norvegicus
tgagggtgcagcaggcagaccatca

SEQ ID NO: 612200 - DNA, 25 bp, Rattus norvegicus
tgagggtgcagctggcagaccatca

SEQ ID NO: 612201 - DNA, 25 bp, Rattus norvegicus
tgagggtgcctcacactctctgaat

SEQ ID NO: 612202 - DNA, 25 bp, Rattus norvegicus
tgagggtgcctctcactctctgaat

SEQ ID NO: 612203 - DNA, 25 bp, Rattus norvegicus
tgagggtgcgcacgctcaccagctt

SEQ ID NO: 612204 - DNA, 25 bp, Rattus norvegicus
tgagggtgcgcaggctcaccagctt

SEQ ID NO: 612205 - DNA, 25 bp, Rattus norvegicus
tgagggtgggtgaaattgctttttc

SEQ ID NO: 612206 - DNA, 25 bp, Rattus norvegicus
tgagggtgggtgtaattgctttttc

SEQ ID NO: 612207 - DNA, 25 bp, Rattus norvegicus
tgagggtgtccccatagtcagtgct

SEQ ID NO: 612208 - DNA, 25 bp, Rattus norvegicus
tgagggtgtcccgatagtcagtgct

SEQ ID NO: 612209 - DNA, 25 bp, Rattus norvegicus
tgagggtgtctccatcaatgtcatt

SEQ ID NO: 612210 - DNA, 25 bp, Rattus norvegicus
tgagggtgtctcgatcaatgtcatt

SEQ ID NO: 612211 - DNA, 25 bp, Rattus norvegicus
tgagggtgttggcatacttctcacc

SEQ ID NO: 612212 - DNA, 25 bp, Rattus norvegicus
tgagggtgttgggatacttctcacc

SEQ ID NO: 612213 - DNA, 25 bp, Rattus norvegicus
tgagggttaaccaccatttcaccac

SEQ ID NO: 612214 - DNA, 25 bp, Rattus norvegicus
tgagggttaacctccatttcaccac

SEQ ID NO: 612215 - DNA, 25 bp, Rattus norvegicus
tgagggttacctcctactgcggcca

SEQ ID NO: 612216 - DNA, 25 bp, Rattus norvegicus
tgagggttacctgctactgcggcca

SEQ ID NO: 612217 - DNA, 25 bp, Rattus norvegicus
tgagggttagggagtattgcacttt

SEQ ID NO: 612218 - DNA, 25 bp, Rattus norvegicus
tgagggttagggtgtattgcacttt

SEQ ID NO: 612219 - DNA, 25 bp, Rattus norvegicus
tgagggttcagactggtccagcttt

SEQ ID NO: 612220 - DNA, 25 bp, Rattus norvegicus
tgagggttcagagtggtccagcttt

SEQ ID NO: 612221 - DNA, 25 bp, Rattus norvegicus
tgagggtttatacacttcgtttatc

SEQ ID NO: 612222 - DNA, 25 bp, Rattus norvegicus
tgagggtttatagacttcgtttatc

SEQ ID NO: 612223 - DNA, 25 bp, Rattus norvegicus
tgagggtttctgaacttcctttgtg

SEQ ID NO: 612224 - DNA, 25 bp, Rattus norvegicus
tgagggtttctgtacttcctttgtg

SEQ ID NO: 612225 - DNA, 25 bp, Rattus norvegicus
tgaggtaaactaacgttactctgtt

SEQ ID NO: 612226 - DNA, 25 bp, Rattus norvegicus
tgaggtaaactatcgttactctgtt

SEQ ID NO: 612227 - DNA, 25 bp, Rattus norvegicus
tgaggtaaaggaccttgggtcctct

SEQ ID NO: 612228 - DNA, 25 bp, Rattus norvegicus
tgaggtaaaggagcttgggtcctct

SEQ ID NO: 612229 - DNA, 25 bp, Rattus norvegicus
tgaggtaacacaatcctggtttccc

SEQ ID NO: 612230 - DNA, 25 bp, Rattus norvegicus
tgaggtaacacattcctggtttccc

SEQ ID NO: 612231 - DNA, 25 bp, Rattus norvegicus
tgaggtaacagccttgccctggcaa

SEQ ID NO: 612232 - DNA, 25 bp, Rattus norvegicus
tgaggtaacagcgttgccctggcaa

SEQ ID NO: 612233 - DNA, 25 bp, Rattus norvegicus
tgaggtaagacaccccttgttttca

SEQ ID NO: 612234 - DNA, 25 bp, Rattus norvegicus
tgaggtaagacagcccttgttttca

SEQ ID NO: 612235 - DNA, 25 bp, Rattus norvegicus
tgaggtaagactatcagatctgaac

SEQ ID NO: 612236 - DNA, 25 bp, Rattus norvegicus
tgaggtaagactttcagatctgaac

SEQ ID NO: 612237 - DNA, 25 bp, Rattus norvegicus
tgaggtaagagaatccgccttccag

SEQ ID NO: 612238 - DNA, 25 bp, Rattus norvegicus
tgaggtaagagattccgccttccag

SEQ ID NO: 612239 - DNA, 25 bp, Rattus norvegicus
tgaggtaagcctcccatttcaggac

SEQ ID NO: 612240 - DNA, 25 bp, Rattus norvegicus
tgaggtaagcctgccatttcaggac

SEQ ID NO: 612241 - DNA, 25 bp, Rattus norvegicus
tgaggtaattttcaccagcagctgt

SEQ ID NO: 612242 - DNA, 25 bp, Rattus norvegicus
tgaggtaattttgaccagcagctgt

SEQ ID NO: 612243 - DNA, 25 bp, Rattus norvegicus
tgaggtacatcaaggcggttctcct

SEQ ID NO: 612244 - DNA, 25 bp, Rattus norvegicus
tgaggtacatcatggcggttctcct

SEQ ID NO: 612245 - DNA, 25 bp, Rattus norvegicus
tgaggtaccaggagtcctaggagac

SEQ ID NO: 612246 - DNA, 25 bp, Rattus norvegicus
tgaggtaccaggtgtcctaggagac

SEQ ID NO: 612247 - DNA, 25 bp, Rattus norvegicus
tgaggtaccctcaacttgacggcaa

SEQ ID NO: 612248 - DNA, 25 bp, Rattus norvegicus
tgaggtaccctctacttgacggcaa

SEQ ID NO: 612249 - DNA, 25 bp, Rattus norvegicus
tgaggtacctgcagtcagctggcaa

SEQ ID NO: 612250 - DNA, 25 bp, Rattus norvegicus
tgaggtacctgcatccagtcatgat

SEQ ID NO: 612251 - DNA, 25 bp, Rattus norvegicus
tgaggtacctgctgtcagctggcaa

SEQ ID NO: 612252 - DNA, 25 bp, Rattus norvegicus
tgaggtacctgcttccagtcatgat

SEQ ID NO: 612253 - DNA, 25 bp, Rattus norvegicus
tgaggtacctttctgttggcttcca

SEQ ID NO: 612254 - DNA, 25 bp, Rattus norvegicus
tgaggtacctttgtgttggcttcca

SEQ ID NO: 612255 - DNA, 25 bp, Rattus norvegicus
tgaggtactcaaactgttcagtctt

SEQ ID NO: 612256 - DNA, 25 bp, Rattus norvegicus
tgaggtactcaatctgttcagtctt

SEQ ID NO: 612257 - DNA, 25 bp, Rattus norvegicus
tgaggtagaatgctccttttccctt

SEQ ID NO: 612258 - DNA, 25 bp, Rattus norvegicus
tgaggtagaatggtccttttccctt

SEQ ID NO: 612259 - DNA, 25 bp, Rattus norvegicus
tgaggtagacctctctccactacaa

SEQ ID NO: 612260 - DNA, 25 bp, Rattus norvegicus
tgaggtagacctgtctccactacaa

SEQ ID NO: 612261 - DNA, 25 bp, Rattus norvegicus
tgaggtagattacctctcctgctgc

SEQ ID NO: 612262 - DNA, 25 bp, Rattus norvegicus
tgaggtagattagctctcctgctgc

SEQ ID NO: 612263 - DNA, 25 bp, Rattus norvegicus
tgaggtagcacgcttctcgcctctg

SEQ ID NO: 612264 - DNA, 25 bp, Rattus norvegicus
tgaggtagcacggttctcgcctctg

SEQ ID NO: 612265 - DNA, 25 bp, Rattus norvegicus
tgaggtagcccacacaccggacaag

SEQ ID NO: 612266 - DNA, 25 bp, Rattus norvegicus
tgaggtagcccagacaccggacaag

SEQ ID NO: 612267 - DNA, 25 bp, Rattus norvegicus
tgaggtagcctgactgtaggccagc

SEQ ID NO: 612268 - DNA, 25 bp, Rattus norvegicus
tgaggtagcctgtctgtaggccagc

SEQ ID NO: 612269 - DNA, 25 bp, Rattus norvegicus
tgaggtagtgggaccctctattttt

SEQ ID NO: 612270 - DNA, 25 bp, Rattus norvegicus
tgaggtagtgggtccctctattttt

SEQ ID NO: 612271 - DNA, 25 bp, Rattus norvegicus
tgaggtatcaaaccagaccagtgac

SEQ ID NO: 612272 - DNA, 25 bp, Rattus norvegicus
tgaggtatcaaagcagaccagtgac

SEQ ID NO: 612273 - DNA, 25 bp, Rattus norvegicus
tgaggtatgcacacttccccataag

SEQ ID NO: 612274 - DNA, 25 bp, Rattus norvegicus
tgaggtatgcactcttccccataag

SEQ ID NO: 612275 - DNA, 25 bp, Rattus norvegicus
tgaggtattccaccattctcttgtt

SEQ ID NO: 612276 - DNA, 25 bp, Rattus norvegicus
tgaggtattccagcattctcttgtt

SEQ ID NO: 612277 - DNA, 25 bp, Rattus norvegicus
tgaggtatttacattgcctgtttac

SEQ ID NO: 612278 - DNA, 25 bp, Rattus norvegicus
tgaggtatttactttgcctgtttac

SEQ ID NO: 612279 - DNA, 25 bp, Rattus norvegicus
tgaggtcaacctccccaagtactta

SEQ ID NO: 612280 - DNA, 25 bp, Rattus norvegicus
tgaggtcaacctgcccaagtactta

SEQ ID NO: 612281 - DNA, 25 bp, Rattus norvegicus
tgaggtcaagcaagaacggtagtgc

SEQ ID NO: 612282 - DNA, 25 bp, Rattus norvegicus
tgaggtcaagcatgaacggtagtgc

SEQ ID NO: 612283 - DNA, 25 bp, Rattus norvegicus
tgaggtcaaggactgttcccatcac

SEQ ID NO: 612284 - DNA, 25 bp, Rattus norvegicus
tgaggtcaaggagtgttcccatcac

SEQ ID NO: 612285 - DNA, 25 bp, Rattus norvegicus
tgaggtcacactatgaagtctggca

SEQ ID NO: 612286 - DNA, 25 bp, Rattus norvegicus
tgaggtcacactttgaagtctggca

SEQ ID NO: 612287 - DNA, 25 bp, Rattus norvegicus
tgaggtcacagcctgcctttttaac

SEQ ID NO: 612288 - DNA, 25 bp, Rattus norvegicus
tgaggtcacagcgtgcctttttaac

SEQ ID NO: 612289 - DNA, 25 bp, Rattus norvegicus
tgaggtcaccgactgtcaactgcac

SEQ ID NO: 612290 - DNA, 25 bp, Rattus norvegicus
tgaggtcaccgagtgtcaactgcac

SEQ ID NO: 612291 - DNA, 25 bp, Rattus norvegicus
tgaggtcagcagcttcctagttcct

SEQ ID NO: 612292 - DNA, 25 bp, Rattus norvegicus
tgaggtcagcaggttcctagttcct

SEQ ID NO: 612293 - DNA, 25 bp, Rattus norvegicus
tgaggtcaggaacacagcagctttt

SEQ ID NO: 612294 - DNA, 25 bp, Rattus norvegicus
tgaggtcaggaagacagcagctttt

SEQ ID NO: 612295 - DNA, 25 bp, Rattus norvegicus
tgaggtcaggcaactgagagccctt

SEQ ID NO: 612296 - DNA, 25 bp, Rattus norvegicus
tgaggtcaggcatctgagagccctt

SEQ ID NO: 612297 - DNA, 25 bp, Rattus norvegicus
tgaggtcagtccagttttggaagca

SEQ ID NO: 612298 - DNA, 25 bp, Rattus norvegicus
tgaggtcagtcctgttttggaagca

SEQ ID NO: 612299 - DNA, 25 bp, Rattus norvegicus
tgaggtcagttgatctacacagagt

SEQ ID NO: 612300 - DNA, 25 bp, Rattus norvegicus
tgaggtcagttgttctacacagagt

SEQ ID NO: 612301 - DNA, 25 bp, Rattus norvegicus
tgaggtcatctgcagaacgtgccct

SEQ ID NO: 612302 - DNA, 25 bp, Rattus norvegicus
tgaggtcatctggagaacgtgccct

SEQ ID NO: 612303 - DNA, 25 bp, Rattus norvegicus
tgaggtcatgaacaggcccagcagc

SEQ ID NO: 612304 - DNA, 25 bp, Rattus norvegicus
tgaggtcatgaagaggcccagcagc

SEQ ID NO: 612305 - DNA, 25 bp, Rattus norvegicus
tgaggtccaggcagtcactgagttt

SEQ ID NO: 612306 - DNA, 25 bp, Rattus norvegicus
tgaggtccaggctgtcactgagttt

SEQ ID NO: 612307 - DNA, 25 bp, Rattus norvegicus
tgaggtccagggaccacagtacatt

SEQ ID NO: 612308 - DNA, 25 bp, Rattus norvegicus
tgaggtccagggtccacagtacatt

SEQ ID NO: 612309 - DNA, 25 bp, Rattus norvegicus
tgaggtcccaccacttttagttaca

SEQ ID NO: 612310 - DNA, 25 bp, Rattus norvegicus
tgaggtcccacctcttttagttaca

SEQ ID NO: 612311 - DNA, 25 bp, Rattus norvegicus
tgaggtcccatacagccagggctct

SEQ ID NO: 612312 - DNA, 25 bp, Rattus norvegicus
tgaggtcccatagagccagggctct

SEQ ID NO: 612313 - DNA, 25 bp, Rattus norvegicus
tgaggtcccctccttaggagggatc

SEQ ID NO: 612314 - DNA, 25 bp, Rattus norvegicus
tgaggtcccctcgttaggagggatc

SEQ ID NO: 612315 - DNA, 25 bp, Rattus norvegicus
tgaggtccctttcctctaaggactt

SEQ ID NO: 612316 - DNA, 25 bp, Rattus norvegicus
tgaggtccctttgctctaaggactt

SEQ ID NO: 612317 - DNA, 25 bp, Rattus norvegicus
tgaggtccggccctgtagataagcc

SEQ ID NO: 612318 - DNA, 25 bp, Rattus norvegicus
tgaggtccggccgtgtagataagcc

SEQ ID NO: 612319 - DNA, 25 bp, Rattus norvegicus
tgaggtcctatgctcaagctctgac

SEQ ID NO: 612320 - DNA, 25 bp, Rattus norvegicus
tgaggtcctatggtcaagctctgac

SEQ ID NO: 612321 - DNA, 25 bp, Rattus norvegicus
tgaggtcctcggaaccgttgtccat

SEQ ID NO: 612322 - DNA, 25 bp, Rattus norvegicus
tgaggtcctcggtaccgttgtccat

SEQ ID NO: 612323 - DNA, 25 bp, Rattus norvegicus
tgaggtcctggaactagtctccgta

SEQ ID NO: 612324 - DNA, 25 bp, Rattus norvegicus
tgaggtcctggatctagtctccgta

SEQ ID NO: 612325 - DNA, 25 bp, Rattus norvegicus
tgaggtcctggtacatgttaatgaa

SEQ ID NO: 612326 - DNA, 25 bp, Rattus norvegicus
tgaggtcctggttcatgttaatgaa

SEQ ID NO: 612327 - DNA, 25 bp, Rattus norvegicus
tgaggtcctgtcattccagatgact

SEQ ID NO: 612328 - DNA, 25 bp, Rattus norvegicus
tgaggtcctgtctttccagatgact

SEQ ID NO: 612329 - DNA, 25 bp, Rattus norvegicus
tgaggtccttagctgagccatttcc

SEQ ID NO: 612330 - DNA, 25 bp, Rattus norvegicus
tgaggtccttaggtgagccatttcc

SEQ ID NO: 612331 - DNA, 25 bp, Rattus norvegicus
tgaggtccttctccttttttgggag

SEQ ID NO: 612332 - DNA, 25 bp, Rattus norvegicus
tgaggtccttctgcttttttgggag

SEQ ID NO: 612333 - DNA, 25 bp, Rattus norvegicus
tgaggtcgccatcacccctgacaat

SEQ ID NO: 612334 - DNA, 25 bp, Rattus norvegicus
tgaggtcgccatgacccctgacaat

SEQ ID NO: 612335 - DNA, 25 bp, Rattus norvegicus
tgaggtctaaaccacattgccgcct

SEQ ID NO: 612336 - DNA, 25 bp, Rattus norvegicus
tgaggtctaaacgacattgccgcct

SEQ ID NO: 612337 - DNA, 25 bp, Rattus norvegicus
tgaggtctaggtatattttgctgta

SEQ ID NO: 612338 - DNA, 25 bp, Rattus norvegicus
tgaggtctaggtttattttgctgta

SEQ ID NO: 612339 - DNA, 25 bp, Rattus norvegicus
tgaggtctcaccaaattttctaatt

SEQ ID NO: 612340 - DNA, 25 bp, Rattus norvegicus
tgaggtctcaccacattctagagcg

SEQ ID NO: 612341 - DNA, 25 bp, Rattus norvegicus
tgaggtctcacctaattttctaatt

SEQ ID NO: 612342 - DNA, 25 bp, Rattus norvegicus
tgaggtctcacctcattctagagcg

SEQ ID NO: 612343 - DNA, 25 bp, Rattus norvegicus
tgaggtctcactccgacttcatgat

SEQ ID NO: 612344 - DNA, 25 bp, Rattus norvegicus
tgaggtctcactgcgacttcatgat

SEQ ID NO: 612345 - DNA, 25 bp, Rattus norvegicus
tgaggtctccaacatcgcacaggct

SEQ ID NO: 612346 - DNA, 25 bp, Rattus norvegicus
tgaggtctccaagatcgcacaggct

SEQ ID NO: 612347 - DNA, 25 bp, Rattus norvegicus
tgaggtctccacaatgatctccaga

SEQ ID NO: 612348 - DNA, 25 bp, Rattus norvegicus
tgaggtctccactatgatctccaga

SEQ ID NO: 612349 - DNA, 25 bp, Rattus norvegicus
tgaggtctccccacaactcagtaaa

SEQ ID NO: 612350 - DNA, 25 bp, Rattus norvegicus
tgaggtctcccctcaactcagtaaa

SEQ ID NO: 612351 - DNA, 25 bp, Rattus norvegicus
tgaggtctccctatgtgcattacat

SEQ ID NO: 612352 - DNA, 25 bp, Rattus norvegicus
tgaggtctccctttgtgcattacat

SEQ ID NO: 612353 - DNA, 25 bp, Rattus norvegicus
tgaggtctcctacaagaaccccggt

SEQ ID NO: 612354 - DNA, 25 bp, Rattus norvegicus
tgaggtctcctagaagaaccccggt

SEQ ID NO: 612355 - DNA, 25 bp, Rattus norvegicus
tgaggtctgagcagcaagtcccaca

SEQ ID NO: 612356 - DNA, 25 bp, Rattus norvegicus
tgaggtctgagctgcaagtcccaca

SEQ ID NO: 612357 - DNA, 25 bp, Rattus norvegicus
tgaggtctgaggacactgccttgta

SEQ ID NO: 612358 - DNA, 25 bp, Rattus norvegicus
tgaggtctgaggtcactgccttgta

SEQ ID NO: 612359 - DNA, 25 bp, Rattus norvegicus
tgaggtctggccatcaggctgctgc

SEQ ID NO: 612360 - DNA, 25 bp, Rattus norvegicus
tgaggtctggccttcaggctgctgc

SEQ ID NO: 612361 - DNA, 25 bp, Rattus norvegicus
tgaggtctggctcagcccttcaaat

SEQ ID NO: 612362 - DNA, 25 bp, Rattus norvegicus
tgaggtctggctcccgatacataat

SEQ ID NO: 612363 - DNA, 25 bp, Rattus norvegicus
tgaggtctggctgagcccttcaaat

SEQ ID NO: 612364 - DNA, 25 bp, Rattus norvegicus
tgaggtctggctgccgatacataat

SEQ ID NO: 612365 - DNA, 25 bp, Rattus norvegicus
tgaggtctggttatttgggctgcaa

SEQ ID NO: 612366 - DNA, 25 bp, Rattus norvegicus
tgaggtctggttttttgggctgcaa

SEQ ID NO: 612367 - DNA, 25 bp, Rattus norvegicus
tgaggtctgtctactctgctaggca

SEQ ID NO: 612368 - DNA, 25 bp, Rattus norvegicus
tgaggtctgtcttctctgctaggca

SEQ ID NO: 612369 - DNA, 25 bp, Rattus norvegicus
tgaggtcttcatcaagctggatgga

SEQ ID NO: 612370 - DNA, 25 bp, Rattus norvegicus
tgaggtcttcatgaagctggatgga

SEQ ID NO: 612371 - DNA, 25 bp, Rattus norvegicus
tgaggtcttccaatttagttaaaat

SEQ ID NO: 612372 - DNA, 25 bp, Rattus norvegicus
tgaggtcttccattttagttaaaat

SEQ ID NO: 612373 - DNA, 25 bp, Rattus norvegicus
tgaggtcttgcacccacaattctaa

SEQ ID NO: 612374 - DNA, 25 bp, Rattus norvegicus
tgaggtcttgcagccacaattctaa

SEQ ID NO: 612375 - DNA, 25 bp, Rattus norvegicus
tgaggtcttttacacgtggaattga

SEQ ID NO: 612376 - DNA, 25 bp, Rattus norvegicus
tgaggtcttttagacgtggaattga

SEQ ID NO: 612377 - DNA, 25 bp, Rattus norvegicus
tgaggtgaaatcagctcttgcaaat

SEQ ID NO: 612378 - DNA, 25 bp, Rattus norvegicus
tgaggtgaaatctgctcttgcaaat

SEQ ID NO: 612379 - DNA, 25 bp, Rattus norvegicus
tgaggtgaactcacttctacccgct

SEQ ID NO: 612380 - DNA, 25 bp, Rattus norvegicus
tgaggtgaactctcttctacccgct

SEQ ID NO: 612381 - DNA, 25 bp, Rattus norvegicus
tgaggtgaattgacccctgaaccac

SEQ ID NO: 612382 - DNA, 25 bp, Rattus norvegicus
tgaggtgaattgtcccctgaaccac

SEQ ID NO: 612383 - DNA, 25 bp, Rattus norvegicus
tgaggtgacacactgatagcccctt

SEQ ID NO: 612384 - DNA, 25 bp, Rattus norvegicus
tgaggtgacacagtgatagcccctt

SEQ ID NO: 612385 - DNA, 25 bp, Rattus norvegicus
tgaggtgaccaccatcgtagtggct

SEQ ID NO: 612386 - DNA, 25 bp, Rattus norvegicus
tgaggtgaccacgatcgtagtggct

SEQ ID NO: 612387 - DNA, 25 bp, Rattus norvegicus
tgaggtgagactccagctgcttcta

SEQ ID NO: 612388 - DNA, 25 bp, Rattus norvegicus
tgaggtgagactgcagctgcttcta

SEQ ID NO: 612389 - DNA, 25 bp, Rattus norvegicus
tgaggtgaggagacctttcgcctgc

SEQ ID NO: 612390 - DNA, 25 bp, Rattus norvegicus
tgaggtgaggagtcctttcgcctgc

SEQ ID NO: 612391 - DNA, 25 bp, Rattus norvegicus
tgaggtgatggtcaccctcctcttc

SEQ ID NO: 612392 - DNA, 25 bp, Rattus norvegicus
tgaggtgatggtgaccctcctcttc

SEQ ID NO: 612393 - DNA, 25 bp, Rattus norvegicus
tgaggtgcacctagctgtgtcgctt

SEQ ID NO: 612394 - DNA, 25 bp, Rattus norvegicus
tgaggtgcaccttgctgtgtcgctt

SEQ ID NO: 612395 - DNA, 25 bp, Rattus norvegicus
tgaggtgcattgagagctgtttcca

SEQ ID NO: 612396 - DNA, 25 bp, Rattus norvegicus
tgaggtgcattgtgagctgtttcca

SEQ ID NO: 612397 - DNA, 25 bp, Rattus norvegicus
tgaggtgccagaaaccatcaacaaa

SEQ ID NO: 612398 - DNA, 25 bp, Rattus norvegicus
tgaggtgccagataccatcaacaaa

SEQ ID NO: 612399 - DNA, 25 bp, Rattus norvegicus
tgaggtgcccgcagtgtccctagcg

SEQ ID NO: 612400 - DNA, 25 bp, Rattus norvegicus
tgaggtgcccgctgtgtccctagcg

SEQ ID NO: 612401 - DNA, 25 bp, Rattus norvegicus
tgaggtgcctgcacaggtgctatat

SEQ ID NO: 612402 - DNA, 25 bp, Rattus norvegicus
tgaggtgcctgctcaggtgctatat

SEQ ID NO: 612403 - DNA, 25 bp, Rattus norvegicus
tgaggtgctgcccaaggactccacc

SEQ ID NO: 612404 - DNA, 25 bp, Rattus norvegicus
tgaggtgctgccgaaggactccacc

SEQ ID NO: 612405 - DNA, 25 bp, Rattus norvegicus
tgaggtggagccctccctggtcttc

SEQ ID NO: 612406 - DNA, 25 bp, Rattus norvegicus
tgaggtggagccgtccctggtcttc

SEQ ID NO: 612407 - DNA, 25 bp, Rattus norvegicus
tgaggtggagtcaggagccttcctc

SEQ ID NO: 612408 - DNA, 25 bp, Rattus norvegicus
tgaggtggagtctggagccttcctc

SEQ ID NO: 612409 - DNA, 25 bp, Rattus norvegicus
tgaggtggcaacaaagctacgctta

SEQ ID NO: 612410 - DNA, 25 bp, Rattus norvegicus
tgaggtggcaactaagctacgctta

SEQ ID NO: 612411 - DNA, 25 bp, Rattus norvegicus
tgaggtggcgctcgagacagagtct

SEQ ID NO: 612412 - DNA, 25 bp, Rattus norvegicus
tgaggtggcgctggagacagagtct

SEQ ID NO: 612413 - DNA, 25 bp, Rattus norvegicus
tgaggtggctatctgtgctcatcaa

SEQ ID NO: 612414 - DNA, 25 bp, Rattus norvegicus
tgaggtggctatgtgtgctcatcaa

SEQ ID NO: 612415 - DNA, 25 bp, Rattus norvegicus
tgaggtgggattagtaatcaacaat

SEQ ID NO: 612416 - DNA, 25 bp, Rattus norvegicus
tgaggtgggatttgtaatcaacaat

SEQ ID NO: 612417 - DNA, 25 bp, Rattus norvegicus
tgaggtggtctcagggctcttctgc

SEQ ID NO: 612418 - DNA, 25 bp, Rattus norvegicus
tgaggtggtctctgggctcttctgc

SEQ ID NO: 612419 - DNA, 25 bp, Rattus norvegicus
tgaggtgtagccactggacacagct

SEQ ID NO: 612420 - DNA, 25 bp, Rattus norvegicus
tgaggtgtagcctctggacacagct

SEQ ID NO: 612421 - DNA, 25 bp, Rattus norvegicus
tgaggtgtatagaggcccctttctc

SEQ ID NO: 612422 - DNA, 25 bp, Rattus norvegicus
tgaggtgtatagtggcccctttctc

SEQ ID NO: 612423 - DNA, 25 bp, Rattus norvegicus
tgaggtgtccgtcttaacatctaac

SEQ ID NO: 612424 - DNA, 25 bp, Rattus norvegicus
tgaggtgtccgtgttaacatctaac

SEQ ID NO: 612425 - DNA, 25 bp, Rattus norvegicus
tgaggtgtgaccagtttggatttga

SEQ ID NO: 612426 - DNA, 25 bp, Rattus norvegicus
tgaggtgtgacctgtttggatttga

SEQ ID NO: 612427 - DNA, 25 bp, Rattus norvegicus
tgaggtgtgagaattctacttgaaa

SEQ ID NO: 612428 - DNA, 25 bp, Rattus norvegicus
tgaggtgtgagatttctacttgaaa

SEQ ID NO: 612429 - DNA, 25 bp, Rattus norvegicus
tgaggtgtgcagaccctgagtcata

SEQ ID NO: 612430 - DNA, 25 bp, Rattus norvegicus
tgaggtgtgcagtccctgagtcata

SEQ ID NO: 612431 - DNA, 25 bp, Rattus norvegicus
tgaggtgtggccatgctcctaaacc

SEQ ID NO: 612432 - DNA, 25 bp, Rattus norvegicus
tgaggtgtggccttgctcctaaacc

SEQ ID NO: 612433 - DNA, 25 bp, Rattus norvegicus
tgaggtgtgtttacgttttatttct

SEQ ID NO: 612434 - DNA, 25 bp, Rattus norvegicus
tgaggtgtgttttcgttttatttct

SEQ ID NO: 612435 - DNA, 25 bp, Rattus norvegicus
tgaggtgttcctaacgtttctgggt

SEQ ID NO: 612436 - DNA, 25 bp, Rattus norvegicus
tgaggtgttccttacgtttctgggt

SEQ ID NO: 612437 - DNA, 25 bp, Rattus norvegicus
tgaggttaagcaaaggttcctataa

SEQ ID NO: 612438 - DNA, 25 bp, Rattus norvegicus
tgaggttaagcataggttcctataa

SEQ ID NO: 612439 - DNA, 25 bp, Rattus norvegicus
tgaggttactggcagctttggttcc

SEQ ID NO: 612440 - DNA, 25 bp, Rattus norvegicus
tgaggttactgggagctttggttcc

SEQ ID NO: 612441 - DNA, 25 bp, Rattus norvegicus
tgaggttagccacctgggacaccca

SEQ ID NO: 612442 - DNA, 25 bp, Rattus norvegicus
tgaggttagccagctgggacaccca

SEQ ID NO: 612443 - DNA, 25 bp, Rattus norvegicus
tgaggttatcttataaccctgtatt

SEQ ID NO: 612444 - DNA, 25 bp, Rattus norvegicus
tgaggttatcttttaaccctgtatt

SEQ ID NO: 612445 - DNA, 25 bp, Rattus norvegicus
tgaggttcaaaacccgtgaccttga

SEQ ID NO: 612446 - DNA, 25 bp, Rattus norvegicus
tgaggttcaaaagccgtgaccttga

SEQ ID NO: 612447 - DNA, 25 bp, Rattus norvegicus
tgaggttcaaacattcttccaccga

SEQ ID NO: 612448 - DNA, 25 bp, Rattus norvegicus
tgaggttcaaactttcttccaccga

SEQ ID NO: 612449 - DNA, 25 bp, Rattus norvegicus
tgaggttcacggcacaggtacatgt

SEQ ID NO: 612450 - DNA, 25 bp, Rattus norvegicus
tgaggttcacgggacaggtacatgt

SEQ ID NO: 612451 - DNA, 25 bp, Rattus norvegicus
tgaggttcactcactccagctgaat

SEQ ID NO: 612452 - DNA, 25 bp, Rattus norvegicus
tgaggttcactctctccagctgaat

SEQ ID NO: 612453 - DNA, 25 bp, Rattus norvegicus
tgaggttccacacaccaggttataa

SEQ ID NO: 612454 - DNA, 25 bp, Rattus norvegicus
tgaggttccacagaccaggttataa

SEQ ID NO: 612455 - DNA, 25 bp, Rattus norvegicus
tgaggttccactcattgtctcgtga

SEQ ID NO: 612456 - DNA, 25 bp, Rattus norvegicus
tgaggttccactgattgtctcgtga

SEQ ID NO: 612457 - DNA, 25 bp, Rattus norvegicus
tgaggttcccatcccagtcaagagg

SEQ ID NO: 612458 - DNA, 25 bp, Rattus norvegicus
tgaggttcccatgccagtcaagagg

SEQ ID NO: 612459 - DNA, 25 bp, Rattus norvegicus
tgaggttccctccttctgggtgttc

SEQ ID NO: 612460 - DNA, 25 bp, Rattus norvegicus
tgaggttccctcgttctgggtgttc

SEQ ID NO: 612461 - DNA, 25 bp, Rattus norvegicus
tgaggttcctctccagggttcaaag

SEQ ID NO: 612462 - DNA, 25 bp, Rattus norvegicus
tgaggttcctctgcagggttcaaag

SEQ ID NO: 612463 - DNA, 25 bp, Rattus norvegicus
tgaggttctaacaccatcacacctg

SEQ ID NO: 612464 - DNA, 25 bp, Rattus norvegicus
tgaggttctaactccatcacacctg

SEQ ID NO: 612465 - DNA, 25 bp, Rattus norvegicus
tgaggttctcagcagcagcccagga

SEQ ID NO: 612466 - DNA, 25 bp, Rattus norvegicus
tgaggttctcaggagcagcccagga

SEQ ID NO: 612467 - DNA, 25 bp, Rattus norvegicus
tgaggttctgaacccttatccaaga

SEQ ID NO: 612468 - DNA, 25 bp, Rattus norvegicus
tgaggttctgaagccttatccaaga

SEQ ID NO: 612469 - DNA, 25 bp, Rattus norvegicus
tgaggttctgatcagggccacaccc

SEQ ID NO: 612470 - DNA, 25 bp, Rattus norvegicus
tgaggttctgatgagggccacaccc

SEQ ID NO: 612471 - DNA, 25 bp, Rattus norvegicus
tgaggttctgtcaagcgctagtgct

SEQ ID NO: 612472 - DNA, 25 bp, Rattus norvegicus
tgaggttctgtctagcgctagtgct

SEQ ID NO: 612473 - DNA, 25 bp, Rattus norvegicus
tgaggttgacctcggagccgccaca

SEQ ID NO: 612474 - DNA, 25 bp, Rattus norvegicus
tgaggttgacctgggagccgccaca

SEQ ID NO: 612475 - DNA, 25 bp, Rattus norvegicus
tgaggttgacggactgtgccttact

SEQ ID NO: 612476 - DNA, 25 bp, Rattus norvegicus
tgaggttgacggtctgtgccttact

SEQ ID NO: 612477 - DNA, 25 bp, Rattus norvegicus
tgaggttgagtaccatgtgctccaa

SEQ ID NO: 612478 - DNA, 25 bp, Rattus norvegicus
tgaggttgagtagcatgtgctccaa

SEQ ID NO: 612479 - DNA, 25 bp, Rattus norvegicus
tgaggttgcccgctaaatctccatt

SEQ ID NO: 612480 - DNA, 25 bp, Rattus norvegicus
tgaggttgcccggtaaatctccatt

SEQ ID NO: 612481 - DNA, 25 bp, Rattus norvegicus
tgaggttgctttactgtgcaccgac

SEQ ID NO: 612482 - DNA, 25 bp, Rattus norvegicus
tgaggttgcttttctgtgcaccgac

SEQ ID NO: 612483 - DNA, 25 bp, Rattus norvegicus
tgaggttggctgacacactcctggg

SEQ ID NO: 612484 - DNA, 25 bp, Rattus norvegicus
tgaggttggctgtcacactcctggg

SEQ ID NO: 612485 - DNA, 25 bp, Rattus norvegicus
tgaggttggtgtcccatcttttaaa

SEQ ID NO: 612486 - DNA, 25 bp, Rattus norvegicus
tgaggttggtgtgccatcttttaaa

SEQ ID NO: 612487 - DNA, 25 bp, Rattus norvegicus
tgaggttggttcaccctgaaaacgt

SEQ ID NO: 612488 - DNA, 25 bp, Rattus norvegicus
tgaggttggttctccctgaaaacgt

SEQ ID NO: 612489 - DNA, 25 bp, Rattus norvegicus
tgaggttgtcacattggtactgagt

SEQ ID NO: 612490 - DNA, 25 bp, Rattus norvegicus
tgaggttgtcactttggtactgagt

SEQ ID NO: 612491 - DNA, 25 bp, Rattus norvegicus
tgaggttgtccgacttactaagcag

SEQ ID NO: 612492 - DNA, 25 bp, Rattus norvegicus
tgaggttgtccgtcttactaagcag

SEQ ID NO: 612493 - DNA, 25 bp, Rattus norvegicus
tgaggttgtggaaactctccctacc

SEQ ID NO: 612494 - DNA, 25 bp, Rattus norvegicus
tgaggttgtggatactctccctacc

SEQ ID NO: 612495 - DNA, 25 bp, Rattus norvegicus
tgaggttgttgcctcccctgggcca

SEQ ID NO: 612496 - DNA, 25 bp, Rattus norvegicus
tgaggttgttgcgtcccctgggcca

SEQ ID NO: 612497 - DNA, 25 bp, Rattus norvegicus
tgaggttgttgtcccccgtgaccag

SEQ ID NO: 612498 - DNA, 25 bp, Rattus norvegicus
tgaggttgttgtgccccgtgaccag

SEQ ID NO: 612499 - DNA, 25 bp, Rattus norvegicus
tgaggtttactaccacgttcttttt

SEQ ID NO: 612500 - DNA, 25 bp, Rattus norvegicus
tgaggtttactagcacgttcttttt

SEQ ID NO: 612501 - DNA, 25 bp, Rattus norvegicus
tgaggtttaggcaagttctcttccc

SEQ ID NO: 612502 - DNA, 25 bp, Rattus norvegicus
tgaggtttaggctagttctcttccc

SEQ ID NO: 612503 - DNA, 25 bp, Rattus norvegicus
tgaggtttcagaccaagtgcccctt

SEQ ID NO: 612504 - DNA, 25 bp, Rattus norvegicus
tgaggtttcagagcaagtgcccctt

SEQ ID NO: 612505 - DNA, 25 bp, Rattus norvegicus
tgaggtttctctataatgcatttag

SEQ ID NO: 612506 - DNA, 25 bp, Rattus norvegicus
tgaggtttctctcccagagttcctg

SEQ ID NO: 612507 - DNA, 25 bp, Rattus norvegicus
tgaggtttctctgccagagttcctg

SEQ ID NO: 612508 - DNA, 25 bp, Rattus norvegicus
tgaggtttctctttaatgcatttag

SEQ ID NO: 612509 - DNA, 25 bp, Rattus norvegicus
tgaggtttgggacaccctcttccca

SEQ ID NO: 612510 - DNA, 25 bp, Rattus norvegicus
tgaggtttgggagaccctcttccca

SEQ ID NO: 612511 - DNA, 25 bp, Rattus norvegicus
tgaggtttgtccagaggcggcatgt

SEQ ID NO: 612512 - DNA, 25 bp, Rattus norvegicus
tgaggtttgtcctgaggcggcatgt

SEQ ID NO: 612513 - DNA, 25 bp, Rattus norvegicus
tgaggtttgtctctcctgggaacgt

SEQ ID NO: 612514 - DNA, 25 bp, Rattus norvegicus
tgaggtttgtctgtcctgggaacgt

SEQ ID NO: 612515 - DNA, 25 bp, Rattus norvegicus
tgaggttttgacacgccattttcgc

SEQ ID NO: 612516 - DNA, 25 bp, Rattus norvegicus
tgaggttttgactcgccattttcgc

SEQ ID NO: 612517 - DNA, 25 bp, Rattus norvegicus
tgaggtttttgccattctgaacaag

SEQ ID NO: 612518 - DNA, 25 bp, Rattus norvegicus
tgaggtttttgcgattctgaacaag

SEQ ID NO: 612519 - DNA, 25 bp, Rattus norvegicus
tgagtaaaacgtccttcatcatggt

SEQ ID NO: 612520 - DNA, 25 bp, Rattus norvegicus
tgagtaaaacgtgcttcatcatggt

SEQ ID NO: 612521 - DNA, 25 bp, Rattus norvegicus
tgagtaaaagcccttccttccagga

SEQ ID NO: 612522 - DNA, 25 bp, Rattus norvegicus
tgagtaaaagccgttccttccagga

SEQ ID NO: 612523 - DNA, 25 bp, Rattus norvegicus
tgagtaaacccactcctttcaattt

SEQ ID NO: 612524 - DNA, 25 bp, Rattus norvegicus
tgagtaaacccagtcctttcaattt

SEQ ID NO: 612525 - DNA, 25 bp, Rattus norvegicus
tgagtaaagccaattcagcttcccc

SEQ ID NO: 612526 - DNA, 25 bp, Rattus norvegicus
tgagtaaagccatttcagcttcccc

SEQ ID NO: 612527 - DNA, 25 bp, Rattus norvegicus
tgagtaaataacaccagcttcctga

SEQ ID NO: 612528 - DNA, 25 bp, Rattus norvegicus
tgagtaaataactccagcttcctga

SEQ ID NO: 612529 - DNA, 25 bp, Rattus norvegicus
tgagtaaattctcctgggacagcct

SEQ ID NO: 612530 - DNA, 25 bp, Rattus norvegicus
tgagtaaattctgctgggacagcct

SEQ ID NO: 612531 - DNA, 25 bp, Rattus norvegicus
tgagtaacaattacaccatccccaa

SEQ ID NO: 612532 - DNA, 25 bp, Rattus norvegicus
tgagtaacaatttcaccatccccaa

SEQ ID NO: 612533 - DNA, 25 bp, Rattus norvegicus
tgagtaacagtgactgcctcgcctg

SEQ ID NO: 612534 - DNA, 25 bp, Rattus norvegicus
tgagtaacagtgtctgcctcgcctg

SEQ ID NO: 612535 - DNA, 25 bp, Rattus norvegicus
tgagtaacatcgatgtcttccccta

SEQ ID NO: 612536 - DNA, 25 bp, Rattus norvegicus
tgagtaacatcgttgtcttccccta

SEQ ID NO: 612537 - DNA, 25 bp, Rattus norvegicus
tgagtaactgcacctgtagacctgt

SEQ ID NO: 612538 - DNA, 25 bp, Rattus norvegicus
tgagtaactgcagctgtagacctgt

SEQ ID NO: 612539 - DNA, 25 bp, Rattus norvegicus
tgagtaagctctcggtttcctgccg

SEQ ID NO: 612540 - DNA, 25 bp, Rattus norvegicus
tgagtaagctctgggtttcctgccg

SEQ ID NO: 612541 - DNA, 25 bp, Rattus norvegicus
tgagtaatccgcctgggttgtcgct

SEQ ID NO: 612542 - DNA, 25 bp, Rattus norvegicus
tgagtaatccgcgtgggttgtcgct

SEQ ID NO: 612543 - DNA, 25 bp, Rattus norvegicus
tgagtaatctttcctacatcccttc

SEQ ID NO: 612544 - DNA, 25 bp, Rattus norvegicus
tgagtaatctttgctacatcccttc

SEQ ID NO: 612545 - DNA, 25 bp, Rattus norvegicus
tgagtaattcctactgttcgcaaac

SEQ ID NO: 612546 - DNA, 25 bp, Rattus norvegicus
tgagtaattccttctgttcgcaaac

SEQ ID NO: 612547 - DNA, 25 bp, Rattus norvegicus
tgagtaattgttcttcagcctctcc

SEQ ID NO: 612548 - DNA, 25 bp, Rattus norvegicus
tgagtaattgttgttcagcctctcc

SEQ ID NO: 612549 - DNA, 25 bp, Rattus norvegicus
tgagtacagcgtagcccaccataaa

SEQ ID NO: 612550 - DNA, 25 bp, Rattus norvegicus
tgagtacagcgttgcccaccataaa

SEQ ID NO: 612551 - DNA, 25 bp, Rattus norvegicus
tgagtacatgctccctttcgaggaa

SEQ ID NO: 612552 - DNA, 25 bp, Rattus norvegicus
tgagtacatgctgcctttcgaggaa

SEQ ID NO: 612553 - DNA, 25 bp, Rattus norvegicus
tgagtacattcaccactaggcctag

SEQ ID NO: 612554 - DNA, 25 bp, Rattus norvegicus
tgagtacattcagcactaggcctag

SEQ ID NO: 612555 - DNA, 25 bp, Rattus norvegicus
tgagtaccacgtcctgtttaccagt

SEQ ID NO: 612556 - DNA, 25 bp, Rattus norvegicus
tgagtaccacgtgctgtttaccagt

SEQ ID NO: 612557 - DNA, 25 bp, Rattus norvegicus
tgagtaccattcctattcaccatat

SEQ ID NO: 612558 - DNA, 25 bp, Rattus norvegicus
tgagtaccattcgtattcaccatat

SEQ ID NO: 612559 - DNA, 25 bp, Rattus norvegicus
tgagtacccacaaggctaaccagat

SEQ ID NO: 612560 - DNA, 25 bp, Rattus norvegicus
tgagtacccacatggctaaccagat

SEQ ID NO: 612561 - DNA, 25 bp, Rattus norvegicus
tgagtacccagcctacaacttgctg

SEQ ID NO: 612562 - DNA, 25 bp, Rattus norvegicus
tgagtacccagcgtacaacttgctg

SEQ ID NO: 612563 - DNA, 25 bp, Rattus norvegicus
tgagtacccattacccagagttaag

SEQ ID NO: 612564 - DNA, 25 bp, Rattus norvegicus
tgagtacccatttcccagagttaag

SEQ ID NO: 612565 - DNA, 25 bp, Rattus norvegicus
tgagtacccgacatggctgttccag

SEQ ID NO: 612566 - DNA, 25 bp, Rattus norvegicus
tgagtacccgacttggctgttccag

SEQ ID NO: 612567 - DNA, 25 bp, Rattus norvegicus
tgagtaccttgcacagtgaccccag

SEQ ID NO: 612568 - DNA, 25 bp, Rattus norvegicus
tgagtaccttgctcagtgaccccag

SEQ ID NO: 612569 - DNA, 25 bp, Rattus norvegicus
tgagtacggagacccacttgcttta

SEQ ID NO: 612570 - DNA, 25 bp, Rattus norvegicus
tgagtacggagagccacttgcttta

SEQ ID NO: 612571 - DNA, 25 bp, Rattus norvegicus
tgagtacgtgaaagagcccctttat

SEQ ID NO: 612572 - DNA, 25 bp, Rattus norvegicus
tgagtacgtgaatgagcccctttat

SEQ ID NO: 612573 - DNA, 25 bp, Rattus norvegicus
tgagtacgtgctccaaactctgcct

SEQ ID NO: 612574 - DNA, 25 bp, Rattus norvegicus
tgagtacgtgctgcaaactctgcct

SEQ ID NO: 612575 - DNA, 25 bp, Rattus norvegicus
tgagtactcttacagcttccctgag

SEQ ID NO: 612576 - DNA, 25 bp, Rattus norvegicus
tgagtactcttagagcttccctgag

SEQ ID NO: 612577 - DNA, 25 bp, Rattus norvegicus
tgagtactgcgactaaacggtggcc

SEQ ID NO: 612578 - DNA, 25 bp, Rattus norvegicus
tgagtactgcgagtaaacggtggcc

SEQ ID NO: 612579 - DNA, 25 bp, Rattus norvegicus
tgagtactgggccacactgtgccaa

SEQ ID NO: 612580 - DNA, 25 bp, Rattus norvegicus
tgagtactgggcgacactgtgccaa

SEQ ID NO: 612581 - DNA, 25 bp, Rattus norvegicus
tgagtacttcttctccgatgggatc

SEQ ID NO: 612582 - DNA, 25 bp, Rattus norvegicus
tgagtacttcttgtccgatgggatc

SEQ ID NO: 612583 - DNA, 25 bp, Rattus norvegicus
tgagtactttctaaccctttcttga

SEQ ID NO: 612584 - DNA, 25 bp, Rattus norvegicus
tgagtactttcttaccctttcttga

SEQ ID NO: 612585 - DNA, 25 bp, Rattus norvegicus
tgagtagactcacacagaacccctt

SEQ ID NO: 612586 - DNA, 25 bp, Rattus norvegicus
tgagtagactcagacagaacccctt

SEQ ID NO: 612587 - DNA, 25 bp, Rattus norvegicus
tgagtagatgctatcaaatatcccc

SEQ ID NO: 612588 - DNA, 25 bp, Rattus norvegicus
tgagtagatgctttcaaatatcccc

SEQ ID NO: 612589 - DNA, 25 bp, Rattus norvegicus
tgagtagcagggaccatccgttcat

SEQ ID NO: 612590 - DNA, 25 bp, Rattus norvegicus
tgagtagcagggtccatccgttcat

SEQ ID NO: 612591 - DNA, 25 bp, Rattus norvegicus
tgagtagcatccagtgtgtgtgtgt

SEQ ID NO: 612592 - DNA, 25 bp, Rattus norvegicus
tgagtagcatcctgtgtgtgtgtgt

SEQ ID NO: 612593 - DNA, 25 bp, Rattus norvegicus
tgagtagccgtcaatcacacagatt

SEQ ID NO: 612594 - DNA, 25 bp, Rattus norvegicus
tgagtagccgtctatcacacagatt

SEQ ID NO: 612595 - DNA, 25 bp, Rattus norvegicus
tgagtaggatataagcacacagaat

SEQ ID NO: 612596 - DNA, 25 bp, Rattus norvegicus
tgagtaggatattagcacacagaat

SEQ ID NO: 612597 - DNA, 25 bp, Rattus norvegicus
tgagtaggatccaggatgtccgcct

SEQ ID NO: 612598 - DNA, 25 bp, Rattus norvegicus
tgagtaggatcctggatgtccgcct

SEQ ID NO: 612599 - DNA, 25 bp, Rattus norvegicus
tgagtagtgggtaaaccaaactata

SEQ ID NO: 612600 - DNA, 25 bp, Rattus norvegicus
tgagtagtgggttaaccaaactata

SEQ ID NO: 612601 - DNA, 25 bp, Rattus norvegicus
tgagtatatgcaaacatacctatat

SEQ ID NO: 612602 - DNA, 25 bp, Rattus norvegicus
tgagtatatgcatacatacctatat

SEQ ID NO: 612603 - DNA, 25 bp, Rattus norvegicus
tgagtatccacgatgctcctctgaa

SEQ ID NO: 612604 - DNA, 25 bp, Rattus norvegicus
tgagtatccacgttgctcctctgaa

SEQ ID NO: 612605 - DNA, 25 bp, Rattus norvegicus
tgagtatccaggaccttgggcagga

SEQ ID NO: 612606 - DNA, 25 bp, Rattus norvegicus
tgagtatccaggtccttgggcagga

SEQ ID NO: 612607 - DNA, 25 bp, Rattus norvegicus
tgagtatccttcacacagtcccttg

SEQ ID NO: 612608 - DNA, 25 bp, Rattus norvegicus
tgagtatccttctcacagtcccttg

SEQ ID NO: 612609 - DNA, 25 bp, Rattus norvegicus
tgagtatctcttccgagtccctgaa

SEQ ID NO: 612610 - DNA, 25 bp, Rattus norvegicus
tgagtatctcttgcgagtccctgaa

SEQ ID NO: 612611 - DNA, 25 bp, Rattus norvegicus
tgagtatgactcacatctcactact

SEQ ID NO: 612612 - DNA, 25 bp, Rattus norvegicus
tgagtatgactctcatctcactact

SEQ ID NO: 612613 - DNA, 25 bp, Rattus norvegicus
tgagtatgtcgtcgagtctactggc

SEQ ID NO: 612614 - DNA, 25 bp, Rattus norvegicus
tgagtatgtcgtggagtctactggc

SEQ ID NO: 612615 - DNA, 25 bp, Rattus norvegicus
tgagtattatgccaacctcctgtaa

SEQ ID NO: 612616 - DNA, 25 bp, Rattus norvegicus
tgagtattatgcgaacctcctgtaa

SEQ ID NO: 612617 - DNA, 25 bp, Rattus norvegicus
tgagtattggccaagcacgcaagat

SEQ ID NO: 612618 - DNA, 25 bp, Rattus norvegicus
tgagtattggcctagcacgcaagat

SEQ ID NO: 612619 - DNA, 25 bp, Rattus norvegicus
tgagtattggtcagtgtcctccctc

SEQ ID NO: 612620 - DNA, 25 bp, Rattus norvegicus
tgagtattggtctgtgtcctccctc

SEQ ID NO: 612621 - DNA, 25 bp, Rattus norvegicus
tgagtatttcagcatggtcatagac

SEQ ID NO: 612622 - DNA, 25 bp, Rattus norvegicus
tgagtatttcaggatggtcatagac

SEQ ID NO: 612623 - DNA, 25 bp, Rattus norvegicus
tgagtcaaccccaggcacgggcaca

SEQ ID NO: 612624 - DNA, 25 bp, Rattus norvegicus
tgagtcaacccctggcacgggcaca

SEQ ID NO: 612625 - DNA, 25 bp, Rattus norvegicus
tgagtcaacctgaccgcctgggcaa

SEQ ID NO: 612626 - DNA, 25 bp, Rattus norvegicus
tgagtcaacctgtccgcctgggcaa

SEQ ID NO: 612627 - DNA, 25 bp, Rattus norvegicus
tgagtcaacgtccattcatcgtcag

SEQ ID NO: 612628 - DNA, 25 bp, Rattus norvegicus
tgagtcaacgtcgattcatcgtcag

SEQ ID NO: 612629 - DNA, 25 bp, Rattus norvegicus
tgagtcaactctcgtctggtgctgc

SEQ ID NO: 612630 - DNA, 25 bp, Rattus norvegicus
tgagtcaactctctgccaccaagtt

SEQ ID NO: 612631 - DNA, 25 bp, Rattus norvegicus
tgagtcaactctggtctggtgctgc

SEQ ID NO: 612632 - DNA, 25 bp, Rattus norvegicus
tgagtcaactctgtgccaccaagtt

SEQ ID NO: 612633 - DNA, 25 bp, Rattus norvegicus
tgagtcaagccaactttctcctaag

SEQ ID NO: 612634 - DNA, 25 bp, Rattus norvegicus
tgagtcaagccatctttctcctaag

SEQ ID NO: 612635 - DNA, 25 bp, Rattus norvegicus
tgagtcaagctgacttgggcactaa

SEQ ID NO: 612636 - DNA, 25 bp, Rattus norvegicus
tgagtcaagctgtcttgggcactaa

SEQ ID NO: 612637 - DNA, 25 bp, Rattus norvegicus
tgagtcaaggccacctaggcaatat

SEQ ID NO: 612638 - DNA, 25 bp, Rattus norvegicus
tgagtcaaggcctcctaggcaatat

SEQ ID NO: 612639 - DNA, 25 bp, Rattus norvegicus
tgagtcacagccaacttagtttggg

SEQ ID NO: 612640 - DNA, 25 bp, Rattus norvegicus
tgagtcacagccagcctttgaggta

SEQ ID NO: 612641 - DNA, 25 bp, Rattus norvegicus
tgagtcacagcctacttagtttggg

SEQ ID NO: 612642 - DNA, 25 bp, Rattus norvegicus
tgagtcacagcctgcctttgaggta

SEQ ID NO: 612643 - DNA, 25 bp, Rattus norvegicus
tgagtcacagttcagggatgccctt

SEQ ID NO: 612644 - DNA, 25 bp, Rattus norvegicus
tgagtcacagttgagggatgccctt

SEQ ID NO: 612645 - DNA, 25 bp, Rattus norvegicus
tgagtcacattcactttctgacgtt

SEQ ID NO: 612646 - DNA, 25 bp, Rattus norvegicus
tgagtcacattctctttctgacgtt

SEQ ID NO: 612647 - DNA, 25 bp, Rattus norvegicus
tgagtcaccaagcaaccctgatcgc

SEQ ID NO: 612648 - DNA, 25 bp, Rattus norvegicus
tgagtcaccaaggaaccctgatcgc

SEQ ID NO: 612649 - DNA, 25 bp, Rattus norvegicus
tgagtcaccacaatttatttcttag

SEQ ID NO: 612650 - DNA, 25 bp, Rattus norvegicus
tgagtcaccacattttatttcttag

SEQ ID NO: 612651 - DNA, 25 bp, Rattus norvegicus
tgagtcaccgtaagtctgtcctggg

SEQ ID NO: 612652 - DNA, 25 bp, Rattus norvegicus
tgagtcaccgtatgtctgtcctggg

SEQ ID NO: 612653 - DNA, 25 bp, Rattus norvegicus
tgagtcaccgttatcccggaagcat

SEQ ID NO: 612654 - DNA, 25 bp, Rattus norvegicus
tgagtcaccgttttcccggaagcat

SEQ ID NO: 612655 - DNA, 25 bp, Rattus norvegicus
tgagtcacctctctatactgtgatc

SEQ ID NO: 612656 - DNA, 25 bp, Rattus norvegicus
tgagtcacctctgtatactgtgatc

SEQ ID NO: 612657 - DNA, 25 bp, Rattus norvegicus
tgagtcaccttgaagtccctattaa

SEQ ID NO: 612658 - DNA, 25 bp, Rattus norvegicus
tgagtcaccttgtagtccctattaa

SEQ ID NO: 612659 - DNA, 25 bp, Rattus norvegicus
tgagtcacgattaccccttagagag

SEQ ID NO: 612660 - DNA, 25 bp, Rattus norvegicus
tgagtcacgatttccccttagagag

SEQ ID NO: 612661 - DNA, 25 bp, Rattus norvegicus
tgagtcacggcacgtgctggctacc

SEQ ID NO: 612662 - DNA, 25 bp, Rattus norvegicus
tgagtcacggcaggtgctggctacc

SEQ ID NO: 612663 - DNA, 25 bp, Rattus norvegicus
tgagtcacggttaggacctttacga

SEQ ID NO: 612664 - DNA, 25 bp, Rattus norvegicus
tgagtcacggtttggacctttacga

SEQ ID NO: 612665 - DNA, 25 bp, Rattus norvegicus
tgagtcactctacccactattcact

SEQ ID NO: 612666 - DNA, 25 bp, Rattus norvegicus
tgagtcactctagccactattcact

SEQ ID NO: 612667 - DNA, 25 bp, Rattus norvegicus
tgagtcactcttctcggtcaggata

SEQ ID NO: 612668 - DNA, 25 bp, Rattus norvegicus
tgagtcactcttgtcggtcaggata

SEQ ID NO: 612669 - DNA, 25 bp, Rattus norvegicus
tgagtcactgagcatccacacctga

SEQ ID NO: 612670 - DNA, 25 bp, Rattus norvegicus
tgagtcactgaggatccacacctga

SEQ ID NO: 612671 - DNA, 25 bp, Rattus norvegicus
tgagtcaggacccttacttcttctg

SEQ ID NO: 612672 - DNA, 25 bp, Rattus norvegicus
tgagtcaggaccgttacttcttctg

SEQ ID NO: 612673 - DNA, 25 bp, Rattus norvegicus
tgagtcaggcagataccctggccta

SEQ ID NO: 612674 - DNA, 25 bp, Rattus norvegicus
tgagtcaggcagttaccctggccta

SEQ ID NO: 612675 - DNA, 25 bp, Rattus norvegicus
tgagtcagggtcagccaggcatgct

SEQ ID NO: 612676 - DNA, 25 bp, Rattus norvegicus
tgagtcagggtcatattctgtctcc

SEQ ID NO: 612677 - DNA, 25 bp, Rattus norvegicus
tgagtcagggtctgccaggcatgct

SEQ ID NO: 612678 - DNA, 25 bp, Rattus norvegicus
tgagtcagggtcttattctgtctcc

SEQ ID NO: 612679 - DNA, 25 bp, Rattus norvegicus
tgagtcatccccaccgtgagctatg

SEQ ID NO: 612680 - DNA, 25 bp, Rattus norvegicus
tgagtcatcccctccgtgagctatg

SEQ ID NO: 612681 - DNA, 25 bp, Rattus norvegicus
tgagtcatcgcactggcccaataaa

SEQ ID NO: 612682 - DNA, 25 bp, Rattus norvegicus
tgagtcatcgcagtggcccaataaa

SEQ ID NO: 612683 - DNA, 25 bp, Rattus norvegicus
tgagtcatcgccatgccaggtagga

SEQ ID NO: 612684 - DNA, 25 bp, Rattus norvegicus
tgagtcatcgccttgccaggtagga

SEQ ID NO: 612685 - DNA, 25 bp, Rattus norvegicus
tgagtcatgcacacggcagtccctc

SEQ ID NO: 612686 - DNA, 25 bp, Rattus norvegicus
tgagtcatgcactcggcagtccctc

SEQ ID NO: 612687 - DNA, 25 bp, Rattus norvegicus
tgagtcatggccacaggaagctaaa

SEQ ID NO: 612688 - DNA, 25 bp, Rattus norvegicus
tgagtcatggccacttgctggcaaa

SEQ ID NO: 612689 - DNA, 25 bp, Rattus norvegicus
tgagtcatggcctcaggaagctaaa

SEQ ID NO: 612690 - DNA, 25 bp, Rattus norvegicus
tgagtcatggcctcttgctggcaaa

SEQ ID NO: 612691 - DNA, 25 bp, Rattus norvegicus
tgagtcatggttcccgttgctcgga

SEQ ID NO: 612692 - DNA, 25 bp, Rattus norvegicus
tgagtcatggttgccgttgctcgga

SEQ ID NO: 612693 - DNA, 25 bp, Rattus norvegicus
tgagtcattctgacctctcctccat

SEQ ID NO: 612694 - DNA, 25 bp, Rattus norvegicus
tgagtcattctgtcctctcctccat

SEQ ID NO: 612695 - DNA, 25 bp, Rattus norvegicus
tgagtcatttctctcccttgagtaa

SEQ ID NO: 612696 - DNA, 25 bp, Rattus norvegicus
tgagtcatttctgtcccttgagtaa

SEQ ID NO: 612697 - DNA, 25 bp, Rattus norvegicus
tgagtccaagtcatctgtccagtga

SEQ ID NO: 612698 - DNA, 25 bp, Rattus norvegicus
tgagtccaagtcttctgtccagtga

SEQ ID NO: 612699 - DNA, 25 bp, Rattus norvegicus
tgagtccacatgatttttttgttca

SEQ ID NO: 612700 - DNA, 25 bp, Rattus norvegicus
tgagtccacatgttttttttgttca

SEQ ID NO: 612701 - DNA, 25 bp, Rattus norvegicus
tgagtccacattaaccattctgcgt

SEQ ID NO: 612702 - DNA, 25 bp, Rattus norvegicus
tgagtccacatttaccattctgcgt

SEQ ID NO: 612703 - DNA, 25 bp, Rattus norvegicus
tgagtccagaagagatccgggccct

SEQ ID NO: 612704 - DNA, 25 bp, Rattus norvegicus
tgagtccagaagtgatccgggccct

SEQ ID NO: 612705 - DNA, 25 bp, Rattus norvegicus
tgagtccagactctggtatcccctg

SEQ ID NO: 612706 - DNA, 25 bp, Rattus norvegicus
tgagtccagactgtggtatcccctg

SEQ ID NO: 612707 - DNA, 25 bp, Rattus norvegicus
tgagtccagatacctgcacctgaga

SEQ ID NO: 612708 - DNA, 25 bp, Rattus norvegicus
tgagtccagatagctgcacctgaga

SEQ ID NO: 612709 - DNA, 25 bp, Rattus norvegicus
tgagtccaggcgacctatgcagcac

SEQ ID NO: 612710 - DNA, 25 bp, Rattus norvegicus
tgagtccaggcgtcctatgcagcac

SEQ ID NO: 612711 - DNA, 25 bp, Rattus norvegicus
tgagtccagggcagttctaagaccc

SEQ ID NO: 612712 - DNA, 25 bp, Rattus norvegicus
tgagtccagggctgttctaagaccc

SEQ ID NO: 612713 - DNA, 25 bp, Rattus norvegicus
tgagtccatcctatagtcattaaat

SEQ ID NO: 612714 - DNA, 25 bp, Rattus norvegicus
tgagtccatcctttagtcattaaat

SEQ ID NO: 612715 - DNA, 25 bp, Rattus norvegicus
tgagtccattcacgaggatgtccct

SEQ ID NO: 612716 - DNA, 25 bp, Rattus norvegicus
tgagtccattcaggaggatgtccct

SEQ ID NO: 612717 - DNA, 25 bp, Rattus norvegicus
tgagtccattccagacagtacccct

SEQ ID NO: 612718 - DNA, 25 bp, Rattus norvegicus
tgagtccattcctgacagtacccct

SEQ ID NO: 612719 - DNA, 25 bp, Rattus norvegicus
tgagtccatttcacacctttggaat

SEQ ID NO: 612720 - DNA, 25 bp, Rattus norvegicus
tgagtccatttctcacctttggaat

SEQ ID NO: 612721 - DNA, 25 bp, Rattus norvegicus
tgagtcccacaaaacgtcgagtctt

SEQ ID NO: 612722 - DNA, 25 bp, Rattus norvegicus
tgagtcccacaatacgtcgagtctt

SEQ ID NO: 612723 - DNA, 25 bp, Rattus norvegicus
tgagtcccaccaataaagcccctgt

SEQ ID NO: 612724 - DNA, 25 bp, Rattus norvegicus
tgagtcccaccattaaagcccctgt

SEQ ID NO: 612725 - DNA, 25 bp, Rattus norvegicus
tgagtcccacctatgttaaataaca

SEQ ID NO: 612726 - DNA, 25 bp, Rattus norvegicus
tgagtcccacctttgttaaataaca

SEQ ID NO: 612727 - DNA, 25 bp, Rattus norvegicus
tgagtcccaggaagtgcttgctcac

SEQ ID NO: 612728 - DNA, 25 bp, Rattus norvegicus
tgagtcccaggatgtgcttgctcac

SEQ ID NO: 612729 - DNA, 25 bp, Rattus norvegicus
tgagtccccattctcctgataattc

SEQ ID NO: 612730 - DNA, 25 bp, Rattus norvegicus
tgagtccccattgtcctgataattc

SEQ ID NO: 612731 - DNA, 25 bp, Rattus norvegicus
tgagtcccggcccaaagagctgtac

SEQ ID NO: 612732 - DNA, 25 bp, Rattus norvegicus
tgagtcccggccgaaagagctgtac

SEQ ID NO: 612733 - DNA, 25 bp, Rattus norvegicus
tgagtccctcatcgtctttgcagat

SEQ ID NO: 612734 - DNA, 25 bp, Rattus norvegicus
tgagtccctcatggtctttgcagat

SEQ ID NO: 612735 - DNA, 25 bp, Rattus norvegicus
tgagtccctctgcaagtggagctgt

SEQ ID NO: 612736 - DNA, 25 bp, Rattus norvegicus
tgagtccctctggaagtggagctgt

SEQ ID NO: 612737 - DNA, 25 bp, Rattus norvegicus
tgagtccctgatcacactgtccatc

SEQ ID NO: 612738 - DNA, 25 bp, Rattus norvegicus
tgagtccctgatgacactgtccatc

SEQ ID NO: 612739 - DNA, 25 bp, Rattus norvegicus
tgagtccctggcagctaaggacagc

SEQ ID NO: 612740 - DNA, 25 bp, Rattus norvegicus
tgagtccctggctgctaaggacagc

SEQ ID NO: 612741 - DNA, 25 bp, Rattus norvegicus
tgagtccctgttcaaaacccgggag

SEQ ID NO: 612742 - DNA, 25 bp, Rattus norvegicus
tgagtccctgttgaaaacccgggag

SEQ ID NO: 612743 - DNA, 25 bp, Rattus norvegicus
tgagtccgacataacacttctatat

SEQ ID NO: 612744 - DNA, 25 bp, Rattus norvegicus
tgagtccgacattacacttctatat

SEQ ID NO: 612745 - DNA, 25 bp, Rattus norvegicus
tgagtccgcataagtattccttctg

SEQ ID NO: 612746 - DNA, 25 bp, Rattus norvegicus
tgagtccgcatatgtattccttctg

SEQ ID NO: 612747 - DNA, 25 bp, Rattus norvegicus
tgagtccggaggacttaagtcaact

SEQ ID NO: 612748 - DNA, 25 bp, Rattus norvegicus
tgagtccggaggtcttaagtcaact

SEQ ID NO: 612749 - DNA, 25 bp, Rattus norvegicus
tgagtcctaaggctgcagctatgcg

SEQ ID NO: 612750 - DNA, 25 bp, Rattus norvegicus
tgagtcctaagggtgcagctatgcg

SEQ ID NO: 612751 - DNA, 25 bp, Rattus norvegicus
tgagtcctatcacgtttgccggaag

SEQ ID NO: 612752 - DNA, 25 bp, Rattus norvegicus
tgagtcctatcaggtttgccggaag

SEQ ID NO: 612753 - DNA, 25 bp, Rattus norvegicus
tgagtcctcagcattgtcctttgaa

SEQ ID NO: 612754 - DNA, 25 bp, Rattus norvegicus
tgagtcctcagctttgtcctttgaa

SEQ ID NO: 612755 - DNA, 25 bp, Rattus norvegicus
tgagtcctcagtaaggacctggcct

SEQ ID NO: 612756 - DNA, 25 bp, Rattus norvegicus
tgagtcctcagttaggacctggcct

SEQ ID NO: 612757 - DNA, 25 bp, Rattus norvegicus
tgagtcctcatcaggccccataggt

SEQ ID NO: 612758 - DNA, 25 bp, Rattus norvegicus
tgagtcctcatctggccccataggt

SEQ ID NO: 612759 - DNA, 25 bp, Rattus norvegicus
tgagtcctcctgcatgtttatcatg

SEQ ID NO: 612760 - DNA, 25 bp, Rattus norvegicus
tgagtcctcctgctacttccgtttg

SEQ ID NO: 612761 - DNA, 25 bp, Rattus norvegicus
tgagtcctcctggatgtttatcatg

SEQ ID NO: 612762 - DNA, 25 bp, Rattus norvegicus
tgagtcctcctggtacttccgtttg

SEQ ID NO: 612763 - DNA, 25 bp, Rattus norvegicus
tgagtcctctccctatgcagccatg

SEQ ID NO: 612764 - DNA, 25 bp, Rattus norvegicus
tgagtcctctccgtatgcagccatg

SEQ ID NO: 612765 - DNA, 25 bp, Rattus norvegicus
tgagtcctgaggagcggtgacccaa

SEQ ID NO: 612766 - DNA, 25 bp, Rattus norvegicus
tgagtcctgaggtgcggtgacccaa

SEQ ID NO: 612767 - DNA, 25 bp, Rattus norvegicus
tgagtcctgccaaggtcaaccaata

SEQ ID NO: 612768 - DNA, 25 bp, Rattus norvegicus
tgagtcctgccatggtcaaccaata

SEQ ID NO: 612769 - DNA, 25 bp, Rattus norvegicus
tgagtcctgcttccctcatgtaacc

SEQ ID NO: 612770 - DNA, 25 bp, Rattus norvegicus
tgagtcctgcttgcctcatgtaacc

SEQ ID NO: 612771 - DNA, 25 bp, Rattus norvegicus
tgagtcctgggtcctggcatcactg

SEQ ID NO: 612772 - DNA, 25 bp, Rattus norvegicus
tgagtcctgggtgctggcatcactg

SEQ ID NO: 612773 - DNA, 25 bp, Rattus norvegicus
tgagtcctgtatacgaaccctttcc

SEQ ID NO: 612774 - DNA, 25 bp, Rattus norvegicus
tgagtcctgtattcgaaccctttcc

SEQ ID NO: 612775 - DNA, 25 bp, Rattus norvegicus
tgagtcctgtctaccagaacttgag

SEQ ID NO: 612776 - DNA, 25 bp, Rattus norvegicus
tgagtcctgtcttccagaacttgag

SEQ ID NO: 612777 - DNA, 25 bp, Rattus norvegicus
tgagtccttaccagtttcgggcgac

SEQ ID NO: 612778 - DNA, 25 bp, Rattus norvegicus
tgagtccttacctgtttcgggcgac

SEQ ID NO: 612779 - DNA, 25 bp, Rattus norvegicus
tgagtccttattcctcttccagaaa

SEQ ID NO: 612780 - DNA, 25 bp, Rattus norvegicus
tgagtccttattgctcttccagaaa

SEQ ID NO: 612781 - DNA, 25 bp, Rattus norvegicus
tgagtccttcccaagtggcccagat

SEQ ID NO: 612782 - DNA, 25 bp, Rattus norvegicus
tgagtccttccctagtggcccagat

SEQ ID NO: 612783 - DNA, 25 bp, Rattus norvegicus
tgagtccttgagctcattcctcaat

SEQ ID NO: 612784 - DNA, 25 bp, Rattus norvegicus
tgagtccttgaggtcattcctcaat

SEQ ID NO: 612785 - DNA, 25 bp, Rattus norvegicus
tgagtccttgctccttggtgctccc

SEQ ID NO: 612786 - DNA, 25 bp, Rattus norvegicus
tgagtccttgctgcttggtgctccc

SEQ ID NO: 612787 - DNA, 25 bp, Rattus norvegicus
tgagtccttggcctgactgtacagg

SEQ ID NO: 612788 - DNA, 25 bp, Rattus norvegicus
tgagtccttggcgtgactgtacagg

SEQ ID NO: 612789 - DNA, 25 bp, Rattus norvegicus
tgagtccttttaatgcattggctaa

SEQ ID NO: 612790 - DNA, 25 bp, Rattus norvegicus
tgagtccttttattgcattggctaa

SEQ ID NO: 612791 - DNA, 25 bp, Rattus norvegicus
tgagtcgaagctacaccaaccaaat

SEQ ID NO: 612792 - DNA, 25 bp, Rattus norvegicus
tgagtcgaagcttcaccaaccaaat

SEQ ID NO: 612793 - DNA, 25 bp, Rattus norvegicus
tgagtcgacaggacatcttcccggt

SEQ ID NO: 612794 - DNA, 25 bp, Rattus norvegicus
tgagtcgacaggtcatcttcccggt

SEQ ID NO: 612795 - DNA, 25 bp, Rattus norvegicus
tgagtcgattctccttcagaacgtg

SEQ ID NO: 612796 - DNA, 25 bp, Rattus norvegicus
tgagtcgattctgcttcagaacgtg

SEQ ID NO: 612797 - DNA, 25 bp, Rattus norvegicus
tgagtcgccatgatttttaaattgt

SEQ ID NO: 612798 - DNA, 25 bp, Rattus norvegicus
tgagtcgccatgttttttaaattgt

SEQ ID NO: 612799 - DNA, 25 bp, Rattus norvegicus
tgagtcgcttccacactgagtgcaa

SEQ ID NO: 612800 - DNA, 25 bp, Rattus norvegicus
tgagtcgcttcctcactgagtgcaa

SEQ ID NO: 612801 - DNA, 25 bp, Rattus norvegicus
tgagtcggaattcctgctgaggctc

SEQ ID NO: 612802 - DNA, 25 bp, Rattus norvegicus
tgagtcggaattgctgctgaggctc

SEQ ID NO: 612803 - DNA, 25 bp, Rattus norvegicus
tgagtcggaccgagagcactgtgcc

SEQ ID NO: 612804 - DNA, 25 bp, Rattus norvegicus
tgagtcggaccgtgagcactgtgcc

SEQ ID NO: 612805 - DNA, 25 bp, Rattus norvegicus
tgagtcggagagcaccagcgaatct

SEQ ID NO: 612806 - DNA, 25 bp, Rattus norvegicus
tgagtcggagaggaccagcgaatct

SEQ ID NO: 612807 - DNA, 25 bp, Rattus norvegicus
tgagtcgggaacagctgatgcctcc

SEQ ID NO: 612808 - DNA, 25 bp, Rattus norvegicus
tgagtcgggaactgctgatgcctcc

SEQ ID NO: 612809 - DNA, 25 bp, Rattus norvegicus
tgagtcgtcagcatgatcccttcaa

SEQ ID NO: 612810 - DNA, 25 bp, Rattus norvegicus
tgagtcgtcagcttgatcccttcaa

SEQ ID NO: 612811 - DNA, 25 bp, Rattus norvegicus
tgagtctaacaaatgcttcccctgc

SEQ ID NO: 612812 - DNA, 25 bp, Rattus norvegicus
tgagtctaacaattgcttcccctgc

SEQ ID NO: 612813 - DNA, 25 bp, Rattus norvegicus
tgagtctacacccagcgttgtcgtg

SEQ ID NO: 612814 - DNA, 25 bp, Rattus norvegicus
tgagtctacaccgagcgttgtcgtg

SEQ ID NO: 612815 - DNA, 25 bp, Rattus norvegicus
tgagtctacttgattagctctcctg

SEQ ID NO: 612816 - DNA, 25 bp, Rattus norvegicus
tgagtctacttgtttagctctcctg

SEQ ID NO: 612817 - DNA, 25 bp, Rattus norvegicus
tgagtctcaatcatctcattggaag

SEQ ID NO: 612818 - DNA, 25 bp, Rattus norvegicus
tgagtctcaatcttctcattggaag

SEQ ID NO: 612819 - DNA, 25 bp, Rattus norvegicus
tgagtctcagacatgagcccttggt

SEQ ID NO: 612820 - DNA, 25 bp, Rattus norvegicus
tgagtctcagacttgagcccttggt

SEQ ID NO: 612821 - DNA, 25 bp, Rattus norvegicus
tgagtctcagttacactcgtgcaag

SEQ ID NO: 612822 - DNA, 25 bp, Rattus norvegicus
tgagtctcagtttcactcgtgcaag

SEQ ID NO: 612823 - DNA, 25 bp, Rattus norvegicus
tgagtctcattaatcaaccccgata

SEQ ID NO: 612824 - DNA, 25 bp, Rattus norvegicus
tgagtctcattattcaaccccgata

SEQ ID NO: 612825 - DNA, 25 bp, Rattus norvegicus
tgagtctcccagaggacccctgctt

SEQ ID NO: 612826 - DNA, 25 bp, Rattus norvegicus
tgagtctcccagtggacccctgctt

SEQ ID NO: 612827 - DNA, 25 bp, Rattus norvegicus
tgagtctcccgaagggccgtatgta

SEQ ID NO: 612828 - DNA, 25 bp, Rattus norvegicus
tgagtctcccgatgggccgtatgta

SEQ ID NO: 612829 - DNA, 25 bp, Rattus norvegicus
tgagtctcgcttatcacatctgcaa

SEQ ID NO: 612830 - DNA, 25 bp, Rattus norvegicus
tgagtctcgcttttcacatctgcaa

SEQ ID NO: 612831 - DNA, 25 bp, Rattus norvegicus
tgagtctcggccactaagctaggtg

SEQ ID NO: 612832 - DNA, 25 bp, Rattus norvegicus
tgagtctcggcctctaagctaggtg

SEQ ID NO: 612833 - DNA, 25 bp, Rattus norvegicus
tgagtctctgtaatgctttctgtta

SEQ ID NO: 612834 - DNA, 25 bp, Rattus norvegicus
tgagtctctgtattgctttctgtta

SEQ ID NO: 612835 - DNA, 25 bp, Rattus norvegicus
tgagtctcttccaggcagcaggcta

SEQ ID NO: 612836 - DNA, 25 bp, Rattus norvegicus
tgagtctcttcctggcagcaggcta

SEQ ID NO: 612837 - DNA, 25 bp, Rattus norvegicus
tgagtctgagaacctggcctcacag

SEQ ID NO: 612838 - DNA, 25 bp, Rattus norvegicus
tgagtctgagaagctggcctcacag

SEQ ID NO: 612839 - DNA, 25 bp, Rattus norvegicus
tgagtctgccttctccgagcgctga

SEQ ID NO: 612840 - DNA, 25 bp, Rattus norvegicus
tgagtctgccttgtccgagcgctga

SEQ ID NO: 612841 - DNA, 25 bp, Rattus norvegicus
tgagtctgtagactgtgatcccctc

SEQ ID NO: 612842 - DNA, 25 bp, Rattus norvegicus
tgagtctgtagagtgtgatcccctc

SEQ ID NO: 612843 - DNA, 25 bp, Rattus norvegicus
tgagtctgtctaccgccttgatttc

SEQ ID NO: 612844 - DNA, 25 bp, Rattus norvegicus
tgagtctgtctagcgccttgatttc

SEQ ID NO: 612845 - DNA, 25 bp, Rattus norvegicus
tgagtctgtctgacctgggagactt

SEQ ID NO: 612846 - DNA, 25 bp, Rattus norvegicus
tgagtctgtctgtcctgggagactt

SEQ ID NO: 612847 - DNA, 25 bp, Rattus norvegicus
tgagtctgttctcctactctaagta

SEQ ID NO: 612848 - DNA, 25 bp, Rattus norvegicus
tgagtctgttctgctactctaagta

SEQ ID NO: 612849 - DNA, 25 bp, Rattus norvegicus
tgagtcttaatacccagcgcaccta

SEQ ID NO: 612850 - DNA, 25 bp, Rattus norvegicus
tgagtcttaatagccagcgcaccta

SEQ ID NO: 612851 - DNA, 25 bp, Rattus norvegicus
tgagtcttacctataggcctgactt

SEQ ID NO: 612852 - DNA, 25 bp, Rattus norvegicus
tgagtcttacctttaggcctgactt

SEQ ID NO: 612853 - DNA, 25 bp, Rattus norvegicus
tgagtcttacttcaactgtgaggtt

SEQ ID NO: 612854 - DNA, 25 bp, Rattus norvegicus
tgagtcttacttgaactgtgaggtt

SEQ ID NO: 612855 - DNA, 25 bp, Rattus norvegicus
tgagtcttcactcttgagtcaacat

SEQ ID NO: 612856 - DNA, 25 bp, Rattus norvegicus
tgagtcttcactgttgagtcaacat

SEQ ID NO: 612857 - DNA, 25 bp, Rattus norvegicus
tgagtcttccgcacacatgacagca

SEQ ID NO: 612858 - DNA, 25 bp, Rattus norvegicus
tgagtcttccgctcacatgacagca

SEQ ID NO: 612859 - DNA, 25 bp, Rattus norvegicus
tgagtcttccttccaggctgtgtga

SEQ ID NO: 612860 - DNA, 25 bp, Rattus norvegicus
tgagtcttccttgcaggctgtgtga

SEQ ID NO: 612861 - DNA, 25 bp, Rattus norvegicus
tgagtcttgaaaccgatcacatcct

SEQ ID NO: 612862 - DNA, 25 bp, Rattus norvegicus
tgagtcttgaaagcgatcacatcct

SEQ ID NO: 612863 - DNA, 25 bp, Rattus norvegicus
tgagtcttgctacgtgtcacttact

SEQ ID NO: 612864 - DNA, 25 bp, Rattus norvegicus
tgagtcttgctaggtgtcacttact

SEQ ID NO: 612865 - DNA, 25 bp, Rattus norvegicus
tgagtcttggagctactgacctgca

SEQ ID NO: 612866 - DNA, 25 bp, Rattus norvegicus
tgagtcttggaggtactgacctgca

SEQ ID NO: 612867 - DNA, 25 bp, Rattus norvegicus
tgagtcttggttatgcaatcctgca

SEQ ID NO: 612868 - DNA, 25 bp, Rattus norvegicus
tgagtcttggttttgcaatcctgca

SEQ ID NO: 612869 - DNA, 25 bp, Rattus norvegicus
tgagtctttaccagtgtgtgcctac

SEQ ID NO: 612870 - DNA, 25 bp, Rattus norvegicus
tgagtctttacctgtgtgtgcctac

SEQ ID NO: 612871 - DNA, 25 bp, Rattus norvegicus
tgagtgaaagcccagcacccttttg

SEQ ID NO: 612872 - DNA, 25 bp, Rattus norvegicus
tgagtgaaagccgagcacccttttg

SEQ ID NO: 612873 - DNA, 25 bp, Rattus norvegicus
tgagtgaactgaaccacctgggtgc

SEQ ID NO: 612874 - DNA, 25 bp, Rattus norvegicus
tgagtgaactgatccacctgggtgc

SEQ ID NO: 612875 - DNA, 25 bp, Rattus norvegicus
tgagtgaagtccagcccttatttgc

SEQ ID NO: 612876 - DNA, 25 bp, Rattus norvegicus
tgagtgaagtcctgcccttatttgc

SEQ ID NO: 612877 - DNA, 25 bp, Rattus norvegicus
tgagtgacacagatgcttccttaat

SEQ ID NO: 612878 - DNA, 25 bp, Rattus norvegicus
tgagtgacacagttgcttccttaat

SEQ ID NO: 612879 - DNA, 25 bp, Rattus norvegicus
tgagtgacatgcaccacccaagcca

SEQ ID NO: 612880 - DNA, 25 bp, Rattus norvegicus
tgagtgacatgctccacccaagcca

SEQ ID NO: 612881 - DNA, 25 bp, Rattus norvegicus
tgagtgacatgtcccacattttctc

SEQ ID NO: 612882 - DNA, 25 bp, Rattus norvegicus
tgagtgacatgtgccacattttctc

SEQ ID NO: 612883 - DNA, 25 bp, Rattus norvegicus
tgagtgacccgcacttgctgtctaa

SEQ ID NO: 612884 - DNA, 25 bp, Rattus norvegicus
tgagtgacccgctcttgctgtctaa

SEQ ID NO: 612885 - DNA, 25 bp, Rattus norvegicus
tgagtgacctcacatccagtgccag

SEQ ID NO: 612886 - DNA, 25 bp, Rattus norvegicus
tgagtgacctcagatccagtgccag

SEQ ID NO: 612887 - DNA, 25 bp, Rattus norvegicus
tgagtgacctgtccggagtgctttt

SEQ ID NO: 612888 - DNA, 25 bp, Rattus norvegicus
tgagtgacctgtgcggagtgctttt

SEQ ID NO: 612889 - DNA, 25 bp, Rattus norvegicus
tgagtgactccaaacaattttgtgg

SEQ ID NO: 612890 - DNA, 25 bp, Rattus norvegicus
tgagtgactccatacaattttgtgg

SEQ ID NO: 612891 - DNA, 25 bp, Rattus norvegicus
tgagtgactctcctagttagccatg

SEQ ID NO: 612892 - DNA, 25 bp, Rattus norvegicus
tgagtgactctcgtagttagccatg

SEQ ID NO: 612893 - DNA, 25 bp, Rattus norvegicus
tgagtgagagtcctgctgtttaaga

SEQ ID NO: 612894 - DNA, 25 bp, Rattus norvegicus
tgagtgagagtcgtgctgtttaaga

SEQ ID NO: 612895 - DNA, 25 bp, Rattus norvegicus
tgagtgagatcaatggccgagacct

SEQ ID NO: 612896 - DNA, 25 bp, Rattus norvegicus
tgagtgagatcattggccgagacct

SEQ ID NO: 612897 - DNA, 25 bp, Rattus norvegicus
tgagtgagatctcgccacagcgcag

SEQ ID NO: 612898 - DNA, 25 bp, Rattus norvegicus
tgagtgagatctggccacagcgcag

SEQ ID NO: 612899 - DNA, 25 bp, Rattus norvegicus
tgagtgagcagtatggagattccca

SEQ ID NO: 612900 - DNA, 25 bp, Rattus norvegicus
tgagtgagcagtttggagattccca

SEQ ID NO: 612901 - DNA, 25 bp, Rattus norvegicus
tgagtgagctgtcgcctcaggcctc

SEQ ID NO: 612902 - DNA, 25 bp, Rattus norvegicus
tgagtgagctgtggcctcaggcctc

SEQ ID NO: 612903 - DNA, 25 bp, Rattus norvegicus
tgagtgaggacaccacccccgggaa

SEQ ID NO: 612904 - DNA, 25 bp, Rattus norvegicus
tgagtgaggacagcacccccgggaa

SEQ ID NO: 612905 - DNA, 25 bp, Rattus norvegicus
tgagtgagggctacccgacagcaca

SEQ ID NO: 612906 - DNA, 25 bp, Rattus norvegicus
tgagtgagggcttcccgacagcaca

SEQ ID NO: 612907 - DNA, 25 bp, Rattus norvegicus
tgagtgagtcgcctgtgttaacctt

SEQ ID NO: 612908 - DNA, 25 bp, Rattus norvegicus
tgagtgagtcgcgtgtgttaacctt

SEQ ID NO: 612909 - DNA, 25 bp, Rattus norvegicus
tgagtgatccacagggtgcctgatg

SEQ ID NO: 612910 - DNA, 25 bp, Rattus norvegicus
tgagtgatccactgggtgcctgatg

SEQ ID NO: 612911 - DNA, 25 bp, Rattus norvegicus
tgagtgatctctctggtcgcagtca

SEQ ID NO: 612912 - DNA, 25 bp, Rattus norvegicus
tgagtgatctctgtggtcgcagtca

SEQ ID NO: 612913 - DNA, 25 bp, Rattus norvegicus
tgagtgatgcgtactggcccttttc

SEQ ID NO: 612914 - DNA, 25 bp, Rattus norvegicus
tgagtgatgcgttctggcccttttc

SEQ ID NO: 612915 - DNA, 25 bp, Rattus norvegicus
tgagtgatggttacctgtttgtcct

SEQ ID NO: 612916 - DNA, 25 bp, Rattus norvegicus
tgagtgatggtttcctgtttgtcct

SEQ ID NO: 612917 - DNA, 25 bp, Rattus norvegicus
tgagtgcaagccacagtctgaaaaa

SEQ ID NO: 612918 - DNA, 25 bp, Rattus norvegicus
tgagtgcaagcctcagtctgaaaaa

SEQ ID NO: 612919 - DNA, 25 bp, Rattus norvegicus
tgagtgcaagttcccgtgtggctca

SEQ ID NO: 612920 - DNA, 25 bp, Rattus norvegicus
tgagtgcaagttgccgtgtggctca

SEQ ID NO: 612921 - DNA, 25 bp, Rattus norvegicus
tgagtgcaccaacaaagggtacctt

SEQ ID NO: 612922 - DNA, 25 bp, Rattus norvegicus
tgagtgcaccaagaaagggtacctt

SEQ ID NO: 612923 - DNA, 25 bp, Rattus norvegicus
tgagtgcactatcgctccgtgggta

SEQ ID NO: 612924 - DNA, 25 bp, Rattus norvegicus
tgagtgcactatggctccgtgggta

SEQ ID NO: 612925 - DNA, 25 bp, Rattus norvegicus
tgagtgcagcccacgtgtcaagagc

SEQ ID NO: 612926 - DNA, 25 bp, Rattus norvegicus
tgagtgcagccctcgtgtcaagagc

SEQ ID NO: 612927 - DNA, 25 bp, Rattus norvegicus
tgagtgcaggaaccctgcccaagat

SEQ ID NO: 612928 - DNA, 25 bp, Rattus norvegicus
tgagtgcaggaagcctgcccaagat

SEQ ID NO: 612929 - DNA, 25 bp, Rattus norvegicus
tgagtgcagtggattctctaaccct

SEQ ID NO: 612930 - DNA, 25 bp, Rattus norvegicus
tgagtgcagtggtttctctaaccct

SEQ ID NO: 612931 - DNA, 25 bp, Rattus norvegicus
tgagtgcatcgtctgttctctccca

SEQ ID NO: 612932 - DNA, 25 bp, Rattus norvegicus
tgagtgcatcgtgtgttctctccca

SEQ ID NO: 612933 - DNA, 25 bp, Rattus norvegicus
tgagtgcatctgagggccccaacta

SEQ ID NO: 612934 - DNA, 25 bp, Rattus norvegicus
tgagtgcatctgtgggccccaacta

SEQ ID NO: 612935 - DNA, 25 bp, Rattus norvegicus
tgagtgcatggacaccccaggcgct

SEQ ID NO: 612936 - DNA, 25 bp, Rattus norvegicus
tgagtgcatggagaccccaggcgct

SEQ ID NO: 612937 - DNA, 25 bp, Rattus norvegicus
tgagtgccagtcctgcaactgccat

SEQ ID NO: 612938 - DNA, 25 bp, Rattus norvegicus
tgagtgccagtcgtgcaactgccat

SEQ ID NO: 612939 - DNA, 25 bp, Rattus norvegicus
tgagtgcccactccataggtgccac

SEQ ID NO: 612940 - DNA, 25 bp, Rattus norvegicus
tgagtgcccactgcataggtgccac

SEQ ID NO: 612941 - DNA, 25 bp, Rattus norvegicus
tgagtgcccatgattctccaggaaa

SEQ ID NO: 612942 - DNA, 25 bp, Rattus norvegicus
tgagtgcccatgtttctccaggaaa

SEQ ID NO: 612943 - DNA, 25 bp, Rattus norvegicus
tgagtgccctgacagccctgtgaaa

SEQ ID NO: 612944 - DNA, 25 bp, Rattus norvegicus
tgagtgccctgagagccctgtgaaa

SEQ ID NO: 612945 - DNA, 25 bp, Rattus norvegicus
tgagtgcctgaaacagaccacctgc

SEQ ID NO: 612946 - DNA, 25 bp, Rattus norvegicus
tgagtgcctgaatcagaccacctgc

SEQ ID NO: 612947 - DNA, 25 bp, Rattus norvegicus
tgagtgcctggtagtcattcctgaa

SEQ ID NO: 612948 - DNA, 25 bp, Rattus norvegicus
tgagtgcctggttgtcattcctgaa

SEQ ID NO: 612949 - DNA, 25 bp, Rattus norvegicus
tgagtgcctgtgatttcctgctaac

SEQ ID NO: 612950 - DNA, 25 bp, Rattus norvegicus
tgagtgcctgtgttttcctgctaac

SEQ ID NO: 612951 - DNA, 25 bp, Rattus norvegicus
tgagtgccttgcaggttggcccaag

SEQ ID NO: 612952 - DNA, 25 bp, Rattus norvegicus
tgagtgccttgctggttggcccaag

SEQ ID NO: 612953 - DNA, 25 bp, Rattus norvegicus
tgagtgcgcgcaatctgattggtca

SEQ ID NO: 612954 - DNA, 25 bp, Rattus norvegicus
tgagtgcgcgcattctgattggtca

SEQ ID NO: 612955 - DNA, 25 bp, Rattus norvegicus
tgagtgcgtgcaatcgcgagagaat

SEQ ID NO: 612956 - DNA, 25 bp, Rattus norvegicus
tgagtgcgtgcattcgcgagagaat

SEQ ID NO: 612957 - DNA, 25 bp, Rattus norvegicus
tgagtgctaaggacctcgacctctg

SEQ ID NO: 612958 - DNA, 25 bp, Rattus norvegicus
tgagtgctaaggtcctcgacctctg

SEQ ID NO: 612959 - DNA, 25 bp, Rattus norvegicus
tgagtgctcagtccttagacaacct

SEQ ID NO: 612960 - DNA, 25 bp, Rattus norvegicus
tgagtgctcagtgcttagacaacct

SEQ ID NO: 612961 - DNA, 25 bp, Rattus norvegicus
tgagtgctgagcagtaccctgtgtg

SEQ ID NO: 612962 - DNA, 25 bp, Rattus norvegicus
tgagtgctgagctgtaccctgtgtg

SEQ ID NO: 612963 - DNA, 25 bp, Rattus norvegicus
tgagtgctgggaatcgaggcctact

SEQ ID NO: 612964 - DNA, 25 bp, Rattus norvegicus
tgagtgctgggattcgaggcctact

SEQ ID NO: 612965 - DNA, 25 bp, Rattus norvegicus
tgagtgctgggcacaatgcaaccgt

SEQ ID NO: 612966 - DNA, 25 bp, Rattus norvegicus
tgagtgctgggctcaatgcaaccgt

SEQ ID NO: 612967 - DNA, 25 bp, Rattus norvegicus
tgagtgctgtctacatgccagtatc

SEQ ID NO: 612968 - DNA, 25 bp, Rattus norvegicus
tgagtgctgtcttcatgccagtatc

SEQ ID NO: 612969 - DNA, 25 bp, Rattus norvegicus
tgagtgctttgaccctaactacagc

SEQ ID NO: 612970 - DNA, 25 bp, Rattus norvegicus
tgagtgctttgagcctaactacagc

SEQ ID NO: 612971 - DNA, 25 bp, Rattus norvegicus
tgagtggaagtcacagacctgccgc

SEQ ID NO: 612972 - DNA, 25 bp, Rattus norvegicus
tgagtggaagtctcagacctgccgc

SEQ ID NO: 612973 - DNA, 25 bp, Rattus norvegicus
tgagtggacgaccaggctcttcctt

SEQ ID NO: 612974 - DNA, 25 bp, Rattus norvegicus
tgagtggacgacgaggctcttcctt

SEQ ID NO: 612975 - DNA, 25 bp, Rattus norvegicus
tgagtggactggaccacacagccta

SEQ ID NO: 612976 - DNA, 25 bp, Rattus norvegicus
tgagtggactggtccacacagccta

SEQ ID NO: 612977 - DNA, 25 bp, Rattus norvegicus
tgagtggactttactgctcactgga

SEQ ID NO: 612978 - DNA, 25 bp, Rattus norvegicus
tgagtggacttttctgctcactgga

SEQ ID NO: 612979 - DNA, 25 bp, Rattus norvegicus
tgagtggagcaacctgtgtctgaca

SEQ ID NO: 612980 - DNA, 25 bp, Rattus norvegicus
tgagtggagcaagctgtgtctgaca

SEQ ID NO: 612981 - DNA, 25 bp, Rattus norvegicus
tgagtggatgtacaggaccctgttt

SEQ ID NO: 612982 - DNA, 25 bp, Rattus norvegicus
tgagtggatgtagaggaccctgttt

SEQ ID NO: 612983 - DNA, 25 bp, Rattus norvegicus
tgagtggccctaaacttggcgtggc

SEQ ID NO: 612984 - DNA, 25 bp, Rattus norvegicus
tgagtggccctatacttggcgtggc

SEQ ID NO: 612985 - DNA, 25 bp, Rattus norvegicus
tgagtggctctgaccctttgaagtt

SEQ ID NO: 612986 - DNA, 25 bp, Rattus norvegicus
tgagtggctctgtccctttgaagtt

SEQ ID NO: 612987 - DNA, 25 bp, Rattus norvegicus
tgagtggctgcaccttaccatgtat

SEQ ID NO: 612988 - DNA, 25 bp, Rattus norvegicus
tgagtggctgcagcttaccatgtat

SEQ ID NO: 612989 - DNA, 25 bp, Rattus norvegicus
tgagtgggaaacatggccgcccatt

SEQ ID NO: 612990 - DNA, 25 bp, Rattus norvegicus
tgagtgggaaacttggccgcccatt

SEQ ID NO: 612991 - DNA, 25 bp, Rattus norvegicus
tgagtgggactcatgggcctgaatc

SEQ ID NO: 612992 - DNA, 25 bp, Rattus norvegicus
tgagtgggactcttgggcctgaatc

SEQ ID NO: 612993 - DNA, 25 bp, Rattus norvegicus
tgagtgggcacacacctttcttagc

SEQ ID NO: 612994 - DNA, 25 bp, Rattus norvegicus
tgagtgggcacagacctttcttagc

SEQ ID NO: 612995 - DNA, 25 bp, Rattus norvegicus
tgagtgggcagcctatcaccctaac

SEQ ID NO: 612996 - DNA, 25 bp, Rattus norvegicus
tgagtgggcagcgtatcaccctaac

SEQ ID NO: 612997 - DNA, 25 bp, Rattus norvegicus
tgagtgggctccaaagtcggcatga

SEQ ID NO: 612998 - DNA, 25 bp, Rattus norvegicus
tgagtgggctcctaagtcggcatga

SEQ ID NO: 612999 - DNA, 25 bp, Rattus norvegicus
tgagtgggtgccaaacaccatctgt

SEQ ID NO: 613000 - DNA, 25 bp, Rattus norvegicus
tgagtgggtgcctaacaccatctgt

SEQ ID NO: 613001 - DNA, 25 bp, Rattus norvegicus
tgagtggtaaggctgaccgtctctc

SEQ ID NO: 613002 - DNA, 25 bp, Rattus norvegicus
tgagtggtaagggtgaccgtctctc

SEQ ID NO: 613003 - DNA, 25 bp, Rattus norvegicus
tgagtggtaccacagcacaatcccc

SEQ ID NO: 613004 - DNA, 25 bp, Rattus norvegicus
tgagtggtaccagagcacaatcccc

SEQ ID NO: 613005 - DNA, 25 bp, Rattus norvegicus
tgagtggtcattacacccttaagcc

SEQ ID NO: 613006 - DNA, 25 bp, Rattus norvegicus
tgagtggtcatttcacccttaagcc

SEQ ID NO: 613007 - DNA, 25 bp, Rattus norvegicus
tgagtggtctgcaagcctgtctgat

SEQ ID NO: 613008 - DNA, 25 bp, Rattus norvegicus
tgagtggtctgctagcctgtctgat

SEQ ID NO: 613009 - DNA, 25 bp, Rattus norvegicus
tgagtggtgaccactccaaccttat

SEQ ID NO: 613010 - DNA, 25 bp, Rattus norvegicus
tgagtggtgacctctccaaccttat

SEQ ID NO: 613011 - DNA, 25 bp, Rattus norvegicus
tgagtggtttctacacagacctgaa

SEQ ID NO: 613012 - DNA, 25 bp, Rattus norvegicus
tgagtggtttcttcacagacctgaa

SEQ ID NO: 613013 - DNA, 25 bp, Rattus norvegicus
tgagtgtcaacacgaggctcggcct

SEQ ID NO: 613014 - DNA, 25 bp, Rattus norvegicus
tgagtgtcaacaggaggctcggcct

SEQ ID NO: 613015 - DNA, 25 bp, Rattus norvegicus
tgagtgtcagctcacttgtttctca

SEQ ID NO: 613016 - DNA, 25 bp, Rattus norvegicus
tgagtgtcagctgacttgtttctca

SEQ ID NO: 613017 - DNA, 25 bp, Rattus norvegicus
tgagtgtcatctaaaccccatcatc

SEQ ID NO: 613018 - DNA, 25 bp, Rattus norvegicus
tgagtgtcatcttaaccccatcatc

SEQ ID NO: 613019 - DNA, 25 bp, Rattus norvegicus
tgagtgtcccaacctcactgaaagc

SEQ ID NO: 613020 - DNA, 25 bp, Rattus norvegicus
tgagtgtcccaagctcactgaaagc

SEQ ID NO: 613021 - DNA, 25 bp, Rattus norvegicus
tgagtgtcccgtcatctcatttttt

SEQ ID NO: 613022 - DNA, 25 bp, Rattus norvegicus
tgagtgtcccgtgatctcatttttt

SEQ ID NO: 613023 - DNA, 25 bp, Rattus norvegicus
tgagtgtcgatgacctgtgtccctc

SEQ ID NO: 613024 - DNA, 25 bp, Rattus norvegicus
tgagtgtcgatgtcctgtgtccctc

SEQ ID NO: 613025 - DNA, 25 bp, Rattus norvegicus
tgagtgtctggcacgacccctaacg

SEQ ID NO: 613026 - DNA, 25 bp, Rattus norvegicus
tgagtgtctggctcgacccctaacg

SEQ ID NO: 613027 - DNA, 25 bp, Rattus norvegicus
tgagtgtctttcattgcaggtttct

SEQ ID NO: 613028 - DNA, 25 bp, Rattus norvegicus
tgagtgtctttctttgcaggtttct

SEQ ID NO: 613029 - DNA, 25 bp, Rattus norvegicus
tgagtgtgaacgctggattcctatg

SEQ ID NO: 613030 - DNA, 25 bp, Rattus norvegicus
tgagtgtgaacggtggattcctatg

SEQ ID NO: 613031 - DNA, 25 bp, Rattus norvegicus
tgagtgtgatcgcaacatcccctgc

SEQ ID NO: 613032 - DNA, 25 bp, Rattus norvegicus
tgagtgtgatcggaacatcccctgc

SEQ ID NO: 613033 - DNA, 25 bp, Rattus norvegicus
tgagtgtgcttcagtgtctcccaac

SEQ ID NO: 613034 - DNA, 25 bp, Rattus norvegicus
tgagtgtgcttctgtgtctcccaac

SEQ ID NO: 613035 - DNA, 25 bp, Rattus norvegicus
tgagtgtgggccagagagccaaact

SEQ ID NO: 613036 - DNA, 25 bp, Rattus norvegicus
tgagtgtgggcctgagagccaaact

SEQ ID NO: 613037 - DNA, 25 bp, Rattus norvegicus
tgagtgtgggttctgatgtcctaca

SEQ ID NO: 613038 - DNA, 25 bp, Rattus norvegicus
tgagtgtgggttgtgatgtcctaca

SEQ ID NO: 613039 - DNA, 25 bp, Rattus norvegicus
tgagtgtggttaatgccggcaagac

SEQ ID NO: 613040 - DNA, 25 bp, Rattus norvegicus
tgagtgtggttattgccggcaagac

SEQ ID NO: 613041 - DNA, 25 bp, Rattus norvegicus
tgagtgtgtacacctgctccaggga

SEQ ID NO: 613042 - DNA, 25 bp, Rattus norvegicus
tgagtgtgtacagctgctccaggga

SEQ ID NO: 613043 - DNA, 25 bp, Rattus norvegicus
tgagtgtgtcctcagcaacctgcgg

SEQ ID NO: 613044 - DNA, 25 bp, Rattus norvegicus
tgagtgtgtcctgagcaacctgcgg

SEQ ID NO: 613045 - DNA, 25 bp, Rattus norvegicus
tgagtgtgtggacatggcgaccagt

SEQ ID NO: 613046 - DNA, 25 bp, Rattus norvegicus
tgagtgtgtggagatggcgaccagt

SEQ ID NO: 613047 - DNA, 25 bp, Rattus norvegicus
tgagtgttcctacgtcatctgactt

SEQ ID NO: 613048 - DNA, 25 bp, Rattus norvegicus
tgagtgttcctaggtcatctgactt

SEQ ID NO: 613049 - DNA, 25 bp, Rattus norvegicus
tgagtgttgctgacctttgttctaa

SEQ ID NO: 613050 - DNA, 25 bp, Rattus norvegicus
tgagtgttgctgtcctttgttctaa

SEQ ID NO: 613051 - DNA, 25 bp, Rattus norvegicus
tgagtgtttagcaccggtttccaga

SEQ ID NO: 613052 - DNA, 25 bp, Rattus norvegicus
tgagtgtttagctccggtttccaga

SEQ ID NO: 613053 - DNA, 25 bp, Rattus norvegicus
tgagtgtttccacacagcagccagc

SEQ ID NO: 613054 - DNA, 25 bp, Rattus norvegicus
tgagtgtttccagacagcagccagc

SEQ ID NO: 613055 - DNA, 25 bp, Rattus norvegicus
tgagtgtttcttctcctctagagat

SEQ ID NO: 613056 - DNA, 25 bp, Rattus norvegicus
tgagtgtttcttgtcctctagagat

SEQ ID NO: 613057 - DNA, 25 bp, Rattus norvegicus
tgagtgtttgtacacagtgagctac

SEQ ID NO: 613058 - DNA, 25 bp, Rattus norvegicus
tgagtgtttgtagacagtgagctac

SEQ ID NO: 613059 - DNA, 25 bp, Rattus norvegicus
tgagtgtttgtgatccaggaatcct

SEQ ID NO: 613060 - DNA, 25 bp, Rattus norvegicus
tgagtgtttgtgttccaggaatcct

SEQ ID NO: 613061 - DNA, 25 bp, Rattus norvegicus
tgagtgttttcccagcatctccagg

SEQ ID NO: 613062 - DNA, 25 bp, Rattus norvegicus
tgagtgttttccgagcatctccagg

SEQ ID NO: 613063 - DNA, 25 bp, Rattus norvegicus
tgagttaaatgtacttcggccctat

SEQ ID NO: 613064 - DNA, 25 bp, Rattus norvegicus
tgagttaaatgttcttcggccctat

SEQ ID NO: 613065 - DNA, 25 bp, Rattus norvegicus
tgagttaacaatccagttatctggg

SEQ ID NO: 613066 - DNA, 25 bp, Rattus norvegicus
tgagttaacaatgcagttatctggg

SEQ ID NO: 613067 - DNA, 25 bp, Rattus norvegicus
tgagttaacagcactttccgtgact

SEQ ID NO: 613068 - DNA, 25 bp, Rattus norvegicus
tgagttaacagctctttccgtgact

SEQ ID NO: 613069 - DNA, 25 bp, Rattus norvegicus
tgagttaacatgacagaacctcctt

SEQ ID NO: 613070 - DNA, 25 bp, Rattus norvegicus
tgagttaacatgtcagaacctcctt

SEQ ID NO: 613071 - DNA, 25 bp, Rattus norvegicus
tgagttaagtcacggctcttccttc

SEQ ID NO: 613072 - DNA, 25 bp, Rattus norvegicus
tgagttaagtcagggctcttccttc

SEQ ID NO: 613073 - DNA, 25 bp, Rattus norvegicus
tgagttaatcacactggcttcccac

SEQ ID NO: 613074 - DNA, 25 bp, Rattus norvegicus
tgagttaatcactctggcttcccac

SEQ ID NO: 613075 - DNA, 25 bp, Rattus norvegicus
tgagttacaaacctatgagcccatg

SEQ ID NO: 613076 - DNA, 25 bp, Rattus norvegicus
tgagttacaaacgtatgagcccatg

SEQ ID NO: 613077 - DNA, 25 bp, Rattus norvegicus
tgagttacaggcatgggccacacct

SEQ ID NO: 613078 - DNA, 25 bp, Rattus norvegicus
tgagttacaggcttgggccacacct

SEQ ID NO: 613079 - DNA, 25 bp, Rattus norvegicus
tgagttacgagtaacctaccctggg

SEQ ID NO: 613080 - DNA, 25 bp, Rattus norvegicus
tgagttacgagttacctaccctggg

SEQ ID NO: 613081 - DNA, 25 bp, Rattus norvegicus
tgagttactacacccattcaacgtt

SEQ ID NO: 613082 - DNA, 25 bp, Rattus norvegicus
tgagttactacagccattcaacgtt

SEQ ID NO: 613083 - DNA, 25 bp, Rattus norvegicus
tgagttactgctcactctgagttct

SEQ ID NO: 613084 - DNA, 25 bp, Rattus norvegicus
tgagttactgctgactctgagttct

SEQ ID NO: 613085 - DNA, 25 bp, Rattus norvegicus
tgagttacttaccttgggcaactta

SEQ ID NO: 613086 - DNA, 25 bp, Rattus norvegicus
tgagttacttacgttgggcaactta

SEQ ID NO: 613087 - DNA, 25 bp, Rattus norvegicus
tgagttagaacacccgagcaaacaa

SEQ ID NO: 613088 - DNA, 25 bp, Rattus norvegicus
tgagttagaacagccgagcaaacaa

SEQ ID NO: 613089 - DNA, 25 bp, Rattus norvegicus
tgagttagaggcagtgttccacagt

SEQ ID NO: 613090 - DNA, 25 bp, Rattus norvegicus
tgagttagaggctgtgttccacagt

SEQ ID NO: 613091 - DNA, 25 bp, Rattus norvegicus
tgagttagatctcccaaaaccggtg

SEQ ID NO: 613092 - DNA, 25 bp, Rattus norvegicus
tgagttagatctgccaaaaccggtg

SEQ ID NO: 613093 - DNA, 25 bp, Rattus norvegicus
tgagttagatggacttgtagccagc

SEQ ID NO: 613094 - DNA, 25 bp, Rattus norvegicus
tgagttagatggtcttgtagccagc

SEQ ID NO: 613095 - DNA, 25 bp, Rattus norvegicus
tgagttatactccaacttctgccat

SEQ ID NO: 613096 - DNA, 25 bp, Rattus norvegicus
tgagttatactcgaacttctgccat

SEQ ID NO: 613097 - DNA, 25 bp, Rattus norvegicus
tgagttatacttcacacggaattct

SEQ ID NO: 613098 - DNA, 25 bp, Rattus norvegicus
tgagttatacttgacacggaattct

SEQ ID NO: 613099 - DNA, 25 bp, Rattus norvegicus
tgagttatgacaccagcgcaccttg

SEQ ID NO: 613100 - DNA, 25 bp, Rattus norvegicus
tgagttatgacagcagcgcaccttg

SEQ ID NO: 613101 - DNA, 25 bp, Rattus norvegicus
tgagttatgagacctgagctgcaga

SEQ ID NO: 613102 - DNA, 25 bp, Rattus norvegicus
tgagttatgagagctgagctgcaga

SEQ ID NO: 613103 - DNA, 25 bp, Rattus norvegicus
tgagttatgggtacagattctgcta

SEQ ID NO: 613104 - DNA, 25 bp, Rattus norvegicus
tgagttatgggttcagattctgcta

SEQ ID NO: 613105 - DNA, 25 bp, Rattus norvegicus
tgagttatgtccacaagggtctacc

SEQ ID NO: 613106 - DNA, 25 bp, Rattus norvegicus
tgagttatgtcctcaagggtctacc

SEQ ID NO: 613107 - DNA, 25 bp, Rattus norvegicus
tgagttatttcacgacaattgtcat

SEQ ID NO: 613108 - DNA, 25 bp, Rattus norvegicus
tgagttatttcaggacaattgtcat

SEQ ID NO: 613109 - DNA, 25 bp, Rattus norvegicus
tgagttcaaatacgcaggccggtct

SEQ ID NO: 613110 - DNA, 25 bp, Rattus norvegicus
tgagttcaaataggcaggccggtct

SEQ ID NO: 613111 - DNA, 25 bp, Rattus norvegicus
tgagttcaaatcaccagcatgcctg

SEQ ID NO: 613112 - DNA, 25 bp, Rattus norvegicus
tgagttcaaatctccagcatgcctg

SEQ ID NO: 613113 - DNA, 25 bp, Rattus norvegicus
tgagttcaagccacaggaagcccac

SEQ ID NO: 613114 - DNA, 25 bp, Rattus norvegicus
tgagttcaagcctcaggaagcccac

SEQ ID NO: 613115 - DNA, 25 bp, Rattus norvegicus
tgagttcaataaactggtgcgtttt

SEQ ID NO: 613116 - DNA, 25 bp, Rattus norvegicus
tgagttcaataatctggtgcgtttt

SEQ ID NO: 613117 - DNA, 25 bp, Rattus norvegicus
tgagttcaattcaggccacctacat

SEQ ID NO: 613118 - DNA, 25 bp, Rattus norvegicus
tgagttcaattctggccacctacat

SEQ ID NO: 613119 - DNA, 25 bp, Rattus norvegicus
tgagttcacacaatgccccgagaag

SEQ ID NO: 613120 - DNA, 25 bp, Rattus norvegicus
tgagttcacacattgccccgagaag

SEQ ID NO: 613121 - DNA, 25 bp, Rattus norvegicus
tgagttcacagaccatgccacaaac

SEQ ID NO: 613122 - DNA, 25 bp, Rattus norvegicus
tgagttcacagagcatgccacaaac

SEQ ID NO: 613123 - DNA, 25 bp, Rattus norvegicus
tgagttcaccaaccaccttcaagag

SEQ ID NO: 613124 - DNA, 25 bp, Rattus norvegicus
tgagttcaccaagcaccttcaagag

SEQ ID NO: 613125 - DNA, 25 bp, Rattus norvegicus
tgagttcacgatacaactccacgca

SEQ ID NO: 613126 - DNA, 25 bp, Rattus norvegicus
tgagttcacgattcaactccacgca

SEQ ID NO: 613127 - DNA, 25 bp, Rattus norvegicus
tgagttcactgcagctcagcctgag

SEQ ID NO: 613128 - DNA, 25 bp, Rattus norvegicus
tgagttcactgctgctcagcctgag

SEQ ID NO: 613129 - DNA, 25 bp, Rattus norvegicus
tgagttcagagccaacttgacagat

SEQ ID NO: 613130 - DNA, 25 bp, Rattus norvegicus
tgagttcagagcgaacttgacagat

SEQ ID NO: 613131 - DNA, 25 bp, Rattus norvegicus
tgagttcagattatggatccagatc

SEQ ID NO: 613132 - DNA, 25 bp, Rattus norvegicus
tgagttcagattttggatccagatc

SEQ ID NO: 613133 - DNA, 25 bp, Rattus norvegicus
tgagttcagctcaagacgctgcaag

SEQ ID NO: 613134 - DNA, 25 bp, Rattus norvegicus
tgagttcagctctagacgctgcaag

SEQ ID NO: 613135 - DNA, 25 bp, Rattus norvegicus
tgagttcaggagcactcagtgcagc

SEQ ID NO: 613136 - DNA, 25 bp, Rattus norvegicus
tgagttcaggaggactcagtgcagc

SEQ ID NO: 613137 - DNA, 25 bp, Rattus norvegicus
tgagttcaggtcctagccccattat

SEQ ID NO: 613138 - DNA, 25 bp, Rattus norvegicus
tgagttcaggtcgtagccccattat

SEQ ID NO: 613139 - DNA, 25 bp, Rattus norvegicus
tgagttcagtccaccgagcccagtg

SEQ ID NO: 613140 - DNA, 25 bp, Rattus norvegicus
tgagttcagtccacggcatcacaag

SEQ ID NO: 613141 - DNA, 25 bp, Rattus norvegicus
tgagttcagtcctccgagcccagtg

SEQ ID NO: 613142 - DNA, 25 bp, Rattus norvegicus
tgagttcagtcctcggcatcacaag

SEQ ID NO: 613143 - DNA, 25 bp, Rattus norvegicus
tgagttcatcctatattcttctgta

SEQ ID NO: 613144 - DNA, 25 bp, Rattus norvegicus
tgagttcatcctcaaagcacccact

SEQ ID NO: 613145 - DNA, 25 bp, Rattus norvegicus
tgagttcatcctgaaagcacccact

SEQ ID NO: 613146 - DNA, 25 bp, Rattus norvegicus
tgagttcatcctttattcttctgta

SEQ ID NO: 613147 - DNA, 25 bp, Rattus norvegicus
tgagttcatgtgcaaccctcacctg

SEQ ID NO: 613148 - DNA, 25 bp, Rattus norvegicus
tgagttcatgtggaaccctcacctg

SEQ ID NO: 613149 - DNA, 25 bp, Rattus norvegicus
tgagttcatttcatccatggaagga

SEQ ID NO: 613150 - DNA, 25 bp, Rattus norvegicus
tgagttcatttcttccatggaagga

SEQ ID NO: 613151 - DNA, 25 bp, Rattus norvegicus
tgagttccacctcttgaagccagac

SEQ ID NO: 613152 - DNA, 25 bp, Rattus norvegicus
tgagttccacctgttgaagccagac

SEQ ID NO: 613153 - DNA, 25 bp, Rattus norvegicus
tgagttccacttcccagcagaggac

SEQ ID NO: 613154 - DNA, 25 bp, Rattus norvegicus
tgagttccacttgccagcagaggac

SEQ ID NO: 613155 - DNA, 25 bp, Rattus norvegicus
tgagttccagacaagttctctccca

SEQ ID NO: 613156 - DNA, 25 bp, Rattus norvegicus
tgagttccagactagttctctccca

SEQ ID NO: 613157 - DNA, 25 bp, Rattus norvegicus
tgagttcccactctggccatcgcag

SEQ ID NO: 613158 - DNA, 25 bp, Rattus norvegicus
tgagttcccactgtggccatcgcag

SEQ ID NO: 613159 - DNA, 25 bp, Rattus norvegicus
tgagttcccagtcatctcgcagaca

SEQ ID NO: 613160 - DNA, 25 bp, Rattus norvegicus
tgagttcccagtgatctcgcagaca

SEQ ID NO: 613161 - DNA, 25 bp, Rattus norvegicus
tgagttccctcactttgaatcctcc

SEQ ID NO: 613162 - DNA, 25 bp, Rattus norvegicus
tgagttccctcagtttgaatcctcc

SEQ ID NO: 613163 - DNA, 25 bp, Rattus norvegicus
tgagttccgcttaaactatacggct

SEQ ID NO: 613164 - DNA, 25 bp, Rattus norvegicus
tgagttccgctttaactatacggct

SEQ ID NO: 613165 - DNA, 25 bp, Rattus norvegicus
tgagttccgggaacctgggccaaaa

SEQ ID NO: 613166 - DNA, 25 bp, Rattus norvegicus
tgagttccgggacctgatcatctga

SEQ ID NO: 613167 - DNA, 25 bp, Rattus norvegicus
tgagttccgggagctgatcatctga

SEQ ID NO: 613168 - DNA, 25 bp, Rattus norvegicus
tgagttccgggatcctgggccaaaa

SEQ ID NO: 613169 - DNA, 25 bp, Rattus norvegicus
tgagttcctaatatgggcctgggtt

SEQ ID NO: 613170 - DNA, 25 bp, Rattus norvegicus
tgagttcctaatttgggcctgggtt

SEQ ID NO: 613171 - DNA, 25 bp, Rattus norvegicus
tgagttcctctaccttgcttaccaa

SEQ ID NO: 613172 - DNA, 25 bp, Rattus norvegicus
tgagttcctctagcttgcttaccaa

SEQ ID NO: 613173 - DNA, 25 bp, Rattus norvegicus
tgagttcctgtcaaggatttcctct

SEQ ID NO: 613174 - DNA, 25 bp, Rattus norvegicus
tgagttcctgtctaggatttcctct

SEQ ID NO: 613175 - DNA, 25 bp, Rattus norvegicus
tgagttcgagaacctgcaccacact

SEQ ID NO: 613176 - DNA, 25 bp, Rattus norvegicus
tgagttcgagaagctgcaccacact

SEQ ID NO: 613177 - DNA, 25 bp, Rattus norvegicus
tgagttcgcttgaccaacttggttg

SEQ ID NO: 613178 - DNA, 25 bp, Rattus norvegicus
tgagttcgcttgtccaacttggttg

SEQ ID NO: 613179 - DNA, 25 bp, Rattus norvegicus
tgagttctagagatttgcctggctg

SEQ ID NO: 613180 - DNA, 25 bp, Rattus norvegicus
tgagttctagagttttgcctggctg

SEQ ID NO: 613181 - DNA, 25 bp, Rattus norvegicus
tgagttctatccctgggacctgcat

SEQ ID NO: 613182 - DNA, 25 bp, Rattus norvegicus
tgagttctatccgtgggacctgcat

SEQ ID NO: 613183 - DNA, 25 bp, Rattus norvegicus
tgagttctcaacatacctcaacttc

SEQ ID NO: 613184 - DNA, 25 bp, Rattus norvegicus
tgagttctcaacttacctcaacttc

SEQ ID NO: 613185 - DNA, 25 bp, Rattus norvegicus
tgagttctcaataaatcctcctctc

SEQ ID NO: 613186 - DNA, 25 bp, Rattus norvegicus
tgagttctcaattaatcctcctctc

SEQ ID NO: 613187 - DNA, 25 bp, Rattus norvegicus
tgagttctcctcagacgccatagaa

SEQ ID NO: 613188 - DNA, 25 bp, Rattus norvegicus
tgagttctcctctgacgccatagaa

SEQ ID NO: 613189 - DNA, 25 bp, Rattus norvegicus
tgagttctctcaacagttcctggat

SEQ ID NO: 613190 - DNA, 25 bp, Rattus norvegicus
tgagttctctcatcagttcctggat

SEQ ID NO: 613191 - DNA, 25 bp, Rattus norvegicus
tgagttctctgccaagcacagcata

SEQ ID NO: 613192 - DNA, 25 bp, Rattus norvegicus
tgagttctctgcgaagcacagcata

SEQ ID NO: 613193 - DNA, 25 bp, Rattus norvegicus
tgagttctgcatccctcacatggag

SEQ ID NO: 613194 - DNA, 25 bp, Rattus norvegicus
tgagttctgcatgcctcacatggag

SEQ ID NO: 613195 - DNA, 25 bp, Rattus norvegicus
tgagttctgcttcaaggcttgaaga

SEQ ID NO: 613196 - DNA, 25 bp, Rattus norvegicus
tgagttctgcttgaaggcttgaaga

SEQ ID NO: 613197 - DNA, 25 bp, Rattus norvegicus
tgagttcttcaacggcaggctcgtc

SEQ ID NO: 613198 - DNA, 25 bp, Rattus norvegicus
tgagttcttcaagggcaggctcgtc

SEQ ID NO: 613199 - DNA, 25 bp, Rattus norvegicus
tgagttcttctcctgtgcgatgaca

SEQ ID NO: 613200 - DNA, 25 bp, Rattus norvegicus
tgagttcttctcgtgtgcgatgaca

SEQ ID NO: 613201 - DNA, 25 bp, Rattus norvegicus
tgagttcttctgagaggcctgggaa

SEQ ID NO: 613202 - DNA, 25 bp, Rattus norvegicus
tgagttcttctgtgaggcctgggaa

SEQ ID NO: 613203 - DNA, 25 bp, Rattus norvegicus
tgagttcttgctatacgtcgtgtac

SEQ ID NO: 613204 - DNA, 25 bp, Rattus norvegicus
tgagttcttgctttacgtcgtgtac

SEQ ID NO: 613205 - DNA, 25 bp, Rattus norvegicus
tgagttctttggcatctttgatcag

SEQ ID NO: 613206 - DNA, 25 bp, Rattus norvegicus
tgagttctttgggatctttgatcag

SEQ ID NO: 613207 - DNA, 25 bp, Rattus norvegicus
tgagttgacggtctttagcagtttt

SEQ ID NO: 613208 - DNA, 25 bp, Rattus norvegicus
tgagttgacggtgtttagcagtttt

SEQ ID NO: 613209 - DNA, 25 bp, Rattus norvegicus
tgagttgagttgcagcctcactctg

SEQ ID NO: 613210 - DNA, 25 bp, Rattus norvegicus
tgagttgagttggagcctcactctg

SEQ ID NO: 613211 - DNA, 25 bp, Rattus norvegicus
tgagttgattcccagtacacacatg

SEQ ID NO: 613212 - DNA, 25 bp, Rattus norvegicus
tgagttgattccgagtacacacatg

SEQ ID NO: 613213 - DNA, 25 bp, Rattus norvegicus
tgagttgctcatagaccttccatag

SEQ ID NO: 613214 - DNA, 25 bp, Rattus norvegicus
tgagttgctcattgaccttccatag

SEQ ID NO: 613215 - DNA, 25 bp, Rattus norvegicus
tgagttgcttctctgtggcgtccca

SEQ ID NO: 613216 - DNA, 25 bp, Rattus norvegicus
tgagttgcttctgtgtggcgtccca

SEQ ID NO: 613217 - DNA, 25 bp, Rattus norvegicus
tgagttggcactccaccgggtccta

SEQ ID NO: 613218 - DNA, 25 bp, Rattus norvegicus
tgagttggcactgcaccgggtccta

SEQ ID NO: 613219 - DNA, 25 bp, Rattus norvegicus
tgagttggcagaacctatttttccc

SEQ ID NO: 613220 - DNA, 25 bp, Rattus norvegicus
tgagttggcagatcctatttttccc

SEQ ID NO: 613221 - DNA, 25 bp, Rattus norvegicus
tgagttggctaccttgctatgtttc

SEQ ID NO: 613222 - DNA, 25 bp, Rattus norvegicus
tgagttggctacgttgctatgtttc

SEQ ID NO: 613223 - DNA, 25 bp, Rattus norvegicus
tgagttggctccagaatggttcgtt

SEQ ID NO: 613224 - DNA, 25 bp, Rattus norvegicus
tgagttggctcctgaatggttcgtt

SEQ ID NO: 613225 - DNA, 25 bp, Rattus norvegicus
tgagttgggaggacacaccgagctc

SEQ ID NO: 613226 - DNA, 25 bp, Rattus norvegicus
tgagttgggaggtcacaccgagctc

SEQ ID NO: 613227 - DNA, 25 bp, Rattus norvegicus
tgagttggtccgcaaattatttaca

SEQ ID NO: 613228 - DNA, 25 bp, Rattus norvegicus
tgagttggtccggaaattatttaca

SEQ ID NO: 613229 - DNA, 25 bp, Rattus norvegicus
tgagttggtggaccaagcccagctt

SEQ ID NO: 613230 - DNA, 25 bp, Rattus norvegicus
tgagttggtggagcaagcccagctt

SEQ ID NO: 613231 - DNA, 25 bp, Rattus norvegicus
tgagttggttttagtatccccatcc

SEQ ID NO: 613232 - DNA, 25 bp, Rattus norvegicus
tgagttggtttttgtatccccatcc

SEQ ID NO: 613233 - DNA, 25 bp, Rattus norvegicus
tgagttgtaatgaaaacgcctgtgt

SEQ ID NO: 613234 - DNA, 25 bp, Rattus norvegicus
tgagttgtaatgtaaacgcctgtgt

SEQ ID NO: 613235 - DNA, 25 bp, Rattus norvegicus
tgagttgtcattcatcctccggacg

SEQ ID NO: 613236 - DNA, 25 bp, Rattus norvegicus
tgagttgtcattgatcctccggacg

SEQ ID NO: 613237 - DNA, 25 bp, Rattus norvegicus
tgagttgtcctacttcgaagtcctt

SEQ ID NO: 613238 - DNA, 25 bp, Rattus norvegicus
tgagttgtcctagttcgaagtcctt

SEQ ID NO: 613239 - DNA, 25 bp, Rattus norvegicus
tgagttgtgactctcctgttatcaa

SEQ ID NO: 613240 - DNA, 25 bp, Rattus norvegicus
tgagttgtgactgtcctgttatcaa

SEQ ID NO: 613241 - DNA, 25 bp, Rattus norvegicus
tgagttgtgagcacttcttctgtag

SEQ ID NO: 613242 - DNA, 25 bp, Rattus norvegicus
tgagttgtgagctcttcttctgtag

SEQ ID NO: 613243 - DNA, 25 bp, Rattus norvegicus
tgagttgtgtgaccagtcgaccatg

SEQ ID NO: 613244 - DNA, 25 bp, Rattus norvegicus
tgagttgtgtgagcagtcgaccatg

SEQ ID NO: 613245 - DNA, 25 bp, Rattus norvegicus
tgagtttaaattcccaactcctttg

SEQ ID NO: 613246 - DNA, 25 bp, Rattus norvegicus
tgagtttaaattgccaactcctttg

SEQ ID NO: 613247 - DNA, 25 bp, Rattus norvegicus
tgagtttaaggtcacagatgcccgg

SEQ ID NO: 613248 - DNA, 25 bp, Rattus norvegicus
tgagtttaaggtgacagatgcccgg

SEQ ID NO: 613249 - DNA, 25 bp, Rattus norvegicus
tgagtttaccttattatacccatca

SEQ ID NO: 613250 - DNA, 25 bp, Rattus norvegicus
tgagtttacctttttatacccatca

SEQ ID NO: 613251 - DNA, 25 bp, Rattus norvegicus
tgagtttagacacctccgatgcctc

SEQ ID NO: 613252 - DNA, 25 bp, Rattus norvegicus
tgagtttagacagctccgatgcctc

SEQ ID NO: 613253 - DNA, 25 bp, Rattus norvegicus
tgagtttagttcctaggacccacat

SEQ ID NO: 613254 - DNA, 25 bp, Rattus norvegicus
tgagtttagttcgtaggacccacat

SEQ ID NO: 613255 - DNA, 25 bp, Rattus norvegicus
tgagtttatagactctccctgagac

SEQ ID NO: 613256 - DNA, 25 bp, Rattus norvegicus
tgagtttatagagtctccctgagac

SEQ ID NO: 613257 - DNA, 25 bp, Rattus norvegicus
tgagtttattgactccaccctgtca

SEQ ID NO: 613258 - DNA, 25 bp, Rattus norvegicus
tgagtttattgagtccaccctgtca

SEQ ID NO: 613259 - DNA, 25 bp, Rattus norvegicus
tgagtttattgccaagtgttgcttc

SEQ ID NO: 613260 - DNA, 25 bp, Rattus norvegicus
tgagtttattgcgaagtgttgcttc

SEQ ID NO: 613261 - DNA, 25 bp, Rattus norvegicus
tgagtttcacatcgctgatccctct

SEQ ID NO: 613262 - DNA, 25 bp, Rattus norvegicus
tgagtttcacatggctgatccctct

SEQ ID NO: 613263 - DNA, 25 bp, Rattus norvegicus
tgagtttcagccctgtaaaagaaat

SEQ ID NO: 613264 - DNA, 25 bp, Rattus norvegicus
tgagtttcagccgtgtaaaagaaat

SEQ ID NO: 613265 - DNA, 25 bp, Rattus norvegicus
tgagtttcctttctctttagggctt

SEQ ID NO: 613266 - DNA, 25 bp, Rattus norvegicus
tgagtttcctttgtctttagggctt

SEQ ID NO: 613267 - DNA, 25 bp, Rattus norvegicus
tgagtttctagcaaccgccaaacgg

SEQ ID NO: 613268 - DNA, 25 bp, Rattus norvegicus
tgagtttctagctaccgccaaacgg

SEQ ID NO: 613269 - DNA, 25 bp, Rattus norvegicus
tgagtttctgcacctccaacataca

SEQ ID NO: 613270 - DNA, 25 bp, Rattus norvegicus
tgagtttctgcagctccaacataca

SEQ ID NO: 613271 - DNA, 25 bp, Rattus norvegicus
tgagtttcttgaatctagggcctgc

SEQ ID NO: 613272 - DNA, 25 bp, Rattus norvegicus
tgagtttcttgattctagggcctgc

SEQ ID NO: 613273 - DNA, 25 bp, Rattus norvegicus
tgagtttcttgtattggtgcctgac

SEQ ID NO: 613274 - DNA, 25 bp, Rattus norvegicus
tgagtttcttgttttggtgcctgac

SEQ ID NO: 613275 - DNA, 25 bp, Rattus norvegicus
tgagtttgaactccggtaccggaga

SEQ ID NO: 613276 - DNA, 25 bp, Rattus norvegicus
tgagtttgaactgcggtaccggaga

SEQ ID NO: 613277 - DNA, 25 bp, Rattus norvegicus
tgagtttgacttctacctgtgcagt

SEQ ID NO: 613278 - DNA, 25 bp, Rattus norvegicus
tgagtttgacttgtacctgtgcagt

SEQ ID NO: 613279 - DNA, 25 bp, Rattus norvegicus
tgagtttgcagccagctcgccgcga

SEQ ID NO: 613280 - DNA, 25 bp, Rattus norvegicus
tgagtttgcagcgagctcgccgcga

SEQ ID NO: 613281 - DNA, 25 bp, Rattus norvegicus
tgagtttgctttctctgccaattaa

SEQ ID NO: 613282 - DNA, 25 bp, Rattus norvegicus
tgagtttgctttgtctgccaattaa

SEQ ID NO: 613283 - DNA, 25 bp, Rattus norvegicus
tgagtttggtttcttgctgtgtgtt

SEQ ID NO: 613284 - DNA, 25 bp, Rattus norvegicus
tgagtttggtttgttgctgtgtgtt

SEQ ID NO: 613285 - DNA, 25 bp, Rattus norvegicus
tgagtttgtagcatccatttgataa

SEQ ID NO: 613286 - DNA, 25 bp, Rattus norvegicus
tgagtttgtagcttccatttgataa

SEQ ID NO: 613287 - DNA, 25 bp, Rattus norvegicus
tgagttttaaccaccaccagaagct

SEQ ID NO: 613288 - DNA, 25 bp, Rattus norvegicus
tgagttttaacctccaccagaagct

SEQ ID NO: 613289 - DNA, 25 bp, Rattus norvegicus
tgagttttaagtaatgccatttctg

SEQ ID NO: 613290 - DNA, 25 bp, Rattus norvegicus
tgagttttaagttatgccatttctg

SEQ ID NO: 613291 - DNA, 25 bp, Rattus norvegicus
tgagttttattgacacctacctaaa

SEQ ID NO: 613292 - DNA, 25 bp, Rattus norvegicus
tgagttttattgtcacctacctaaa

SEQ ID NO: 613293 - DNA, 25 bp, Rattus norvegicus
tgagttttcaagcagtcccttaaag

SEQ ID NO: 613294 - DNA, 25 bp, Rattus norvegicus
tgagttttcaaggagtcccttaaag

SEQ ID NO: 613295 - DNA, 25 bp, Rattus norvegicus
tgagttttcacaacgcttgaccaat

SEQ ID NO: 613296 - DNA, 25 bp, Rattus norvegicus
tgagttttcacatcgcttgaccaat

SEQ ID NO: 613297 - DNA, 25 bp, Rattus norvegicus
tgagttttcatgatgctgctccatc

SEQ ID NO: 613298 - DNA, 25 bp, Rattus norvegicus
tgagttttcatgttgctgctccatc

SEQ ID NO: 613299 - DNA, 25 bp, Rattus norvegicus
tgagttttccaacacatcacggcgg

SEQ ID NO: 613300 - DNA, 25 bp, Rattus norvegicus
tgagttttccaagacatcacggcgg

SEQ ID NO: 613301 - DNA, 25 bp, Rattus norvegicus
tgagttttccttatgtggtttccag

SEQ ID NO: 613302 - DNA, 25 bp, Rattus norvegicus
tgagttttccttttgtggtttccag

SEQ ID NO: 613303 - DNA, 25 bp, Rattus norvegicus
tgagttttctacaaatcccaccttt

SEQ ID NO: 613304 - DNA, 25 bp, Rattus norvegicus
tgagttttctactaatcccaccttt

SEQ ID NO: 613305 - DNA, 25 bp, Rattus norvegicus
tgagttttctcaactaagcctagcg

SEQ ID NO: 613306 - DNA, 25 bp, Rattus norvegicus
tgagttttctcatctaagcctagcg

SEQ ID NO: 613307 - DNA, 25 bp, Rattus norvegicus
tgagttttcttgatgtaccctccac

SEQ ID NO: 613308 - DNA, 25 bp, Rattus norvegicus
tgagttttcttgttgtaccctccac

SEQ ID NO: 613309 - DNA, 25 bp, Rattus norvegicus
tgagttttctttacttaatgttggt

SEQ ID NO: 613310 - DNA, 25 bp, Rattus norvegicus
tgagttttctttccacgtgccaagt

SEQ ID NO: 613311 - DNA, 25 bp, Rattus norvegicus
tgagttttctttgcacgtgccaagt

SEQ ID NO: 613312 - DNA, 25 bp, Rattus norvegicus
tgagttttcttttcttaatgttggt

SEQ ID NO: 613313 - DNA, 25 bp, Rattus norvegicus
tgagtttttaatcttcctaaagact

SEQ ID NO: 613314 - DNA, 25 bp, Rattus norvegicus
tgagtttttaatgttcctaaagact

SEQ ID NO: 613315 - DNA, 25 bp, Rattus norvegicus
tgagtttttgaaccctgagacccct

SEQ ID NO: 613316 - DNA, 25 bp, Rattus norvegicus
tgagtttttgaagcctgagacccct

SEQ ID NO: 613317 - DNA, 25 bp, Rattus norvegicus
tgagtttttggccaggacagcctgt

SEQ ID NO: 613318 - DNA, 25 bp, Rattus norvegicus
tgagtttttggcgaggacagcctgt

SEQ ID NO: 613319 - DNA, 25 bp, Rattus norvegicus
tgagttttttcccagagctccagat

SEQ ID NO: 613320 - DNA, 25 bp, Rattus norvegicus
tgagttttttccgagagctccagat

SEQ ID NO: 613321 - DNA, 25 bp, Rattus norvegicus
tgataaaaccacatcattaccaatg

SEQ ID NO: 613322 - DNA, 25 bp, Rattus norvegicus
tgataaaaccacttcattaccaatg

SEQ ID NO: 613323 - DNA, 25 bp, Rattus norvegicus
tgataaacactaatcccgggagcag

SEQ ID NO: 613324 - DNA, 25 bp, Rattus norvegicus
tgataaacactattcccgggagcag

SEQ ID NO: 613325 - DNA, 25 bp, Rattus norvegicus
tgataaaccccgacaggcctttgaa

SEQ ID NO: 613326 - DNA, 25 bp, Rattus norvegicus
tgataaaccccgtcaggcctttgaa

SEQ ID NO: 613327 - DNA, 25 bp, Rattus norvegicus
tgataaacctccagtttgctgcgta

SEQ ID NO: 613328 - DNA, 25 bp, Rattus norvegicus
tgataaacctcctgtttgctgcgta

SEQ ID NO: 613329 - DNA, 25 bp, Rattus norvegicus
tgataaactgttcaccttaacggtc

SEQ ID NO: 613330 - DNA, 25 bp, Rattus norvegicus
tgataaactgttgaccttaacggtc

SEQ ID NO: 613331 - DNA, 25 bp, Rattus norvegicus
tgataaaggctaccctctgggacgt

SEQ ID NO: 613332 - DNA, 25 bp, Rattus norvegicus
tgataaaggctagcctctgggacgt

SEQ ID NO: 613333 - DNA, 25 bp, Rattus norvegicus
tgataaagggaccacacacctggct

SEQ ID NO: 613334 - DNA, 25 bp, Rattus norvegicus
tgataaagggacgacacacctggct

SEQ ID NO: 613335 - DNA, 25 bp, Rattus norvegicus
tgataaaggtacatcccaatcccca

SEQ ID NO: 613336 - DNA, 25 bp, Rattus norvegicus
tgataaaggtacttcccaatcccca

SEQ ID NO: 613337 - DNA, 25 bp, Rattus norvegicus
tgataaatccatacgctgcttgtac

SEQ ID NO: 613338 - DNA, 25 bp, Rattus norvegicus
tgataaatccattcgctgcttgtac

SEQ ID NO: 613339 - DNA, 25 bp, Rattus norvegicus
tgataaatttccctcaactatgaaa

SEQ ID NO: 613340 - DNA, 25 bp, Rattus norvegicus
tgataaatttccgtcaactatgaaa

SEQ ID NO: 613341 - DNA, 25 bp, Rattus norvegicus
tgataacaaaatacacctcccctgc

SEQ ID NO: 613342 - DNA, 25 bp, Rattus norvegicus
tgataacaaaattcacctcccctgc

SEQ ID NO: 613343 - DNA, 25 bp, Rattus norvegicus
tgataacagaacatgcagctacttt

SEQ ID NO: 613344 - DNA, 25 bp, Rattus norvegicus
tgataacagaacttgcagctacttt

SEQ ID NO: 613345 - DNA, 25 bp, Rattus norvegicus
tgataacatgcccagtccatacagc

SEQ ID NO: 613346 - DNA, 25 bp, Rattus norvegicus
tgataacatgccgagtccatacagc

SEQ ID NO: 613347 - DNA, 25 bp, Rattus norvegicus
tgataacattccaggaaccccacag

SEQ ID NO: 613348 - DNA, 25 bp, Rattus norvegicus
tgataacattcctggaaccccacag

SEQ ID NO: 613349 - DNA, 25 bp, Rattus norvegicus
tgataacccctaattgttctacaaa

SEQ ID NO: 613350 - DNA, 25 bp, Rattus norvegicus
tgataacccctatttgttctacaaa

SEQ ID NO: 613351 - DNA, 25 bp, Rattus norvegicus
tgataaccctttatcacttactgta

SEQ ID NO: 613352 - DNA, 25 bp, Rattus norvegicus
tgataaccctttttcacttactgta

SEQ ID NO: 613353 - DNA, 25 bp, Rattus norvegicus
tgataaccgatgactgccctaggtc

SEQ ID NO: 613354 - DNA, 25 bp, Rattus norvegicus
tgataaccgatgtctgccctaggtc

SEQ ID NO: 613355 - DNA, 25 bp, Rattus norvegicus
tgataacctcaaatcttccctaact

SEQ ID NO: 613356 - DNA, 25 bp, Rattus norvegicus
tgataacctcaattcttccctaact

SEQ ID NO: 613357 - DNA, 25 bp, Rattus norvegicus
tgataacctgtcacaagttgtttga

SEQ ID NO: 613358 - DNA, 25 bp, Rattus norvegicus
tgataacctgtctcaagttgtttga

SEQ ID NO: 613359 - DNA, 25 bp, Rattus norvegicus
tgataacgctttatcacaacccagt

SEQ ID NO: 613360 - DNA, 25 bp, Rattus norvegicus
tgataacgctttttcacaacccagt

SEQ ID NO: 613361 - DNA, 25 bp, Rattus norvegicus
tgataactaacacttctttccgctg

SEQ ID NO: 613362 - DNA, 25 bp, Rattus norvegicus
tgataactaacagttctttccgctg

SEQ ID NO: 613363 - DNA, 25 bp, Rattus norvegicus
tgataactctccaaggtggctgtcc

SEQ ID NO: 613364 - DNA, 25 bp, Rattus norvegicus
tgataactctcctaggtggctgtcc

SEQ ID NO: 613365 - DNA, 25 bp, Rattus norvegicus
tgataacttcagatgcccagactcc

SEQ ID NO: 613366 - DNA, 25 bp, Rattus norvegicus
tgataacttcagttgcccagactcc

SEQ ID NO: 613367 - DNA, 25 bp, Rattus norvegicus
tgataacttgtgcaacgctgctggg

SEQ ID NO: 613368 - DNA, 25 bp, Rattus norvegicus
tgataacttgtggaacgctgctggg

SEQ ID NO: 613369 - DNA, 25 bp, Rattus norvegicus
tgataagagctgctctgtaccgccc

SEQ ID NO: 613370 - DNA, 25 bp, Rattus norvegicus
tgataagagctggtctgtaccgccc

SEQ ID NO: 613371 - DNA, 25 bp, Rattus norvegicus
tgataagccacacgctctcacgaga

SEQ ID NO: 613372 - DNA, 25 bp, Rattus norvegicus
tgataagccacaggctctcacgaga

SEQ ID NO: 613373 - DNA, 25 bp, Rattus norvegicus
tgataagcctcgctgagaccatctt

SEQ ID NO: 613374 - DNA, 25 bp, Rattus norvegicus
tgataagcctcggtgagaccatctt

SEQ ID NO: 613375 - DNA, 25 bp, Rattus norvegicus
tgataaggagaacgccactgtctgc

SEQ ID NO: 613376 - DNA, 25 bp, Rattus norvegicus
tgataaggagaaggccactgtctgc

SEQ ID NO: 613377 - DNA, 25 bp, Rattus norvegicus
tgataaggcactatccgtttgcacc

SEQ ID NO: 613378 - DNA, 25 bp, Rattus norvegicus
tgataaggcactttccgtttgcacc

SEQ ID NO: 613379 - DNA, 25 bp, Rattus norvegicus
tgataagggcacacttctccaggca

SEQ ID NO: 613380 - DNA, 25 bp, Rattus norvegicus
tgataagggcactcttctccaggca

SEQ ID NO: 613381 - DNA, 25 bp, Rattus norvegicus
tgataaggttcaagggaaatcccca

SEQ ID NO: 613382 - DNA, 25 bp, Rattus norvegicus
tgataaggttcatgggaaatcccca

SEQ ID NO: 613383 - DNA, 25 bp, Rattus norvegicus
tgataagtgttgctggactctgcag

SEQ ID NO: 613384 - DNA, 25 bp, Rattus norvegicus
tgataagtgttggtggactctgcag

SEQ ID NO: 613385 - DNA, 25 bp, Rattus norvegicus
tgataagttcacaggcctctgggag

SEQ ID NO: 613386 - DNA, 25 bp, Rattus norvegicus
tgataagttcactggcctctgggag

SEQ ID NO: 613387 - DNA, 25 bp, Rattus norvegicus
tgataatatcctcctttgcttcctg

SEQ ID NO: 613388 - DNA, 25 bp, Rattus norvegicus
tgataatatcctgctttgcttcctg

SEQ ID NO: 613389 - DNA, 25 bp, Rattus norvegicus
tgataatccagaagctttccccagt

SEQ ID NO: 613390 - DNA, 25 bp, Rattus norvegicus
tgataatccagatgctttccccagt

SEQ ID NO: 613391 - DNA, 25 bp, Rattus norvegicus
tgataatccagccactacttcttag

SEQ ID NO: 613392 - DNA, 25 bp, Rattus norvegicus
tgataatccagcgactacttcttag

SEQ ID NO: 613393 - DNA, 25 bp, Rattus norvegicus
tgataatctattaactggcacacaa

SEQ ID NO: 613394 - DNA, 25 bp, Rattus norvegicus
tgataatctatttactggcacacaa

SEQ ID NO: 613395 - DNA, 25 bp, Rattus norvegicus
tgataatctccccagactatgccta

SEQ ID NO: 613396 - DNA, 25 bp, Rattus norvegicus
tgataatctcccgagactatgccta

SEQ ID NO: 613397 - DNA, 25 bp, Rattus norvegicus
tgataatgccatagcttctaacagt

SEQ ID NO: 613398 - DNA, 25 bp, Rattus norvegicus
tgataatgccattgcttctaacagt

SEQ ID NO: 613399 - DNA, 25 bp, Rattus norvegicus
tgataatgccttatcttctgtaccc

SEQ ID NO: 613400 - DNA, 25 bp, Rattus norvegicus
tgataatgccttttcttctgtaccc

SEQ ID NO: 613401 - DNA, 25 bp, Rattus norvegicus
tgataattatcacagctacttggct

SEQ ID NO: 613402 - DNA, 25 bp, Rattus norvegicus
tgataattatcagagctacttggct

SEQ ID NO: 613403 - DNA, 25 bp, Rattus norvegicus
tgataattcggtcactctcttccta

SEQ ID NO: 613404 - DNA, 25 bp, Rattus norvegicus
tgataattcggtgactctcttccta

SEQ ID NO: 613405 - DNA, 25 bp, Rattus norvegicus
tgataatttaaaaccccgtaaggct

SEQ ID NO: 613406 - DNA, 25 bp, Rattus norvegicus
tgataatttaaatccccgtaaggct

SEQ ID NO: 613407 - DNA, 25 bp, Rattus norvegicus
tgataatttcttatcccctcctaat

SEQ ID NO: 613408 - DNA, 25 bp, Rattus norvegicus
tgataatttcttttcccctcctaat

SEQ ID NO: 613409 - DNA, 25 bp, Rattus norvegicus
tgatacaaatttccacgccagagcc

SEQ ID NO: 613410 - DNA, 25 bp, Rattus norvegicus
tgatacaaatttgcacgccagagcc

SEQ ID NO: 613411 - DNA, 25 bp, Rattus norvegicus
tgatacaatcgtcgtcagtcctttg

SEQ ID NO: 613412 - DNA, 25 bp, Rattus norvegicus
tgatacaatcgtggtcagtcctttg

SEQ ID NO: 613413 - DNA, 25 bp, Rattus norvegicus
tgatacacaagcatcattcccatct

SEQ ID NO: 613414 - DNA, 25 bp, Rattus norvegicus
tgatacacaagcttcattcccatct

SEQ ID NO: 613415 - DNA, 25 bp, Rattus norvegicus
tgatacacactacccttggcacttt

SEQ ID NO: 613416 - DNA, 25 bp, Rattus norvegicus
tgatacacactagccttggcacttt

SEQ ID NO: 613417 - DNA, 25 bp, Rattus norvegicus
tgatacacaggcaggcacggtgctg

SEQ ID NO: 613418 - DNA, 25 bp, Rattus norvegicus
tgatacacaggctggcacggtgctg

SEQ ID NO: 613419 - DNA, 25 bp, Rattus norvegicus
tgatacacatcactgtgccttctgt

SEQ ID NO: 613420 - DNA, 25 bp, Rattus norvegicus
tgatacacatcagtgtgccttctgt

SEQ ID NO: 613421 - DNA, 25 bp, Rattus norvegicus
tgatacaccggacggagcagctgtt

SEQ ID NO: 613422 - DNA, 25 bp, Rattus norvegicus
tgatacaccggagggagcagctgtt

SEQ ID NO: 613423 - DNA, 25 bp, Rattus norvegicus
tgatacacctagatgtctctctcag

SEQ ID NO: 613424 - DNA, 25 bp, Rattus norvegicus
tgatacacctagttgtctctctcag

SEQ ID NO: 613425 - DNA, 25 bp, Rattus norvegicus
tgatacactctactgctccttttct

SEQ ID NO: 613426 - DNA, 25 bp, Rattus norvegicus
tgatacactctagtgctccttttct

SEQ ID NO: 613427 - DNA, 25 bp, Rattus norvegicus
tgatacactgtacatctttcccatc

SEQ ID NO: 613428 - DNA, 25 bp, Rattus norvegicus
tgatacactgtagatctttcccatc

SEQ ID NO: 613429 - DNA, 25 bp, Rattus norvegicus
tgatacagacacatggaacctttcc

SEQ ID NO: 613430 - DNA, 25 bp, Rattus norvegicus
tgatacagacacttggaacctttcc

SEQ ID NO: 613431 - DNA, 25 bp, Rattus norvegicus
tgatacagattgacagcacccactc

SEQ ID NO: 613432 - DNA, 25 bp, Rattus norvegicus
tgatacagattgtcagcacccactc

SEQ ID NO: 613433 - DNA, 25 bp, Rattus norvegicus
tgatacagctctactcatggtacgc

SEQ ID NO: 613434 - DNA, 25 bp, Rattus norvegicus
tgatacagctcttctcatggtacgc

SEQ ID NO: 613435 - DNA, 25 bp, Rattus norvegicus
tgatacagtggaactggctccctca

SEQ ID NO: 613436 - DNA, 25 bp, Rattus norvegicus
tgatacagtggatctggctccctca

SEQ ID NO: 613437 - DNA, 25 bp, Rattus norvegicus
tgatacagtggtcccctggtctcca

SEQ ID NO: 613438 - DNA, 25 bp, Rattus norvegicus
tgatacagtggtgccctggtctcca

SEQ ID NO: 613439 - DNA, 25 bp, Rattus norvegicus
tgatacatttgcacgtacagccctg

SEQ ID NO: 613440 - DNA, 25 bp, Rattus norvegicus
tgatacatttgctcgtacagccctg

SEQ ID NO: 613441 - DNA, 25 bp, Rattus norvegicus
tgatacatttggatgtgcttgtggg

SEQ ID NO: 613442 - DNA, 25 bp, Rattus norvegicus
tgatacatttggttgtgcttgtggg

SEQ ID NO: 613443 - DNA, 25 bp, Rattus norvegicus
tgataccaaacacagctcctgcttc

SEQ ID NO: 613444 - DNA, 25 bp, Rattus norvegicus
tgataccaaacagagctcctgcttc

SEQ ID NO: 613445 - DNA, 25 bp, Rattus norvegicus
tgataccacagcaatgccatacttt

SEQ ID NO: 613446 - DNA, 25 bp, Rattus norvegicus
tgataccacagctatgccatacttt

SEQ ID NO: 613447 - DNA, 25 bp, Rattus norvegicus
tgataccatctcctaccactgaact

SEQ ID NO: 613448 - DNA, 25 bp, Rattus norvegicus
tgataccatctcgtaccactgaact

SEQ ID NO: 613449 - DNA, 25 bp, Rattus norvegicus
tgatacccaccccaacaagttctgg

SEQ ID NO: 613450 - DNA, 25 bp, Rattus norvegicus
tgatacccacccgaacaagttctgg

SEQ ID NO: 613451 - DNA, 25 bp, Rattus norvegicus
tgataccctgctctgtagtctgaca

SEQ ID NO: 613452 - DNA, 25 bp, Rattus norvegicus
tgataccctgctgtgtagtctgaca

SEQ ID NO: 613453 - DNA, 25 bp, Rattus norvegicus
tgatacctatcaatcctcgggcagt

SEQ ID NO: 613454 - DNA, 25 bp, Rattus norvegicus
tgatacctatcattcctcgggcagt

SEQ ID NO: 613455 - DNA, 25 bp, Rattus norvegicus
tgatacctcctcacagctattactc

SEQ ID NO: 613456 - DNA, 25 bp, Rattus norvegicus
tgatacctcctctcagctattactc

SEQ ID NO: 613457 - DNA, 25 bp, Rattus norvegicus
tgatacctctctagctaattttctg

SEQ ID NO: 613458 - DNA, 25 bp, Rattus norvegicus
tgatacctctcttgctaattttctg

SEQ ID NO: 613459 - DNA, 25 bp, Rattus norvegicus
tgatacctggtgattgtttcctttc

SEQ ID NO: 613460 - DNA, 25 bp, Rattus norvegicus
tgatacctggtgtttgtttcctttc

SEQ ID NO: 613461 - DNA, 25 bp, Rattus norvegicus
tgataccttctccatgagcagtggc

SEQ ID NO: 613462 - DNA, 25 bp, Rattus norvegicus
tgataccttctcgatgagcagtggc

SEQ ID NO: 613463 - DNA, 25 bp, Rattus norvegicus
tgataccttttgctcttttcagggc

SEQ ID NO: 613464 - DNA, 25 bp, Rattus norvegicus
tgataccttttggtcttttcagggc

SEQ ID NO: 613465 - DNA, 25 bp, Rattus norvegicus
tgatacgaaccgaaccaaactcctt

SEQ ID NO: 613466 - DNA, 25 bp, Rattus norvegicus
tgatacgaaccgtaccaaactcctt

SEQ ID NO: 613467 - DNA, 25 bp, Rattus norvegicus
tgatacgggcgaaataatgctcgat

SEQ ID NO: 613468 - DNA, 25 bp, Rattus norvegicus
tgatacgggcgatataatgctcgat

SEQ ID NO: 613469 - DNA, 25 bp, Rattus norvegicus
tgatacgtaaataccttcgcctctg

SEQ ID NO: 613470 - DNA, 25 bp, Rattus norvegicus
tgatacgtaaattccttcgcctctg

SEQ ID NO: 613471 - DNA, 25 bp, Rattus norvegicus
tgatacgtgaggctatccctcattt

SEQ ID NO: 613472 - DNA, 25 bp, Rattus norvegicus
tgatacgtgagggtatccctcattt

SEQ ID NO: 613473 - DNA, 25 bp, Rattus norvegicus
tgatactactttccctacttgccat

SEQ ID NO: 613474 - DNA, 25 bp, Rattus norvegicus
tgatactactttgcctacttgccat

SEQ ID NO: 613475 - DNA, 25 bp, Rattus norvegicus
tgatactctcaaccagcaaagccag

SEQ ID NO: 613476 - DNA, 25 bp, Rattus norvegicus
tgatactctcaagcagcaaagccag

SEQ ID NO: 613477 - DNA, 25 bp, Rattus norvegicus
tgatactctgacactgttcttggct

SEQ ID NO: 613478 - DNA, 25 bp, Rattus norvegicus
tgatactctgactctgttcttggct

SEQ ID NO: 613479 - DNA, 25 bp, Rattus norvegicus
tgatactgagccaggcaacctgagc

SEQ ID NO: 613480 - DNA, 25 bp, Rattus norvegicus
tgatactgagcctggcaacctgagc

SEQ ID NO: 613481 - DNA, 25 bp, Rattus norvegicus
tgatactgccctaaagtctcccaat

SEQ ID NO: 613482 - DNA, 25 bp, Rattus norvegicus
tgatactgcccttaagtctcccaat

SEQ ID NO: 613483 - DNA, 25 bp, Rattus norvegicus
tgatactgggccagtggacacacaa

SEQ ID NO: 613484 - DNA, 25 bp, Rattus norvegicus
tgatactgggcctgtggacacacaa

SEQ ID NO: 613485 - DNA, 25 bp, Rattus norvegicus
tgatactgggtcagcaccaggagcc

SEQ ID NO: 613486 - DNA, 25 bp, Rattus norvegicus
tgatactgggtctgcaccaggagcc

SEQ ID NO: 613487 - DNA, 25 bp, Rattus norvegicus
tgatactgtaaaatgggtcttttgt

SEQ ID NO: 613488 - DNA, 25 bp, Rattus norvegicus
tgatactgtaaattgggtcttttgt

SEQ ID NO: 613489 - DNA, 25 bp, Rattus norvegicus
tgatactgtctcattgaagcaccct

SEQ ID NO: 613490 - DNA, 25 bp, Rattus norvegicus
tgatactgtctctttgaagcaccct

SEQ ID NO: 613491 - DNA, 25 bp, Rattus norvegicus
tgatactgttacactgtctgtcctg

SEQ ID NO: 613492 - DNA, 25 bp, Rattus norvegicus
tgatactgttactctgtctgtcctg

SEQ ID NO: 613493 - DNA, 25 bp, Rattus norvegicus
tgatacttaataccatatttcagct

SEQ ID NO: 613494 - DNA, 25 bp, Rattus norvegicus
tgatacttaatagcatatttcagct

SEQ ID NO: 613495 - DNA, 25 bp, Rattus norvegicus
tgatacttcagtcagaccggacttg

SEQ ID NO: 613496 - DNA, 25 bp, Rattus norvegicus
tgatacttcagtgagaccggacttg

SEQ ID NO: 613497 - DNA, 25 bp, Rattus norvegicus
tgatacttgggacggttggttcctt

SEQ ID NO: 613498 - DNA, 25 bp, Rattus norvegicus
tgatacttgggagggttggttcctt

SEQ ID NO: 613499 - DNA, 25 bp, Rattus norvegicus
tgatacttgtctcaatctttctcct

SEQ ID NO: 613500 - DNA, 25 bp, Rattus norvegicus
tgatacttgtctctccttcatagtg

SEQ ID NO: 613501 - DNA, 25 bp, Rattus norvegicus
tgatacttgtctgaatctttctcct

SEQ ID NO: 613502 - DNA, 25 bp, Rattus norvegicus
tgatacttgtctgtccttcatagtg

SEQ ID NO: 613503 - DNA, 25 bp, Rattus norvegicus
tgatagactaaacctaaccgcctct

SEQ ID NO: 613504 - DNA, 25 bp, Rattus norvegicus
tgatagactaaagctaaccgcctct

SEQ ID NO: 613505 - DNA, 25 bp, Rattus norvegicus
tgatagagatcacccggtatgccct

SEQ ID NO: 613506 - DNA, 25 bp, Rattus norvegicus
tgatagagatcagccggtatgccct

SEQ ID NO: 613507 - DNA, 25 bp, Rattus norvegicus
tgatagagatgacccacctcattgt

SEQ ID NO: 613508 - DNA, 25 bp, Rattus norvegicus
tgatagagatgagccacctcattgt

SEQ ID NO: 613509 - DNA, 25 bp, Rattus norvegicus
tgatagataaggaccaatcccatat

SEQ ID NO: 613510 - DNA, 25 bp, Rattus norvegicus
tgatagataaggtccaatcccatat

SEQ ID NO: 613511 - DNA, 25 bp, Rattus norvegicus
tgatagatacctacaagccttgtgg

SEQ ID NO: 613512 - DNA, 25 bp, Rattus norvegicus
tgatagataccttcaagccttgtgg

SEQ ID NO: 613513 - DNA, 25 bp, Rattus norvegicus
tgatagatctgaccgtcttgctcgc

SEQ ID NO: 613514 - DNA, 25 bp, Rattus norvegicus
tgatagatctgagcgtcttgctcgc

SEQ ID NO: 613515 - DNA, 25 bp, Rattus norvegicus
tgatagatctgtcggacctggctca

SEQ ID NO: 613516 - DNA, 25 bp, Rattus norvegicus
tgatagatctgtgggacctggctca

SEQ ID NO: 613517 - DNA, 25 bp, Rattus norvegicus
tgatagatgcttcttgtatccgcat

SEQ ID NO: 613518 - DNA, 25 bp, Rattus norvegicus
tgatagatgcttgttgtatccgcat

SEQ ID NO: 613519 - DNA, 25 bp, Rattus norvegicus
tgatagcaagtcctgttcgcttggt

SEQ ID NO: 613520 - DNA, 25 bp, Rattus norvegicus
tgatagcaagtcgtgttcgcttggt

SEQ ID NO: 613521 - DNA, 25 bp, Rattus norvegicus
tgatagcacaatctctgggccaccc

SEQ ID NO: 613522 - DNA, 25 bp, Rattus norvegicus
tgatagcacaatgtctgggccaccc

SEQ ID NO: 613523 - DNA, 25 bp, Rattus norvegicus
tgatagcacaccctcagggaaagag

SEQ ID NO: 613524 - DNA, 25 bp, Rattus norvegicus
tgatagcacaccgtcagggaaagag

SEQ ID NO: 613525 - DNA, 25 bp, Rattus norvegicus
tgatagcatagtctggtcaccatgg

SEQ ID NO: 613526 - DNA, 25 bp, Rattus norvegicus
tgatagcatagtgtggtcaccatgg

SEQ ID NO: 613527 - DNA, 25 bp, Rattus norvegicus
tgatagccaacccttctttttctac

SEQ ID NO: 613528 - DNA, 25 bp, Rattus norvegicus
tgatagccaaccgttctttttctac

SEQ ID NO: 613529 - DNA, 25 bp, Rattus norvegicus
tgatagccacgtcggtcactgtatt

SEQ ID NO: 613530 - DNA, 25 bp, Rattus norvegicus
tgatagccacgtgggtcactgtatt

SEQ ID NO: 613531 - DNA, 25 bp, Rattus norvegicus
tgatagccagccactaccagacgaa

SEQ ID NO: 613532 - DNA, 25 bp, Rattus norvegicus
tgatagccagcctctaccagacgaa

SEQ ID NO: 613533 - DNA, 25 bp, Rattus norvegicus
tgatagcctctcctatgatgtgggc

SEQ ID NO: 613534 - DNA, 25 bp, Rattus norvegicus
tgatagcctctcgtatgatgtgggc

SEQ ID NO: 613535 - DNA, 25 bp, Rattus norvegicus
tgatagcctgcacgactgggcacta

SEQ ID NO: 613536 - DNA, 25 bp, Rattus norvegicus
tgatagcctgcaggactgggcacta

SEQ ID NO: 613537 - DNA, 25 bp, Rattus norvegicus
tgatagccttcacagcacagagact

SEQ ID NO: 613538 - DNA, 25 bp, Rattus norvegicus
tgatagccttcagagcacagagact

SEQ ID NO: 613539 - DNA, 25 bp, Rattus norvegicus
tgatagctaacgacaggcccctcag

SEQ ID NO: 613540 - DNA, 25 bp, Rattus norvegicus
tgatagctaacgtcaggcccctcag

SEQ ID NO: 613541 - DNA, 25 bp, Rattus norvegicus
tgatagctagatacctaaccctggc

SEQ ID NO: 613542 - DNA, 25 bp, Rattus norvegicus
tgatagctagattcctaaccctggc

SEQ ID NO: 613543 - DNA, 25 bp, Rattus norvegicus
tgatagctcacacctacaatcccag

SEQ ID NO: 613544 - DNA, 25 bp, Rattus norvegicus
tgatagctcacagctacaatcccag

SEQ ID NO: 613545 - DNA, 25 bp, Rattus norvegicus
tgatagctctgaactttccagcacc

SEQ ID NO: 613546 - DNA, 25 bp, Rattus norvegicus
tgatagctctgatctttccagcacc

SEQ ID NO: 613547 - DNA, 25 bp, Rattus norvegicus
tgatagctcttcctctgaaacttgg

SEQ ID NO: 613548 - DNA, 25 bp, Rattus norvegicus
tgatagctcttcgtctgaaacttgg

SEQ ID NO: 613549 - DNA, 25 bp, Rattus norvegicus
tgatagctgcctccagtagaccaag

SEQ ID NO: 613550 - DNA, 25 bp, Rattus norvegicus
tgatagctgcctgcagtagaccaag

SEQ ID NO: 613551 - DNA, 25 bp, Rattus norvegicus
tgatagctgcttcggacgggtccta

SEQ ID NO: 613552 - DNA, 25 bp, Rattus norvegicus
tgatagctgcttgggacgggtccta

SEQ ID NO: 613553 - DNA, 25 bp, Rattus norvegicus
tgatagcttctcctttccctgaagt

SEQ ID NO: 613554 - DNA, 25 bp, Rattus norvegicus
tgatagcttctcgtttccctgaagt

SEQ ID NO: 613555 - DNA, 25 bp, Rattus norvegicus
tgataggaaaacatccagtctgtta

SEQ ID NO: 613556 - DNA, 25 bp, Rattus norvegicus
tgataggaaaacttccagtctgtta

SEQ ID NO: 613557 - DNA, 25 bp, Rattus norvegicus
tgataggactgaaggctgccacccc

SEQ ID NO: 613558 - DNA, 25 bp, Rattus norvegicus
tgataggactgatggctgccacccc

SEQ ID NO: 613559 - DNA, 25 bp, Rattus norvegicus
tgataggcacagctgtccccagact

SEQ ID NO: 613560 - DNA, 25 bp, Rattus norvegicus
tgataggcacaggtgtccccagact

SEQ ID NO: 613561 - DNA, 25 bp, Rattus norvegicus
tgataggcatccatgtttgcgttct

SEQ ID NO: 613562 - DNA, 25 bp, Rattus norvegicus
tgataggcatccttgtttgcgttct

SEQ ID NO: 613563 - DNA, 25 bp, Rattus norvegicus
tgataggctttgaggttctgcaccc

SEQ ID NO: 613564 - DNA, 25 bp, Rattus norvegicus
tgataggctttgtggttctgcaccc

SEQ ID NO: 613565 - DNA, 25 bp, Rattus norvegicus
tgatagggacctctgatgactccac

SEQ ID NO: 613566 - DNA, 25 bp, Rattus norvegicus
tgatagggacctgtgatgactccac

SEQ ID NO: 613567 - DNA, 25 bp, Rattus norvegicus
tgatagggacttaagcaccagctct

SEQ ID NO: 613568 - DNA, 25 bp, Rattus norvegicus
tgatagggactttagcaccagctct

SEQ ID NO: 613569 - DNA, 25 bp, Rattus norvegicus
tgatagggcctcactccaaggagac

SEQ ID NO: 613570 - DNA, 25 bp, Rattus norvegicus
tgatagggcctctctccaaggagac

SEQ ID NO: 613571 - DNA, 25 bp, Rattus norvegicus
tgatagggtctcatgccaacacgga

SEQ ID NO: 613572 - DNA, 25 bp, Rattus norvegicus
tgatagggtctcttgccaacacgga

SEQ ID NO: 613573 - DNA, 25 bp, Rattus norvegicus
tgataggtcacaatctccatcctta

SEQ ID NO: 613574 - DNA, 25 bp, Rattus norvegicus
tgataggtcacattctccatcctta

SEQ ID NO: 613575 - DNA, 25 bp, Rattus norvegicus
tgataggtccagaggtcccgtatgt

SEQ ID NO: 613576 - DNA, 25 bp, Rattus norvegicus
tgataggtccagtggtcccgtatgt

SEQ ID NO: 613577 - DNA, 25 bp, Rattus norvegicus
tgataggtgattattgcccatgaat

SEQ ID NO: 613578 - DNA, 25 bp, Rattus norvegicus
tgataggtgatttttgcccatgaat

SEQ ID NO: 613579 - DNA, 25 bp, Rattus norvegicus
tgatagtaggttaggctctagtcat

SEQ ID NO: 613580 - DNA, 25 bp, Rattus norvegicus
tgatagtaggtttggctctagtcat

SEQ ID NO: 613581 - DNA, 25 bp, Rattus norvegicus
tgatagtatcttcagggcatgtata

SEQ ID NO: 613582 - DNA, 25 bp, Rattus norvegicus
tgatagtatcttgagggcatgtata

SEQ ID NO: 613583 - DNA, 25 bp, Rattus norvegicus
tgatagtcccatagaatgtttcttg

SEQ ID NO: 613584 - DNA, 25 bp, Rattus norvegicus
tgatagtcccattgaatgtttcttg

SEQ ID NO: 613585 - DNA, 25 bp, Rattus norvegicus
tgatagtccttcaccctgcagtgtt

SEQ ID NO: 613586 - DNA, 25 bp, Rattus norvegicus
tgatagtccttctccctgcagtgtt

SEQ ID NO: 613587 - DNA, 25 bp, Rattus norvegicus
tgatagtctccccaggttgttcatt

SEQ ID NO: 613588 - DNA, 25 bp, Rattus norvegicus
tgatagtctcccgaggttgttcatt

SEQ ID NO: 613589 - DNA, 25 bp, Rattus norvegicus
tgatagtgactgaccctgtggactg

SEQ ID NO: 613590 - DNA, 25 bp, Rattus norvegicus
tgatagtgactgtccctgtggactg

SEQ ID NO: 613591 - DNA, 25 bp, Rattus norvegicus
tgatagtgctgcattaactgtctcc

SEQ ID NO: 613592 - DNA, 25 bp, Rattus norvegicus
tgatagtgctgctttaactgtctcc

SEQ ID NO: 613593 - DNA, 25 bp, Rattus norvegicus
tgatagtgctgtaggcaagccccac

SEQ ID NO: 613594 - DNA, 25 bp, Rattus norvegicus
tgatagtgctgttggcaagccccac

SEQ ID NO: 613595 - DNA, 25 bp, Rattus norvegicus
tgatagtggcttacgtcactcctag

SEQ ID NO: 613596 - DNA, 25 bp, Rattus norvegicus
tgatagtggctttcgtcactcctag

SEQ ID NO: 613597 - DNA, 25 bp, Rattus norvegicus
tgatagtgtcccaccttacctatga

SEQ ID NO: 613598 - DNA, 25 bp, Rattus norvegicus
tgatagtgtccctccttacctatga

SEQ ID NO: 613599 - DNA, 25 bp, Rattus norvegicus
tgatagtgtgttcctctcagtctca

SEQ ID NO: 613600 - DNA, 25 bp, Rattus norvegicus
tgatagtgtgttgctctcagtctca

SEQ ID NO: 613601 - DNA, 25 bp, Rattus norvegicus
tgatagtgttgcagtcatcctgtgt

SEQ ID NO: 613602 - DNA, 25 bp, Rattus norvegicus
tgatagtgttgctgtcatcctgtgt

SEQ ID NO: 613603 - DNA, 25 bp, Rattus norvegicus
tgatagttcctaaggttttgctttt

SEQ ID NO: 613604 - DNA, 25 bp, Rattus norvegicus
tgatagttcctatggttttgctttt

SEQ ID NO: 613605 - DNA, 25 bp, Rattus norvegicus
tgatagtttcgtagtgttttgcctt

SEQ ID NO: 613606 - DNA, 25 bp, Rattus norvegicus
tgatagtttcgttgtgttttgcctt

SEQ ID NO: 613607 - DNA, 25 bp, Rattus norvegicus
tgatagtttgctccagtcctgactt

SEQ ID NO: 613608 - DNA, 25 bp, Rattus norvegicus
tgatagtttgctgcagtcctgactt

SEQ ID NO: 613609 - DNA, 25 bp, Rattus norvegicus
tgatataaggccatcattccactcc

SEQ ID NO: 613610 - DNA, 25 bp, Rattus norvegicus
tgatataaggccttcattccactcc

SEQ ID NO: 613611 - DNA, 25 bp, Rattus norvegicus
tgatatagaaggctgctccacccaa

SEQ ID NO: 613612 - DNA, 25 bp, Rattus norvegicus
tgatatagaagggtgctccacccaa

SEQ ID NO: 613613 - DNA, 25 bp, Rattus norvegicus
tgatatattttacagtctatgcatt

SEQ ID NO: 613614 - DNA, 25 bp, Rattus norvegicus
tgatatattttagagtctatgcatt

SEQ ID NO: 613615 - DNA, 25 bp, Rattus norvegicus
tgatatcaatccagcctggtacacg

SEQ ID NO: 613616 - DNA, 25 bp, Rattus norvegicus
tgatatcaatcctgcctggtacacg

SEQ ID NO: 613617 - DNA, 25 bp, Rattus norvegicus
tgatatcatcaaacacgccagtgcg

SEQ ID NO: 613618 - DNA, 25 bp, Rattus norvegicus
tgatatcatcaatcacgccagtgcg

SEQ ID NO: 613619 - DNA, 25 bp, Rattus norvegicus
tgatatccatctaaagcccgatagg

SEQ ID NO: 613620 - DNA, 25 bp, Rattus norvegicus
tgatatccatcttaagcccgatagg

SEQ ID NO: 613621 - DNA, 25 bp, Rattus norvegicus
tgatatcccctacgagttacgagat

SEQ ID NO: 613622 - DNA, 25 bp, Rattus norvegicus
tgatatcccctaggagttacgagat

SEQ ID NO: 613623 - DNA, 25 bp, Rattus norvegicus
tgatatcctggccatgtgaacctca

SEQ ID NO: 613624 - DNA, 25 bp, Rattus norvegicus
tgatatcctggcgatgtgaacctca

SEQ ID NO: 613625 - DNA, 25 bp, Rattus norvegicus
tgatatctctggctgttaacttgtc

SEQ ID NO: 613626 - DNA, 25 bp, Rattus norvegicus
tgatatctctgggtgttaacttgtc

SEQ ID NO: 613627 - DNA, 25 bp, Rattus norvegicus
tgatatctgcacactcccagacaag

SEQ ID NO: 613628 - DNA, 25 bp, Rattus norvegicus
tgatatctgcactctcccagacaag

SEQ ID NO: 613629 - DNA, 25 bp, Rattus norvegicus
tgatatctggttcccttattctgag

SEQ ID NO: 613630 - DNA, 25 bp, Rattus norvegicus
tgatatctggttgccttattctgag

SEQ ID NO: 613631 - DNA, 25 bp, Rattus norvegicus
tgatatgaaatcagtggcacctggg

SEQ ID NO: 613632 - DNA, 25 bp, Rattus norvegicus
tgatatgaaatctgtggcacctggg

SEQ ID NO: 613633 - DNA, 25 bp, Rattus norvegicus
tgatatgaagcccaagcacctactc

SEQ ID NO: 613634 - DNA, 25 bp, Rattus norvegicus
tgatatgaagccgaagcacctactc

SEQ ID NO: 613635 - DNA, 25 bp, Rattus norvegicus
tgatatgacttcaagcttattcccc

SEQ ID NO: 613636 - DNA, 25 bp, Rattus norvegicus
tgatatgacttctagcttattcccc

SEQ ID NO: 613637 - DNA, 25 bp, Rattus norvegicus
tgatatgcaacacaccacagactcc

SEQ ID NO: 613638 - DNA, 25 bp, Rattus norvegicus
tgatatgcaacagaccacagactcc

SEQ ID NO: 613639 - DNA, 25 bp, Rattus norvegicus
tgatatggactgactggcagctcaa

SEQ ID NO: 613640 - DNA, 25 bp, Rattus norvegicus
tgatatggactgtctggcagctcaa

SEQ ID NO: 613641 - DNA, 25 bp, Rattus norvegicus
tgatatggccctcgtcgtcgtgtaa

SEQ ID NO: 613642 - DNA, 25 bp, Rattus norvegicus
tgatatggccctggtcgtcgtgtaa

SEQ ID NO: 613643 - DNA, 25 bp, Rattus norvegicus
tgatatgggtcaccagactggacac

SEQ ID NO: 613644 - DNA, 25 bp, Rattus norvegicus
tgatatgggtcagcagactggacac

SEQ ID NO: 613645 - DNA, 25 bp, Rattus norvegicus
tgatatgtgcctctatcctcagcta

SEQ ID NO: 613646 - DNA, 25 bp, Rattus norvegicus
tgatatgtgcctgtatcctcagcta

SEQ ID NO: 613647 - DNA, 25 bp, Rattus norvegicus
tgatatgtgcttatccaactatagc

SEQ ID NO: 613648 - DNA, 25 bp, Rattus norvegicus
tgatatgtgcttttccaactatagc

SEQ ID NO: 613649 - DNA, 25 bp, Rattus norvegicus
tgatatgttgtcctcatcttcattc

SEQ ID NO: 613650 - DNA, 25 bp, Rattus norvegicus
tgatatgttgtcgtcatcttcattc

SEQ ID NO: 613651 - DNA, 25 bp, Rattus norvegicus
tgatattaaaaacttgaccttcgaa

SEQ ID NO: 613652 - DNA, 25 bp, Rattus norvegicus
tgatattaaaaagttgaccttcgaa

SEQ ID NO: 613653 - DNA, 25 bp, Rattus norvegicus
tgatattctcagagttttaagtggt

SEQ ID NO: 613654 - DNA, 25 bp, Rattus norvegicus
tgatattctcagtgttttaagtggt

SEQ ID NO: 613655 - DNA, 25 bp, Rattus norvegicus
tgatattggccaacgggaagctcct

SEQ ID NO: 613656 - DNA, 25 bp, Rattus norvegicus
tgatattggccatcgggaagctcct

SEQ ID NO: 613657 - DNA, 25 bp, Rattus norvegicus
tgatattggcctccacaagttggtg

SEQ ID NO: 613658 - DNA, 25 bp, Rattus norvegicus
tgatattggcctgcacaagttggtg

SEQ ID NO: 613659 - DNA, 25 bp, Rattus norvegicus
tgatattgtaccctgattgagtcca

SEQ ID NO: 613660 - DNA, 25 bp, Rattus norvegicus
tgatattgtaccgtgattgagtcca

SEQ ID NO: 613661 - DNA, 25 bp, Rattus norvegicus
tgatattgtattccaccagctccca

SEQ ID NO: 613662 - DNA, 25 bp, Rattus norvegicus
tgatattgtattgcaccagctccca

SEQ ID NO: 613663 - DNA, 25 bp, Rattus norvegicus
tgatatttatcacatggccaagaga

SEQ ID NO: 613664 - DNA, 25 bp, Rattus norvegicus
tgatatttatcagatggccaagaga

SEQ ID NO: 613665 - DNA, 25 bp, Rattus norvegicus
tgatatttcctaaccattttcctcc

SEQ ID NO: 613666 - DNA, 25 bp, Rattus norvegicus
tgatatttcctatccattttcctcc

SEQ ID NO: 613667 - DNA, 25 bp, Rattus norvegicus
tgatatttgagaatcctggtgcccc

SEQ ID NO: 613668 - DNA, 25 bp, Rattus norvegicus
tgatatttgagattcctggtgcccc

SEQ ID NO: 613669 - DNA, 25 bp, Rattus norvegicus
tgatatttttataccctaataccaa

SEQ ID NO: 613670 - DNA, 25 bp, Rattus norvegicus
tgatatttttatagccatgtgtggt

SEQ ID NO: 613671 - DNA, 25 bp, Rattus norvegicus
tgatatttttattccctaataccaa

SEQ ID NO: 613672 - DNA, 25 bp, Rattus norvegicus
tgatatttttattgccatgtgtggt

SEQ ID NO: 613673 - DNA, 25 bp, Rattus norvegicus
tgatatttttgtatttccgtggaag

SEQ ID NO: 613674 - DNA, 25 bp, Rattus norvegicus
tgatatttttgtttttccgtggaag

SEQ ID NO: 613675 - DNA, 25 bp, Rattus norvegicus
tgatcaaaaccccacacttatccat

SEQ ID NO: 613676 - DNA, 25 bp, Rattus norvegicus
tgatcaaaacccgacacttatccat

SEQ ID NO: 613677 - DNA, 25 bp, Rattus norvegicus
tgatcaaactctcactgctctcgca

SEQ ID NO: 613678 - DNA, 25 bp, Rattus norvegicus
tgatcaaactctgactgctctcgca

SEQ ID NO: 613679 - DNA, 25 bp, Rattus norvegicus
tgatcaaagtatcctgtacagttgt

SEQ ID NO: 613680 - DNA, 25 bp, Rattus norvegicus
tgatcaaagtatgctgtacagttgt

SEQ ID NO: 613681 - DNA, 25 bp, Rattus norvegicus
tgatcaaatgcacccatccaatggt

SEQ ID NO: 613682 - DNA, 25 bp, Rattus norvegicus
tgatcaaatgcagccatccaatggt

SEQ ID NO: 613683 - DNA, 25 bp, Rattus norvegicus
tgatcaacaccgacaacgtcactga

SEQ ID NO: 613684 - DNA, 25 bp, Rattus norvegicus
tgatcaacaccgtcaacgtcactga

SEQ ID NO: 613685 - DNA, 25 bp, Rattus norvegicus
tgatcaacactacagcaccttttgc

SEQ ID NO: 613686 - DNA, 25 bp, Rattus norvegicus
tgatcaacactagagcaccttttgc

SEQ ID NO: 613687 - DNA, 25 bp, Rattus norvegicus
tgatcaaccctgagccacgtggtgt

SEQ ID NO: 613688 - DNA, 25 bp, Rattus norvegicus
tgatcaaccctgtgccacgtggtgt

SEQ ID NO: 613689 - DNA, 25 bp, Rattus norvegicus
tgatcaacctaccaagagcccagaa

SEQ ID NO: 613690 - DNA, 25 bp, Rattus norvegicus
tgatcaacctacgaagagcccagaa

SEQ ID NO: 613691 - DNA, 25 bp, Rattus norvegicus
tgatcaactatacactttgcccctc

SEQ ID NO: 613692 - DNA, 25 bp, Rattus norvegicus
tgatcaactatagactttgcccctc

SEQ ID NO: 613693 - DNA, 25 bp, Rattus norvegicus
tgatcaactatgcaggccgaggcag

SEQ ID NO: 613694 - DNA, 25 bp, Rattus norvegicus
tgatcaactatggaggccgaggcag

SEQ ID NO: 613695 - DNA, 25 bp, Rattus norvegicus
tgatcaagatcaccctcagcaagag

SEQ ID NO: 613696 - DNA, 25 bp, Rattus norvegicus
tgatcaagatcagcctcagcaagag

SEQ ID NO: 613697 - DNA, 25 bp, Rattus norvegicus
tgatcaagctctctgtccccgtgac

SEQ ID NO: 613698 - DNA, 25 bp, Rattus norvegicus
tgatcaagctctgtgtccccgtgac

SEQ ID NO: 613699 - DNA, 25 bp, Rattus norvegicus
tgatcaaggccaacactcaagagag

SEQ ID NO: 613700 - DNA, 25 bp, Rattus norvegicus
tgatcaaggccatcactcaagagag

SEQ ID NO: 613701 - DNA, 25 bp, Rattus norvegicus
tgatcaagtgtgaccccaatgacca

SEQ ID NO: 613702 - DNA, 25 bp, Rattus norvegicus
tgatcaagtgtgtccccaatgacca

SEQ ID NO: 613703 - DNA, 25 bp, Rattus norvegicus
tgatcacaagatactgtccccaaac

SEQ ID NO: 613704 - DNA, 25 bp, Rattus norvegicus
tgatcacaagattctgtccccaaac

SEQ ID NO: 613705 - DNA, 25 bp, Rattus norvegicus
tgatcacacccaaatctagctgcat

SEQ ID NO: 613706 - DNA, 25 bp, Rattus norvegicus
tgatcacacccatatctagctgcat

SEQ ID NO: 613707 - DNA, 25 bp, Rattus norvegicus
tgatcacacctacggtgctagtgag

SEQ ID NO: 613708 - DNA, 25 bp, Rattus norvegicus
tgatcacacctagggtgctagtgag

SEQ ID NO: 613709 - DNA, 25 bp, Rattus norvegicus
tgatcaccaacaaccgactacagtt

SEQ ID NO: 613710 - DNA, 25 bp, Rattus norvegicus
tgatcaccaacatccgactacagtt

SEQ ID NO: 613711 - DNA, 25 bp, Rattus norvegicus
tgatcaccagctctctgaacgcggg

SEQ ID NO: 613712 - DNA, 25 bp, Rattus norvegicus
tgatcaccagctgtctgaacgcggg

SEQ ID NO: 613713 - DNA, 25 bp, Rattus norvegicus
tgatcaccccagcttctgattttac

SEQ ID NO: 613714 - DNA, 25 bp, Rattus norvegicus
tgatcaccccaggttctgattttac

SEQ ID NO: 613715 - DNA, 25 bp, Rattus norvegicus
tgatcacccttcctgagtctaatat

SEQ ID NO: 613716 - DNA, 25 bp, Rattus norvegicus
tgatcacccttcgtgagtctaatat

SEQ ID NO: 613717 - DNA, 25 bp, Rattus norvegicus
tgatcacctaagctgcctcagaact

SEQ ID NO: 613718 - DNA, 25 bp, Rattus norvegicus
tgatcacctaaggtgcctcagaact

SEQ ID NO: 613719 - DNA, 25 bp, Rattus norvegicus
tgatcacctagaagagcctgccaat

SEQ ID NO: 613720 - DNA, 25 bp, Rattus norvegicus
tgatcacctagatgagcctgccaat

SEQ ID NO: 613721 - DNA, 25 bp, Rattus norvegicus
tgatcacctcccaccatctgtgatg

SEQ ID NO: 613722 - DNA, 25 bp, Rattus norvegicus
tgatcacctccctccatctgtgatg

SEQ ID NO: 613723 - DNA, 25 bp, Rattus norvegicus
tgatcacctgatcagcctagctctt

SEQ ID NO: 613724 - DNA, 25 bp, Rattus norvegicus
tgatcacctgatgagcctagctctt

SEQ ID NO: 613725 - DNA, 25 bp, Rattus norvegicus
tgatcacctgccatctttgtaggaa

SEQ ID NO: 613726 - DNA, 25 bp, Rattus norvegicus
tgatcacctgccttctttgtaggaa

SEQ ID NO: 613727 - DNA, 25 bp, Rattus norvegicus
tgatcacctgctcctgaagtctttt

SEQ ID NO: 613728 - DNA, 25 bp, Rattus norvegicus
tgatcacctgctgctgaagtctttt

SEQ ID NO: 613729 - DNA, 25 bp, Rattus norvegicus
tgatcaccttgcacagggcctcagt

SEQ ID NO: 613730 - DNA, 25 bp, Rattus norvegicus
tgatcaccttgctcagggcctcagt

SEQ ID NO: 613731 - DNA, 25 bp, Rattus norvegicus
tgatcacgccaccagtatatttggt

SEQ ID NO: 613732 - DNA, 25 bp, Rattus norvegicus
tgatcacgccacgagtatatttggt

SEQ ID NO: 613733 - DNA, 25 bp, Rattus norvegicus
tgatcacgcttcatttccgaggacg

SEQ ID NO: 613734 - DNA, 25 bp, Rattus norvegicus
tgatcacgcttcttttccgaggacg

SEQ ID NO: 613735 - DNA, 25 bp, Rattus norvegicus
tgatcacgttccagccaatgttccg

SEQ ID NO: 613736 - DNA, 25 bp, Rattus norvegicus
tgatcacgttcctgccaatgttccg

SEQ ID NO: 613737 - DNA, 25 bp, Rattus norvegicus
tgatcactataactttgctgcaggt

SEQ ID NO: 613738 - DNA, 25 bp, Rattus norvegicus
tgatcactataagtttgctgcaggt

SEQ ID NO: 613739 - DNA, 25 bp, Rattus norvegicus
tgatcactcacaattctgcaaccca

SEQ ID NO: 613740 - DNA, 25 bp, Rattus norvegicus
tgatcactcacatttctgcaaccca

SEQ ID NO: 613741 - DNA, 25 bp, Rattus norvegicus
tgatcactcctacttttctgtcgtc

SEQ ID NO: 613742 - DNA, 25 bp, Rattus norvegicus
tgatcactcctagttttctgtcgtc

SEQ ID NO: 613743 - DNA, 25 bp, Rattus norvegicus
tgatcactcgatcactcgggtcaag

SEQ ID NO: 613744 - DNA, 25 bp, Rattus norvegicus
tgatcactcgatgactcgggtcaag

SEQ ID NO: 613745 - DNA, 25 bp, Rattus norvegicus
tgatcactctgaatggttgaagcca

SEQ ID NO: 613746 - DNA, 25 bp, Rattus norvegicus
tgatcactctgattggttgaagcca

SEQ ID NO: 613747 - DNA, 25 bp, Rattus norvegicus
tgatcactctgtcttgtacgttttg

SEQ ID NO: 613748 - DNA, 25 bp, Rattus norvegicus
tgatcactctgtgttgtacgttttg

SEQ ID NO: 613749 - DNA, 25 bp, Rattus norvegicus
tgatcactggcacgaacatgccctg

SEQ ID NO: 613750 - DNA, 25 bp, Rattus norvegicus
tgatcactggcaggaacatgccctg

SEQ ID NO: 613751 - DNA, 25 bp, Rattus norvegicus
tgatcactgtgcacctcatgtggct

SEQ ID NO: 613752 - DNA, 25 bp, Rattus norvegicus
tgatcactgtgctcctcatgtggct

SEQ ID NO: 613753 - DNA, 25 bp, Rattus norvegicus
tgatcacttatcatccactcggtat

SEQ ID NO: 613754 - DNA, 25 bp, Rattus norvegicus
tgatcacttatcttccactcggtat

SEQ ID NO: 613755 - DNA, 25 bp, Rattus norvegicus
tgatcacttgtgatgtctacctttc

SEQ ID NO: 613756 - DNA, 25 bp, Rattus norvegicus
tgatcacttgtgttgtctacctttc

SEQ ID NO: 613757 - DNA, 25 bp, Rattus norvegicus
tgatcactttaaaccacactgtaga

SEQ ID NO: 613758 - DNA, 25 bp, Rattus norvegicus
tgatcactttaatccacactgtaga

SEQ ID NO: 613759 - DNA, 25 bp, Rattus norvegicus
tgatcagaagtacaccctcactctc

SEQ ID NO: 613760 - DNA, 25 bp, Rattus norvegicus
tgatcagaagtagaccctcactctc

SEQ ID NO: 613761 - DNA, 25 bp, Rattus norvegicus
tgatcagactgactaccacaccttc

SEQ ID NO: 613762 - DNA, 25 bp, Rattus norvegicus
tgatcagactgagtaccacaccttc

SEQ ID NO: 613763 - DNA, 25 bp, Rattus norvegicus
tgatcagattcactaagcctctcct

SEQ ID NO: 613764 - DNA, 25 bp, Rattus norvegicus
tgatcagattcagtaagcctctcct

SEQ ID NO: 613765 - DNA, 25 bp, Rattus norvegicus
tgatcagcactgatgcgattcccat

SEQ ID NO: 613766 - DNA, 25 bp, Rattus norvegicus
tgatcagcactgttgcgattcccat

SEQ ID NO: 613767 - DNA, 25 bp, Rattus norvegicus
tgatcagcagctcgctataccttga

SEQ ID NO: 613768 - DNA, 25 bp, Rattus norvegicus
tgatcagcagctggctataccttga

SEQ ID NO: 613769 - DNA, 25 bp, Rattus norvegicus
tgatcagcgtttccattccattcaa

SEQ ID NO: 613770 - DNA, 25 bp, Rattus norvegicus
tgatcagcgtttgcattccattcaa

SEQ ID NO: 613771 - DNA, 25 bp, Rattus norvegicus
tgatcagctaccatagttcattact

SEQ ID NO: 613772 - DNA, 25 bp, Rattus norvegicus
tgatcagctaccttagttcattact

SEQ ID NO: 613773 - DNA, 25 bp, Rattus norvegicus
tgatcagctggaactctgcttgcgc

SEQ ID NO: 613774 - DNA, 25 bp, Rattus norvegicus
tgatcagctggatctctgcttgcgc

SEQ ID NO: 613775 - DNA, 25 bp, Rattus norvegicus
tgatcagctgtcaccccagaggttc

SEQ ID NO: 613776 - DNA, 25 bp, Rattus norvegicus
tgatcagctgtctccccagaggttc

SEQ ID NO: 613777 - DNA, 25 bp, Rattus norvegicus
tgatcaggactaacgagactcggga

SEQ ID NO: 613778 - DNA, 25 bp, Rattus norvegicus
tgatcaggactatcgagactcggga

SEQ ID NO: 613779 - DNA, 25 bp, Rattus norvegicus
tgatcaggagggacagccatgtttg

SEQ ID NO: 613780 - DNA, 25 bp, Rattus norvegicus
tgatcaggagggtcagccatgtttg

SEQ ID NO: 613781 - DNA, 25 bp, Rattus norvegicus
tgatcaggagttaggcgtccggccc

SEQ ID NO: 613782 - DNA, 25 bp, Rattus norvegicus
tgatcaggagtttggcgtccggccc

SEQ ID NO: 613783 - DNA, 25 bp, Rattus norvegicus
tgatcaggattaaggtctcccgttc

SEQ ID NO: 613784 - DNA, 25 bp, Rattus norvegicus
tgatcaggattatggtctcccgttc

SEQ ID NO: 613785 - DNA, 25 bp, Rattus norvegicus
tgatcaggcaatacggtcaattgtc

SEQ ID NO: 613786 - DNA, 25 bp, Rattus norvegicus
tgatcaggcaattcggtcaattgtc

SEQ ID NO: 613787 - DNA, 25 bp, Rattus norvegicus
tgatcaggcctcctgggaattgctg

SEQ ID NO: 613788 - DNA, 25 bp, Rattus norvegicus
tgatcaggcctcgtgggaattgctg

SEQ ID NO: 613789 - DNA, 25 bp, Rattus norvegicus
tgatcagttcatagtgtcccaggac

SEQ ID NO: 613790 - DNA, 25 bp, Rattus norvegicus
tgatcagttcattgtgtcccaggac

SEQ ID NO: 613791 - DNA, 25 bp, Rattus norvegicus
tgatcagttctgagccgaggagctg

SEQ ID NO: 613792 - DNA, 25 bp, Rattus norvegicus
tgatcagttctgtgccgaggagctg

SEQ ID NO: 613793 - DNA, 25 bp, Rattus norvegicus
tgatcagttgacaaataggcccttt

SEQ ID NO: 613794 - DNA, 25 bp, Rattus norvegicus
tgatcagttgacaggattagctccc

SEQ ID NO: 613795 - DNA, 25 bp, Rattus norvegicus
tgatcagttgactaataggcccttt

SEQ ID NO: 613796 - DNA, 25 bp, Rattus norvegicus
tgatcagttgactggattagctccc

SEQ ID NO: 613797 - DNA, 25 bp, Rattus norvegicus
tgatcagtttcacaaagtttgttcc

SEQ ID NO: 613798 - DNA, 25 bp, Rattus norvegicus
tgatcagtttcagaaagtttgttcc

SEQ ID NO: 613799 - DNA, 25 bp, Rattus norvegicus
tgatcagtttctatgtcttcctgcc

SEQ ID NO: 613800 - DNA, 25 bp, Rattus norvegicus
tgatcagtttctttgtcttcctgcc

SEQ ID NO: 613801 - DNA, 25 bp, Rattus norvegicus
tgatcataagagaacacacccaccc

SEQ ID NO: 613802 - DNA, 25 bp, Rattus norvegicus
tgatcataagagtacacacccaccc

SEQ ID NO: 613803 - DNA, 25 bp, Rattus norvegicus
tgatcataagccacacttcaactct

SEQ ID NO: 613804 - DNA, 25 bp, Rattus norvegicus
tgatcataagcctcacttcaactct

SEQ ID NO: 613805 - DNA, 25 bp, Rattus norvegicus
tgatcatactctcttcaagctccaa

SEQ ID NO: 613806 - DNA, 25 bp, Rattus norvegicus
tgatcatactctgttcaagctccaa

SEQ ID NO: 613807 - DNA, 25 bp, Rattus norvegicus
tgatcatagctaacattcactcccc

SEQ ID NO: 613808 - DNA, 25 bp, Rattus norvegicus
tgatcatagctatcattcactcccc

SEQ ID NO: 613809 - DNA, 25 bp, Rattus norvegicus
tgatcatcacccatatcagcgtcta

SEQ ID NO: 613810 - DNA, 25 bp, Rattus norvegicus
tgatcatcacccttatcagcgtcta

SEQ ID NO: 613811 - DNA, 25 bp, Rattus norvegicus
tgatcatcagtcattcctcgtgagt

SEQ ID NO: 613812 - DNA, 25 bp, Rattus norvegicus
tgatcatcagtctttcctcgtgagt

SEQ ID NO: 613813 - DNA, 25 bp, Rattus norvegicus
tgatcatccatgctacggctgacga

SEQ ID NO: 613814 - DNA, 25 bp, Rattus norvegicus
tgatcatccatggtacggctgacga

SEQ ID NO: 613815 - DNA, 25 bp, Rattus norvegicus
tgatcatcccttactacgtggtgat

SEQ ID NO: 613816 - DNA, 25 bp, Rattus norvegicus
tgatcatccctttctacgtggtgat

SEQ ID NO: 613817 - DNA, 25 bp, Rattus norvegicus
tgatcatccggaagcctgtgactgt

SEQ ID NO: 613818 - DNA, 25 bp, Rattus norvegicus
tgatcatccggatgcctgtgactgt

SEQ ID NO: 613819 - DNA, 25 bp, Rattus norvegicus
tgatcatcggcaagggaggcgccac

SEQ ID NO: 613820 - DNA, 25 bp, Rattus norvegicus
tgatcatcggcatgggaggcgccac

SEQ ID NO: 613821 - DNA, 25 bp, Rattus norvegicus
tgatcatctggtcttttcttcagct

SEQ ID NO: 613822 - DNA, 25 bp, Rattus norvegicus
tgatcatctggtgttttcttcagct

SEQ ID NO: 613823 - DNA, 25 bp, Rattus norvegicus
tgatcatcttgcactccatatgaag

SEQ ID NO: 613824 - DNA, 25 bp, Rattus norvegicus
tgatcatcttgctctccatatgaag

SEQ ID NO: 613825 - DNA, 25 bp, Rattus norvegicus
tgatcatgcattcttgaggtggtct

SEQ ID NO: 613826 - DNA, 25 bp, Rattus norvegicus
tgatcatgcattgttgaggtggtct

SEQ ID NO: 613827 - DNA, 25 bp, Rattus norvegicus
tgatcatgcctgctcattgtgtgac

SEQ ID NO: 613828 - DNA, 25 bp, Rattus norvegicus
tgatcatgcctggtcattgtgtgac

SEQ ID NO: 613829 - DNA, 25 bp, Rattus norvegicus
tgatcatgttggcttctttccttct

SEQ ID NO: 613830 - DNA, 25 bp, Rattus norvegicus
tgatcatgttgggttctttccttct

SEQ ID NO: 613831 - DNA, 25 bp, Rattus norvegicus
tgatcattatccaaagccacagaga

SEQ ID NO: 613832 - DNA, 25 bp, Rattus norvegicus
tgatcattatcctaagccacagaga

SEQ ID NO: 613833 - DNA, 25 bp, Rattus norvegicus
tgatcatttgtcatccactttggag

SEQ ID NO: 613834 - DNA, 25 bp, Rattus norvegicus
tgatcatttgtcttccactttggag

SEQ ID NO: 613835 - DNA, 25 bp, Rattus norvegicus
tgatcattttgcatccgtctggaaa

SEQ ID NO: 613836 - DNA, 25 bp, Rattus norvegicus
tgatcattttgcttccgtctggaaa

SEQ ID NO: 613837 - DNA, 25 bp, Rattus norvegicus
tgatccaaagcaacgctcctaggag

SEQ ID NO: 613838 - DNA, 25 bp, Rattus norvegicus
tgatccaaagcatcgctcctaggag

SEQ ID NO: 613839 - DNA, 25 bp, Rattus norvegicus
tgatccaaagccaagccaggactgg

SEQ ID NO: 613840 - DNA, 25 bp, Rattus norvegicus
tgatccaaagcctagccaggactgg

SEQ ID NO: 613841 - DNA, 25 bp, Rattus norvegicus
tgatccaactctacaccatgcggag

SEQ ID NO: 613842 - DNA, 25 bp, Rattus norvegicus
tgatccaactcttcaccatgcggag

SEQ ID NO: 613843 - DNA, 25 bp, Rattus norvegicus
tgatccaataaaaactcttccctct

SEQ ID NO: 613844 - DNA, 25 bp, Rattus norvegicus
tgatccaataaatactcttccctct

SEQ ID NO: 613845 - DNA, 25 bp, Rattus norvegicus
tgatccaatcagatacgaaaggcct

SEQ ID NO: 613846 - DNA, 25 bp, Rattus norvegicus
tgatccaatcagttacgaaaggcct

SEQ ID NO: 613847 - DNA, 25 bp, Rattus norvegicus
tgatccacaatgagttcaccttggg

SEQ ID NO: 613848 - DNA, 25 bp, Rattus norvegicus
tgatccacaatgtgttcaccttggg

SEQ ID NO: 613849 - DNA, 25 bp, Rattus norvegicus
tgatccacatcaaagccattttcct

SEQ ID NO: 613850 - DNA, 25 bp, Rattus norvegicus
tgatccacatcatagccattttcct

SEQ ID NO: 613851 - DNA, 25 bp, Rattus norvegicus
tgatccacatccctattaataacat

SEQ ID NO: 613852 - DNA, 25 bp, Rattus norvegicus
tgatccacatccgtattaataacat

SEQ ID NO: 613853 - DNA, 25 bp, Rattus norvegicus
tgatccacatgtccatgcgtgtgca

SEQ ID NO: 613854 - DNA, 25 bp, Rattus norvegicus
tgatccacatgtgcatgcgtgtgca

SEQ ID NO: 613855 - DNA, 25 bp, Rattus norvegicus
tgatccaccctacgaagacttgcca

SEQ ID NO: 613856 - DNA, 25 bp, Rattus norvegicus
tgatccaccctaggaagacttgcca

SEQ ID NO: 613857 - DNA, 25 bp, Rattus norvegicus
tgatccacctaaatgacccctatga

SEQ ID NO: 613858 - DNA, 25 bp, Rattus norvegicus
tgatccacctaattgacccctatga

SEQ ID NO: 613859 - DNA, 25 bp, Rattus norvegicus
tgatccacgggaagcaggccttctg

SEQ ID NO: 613860 - DNA, 25 bp, Rattus norvegicus
tgatccacgggatgcaggccttctg

SEQ ID NO: 613861 - DNA, 25 bp, Rattus norvegicus
tgatccactgtgaccggcgcgctgt

SEQ ID NO: 613862 - DNA, 25 bp, Rattus norvegicus
tgatccactgtgtccggcgcgctgt

SEQ ID NO: 613863 - DNA, 25 bp, Rattus norvegicus
tgatccacttctctaattcaccgtt

SEQ ID NO: 613864 - DNA, 25 bp, Rattus norvegicus
tgatccacttctgtaattcaccgtt

SEQ ID NO: 613865 - DNA, 25 bp, Rattus norvegicus
tgatccagaaccagaatgccaccga

SEQ ID NO: 613866 - DNA, 25 bp, Rattus norvegicus
tgatccagaacctgaatgccaccga

SEQ ID NO: 613867 - DNA, 25 bp, Rattus norvegicus
tgatccagacccaaagcctggtcca

SEQ ID NO: 613868 - DNA, 25 bp, Rattus norvegicus
tgatccagaccctaagcctggtcca

SEQ ID NO: 613869 - DNA, 25 bp, Rattus norvegicus
tgatccagagagagcctagatgact

SEQ ID NO: 613870 - DNA, 25 bp, Rattus norvegicus
tgatccagagagtgcctagatgact

SEQ ID NO: 613871 - DNA, 25 bp, Rattus norvegicus
tgatccagatataccagcagcaagt

SEQ ID NO: 613872 - DNA, 25 bp, Rattus norvegicus
tgatccagatattccagcagcaagt

SEQ ID NO: 613873 - DNA, 25 bp, Rattus norvegicus
tgatccagcaaacgcaaggtcaagg

SEQ ID NO: 613874 - DNA, 25 bp, Rattus norvegicus
tgatccagcaaaggcaaggtcaagg

SEQ ID NO: 613875 - DNA, 25 bp, Rattus norvegicus
tgatccagcaggagcacgagcggca

SEQ ID NO: 613876 - DNA, 25 bp, Rattus norvegicus
tgatccagcaggtgcacgagcggca

SEQ ID NO: 613877 - DNA, 25 bp, Rattus norvegicus
tgatccagcatcatgtaccttacgg

SEQ ID NO: 613878 - DNA, 25 bp, Rattus norvegicus
tgatccagcatcttgtaccttacgg

SEQ ID NO: 613879 - DNA, 25 bp, Rattus norvegicus
tgatccagctatcctgagtggccag

SEQ ID NO: 613880 - DNA, 25 bp, Rattus norvegicus
tgatccagctatgctgagtggccag

SEQ ID NO: 613881 - DNA, 25 bp, Rattus norvegicus
tgatccagctgacccctgaggctga

SEQ ID NO: 613882 - DNA, 25 bp, Rattus norvegicus
tgatccagctgagccctgaggctga

SEQ ID NO: 613883 - DNA, 25 bp, Rattus norvegicus
tgatccagctgccacgcaagggcaa

SEQ ID NO: 613884 - DNA, 25 bp, Rattus norvegicus
tgatccagctgcgacgcaagggcaa

SEQ ID NO: 613885 - DNA, 25 bp, Rattus norvegicus
tgatccaggctgattggctgactat

SEQ ID NO: 613886 - DNA, 25 bp, Rattus norvegicus
tgatccaggctgtttggctgactat

SEQ ID NO: 613887 - DNA, 25 bp, Rattus norvegicus
tgatccagtcttcagagccgaggct

SEQ ID NO: 613888 - DNA, 25 bp, Rattus norvegicus
tgatccagtcttgagagccgaggct

SEQ ID NO: 613889 - DNA, 25 bp, Rattus norvegicus
tgatccagttacaggtgagcaccgt

SEQ ID NO: 613890 - DNA, 25 bp, Rattus norvegicus
tgatccagttactggtgagcaccgt

SEQ ID NO: 613891 - DNA, 25 bp, Rattus norvegicus
tgatccatcagtcaaattgctgctg

SEQ ID NO: 613892 - DNA, 25 bp, Rattus norvegicus
tgatccatcagtgaaattgctgctg

SEQ ID NO: 613893 - DNA, 25 bp, Rattus norvegicus
tgatccatctgtctagtttctgaac

SEQ ID NO: 613894 - DNA, 25 bp, Rattus norvegicus
tgatccatctgtgtagtttctgaac

SEQ ID NO: 613895 - DNA, 25 bp, Rattus norvegicus
tgatccatgagccagaaccgcatat

SEQ ID NO: 613896 - DNA, 25 bp, Rattus norvegicus
tgatccatgagcgagaaccgcatat

SEQ ID NO: 613897 - DNA, 25 bp, Rattus norvegicus
tgatccatgaggcacttcgggaacc

SEQ ID NO: 613898 - DNA, 25 bp, Rattus norvegicus
tgatccatgagggacttcgggaacc

SEQ ID NO: 613899 - DNA, 25 bp, Rattus norvegicus
tgatccatgagtcggctgcagcctc

SEQ ID NO: 613900 - DNA, 25 bp, Rattus norvegicus
tgatccatgagtgggctgcagcctc

SEQ ID NO: 613901 - DNA, 25 bp, Rattus norvegicus
tgatccatgattaccttccattgcc

SEQ ID NO: 613902 - DNA, 25 bp, Rattus norvegicus
tgatccatgatttccttccattgcc

SEQ ID NO: 613903 - DNA, 25 bp, Rattus norvegicus
tgatccattcagaaactcaccacat

SEQ ID NO: 613904 - DNA, 25 bp, Rattus norvegicus
tgatccattcagtaactcaccacat

SEQ ID NO: 613905 - DNA, 25 bp, Rattus norvegicus
tgatcccaacacatgactctgaggt

SEQ ID NO: 613906 - DNA, 25 bp, Rattus norvegicus
tgatcccaacacttgactctgaggt

SEQ ID NO: 613907 - DNA, 25 bp, Rattus norvegicus
tgatcccaacctagaagacagtccc

SEQ ID NO: 613908 - DNA, 25 bp, Rattus norvegicus
tgatcccaaccttgaagacagtccc

SEQ ID NO: 613909 - DNA, 25 bp, Rattus norvegicus
tgatcccaccttctaagctgtgtgg

SEQ ID NO: 613910 - DNA, 25 bp, Rattus norvegicus
tgatcccaccttgtaagctgtgtgg

SEQ ID NO: 613911 - DNA, 25 bp, Rattus norvegicus
tgatcccacggcatacctgtaagca

SEQ ID NO: 613912 - DNA, 25 bp, Rattus norvegicus
tgatcccacggcttacctgtaagca

SEQ ID NO: 613913 - DNA, 25 bp, Rattus norvegicus
tgatcccacgtcacaaagggctgga

SEQ ID NO: 613914 - DNA, 25 bp, Rattus norvegicus
tgatcccacgtctcaaagggctgga

SEQ ID NO: 613915 - DNA, 25 bp, Rattus norvegicus
tgatcccactgaagccctaaacaca

SEQ ID NO: 613916 - DNA, 25 bp, Rattus norvegicus
tgatcccactgatgccctaaacaca

SEQ ID NO: 613917 - DNA, 25 bp, Rattus norvegicus
tgatcccagcagcagttagcacgga

SEQ ID NO: 613918 - DNA, 25 bp, Rattus norvegicus
tgatcccagcaggagttagcacgga

SEQ ID NO: 613919 - DNA, 25 bp, Rattus norvegicus
tgatcccagccaccaagtaaccaaa

SEQ ID NO: 613920 - DNA, 25 bp, Rattus norvegicus
tgatcccagccagcaagtaaccaaa

SEQ ID NO: 613921 - DNA, 25 bp, Rattus norvegicus
tgatcccagcctccaattcggatac

SEQ ID NO: 613922 - DNA, 25 bp, Rattus norvegicus
tgatcccagcctgcaattcggatac

SEQ ID NO: 613923 - DNA, 25 bp, Rattus norvegicus
tgatcccagggacctcagaatgaga

SEQ ID NO: 613924 - DNA, 25 bp, Rattus norvegicus
tgatcccagggagctcagaatgaga

SEQ ID NO: 613925 - DNA, 25 bp, Rattus norvegicus
tgatcccaggtacaaggccttgtga

SEQ ID NO: 613926 - DNA, 25 bp, Rattus norvegicus
tgatcccaggtagaaggccttgtga

SEQ ID NO: 613927 - DNA, 25 bp, Rattus norvegicus
tgatccccaacaccctgataaaata

SEQ ID NO: 613928 - DNA, 25 bp, Rattus norvegicus
tgatccccaacagcctgataaaata

SEQ ID NO: 613929 - DNA, 25 bp, Rattus norvegicus
tgatccccaagactcacatggtgga

SEQ ID NO: 613930 - DNA, 25 bp, Rattus norvegicus
tgatccccaagagtcacatggtgga

SEQ ID NO: 613931 - DNA, 25 bp, Rattus norvegicus
tgatccccgacaactacgagaagga

SEQ ID NO: 613932 - DNA, 25 bp, Rattus norvegicus
tgatccccgacatctacgagaagga

SEQ ID NO: 613933 - DNA, 25 bp, Rattus norvegicus
tgatccccggctacagaactttgta

SEQ ID NO: 613934 - DNA, 25 bp, Rattus norvegicus
tgatccccggcttcagaactttgta

SEQ ID NO: 613935 - DNA, 25 bp, Rattus norvegicus
tgatcccctcccaggcaagggttgg

SEQ ID NO: 613936 - DNA, 25 bp, Rattus norvegicus
tgatcccctccctggcaagggttgg

SEQ ID NO: 613937 - DNA, 25 bp, Rattus norvegicus
tgatcccctcttctggcttttgtga

SEQ ID NO: 613938 - DNA, 25 bp, Rattus norvegicus
tgatcccctcttgtggcttttgtga

SEQ ID NO: 613939 - DNA, 25 bp, Rattus norvegicus
tgatccccttttccttaaacggtgt

SEQ ID NO: 613940 - DNA, 25 bp, Rattus norvegicus
tgatccccttttgcttaaacggtgt

SEQ ID NO: 613941 - DNA, 25 bp, Rattus norvegicus
tgatcccgggtactcgtggccgcct

SEQ ID NO: 613942 - DNA, 25 bp, Rattus norvegicus
tgatcccgggtagtcgtggccgcct

SEQ ID NO: 613943 - DNA, 25 bp, Rattus norvegicus
tgatcccgtgctccggtttctgtag

SEQ ID NO: 613944 - DNA, 25 bp, Rattus norvegicus
tgatcccgtgctgcggtttctgtag

SEQ ID NO: 613945 - DNA, 25 bp, Rattus norvegicus
tgatccctactcagtttggcagtca

SEQ ID NO: 613946 - DNA, 25 bp, Rattus norvegicus
tgatccctactcctttcaacaacaa

SEQ ID NO: 613947 - DNA, 25 bp, Rattus norvegicus
tgatccctactcgtttcaacaacaa

SEQ ID NO: 613948 - DNA, 25 bp, Rattus norvegicus
tgatccctactctgtttggcagtca

SEQ ID NO: 613949 - DNA, 25 bp, Rattus norvegicus
tgatccctcgctctgtacggacctt

SEQ ID NO: 613950 - DNA, 25 bp, Rattus norvegicus
tgatccctcgctgtgtacggacctt

SEQ ID NO: 613951 - DNA, 25 bp, Rattus norvegicus
tgatccctcgggatttgtttacaag

SEQ ID NO: 613952 - DNA, 25 bp, Rattus norvegicus
tgatccctcgggttttgtttacaag

SEQ ID NO: 613953 - DNA, 25 bp, Rattus norvegicus
tgatccctctttctctgtacagtgg

SEQ ID NO: 613954 - DNA, 25 bp, Rattus norvegicus
tgatccctctttgtctgtacagtgg

SEQ ID NO: 613955 - DNA, 25 bp, Rattus norvegicus
tgatccctgaaaacttaccccatgg

SEQ ID NO: 613956 - DNA, 25 bp, Rattus norvegicus
tgatccctgaaatcttaccccatgg

SEQ ID NO: 613957 - DNA, 25 bp, Rattus norvegicus
tgatccctgaggagtaggaccgtca

SEQ ID NO: 613958 - DNA, 25 bp, Rattus norvegicus
tgatccctgaggtgtaggaccgtca

SEQ ID NO: 613959 - DNA, 25 bp, Rattus norvegicus
tgatccctggaaccaatgtcaaaag

SEQ ID NO: 613960 - DNA, 25 bp, Rattus norvegicus
tgatccctggaagcaatgtcaaaag

SEQ ID NO: 613961 - DNA, 25 bp, Rattus norvegicus
tgatccctggaccagactcagtgga

SEQ ID NO: 613962 - DNA, 25 bp, Rattus norvegicus
tgatccctggacctccgtcagaaag

SEQ ID NO: 613963 - DNA, 25 bp, Rattus norvegicus
tgatccctggacgagactcagtgga

SEQ ID NO: 613964 - DNA, 25 bp, Rattus norvegicus
tgatccctggacgtccgtcagaaag

SEQ ID NO: 613965 - DNA, 25 bp, Rattus norvegicus
tgatccctgggaccttgttaaaaag

SEQ ID NO: 613966 - DNA, 25 bp, Rattus norvegicus
tgatccctgggagcttgttaaaaag

SEQ ID NO: 613967 - DNA, 25 bp, Rattus norvegicus
tgatcccttcacctattgccaattg

SEQ ID NO: 613968 - DNA, 25 bp, Rattus norvegicus
tgatcccttcacgtattgccaattg

SEQ ID NO: 613969 - DNA, 25 bp, Rattus norvegicus
tgatcccttctcatgtatagactcc

SEQ ID NO: 613970 - DNA, 25 bp, Rattus norvegicus
tgatcccttctcttgtatagactcc

SEQ ID NO: 613971 - DNA, 25 bp, Rattus norvegicus
tgatcccttgccaactctgtattta

SEQ ID NO: 613972 - DNA, 25 bp, Rattus norvegicus
tgatcccttgcctactctgtattta

SEQ ID NO: 613973 - DNA, 25 bp, Rattus norvegicus
tgatccctttacattggtggcttgc

SEQ ID NO: 613974 - DNA, 25 bp, Rattus norvegicus
tgatccctttactttggtggcttgc

SEQ ID NO: 613975 - DNA, 25 bp, Rattus norvegicus
tgatccctttcaataaccagcagct

SEQ ID NO: 613976 - DNA, 25 bp, Rattus norvegicus
tgatccctttcattaaccagcagct

SEQ ID NO: 613977 - DNA, 25 bp, Rattus norvegicus
tgatccctttggattagggagctgt

SEQ ID NO: 613978 - DNA, 25 bp, Rattus norvegicus
tgatccctttggtttagggagctgt

SEQ ID NO: 613979 - DNA, 25 bp, Rattus norvegicus
tgatccgaacacaggaaccccaaag

SEQ ID NO: 613980 - DNA, 25 bp, Rattus norvegicus
tgatccgaacactggaaccccaaag

SEQ ID NO: 613981 - DNA, 25 bp, Rattus norvegicus
tgatccgaactcattacgaccatgt

SEQ ID NO: 613982 - DNA, 25 bp, Rattus norvegicus
tgatccgaactctttacgaccatgt

SEQ ID NO: 613983 - DNA, 25 bp, Rattus norvegicus
tgatccgactctcatccagagcgca

SEQ ID NO: 613984 - DNA, 25 bp, Rattus norvegicus
tgatccgactctgatccagagcgca

SEQ ID NO: 613985 - DNA, 25 bp, Rattus norvegicus
tgatccgctcttatcaatgaagcag

SEQ ID NO: 613986 - DNA, 25 bp, Rattus norvegicus
tgatccgctcttttcaatgaagcag

SEQ ID NO: 613987 - DNA, 25 bp, Rattus norvegicus
tgatccgggccacagctgctaattc

SEQ ID NO: 613988 - DNA, 25 bp, Rattus norvegicus
tgatccgggccagagctgctaattc

SEQ ID NO: 613989 - DNA, 25 bp, Rattus norvegicus
tgatccgtatgtacaactcctgggc

SEQ ID NO: 613990 - DNA, 25 bp, Rattus norvegicus
tgatccgtatgttcaactcctgggc

SEQ ID NO: 613991 - DNA, 25 bp, Rattus norvegicus
tgatcctaaagacaccttcctattc

SEQ ID NO: 613992 - DNA, 25 bp, Rattus norvegicus
tgatcctaaagagaccttcctattc

SEQ ID NO: 613993 - DNA, 25 bp, Rattus norvegicus
tgatcctaagtgaccccaactttga

SEQ ID NO: 613994 - DNA, 25 bp, Rattus norvegicus
tgatcctaagtgtccccaactttga

SEQ ID NO: 613995 - DNA, 25 bp, Rattus norvegicus
tgatcctacactcaagtcccttaag

SEQ ID NO: 613996 - DNA, 25 bp, Rattus norvegicus
tgatcctacactgaagtcccttaag

SEQ ID NO: 613997 - DNA, 25 bp, Rattus norvegicus
tgatcctactcacccaatttatgtt

SEQ ID NO: 613998 - DNA, 25 bp, Rattus norvegicus
tgatcctactcagccaatttatgtt

SEQ ID NO: 613999 - DNA, 25 bp, Rattus norvegicus
tgatcctagccaattctgtgtcctt

SEQ ID NO: 614000 - DNA, 25 bp, Rattus norvegicus
tgatcctagccatttctgtgtcctt

SEQ ID NO: 614001 - DNA, 25 bp, Rattus norvegicus
tgatcctagtccctggcatgtgtag

SEQ ID NO: 614002 - DNA, 25 bp, Rattus norvegicus
tgatcctagtccgtggcatgtgtag

SEQ ID NO: 614003 - DNA, 25 bp, Rattus norvegicus
tgatcctatgtaacctctcatttcg

SEQ ID NO: 614004 - DNA, 25 bp, Rattus norvegicus
tgatcctatgtatcctctcatttcg

SEQ ID NO: 614005 - DNA, 25 bp, Rattus norvegicus
tgatcctcaaacatcattccaactt

SEQ ID NO: 614006 - DNA, 25 bp, Rattus norvegicus
tgatcctcaaacttcattccaactt

SEQ ID NO: 614007 - DNA, 25 bp, Rattus norvegicus
tgatcctcacgcatgtacagcaaat

SEQ ID NO: 614008 - DNA, 25 bp, Rattus norvegicus
tgatcctcacgcttgtacagcaaat

SEQ ID NO: 614009 - DNA, 25 bp, Rattus norvegicus
tgatcctcagttcctgttgttcata

SEQ ID NO: 614010 - DNA, 25 bp, Rattus norvegicus
tgatcctcagttgctgttgttcata

SEQ ID NO: 614011 - DNA, 25 bp, Rattus norvegicus
tgatcctccaaaattttcttaccca

SEQ ID NO: 614012 - DNA, 25 bp, Rattus norvegicus
tgatcctccaaatttttcttaccca

SEQ ID NO: 614013 - DNA, 25 bp, Rattus norvegicus
tgatcctcctctaagctcatgagta

SEQ ID NO: 614014 - DNA, 25 bp, Rattus norvegicus
tgatcctcctcttagctcatgagta

SEQ ID NO: 614015 - DNA, 25 bp, Rattus norvegicus
tgatcctcgaacactgtactttcta

SEQ ID NO: 614016 - DNA, 25 bp, Rattus norvegicus
tgatcctcgaactctgtactttcta

SEQ ID NO: 614017 - DNA, 25 bp, Rattus norvegicus
tgatcctcgcaccaaccacttttaa

SEQ ID NO: 614018 - DNA, 25 bp, Rattus norvegicus
tgatcctcgcacgaaccacttttaa

SEQ ID NO: 614019 - DNA, 25 bp, Rattus norvegicus
tgatcctcggcaaggcatacggcgc

SEQ ID NO: 614020 - DNA, 25 bp, Rattus norvegicus
tgatcctcggcatggcatacggcgc

SEQ ID NO: 614021 - DNA, 25 bp, Rattus norvegicus
tgatcctctaggacctggcagaata

SEQ ID NO: 614022 - DNA, 25 bp, Rattus norvegicus
tgatcctctaggtcctggcagaata

SEQ ID NO: 614023 - DNA, 25 bp, Rattus norvegicus
tgatcctctgacctgtgcaaagttg

SEQ ID NO: 614024 - DNA, 25 bp, Rattus norvegicus
tgatcctctgacgtgtgcaaagttg

SEQ ID NO: 614025 - DNA, 25 bp, Rattus norvegicus
tgatcctctgctataggtcacggtt

SEQ ID NO: 614026 - DNA, 25 bp, Rattus norvegicus
tgatcctctgctttaggtcacggtt

SEQ ID NO: 614027 - DNA, 25 bp, Rattus norvegicus
tgatcctgagccagatgtcatccca

SEQ ID NO: 614028 - DNA, 25 bp, Rattus norvegicus
tgatcctgagcctgatgtcatccca

SEQ ID NO: 614029 - DNA, 25 bp, Rattus norvegicus
tgatcctgaggtactgagctgtttc

SEQ ID NO: 614030 - DNA, 25 bp, Rattus norvegicus
tgatcctgaggttctgagctgtttc

SEQ ID NO: 614031 - DNA, 25 bp, Rattus norvegicus
tgatcctgcaagacctgacgttcgt

SEQ ID NO: 614032 - DNA, 25 bp, Rattus norvegicus
tgatcctgcaagtcctgacgttcgt

SEQ ID NO: 614033 - DNA, 25 bp, Rattus norvegicus
tgatcctgctatacttttccttaaa

SEQ ID NO: 614034 - DNA, 25 bp, Rattus norvegicus
tgatcctgctattcttttccttaaa

SEQ ID NO: 614035 - DNA, 25 bp, Rattus norvegicus
tgatcctggcctatgcagcttgggt

SEQ ID NO: 614036 - DNA, 25 bp, Rattus norvegicus
tgatcctggcctttgcagcttgggt

SEQ ID NO: 614037 - DNA, 25 bp, Rattus norvegicus
tgatcctgggatacacatgtgttta

SEQ ID NO: 614038 - DNA, 25 bp, Rattus norvegicus
tgatcctgggattcacatgtgttta

SEQ ID NO: 614039 - DNA, 25 bp, Rattus norvegicus
tgatcctgtcacactctttcttttt

SEQ ID NO: 614040 - DNA, 25 bp, Rattus norvegicus
tgatcctgtcactctctttcttttt

SEQ ID NO: 614041 - DNA, 25 bp, Rattus norvegicus
tgatcctgtgggagggccatttcat

SEQ ID NO: 614042 - DNA, 25 bp, Rattus norvegicus
tgatcctgtgggtgggccatttcat

SEQ ID NO: 614043 - DNA, 25 bp, Rattus norvegicus
tgatcctgtgtcatctagggtaaca

SEQ ID NO: 614044 - DNA, 25 bp, Rattus norvegicus
tgatcctgtgtcttctagggtaaca

SEQ ID NO: 614045 - DNA, 25 bp, Rattus norvegicus
tgatcctgtgtgatgcttggacatt

SEQ ID NO: 614046 - DNA, 25 bp, Rattus norvegicus
tgatcctgtgtgttgcttggacatt

SEQ ID NO: 614047 - DNA, 25 bp, Rattus norvegicus
tgatccttcagtcttccgcaagcat

SEQ ID NO: 614048 - DNA, 25 bp, Rattus norvegicus
tgatccttcagtgttccgcaagcat

SEQ ID NO: 614049 - DNA, 25 bp, Rattus norvegicus
tgatccttccctccgaataaaggca

SEQ ID NO: 614050 - DNA, 25 bp, Rattus norvegicus
tgatccttccctgcgaataaaggca

SEQ ID NO: 614051 - DNA, 25 bp, Rattus norvegicus
tgatccttctggctggaacactttt

SEQ ID NO: 614052 - DNA, 25 bp, Rattus norvegicus
tgatccttctgggtggaacactttt

SEQ ID NO: 614053 - DNA, 25 bp, Rattus norvegicus
tgatccttgaaacccgcatgatgga

SEQ ID NO: 614054 - DNA, 25 bp, Rattus norvegicus
tgatccttgaaagccgcatgatgga

SEQ ID NO: 614055 - DNA, 25 bp, Rattus norvegicus
tgatccttgcacaccagcagctgaa

SEQ ID NO: 614056 - DNA, 25 bp, Rattus norvegicus
tgatccttgcactccagcagctgaa

SEQ ID NO: 614057 - DNA, 25 bp, Rattus norvegicus
tgatccttgctcatgtctatgcagg

SEQ ID NO: 614058 - DNA, 25 bp, Rattus norvegicus
tgatccttgctcttgtctatgcagg

SEQ ID NO: 614059 - DNA, 25 bp, Rattus norvegicus
tgatcctttgtgagttcctgggttc

SEQ ID NO: 614060 - DNA, 25 bp, Rattus norvegicus
tgatcctttgtgtgttcctgggttc

SEQ ID NO: 614061 - DNA, 25 bp, Rattus norvegicus
tgatccttttgaccgcttgaccaga

SEQ ID NO: 614062 - DNA, 25 bp, Rattus norvegicus
tgatccttttgagcgcttgaccaga

SEQ ID NO: 614063 - DNA, 25 bp, Rattus norvegicus
tgatcctttttcattcggcccgagg

SEQ ID NO: 614064 - DNA, 25 bp, Rattus norvegicus
tgatcctttttctttcggcccgagg

SEQ ID NO: 614065 - DNA, 25 bp, Rattus norvegicus
tgatcgaaccttatacacacccatt

SEQ ID NO: 614066 - DNA, 25 bp, Rattus norvegicus
tgatcgaaccttttacacacccatt

SEQ ID NO: 614067 - DNA, 25 bp, Rattus norvegicus
tgatcgaagccccaccttcctttga

SEQ ID NO: 614068 - DNA, 25 bp, Rattus norvegicus
tgatcgaagcccgaccttcctttga

SEQ ID NO: 614069 - DNA, 25 bp, Rattus norvegicus
tgatcgaatcttaccagtcctcact

SEQ ID NO: 614070 - DNA, 25 bp, Rattus norvegicus
tgatcgaatctttccagtcctcact

SEQ ID NO: 614071 - DNA, 25 bp, Rattus norvegicus
tgatcgagggtcactgtggcgtaat

SEQ ID NO: 614072 - DNA, 25 bp, Rattus norvegicus
tgatcgagggtctctgtggcgtaat

SEQ ID NO: 614073 - DNA, 25 bp, Rattus norvegicus
tgatcgaggttgataactcctcccc

SEQ ID NO: 614074 - DNA, 25 bp, Rattus norvegicus
tgatcgaggttgttaactcctcccc

SEQ ID NO: 614075 - DNA, 25 bp, Rattus norvegicus
tgatcgatcgccagccactagctgc

SEQ ID NO: 614076 - DNA, 25 bp, Rattus norvegicus
tgatcgatcgcctgccactagctgc

SEQ ID NO: 614077 - DNA, 25 bp, Rattus norvegicus
tgatcgatgtcaatgctctccaggt

SEQ ID NO: 614078 - DNA, 25 bp, Rattus norvegicus
tgatcgatgtcattgctctccaggt

SEQ ID NO: 614079 - DNA, 25 bp, Rattus norvegicus
tgatcgcacactcgctgcactgtga

SEQ ID NO: 614080 - DNA, 25 bp, Rattus norvegicus
tgatcgcacactggctgcactgtga

SEQ ID NO: 614081 - DNA, 25 bp, Rattus norvegicus
tgatcgcatagcaacaattttgtgg

SEQ ID NO: 614082 - DNA, 25 bp, Rattus norvegicus
tgatcgcatagctacaattttgtgg

SEQ ID NO: 614083 - DNA, 25 bp, Rattus norvegicus
tgatcgcatcttactctgggttttc

SEQ ID NO: 614084 - DNA, 25 bp, Rattus norvegicus
tgatcgcatcttactgtttccaaat

SEQ ID NO: 614085 - DNA, 25 bp, Rattus norvegicus
tgatcgcatctttctctgggttttc

SEQ ID NO: 614086 - DNA, 25 bp, Rattus norvegicus
tgatcgcatctttctgtttccaaat

SEQ ID NO: 614087 - DNA, 25 bp, Rattus norvegicus
tgatcgcattgcaatacctgaggcc

SEQ ID NO: 614088 - DNA, 25 bp, Rattus norvegicus
tgatcgcattgctatacctgaggcc

SEQ ID NO: 614089 - DNA, 25 bp, Rattus norvegicus
tgatcgccccttcgtctgaaagaaa

SEQ ID NO: 614090 - DNA, 25 bp, Rattus norvegicus
tgatcgccccttggtctgaaagaaa

SEQ ID NO: 614091 - DNA, 25 bp, Rattus norvegicus
tgatcgccgaagaagtcaccacgtg

SEQ ID NO: 614092 - DNA, 25 bp, Rattus norvegicus
tgatcgccgaagtagtcaccacgtg

SEQ ID NO: 614093 - DNA, 25 bp, Rattus norvegicus
tgatcgcgacatcgcttgtcgaacc

SEQ ID NO: 614094 - DNA, 25 bp, Rattus norvegicus
tgatcgcgacatggcttgtcgaacc

SEQ ID NO: 614095 - DNA, 25 bp, Rattus norvegicus
tgatcgcgatgcagtacacctctaa

SEQ ID NO: 614096 - DNA, 25 bp, Rattus norvegicus
tgatcgcgatgctgtacacctctaa

SEQ ID NO: 614097 - DNA, 25 bp, Rattus norvegicus
tgatcgctcgcccacagacaaggag

SEQ ID NO: 614098 - DNA, 25 bp, Rattus norvegicus
tgatcgctcgccgacagacaaggag

SEQ ID NO: 614099 - DNA, 25 bp, Rattus norvegicus
tgatcgctgaatagctttctcgtcc

SEQ ID NO: 614100 - DNA, 25 bp, Rattus norvegicus
tgatcgctgaattgctttctcgtcc

SEQ ID NO: 614101 - DNA, 25 bp, Rattus norvegicus
tgatcgctgttcctttgctacttca

SEQ ID NO: 614102 - DNA, 25 bp, Rattus norvegicus
tgatcgctgttcgtttgctacttca

SEQ ID NO: 614103 - DNA, 25 bp, Rattus norvegicus
tgatcggaatatccactgtgaagag

SEQ ID NO: 614104 - DNA, 25 bp, Rattus norvegicus
tgatcggaatatgcactgtgaagag

SEQ ID NO: 614105 - DNA, 25 bp, Rattus norvegicus
tgatcggacgggaggcccatcacca

SEQ ID NO: 614106 - DNA, 25 bp, Rattus norvegicus
tgatcggacgggtggcccatcacca

SEQ ID NO: 614107 - DNA, 25 bp, Rattus norvegicus
tgatcggattccatttccccttgaa

SEQ ID NO: 614108 - DNA, 25 bp, Rattus norvegicus
tgatcggattccttttccccttgaa

SEQ ID NO: 614109 - DNA, 25 bp, Rattus norvegicus
tgatcggcactgctcaggctaataa

SEQ ID NO: 614110 - DNA, 25 bp, Rattus norvegicus
tgatcggcactggtcaggctaataa

SEQ ID NO: 614111 - DNA, 25 bp, Rattus norvegicus
tgatcggttccgagatccttgaatt

SEQ ID NO: 614112 - DNA, 25 bp, Rattus norvegicus
tgatcggttccgtgatccttgaatt

SEQ ID NO: 614113 - DNA, 25 bp, Rattus norvegicus
tgatcggtttccattctacgtcacg

SEQ ID NO: 614114 - DNA, 25 bp, Rattus norvegicus
tgatcggtttcctttctacgtcacg

SEQ ID NO: 614115 - DNA, 25 bp, Rattus norvegicus
tgatcgtaagatcctcttccggtaa

SEQ ID NO: 614116 - DNA, 25 bp, Rattus norvegicus
tgatcgtaagatgctcttccggtaa

SEQ ID NO: 614117 - DNA, 25 bp, Rattus norvegicus
tgatcgtacagcagttggggacacc

SEQ ID NO: 614118 - DNA, 25 bp, Rattus norvegicus
tgatcgtacagctgttggggacacc

SEQ ID NO: 614119 - DNA, 25 bp, Rattus norvegicus
tgatcgtctctaccatcctgatgat

SEQ ID NO: 614120 - DNA, 25 bp, Rattus norvegicus
tgatcgtctctagcatcctgatgat

SEQ ID NO: 614121 - DNA, 25 bp, Rattus norvegicus
tgatcgtgacaaccggcccagacag

SEQ ID NO: 614122 - DNA, 25 bp, Rattus norvegicus
tgatcgtgacaagcggcccagacag

SEQ ID NO: 614123 - DNA, 25 bp, Rattus norvegicus
tgatcgtggtgaacgacaacggcaa

SEQ ID NO: 614124 - DNA, 25 bp, Rattus norvegicus
tgatcgtggtgatcgacaacggcaa

SEQ ID NO: 614125 - DNA, 25 bp, Rattus norvegicus
tgatctaactctccaggtccgagtt

SEQ ID NO: 614126 - DNA, 25 bp, Rattus norvegicus
tgatctaactctgcaggtccgagtt

SEQ ID NO: 614127 - DNA, 25 bp, Rattus norvegicus
tgatctaactggagcttcctctctg

SEQ ID NO: 614128 - DNA, 25 bp, Rattus norvegicus
tgatctaactggtgcttcctctctg

SEQ ID NO: 614129 - DNA, 25 bp, Rattus norvegicus
tgatctaaggctcctccatcgacac

SEQ ID NO: 614130 - DNA, 25 bp, Rattus norvegicus
tgatctaaggctgctccatcgacac

SEQ ID NO: 614131 - DNA, 25 bp, Rattus norvegicus
tgatctaatccactcactatctgac

SEQ ID NO: 614132 - DNA, 25 bp, Rattus norvegicus
tgatctaatccagtcactatctgac

SEQ ID NO: 614133 - DNA, 25 bp, Rattus norvegicus
tgatctacagtgaacactctgcacc

SEQ ID NO: 614134 - DNA, 25 bp, Rattus norvegicus
tgatctacagtgtacactctgcacc

SEQ ID NO: 614135 - DNA, 25 bp, Rattus norvegicus
tgatctacatgaaatgctgcctcaa

SEQ ID NO: 614136 - DNA, 25 bp, Rattus norvegicus
tgatctacatgatatgctgcctcaa

SEQ ID NO: 614137 - DNA, 25 bp, Rattus norvegicus
tgatctacctggcagacctgagctg

SEQ ID NO: 614138 - DNA, 25 bp, Rattus norvegicus
tgatctacctgggagacctgagctg

SEQ ID NO: 614139 - DNA, 25 bp, Rattus norvegicus
tgatctacgggtacaacgccgccta

SEQ ID NO: 614140 - DNA, 25 bp, Rattus norvegicus
tgatctacgggttcaacgccgccta

SEQ ID NO: 614141 - DNA, 25 bp, Rattus norvegicus
tgatctactggcacatttcaatagt

SEQ ID NO: 614142 - DNA, 25 bp, Rattus norvegicus
tgatctactggctcatttcaatagt

SEQ ID NO: 614143 - DNA, 25 bp, Rattus norvegicus
tgatctactttgaagtacacctccc

SEQ ID NO: 614144 - DNA, 25 bp, Rattus norvegicus
tgatctactttgtagtacacctccc

SEQ ID NO: 614145 - DNA, 25 bp, Rattus norvegicus
tgatctagacgaaaccttggtgcac

SEQ ID NO: 614146 - DNA, 25 bp, Rattus norvegicus
tgatctagacgataccttggtgcac

SEQ ID NO: 614147 - DNA, 25 bp, Rattus norvegicus
tgatctagactgacggtgccttgac

SEQ ID NO: 614148 - DNA, 25 bp, Rattus norvegicus
tgatctagactgtcggtgccttgac

SEQ ID NO: 614149 - DNA, 25 bp, Rattus norvegicus
tgatctagatgacgccaatgacccc

SEQ ID NO: 614150 - DNA, 25 bp, Rattus norvegicus
tgatctagatgaggccaatgacccc

SEQ ID NO: 614151 - DNA, 25 bp, Rattus norvegicus
tgatctagcctccaccatgaagaag

SEQ ID NO: 614152 - DNA, 25 bp, Rattus norvegicus
tgatctagcctcgaccatgaagaag

SEQ ID NO: 614153 - DNA, 25 bp, Rattus norvegicus
tgatctagcgatcgttgtcacccac

SEQ ID NO: 614154 - DNA, 25 bp, Rattus norvegicus
tgatctagcgatggttgtcacccac

SEQ ID NO: 614155 - DNA, 25 bp, Rattus norvegicus
tgatctagctttatatcccaccgga

SEQ ID NO: 614156 - DNA, 25 bp, Rattus norvegicus
tgatctagctttttatcccaccgga

SEQ ID NO: 614157 - DNA, 25 bp, Rattus norvegicus
tgatctagggagacctgctcagctg

SEQ ID NO: 614158 - DNA, 25 bp, Rattus norvegicus
tgatctagggagtcctgctcagctg

SEQ ID NO: 614159 - DNA, 25 bp, Rattus norvegicus
tgatctatagtcatgctcctcagta

SEQ ID NO: 614160 - DNA, 25 bp, Rattus norvegicus
tgatctatagtcttgctcctcagta

SEQ ID NO: 614161 - DNA, 25 bp, Rattus norvegicus
tgatctatagttcctctgtgaggaa

SEQ ID NO: 614162 - DNA, 25 bp, Rattus norvegicus
tgatctatagttgctctgtgaggaa

SEQ ID NO: 614163 - DNA, 25 bp, Rattus norvegicus
tgatctatctctccgttctccatgg

SEQ ID NO: 614164 - DNA, 25 bp, Rattus norvegicus
tgatctatctctgcgttctccatgg

SEQ ID NO: 614165 - DNA, 25 bp, Rattus norvegicus
tgatctatgcagctctaagttccct

SEQ ID NO: 614166 - DNA, 25 bp, Rattus norvegicus
tgatctatgcaggtctaagttccct

SEQ ID NO: 614167 - DNA, 25 bp, Rattus norvegicus
tgatctatgggcatgaaaactgaat

SEQ ID NO: 614168 - DNA, 25 bp, Rattus norvegicus
tgatctatgggcttgaaaactgaat

SEQ ID NO: 614169 - DNA, 25 bp, Rattus norvegicus
tgatctcaatggcttctggacctat

SEQ ID NO: 614170 - DNA, 25 bp, Rattus norvegicus
tgatctcaatgggttctggacctat

SEQ ID NO: 614171 - DNA, 25 bp, Rattus norvegicus
tgatctcacccacggttattcagaa

SEQ ID NO: 614172 - DNA, 25 bp, Rattus norvegicus
tgatctcacccagggttattcagaa

SEQ ID NO: 614173 - DNA, 25 bp, Rattus norvegicus
tgatctcacctccattaacattctt

SEQ ID NO: 614174 - DNA, 25 bp, Rattus norvegicus
tgatctcacctcgattaacattctt

SEQ ID NO: 614175 - DNA, 25 bp, Rattus norvegicus
tgatctcactatacagctcagctta

SEQ ID NO: 614176 - DNA, 25 bp, Rattus norvegicus
tgatctcactattcagctcagctta

SEQ ID NO: 614177 - DNA, 25 bp, Rattus norvegicus
tgatctcactgtaagcctggctgga

SEQ ID NO: 614178 - DNA, 25 bp, Rattus norvegicus
tgatctcactgttagcctggctgga

SEQ ID NO: 614179 - DNA, 25 bp, Rattus norvegicus
tgatctcagagaagacccttctact

SEQ ID NO: 614180 - DNA, 25 bp, Rattus norvegicus
tgatctcagagatgacccttctact

SEQ ID NO: 614181 - DNA, 25 bp, Rattus norvegicus
tgatctcagcttaggatccttggta

SEQ ID NO: 614182 - DNA, 25 bp, Rattus norvegicus
tgatctcagctttggatccttggta

SEQ ID NO: 614183 - DNA, 25 bp, Rattus norvegicus
tgatctcaggtcacggctttgccca

SEQ ID NO: 614184 - DNA, 25 bp, Rattus norvegicus
tgatctcaggtctcggctttgccca

SEQ ID NO: 614185 - DNA, 25 bp, Rattus norvegicus
tgatctccaaacctgcctcaaaagc

SEQ ID NO: 614186 - DNA, 25 bp, Rattus norvegicus
tgatctccaaacgtgcctcaaaagc

SEQ ID NO: 614187 - DNA, 25 bp, Rattus norvegicus
tgatctccaactctgactaactctt

SEQ ID NO: 614188 - DNA, 25 bp, Rattus norvegicus
tgatctccaactgtgactaactctt

SEQ ID NO: 614189 - DNA, 25 bp, Rattus norvegicus
tgatctccagtgctgaggactcgag

SEQ ID NO: 614190 - DNA, 25 bp, Rattus norvegicus
tgatctccagtggtgaggactcgag

SEQ ID NO: 614191 - DNA, 25 bp, Rattus norvegicus
tgatctccatgtagatgccacgtca

SEQ ID NO: 614192 - DNA, 25 bp, Rattus norvegicus
tgatctccatgttgatgccacgtca

SEQ ID NO: 614193 - DNA, 25 bp, Rattus norvegicus
tgatctcccaccagaggaaccttgt

SEQ ID NO: 614194 - DNA, 25 bp, Rattus norvegicus
tgatctcccacctgaggaaccttgt

SEQ ID NO: 614195 - DNA, 25 bp, Rattus norvegicus
tgatctccctctccgcatgtaaaaa

SEQ ID NO: 614196 - DNA, 25 bp, Rattus norvegicus
tgatctccctctgcgcatgtaaaaa

SEQ ID NO: 614197 - DNA, 25 bp, Rattus norvegicus
tgatctccctgcagaatgagcccaa

SEQ ID NO: 614198 - DNA, 25 bp, Rattus norvegicus
tgatctccctgctgaatgagcccaa

SEQ ID NO: 614199 - DNA, 25 bp, Rattus norvegicus
tgatctccgagtagtgcatcttggg

SEQ ID NO: 614200 - DNA, 25 bp, Rattus norvegicus
tgatctccgagttgtgcatcttggg

SEQ ID NO: 614201 - DNA, 25 bp, Rattus norvegicus
tgatctcctaccagctggacgaaaa

SEQ ID NO: 614202 - DNA, 25 bp, Rattus norvegicus
tgatctcctacctgctggacgaaaa

SEQ ID NO: 614203 - DNA, 25 bp, Rattus norvegicus
tgatctcctgatataccttggtatg

SEQ ID NO: 614204 - DNA, 25 bp, Rattus norvegicus
tgatctcctgatttaccttggtatg

SEQ ID NO: 614205 - DNA, 25 bp, Rattus norvegicus
tgatctcggaagctaagcagggtcg

SEQ ID NO: 614206 - DNA, 25 bp, Rattus norvegicus
tgatctcggaaggtaagcagggtcg

SEQ ID NO: 614207 - DNA, 25 bp, Rattus norvegicus
tgatctcgtaggattctagggcttt

SEQ ID NO: 614208 - DNA, 25 bp, Rattus norvegicus
tgatctcgtaggtttctagggcttt

SEQ ID NO: 614209 - DNA, 25 bp, Rattus norvegicus
tgatctcgtgtcactatatccaaca

SEQ ID NO: 614210 - DNA, 25 bp, Rattus norvegicus
tgatctcgtgtctctatatccaaca

SEQ ID NO: 614211 - DNA, 25 bp, Rattus norvegicus
tgatctctatcgatgggaagtcctt

SEQ ID NO: 614212 - DNA, 25 bp, Rattus norvegicus
tgatctctatcgttgggaagtcctt

SEQ ID NO: 614213 - DNA, 25 bp, Rattus norvegicus
tgatctctccatcttaataactagg

SEQ ID NO: 614214 - DNA, 25 bp, Rattus norvegicus
tgatctctccatgttaataactagg

SEQ ID NO: 614215 - DNA, 25 bp, Rattus norvegicus
tgatctctgcatccacacgcatatg

SEQ ID NO: 614216 - DNA, 25 bp, Rattus norvegicus
tgatctctgcatccgtgtcacagca

SEQ ID NO: 614217 - DNA, 25 bp, Rattus norvegicus
tgatctctgcatgcacacgcatatg

SEQ ID NO: 614218 - DNA, 25 bp, Rattus norvegicus
tgatctctgcatgcgtgtcacagca

SEQ ID NO: 614219 - DNA, 25 bp, Rattus norvegicus
tgatctctgcccattcagatatgta

SEQ ID NO: 614220 - DNA, 25 bp, Rattus norvegicus
tgatctctgccctttcagatatgta

SEQ ID NO: 614221 - DNA, 25 bp, Rattus norvegicus
tgatctctggcgcagtccaggcaag

SEQ ID NO: 614222 - DNA, 25 bp, Rattus norvegicus
tgatctctggcggagtccaggcaag

SEQ ID NO: 614223 - DNA, 25 bp, Rattus norvegicus
tgatctctggtaactgtgactccaa

SEQ ID NO: 614224 - DNA, 25 bp, Rattus norvegicus
tgatctctggtatctgtgactccaa

SEQ ID NO: 614225 - DNA, 25 bp, Rattus norvegicus
tgatctctgttccttcacaacatgg

SEQ ID NO: 614226 - DNA, 25 bp, Rattus norvegicus
tgatctctgttcgttcacaacatgg

SEQ ID NO: 614227 - DNA, 25 bp, Rattus norvegicus
tgatctcttcaaccttcagtttcct

SEQ ID NO: 614228 - DNA, 25 bp, Rattus norvegicus
tgatctcttcaagcttcagtttcct

SEQ ID NO: 614229 - DNA, 25 bp, Rattus norvegicus
tgatctcttcagaggagtgcccttt

SEQ ID NO: 614230 - DNA, 25 bp, Rattus norvegicus
tgatctcttcagtggagtgcccttt

SEQ ID NO: 614231 - DNA, 25 bp, Rattus norvegicus
tgatctctttttcccatcagcaaaa

SEQ ID NO: 614232 - DNA, 25 bp, Rattus norvegicus
tgatctctttttgccatcagcaaaa

SEQ ID NO: 614233 - DNA, 25 bp, Rattus norvegicus
tgatctgaccatacattatattcaa

SEQ ID NO: 614234 - DNA, 25 bp, Rattus norvegicus
tgatctgaccattcattatattcaa

SEQ ID NO: 614235 - DNA, 25 bp, Rattus norvegicus
tgatctgactcaacgtgtgacatat

SEQ ID NO: 614236 - DNA, 25 bp, Rattus norvegicus
tgatctgactcatcgtgtgacatat

SEQ ID NO: 614237 - DNA, 25 bp, Rattus norvegicus
tgatctgagcacaggtccccaagag

SEQ ID NO: 614238 - DNA, 25 bp, Rattus norvegicus
tgatctgagcactggtccccaagag

SEQ ID NO: 614239 - DNA, 25 bp, Rattus norvegicus
tgatctgaggtgcttatcctgtgct

SEQ ID NO: 614240 - DNA, 25 bp, Rattus norvegicus
tgatctgaggtggttatcctgtgct

SEQ ID NO: 614241 - DNA, 25 bp, Rattus norvegicus
tgatctgagtacctggcttggcctc

SEQ ID NO: 614242 - DNA, 25 bp, Rattus norvegicus
tgatctgagtacgtggcttggcctc

SEQ ID NO: 614243 - DNA, 25 bp, Rattus norvegicus
tgatctgatctgacacttttgtccc

SEQ ID NO: 614244 - DNA, 25 bp, Rattus norvegicus
tgatctgatctgtcacttttgtccc

SEQ ID NO: 614245 - DNA, 25 bp, Rattus norvegicus
tgatctgcacggatgcagttgcaaa

SEQ ID NO: 614246 - DNA, 25 bp, Rattus norvegicus
tgatctgcacggttgcagttgcaaa

SEQ ID NO: 614247 - DNA, 25 bp, Rattus norvegicus
tgatctgcagaccaagtttgctcgc

SEQ ID NO: 614248 - DNA, 25 bp, Rattus norvegicus
tgatctgcagacgaagtttgctcgc

SEQ ID NO: 614249 - DNA, 25 bp, Rattus norvegicus
tgatctgcagcactgtcaggaggcc

SEQ ID NO: 614250 - DNA, 25 bp, Rattus norvegicus
tgatctgcagcagtgtcaggaggcc

SEQ ID NO: 614251 - DNA, 25 bp, Rattus norvegicus
tgatctgcattgacaccagctctta

SEQ ID NO: 614252 - DNA, 25 bp, Rattus norvegicus
tgatctgcattgtcaccagctctta

SEQ ID NO: 614253 - DNA, 25 bp, Rattus norvegicus
tgatctgcggatcctgggcttctct

SEQ ID NO: 614254 - DNA, 25 bp, Rattus norvegicus
tgatctgcggatgctgggcttctct

SEQ ID NO: 614255 - DNA, 25 bp, Rattus norvegicus
tgatctgctcaaaaaaccgggccca

SEQ ID NO: 614256 - DNA, 25 bp, Rattus norvegicus
tgatctgctcaataaaccgggccca

SEQ ID NO: 614257 - DNA, 25 bp, Rattus norvegicus
tgatctgctgaccagacttgacgct

SEQ ID NO: 614258 - DNA, 25 bp, Rattus norvegicus
tgatctgctgacgagacttgacgct

SEQ ID NO: 614259 - DNA, 25 bp, Rattus norvegicus
tgatctggaacaccaactgctcagt

SEQ ID NO: 614260 - DNA, 25 bp, Rattus norvegicus
tgatctggaacagcaactgctcagt

SEQ ID NO: 614261 - DNA, 25 bp, Rattus norvegicus
tgatctggaggaagctggtgactct

SEQ ID NO: 614262 - DNA, 25 bp, Rattus norvegicus
tgatctggaggatgctggtgactct

SEQ ID NO: 614263 - DNA, 25 bp, Rattus norvegicus
tgatctggatggagtgcctttggat

SEQ ID NO: 614264 - DNA, 25 bp, Rattus norvegicus
tgatctggatggtgtgcctttggat

SEQ ID NO: 614265 - DNA, 25 bp, Rattus norvegicus
tgatctggcaccaaacgctggagaa

SEQ ID NO: 614266 - DNA, 25 bp, Rattus norvegicus
tgatctggcacctaacgctggagaa

SEQ ID NO: 614267 - DNA, 25 bp, Rattus norvegicus
tgatctggccacctggcaagagccg

SEQ ID NO: 614268 - DNA, 25 bp, Rattus norvegicus
tgatctggccacgtggcaagagccg

SEQ ID NO: 614269 - DNA, 25 bp, Rattus norvegicus
tgatctggctaacttgggcactccc

SEQ ID NO: 614270 - DNA, 25 bp, Rattus norvegicus
tgatctggctaagttgggcactccc

SEQ ID NO: 614271 - DNA, 25 bp, Rattus norvegicus
tgatctggctttcgatttctccctt

SEQ ID NO: 614272 - DNA, 25 bp, Rattus norvegicus
tgatctggctttggatttctccctt

SEQ ID NO: 614273 - DNA, 25 bp, Rattus norvegicus
tgatctggtaatagcccgaatcctt

SEQ ID NO: 614274 - DNA, 25 bp, Rattus norvegicus
tgatctggtaattgcccgaatcctt

SEQ ID NO: 614275 - DNA, 25 bp, Rattus norvegicus
tgatctggttccagcctaccccttt

SEQ ID NO: 614276 - DNA, 25 bp, Rattus norvegicus
tgatctggttcctgcctaccccttt

SEQ ID NO: 614277 - DNA, 25 bp, Rattus norvegicus
tgatctgtaactcagcgaccctggg

SEQ ID NO: 614278 - DNA, 25 bp, Rattus norvegicus
tgatctgtaactgagcgaccctggg

SEQ ID NO: 614279 - DNA, 25 bp, Rattus norvegicus
tgatctgtatcaactgctgctaatt

SEQ ID NO: 614280 - DNA, 25 bp, Rattus norvegicus
tgatctgtatcatctgctgctaatt

SEQ ID NO: 614281 - DNA, 25 bp, Rattus norvegicus
tgatctgtatggaagctccctgaac

SEQ ID NO: 614282 - DNA, 25 bp, Rattus norvegicus
tgatctgtatggtagctccctgaac

SEQ ID NO: 614283 - DNA, 25 bp, Rattus norvegicus
tgatctgtcaccattttcaggcact

SEQ ID NO: 614284 - DNA, 25 bp, Rattus norvegicus
tgatctgtcacctttttcaggcact

SEQ ID NO: 614285 - DNA, 25 bp, Rattus norvegicus
tgatctgtcataaataccccactat

SEQ ID NO: 614286 - DNA, 25 bp, Rattus norvegicus
tgatctgtcatatataccccactat

SEQ ID NO: 614287 - DNA, 25 bp, Rattus norvegicus
tgatctgtcatgataactccttaaa

SEQ ID NO: 614288 - DNA, 25 bp, Rattus norvegicus
tgatctgtcatgttaactccttaaa

SEQ ID NO: 614289 - DNA, 25 bp, Rattus norvegicus
tgatctgtccttccaagtgtagtcc

SEQ ID NO: 614290 - DNA, 25 bp, Rattus norvegicus
tgatctgtccttgcaagtgtagtcc

SEQ ID NO: 614291 - DNA, 25 bp, Rattus norvegicus
tgatctgtctggaattgcctctgga

SEQ ID NO: 614292 - DNA, 25 bp, Rattus norvegicus
tgatctgtctggtattgcctctgga

SEQ ID NO: 614293 - DNA, 25 bp, Rattus norvegicus
tgatctgtcttgatattgtttactg

SEQ ID NO: 614294 - DNA, 25 bp, Rattus norvegicus
tgatctgtcttgttattgtttactg

SEQ ID NO: 614295 - DNA, 25 bp, Rattus norvegicus
tgatctgtgcacaggtatacgtacg

SEQ ID NO: 614296 - DNA, 25 bp, Rattus norvegicus
tgatctgtgcactggtatacgtacg

SEQ ID NO: 614297 - DNA, 25 bp, Rattus norvegicus
tgatctgtgggcctgtaacgcgtca

SEQ ID NO: 614298 - DNA, 25 bp, Rattus norvegicus
tgatctgtgggcgtgtaacgcgtca

SEQ ID NO: 614299 - DNA, 25 bp, Rattus norvegicus
tgatctgtgtatccattgcggctcc

SEQ ID NO: 614300 - DNA, 25 bp, Rattus norvegicus
tgatctgtgtatgcattgcggctcc

SEQ ID NO: 614301 - DNA, 25 bp, Rattus norvegicus
tgatctgtgtgcatcacagggcaag

SEQ ID NO: 614302 - DNA, 25 bp, Rattus norvegicus
tgatctgtgtgcttcacagggcaag

SEQ ID NO: 614303 - DNA, 25 bp, Rattus norvegicus
tgatctgttcaacccaaacttcaag

SEQ ID NO: 614304 - DNA, 25 bp, Rattus norvegicus
tgatctgttcaagccaaacttcaag

SEQ ID NO: 614305 - DNA, 25 bp, Rattus norvegicus
tgatctgttcgtcgccatacttaga

SEQ ID NO: 614306 - DNA, 25 bp, Rattus norvegicus
tgatctgttcgtggccatacttaga

SEQ ID NO: 614307 - DNA, 25 bp, Rattus norvegicus
tgatctgttctcctagtgtttccca

SEQ ID NO: 614308 - DNA, 25 bp, Rattus norvegicus
tgatctgttctcgtagtgtttccca

SEQ ID NO: 614309 - DNA, 25 bp, Rattus norvegicus
tgatctgttctgctactggcatgat

SEQ ID NO: 614310 - DNA, 25 bp, Rattus norvegicus
tgatctgttctggtactggcatgat

SEQ ID NO: 614311 - DNA, 25 bp, Rattus norvegicus
tgatctgtttatccgataactcctt

SEQ ID NO: 614312 - DNA, 25 bp, Rattus norvegicus
tgatctgtttatgcgataactcctt

SEQ ID NO: 614313 - DNA, 25 bp, Rattus norvegicus
tgatctgttttcaatgaccccttca

SEQ ID NO: 614314 - DNA, 25 bp, Rattus norvegicus
tgatctgttttctatgaccccttca

SEQ ID NO: 614315 - DNA, 25 bp, Rattus norvegicus
tgatcttactatatggagccagcct

SEQ ID NO: 614316 - DNA, 25 bp, Rattus norvegicus
tgatcttactatttggagccagcct

SEQ ID NO: 614317 - DNA, 25 bp, Rattus norvegicus
tgatcttactgcatcttagaggccc

SEQ ID NO: 614318 - DNA, 25 bp, Rattus norvegicus
tgatcttactgcttcttagaggccc

SEQ ID NO: 614319 - DNA, 25 bp, Rattus norvegicus
tgatcttagacacccaaagttggga

SEQ ID NO: 614320 - DNA, 25 bp, Rattus norvegicus
tgatcttagacagccaaagttggga

SEQ ID NO: 614321 - DNA, 25 bp, Rattus norvegicus
tgatcttaggatacgtgccacccag

SEQ ID NO: 614322 - DNA, 25 bp, Rattus norvegicus
tgatcttaggattcgtgccacccag

SEQ ID NO: 614323 - DNA, 25 bp, Rattus norvegicus
tgatcttatggccttcagtcccagt

SEQ ID NO: 614324 - DNA, 25 bp, Rattus norvegicus
tgatcttatggcgttcagtcccagt

SEQ ID NO: 614325 - DNA, 25 bp, Rattus norvegicus
tgatcttcagatcgcacagtttgca

SEQ ID NO: 614326 - DNA, 25 bp, Rattus norvegicus
tgatcttcagatcgtgtcattcccc

SEQ ID NO: 614327 - DNA, 25 bp, Rattus norvegicus
tgatcttcagatggcacagtttgca

SEQ ID NO: 614328 - DNA, 25 bp, Rattus norvegicus
tgatcttcagatggtgtcattcccc

SEQ ID NO: 614329 - DNA, 25 bp, Rattus norvegicus
tgatcttcagcgagcccttggagaa

SEQ ID NO: 614330 - DNA, 25 bp, Rattus norvegicus
tgatcttcagcgtgcccttggagaa

SEQ ID NO: 614331 - DNA, 25 bp, Rattus norvegicus
tgatcttcatcaatctctggttctc

SEQ ID NO: 614332 - DNA, 25 bp, Rattus norvegicus
tgatcttcatcattctctggttctc

SEQ ID NO: 614333 - DNA, 25 bp, Rattus norvegicus
tgatcttccaagagacagcccgctt

SEQ ID NO: 614334 - DNA, 25 bp, Rattus norvegicus
tgatcttccaagtgacagcccgctt

SEQ ID NO: 614335 - DNA, 25 bp, Rattus norvegicus
tgatcttccagacaagctgtgcttg

SEQ ID NO: 614336 - DNA, 25 bp, Rattus norvegicus
tgatcttccagagaagctgtgcttg

SEQ ID NO: 614337 - DNA, 25 bp, Rattus norvegicus
tgatcttccataccatcgagcagct

SEQ ID NO: 614338 - DNA, 25 bp, Rattus norvegicus
tgatcttccatagcatcgagcagct

SEQ ID NO: 614339 - DNA, 25 bp, Rattus norvegicus
tgatcttcccagaggtttcacactg

SEQ ID NO: 614340 - DNA, 25 bp, Rattus norvegicus
tgatcttcccagtggtttcacactg

SEQ ID NO: 614341 - DNA, 25 bp, Rattus norvegicus
tgatcttcctgacgatctctaccat

SEQ ID NO: 614342 - DNA, 25 bp, Rattus norvegicus
tgatcttcctgaggatctctaccat

SEQ ID NO: 614343 - DNA, 25 bp, Rattus norvegicus
tgatcttcctgccagtgtgatgtga

SEQ ID NO: 614344 - DNA, 25 bp, Rattus norvegicus
tgatcttcctgcgagtgtgatgtga

SEQ ID NO: 614345 - DNA, 25 bp, Rattus norvegicus
tgatcttcctgtcgtggaagcaaag

SEQ ID NO: 614346 - DNA, 25 bp, Rattus norvegicus
tgatcttcctgtggtggaagcaaag

SEQ ID NO: 614347 - DNA, 25 bp, Rattus norvegicus
tgatcttcctttagccttcattgtg

SEQ ID NO: 614348 - DNA, 25 bp, Rattus norvegicus
tgatcttccttttgccttcattgtg

SEQ ID NO: 614349 - DNA, 25 bp, Rattus norvegicus
tgatcttcgaagagccctggtgttt

SEQ ID NO: 614350 - DNA, 25 bp, Rattus norvegicus
tgatcttcgaagtgccctggtgttt

SEQ ID NO: 614351 - DNA, 25 bp, Rattus norvegicus
tgatcttctgaaccactttcctaaa

SEQ ID NO: 614352 - DNA, 25 bp, Rattus norvegicus
tgatcttctgaagcactttcctaaa

SEQ ID NO: 614353 - DNA, 25 bp, Rattus norvegicus
tgatcttcttgtcagcacatccaaa

SEQ ID NO: 614354 - DNA, 25 bp, Rattus norvegicus
tgatcttcttgtgagcacatccaaa

SEQ ID NO: 614355 - DNA, 25 bp, Rattus norvegicus
tgatcttgacccacctacatatgaa

SEQ ID NO: 614356 - DNA, 25 bp, Rattus norvegicus
tgatcttgaccctcctacatatgaa

SEQ ID NO: 614357 - DNA, 25 bp, Rattus norvegicus
tgatcttgctgcagacatctgctgc

SEQ ID NO: 614358 - DNA, 25 bp, Rattus norvegicus
tgatcttgctgctgacatctgctgc

SEQ ID NO: 614359 - DNA, 25 bp, Rattus norvegicus
tgatcttgcttgcatgaccctttaa

SEQ ID NO: 614360 - DNA, 25 bp, Rattus norvegicus
tgatcttgcttggatgaccctttaa

SEQ ID NO: 614361 - DNA, 25 bp, Rattus norvegicus
tgatcttggccgagctttttattgt

SEQ ID NO: 614362 - DNA, 25 bp, Rattus norvegicus
tgatcttggccgtgctttttattgt

SEQ ID NO: 614363 - DNA, 25 bp, Rattus norvegicus
tgatcttggcgcagaagtggcttaa

SEQ ID NO: 614364 - DNA, 25 bp, Rattus norvegicus
tgatcttggcgctgaagtggcttaa

SEQ ID NO: 614365 - DNA, 25 bp, Rattus norvegicus
tgatcttggtcaatcttgcttgcaa

SEQ ID NO: 614366 - DNA, 25 bp, Rattus norvegicus
tgatcttggtcattcttgcttgcaa

SEQ ID NO: 614367 - DNA, 25 bp, Rattus norvegicus
tgatcttggtccaaatggtccctca

SEQ ID NO: 614368 - DNA, 25 bp, Rattus norvegicus
tgatcttggtcctaatggtccctca

SEQ ID NO: 614369 - DNA, 25 bp, Rattus norvegicus
tgatcttgttctacctttcttttgt

SEQ ID NO: 614370 - DNA, 25 bp, Rattus norvegicus
tgatcttgttcttcctttcttttgt

SEQ ID NO: 614371 - DNA, 25 bp, Rattus norvegicus
tgatctttaccaacctcatggctat

SEQ ID NO: 614372 - DNA, 25 bp, Rattus norvegicus
tgatctttaccatcctcatggctat

SEQ ID NO: 614373 - DNA, 25 bp, Rattus norvegicus
tgatctttagcaagtgcggcctcat

SEQ ID NO: 614374 - DNA, 25 bp, Rattus norvegicus
tgatctttagcatgtgcggcctcat

SEQ ID NO: 614375 - DNA, 25 bp, Rattus norvegicus
tgatctttatgtatgccggcagtga

SEQ ID NO: 614376 - DNA, 25 bp, Rattus norvegicus
tgatctttatgtttgccggcagtga

SEQ ID NO: 614377 - DNA, 25 bp, Rattus norvegicus
tgatctttcaatccctacctctaag

SEQ ID NO: 614378 - DNA, 25 bp, Rattus norvegicus
tgatctttcaatgcctacctctaag

SEQ ID NO: 614379 - DNA, 25 bp, Rattus norvegicus
tgatctttcttcagagatgcccttc

SEQ ID NO: 614380 - DNA, 25 bp, Rattus norvegicus
tgatctttcttctgagatgcccttc

SEQ ID NO: 614381 - DNA, 25 bp, Rattus norvegicus
tgatctttgattattcttctataaa

SEQ ID NO: 614382 - DNA, 25 bp, Rattus norvegicus
tgatctttgatttttcttctataaa

SEQ ID NO: 614383 - DNA, 25 bp, Rattus norvegicus
tgatctttgctccacaccaatgttc

SEQ ID NO: 614384 - DNA, 25 bp, Rattus norvegicus
tgatctttgctcgacaccaatgttc

SEQ ID NO: 614385 - DNA, 25 bp, Rattus norvegicus
tgatctttgctgcacactgggtccc

SEQ ID NO: 614386 - DNA, 25 bp, Rattus norvegicus
tgatctttgctggacactgggtccc

SEQ ID NO: 614387 - DNA, 25 bp, Rattus norvegicus
tgatctttgggtctcaggccttcct

SEQ ID NO: 614388 - DNA, 25 bp, Rattus norvegicus
tgatctttgggtgtcaggccttcct

SEQ ID NO: 614389 - DNA, 25 bp, Rattus norvegicus
tgatctttgtcccatggtaaactat

SEQ ID NO: 614390 - DNA, 25 bp, Rattus norvegicus
tgatctttgtccgatggtaaactat

SEQ ID NO: 614391 - DNA, 25 bp, Rattus norvegicus
tgatctttgtgactgtggcttgccc

SEQ ID NO: 614392 - DNA, 25 bp, Rattus norvegicus
tgatctttgtgagtgtggcttgccc

SEQ ID NO: 614393 - DNA, 25 bp, Rattus norvegicus
tgatcttttaagaccttcccttcct

SEQ ID NO: 614394 - DNA, 25 bp, Rattus norvegicus
tgatcttttaagtccttcccttcct

SEQ ID NO: 614395 - DNA, 25 bp, Rattus norvegicus
tgatcttttcaactgcaggtctcag

SEQ ID NO: 614396 - DNA, 25 bp, Rattus norvegicus
tgatcttttcaagtgcaggtctcag

SEQ ID NO: 614397 - DNA, 25 bp, Rattus norvegicus
tgatcttttcagagtgtcccaaatt

SEQ ID NO: 614398 - DNA, 25 bp, Rattus norvegicus
tgatcttttcagtgtgtcccaaatt

SEQ ID NO: 614399 - DNA, 25 bp, Rattus norvegicus
tgatcttttcccatacccttactgt

SEQ ID NO: 614400 - DNA, 25 bp, Rattus norvegicus
tgatcttttcccttacccttactgt

SEQ ID NO: 614401 - DNA, 25 bp, Rattus norvegicus
tgatcttttgctcaccttcaatcag

SEQ ID NO: 614402 - DNA, 25 bp, Rattus norvegicus
tgatcttttgctgaccttcaatcag

SEQ ID NO: 614403 - DNA, 25 bp, Rattus norvegicus
tgatcttttgttactcttgccttag

SEQ ID NO: 614404 - DNA, 25 bp, Rattus norvegicus
tgatcttttgtttctcttgccttag

SEQ ID NO: 614405 - DNA, 25 bp, Rattus norvegicus
tgatctttttatccgcatggacatg

SEQ ID NO: 614406 - DNA, 25 bp, Rattus norvegicus
tgatctttttatgcgcatggacatg

SEQ ID NO: 614407 - DNA, 25 bp, Rattus norvegicus
tgatgaaaaaatcccagatctggag

SEQ ID NO: 614408 - DNA, 25 bp, Rattus norvegicus
tgatgaaaaaatgccagatctggag

SEQ ID NO: 614409 - DNA, 25 bp, Rattus norvegicus
tgatgaaaccacctctgtaaagtag

SEQ ID NO: 614410 - DNA, 25 bp, Rattus norvegicus
tgatgaaaccacgtctgtaaagtag

SEQ ID NO: 614411 - DNA, 25 bp, Rattus norvegicus
tgatgaaactggctaccttcccctt

SEQ ID NO: 614412 - DNA, 25 bp, Rattus norvegicus
tgatgaaactgggtaccttcccctt

SEQ ID NO: 614413 - DNA, 25 bp, Rattus norvegicus
tgatgaaaggacagtcggcccctta

SEQ ID NO: 614414 - DNA, 25 bp, Rattus norvegicus
tgatgaaaggactgtcggcccctta

SEQ ID NO: 614415 - DNA, 25 bp, Rattus norvegicus
tgatgaaagttgactcaacagcatg

SEQ ID NO: 614416 - DNA, 25 bp, Rattus norvegicus
tgatgaaagttgtctcaacagcatg

SEQ ID NO: 614417 - DNA, 25 bp, Rattus norvegicus
tgatgaaattcgaactctccctgca

SEQ ID NO: 614418 - DNA, 25 bp, Rattus norvegicus
tgatgaaattcgtactctccctgca

SEQ ID NO: 614419 - DNA, 25 bp, Rattus norvegicus
tgatgaacactgagaccacctgatt

SEQ ID NO: 614420 - DNA, 25 bp, Rattus norvegicus
tgatgaacactgtgaccacctgatt

SEQ ID NO: 614421 - DNA, 25 bp, Rattus norvegicus
tgatgaacgtttagccaggtaattt

SEQ ID NO: 614422 - DNA, 25 bp, Rattus norvegicus
tgatgaacgttttgccaggtaattt

SEQ ID NO: 614423 - DNA, 25 bp, Rattus norvegicus
tgatgaactatcagagctcctccta

SEQ ID NO: 614424 - DNA, 25 bp, Rattus norvegicus
tgatgaactatctgagctcctccta

SEQ ID NO: 614425 - DNA, 25 bp, Rattus norvegicus
tgatgaactcatcgagaaaaccgtc

SEQ ID NO: 614426 - DNA, 25 bp, Rattus norvegicus
tgatgaactcatggagaaaaccgtc

SEQ ID NO: 614427 - DNA, 25 bp, Rattus norvegicus
tgatgaactgcgcaaagcctgcctg

SEQ ID NO: 614428 - DNA, 25 bp, Rattus norvegicus
tgatgaactgcggaaagcctgcctg

SEQ ID NO: 614429 - DNA, 25 bp, Rattus norvegicus
tgatgaactgtacccggaacctcaa

SEQ ID NO: 614430 - DNA, 25 bp, Rattus norvegicus
tgatgaactgtagccggaacctcaa

SEQ ID NO: 614431 - DNA, 25 bp, Rattus norvegicus
tgatgaacttcaattcccctcagga

SEQ ID NO: 614432 - DNA, 25 bp, Rattus norvegicus
tgatgaacttcatttcccctcagga

SEQ ID NO: 614433 - DNA, 25 bp, Rattus norvegicus
tgatgaacttccagggcccaaaggt

SEQ ID NO: 614434 - DNA, 25 bp, Rattus norvegicus
tgatgaacttcctgggcccaaaggt

SEQ ID NO: 614435 - DNA, 25 bp, Rattus norvegicus
tgatgaagactgaccacactccatg

SEQ ID NO: 614436 - DNA, 25 bp, Rattus norvegicus
tgatgaagactgtccacactccatg

SEQ ID NO: 614437 - DNA, 25 bp, Rattus norvegicus
tgatgaagagcgaccaacctgaatt

SEQ ID NO: 614438 - DNA, 25 bp, Rattus norvegicus
tgatgaagagcgtccaacctgaatt

SEQ ID NO: 614439 - DNA, 25 bp, Rattus norvegicus
tgatgaagatagacgagccagacac

SEQ ID NO: 614440 - DNA, 25 bp, Rattus norvegicus
tgatgaagatagtcgagccagacac

SEQ ID NO: 614441 - DNA, 25 bp, Rattus norvegicus
tgatgaagctatccgagccgttctc

SEQ ID NO: 614442 - DNA, 25 bp, Rattus norvegicus
tgatgaagctatgcgagccgttctc

SEQ ID NO: 614443 - DNA, 25 bp, Rattus norvegicus
tgatgaagcttgcaggctctcagcc

SEQ ID NO: 614444 - DNA, 25 bp, Rattus norvegicus
tgatgaagcttggaggctctcagcc

SEQ ID NO: 614445 - DNA, 25 bp, Rattus norvegicus
tgatgaaggtttctatctgcttggg

SEQ ID NO: 614446 - DNA, 25 bp, Rattus norvegicus
tgatgaaggtttgtatctgcttggg

SEQ ID NO: 614447 - DNA, 25 bp, Rattus norvegicus
tgatgaataggcacacattcctgcc

SEQ ID NO: 614448 - DNA, 25 bp, Rattus norvegicus
tgatgaataggctcacattcctgcc

SEQ ID NO: 614449 - DNA, 25 bp, Rattus norvegicus
tgatgaatatgtactcctgcactcc

SEQ ID NO: 614450 - DNA, 25 bp, Rattus norvegicus
tgatgaatatgttctcctgcactcc

SEQ ID NO: 614451 - DNA, 25 bp, Rattus norvegicus
tgatgaatcgaactgtatcctcccc

SEQ ID NO: 614452 - DNA, 25 bp, Rattus norvegicus
tgatgaatcgaagtgtatcctcccc

SEQ ID NO: 614453 - DNA, 25 bp, Rattus norvegicus
tgatgaatctgtctgtgtctgtgga

SEQ ID NO: 614454 - DNA, 25 bp, Rattus norvegicus
tgatgaatctgtgtgtgtctgtgga

SEQ ID NO: 614455 - DNA, 25 bp, Rattus norvegicus
tgatgaatggctaggccgctgcctc

SEQ ID NO: 614456 - DNA, 25 bp, Rattus norvegicus
tgatgaatggcttggccgctgcctc

SEQ ID NO: 614457 - DNA, 25 bp, Rattus norvegicus
tgatgaatgggtccctgtctcagaa

SEQ ID NO: 614458 - DNA, 25 bp, Rattus norvegicus
tgatgaatgggtgcctgtctcagaa

SEQ ID NO: 614459 - DNA, 25 bp, Rattus norvegicus
tgatgaattactcacttactgaaac

SEQ ID NO: 614460 - DNA, 25 bp, Rattus norvegicus
tgatgaattactgacttactgaaac

SEQ ID NO: 614461 - DNA, 25 bp, Rattus norvegicus
tgatgacaaaacagcgagcctccac

SEQ ID NO: 614462 - DNA, 25 bp, Rattus norvegicus
tgatgacaaaactgcgagcctccac

SEQ ID NO: 614463 - DNA, 25 bp, Rattus norvegicus
tgatgacaacccactattcttccca

SEQ ID NO: 614464 - DNA, 25 bp, Rattus norvegicus
tgatgacaaccctctattcttccca

SEQ ID NO: 614465 - DNA, 25 bp, Rattus norvegicus
tgatgacacatcacgcatggaagaa

SEQ ID NO: 614466 - DNA, 25 bp, Rattus norvegicus
tgatgacacatctcgcatggaagaa

SEQ ID NO: 614467 - DNA, 25 bp, Rattus norvegicus
tgatgacaccatactcagcaggcag

SEQ ID NO: 614468 - DNA, 25 bp, Rattus norvegicus
tgatgacaccatcctggagtgccgc

SEQ ID NO: 614469 - DNA, 25 bp, Rattus norvegicus
tgatgacaccatgctggagtgccgc

SEQ ID NO: 614470 - DNA, 25 bp, Rattus norvegicus
tgatgacaccattctcagcaggcag

SEQ ID NO: 614471 - DNA, 25 bp, Rattus norvegicus
tgatgacaccggctctggtcttttg

SEQ ID NO: 614472 - DNA, 25 bp, Rattus norvegicus
tgatgacaccgggtctggtcttttg

SEQ ID NO: 614473 - DNA, 25 bp, Rattus norvegicus
tgatgacactgcatgcctcagagga

SEQ ID NO: 614474 - DNA, 25 bp, Rattus norvegicus
tgatgacactgcttgcctcagagga

SEQ ID NO: 614475 - DNA, 25 bp, Rattus norvegicus
tgatgacagcagagaaaccccacct

SEQ ID NO: 614476 - DNA, 25 bp, Rattus norvegicus
tgatgacagcagtgaaaccccacct

SEQ ID NO: 614477 - DNA, 25 bp, Rattus norvegicus
tgatgacaggccaggttcccagtgg

SEQ ID NO: 614478 - DNA, 25 bp, Rattus norvegicus
tgatgacaggcctggttcccagtgg

SEQ ID NO: 614479 - DNA, 25 bp, Rattus norvegicus
tgatgacagtctagctcccacaatg

SEQ ID NO: 614480 - DNA, 25 bp, Rattus norvegicus
tgatgacagtcttgctcccacaatg

SEQ ID NO: 614481 - DNA, 25 bp, Rattus norvegicus
tgatgacatcaacacctggaatctt

SEQ ID NO: 614482 - DNA, 25 bp, Rattus norvegicus
tgatgacatcaagacctggaatctt

SEQ ID NO: 614483 - DNA, 25 bp, Rattus norvegicus
tgatgacatcccactgaggactgct

SEQ ID NO: 614484 - DNA, 25 bp, Rattus norvegicus
tgatgacatccctctgaggactgct

SEQ ID NO: 614485 - DNA, 25 bp, Rattus norvegicus
tgatgacatggactgacacctgcct

SEQ ID NO: 614486 - DNA, 25 bp, Rattus norvegicus
tgatgacatggagtgacacctgcct

SEQ ID NO: 614487 - DNA, 25 bp, Rattus norvegicus
tgatgacatgtaaccccgaggctta

SEQ ID NO: 614488 - DNA, 25 bp, Rattus norvegicus
tgatgacatgtatccccgaggctta

SEQ ID NO: 614489 - DNA, 25 bp, Rattus norvegicus
tgatgacattgacccttgtactggc

SEQ ID NO: 614490 - DNA, 25 bp, Rattus norvegicus
tgatgacattgagccttgtactggc

SEQ ID NO: 614491 - DNA, 25 bp, Rattus norvegicus
tgatgacatttcaccctccaggtgg

SEQ ID NO: 614492 - DNA, 25 bp, Rattus norvegicus
tgatgacatttctccctccaggtgg

SEQ ID NO: 614493 - DNA, 25 bp, Rattus norvegicus
tgatgaccaagtaccaggccagcat

SEQ ID NO: 614494 - DNA, 25 bp, Rattus norvegicus
tgatgaccaagttccaggccagcat

SEQ ID NO: 614495 - DNA, 25 bp, Rattus norvegicus
tgatgaccacatatatgcccctgta

SEQ ID NO: 614496 - DNA, 25 bp, Rattus norvegicus
tgatgaccacatttatgcccctgta

SEQ ID NO: 614497 - DNA, 25 bp, Rattus norvegicus
tgatgaccacgccttttgtctttgc

SEQ ID NO: 614498 - DNA, 25 bp, Rattus norvegicus
tgatgaccacgcgttttgtctttgc

SEQ ID NO: 614499 - DNA, 25 bp, Rattus norvegicus
tgatgaccagtcacttgctaaatac

SEQ ID NO: 614500 - DNA, 25 bp, Rattus norvegicus
tgatgaccagtctcttgctaaatac

SEQ ID NO: 614501 - DNA, 25 bp, Rattus norvegicus
tgatgaccccttaataaacacgttt

SEQ ID NO: 614502 - DNA, 25 bp, Rattus norvegicus
tgatgacccctttataaacacgttt

SEQ ID NO: 614503 - DNA, 25 bp, Rattus norvegicus
tgatgaccctcaagggacttccaag

SEQ ID NO: 614504 - DNA, 25 bp, Rattus norvegicus
tgatgaccctcatgggacttccaag

SEQ ID NO: 614505 - DNA, 25 bp, Rattus norvegicus
tgatgaccggtgaacagcctccgca

SEQ ID NO: 614506 - DNA, 25 bp, Rattus norvegicus
tgatgaccggtgtacagcctccgca

SEQ ID NO: 614507 - DNA, 25 bp, Rattus norvegicus
tgatgaccgttcagaggctcacagt

SEQ ID NO: 614508 - DNA, 25 bp, Rattus norvegicus
tgatgaccgttctgaggctcacagt

SEQ ID NO: 614509 - DNA, 25 bp, Rattus norvegicus
tgatgacctcaaagcactttcctgg

SEQ ID NO: 614510 - DNA, 25 bp, Rattus norvegicus
tgatgacctcaatgcactttcctgg

SEQ ID NO: 614511 - DNA, 25 bp, Rattus norvegicus
tgatgacctcatatttatccagaaa

SEQ ID NO: 614512 - DNA, 25 bp, Rattus norvegicus
tgatgacctcatttttatccagaaa

SEQ ID NO: 614513 - DNA, 25 bp, Rattus norvegicus
tgatgacctctaccctcttagagtt

SEQ ID NO: 614514 - DNA, 25 bp, Rattus norvegicus
tgatgacctctagcctcttagagtt

SEQ ID NO: 614515 - DNA, 25 bp, Rattus norvegicus
tgatgacctgtacttgatcgccatt

SEQ ID NO: 614516 - DNA, 25 bp, Rattus norvegicus
tgatgacctgtagttgatcgccatt

SEQ ID NO: 614517 - DNA, 25 bp, Rattus norvegicus
tgatgaccttcaccacgggacacag

SEQ ID NO: 614518 - DNA, 25 bp, Rattus norvegicus
tgatgaccttcacctggacaggact

SEQ ID NO: 614519 - DNA, 25 bp, Rattus norvegicus
tgatgaccttcagcacgggacacag

SEQ ID NO: 614520 - DNA, 25 bp, Rattus norvegicus
tgatgaccttcagctggacaggact

SEQ ID NO: 614521 - DNA, 25 bp, Rattus norvegicus
tgatgacgacatcccatacttgtgt

SEQ ID NO: 614522 - DNA, 25 bp, Rattus norvegicus
tgatgacgacatgccatacttgtgt

SEQ ID NO: 614523 - DNA, 25 bp, Rattus norvegicus
tgatgacggtgtagtccaagctcaa

SEQ ID NO: 614524 - DNA, 25 bp, Rattus norvegicus
tgatgacggtgttgtccaagctcaa

SEQ ID NO: 614525 - DNA, 25 bp, Rattus norvegicus
tgatgactaataactccaacccctc

SEQ ID NO: 614526 - DNA, 25 bp, Rattus norvegicus
tgatgactaatatctccaacccctc

SEQ ID NO: 614527 - DNA, 25 bp, Rattus norvegicus
tgatgactatttatggttgttacct

SEQ ID NO: 614528 - DNA, 25 bp, Rattus norvegicus
tgatgactatttttggttgttacct

SEQ ID NO: 614529 - DNA, 25 bp, Rattus norvegicus
tgatgactcagcagtagctacctcc

SEQ ID NO: 614530 - DNA, 25 bp, Rattus norvegicus
tgatgactcagctgtagctacctcc

SEQ ID NO: 614531 - DNA, 25 bp, Rattus norvegicus
tgatgactcccacagatgaccaccg

SEQ ID NO: 614532 - DNA, 25 bp, Rattus norvegicus
tgatgactcccagagatgaccaccg

SEQ ID NO: 614533 - DNA, 25 bp, Rattus norvegicus
tgatgactccctcaaatatgccctg

SEQ ID NO: 614534 - DNA, 25 bp, Rattus norvegicus
tgatgactccctgaaatatgccctg

SEQ ID NO: 614535 - DNA, 25 bp, Rattus norvegicus
tgatgactctaaaagctcaccctgt

SEQ ID NO: 614536 - DNA, 25 bp, Rattus norvegicus
tgatgactctaatagctcaccctgt

SEQ ID NO: 614537 - DNA, 25 bp, Rattus norvegicus
tgatgactctcaatcattccttcat

SEQ ID NO: 614538 - DNA, 25 bp, Rattus norvegicus
tgatgactctcattcattccttcat

SEQ ID NO: 614539 - DNA, 25 bp, Rattus norvegicus
tgatgactgagaacctgatctgtcc

SEQ ID NO: 614540 - DNA, 25 bp, Rattus norvegicus
tgatgactgagatcctgatctgtcc

SEQ ID NO: 614541 - DNA, 25 bp, Rattus norvegicus
tgatgactgatcaactcttgcacta

SEQ ID NO: 614542 - DNA, 25 bp, Rattus norvegicus
tgatgactgatctactcttgcacta

SEQ ID NO: 614543 - DNA, 25 bp, Rattus norvegicus
tgatgactgctccatggttacactg

SEQ ID NO: 614544 - DNA, 25 bp, Rattus norvegicus
tgatgactgctcgatggttacactg

SEQ ID NO: 614545 - DNA, 25 bp, Rattus norvegicus
tgatgactgtacacggtccagctaa

SEQ ID NO: 614546 - DNA, 25 bp, Rattus norvegicus
tgatgactgtactcggtccagctaa

SEQ ID NO: 614547 - DNA, 25 bp, Rattus norvegicus
tgatgactgtagcaagaagcccttg

SEQ ID NO: 614548 - DNA, 25 bp, Rattus norvegicus
tgatgactgtaggaagaagcccttg

SEQ ID NO: 614549 - DNA, 25 bp, Rattus norvegicus
tgatgacttttccagtgtcccgata

SEQ ID NO: 614550 - DNA, 25 bp, Rattus norvegicus
tgatgacttttcgagtgtcccgata

SEQ ID NO: 614551 - DNA, 25 bp, Rattus norvegicus
tgatgacttttgaggttgttggcaa

SEQ ID NO: 614552 - DNA, 25 bp, Rattus norvegicus
tgatgacttttgcaacaccaccaga

SEQ ID NO: 614553 - DNA, 25 bp, Rattus norvegicus
tgatgacttttggaacaccaccaga

SEQ ID NO: 614554 - DNA, 25 bp, Rattus norvegicus
tgatgacttttgtggttgttggcaa

SEQ ID NO: 614555 - DNA, 25 bp, Rattus norvegicus
tgatgagaacctcaaggccttcctc

SEQ ID NO: 614556 - DNA, 25 bp, Rattus norvegicus
tgatgagaacctgaaggccttcctc

SEQ ID NO: 614557 - DNA, 25 bp, Rattus norvegicus
tgatgagacaccacgttctgacctg

SEQ ID NO: 614558 - DNA, 25 bp, Rattus norvegicus
tgatgagacacctcgttctgacctg

SEQ ID NO: 614559 - DNA, 25 bp, Rattus norvegicus
tgatgagagccactgagaagcccca

SEQ ID NO: 614560 - DNA, 25 bp, Rattus norvegicus
tgatgagagccagtgagaagcccca

SEQ ID NO: 614561 - DNA, 25 bp, Rattus norvegicus
tgatgagatccaacctcttaacaag

SEQ ID NO: 614562 - DNA, 25 bp, Rattus norvegicus
tgatgagatccatcctcttaacaag

SEQ ID NO: 614563 - DNA, 25 bp, Rattus norvegicus
tgatgagatctcagacctgcaccag

SEQ ID NO: 614564 - DNA, 25 bp, Rattus norvegicus
tgatgagatctctgacctgcaccag

SEQ ID NO: 614565 - DNA, 25 bp, Rattus norvegicus
tgatgagatgtgacatggatgcacc

SEQ ID NO: 614566 - DNA, 25 bp, Rattus norvegicus
tgatgagatgtgtcatggatgcacc

SEQ ID NO: 614567 - DNA, 25 bp, Rattus norvegicus
tgatgagatttgagcctgggttgta

SEQ ID NO: 614568 - DNA, 25 bp, Rattus norvegicus
tgatgagatttgtgcctgggttgta

SEQ ID NO: 614569 - DNA, 25 bp, Rattus norvegicus
tgatgagcaagccactgtctgctct

SEQ ID NO: 614570 - DNA, 25 bp, Rattus norvegicus
tgatgagcaagcgactgtctgctct

SEQ ID NO: 614571 - DNA, 25 bp, Rattus norvegicus
tgatgagcaagtccacctttgacgc

SEQ ID NO: 614572 - DNA, 25 bp, Rattus norvegicus
tgatgagcaagtgcacctttgacgc

SEQ ID NO: 614573 - DNA, 25 bp, Rattus norvegicus
tgatgagcacatattgattccaagt

SEQ ID NO: 614574 - DNA, 25 bp, Rattus norvegicus
tgatgagcacattttgattccaagt

SEQ ID NO: 614575 - DNA, 25 bp, Rattus norvegicus
tgatgagccaatactgttgccacct

SEQ ID NO: 614576 - DNA, 25 bp, Rattus norvegicus
tgatgagccaattctgttgccacct

SEQ ID NO: 614577 - DNA, 25 bp, Rattus norvegicus
tgatgagcccaacgatgcggcctca

SEQ ID NO: 614578 - DNA, 25 bp, Rattus norvegicus
tgatgagcccaaggatgcggcctca

SEQ ID NO: 614579 - DNA, 25 bp, Rattus norvegicus
tgatgagcccgaagcaccatgacca

SEQ ID NO: 614580 - DNA, 25 bp, Rattus norvegicus
tgatgagcccgatgcaccatgacca

SEQ ID NO: 614581 - DNA, 25 bp, Rattus norvegicus
tgatgagccctaaacctccatgtgt

SEQ ID NO: 614582 - DNA, 25 bp, Rattus norvegicus
tgatgagccctatacctccatgtgt

SEQ ID NO: 614583 - DNA, 25 bp, Rattus norvegicus
tgatgagccctcatatcgtgtcatg

SEQ ID NO: 614584 - DNA, 25 bp, Rattus norvegicus
tgatgagccctcttatcgtgtcatg

SEQ ID NO: 614585 - DNA, 25 bp, Rattus norvegicus
tgatgagccgaaatgcagcaacaat

SEQ ID NO: 614586 - DNA, 25 bp, Rattus norvegicus
tgatgagccgaattgcagcaacaat

SEQ ID NO: 614587 - DNA, 25 bp, Rattus norvegicus
tgatgagccggcacgagtacctgcc

SEQ ID NO: 614588 - DNA, 25 bp, Rattus norvegicus
tgatgagccggctcgagtacctgcc

SEQ ID NO: 614589 - DNA, 25 bp, Rattus norvegicus
tgatgagccgtaccagccctgggat

SEQ ID NO: 614590 - DNA, 25 bp, Rattus norvegicus
tgatgagccgtagcagccctgggat

SEQ ID NO: 614591 - DNA, 25 bp, Rattus norvegicus
tgatgagcctccattttcatgctta

SEQ ID NO: 614592 - DNA, 25 bp, Rattus norvegicus
tgatgagcctcctttttcatgctta

SEQ ID NO: 614593 - DNA, 25 bp, Rattus norvegicus
tgatgagcctctccgcaactgtgat

SEQ ID NO: 614594 - DNA, 25 bp, Rattus norvegicus
tgatgagcctctgcgcaactgtgat

SEQ ID NO: 614595 - DNA, 25 bp, Rattus norvegicus
tgatgagcctgccataattgtccat

SEQ ID NO: 614596 - DNA, 25 bp, Rattus norvegicus
tgatgagcctgcgataattgtccat

SEQ ID NO: 614597 - DNA, 25 bp, Rattus norvegicus
tgatgagcgagaatcccagttcccc

SEQ ID NO: 614598 - DNA, 25 bp, Rattus norvegicus
tgatgagcgagattcccagttcccc

SEQ ID NO: 614599 - DNA, 25 bp, Rattus norvegicus
tgatgagctgaacacccaggtcgct

SEQ ID NO: 614600 - DNA, 25 bp, Rattus norvegicus
tgatgagctgaagacccaggtcgct

SEQ ID NO: 614601 - DNA, 25 bp, Rattus norvegicus
tgatgagctgccactagtagtccca

SEQ ID NO: 614602 - DNA, 25 bp, Rattus norvegicus
tgatgagctgcctctagtagtccca

SEQ ID NO: 614603 - DNA, 25 bp, Rattus norvegicus
tgatgagctgggagtccttaccttc

SEQ ID NO: 614604 - DNA, 25 bp, Rattus norvegicus
tgatgagctgggtgtccttaccttc

SEQ ID NO: 614605 - DNA, 25 bp, Rattus norvegicus
tgatgaggacacataaaccctaatt

SEQ ID NO: 614606 - DNA, 25 bp, Rattus norvegicus
tgatgaggacacttaaaccctaatt

SEQ ID NO: 614607 - DNA, 25 bp, Rattus norvegicus
tgatgaggcgccattccaggagaaa

SEQ ID NO: 614608 - DNA, 25 bp, Rattus norvegicus
tgatgaggcgcctttccaggagaaa

SEQ ID NO: 614609 - DNA, 25 bp, Rattus norvegicus
tgatgaggctttccctacttctaaa

SEQ ID NO: 614610 - DNA, 25 bp, Rattus norvegicus
tgatgaggctttgcctacttctaaa

SEQ ID NO: 614611 - DNA, 25 bp, Rattus norvegicus
tgatgagggtccagtcctggctcca

SEQ ID NO: 614612 - DNA, 25 bp, Rattus norvegicus
tgatgagggtcctgtcctggctcca

SEQ ID NO: 614613 - DNA, 25 bp, Rattus norvegicus
tgatgaggtattcagcggcttgcgt

SEQ ID NO: 614614 - DNA, 25 bp, Rattus norvegicus
tgatgaggtattgagcggcttgcgt

SEQ ID NO: 614615 - DNA, 25 bp, Rattus norvegicus
tgatgaggtgaacctgccactgcac

SEQ ID NO: 614616 - DNA, 25 bp, Rattus norvegicus
tgatgaggtgaagctgccactgcac

SEQ ID NO: 614617 - DNA, 25 bp, Rattus norvegicus
tgatgaggtgcaccagaaccatgtc

SEQ ID NO: 614618 - DNA, 25 bp, Rattus norvegicus
tgatgaggtgcagcagaaccatgtc

SEQ ID NO: 614619 - DNA, 25 bp, Rattus norvegicus
tgatgagtaaaaagccccaaactgg

SEQ ID NO: 614620 - DNA, 25 bp, Rattus norvegicus
tgatgagtaaaatgccccaaactgg

SEQ ID NO: 614621 - DNA, 25 bp, Rattus norvegicus
tgatgagtccacagctcatgtgacc

SEQ ID NO: 614622 - DNA, 25 bp, Rattus norvegicus
tgatgagtccactgctcatgtgacc

SEQ ID NO: 614623 - DNA, 25 bp, Rattus norvegicus
tgatgagtccttcactgccagcaca

SEQ ID NO: 614624 - DNA, 25 bp, Rattus norvegicus
tgatgagtccttgactgccagcaca

SEQ ID NO: 614625 - DNA, 25 bp, Rattus norvegicus
tgatgagtctgcaggtgcctatgcc

SEQ ID NO: 614626 - DNA, 25 bp, Rattus norvegicus
tgatgagtctgctggtgcctatgcc

SEQ ID NO: 614627 - DNA, 25 bp, Rattus norvegicus
tgatgagtggacatttgggagcaat

SEQ ID NO: 614628 - DNA, 25 bp, Rattus norvegicus
tgatgagtggacttttgggagcaat

SEQ ID NO: 614629 - DNA, 25 bp, Rattus norvegicus
tgatgagtgtatacccaatccctgg

SEQ ID NO: 614630 - DNA, 25 bp, Rattus norvegicus
tgatgagtgtattcccaatccctgg

SEQ ID NO: 614631 - DNA, 25 bp, Rattus norvegicus
tgatgatagccaaaggtgacctcac

SEQ ID NO: 614632 - DNA, 25 bp, Rattus norvegicus
tgatgatagccataggtgacctcac

SEQ ID NO: 614633 - DNA, 25 bp, Rattus norvegicus
tgatgatagcgacattcctaccgcc

SEQ ID NO: 614634 - DNA, 25 bp, Rattus norvegicus
tgatgatagcgagattcctaccgcc

SEQ ID NO: 614635 - DNA, 25 bp, Rattus norvegicus
tgatgatatcctagaccgcacttat

SEQ ID NO: 614636 - DNA, 25 bp, Rattus norvegicus
tgatgatatccttgaccgcacttat

SEQ ID NO: 614637 - DNA, 25 bp, Rattus norvegicus
tgatgatatctgaacgtcaccttcc

SEQ ID NO: 614638 - DNA, 25 bp, Rattus norvegicus
tgatgatatctgtacgtcaccttcc

SEQ ID NO: 614639 - DNA, 25 bp, Rattus norvegicus
tgatgatcaaccctgaaccgccagg

SEQ ID NO: 614640 - DNA, 25 bp, Rattus norvegicus
tgatgatcaaccgtgaaccgccagg

SEQ ID NO: 614641 - DNA, 25 bp, Rattus norvegicus
tgatgatcagccacacgactgtttt

SEQ ID NO: 614642 - DNA, 25 bp, Rattus norvegicus
tgatgatcagcctcacgactgtttt

SEQ ID NO: 614643 - DNA, 25 bp, Rattus norvegicus
tgatgatcagttctacagtatttac

SEQ ID NO: 614644 - DNA, 25 bp, Rattus norvegicus
tgatgatcagttgtacagtatttac

SEQ ID NO: 614645 - DNA, 25 bp, Rattus norvegicus
tgatgatcctcaagttcagcttctt

SEQ ID NO: 614646 - DNA, 25 bp, Rattus norvegicus
tgatgatcctcatgttcagcttctt

SEQ ID NO: 614647 - DNA, 25 bp, Rattus norvegicus
tgatgatcctgtacctttaccaaat

SEQ ID NO: 614648 - DNA, 25 bp, Rattus norvegicus
tgatgatcctgttcctttaccaaat

SEQ ID NO: 614649 - DNA, 25 bp, Rattus norvegicus
tgatgatcggcaagttcgccttcat

SEQ ID NO: 614650 - DNA, 25 bp, Rattus norvegicus
tgatgatcggcatgttcgccttcat

SEQ ID NO: 614651 - DNA, 25 bp, Rattus norvegicus
tgatgatgcggcagtctttgtgtta

SEQ ID NO: 614652 - DNA, 25 bp, Rattus norvegicus
tgatgatgcggctgtctttgtgtta

SEQ ID NO: 614653 - DNA, 25 bp, Rattus norvegicus
tgatgatggctactgaagctctccc

SEQ ID NO: 614654 - DNA, 25 bp, Rattus norvegicus
tgatgatggctagtgaagctctccc

SEQ ID NO: 614655 - DNA, 25 bp, Rattus norvegicus
tgatgatgggtaacagtcctctccc

SEQ ID NO: 614656 - DNA, 25 bp, Rattus norvegicus
tgatgatgggtatcagtcctctccc

SEQ ID NO: 614657 - DNA, 25 bp, Rattus norvegicus
tgatgatggtgtacttggtctggca

SEQ ID NO: 614658 - DNA, 25 bp, Rattus norvegicus
tgatgatggtgttcttggtctggca

SEQ ID NO: 614659 - DNA, 25 bp, Rattus norvegicus
tgatgatgtattcattccaggggcc

SEQ ID NO: 614660 - DNA, 25 bp, Rattus norvegicus
tgatgatgtattgattccaggggcc

SEQ ID NO: 614661 - DNA, 25 bp, Rattus norvegicus
tgatgatgtgcacatgtggacagct

SEQ ID NO: 614662 - DNA, 25 bp, Rattus norvegicus
tgatgatgtgcagatgtggacagct

SEQ ID NO: 614663 - DNA, 25 bp, Rattus norvegicus
tgatgattaccccaaaggcttcttc

SEQ ID NO: 614664 - DNA, 25 bp, Rattus norvegicus
tgatgattacccgaaaggcttcttc

SEQ ID NO: 614665 - DNA, 25 bp, Rattus norvegicus
tgatgattactaaagaggacgtgct

SEQ ID NO: 614666 - DNA, 25 bp, Rattus norvegicus
tgatgattactatagaggacgtgct

SEQ ID NO: 614667 - DNA, 25 bp, Rattus norvegicus
tgatgattatccctgatggagaatg

SEQ ID NO: 614668 - DNA, 25 bp, Rattus norvegicus
tgatgattatccgtgatggagaatg

SEQ ID NO: 614669 - DNA, 25 bp, Rattus norvegicus
tgatgattcctaattcctcttgcgt

SEQ ID NO: 614670 - DNA, 25 bp, Rattus norvegicus
tgatgattcctatttcctcttgcgt

SEQ ID NO: 614671 - DNA, 25 bp, Rattus norvegicus
tgatgattcctgaagcatctggccc

SEQ ID NO: 614672 - DNA, 25 bp, Rattus norvegicus
tgatgattcctgtagcatctggccc

SEQ ID NO: 614673 - DNA, 25 bp, Rattus norvegicus
tgatgattggcaccccagaggcatt

SEQ ID NO: 614674 - DNA, 25 bp, Rattus norvegicus
tgatgattggcagcccagaggcatt

SEQ ID NO: 614675 - DNA, 25 bp, Rattus norvegicus
tgatgcaaccgacaagcctcatgcc

SEQ ID NO: 614676 - DNA, 25 bp, Rattus norvegicus
tgatgcaaccgagaagcctcatgcc

SEQ ID NO: 614677 - DNA, 25 bp, Rattus norvegicus
tgatgcaagcctccttgtaggactg

SEQ ID NO: 614678 - DNA, 25 bp, Rattus norvegicus
tgatgcaagcctgcttgtaggactg

SEQ ID NO: 614679 - DNA, 25 bp, Rattus norvegicus
tgatgcaagtgtccatgtagccctg

SEQ ID NO: 614680 - DNA, 25 bp, Rattus norvegicus
tgatgcaagtgtgcatgtagccctg

SEQ ID NO: 614681 - DNA, 25 bp, Rattus norvegicus
tgatgcaatataacctttctgagat

SEQ ID NO: 614682 - DNA, 25 bp, Rattus norvegicus
tgatgcaatatatcctttctgagat

SEQ ID NO: 614683 - DNA, 25 bp, Rattus norvegicus
tgatgcacagacactcacctgaaga

SEQ ID NO: 614684 - DNA, 25 bp, Rattus norvegicus
tgatgcacagactctcacctgaaga

SEQ ID NO: 614685 - DNA, 25 bp, Rattus norvegicus
tgatgcacatctcggcttctgcata

SEQ ID NO: 614686 - DNA, 25 bp, Rattus norvegicus
tgatgcacatctgggcttctgcata

SEQ ID NO: 614687 - DNA, 25 bp, Rattus norvegicus
tgatgcaccaggaccttaagggctc

SEQ ID NO: 614688 - DNA, 25 bp, Rattus norvegicus
tgatgcaccaggtccttaagggctc

SEQ ID NO: 614689 - DNA, 25 bp, Rattus norvegicus
tgatgcacccataccgggatctcat

SEQ ID NO: 614690 - DNA, 25 bp, Rattus norvegicus
tgatgcacccattccgggatctcat

SEQ ID NO: 614691 - DNA, 25 bp, Rattus norvegicus
tgatgcacccgtcacagatggagaa

SEQ ID NO: 614692 - DNA, 25 bp, Rattus norvegicus
tgatgcacccgtgacagatggagaa

SEQ ID NO: 614693 - DNA, 25 bp, Rattus norvegicus
tgatgcacttacactgaagccttgt

SEQ ID NO: 614694 - DNA, 25 bp, Rattus norvegicus
tgatgcacttactctgaagccttgt

SEQ ID NO: 614695 - DNA, 25 bp, Rattus norvegicus
tgatgcacttggaggccagcaatcc

SEQ ID NO: 614696 - DNA, 25 bp, Rattus norvegicus
tgatgcacttggtggccagcaatcc

SEQ ID NO: 614697 - DNA, 25 bp, Rattus norvegicus
tgatgcactttcatggagaccgcca

SEQ ID NO: 614698 - DNA, 25 bp, Rattus norvegicus
tgatgcactttcttggagaccgcca

SEQ ID NO: 614699 - DNA, 25 bp, Rattus norvegicus
tgatgcagctgtatcctataacggg

SEQ ID NO: 614700 - DNA, 25 bp, Rattus norvegicus
tgatgcagctgtcgccttcacacaa

SEQ ID NO: 614701 - DNA, 25 bp, Rattus norvegicus
tgatgcagctgtggccttcacacaa

SEQ ID NO: 614702 - DNA, 25 bp, Rattus norvegicus
tgatgcagctgtttcctataacggg

SEQ ID NO: 614703 - DNA, 25 bp, Rattus norvegicus
tgatgcagggctatgaggcttagat

SEQ ID NO: 614704 - DNA, 25 bp, Rattus norvegicus
tgatgcagggctttgaggcttagat

SEQ ID NO: 614705 - DNA, 25 bp, Rattus norvegicus
tgatgcagtcagattacccgagggt

SEQ ID NO: 614706 - DNA, 25 bp, Rattus norvegicus
tgatgcagtcagtttacccgagggt

SEQ ID NO: 614707 - DNA, 25 bp, Rattus norvegicus
tgatgcagttcaagccatggccttc

SEQ ID NO: 614708 - DNA, 25 bp, Rattus norvegicus
tgatgcagttcatgccatggccttc

SEQ ID NO: 614709 - DNA, 25 bp, Rattus norvegicus
tgatgcagttgtacagcgcccggca

SEQ ID NO: 614710 - DNA, 25 bp, Rattus norvegicus
tgatgcagttgttcagcgcccggca

SEQ ID NO: 614711 - DNA, 25 bp, Rattus norvegicus
tgatgcatacttcccaacatggagg

SEQ ID NO: 614712 - DNA, 25 bp, Rattus norvegicus
tgatgcatacttgccaacatggagg

SEQ ID NO: 614713 - DNA, 25 bp, Rattus norvegicus
tgatgcatagtgactgactgggctt

SEQ ID NO: 614714 - DNA, 25 bp, Rattus norvegicus
tgatgcatagtgtctgactgggctt

SEQ ID NO: 614715 - DNA, 25 bp, Rattus norvegicus
tgatgcatattcagcctcccaagaa

SEQ ID NO: 614716 - DNA, 25 bp, Rattus norvegicus
tgatgcatattcctgctccgtttcc

SEQ ID NO: 614717 - DNA, 25 bp, Rattus norvegicus
tgatgcatattcgtgctccgtttcc

SEQ ID NO: 614718 - DNA, 25 bp, Rattus norvegicus
tgatgcatattctgcctcccaagaa

SEQ ID NO: 614719 - DNA, 25 bp, Rattus norvegicus
tgatgcatcttgcttcactgttttc

SEQ ID NO: 614720 - DNA, 25 bp, Rattus norvegicus
tgatgcatcttggttcactgttttc

SEQ ID NO: 614721 - DNA, 25 bp, Rattus norvegicus
tgatgcatgcgcatgggtcctgcga

SEQ ID NO: 614722 - DNA, 25 bp, Rattus norvegicus
tgatgcatgcgcttgggtcctgcga

SEQ ID NO: 614723 - DNA, 25 bp, Rattus norvegicus
tgatgcatgtagaacctggtgaacc

SEQ ID NO: 614724 - DNA, 25 bp, Rattus norvegicus
tgatgcatgtagtacctggtgaacc

SEQ ID NO: 614725 - DNA, 25 bp, Rattus norvegicus
tgatgccaaatgcacacaggttcct

SEQ ID NO: 614726 - DNA, 25 bp, Rattus norvegicus
tgatgccaaatggacacaggttcct

SEQ ID NO: 614727 - DNA, 25 bp, Rattus norvegicus
tgatgccaacatctccacattttgt

SEQ ID NO: 614728 - DNA, 25 bp, Rattus norvegicus
tgatgccaacatgtccacattttgt

SEQ ID NO: 614729 - DNA, 25 bp, Rattus norvegicus
tgatgccaagacctaccgtgattac

SEQ ID NO: 614730 - DNA, 25 bp, Rattus norvegicus
tgatgccaagacgtaccgtgattac

SEQ ID NO: 614731 - DNA, 25 bp, Rattus norvegicus
tgatgccacatcctgtttctttttg

SEQ ID NO: 614732 - DNA, 25 bp, Rattus norvegicus
tgatgccacatcgtgtttctttttg

SEQ ID NO: 614733 - DNA, 25 bp, Rattus norvegicus
tgatgccaccatccttgagtaagaa

SEQ ID NO: 614734 - DNA, 25 bp, Rattus norvegicus
tgatgccaccatgcttgagtaagaa

SEQ ID NO: 614735 - DNA, 25 bp, Rattus norvegicus
tgatgccacctgattccccaaaagg

SEQ ID NO: 614736 - DNA, 25 bp, Rattus norvegicus
tgatgccacctgtttccccaaaagg

SEQ ID NO: 614737 - DNA, 25 bp, Rattus norvegicus
tgatgccagcatagtctaaggtagc

SEQ ID NO: 614738 - DNA, 25 bp, Rattus norvegicus
tgatgccagcattgtctaaggtagc

SEQ ID NO: 614739 - DNA, 25 bp, Rattus norvegicus
tgatgccagcgaatccactcagaat

SEQ ID NO: 614740 - DNA, 25 bp, Rattus norvegicus
tgatgccagcgattccactcagaat

SEQ ID NO: 614741 - DNA, 25 bp, Rattus norvegicus
tgatgccagtcacacccggtgagca

SEQ ID NO: 614742 - DNA, 25 bp, Rattus norvegicus
tgatgccagtcagacccggtgagca

SEQ ID NO: 614743 - DNA, 25 bp, Rattus norvegicus
tgatgccagtgcaaagtgctccttg

SEQ ID NO: 614744 - DNA, 25 bp, Rattus norvegicus
tgatgccagtgctaagtgctccttg

SEQ ID NO: 614745 - DNA, 25 bp, Rattus norvegicus
tgatgccagttcacaagccgcagag

SEQ ID NO: 614746 - DNA, 25 bp, Rattus norvegicus
tgatgccagttctcaagccgcagag

SEQ ID NO: 614747 - DNA, 25 bp, Rattus norvegicus
tgatgccatatgataccgtgtctcc

SEQ ID NO: 614748 - DNA, 25 bp, Rattus norvegicus
tgatgccatatgttaccgtgtctcc

SEQ ID NO: 614749 - DNA, 25 bp, Rattus norvegicus
tgatgccatgttcgtctttgtccca

SEQ ID NO: 614750 - DNA, 25 bp, Rattus norvegicus
tgatgccatgttggtctttgtccca

SEQ ID NO: 614751 - DNA, 25 bp, Rattus norvegicus
tgatgccatttcatggaagaagatg

SEQ ID NO: 614752 - DNA, 25 bp, Rattus norvegicus
tgatgccatttcttggaagaagatg

SEQ ID NO: 614753 - DNA, 25 bp, Rattus norvegicus
tgatgcccagacacttatactttat

SEQ ID NO: 614754 - DNA, 25 bp, Rattus norvegicus
tgatgcccagactcttatactttat

SEQ ID NO: 614755 - DNA, 25 bp, Rattus norvegicus
tgatgcccagtcagttgttttccaa

SEQ ID NO: 614756 - DNA, 25 bp, Rattus norvegicus
tgatgcccagtctgttgttttccaa

SEQ ID NO: 614757 - DNA, 25 bp, Rattus norvegicus
tgatgcccatgcaggagacgcttaa

SEQ ID NO: 614758 - DNA, 25 bp, Rattus norvegicus
tgatgcccatgctggagacgcttaa

SEQ ID NO: 614759 - DNA, 25 bp, Rattus norvegicus
tgatgcccatggactgtactactat

SEQ ID NO: 614760 - DNA, 25 bp, Rattus norvegicus
tgatgcccatggtctgtactactat

SEQ ID NO: 614761 - DNA, 25 bp, Rattus norvegicus
tgatgccccattctccagagcattc

SEQ ID NO: 614762 - DNA, 25 bp, Rattus norvegicus
tgatgccccattgtccagagcattc

SEQ ID NO: 614763 - DNA, 25 bp, Rattus norvegicus
tgatgcccctgcaacggattcagaa

SEQ ID NO: 614764 - DNA, 25 bp, Rattus norvegicus
tgatgcccctgctacggattcagaa

SEQ ID NO: 614765 - DNA, 25 bp, Rattus norvegicus
tgatgccctcccaagccagaagagg

SEQ ID NO: 614766 - DNA, 25 bp, Rattus norvegicus
tgatgccctccctagccagaagagg

SEQ ID NO: 614767 - DNA, 25 bp, Rattus norvegicus
tgatgccctctcagttatgtgcaaa

SEQ ID NO: 614768 - DNA, 25 bp, Rattus norvegicus
tgatgccctctctgttatgtgcaaa

SEQ ID NO: 614769 - DNA, 25 bp, Rattus norvegicus
tgatgccctctgaaactttagaccc

SEQ ID NO: 614770 - DNA, 25 bp, Rattus norvegicus
tgatgccctctgtaactttagaccc

SEQ ID NO: 614771 - DNA, 25 bp, Rattus norvegicus
tgatgcccttaacaagaccccttag

SEQ ID NO: 614772 - DNA, 25 bp, Rattus norvegicus
tgatgcccttaagaagaccccttag

SEQ ID NO: 614773 - DNA, 25 bp, Rattus norvegicus
tgatgcccttcaacatggacacgcg

SEQ ID NO: 614774 - DNA, 25 bp, Rattus norvegicus
tgatgcccttcatcatggacacgcg

SEQ ID NO: 614775 - DNA, 25 bp, Rattus norvegicus
tgatgcccttgtctgtacctcgtgt

SEQ ID NO: 614776 - DNA, 25 bp, Rattus norvegicus
tgatgcccttgtgtgtacctcgtgt

SEQ ID NO: 614777 - DNA, 25 bp, Rattus norvegicus
tgatgccctttcctctatcataagt

SEQ ID NO: 614778 - DNA, 25 bp, Rattus norvegicus
tgatgccctttcgtctatcataagt

SEQ ID NO: 614779 - DNA, 25 bp, Rattus norvegicus
tgatgccgatggagcaatggccaaa

SEQ ID NO: 614780 - DNA, 25 bp, Rattus norvegicus
tgatgccgatggtgcaatggccaaa

SEQ ID NO: 614781 - DNA, 25 bp, Rattus norvegicus
tgatgccgcagtaacagtgaggtgt

SEQ ID NO: 614782 - DNA, 25 bp, Rattus norvegicus
tgatgccgcagttacagtgaggtgt

SEQ ID NO: 614783 - DNA, 25 bp, Rattus norvegicus
tgatgccggcgactcttggatcctt

SEQ ID NO: 614784 - DNA, 25 bp, Rattus norvegicus
tgatgccggcgagtcttggatcctt

SEQ ID NO: 614785 - DNA, 25 bp, Rattus norvegicus
tgatgcctaaccaaagtgtgtgcct

SEQ ID NO: 614786 - DNA, 25 bp, Rattus norvegicus
tgatgcctaacctaagtgtgtgcct

SEQ ID NO: 614787 - DNA, 25 bp, Rattus norvegicus
tgatgcctacaacactcttcaggcc

SEQ ID NO: 614788 - DNA, 25 bp, Rattus norvegicus
tgatgcctacaagactcttcaggcc

SEQ ID NO: 614789 - DNA, 25 bp, Rattus norvegicus
tgatgcctaccgagaccagtttcga

SEQ ID NO: 614790 - DNA, 25 bp, Rattus norvegicus
tgatgcctaccgtgaccagtttcga

SEQ ID NO: 614791 - DNA, 25 bp, Rattus norvegicus
tgatgcctacctcataagaacactg

SEQ ID NO: 614792 - DNA, 25 bp, Rattus norvegicus
tgatgcctacctccgcttggatttt

SEQ ID NO: 614793 - DNA, 25 bp, Rattus norvegicus
tgatgcctacctgataagaacactg

SEQ ID NO: 614794 - DNA, 25 bp, Rattus norvegicus
tgatgcctacctgcgcttggatttt

SEQ ID NO: 614795 - DNA, 25 bp, Rattus norvegicus
tgatgcctacttccccagattactg

SEQ ID NO: 614796 - DNA, 25 bp, Rattus norvegicus
tgatgcctacttgcccagattactg

SEQ ID NO: 614797 - DNA, 25 bp, Rattus norvegicus
tgatgcctagcactttttccttaca

SEQ ID NO: 614798 - DNA, 25 bp, Rattus norvegicus
tgatgcctagcagtttttccttaca

SEQ ID NO: 614799 - DNA, 25 bp, Rattus norvegicus
tgatgcctcactacacatcaaacca

SEQ ID NO: 614800 - DNA, 25 bp, Rattus norvegicus
tgatgcctcacttcacatcaaacca

SEQ ID NO: 614801 - DNA, 25 bp, Rattus norvegicus
tgatgcctcgccagcaaacgacaat

SEQ ID NO: 614802 - DNA, 25 bp, Rattus norvegicus
tgatgcctcgcctgcaaacgacaat

SEQ ID NO: 614803 - DNA, 25 bp, Rattus norvegicus
tgatgcctcggtcctgggaaagccc

SEQ ID NO: 614804 - DNA, 25 bp, Rattus norvegicus
tgatgcctcggtgctgggaaagccc

SEQ ID NO: 614805 - DNA, 25 bp, Rattus norvegicus
tgatgcctctagagctaacacccaa

SEQ ID NO: 614806 - DNA, 25 bp, Rattus norvegicus
tgatgcctctagtgctaacacccaa

SEQ ID NO: 614807 - DNA, 25 bp, Rattus norvegicus
tgatgcctctcaacgaaggtgctca

SEQ ID NO: 614808 - DNA, 25 bp, Rattus norvegicus
tgatgcctctcatcgaaggtgctca

SEQ ID NO: 614809 - DNA, 25 bp, Rattus norvegicus
tgatgcctctgcacaccgtaatgtg

SEQ ID NO: 614810 - DNA, 25 bp, Rattus norvegicus
tgatgcctctgctcaccgtaatgtg

SEQ ID NO: 614811 - DNA, 25 bp, Rattus norvegicus
tgatgcctggcaaagactgtgtaag

SEQ ID NO: 614812 - DNA, 25 bp, Rattus norvegicus
tgatgcctggcatagactgtgtaag

SEQ ID NO: 614813 - DNA, 25 bp, Rattus norvegicus
tgatgcctggccagaaacttcagtc

SEQ ID NO: 614814 - DNA, 25 bp, Rattus norvegicus
tgatgcctggcctgaaacttcagtc

SEQ ID NO: 614815 - DNA, 25 bp, Rattus norvegicus
tgatgcctgtggatgatttctgtct

SEQ ID NO: 614816 - DNA, 25 bp, Rattus norvegicus
tgatgcctgtggttgatttctgtct

SEQ ID NO: 614817 - DNA, 25 bp, Rattus norvegicus
tgatgccttataaattttccttttt

SEQ ID NO: 614818 - DNA, 25 bp, Rattus norvegicus
tgatgccttatatattttccttttt

SEQ ID NO: 614819 - DNA, 25 bp, Rattus norvegicus
tgatgccttctgaggctgcagaaca

SEQ ID NO: 614820 - DNA, 25 bp, Rattus norvegicus
tgatgccttctgtggctgcagaaca

SEQ ID NO: 614821 - DNA, 25 bp, Rattus norvegicus
tgatgcgacttgaccccgggatgtg

SEQ ID NO: 614822 - DNA, 25 bp, Rattus norvegicus
tgatgcgacttgtccccgggatgtg

SEQ ID NO: 614823 - DNA, 25 bp, Rattus norvegicus
tgatgcgagcctaacagggaccctt

SEQ ID NO: 614824 - DNA, 25 bp, Rattus norvegicus
tgatgcgagccttacagggaccctt

SEQ ID NO: 614825 - DNA, 25 bp, Rattus norvegicus
tgatgcgaggagctcccacaccaga

SEQ ID NO: 614826 - DNA, 25 bp, Rattus norvegicus
tgatgcgaggaggtcccacaccaga

SEQ ID NO: 614827 - DNA, 25 bp, Rattus norvegicus
tgatgcgatgatctctgaggcctcc

SEQ ID NO: 614828 - DNA, 25 bp, Rattus norvegicus
tgatgcgatgatgtctgaggcctcc

SEQ ID NO: 614829 - DNA, 25 bp, Rattus norvegicus
tgatgcgcacacaggattggaccct

SEQ ID NO: 614830 - DNA, 25 bp, Rattus norvegicus
tgatgcgcacactggattggaccct

SEQ ID NO: 614831 - DNA, 25 bp, Rattus norvegicus
tgatgcgcacgcagtgcgggtcata

SEQ ID NO: 614832 - DNA, 25 bp, Rattus norvegicus
tgatgcgcacgctgtgcgggtcata

SEQ ID NO: 614833 - DNA, 25 bp, Rattus norvegicus
tgatgcgcgtgtacgtagctcagct

SEQ ID NO: 614834 - DNA, 25 bp, Rattus norvegicus
tgatgcgcgtgttcgtagctcagct

SEQ ID NO: 614835 - DNA, 25 bp, Rattus norvegicus
tgatgcggactgctagctatcactg

SEQ ID NO: 614836 - DNA, 25 bp, Rattus norvegicus
tgatgcggactggtagctatcactg

SEQ ID NO: 614837 - DNA, 25 bp, Rattus norvegicus
tgatgcggcctcacaggaagaccat

SEQ ID NO: 614838 - DNA, 25 bp, Rattus norvegicus
tgatgcggcctctcaggaagaccat

SEQ ID NO: 614839 - DNA, 25 bp, Rattus norvegicus
tgatgcggctgacctacctgggcat

SEQ ID NO: 614840 - DNA, 25 bp, Rattus norvegicus
tgatgcggctgagctacctgggcat

SEQ ID NO: 614841 - DNA, 25 bp, Rattus norvegicus
tgatgcgggccaatatccaggctgt

SEQ ID NO: 614842 - DNA, 25 bp, Rattus norvegicus
tgatgcgggccattatccaggctgt

SEQ ID NO: 614843 - DNA, 25 bp, Rattus norvegicus
tgatgcgtacacaaggtcactgttg

SEQ ID NO: 614844 - DNA, 25 bp, Rattus norvegicus
tgatgcgtacactaggtcactgttg

SEQ ID NO: 614845 - DNA, 25 bp, Rattus norvegicus
tgatgcgttacaccactgctgggca

SEQ ID NO: 614846 - DNA, 25 bp, Rattus norvegicus
tgatgcgttacagcactgctgggca

SEQ ID NO: 614847 - DNA, 25 bp, Rattus norvegicus
tgatgcgttacgatagccaaaagga

SEQ ID NO: 614848 - DNA, 25 bp, Rattus norvegicus
tgatgcgttacgttagccaaaagga

SEQ ID NO: 614849 - DNA, 25 bp, Rattus norvegicus
tgatgcgttcgtacattgcccagtt

SEQ ID NO: 614850 - DNA, 25 bp, Rattus norvegicus
tgatgcgttcgttcattgcccagtt

SEQ ID NO: 614851 - DNA, 25 bp, Rattus norvegicus
tgatgctaaggacccaacacctctg

SEQ ID NO: 614852 - DNA, 25 bp, Rattus norvegicus
tgatgctaaggagccaacacctctg

SEQ ID NO: 614853 - DNA, 25 bp, Rattus norvegicus
tgatgctacaatcacacgaacagtg

SEQ ID NO: 614854 - DNA, 25 bp, Rattus norvegicus
tgatgctacaatgacacgaacagtg

SEQ ID NO: 614855 - DNA, 25 bp, Rattus norvegicus
tgatgctagcacctaacactggtca

SEQ ID NO: 614856 - DNA, 25 bp, Rattus norvegicus
tgatgctagcacgtaacactggtca

SEQ ID NO: 614857 - DNA, 25 bp, Rattus norvegicus
tgatgctataaactgcctgcccctt

SEQ ID NO: 614858 - DNA, 25 bp, Rattus norvegicus
tgatgctataaagtgcctgcccctt

SEQ ID NO: 614859 - DNA, 25 bp, Rattus norvegicus
tgatgctatcctcaccctgcagttc

SEQ ID NO: 614860 - DNA, 25 bp, Rattus norvegicus
tgatgctatcctgaccctgcagttc

SEQ ID NO: 614861 - DNA, 25 bp, Rattus norvegicus
tgatgctcaacactacgctctctgc

SEQ ID NO: 614862 - DNA, 25 bp, Rattus norvegicus
tgatgctcaacagtacgctctctgc

SEQ ID NO: 614863 - DNA, 25 bp, Rattus norvegicus
tgatgctcaatcacgccaataggct

SEQ ID NO: 614864 - DNA, 25 bp, Rattus norvegicus
tgatgctcaatctcgccaataggct

SEQ ID NO: 614865 - DNA, 25 bp, Rattus norvegicus
tgatgctcagcccactgtgaagagt

SEQ ID NO: 614866 - DNA, 25 bp, Rattus norvegicus
tgatgctcagccgactgtgaagagt

SEQ ID NO: 614867 - DNA, 25 bp, Rattus norvegicus
tgatgctcagtgatcctaaactcac

SEQ ID NO: 614868 - DNA, 25 bp, Rattus norvegicus
tgatgctcagtgttcctaaactcac

SEQ ID NO: 614869 - DNA, 25 bp, Rattus norvegicus
tgatgctcatggaaggcacacgact

SEQ ID NO: 614870 - DNA, 25 bp, Rattus norvegicus
tgatgctcatggtaggcacacgact

SEQ ID NO: 614871 - DNA, 25 bp, Rattus norvegicus
tgatgctccaggacatgcagtgcaa

SEQ ID NO: 614872 - DNA, 25 bp, Rattus norvegicus
tgatgctccaggtcatgcagtgcaa

SEQ ID NO: 614873 - DNA, 25 bp, Rattus norvegicus
tgatgctccatgatgccttccagtt

SEQ ID NO: 614874 - DNA, 25 bp, Rattus norvegicus
tgatgctccatgttgccttccagtt

SEQ ID NO: 614875 - DNA, 25 bp, Rattus norvegicus
tgatgctcgtgacccctgacaaaga

SEQ ID NO: 614876 - DNA, 25 bp, Rattus norvegicus
tgatgctcgtgagccctgacaaaga

SEQ ID NO: 614877 - DNA, 25 bp, Rattus norvegicus
tgatgctctggtcccatatctaata

SEQ ID NO: 614878 - DNA, 25 bp, Rattus norvegicus
tgatgctctggtgccatatctaata

SEQ ID NO: 614879 - DNA, 25 bp, Rattus norvegicus
tgatgctgacatcgtgcttcggctc

SEQ ID NO: 614880 - DNA, 25 bp, Rattus norvegicus
tgatgctgacatggtgcttcggctc

SEQ ID NO: 614881 - DNA, 25 bp, Rattus norvegicus
tgatgctgactaagccatccacggt

SEQ ID NO: 614882 - DNA, 25 bp, Rattus norvegicus
tgatgctgactatgccatccacggt

SEQ ID NO: 614883 - DNA, 25 bp, Rattus norvegicus
tgatgctgagtcacggtcccgaggt

SEQ ID NO: 614884 - DNA, 25 bp, Rattus norvegicus
tgatgctgagtctcggtcccgaggt

SEQ ID NO: 614885 - DNA, 25 bp, Rattus norvegicus
tgatgctgctgcactcgccgtcgct

SEQ ID NO: 614886 - DNA, 25 bp, Rattus norvegicus
tgatgctgctgctctcgccgtcgct

SEQ ID NO: 614887 - DNA, 25 bp, Rattus norvegicus
tgatgctgctgtagaccccattgat

SEQ ID NO: 614888 - DNA, 25 bp, Rattus norvegicus
tgatgctgctgttgaccccattgat

SEQ ID NO: 614889 - DNA, 25 bp, Rattus norvegicus
tgatgctggattagtgacttacccc

SEQ ID NO: 614890 - DNA, 25 bp, Rattus norvegicus
tgatgctggatttgtgacttacccc

SEQ ID NO: 614891 - DNA, 25 bp, Rattus norvegicus
tgatgctggcaaccactgctttaag

SEQ ID NO: 614892 - DNA, 25 bp, Rattus norvegicus
tgatgctggcaagcactgctttaag

SEQ ID NO: 614893 - DNA, 25 bp, Rattus norvegicus
tgatgctggcagattatcctcaact

SEQ ID NO: 614894 - DNA, 25 bp, Rattus norvegicus
tgatgctggcagtttatcctcaact

SEQ ID NO: 614895 - DNA, 25 bp, Rattus norvegicus
tgatgctggctcagatgctacagat

SEQ ID NO: 614896 - DNA, 25 bp, Rattus norvegicus
tgatgctggctctgatgctacagat

SEQ ID NO: 614897 - DNA, 25 bp, Rattus norvegicus
tgatgctggtgcagagtatgtcgtg

SEQ ID NO: 614898 - DNA, 25 bp, Rattus norvegicus
tgatgctggtgctgagtatgtcgtg

SEQ ID NO: 614899 - DNA, 25 bp, Rattus norvegicus
tgatgctgtaacctgatggaggaca

SEQ ID NO: 614900 - DNA, 25 bp, Rattus norvegicus
tgatgctgtaacgtgatggaggaca

SEQ ID NO: 614901 - DNA, 25 bp, Rattus norvegicus
tgatgctgtacccatcccggattta

SEQ ID NO: 614902 - DNA, 25 bp, Rattus norvegicus
tgatgctgtaccgatcccggattta

SEQ ID NO: 614903 - DNA, 25 bp, Rattus norvegicus
tgatgctgtagcagaaggcctgact

SEQ ID NO: 614904 - DNA, 25 bp, Rattus norvegicus
tgatgctgtagctgaaggcctgact

SEQ ID NO: 614905 - DNA, 25 bp, Rattus norvegicus
tgatgctgtcctacagataccttct

SEQ ID NO: 614906 - DNA, 25 bp, Rattus norvegicus
tgatgctgtccttcagataccttct

SEQ ID NO: 614907 - DNA, 25 bp, Rattus norvegicus
tgatgctgtgtaatcccatctgtgg

SEQ ID NO: 614908 - DNA, 25 bp, Rattus norvegicus
tgatgctgtgtattcccatctgtgg

SEQ ID NO: 614909 - DNA, 25 bp, Rattus norvegicus
tgatgctgttacctgctgctgccaa

SEQ ID NO: 614910 - DNA, 25 bp, Rattus norvegicus
tgatgctgttacgtgctgctgccaa

SEQ ID NO: 614911 - DNA, 25 bp, Rattus norvegicus
tgatgctgttttcccaggcctgaat

SEQ ID NO: 614912 - DNA, 25 bp, Rattus norvegicus
tgatgctgttttgccaggcctgaat

SEQ ID NO: 614913 - DNA, 25 bp, Rattus norvegicus
tgatgcttctggaccgctatggtga

SEQ ID NO: 614914 - DNA, 25 bp, Rattus norvegicus
tgatgcttctggtccgctatggtga

SEQ ID NO: 614915 - DNA, 25 bp, Rattus norvegicus
tgatgcttgaacactcacctttgac

SEQ ID NO: 614916 - DNA, 25 bp, Rattus norvegicus
tgatgcttgaactctcacctttgac

SEQ ID NO: 614917 - DNA, 25 bp, Rattus norvegicus
tgatgcttgatgcttaccacttatc

SEQ ID NO: 614918 - DNA, 25 bp, Rattus norvegicus
tgatgcttgatggttaccacttatc

SEQ ID NO: 614919 - DNA, 25 bp, Rattus norvegicus
tgatgcttgttccttcaatgtcctt

SEQ ID NO: 614920 - DNA, 25 bp, Rattus norvegicus
tgatgcttgttcgttcaatgtcctt

SEQ ID NO: 614921 - DNA, 25 bp, Rattus norvegicus
tgatgctttctgacttttcatgata

SEQ ID NO: 614922 - DNA, 25 bp, Rattus norvegicus
tgatgctttctgtcttttcatgata

SEQ ID NO: 614923 - DNA, 25 bp, Rattus norvegicus
tgatgctttcttaggaaaacagaat

SEQ ID NO: 614924 - DNA, 25 bp, Rattus norvegicus
tgatgctttctttggaaaacagaat

SEQ ID NO: 614925 - DNA, 25 bp, Rattus norvegicus
tgatggaaaatccttccctggcctt

SEQ ID NO: 614926 - DNA, 25 bp, Rattus norvegicus
tgatggaaaatcgttccctggcctt

SEQ ID NO: 614927 - DNA, 25 bp, Rattus norvegicus
tgatggaacttccacaagctttctt

SEQ ID NO: 614928 - DNA, 25 bp, Rattus norvegicus
tgatggaacttcgacaagctttctt

SEQ ID NO: 614929 - DNA, 25 bp, Rattus norvegicus
tgatggaagagcagacaccaccctc

SEQ ID NO: 614930 - DNA, 25 bp, Rattus norvegicus
tgatggaagagctgacaccaccctc

SEQ ID NO: 614931 - DNA, 25 bp, Rattus norvegicus
tgatggaagctacacacctggcatg

SEQ ID NO: 614932 - DNA, 25 bp, Rattus norvegicus
tgatggaagctagacacctggcatg

SEQ ID NO: 614933 - DNA, 25 bp, Rattus norvegicus
tgatggaagtcaccggaagcccctc

SEQ ID NO: 614934 - DNA, 25 bp, Rattus norvegicus
tgatggaagtcagcggaagcccctc

SEQ ID NO: 614935 - DNA, 25 bp, Rattus norvegicus
tgatggacaactacgcagccagctt

SEQ ID NO: 614936 - DNA, 25 bp, Rattus norvegicus
tgatggacaacttcgcagccagctt

SEQ ID NO: 614937 - DNA, 25 bp, Rattus norvegicus
tgatggacaagcagccccttcgagt

SEQ ID NO: 614938 - DNA, 25 bp, Rattus norvegicus
tgatggacaagctgccccttcgagt

SEQ ID NO: 614939 - DNA, 25 bp, Rattus norvegicus
tgatggacacacacactgggtttgt

SEQ ID NO: 614940 - DNA, 25 bp, Rattus norvegicus
tgatggacacactcactgggtttgt

SEQ ID NO: 614941 - DNA, 25 bp, Rattus norvegicus
tgatggacatgacaccctatccctt

SEQ ID NO: 614942 - DNA, 25 bp, Rattus norvegicus
tgatggacatgagaccctatccctt

SEQ ID NO: 614943 - DNA, 25 bp, Rattus norvegicus
tgatggaccagaacctgaagtgtct

SEQ ID NO: 614944 - DNA, 25 bp, Rattus norvegicus
tgatggaccagatcctgaagtgtct

SEQ ID NO: 614945 - DNA, 25 bp, Rattus norvegicus
tgatggaccatcaacgacccattca

SEQ ID NO: 614946 - DNA, 25 bp, Rattus norvegicus
tgatggaccatctacgacccattca

SEQ ID NO: 614947 - DNA, 25 bp, Rattus norvegicus
tgatggaccattctgtcctgttcca

SEQ ID NO: 614948 - DNA, 25 bp, Rattus norvegicus
tgatggaccattgtgtcctgttcca

SEQ ID NO: 614949 - DNA, 25 bp, Rattus norvegicus
tgatggaccctgaaaagcctgttta

SEQ ID NO: 614950 - DNA, 25 bp, Rattus norvegicus
tgatggaccctgtaaagcctgttta

SEQ ID NO: 614951 - DNA, 25 bp, Rattus norvegicus
tgatggacgtgtccgatttgctctt

SEQ ID NO: 614952 - DNA, 25 bp, Rattus norvegicus
tgatggacgtgtgcgatttgctctt

SEQ ID NO: 614953 - DNA, 25 bp, Rattus norvegicus
tgatggactcacactcagagaccgc

SEQ ID NO: 614954 - DNA, 25 bp, Rattus norvegicus
tgatggactcactctcagagaccgc

SEQ ID NO: 614955 - DNA, 25 bp, Rattus norvegicus
tgatggacttttcgtttgtttccat

SEQ ID NO: 614956 - DNA, 25 bp, Rattus norvegicus
tgatggacttttggtttgtttccat

SEQ ID NO: 614957 - DNA, 25 bp, Rattus norvegicus
tgatggagactccttctgagatgca

SEQ ID NO: 614958 - DNA, 25 bp, Rattus norvegicus
tgatggagactcgttctgagatgca

SEQ ID NO: 614959 - DNA, 25 bp, Rattus norvegicus
tgatggagagtgcagcccgtcctat

SEQ ID NO: 614960 - DNA, 25 bp, Rattus norvegicus
tgatggagagtggagcccgtcctat

SEQ ID NO: 614961 - DNA, 25 bp, Rattus norvegicus
tgatggagcaccacctggcggctat

SEQ ID NO: 614962 - DNA, 25 bp, Rattus norvegicus
tgatggagcacctcctggcggctat

SEQ ID NO: 614963 - DNA, 25 bp, Rattus norvegicus
tgatggaggagcatcacgcgtacat

SEQ ID NO: 614964 - DNA, 25 bp, Rattus norvegicus
tgatggaggagcttcacgcgtacat

SEQ ID NO: 614965 - DNA, 25 bp, Rattus norvegicus
tgatggagtcccagtgatctgccag

SEQ ID NO: 614966 - DNA, 25 bp, Rattus norvegicus
tgatggagtccctgtgatctgccag

SEQ ID NO: 614967 - DNA, 25 bp, Rattus norvegicus
tgatggagtcttcttattctggctg

SEQ ID NO: 614968 - DNA, 25 bp, Rattus norvegicus
tgatggagtcttgttattctggctg

SEQ ID NO: 614969 - DNA, 25 bp, Rattus norvegicus
tgatggatacctctttaccacctcc

SEQ ID NO: 614970 - DNA, 25 bp, Rattus norvegicus
tgatggatacctgtttaccacctcc

SEQ ID NO: 614971 - DNA, 25 bp, Rattus norvegicus
tgatggatagtcctcactagcgctg

SEQ ID NO: 614972 - DNA, 25 bp, Rattus norvegicus
tgatggatagtcgtcactagcgctg

SEQ ID NO: 614973 - DNA, 25 bp, Rattus norvegicus
tgatggatcgtacacattcctcccc

SEQ ID NO: 614974 - DNA, 25 bp, Rattus norvegicus
tgatggatcgtagacattcctcccc

SEQ ID NO: 614975 - DNA, 25 bp, Rattus norvegicus
tgatggatgagaactgtcaacctgg

SEQ ID NO: 614976 - DNA, 25 bp, Rattus norvegicus
tgatggatgagatctgtcaacctgg

SEQ ID NO: 614977 - DNA, 25 bp, Rattus norvegicus
tgatggatggctacactggtcaaaa

SEQ ID NO: 614978 - DNA, 25 bp, Rattus norvegicus
tgatggatggcttcactggtcaaaa

SEQ ID NO: 614979 - DNA, 25 bp, Rattus norvegicus
tgatggcaacataaccgacctccgt

SEQ ID NO: 614980 - DNA, 25 bp, Rattus norvegicus
tgatggcaacattaccgacctccgt

SEQ ID NO: 614981 - DNA, 25 bp, Rattus norvegicus
tgatggcaacgcactaagcctccaa

SEQ ID NO: 614982 - DNA, 25 bp, Rattus norvegicus
tgatggcaacgctctaagcctccaa

SEQ ID NO: 614983 - DNA, 25 bp, Rattus norvegicus
tgatggcacatgcttgtcatctcgg

SEQ ID NO: 614984 - DNA, 25 bp, Rattus norvegicus
tgatggcacatggttgtcatctcgg

SEQ ID NO: 614985 - DNA, 25 bp, Rattus norvegicus
tgatggcaccttcagctctgaggag

SEQ ID NO: 614986 - DNA, 25 bp, Rattus norvegicus
tgatggcaccttgagctctgaggag

SEQ ID NO: 614987 - DNA, 25 bp, Rattus norvegicus
tgatggcagccacacctaaacgagg

SEQ ID NO: 614988 - DNA, 25 bp, Rattus norvegicus
tgatggcagccagacctaaacgagg

SEQ ID NO: 614989 - DNA, 25 bp, Rattus norvegicus
tgatggcagcccagaagacctttct

SEQ ID NO: 614990 - DNA, 25 bp, Rattus norvegicus
tgatggcagccctgaagacctttct

SEQ ID NO: 614991 - DNA, 25 bp, Rattus norvegicus
tgatggccaagtacagctccggtga

SEQ ID NO: 614992 - DNA, 25 bp, Rattus norvegicus
tgatggccaagttcagctccggtga

SEQ ID NO: 614993 - DNA, 25 bp, Rattus norvegicus
tgatggccaattccagttcactggt

SEQ ID NO: 614994 - DNA, 25 bp, Rattus norvegicus
tgatggccaattgcagttcactggt

SEQ ID NO: 614995 - DNA, 25 bp, Rattus norvegicus
tgatggccacacaaaatatactttt

SEQ ID NO: 614996 - DNA, 25 bp, Rattus norvegicus
tgatggccacactaaatatactttt

SEQ ID NO: 614997 - DNA, 25 bp, Rattus norvegicus
tgatggccacctatgtcaacgtgta

SEQ ID NO: 614998 - DNA, 25 bp, Rattus norvegicus
tgatggccacctttgtcaacgtgta

SEQ ID NO: 614999 - DNA, 25 bp, Rattus norvegicus
tgatggccatgactacctttacttc

SEQ ID NO: 615000 - DNA, 25 bp, Rattus norvegicus
tgatggccatgagtacctttacttc

SEQ ID NO: 615001 - DNA, 25 bp, Rattus norvegicus
tgatggccatgtaatcactcaggca

SEQ ID NO: 615002 - DNA, 25 bp, Rattus norvegicus
tgatggccatgttatcactcaggca

SEQ ID NO: 615003 - DNA, 25 bp, Rattus norvegicus
tgatggcccattagccagtggacac

SEQ ID NO: 615004 - DNA, 25 bp, Rattus norvegicus
tgatggcccatttgccagtggacac

SEQ ID NO: 615005 - DNA, 25 bp, Rattus norvegicus
tgatggccccttcatagattcctta

SEQ ID NO: 615006 - DNA, 25 bp, Rattus norvegicus
tgatggccccttgatagattcctta

SEQ ID NO: 615007 - DNA, 25 bp, Rattus norvegicus
tgatggcctactctgaacttcctaa

SEQ ID NO: 615008 - DNA, 25 bp, Rattus norvegicus
tgatggcctactgtgaacttcctaa

SEQ ID NO: 615009 - DNA, 25 bp, Rattus norvegicus
tgatggcctgaactatgagcaaacg

SEQ ID NO: 615010 - DNA, 25 bp, Rattus norvegicus
tgatggcctgaagtatgagcaaacg

SEQ ID NO: 615011 - DNA, 25 bp, Rattus norvegicus
tgatggcctgacatactgctcaaag

SEQ ID NO: 615012 - DNA, 25 bp, Rattus norvegicus
tgatggcctgacttactgctcaaag

SEQ ID NO: 615013 - DNA, 25 bp, Rattus norvegicus
tgatggcctgcgagaaccagcacat

SEQ ID NO: 615014 - DNA, 25 bp, Rattus norvegicus
tgatggcctgcgtgaaccagcacat

SEQ ID NO: 615015 - DNA, 25 bp, Rattus norvegicus
tgatggccttctcggtgcaggtacc

SEQ ID NO: 615016 - DNA, 25 bp, Rattus norvegicus
tgatggccttctcgtgtctggaatc

SEQ ID NO: 615017 - DNA, 25 bp, Rattus norvegicus
tgatggccttctgggtgcaggtacc

SEQ ID NO: 615018 - DNA, 25 bp, Rattus norvegicus
tgatggccttctggtgtctggaatc

SEQ ID NO: 615019 - DNA, 25 bp, Rattus norvegicus
tgatggcgatgtagcacccaggcag

SEQ ID NO: 615020 - DNA, 25 bp, Rattus norvegicus
tgatggcgatgttgcacccaggcag

SEQ ID NO: 615021 - DNA, 25 bp, Rattus norvegicus
tgatggcggccacgctcatgtgttc

SEQ ID NO: 615022 - DNA, 25 bp, Rattus norvegicus
tgatggcggccaggctcatgtgttc

SEQ ID NO: 615023 - DNA, 25 bp, Rattus norvegicus
tgatggctaccccttccagtgaaac

SEQ ID NO: 615024 - DNA, 25 bp, Rattus norvegicus
tgatggctacccgttccagtgaaac

SEQ ID NO: 615025 - DNA, 25 bp, Rattus norvegicus
tgatggctcattcccataatctaag

SEQ ID NO: 615026 - DNA, 25 bp, Rattus norvegicus
tgatggctcattgccataatctaag

SEQ ID NO: 615027 - DNA, 25 bp, Rattus norvegicus
tgatggctgcctatgaatcccggga

SEQ ID NO: 615028 - DNA, 25 bp, Rattus norvegicus
tgatggctgcctttgaatcccggga

SEQ ID NO: 615029 - DNA, 25 bp, Rattus norvegicus
tgatggctgctaacaccgggtggtc

SEQ ID NO: 615030 - DNA, 25 bp, Rattus norvegicus
tgatggctgctatcaccgggtggtc

SEQ ID NO: 615031 - DNA, 25 bp, Rattus norvegicus
tgatggctggctaaaccctctgaat

SEQ ID NO: 615032 - DNA, 25 bp, Rattus norvegicus
tgatggctggcttaaccctctgaat

SEQ ID NO: 615033 - DNA, 25 bp, Rattus norvegicus
tgatggctgggtcaagtctgatatc

SEQ ID NO: 615034 - DNA, 25 bp, Rattus norvegicus
tgatggctgggtgaagtctgatatc

SEQ ID NO: 615035 - DNA, 25 bp, Rattus norvegicus
tgatggcttagcatgcactctccca

SEQ ID NO: 615036 - DNA, 25 bp, Rattus norvegicus
tgatggcttagcttgcactctccca

SEQ ID NO: 615037 - DNA, 25 bp, Rattus norvegicus
tgatggcttatgcagagctctctgg

SEQ ID NO: 615038 - DNA, 25 bp, Rattus norvegicus
tgatggcttatggagagctctctgg

SEQ ID NO: 615039 - DNA, 25 bp, Rattus norvegicus
tgatggcttattccctcctaaaaga

SEQ ID NO: 615040 - DNA, 25 bp, Rattus norvegicus
tgatggcttattgcctcctaaaaga

SEQ ID NO: 615041 - DNA, 25 bp, Rattus norvegicus
tgatggcttccgagagagctcattg

SEQ ID NO: 615042 - DNA, 25 bp, Rattus norvegicus
tgatggcttccgtgagagctcattg

SEQ ID NO: 615043 - DNA, 25 bp, Rattus norvegicus
tgatggcttcttactgacctttaat

SEQ ID NO: 615044 - DNA, 25 bp, Rattus norvegicus
tgatggcttcttagggagttgcttc

SEQ ID NO: 615045 - DNA, 25 bp, Rattus norvegicus
tgatggcttctttctgacctttaat

SEQ ID NO: 615046 - DNA, 25 bp, Rattus norvegicus
tgatggcttctttgggagttgcttc

SEQ ID NO: 615047 - DNA, 25 bp, Rattus norvegicus
tgatggcttggtcactatctgtcac

SEQ ID NO: 615048 - DNA, 25 bp, Rattus norvegicus
tgatggcttggtgactatctgtcac

SEQ ID NO: 615049 - DNA, 25 bp, Rattus norvegicus
tgatgggaaaccattcaccagccac

SEQ ID NO: 615050 - DNA, 25 bp, Rattus norvegicus
tgatgggaaacctttcaccagccac

SEQ ID NO: 615051 - DNA, 25 bp, Rattus norvegicus
tgatgggaacccaaccttgaccttg

SEQ ID NO: 615052 - DNA, 25 bp, Rattus norvegicus
tgatgggaaccctaccttgaccttg

SEQ ID NO: 615053 - DNA, 25 bp, Rattus norvegicus
tgatgggaatacacctctgaggctt

SEQ ID NO: 615054 - DNA, 25 bp, Rattus norvegicus
tgatgggaatactcctctgaggctt

SEQ ID NO: 615055 - DNA, 25 bp, Rattus norvegicus
tgatgggacctcaccaccggatgat

SEQ ID NO: 615056 - DNA, 25 bp, Rattus norvegicus
tgatgggacctctccaccggatgat

SEQ ID NO: 615057 - DNA, 25 bp, Rattus norvegicus
tgatgggaccttctcactcattgca

SEQ ID NO: 615058 - DNA, 25 bp, Rattus norvegicus
tgatgggaccttgtcactcattgca

SEQ ID NO: 615059 - DNA, 25 bp, Rattus norvegicus
tgatgggagacaccggctacaccac

SEQ ID NO: 615060 - DNA, 25 bp, Rattus norvegicus
tgatgggagacagcggctacaccac

SEQ ID NO: 615061 - DNA, 25 bp, Rattus norvegicus
tgatgggatctcacctggtgcagtc

SEQ ID NO: 615062 - DNA, 25 bp, Rattus norvegicus
tgatgggatctctcctggtgcagtc

SEQ ID NO: 615063 - DNA, 25 bp, Rattus norvegicus
tgatgggcaagcctcatgctgagaa

SEQ ID NO: 615064 - DNA, 25 bp, Rattus norvegicus
tgatgggcaagcgtcatgctgagaa

SEQ ID NO: 615065 - DNA, 25 bp, Rattus norvegicus
tgatgggcagcaacagtcggagaca

SEQ ID NO: 615066 - DNA, 25 bp, Rattus norvegicus
tgatgggcagcatcagtcggagaca

SEQ ID NO: 615067 - DNA, 25 bp, Rattus norvegicus
tgatgggcatcacctctagagaaaa

SEQ ID NO: 615068 - DNA, 25 bp, Rattus norvegicus
tgatgggcatcagctctagagaaaa

SEQ ID NO: 615069 - DNA, 25 bp, Rattus norvegicus
tgatgggcattgctctcacatgcat

SEQ ID NO: 615070 - DNA, 25 bp, Rattus norvegicus
tgatgggcattggtctcacatgcat

SEQ ID NO: 615071 - DNA, 25 bp, Rattus norvegicus
tgatgggccaagctacaagccgctt

SEQ ID NO: 615072 - DNA, 25 bp, Rattus norvegicus
tgatgggccaaggtacaagccgctt

SEQ ID NO: 615073 - DNA, 25 bp, Rattus norvegicus
tgatgggcccacctcctggcatgag

SEQ ID NO: 615074 - DNA, 25 bp, Rattus norvegicus
tgatgggcccacgtcctggcatgag

SEQ ID NO: 615075 - DNA, 25 bp, Rattus norvegicus
tgatgggccctgcttagccttactt

SEQ ID NO: 615076 - DNA, 25 bp, Rattus norvegicus
tgatgggccctggttagccttactt

SEQ ID NO: 615077 - DNA, 25 bp, Rattus norvegicus
tgatgggccgtgattaccaccccaa

SEQ ID NO: 615078 - DNA, 25 bp, Rattus norvegicus
tgatgggccgtgtttaccaccccaa

SEQ ID NO: 615079 - DNA, 25 bp, Rattus norvegicus
tgatgggcctgaccagcgattctgc

SEQ ID NO: 615080 - DNA, 25 bp, Rattus norvegicus
tgatgggcctgagcagcgattctgc

SEQ ID NO: 615081 - DNA, 25 bp, Rattus norvegicus
tgatgggcctgcctggactgaacca

SEQ ID NO: 615082 - DNA, 25 bp, Rattus norvegicus
tgatgggcctgcgtggactgaacca

SEQ ID NO: 615083 - DNA, 25 bp, Rattus norvegicus
tgatgggcctgtctgtactttgatt

SEQ ID NO: 615084 - DNA, 25 bp, Rattus norvegicus
tgatgggcctgtgtgtactttgatt

SEQ ID NO: 615085 - DNA, 25 bp, Rattus norvegicus
tgatgggctcagcagcagcagtttc

SEQ ID NO: 615086 - DNA, 25 bp, Rattus norvegicus
tgatgggctcaggagcagcagtttc

SEQ ID NO: 615087 - DNA, 25 bp, Rattus norvegicus
tgatgggctcttcaaggtctttacc

SEQ ID NO: 615088 - DNA, 25 bp, Rattus norvegicus
tgatgggctcttgaaggtctttacc

SEQ ID NO: 615089 - DNA, 25 bp, Rattus norvegicus
tgatgggtaaccctcgacactcgct

SEQ ID NO: 615090 - DNA, 25 bp, Rattus norvegicus
tgatgggtaaccgtcgacactcgct

SEQ ID NO: 615091 - DNA, 25 bp, Rattus norvegicus
tgatgggtccatagatgcctgcaaa

SEQ ID NO: 615092 - DNA, 25 bp, Rattus norvegicus
tgatgggtccattgatgcctgcaaa

SEQ ID NO: 615093 - DNA, 25 bp, Rattus norvegicus
tgatgggtgcctaaggtcctctgca

SEQ ID NO: 615094 - DNA, 25 bp, Rattus norvegicus
tgatgggtgccttaggtcctctgca

SEQ ID NO: 615095 - DNA, 25 bp, Rattus norvegicus
tgatggtaaactcctctgcctctgt

SEQ ID NO: 615096 - DNA, 25 bp, Rattus norvegicus
tgatggtaaactgctctgcctctgt

SEQ ID NO: 615097 - DNA, 25 bp, Rattus norvegicus
tgatggtacatgctggtaatcccag

SEQ ID NO: 615098 - DNA, 25 bp, Rattus norvegicus
tgatggtacatggtggtaatcccag

SEQ ID NO: 615099 - DNA, 25 bp, Rattus norvegicus
tgatggtccacgcttgtgaccccag

SEQ ID NO: 615100 - DNA, 25 bp, Rattus norvegicus
tgatggtccacggttgtgaccccag

SEQ ID NO: 615101 - DNA, 25 bp, Rattus norvegicus
tgatggtccagaaccttgcgacatg

SEQ ID NO: 615102 - DNA, 25 bp, Rattus norvegicus
tgatggtccagatccttgcgacatg

SEQ ID NO: 615103 - DNA, 25 bp, Rattus norvegicus
tgatggtccccacacgaggtctcat

SEQ ID NO: 615104 - DNA, 25 bp, Rattus norvegicus
tgatggtccccagacgaggtctcat

SEQ ID NO: 615105 - DNA, 25 bp, Rattus norvegicus
tgatggtctaccagctcctgtgtca

SEQ ID NO: 615106 - DNA, 25 bp, Rattus norvegicus
tgatggtctacctgctcctgtgtca

SEQ ID NO: 615107 - DNA, 25 bp, Rattus norvegicus
tgatggtctccaatcctccgtattc

SEQ ID NO: 615108 - DNA, 25 bp, Rattus norvegicus
tgatggtctccattcctccgtattc

SEQ ID NO: 615109 - DNA, 25 bp, Rattus norvegicus
tgatggtctcctagtagtgccgaga

SEQ ID NO: 615110 - DNA, 25 bp, Rattus norvegicus
tgatggtctccttgtagtgccgaga

SEQ ID NO: 615111 - DNA, 25 bp, Rattus norvegicus
tgatggtctctaagtgccaacgggt

SEQ ID NO: 615112 - DNA, 25 bp, Rattus norvegicus
tgatggtctctatgtgccaacgggt

SEQ ID NO: 615113 - DNA, 25 bp, Rattus norvegicus
tgatggtctggcagtgaccccaacg

SEQ ID NO: 615114 - DNA, 25 bp, Rattus norvegicus
tgatggtctggctgtgaccccaacg

SEQ ID NO: 615115 - DNA, 25 bp, Rattus norvegicus
tgatggtctttgaagcagtttccct

SEQ ID NO: 615116 - DNA, 25 bp, Rattus norvegicus
tgatggtctttgtagcagtttccct

SEQ ID NO: 615117 - DNA, 25 bp, Rattus norvegicus
tgatggtgatgtctggcttccagtc

SEQ ID NO: 615118 - DNA, 25 bp, Rattus norvegicus
tgatggtgatgtgtggcttccagtc

SEQ ID NO: 615119 - DNA, 25 bp, Rattus norvegicus
tgatggtgcatcactccatggttca

SEQ ID NO: 615120 - DNA, 25 bp, Rattus norvegicus
tgatggtgcatctctccatggttca

SEQ ID NO: 615121 - DNA, 25 bp, Rattus norvegicus
tgatggtgccagagtcgttcagcat

SEQ ID NO: 615122 - DNA, 25 bp, Rattus norvegicus
tgatggtgccagtgtcgttcagcat

SEQ ID NO: 615123 - DNA, 25 bp, Rattus norvegicus
tgatggtggatcatcatccgacttc

SEQ ID NO: 615124 - DNA, 25 bp, Rattus norvegicus
tgatggtggatcttcatccgacttc

SEQ ID NO: 615125 - DNA, 25 bp, Rattus norvegicus
tgatggtggcagaccaggccaccca

SEQ ID NO: 615126 - DNA, 25 bp, Rattus norvegicus
tgatggtggcagtccaggccaccca

SEQ ID NO: 615127 - DNA, 25 bp, Rattus norvegicus
tgatggtgggttaccaggacagcct

SEQ ID NO: 615128 - DNA, 25 bp, Rattus norvegicus
tgatggtgggtttccaggacagcct

SEQ ID NO: 615129 - DNA, 25 bp, Rattus norvegicus
tgatggtggtacagcactgagtgct

SEQ ID NO: 615130 - DNA, 25 bp, Rattus norvegicus
tgatggtggtactgcactgagtgct

SEQ ID NO: 615131 - DNA, 25 bp, Rattus norvegicus
tgatggtgtcccacgagaaggcctg

SEQ ID NO: 615132 - DNA, 25 bp, Rattus norvegicus
tgatggtgtccctcgagaaggcctg

SEQ ID NO: 615133 - DNA, 25 bp, Rattus norvegicus
tgatggtgtcgacagctcccagagt

SEQ ID NO: 615134 - DNA, 25 bp, Rattus norvegicus
tgatggtgtcgagagctcccagagt

SEQ ID NO: 615135 - DNA, 25 bp, Rattus norvegicus
tgatggttaaggcacttattttcct

SEQ ID NO: 615136 - DNA, 25 bp, Rattus norvegicus
tgatggttaagggacttattttcct

SEQ ID NO: 615137 - DNA, 25 bp, Rattus norvegicus
tgatggttaatgactccacccagct

SEQ ID NO: 615138 - DNA, 25 bp, Rattus norvegicus
tgatggttaatgtctccacccagct

SEQ ID NO: 615139 - DNA, 25 bp, Rattus norvegicus
tgatggttatacatttggttcccaa

SEQ ID NO: 615140 - DNA, 25 bp, Rattus norvegicus
tgatggttatacttttggttcccaa

SEQ ID NO: 615141 - DNA, 25 bp, Rattus norvegicus
tgatggttcgctaaagtgtcagcaa

SEQ ID NO: 615142 - DNA, 25 bp, Rattus norvegicus
tgatggttcgcttaagtgtcagcaa

SEQ ID NO: 615143 - DNA, 25 bp, Rattus norvegicus
tgatggttgacacctccagcaagac

SEQ ID NO: 615144 - DNA, 25 bp, Rattus norvegicus
tgatggttgacagctccagcaagac

SEQ ID NO: 615145 - DNA, 25 bp, Rattus norvegicus
tgatggttgatgaagcccgacgcgc

SEQ ID NO: 615146 - DNA, 25 bp, Rattus norvegicus
tgatggttgatgtagcccgacgcgc

SEQ ID NO: 615147 - DNA, 25 bp, Rattus norvegicus
tgatggttgcatcagtcactgtcat

SEQ ID NO: 615148 - DNA, 25 bp, Rattus norvegicus
tgatggttgcatgagtcactgtcat

SEQ ID NO: 615149 - DNA, 25 bp, Rattus norvegicus
tgatggttggttagtcagaatacat

SEQ ID NO: 615150 - DNA, 25 bp, Rattus norvegicus
tgatggttggtttgtcagaatacat

SEQ ID NO: 615151 - DNA, 25 bp, Rattus norvegicus
tgatggtttccaacgtcctcttaat

SEQ ID NO: 615152 - DNA, 25 bp, Rattus norvegicus
tgatggtttccatcgtcctcttaat

SEQ ID NO: 615153 - DNA, 25 bp, Rattus norvegicus
tgatgtaaaattatcagctctctgc

SEQ ID NO: 615154 - DNA, 25 bp, Rattus norvegicus
tgatgtaaaattttcagctctctgc

SEQ ID NO: 615155 - DNA, 25 bp, Rattus norvegicus
tgatgtaaagccacagcgcctgcat

SEQ ID NO: 615156 - DNA, 25 bp, Rattus norvegicus
tgatgtaaagcctcagcgcctgcat

SEQ ID NO: 615157 - DNA, 25 bp, Rattus norvegicus
tgatgtaatcggaatgatgctcaca

SEQ ID NO: 615158 - DNA, 25 bp, Rattus norvegicus
tgatgtaatcggtatgatgctcaca

SEQ ID NO: 615159 - DNA, 25 bp, Rattus norvegicus
tgatgtaatcttagccagtgtgtgt

SEQ ID NO: 615160 - DNA, 25 bp, Rattus norvegicus
tgatgtaatctttgccagtgtgtgt

SEQ ID NO: 615161 - DNA, 25 bp, Rattus norvegicus
tgatgtacaggacttcttgccaggc

SEQ ID NO: 615162 - DNA, 25 bp, Rattus norvegicus
tgatgtacaggagttcttgccaggc

SEQ ID NO: 615163 - DNA, 25 bp, Rattus norvegicus
tgatgtaccaaccaagagacactga

SEQ ID NO: 615164 - DNA, 25 bp, Rattus norvegicus
tgatgtaccaacgaagagacactga

SEQ ID NO: 615165 - DNA, 25 bp, Rattus norvegicus
tgatgtacctccctgcttgaagaac

SEQ ID NO: 615166 - DNA, 25 bp, Rattus norvegicus
tgatgtacctccgtgcttgaagaac

SEQ ID NO: 615167 - DNA, 25 bp, Rattus norvegicus
tgatgtacttcgccagcctcgtgtc

SEQ ID NO: 615168 - DNA, 25 bp, Rattus norvegicus
tgatgtacttcggcagcctcgtgtc

SEQ ID NO: 615169 - DNA, 25 bp, Rattus norvegicus
tgatgtagaaagacccagcctgctg

SEQ ID NO: 615170 - DNA, 25 bp, Rattus norvegicus
tgatgtagaaagtcccagcctgctg

SEQ ID NO: 615171 - DNA, 25 bp, Rattus norvegicus
tgatgtagaacactcctgaagggaa

SEQ ID NO: 615172 - DNA, 25 bp, Rattus norvegicus
tgatgtagaacagtcctgaagggaa

SEQ ID NO: 615173 - DNA, 25 bp, Rattus norvegicus
tgatgtagcaccagggcccacgcgg

SEQ ID NO: 615174 - DNA, 25 bp, Rattus norvegicus
tgatgtagcacctgggcccacgcgg

SEQ ID NO: 615175 - DNA, 25 bp, Rattus norvegicus
tgatgtagttgtatggtggtcgcca

SEQ ID NO: 615176 - DNA, 25 bp, Rattus norvegicus
tgatgtagttgtttggtggtcgcca

SEQ ID NO: 615177 - DNA, 25 bp, Rattus norvegicus
tgatgtatactgagagcttctccca

SEQ ID NO: 615178 - DNA, 25 bp, Rattus norvegicus
tgatgtatactgtgagcttctccca

SEQ ID NO: 615179 - DNA, 25 bp, Rattus norvegicus
tgatgtatagaccattctccctaca

SEQ ID NO: 615180 - DNA, 25 bp, Rattus norvegicus
tgatgtatagacgattctccctaca

SEQ ID NO: 615181 - DNA, 25 bp, Rattus norvegicus
tgatgtatccagcatcgtctttttt

SEQ ID NO: 615182 - DNA, 25 bp, Rattus norvegicus
tgatgtatccaggatcgtctttttt

SEQ ID NO: 615183 - DNA, 25 bp, Rattus norvegicus
tgatgtatcccacctgccgggagag

SEQ ID NO: 615184 - DNA, 25 bp, Rattus norvegicus
tgatgtatcccagctgccgggagag

SEQ ID NO: 615185 - DNA, 25 bp, Rattus norvegicus
tgatgtatgtgtactccggtggccc

SEQ ID NO: 615186 - DNA, 25 bp, Rattus norvegicus
tgatgtatgtgttctccggtggccc

SEQ ID NO: 615187 - DNA, 25 bp, Rattus norvegicus
tgatgtattccacaaaacccacctt

SEQ ID NO: 615188 - DNA, 25 bp, Rattus norvegicus
tgatgtattccagaaaacccacctt

SEQ ID NO: 615189 - DNA, 25 bp, Rattus norvegicus
tgatgtatttagactttctcacaat

SEQ ID NO: 615190 - DNA, 25 bp, Rattus norvegicus
tgatgtatttagtctttctcacaat

SEQ ID NO: 615191 - DNA, 25 bp, Rattus norvegicus
tgatgtcaaccactccaaggatcca

SEQ ID NO: 615192 - DNA, 25 bp, Rattus norvegicus
tgatgtcaaccagtccaaggatcca

SEQ ID NO: 615193 - DNA, 25 bp, Rattus norvegicus
tgatgtcacacaaggccatcctttg

SEQ ID NO: 615194 - DNA, 25 bp, Rattus norvegicus
tgatgtcacacatggccatcctttg

SEQ ID NO: 615195 - DNA, 25 bp, Rattus norvegicus
tgatgtcacattactcagcctctga

SEQ ID NO: 615196 - DNA, 25 bp, Rattus norvegicus
tgatgtcacatttctcagcctctga

SEQ ID NO: 615197 - DNA, 25 bp, Rattus norvegicus
tgatgtcaccttaatgccatgcctt

SEQ ID NO: 615198 - DNA, 25 bp, Rattus norvegicus
tgatgtcacctttatgccatgcctt

SEQ ID NO: 615199 - DNA, 25 bp, Rattus norvegicus
tgatgtcacttgaagctaaaagcat

SEQ ID NO: 615200 - DNA, 25 bp, Rattus norvegicus
tgatgtcacttgtagctaaaagcat

SEQ ID NO: 615201 - DNA, 25 bp, Rattus norvegicus
tgatgtcagaaacttggcttcccct

SEQ ID NO: 615202 - DNA, 25 bp, Rattus norvegicus
tgatgtcagaaagttggcttcccct

SEQ ID NO: 615203 - DNA, 25 bp, Rattus norvegicus
tgatgtcagctaatatctttggccc

SEQ ID NO: 615204 - DNA, 25 bp, Rattus norvegicus
tgatgtcagctattatctttggccc

SEQ ID NO: 615205 - DNA, 25 bp, Rattus norvegicus
tgatgtcagcttctagtgcccaaca

SEQ ID NO: 615206 - DNA, 25 bp, Rattus norvegicus
tgatgtcagcttgtagtgcccaaca

SEQ ID NO: 615207 - DNA, 25 bp, Rattus norvegicus
tgatgtcaggacattgccattcttc

SEQ ID NO: 615208 - DNA, 25 bp, Rattus norvegicus
tgatgtcaggactttgccattcttc

SEQ ID NO: 615209 - DNA, 25 bp, Rattus norvegicus
tgatgtcaggcgcttcactcgaagc

SEQ ID NO: 615210 - DNA, 25 bp, Rattus norvegicus
tgatgtcaggcggttcactcgaagc

SEQ ID NO: 615211 - DNA, 25 bp, Rattus norvegicus
tgatgtcaggtgattgcctgaccac

SEQ ID NO: 615212 - DNA, 25 bp, Rattus norvegicus
tgatgtcaggtgtttgcctgaccac

SEQ ID NO: 615213 - DNA, 25 bp, Rattus norvegicus
tgatgtcatacactagcctatttgg

SEQ ID NO: 615214 - DNA, 25 bp, Rattus norvegicus
tgatgtcatacagtagcctatttgg

SEQ ID NO: 615215 - DNA, 25 bp, Rattus norvegicus
tgatgtcatatcacagaacaccctg

SEQ ID NO: 615216 - DNA, 25 bp, Rattus norvegicus
tgatgtcatatctcagaacaccctg

SEQ ID NO: 615217 - DNA, 25 bp, Rattus norvegicus
tgatgtcatcatccgctgtttcaaa

SEQ ID NO: 615218 - DNA, 25 bp, Rattus norvegicus
tgatgtcatcatgcgctgtttcaaa

SEQ ID NO: 615219 - DNA, 25 bp, Rattus norvegicus
tgatgtcatcttacctacacaggat

SEQ ID NO: 615220 - DNA, 25 bp, Rattus norvegicus
tgatgtcatctttcctacacaggat

SEQ ID NO: 615221 - DNA, 25 bp, Rattus norvegicus
tgatgtcatgttctcagtaaaccat

SEQ ID NO: 615222 - DNA, 25 bp, Rattus norvegicus
tgatgtcatgttgtcagtaaaccat

SEQ ID NO: 615223 - DNA, 25 bp, Rattus norvegicus
tgatgtccaccaaagacctgtgttg

SEQ ID NO: 615224 - DNA, 25 bp, Rattus norvegicus
tgatgtccaccatagacctgtgttg

SEQ ID NO: 615225 - DNA, 25 bp, Rattus norvegicus
tgatgtccagaccagttcgcacagt

SEQ ID NO: 615226 - DNA, 25 bp, Rattus norvegicus
tgatgtccagacgagttcgcacagt

SEQ ID NO: 615227 - DNA, 25 bp, Rattus norvegicus
tgatgtccaggcacagctccacaaa

SEQ ID NO: 615228 - DNA, 25 bp, Rattus norvegicus
tgatgtccaggctcagctccacaaa

SEQ ID NO: 615229 - DNA, 25 bp, Rattus norvegicus
tgatgtccaggtcacagaggatgct

SEQ ID NO: 615230 - DNA, 25 bp, Rattus norvegicus
tgatgtccaggtgacagaggatgct

SEQ ID NO: 615231 - DNA, 25 bp, Rattus norvegicus
tgatgtccatgtcaaattgccccgg

SEQ ID NO: 615232 - DNA, 25 bp, Rattus norvegicus
tgatgtccatgtgaaattgccccgg

SEQ ID NO: 615233 - DNA, 25 bp, Rattus norvegicus
tgatgtcccaccagggtacttctgc

SEQ ID NO: 615234 - DNA, 25 bp, Rattus norvegicus
tgatgtcccacctgggtacttctgc

SEQ ID NO: 615235 - DNA, 25 bp, Rattus norvegicus
tgatgtcccaggcagatctagcagc

SEQ ID NO: 615236 - DNA, 25 bp, Rattus norvegicus
tgatgtcccagggagatctagcagc

SEQ ID NO: 615237 - DNA, 25 bp, Rattus norvegicus
tgatgtccccatagaagagggccca

SEQ ID NO: 615238 - DNA, 25 bp, Rattus norvegicus
tgatgtccccatattagcctgtgtg

SEQ ID NO: 615239 - DNA, 25 bp, Rattus norvegicus
tgatgtccccattgaagagggccca

SEQ ID NO: 615240 - DNA, 25 bp, Rattus norvegicus
tgatgtccccattttagcctgtgtg

SEQ ID NO: 615241 - DNA, 25 bp, Rattus norvegicus
tgatgtcctactaagctgtgctcgt

SEQ ID NO: 615242 - DNA, 25 bp, Rattus norvegicus
tgatgtcctacttagctgtgctcgt

SEQ ID NO: 615243 - DNA, 25 bp, Rattus norvegicus
tgatgtcctatcagcagaatcctca

SEQ ID NO: 615244 - DNA, 25 bp, Rattus norvegicus
tgatgtcctatctgcagaatcctca

SEQ ID NO: 615245 - DNA, 25 bp, Rattus norvegicus
tgatgtcctcaaactctgtgttgcc

SEQ ID NO: 615246 - DNA, 25 bp, Rattus norvegicus
tgatgtcctcaatctctgtgttgcc

SEQ ID NO: 615247 - DNA, 25 bp, Rattus norvegicus
tgatgtcctcctctgaccatgtaga

SEQ ID NO: 615248 - DNA, 25 bp, Rattus norvegicus
tgatgtcctcctgtgaccatgtaga

SEQ ID NO: 615249 - DNA, 25 bp, Rattus norvegicus
tgatgtcctcgccagatcagagtgt

SEQ ID NO: 615250 - DNA, 25 bp, Rattus norvegicus
tgatgtcctcgcgagatcagagtgt

SEQ ID NO: 615251 - DNA, 25 bp, Rattus norvegicus
tgatgtccttgcctacagatttgcc

SEQ ID NO: 615252 - DNA, 25 bp, Rattus norvegicus
tgatgtccttgcgtacagatttgcc

SEQ ID NO: 615253 - DNA, 25 bp, Rattus norvegicus
tgatgtcgagctcctggtcctgctg

SEQ ID NO: 615254 - DNA, 25 bp, Rattus norvegicus
tgatgtcgagctgctggtcctgctg

SEQ ID NO: 615255 - DNA, 25 bp, Rattus norvegicus
tgatgtcgcatgcaggagcacccct

SEQ ID NO: 615256 - DNA, 25 bp, Rattus norvegicus
tgatgtcgcatggaggagcacccct

SEQ ID NO: 615257 - DNA, 25 bp, Rattus norvegicus
tgatgtcgctggacagacgctcggc

SEQ ID NO: 615258 - DNA, 25 bp, Rattus norvegicus
tgatgtcgctggtcagacgctcggc

SEQ ID NO: 615259 - DNA, 25 bp, Rattus norvegicus
tgatgtcgctgtacgttggaggcac

SEQ ID NO: 615260 - DNA, 25 bp, Rattus norvegicus
tgatgtcgctgttcgttggaggcac

SEQ ID NO: 615261 - DNA, 25 bp, Rattus norvegicus
tgatgtctcagaacctatcgaaggc

SEQ ID NO: 615262 - DNA, 25 bp, Rattus norvegicus
tgatgtctcagatcctatcgaaggc

SEQ ID NO: 615263 - DNA, 25 bp, Rattus norvegicus
tgatgtctcagtctcctaacgtaaa

SEQ ID NO: 615264 - DNA, 25 bp, Rattus norvegicus
tgatgtctcagtgtcctaacgtaaa

SEQ ID NO: 615265 - DNA, 25 bp, Rattus norvegicus
tgatgtctccggcattgatgggcat

SEQ ID NO: 615266 - DNA, 25 bp, Rattus norvegicus
tgatgtctccgggattgatgggcat

SEQ ID NO: 615267 - DNA, 25 bp, Rattus norvegicus
tgatgtctccttccttcagaatcta

SEQ ID NO: 615268 - DNA, 25 bp, Rattus norvegicus
tgatgtctccttgcttcagaatcta

SEQ ID NO: 615269 - DNA, 25 bp, Rattus norvegicus
tgatgtctcggtccctcaggtcttc

SEQ ID NO: 615270 - DNA, 25 bp, Rattus norvegicus
tgatgtctcggtgcctcaggtcttc

SEQ ID NO: 615271 - DNA, 25 bp, Rattus norvegicus
tgatgtctctcccattttgcagtag

SEQ ID NO: 615272 - DNA, 25 bp, Rattus norvegicus
tgatgtctctccgattttgcagtag

SEQ ID NO: 615273 - DNA, 25 bp, Rattus norvegicus
tgatgtctgaagatattgctgccca

SEQ ID NO: 615274 - DNA, 25 bp, Rattus norvegicus
tgatgtctgaagttattgctgccca

SEQ ID NO: 615275 - DNA, 25 bp, Rattus norvegicus
tgatgtctgagcctgcaagtctgca

SEQ ID NO: 615276 - DNA, 25 bp, Rattus norvegicus
tgatgtctgagcgtgcaagtctgca

SEQ ID NO: 615277 - DNA, 25 bp, Rattus norvegicus
tgatgtctgcatctgtgctgcgtgt

SEQ ID NO: 615278 - DNA, 25 bp, Rattus norvegicus
tgatgtctgcatgtgtgctgcgtgt

SEQ ID NO: 615279 - DNA, 25 bp, Rattus norvegicus
tgatgtctgcttaagttctggccac

SEQ ID NO: 615280 - DNA, 25 bp, Rattus norvegicus
tgatgtctgctttagttctggccac

SEQ ID NO: 615281 - DNA, 25 bp, Rattus norvegicus
tgatgtctgtccagactggatccgg

SEQ ID NO: 615282 - DNA, 25 bp, Rattus norvegicus
tgatgtctgtcctgactggatccgg

SEQ ID NO: 615283 - DNA, 25 bp, Rattus norvegicus
tgatgtctgtctagcctggaagagg

SEQ ID NO: 615284 - DNA, 25 bp, Rattus norvegicus
tgatgtctgtcttgcctggaagagg

SEQ ID NO: 615285 - DNA, 25 bp, Rattus norvegicus
tgatgtcttgatcaggtgatgccca

SEQ ID NO: 615286 - DNA, 25 bp, Rattus norvegicus
tgatgtcttgatgaggtgatgccca

SEQ ID NO: 615287 - DNA, 25 bp, Rattus norvegicus
tgatgtcttgttccaggtgtttccc

SEQ ID NO: 615288 - DNA, 25 bp, Rattus norvegicus
tgatgtcttgttgcaggtgtttccc

SEQ ID NO: 615289 - DNA, 25 bp, Rattus norvegicus
tgatgtgaacccaaaggcctatccc

SEQ ID NO: 615290 - DNA, 25 bp, Rattus norvegicus
tgatgtgaaccctaaggcctatccc

SEQ ID NO: 615291 - DNA, 25 bp, Rattus norvegicus
tgatgtgaactcagtctcctggtgt

SEQ ID NO: 615292 - DNA, 25 bp, Rattus norvegicus
tgatgtgaactctgtctcctggtgt

SEQ ID NO: 615293 - DNA, 25 bp, Rattus norvegicus
tgatgtgacagaccgaaggcttctt

SEQ ID NO: 615294 - DNA, 25 bp, Rattus norvegicus
tgatgtgacagagcgaaggcttctt

SEQ ID NO: 615295 - DNA, 25 bp, Rattus norvegicus
tgatgtgactgacttgtcctttgct

SEQ ID NO: 615296 - DNA, 25 bp, Rattus norvegicus
tgatgtgactgagttgtcctttgct

SEQ ID NO: 615297 - DNA, 25 bp, Rattus norvegicus
tgatgtgagatgaccaacgacctgt

SEQ ID NO: 615298 - DNA, 25 bp, Rattus norvegicus
tgatgtgagatgtccaacgacctgt

SEQ ID NO: 615299 - DNA, 25 bp, Rattus norvegicus
tgatgtgagcagaacacccgcagcc

SEQ ID NO: 615300 - DNA, 25 bp, Rattus norvegicus
tgatgtgagcagtacacccgcagcc

SEQ ID NO: 615301 - DNA, 25 bp, Rattus norvegicus
tgatgtgaggctccctttaatccta

SEQ ID NO: 615302 - DNA, 25 bp, Rattus norvegicus
tgatgtgaggctgcctttaatccta

SEQ ID NO: 615303 - DNA, 25 bp, Rattus norvegicus
tgatgtgcaaagagtcgtccatgta

SEQ ID NO: 615304 - DNA, 25 bp, Rattus norvegicus
tgatgtgcaaagtgtcgtccatgta

SEQ ID NO: 615305 - DNA, 25 bp, Rattus norvegicus
tgatgtgcacacctcacgtgagtta

SEQ ID NO: 615306 - DNA, 25 bp, Rattus norvegicus
tgatgtgcacacgtcacgtgagtta

SEQ ID NO: 615307 - DNA, 25 bp, Rattus norvegicus
tgatgtgcaccccaaccattttgta

SEQ ID NO: 615308 - DNA, 25 bp, Rattus norvegicus
tgatgtgcacccgaaccattttgta

SEQ ID NO: 615309 - DNA, 25 bp, Rattus norvegicus
tgatgtgcagacatgggaggcttct

SEQ ID NO: 615310 - DNA, 25 bp, Rattus norvegicus
tgatgtgcagacttgggaggcttct

SEQ ID NO: 615311 - DNA, 25 bp, Rattus norvegicus
tgatgtgcaggccttacacacacta

SEQ ID NO: 615312 - DNA, 25 bp, Rattus norvegicus
tgatgtgcaggcgttacacacacta

SEQ ID NO: 615313 - DNA, 25 bp, Rattus norvegicus
tgatgtgcgccaaggtgtggttcac

SEQ ID NO: 615314 - DNA, 25 bp, Rattus norvegicus
tgatgtgcgccatggtgtggttcac

SEQ ID NO: 615315 - DNA, 25 bp, Rattus norvegicus
tgatgtgctagcataactgctctag

SEQ ID NO: 615316 - DNA, 25 bp, Rattus norvegicus
tgatgtgctagcttaactgctctag

SEQ ID NO: 615317 - DNA, 25 bp, Rattus norvegicus
tgatgtgctctgaagccacaggctc

SEQ ID NO: 615318 - DNA, 25 bp, Rattus norvegicus
tgatgtgctctgtagccacaggctc

SEQ ID NO: 615319 - DNA, 25 bp, Rattus norvegicus
tgatgtgctgctccgtggagtacaa

SEQ ID NO: 615320 - DNA, 25 bp, Rattus norvegicus
tgatgtgctgctgcgtggagtacaa

SEQ ID NO: 615321 - DNA, 25 bp, Rattus norvegicus
tgatgtggaatacctcctgctctcc

SEQ ID NO: 615322 - DNA, 25 bp, Rattus norvegicus
tgatgtggaatagctcctgctctcc

SEQ ID NO: 615323 - DNA, 25 bp, Rattus norvegicus
tgatgtggacgactaccccgagaga

SEQ ID NO: 615324 - DNA, 25 bp, Rattus norvegicus
tgatgtggacgagtaccccgagaga

SEQ ID NO: 615325 - DNA, 25 bp, Rattus norvegicus
tgatgtggagccaatcaagtgggca

SEQ ID NO: 615326 - DNA, 25 bp, Rattus norvegicus
tgatgtggagcctatcaagtgggca

SEQ ID NO: 615327 - DNA, 25 bp, Rattus norvegicus
tgatgtggccaaccagctcaacaac

SEQ ID NO: 615328 - DNA, 25 bp, Rattus norvegicus
tgatgtggccaagcagctcaacaac

SEQ ID NO: 615329 - DNA, 25 bp, Rattus norvegicus
tgatgtggccatcgcatagatcctg

SEQ ID NO: 615330 - DNA, 25 bp, Rattus norvegicus
tgatgtggccatggcatagatcctg

SEQ ID NO: 615331 - DNA, 25 bp, Rattus norvegicus
tgatgtgggaatcaggctgcctctt

SEQ ID NO: 615332 - DNA, 25 bp, Rattus norvegicus
tgatgtgggaatgaggctgcctctt

SEQ ID NO: 615333 - DNA, 25 bp, Rattus norvegicus
tgatgtgggcacagacactggcttt

SEQ ID NO: 615334 - DNA, 25 bp, Rattus norvegicus
tgatgtgggcactgacactggcttt

SEQ ID NO: 615335 - DNA, 25 bp, Rattus norvegicus
tgatgtggtccacctgtgaatctcc

SEQ ID NO: 615336 - DNA, 25 bp, Rattus norvegicus
tgatgtggtccagctgtgaatctcc

SEQ ID NO: 615337 - DNA, 25 bp, Rattus norvegicus
tgatgtgtaacaaggtctcctttca

SEQ ID NO: 615338 - DNA, 25 bp, Rattus norvegicus
tgatgtgtaacatggtctcctttca

SEQ ID NO: 615339 - DNA, 25 bp, Rattus norvegicus
tgatgtgtacatatgctgggagctg

SEQ ID NO: 615340 - DNA, 25 bp, Rattus norvegicus
tgatgtgtacatttgctgggagctg

SEQ ID NO: 615341 - DNA, 25 bp, Rattus norvegicus
tgatgtgtattccattccgctcgcc

SEQ ID NO: 615342 - DNA, 25 bp, Rattus norvegicus
tgatgtgtattcgattccgctcgcc

SEQ ID NO: 615343 - DNA, 25 bp, Rattus norvegicus
tgatgtgtatttacggctctccagc

SEQ ID NO: 615344 - DNA, 25 bp, Rattus norvegicus
tgatgtgtatttcgccgacacactc

SEQ ID NO: 615345 - DNA, 25 bp, Rattus norvegicus
tgatgtgtatttggccgacacactc

SEQ ID NO: 615346 - DNA, 25 bp, Rattus norvegicus
tgatgtgtattttcggctctccagc

SEQ ID NO: 615347 - DNA, 25 bp, Rattus norvegicus
tgatgtgtcacacgtcctgtgtggc

SEQ ID NO: 615348 - DNA, 25 bp, Rattus norvegicus
tgatgtgtcacaggtcctgtgtggc

SEQ ID NO: 615349 - DNA, 25 bp, Rattus norvegicus
tgatgtgtccaaattagccccagaa

SEQ ID NO: 615350 - DNA, 25 bp, Rattus norvegicus
tgatgtgtccaatttagccccagaa

SEQ ID NO: 615351 - DNA, 25 bp, Rattus norvegicus
tgatgtgtccagctcaacctttgtg

SEQ ID NO: 615352 - DNA, 25 bp, Rattus norvegicus
tgatgtgtccaggtcaacctttgtg

SEQ ID NO: 615353 - DNA, 25 bp, Rattus norvegicus
tgatgtgtccctcctgcattgcgcc

SEQ ID NO: 615354 - DNA, 25 bp, Rattus norvegicus
tgatgtgtccctgctgcattgcgcc

SEQ ID NO: 615355 - DNA, 25 bp, Rattus norvegicus
tgatgtgtgaagagcccatcttcca

SEQ ID NO: 615356 - DNA, 25 bp, Rattus norvegicus
tgatgtgtgaagtgcccatcttcca

SEQ ID NO: 615357 - DNA, 25 bp, Rattus norvegicus
tgatgtgtgacaatcccttgagaaa

SEQ ID NO: 615358 - DNA, 25 bp, Rattus norvegicus
tgatgtgtgacattcccttgagaaa

SEQ ID NO: 615359 - DNA, 25 bp, Rattus norvegicus
tgatgtgtgcaaatattgggccagc

SEQ ID NO: 615360 - DNA, 25 bp, Rattus norvegicus
tgatgtgtgcaattattgggccagc

SEQ ID NO: 615361 - DNA, 25 bp, Rattus norvegicus
tgatgtgtgcccaggcctcgaaata

SEQ ID NO: 615362 - DNA, 25 bp, Rattus norvegicus
tgatgtgtgccctggcctcgaaata

SEQ ID NO: 615363 - DNA, 25 bp, Rattus norvegicus
tgatgtgtttcgatcacccagagaa

SEQ ID NO: 615364 - DNA, 25 bp, Rattus norvegicus
tgatgtgtttcgttcacccagagaa

SEQ ID NO: 615365 - DNA, 25 bp, Rattus norvegicus
tgatgtgtttttccatcgacagccc

SEQ ID NO: 615366 - DNA, 25 bp, Rattus norvegicus
tgatgtgtttttgcatcgacagccc

SEQ ID NO: 615367 - DNA, 25 bp, Rattus norvegicus
tgatgttaacgcagacctgactgaa

SEQ ID NO: 615368 - DNA, 25 bp, Rattus norvegicus
tgatgttaacgctgacctgactgaa

SEQ ID NO: 615369 - DNA, 25 bp, Rattus norvegicus
tgatgttaactgacctggcacttcc

SEQ ID NO: 615370 - DNA, 25 bp, Rattus norvegicus
tgatgttaactgtcctggcacttcc

SEQ ID NO: 615371 - DNA, 25 bp, Rattus norvegicus
tgatgttacagcctcattgcaagct

SEQ ID NO: 615372 - DNA, 25 bp, Rattus norvegicus
tgatgttacagcgtcattgcaagct

SEQ ID NO: 615373 - DNA, 25 bp, Rattus norvegicus
tgatgttacttcaggttccttttct

SEQ ID NO: 615374 - DNA, 25 bp, Rattus norvegicus
tgatgttacttctggttccttttct

SEQ ID NO: 615375 - DNA, 25 bp, Rattus norvegicus
tgatgttagcagacacctctctgtg

SEQ ID NO: 615376 - DNA, 25 bp, Rattus norvegicus
tgatgttagcagtcacctctctgtg

SEQ ID NO: 615377 - DNA, 25 bp, Rattus norvegicus
tgatgttagcttctccctacgctgt

SEQ ID NO: 615378 - DNA, 25 bp, Rattus norvegicus
tgatgttagcttgtccctacgctgt

SEQ ID NO: 615379 - DNA, 25 bp, Rattus norvegicus
tgatgttaggctactcaggcctgat

SEQ ID NO: 615380 - DNA, 25 bp, Rattus norvegicus
tgatgttaggcttctcaggcctgat

SEQ ID NO: 615381 - DNA, 25 bp, Rattus norvegicus
tgatgttatctaacccagcctagag

SEQ ID NO: 615382 - DNA, 25 bp, Rattus norvegicus
tgatgttatctatcccagcctagag

SEQ ID NO: 615383 - DNA, 25 bp, Rattus norvegicus
tgatgttatgccactgtcagagctg

SEQ ID NO: 615384 - DNA, 25 bp, Rattus norvegicus
tgatgttatgcctctgtcagagctg

SEQ ID NO: 615385 - DNA, 25 bp, Rattus norvegicus
tgatgttcacttagtgtccagccct

SEQ ID NO: 615386 - DNA, 25 bp, Rattus norvegicus
tgatgttcactttgtgtccagccct

SEQ ID NO: 615387 - DNA, 25 bp, Rattus norvegicus
tgatgttcagaaacctcactctgtt

SEQ ID NO: 615388 - DNA, 25 bp, Rattus norvegicus
tgatgttcagaatcctcactctgtt

SEQ ID NO: 615389 - DNA, 25 bp, Rattus norvegicus
tgatgttcagcaaggtgtcctcatt

SEQ ID NO: 615390 - DNA, 25 bp, Rattus norvegicus
tgatgttcagcatggtgtcctcatt

SEQ ID NO: 615391 - DNA, 25 bp, Rattus norvegicus
tgatgttcagtgagatcctttgcct

SEQ ID NO: 615392 - DNA, 25 bp, Rattus norvegicus
tgatgttcagtgtgatcctttgcct

SEQ ID NO: 615393 - DNA, 25 bp, Rattus norvegicus
tgatgttcatttcccatttctcatg

SEQ ID NO: 615394 - DNA, 25 bp, Rattus norvegicus
tgatgttcatttgccatttctcatg

SEQ ID NO: 615395 - DNA, 25 bp, Rattus norvegicus
tgatgttccattcagtctgcagcta

SEQ ID NO: 615396 - DNA, 25 bp, Rattus norvegicus
tgatgttccattgagtctgcagcta

SEQ ID NO: 615397 - DNA, 25 bp, Rattus norvegicus
tgatgttcccctagctgtcatggac

SEQ ID NO: 615398 - DNA, 25 bp, Rattus norvegicus
tgatgttccccttgctgtcatggac

SEQ ID NO: 615399 - DNA, 25 bp, Rattus norvegicus
tgatgttcctccacagcgatagaag

SEQ ID NO: 615400 - DNA, 25 bp, Rattus norvegicus
tgatgttcctcctcagcgatagaag

SEQ ID NO: 615401 - DNA, 25 bp, Rattus norvegicus
tgatgttctctgagtgggcccaaga

SEQ ID NO: 615402 - DNA, 25 bp, Rattus norvegicus
tgatgttctctgtgtgggcccaaga

SEQ ID NO: 615403 - DNA, 25 bp, Rattus norvegicus
tgatgttctgttcttcagaccccaa

SEQ ID NO: 615404 - DNA, 25 bp, Rattus norvegicus
tgatgttctgttgttcagaccccaa

SEQ ID NO: 615405 - DNA, 25 bp, Rattus norvegicus
tgatgttcttgtattatttctctaa

SEQ ID NO: 615406 - DNA, 25 bp, Rattus norvegicus
tgatgttcttgttttatttctctaa

SEQ ID NO: 615407 - DNA, 25 bp, Rattus norvegicus
tgatgttcttttcacctctcattgt

SEQ ID NO: 615408 - DNA, 25 bp, Rattus norvegicus
tgatgttcttttgacctctcattgt

SEQ ID NO: 615409 - DNA, 25 bp, Rattus norvegicus
tgatgttgacaacccctgaggagcc

SEQ ID NO: 615410 - DNA, 25 bp, Rattus norvegicus
tgatgttgacaaccgtgaacccata

SEQ ID NO: 615411 - DNA, 25 bp, Rattus norvegicus
tgatgttgacaagccctgaggagcc

SEQ ID NO: 615412 - DNA, 25 bp, Rattus norvegicus
tgatgttgacaagcgtgaacccata

SEQ ID NO: 615413 - DNA, 25 bp, Rattus norvegicus
tgatgttgaccacttccgaatacca

SEQ ID NO: 615414 - DNA, 25 bp, Rattus norvegicus
tgatgttgaccagttccgaatacca

SEQ ID NO: 615415 - DNA, 25 bp, Rattus norvegicus
tgatgttgactgcagggcttcccga

SEQ ID NO: 615416 - DNA, 25 bp, Rattus norvegicus
tgatgttgactggagggcttcccga

SEQ ID NO: 615417 - DNA, 25 bp, Rattus norvegicus
tgatgttgccccactttctacatgg

SEQ ID NO: 615418 - DNA, 25 bp, Rattus norvegicus
tgatgttgcccctctttctacatgg

SEQ ID NO: 615419 - DNA, 25 bp, Rattus norvegicus
tgatgttgctgaacgggtgtcattc

SEQ ID NO: 615420 - DNA, 25 bp, Rattus norvegicus
tgatgttgctgatcgggtgtcattc

SEQ ID NO: 615421 - DNA, 25 bp, Rattus norvegicus
tgatgttggtagagcctgtgatcgt

SEQ ID NO: 615422 - DNA, 25 bp, Rattus norvegicus
tgatgttggtagtgcctgtgatcgt

SEQ ID NO: 615423 - DNA, 25 bp, Rattus norvegicus
tgatgttggttcaggtggtgcattt

SEQ ID NO: 615424 - DNA, 25 bp, Rattus norvegicus
tgatgttggttctggtggtgcattt

SEQ ID NO: 615425 - DNA, 25 bp, Rattus norvegicus
tgatgttgtctgagaccttggtcca

SEQ ID NO: 615426 - DNA, 25 bp, Rattus norvegicus
tgatgttgtctgtgaccttggtcca

SEQ ID NO: 615427 - DNA, 25 bp, Rattus norvegicus
tgatgtttatctctcctggttccta

SEQ ID NO: 615428 - DNA, 25 bp, Rattus norvegicus
tgatgtttatctgtcctggttccta

SEQ ID NO: 615429 - DNA, 25 bp, Rattus norvegicus
tgatgtttcatcatttggtttttaa

SEQ ID NO: 615430 - DNA, 25 bp, Rattus norvegicus
tgatgtttcatcttttggtttttaa

SEQ ID NO: 615431 - DNA, 25 bp, Rattus norvegicus
tgatgtttgatcactctcgctttta

SEQ ID NO: 615432 - DNA, 25 bp, Rattus norvegicus
tgatgtttgatctctctcgctttta

SEQ ID NO: 615433 - DNA, 25 bp, Rattus norvegicus
tgatgtttgcaccacatgccaggca

SEQ ID NO: 615434 - DNA, 25 bp, Rattus norvegicus
tgatgtttgcacgacatgccaggca

SEQ ID NO: 615435 - DNA, 25 bp, Rattus norvegicus
tgatgtttggtacctcggaccgcgt

SEQ ID NO: 615436 - DNA, 25 bp, Rattus norvegicus
tgatgtttggtagctcggaccgcgt

SEQ ID NO: 615437 - DNA, 25 bp, Rattus norvegicus
tgatgtttgtaaccagacccagctg

SEQ ID NO: 615438 - DNA, 25 bp, Rattus norvegicus
tgatgtttgtaagcagacccagctg

SEQ ID NO: 615439 - DNA, 25 bp, Rattus norvegicus
tgatgtttgtctattgctttcttaa

SEQ ID NO: 615440 - DNA, 25 bp, Rattus norvegicus
tgatgtttgtcttttgctttcttaa

SEQ ID NO: 615441 - DNA, 25 bp, Rattus norvegicus
tgatgtttgtgtcgaacggcgcttt

SEQ ID NO: 615442 - DNA, 25 bp, Rattus norvegicus
tgatgtttgtgtggaacggcgcttt

SEQ ID NO: 615443 - DNA, 25 bp, Rattus norvegicus
tgatgtttttccatcgtgcagtgga

SEQ ID NO: 615444 - DNA, 25 bp, Rattus norvegicus
tgatgtttttccttcgtgcagtgga

SEQ ID NO: 615445 - DNA, 25 bp, Rattus norvegicus
tgattaaaaaccacctccccagaat

SEQ ID NO: 615446 - DNA, 25 bp, Rattus norvegicus
tgattaaaaacctcctccccagaat

SEQ ID NO: 615447 - DNA, 25 bp, Rattus norvegicus
tgattaaagccaagtgttccctgtg

SEQ ID NO: 615448 - DNA, 25 bp, Rattus norvegicus
tgattaaagccatgtgttccctgtg

SEQ ID NO: 615449 - DNA, 25 bp, Rattus norvegicus
tgattaaagtctcactctcctggcc

SEQ ID NO: 615450 - DNA, 25 bp, Rattus norvegicus
tgattaaagtctgactctcctggcc

SEQ ID NO: 615451 - DNA, 25 bp, Rattus norvegicus
tgattaaatagtacattgcattctg

SEQ ID NO: 615452 - DNA, 25 bp, Rattus norvegicus
tgattaaatagttcattgcattctg

SEQ ID NO: 615453 - DNA, 25 bp, Rattus norvegicus
tgattaaatgctcctaaccctgtaa

SEQ ID NO: 615454 - DNA, 25 bp, Rattus norvegicus
tgattaaatgctgctaaccctgtaa

SEQ ID NO: 615455 - DNA, 25 bp, Rattus norvegicus
tgattaacacacagtctgggctggc

SEQ ID NO: 615456 - DNA, 25 bp, Rattus norvegicus
tgattaacacactgtctgggctggc

SEQ ID NO: 615457 - DNA, 25 bp, Rattus norvegicus
tgattaacacccacatgacccacat

SEQ ID NO: 615458 - DNA, 25 bp, Rattus norvegicus
tgattaacaccctcatgacccacat

SEQ ID NO: 615459 - DNA, 25 bp, Rattus norvegicus
tgattaacctttacgagcccatttc

SEQ ID NO: 615460 - DNA, 25 bp, Rattus norvegicus
tgattaaccttttcgagcccatttc

SEQ ID NO: 615461 - DNA, 25 bp, Rattus norvegicus
tgattaacgttcaaggagctgcctt

SEQ ID NO: 615462 - DNA, 25 bp, Rattus norvegicus
tgattaacgttctaggagctgcctt

SEQ ID NO: 615463 - DNA, 25 bp, Rattus norvegicus
tgattaatacttctgtccccagtct

SEQ ID NO: 615464 - DNA, 25 bp, Rattus norvegicus
tgattaatacttgtgtccccagtct

SEQ ID NO: 615465 - DNA, 25 bp, Rattus norvegicus
tgattaattctaatttttccaccca

SEQ ID NO: 615466 - DNA, 25 bp, Rattus norvegicus
tgattaattctattttttccaccca

SEQ ID NO: 615467 - DNA, 25 bp, Rattus norvegicus
tgattacagcagaactcaccagtcc

SEQ ID NO: 615468 - DNA, 25 bp, Rattus norvegicus
tgattacagcagtactcaccagtcc

SEQ ID NO: 615469 - DNA, 25 bp, Rattus norvegicus
tgattacagggaacaagtgcccgca

SEQ ID NO: 615470 - DNA, 25 bp, Rattus norvegicus
tgattacagggatcaagtgcccgca

SEQ ID NO: 615471 - DNA, 25 bp, Rattus norvegicus
tgattacaggtcacagggactcaga

SEQ ID NO: 615472 - DNA, 25 bp, Rattus norvegicus
tgattacaggtctcagggactcaga

SEQ ID NO: 615473 - DNA, 25 bp, Rattus norvegicus
tgattacagtctctcttttactaga

SEQ ID NO: 615474 - DNA, 25 bp, Rattus norvegicus
tgattacagtctgtcttttactaga

SEQ ID NO: 615475 - DNA, 25 bp, Rattus norvegicus
tgattacatagactctttccccagt

SEQ ID NO: 615476 - DNA, 25 bp, Rattus norvegicus
tgattacatagagtctttccccagt

SEQ ID NO: 615477 - DNA, 25 bp, Rattus norvegicus
tgattacatcggaggctgccagctg

SEQ ID NO: 615478 - DNA, 25 bp, Rattus norvegicus
tgattacatcggtggctgccagctg

SEQ ID NO: 615479 - DNA, 25 bp, Rattus norvegicus
tgattaccctaaaccctacagattt

SEQ ID NO: 615480 - DNA, 25 bp, Rattus norvegicus
tgattaccctaatccctacagattt

SEQ ID NO: 615481 - DNA, 25 bp, Rattus norvegicus
tgattaccctgtcagcctgctgcat

SEQ ID NO: 615482 - DNA, 25 bp, Rattus norvegicus
tgattaccctgtgagcctgctgcat

SEQ ID NO: 615483 - DNA, 25 bp, Rattus norvegicus
tgattaccggcaagtaactctcggc

SEQ ID NO: 615484 - DNA, 25 bp, Rattus norvegicus
tgattaccggcatgtaactctcggc

SEQ ID NO: 615485 - DNA, 25 bp, Rattus norvegicus
tgattaccggcgcatcacgcggacc

SEQ ID NO: 615486 - DNA, 25 bp, Rattus norvegicus
tgattaccggcggatcacgcggacc

SEQ ID NO: 615487 - DNA, 25 bp, Rattus norvegicus
tgattacctcttctactgcattgaa

SEQ ID NO: 615488 - DNA, 25 bp, Rattus norvegicus
tgattacctcttgtactgcattgaa

SEQ ID NO: 615489 - DNA, 25 bp, Rattus norvegicus
tgattacctttaaactctgctccat

SEQ ID NO: 615490 - DNA, 25 bp, Rattus norvegicus
tgattacctttatactctgctccat

SEQ ID NO: 615491 - DNA, 25 bp, Rattus norvegicus
tgattactaccacccacgttggtgt

SEQ ID NO: 615492 - DNA, 25 bp, Rattus norvegicus
tgattactaccagccacgttggtgt

SEQ ID NO: 615493 - DNA, 25 bp, Rattus norvegicus
tgattactcattcaccagcgctgac

SEQ ID NO: 615494 - DNA, 25 bp, Rattus norvegicus
tgattactcattgaccagcgctgac

SEQ ID NO: 615495 - DNA, 25 bp, Rattus norvegicus
tgattactgtttacagccagcagga

SEQ ID NO: 615496 - DNA, 25 bp, Rattus norvegicus
tgattactgttttcagccagcagga

SEQ ID NO: 615497 - DNA, 25 bp, Rattus norvegicus
tgattacttagtatccttggctggc

SEQ ID NO: 615498 - DNA, 25 bp, Rattus norvegicus
tgattacttagtttccttggctggc

SEQ ID NO: 615499 - DNA, 25 bp, Rattus norvegicus
tgattacttctcacagttgctggaa

SEQ ID NO: 615500 - DNA, 25 bp, Rattus norvegicus
tgattacttctctcagttgctggaa

SEQ ID NO: 615501 - DNA, 25 bp, Rattus norvegicus
tgattacttctgagttcctacccag

SEQ ID NO: 615502 - DNA, 25 bp, Rattus norvegicus
tgattacttctgtgttcctacccag

SEQ ID NO: 615503 - DNA, 25 bp, Rattus norvegicus
tgattacttgtaatattgccactgt

SEQ ID NO: 615504 - DNA, 25 bp, Rattus norvegicus
tgattacttgtattattgccactgt

SEQ ID NO: 615505 - DNA, 25 bp, Rattus norvegicus
tgattagagatacctcccactcaga

SEQ ID NO: 615506 - DNA, 25 bp, Rattus norvegicus
tgattagagatagctcccactcaga

SEQ ID NO: 615507 - DNA, 25 bp, Rattus norvegicus
tgattagagccgcataatatccctc

SEQ ID NO: 615508 - DNA, 25 bp, Rattus norvegicus
tgattagagccggataatatccctc

SEQ ID NO: 615509 - DNA, 25 bp, Rattus norvegicus
tgattagcaaggagcctcactttct

SEQ ID NO: 615510 - DNA, 25 bp, Rattus norvegicus
tgattagcaaggtgcctcactttct

SEQ ID NO: 615511 - DNA, 25 bp, Rattus norvegicus
tgattagcagagctccggcctggca

SEQ ID NO: 615512 - DNA, 25 bp, Rattus norvegicus
tgattagcagaggtccggcctggca

SEQ ID NO: 615513 - DNA, 25 bp, Rattus norvegicus
tgattagcaggtcggataaaacatc

SEQ ID NO: 615514 - DNA, 25 bp, Rattus norvegicus
tgattagcaggtgggataaaacatc

SEQ ID NO: 615515 - DNA, 25 bp, Rattus norvegicus
tgattagccaaactcttccctttgg

SEQ ID NO: 615516 - DNA, 25 bp, Rattus norvegicus
tgattagccaaagtcttccctttgg

SEQ ID NO: 615517 - DNA, 25 bp, Rattus norvegicus
tgattagcccttcaggtatctcctg

SEQ ID NO: 615518 - DNA, 25 bp, Rattus norvegicus
tgattagcccttgaggtatctcctg

SEQ ID NO: 615519 - DNA, 25 bp, Rattus norvegicus
tgattagcggctctgtatccaattg

SEQ ID NO: 615520 - DNA, 25 bp, Rattus norvegicus
tgattagcggctgtgtatccaattg

SEQ ID NO: 615521 - DNA, 25 bp, Rattus norvegicus
tgattagctgctcgcacaggctttt

SEQ ID NO: 615522 - DNA, 25 bp, Rattus norvegicus
tgattagctgctggcacaggctttt

SEQ ID NO: 615523 - DNA, 25 bp, Rattus norvegicus
tgattagctgtgaatccccgagccc

SEQ ID NO: 615524 - DNA, 25 bp, Rattus norvegicus
tgattagctgtgtatccccgagccc

SEQ ID NO: 615525 - DNA, 25 bp, Rattus norvegicus
tgattaggacctaggattcaccgcc

SEQ ID NO: 615526 - DNA, 25 bp, Rattus norvegicus
tgattaggaccttggattcaccgcc

SEQ ID NO: 615527 - DNA, 25 bp, Rattus norvegicus
tgattagtctggctggaccttcagc

SEQ ID NO: 615528 - DNA, 25 bp, Rattus norvegicus
tgattagtctgggtggaccttcagc

SEQ ID NO: 615529 - DNA, 25 bp, Rattus norvegicus
tgattagtgccaatactgtgggaac

SEQ ID NO: 615530 - DNA, 25 bp, Rattus norvegicus
tgattagtgccattactgtgggaac

SEQ ID NO: 615531 - DNA, 25 bp, Rattus norvegicus
tgattagttactcccttctgtgtga

SEQ ID NO: 615532 - DNA, 25 bp, Rattus norvegicus
tgattagttactgccttctgtgtga

SEQ ID NO: 615533 - DNA, 25 bp, Rattus norvegicus
tgattatactatcatcctaccttct

SEQ ID NO: 615534 - DNA, 25 bp, Rattus norvegicus
tgattatactatgatcctaccttct

SEQ ID NO: 615535 - DNA, 25 bp, Rattus norvegicus
tgattatctcagaggtgtcaccagg

SEQ ID NO: 615536 - DNA, 25 bp, Rattus norvegicus
tgattatctcagtggtgtcaccagg

SEQ ID NO: 615537 - DNA, 25 bp, Rattus norvegicus
tgattatcttttcccattgaccgtt

SEQ ID NO: 615538 - DNA, 25 bp, Rattus norvegicus
tgattatcttttgccattgaccgtt

SEQ ID NO: 615539 - DNA, 25 bp, Rattus norvegicus
tgattatgagcacctcctccatcaa

SEQ ID NO: 615540 - DNA, 25 bp, Rattus norvegicus
tgattatgagcagctcctccatcaa

SEQ ID NO: 615541 - DNA, 25 bp, Rattus norvegicus
tgattatgctcacctcctagtcttc

SEQ ID NO: 615542 - DNA, 25 bp, Rattus norvegicus
tgattatgctcagctcctagtcttc

SEQ ID NO: 615543 - DNA, 25 bp, Rattus norvegicus
tgattattaactaaccttttctggt

SEQ ID NO: 615544 - DNA, 25 bp, Rattus norvegicus
tgattattaacttaccttttctggt

SEQ ID NO: 615545 - DNA, 25 bp, Rattus norvegicus
tgattatttcctaccaaacgtcttg

SEQ ID NO: 615546 - DNA, 25 bp, Rattus norvegicus
tgattatttccttccaaacgtcttg

SEQ ID NO: 615547 - DNA, 25 bp, Rattus norvegicus
tgattcacacggcacagcgacggac

SEQ ID NO: 615548 - DNA, 25 bp, Rattus norvegicus
tgattcacacgggacagcgacggac

SEQ ID NO: 615549 - DNA, 25 bp, Rattus norvegicus
tgattcacactcacaatgcctgtca

SEQ ID NO: 615550 - DNA, 25 bp, Rattus norvegicus
tgattcacactctcaatgcctgtca

SEQ ID NO: 615551 - DNA, 25 bp, Rattus norvegicus
tgattcacatggcaatcccagactc

SEQ ID NO: 615552 - DNA, 25 bp, Rattus norvegicus
tgattcacatgggaatcccagactc

SEQ ID NO: 615553 - DNA, 25 bp, Rattus norvegicus
tgattcagacagacgctcctctggt

SEQ ID NO: 615554 - DNA, 25 bp, Rattus norvegicus
tgattcagacagtcgctcctctggt

SEQ ID NO: 615555 - DNA, 25 bp, Rattus norvegicus
tgattcagacgaagctgggagctct

SEQ ID NO: 615556 - DNA, 25 bp, Rattus norvegicus
tgattcagacgatgctgggagctct

SEQ ID NO: 615557 - DNA, 25 bp, Rattus norvegicus
tgattcagcggccacagtccaaagg

SEQ ID NO: 615558 - DNA, 25 bp, Rattus norvegicus
tgattcagcggcgacagtccaaagg

SEQ ID NO: 615559 - DNA, 25 bp, Rattus norvegicus
tgattcagctcgagtggctagccac

SEQ ID NO: 615560 - DNA, 25 bp, Rattus norvegicus
tgattcagctcgtgtggctagccac

SEQ ID NO: 615561 - DNA, 25 bp, Rattus norvegicus
tgattcagctgcaataagccgcctc

SEQ ID NO: 615562 - DNA, 25 bp, Rattus norvegicus
tgattcagctgctataagccgcctc

SEQ ID NO: 615563 - DNA, 25 bp, Rattus norvegicus
tgattcagtagccaccaggaccatc

SEQ ID NO: 615564 - DNA, 25 bp, Rattus norvegicus
tgattcagtagcgaccaggaccatc

SEQ ID NO: 615565 - DNA, 25 bp, Rattus norvegicus
tgattcagtattctgtggtccctgg

SEQ ID NO: 615566 - DNA, 25 bp, Rattus norvegicus
tgattcagtattgtgtggtccctgg

SEQ ID NO: 615567 - DNA, 25 bp, Rattus norvegicus
tgattcagtcagagttccccagcct

SEQ ID NO: 615568 - DNA, 25 bp, Rattus norvegicus
tgattcagtcagtgttccccagcct

SEQ ID NO: 615569 - DNA, 25 bp, Rattus norvegicus
tgattcagttccatgacttctcaac

SEQ ID NO: 615570 - DNA, 25 bp, Rattus norvegicus
tgattcagttccttgacttctcaac

SEQ ID NO: 615571 - DNA, 25 bp, Rattus norvegicus
tgattcatctaaacagcctgaccct

SEQ ID NO: 615572 - DNA, 25 bp, Rattus norvegicus
tgattcatctaatcagcctgaccct

SEQ ID NO: 615573 - DNA, 25 bp, Rattus norvegicus
tgattcatgtctcccatcttgtctg

SEQ ID NO: 615574 - DNA, 25 bp, Rattus norvegicus
tgattcatgtctgccatcttgtctg

SEQ ID NO: 615575 - DNA, 25 bp, Rattus norvegicus
tgattcattcacactcttttctttg

SEQ ID NO: 615576 - DNA, 25 bp, Rattus norvegicus
tgattcattcactctcttttctttg

SEQ ID NO: 615577 - DNA, 25 bp, Rattus norvegicus
tgattcattcatacctttcaggagt

SEQ ID NO: 615578 - DNA, 25 bp, Rattus norvegicus
tgattcattcattcctttcaggagt

SEQ ID NO: 615579 - DNA, 25 bp, Rattus norvegicus
tgattcatttacactccatggcttg

SEQ ID NO: 615580 - DNA, 25 bp, Rattus norvegicus
tgattcatttactctccatggcttg

SEQ ID NO: 615581 - DNA, 25 bp, Rattus norvegicus
tgattccaacacaagcatctgtcac

SEQ ID NO: 615582 - DNA, 25 bp, Rattus norvegicus
tgattccaacactagcatctgtcac

SEQ ID NO: 615583 - DNA, 25 bp, Rattus norvegicus
tgattccaagaacctcagaggactt

SEQ ID NO: 615584 - DNA, 25 bp, Rattus norvegicus
tgattccaagaagctcagaggactt

SEQ ID NO: 615585 - DNA, 25 bp, Rattus norvegicus
tgattccaagttaccactctctaga

SEQ ID NO: 615586 - DNA, 25 bp, Rattus norvegicus
tgattccaagtttccactctctaga

SEQ ID NO: 615587 - DNA, 25 bp, Rattus norvegicus
tgattccatagtacgtcagcgtgac

SEQ ID NO: 615588 - DNA, 25 bp, Rattus norvegicus
tgattccatagttcgtcagcgtgac

SEQ ID NO: 615589 - DNA, 25 bp, Rattus norvegicus
tgattccatctgattctgttttctg

SEQ ID NO: 615590 - DNA, 25 bp, Rattus norvegicus
tgattccatctgtttctgttttctg

SEQ ID NO: 615591 - DNA, 25 bp, Rattus norvegicus
tgattccatgcaagtatcaccgtgc

SEQ ID NO: 615592 - DNA, 25 bp, Rattus norvegicus
tgattccatgcatgtatcaccgtgc

SEQ ID NO: 615593 - DNA, 25 bp, Rattus norvegicus
tgattccattgaccgttagctcagt

SEQ ID NO: 615594 - DNA, 25 bp, Rattus norvegicus
tgattccattgagcgttagctcagt

SEQ ID NO: 615595 - DNA, 25 bp, Rattus norvegicus
tgattcccagtgaccattctcttta

SEQ ID NO: 615596 - DNA, 25 bp, Rattus norvegicus
tgattcccagtgtccattctcttta

SEQ ID NO: 615597 - DNA, 25 bp, Rattus norvegicus
tgattcccatgcagactccttttaa

SEQ ID NO: 615598 - DNA, 25 bp, Rattus norvegicus
tgattcccatgctgactccttttaa

SEQ ID NO: 615599 - DNA, 25 bp, Rattus norvegicus
tgattccccaacatcaaccataggg

SEQ ID NO: 615600 - DNA, 25 bp, Rattus norvegicus
tgattccccaacttcaaccataggg

SEQ ID NO: 615601 - DNA, 25 bp, Rattus norvegicus
tgattccccacactcggaagcaaat

SEQ ID NO: 615602 - DNA, 25 bp, Rattus norvegicus
tgattccccacagtcggaagcaaat

SEQ ID NO: 615603 - DNA, 25 bp, Rattus norvegicus
tgattccccgagctttttagatgtt

SEQ ID NO: 615604 - DNA, 25 bp, Rattus norvegicus
tgattccccgaggtttttagatgtt

SEQ ID NO: 615605 - DNA, 25 bp, Rattus norvegicus
tgattcccctggattggtggcctaa

SEQ ID NO: 615606 - DNA, 25 bp, Rattus norvegicus
tgattcccctggtttggtggcctaa

SEQ ID NO: 615607 - DNA, 25 bp, Rattus norvegicus
tgattccctataaaaaggcctgtgt

SEQ ID NO: 615608 - DNA, 25 bp, Rattus norvegicus
tgattccctatataaaggcctgtgt

SEQ ID NO: 615609 - DNA, 25 bp, Rattus norvegicus
tgattccctgtaagactgtgtcttc

SEQ ID NO: 615610 - DNA, 25 bp, Rattus norvegicus
tgattccctgtatgactgtgtcttc

SEQ ID NO: 615611 - DNA, 25 bp, Rattus norvegicus
tgattcccttctagggcctatagaa

SEQ ID NO: 615612 - DNA, 25 bp, Rattus norvegicus
tgattcccttcttgggcctatagaa

SEQ ID NO: 615613 - DNA, 25 bp, Rattus norvegicus
tgattccctttaaccacaaaactag

SEQ ID NO: 615614 - DNA, 25 bp, Rattus norvegicus
tgattccctttatccacaaaactag

SEQ ID NO: 615615 - DNA, 25 bp, Rattus norvegicus
tgattccggctgaggcagcatggat

SEQ ID NO: 615616 - DNA, 25 bp, Rattus norvegicus
tgattccggctgtggcagcatggat

SEQ ID NO: 615617 - DNA, 25 bp, Rattus norvegicus
tgattccgtctactggtgtgcagat

SEQ ID NO: 615618 - DNA, 25 bp, Rattus norvegicus
tgattccgtctagtggtgtgcagat

SEQ ID NO: 615619 - DNA, 25 bp, Rattus norvegicus
tgattccgtgacatccgaggtcatg

SEQ ID NO: 615620 - DNA, 25 bp, Rattus norvegicus
tgattccgtgacttccgaggtcatg

SEQ ID NO: 615621 - DNA, 25 bp, Rattus norvegicus
tgattcctaagtactccctggagat

SEQ ID NO: 615622 - DNA, 25 bp, Rattus norvegicus
tgattcctaagttctccctggagat

SEQ ID NO: 615623 - DNA, 25 bp, Rattus norvegicus
tgattcctagaacccctatcagaca

SEQ ID NO: 615624 - DNA, 25 bp, Rattus norvegicus
tgattcctagaagccctatcagaca

SEQ ID NO: 615625 - DNA, 25 bp, Rattus norvegicus
tgattcctagagattcccagtaccc

SEQ ID NO: 615626 - DNA, 25 bp, Rattus norvegicus
tgattcctagagtttcccagtaccc

SEQ ID NO: 615627 - DNA, 25 bp, Rattus norvegicus
tgattcctagctacattcgtgactc

SEQ ID NO: 615628 - DNA, 25 bp, Rattus norvegicus
tgattcctagcttcattcgtgactc

SEQ ID NO: 615629 - DNA, 25 bp, Rattus norvegicus
tgattcctcagactaccattcatac

SEQ ID NO: 615630 - DNA, 25 bp, Rattus norvegicus
tgattcctcagagtaccattcatac

SEQ ID NO: 615631 - DNA, 25 bp, Rattus norvegicus
tgattcctcaggcttgtcacaactt

SEQ ID NO: 615632 - DNA, 25 bp, Rattus norvegicus
tgattcctcagggttgtcacaactt

SEQ ID NO: 615633 - DNA, 25 bp, Rattus norvegicus
tgattcctctcgcacgatctgcggg

SEQ ID NO: 615634 - DNA, 25 bp, Rattus norvegicus
tgattcctctcggacgatctgcggg

SEQ ID NO: 615635 - DNA, 25 bp, Rattus norvegicus
tgattcctctgacaactctttctta

SEQ ID NO: 615636 - DNA, 25 bp, Rattus norvegicus
tgattcctctgagaactctttctta

SEQ ID NO: 615637 - DNA, 25 bp, Rattus norvegicus
tgattcctgaatacctgttgctctt

SEQ ID NO: 615638 - DNA, 25 bp, Rattus norvegicus
tgattcctgaattcctgttgctctt

SEQ ID NO: 615639 - DNA, 25 bp, Rattus norvegicus
tgattcctgagcactgtgcatgaga

SEQ ID NO: 615640 - DNA, 25 bp, Rattus norvegicus
tgattcctgagcacttagcgggtta

SEQ ID NO: 615641 - DNA, 25 bp, Rattus norvegicus
tgattcctgagccttcattcttgaa

SEQ ID NO: 615642 - DNA, 25 bp, Rattus norvegicus
tgattcctgagcgttcattcttgaa

SEQ ID NO: 615643 - DNA, 25 bp, Rattus norvegicus
tgattcctgagctctgtgcatgaga

SEQ ID NO: 615644 - DNA, 25 bp, Rattus norvegicus
tgattcctgagctcttagcgggtta

SEQ ID NO: 615645 - DNA, 25 bp, Rattus norvegicus
tgattcctgagtaccatggtgcctt

SEQ ID NO: 615646 - DNA, 25 bp, Rattus norvegicus
tgattcctgagttccatggtgcctt

SEQ ID NO: 615647 - DNA, 25 bp, Rattus norvegicus
tgattcctgccgattgttcatcgtt

SEQ ID NO: 615648 - DNA, 25 bp, Rattus norvegicus
tgattcctgccgtttgttcatcgtt

SEQ ID NO: 615649 - DNA, 25 bp, Rattus norvegicus
tgattcctgcttagactctgttaca

SEQ ID NO: 615650 - DNA, 25 bp, Rattus norvegicus
tgattcctgctttgactctgttaca

SEQ ID NO: 615651 - DNA, 25 bp, Rattus norvegicus
tgattcctgtcccttacgtggagaa

SEQ ID NO: 615652 - DNA, 25 bp, Rattus norvegicus
tgattcctgtccgttacgtggagaa

SEQ ID NO: 615653 - DNA, 25 bp, Rattus norvegicus
tgattccttccacccgagtttaagg

SEQ ID NO: 615654 - DNA, 25 bp, Rattus norvegicus
tgattccttccagccgagtttaagg

SEQ ID NO: 615655 - DNA, 25 bp, Rattus norvegicus
tgattccttgggagatgcccctcgg

SEQ ID NO: 615656 - DNA, 25 bp, Rattus norvegicus
tgattccttgggtgatgcccctcgg

SEQ ID NO: 615657 - DNA, 25 bp, Rattus norvegicus
tgattcctttctactcagctttgtg

SEQ ID NO: 615658 - DNA, 25 bp, Rattus norvegicus
tgattcctttcttctcagctttgtg

SEQ ID NO: 615659 - DNA, 25 bp, Rattus norvegicus
tgattcctttgtatcccactttcat

SEQ ID NO: 615660 - DNA, 25 bp, Rattus norvegicus
tgattcctttgtttcccactttcat

SEQ ID NO: 615661 - DNA, 25 bp, Rattus norvegicus
tgattcgaagccaggcaccattcgt

SEQ ID NO: 615662 - DNA, 25 bp, Rattus norvegicus
tgattcgaagcctggcaccattcgt

SEQ ID NO: 615663 - DNA, 25 bp, Rattus norvegicus
tgattcgcccatcctctgcttttgc

SEQ ID NO: 615664 - DNA, 25 bp, Rattus norvegicus
tgattcgcccatgctctgcttttgc

SEQ ID NO: 615665 - DNA, 25 bp, Rattus norvegicus
tgattcgctgagcagggctcacagt

SEQ ID NO: 615666 - DNA, 25 bp, Rattus norvegicus
tgattcgctgaggagggctcacagt

SEQ ID NO: 615667 - DNA, 25 bp, Rattus norvegicus
tgattcgtgaccattttctccattc

SEQ ID NO: 615668 - DNA, 25 bp, Rattus norvegicus
tgattcgtgacctttttctccattc

SEQ ID NO: 615669 - DNA, 25 bp, Rattus norvegicus
tgattctaacctaattcttcccata

SEQ ID NO: 615670 - DNA, 25 bp, Rattus norvegicus
tgattctaaccttattcttcccata

SEQ ID NO: 615671 - DNA, 25 bp, Rattus norvegicus
tgattctactttccattgacctcac

SEQ ID NO: 615672 - DNA, 25 bp, Rattus norvegicus
tgattctactttgcattgacctcac

SEQ ID NO: 615673 - DNA, 25 bp, Rattus norvegicus
tgattctatttaatccttctgcctc

SEQ ID NO: 615674 - DNA, 25 bp, Rattus norvegicus
tgattctatttattccttctgcctc

SEQ ID NO: 615675 - DNA, 25 bp, Rattus norvegicus
tgattctcacagatgggctcctgca

SEQ ID NO: 615676 - DNA, 25 bp, Rattus norvegicus
tgattctcacagttgggctcctgca

SEQ ID NO: 615677 - DNA, 25 bp, Rattus norvegicus
tgattctcaggaagaacccgcacct

SEQ ID NO: 615678 - DNA, 25 bp, Rattus norvegicus
tgattctcaggatgaacccgcacct

SEQ ID NO: 615679 - DNA, 25 bp, Rattus norvegicus
tgattctccagtccgtggtggcaga

SEQ ID NO: 615680 - DNA, 25 bp, Rattus norvegicus
tgattctccagtgcgtggtggcaga

SEQ ID NO: 615681 - DNA, 25 bp, Rattus norvegicus
tgattctccccgatgtgcactagag

SEQ ID NO: 615682 - DNA, 25 bp, Rattus norvegicus
tgattctccccgttgtgcactagag

SEQ ID NO: 615683 - DNA, 25 bp, Rattus norvegicus
tgattctcccttcactgacagctgt

SEQ ID NO: 615684 - DNA, 25 bp, Rattus norvegicus
tgattctcccttgactgacagctgt

SEQ ID NO: 615685 - DNA, 25 bp, Rattus norvegicus
tgattctccttacctgtgattactc

SEQ ID NO: 615686 - DNA, 25 bp, Rattus norvegicus
tgattctccttagctgtgattactc

SEQ ID NO: 615687 - DNA, 25 bp, Rattus norvegicus
tgattctcgaaaccttgtgtgctcc

SEQ ID NO: 615688 - DNA, 25 bp, Rattus norvegicus
tgattctcgaaagcttgtgtgctcc

SEQ ID NO: 615689 - DNA, 25 bp, Rattus norvegicus
tgattctcgtctccatctcaccatt

SEQ ID NO: 615690 - DNA, 25 bp, Rattus norvegicus
tgattctcgtctgcatctcaccatt

SEQ ID NO: 615691 - DNA, 25 bp, Rattus norvegicus
tgattctctgtaagactgcacgtcc

SEQ ID NO: 615692 - DNA, 25 bp, Rattus norvegicus
tgattctctgtatgactgcacgtcc

SEQ ID NO: 615693 - DNA, 25 bp, Rattus norvegicus
tgattctgacaaaagataggcttgt

SEQ ID NO: 615694 - DNA, 25 bp, Rattus norvegicus
tgattctgacaatagataggcttgt

SEQ ID NO: 615695 - DNA, 25 bp, Rattus norvegicus
tgattctgccaaaaaggttctcctg

SEQ ID NO: 615696 - DNA, 25 bp, Rattus norvegicus
tgattctgccaataaggttctcctg

SEQ ID NO: 615697 - DNA, 25 bp, Rattus norvegicus
tgattctgcccaactcaagcatcct

SEQ ID NO: 615698 - DNA, 25 bp, Rattus norvegicus
tgattctgcccatctcaagcatcct

SEQ ID NO: 615699 - DNA, 25 bp, Rattus norvegicus
tgattctggcagagacatagtcaaa

SEQ ID NO: 615700 - DNA, 25 bp, Rattus norvegicus
tgattctggcagtgacatagtcaaa

SEQ ID NO: 615701 - DNA, 25 bp, Rattus norvegicus
tgattctggtataggacgtcctaat

SEQ ID NO: 615702 - DNA, 25 bp, Rattus norvegicus
tgattctggtattggacgtcctaat

SEQ ID NO: 615703 - DNA, 25 bp, Rattus norvegicus
tgattctgtcagagtcctcgggcac

SEQ ID NO: 615704 - DNA, 25 bp, Rattus norvegicus
tgattctgtcagtgtcctcgggcac

SEQ ID NO: 615705 - DNA, 25 bp, Rattus norvegicus
tgattcttagcaattgtgcctcctc

SEQ ID NO: 615706 - DNA, 25 bp, Rattus norvegicus
tgattcttagcatttgtgcctcctc

SEQ ID NO: 615707 - DNA, 25 bp, Rattus norvegicus
tgattcttcagtcccacgcgttcaa

SEQ ID NO: 615708 - DNA, 25 bp, Rattus norvegicus
tgattcttcagtgccacgcgttcaa

SEQ ID NO: 615709 - DNA, 25 bp, Rattus norvegicus
tgattcttctaacattcctacgcta

SEQ ID NO: 615710 - DNA, 25 bp, Rattus norvegicus
tgattcttctaagattcctacgcta

SEQ ID NO: 615711 - DNA, 25 bp, Rattus norvegicus
tgattcttgaggaccgaccatcgaa

SEQ ID NO: 615712 - DNA, 25 bp, Rattus norvegicus
tgattcttgaggtccgaccatcgaa

SEQ ID NO: 615713 - DNA, 25 bp, Rattus norvegicus
tgattcttgcccagccggtgcttca

SEQ ID NO: 615714 - DNA, 25 bp, Rattus norvegicus
tgattcttgccctgccggtgcttca

SEQ ID NO: 615715 - DNA, 25 bp, Rattus norvegicus
tgattctttttcatgcccctgttta

SEQ ID NO: 615716 - DNA, 25 bp, Rattus norvegicus
tgattctttttcttgcccctgttta

SEQ ID NO: 615717 - DNA, 25 bp, Rattus norvegicus
tgattgaacacccatatcctgacgc

SEQ ID NO: 615718 - DNA, 25 bp, Rattus norvegicus
tgattgaacaccctgagtacggaga

SEQ ID NO: 615719 - DNA, 25 bp, Rattus norvegicus
tgattgaacaccgatatcctgacgc

SEQ ID NO: 615720 - DNA, 25 bp, Rattus norvegicus
tgattgaacaccgtgagtacggaga

SEQ ID NO: 615721 - DNA, 25 bp, Rattus norvegicus
tgattgacaagtactgcccgggcat

SEQ ID NO: 615722 - DNA, 25 bp, Rattus norvegicus
tgattgacaagttctgcccgggcat

SEQ ID NO: 615723 - DNA, 25 bp, Rattus norvegicus
tgattgacactcagcagtgcggtat

SEQ ID NO: 615724 - DNA, 25 bp, Rattus norvegicus
tgattgacactctgcagtgcggtat

SEQ ID NO: 615725 - DNA, 25 bp, Rattus norvegicus
tgattgacagacctgcaccccatta

SEQ ID NO: 615726 - DNA, 25 bp, Rattus norvegicus
tgattgacagacgtgcaccccatta

SEQ ID NO: 615727 - DNA, 25 bp, Rattus norvegicus
tgattgacaggcaggcactggtcca

SEQ ID NO: 615728 - DNA, 25 bp, Rattus norvegicus
tgattgacaggctggcactggtcca

SEQ ID NO: 615729 - DNA, 25 bp, Rattus norvegicus
tgattgacatggcagggcctagccc

SEQ ID NO: 615730 - DNA, 25 bp, Rattus norvegicus
tgattgacatgggagggcctagccc

SEQ ID NO: 615731 - DNA, 25 bp, Rattus norvegicus
tgattgacatttatgggacgggcat

SEQ ID NO: 615732 - DNA, 25 bp, Rattus norvegicus
tgattgacatttttgggacgggcat

SEQ ID NO: 615733 - DNA, 25 bp, Rattus norvegicus
tgattgaccgggaaacgacacttcg

SEQ ID NO: 615734 - DNA, 25 bp, Rattus norvegicus
tgattgaccgggtaacgacacttcg

SEQ ID NO: 615735 - DNA, 25 bp, Rattus norvegicus
tgattgacgtgactgtgcccctgca

SEQ ID NO: 615736 - DNA, 25 bp, Rattus norvegicus
tgattgacgtgagtgtgcccctgca

SEQ ID NO: 615737 - DNA, 25 bp, Rattus norvegicus
tgattgactgaactgctggtgctgt

SEQ ID NO: 615738 - DNA, 25 bp, Rattus norvegicus
tgattgactgaagtgctggtgctgt

SEQ ID NO: 615739 - DNA, 25 bp, Rattus norvegicus
tgattgactgtgaacggcgtctgga

SEQ ID NO: 615740 - DNA, 25 bp, Rattus norvegicus
tgattgactgtgtacggcgtctgga

SEQ ID NO: 615741 - DNA, 25 bp, Rattus norvegicus
tgattgacttccagtgatgcccgag

SEQ ID NO: 615742 - DNA, 25 bp, Rattus norvegicus
tgattgacttcctgtgatgcccgag

SEQ ID NO: 615743 - DNA, 25 bp, Rattus norvegicus
tgattgagacagatgcaccttggtg

SEQ ID NO: 615744 - DNA, 25 bp, Rattus norvegicus
tgattgagacagttgcaccttggtg

SEQ ID NO: 615745 - DNA, 25 bp, Rattus norvegicus
tgattgagatttaccgccctatgta

SEQ ID NO: 615746 - DNA, 25 bp, Rattus norvegicus
tgattgagattttccgccctatgta

SEQ ID NO: 615747 - DNA, 25 bp, Rattus norvegicus
tgattgagctcacccaggctggact

SEQ ID NO: 615748 - DNA, 25 bp, Rattus norvegicus
tgattgagctcagccaggctggact

SEQ ID NO: 615749 - DNA, 25 bp, Rattus norvegicus
tgattgagttgaccctcacacaggt

SEQ ID NO: 615750 - DNA, 25 bp, Rattus norvegicus
tgattgagttgagcctcacacaggt

SEQ ID NO: 615751 - DNA, 25 bp, Rattus norvegicus
tgattgatagctatgtgccgccttt

SEQ ID NO: 615752 - DNA, 25 bp, Rattus norvegicus
tgattgatagctttgtgccgccttt

SEQ ID NO: 615753 - DNA, 25 bp, Rattus norvegicus
tgattgatcttcctggctcccatga

SEQ ID NO: 615754 - DNA, 25 bp, Rattus norvegicus
tgattgatcttcgtggctcccatga

SEQ ID NO: 615755 - DNA, 25 bp, Rattus norvegicus
tgattgatgggcacctgggatcctt

SEQ ID NO: 615756 - DNA, 25 bp, Rattus norvegicus
tgattgatgggctcctgggatcctt

SEQ ID NO: 615757 - DNA, 25 bp, Rattus norvegicus
tgattgatggtcaggatttgctgaa

SEQ ID NO: 615758 - DNA, 25 bp, Rattus norvegicus
tgattgatggtctggatttgctgaa

SEQ ID NO: 615759 - DNA, 25 bp, Rattus norvegicus
tgattgcaccctatggaaaaccact

SEQ ID NO: 615760 - DNA, 25 bp, Rattus norvegicus
tgattgcaccctttggaaaaccact

SEQ ID NO: 615761 - DNA, 25 bp, Rattus norvegicus
tgattgcagcggagcctatggcaca

SEQ ID NO: 615762 - DNA, 25 bp, Rattus norvegicus
tgattgcagcggtgcctatggcaca

SEQ ID NO: 615763 - DNA, 25 bp, Rattus norvegicus
tgattgcatccgcaagtgcccatga

SEQ ID NO: 615764 - DNA, 25 bp, Rattus norvegicus
tgattgcatccggaagtgcccatga

SEQ ID NO: 615765 - DNA, 25 bp, Rattus norvegicus
tgattgccacttcatacctgtatgc

SEQ ID NO: 615766 - DNA, 25 bp, Rattus norvegicus
tgattgccacttgatacctgtatgc

SEQ ID NO: 615767 - DNA, 25 bp, Rattus norvegicus
tgattgccctggaacaggctatgta

SEQ ID NO: 615768 - DNA, 25 bp, Rattus norvegicus
tgattgccctggtacaggctatgta

SEQ ID NO: 615769 - DNA, 25 bp, Rattus norvegicus
tgattgcccttccatacctggttca

SEQ ID NO: 615770 - DNA, 25 bp, Rattus norvegicus
tgattgcccttcgatacctggttca

SEQ ID NO: 615771 - DNA, 25 bp, Rattus norvegicus
tgattgcctaacacatcctagctag

SEQ ID NO: 615772 - DNA, 25 bp, Rattus norvegicus
tgattgcctaactcatcctagctag

SEQ ID NO: 615773 - DNA, 25 bp, Rattus norvegicus
tgattgcctctacccattctggaag

SEQ ID NO: 615774 - DNA, 25 bp, Rattus norvegicus
tgattgcctctagccattctggaag

SEQ ID NO: 615775 - DNA, 25 bp, Rattus norvegicus
tgattgcgacgtcgttgggtacttc

SEQ ID NO: 615776 - DNA, 25 bp, Rattus norvegicus
tgattgcgacgtggttgggtacttc

SEQ ID NO: 615777 - DNA, 25 bp, Rattus norvegicus
tgattgctatcactaatgccccaaa

SEQ ID NO: 615778 - DNA, 25 bp, Rattus norvegicus
tgattgctatcagtaatgccccaaa

SEQ ID NO: 615779 - DNA, 25 bp, Rattus norvegicus
tgattgctcaggcactctactaacc

SEQ ID NO: 615780 - DNA, 25 bp, Rattus norvegicus
tgattgctcagggactctactaacc

SEQ ID NO: 615781 - DNA, 25 bp, Rattus norvegicus
tgattgctttttagttgggagtgat

SEQ ID NO: 615782 - DNA, 25 bp, Rattus norvegicus
tgattgcttttttgttgggagtgat

SEQ ID NO: 615783 - DNA, 25 bp, Rattus norvegicus
tgattggagcctcttttctttacct

SEQ ID NO: 615784 - DNA, 25 bp, Rattus norvegicus
tgattggagcctgttttctttacct

SEQ ID NO: 615785 - DNA, 25 bp, Rattus norvegicus
tgattggagcttccacttctagcat

SEQ ID NO: 615786 - DNA, 25 bp, Rattus norvegicus
tgattggagcttgcacttctagcat

SEQ ID NO: 615787 - DNA, 25 bp, Rattus norvegicus
tgattggatcctctgttgcgtattc

SEQ ID NO: 615788 - DNA, 25 bp, Rattus norvegicus
tgattggatcctgtgttgcgtattc

SEQ ID NO: 615789 - DNA, 25 bp, Rattus norvegicus
tgattggcagatcgtgtgcctgctt

SEQ ID NO: 615790 - DNA, 25 bp, Rattus norvegicus
tgattggcagatggtgtgcctgctt

SEQ ID NO: 615791 - DNA, 25 bp, Rattus norvegicus
tgattggccaccctgttcaagatgg

SEQ ID NO: 615792 - DNA, 25 bp, Rattus norvegicus
tgattggccaccgtgttcaagatgg

SEQ ID NO: 615793 - DNA, 25 bp, Rattus norvegicus
tgattggccagtatattcgctccac

SEQ ID NO: 615794 - DNA, 25 bp, Rattus norvegicus
tgattggccagtttattcgctccac

SEQ ID NO: 615795 - DNA, 25 bp, Rattus norvegicus
tgattggctccaacccatcgcagtt

SEQ ID NO: 615796 - DNA, 25 bp, Rattus norvegicus
tgattggctccatcccatcgcagtt

SEQ ID NO: 615797 - DNA, 25 bp, Rattus norvegicus
tgattggcttttagactccttgtct

SEQ ID NO: 615798 - DNA, 25 bp, Rattus norvegicus
tgattggctttttgactccttgtct

SEQ ID NO: 615799 - DNA, 25 bp, Rattus norvegicus
tgattgggaaatccaagcccacctg

SEQ ID NO: 615800 - DNA, 25 bp, Rattus norvegicus
tgattgggaaatgcaagcccacctg

SEQ ID NO: 615801 - DNA, 25 bp, Rattus norvegicus
tgattgggccacagctcgtgtgcca

SEQ ID NO: 615802 - DNA, 25 bp, Rattus norvegicus
tgattgggccactgctcgtgtgcca

SEQ ID NO: 615803 - DNA, 25 bp, Rattus norvegicus
tgattggtccgacggcatctctagc

SEQ ID NO: 615804 - DNA, 25 bp, Rattus norvegicus
tgattggtccgagggcatctctagc

SEQ ID NO: 615805 - DNA, 25 bp, Rattus norvegicus
tgattggtgagtagaccgtcctggc

SEQ ID NO: 615806 - DNA, 25 bp, Rattus norvegicus
tgattggtgagttgaccgtcctggc

SEQ ID NO: 615807 - DNA, 25 bp, Rattus norvegicus
tgattggttgtcacttcccacaaga

SEQ ID NO: 615808 - DNA, 25 bp, Rattus norvegicus
tgattggttgtctcttcccacaaga

SEQ ID NO: 615809 - DNA, 25 bp, Rattus norvegicus
tgattgtactgcatgctctatcctg

SEQ ID NO: 615810 - DNA, 25 bp, Rattus norvegicus
tgattgtactgcttgctctatcctg

SEQ ID NO: 615811 - DNA, 25 bp, Rattus norvegicus
tgattgtagcagaaacccggtcctt

SEQ ID NO: 615812 - DNA, 25 bp, Rattus norvegicus
tgattgtagcagtaacccggtcctt

SEQ ID NO: 615813 - DNA, 25 bp, Rattus norvegicus
tgattgtcaccaacataccctacat

SEQ ID NO: 615814 - DNA, 25 bp, Rattus norvegicus
tgattgtcaccatcataccctacat

SEQ ID NO: 615815 - DNA, 25 bp, Rattus norvegicus
tgattgtccaacctgtggtgctcct

SEQ ID NO: 615816 - DNA, 25 bp, Rattus norvegicus
tgattgtccaacgtgtggtgctcct

SEQ ID NO: 615817 - DNA, 25 bp, Rattus norvegicus
tgattgtcccctatagttaagtttg

SEQ ID NO: 615818 - DNA, 25 bp, Rattus norvegicus
tgattgtcccctttagttaagtttg

SEQ ID NO: 615819 - DNA, 25 bp, Rattus norvegicus
tgattgtctcagctgctgttgttgc

SEQ ID NO: 615820 - DNA, 25 bp, Rattus norvegicus
tgattgtctcaggtgctgttgttgc

SEQ ID NO: 615821 - DNA, 25 bp, Rattus norvegicus
tgattgtctgtgagtgtctcctctc

SEQ ID NO: 615822 - DNA, 25 bp, Rattus norvegicus
tgattgtctgtgtgtgtctcctctc

SEQ ID NO: 615823 - DNA, 25 bp, Rattus norvegicus
tgattgtctttgatgacccctgcat

SEQ ID NO: 615824 - DNA, 25 bp, Rattus norvegicus
tgattgtctttgttgacccctgcat

SEQ ID NO: 615825 - DNA, 25 bp, Rattus norvegicus
tgattgtgaagaatgcctctccctg

SEQ ID NO: 615826 - DNA, 25 bp, Rattus norvegicus
tgattgtgaagattgcctctccctg

SEQ ID NO: 615827 - DNA, 25 bp, Rattus norvegicus
tgattgtgaatgacgggcgttcttt

SEQ ID NO: 615828 - DNA, 25 bp, Rattus norvegicus
tgattgtgaatgtcgggcgttcttt

SEQ ID NO: 615829 - DNA, 25 bp, Rattus norvegicus
tgattgtgctggaaccttcctatag

SEQ ID NO: 615830 - DNA, 25 bp, Rattus norvegicus
tgattgtgctggtaccttcctatag

SEQ ID NO: 615831 - DNA, 25 bp, Rattus norvegicus
tgattgtgctgtactctgtctgctc

SEQ ID NO: 615832 - DNA, 25 bp, Rattus norvegicus
tgattgtgctgttctctgtctgctc

SEQ ID NO: 615833 - DNA, 25 bp, Rattus norvegicus
tgattgtgcttaatgccccagactc

SEQ ID NO: 615834 - DNA, 25 bp, Rattus norvegicus
tgattgtgcttattgccccagactc

SEQ ID NO: 615835 - DNA, 25 bp, Rattus norvegicus
tgattgtgggcaagcgcttccgaaa

SEQ ID NO: 615836 - DNA, 25 bp, Rattus norvegicus
tgattgtgggcatgcgcttccgaaa

SEQ ID NO: 615837 - DNA, 25 bp, Rattus norvegicus
tgattgtgtattctgcctggcattt

SEQ ID NO: 615838 - DNA, 25 bp, Rattus norvegicus
tgattgtgtattgtgcctggcattt

SEQ ID NO: 615839 - DNA, 25 bp, Rattus norvegicus
tgattgttttctacagagtgccctc

SEQ ID NO: 615840 - DNA, 25 bp, Rattus norvegicus
tgattgttttctagtcaacctgctc

SEQ ID NO: 615841 - DNA, 25 bp, Rattus norvegicus
tgattgttttcttcagagtgccctc

SEQ ID NO: 615842 - DNA, 25 bp, Rattus norvegicus
tgattgttttcttgtcaacctgctc

SEQ ID NO: 615843 - DNA, 25 bp, Rattus norvegicus
tgatttaaactgatccccgtcagcg

SEQ ID NO: 615844 - DNA, 25 bp, Rattus norvegicus
tgatttaaactgttccccgtcagcg

SEQ ID NO: 615845 - DNA, 25 bp, Rattus norvegicus
tgatttaaagccagtgggtcttttt

SEQ ID NO: 615846 - DNA, 25 bp, Rattus norvegicus
tgatttaaagcctgtgggtcttttt

SEQ ID NO: 615847 - DNA, 25 bp, Rattus norvegicus
tgatttaagccaatctccaagtctg

SEQ ID NO: 615848 - DNA, 25 bp, Rattus norvegicus
tgatttaagccacttctgttcctct

SEQ ID NO: 615849 - DNA, 25 bp, Rattus norvegicus
tgatttaagccagttctgttcctct

SEQ ID NO: 615850 - DNA, 25 bp, Rattus norvegicus
tgatttaagccattctccaagtctg

SEQ ID NO: 615851 - DNA, 25 bp, Rattus norvegicus
tgatttaattagacaccccgtgctg

SEQ ID NO: 615852 - DNA, 25 bp, Rattus norvegicus
tgatttaattagtcaccccgtgctg

SEQ ID NO: 615853 - DNA, 25 bp, Rattus norvegicus
tgatttacagttctgctctcgttgc

SEQ ID NO: 615854 - DNA, 25 bp, Rattus norvegicus
tgatttacagttgtgctctcgttgc

SEQ ID NO: 615855 - DNA, 25 bp, Rattus norvegicus
tgatttagaagacggcccggactgt

SEQ ID NO: 615856 - DNA, 25 bp, Rattus norvegicus
tgatttagaagagggcccggactgt

SEQ ID NO: 615857 - DNA, 25 bp, Rattus norvegicus
tgatttagacgcacttcctatggat

SEQ ID NO: 615858 - DNA, 25 bp, Rattus norvegicus
tgatttagacgctcttcctatggat

SEQ ID NO: 615859 - DNA, 25 bp, Rattus norvegicus
tgatttagacttctccacttagcgg

SEQ ID NO: 615860 - DNA, 25 bp, Rattus norvegicus
tgatttagacttgtccacttagcgg

SEQ ID NO: 615861 - DNA, 25 bp, Rattus norvegicus
tgatttagcacaccaaggtctcctc

SEQ ID NO: 615862 - DNA, 25 bp, Rattus norvegicus
tgatttagcacagcaaggtctcctc

SEQ ID NO: 615863 - DNA, 25 bp, Rattus norvegicus
tgatttagctctcacagctgcccat

SEQ ID NO: 615864 - DNA, 25 bp, Rattus norvegicus
tgatttagctctgacagctgcccat

SEQ ID NO: 615865 - DNA, 25 bp, Rattus norvegicus
tgatttaggtaaatgtcacttccaa

SEQ ID NO: 615866 - DNA, 25 bp, Rattus norvegicus
tgatttaggtaattgtcacttccaa

SEQ ID NO: 615867 - DNA, 25 bp, Rattus norvegicus
tgatttagtcttcctatcccagtga

SEQ ID NO: 615868 - DNA, 25 bp, Rattus norvegicus
tgatttagtcttgctatcccagtga

SEQ ID NO: 615869 - DNA, 25 bp, Rattus norvegicus
tgatttatccggaacccagcatggg

SEQ ID NO: 615870 - DNA, 25 bp, Rattus norvegicus
tgatttatccggtacccagcatggg

SEQ ID NO: 615871 - DNA, 25 bp, Rattus norvegicus
tgatttatctccagttgcctttgtt

SEQ ID NO: 615872 - DNA, 25 bp, Rattus norvegicus
tgatttatctcctgttgcctttgtt

SEQ ID NO: 615873 - DNA, 25 bp, Rattus norvegicus
tgatttatgtctacgcaggccggct

SEQ ID NO: 615874 - DNA, 25 bp, Rattus norvegicus
tgatttatgtcttcgcaggccggct

SEQ ID NO: 615875 - DNA, 25 bp, Rattus norvegicus
tgatttattcccattgagacgccat

SEQ ID NO: 615876 - DNA, 25 bp, Rattus norvegicus
tgatttattccctttgagacgccat

SEQ ID NO: 615877 - DNA, 25 bp, Rattus norvegicus
tgatttatttccatgctgcagtcgc

SEQ ID NO: 615878 - DNA, 25 bp, Rattus norvegicus
tgatttatttccttgctgcagtcgc

SEQ ID NO: 615879 - DNA, 25 bp, Rattus norvegicus
tgatttattttcaacttctaagtgt

SEQ ID NO: 615880 - DNA, 25 bp, Rattus norvegicus
tgatttattttctacttctaagtgt

SEQ ID NO: 615881 - DNA, 25 bp, Rattus norvegicus
tgatttcaaaaacggtggtcgtaag

SEQ ID NO: 615882 - DNA, 25 bp, Rattus norvegicus
tgatttcaaaaagggtggtcgtaag

SEQ ID NO: 615883 - DNA, 25 bp, Rattus norvegicus
tgatttcaacttcctcaggcactct

SEQ ID NO: 615884 - DNA, 25 bp, Rattus norvegicus
tgatttcaacttgctcaggcactct

SEQ ID NO: 615885 - DNA, 25 bp, Rattus norvegicus
tgatttcaatttatcccagctaccc

SEQ ID NO: 615886 - DNA, 25 bp, Rattus norvegicus
tgatttcaatttttcccagctaccc

SEQ ID NO: 615887 - DNA, 25 bp, Rattus norvegicus
tgatttcacctgattccagtcttta

SEQ ID NO: 615888 - DNA, 25 bp, Rattus norvegicus
tgatttcacctgtttccagtcttta

SEQ ID NO: 615889 - DNA, 25 bp, Rattus norvegicus
tgatttcagagcagctggtcccctt

SEQ ID NO: 615890 - DNA, 25 bp, Rattus norvegicus
tgatttcagagctgctggtcccctt

SEQ ID NO: 615891 - DNA, 25 bp, Rattus norvegicus
tgatttcaggtgcttcaggacttga

SEQ ID NO: 615892 - DNA, 25 bp, Rattus norvegicus
tgatttcaggtggttcaggacttga

SEQ ID NO: 615893 - DNA, 25 bp, Rattus norvegicus
tgatttcagtggcattttttcgtct

SEQ ID NO: 615894 - DNA, 25 bp, Rattus norvegicus
tgatttcagtgggattttttcgtct

SEQ ID NO: 615895 - DNA, 25 bp, Rattus norvegicus
tgatttcatgaactgctggccctgg

SEQ ID NO: 615896 - DNA, 25 bp, Rattus norvegicus
tgatttcatgaagtgctggccctgg

SEQ ID NO: 615897 - DNA, 25 bp, Rattus norvegicus
tgatttccacgtcctctttgccgta

SEQ ID NO: 615898 - DNA, 25 bp, Rattus norvegicus
tgatttccacgtgctctttgccgta

SEQ ID NO: 615899 - DNA, 25 bp, Rattus norvegicus
tgatttccagccagagaccttcaag

SEQ ID NO: 615900 - DNA, 25 bp, Rattus norvegicus
tgatttccagcctgagaccttcaag

SEQ ID NO: 615901 - DNA, 25 bp, Rattus norvegicus
tgatttccctagattttgttttgct

SEQ ID NO: 615902 - DNA, 25 bp, Rattus norvegicus
tgatttccctagtttttgttttgct

SEQ ID NO: 615903 - DNA, 25 bp, Rattus norvegicus
tgatttcccttcattgagttgtaca

SEQ ID NO: 615904 - DNA, 25 bp, Rattus norvegicus
tgatttcccttctttgagttgtaca

SEQ ID NO: 615905 - DNA, 25 bp, Rattus norvegicus
tgatttccctttagtgagctgttac

SEQ ID NO: 615906 - DNA, 25 bp, Rattus norvegicus
tgatttccctttcccttacgcaaag

SEQ ID NO: 615907 - DNA, 25 bp, Rattus norvegicus
tgatttccctttgccttacgcaaag

SEQ ID NO: 615908 - DNA, 25 bp, Rattus norvegicus
tgatttcccttttgtgagctgttac

SEQ ID NO: 615909 - DNA, 25 bp, Rattus norvegicus
tgatttccgccaagaactctgtcca

SEQ ID NO: 615910 - DNA, 25 bp, Rattus norvegicus
tgatttccgccatgaactctgtcca

SEQ ID NO: 615911 - DNA, 25 bp, Rattus norvegicus
tgatttccttcacaggcatcttctc

SEQ ID NO: 615912 - DNA, 25 bp, Rattus norvegicus
tgatttccttcagaggcatcttctc

SEQ ID NO: 615913 - DNA, 25 bp, Rattus norvegicus
tgatttccttgaactccgttatcct

SEQ ID NO: 615914 - DNA, 25 bp, Rattus norvegicus
tgatttccttgatctccgttatcct

SEQ ID NO: 615915 - DNA, 25 bp, Rattus norvegicus
tgatttccttttactagcctttggg

SEQ ID NO: 615916 - DNA, 25 bp, Rattus norvegicus
tgatttcctttttctagcctttggg

SEQ ID NO: 615917 - DNA, 25 bp, Rattus norvegicus
tgatttcgagagctggcagccattc

SEQ ID NO: 615918 - DNA, 25 bp, Rattus norvegicus
tgatttcgagaggtggcagccattc

SEQ ID NO: 615919 - DNA, 25 bp, Rattus norvegicus
tgatttcgcaggacggtggtgatct

SEQ ID NO: 615920 - DNA, 25 bp, Rattus norvegicus
tgatttcgcaggtcggtggtgatct

SEQ ID NO: 615921 - DNA, 25 bp, Rattus norvegicus
tgatttcgcagtctgcacagtggca

SEQ ID NO: 615922 - DNA, 25 bp, Rattus norvegicus
tgatttcgcagtgtgcacagtggca

SEQ ID NO: 615923 - DNA, 25 bp, Rattus norvegicus
tgatttcggatgacattcacctacc

SEQ ID NO: 615924 - DNA, 25 bp, Rattus norvegicus
tgatttcggatgtcattcacctacc

SEQ ID NO: 615925 - DNA, 25 bp, Rattus norvegicus
tgatttcgtactagagcatcgctac

SEQ ID NO: 615926 - DNA, 25 bp, Rattus norvegicus
tgatttcgtacttgagcatcgctac

SEQ ID NO: 615927 - DNA, 25 bp, Rattus norvegicus
tgatttctacacacttcccaggaat

SEQ ID NO: 615928 - DNA, 25 bp, Rattus norvegicus
tgatttctacactcttcccaggaat

SEQ ID NO: 615929 - DNA, 25 bp, Rattus norvegicus
tgatttctacagctctctttctaca

SEQ ID NO: 615930 - DNA, 25 bp, Rattus norvegicus
tgatttctacaggtctctttctaca

SEQ ID NO: 615931 - DNA, 25 bp, Rattus norvegicus
tgatttctagttccacccgtgacac

SEQ ID NO: 615932 - DNA, 25 bp, Rattus norvegicus
tgatttctagttgcacccgtgacac

SEQ ID NO: 615933 - DNA, 25 bp, Rattus norvegicus
tgatttctataccatctgttgcaat

SEQ ID NO: 615934 - DNA, 25 bp, Rattus norvegicus
tgatttctatacgatctgttgcaat

SEQ ID NO: 615935 - DNA, 25 bp, Rattus norvegicus
tgatttctatccacagtcagccttc

SEQ ID NO: 615936 - DNA, 25 bp, Rattus norvegicus
tgatttctatcctcagtcagccttc

SEQ ID NO: 615937 - DNA, 25 bp, Rattus norvegicus
tgatttctcctaaactgtgggctat

SEQ ID NO: 615938 - DNA, 25 bp, Rattus norvegicus
tgatttctcctatactgtgggctat

SEQ ID NO: 615939 - DNA, 25 bp, Rattus norvegicus
tgatttctctacctcaactgtgtgg

SEQ ID NO: 615940 - DNA, 25 bp, Rattus norvegicus
tgatttctctacgtcaactgtgtgg

SEQ ID NO: 615941 - DNA, 25 bp, Rattus norvegicus
tgatttctctgtcagcgtcggcatt

SEQ ID NO: 615942 - DNA, 25 bp, Rattus norvegicus
tgatttctctgtgagcgtcggcatt

SEQ ID NO: 615943 - DNA, 25 bp, Rattus norvegicus
tgatttctgaggaccatctggcatg

SEQ ID NO: 615944 - DNA, 25 bp, Rattus norvegicus
tgatttctgaggtccatctggcatg

SEQ ID NO: 615945 - DNA, 25 bp, Rattus norvegicus
tgatttctgcctatgacgaccacca

SEQ ID NO: 615946 - DNA, 25 bp, Rattus norvegicus
tgatttctgcctttgacgaccacca

SEQ ID NO: 615947 - DNA, 25 bp, Rattus norvegicus
tgatttctgctgcatctttgactaa

SEQ ID NO: 615948 - DNA, 25 bp, Rattus norvegicus
tgatttctgctggatctttgactaa

SEQ ID NO: 615949 - DNA, 25 bp, Rattus norvegicus
tgatttctgcttcagtctaccttac

SEQ ID NO: 615950 - DNA, 25 bp, Rattus norvegicus
tgatttctgcttgagtctaccttac

SEQ ID NO: 615951 - DNA, 25 bp, Rattus norvegicus
tgatttctggctataggatcccctt

SEQ ID NO: 615952 - DNA, 25 bp, Rattus norvegicus
tgatttctggctttaggatcccctt

SEQ ID NO: 615953 - DNA, 25 bp, Rattus norvegicus
tgatttctgtatacatcctcccagg

SEQ ID NO: 615954 - DNA, 25 bp, Rattus norvegicus
tgatttctgtattcatcctcccagg

SEQ ID NO: 615955 - DNA, 25 bp, Rattus norvegicus
tgatttctgtggaccttgtggccag

SEQ ID NO: 615956 - DNA, 25 bp, Rattus norvegicus
tgatttctgtggtccttgtggccag

SEQ ID NO: 615957 - DNA, 25 bp, Rattus norvegicus
tgatttcttacacgctacgtttgga

SEQ ID NO: 615958 - DNA, 25 bp, Rattus norvegicus
tgatttcttacaggctacgtttgga

SEQ ID NO: 615959 - DNA, 25 bp, Rattus norvegicus
tgatttcttatacccatttttgccc

SEQ ID NO: 615960 - DNA, 25 bp, Rattus norvegicus
tgatttcttatagccatttttgccc

SEQ ID NO: 615961 - DNA, 25 bp, Rattus norvegicus
tgatttcttcacacagacagctggc

SEQ ID NO: 615962 - DNA, 25 bp, Rattus norvegicus
tgatttcttcactcagacagctggc

SEQ ID NO: 615963 - DNA, 25 bp, Rattus norvegicus
tgatttcttgataggctggttgctt

SEQ ID NO: 615964 - DNA, 25 bp, Rattus norvegicus
tgatttcttgattggctggttgctt

SEQ ID NO: 615965 - DNA, 25 bp, Rattus norvegicus
tgatttcttgttaactcttgcccta

SEQ ID NO: 615966 - DNA, 25 bp, Rattus norvegicus
tgatttcttgtttactcttgcccta

SEQ ID NO: 615967 - DNA, 25 bp, Rattus norvegicus
tgatttctttgtatgtgttgacggt

SEQ ID NO: 615968 - DNA, 25 bp, Rattus norvegicus
tgatttctttgtttgtgttgacggt

SEQ ID NO: 615969 - DNA, 25 bp, Rattus norvegicus
tgatttcttttgaaccagccacgtc

SEQ ID NO: 615970 - DNA, 25 bp, Rattus norvegicus
tgatttcttttgtaccagccacgtc

SEQ ID NO: 615971 - DNA, 25 bp, Rattus norvegicus
tgatttgaactgaaagggcttaact

SEQ ID NO: 615972 - DNA, 25 bp, Rattus norvegicus
tgatttgaactgtaagggcttaact

SEQ ID NO: 615973 - DNA, 25 bp, Rattus norvegicus
tgatttgaagctacctgctgtgcct

SEQ ID NO: 615974 - DNA, 25 bp, Rattus norvegicus
tgatttgaagcttcctgctgtgcct

SEQ ID NO: 615975 - DNA, 25 bp, Rattus norvegicus
tgatttgaaggtctagccttgcctt

SEQ ID NO: 615976 - DNA, 25 bp, Rattus norvegicus
tgatttgaaggtgtagccttgcctt

SEQ ID NO: 615977 - DNA, 25 bp, Rattus norvegicus
tgatttgaatatagcccacttgaat

SEQ ID NO: 615978 - DNA, 25 bp, Rattus norvegicus
tgatttgaatattgcccacttgaat

SEQ ID NO: 615979 - DNA, 25 bp, Rattus norvegicus
tgatttgcacataggccacttccca

SEQ ID NO: 615980 - DNA, 25 bp, Rattus norvegicus
tgatttgcacattggccacttccca

SEQ ID NO: 615981 - DNA, 25 bp, Rattus norvegicus
tgatttgcatgtatattccctagaa

SEQ ID NO: 615982 - DNA, 25 bp, Rattus norvegicus
tgatttgcatgtttattccctagaa

SEQ ID NO: 615983 - DNA, 25 bp, Rattus norvegicus
tgatttgcccaaatccagtttttag

SEQ ID NO: 615984 - DNA, 25 bp, Rattus norvegicus
tgatttgcccaattccagtttttag

SEQ ID NO: 615985 - DNA, 25 bp, Rattus norvegicus
tgatttgcttgaatcctacacttgg

SEQ ID NO: 615986 - DNA, 25 bp, Rattus norvegicus
tgatttgcttgattcctacacttgg

SEQ ID NO: 615987 - DNA, 25 bp, Rattus norvegicus
tgatttggaccacagccttaggatc

SEQ ID NO: 615988 - DNA, 25 bp, Rattus norvegicus
tgatttggaccagagccttaggatc

SEQ ID NO: 615989 - DNA, 25 bp, Rattus norvegicus
tgatttgggacacatcctgcctcac

SEQ ID NO: 615990 - DNA, 25 bp, Rattus norvegicus
tgatttgggacagatcctgcctcac

SEQ ID NO: 615991 - DNA, 25 bp, Rattus norvegicus
tgatttggttgcactttagaacatt

SEQ ID NO: 615992 - DNA, 25 bp, Rattus norvegicus
tgatttggttgctctttagaacatt

SEQ ID NO: 615993 - DNA, 25 bp, Rattus norvegicus
tgatttgtatgcctggctctgctag

SEQ ID NO: 615994 - DNA, 25 bp, Rattus norvegicus
tgatttgtatgcgtggctctgctag

SEQ ID NO: 615995 - DNA, 25 bp, Rattus norvegicus
tgatttgtcagcaagcctttggagg

SEQ ID NO: 615996 - DNA, 25 bp, Rattus norvegicus
tgatttgtcagctagcctttggagg

SEQ ID NO: 615997 - DNA, 25 bp, Rattus norvegicus
tgatttgtgatcctcccagcatata

SEQ ID NO: 615998 - DNA, 25 bp, Rattus norvegicus
tgatttgtgatcgtcccagcatata

SEQ ID NO: 615999 - DNA, 25 bp, Rattus norvegicus
tgatttgttgtaacacttcagggtg

SEQ ID NO: 616000 - DNA, 25 bp, Rattus norvegicus
tgatttgttgtatcacttcagggtg

SEQ ID NO: 616001 - DNA, 25 bp, Rattus norvegicus
tgattttaaaccatcccgacaaagg

SEQ ID NO: 616002 - DNA, 25 bp, Rattus norvegicus
tgattttaaaccttcccgacaaagg

SEQ ID NO: 616003 - DNA, 25 bp, Rattus norvegicus
tgattttaaagtaccctccacgaat

SEQ ID NO: 616004 - DNA, 25 bp, Rattus norvegicus
tgattttaaagttccctccacgaat

SEQ ID NO: 616005 - DNA, 25 bp, Rattus norvegicus
tgattttaacgacttcccagtccct

SEQ ID NO: 616006 - DNA, 25 bp, Rattus norvegicus
tgattttaacgagttcccagtccct

SEQ ID NO: 616007 - DNA, 25 bp, Rattus norvegicus
tgattttacaccaacactgctattg

SEQ ID NO: 616008 - DNA, 25 bp, Rattus norvegicus
tgattttacacctacactgctattg

SEQ ID NO: 616009 - DNA, 25 bp, Rattus norvegicus
tgattttacatgacgctgcttgagc

SEQ ID NO: 616010 - DNA, 25 bp, Rattus norvegicus
tgattttacatgtcgctgcttgagc

SEQ ID NO: 616011 - DNA, 25 bp, Rattus norvegicus
tgattttaccttcgaccccttcatg

SEQ ID NO: 616012 - DNA, 25 bp, Rattus norvegicus
tgattttaccttggaccccttcatg

SEQ ID NO: 616013 - DNA, 25 bp, Rattus norvegicus
tgattttactcgacgtgtcctccat

SEQ ID NO: 616014 - DNA, 25 bp, Rattus norvegicus
tgattttactcgtcgtgtcctccat

SEQ ID NO: 616015 - DNA, 25 bp, Rattus norvegicus
tgattttagcaaagtctttcccctc

SEQ ID NO: 616016 - DNA, 25 bp, Rattus norvegicus
tgattttagcaatgtctttcccctc

SEQ ID NO: 616017 - DNA, 25 bp, Rattus norvegicus
tgattttagttgcaaaacccatgga

SEQ ID NO: 616018 - DNA, 25 bp, Rattus norvegicus
tgattttagttggaaaacccatgga

SEQ ID NO: 616019 - DNA, 25 bp, Rattus norvegicus
tgattttatcagcttgctacacgga

SEQ ID NO: 616020 - DNA, 25 bp, Rattus norvegicus
tgattttatcaggttgctacacgga

SEQ ID NO: 616021 - DNA, 25 bp, Rattus norvegicus
tgattttcagatatctgggcccttc

SEQ ID NO: 616022 - DNA, 25 bp, Rattus norvegicus
tgattttcagatttctgggcccttc

SEQ ID NO: 616023 - DNA, 25 bp, Rattus norvegicus
tgattttcccctattcttctaggtg

SEQ ID NO: 616024 - DNA, 25 bp, Rattus norvegicus
tgattttccccttttcttctaggtg

SEQ ID NO: 616025 - DNA, 25 bp, Rattus norvegicus
tgattttcccgtaatctcagcccgg

SEQ ID NO: 616026 - DNA, 25 bp, Rattus norvegicus
tgattttcccgttatctcagcccgg

SEQ ID NO: 616027 - DNA, 25 bp, Rattus norvegicus
tgattttccgggattaactgtagca

SEQ ID NO: 616028 - DNA, 25 bp, Rattus norvegicus
tgattttccgggtttaactgtagca

SEQ ID NO: 616029 - DNA, 25 bp, Rattus norvegicus
tgattttcctacaattctgtccttc

SEQ ID NO: 616030 - DNA, 25 bp, Rattus norvegicus
tgattttcctacagacttcccagcc

SEQ ID NO: 616031 - DNA, 25 bp, Rattus norvegicus
tgattttcctactattctgtccttc

SEQ ID NO: 616032 - DNA, 25 bp, Rattus norvegicus
tgattttcctactgacttcccagcc

SEQ ID NO: 616033 - DNA, 25 bp, Rattus norvegicus
tgattttcctccaacagtgcattaa

SEQ ID NO: 616034 - DNA, 25 bp, Rattus norvegicus
tgattttcctcctacagtgcattaa

SEQ ID NO: 616035 - DNA, 25 bp, Rattus norvegicus
tgattttcctctcgcctggtaccag

SEQ ID NO: 616036 - DNA, 25 bp, Rattus norvegicus
tgattttcctctggcctggtaccag

SEQ ID NO: 616037 - DNA, 25 bp, Rattus norvegicus
tgattttctctcactgtattagaaa

SEQ ID NO: 616038 - DNA, 25 bp, Rattus norvegicus
tgattttctctctctgtattagaaa

SEQ ID NO: 616039 - DNA, 25 bp, Rattus norvegicus
tgattttctcttagccagcactatc

SEQ ID NO: 616040 - DNA, 25 bp, Rattus norvegicus
tgattttctctttgccagcactatc

SEQ ID NO: 616041 - DNA, 25 bp, Rattus norvegicus
tgattttgcactctctggaaaacca

SEQ ID NO: 616042 - DNA, 25 bp, Rattus norvegicus
tgattttgcactgtctggaaaacca

SEQ ID NO: 616043 - DNA, 25 bp, Rattus norvegicus
tgattttgctctccctttctcttac

SEQ ID NO: 616044 - DNA, 25 bp, Rattus norvegicus
tgattttgctctgcctttctcttac

SEQ ID NO: 616045 - DNA, 25 bp, Rattus norvegicus
tgattttggcttacccctcatcaga

SEQ ID NO: 616046 - DNA, 25 bp, Rattus norvegicus
tgattttggctttcccctcatcaga

SEQ ID NO: 616047 - DNA, 25 bp, Rattus norvegicus
tgattttgtggaagcccttgtgtct

SEQ ID NO: 616048 - DNA, 25 bp, Rattus norvegicus
tgattttgtggatgcccttgtgtct

SEQ ID NO: 616049 - DNA, 25 bp, Rattus norvegicus
tgatttttaaaacacccagaggcca

SEQ ID NO: 616050 - DNA, 25 bp, Rattus norvegicus
tgatttttaaaacatttctccctga

SEQ ID NO: 616051 - DNA, 25 bp, Rattus norvegicus
tgatttttaaaagacccagaggcca

SEQ ID NO: 616052 - DNA, 25 bp, Rattus norvegicus
tgatttttaaaagatttctccctga

SEQ ID NO: 616053 - DNA, 25 bp, Rattus norvegicus
tgatttttaatgctgaagtgttccc

SEQ ID NO: 616054 - DNA, 25 bp, Rattus norvegicus
tgatttttaatggtgaagtgttccc

SEQ ID NO: 616055 - DNA, 25 bp, Rattus norvegicus
tgatttttacctaccctttggcaag

SEQ ID NO: 616056 - DNA, 25 bp, Rattus norvegicus
tgatttttaccttccctttggcaag

SEQ ID NO: 616057 - DNA, 25 bp, Rattus norvegicus
tgatttttcaccatcttcaggctgg

SEQ ID NO: 616058 - DNA, 25 bp, Rattus norvegicus
tgatttttcaccttcttcaggctgg

SEQ ID NO: 616059 - DNA, 25 bp, Rattus norvegicus
tgatttttcactagactcgggccaa

SEQ ID NO: 616060 - DNA, 25 bp, Rattus norvegicus
tgatttttcacttgactcgggccaa

SEQ ID NO: 616061 - DNA, 25 bp, Rattus norvegicus
tgatttttccaactccaggttcctg

SEQ ID NO: 616062 - DNA, 25 bp, Rattus norvegicus
tgatttttccaagtccaggttcctg

SEQ ID NO: 616063 - DNA, 25 bp, Rattus norvegicus
tgatttttcccaattggtgtccttc

SEQ ID NO: 616064 - DNA, 25 bp, Rattus norvegicus
tgatttttcccatttggtgtccttc

SEQ ID NO: 616065 - DNA, 25 bp, Rattus norvegicus
tgatttttctagatgtgtctgctct

SEQ ID NO: 616066 - DNA, 25 bp, Rattus norvegicus
tgatttttctagttgtgtctgctct

SEQ ID NO: 616067 - DNA, 25 bp, Rattus norvegicus
tgatttttctttagtgtcttgctga

SEQ ID NO: 616068 - DNA, 25 bp, Rattus norvegicus
tgatttttcttttgtgtcttgctga

SEQ ID NO: 616069 - DNA, 25 bp, Rattus norvegicus
tgatttttgttacggtttggagctt

SEQ ID NO: 616070 - DNA, 25 bp, Rattus norvegicus
tgatttttgttagggtttggagctt

SEQ ID NO: 616071 - DNA, 25 bp, Rattus norvegicus
tgcaaaaatcagacctctcggcgcg

SEQ ID NO: 616072 - DNA, 25 bp, Rattus norvegicus
tgcaaaaatcagtcctctcggcgcg

SEQ ID NO: 616073 - DNA, 25 bp, Rattus norvegicus
tgcaaaacaaatcggtatacccttt

SEQ ID NO: 616074 - DNA, 25 bp, Rattus norvegicus
tgcaaaacaaatgggtatacccttt

SEQ ID NO: 616075 - DNA, 25 bp, Rattus norvegicus
tgcaaaaccataccatttccataac

SEQ ID NO: 616076 - DNA, 25 bp, Rattus norvegicus
tgcaaaaccatagcatttccataac

SEQ ID NO: 616077 - DNA, 25 bp, Rattus norvegicus
tgcaaaacccttctagattggcctc

SEQ ID NO: 616078 - DNA, 25 bp, Rattus norvegicus
tgcaaaacccttgtagattggcctc

SEQ ID NO: 616079 - DNA, 25 bp, Rattus norvegicus
tgcaaaacgctgacgtctcgagaac

SEQ ID NO: 616080 - DNA, 25 bp, Rattus norvegicus
tgcaaaacgctgtcgtctcgagaac

SEQ ID NO: 616081 - DNA, 25 bp, Rattus norvegicus
tgcaaaacgtcaacgttggtccgtt

SEQ ID NO: 616082 - DNA, 25 bp, Rattus norvegicus
tgcaaaacgtcatcgttggtccgtt

SEQ ID NO: 616083 - DNA, 25 bp, Rattus norvegicus
tgcaaaatgcctactttaactcttt

SEQ ID NO: 616084 - DNA, 25 bp, Rattus norvegicus
tgcaaaatgccttctttaactcttt

SEQ ID NO: 616085 - DNA, 25 bp, Rattus norvegicus
tgcaaaatgctacactccacaaaag

SEQ ID NO: 616086 - DNA, 25 bp, Rattus norvegicus
tgcaaaatgctagactccacaaaag

SEQ ID NO: 616087 - DNA, 25 bp, Rattus norvegicus
tgcaaacacaatacccaggcgtcag

SEQ ID NO: 616088 - DNA, 25 bp, Rattus norvegicus
tgcaaacacaattcccaggcgtcag

SEQ ID NO: 616089 - DNA, 25 bp, Rattus norvegicus
tgcaaacacactagcttcctggttg

SEQ ID NO: 616090 - DNA, 25 bp, Rattus norvegicus
tgcaaacacacttgcttcctggttg

SEQ ID NO: 616091 - DNA, 25 bp, Rattus norvegicus
tgcaaacacggtatcaccaatcttc

SEQ ID NO: 616092 - DNA, 25 bp, Rattus norvegicus
tgcaaacacggtttcaccaatcttc

SEQ ID NO: 616093 - DNA, 25 bp, Rattus norvegicus
tgcaaacactaacactcctcaaatg

SEQ ID NO: 616094 - DNA, 25 bp, Rattus norvegicus
tgcaaacactaagactcctcaaatg

SEQ ID NO: 616095 - DNA, 25 bp, Rattus norvegicus
tgcaaacagatacaacctaccctat

SEQ ID NO: 616096 - DNA, 25 bp, Rattus norvegicus
tgcaaacagatagaacctaccctat

SEQ ID NO: 616097 - DNA, 25 bp, Rattus norvegicus
tgcaaacagcaactgcctcttcggt

SEQ ID NO: 616098 - DNA, 25 bp, Rattus norvegicus
tgcaaacagcaagtgcctcttcggt

SEQ ID NO: 616099 - DNA, 25 bp, Rattus norvegicus
tgcaaacagtctattcacctcgatc

SEQ ID NO: 616100 - DNA, 25 bp, Rattus norvegicus
tgcaaacagtcttttcacctcgatc

SEQ ID NO: 616101 - DNA, 25 bp, Rattus norvegicus
tgcaaacataacactaccacacggt

SEQ ID NO: 616102 - DNA, 25 bp, Rattus norvegicus
tgcaaacataactctaccacacggt

SEQ ID NO: 616103 - DNA, 25 bp, Rattus norvegicus
tgcaaaccactcctgaccttaagaa

SEQ ID NO: 616104 - DNA, 25 bp, Rattus norvegicus
tgcaaaccactcgtgaccttaagaa

SEQ ID NO: 616105 - DNA, 25 bp, Rattus norvegicus
tgcaaaccaggactctcttcaggct

SEQ ID NO: 616106 - DNA, 25 bp, Rattus norvegicus
tgcaaaccaggagtctcttcaggct

SEQ ID NO: 616107 - DNA, 25 bp, Rattus norvegicus
tgcaaacccctcacaaatatcaagt

SEQ ID NO: 616108 - DNA, 25 bp, Rattus norvegicus
tgcaaacccctctcaaatatcaagt

SEQ ID NO: 616109 - DNA, 25 bp, Rattus norvegicus
tgcaaacgaaagatgacctattact

SEQ ID NO: 616110 - DNA, 25 bp, Rattus norvegicus
tgcaaacgaaagttgacctattact

SEQ ID NO: 616111 - DNA, 25 bp, Rattus norvegicus
tgcaaacgactcatccgaagctgtg

SEQ ID NO: 616112 - DNA, 25 bp, Rattus norvegicus
tgcaaacgactcttccgaagctgtg

SEQ ID NO: 616113 - DNA, 25 bp, Rattus norvegicus
tgcaaacgatcacgactggtcccat

SEQ ID NO: 616114 - DNA, 25 bp, Rattus norvegicus
tgcaaacgatcaggactggtcccat

SEQ ID NO: 616115 - DNA, 25 bp, Rattus norvegicus
tgcaaacgggtgatctgtccggtac

SEQ ID NO: 616116 - DNA, 25 bp, Rattus norvegicus
tgcaaacgggtgttctgtccggtac

SEQ ID NO: 616117 - DNA, 25 bp, Rattus norvegicus
tgcaaactcaccctgagtcagcgac

SEQ ID NO: 616118 - DNA, 25 bp, Rattus norvegicus
tgcaaactcaccgtgagtcagcgac

SEQ ID NO: 616119 - DNA, 25 bp, Rattus norvegicus
tgcaaactccacaaactggcagcag

SEQ ID NO: 616120 - DNA, 25 bp, Rattus norvegicus
tgcaaactccactaactggcagcag

SEQ ID NO: 616121 - DNA, 25 bp, Rattus norvegicus
tgcaaactgctcaaacgtgacctac

SEQ ID NO: 616122 - DNA, 25 bp, Rattus norvegicus
tgcaaactgctctaacgtgacctac

SEQ ID NO: 616123 - DNA, 25 bp, Rattus norvegicus
tgcaaagaccttagctaggcaagct

SEQ ID NO: 616124 - DNA, 25 bp, Rattus norvegicus
tgcaaagacctttgctaggcaagct

SEQ ID NO: 616125 - DNA, 25 bp, Rattus norvegicus
tgcaaagacggcacttacatcatgt

SEQ ID NO: 616126 - DNA, 25 bp, Rattus norvegicus
tgcaaagacggctcttacatcatgt

SEQ ID NO: 616127 - DNA, 25 bp, Rattus norvegicus
tgcaaagagttcagtctgccgccgt

SEQ ID NO: 616128 - DNA, 25 bp, Rattus norvegicus
tgcaaagagttctgtctgccgccgt

SEQ ID NO: 616129 - DNA, 25 bp, Rattus norvegicus
tgcaaagatcaaagcttgtatataa

SEQ ID NO: 616130 - DNA, 25 bp, Rattus norvegicus
tgcaaagatcaatgcttgtatataa

SEQ ID NO: 616131 - DNA, 25 bp, Rattus norvegicus
tgcaaagcaagacctgaagcccact

SEQ ID NO: 616132 - DNA, 25 bp, Rattus norvegicus
tgcaaagcaagagctgaagcccact

SEQ ID NO: 616133 - DNA, 25 bp, Rattus norvegicus
tgcaaagcaggtccttttccttgac

SEQ ID NO: 616134 - DNA, 25 bp, Rattus norvegicus
tgcaaagcaggtgcttttccttgac

SEQ ID NO: 616135 - DNA, 25 bp, Rattus norvegicus
tgcaaagcccagctaccgagggaat

SEQ ID NO: 616136 - DNA, 25 bp, Rattus norvegicus
tgcaaagcccaggtaccgagggaat

SEQ ID NO: 616137 - DNA, 25 bp, Rattus norvegicus
tgcaaagcccctacttccagagtag

SEQ ID NO: 616138 - DNA, 25 bp, Rattus norvegicus
tgcaaagccccttcttccagagtag

SEQ ID NO: 616139 - DNA, 25 bp, Rattus norvegicus
tgcaaagcgcacatctgccttcatt

SEQ ID NO: 616140 - DNA, 25 bp, Rattus norvegicus
tgcaaagcgcacttctgccttcatt

SEQ ID NO: 616141 - DNA, 25 bp, Rattus norvegicus
tgcaaagcgtccaggccaggcacaa

SEQ ID NO: 616142 - DNA, 25 bp, Rattus norvegicus
tgcaaagcgtcctggccaggcacaa

SEQ ID NO: 616143 - DNA, 25 bp, Rattus norvegicus
tgcaaagctcccaccgaaaggtgtg

SEQ ID NO: 616144 - DNA, 25 bp, Rattus norvegicus
tgcaaagctccctccgaaaggtgtg

SEQ ID NO: 616145 - DNA, 25 bp, Rattus norvegicus
tgcaaagctgcactggagggcccca

SEQ ID NO: 616146 - DNA, 25 bp, Rattus norvegicus
tgcaaagctgcagtggagggcccca

SEQ ID NO: 616147 - DNA, 25 bp, Rattus norvegicus
tgcaaaggtcccagtggcactgggt

SEQ ID NO: 616148 - DNA, 25 bp, Rattus norvegicus
tgcaaaggtccctgtggcactgggt

SEQ ID NO: 616149 - DNA, 25 bp, Rattus norvegicus
tgcaaaggtcctccttctacaggat

SEQ ID NO: 616150 - DNA, 25 bp, Rattus norvegicus
tgcaaaggtcctgcttctacaggat

SEQ ID NO: 616151 - DNA, 25 bp, Rattus norvegicus
tgcaaaggtctgctaccttcttctg

SEQ ID NO: 616152 - DNA, 25 bp, Rattus norvegicus
tgcaaaggtctggtaccttcttctg

SEQ ID NO: 616153 - DNA, 25 bp, Rattus norvegicus
tgcaaagtactacacatgacatcag

SEQ ID NO: 616154 - DNA, 25 bp, Rattus norvegicus
tgcaaagtactagacatgacatcag

SEQ ID NO: 616155 - DNA, 25 bp, Rattus norvegicus
tgcaaagtgcaaaactccctaaccc

SEQ ID NO: 616156 - DNA, 25 bp, Rattus norvegicus
tgcaaagtgcaatactccctaaccc

SEQ ID NO: 616157 - DNA, 25 bp, Rattus norvegicus
tgcaaagtttctaccttgcttacag

SEQ ID NO: 616158 - DNA, 25 bp, Rattus norvegicus
tgcaaagtttcttccttgcttacag

SEQ ID NO: 616159 - DNA, 25 bp, Rattus norvegicus
tgcaaataaagtcacccgaccctgg

SEQ ID NO: 616160 - DNA, 25 bp, Rattus norvegicus
tgcaaataaagtgacccgaccctgg

SEQ ID NO: 616161 - DNA, 25 bp, Rattus norvegicus
tgcaaatacttaacgttcggaccct

SEQ ID NO: 616162 - DNA, 25 bp, Rattus norvegicus
tgcaaatacttatcgttcggaccct

SEQ ID NO: 616163 - DNA, 25 bp, Rattus norvegicus
tgcaaatcgtgtacccacctgaaaa

SEQ ID NO: 616164 - DNA, 25 bp, Rattus norvegicus
tgcaaatcgtgttcccacctgaaaa

SEQ ID NO: 616165 - DNA, 25 bp, Rattus norvegicus
tgcaaatgacctagatccctttttc

SEQ ID NO: 616166 - DNA, 25 bp, Rattus norvegicus
tgcaaatgaccttgatccctttttc

SEQ ID NO: 616167 - DNA, 25 bp, Rattus norvegicus
tgcaaatgagacattctcctggccc

SEQ ID NO: 616168 - DNA, 25 bp, Rattus norvegicus
tgcaaatgagactttctcctggccc

SEQ ID NO: 616169 - DNA, 25 bp, Rattus norvegicus
tgcaaatgatttctgagtgtgtaaa

SEQ ID NO: 616170 - DNA, 25 bp, Rattus norvegicus
tgcaaatgatttgtgagtgtgtaaa

SEQ ID NO: 616171 - DNA, 25 bp, Rattus norvegicus
tgcaaatgccatatcagtgaacaag

SEQ ID NO: 616172 - DNA, 25 bp, Rattus norvegicus
tgcaaatgccatttcagtgaacaag

SEQ ID NO: 616173 - DNA, 25 bp, Rattus norvegicus
tgcaaatgcggccacgggaaattaa

SEQ ID NO: 616174 - DNA, 25 bp, Rattus norvegicus
tgcaaatgcggcgacgggaaattaa

SEQ ID NO: 616175 - DNA, 25 bp, Rattus norvegicus
tgcaaatgctatactcccttacata

SEQ ID NO: 616176 - DNA, 25 bp, Rattus norvegicus
tgcaaatgctattctcccttacata

SEQ ID NO: 616177 - DNA, 25 bp, Rattus norvegicus
tgcaaatggataacaccatctgaac

SEQ ID NO: 616178 - DNA, 25 bp, Rattus norvegicus
tgcaaatggatatcaccatctgaac

SEQ ID NO: 616179 - DNA, 25 bp, Rattus norvegicus
tgcaaatggatgacagccgctgcct

SEQ ID NO: 616180 - DNA, 25 bp, Rattus norvegicus
tgcaaatggatgtcagccgctgcct

SEQ ID NO: 616181 - DNA, 25 bp, Rattus norvegicus
tgcaaatggccaccattacccttga

SEQ ID NO: 616182 - DNA, 25 bp, Rattus norvegicus
tgcaaatggccagcattacccttga

SEQ ID NO: 616183 - DNA, 25 bp, Rattus norvegicus
tgcaaatgggaaccacggcctgtgt

SEQ ID NO: 616184 - DNA, 25 bp, Rattus norvegicus
tgcaaatgggaagcacggcctgtgt

SEQ ID NO: 616185 - DNA, 25 bp, Rattus norvegicus
tgcaaatgtgtcaccaggctaggct

SEQ ID NO: 616186 - DNA, 25 bp, Rattus norvegicus
tgcaaatgtgtctccaggctaggct

SEQ ID NO: 616187 - DNA, 25 bp, Rattus norvegicus
tgcaaatgtttgctcgcacgccaca

SEQ ID NO: 616188 - DNA, 25 bp, Rattus norvegicus
tgcaaatgtttggtcgcacgccaca

SEQ ID NO: 616189 - DNA, 25 bp, Rattus norvegicus
tgcaaatgttttactctcttgtgga

SEQ ID NO: 616190 - DNA, 25 bp, Rattus norvegicus
tgcaaatgttttctgcctcttcttt

SEQ ID NO: 616191 - DNA, 25 bp, Rattus norvegicus
tgcaaatgttttgtgcctcttcttt

SEQ ID NO: 616192 - DNA, 25 bp, Rattus norvegicus
tgcaaatgtttttctctcttgtgga

SEQ ID NO: 616193 - DNA, 25 bp, Rattus norvegicus
tgcaaattaatcctctcacgactgt

SEQ ID NO: 616194 - DNA, 25 bp, Rattus norvegicus
tgcaaattaatcgtctcacgactgt

SEQ ID NO: 616195 - DNA, 25 bp, Rattus norvegicus
tgcaaattccacatggcctgtgtaa

SEQ ID NO: 616196 - DNA, 25 bp, Rattus norvegicus
tgcaaattccacttggcctgtgtaa

SEQ ID NO: 616197 - DNA, 25 bp, Rattus norvegicus
tgcaaattgagtatctttctcctta

SEQ ID NO: 616198 - DNA, 25 bp, Rattus norvegicus
tgcaaattgagtttctttctcctta

SEQ ID NO: 616199 - DNA, 25 bp, Rattus norvegicus
tgcaaatttgaaatccctttcccca

SEQ ID NO: 616200 - DNA, 25 bp, Rattus norvegicus
tgcaaatttgaattccctttcccca

SEQ ID NO: 616201 - DNA, 25 bp, Rattus norvegicus
tgcaaattttcaccatggatgtgaa

SEQ ID NO: 616202 - DNA, 25 bp, Rattus norvegicus
tgcaaattttcagcatggatgtgaa

SEQ ID NO: 616203 - DNA, 25 bp, Rattus norvegicus
tgcaacaaacccaccaacaagacag

SEQ ID NO: 616204 - DNA, 25 bp, Rattus norvegicus
tgcaacaaaccctccaacaagacag

SEQ ID NO: 616205 - DNA, 25 bp, Rattus norvegicus
tgcaacacagccatagagacattta

SEQ ID NO: 616206 - DNA, 25 bp, Rattus norvegicus
tgcaacacagccttagagacattta

SEQ ID NO: 616207 - DNA, 25 bp, Rattus norvegicus
tgcaacaccgttctttacgagcaac

SEQ ID NO: 616208 - DNA, 25 bp, Rattus norvegicus
tgcaacaccgttgtttacgagcaac

SEQ ID NO: 616209 - DNA, 25 bp, Rattus norvegicus
tgcaacacggtcaccggagctaaaa

SEQ ID NO: 616210 - DNA, 25 bp, Rattus norvegicus
tgcaacacggtctccggagctaaaa

SEQ ID NO: 616211 - DNA, 25 bp, Rattus norvegicus
tgcaacactgcaacggaatccacat

SEQ ID NO: 616212 - DNA, 25 bp, Rattus norvegicus
tgcaacactgcatcggaatccacat

SEQ ID NO: 616213 - DNA, 25 bp, Rattus norvegicus
tgcaacactgtcagaacgcgtcaag

SEQ ID NO: 616214 - DNA, 25 bp, Rattus norvegicus
tgcaacactgtctgaacgcgtcaag

SEQ ID NO: 616215 - DNA, 25 bp, Rattus norvegicus
tgcaacacttacacagcagcaacag

SEQ ID NO: 616216 - DNA, 25 bp, Rattus norvegicus
tgcaacacttactcagcagcaacag

SEQ ID NO: 616217 - DNA, 25 bp, Rattus norvegicus
tgcaacacttctcccaagcgattgg

SEQ ID NO: 616218 - DNA, 25 bp, Rattus norvegicus
tgcaacacttctgccaagcgattgg

SEQ ID NO: 616219 - DNA, 25 bp, Rattus norvegicus
tgcaacagacatacccgggctgagg

SEQ ID NO: 616220 - DNA, 25 bp, Rattus norvegicus
tgcaacagacattcccgggctgagg

SEQ ID NO: 616221 - DNA, 25 bp, Rattus norvegicus
tgcaacagatatattgacccacatg

SEQ ID NO: 616222 - DNA, 25 bp, Rattus norvegicus
tgcaacagatattttgacccacatg

SEQ ID NO: 616223 - DNA, 25 bp, Rattus norvegicus
tgcaacagcagtattcctagactct

SEQ ID NO: 616224 - DNA, 25 bp, Rattus norvegicus
tgcaacagcagttttcctagactct

SEQ ID NO: 616225 - DNA, 25 bp, Rattus norvegicus
tgcaacagctgtcctgaaatttttt

SEQ ID NO: 616226 - DNA, 25 bp, Rattus norvegicus
tgcaacagctgtgctgaaatttttt

SEQ ID NO: 616227 - DNA, 25 bp, Rattus norvegicus
tgcaacaggaggctcactgggcatt

SEQ ID NO: 616228 - DNA, 25 bp, Rattus norvegicus
tgcaacaggagggtcactgggcatt

SEQ ID NO: 616229 - DNA, 25 bp, Rattus norvegicus
tgcaacaggctcaccgcgtttaatc

SEQ ID NO: 616230 - DNA, 25 bp, Rattus norvegicus
tgcaacaggctctccgcgtttaatc

SEQ ID NO: 616231 - DNA, 25 bp, Rattus norvegicus
tgcaacaggtccacgtttcggctca

SEQ ID NO: 616232 - DNA, 25 bp, Rattus norvegicus
tgcaacaggtcctcgtttcggctca

SEQ ID NO: 616233 - DNA, 25 bp, Rattus norvegicus
tgcaacatgagaagtccctgcacca

SEQ ID NO: 616234 - DNA, 25 bp, Rattus norvegicus
tgcaacatgagatgtccctgcacca

SEQ ID NO: 616235 - DNA, 25 bp, Rattus norvegicus
tgcaacatgagtaccacagtggctt

SEQ ID NO: 616236 - DNA, 25 bp, Rattus norvegicus
tgcaacatgagttccacagtggctt

SEQ ID NO: 616237 - DNA, 25 bp, Rattus norvegicus
tgcaacatgccaactcagcttaaag

SEQ ID NO: 616238 - DNA, 25 bp, Rattus norvegicus
tgcaacatgccatctcagcttaaag

SEQ ID NO: 616239 - DNA, 25 bp, Rattus norvegicus
tgcaacatggcacctgtcccatcag

SEQ ID NO: 616240 - DNA, 25 bp, Rattus norvegicus
tgcaacatggcagctgtcccatcag

SEQ ID NO: 616241 - DNA, 25 bp, Rattus norvegicus
tgcaacattccgcttttaactatat

SEQ ID NO: 616242 - DNA, 25 bp, Rattus norvegicus
tgcaacattccggttttaactatat

SEQ ID NO: 616243 - DNA, 25 bp, Rattus norvegicus
tgcaacattgcaagagctagctggg

SEQ ID NO: 616244 - DNA, 25 bp, Rattus norvegicus
tgcaacattgcatgagctagctggg

SEQ ID NO: 616245 - DNA, 25 bp, Rattus norvegicus
tgcaacattgtccttccagagtaag

SEQ ID NO: 616246 - DNA, 25 bp, Rattus norvegicus
tgcaacattgtcgttccagagtaag

SEQ ID NO: 616247 - DNA, 25 bp, Rattus norvegicus
tgcaaccaacccattggttcctgac

SEQ ID NO: 616248 - DNA, 25 bp, Rattus norvegicus
tgcaaccaaccctttggttcctgac

SEQ ID NO: 616249 - DNA, 25 bp, Rattus norvegicus
tgcaaccaacctacagagtcactat

SEQ ID NO: 616250 - DNA, 25 bp, Rattus norvegicus
tgcaaccaaccttcagagtcactat

SEQ ID NO: 616251 - DNA, 25 bp, Rattus norvegicus
tgcaaccaattcaccaggagccttg

SEQ ID NO: 616252 - DNA, 25 bp, Rattus norvegicus
tgcaaccaattctccaggagccttg

SEQ ID NO: 616253 - DNA, 25 bp, Rattus norvegicus
tgcaaccagatgactcggagtttaa

SEQ ID NO: 616254 - DNA, 25 bp, Rattus norvegicus
tgcaaccagatgtctcggagtttaa

SEQ ID NO: 616255 - DNA, 25 bp, Rattus norvegicus
tgcaaccattgcaggacaaaccaga

SEQ ID NO: 616256 - DNA, 25 bp, Rattus norvegicus
tgcaaccattgctggacaaaccaga

SEQ ID NO: 616257 - DNA, 25 bp, Rattus norvegicus
tgcaacccaggaattcaagactagc

SEQ ID NO: 616258 - DNA, 25 bp, Rattus norvegicus
tgcaacccaggacattctagacacg

SEQ ID NO: 616259 - DNA, 25 bp, Rattus norvegicus
tgcaacccaggagattctagacacg

SEQ ID NO: 616260 - DNA, 25 bp, Rattus norvegicus
tgcaacccaggatttcaagactagc

SEQ ID NO: 616261 - DNA, 25 bp, Rattus norvegicus
tgcaacccatgaccatccaggtgag

SEQ ID NO: 616262 - DNA, 25 bp, Rattus norvegicus
tgcaacccatgagcatccaggtgag

SEQ ID NO: 616263 - DNA, 25 bp, Rattus norvegicus
tgcaacccgggcctgcagaactgag

SEQ ID NO: 616264 - DNA, 25 bp, Rattus norvegicus
tgcaacccgggcgtgcagaactgag

SEQ ID NO: 616265 - DNA, 25 bp, Rattus norvegicus
tgcaaccctgatatgctcacatgga

SEQ ID NO: 616266 - DNA, 25 bp, Rattus norvegicus
tgcaaccctgatttgctcacatgga

SEQ ID NO: 616267 - DNA, 25 bp, Rattus norvegicus
tgcaaccctgttaggcatcgagcgg

SEQ ID NO: 616268 - DNA, 25 bp, Rattus norvegicus
tgcaaccctgtttggcatcgagcgg

SEQ ID NO: 616269 - DNA, 25 bp, Rattus norvegicus
tgcaacccttgaaggccagagatga

SEQ ID NO: 616270 - DNA, 25 bp, Rattus norvegicus
tgcaacccttgatggccagagatga

SEQ ID NO: 616271 - DNA, 25 bp, Rattus norvegicus
tgcaaccctttaatatagctcctcg

SEQ ID NO: 616272 - DNA, 25 bp, Rattus norvegicus
tgcaaccctttattatagctcctcg

SEQ ID NO: 616273 - DNA, 25 bp, Rattus norvegicus
tgcaaccgcagccaagatgtctttg

SEQ ID NO: 616274 - DNA, 25 bp, Rattus norvegicus
tgcaaccgcagcgaagatgtctttg

SEQ ID NO: 616275 - DNA, 25 bp, Rattus norvegicus
tgcaaccgccaacctgttgcctaaa

SEQ ID NO: 616276 - DNA, 25 bp, Rattus norvegicus
tgcaaccgccaagctgttgcctaaa

SEQ ID NO: 616277 - DNA, 25 bp, Rattus norvegicus
tgcaacctcaccaatcacagtaaag

SEQ ID NO: 616278 - DNA, 25 bp, Rattus norvegicus
tgcaacctcacctatcacagtaaag

SEQ ID NO: 616279 - DNA, 25 bp, Rattus norvegicus
tgcaacctgcaaagcactcaagagt

SEQ ID NO: 616280 - DNA, 25 bp, Rattus norvegicus
tgcaacctgcaatgcactcaagagt

SEQ ID NO: 616281 - DNA, 25 bp, Rattus norvegicus
tgcaacctgcagcatctcacagatt

SEQ ID NO: 616282 - DNA, 25 bp, Rattus norvegicus
tgcaacctgcaggatctcacagatt

SEQ ID NO: 616283 - DNA, 25 bp, Rattus norvegicus
tgcaacctggctccaagtcaaggaa

SEQ ID NO: 616284 - DNA, 25 bp, Rattus norvegicus
tgcaacctggctgcaagtcaaggaa

SEQ ID NO: 616285 - DNA, 25 bp, Rattus norvegicus
tgcaacgccagcaccattctcagtt

SEQ ID NO: 616286 - DNA, 25 bp, Rattus norvegicus
tgcaacgccagctccattctcagtt

SEQ ID NO: 616287 - DNA, 25 bp, Rattus norvegicus
tgcaacgtagctatcgatggactcc

SEQ ID NO: 616288 - DNA, 25 bp, Rattus norvegicus
tgcaacgtagctttcgatggactcc

SEQ ID NO: 616289 - DNA, 25 bp, Rattus norvegicus
tgcaacgtccctacagggtcatagt

SEQ ID NO: 616290 - DNA, 25 bp, Rattus norvegicus
tgcaacgtcccttcagggtcatagt

SEQ ID NO: 616291 - DNA, 25 bp, Rattus norvegicus
tgcaactacagtagcgaagcgcaaa

SEQ ID NO: 616292 - DNA, 25 bp, Rattus norvegicus
tgcaactacagttgcgaagcgcaaa

SEQ ID NO: 616293 - DNA, 25 bp, Rattus norvegicus
tgcaactagaccaagccggagctgg

SEQ ID NO: 616294 - DNA, 25 bp, Rattus norvegicus
tgcaactagacctagccggagctgg

SEQ ID NO: 616295 - DNA, 25 bp, Rattus norvegicus
tgcaactccggcacatgctatgcta

SEQ ID NO: 616296 - DNA, 25 bp, Rattus norvegicus
tgcaactccggctcatgctatgcta

SEQ ID NO: 616297 - DNA, 25 bp, Rattus norvegicus
tgcaactccttcagtaacacagcct

SEQ ID NO: 616298 - DNA, 25 bp, Rattus norvegicus
tgcaactccttctgtaacacagcct

SEQ ID NO: 616299 - DNA, 25 bp, Rattus norvegicus
tgcaactctggccatagactcggag

SEQ ID NO: 616300 - DNA, 25 bp, Rattus norvegicus
tgcaactctggcgatagactcggag

SEQ ID NO: 616301 - DNA, 25 bp, Rattus norvegicus
tgcaactcttcccatcccaagaaag

SEQ ID NO: 616302 - DNA, 25 bp, Rattus norvegicus
tgcaactcttccgatcccaagaaag

SEQ ID NO: 616303 - DNA, 25 bp, Rattus norvegicus
tgcaactgcaccagctgtcggtcta

SEQ ID NO: 616304 - DNA, 25 bp, Rattus norvegicus
tgcaactgcacctgctgtcggtcta

SEQ ID NO: 616305 - DNA, 25 bp, Rattus norvegicus
tgcaactgctgcatggtgtgcgccg

SEQ ID NO: 616306 - DNA, 25 bp, Rattus norvegicus
tgcaactgctgcttggtgtgcgccg

SEQ ID NO: 616307 - DNA, 25 bp, Rattus norvegicus
tgcaactgtcgtaattcatatcccc

SEQ ID NO: 616308 - DNA, 25 bp, Rattus norvegicus
tgcaactgtcgttattcatatcccc

SEQ ID NO: 616309 - DNA, 25 bp, Rattus norvegicus
tgcaacttagagcagcccttgggag

SEQ ID NO: 616310 - DNA, 25 bp, Rattus norvegicus
tgcaacttagaggagcccttgggag

SEQ ID NO: 616311 - DNA, 25 bp, Rattus norvegicus
tgcaacttagtgctcagcgatgaaa

SEQ ID NO: 616312 - DNA, 25 bp, Rattus norvegicus
tgcaacttagtggtcagcgatgaaa

SEQ ID NO: 616313 - DNA, 25 bp, Rattus norvegicus
tgcaacttgtcacctgaacgcttca

SEQ ID NO: 616314 - DNA, 25 bp, Rattus norvegicus
tgcaacttgtcagctgaacgcttca

SEQ ID NO: 616315 - DNA, 25 bp, Rattus norvegicus
tgcaagaaacttcatccctaacacc

SEQ ID NO: 616316 - DNA, 25 bp, Rattus norvegicus
tgcaagaaacttgatccctaacacc

SEQ ID NO: 616317 - DNA, 25 bp, Rattus norvegicus
tgcaagaacctaccatggctctcct

SEQ ID NO: 616318 - DNA, 25 bp, Rattus norvegicus
tgcaagaacctagcatggctctcct

SEQ ID NO: 616319 - DNA, 25 bp, Rattus norvegicus
tgcaagaagactcaattcaaagctt

SEQ ID NO: 616320 - DNA, 25 bp, Rattus norvegicus
tgcaagaagactgaattcaaagctt

SEQ ID NO: 616321 - DNA, 25 bp, Rattus norvegicus
tgcaagaagctccagggcatgcccg

SEQ ID NO: 616322 - DNA, 25 bp, Rattus norvegicus
tgcaagaagctcgagggcatgcccg

SEQ ID NO: 616323 - DNA, 25 bp, Rattus norvegicus
tgcaagacaaaacctgccccgtggt

SEQ ID NO: 616324 - DNA, 25 bp, Rattus norvegicus
tgcaagacaaaagctgccccgtggt

SEQ ID NO: 616325 - DNA, 25 bp, Rattus norvegicus
tgcaagacagggactcgtggagccc

SEQ ID NO: 616326 - DNA, 25 bp, Rattus norvegicus
tgcaagacagggtctcgtggagccc

SEQ ID NO: 616327 - DNA, 25 bp, Rattus norvegicus
tgcaagacatgcctacactcagtag

SEQ ID NO: 616328 - DNA, 25 bp, Rattus norvegicus
tgcaagacatgcgtacactcagtag

SEQ ID NO: 616329 - DNA, 25 bp, Rattus norvegicus
tgcaagacgcgcagaaattcactct

SEQ ID NO: 616330 - DNA, 25 bp, Rattus norvegicus
tgcaagacgcgctgaaattcactct

SEQ ID NO: 616331 - DNA, 25 bp, Rattus norvegicus
tgcaagactattatcccagagatgg

SEQ ID NO: 616332 - DNA, 25 bp, Rattus norvegicus
tgcaagactattttcccagagatgg

SEQ ID NO: 616333 - DNA, 25 bp, Rattus norvegicus
tgcaagagcaatacctggacgcctg

SEQ ID NO: 616334 - DNA, 25 bp, Rattus norvegicus
tgcaagagcaattcctggacgcctg

SEQ ID NO: 616335 - DNA, 25 bp, Rattus norvegicus
tgcaagagctctattacctgcaaga

SEQ ID NO: 616336 - DNA, 25 bp, Rattus norvegicus
tgcaagagctcttttacctgcaaga

SEQ ID NO: 616337 - DNA, 25 bp, Rattus norvegicus
tgcaagagctgaccatgcgcagtct

SEQ ID NO: 616338 - DNA, 25 bp, Rattus norvegicus
tgcaagagctgagcatgcgcagtct

SEQ ID NO: 616339 - DNA, 25 bp, Rattus norvegicus
tgcaagagtcctctgtgcagcaaaa

SEQ ID NO: 616340 - DNA, 25 bp, Rattus norvegicus
tgcaagagtcctgtgtgcagcaaaa

SEQ ID NO: 616341 - DNA, 25 bp, Rattus norvegicus
tgcaagatatggaagcccagggcaa

SEQ ID NO: 616342 - DNA, 25 bp, Rattus norvegicus
tgcaagatatggtagcccagggcaa

SEQ ID NO: 616343 - DNA, 25 bp, Rattus norvegicus
tgcaagatccgtcaagggcgcttct

SEQ ID NO: 616344 - DNA, 25 bp, Rattus norvegicus
tgcaagatccgtgaagggcgcttct

SEQ ID NO: 616345 - DNA, 25 bp, Rattus norvegicus
tgcaagatggacaggcagactgctt

SEQ ID NO: 616346 - DNA, 25 bp, Rattus norvegicus
tgcaagatggactggcagactgctt

SEQ ID NO: 616347 - DNA, 25 bp, Rattus norvegicus
tgcaagattcttcctgctttccctc

SEQ ID NO: 616348 - DNA, 25 bp, Rattus norvegicus
tgcaagattcttgctgctttccctc

SEQ ID NO: 616349 - DNA, 25 bp, Rattus norvegicus
tgcaagatttccacctgctgggctg

SEQ ID NO: 616350 - DNA, 25 bp, Rattus norvegicus
tgcaagatttcctcctgctgggctg

SEQ ID NO: 616351 - DNA, 25 bp, Rattus norvegicus
tgcaagcaaatcctcaacttccaag

SEQ ID NO: 616352 - DNA, 25 bp, Rattus norvegicus
tgcaagcaaatcgtcaacttccaag

SEQ ID NO: 616353 - DNA, 25 bp, Rattus norvegicus
tgcaagcaaccaaccatacatagaa

SEQ ID NO: 616354 - DNA, 25 bp, Rattus norvegicus
tgcaagcaaccatccatacatagaa

SEQ ID NO: 616355 - DNA, 25 bp, Rattus norvegicus
tgcaagcaacccaatgaggacattt

SEQ ID NO: 616356 - DNA, 25 bp, Rattus norvegicus
tgcaagcaaccctatgaggacattt

SEQ ID NO: 616357 - DNA, 25 bp, Rattus norvegicus
tgcaagcagaacacgcacagccatg

SEQ ID NO: 616358 - DNA, 25 bp, Rattus norvegicus
tgcaagcagaactcgcacagccatg

SEQ ID NO: 616359 - DNA, 25 bp, Rattus norvegicus
tgcaagcatgacatttacttacctt

SEQ ID NO: 616360 - DNA, 25 bp, Rattus norvegicus
tgcaagcatgacttttacttacctt

SEQ ID NO: 616361 - DNA, 25 bp, Rattus norvegicus
tgcaagccagcccaacttttaactg

SEQ ID NO: 616362 - DNA, 25 bp, Rattus norvegicus
tgcaagccagccgaacttttaactg

SEQ ID NO: 616363 - DNA, 25 bp, Rattus norvegicus
tgcaagcccccactaaaattcattg

SEQ ID NO: 616364 - DNA, 25 bp, Rattus norvegicus
tgcaagcccccagtaaaattcattg

SEQ ID NO: 616365 - DNA, 25 bp, Rattus norvegicus
tgcaagccgttcagtgtgctccagg

SEQ ID NO: 616366 - DNA, 25 bp, Rattus norvegicus
tgcaagccgttctgtgtgctccagg

SEQ ID NO: 616367 - DNA, 25 bp, Rattus norvegicus
tgcaagcctcctagtaggactgttg

SEQ ID NO: 616368 - DNA, 25 bp, Rattus norvegicus
tgcaagcctccttgtaggactgttg

SEQ ID NO: 616369 - DNA, 25 bp, Rattus norvegicus
tgcaagcctgtgaaactgatcagca

SEQ ID NO: 616370 - DNA, 25 bp, Rattus norvegicus
tgcaagcctgtgtaactgatcagca

SEQ ID NO: 616371 - DNA, 25 bp, Rattus norvegicus
tgcaagcgctagatctgacagacaa

SEQ ID NO: 616372 - DNA, 25 bp, Rattus norvegicus
tgcaagcgctagttctgacagacaa

SEQ ID NO: 616373 - DNA, 25 bp, Rattus norvegicus
tgcaagctcgtaatttcttacctgg

SEQ ID NO: 616374 - DNA, 25 bp, Rattus norvegicus
tgcaagctcgtattttcttacctgg

SEQ ID NO: 616375 - DNA, 25 bp, Rattus norvegicus
tgcaagctctgtcaggccatctgtc

SEQ ID NO: 616376 - DNA, 25 bp, Rattus norvegicus
tgcaagctctgtgaggccatctgtc

SEQ ID NO: 616377 - DNA, 25 bp, Rattus norvegicus
tgcaagctctttcaagtcttcccac

SEQ ID NO: 616378 - DNA, 25 bp, Rattus norvegicus
tgcaagctctttgaagtcttcccac

SEQ ID NO: 616379 - DNA, 25 bp, Rattus norvegicus
tgcaagctgtttatgaactctacaa

SEQ ID NO: 616380 - DNA, 25 bp, Rattus norvegicus
tgcaagctgtttttgaactctacaa

SEQ ID NO: 616381 - DNA, 25 bp, Rattus norvegicus
tgcaaggacaacagcaaggccccgt

SEQ ID NO: 616382 - DNA, 25 bp, Rattus norvegicus
tgcaaggacaactgcaaggccccgt

SEQ ID NO: 616383 - DNA, 25 bp, Rattus norvegicus
tgcaaggagacccttcttttctttt

SEQ ID NO: 616384 - DNA, 25 bp, Rattus norvegicus
tgcaaggagaccgttcttttctttt

SEQ ID NO: 616385 - DNA, 25 bp, Rattus norvegicus
tgcaaggatccccttcatgctgagg

SEQ ID NO: 616386 - DNA, 25 bp, Rattus norvegicus
tgcaaggatcccgttcatgctgagg

SEQ ID NO: 616387 - DNA, 25 bp, Rattus norvegicus
tgcaaggatcgcagccctggagctg

SEQ ID NO: 616388 - DNA, 25 bp, Rattus norvegicus
tgcaaggatcgctgccctggagctg

SEQ ID NO: 616389 - DNA, 25 bp, Rattus norvegicus
tgcaaggcatgaaacccagagtctg

SEQ ID NO: 616390 - DNA, 25 bp, Rattus norvegicus
tgcaaggcatgatacccagagtctg

SEQ ID NO: 616391 - DNA, 25 bp, Rattus norvegicus
tgcaaggcatgcagtctaatttttt

SEQ ID NO: 616392 - DNA, 25 bp, Rattus norvegicus
tgcaaggcatgctgtctaatttttt

SEQ ID NO: 616393 - DNA, 25 bp, Rattus norvegicus
tgcaaggcattgagcacctggctct

SEQ ID NO: 616394 - DNA, 25 bp, Rattus norvegicus
tgcaaggcattgtgcacctggctct

SEQ ID NO: 616395 - DNA, 25 bp, Rattus norvegicus
tgcaaggcgagtccagccactggtt

SEQ ID NO: 616396 - DNA, 25 bp, Rattus norvegicus
tgcaaggcgagtgcagccactggtt

SEQ ID NO: 616397 - DNA, 25 bp, Rattus norvegicus
tgcaaggctgcccacaaggataact

SEQ ID NO: 616398 - DNA, 25 bp, Rattus norvegicus
tgcaaggctgccgacaaggataact

SEQ ID NO: 616399 - DNA, 25 bp, Rattus norvegicus
tgcaaggctttacttcccctggaat

SEQ ID NO: 616400 - DNA, 25 bp, Rattus norvegicus
tgcaaggctttagttcccctggaat

SEQ ID NO: 616401 - DNA, 25 bp, Rattus norvegicus
tgcaagggaagcaggatttttctcc

SEQ ID NO: 616402 - DNA, 25 bp, Rattus norvegicus
tgcaagggaagctggatttttctcc

SEQ ID NO: 616403 - DNA, 25 bp, Rattus norvegicus
tgcaagggacctactatgcccggga

SEQ ID NO: 616404 - DNA, 25 bp, Rattus norvegicus
tgcaagggaccttctatgcccggga

SEQ ID NO: 616405 - DNA, 25 bp, Rattus norvegicus
tgcaagggccctcagtatctacgag

SEQ ID NO: 616406 - DNA, 25 bp, Rattus norvegicus
tgcaagggccctgagtatctacgag

SEQ ID NO: 616407 - DNA, 25 bp, Rattus norvegicus
tgcaaggtatacactcatctccatg

SEQ ID NO: 616408 - DNA, 25 bp, Rattus norvegicus
tgcaaggtatactctcatctccatg

SEQ ID NO: 616409 - DNA, 25 bp, Rattus norvegicus
tgcaaggtccttcttacgcgtaaat

SEQ ID NO: 616410 - DNA, 25 bp, Rattus norvegicus
tgcaaggtccttgttacgcgtaaat

SEQ ID NO: 616411 - DNA, 25 bp, Rattus norvegicus
tgcaaggtcgacaacttccagggaa

SEQ ID NO: 616412 - DNA, 25 bp, Rattus norvegicus
tgcaaggtcgactacttccagggaa

SEQ ID NO: 616413 - DNA, 25 bp, Rattus norvegicus
tgcaaggtcttcactacctgtggtt

SEQ ID NO: 616414 - DNA, 25 bp, Rattus norvegicus
tgcaaggtcttctctacctgtggtt

SEQ ID NO: 616415 - DNA, 25 bp, Rattus norvegicus
tgcaaggtgcaacgctgtcaggaca

SEQ ID NO: 616416 - DNA, 25 bp, Rattus norvegicus
tgcaaggtgcaaggctgtcaggaca

SEQ ID NO: 616417 - DNA, 25 bp, Rattus norvegicus
tgcaaggttaacactccctgttaga

SEQ ID NO: 616418 - DNA, 25 bp, Rattus norvegicus
tgcaaggttaactctccctgttaga

SEQ ID NO: 616419 - DNA, 25 bp, Rattus norvegicus
tgcaagtaagtaatcctcaggacgg

SEQ ID NO: 616420 - DNA, 25 bp, Rattus norvegicus
tgcaagtaagtattcctcaggacgg

SEQ ID NO: 616421 - DNA, 25 bp, Rattus norvegicus
tgcaagtccattccaaaacacattg

SEQ ID NO: 616422 - DNA, 25 bp, Rattus norvegicus
tgcaagtccattgcaaaacacattg

SEQ ID NO: 616423 - DNA, 25 bp, Rattus norvegicus
tgcaagtctcttcatagccaaaagg

SEQ ID NO: 616424 - DNA, 25 bp, Rattus norvegicus
tgcaagtctcttgatagccaaaagg

SEQ ID NO: 616425 - DNA, 25 bp, Rattus norvegicus
tgcaagtgcacacacgacaggctct

SEQ ID NO: 616426 - DNA, 25 bp, Rattus norvegicus
tgcaagtgcacagacgacaggctct

SEQ ID NO: 616427 - DNA, 25 bp, Rattus norvegicus
tgcaagtggacaatttaacatcaaa

SEQ ID NO: 616428 - DNA, 25 bp, Rattus norvegicus
tgcaagtggacattttaacatcaaa

SEQ ID NO: 616429 - DNA, 25 bp, Rattus norvegicus
tgcaagttactaaagagctgttatc

SEQ ID NO: 616430 - DNA, 25 bp, Rattus norvegicus
tgcaagttactatagagctgttatc

SEQ ID NO: 616431 - DNA, 25 bp, Rattus norvegicus
tgcaagtttcaaccgacaccatacc

SEQ ID NO: 616432 - DNA, 25 bp, Rattus norvegicus
tgcaagtttcaagcgacaccatacc

SEQ ID NO: 616433 - DNA, 25 bp, Rattus norvegicus
tgcaagtttctacaccaggagcgga

SEQ ID NO: 616434 - DNA, 25 bp, Rattus norvegicus
tgcaagtttctagaccaggagcgga

SEQ ID NO: 616435 - DNA, 25 bp, Rattus norvegicus
tgcaataatcgaagtccctggcaga

SEQ ID NO: 616436 - DNA, 25 bp, Rattus norvegicus
tgcaataatcgatgtccctggcaga

SEQ ID NO: 616437 - DNA, 25 bp, Rattus norvegicus
tgcaataattcgacacctggctact

SEQ ID NO: 616438 - DNA, 25 bp, Rattus norvegicus
tgcaataattcgtcacctggctact

SEQ ID NO: 616439 - DNA, 25 bp, Rattus norvegicus
tgcaatacacacacagctcattctg

SEQ ID NO: 616440 - DNA, 25 bp, Rattus norvegicus
tgcaatacacactcagctcattctg

SEQ ID NO: 616441 - DNA, 25 bp, Rattus norvegicus
tgcaatacagcacgactctagaccc

SEQ ID NO: 616442 - DNA, 25 bp, Rattus norvegicus
tgcaatacagcaggactctagaccc

SEQ ID NO: 616443 - DNA, 25 bp, Rattus norvegicus
tgcaatacagtacatgggtccttgt

SEQ ID NO: 616444 - DNA, 25 bp, Rattus norvegicus
tgcaatacagtagatgggtccttgt

SEQ ID NO: 616445 - DNA, 25 bp, Rattus norvegicus
tgcaatatgtgtaacctttccgagg

SEQ ID NO: 616446 - DNA, 25 bp, Rattus norvegicus
tgcaatatgtgtcggtgacatcccc

SEQ ID NO: 616447 - DNA, 25 bp, Rattus norvegicus
tgcaatatgtgtgggtgacatcccc

SEQ ID NO: 616448 - DNA, 25 bp, Rattus norvegicus
tgcaatatgtgttacctttccgagg

SEQ ID NO: 616449 - DNA, 25 bp, Rattus norvegicus
tgcaatattcaaatcctctctccag

SEQ ID NO: 616450 - DNA, 25 bp, Rattus norvegicus
tgcaatattcaattcctctctccag

SEQ ID NO: 616451 - DNA, 25 bp, Rattus norvegicus
tgcaatattctgacaagtgggcctt

SEQ ID NO: 616452 - DNA, 25 bp, Rattus norvegicus
tgcaatattctgtcaagtgggcctt

SEQ ID NO: 616453 - DNA, 25 bp, Rattus norvegicus
tgcaatcagtggattcatcaggtct

SEQ ID NO: 616454 - DNA, 25 bp, Rattus norvegicus
tgcaatcagtggtttcatcaggtct

SEQ ID NO: 616455 - DNA, 25 bp, Rattus norvegicus
tgcaatcatgcaaaccagtaccaga

SEQ ID NO: 616456 - DNA, 25 bp, Rattus norvegicus
tgcaatcatgcataccagtaccaga

SEQ ID NO: 616457 - DNA, 25 bp, Rattus norvegicus
tgcaatccaggcaatgaacggcttt

SEQ ID NO: 616458 - DNA, 25 bp, Rattus norvegicus
tgcaatccaggctatgaacggcttt

SEQ ID NO: 616459 - DNA, 25 bp, Rattus norvegicus
tgcaatcccaacaattacaagactc

SEQ ID NO: 616460 - DNA, 25 bp, Rattus norvegicus
tgcaatcccaactattacaagactc

SEQ ID NO: 616461 - DNA, 25 bp, Rattus norvegicus
tgcaatcccggcactctggaggtgg

SEQ ID NO: 616462 - DNA, 25 bp, Rattus norvegicus
tgcaatcccggctctctggaggtgg

SEQ ID NO: 616463 - DNA, 25 bp, Rattus norvegicus
tgcaatcgattccttattattcaga

SEQ ID NO: 616464 - DNA, 25 bp, Rattus norvegicus
tgcaatcgattcgttattattcaga

SEQ ID NO: 616465 - DNA, 25 bp, Rattus norvegicus
tgcaatcggcagagtgctacctagt

SEQ ID NO: 616466 - DNA, 25 bp, Rattus norvegicus
tgcaatcggcagtgtgctacctagt

SEQ ID NO: 616467 - DNA, 25 bp, Rattus norvegicus
tgcaatctgatgaaaccaggtccaa

SEQ ID NO: 616468 - DNA, 25 bp, Rattus norvegicus
tgcaatctgatgtaaccaggtccaa

SEQ ID NO: 616469 - DNA, 25 bp, Rattus norvegicus
tgcaatctgcgcacgtaccatgatg

SEQ ID NO: 616470 - DNA, 25 bp, Rattus norvegicus
tgcaatctgcgctcgtaccatgatg

SEQ ID NO: 616471 - DNA, 25 bp, Rattus norvegicus
tgcaatcttgtaatgtggcctgaaa

SEQ ID NO: 616472 - DNA, 25 bp, Rattus norvegicus
tgcaatcttgtattgtggcctgaaa

SEQ ID NO: 616473 - DNA, 25 bp, Rattus norvegicus
tgcaatgacagacgcctttgatttt

SEQ ID NO: 616474 - DNA, 25 bp, Rattus norvegicus
tgcaatgacagaggcctttgatttt

SEQ ID NO: 616475 - DNA, 25 bp, Rattus norvegicus
tgcaatgagcttctttcctgcccaa

SEQ ID NO: 616476 - DNA, 25 bp, Rattus norvegicus
tgcaatgagcttgtttcctgcccaa

SEQ ID NO: 616477 - DNA, 25 bp, Rattus norvegicus
tgcaatgatctgagccttctttcta

SEQ ID NO: 616478 - DNA, 25 bp, Rattus norvegicus
tgcaatgatctgtgccttctttcta

SEQ ID NO: 616479 - DNA, 25 bp, Rattus norvegicus
tgcaatgcagctcctctttattttg

SEQ ID NO: 616480 - DNA, 25 bp, Rattus norvegicus
tgcaatgcagctgctctttattttg

SEQ ID NO: 616481 - DNA, 25 bp, Rattus norvegicus
tgcaatgcccacacgatcagaaaag

SEQ ID NO: 616482 - DNA, 25 bp, Rattus norvegicus
tgcaatgcccactcgatcagaaaag

SEQ ID NO: 616483 - DNA, 25 bp, Rattus norvegicus
tgcaatgccctcaagtggtgtactt

SEQ ID NO: 616484 - DNA, 25 bp, Rattus norvegicus
tgcaatgccctctagtggtgtactt

SEQ ID NO: 616485 - DNA, 25 bp, Rattus norvegicus
tgcaatgccctgcagttcttcgact

SEQ ID NO: 616486 - DNA, 25 bp, Rattus norvegicus
tgcaatgccctggagttcttcgact

SEQ ID NO: 616487 - DNA, 25 bp, Rattus norvegicus
tgcaatggatgtaaacggctactct

SEQ ID NO: 616488 - DNA, 25 bp, Rattus norvegicus
tgcaatggatgttaacggctactct

SEQ ID NO: 616489 - DNA, 25 bp, Rattus norvegicus
tgcaatgggacaagcaaagttgact

SEQ ID NO: 616490 - DNA, 25 bp, Rattus norvegicus
tgcaatgggacatgcaaagttgact

SEQ ID NO: 616491 - DNA, 25 bp, Rattus norvegicus
tgcaatggtcttattgtcctctctc

SEQ ID NO: 616492 - DNA, 25 bp, Rattus norvegicus
tgcaatggtctttttgtcctctctc

SEQ ID NO: 616493 - DNA, 25 bp, Rattus norvegicus
tgcaatggttagatacactccgagt

SEQ ID NO: 616494 - DNA, 25 bp, Rattus norvegicus
tgcaatggttagttacactccgagt

SEQ ID NO: 616495 - DNA, 25 bp, Rattus norvegicus
tgcaatggttgcactgctggtcacc

SEQ ID NO: 616496 - DNA, 25 bp, Rattus norvegicus
tgcaatggttgctctgctggtcacc

SEQ ID NO: 616497 - DNA, 25 bp, Rattus norvegicus
tgcaatgtacaaccaccggccatgt

SEQ ID NO: 616498 - DNA, 25 bp, Rattus norvegicus
tgcaatgtacaagcaccggccatgt

SEQ ID NO: 616499 - DNA, 25 bp, Rattus norvegicus
tgcaatgtatctccttacagtcctg

SEQ ID NO: 616500 - DNA, 25 bp, Rattus norvegicus
tgcaatgtatctgcttacagtcctg

SEQ ID NO: 616501 - DNA, 25 bp, Rattus norvegicus
tgcaatgtgttcatcttcctttcat

SEQ ID NO: 616502 - DNA, 25 bp, Rattus norvegicus
tgcaatgtgttcttcttcctttcat

SEQ ID NO: 616503 - DNA, 25 bp, Rattus norvegicus
tgcaatgttctccaatttctgggtt

SEQ ID NO: 616504 - DNA, 25 bp, Rattus norvegicus
tgcaatgttctcgaatttctgggtt

SEQ ID NO: 616505 - DNA, 25 bp, Rattus norvegicus
tgcaattcagaaagtccgtcaccat

SEQ ID NO: 616506 - DNA, 25 bp, Rattus norvegicus
tgcaattcagaatgtccgtcaccat

SEQ ID NO: 616507 - DNA, 25 bp, Rattus norvegicus
tgcaattcccctccggatcgcaggg

SEQ ID NO: 616508 - DNA, 25 bp, Rattus norvegicus
tgcaattcccctgcggatcgcaggg

SEQ ID NO: 616509 - DNA, 25 bp, Rattus norvegicus
tgcaattcggataccctgttcctcc

SEQ ID NO: 616510 - DNA, 25 bp, Rattus norvegicus
tgcaattcggattccctgttcctcc

SEQ ID NO: 616511 - DNA, 25 bp, Rattus norvegicus
tgcaattctagcaggcctagaactc

SEQ ID NO: 616512 - DNA, 25 bp, Rattus norvegicus
tgcaattctagctggcctagaactc

SEQ ID NO: 616513 - DNA, 25 bp, Rattus norvegicus
tgcaattctgctacctcaacctgag

SEQ ID NO: 616514 - DNA, 25 bp, Rattus norvegicus
tgcaattctgcttcctcaacctgag

SEQ ID NO: 616515 - DNA, 25 bp, Rattus norvegicus
tgcaattgcttcaagagtctcacgg

SEQ ID NO: 616516 - DNA, 25 bp, Rattus norvegicus
tgcaattgcttctagagtctcacgg

SEQ ID NO: 616517 - DNA, 25 bp, Rattus norvegicus
tgcaatttcctactcaccaagactc

SEQ ID NO: 616518 - DNA, 25 bp, Rattus norvegicus
tgcaatttcctagtcaccaagactc

SEQ ID NO: 616519 - DNA, 25 bp, Rattus norvegicus
tgcaatttctctctggagcgcttgc

SEQ ID NO: 616520 - DNA, 25 bp, Rattus norvegicus
tgcaatttctctgtggagcgcttgc

SEQ ID NO: 616521 - DNA, 25 bp, Rattus norvegicus
tgcaatttctgtcgtaagtctactg

SEQ ID NO: 616522 - DNA, 25 bp, Rattus norvegicus
tgcaatttctgtggtaagtctactg

SEQ ID NO: 616523 - DNA, 25 bp, Rattus norvegicus
tgcaatttgaggaccaatccttccc

SEQ ID NO: 616524 - DNA, 25 bp, Rattus norvegicus
tgcaatttgaggtccaatccttccc

SEQ ID NO: 616525 - DNA, 25 bp, Rattus norvegicus
tgcaatttttcacttcttccaacct

SEQ ID NO: 616526 - DNA, 25 bp, Rattus norvegicus
tgcaatttttcagttcttccaacct

SEQ ID NO: 616527 - DNA, 25 bp, Rattus norvegicus
tgcacaaaatcaccccatagtgttt

SEQ ID NO: 616528 - DNA, 25 bp, Rattus norvegicus
tgcacaaaatcagcccatagtgttt

SEQ ID NO: 616529 - DNA, 25 bp, Rattus norvegicus
tgcacaaacctccaagacatgtctg

SEQ ID NO: 616530 - DNA, 25 bp, Rattus norvegicus
tgcacaaacctcgaagacatgtctg

SEQ ID NO: 616531 - DNA, 25 bp, Rattus norvegicus
tgcacaaaccttactcaacaccgga

SEQ ID NO: 616532 - DNA, 25 bp, Rattus norvegicus
tgcacaaacctttctcaacaccgga

SEQ ID NO: 616533 - DNA, 25 bp, Rattus norvegicus
tgcacaaactctcagattgggaagg

SEQ ID NO: 616534 - DNA, 25 bp, Rattus norvegicus
tgcacaaactctgagattgggaagg

SEQ ID NO: 616535 - DNA, 25 bp, Rattus norvegicus
tgcacaaagcacaagtctggacagt

SEQ ID NO: 616536 - DNA, 25 bp, Rattus norvegicus
tgcacaaagcactagtctggacagt

SEQ ID NO: 616537 - DNA, 25 bp, Rattus norvegicus
tgcacaaagccacgaaccatctaag

SEQ ID NO: 616538 - DNA, 25 bp, Rattus norvegicus
tgcacaaagccaggaaccatctaag

SEQ ID NO: 616539 - DNA, 25 bp, Rattus norvegicus
tgcacaaagtcaagtcttcacctgg

SEQ ID NO: 616540 - DNA, 25 bp, Rattus norvegicus
tgcacaaagtcatgtcttcacctgg

SEQ ID NO: 616541 - DNA, 25 bp, Rattus norvegicus
tgcacaacactgacccatcataaat

SEQ ID NO: 616542 - DNA, 25 bp, Rattus norvegicus
tgcacaacactgtcccatcataaat

SEQ ID NO: 616543 - DNA, 25 bp, Rattus norvegicus
tgcacaaccacaagagcctgggcat

SEQ ID NO: 616544 - DNA, 25 bp, Rattus norvegicus
tgcacaaccacatgagcctgggcat

SEQ ID NO: 616545 - DNA, 25 bp, Rattus norvegicus
tgcacaactgcgaggccaagttgct

SEQ ID NO: 616546 - DNA, 25 bp, Rattus norvegicus
tgcacaactgcgtggccaagttgct

SEQ ID NO: 616547 - DNA, 25 bp, Rattus norvegicus
tgcacaactttgaggccacacactg

SEQ ID NO: 616548 - DNA, 25 bp, Rattus norvegicus
tgcacaactttgtggccacacactg

SEQ ID NO: 616549 - DNA, 25 bp, Rattus norvegicus
tgcacaagagaacactgtccttcct

SEQ ID NO: 616550 - DNA, 25 bp, Rattus norvegicus
tgcacaagagaagactgtccttcct

SEQ ID NO: 616551 - DNA, 25 bp, Rattus norvegicus
tgcacaagatcacgctatacactag

SEQ ID NO: 616552 - DNA, 25 bp, Rattus norvegicus
tgcacaagatcaggctatacactag

SEQ ID NO: 616553 - DNA, 25 bp, Rattus norvegicus
tgcacaagccggcaaactggctcct

SEQ ID NO: 616554 - DNA, 25 bp, Rattus norvegicus
tgcacaagccgggaaactggctcct

SEQ ID NO: 616555 - DNA, 25 bp, Rattus norvegicus
tgcacaagtggcactagccccaggg

SEQ ID NO: 616556 - DNA, 25 bp, Rattus norvegicus
tgcacaagtggctctagccccaggg

SEQ ID NO: 616557 - DNA, 25 bp, Rattus norvegicus
tgcacaatagcacgtagttttactt

SEQ ID NO: 616558 - DNA, 25 bp, Rattus norvegicus
tgcacaatagcaggtagttttactt

SEQ ID NO: 616559 - DNA, 25 bp, Rattus norvegicus
tgcacaatattcacaccagtctgga

SEQ ID NO: 616560 - DNA, 25 bp, Rattus norvegicus
tgcacaatattctcaccagtctgga

SEQ ID NO: 616561 - DNA, 25 bp, Rattus norvegicus
tgcacaatctgcactctgatctaag

SEQ ID NO: 616562 - DNA, 25 bp, Rattus norvegicus
tgcacaatctgctctctgatctaag

SEQ ID NO: 616563 - DNA, 25 bp, Rattus norvegicus
tgcacaatgactcactcctgtaacc

SEQ ID NO: 616564 - DNA, 25 bp, Rattus norvegicus
tgcacaatgactgactcctgtaacc

SEQ ID NO: 616565 - DNA, 25 bp, Rattus norvegicus
tgcacaatgcacacagaaatggaag

SEQ ID NO: 616566 - DNA, 25 bp, Rattus norvegicus
tgcacaatgcactcagaaatggaag

SEQ ID NO: 616567 - DNA, 25 bp, Rattus norvegicus
tgcacaatggtgcttggctgccatg

SEQ ID NO: 616568 - DNA, 25 bp, Rattus norvegicus
tgcacaatggtggttggctgccatg

SEQ ID NO: 616569 - DNA, 25 bp, Rattus norvegicus
tgcacaatgtgccttattcaccgtt

SEQ ID NO: 616570 - DNA, 25 bp, Rattus norvegicus
tgcacaatgtgcgttattcaccgtt

SEQ ID NO: 616571 - DNA, 25 bp, Rattus norvegicus
tgcacaatgtggaagcgtcctctct

SEQ ID NO: 616572 - DNA, 25 bp, Rattus norvegicus
tgcacaatgtggtagcgtcctctct

SEQ ID NO: 616573 - DNA, 25 bp, Rattus norvegicus
tgcacaatttcaccgacggccttgc

SEQ ID NO: 616574 - DNA, 25 bp, Rattus norvegicus
tgcacaatttcagcgacggccttgc

SEQ ID NO: 616575 - DNA, 25 bp, Rattus norvegicus
tgcacacaatacacagacctacatg

SEQ ID NO: 616576 - DNA, 25 bp, Rattus norvegicus
tgcacacaatactcagacctacatg

SEQ ID NO: 616577 - DNA, 25 bp, Rattus norvegicus
tgcacacacggacggatgcgtctac

SEQ ID NO: 616578 - DNA, 25 bp, Rattus norvegicus
tgcacacacggagggatgcgtctac

SEQ ID NO: 616579 - DNA, 25 bp, Rattus norvegicus
tgcacacactgcatcaacagaattt

SEQ ID NO: 616580 - DNA, 25 bp, Rattus norvegicus
tgcacacactgcttcaacagaattt

SEQ ID NO: 616581 - DNA, 25 bp, Rattus norvegicus
tgcacacacttgatcggccttttct

SEQ ID NO: 616582 - DNA, 25 bp, Rattus norvegicus
tgcacacacttgttcggccttttct

SEQ ID NO: 616583 - DNA, 25 bp, Rattus norvegicus
tgcacacactttaagttgggtaccg

SEQ ID NO: 616584 - DNA, 25 bp, Rattus norvegicus
tgcacacacttttagttgggtaccg

SEQ ID NO: 616585 - DNA, 25 bp, Rattus norvegicus
tgcacacagcatacaagtcctcaag

SEQ ID NO: 616586 - DNA, 25 bp, Rattus norvegicus
tgcacacagcattcaagtcctcaag

SEQ ID NO: 616587 - DNA, 25 bp, Rattus norvegicus
tgcacacagcccactagtatggttt

SEQ ID NO: 616588 - DNA, 25 bp, Rattus norvegicus
tgcacacagccctctagtatggttt

SEQ ID NO: 616589 - DNA, 25 bp, Rattus norvegicus
tgcacacaggatcggtgctgtacca

SEQ ID NO: 616590 - DNA, 25 bp, Rattus norvegicus
tgcacacaggatgggtgctgtacca

SEQ ID NO: 616591 - DNA, 25 bp, Rattus norvegicus
tgcacacagtcaacaccacacagag

SEQ ID NO: 616592 - DNA, 25 bp, Rattus norvegicus
tgcacacagtcatcaccacacagag

SEQ ID NO: 616593 - DNA, 25 bp, Rattus norvegicus
tgcacacatcaaacagtcctaagga

SEQ ID NO: 616594 - DNA, 25 bp, Rattus norvegicus
tgcacacatcaatcagtcctaagga

SEQ ID NO: 616595 - DNA, 25 bp, Rattus norvegicus
tgcacacatcatattcacacatcac

SEQ ID NO: 616596 - DNA, 25 bp, Rattus norvegicus
tgcacacatcattttcacacatcac

SEQ ID NO: 616597 - DNA, 25 bp, Rattus norvegicus
tgcacacatcccatacacatgcata

SEQ ID NO: 616598 - DNA, 25 bp, Rattus norvegicus
tgcacacatcccttacacatgcata

SEQ ID NO: 616599 - DNA, 25 bp, Rattus norvegicus
tgcacacatggtccagaaactgctt

SEQ ID NO: 616600 - DNA, 25 bp, Rattus norvegicus
tgcacacatggtgcagaaactgctt

SEQ ID NO: 616601 - DNA, 25 bp, Rattus norvegicus
tgcacacattggatggagccctgag

SEQ ID NO: 616602 - DNA, 25 bp, Rattus norvegicus
tgcacacattggttggagccctgag

SEQ ID NO: 616603 - DNA, 25 bp, Rattus norvegicus
tgcacaccaaaaatctagcactggg

SEQ ID NO: 616604 - DNA, 25 bp, Rattus norvegicus
tgcacaccaaaattctagcactggg

SEQ ID NO: 616605 - DNA, 25 bp, Rattus norvegicus
tgcacaccaaagacccaaagcttga

SEQ ID NO: 616606 - DNA, 25 bp, Rattus norvegicus
tgcacaccaaagtcccaaagcttga

SEQ ID NO: 616607 - DNA, 25 bp, Rattus norvegicus
tgcacaccactgagaatcgcagcca

SEQ ID NO: 616608 - DNA, 25 bp, Rattus norvegicus
tgcacaccactgtgaatcgcagcca

SEQ ID NO: 616609 - DNA, 25 bp, Rattus norvegicus
tgcacaccagcaatgggaattctgt

SEQ ID NO: 616610 - DNA, 25 bp, Rattus norvegicus
tgcacaccagcattgggaattctgt

SEQ ID NO: 616611 - DNA, 25 bp, Rattus norvegicus
tgcacaccagtgatcggaggcccaa

SEQ ID NO: 616612 - DNA, 25 bp, Rattus norvegicus
tgcacaccagtgttcggaggcccaa

SEQ ID NO: 616613 - DNA, 25 bp, Rattus norvegicus
tgcacaccatctaaaaggtcctcac

SEQ ID NO: 616614 - DNA, 25 bp, Rattus norvegicus
tgcacaccatcttaaaggtcctcac

SEQ ID NO: 616615 - DNA, 25 bp, Rattus norvegicus
tgcacaccatgcagctggctcatag

SEQ ID NO: 616616 - DNA, 25 bp, Rattus norvegicus
tgcacaccatgcctactgagaagag

SEQ ID NO: 616617 - DNA, 25 bp, Rattus norvegicus
tgcacaccatgcgtactgagaagag

SEQ ID NO: 616618 - DNA, 25 bp, Rattus norvegicus
tgcacaccatgctgctggctcatag

SEQ ID NO: 616619 - DNA, 25 bp, Rattus norvegicus
tgcacaccccaaactctgttacaaa

SEQ ID NO: 616620 - DNA, 25 bp, Rattus norvegicus
tgcacaccccaatctctgttacaaa

SEQ ID NO: 616621 - DNA, 25 bp, Rattus norvegicus
tgcacaccctgcacatggccagatt

SEQ ID NO: 616622 - DNA, 25 bp, Rattus norvegicus
tgcacaccctgctcatggccagatt

SEQ ID NO: 616623 - DNA, 25 bp, Rattus norvegicus
tgcacacccttgacatttctttaag

SEQ ID NO: 616624 - DNA, 25 bp, Rattus norvegicus
tgcacacccttgtcatttctttaag

SEQ ID NO: 616625 - DNA, 25 bp, Rattus norvegicus
tgcacaccctttaccgatgaagtag

SEQ ID NO: 616626 - DNA, 25 bp, Rattus norvegicus
tgcacacccttttccgatgaagtag

SEQ ID NO: 616627 - DNA, 25 bp, Rattus norvegicus
tgcacacctgcgaggccaaagtgct

SEQ ID NO: 616628 - DNA, 25 bp, Rattus norvegicus
tgcacacctgcgtggccaaagtgct

SEQ ID NO: 616629 - DNA, 25 bp, Rattus norvegicus
tgcacacctgtaaccacttgtattc

SEQ ID NO: 616630 - DNA, 25 bp, Rattus norvegicus
tgcacacctgtatccacttgtattc

SEQ ID NO: 616631 - DNA, 25 bp, Rattus norvegicus
tgcacacctgtgacatgtctattca

SEQ ID NO: 616632 - DNA, 25 bp, Rattus norvegicus
tgcacacctgtgtcatgtctattca

SEQ ID NO: 616633 - DNA, 25 bp, Rattus norvegicus
tgcacacgcatgattcacagccata

SEQ ID NO: 616634 - DNA, 25 bp, Rattus norvegicus
tgcacacgcatgcatgtctgcacaa

SEQ ID NO: 616635 - DNA, 25 bp, Rattus norvegicus
tgcacacgcatggatgtctgcacaa

SEQ ID NO: 616636 - DNA, 25 bp, Rattus norvegicus
tgcacacgcatgtttcacagccata

SEQ ID NO: 616637 - DNA, 25 bp, Rattus norvegicus
tgcacacgcgtgcttcttgggtttc

SEQ ID NO: 616638 - DNA, 25 bp, Rattus norvegicus
tgcacacgcgtggttcttgggtttc

SEQ ID NO: 616639 - DNA, 25 bp, Rattus norvegicus
tgcacacgggcgagcgtccctacaa

SEQ ID NO: 616640 - DNA, 25 bp, Rattus norvegicus
tgcacacgggcgtgcgtccctacaa

SEQ ID NO: 616641 - DNA, 25 bp, Rattus norvegicus
tgcacacggttcagaatgctgacca

SEQ ID NO: 616642 - DNA, 25 bp, Rattus norvegicus
tgcacacggttctgaatgctgacca

SEQ ID NO: 616643 - DNA, 25 bp, Rattus norvegicus
tgcacacgtggtcgcagacgtctgt

SEQ ID NO: 616644 - DNA, 25 bp, Rattus norvegicus
tgcacacgtggtggcagacgtctgt

SEQ ID NO: 616645 - DNA, 25 bp, Rattus norvegicus
tgcacacgttgcaaccctagaggag

SEQ ID NO: 616646 - DNA, 25 bp, Rattus norvegicus
tgcacacgttgctaccctagaggag

SEQ ID NO: 616647 - DNA, 25 bp, Rattus norvegicus
tgcacactaacccacagtacagttg

SEQ ID NO: 616648 - DNA, 25 bp, Rattus norvegicus
tgcacactaaccgacagtacagttg

SEQ ID NO: 616649 - DNA, 25 bp, Rattus norvegicus
tgcacactcttaatcccagctctgg

SEQ ID NO: 616650 - DNA, 25 bp, Rattus norvegicus
tgcacactcttattcccagctctgg

SEQ ID NO: 616651 - DNA, 25 bp, Rattus norvegicus
tgcacactctttaacagcatgctgt

SEQ ID NO: 616652 - DNA, 25 bp, Rattus norvegicus
tgcacactcttttacagcatgctgt

SEQ ID NO: 616653 - DNA, 25 bp, Rattus norvegicus
tgcacactgagtacccaatgcatgt

SEQ ID NO: 616654 - DNA, 25 bp, Rattus norvegicus
tgcacactgagttcccaatgcatgt

SEQ ID NO: 616655 - DNA, 25 bp, Rattus norvegicus
tgcacactgcacatgacctagagag

SEQ ID NO: 616656 - DNA, 25 bp, Rattus norvegicus
tgcacactgcacttgacctagagag

SEQ ID NO: 616657 - DNA, 25 bp, Rattus norvegicus
tgcacactggctaaaacggcttttg

SEQ ID NO: 616658 - DNA, 25 bp, Rattus norvegicus
tgcacactggcttaaacggcttttg

SEQ ID NO: 616659 - DNA, 25 bp, Rattus norvegicus
tgcacactggtcaggcagctggtta

SEQ ID NO: 616660 - DNA, 25 bp, Rattus norvegicus
tgcacactggtctggcagctggtta

SEQ ID NO: 616661 - DNA, 25 bp, Rattus norvegicus
tgcacactggtgatgccagcactga

SEQ ID NO: 616662 - DNA, 25 bp, Rattus norvegicus
tgcacactggtgttgccagcactga

SEQ ID NO: 616663 - DNA, 25 bp, Rattus norvegicus
tgcacacttcacaactggatgctca

SEQ ID NO: 616664 - DNA, 25 bp, Rattus norvegicus
tgcacacttcactactggatgctca

SEQ ID NO: 616665 - DNA, 25 bp, Rattus norvegicus
tgcacacttcttcggttgatctatg

SEQ ID NO: 616666 - DNA, 25 bp, Rattus norvegicus
tgcacacttcttgggttgatctatg

SEQ ID NO: 616667 - DNA, 25 bp, Rattus norvegicus
tgcacacttgcgctggcatacaggg

SEQ ID NO: 616668 - DNA, 25 bp, Rattus norvegicus
tgcacacttgcggtggcatacaggg

SEQ ID NO: 616669 - DNA, 25 bp, Rattus norvegicus
tgcacactttcactttcccaaaggt

SEQ ID NO: 616670 - DNA, 25 bp, Rattus norvegicus
tgcacactttcagtttcccaaaggt

SEQ ID NO: 616671 - DNA, 25 bp, Rattus norvegicus
tgcacagaaagccttcacactggat

SEQ ID NO: 616672 - DNA, 25 bp, Rattus norvegicus
tgcacagaaagcgttcacactggat

SEQ ID NO: 616673 - DNA, 25 bp, Rattus norvegicus
tgcacagaagcaacagcagccttgt

SEQ ID NO: 616674 - DNA, 25 bp, Rattus norvegicus
tgcacagaagcatcagcagccttgt

SEQ ID NO: 616675 - DNA, 25 bp, Rattus norvegicus
tgcacagacagcaccaaggtcactg

SEQ ID NO: 616676 - DNA, 25 bp, Rattus norvegicus
tgcacagacagctccaaggtcactg

SEQ ID NO: 616677 - DNA, 25 bp, Rattus norvegicus
tgcacagacctgattcatcatatgg

SEQ ID NO: 616678 - DNA, 25 bp, Rattus norvegicus
tgcacagacctgtttcatcatatgg

SEQ ID NO: 616679 - DNA, 25 bp, Rattus norvegicus
tgcacagacgacacaaacccaggat

SEQ ID NO: 616680 - DNA, 25 bp, Rattus norvegicus
tgcacagacgactcaaacccaggat

SEQ ID NO: 616681 - DNA, 25 bp, Rattus norvegicus
tgcacagactcacccacaagtattg

SEQ ID NO: 616682 - DNA, 25 bp, Rattus norvegicus
tgcacagactcagccacaagtattg

SEQ ID NO: 616683 - DNA, 25 bp, Rattus norvegicus
tgcacagagacaccaccttgttgaa

SEQ ID NO: 616684 - DNA, 25 bp, Rattus norvegicus
tgcacagagacagcaccttgttgaa

SEQ ID NO: 616685 - DNA, 25 bp, Rattus norvegicus
tgcacagagagcatgagtgtgtaca

SEQ ID NO: 616686 - DNA, 25 bp, Rattus norvegicus
tgcacagagagcttgagtgtgtaca

SEQ ID NO: 616687 - DNA, 25 bp, Rattus norvegicus
tgcacagatggcacacggggctgaa

SEQ ID NO: 616688 - DNA, 25 bp, Rattus norvegicus
tgcacagatggctcacggggctgaa

SEQ ID NO: 616689 - DNA, 25 bp, Rattus norvegicus
tgcacagcacacaagcttctggaat

SEQ ID NO: 616690 - DNA, 25 bp, Rattus norvegicus
tgcacagcacactagcttctggaat

SEQ ID NO: 616691 - DNA, 25 bp, Rattus norvegicus
tgcacagcacagatgggccatgagt

SEQ ID NO: 616692 - DNA, 25 bp, Rattus norvegicus
tgcacagcacagttgggccatgagt

SEQ ID NO: 616693 - DNA, 25 bp, Rattus norvegicus
tgcacagcactgaagaatcctataa

SEQ ID NO: 616694 - DNA, 25 bp, Rattus norvegicus
tgcacagcactgtagaatcctataa

SEQ ID NO: 616695 - DNA, 25 bp, Rattus norvegicus
tgcacagcagcacattctcagttct

SEQ ID NO: 616696 - DNA, 25 bp, Rattus norvegicus
tgcacagcagcagattctcagttct

SEQ ID NO: 616697 - DNA, 25 bp, Rattus norvegicus
tgcacagcagctctaccgacacaga

SEQ ID NO: 616698 - DNA, 25 bp, Rattus norvegicus
tgcacagcagctgtaccgacacaga

SEQ ID NO: 616699 - DNA, 25 bp, Rattus norvegicus
tgcacagccagaccggcagtgtcat

SEQ ID NO: 616700 - DNA, 25 bp, Rattus norvegicus
tgcacagccagagcggcagtgtcat

SEQ ID NO: 616701 - DNA, 25 bp, Rattus norvegicus
tgcacagccctgatgtttatgaagc

SEQ ID NO: 616702 - DNA, 25 bp, Rattus norvegicus
tgcacagccctgttgtttatgaagc

SEQ ID NO: 616703 - DNA, 25 bp, Rattus norvegicus
tgcacagccgtcagactacaggaag

SEQ ID NO: 616704 - DNA, 25 bp, Rattus norvegicus
tgcacagccgtctgactacaggaag

SEQ ID NO: 616705 - DNA, 25 bp, Rattus norvegicus
tgcacagcttacactcctgttaagt

SEQ ID NO: 616706 - DNA, 25 bp, Rattus norvegicus
tgcacagcttactctcctgttaagt

SEQ ID NO: 616707 - DNA, 25 bp, Rattus norvegicus
tgcacagcttggacccttggacaag

SEQ ID NO: 616708 - DNA, 25 bp, Rattus norvegicus
tgcacagcttggtcccttggacaag

SEQ ID NO: 616709 - DNA, 25 bp, Rattus norvegicus
tgcacagctttaccggcaactgaat

SEQ ID NO: 616710 - DNA, 25 bp, Rattus norvegicus
tgcacagctttagcggcaactgaat

SEQ ID NO: 616711 - DNA, 25 bp, Rattus norvegicus
tgcacaggagtacagtttcaaccaa

SEQ ID NO: 616712 - DNA, 25 bp, Rattus norvegicus
tgcacaggagtagagtttcaaccaa

SEQ ID NO: 616713 - DNA, 25 bp, Rattus norvegicus
tgcacaggccgccagaaactcggcg

SEQ ID NO: 616714 - DNA, 25 bp, Rattus norvegicus
tgcacaggccgcgagaaactcggcg

SEQ ID NO: 616715 - DNA, 25 bp, Rattus norvegicus
tgcacaggcctgcactgaaggacat

SEQ ID NO: 616716 - DNA, 25 bp, Rattus norvegicus
tgcacaggcctggactgaaggacat

SEQ ID NO: 616717 - DNA, 25 bp, Rattus norvegicus
tgcacagggactcgaagccgagttt

SEQ ID NO: 616718 - DNA, 25 bp, Rattus norvegicus
tgcacagggactggaagccgagttt

SEQ ID NO: 616719 - DNA, 25 bp, Rattus norvegicus
tgcacaggtagaaatctgccccact

SEQ ID NO: 616720 - DNA, 25 bp, Rattus norvegicus
tgcacaggtagatatctgccccact

SEQ ID NO: 616721 - DNA, 25 bp, Rattus norvegicus
tgcacaggtaggagagacactcata

SEQ ID NO: 616722 - DNA, 25 bp, Rattus norvegicus
tgcacaggtaggtgagacactcata

SEQ ID NO: 616723 - DNA, 25 bp, Rattus norvegicus
tgcacaggtgcccaggctccaagga

SEQ ID NO: 616724 - DNA, 25 bp, Rattus norvegicus
tgcacaggtgccgaggctccaagga

SEQ ID NO: 616725 - DNA, 25 bp, Rattus norvegicus
tgcacagtcgccatggtctgagctg

SEQ ID NO: 616726 - DNA, 25 bp, Rattus norvegicus
tgcacagtcgccttggtctgagctg

SEQ ID NO: 616727 - DNA, 25 bp, Rattus norvegicus
tgcacagtgaccaatgtccacataa

SEQ ID NO: 616728 - DNA, 25 bp, Rattus norvegicus
tgcacagtgacctatgtccacataa

SEQ ID NO: 616729 - DNA, 25 bp, Rattus norvegicus
tgcacagtgactcggttaaaccgag

SEQ ID NO: 616730 - DNA, 25 bp, Rattus norvegicus
tgcacagtgactgggttaaaccgag

SEQ ID NO: 616731 - DNA, 25 bp, Rattus norvegicus
tgcacagtgcacactgggagagcaa

SEQ ID NO: 616732 - DNA, 25 bp, Rattus norvegicus
tgcacagtgcactctgggagagcaa

SEQ ID NO: 616733 - DNA, 25 bp, Rattus norvegicus
tgcacagtgccacgagtctccttgc

SEQ ID NO: 616734 - DNA, 25 bp, Rattus norvegicus
tgcacagtgccaggagtctccttgc

SEQ ID NO: 616735 - DNA, 25 bp, Rattus norvegicus
tgcacagtgcctctgagggcagttt

SEQ ID NO: 616736 - DNA, 25 bp, Rattus norvegicus
tgcacagtgcctgtgagggcagttt

SEQ ID NO: 616737 - DNA, 25 bp, Rattus norvegicus
tgcacagtgctcacgctgggcaaaa

SEQ ID NO: 616738 - DNA, 25 bp, Rattus norvegicus
tgcacagtgctctcgctgggcaaaa

SEQ ID NO: 616739 - DNA, 25 bp, Rattus norvegicus
tgcacagtggccctctgtctgcagg

SEQ ID NO: 616740 - DNA, 25 bp, Rattus norvegicus
tgcacagtggccgtctgtctgcagg

SEQ ID NO: 616741 - DNA, 25 bp, Rattus norvegicus
tgcacagttgtcactcagctaacgg

SEQ ID NO: 616742 - DNA, 25 bp, Rattus norvegicus
tgcacagttgtctctcagctaacgg

SEQ ID NO: 616743 - DNA, 25 bp, Rattus norvegicus
tgcacagtttgcattgagactcctt

SEQ ID NO: 616744 - DNA, 25 bp, Rattus norvegicus
tgcacagtttgctttgagactcctt

SEQ ID NO: 616745 - DNA, 25 bp, Rattus norvegicus
tgcacatacaccagccacctggaag

SEQ ID NO: 616746 - DNA, 25 bp, Rattus norvegicus
tgcacatacacctgccacctggaag

SEQ ID NO: 616747 - DNA, 25 bp, Rattus norvegicus
tgcacatagttcaggcttcaaacaa

SEQ ID NO: 616748 - DNA, 25 bp, Rattus norvegicus
tgcacatagttctggcttcaaacaa

SEQ ID NO: 616749 - DNA, 25 bp, Rattus norvegicus
tgcacatataaccacagaccggaga

SEQ ID NO: 616750 - DNA, 25 bp, Rattus norvegicus
tgcacatataacgacagaccggaga

SEQ ID NO: 616751 - DNA, 25 bp, Rattus norvegicus
tgcacatatctcacattttaaaggt

SEQ ID NO: 616752 - DNA, 25 bp, Rattus norvegicus
tgcacatatctctcattttaaaggt

SEQ ID NO: 616753 - DNA, 25 bp, Rattus norvegicus
tgcacatatgaccacgtacaccaga

SEQ ID NO: 616754 - DNA, 25 bp, Rattus norvegicus
tgcacatatgacgacgtacaccaga

SEQ ID NO: 616755 - DNA, 25 bp, Rattus norvegicus
tgcacatattgtatcataggacctg

SEQ ID NO: 616756 - DNA, 25 bp, Rattus norvegicus
tgcacatattgtttcataggacctg

SEQ ID NO: 616757 - DNA, 25 bp, Rattus norvegicus
tgcacatcaaaaataccactaaggg

SEQ ID NO: 616758 - DNA, 25 bp, Rattus norvegicus
tgcacatcaaaattaccactaaggg

SEQ ID NO: 616759 - DNA, 25 bp, Rattus norvegicus
tgcacatcaatcaggccacgaacgg

SEQ ID NO: 616760 - DNA, 25 bp, Rattus norvegicus
tgcacatcaatctggccacgaacgg

SEQ ID NO: 616761 - DNA, 25 bp, Rattus norvegicus
tgcacatcactgcacagacctgatt

SEQ ID NO: 616762 - DNA, 25 bp, Rattus norvegicus
tgcacatcactggacagacctgatt

SEQ ID NO: 616763 - DNA, 25 bp, Rattus norvegicus
tgcacatcacttacagatatcctcc

SEQ ID NO: 616764 - DNA, 25 bp, Rattus norvegicus
tgcacatcacttcctgaaagcctaa

SEQ ID NO: 616765 - DNA, 25 bp, Rattus norvegicus
tgcacatcacttgctgaaagcctaa

SEQ ID NO: 616766 - DNA, 25 bp, Rattus norvegicus
tgcacatcactttcagatatcctcc

SEQ ID NO: 616767 - DNA, 25 bp, Rattus norvegicus
tgcacatcatcaactgtttcacctt

SEQ ID NO: 616768 - DNA, 25 bp, Rattus norvegicus
tgcacatcatcatctgtttcacctt

SEQ ID NO: 616769 - DNA, 25 bp, Rattus norvegicus
tgcacatccctcagcaggaattatt

SEQ ID NO: 616770 - DNA, 25 bp, Rattus norvegicus
tgcacatccctctgcaggaattatt

SEQ ID NO: 616771 - DNA, 25 bp, Rattus norvegicus
tgcacatctccaaggacgtcatcta

SEQ ID NO: 616772 - DNA, 25 bp, Rattus norvegicus
tgcacatctccatggacgtcatcta

SEQ ID NO: 616773 - DNA, 25 bp, Rattus norvegicus
tgcacatctcctaacgagtcttgtc

SEQ ID NO: 616774 - DNA, 25 bp, Rattus norvegicus
tgcacatctccttacgagtcttgtc

SEQ ID NO: 616775 - DNA, 25 bp, Rattus norvegicus
tgcacatctcttctaaccctggata

SEQ ID NO: 616776 - DNA, 25 bp, Rattus norvegicus
tgcacatctcttgtaaccctggata

SEQ ID NO: 616777 - DNA, 25 bp, Rattus norvegicus
tgcacatcttggcattgagcagagt

SEQ ID NO: 616778 - DNA, 25 bp, Rattus norvegicus
tgcacatcttgggattgagcagagt

SEQ ID NO: 616779 - DNA, 25 bp, Rattus norvegicus
tgcacatgaatgacagcctttccct

SEQ ID NO: 616780 - DNA, 25 bp, Rattus norvegicus
tgcacatgaatgtcagcctttccct

SEQ ID NO: 616781 - DNA, 25 bp, Rattus norvegicus
tgcacatgccatagcctagctgatg

SEQ ID NO: 616782 - DNA, 25 bp, Rattus norvegicus
tgcacatgccattgcctagctgatg

SEQ ID NO: 616783 - DNA, 25 bp, Rattus norvegicus
tgcacatgcccacagcctgagagag

SEQ ID NO: 616784 - DNA, 25 bp, Rattus norvegicus
tgcacatgcccagagcctgagagag

SEQ ID NO: 616785 - DNA, 25 bp, Rattus norvegicus
tgcacatgcccgagttcattcaaga

SEQ ID NO: 616786 - DNA, 25 bp, Rattus norvegicus
tgcacatgcccgtgttcattcaaga

SEQ ID NO: 616787 - DNA, 25 bp, Rattus norvegicus
tgcacatgcctgagatgtcagcact

SEQ ID NO: 616788 - DNA, 25 bp, Rattus norvegicus
tgcacatgcctgtgatgtcagcact

SEQ ID NO: 616789 - DNA, 25 bp, Rattus norvegicus
tgcacatgctggacatggtggcgct

SEQ ID NO: 616790 - DNA, 25 bp, Rattus norvegicus
tgcacatgctggtcatggtggcgct

SEQ ID NO: 616791 - DNA, 25 bp, Rattus norvegicus
tgcacatggcccagcactaccagag

SEQ ID NO: 616792 - DNA, 25 bp, Rattus norvegicus
tgcacatggccctgcactaccagag

SEQ ID NO: 616793 - DNA, 25 bp, Rattus norvegicus
tgcacatgtaaaaggacaagctgat

SEQ ID NO: 616794 - DNA, 25 bp, Rattus norvegicus
tgcacatgtaaatggacaagctgat

SEQ ID NO: 616795 - DNA, 25 bp, Rattus norvegicus
tgcacatgtgtacggtgggcttctt

SEQ ID NO: 616796 - DNA, 25 bp, Rattus norvegicus
tgcacatgtgtagggtgggcttctt

SEQ ID NO: 616797 - DNA, 25 bp, Rattus norvegicus
tgcacattaatcacattcccaacaa

SEQ ID NO: 616798 - DNA, 25 bp, Rattus norvegicus
tgcacattaatctcattcccaacaa

SEQ ID NO: 616799 - DNA, 25 bp, Rattus norvegicus
tgcacattactccacctcgaaggaa

SEQ ID NO: 616800 - DNA, 25 bp, Rattus norvegicus
tgcacattactcgacctcgaaggaa

SEQ ID NO: 616801 - DNA, 25 bp, Rattus norvegicus
tgcacattacttattgtcagtttgt

SEQ ID NO: 616802 - DNA, 25 bp, Rattus norvegicus
tgcacattactttttgtcagtttgt

SEQ ID NO: 616803 - DNA, 25 bp, Rattus norvegicus
tgcacattagcactgtactcttgct

SEQ ID NO: 616804 - DNA, 25 bp, Rattus norvegicus
tgcacattagcagtgtactcttgct

SEQ ID NO: 616805 - DNA, 25 bp, Rattus norvegicus
tgcacattcacgaactcggaggccg

SEQ ID NO: 616806 - DNA, 25 bp, Rattus norvegicus
tgcacattcacgtactcggaggccg

SEQ ID NO: 616807 - DNA, 25 bp, Rattus norvegicus
tgcacattcctcaggagtcttttga

SEQ ID NO: 616808 - DNA, 25 bp, Rattus norvegicus
tgcacattcctctggagtcttttga

SEQ ID NO: 616809 - DNA, 25 bp, Rattus norvegicus
tgcacattccttccgtgatgctgtc

SEQ ID NO: 616810 - DNA, 25 bp, Rattus norvegicus
tgcacattccttgcgtgatgctgtc

SEQ ID NO: 616811 - DNA, 25 bp, Rattus norvegicus
tgcacattctgccttgtgagtacaa

SEQ ID NO: 616812 - DNA, 25 bp, Rattus norvegicus
tgcacattctgcgttgtgagtacaa

SEQ ID NO: 616813 - DNA, 25 bp, Rattus norvegicus
tgcacattgccgctagagtactgat

SEQ ID NO: 616814 - DNA, 25 bp, Rattus norvegicus
tgcacattgccggtagagtactgat

SEQ ID NO: 616815 - DNA, 25 bp, Rattus norvegicus
tgcacatttcagctcacatctatca

SEQ ID NO: 616816 - DNA, 25 bp, Rattus norvegicus
tgcacatttcaggtcacatctatca

SEQ ID NO: 616817 - DNA, 25 bp, Rattus norvegicus
tgcacatttctccatagcagctttg

SEQ ID NO: 616818 - DNA, 25 bp, Rattus norvegicus
tgcacatttctcgatagcagctttg

SEQ ID NO: 616819 - DNA, 25 bp, Rattus norvegicus
tgcacatttgcacacgacacggcga

SEQ ID NO: 616820 - DNA, 25 bp, Rattus norvegicus
tgcacatttgcacagccgaaactaa

SEQ ID NO: 616821 - DNA, 25 bp, Rattus norvegicus
tgcacatttgcagacgacacggcga

SEQ ID NO: 616822 - DNA, 25 bp, Rattus norvegicus
tgcacatttgcagagccgaaactaa

SEQ ID NO: 616823 - DNA, 25 bp, Rattus norvegicus
tgcacattttcaaccttctgcggga

SEQ ID NO: 616824 - DNA, 25 bp, Rattus norvegicus
tgcacattttcatccttctgcggga

SEQ ID NO: 616825 - DNA, 25 bp, Rattus norvegicus
tgcacattttctatgatcccttggt

SEQ ID NO: 616826 - DNA, 25 bp, Rattus norvegicus
tgcacattttctttgatcccttggt

SEQ ID NO: 616827 - DNA, 25 bp, Rattus norvegicus
tgcaccaaaaccacagttgtcacac

SEQ ID NO: 616828 - DNA, 25 bp, Rattus norvegicus
tgcaccaaaacctcagttgtcacac

SEQ ID NO: 616829 - DNA, 25 bp, Rattus norvegicus
tgcaccaaagctccgaatctaagcg

SEQ ID NO: 616830 - DNA, 25 bp, Rattus norvegicus
tgcaccaaagctgcgaatctaagcg

SEQ ID NO: 616831 - DNA, 25 bp, Rattus norvegicus
tgcaccaacaggaactgtgtcacct

SEQ ID NO: 616832 - DNA, 25 bp, Rattus norvegicus
tgcaccaacaggtactgtgtcacct

SEQ ID NO: 616833 - DNA, 25 bp, Rattus norvegicus
tgcaccaaggagaaacataagttac

SEQ ID NO: 616834 - DNA, 25 bp, Rattus norvegicus
tgcaccaaggagtaacataagttac

SEQ ID NO: 616835 - DNA, 25 bp, Rattus norvegicus
tgcaccacttctacagaccaaggag

SEQ ID NO: 616836 - DNA, 25 bp, Rattus norvegicus
tgcaccacttcttcagaccaaggag

SEQ ID NO: 616837 - DNA, 25 bp, Rattus norvegicus
tgcaccagaggaaggctcagcttgt

SEQ ID NO: 616838 - DNA, 25 bp, Rattus norvegicus
tgcaccagaggatggctcagcttgt

SEQ ID NO: 616839 - DNA, 25 bp, Rattus norvegicus
tgcaccagatgtcgcggtcgctgtt

SEQ ID NO: 616840 - DNA, 25 bp, Rattus norvegicus
tgcaccagatgtggcggtcgctgtt

SEQ ID NO: 616841 - DNA, 25 bp, Rattus norvegicus
tgcaccagcagcctgttcactacta

SEQ ID NO: 616842 - DNA, 25 bp, Rattus norvegicus
tgcaccagcagcgtgttcactacta

SEQ ID NO: 616843 - DNA, 25 bp, Rattus norvegicus
tgcaccagcgctacaacagggccat

SEQ ID NO: 616844 - DNA, 25 bp, Rattus norvegicus
tgcaccagcgcttcaacagggccat

SEQ ID NO: 616845 - DNA, 25 bp, Rattus norvegicus
tgcaccagcggcacacggagatgat

SEQ ID NO: 616846 - DNA, 25 bp, Rattus norvegicus
tgcaccagcggctcacggagatgat

SEQ ID NO: 616847 - DNA, 25 bp, Rattus norvegicus
tgcaccagcgtgctcgggagtatat

SEQ ID NO: 616848 - DNA, 25 bp, Rattus norvegicus
tgcaccagcgtggtcgggagtatat

SEQ ID NO: 616849 - DNA, 25 bp, Rattus norvegicus
tgcaccaggaaaccttggcttcact

SEQ ID NO: 616850 - DNA, 25 bp, Rattus norvegicus
tgcaccaggaaagcttggcttcact

SEQ ID NO: 616851 - DNA, 25 bp, Rattus norvegicus
tgcaccaggaatcagcaggctcaac

SEQ ID NO: 616852 - DNA, 25 bp, Rattus norvegicus
tgcaccaggaatgagcaggctcaac

SEQ ID NO: 616853 - DNA, 25 bp, Rattus norvegicus
tgcaccaggataccttggcaggcat

SEQ ID NO: 616854 - DNA, 25 bp, Rattus norvegicus
tgcaccaggatagcttggcaggcat

SEQ ID NO: 616855 - DNA, 25 bp, Rattus norvegicus
tgcaccaggatgaccccatgtctgt

SEQ ID NO: 616856 - DNA, 25 bp, Rattus norvegicus
tgcaccaggatgtccccatgtctgt

SEQ ID NO: 616857 - DNA, 25 bp, Rattus norvegicus
tgcaccaggctgagtattctgaact

SEQ ID NO: 616858 - DNA, 25 bp, Rattus norvegicus
tgcaccaggctgtgtattctgaact

SEQ ID NO: 616859 - DNA, 25 bp, Rattus norvegicus
tgcaccaggtccataagggctcctg

SEQ ID NO: 616860 - DNA, 25 bp, Rattus norvegicus
tgcaccaggtccttaagggctcctg

SEQ ID NO: 616861 - DNA, 25 bp, Rattus norvegicus
tgcaccagtgcacttttcctgtttg

SEQ ID NO: 616862 - DNA, 25 bp, Rattus norvegicus
tgcaccagtgcagttttcctgtttg

SEQ ID NO: 616863 - DNA, 25 bp, Rattus norvegicus
tgcaccatcacaccatgaagccata

SEQ ID NO: 616864 - DNA, 25 bp, Rattus norvegicus
tgcaccatcacagcatgaagccata

SEQ ID NO: 616865 - DNA, 25 bp, Rattus norvegicus
tgcaccatccaaagcagcagcataa

SEQ ID NO: 616866 - DNA, 25 bp, Rattus norvegicus
tgcaccatccaatgcagcagcataa

SEQ ID NO: 616867 - DNA, 25 bp, Rattus norvegicus
tgcaccatcgcaagaagttttccta

SEQ ID NO: 616868 - DNA, 25 bp, Rattus norvegicus
tgcaccatcgcatgaagttttccta

SEQ ID NO: 616869 - DNA, 25 bp, Rattus norvegicus
tgcaccatctgcattcaaacaaatg

SEQ ID NO: 616870 - DNA, 25 bp, Rattus norvegicus
tgcaccatctgctttcaaacaaatg

SEQ ID NO: 616871 - DNA, 25 bp, Rattus norvegicus
tgcaccatgccacgatctcacggtt

SEQ ID NO: 616872 - DNA, 25 bp, Rattus norvegicus
tgcaccatgccaggatctcacggtt

SEQ ID NO: 616873 - DNA, 25 bp, Rattus norvegicus
tgcaccatgtatatgctggtacccc

SEQ ID NO: 616874 - DNA, 25 bp, Rattus norvegicus
tgcaccatgtatttgctggtacccc

SEQ ID NO: 616875 - DNA, 25 bp, Rattus norvegicus
tgcacccaaggccatcggaaagtca

SEQ ID NO: 616876 - DNA, 25 bp, Rattus norvegicus
tgcacccaaggcgatcggaaagtca

SEQ ID NO: 616877 - DNA, 25 bp, Rattus norvegicus
tgcacccagcacaatctgcagagat

SEQ ID NO: 616878 - DNA, 25 bp, Rattus norvegicus
tgcacccagcactatctgcagagat

SEQ ID NO: 616879 - DNA, 25 bp, Rattus norvegicus
tgcacccaggtgataccagttctag

SEQ ID NO: 616880 - DNA, 25 bp, Rattus norvegicus
tgcacccaggtgttaccagttctag

SEQ ID NO: 616881 - DNA, 25 bp, Rattus norvegicus
tgcacccagtccatgatttgagttc

SEQ ID NO: 616882 - DNA, 25 bp, Rattus norvegicus
tgcacccagtccttgatttgagttc

SEQ ID NO: 616883 - DNA, 25 bp, Rattus norvegicus
tgcacccatcagagtttaataaatg

SEQ ID NO: 616884 - DNA, 25 bp, Rattus norvegicus
tgcacccatcagtgtttaataaatg

SEQ ID NO: 616885 - DNA, 25 bp, Rattus norvegicus
tgcacccattccatactcagtaatt

SEQ ID NO: 616886 - DNA, 25 bp, Rattus norvegicus
tgcacccattccttactcagtaatt

SEQ ID NO: 616887 - DNA, 25 bp, Rattus norvegicus
tgcaccccaggcaaaatctaagtca

SEQ ID NO: 616888 - DNA, 25 bp, Rattus norvegicus
tgcaccccaggctaaatctaagtca

SEQ ID NO: 616889 - DNA, 25 bp, Rattus norvegicus
tgcaccccaggtagtcattcatcta

SEQ ID NO: 616890 - DNA, 25 bp, Rattus norvegicus
tgcaccccaggttgtcattcatcta

SEQ ID NO: 616891 - DNA, 25 bp, Rattus norvegicus
tgcaccccattacctgtcatctgta

SEQ ID NO: 616892 - DNA, 25 bp, Rattus norvegicus
tgcaccccattagctgtcatctgta

SEQ ID NO: 616893 - DNA, 25 bp, Rattus norvegicus
tgcacccctccaagattgacaataa

SEQ ID NO: 616894 - DNA, 25 bp, Rattus norvegicus
tgcacccctccatgattgacaataa

SEQ ID NO: 616895 - DNA, 25 bp, Rattus norvegicus
tgcacccctcggatttatggcagag

SEQ ID NO: 616896 - DNA, 25 bp, Rattus norvegicus
tgcacccctcggttttatggcagag

SEQ ID NO: 616897 - DNA, 25 bp, Rattus norvegicus
tgcacccctgctatagagctaggta

SEQ ID NO: 616898 - DNA, 25 bp, Rattus norvegicus
tgcacccctgctttagagctaggta

SEQ ID NO: 616899 - DNA, 25 bp, Rattus norvegicus
tgcaccccttttcacacctgtgaaa

SEQ ID NO: 616900 - DNA, 25 bp, Rattus norvegicus
tgcaccccttttgacacctgtgaaa

SEQ ID NO: 616901 - DNA, 25 bp, Rattus norvegicus
tgcacccgggccagtttgccatggg

SEQ ID NO: 616902 - DNA, 25 bp, Rattus norvegicus
tgcacccgggcctgtttgccatggg

SEQ ID NO: 616903 - DNA, 25 bp, Rattus norvegicus
tgcaccctaacgcttctaatttaga

SEQ ID NO: 616904 - DNA, 25 bp, Rattus norvegicus
tgcaccctaacggttctaatttaga

SEQ ID NO: 616905 - DNA, 25 bp, Rattus norvegicus
tgcaccctcaagcacgatacagctg

SEQ ID NO: 616906 - DNA, 25 bp, Rattus norvegicus
tgcaccctcaaggacgatacagctg

SEQ ID NO: 616907 - DNA, 25 bp, Rattus norvegicus
tgcaccctgatcaacagtgtacact

SEQ ID NO: 616908 - DNA, 25 bp, Rattus norvegicus
tgcaccctgatcatgatgtcctgag

SEQ ID NO: 616909 - DNA, 25 bp, Rattus norvegicus
tgcaccctgatctacagtgtacact

SEQ ID NO: 616910 - DNA, 25 bp, Rattus norvegicus
tgcaccctgatcttgatgtcctgag

SEQ ID NO: 616911 - DNA, 25 bp, Rattus norvegicus
tgcaccctgggcctaggagacgcca

SEQ ID NO: 616912 - DNA, 25 bp, Rattus norvegicus
tgcaccctgggcgtaggagacgcca

SEQ ID NO: 616913 - DNA, 25 bp, Rattus norvegicus
tgcaccctgtcaatgttttactcca

SEQ ID NO: 616914 - DNA, 25 bp, Rattus norvegicus
tgcaccctgtcattgttttactcca

SEQ ID NO: 616915 - DNA, 25 bp, Rattus norvegicus
tgcacccttgggaagacttgctttg

SEQ ID NO: 616916 - DNA, 25 bp, Rattus norvegicus
tgcacccttgggtagacttgctttg

SEQ ID NO: 616917 - DNA, 25 bp, Rattus norvegicus
tgcaccctttcaaggagcttcgagt

SEQ ID NO: 616918 - DNA, 25 bp, Rattus norvegicus
tgcaccctttcatggagcttcgagt

SEQ ID NO: 616919 - DNA, 25 bp, Rattus norvegicus
tgcaccgacaatagcttcaggcgtt

SEQ ID NO: 616920 - DNA, 25 bp, Rattus norvegicus
tgcaccgacaattgcttcaggcgtt

SEQ ID NO: 616921 - DNA, 25 bp, Rattus norvegicus
tgcaccgagggaatacgctaaggct

SEQ ID NO: 616922 - DNA, 25 bp, Rattus norvegicus
tgcaccgagggattacgctaaggct

SEQ ID NO: 616923 - DNA, 25 bp, Rattus norvegicus
tgcaccgcaattatgtcccagattt

SEQ ID NO: 616924 - DNA, 25 bp, Rattus norvegicus
tgcaccgcaattttgtcccagattt

SEQ ID NO: 616925 - DNA, 25 bp, Rattus norvegicus
tgcaccgctctaactggttttaagg

SEQ ID NO: 616926 - DNA, 25 bp, Rattus norvegicus
tgcaccgctctatctggttttaagg

SEQ ID NO: 616927 - DNA, 25 bp, Rattus norvegicus
tgcaccgctgacctgagctgggaac

SEQ ID NO: 616928 - DNA, 25 bp, Rattus norvegicus
tgcaccgctgacgtgagctgggaac

SEQ ID NO: 616929 - DNA, 25 bp, Rattus norvegicus
tgcaccgctggtattttcttgtctt

SEQ ID NO: 616930 - DNA, 25 bp, Rattus norvegicus
tgcaccgctggttttttcttgtctt

SEQ ID NO: 616931 - DNA, 25 bp, Rattus norvegicus
tgcaccggaagcacatcatgggtca

SEQ ID NO: 616932 - DNA, 25 bp, Rattus norvegicus
tgcaccggaagctcatcatgggtca

SEQ ID NO: 616933 - DNA, 25 bp, Rattus norvegicus
tgcaccggcagtattaatgtcccct

SEQ ID NO: 616934 - DNA, 25 bp, Rattus norvegicus
tgcaccggcagttttaatgtcccct

SEQ ID NO: 616935 - DNA, 25 bp, Rattus norvegicus
tgcaccggctccatcgccaagggaa

SEQ ID NO: 616936 - DNA, 25 bp, Rattus norvegicus
tgcaccggctccttcgccaagggaa

SEQ ID NO: 616937 - DNA, 25 bp, Rattus norvegicus
tgcaccggctgaactctggaagcaa

SEQ ID NO: 616938 - DNA, 25 bp, Rattus norvegicus
tgcaccggctgacctctggcttgat

SEQ ID NO: 616939 - DNA, 25 bp, Rattus norvegicus
tgcaccggctgagctctggcttgat

SEQ ID NO: 616940 - DNA, 25 bp, Rattus norvegicus
tgcaccggctgatctctggaagcaa

SEQ ID NO: 616941 - DNA, 25 bp, Rattus norvegicus
tgcaccgggacccaagtccatgtaa

SEQ ID NO: 616942 - DNA, 25 bp, Rattus norvegicus
tgcaccgggaccgaagtccatgtaa

SEQ ID NO: 616943 - DNA, 25 bp, Rattus norvegicus
tgcaccgggatccatcgagcaagcg

SEQ ID NO: 616944 - DNA, 25 bp, Rattus norvegicus
tgcaccgggatcgatcgagcaagcg

SEQ ID NO: 616945 - DNA, 25 bp, Rattus norvegicus
tgcaccgtagccattgttccatgaa

SEQ ID NO: 616946 - DNA, 25 bp, Rattus norvegicus
tgcaccgtagcctttgttccatgaa

SEQ ID NO: 616947 - DNA, 25 bp, Rattus norvegicus
tgcaccgtcctcagtatgttgacag

SEQ ID NO: 616948 - DNA, 25 bp, Rattus norvegicus
tgcaccgtcctctgtatgttgacag

SEQ ID NO: 616949 - DNA, 25 bp, Rattus norvegicus
tgcaccgtcgctcagtgagctggat

SEQ ID NO: 616950 - DNA, 25 bp, Rattus norvegicus
tgcaccgtcgctgagtgagctggat

SEQ ID NO: 616951 - DNA, 25 bp, Rattus norvegicus
tgcaccgtctgcaccgaaagggcag

SEQ ID NO: 616952 - DNA, 25 bp, Rattus norvegicus
tgcaccgtctgcattacaagggcaa

SEQ ID NO: 616953 - DNA, 25 bp, Rattus norvegicus
tgcaccgtctgctccgaaagggcag

SEQ ID NO: 616954 - DNA, 25 bp, Rattus norvegicus
tgcaccgtctgctttacaagggcaa

SEQ ID NO: 616955 - DNA, 25 bp, Rattus norvegicus
tgcaccgtgccacgctctttaaaat

SEQ ID NO: 616956 - DNA, 25 bp, Rattus norvegicus
tgcaccgtgccaggctctttaaaat

SEQ ID NO: 616957 - DNA, 25 bp, Rattus norvegicus
tgcaccgtgtttccagattcgatgt

SEQ ID NO: 616958 - DNA, 25 bp, Rattus norvegicus
tgcaccgtgtttgcagattcgatgt

SEQ ID NO: 616959 - DNA, 25 bp, Rattus norvegicus
tgcaccgtttccaacttgtgtctca

SEQ ID NO: 616960 - DNA, 25 bp, Rattus norvegicus
tgcaccgtttcctacttgtgtctca

SEQ ID NO: 616961 - DNA, 25 bp, Rattus norvegicus
tgcacctacagcattgactaaccag

SEQ ID NO: 616962 - DNA, 25 bp, Rattus norvegicus
tgcacctacagctttgactaaccag

SEQ ID NO: 616963 - DNA, 25 bp, Rattus norvegicus
tgcacctacgggacgggttcttggc

SEQ ID NO: 616964 - DNA, 25 bp, Rattus norvegicus
tgcacctacgggtcgggttcttggc

SEQ ID NO: 616965 - DNA, 25 bp, Rattus norvegicus
tgcacctactctaagctgtggtctt

SEQ ID NO: 616966 - DNA, 25 bp, Rattus norvegicus
tgcacctactcttagctgtggtctt

SEQ ID NO: 616967 - DNA, 25 bp, Rattus norvegicus
tgcacctagaggatagccagggcgc

SEQ ID NO: 616968 - DNA, 25 bp, Rattus norvegicus
tgcacctagaggttagccagggcgc

SEQ ID NO: 616969 - DNA, 25 bp, Rattus norvegicus
tgcacctatgcaccgatgggaagct

SEQ ID NO: 616970 - DNA, 25 bp, Rattus norvegicus
tgcacctatgcagcgatgggaagct

SEQ ID NO: 616971 - DNA, 25 bp, Rattus norvegicus
tgcacctatggcctcgaaggaagca

SEQ ID NO: 616972 - DNA, 25 bp, Rattus norvegicus
tgcacctatggcgtcgaaggaagca

SEQ ID NO: 616973 - DNA, 25 bp, Rattus norvegicus
tgcacctcacttcgcaagatcttat

SEQ ID NO: 616974 - DNA, 25 bp, Rattus norvegicus
tgcacctcacttggcaagatcttat

SEQ ID NO: 616975 - DNA, 25 bp, Rattus norvegicus
tgcacctcagggatcatttgaatac

SEQ ID NO: 616976 - DNA, 25 bp, Rattus norvegicus
tgcacctcagggttcatttgaatac

SEQ ID NO: 616977 - DNA, 25 bp, Rattus norvegicus
tgcacctcatccagttcctttaaaa

SEQ ID NO: 616978 - DNA, 25 bp, Rattus norvegicus
tgcacctcatcctgttcctttaaaa

SEQ ID NO: 616979 - DNA, 25 bp, Rattus norvegicus
tgcacctcctgcatgttagagacct

SEQ ID NO: 616980 - DNA, 25 bp, Rattus norvegicus
tgcacctcctgcttgttagagacct

SEQ ID NO: 616981 - DNA, 25 bp, Rattus norvegicus
tgcacctcgattctattttccacaa

SEQ ID NO: 616982 - DNA, 25 bp, Rattus norvegicus
tgcacctcgattgtattttccacaa

SEQ ID NO: 616983 - DNA, 25 bp, Rattus norvegicus
tgcacctctgtcaatcctgatttta

SEQ ID NO: 616984 - DNA, 25 bp, Rattus norvegicus
tgcacctctgtctatcctgatttta

SEQ ID NO: 616985 - DNA, 25 bp, Rattus norvegicus
tgcacctcttcacttgtctaataac

SEQ ID NO: 616986 - DNA, 25 bp, Rattus norvegicus
tgcacctcttcagttgtctaataac

SEQ ID NO: 616987 - DNA, 25 bp, Rattus norvegicus
tgcacctcttctaaagccatgagct

SEQ ID NO: 616988 - DNA, 25 bp, Rattus norvegicus
tgcacctcttcttaagccatgagct

SEQ ID NO: 616989 - DNA, 25 bp, Rattus norvegicus
tgcacctcttttccagtggttaaga

SEQ ID NO: 616990 - DNA, 25 bp, Rattus norvegicus
tgcacctcttttgcagtggttaaga

SEQ ID NO: 616991 - DNA, 25 bp, Rattus norvegicus
tgcacctgcaatcatatcttcccta

SEQ ID NO: 616992 - DNA, 25 bp, Rattus norvegicus
tgcacctgcaatgatatcttcccta

SEQ ID NO: 616993 - DNA, 25 bp, Rattus norvegicus
tgcacctgcacactgaaatgggagt

SEQ ID NO: 616994 - DNA, 25 bp, Rattus norvegicus
tgcacctgcacagtgaaatgggagt

SEQ ID NO: 616995 - DNA, 25 bp, Rattus norvegicus
tgcacctgcagtctctttccactgg

SEQ ID NO: 616996 - DNA, 25 bp, Rattus norvegicus
tgcacctgcagtgtctttccactgg

SEQ ID NO: 616997 - DNA, 25 bp, Rattus norvegicus
tgcacctgctgaagtttctggacgc

SEQ ID NO: 616998 - DNA, 25 bp, Rattus norvegicus
tgcacctgctgatgtttctggacgc

SEQ ID NO: 616999 - DNA, 25 bp, Rattus norvegicus
tgcacctggcacaaaacacacctaa

SEQ ID NO: 617000 - DNA, 25 bp, Rattus norvegicus
tgcacctggcactaaacacacctaa

SEQ ID NO: 617001 - DNA, 25 bp, Rattus norvegicus
tgcacctggcatagtgattctcttc

SEQ ID NO: 617002 - DNA, 25 bp, Rattus norvegicus
tgcacctggcattgtgattctcttc

SEQ ID NO: 617003 - DNA, 25 bp, Rattus norvegicus
tgcacctgggcgcagacatgtgaat

SEQ ID NO: 617004 - DNA, 25 bp, Rattus norvegicus
tgcacctgggcggagacatgtgaat

SEQ ID NO: 617005 - DNA, 25 bp, Rattus norvegicus
tgcacctgggtgatgaaggcctcac

SEQ ID NO: 617006 - DNA, 25 bp, Rattus norvegicus
tgcacctgggtgttgaaggcctcac

SEQ ID NO: 617007 - DNA, 25 bp, Rattus norvegicus
tgcacctgtcagcatattacggcag

SEQ ID NO: 617008 - DNA, 25 bp, Rattus norvegicus
tgcacctgtcaggatattacggcag

SEQ ID NO: 617009 - DNA, 25 bp, Rattus norvegicus
tgcacctgtcttccttacaattgaa

SEQ ID NO: 617010 - DNA, 25 bp, Rattus norvegicus
tgcacctgtcttgcttacaattgaa

SEQ ID NO: 617011 - DNA, 25 bp, Rattus norvegicus
tgcacctgtttcactgggttatgtc

SEQ ID NO: 617012 - DNA, 25 bp, Rattus norvegicus
tgcacctgtttctctgggttatgtc

SEQ ID NO: 617013 - DNA, 25 bp, Rattus norvegicus
tgcaccttccacatttgtcttccaa

SEQ ID NO: 617014 - DNA, 25 bp, Rattus norvegicus
tgcaccttccacttttgtcttccaa

SEQ ID NO: 617015 - DNA, 25 bp, Rattus norvegicus
tgcaccttccttccagggaacaatt

SEQ ID NO: 617016 - DNA, 25 bp, Rattus norvegicus
tgcaccttccttgcagggaacaatt

SEQ ID NO: 617017 - DNA, 25 bp, Rattus norvegicus
tgcaccttcttcagtggtacttttt

SEQ ID NO: 617018 - DNA, 25 bp, Rattus norvegicus
tgcaccttcttctgtggtacttttt

SEQ ID NO: 617019 - DNA, 25 bp, Rattus norvegicus
tgcaccttgaccactgtcttgacag

SEQ ID NO: 617020 - DNA, 25 bp, Rattus norvegicus
tgcaccttgacctctgtcttgacag

SEQ ID NO: 617021 - DNA, 25 bp, Rattus norvegicus
tgcaccttgcatatcaccattgctt

SEQ ID NO: 617022 - DNA, 25 bp, Rattus norvegicus
tgcaccttgcatcactgaatcctgt

SEQ ID NO: 617023 - DNA, 25 bp, Rattus norvegicus
tgcaccttgcatgactgaatcctgt

SEQ ID NO: 617024 - DNA, 25 bp, Rattus norvegicus
tgcaccttgcatttcaccattgctt

SEQ ID NO: 617025 - DNA, 25 bp, Rattus norvegicus
tgcaccttgctgagccaatgcttct

SEQ ID NO: 617026 - DNA, 25 bp, Rattus norvegicus
tgcaccttgctgtgccaatgcttct

SEQ ID NO: 617027 - DNA, 25 bp, Rattus norvegicus
tgcacgaatgacaacagaccctaac

SEQ ID NO: 617028 - DNA, 25 bp, Rattus norvegicus
tgcacgaatgactacagaccctaac

SEQ ID NO: 617029 - DNA, 25 bp, Rattus norvegicus
tgcacgacagctaccgagaggagct

SEQ ID NO: 617030 - DNA, 25 bp, Rattus norvegicus
tgcacgacagcttccgagaggagct

SEQ ID NO: 617031 - DNA, 25 bp, Rattus norvegicus
tgcacgagccttatcccatttgtag

SEQ ID NO: 617032 - DNA, 25 bp, Rattus norvegicus
tgcacgagccttttcccatttgtag

SEQ ID NO: 617033 - DNA, 25 bp, Rattus norvegicus
tgcacgagtcacaccggaacttggg

SEQ ID NO: 617034 - DNA, 25 bp, Rattus norvegicus
tgcacgagtcactccggaacttggg

SEQ ID NO: 617035 - DNA, 25 bp, Rattus norvegicus
tgcacgagttttaacctagctggtt

SEQ ID NO: 617036 - DNA, 25 bp, Rattus norvegicus
tgcacgagtttttacctagctggtt

SEQ ID NO: 617037 - DNA, 25 bp, Rattus norvegicus
tgcacgatggcaaggtggtctccac

SEQ ID NO: 617038 - DNA, 25 bp, Rattus norvegicus
tgcacgatggcatggtggtctccac

SEQ ID NO: 617039 - DNA, 25 bp, Rattus norvegicus
tgcacgcaccaaatcataatcccat

SEQ ID NO: 617040 - DNA, 25 bp, Rattus norvegicus
tgcacgcaccaattcataatcccat

SEQ ID NO: 617041 - DNA, 25 bp, Rattus norvegicus
tgcacgcacgcacaatctagggatt

SEQ ID NO: 617042 - DNA, 25 bp, Rattus norvegicus
tgcacgcacgcagaatctagggatt

SEQ ID NO: 617043 - DNA, 25 bp, Rattus norvegicus
tgcacgcactcacggagctctggaa

SEQ ID NO: 617044 - DNA, 25 bp, Rattus norvegicus
tgcacgcactcagggagctctggaa

SEQ ID NO: 617045 - DNA, 25 bp, Rattus norvegicus
tgcacgcagccaattctgggataac

SEQ ID NO: 617046 - DNA, 25 bp, Rattus norvegicus
tgcacgcagccatttctgggataac

SEQ ID NO: 617047 - DNA, 25 bp, Rattus norvegicus
tgcacgcattgcagagtggcacgaa

SEQ ID NO: 617048 - DNA, 25 bp, Rattus norvegicus
tgcacgcattgctgagtggcacgaa

SEQ ID NO: 617049 - DNA, 25 bp, Rattus norvegicus
tgcacgccgagaacaggaatccctg

SEQ ID NO: 617050 - DNA, 25 bp, Rattus norvegicus
tgcacgccgagatcaggaatccctg

SEQ ID NO: 617051 - DNA, 25 bp, Rattus norvegicus
tgcacgcctggccaatatcgatgag

SEQ ID NO: 617052 - DNA, 25 bp, Rattus norvegicus
tgcacgcctggcgaatatcgatgag

SEQ ID NO: 617053 - DNA, 25 bp, Rattus norvegicus
tgcacgccttccattttcaataaaa

SEQ ID NO: 617054 - DNA, 25 bp, Rattus norvegicus
tgcacgccttcctttttcaataaaa

SEQ ID NO: 617055 - DNA, 25 bp, Rattus norvegicus
tgcacgcgcgcgatcaacaaatgaa

SEQ ID NO: 617056 - DNA, 25 bp, Rattus norvegicus
tgcacgcgcgcgttcaacaaatgaa

SEQ ID NO: 617057 - DNA, 25 bp, Rattus norvegicus
tgcacgcgctcgaggccgatgcgga

SEQ ID NO: 617058 - DNA, 25 bp, Rattus norvegicus
tgcacgcgctcgtggccgatgcgga

SEQ ID NO: 617059 - DNA, 25 bp, Rattus norvegicus
tgcacgctcaggaccacactgaaaa

SEQ ID NO: 617060 - DNA, 25 bp, Rattus norvegicus
tgcacgctcaggtccacactgaaaa

SEQ ID NO: 617061 - DNA, 25 bp, Rattus norvegicus
tgcacgctcttgcagaacttgccaa

SEQ ID NO: 617062 - DNA, 25 bp, Rattus norvegicus
tgcacgctcttggagaacttgccaa

SEQ ID NO: 617063 - DNA, 25 bp, Rattus norvegicus
tgcacgctgccactggagattgatt

SEQ ID NO: 617064 - DNA, 25 bp, Rattus norvegicus
tgcacgctgccagtggagattgatt

SEQ ID NO: 617065 - DNA, 25 bp, Rattus norvegicus
tgcacgctggaacaatcccatcgaa

SEQ ID NO: 617066 - DNA, 25 bp, Rattus norvegicus
tgcacgctggaagaatcccatcgaa

SEQ ID NO: 617067 - DNA, 25 bp, Rattus norvegicus
tgcacgcttaatattttcgcttcag

SEQ ID NO: 617068 - DNA, 25 bp, Rattus norvegicus
tgcacgcttaattttttcgcttcag

SEQ ID NO: 617069 - DNA, 25 bp, Rattus norvegicus
tgcacggcatgactcagcacactgt

SEQ ID NO: 617070 - DNA, 25 bp, Rattus norvegicus
tgcacggcatgagtcagcacactgt

SEQ ID NO: 617071 - DNA, 25 bp, Rattus norvegicus
tgcacggccactcagaacaacttca

SEQ ID NO: 617072 - DNA, 25 bp, Rattus norvegicus
tgcacggccactgagaacaacttca

SEQ ID NO: 617073 - DNA, 25 bp, Rattus norvegicus
tgcacggcggctccgttgctgtaac

SEQ ID NO: 617074 - DNA, 25 bp, Rattus norvegicus
tgcacggcggctgcgttgctgtaac

SEQ ID NO: 617075 - DNA, 25 bp, Rattus norvegicus
tgcacgggttgtagattctgtcttc

SEQ ID NO: 617076 - DNA, 25 bp, Rattus norvegicus
tgcacgggttgttgattctgtcttc

SEQ ID NO: 617077 - DNA, 25 bp, Rattus norvegicus
tgcacggtacacaggaggtcttcct

SEQ ID NO: 617078 - DNA, 25 bp, Rattus norvegicus
tgcacggtacactggaggtcttcct

SEQ ID NO: 617079 - DNA, 25 bp, Rattus norvegicus
tgcacggtgataacccagggctgga

SEQ ID NO: 617080 - DNA, 25 bp, Rattus norvegicus
tgcacggtgatatcccagggctgga

SEQ ID NO: 617081 - DNA, 25 bp, Rattus norvegicus
tgcacggttgtcattacctctggaa

SEQ ID NO: 617082 - DNA, 25 bp, Rattus norvegicus
tgcacggttgtctttacctctggaa

SEQ ID NO: 617083 - DNA, 25 bp, Rattus norvegicus
tgcacgtactcaattgtccccaagg

SEQ ID NO: 617084 - DNA, 25 bp, Rattus norvegicus
tgcacgtactcatttgtccccaagg

SEQ ID NO: 617085 - DNA, 25 bp, Rattus norvegicus
tgcacgtccctgacgtacttagaga

SEQ ID NO: 617086 - DNA, 25 bp, Rattus norvegicus
tgcacgtccctgtcgtacttagaga

SEQ ID NO: 617087 - DNA, 25 bp, Rattus norvegicus
tgcacgtctcttactaagtctcggt

SEQ ID NO: 617088 - DNA, 25 bp, Rattus norvegicus
tgcacgtctctttctaagtctcggt

SEQ ID NO: 617089 - DNA, 25 bp, Rattus norvegicus
tgcacgtgaccgaggaggtgtttaa

SEQ ID NO: 617090 - DNA, 25 bp, Rattus norvegicus
tgcacgtgaccgtggaggtgtttaa

SEQ ID NO: 617091 - DNA, 25 bp, Rattus norvegicus
tgcacgtgagcgacctatgtgatct

SEQ ID NO: 617092 - DNA, 25 bp, Rattus norvegicus
tgcacgtgagcgtcctatgtgatct

SEQ ID NO: 617093 - DNA, 25 bp, Rattus norvegicus
tgcacgtgcagacactggcaaccag

SEQ ID NO: 617094 - DNA, 25 bp, Rattus norvegicus
tgcacgtgcagagactggcaaccag

SEQ ID NO: 617095 - DNA, 25 bp, Rattus norvegicus
tgcacgtgcgaccaaagtctctcga

SEQ ID NO: 617096 - DNA, 25 bp, Rattus norvegicus
tgcacgtgcgacgaaagtctctcga

SEQ ID NO: 617097 - DNA, 25 bp, Rattus norvegicus
tgcacgtgctttactgttttcaagt

SEQ ID NO: 617098 - DNA, 25 bp, Rattus norvegicus
tgcacgtgcttttctgttttcaagt

SEQ ID NO: 617099 - DNA, 25 bp, Rattus norvegicus
tgcacgtgtatgactggagggatct

SEQ ID NO: 617100 - DNA, 25 bp, Rattus norvegicus
tgcacgtgtatgtctggagggatct

SEQ ID NO: 617101 - DNA, 25 bp, Rattus norvegicus
tgcacgtgtcacatcctagtattat

SEQ ID NO: 617102 - DNA, 25 bp, Rattus norvegicus
tgcacgtgtcacttcctagtattat

SEQ ID NO: 617103 - DNA, 25 bp, Rattus norvegicus
tgcacgtgtgtccatgcatgtgcgt

SEQ ID NO: 617104 - DNA, 25 bp, Rattus norvegicus
tgcacgtgtgtcgatgcatgtgcgt

SEQ ID NO: 617105 - DNA, 25 bp, Rattus norvegicus
tgcacgttcagcctttagcaaaaca

SEQ ID NO: 617106 - DNA, 25 bp, Rattus norvegicus
tgcacgttcagcgtttagcaaaaca

SEQ ID NO: 617107 - DNA, 25 bp, Rattus norvegicus
tgcacgttcagtcgcatttgacatt

SEQ ID NO: 617108 - DNA, 25 bp, Rattus norvegicus
tgcacgttcagtggcatttgacatt

SEQ ID NO: 617109 - DNA, 25 bp, Rattus norvegicus
tgcacgttctccatgtttcatacag

SEQ ID NO: 617110 - DNA, 25 bp, Rattus norvegicus
tgcacgttctccttgtttcatacag

SEQ ID NO: 617111 - DNA, 25 bp, Rattus norvegicus
tgcacgttgattcacagctcatcct

SEQ ID NO: 617112 - DNA, 25 bp, Rattus norvegicus
tgcacgttgattgacagctcatcct

SEQ ID NO: 617113 - DNA, 25 bp, Rattus norvegicus
tgcactaagactacctttctaagaa

SEQ ID NO: 617114 - DNA, 25 bp, Rattus norvegicus
tgcactaagacttcctttctaagaa

SEQ ID NO: 617115 - DNA, 25 bp, Rattus norvegicus
tgcactacccacatactgtgtgtaa

SEQ ID NO: 617116 - DNA, 25 bp, Rattus norvegicus
tgcactacccacttactgtgtgtaa

SEQ ID NO: 617117 - DNA, 25 bp, Rattus norvegicus
tgcactactgcaacgacttaattct

SEQ ID NO: 617118 - DNA, 25 bp, Rattus norvegicus
tgcactactgcatcgacttaattct

SEQ ID NO: 617119 - DNA, 25 bp, Rattus norvegicus
tgcactaggtgtacagcagccatca

SEQ ID NO: 617120 - DNA, 25 bp, Rattus norvegicus
tgcactaggtgttcagcagccatca

SEQ ID NO: 617121 - DNA, 25 bp, Rattus norvegicus
tgcactatacctagtgtacagcctc

SEQ ID NO: 617122 - DNA, 25 bp, Rattus norvegicus
tgcactataccttgtgtacagcctc

SEQ ID NO: 617123 - DNA, 25 bp, Rattus norvegicus
tgcactatcaccacctggcaagtta

SEQ ID NO: 617124 - DNA, 25 bp, Rattus norvegicus
tgcactatcacctcctggcaagtta

SEQ ID NO: 617125 - DNA, 25 bp, Rattus norvegicus
tgcactatccatacatctcatttaa

SEQ ID NO: 617126 - DNA, 25 bp, Rattus norvegicus
tgcactatccattcatctcatttaa

SEQ ID NO: 617127 - DNA, 25 bp, Rattus norvegicus
tgcactatggagctgtcatcttcta

SEQ ID NO: 617128 - DNA, 25 bp, Rattus norvegicus
tgcactatggaggtgtcatcttcta

SEQ ID NO: 617129 - DNA, 25 bp, Rattus norvegicus
tgcactattaaccatcatcactcat

SEQ ID NO: 617130 - DNA, 25 bp, Rattus norvegicus
tgcactattaacgatcatcactcat

SEQ ID NO: 617131 - DNA, 25 bp, Rattus norvegicus
tgcactcaagttatttcttacccct

SEQ ID NO: 617132 - DNA, 25 bp, Rattus norvegicus
tgcactcaagttttttcttacccct

SEQ ID NO: 617133 - DNA, 25 bp, Rattus norvegicus
tgcactcacactaggtcgactactt

SEQ ID NO: 617134 - DNA, 25 bp, Rattus norvegicus
tgcactcacacttggtcgactactt

SEQ ID NO: 617135 - DNA, 25 bp, Rattus norvegicus
tgcactcaccaaaataacctacaca

SEQ ID NO: 617136 - DNA, 25 bp, Rattus norvegicus
tgcactcaccaatataacctacaca

SEQ ID NO: 617137 - DNA, 25 bp, Rattus norvegicus
tgcactcaccttacgtattgtacat

SEQ ID NO: 617138 - DNA, 25 bp, Rattus norvegicus
tgcactcacctttcgtattgtacat

SEQ ID NO: 617139 - DNA, 25 bp, Rattus norvegicus
tgcactcagaataacacccactcag

SEQ ID NO: 617140 - DNA, 25 bp, Rattus norvegicus
tgcactcagaattacacccactcag

SEQ ID NO: 617141 - DNA, 25 bp, Rattus norvegicus
tgcactcatcaaccaaaggcaggtg

SEQ ID NO: 617142 - DNA, 25 bp, Rattus norvegicus
tgcactcatcaagcaaaggcaggtg

SEQ ID NO: 617143 - DNA, 25 bp, Rattus norvegicus
tgcactcatggtaagatggccctga

SEQ ID NO: 617144 - DNA, 25 bp, Rattus norvegicus
tgcactcatggttagatggccctga

SEQ ID NO: 617145 - DNA, 25 bp, Rattus norvegicus
tgcactcatgtacttcgtttgactt

SEQ ID NO: 617146 - DNA, 25 bp, Rattus norvegicus
tgcactcatgtagttcgtttgactt

SEQ ID NO: 617147 - DNA, 25 bp, Rattus norvegicus
tgcactccagccagtgtttgcagtc

SEQ ID NO: 617148 - DNA, 25 bp, Rattus norvegicus
tgcactccagcctgtgtttgcagtc

SEQ ID NO: 617149 - DNA, 25 bp, Rattus norvegicus
tgcactccaggaagctacgttgact

SEQ ID NO: 617150 - DNA, 25 bp, Rattus norvegicus
tgcactccaggatgctacgttgact

SEQ ID NO: 617151 - DNA, 25 bp, Rattus norvegicus
tgcactccagtaataacaatgttga

SEQ ID NO: 617152 - DNA, 25 bp, Rattus norvegicus
tgcactccagtattaacaatgttga

SEQ ID NO: 617153 - DNA, 25 bp, Rattus norvegicus
tgcactccattccaaccagtgggat

SEQ ID NO: 617154 - DNA, 25 bp, Rattus norvegicus
tgcactccattcgaaccagtgggat

SEQ ID NO: 617155 - DNA, 25 bp, Rattus norvegicus
tgcactcccatcatgtttgtattag

SEQ ID NO: 617156 - DNA, 25 bp, Rattus norvegicus
tgcactcccatcttgtttgtattag

SEQ ID NO: 617157 - DNA, 25 bp, Rattus norvegicus
tgcactccctaaagttgcagaatta

SEQ ID NO: 617158 - DNA, 25 bp, Rattus norvegicus
tgcactccctaatgttgcagaatta

SEQ ID NO: 617159 - DNA, 25 bp, Rattus norvegicus
tgcactccggttacctttcataaag

SEQ ID NO: 617160 - DNA, 25 bp, Rattus norvegicus
tgcactccggtttcctttcataaag

SEQ ID NO: 617161 - DNA, 25 bp, Rattus norvegicus
tgcactcctgtgcactgtcagtgag

SEQ ID NO: 617162 - DNA, 25 bp, Rattus norvegicus
tgcactcctgtggactgtcagtgag

SEQ ID NO: 617163 - DNA, 25 bp, Rattus norvegicus
tgcactccttgaacaaggattgagg

SEQ ID NO: 617164 - DNA, 25 bp, Rattus norvegicus
tgcactccttgatcaaggattgagg

SEQ ID NO: 617165 - DNA, 25 bp, Rattus norvegicus
tgcactccttggacgagccgctcga

SEQ ID NO: 617166 - DNA, 25 bp, Rattus norvegicus
tgcactccttggtcgagccgctcga

SEQ ID NO: 617167 - DNA, 25 bp, Rattus norvegicus
tgcactcctttcactgatagctaga

SEQ ID NO: 617168 - DNA, 25 bp, Rattus norvegicus
tgcactcctttctctgatagctaga

SEQ ID NO: 617169 - DNA, 25 bp, Rattus norvegicus
tgcactcgatgaagcgaccctgtaa

SEQ ID NO: 617170 - DNA, 25 bp, Rattus norvegicus
tgcactcgatgatgcgaccctgtaa

SEQ ID NO: 617171 - DNA, 25 bp, Rattus norvegicus
tgcactcgggaaccagaatcaagtt

SEQ ID NO: 617172 - DNA, 25 bp, Rattus norvegicus
tgcactcgggaagcagaatcaagtt

SEQ ID NO: 617173 - DNA, 25 bp, Rattus norvegicus
tgcactcgttttcgcattgcagcta

SEQ ID NO: 617174 - DNA, 25 bp, Rattus norvegicus
tgcactcgttttggcattgcagcta

SEQ ID NO: 617175 - DNA, 25 bp, Rattus norvegicus
tgcactctcagtaagcttagggatt

SEQ ID NO: 617176 - DNA, 25 bp, Rattus norvegicus
tgcactctcagttagcttagggatt

SEQ ID NO: 617177 - DNA, 25 bp, Rattus norvegicus
tgcactctcataagtccagggtagt

SEQ ID NO: 617178 - DNA, 25 bp, Rattus norvegicus
tgcactctcatatgtccagggtagt

SEQ ID NO: 617179 - DNA, 25 bp, Rattus norvegicus
tgcactctcccgatggctgcttgga

SEQ ID NO: 617180 - DNA, 25 bp, Rattus norvegicus
tgcactctcccgttggctgcttgga

SEQ ID NO: 617181 - DNA, 25 bp, Rattus norvegicus
tgcactctgatcagggctggtgagc

SEQ ID NO: 617182 - DNA, 25 bp, Rattus norvegicus
tgcactctgatctgggctggtgagc

SEQ ID NO: 617183 - DNA, 25 bp, Rattus norvegicus
tgcactctgcgcacttggaggacaa

SEQ ID NO: 617184 - DNA, 25 bp, Rattus norvegicus
tgcactctgcgctcttggaggacaa

SEQ ID NO: 617185 - DNA, 25 bp, Rattus norvegicus
tgcactctgtgcaaggctccatggt

SEQ ID NO: 617186 - DNA, 25 bp, Rattus norvegicus
tgcactctgtgcacattgactcaga

SEQ ID NO: 617187 - DNA, 25 bp, Rattus norvegicus
tgcactctgtgctaggctccatggt

SEQ ID NO: 617188 - DNA, 25 bp, Rattus norvegicus
tgcactctgtgctcattgactcaga

SEQ ID NO: 617189 - DNA, 25 bp, Rattus norvegicus
tgcactcttggcatcgggaacgcaa

SEQ ID NO: 617190 - DNA, 25 bp, Rattus norvegicus
tgcactcttggcttcgggaacgcaa

SEQ ID NO: 617191 - DNA, 25 bp, Rattus norvegicus
tgcactctttgcagggatactggat

SEQ ID NO: 617192 - DNA, 25 bp, Rattus norvegicus
tgcactctttgctgggatactggat

SEQ ID NO: 617193 - DNA, 25 bp, Rattus norvegicus
tgcactgaaacaccacattatagaa

SEQ ID NO: 617194 - DNA, 25 bp, Rattus norvegicus
tgcactgaaacagcacattatagaa

SEQ ID NO: 617195 - DNA, 25 bp, Rattus norvegicus
tgcactgaatgcaacccggtcaact

SEQ ID NO: 617196 - DNA, 25 bp, Rattus norvegicus
tgcactgaatgctacccggtcaact

SEQ ID NO: 617197 - DNA, 25 bp, Rattus norvegicus
tgcactgaccacattgctgctgtag

SEQ ID NO: 617198 - DNA, 25 bp, Rattus norvegicus
tgcactgaccactttgctgctgtag

SEQ ID NO: 617199 - DNA, 25 bp, Rattus norvegicus
tgcactgacctgactgacgctcatg

SEQ ID NO: 617200 - DNA, 25 bp, Rattus norvegicus
tgcactgacctgtctgacgctcatg

SEQ ID NO: 617201 - DNA, 25 bp, Rattus norvegicus
tgcactgactctacagtggctacca

SEQ ID NO: 617202 - DNA, 25 bp, Rattus norvegicus
tgcactgactcttcagtggctacca

SEQ ID NO: 617203 - DNA, 25 bp, Rattus norvegicus
tgcactgatcgcagccaatgcactc

SEQ ID NO: 617204 - DNA, 25 bp, Rattus norvegicus
tgcactgatcgctgccaatgcactc

SEQ ID NO: 617205 - DNA, 25 bp, Rattus norvegicus
tgcactgatgacctttgaccaacta

SEQ ID NO: 617206 - DNA, 25 bp, Rattus norvegicus
tgcactgatgacgtttgaccaacta

SEQ ID NO: 617207 - DNA, 25 bp, Rattus norvegicus
tgcactgatgctagtcagctgcatg

SEQ ID NO: 617208 - DNA, 25 bp, Rattus norvegicus
tgcactgatgcttgtcagctgcatg

SEQ ID NO: 617209 - DNA, 25 bp, Rattus norvegicus
tgcactgatgtgacgaaccttattc

SEQ ID NO: 617210 - DNA, 25 bp, Rattus norvegicus
tgcactgatgtgtcgaaccttattc

SEQ ID NO: 617211 - DNA, 25 bp, Rattus norvegicus
tgcactgattaaatgtacagccggc

SEQ ID NO: 617212 - DNA, 25 bp, Rattus norvegicus
tgcactgattaattgtacagccggc

SEQ ID NO: 617213 - DNA, 25 bp, Rattus norvegicus
tgcactgcaactctaggccgggttt

SEQ ID NO: 617214 - DNA, 25 bp, Rattus norvegicus
tgcactgcaactgtaggccgggttt

SEQ ID NO: 617215 - DNA, 25 bp, Rattus norvegicus
tgcactgcagttaactctaaggagt

SEQ ID NO: 617216 - DNA, 25 bp, Rattus norvegicus
tgcactgcagtttactctaaggagt

SEQ ID NO: 617217 - DNA, 25 bp, Rattus norvegicus
tgcactgcatcaagtccctgggagt

SEQ ID NO: 617218 - DNA, 25 bp, Rattus norvegicus
tgcactgcatcatgtccctgggagt

SEQ ID NO: 617219 - DNA, 25 bp, Rattus norvegicus
tgcactgcatccacaagtggctgaa

SEQ ID NO: 617220 - DNA, 25 bp, Rattus norvegicus
tgcactgcatcctcaagtggctgaa

SEQ ID NO: 617221 - DNA, 25 bp, Rattus norvegicus
tgcactgcctagacttcttactaaa

SEQ ID NO: 617222 - DNA, 25 bp, Rattus norvegicus
tgcactgcctagtcttcttactaaa

SEQ ID NO: 617223 - DNA, 25 bp, Rattus norvegicus
tgcactgcgcatcgttgccaaatat

SEQ ID NO: 617224 - DNA, 25 bp, Rattus norvegicus
tgcactgcgcatggttgccaaatat

SEQ ID NO: 617225 - DNA, 25 bp, Rattus norvegicus
tgcactgcgcgcacggctacgggaa

SEQ ID NO: 617226 - DNA, 25 bp, Rattus norvegicus
tgcactgcgcgctcggctacgggaa

SEQ ID NO: 617227 - DNA, 25 bp, Rattus norvegicus
tgcactgctcttagaatggtccgaa

SEQ ID NO: 617228 - DNA, 25 bp, Rattus norvegicus
tgcactgctctttgaatggtccgaa

SEQ ID NO: 617229 - DNA, 25 bp, Rattus norvegicus
tgcactgcttctctttgttcctgaa

SEQ ID NO: 617230 - DNA, 25 bp, Rattus norvegicus
tgcactgcttctgtttgttcctgaa

SEQ ID NO: 617231 - DNA, 25 bp, Rattus norvegicus
tgcactgctttgactccggaataaa

SEQ ID NO: 617232 - DNA, 25 bp, Rattus norvegicus
tgcactgctttgtctccggaataaa

SEQ ID NO: 617233 - DNA, 25 bp, Rattus norvegicus
tgcactggagtgcttctgaagccac

SEQ ID NO: 617234 - DNA, 25 bp, Rattus norvegicus
tgcactggagtggttctgaagccac

SEQ ID NO: 617235 - DNA, 25 bp, Rattus norvegicus
tgcactggccacaaggaagcctttt

SEQ ID NO: 617236 - DNA, 25 bp, Rattus norvegicus
tgcactggccactaggaagcctttt

SEQ ID NO: 617237 - DNA, 25 bp, Rattus norvegicus
tgcactggccagacatttctaaagc

SEQ ID NO: 617238 - DNA, 25 bp, Rattus norvegicus
tgcactggccagtcatttctaaagc

SEQ ID NO: 617239 - DNA, 25 bp, Rattus norvegicus
tgcactggcctcactcagattgaaa

SEQ ID NO: 617240 - DNA, 25 bp, Rattus norvegicus
tgcactggcctctctcagattgaaa

SEQ ID NO: 617241 - DNA, 25 bp, Rattus norvegicus
tgcactggcctgagatgcggattcc

SEQ ID NO: 617242 - DNA, 25 bp, Rattus norvegicus
tgcactggcctgtgatgcggattcc

SEQ ID NO: 617243 - DNA, 25 bp, Rattus norvegicus
tgcactgtacataccacgagcattg

SEQ ID NO: 617244 - DNA, 25 bp, Rattus norvegicus
tgcactgtacattccacgagcattg

SEQ ID NO: 617245 - DNA, 25 bp, Rattus norvegicus
tgcactgtatctcttctggtgtcca

SEQ ID NO: 617246 - DNA, 25 bp, Rattus norvegicus
tgcactgtatctgttctggtgtcca

SEQ ID NO: 617247 - DNA, 25 bp, Rattus norvegicus
tgcactgtccctctgctcatgaact

SEQ ID NO: 617248 - DNA, 25 bp, Rattus norvegicus
tgcactgtccctgtgctcatgaact

SEQ ID NO: 617249 - DNA, 25 bp, Rattus norvegicus
tgcactgtcctacgcatacctttat

SEQ ID NO: 617250 - DNA, 25 bp, Rattus norvegicus
tgcactgtcctaggcatacctttat

SEQ ID NO: 617251 - DNA, 25 bp, Rattus norvegicus
tgcactgtctgtcgttgagatacct

SEQ ID NO: 617252 - DNA, 25 bp, Rattus norvegicus
tgcactgtctgtggttgagatacct

SEQ ID NO: 617253 - DNA, 25 bp, Rattus norvegicus
tgcactgtgaccaagagttcccaat

SEQ ID NO: 617254 - DNA, 25 bp, Rattus norvegicus
tgcactgtgacctagagttcccaat

SEQ ID NO: 617255 - DNA, 25 bp, Rattus norvegicus
tgcactgtgtcaaccatgccaaaca

SEQ ID NO: 617256 - DNA, 25 bp, Rattus norvegicus
tgcactgtgtcatccatgccaaaca

SEQ ID NO: 617257 - DNA, 25 bp, Rattus norvegicus
tgcactgttaccagcttgccttttc

SEQ ID NO: 617258 - DNA, 25 bp, Rattus norvegicus
tgcactgttacctgcttgccttttc

SEQ ID NO: 617259 - DNA, 25 bp, Rattus norvegicus
tgcactgttgctacacctccgtttt

SEQ ID NO: 617260 - DNA, 25 bp, Rattus norvegicus
tgcactgttgcttcacctccgtttt

SEQ ID NO: 617261 - DNA, 25 bp, Rattus norvegicus
tgcactgttgtgacttgttggccat

SEQ ID NO: 617262 - DNA, 25 bp, Rattus norvegicus
tgcactgttgtgtcttgttggccat

SEQ ID NO: 617263 - DNA, 25 bp, Rattus norvegicus
tgcactgtttgtactcccaagcaga

SEQ ID NO: 617264 - DNA, 25 bp, Rattus norvegicus
tgcactgtttgttctcccaagcaga

SEQ ID NO: 617265 - DNA, 25 bp, Rattus norvegicus
tgcacttagtcacagggctatctct

SEQ ID NO: 617266 - DNA, 25 bp, Rattus norvegicus
tgcacttagtcagagggctatctct

SEQ ID NO: 617267 - DNA, 25 bp, Rattus norvegicus
tgcacttatcctcaggccttagagt

SEQ ID NO: 617268 - DNA, 25 bp, Rattus norvegicus
tgcacttatcctgaggccttagagt

SEQ ID NO: 617269 - DNA, 25 bp, Rattus norvegicus
tgcacttattttcgcgtttgtctac

SEQ ID NO: 617270 - DNA, 25 bp, Rattus norvegicus
tgcacttattttggcgtttgtctac

SEQ ID NO: 617271 - DNA, 25 bp, Rattus norvegicus
tgcacttcacccaggcagatggagg

SEQ ID NO: 617272 - DNA, 25 bp, Rattus norvegicus
tgcacttcaccctggcagatggagg

SEQ ID NO: 617273 - DNA, 25 bp, Rattus norvegicus
tgcacttccagtatgaggtcaccga

SEQ ID NO: 617274 - DNA, 25 bp, Rattus norvegicus
tgcacttccagtttgaggtcaccga

SEQ ID NO: 617275 - DNA, 25 bp, Rattus norvegicus
tgcacttcccttagctcaagaatct

SEQ ID NO: 617276 - DNA, 25 bp, Rattus norvegicus
tgcacttcccttctgatatcagagt

SEQ ID NO: 617277 - DNA, 25 bp, Rattus norvegicus
tgcacttcccttgtgatatcagagt

SEQ ID NO: 617278 - DNA, 25 bp, Rattus norvegicus
tgcacttccctttgctcaagaatct

SEQ ID NO: 617279 - DNA, 25 bp, Rattus norvegicus
tgcacttcctggacattcctagaaa

SEQ ID NO: 617280 - DNA, 25 bp, Rattus norvegicus
tgcacttcctggtcattcctagaaa

SEQ ID NO: 617281 - DNA, 25 bp, Rattus norvegicus
tgcacttcgcgcacttcgtgtcggt

SEQ ID NO: 617282 - DNA, 25 bp, Rattus norvegicus
tgcacttcgcgctcttcgtgtcggt

SEQ ID NO: 617283 - DNA, 25 bp, Rattus norvegicus
tgcacttcgtccattaggagtctgt

SEQ ID NO: 617284 - DNA, 25 bp, Rattus norvegicus
tgcacttcgtcctttaggagtctgt

SEQ ID NO: 617285 - DNA, 25 bp, Rattus norvegicus
tgcacttctatacagaggctgcccg

SEQ ID NO: 617286 - DNA, 25 bp, Rattus norvegicus
tgcacttctatagagaggctgcccg

SEQ ID NO: 617287 - DNA, 25 bp, Rattus norvegicus
tgcacttctcttaggtctgtttata

SEQ ID NO: 617288 - DNA, 25 bp, Rattus norvegicus
tgcacttctctttggtctgtttata

SEQ ID NO: 617289 - DNA, 25 bp, Rattus norvegicus
tgcacttctttcagtaatcatactt

SEQ ID NO: 617290 - DNA, 25 bp, Rattus norvegicus
tgcacttctttctgtaatcatactt

SEQ ID NO: 617291 - DNA, 25 bp, Rattus norvegicus
tgcacttgaaggcaggaccctctga

SEQ ID NO: 617292 - DNA, 25 bp, Rattus norvegicus
tgcacttgaagggaggaccctctga

SEQ ID NO: 617293 - DNA, 25 bp, Rattus norvegicus
tgcacttgccacagctgtgtagcgg

SEQ ID NO: 617294 - DNA, 25 bp, Rattus norvegicus
tgcacttgccactgctgtgtagcgg

SEQ ID NO: 617295 - DNA, 25 bp, Rattus norvegicus
tgcacttgccttatgctctggaatc

SEQ ID NO: 617296 - DNA, 25 bp, Rattus norvegicus
tgcacttgccttttgctctggaatc

SEQ ID NO: 617297 - DNA, 25 bp, Rattus norvegicus
tgcacttgcgtccagttcgtgtaga

SEQ ID NO: 617298 - DNA, 25 bp, Rattus norvegicus
tgcacttgcgtcgagttcgtgtaga

SEQ ID NO: 617299 - DNA, 25 bp, Rattus norvegicus
tgcacttgctaacgactgggtggtt

SEQ ID NO: 617300 - DNA, 25 bp, Rattus norvegicus
tgcacttgctaaggactgggtggtt

SEQ ID NO: 617301 - DNA, 25 bp, Rattus norvegicus
tgcacttggtgcaacatgagagctt

SEQ ID NO: 617302 - DNA, 25 bp, Rattus norvegicus
tgcacttggtgctacatgagagctt

SEQ ID NO: 617303 - DNA, 25 bp, Rattus norvegicus
tgcacttgtgcaccattctggacgc

SEQ ID NO: 617304 - DNA, 25 bp, Rattus norvegicus
tgcacttgtgcagcattctggacgc

SEQ ID NO: 617305 - DNA, 25 bp, Rattus norvegicus
tgcacttgtgtgaaccatacatgta

SEQ ID NO: 617306 - DNA, 25 bp, Rattus norvegicus
tgcacttgtgtgtaccatacatgta

SEQ ID NO: 617307 - DNA, 25 bp, Rattus norvegicus
tgcactttaatgactgtccatcctt

SEQ ID NO: 617308 - DNA, 25 bp, Rattus norvegicus
tgcactttaatgtctgtccatcctt

SEQ ID NO: 617309 - DNA, 25 bp, Rattus norvegicus
tgcactttatttattgcttccgcgc

SEQ ID NO: 617310 - DNA, 25 bp, Rattus norvegicus
tgcactttattttttgcttccgcgc

SEQ ID NO: 617311 - DNA, 25 bp, Rattus norvegicus
tgcactttcaccctggagagacata

SEQ ID NO: 617312 - DNA, 25 bp, Rattus norvegicus
tgcactttcaccgtggagagacata

SEQ ID NO: 617313 - DNA, 25 bp, Rattus norvegicus
tgcactttccccagtcctttgtgtc

SEQ ID NO: 617314 - DNA, 25 bp, Rattus norvegicus
tgcactttcccctgtcctttgtgtc

SEQ ID NO: 617315 - DNA, 25 bp, Rattus norvegicus
tgcactttccctctcacttaagata

SEQ ID NO: 617316 - DNA, 25 bp, Rattus norvegicus
tgcactttccctgtcacttaagata

SEQ ID NO: 617317 - DNA, 25 bp, Rattus norvegicus
tgcactttgaaaagacactgtcctc

SEQ ID NO: 617318 - DNA, 25 bp, Rattus norvegicus
tgcactttgaaatgacactgtcctc

SEQ ID NO: 617319 - DNA, 25 bp, Rattus norvegicus
tgcactttgacaatcccaggaggga

SEQ ID NO: 617320 - DNA, 25 bp, Rattus norvegicus
tgcactttgacattcccaggaggga

SEQ ID NO: 617321 - DNA, 25 bp, Rattus norvegicus
tgcactttgccgcactggatggaat

SEQ ID NO: 617322 - DNA, 25 bp, Rattus norvegicus
tgcactttgccggactggatggaat

SEQ ID NO: 617323 - DNA, 25 bp, Rattus norvegicus
tgcactttgctcatggtaagctcca

SEQ ID NO: 617324 - DNA, 25 bp, Rattus norvegicus
tgcactttgctcttggtaagctcca

SEQ ID NO: 617325 - DNA, 25 bp, Rattus norvegicus
tgcactttggctcattcatcacgag

SEQ ID NO: 617326 - DNA, 25 bp, Rattus norvegicus
tgcactttggctgattcatcacgag

SEQ ID NO: 617327 - DNA, 25 bp, Rattus norvegicus
tgcactttggtgatctctatcctgg

SEQ ID NO: 617328 - DNA, 25 bp, Rattus norvegicus
tgcactttggtgttctctatcctgg

SEQ ID NO: 617329 - DNA, 25 bp, Rattus norvegicus
tgcactttgtgtagccccaagacat

SEQ ID NO: 617330 - DNA, 25 bp, Rattus norvegicus
tgcactttgtgttgccccaagacat

SEQ ID NO: 617331 - DNA, 25 bp, Rattus norvegicus
tgcacttttaggagagccactgctg

SEQ ID NO: 617332 - DNA, 25 bp, Rattus norvegicus
tgcacttttaggtgagccactgctg

SEQ ID NO: 617333 - DNA, 25 bp, Rattus norvegicus
tgcacttttctaaccagtcagttgc

SEQ ID NO: 617334 - DNA, 25 bp, Rattus norvegicus
tgcacttttctatccagtcagttgc

SEQ ID NO: 617335 - DNA, 25 bp, Rattus norvegicus
tgcacttttcttcgtcttggctaca

SEQ ID NO: 617336 - DNA, 25 bp, Rattus norvegicus
tgcacttttcttggtcttggctaca

SEQ ID NO: 617337 - DNA, 25 bp, Rattus norvegicus
tgcagaaaaccaaatagcccacctt

SEQ ID NO: 617338 - DNA, 25 bp, Rattus norvegicus
tgcagaaaaccatatagcccacctt

SEQ ID NO: 617339 - DNA, 25 bp, Rattus norvegicus
tgcagaaacaggacaaacagcgcta

SEQ ID NO: 617340 - DNA, 25 bp, Rattus norvegicus
tgcagaaacaggtcaaacagcgcta

SEQ ID NO: 617341 - DNA, 25 bp, Rattus norvegicus
tgcagaaacccgaccactatttatt

SEQ ID NO: 617342 - DNA, 25 bp, Rattus norvegicus
tgcagaaacccgtccactatttatt

SEQ ID NO: 617343 - DNA, 25 bp, Rattus norvegicus
tgcagaaagggaacacgtgctgtca

SEQ ID NO: 617344 - DNA, 25 bp, Rattus norvegicus
tgcagaaagggatcacgtgctgtca

SEQ ID NO: 617345 - DNA, 25 bp, Rattus norvegicus
tgcagaaagttcctgggcgatgacc

SEQ ID NO: 617346 - DNA, 25 bp, Rattus norvegicus
tgcagaaagttcgtgggcgatgacc

SEQ ID NO: 617347 - DNA, 25 bp, Rattus norvegicus
tgcagaaatctgcaaccctcgagag

SEQ ID NO: 617348 - DNA, 25 bp, Rattus norvegicus
tgcagaaatctggaaccctcgagag

SEQ ID NO: 617349 - DNA, 25 bp, Rattus norvegicus
tgcagaacacctagggagccgtggt

SEQ ID NO: 617350 - DNA, 25 bp, Rattus norvegicus
tgcagaacaccttgggagccgtggt

SEQ ID NO: 617351 - DNA, 25 bp, Rattus norvegicus
tgcagaaccagcatgtggccatagt

SEQ ID NO: 617352 - DNA, 25 bp, Rattus norvegicus
tgcagaaccagcttgtggccatagt

SEQ ID NO: 617353 - DNA, 25 bp, Rattus norvegicus
tgcagaacccgtccagtgacatcag

SEQ ID NO: 617354 - DNA, 25 bp, Rattus norvegicus
tgcagaacccgtgcagtgacatcag

SEQ ID NO: 617355 - DNA, 25 bp, Rattus norvegicus
tgcagaacccttaccagagtctgac

SEQ ID NO: 617356 - DNA, 25 bp, Rattus norvegicus
tgcagaaccctttccagagtctgac

SEQ ID NO: 617357 - DNA, 25 bp, Rattus norvegicus
tgcagaaccgagaggcagcttgtct

SEQ ID NO: 617358 - DNA, 25 bp, Rattus norvegicus
tgcagaaccgagtggcagcttgtct

SEQ ID NO: 617359 - DNA, 25 bp, Rattus norvegicus
tgcagaacctggcacagtacatctt

SEQ ID NO: 617360 - DNA, 25 bp, Rattus norvegicus
tgcagaacctgggacagtacatctt

SEQ ID NO: 617361 - DNA, 25 bp, Rattus norvegicus
tgcagaacctgtatgccgagggcaa

SEQ ID NO: 617362 - DNA, 25 bp, Rattus norvegicus
tgcagaacctgtttgccgagggcaa

SEQ ID NO: 617363 - DNA, 25 bp, Rattus norvegicus
tgcagaactatcacaccgaggctct

SEQ ID NO: 617364 - DNA, 25 bp, Rattus norvegicus
tgcagaactatctcaccgaggctct

SEQ ID NO: 617365 - DNA, 25 bp, Rattus norvegicus
tgcagaactgcaccgcagccctagt

SEQ ID NO: 617366 - DNA, 25 bp, Rattus norvegicus
tgcagaactgcagcgcagccctagt

SEQ ID NO: 617367 - DNA, 25 bp, Rattus norvegicus
tgcagaactggcctcataactaaat

SEQ ID NO: 617368 - DNA, 25 bp, Rattus norvegicus
tgcagaactggcgtcataactaaat

SEQ ID NO: 617369 - DNA, 25 bp, Rattus norvegicus
tgcagaagaacacttcctgtcccag

SEQ ID NO: 617370 - DNA, 25 bp, Rattus norvegicus
tgcagaagaacagttcctgtcccag

SEQ ID NO: 617371 - DNA, 25 bp, Rattus norvegicus
tgcagaagagatatccacagctatc

SEQ ID NO: 617372 - DNA, 25 bp, Rattus norvegicus
tgcagaagagatttccacagctatc

SEQ ID NO: 617373 - DNA, 25 bp, Rattus norvegicus
tgcagaagatcccaggtcatcacct

SEQ ID NO: 617374 - DNA, 25 bp, Rattus norvegicus
tgcagaagatccgaggtcatcacct

SEQ ID NO: 617375 - DNA, 25 bp, Rattus norvegicus
tgcagaagcaccacaagcagcagca

SEQ ID NO: 617376 - DNA, 25 bp, Rattus norvegicus
tgcagaagcacctcaagcagcagca

SEQ ID NO: 617377 - DNA, 25 bp, Rattus norvegicus
tgcagaagcagactcgggctggcca

SEQ ID NO: 617378 - DNA, 25 bp, Rattus norvegicus
tgcagaagcagagtcgggctggcca

SEQ ID NO: 617379 - DNA, 25 bp, Rattus norvegicus
tgcagaagcccaaagaatttgtact

SEQ ID NO: 617380 - DNA, 25 bp, Rattus norvegicus
tgcagaagcccatagaatttgtact

SEQ ID NO: 617381 - DNA, 25 bp, Rattus norvegicus
tgcagaagcgccaggcggtgtacaa

SEQ ID NO: 617382 - DNA, 25 bp, Rattus norvegicus
tgcagaagcgcctggcggtgtacaa

SEQ ID NO: 617383 - DNA, 25 bp, Rattus norvegicus
tgcagaagctggacgcgcaggtcaa

SEQ ID NO: 617384 - DNA, 25 bp, Rattus norvegicus
tgcagaagctggtcgcgcaggtcaa

SEQ ID NO: 617385 - DNA, 25 bp, Rattus norvegicus
tgcagaaggtatccacttctcctag

SEQ ID NO: 617386 - DNA, 25 bp, Rattus norvegicus
tgcagaaggtatgcacttctcctag

SEQ ID NO: 617387 - DNA, 25 bp, Rattus norvegicus
tgcagaaggtccaggcagccactga

SEQ ID NO: 617388 - DNA, 25 bp, Rattus norvegicus
tgcagaaggtcctggcagccactga

SEQ ID NO: 617389 - DNA, 25 bp, Rattus norvegicus
tgcagaagtaacatatccttcatga

SEQ ID NO: 617390 - DNA, 25 bp, Rattus norvegicus
tgcagaagtaacttatccttcatga

SEQ ID NO: 617391 - DNA, 25 bp, Rattus norvegicus
tgcagaagtgccatgctctctgtac

SEQ ID NO: 617392 - DNA, 25 bp, Rattus norvegicus
tgcagaagtgccttgctctctgtac

SEQ ID NO: 617393 - DNA, 25 bp, Rattus norvegicus
tgcagaagtttcagccaaggcagaa

SEQ ID NO: 617394 - DNA, 25 bp, Rattus norvegicus
tgcagaagtttctgccaaggcagaa

SEQ ID NO: 617395 - DNA, 25 bp, Rattus norvegicus
tgcagaatacctagagggcccttcc

SEQ ID NO: 617396 - DNA, 25 bp, Rattus norvegicus
tgcagaataccttgagggcccttcc

SEQ ID NO: 617397 - DNA, 25 bp, Rattus norvegicus
tgcagaatatttacgcggcctatct

SEQ ID NO: 617398 - DNA, 25 bp, Rattus norvegicus
tgcagaatattttcgcggcctatct

SEQ ID NO: 617399 - DNA, 25 bp, Rattus norvegicus
tgcagaatcacaagacacctcctgt

SEQ ID NO: 617400 - DNA, 25 bp, Rattus norvegicus
tgcagaatcacatgacacctcctgt

SEQ ID NO: 617401 - DNA, 25 bp, Rattus norvegicus
tgcagaatctgcacttccaaatgcc

SEQ ID NO: 617402 - DNA, 25 bp, Rattus norvegicus
tgcagaatctgctcttccaaatgcc

SEQ ID NO: 617403 - DNA, 25 bp, Rattus norvegicus
tgcagaatgggcagggctacaccgc

SEQ ID NO: 617404 - DNA, 25 bp, Rattus norvegicus
tgcagaatgggctgggctacaccgc

SEQ ID NO: 617405 - DNA, 25 bp, Rattus norvegicus
tgcagacaatctcagtctagttatt

SEQ ID NO: 617406 - DNA, 25 bp, Rattus norvegicus
tgcagacaatctgagtctagttatt

SEQ ID NO: 617407 - DNA, 25 bp, Rattus norvegicus
tgcagacacaacagcctctttagag

SEQ ID NO: 617408 - DNA, 25 bp, Rattus norvegicus
tgcagacacaactgcctctttagag

SEQ ID NO: 617409 - DNA, 25 bp, Rattus norvegicus
tgcagacacacaccttgttcagaga

SEQ ID NO: 617410 - DNA, 25 bp, Rattus norvegicus
tgcagacacacagcttgttcagaga

SEQ ID NO: 617411 - DNA, 25 bp, Rattus norvegicus
tgcagacacaggacgccgaagtgct

SEQ ID NO: 617412 - DNA, 25 bp, Rattus norvegicus
tgcagacacaggtcgccgaagtgct

SEQ ID NO: 617413 - DNA, 25 bp, Rattus norvegicus
tgcagacacagtacccaggcacggg

SEQ ID NO: 617414 - DNA, 25 bp, Rattus norvegicus
tgcagacacagtactttttgtatct

SEQ ID NO: 617415 - DNA, 25 bp, Rattus norvegicus
tgcagacacagttcccaggcacggg

SEQ ID NO: 617416 - DNA, 25 bp, Rattus norvegicus
tgcagacacagttctttttgtatct

SEQ ID NO: 617417 - DNA, 25 bp, Rattus norvegicus
tgcagacacatcatacagacatatc

SEQ ID NO: 617418 - DNA, 25 bp, Rattus norvegicus
tgcagacacatcttacagacatatc

SEQ ID NO: 617419 - DNA, 25 bp, Rattus norvegicus
tgcagacacctgatgtgcctgggat

SEQ ID NO: 617420 - DNA, 25 bp, Rattus norvegicus
tgcagacacctgttgtgcctgggat

SEQ ID NO: 617421 - DNA, 25 bp, Rattus norvegicus
tgcagacactgactcccctgagaaa

SEQ ID NO: 617422 - DNA, 25 bp, Rattus norvegicus
tgcagacactgagtcccctgagaaa

SEQ ID NO: 617423 - DNA, 25 bp, Rattus norvegicus
tgcagacagaacatgtatacataat

SEQ ID NO: 617424 - DNA, 25 bp, Rattus norvegicus
tgcagacagaacttgtatacataat

SEQ ID NO: 617425 - DNA, 25 bp, Rattus norvegicus
tgcagacagctactcctttgtgttt

SEQ ID NO: 617426 - DNA, 25 bp, Rattus norvegicus
tgcagacagctagtcctttgtgttt

SEQ ID NO: 617427 - DNA, 25 bp, Rattus norvegicus
tgcagacaggacagcctcctacgac

SEQ ID NO: 617428 - DNA, 25 bp, Rattus norvegicus
tgcagacaggactgcctcctacgac

SEQ ID NO: 617429 - DNA, 25 bp, Rattus norvegicus
tgcagacaggttcctatttcaccgg

SEQ ID NO: 617430 - DNA, 25 bp, Rattus norvegicus
tgcagacaggttgctatttcaccgg

SEQ ID NO: 617431 - DNA, 25 bp, Rattus norvegicus
tgcagacagtctctaagacattttc

SEQ ID NO: 617432 - DNA, 25 bp, Rattus norvegicus
tgcagacagtctgtaagacattttc

SEQ ID NO: 617433 - DNA, 25 bp, Rattus norvegicus
tgcagacagtttatgaggccccatg

SEQ ID NO: 617434 - DNA, 25 bp, Rattus norvegicus
tgcagacagtttttgaggccccatg

SEQ ID NO: 617435 - DNA, 25 bp, Rattus norvegicus
tgcagacatacaccactcagagctt

SEQ ID NO: 617436 - DNA, 25 bp, Rattus norvegicus
tgcagacatacagcactcagagctt

SEQ ID NO: 617437 - DNA, 25 bp, Rattus norvegicus
tgcagacattgtatttcacttgaag

SEQ ID NO: 617438 - DNA, 25 bp, Rattus norvegicus
tgcagacattgtttttcacttgaag

SEQ ID NO: 617439 - DNA, 25 bp, Rattus norvegicus
tgcagaccatttccctagcttgtga

SEQ ID NO: 617440 - DNA, 25 bp, Rattus norvegicus
tgcagaccatttgcctagcttgtga

SEQ ID NO: 617441 - DNA, 25 bp, Rattus norvegicus
tgcagaccccgactcagaagtaaac

SEQ ID NO: 617442 - DNA, 25 bp, Rattus norvegicus
tgcagaccccgagtcagaagtaaac

SEQ ID NO: 617443 - DNA, 25 bp, Rattus norvegicus
tgcagaccccggattctattttgca

SEQ ID NO: 617444 - DNA, 25 bp, Rattus norvegicus
tgcagaccccggtttctattttgca

SEQ ID NO: 617445 - DNA, 25 bp, Rattus norvegicus
tgcagacctcgccagactgagaaac

SEQ ID NO: 617446 - DNA, 25 bp, Rattus norvegicus
tgcagacctcgcgagactgagaaac

SEQ ID NO: 617447 - DNA, 25 bp, Rattus norvegicus
tgcagacctgagcatcaggcgccca

SEQ ID NO: 617448 - DNA, 25 bp, Rattus norvegicus
tgcagacctgaggatcaggcgccca

SEQ ID NO: 617449 - DNA, 25 bp, Rattus norvegicus
tgcagacctgcccgcgcacatgaag

SEQ ID NO: 617450 - DNA, 25 bp, Rattus norvegicus
tgcagacctgccggcgcacatgaag

SEQ ID NO: 617451 - DNA, 25 bp, Rattus norvegicus
tgcagacgcacacccgagactatgt

SEQ ID NO: 617452 - DNA, 25 bp, Rattus norvegicus
tgcagacgcacagccgagactatgt

SEQ ID NO: 617453 - DNA, 25 bp, Rattus norvegicus
tgcagacgccggatgagctgtttga

SEQ ID NO: 617454 - DNA, 25 bp, Rattus norvegicus
tgcagacgccggttgagctgtttga

SEQ ID NO: 617455 - DNA, 25 bp, Rattus norvegicus
tgcagacgctctcgctgatagctca

SEQ ID NO: 617456 - DNA, 25 bp, Rattus norvegicus
tgcagacgctctggctgatagctca

SEQ ID NO: 617457 - DNA, 25 bp, Rattus norvegicus
tgcagacgcttgatagagtaggaaa

SEQ ID NO: 617458 - DNA, 25 bp, Rattus norvegicus
tgcagacgcttgttagagtaggaaa

SEQ ID NO: 617459 - DNA, 25 bp, Rattus norvegicus
tgcagacggcctaggctcagctcat

SEQ ID NO: 617460 - DNA, 25 bp, Rattus norvegicus
tgcagacggccttggctcagctcat

SEQ ID NO: 617461 - DNA, 25 bp, Rattus norvegicus
tgcagactaactagggctacaggga

SEQ ID NO: 617462 - DNA, 25 bp, Rattus norvegicus
tgcagactaacttgggctacaggga

SEQ ID NO: 617463 - DNA, 25 bp, Rattus norvegicus
tgcagactaccccactagagaacag

SEQ ID NO: 617464 - DNA, 25 bp, Rattus norvegicus
tgcagactacccgactagagaacag

SEQ ID NO: 617465 - DNA, 25 bp, Rattus norvegicus
tgcagactagcaaggccagcccagg

SEQ ID NO: 617466 - DNA, 25 bp, Rattus norvegicus
tgcagactagcatggccagcccagg

SEQ ID NO: 617467 - DNA, 25 bp, Rattus norvegicus
tgcagactagttcctgtgacccagt

SEQ ID NO: 617468 - DNA, 25 bp, Rattus norvegicus
tgcagactagttgctgtgacccagt

SEQ ID NO: 617469 - DNA, 25 bp, Rattus norvegicus
tgcagactcaaacctgatccagcaa

SEQ ID NO: 617470 - DNA, 25 bp, Rattus norvegicus
tgcagactcaaagctgatccagcaa

SEQ ID NO: 617471 - DNA, 25 bp, Rattus norvegicus
tgcagactccttccatcataagact

SEQ ID NO: 617472 - DNA, 25 bp, Rattus norvegicus
tgcagactccttcgaccacaaaaag

SEQ ID NO: 617473 - DNA, 25 bp, Rattus norvegicus
tgcagactccttgcatcataagact

SEQ ID NO: 617474 - DNA, 25 bp, Rattus norvegicus
tgcagactccttggaccacaaaaag

SEQ ID NO: 617475 - DNA, 25 bp, Rattus norvegicus
tgcagactcgacatgtcctggagag

SEQ ID NO: 617476 - DNA, 25 bp, Rattus norvegicus
tgcagactcgacttgtcctggagag

SEQ ID NO: 617477 - DNA, 25 bp, Rattus norvegicus
tgcagactctgcctgggacatgtga

SEQ ID NO: 617478 - DNA, 25 bp, Rattus norvegicus
tgcagactctgcgtgggacatgtga

SEQ ID NO: 617479 - DNA, 25 bp, Rattus norvegicus
tgcagactcttcaaggccatcgaaa

SEQ ID NO: 617480 - DNA, 25 bp, Rattus norvegicus
tgcagactcttctaggccatcgaaa

SEQ ID NO: 617481 - DNA, 25 bp, Rattus norvegicus
tgcagactgcttcctttggctggaa

SEQ ID NO: 617482 - DNA, 25 bp, Rattus norvegicus
tgcagactgcttgctttggctggaa

SEQ ID NO: 617483 - DNA, 25 bp, Rattus norvegicus
tgcagactggaaagggaccccatcc

SEQ ID NO: 617484 - DNA, 25 bp, Rattus norvegicus
tgcagactggaatgggaccccatcc

SEQ ID NO: 617485 - DNA, 25 bp, Rattus norvegicus
tgcagactggccaaatttctgtccc

SEQ ID NO: 617486 - DNA, 25 bp, Rattus norvegicus
tgcagactggcctaatttctgtccc

SEQ ID NO: 617487 - DNA, 25 bp, Rattus norvegicus
tgcagactgttccttttcgcttttt

SEQ ID NO: 617488 - DNA, 25 bp, Rattus norvegicus
tgcagactgttcgttttcgcttttt

SEQ ID NO: 617489 - DNA, 25 bp, Rattus norvegicus
tgcagacttattatcattcagactt

SEQ ID NO: 617490 - DNA, 25 bp, Rattus norvegicus
tgcagacttattttcattcagactt

SEQ ID NO: 617491 - DNA, 25 bp, Rattus norvegicus
tgcagacttcatccagcagggcatc

SEQ ID NO: 617492 - DNA, 25 bp, Rattus norvegicus
tgcagacttcatgcagcagggcatc

SEQ ID NO: 617493 - DNA, 25 bp, Rattus norvegicus
tgcagagaaagacgacattacagat

SEQ ID NO: 617494 - DNA, 25 bp, Rattus norvegicus
tgcagagaaagaggacattacagat

SEQ ID NO: 617495 - DNA, 25 bp, Rattus norvegicus
tgcagagaactcacactcattccca

SEQ ID NO: 617496 - DNA, 25 bp, Rattus norvegicus
tgcagagaactctcactcattccca

SEQ ID NO: 617497 - DNA, 25 bp, Rattus norvegicus
tgcagagaagctcccgagagaacat

SEQ ID NO: 617498 - DNA, 25 bp, Rattus norvegicus
tgcagagaagctgccgagagaacat

SEQ ID NO: 617499 - DNA, 25 bp, Rattus norvegicus
tgcagagacactccctcttgggaat

SEQ ID NO: 617500 - DNA, 25 bp, Rattus norvegicus
tgcagagacactgcctcttgggaat

SEQ ID NO: 617501 - DNA, 25 bp, Rattus norvegicus
tgcagagacagcaacattccagacc

SEQ ID NO: 617502 - DNA, 25 bp, Rattus norvegicus
tgcagagacagctacattccagacc

SEQ ID NO: 617503 - DNA, 25 bp, Rattus norvegicus
tgcagagagacaacggacagacctt

SEQ ID NO: 617504 - DNA, 25 bp, Rattus norvegicus
tgcagagagacatcggacagacctt

SEQ ID NO: 617505 - DNA, 25 bp, Rattus norvegicus
tgcagagagcacaagcctcgagttt

SEQ ID NO: 617506 - DNA, 25 bp, Rattus norvegicus
tgcagagagcactagcctcgagttt

SEQ ID NO: 617507 - DNA, 25 bp, Rattus norvegicus
tgcagagagccaattactacaagtg

SEQ ID NO: 617508 - DNA, 25 bp, Rattus norvegicus
tgcagagagccatttactacaagtg

SEQ ID NO: 617509 - DNA, 25 bp, Rattus norvegicus
tgcagagaggaacacgtttaatgtt

SEQ ID NO: 617510 - DNA, 25 bp, Rattus norvegicus
tgcagagaggaagacgtttaatgtt

SEQ ID NO: 617511 - DNA, 25 bp, Rattus norvegicus
tgcagagataacaactcctggcctc

SEQ ID NO: 617512 - DNA, 25 bp, Rattus norvegicus
tgcagagataactactcctggcctc

SEQ ID NO: 617513 - DNA, 25 bp, Rattus norvegicus
tgcagagattgcaaattgatcgtgc

SEQ ID NO: 617514 - DNA, 25 bp, Rattus norvegicus
tgcagagattgctaattgatcgtgc

SEQ ID NO: 617515 - DNA, 25 bp, Rattus norvegicus
tgcagagcaaagcttcctcttcctt

SEQ ID NO: 617516 - DNA, 25 bp, Rattus norvegicus
tgcagagcaaaggttcctcttcctt

SEQ ID NO: 617517 - DNA, 25 bp, Rattus norvegicus
tgcagagcacaacgcacttgtcaga

SEQ ID NO: 617518 - DNA, 25 bp, Rattus norvegicus
tgcagagcacaaggcacttgtcaga

SEQ ID NO: 617519 - DNA, 25 bp, Rattus norvegicus
tgcagagcagctatgcccagaccag

SEQ ID NO: 617520 - DNA, 25 bp, Rattus norvegicus
tgcagagcagctttgcccagaccag

SEQ ID NO: 617521 - DNA, 25 bp, Rattus norvegicus
tgcagagcaggaccccagctgccct

SEQ ID NO: 617522 - DNA, 25 bp, Rattus norvegicus
tgcagagcaggagcccagctgccct

SEQ ID NO: 617523 - DNA, 25 bp, Rattus norvegicus
tgcagagcccgactcaacacctgga

SEQ ID NO: 617524 - DNA, 25 bp, Rattus norvegicus
tgcagagcccgagtcaacacctgga

SEQ ID NO: 617525 - DNA, 25 bp, Rattus norvegicus
tgcagagcccgtacagccagtcctg

SEQ ID NO: 617526 - DNA, 25 bp, Rattus norvegicus
tgcagagcccgttcagccagtcctg

SEQ ID NO: 617527 - DNA, 25 bp, Rattus norvegicus
tgcagagccctcatctagaactaac

SEQ ID NO: 617528 - DNA, 25 bp, Rattus norvegicus
tgcagagccctcttctagaactaac

SEQ ID NO: 617529 - DNA, 25 bp, Rattus norvegicus
tgcagagcctcactgggatgtccat

SEQ ID NO: 617530 - DNA, 25 bp, Rattus norvegicus
tgcagagcctcagtgggatgtccat

SEQ ID NO: 617531 - DNA, 25 bp, Rattus norvegicus
tgcagagcctctcgcatccctggag

SEQ ID NO: 617532 - DNA, 25 bp, Rattus norvegicus
tgcagagcctctggcatccctggag

SEQ ID NO: 617533 - DNA, 25 bp, Rattus norvegicus
tgcagagcctttctcaccaacagga

SEQ ID NO: 617534 - DNA, 25 bp, Rattus norvegicus
tgcagagcctttgtcaccaacagga

SEQ ID NO: 617535 - DNA, 25 bp, Rattus norvegicus
tgcagagcgaacatgtaaatacact

SEQ ID NO: 617536 - DNA, 25 bp, Rattus norvegicus
tgcagagcgaacttgtaaatacact

SEQ ID NO: 617537 - DNA, 25 bp, Rattus norvegicus
tgcagagcgccccaacagaaagtaa

SEQ ID NO: 617538 - DNA, 25 bp, Rattus norvegicus
tgcagagcgcccgaacagaaagtaa

SEQ ID NO: 617539 - DNA, 25 bp, Rattus norvegicus
tgcagagcgggacatcgttcagttt

SEQ ID NO: 617540 - DNA, 25 bp, Rattus norvegicus
tgcagagcgggagatcgttcagttt

SEQ ID NO: 617541 - DNA, 25 bp, Rattus norvegicus
tgcagagctatgactgaacggcaga

SEQ ID NO: 617542 - DNA, 25 bp, Rattus norvegicus
tgcagagctatgtctgaacggcaga

SEQ ID NO: 617543 - DNA, 25 bp, Rattus norvegicus
tgcagagctctcagtctaggcaact

SEQ ID NO: 617544 - DNA, 25 bp, Rattus norvegicus
tgcagagctctctgtctaggcaact

SEQ ID NO: 617545 - DNA, 25 bp, Rattus norvegicus
tgcagagctgacacccaaacaggtc

SEQ ID NO: 617546 - DNA, 25 bp, Rattus norvegicus
tgcagagctgactcccaaacaggtc

SEQ ID NO: 617547 - DNA, 25 bp, Rattus norvegicus
tgcagagctttcaccttggttatgt

SEQ ID NO: 617548 - DNA, 25 bp, Rattus norvegicus
tgcagagctttctccttggttatgt

SEQ ID NO: 617549 - DNA, 25 bp, Rattus norvegicus
tgcagaggaaatcccatcatcagtg

SEQ ID NO: 617550 - DNA, 25 bp, Rattus norvegicus
tgcagaggaaatgccatcatcagtg

SEQ ID NO: 617551 - DNA, 25 bp, Rattus norvegicus
tgcagaggacccaaattcagaaact

SEQ ID NO: 617552 - DNA, 25 bp, Rattus norvegicus
tgcagaggacccagattcctgcaat

SEQ ID NO: 617553 - DNA, 25 bp, Rattus norvegicus
tgcagaggaccctaattcagaaact

SEQ ID NO: 617554 - DNA, 25 bp, Rattus norvegicus
tgcagaggaccctgattcctgcaat

SEQ ID NO: 617555 - DNA, 25 bp, Rattus norvegicus
tgcagaggagctccactgctgcagt

SEQ ID NO: 617556 - DNA, 25 bp, Rattus norvegicus
tgcagaggagctgcactgctgcagt

SEQ ID NO: 617557 - DNA, 25 bp, Rattus norvegicus
tgcagaggatgtatccgtcgcctta

SEQ ID NO: 617558 - DNA, 25 bp, Rattus norvegicus
tgcagaggatgtttccgtcgcctta

SEQ ID NO: 617559 - DNA, 25 bp, Rattus norvegicus
tgcagaggccaaaactagacagtgt

SEQ ID NO: 617560 - DNA, 25 bp, Rattus norvegicus
tgcagaggccaatactagacagtgt

SEQ ID NO: 617561 - DNA, 25 bp, Rattus norvegicus
tgcagaggctgcacaggctggcttc

SEQ ID NO: 617562 - DNA, 25 bp, Rattus norvegicus
tgcagaggctgctcaggctggcttc

SEQ ID NO: 617563 - DNA, 25 bp, Rattus norvegicus
tgcagagggacaacgtggcttcaga

SEQ ID NO: 617564 - DNA, 25 bp, Rattus norvegicus
tgcagagggacatcgtggcttcaga

SEQ ID NO: 617565 - DNA, 25 bp, Rattus norvegicus
tgcagagggcttcttttccagctct

SEQ ID NO: 617566 - DNA, 25 bp, Rattus norvegicus
tgcagagggcttgttttccagctct

SEQ ID NO: 617567 - DNA, 25 bp, Rattus norvegicus
tgcagaggtgccacacctgatcctg

SEQ ID NO: 617568 - DNA, 25 bp, Rattus norvegicus
tgcagaggtgcctcacctgatcctg

SEQ ID NO: 617569 - DNA, 25 bp, Rattus norvegicus
tgcagagtcatcactgaccctaaag

SEQ ID NO: 617570 - DNA, 25 bp, Rattus norvegicus
tgcagagtcatctctgaccctaaag

SEQ ID NO: 617571 - DNA, 25 bp, Rattus norvegicus
tgcagagtcccaaaccttttagatc

SEQ ID NO: 617572 - DNA, 25 bp, Rattus norvegicus
tgcagagtcccataccttttagatc

SEQ ID NO: 617573 - DNA, 25 bp, Rattus norvegicus
tgcagagtcgcgctggccttgtttc

SEQ ID NO: 617574 - DNA, 25 bp, Rattus norvegicus
tgcagagtcgcggtggccttgtttc

SEQ ID NO: 617575 - DNA, 25 bp, Rattus norvegicus
tgcagagtctcaaccccgaggaagg

SEQ ID NO: 617576 - DNA, 25 bp, Rattus norvegicus
tgcagagtctcatccccgaggaagg

SEQ ID NO: 617577 - DNA, 25 bp, Rattus norvegicus
tgcagagtctgtccctatttatgta

SEQ ID NO: 617578 - DNA, 25 bp, Rattus norvegicus
tgcagagtctgtctgtcccccatat

SEQ ID NO: 617579 - DNA, 25 bp, Rattus norvegicus
tgcagagtctgtgcctatttatgta

SEQ ID NO: 617580 - DNA, 25 bp, Rattus norvegicus
tgcagagtctgtgtgtcccccatat

SEQ ID NO: 617581 - DNA, 25 bp, Rattus norvegicus
tgcagagtgcctcttctatagatgt

SEQ ID NO: 617582 - DNA, 25 bp, Rattus norvegicus
tgcagagtgcctgttctatagatgt

SEQ ID NO: 617583 - DNA, 25 bp, Rattus norvegicus
tgcagagtgctaacggcttcaatat

SEQ ID NO: 617584 - DNA, 25 bp, Rattus norvegicus
tgcagagtgctatcggcttcaatat

SEQ ID NO: 617585 - DNA, 25 bp, Rattus norvegicus
tgcagataacatagcgaagcggtat

SEQ ID NO: 617586 - DNA, 25 bp, Rattus norvegicus
tgcagataacattgcgaagcggtat

SEQ ID NO: 617587 - DNA, 25 bp, Rattus norvegicus
tgcagatactttcctctcggataaa

SEQ ID NO: 617588 - DNA, 25 bp, Rattus norvegicus
tgcagatactttgctctcggataaa

SEQ ID NO: 617589 - DNA, 25 bp, Rattus norvegicus
tgcagataggcaaccttggccagga

SEQ ID NO: 617590 - DNA, 25 bp, Rattus norvegicus
tgcagataggcatccttggccagga

SEQ ID NO: 617591 - DNA, 25 bp, Rattus norvegicus
tgcagatatgaccaacacccagagt

SEQ ID NO: 617592 - DNA, 25 bp, Rattus norvegicus
tgcagatatgacgaacacccagagt

SEQ ID NO: 617593 - DNA, 25 bp, Rattus norvegicus
tgcagatcaccaagcaggccatggg

SEQ ID NO: 617594 - DNA, 25 bp, Rattus norvegicus
tgcagatcaccatgcaggccatggg

SEQ ID NO: 617595 - DNA, 25 bp, Rattus norvegicus
tgcagatcaggaagattctaccaat

SEQ ID NO: 617596 - DNA, 25 bp, Rattus norvegicus
tgcagatcaggatgattctaccaat

SEQ ID NO: 617597 - DNA, 25 bp, Rattus norvegicus
tgcagatcatgtctgtcagtcctga

SEQ ID NO: 617598 - DNA, 25 bp, Rattus norvegicus
tgcagatcatgtgtgtcagtcctga

SEQ ID NO: 617599 - DNA, 25 bp, Rattus norvegicus
tgcagatcattcacgtctcatggaa

SEQ ID NO: 617600 - DNA, 25 bp, Rattus norvegicus
tgcagatcattctcgtctcatggaa

SEQ ID NO: 617601 - DNA, 25 bp, Rattus norvegicus
tgcagatccaggagctatgtctcgt

SEQ ID NO: 617602 - DNA, 25 bp, Rattus norvegicus
tgcagatccaggtgctatgtctcgt

SEQ ID NO: 617603 - DNA, 25 bp, Rattus norvegicus
tgcagatcctccagaaagcccagta

SEQ ID NO: 617604 - DNA, 25 bp, Rattus norvegicus
tgcagatcctcctgaaagcccagta

SEQ ID NO: 617605 - DNA, 25 bp, Rattus norvegicus
tgcagatcgctaacggcagctttca

SEQ ID NO: 617606 - DNA, 25 bp, Rattus norvegicus
tgcagatcgctatcggcagctttca

SEQ ID NO: 617607 - DNA, 25 bp, Rattus norvegicus
tgcagatcggaaatcccataggtct

SEQ ID NO: 617608 - DNA, 25 bp, Rattus norvegicus
tgcagatcggaattcccataggtct

SEQ ID NO: 617609 - DNA, 25 bp, Rattus norvegicus
tgcagatctccgagtgccagaggaa

SEQ ID NO: 617610 - DNA, 25 bp, Rattus norvegicus
tgcagatctccgtgtgccagaggaa

SEQ ID NO: 617611 - DNA, 25 bp, Rattus norvegicus
tgcagatcttctcttacactctcct

SEQ ID NO: 617612 - DNA, 25 bp, Rattus norvegicus
tgcagatcttctgttacactctcct

SEQ ID NO: 617613 - DNA, 25 bp, Rattus norvegicus
tgcagatgaactctttcgtgtccca

SEQ ID NO: 617614 - DNA, 25 bp, Rattus norvegicus
tgcagatgaactgtttcgtgtccca

SEQ ID NO: 617615 - DNA, 25 bp, Rattus norvegicus
tgcagatgcactatcgctgccactg

SEQ ID NO: 617616 - DNA, 25 bp, Rattus norvegicus
tgcagatgcactttcgctgccactg

SEQ ID NO: 617617 - DNA, 25 bp, Rattus norvegicus
tgcagatgcatcactgcggtctcgt

SEQ ID NO: 617618 - DNA, 25 bp, Rattus norvegicus
tgcagatgcatctctgcggtctcgt

SEQ ID NO: 617619 - DNA, 25 bp, Rattus norvegicus
tgcagatgccagagacaagacccag

SEQ ID NO: 617620 - DNA, 25 bp, Rattus norvegicus
tgcagatgccagtgacaagacccag

SEQ ID NO: 617621 - DNA, 25 bp, Rattus norvegicus
tgcagatgctaacagcgttttcccc

SEQ ID NO: 617622 - DNA, 25 bp, Rattus norvegicus
tgcagatgctaagagcgttttcccc

SEQ ID NO: 617623 - DNA, 25 bp, Rattus norvegicus
tgcagatggccaagacactcagtga

SEQ ID NO: 617624 - DNA, 25 bp, Rattus norvegicus
tgcagatggccatgacactcagtga

SEQ ID NO: 617625 - DNA, 25 bp, Rattus norvegicus
tgcagatggcgcattgctctctaca

SEQ ID NO: 617626 - DNA, 25 bp, Rattus norvegicus
tgcagatggcgctttgctctctaca

SEQ ID NO: 617627 - DNA, 25 bp, Rattus norvegicus
tgcagattaaccagcctctcctact

SEQ ID NO: 617628 - DNA, 25 bp, Rattus norvegicus
tgcagattaacctgcctctcctact

SEQ ID NO: 617629 - DNA, 25 bp, Rattus norvegicus
tgcagattagcacacagtctccatg

SEQ ID NO: 617630 - DNA, 25 bp, Rattus norvegicus
tgcagattagcagacagtctccatg

SEQ ID NO: 617631 - DNA, 25 bp, Rattus norvegicus
tgcagattattcagccctaaaaagg

SEQ ID NO: 617632 - DNA, 25 bp, Rattus norvegicus
tgcagattattctgccctaaaaagg

SEQ ID NO: 617633 - DNA, 25 bp, Rattus norvegicus
tgcagattcagacccacatgaccat

SEQ ID NO: 617634 - DNA, 25 bp, Rattus norvegicus
tgcagattcagagccacatgaccat

SEQ ID NO: 617635 - DNA, 25 bp, Rattus norvegicus
tgcagattccaaataaatagtttct

SEQ ID NO: 617636 - DNA, 25 bp, Rattus norvegicus
tgcagattccaattaaatagtttct

SEQ ID NO: 617637 - DNA, 25 bp, Rattus norvegicus
tgcagattccagaaataaccaggaa

SEQ ID NO: 617638 - DNA, 25 bp, Rattus norvegicus
tgcagattccagtaataaccaggaa

SEQ ID NO: 617639 - DNA, 25 bp, Rattus norvegicus
tgcagattccttctttgtattgtaa

SEQ ID NO: 617640 - DNA, 25 bp, Rattus norvegicus
tgcagattccttgtttgtattgtaa

SEQ ID NO: 617641 - DNA, 25 bp, Rattus norvegicus
tgcagattggtcacttggcccagag

SEQ ID NO: 617642 - DNA, 25 bp, Rattus norvegicus
tgcagattggtctcttggcccagag

SEQ ID NO: 617643 - DNA, 25 bp, Rattus norvegicus
tgcagatttagcaagtccagccctg

SEQ ID NO: 617644 - DNA, 25 bp, Rattus norvegicus
tgcagatttagctagtccagccctg

SEQ ID NO: 617645 - DNA, 25 bp, Rattus norvegicus
tgcagatttcaaccaccctgttgat

SEQ ID NO: 617646 - DNA, 25 bp, Rattus norvegicus
tgcagatttcaagcaccctgttgat

SEQ ID NO: 617647 - DNA, 25 bp, Rattus norvegicus
tgcagatttcatcgctttcggtaac

SEQ ID NO: 617648 - DNA, 25 bp, Rattus norvegicus
tgcagatttcatggctttcggtaac

SEQ ID NO: 617649 - DNA, 25 bp, Rattus norvegicus
tgcagatttgatacaactccccaat

SEQ ID NO: 617650 - DNA, 25 bp, Rattus norvegicus
tgcagatttgattcaactccccaat

SEQ ID NO: 617651 - DNA, 25 bp, Rattus norvegicus
tgcagcaactctccggaaccgggag

SEQ ID NO: 617652 - DNA, 25 bp, Rattus norvegicus
tgcagcaactctgcggaaccgggag

SEQ ID NO: 617653 - DNA, 25 bp, Rattus norvegicus
tgcagcaactgcacagactcacatg

SEQ ID NO: 617654 - DNA, 25 bp, Rattus norvegicus
tgcagcaactgctcagactcacatg

SEQ ID NO: 617655 - DNA, 25 bp, Rattus norvegicus
tgcagcaagatacggccgccatcgc

SEQ ID NO: 617656 - DNA, 25 bp, Rattus norvegicus
tgcagcaagatagggccgccatcgc

SEQ ID NO: 617657 - DNA, 25 bp, Rattus norvegicus
tgcagcaatgcacgcccagagatgt

SEQ ID NO: 617658 - DNA, 25 bp, Rattus norvegicus
tgcagcaatgcaggcccagagatgt

SEQ ID NO: 617659 - DNA, 25 bp, Rattus norvegicus
tgcagcaattccaaagcatttcgcc

SEQ ID NO: 617660 - DNA, 25 bp, Rattus norvegicus
tgcagcaattcctaagcatttcgcc

SEQ ID NO: 617661 - DNA, 25 bp, Rattus norvegicus
tgcagcacaaagcaacaagccccgg

SEQ ID NO: 617662 - DNA, 25 bp, Rattus norvegicus
tgcagcacaaaggaacaagccccgg

SEQ ID NO: 617663 - DNA, 25 bp, Rattus norvegicus
tgcagcacaagaagccagccgacat

SEQ ID NO: 617664 - DNA, 25 bp, Rattus norvegicus
tgcagcacaagatgccagccgacat

SEQ ID NO: 617665 - DNA, 25 bp, Rattus norvegicus
tgcagcacaatgactccctcaatgt

SEQ ID NO: 617666 - DNA, 25 bp, Rattus norvegicus
tgcagcacaatgtctccctcaatgt

SEQ ID NO: 617667 - DNA, 25 bp, Rattus norvegicus
tgcagcacagcacgtctaataggat

SEQ ID NO: 617668 - DNA, 25 bp, Rattus norvegicus
tgcagcacagcaggtctaataggat

SEQ ID NO: 617669 - DNA, 25 bp, Rattus norvegicus
tgcagcaccacacttttggtcttaa

SEQ ID NO: 617670 - DNA, 25 bp, Rattus norvegicus
tgcagcaccacagttttggtcttaa

SEQ ID NO: 617671 - DNA, 25 bp, Rattus norvegicus
tgcagcaccagcaagtggcacacga

SEQ ID NO: 617672 - DNA, 25 bp, Rattus norvegicus
tgcagcaccagccaagaaggctaaa

SEQ ID NO: 617673 - DNA, 25 bp, Rattus norvegicus
tgcagcaccagcgaagaaggctaaa

SEQ ID NO: 617674 - DNA, 25 bp, Rattus norvegicus
tgcagcaccagctagtggcacacga

SEQ ID NO: 617675 - DNA, 25 bp, Rattus norvegicus
tgcagcaccgctcacagtattttga

SEQ ID NO: 617676 - DNA, 25 bp, Rattus norvegicus
tgcagcaccgctgacagtattttga

SEQ ID NO: 617677 - DNA, 25 bp, Rattus norvegicus
tgcagcaccgtgatgtgtctttaac

SEQ ID NO: 617678 - DNA, 25 bp, Rattus norvegicus
tgcagcaccgtgttgtgtctttaac

SEQ ID NO: 617679 - DNA, 25 bp, Rattus norvegicus
tgcagcacctgtcgaacacttagcg

SEQ ID NO: 617680 - DNA, 25 bp, Rattus norvegicus
tgcagcacctgtggaacacttagcg

SEQ ID NO: 617681 - DNA, 25 bp, Rattus norvegicus
tgcagcacgaggaaagcactgtctt

SEQ ID NO: 617682 - DNA, 25 bp, Rattus norvegicus
tgcagcacgaggtaagcactgtctt

SEQ ID NO: 617683 - DNA, 25 bp, Rattus norvegicus
tgcagcacgattcccttttgataag

SEQ ID NO: 617684 - DNA, 25 bp, Rattus norvegicus
tgcagcacgattgccttttgataag

SEQ ID NO: 617685 - DNA, 25 bp, Rattus norvegicus
tgcagcacgcgacttcacacaatga

SEQ ID NO: 617686 - DNA, 25 bp, Rattus norvegicus
tgcagcacgcgagttcacacaatga

SEQ ID NO: 617687 - DNA, 25 bp, Rattus norvegicus
tgcagcagacagatgcgttctacag

SEQ ID NO: 617688 - DNA, 25 bp, Rattus norvegicus
tgcagcagacagttgcgttctacag

SEQ ID NO: 617689 - DNA, 25 bp, Rattus norvegicus
tgcagcagagaccatcaaccctgac

SEQ ID NO: 617690 - DNA, 25 bp, Rattus norvegicus
tgcagcagagacgatcaaccctgac

SEQ ID NO: 617691 - DNA, 25 bp, Rattus norvegicus
tgcagcagcatgaagggccaggaca

SEQ ID NO: 617692 - DNA, 25 bp, Rattus norvegicus
tgcagcagcatgtagggccaggaca

SEQ ID NO: 617693 - DNA, 25 bp, Rattus norvegicus
tgcagcagccacagccttagcagag

SEQ ID NO: 617694 - DNA, 25 bp, Rattus norvegicus
tgcagcagccactgccttagcagag

SEQ ID NO: 617695 - DNA, 25 bp, Rattus norvegicus
tgcagcagccatccaattacctgga

SEQ ID NO: 617696 - DNA, 25 bp, Rattus norvegicus
tgcagcagccatgcaattacctgga

SEQ ID NO: 617697 - DNA, 25 bp, Rattus norvegicus
tgcagcagccccagattgaaagact

SEQ ID NO: 617698 - DNA, 25 bp, Rattus norvegicus
tgcagcagcccctgattgaaagact

SEQ ID NO: 617699 - DNA, 25 bp, Rattus norvegicus
tgcagcagccgaagagactctgcgg

SEQ ID NO: 617700 - DNA, 25 bp, Rattus norvegicus
tgcagcagccgatgagactctgcgg

SEQ ID NO: 617701 - DNA, 25 bp, Rattus norvegicus
tgcagcagctccagactgaggtctt

SEQ ID NO: 617702 - DNA, 25 bp, Rattus norvegicus
tgcagcagctcctgactgaggtctt

SEQ ID NO: 617703 - DNA, 25 bp, Rattus norvegicus
tgcagcagctggaggcagccctgca

SEQ ID NO: 617704 - DNA, 25 bp, Rattus norvegicus
tgcagcagctggtggcagccctgca

SEQ ID NO: 617705 - DNA, 25 bp, Rattus norvegicus
tgcagcaggcccacgaagagaaggc

SEQ ID NO: 617706 - DNA, 25 bp, Rattus norvegicus
tgcagcaggccctcgaagagaaggc

SEQ ID NO: 617707 - DNA, 25 bp, Rattus norvegicus
tgcagcagggctcccaaggtcagaa

SEQ ID NO: 617708 - DNA, 25 bp, Rattus norvegicus
tgcagcagggctgccaaggtcagaa

SEQ ID NO: 617709 - DNA, 25 bp, Rattus norvegicus
tgcagcaggtctctcactataatat

SEQ ID NO: 617710 - DNA, 25 bp, Rattus norvegicus
tgcagcaggtctgtcactataatat

SEQ ID NO: 617711 - DNA, 25 bp, Rattus norvegicus
tgcagcaggtggcaagcccttgcct

SEQ ID NO: 617712 - DNA, 25 bp, Rattus norvegicus
tgcagcaggtgggaagcccttgcct

SEQ ID NO: 617713 - DNA, 25 bp, Rattus norvegicus
tgcagcagtcatcccatcataacgc

SEQ ID NO: 617714 - DNA, 25 bp, Rattus norvegicus
tgcagcagtcatgccatcataacgc

SEQ ID NO: 617715 - DNA, 25 bp, Rattus norvegicus
tgcagcagtgcgattgtgcctttac

SEQ ID NO: 617716 - DNA, 25 bp, Rattus norvegicus
tgcagcagtgcgtttgtgcctttac

SEQ ID NO: 617717 - DNA, 25 bp, Rattus norvegicus
tgcagcagtggcctgaataacatct

SEQ ID NO: 617718 - DNA, 25 bp, Rattus norvegicus
tgcagcagtggcgtgaataacatct

SEQ ID NO: 617719 - DNA, 25 bp, Rattus norvegicus
tgcagcatagctaccttcagagttt

SEQ ID NO: 617720 - DNA, 25 bp, Rattus norvegicus
tgcagcatagcttccttcagagttt

SEQ ID NO: 617721 - DNA, 25 bp, Rattus norvegicus
tgcagcatccttcgcactcttgggc

SEQ ID NO: 617722 - DNA, 25 bp, Rattus norvegicus
tgcagcatccttggcactcttgggc

SEQ ID NO: 617723 - DNA, 25 bp, Rattus norvegicus
tgcagcatctgaaccacgtaggcaa

SEQ ID NO: 617724 - DNA, 25 bp, Rattus norvegicus
tgcagcatctgatccacgtaggcaa

SEQ ID NO: 617725 - DNA, 25 bp, Rattus norvegicus
tgcagcatgcatacatccaggaaaa

SEQ ID NO: 617726 - DNA, 25 bp, Rattus norvegicus
tgcagcatgcattcatccaggaaaa

SEQ ID NO: 617727 - DNA, 25 bp, Rattus norvegicus
tgcagcatgccaaggacttcaggga

SEQ ID NO: 617728 - DNA, 25 bp, Rattus norvegicus
tgcagcatgccatggacttcaggga

SEQ ID NO: 617729 - DNA, 25 bp, Rattus norvegicus
tgcagcattacgcatcaggctttag

SEQ ID NO: 617730 - DNA, 25 bp, Rattus norvegicus
tgcagcattacggatcaggctttag

SEQ ID NO: 617731 - DNA, 25 bp, Rattus norvegicus
tgcagcattagaataccagggaaat

SEQ ID NO: 617732 - DNA, 25 bp, Rattus norvegicus
tgcagcattagattaccagggaaat

SEQ ID NO: 617733 - DNA, 25 bp, Rattus norvegicus
tgcagcattctcctggcagattttt

SEQ ID NO: 617734 - DNA, 25 bp, Rattus norvegicus
tgcagcattctcgtggcagattttt

SEQ ID NO: 617735 - DNA, 25 bp, Rattus norvegicus
tgcagcatttctcttgactagcaat

SEQ ID NO: 617736 - DNA, 25 bp, Rattus norvegicus
tgcagcatttctgttgactagcaat

SEQ ID NO: 617737 - DNA, 25 bp, Rattus norvegicus
tgcagcatttgtagttcgcaccaat

SEQ ID NO: 617738 - DNA, 25 bp, Rattus norvegicus
tgcagcatttgttgttcgcaccaat

SEQ ID NO: 617739 - DNA, 25 bp, Rattus norvegicus
tgcagcattttgctcacctgaggag

SEQ ID NO: 617740 - DNA, 25 bp, Rattus norvegicus
tgcagcattttggtcacctgaggag

SEQ ID NO: 617741 - DNA, 25 bp, Rattus norvegicus
tgcagccaaaatccaggcgagtttt

SEQ ID NO: 617742 - DNA, 25 bp, Rattus norvegicus
tgcagccaaaatgcaggcgagtttt

SEQ ID NO: 617743 - DNA, 25 bp, Rattus norvegicus
tgcagccaacatagtagtactgtgt

SEQ ID NO: 617744 - DNA, 25 bp, Rattus norvegicus
tgcagccaacattgtagtactgtgt

SEQ ID NO: 617745 - DNA, 25 bp, Rattus norvegicus
tgcagccaagctcaggccaccaggg

SEQ ID NO: 617746 - DNA, 25 bp, Rattus norvegicus
tgcagccaagctgaggccaccaggg

SEQ ID NO: 617747 - DNA, 25 bp, Rattus norvegicus
tgcagccaatcaaggcctcatgcgc

SEQ ID NO: 617748 - DNA, 25 bp, Rattus norvegicus
tgcagccaatcatggcctcatgcgc

SEQ ID NO: 617749 - DNA, 25 bp, Rattus norvegicus
tgcagccaatccattcacgacagct

SEQ ID NO: 617750 - DNA, 25 bp, Rattus norvegicus
tgcagccaatcctttcacgacagct

SEQ ID NO: 617751 - DNA, 25 bp, Rattus norvegicus
tgcagccaccaaagaaagttcctaa

SEQ ID NO: 617752 - DNA, 25 bp, Rattus norvegicus
tgcagccaccaatgaaagttcctaa

SEQ ID NO: 617753 - DNA, 25 bp, Rattus norvegicus
tgcagccacgagaggcggaggccgc

SEQ ID NO: 617754 - DNA, 25 bp, Rattus norvegicus
tgcagccacgagtggcggaggccgc

SEQ ID NO: 617755 - DNA, 25 bp, Rattus norvegicus
tgcagccagaatacggagatttagt

SEQ ID NO: 617756 - DNA, 25 bp, Rattus norvegicus
tgcagccagaattcggagatttagt

SEQ ID NO: 617757 - DNA, 25 bp, Rattus norvegicus
tgcagccagtcacccagtgatagta

SEQ ID NO: 617758 - DNA, 25 bp, Rattus norvegicus
tgcagccagtcagccagtgatagta

SEQ ID NO: 617759 - DNA, 25 bp, Rattus norvegicus
tgcagccatactcggccaagctaga

SEQ ID NO: 617760 - DNA, 25 bp, Rattus norvegicus
tgcagccatactgggccaagctaga

SEQ ID NO: 617761 - DNA, 25 bp, Rattus norvegicus
tgcagccatgtaaccacaacaatcc

SEQ ID NO: 617762 - DNA, 25 bp, Rattus norvegicus
tgcagccatgtatccacaacaatcc

SEQ ID NO: 617763 - DNA, 25 bp, Rattus norvegicus
tgcagccattagcattaggcggctt

SEQ ID NO: 617764 - DNA, 25 bp, Rattus norvegicus
tgcagccattaggattaggcggctt

SEQ ID NO: 617765 - DNA, 25 bp, Rattus norvegicus
tgcagccattgacccctgaggtata

SEQ ID NO: 617766 - DNA, 25 bp, Rattus norvegicus
tgcagccattgagccctgaggtata

SEQ ID NO: 617767 - DNA, 25 bp, Rattus norvegicus
tgcagccatttcatcagtagtaata

SEQ ID NO: 617768 - DNA, 25 bp, Rattus norvegicus
tgcagccatttcttcagtagtaata

SEQ ID NO: 617769 - DNA, 25 bp, Rattus norvegicus
tgcagcccaaaccatttgtatcagg

SEQ ID NO: 617770 - DNA, 25 bp, Rattus norvegicus
tgcagcccaaacgatttgtatcagg

SEQ ID NO: 617771 - DNA, 25 bp, Rattus norvegicus
tgcagcccaattaattttttacaaa

SEQ ID NO: 617772 - DNA, 25 bp, Rattus norvegicus
tgcagcccaatttattttttacaaa

SEQ ID NO: 617773 - DNA, 25 bp, Rattus norvegicus
tgcagcccagtgctacgacctgata

SEQ ID NO: 617774 - DNA, 25 bp, Rattus norvegicus
tgcagcccagtggtacgacctgata

SEQ ID NO: 617775 - DNA, 25 bp, Rattus norvegicus
tgcagcccatcaagctggctagggt

SEQ ID NO: 617776 - DNA, 25 bp, Rattus norvegicus
tgcagcccatcacctaggacaaaga

SEQ ID NO: 617777 - DNA, 25 bp, Rattus norvegicus
tgcagcccatcagctaggacaaaga

SEQ ID NO: 617778 - DNA, 25 bp, Rattus norvegicus
tgcagcccatcatgctggctagggt

SEQ ID NO: 617779 - DNA, 25 bp, Rattus norvegicus
tgcagccccagaacagttaccatga

SEQ ID NO: 617780 - DNA, 25 bp, Rattus norvegicus
tgcagccccagatcagttaccatga

SEQ ID NO: 617781 - DNA, 25 bp, Rattus norvegicus
tgcagcccctctatagtacatctgg

SEQ ID NO: 617782 - DNA, 25 bp, Rattus norvegicus
tgcagcccctctttagtacatctgg

SEQ ID NO: 617783 - DNA, 25 bp, Rattus norvegicus
tgcagcccctggagttcagcgattg

SEQ ID NO: 617784 - DNA, 25 bp, Rattus norvegicus
tgcagcccctggtgttcagcgattg

SEQ ID NO: 617785 - DNA, 25 bp, Rattus norvegicus
tgcagccccttacgagtagccagta

SEQ ID NO: 617786 - DNA, 25 bp, Rattus norvegicus
tgcagccccttaggagtagccagta

SEQ ID NO: 617787 - DNA, 25 bp, Rattus norvegicus
tgcagcccgcagatttaaaggaagt

SEQ ID NO: 617788 - DNA, 25 bp, Rattus norvegicus
tgcagcccgcagttttaaaggaagt

SEQ ID NO: 617789 - DNA, 25 bp, Rattus norvegicus
tgcagcccggacaacctaaaatcta

SEQ ID NO: 617790 - DNA, 25 bp, Rattus norvegicus
tgcagcccggactacctaaaatcta

SEQ ID NO: 617791 - DNA, 25 bp, Rattus norvegicus
tgcagcccgggtagaatccttggaa

SEQ ID NO: 617792 - DNA, 25 bp, Rattus norvegicus
tgcagcccgggttgaatccttggaa

SEQ ID NO: 617793 - DNA, 25 bp, Rattus norvegicus
tgcagcccgtatcgtacatggtact

SEQ ID NO: 617794 - DNA, 25 bp, Rattus norvegicus
tgcagcccgtatggtacatggtact

SEQ ID NO: 617795 - DNA, 25 bp, Rattus norvegicus
tgcagcccgtgtaaccatatgaagt

SEQ ID NO: 617796 - DNA, 25 bp, Rattus norvegicus
tgcagcccgtgttaccatatgaagt

SEQ ID NO: 617797 - DNA, 25 bp, Rattus norvegicus
tgcagccctcagacagcgagcagga

SEQ ID NO: 617798 - DNA, 25 bp, Rattus norvegicus
tgcagccctcagtcagcgagcagga

SEQ ID NO: 617799 - DNA, 25 bp, Rattus norvegicus
tgcagccctcggaccagattatggg

SEQ ID NO: 617800 - DNA, 25 bp, Rattus norvegicus
tgcagccctcggtccagattatggg

SEQ ID NO: 617801 - DNA, 25 bp, Rattus norvegicus
tgcagccctggacgtttccttttcc

SEQ ID NO: 617802 - DNA, 25 bp, Rattus norvegicus
tgcagccctggaggtttccttttcc

SEQ ID NO: 617803 - DNA, 25 bp, Rattus norvegicus
tgcagccctggtccttctgggcaga

SEQ ID NO: 617804 - DNA, 25 bp, Rattus norvegicus
tgcagccctggtgcttctgggcaga

SEQ ID NO: 617805 - DNA, 25 bp, Rattus norvegicus
tgcagccctgtccacagatcagaag

SEQ ID NO: 617806 - DNA, 25 bp, Rattus norvegicus
tgcagccctgtcgacagatcagaag

SEQ ID NO: 617807 - DNA, 25 bp, Rattus norvegicus
tgcagcccttaacacagaccattgt

SEQ ID NO: 617808 - DNA, 25 bp, Rattus norvegicus
tgcagcccttaagacagaccattgt

SEQ ID NO: 617809 - DNA, 25 bp, Rattus norvegicus
tgcagccgccacacgcagagaggag

SEQ ID NO: 617810 - DNA, 25 bp, Rattus norvegicus
tgcagccgccactcgcagagaggag

SEQ ID NO: 617811 - DNA, 25 bp, Rattus norvegicus
tgcagccgcccactgaggtagaagc

SEQ ID NO: 617812 - DNA, 25 bp, Rattus norvegicus
tgcagccgcccagtgaggtagaagc

SEQ ID NO: 617813 - DNA, 25 bp, Rattus norvegicus
tgcagccggctacaatgtcaggttt

SEQ ID NO: 617814 - DNA, 25 bp, Rattus norvegicus
tgcagccggctagaatgtcaggttt

SEQ ID NO: 617815 - DNA, 25 bp, Rattus norvegicus
tgcagccgtagtctttcattccaca

SEQ ID NO: 617816 - DNA, 25 bp, Rattus norvegicus
tgcagccgtagtgtttcattccaca

SEQ ID NO: 617817 - DNA, 25 bp, Rattus norvegicus
tgcagcctacatagcacgtgttgct

SEQ ID NO: 617818 - DNA, 25 bp, Rattus norvegicus
tgcagcctacattgcacgtgttgct

SEQ ID NO: 617819 - DNA, 25 bp, Rattus norvegicus
tgcagcctatccagatgacctcttt

SEQ ID NO: 617820 - DNA, 25 bp, Rattus norvegicus
tgcagcctatcctgatgacctcttt

SEQ ID NO: 617821 - DNA, 25 bp, Rattus norvegicus
tgcagcctatgcaaatccgtacctt

SEQ ID NO: 617822 - DNA, 25 bp, Rattus norvegicus
tgcagcctatgctaatccgtacctt

SEQ ID NO: 617823 - DNA, 25 bp, Rattus norvegicus
tgcagcctatttcggaatacgtcct

SEQ ID NO: 617824 - DNA, 25 bp, Rattus norvegicus
tgcagcctatttgggaatacgtcct

SEQ ID NO: 617825 - DNA, 25 bp, Rattus norvegicus
tgcagcctcaaacctgatgtggtgt

SEQ ID NO: 617826 - DNA, 25 bp, Rattus norvegicus
tgcagcctcaaagctgatgtggtgt

SEQ ID NO: 617827 - DNA, 25 bp, Rattus norvegicus
tgcagcctcagcactgctctttgag

SEQ ID NO: 617828 - DNA, 25 bp, Rattus norvegicus
tgcagcctcagctctgctctttgag

SEQ ID NO: 617829 - DNA, 25 bp, Rattus norvegicus
tgcagcctcatgatctgtgccttat

SEQ ID NO: 617830 - DNA, 25 bp, Rattus norvegicus
tgcagcctcatgttctgtgccttat

SEQ ID NO: 617831 - DNA, 25 bp, Rattus norvegicus
tgcagcctccacctggatactaacg

SEQ ID NO: 617832 - DNA, 25 bp, Rattus norvegicus
tgcagcctccacgtggatactaacg

SEQ ID NO: 617833 - DNA, 25 bp, Rattus norvegicus
tgcagcctccatacaagtcaggcag

SEQ ID NO: 617834 - DNA, 25 bp, Rattus norvegicus
tgcagcctccattcaagtcaggcag

SEQ ID NO: 617835 - DNA, 25 bp, Rattus norvegicus
tgcagcctcctcagaggtcgaatta

SEQ ID NO: 617836 - DNA, 25 bp, Rattus norvegicus
tgcagcctcctctgaggtcgaatta

SEQ ID NO: 617837 - DNA, 25 bp, Rattus norvegicus
tgcagcctgcataactcatttcttt

SEQ ID NO: 617838 - DNA, 25 bp, Rattus norvegicus
tgcagcctgcatagcatacattcgg

SEQ ID NO: 617839 - DNA, 25 bp, Rattus norvegicus
tgcagcctgcattactcatttcttt

SEQ ID NO: 617840 - DNA, 25 bp, Rattus norvegicus
tgcagcctgcattgcatacattcgg

SEQ ID NO: 617841 - DNA, 25 bp, Rattus norvegicus
tgcagcctgcccatcagacacatga

SEQ ID NO: 617842 - DNA, 25 bp, Rattus norvegicus
tgcagcctgcccttcagacacatga

SEQ ID NO: 617843 - DNA, 25 bp, Rattus norvegicus
tgcagcctgggacctggactctagc

SEQ ID NO: 617844 - DNA, 25 bp, Rattus norvegicus
tgcagcctgggacgagccggttggc

SEQ ID NO: 617845 - DNA, 25 bp, Rattus norvegicus
tgcagcctgggagctggactctagc

SEQ ID NO: 617846 - DNA, 25 bp, Rattus norvegicus
tgcagcctgggaggagccggttggc

SEQ ID NO: 617847 - DNA, 25 bp, Rattus norvegicus
tgcagcctgggcacagactgtgata

SEQ ID NO: 617848 - DNA, 25 bp, Rattus norvegicus
tgcagcctgggctcagactgtgata

SEQ ID NO: 617849 - DNA, 25 bp, Rattus norvegicus
tgcagcctggttataccacacagac

SEQ ID NO: 617850 - DNA, 25 bp, Rattus norvegicus
tgcagcctggttttaccacacagac

SEQ ID NO: 617851 - DNA, 25 bp, Rattus norvegicus
tgcagcctgtaaccatcggctgggc

SEQ ID NO: 617852 - DNA, 25 bp, Rattus norvegicus
tgcagcctgtaagcatcggctgggc

SEQ ID NO: 617853 - DNA, 25 bp, Rattus norvegicus
tgcagcctgtacagtattgccctgt

SEQ ID NO: 617854 - DNA, 25 bp, Rattus norvegicus
tgcagcctgtactgtattgccctgt

SEQ ID NO: 617855 - DNA, 25 bp, Rattus norvegicus
tgcagcctgtgtacctacatcataa

SEQ ID NO: 617856 - DNA, 25 bp, Rattus norvegicus
tgcagcctgtgttcctacatcataa

SEQ ID NO: 617857 - DNA, 25 bp, Rattus norvegicus
tgcagccttgacatgttttcacaat

SEQ ID NO: 617858 - DNA, 25 bp, Rattus norvegicus
tgcagccttgacttgttttcacaat

SEQ ID NO: 617859 - DNA, 25 bp, Rattus norvegicus
tgcagccttgcacaccagagttaca

SEQ ID NO: 617860 - DNA, 25 bp, Rattus norvegicus
tgcagccttgcagaccagagttaca

SEQ ID NO: 617861 - DNA, 25 bp, Rattus norvegicus
tgcagccttttcatacctggtcgac

SEQ ID NO: 617862 - DNA, 25 bp, Rattus norvegicus
tgcagccttttcttacctggtcgac

SEQ ID NO: 617863 - DNA, 25 bp, Rattus norvegicus
tgcagcgaccggatccatctggatt

SEQ ID NO: 617864 - DNA, 25 bp, Rattus norvegicus
tgcagcgaccggttccatctggatt

SEQ ID NO: 617865 - DNA, 25 bp, Rattus norvegicus
tgcagcgaggcgaggccgattacat

SEQ ID NO: 617866 - DNA, 25 bp, Rattus norvegicus
tgcagcgaggcgtggccgattacat

SEQ ID NO: 617867 - DNA, 25 bp, Rattus norvegicus
tgcagcgagtgcagccatttgcctg

SEQ ID NO: 617868 - DNA, 25 bp, Rattus norvegicus
tgcagcgagtgctgccatttgcctg

SEQ ID NO: 617869 - DNA, 25 bp, Rattus norvegicus
tgcagcgcatcaacaggacaggccg

SEQ ID NO: 617870 - DNA, 25 bp, Rattus norvegicus
tgcagcgcatcatcaggacaggccg

SEQ ID NO: 617871 - DNA, 25 bp, Rattus norvegicus
tgcagcgccctgacctgcggatgga

SEQ ID NO: 617872 - DNA, 25 bp, Rattus norvegicus
tgcagcgccctgtcctgcggatgga

SEQ ID NO: 617873 - DNA, 25 bp, Rattus norvegicus
tgcagcgcctccaaaactttgggtt

SEQ ID NO: 617874 - DNA, 25 bp, Rattus norvegicus
tgcagcgcctcctaaactttgggtt

SEQ ID NO: 617875 - DNA, 25 bp, Rattus norvegicus
tgcagcgcgcacacgtcggcatatg

SEQ ID NO: 617876 - DNA, 25 bp, Rattus norvegicus
tgcagcgcgcactcgtcggcatatg

SEQ ID NO: 617877 - DNA, 25 bp, Rattus norvegicus
tgcagcgcgcagaactagaagaccc

SEQ ID NO: 617878 - DNA, 25 bp, Rattus norvegicus
tgcagcgcgcagtactagaagaccc

SEQ ID NO: 617879 - DNA, 25 bp, Rattus norvegicus
tgcagcgcgcgcagtctcttggcct

SEQ ID NO: 617880 - DNA, 25 bp, Rattus norvegicus
tgcagcgcgcgctgtctcttggcct

SEQ ID NO: 617881 - DNA, 25 bp, Rattus norvegicus
tgcagcgctgtcaatctcgattaaa

SEQ ID NO: 617882 - DNA, 25 bp, Rattus norvegicus
tgcagcgctgtctatctcgattaaa

SEQ ID NO: 617883 - DNA, 25 bp, Rattus norvegicus
tgcagcggaaagatgctctggtcca

SEQ ID NO: 617884 - DNA, 25 bp, Rattus norvegicus
tgcagcggaaagttgctctggtcca

SEQ ID NO: 617885 - DNA, 25 bp, Rattus norvegicus
tgcagcggctgtccatctccaaggg

SEQ ID NO: 617886 - DNA, 25 bp, Rattus norvegicus
tgcagcggctgtgcatctccaaggg

SEQ ID NO: 617887 - DNA, 25 bp, Rattus norvegicus
tgcagcgtgcagatttcggaacacc

SEQ ID NO: 617888 - DNA, 25 bp, Rattus norvegicus
tgcagcgtgcagttttcggaacacc

SEQ ID NO: 617889 - DNA, 25 bp, Rattus norvegicus
tgcagcgttggcaatggtgaacaca

SEQ ID NO: 617890 - DNA, 25 bp, Rattus norvegicus
tgcagcgttggctatggtgaacaca

SEQ ID NO: 617891 - DNA, 25 bp, Rattus norvegicus
tgcagctacgttcttcaatggtcaa

SEQ ID NO: 617892 - DNA, 25 bp, Rattus norvegicus
tgcagctacgttgttcaatggtcaa

SEQ ID NO: 617893 - DNA, 25 bp, Rattus norvegicus
tgcagctactgtacagcaatggcgt

SEQ ID NO: 617894 - DNA, 25 bp, Rattus norvegicus
tgcagctactgttcagcaatggcgt

SEQ ID NO: 617895 - DNA, 25 bp, Rattus norvegicus
tgcagctatgccctttgagaatccg

SEQ ID NO: 617896 - DNA, 25 bp, Rattus norvegicus
tgcagctatgccgtttgagaatccg

SEQ ID NO: 617897 - DNA, 25 bp, Rattus norvegicus
tgcagctcaataagtgcccggcgtg

SEQ ID NO: 617898 - DNA, 25 bp, Rattus norvegicus
tgcagctcaatatgtgcccggcgtg

SEQ ID NO: 617899 - DNA, 25 bp, Rattus norvegicus
tgcagctcacacacagatgacttct

SEQ ID NO: 617900 - DNA, 25 bp, Rattus norvegicus
tgcagctcacactcagatgacttct

SEQ ID NO: 617901 - DNA, 25 bp, Rattus norvegicus
tgcagctcactccaagggccaacaa

SEQ ID NO: 617902 - DNA, 25 bp, Rattus norvegicus
tgcagctcactcgaagggccaacaa

SEQ ID NO: 617903 - DNA, 25 bp, Rattus norvegicus
tgcagctcagcaaccaggactattt

SEQ ID NO: 617904 - DNA, 25 bp, Rattus norvegicus
tgcagctcagcatccaggactattt

SEQ ID NO: 617905 - DNA, 25 bp, Rattus norvegicus
tgcagctcaggtaggctgagagcca

SEQ ID NO: 617906 - DNA, 25 bp, Rattus norvegicus
tgcagctcaggttggctgagagcca

SEQ ID NO: 617907 - DNA, 25 bp, Rattus norvegicus
tgcagctcagtccgcggagtgcttt

SEQ ID NO: 617908 - DNA, 25 bp, Rattus norvegicus
tgcagctcagtcggcggagtgcttt

SEQ ID NO: 617909 - DNA, 25 bp, Rattus norvegicus
tgcagctccaggaggcactgctgaa

SEQ ID NO: 617910 - DNA, 25 bp, Rattus norvegicus
tgcagctccaggtggcactgctgaa

SEQ ID NO: 617911 - DNA, 25 bp, Rattus norvegicus
tgcagctcccagataaaccacagtg

SEQ ID NO: 617912 - DNA, 25 bp, Rattus norvegicus
tgcagctcccagttaaaccacagtg

SEQ ID NO: 617913 - DNA, 25 bp, Rattus norvegicus
tgcagctccggcaaaggacgattgt

SEQ ID NO: 617914 - DNA, 25 bp, Rattus norvegicus
tgcagctccggctaaggacgattgt

SEQ ID NO: 617915 - DNA, 25 bp, Rattus norvegicus
tgcagctcctaccagttcgccttat

SEQ ID NO: 617916 - DNA, 25 bp, Rattus norvegicus
tgcagctcctacgagttcgccttat

SEQ ID NO: 617917 - DNA, 25 bp, Rattus norvegicus
tgcagctcctgaagacccacgttta

SEQ ID NO: 617918 - DNA, 25 bp, Rattus norvegicus
tgcagctcctgatgacccacgttta

SEQ ID NO: 617919 - DNA, 25 bp, Rattus norvegicus
tgcagctccttgattctgatggtgt

SEQ ID NO: 617920 - DNA, 25 bp, Rattus norvegicus
tgcagctccttgtttctgatggtgt

SEQ ID NO: 617921 - DNA, 25 bp, Rattus norvegicus
tgcagctcgaagacggcgtcgacct

SEQ ID NO: 617922 - DNA, 25 bp, Rattus norvegicus
tgcagctcgaagtcggcgtcgacct

SEQ ID NO: 617923 - DNA, 25 bp, Rattus norvegicus
tgcagctcgagaaggcctctttgag

SEQ ID NO: 617924 - DNA, 25 bp, Rattus norvegicus
tgcagctcgagatggcctctttgag

SEQ ID NO: 617925 - DNA, 25 bp, Rattus norvegicus
tgcagctctctcacaagtacctgtt

SEQ ID NO: 617926 - DNA, 25 bp, Rattus norvegicus
tgcagctctctctcaagtacctgtt

SEQ ID NO: 617927 - DNA, 25 bp, Rattus norvegicus
tgcagctctcttattacccagaata

SEQ ID NO: 617928 - DNA, 25 bp, Rattus norvegicus
tgcagctctctttttacccagaata

SEQ ID NO: 617929 - DNA, 25 bp, Rattus norvegicus
tgcagctctgggaagcgatgtgctc

SEQ ID NO: 617930 - DNA, 25 bp, Rattus norvegicus
tgcagctctgggtagcgatgtgctc

SEQ ID NO: 617931 - DNA, 25 bp, Rattus norvegicus
tgcagctctgtgactgttggccatg

SEQ ID NO: 617932 - DNA, 25 bp, Rattus norvegicus
tgcagctctgtgtctgttggccatg

SEQ ID NO: 617933 - DNA, 25 bp, Rattus norvegicus
tgcagctgaggtatcattggagatg

SEQ ID NO: 617934 - DNA, 25 bp, Rattus norvegicus
tgcagctgaggtttcattggagatg

SEQ ID NO: 617935 - DNA, 25 bp, Rattus norvegicus
tgcagctgatgaccgcagttcatac

SEQ ID NO: 617936 - DNA, 25 bp, Rattus norvegicus
tgcagctgatgagcgcagttcatac

SEQ ID NO: 617937 - DNA, 25 bp, Rattus norvegicus
tgcagctgattgacatccgatccat

SEQ ID NO: 617938 - DNA, 25 bp, Rattus norvegicus
tgcagctgattgtcatccgatccat

SEQ ID NO: 617939 - DNA, 25 bp, Rattus norvegicus
tgcagctgccaaatggcgtcactta

SEQ ID NO: 617940 - DNA, 25 bp, Rattus norvegicus
tgcagctgccaattggcgtcactta

SEQ ID NO: 617941 - DNA, 25 bp, Rattus norvegicus
tgcagctgcccaaatgtaggtcctg

SEQ ID NO: 617942 - DNA, 25 bp, Rattus norvegicus
tgcagctgcccacatggcgccaggt

SEQ ID NO: 617943 - DNA, 25 bp, Rattus norvegicus
tgcagctgcccagatggcgccaggt

SEQ ID NO: 617944 - DNA, 25 bp, Rattus norvegicus
tgcagctgcccatatgtaggtcctg

SEQ ID NO: 617945 - DNA, 25 bp, Rattus norvegicus
tgcagctgccgtaggagctctagaa

SEQ ID NO: 617946 - DNA, 25 bp, Rattus norvegicus
tgcagctgccgttggagctctagaa

SEQ ID NO: 617947 - DNA, 25 bp, Rattus norvegicus
tgcagctgcctgatcaactatggag

SEQ ID NO: 617948 - DNA, 25 bp, Rattus norvegicus
tgcagctgcctgttcaactatggag

SEQ ID NO: 617949 - DNA, 25 bp, Rattus norvegicus
tgcagctgctccaggtggctacagt

SEQ ID NO: 617950 - DNA, 25 bp, Rattus norvegicus
tgcagctgctcctggtggctacagt

SEQ ID NO: 617951 - DNA, 25 bp, Rattus norvegicus
tgcagctgcttcagtcacgaatgtg

SEQ ID NO: 617952 - DNA, 25 bp, Rattus norvegicus
tgcagctgcttcctcataggtgaca

SEQ ID NO: 617953 - DNA, 25 bp, Rattus norvegicus
tgcagctgcttcgtcataggtgaca

SEQ ID NO: 617954 - DNA, 25 bp, Rattus norvegicus
tgcagctgcttctgtcacgaatgtg

SEQ ID NO: 617955 - DNA, 25 bp, Rattus norvegicus
tgcagctgcttgagggtgacttcag

SEQ ID NO: 617956 - DNA, 25 bp, Rattus norvegicus
tgcagctgcttgtgggtgacttcag

SEQ ID NO: 617957 - DNA, 25 bp, Rattus norvegicus
tgcagctggagtactggacatccca

SEQ ID NO: 617958 - DNA, 25 bp, Rattus norvegicus
tgcagctggagttctggacatccca

SEQ ID NO: 617959 - DNA, 25 bp, Rattus norvegicus
tgcagctggataccggcaactacct

SEQ ID NO: 617960 - DNA, 25 bp, Rattus norvegicus
tgcagctggatagcggcaactacct

SEQ ID NO: 617961 - DNA, 25 bp, Rattus norvegicus
tgcagctggcagcaaaacccgaagt

SEQ ID NO: 617962 - DNA, 25 bp, Rattus norvegicus
tgcagctggcaggaaaacccgaagt

SEQ ID NO: 617963 - DNA, 25 bp, Rattus norvegicus
tgcagctggtccagagcccactctt

SEQ ID NO: 617964 - DNA, 25 bp, Rattus norvegicus
tgcagctggtcctgagcccactctt

SEQ ID NO: 617965 - DNA, 25 bp, Rattus norvegicus
tgcagctgtatgctcactctggtga

SEQ ID NO: 617966 - DNA, 25 bp, Rattus norvegicus
tgcagctgtatggtcactctggtga

SEQ ID NO: 617967 - DNA, 25 bp, Rattus norvegicus
tgcagctgtcagagctggtgtgcac

SEQ ID NO: 617968 - DNA, 25 bp, Rattus norvegicus
tgcagctgtcagagtaaagaaacat

SEQ ID NO: 617969 - DNA, 25 bp, Rattus norvegicus
tgcagctgtcagtgctggtgtgcac

SEQ ID NO: 617970 - DNA, 25 bp, Rattus norvegicus
tgcagctgtcagtgtaaagaaacat

SEQ ID NO: 617971 - DNA, 25 bp, Rattus norvegicus
tgcagctgtctaccccttgggatga

SEQ ID NO: 617972 - DNA, 25 bp, Rattus norvegicus
tgcagctgtctagcccttgggatga

SEQ ID NO: 617973 - DNA, 25 bp, Rattus norvegicus
tgcagctgtcttctgtgggactgaa

SEQ ID NO: 617974 - DNA, 25 bp, Rattus norvegicus
tgcagctgtcttgtgtgggactgaa

SEQ ID NO: 617975 - DNA, 25 bp, Rattus norvegicus
tgcagctgtgctataggctgacata

SEQ ID NO: 617976 - DNA, 25 bp, Rattus norvegicus
tgcagctgtgctttaggctgacata

SEQ ID NO: 617977 - DNA, 25 bp, Rattus norvegicus
tgcagcttagaaccatacccagata

SEQ ID NO: 617978 - DNA, 25 bp, Rattus norvegicus
tgcagcttagaagcatacccagata

SEQ ID NO: 617979 - DNA, 25 bp, Rattus norvegicus
tgcagcttccctaaatggctatggg

SEQ ID NO: 617980 - DNA, 25 bp, Rattus norvegicus
tgcagcttccctacaggaagagccg

SEQ ID NO: 617981 - DNA, 25 bp, Rattus norvegicus
tgcagcttcccttaatggctatggg

SEQ ID NO: 617982 - DNA, 25 bp, Rattus norvegicus
tgcagcttcccttcaggaagagccg

SEQ ID NO: 617983 - DNA, 25 bp, Rattus norvegicus
tgcagcttcctgctaaggtgggatt

SEQ ID NO: 617984 - DNA, 25 bp, Rattus norvegicus
tgcagcttcctggtaaggtgggatt

SEQ ID NO: 617985 - DNA, 25 bp, Rattus norvegicus
tgcagcttcgggacctgacagcatg

SEQ ID NO: 617986 - DNA, 25 bp, Rattus norvegicus
tgcagcttcgggtcctgacagcatg

SEQ ID NO: 617987 - DNA, 25 bp, Rattus norvegicus
tgcagcttctctaccagggatggaa

SEQ ID NO: 617988 - DNA, 25 bp, Rattus norvegicus
tgcagcttctcttccagggatggaa

SEQ ID NO: 617989 - DNA, 25 bp, Rattus norvegicus
tgcagcttcttcagtctgtgaggtt

SEQ ID NO: 617990 - DNA, 25 bp, Rattus norvegicus
tgcagcttcttctgtctgtgaggtt

SEQ ID NO: 617991 - DNA, 25 bp, Rattus norvegicus
tgcagcttggtgaccgcggcctcta

SEQ ID NO: 617992 - DNA, 25 bp, Rattus norvegicus
tgcagcttggtgtccgcggcctcta

SEQ ID NO: 617993 - DNA, 25 bp, Rattus norvegicus
tgcagctttccacatcgacggacat

SEQ ID NO: 617994 - DNA, 25 bp, Rattus norvegicus
tgcagctttccagatcgacggacat

SEQ ID NO: 617995 - DNA, 25 bp, Rattus norvegicus
tgcagctttgttccacggagcctgg

SEQ ID NO: 617996 - DNA, 25 bp, Rattus norvegicus
tgcagctttgttgcacggagcctgg

SEQ ID NO: 617997 - DNA, 25 bp, Rattus norvegicus
tgcaggaacagtctcctgtcctgtc

SEQ ID NO: 617998 - DNA, 25 bp, Rattus norvegicus
tgcaggaacagtgtcctgtcctgtc

SEQ ID NO: 617999 - DNA, 25 bp, Rattus norvegicus
tgcaggaactttatcttgggagcga

SEQ ID NO: 618000 - DNA, 25 bp, Rattus norvegicus
tgcaggaactttttcttgggagcga

SEQ ID NO: 618001 - DNA, 25 bp, Rattus norvegicus
tgcaggaagactacttagctcccca

SEQ ID NO: 618002 - DNA, 25 bp, Rattus norvegicus
tgcaggaagacttcttagctcccca

SEQ ID NO: 618003 - DNA, 25 bp, Rattus norvegicus
tgcaggaagagccattctgtgcctt

SEQ ID NO: 618004 - DNA, 25 bp, Rattus norvegicus
tgcaggaagagcgattctgtgcctt

SEQ ID NO: 618005 - DNA, 25 bp, Rattus norvegicus
tgcaggacagtaccagttcccaaaa

SEQ ID NO: 618006 - DNA, 25 bp, Rattus norvegicus
tgcaggacagtagcagttcccaaaa

SEQ ID NO: 618007 - DNA, 25 bp, Rattus norvegicus
tgcaggacattcaatggccactcaa

SEQ ID NO: 618008 - DNA, 25 bp, Rattus norvegicus
tgcaggacattctatggccactcaa

SEQ ID NO: 618009 - DNA, 25 bp, Rattus norvegicus
tgcaggacctctacagcattgtacg

SEQ ID NO: 618010 - DNA, 25 bp, Rattus norvegicus
tgcaggacctcttcagcattgtacg

SEQ ID NO: 618011 - DNA, 25 bp, Rattus norvegicus
tgcaggacctgaagaggcttcctta

SEQ ID NO: 618012 - DNA, 25 bp, Rattus norvegicus
tgcaggacctgatgaggcttcctta

SEQ ID NO: 618013 - DNA, 25 bp, Rattus norvegicus
tgcaggacctgtccatcttcatcac

SEQ ID NO: 618014 - DNA, 25 bp, Rattus norvegicus
tgcaggacctgtgcatcttcatcac

SEQ ID NO: 618015 - DNA, 25 bp, Rattus norvegicus
tgcaggacgaacatggcagccagct

SEQ ID NO: 618016 - DNA, 25 bp, Rattus norvegicus
tgcaggacgaacttggcagccagct

SEQ ID NO: 618017 - DNA, 25 bp, Rattus norvegicus
tgcaggacggtcacatttatcaagt

SEQ ID NO: 618018 - DNA, 25 bp, Rattus norvegicus
tgcaggacggtctcatttatcaagt

SEQ ID NO: 618019 - DNA, 25 bp, Rattus norvegicus
tgcaggacttcgacatccccaaggg

SEQ ID NO: 618020 - DNA, 25 bp, Rattus norvegicus
tgcaggacttcgtcatccccaaggg

SEQ ID NO: 618021 - DNA, 25 bp, Rattus norvegicus
tgcaggacttgcctgatccatcttg

SEQ ID NO: 618022 - DNA, 25 bp, Rattus norvegicus
tgcaggacttgcgtgatccatcttg

SEQ ID NO: 618023 - DNA, 25 bp, Rattus norvegicus
tgcaggagaccacactggcagccaa

SEQ ID NO: 618024 - DNA, 25 bp, Rattus norvegicus
tgcaggagaccagactggcagccaa

SEQ ID NO: 618025 - DNA, 25 bp, Rattus norvegicus
tgcaggagaggtattcatctcttaa

SEQ ID NO: 618026 - DNA, 25 bp, Rattus norvegicus
tgcaggagaggttttcatctcttaa

SEQ ID NO: 618027 - DNA, 25 bp, Rattus norvegicus
tgcaggagcaaaccaagttcacacg

SEQ ID NO: 618028 - DNA, 25 bp, Rattus norvegicus
tgcaggagcaaagcaagttcacacg

SEQ ID NO: 618029 - DNA, 25 bp, Rattus norvegicus
tgcaggagccatcgtgtcttttcat

SEQ ID NO: 618030 - DNA, 25 bp, Rattus norvegicus
tgcaggagccatggtgtcttttcat

SEQ ID NO: 618031 - DNA, 25 bp, Rattus norvegicus
tgcaggagcgacaacagcagcgttt

SEQ ID NO: 618032 - DNA, 25 bp, Rattus norvegicus
tgcaggagcgactacagcagcgttt

SEQ ID NO: 618033 - DNA, 25 bp, Rattus norvegicus
tgcaggaggcagctcttacccctac

SEQ ID NO: 618034 - DNA, 25 bp, Rattus norvegicus
tgcaggaggcaggtcttacccctac

SEQ ID NO: 618035 - DNA, 25 bp, Rattus norvegicus
tgcaggaggcggagcttccccttct

SEQ ID NO: 618036 - DNA, 25 bp, Rattus norvegicus
tgcaggaggcggtgcttccccttct

SEQ ID NO: 618037 - DNA, 25 bp, Rattus norvegicus
tgcaggagggagcacttctctgcca

SEQ ID NO: 618038 - DNA, 25 bp, Rattus norvegicus
tgcaggagggaggacttctctgcca

SEQ ID NO: 618039 - DNA, 25 bp, Rattus norvegicus
tgcaggaggtgaatcatagccactt

SEQ ID NO: 618040 - DNA, 25 bp, Rattus norvegicus
tgcaggaggtgattcatagccactt

SEQ ID NO: 618041 - DNA, 25 bp, Rattus norvegicus
tgcaggagtctacccaggagctctc

SEQ ID NO: 618042 - DNA, 25 bp, Rattus norvegicus
tgcaggagtctagccaggagctctc

SEQ ID NO: 618043 - DNA, 25 bp, Rattus norvegicus
tgcaggagtctgataccaacttcca

SEQ ID NO: 618044 - DNA, 25 bp, Rattus norvegicus
tgcaggagtctgttaccaacttcca

SEQ ID NO: 618045 - DNA, 25 bp, Rattus norvegicus
tgcaggagtttgaagaccggctttt

SEQ ID NO: 618046 - DNA, 25 bp, Rattus norvegicus
tgcaggagtttgtagaccggctttt

SEQ ID NO: 618047 - DNA, 25 bp, Rattus norvegicus
tgcaggatctggactccccagtgta

SEQ ID NO: 618048 - DNA, 25 bp, Rattus norvegicus
tgcaggatctggtctccccagtgta

SEQ ID NO: 618049 - DNA, 25 bp, Rattus norvegicus
tgcaggatgctaccagtgccataag

SEQ ID NO: 618050 - DNA, 25 bp, Rattus norvegicus
tgcaggatgctagcagtgccataag

SEQ ID NO: 618051 - DNA, 25 bp, Rattus norvegicus
tgcaggatggcacgacagtactaaa

SEQ ID NO: 618052 - DNA, 25 bp, Rattus norvegicus
tgcaggatggcaggacagtactaaa

SEQ ID NO: 618053 - DNA, 25 bp, Rattus norvegicus
tgcaggattccacacaccgtacaaa

SEQ ID NO: 618054 - DNA, 25 bp, Rattus norvegicus
tgcaggattccagacaccgtacaaa

SEQ ID NO: 618055 - DNA, 25 bp, Rattus norvegicus
tgcaggattggaaggtgacctacct

SEQ ID NO: 618056 - DNA, 25 bp, Rattus norvegicus
tgcaggattggatggtgacctacct

SEQ ID NO: 618057 - DNA, 25 bp, Rattus norvegicus
tgcaggcaaaatccaatgcgcataa

SEQ ID NO: 618058 - DNA, 25 bp, Rattus norvegicus
tgcaggcaaaatgcaatgcgcataa

SEQ ID NO: 618059 - DNA, 25 bp, Rattus norvegicus
tgcaggcaaagacaccaatggctcc

SEQ ID NO: 618060 - DNA, 25 bp, Rattus norvegicus
tgcaggcaaagagaccaatggctcc

SEQ ID NO: 618061 - DNA, 25 bp, Rattus norvegicus
tgcaggcaacagacacacaggtgat

SEQ ID NO: 618062 - DNA, 25 bp, Rattus norvegicus
tgcaggcaacagtcacacaggtgat

SEQ ID NO: 618063 - DNA, 25 bp, Rattus norvegicus
tgcaggcaagaccacggcacagtat

SEQ ID NO: 618064 - DNA, 25 bp, Rattus norvegicus
tgcaggcaagacgacggcacagtat

SEQ ID NO: 618065 - DNA, 25 bp, Rattus norvegicus
tgcaggcaagcccagtcagggaata

SEQ ID NO: 618066 - DNA, 25 bp, Rattus norvegicus
tgcaggcaagccgagtcagggaata

SEQ ID NO: 618067 - DNA, 25 bp, Rattus norvegicus
tgcaggcaagtcacattcatataaa

SEQ ID NO: 618068 - DNA, 25 bp, Rattus norvegicus
tgcaggcaagtctcattcatataaa

SEQ ID NO: 618069 - DNA, 25 bp, Rattus norvegicus
tgcaggcacactacctaacaggatt

SEQ ID NO: 618070 - DNA, 25 bp, Rattus norvegicus
tgcaggcacacttcctaacaggatt

SEQ ID NO: 618071 - DNA, 25 bp, Rattus norvegicus
tgcaggcacagaccactgaatctgg

SEQ ID NO: 618072 - DNA, 25 bp, Rattus norvegicus
tgcaggcacagagcactgaatctgg

SEQ ID NO: 618073 - DNA, 25 bp, Rattus norvegicus
tgcaggcacgttagtatgggtccca

SEQ ID NO: 618074 - DNA, 25 bp, Rattus norvegicus
tgcaggcacgtttgtatgggtccca

SEQ ID NO: 618075 - DNA, 25 bp, Rattus norvegicus
tgcaggcagaagaccttggtcaggc

SEQ ID NO: 618076 - DNA, 25 bp, Rattus norvegicus
tgcaggcagaagtccttggtcaggc

SEQ ID NO: 618077 - DNA, 25 bp, Rattus norvegicus
tgcaggcagcaaatccactttatct

SEQ ID NO: 618078 - DNA, 25 bp, Rattus norvegicus
tgcaggcagcaattccactttatct

SEQ ID NO: 618079 - DNA, 25 bp, Rattus norvegicus
tgcaggcagcagatctgatcctaga

SEQ ID NO: 618080 - DNA, 25 bp, Rattus norvegicus
tgcaggcagcagttctgatcctaga

SEQ ID NO: 618081 - DNA, 25 bp, Rattus norvegicus
tgcaggcagcctaacgattaaaact

SEQ ID NO: 618082 - DNA, 25 bp, Rattus norvegicus
tgcaggcagccttacgattaaaact

SEQ ID NO: 618083 - DNA, 25 bp, Rattus norvegicus
tgcaggcagcggacaccttaaactt

SEQ ID NO: 618084 - DNA, 25 bp, Rattus norvegicus
tgcaggcagcggtcaccttaaactt

SEQ ID NO: 618085 - DNA, 25 bp, Rattus norvegicus
tgcaggcagcgtaaagtcacagact

SEQ ID NO: 618086 - DNA, 25 bp, Rattus norvegicus
tgcaggcagcgttaagtcacagact

SEQ ID NO: 618087 - DNA, 25 bp, Rattus norvegicus
tgcaggcaggaaactcagggttcac

SEQ ID NO: 618088 - DNA, 25 bp, Rattus norvegicus
tgcaggcaggaatctcagggttcac

SEQ ID NO: 618089 - DNA, 25 bp, Rattus norvegicus
tgcaggcagggacactcatccgtca

SEQ ID NO: 618090 - DNA, 25 bp, Rattus norvegicus
tgcaggcagggagactcatccgtca

SEQ ID NO: 618091 - DNA, 25 bp, Rattus norvegicus
tgcaggcaggttactccttacctgg

SEQ ID NO: 618092 - DNA, 25 bp, Rattus norvegicus
tgcaggcaggtttctccttacctgg

SEQ ID NO: 618093 - DNA, 25 bp, Rattus norvegicus
tgcaggcagtggagcgtctcaacca

SEQ ID NO: 618094 - DNA, 25 bp, Rattus norvegicus
tgcaggcagtggtgcgtctcaacca

SEQ ID NO: 618095 - DNA, 25 bp, Rattus norvegicus
tgcaggcatacacgcattacgaaca

SEQ ID NO: 618096 - DNA, 25 bp, Rattus norvegicus
tgcaggcatacaggcattacgaaca

SEQ ID NO: 618097 - DNA, 25 bp, Rattus norvegicus
tgcaggcatatgagggtggctccct

SEQ ID NO: 618098 - DNA, 25 bp, Rattus norvegicus
tgcaggcatatgtgggtggctccct

SEQ ID NO: 618099 - DNA, 25 bp, Rattus norvegicus
tgcaggcatcggacacacatgtgga

SEQ ID NO: 618100 - DNA, 25 bp, Rattus norvegicus
tgcaggcatcggtcacacatgtgga

SEQ ID NO: 618101 - DNA, 25 bp, Rattus norvegicus
tgcaggcatctgatgacaagagact

SEQ ID NO: 618102 - DNA, 25 bp, Rattus norvegicus
tgcaggcatctgttgacaagagact

SEQ ID NO: 618103 - DNA, 25 bp, Rattus norvegicus
tgcaggcatgccattctagatgtct

SEQ ID NO: 618104 - DNA, 25 bp, Rattus norvegicus
tgcaggcatgcctttctagatgtct

SEQ ID NO: 618105 - DNA, 25 bp, Rattus norvegicus
tgcaggccacagatctaattctcta

SEQ ID NO: 618106 - DNA, 25 bp, Rattus norvegicus
tgcaggccacagttctaattctcta

SEQ ID NO: 618107 - DNA, 25 bp, Rattus norvegicus
tgcaggccaccactgactatgagaa

SEQ ID NO: 618108 - DNA, 25 bp, Rattus norvegicus
tgcaggccaccagtgactatgagaa

SEQ ID NO: 618109 - DNA, 25 bp, Rattus norvegicus
tgcaggccagagcagcatctttcag

SEQ ID NO: 618110 - DNA, 25 bp, Rattus norvegicus
tgcaggccagaggagcatctttcag

SEQ ID NO: 618111 - DNA, 25 bp, Rattus norvegicus
tgcaggccagtgacaatgccctgga

SEQ ID NO: 618112 - DNA, 25 bp, Rattus norvegicus
tgcaggccagtgtcaatgccctgga

SEQ ID NO: 618113 - DNA, 25 bp, Rattus norvegicus
tgcaggcccagaccctaggcttgtg

SEQ ID NO: 618114 - DNA, 25 bp, Rattus norvegicus
tgcaggcccagagcctaggcttgtg

SEQ ID NO: 618115 - DNA, 25 bp, Rattus norvegicus
tgcaggccccagagaactaagtttt

SEQ ID NO: 618116 - DNA, 25 bp, Rattus norvegicus
tgcaggccccagtgaactaagtttt

SEQ ID NO: 618117 - DNA, 25 bp, Rattus norvegicus
tgcaggccctaaatggttttatttt

SEQ ID NO: 618118 - DNA, 25 bp, Rattus norvegicus
tgcaggccctaattggttttatttt

SEQ ID NO: 618119 - DNA, 25 bp, Rattus norvegicus
tgcaggccctgcaagacagcgcaac

SEQ ID NO: 618120 - DNA, 25 bp, Rattus norvegicus
tgcaggccctgctagacagcgcaac

SEQ ID NO: 618121 - DNA, 25 bp, Rattus norvegicus
tgcaggccgggactcaggattcctc

SEQ ID NO: 618122 - DNA, 25 bp, Rattus norvegicus
tgcaggccgggagtcaggattcctc

SEQ ID NO: 618123 - DNA, 25 bp, Rattus norvegicus
tgcaggcctactctgcttcttgacc

SEQ ID NO: 618124 - DNA, 25 bp, Rattus norvegicus
tgcaggcctactgtgcttcttgacc

SEQ ID NO: 618125 - DNA, 25 bp, Rattus norvegicus
tgcaggcctattacggctgctgaag

SEQ ID NO: 618126 - DNA, 25 bp, Rattus norvegicus
tgcaggcctatttcggctgctgaag

SEQ ID NO: 618127 - DNA, 25 bp, Rattus norvegicus
tgcaggcctcacagctgaagcggac

SEQ ID NO: 618128 - DNA, 25 bp, Rattus norvegicus
tgcaggcctcactgctgaagcggac

SEQ ID NO: 618129 - DNA, 25 bp, Rattus norvegicus
tgcaggcctccaagaagtctcgaga

SEQ ID NO: 618130 - DNA, 25 bp, Rattus norvegicus
tgcaggcctccatgaagtctcgaga

SEQ ID NO: 618131 - DNA, 25 bp, Rattus norvegicus
tgcaggcctcggaaatttgggatta

SEQ ID NO: 618132 - DNA, 25 bp, Rattus norvegicus
tgcaggcctcggtaatttgggatta

SEQ ID NO: 618133 - DNA, 25 bp, Rattus norvegicus
tgcaggcctgagatgtttcttgagc

SEQ ID NO: 618134 - DNA, 25 bp, Rattus norvegicus
tgcaggcctgagttgtttcttgagc

SEQ ID NO: 618135 - DNA, 25 bp, Rattus norvegicus
tgcaggcctgttaacttcatggagt

SEQ ID NO: 618136 - DNA, 25 bp, Rattus norvegicus
tgcaggcctgttctctgtggtcaca

SEQ ID NO: 618137 - DNA, 25 bp, Rattus norvegicus
tgcaggcctgttgtctgtggtcaca

SEQ ID NO: 618138 - DNA, 25 bp, Rattus norvegicus
tgcaggcctgtttacttcatggagt

SEQ ID NO: 618139 - DNA, 25 bp, Rattus norvegicus
tgcaggccttatacacatccatttt

SEQ ID NO: 618140 - DNA, 25 bp, Rattus norvegicus
tgcaggccttattcacatccatttt

SEQ ID NO: 618141 - DNA, 25 bp, Rattus norvegicus
tgcaggccttgaagtggagaacccc

SEQ ID NO: 618142 - DNA, 25 bp, Rattus norvegicus
tgcaggccttgatgtggagaacccc

SEQ ID NO: 618143 - DNA, 25 bp, Rattus norvegicus
tgcaggcgaataaccccacagacat

SEQ ID NO: 618144 - DNA, 25 bp, Rattus norvegicus
tgcaggcgaatatccccacagacat

SEQ ID NO: 618145 - DNA, 25 bp, Rattus norvegicus
tgcaggcggagtcaccaggaatctt

SEQ ID NO: 618146 - DNA, 25 bp, Rattus norvegicus
tgcaggcggagtgaccaggaatctt

SEQ ID NO: 618147 - DNA, 25 bp, Rattus norvegicus
tgcaggcgttcccactaatgtagct

SEQ ID NO: 618148 - DNA, 25 bp, Rattus norvegicus
tgcaggcgttccgactaatgtagct

SEQ ID NO: 618149 - DNA, 25 bp, Rattus norvegicus
tgcaggctcacacttggacccatga

SEQ ID NO: 618150 - DNA, 25 bp, Rattus norvegicus
tgcaggctcacagttggacccatga

SEQ ID NO: 618151 - DNA, 25 bp, Rattus norvegicus
tgcaggctcagcagaagcacaaagt

SEQ ID NO: 618152 - DNA, 25 bp, Rattus norvegicus
tgcaggctcagctgaagcacaaagt

SEQ ID NO: 618153 - DNA, 25 bp, Rattus norvegicus
tgcaggctccagacgggattttatg

SEQ ID NO: 618154 - DNA, 25 bp, Rattus norvegicus
tgcaggctccagtcgggattttatg

SEQ ID NO: 618155 - DNA, 25 bp, Rattus norvegicus
tgcaggctccctaaaatacatagaa

SEQ ID NO: 618156 - DNA, 25 bp, Rattus norvegicus
tgcaggctcccttaaatacatagaa

SEQ ID NO: 618157 - DNA, 25 bp, Rattus norvegicus
tgcaggctccgcacatggtggttta

SEQ ID NO: 618158 - DNA, 25 bp, Rattus norvegicus
tgcaggctccgctcatggtggttta

SEQ ID NO: 618159 - DNA, 25 bp, Rattus norvegicus
tgcaggctcctgcagtagatgttag

SEQ ID NO: 618160 - DNA, 25 bp, Rattus norvegicus
tgcaggctcctggagtagatgttag

SEQ ID NO: 618161 - DNA, 25 bp, Rattus norvegicus
tgcaggctccttcaagcaccaagta

SEQ ID NO: 618162 - DNA, 25 bp, Rattus norvegicus
tgcaggctccttgaagcaccaagta

SEQ ID NO: 618163 - DNA, 25 bp, Rattus norvegicus
tgcaggctctgaaccgtggccatga

SEQ ID NO: 618164 - DNA, 25 bp, Rattus norvegicus
tgcaggctctgatccgtggccatga

SEQ ID NO: 618165 - DNA, 25 bp, Rattus norvegicus
tgcaggctgacgcatgtaccctgag

SEQ ID NO: 618166 - DNA, 25 bp, Rattus norvegicus
tgcaggctgacggatgtaccctgag

SEQ ID NO: 618167 - DNA, 25 bp, Rattus norvegicus
tgcaggctgctcagttgccggacaa

SEQ ID NO: 618168 - DNA, 25 bp, Rattus norvegicus
tgcaggctgctctgttgccggacaa

SEQ ID NO: 618169 - DNA, 25 bp, Rattus norvegicus
tgcaggctggaacaccaagcattca

SEQ ID NO: 618170 - DNA, 25 bp, Rattus norvegicus
tgcaggctggaagaccaagcattca

SEQ ID NO: 618171 - DNA, 25 bp, Rattus norvegicus
tgcaggctgtatctttctaaccacc

SEQ ID NO: 618172 - DNA, 25 bp, Rattus norvegicus
tgcaggctgtatgtttctaaccacc

SEQ ID NO: 618173 - DNA, 25 bp, Rattus norvegicus
tgcaggctgtcaagacctttgagca

SEQ ID NO: 618174 - DNA, 25 bp, Rattus norvegicus
tgcaggctgtcatgacctttgagca

SEQ ID NO: 618175 - DNA, 25 bp, Rattus norvegicus
tgcaggctgtgtcagttgctccaag

SEQ ID NO: 618176 - DNA, 25 bp, Rattus norvegicus
tgcaggctgtgtgagttgctccaag

SEQ ID NO: 618177 - DNA, 25 bp, Rattus norvegicus
tgcaggcttagcattgacactattt

SEQ ID NO: 618178 - DNA, 25 bp, Rattus norvegicus
tgcaggcttagctttgacactattt

SEQ ID NO: 618179 - DNA, 25 bp, Rattus norvegicus
tgcagggaagttagtttctccgctt

SEQ ID NO: 618180 - DNA, 25 bp, Rattus norvegicus
tgcagggaagtttgtttctccgctt

SEQ ID NO: 618181 - DNA, 25 bp, Rattus norvegicus
tgcagggaatttccaccaccactgc

SEQ ID NO: 618182 - DNA, 25 bp, Rattus norvegicus
tgcagggaatttgcaccaccactgc

SEQ ID NO: 618183 - DNA, 25 bp, Rattus norvegicus
tgcagggacagccaacagacgtttc

SEQ ID NO: 618184 - DNA, 25 bp, Rattus norvegicus
tgcagggacagcgaacagacgtttc

SEQ ID NO: 618185 - DNA, 25 bp, Rattus norvegicus
tgcagggacccaagagaatcaaagg

SEQ ID NO: 618186 - DNA, 25 bp, Rattus norvegicus
tgcagggacccatgagaatcaaagg

SEQ ID NO: 618187 - DNA, 25 bp, Rattus norvegicus
tgcagggactctatgtctacggacg

SEQ ID NO: 618188 - DNA, 25 bp, Rattus norvegicus
tgcagggactctttgtctacggacg

SEQ ID NO: 618189 - DNA, 25 bp, Rattus norvegicus
tgcagggagcaacacgccatctttc

SEQ ID NO: 618190 - DNA, 25 bp, Rattus norvegicus
tgcagggagcaagacgccatctttc

SEQ ID NO: 618191 - DNA, 25 bp, Rattus norvegicus
tgcagggatagaaataacacaggct

SEQ ID NO: 618192 - DNA, 25 bp, Rattus norvegicus
tgcagggatagatataacacaggct

SEQ ID NO: 618193 - DNA, 25 bp, Rattus norvegicus
tgcagggatatcctgagtacccaaa

SEQ ID NO: 618194 - DNA, 25 bp, Rattus norvegicus
tgcagggatatcgtgagtacccaaa

SEQ ID NO: 618195 - DNA, 25 bp, Rattus norvegicus
tgcagggcagatacgcggagtacat

SEQ ID NO: 618196 - DNA, 25 bp, Rattus norvegicus
tgcagggcagattcgcggagtacat

SEQ ID NO: 618197 - DNA, 25 bp, Rattus norvegicus
tgcagggcagttagtcaaccttgat

SEQ ID NO: 618198 - DNA, 25 bp, Rattus norvegicus
tgcagggcagtttgtcaaccttgat

SEQ ID NO: 618199 - DNA, 25 bp, Rattus norvegicus
tgcagggccactctcattatggaaa

SEQ ID NO: 618200 - DNA, 25 bp, Rattus norvegicus
tgcagggccactgtcattatggaaa

SEQ ID NO: 618201 - DNA, 25 bp, Rattus norvegicus
tgcagggcccatcccagtagggtta

SEQ ID NO: 618202 - DNA, 25 bp, Rattus norvegicus
tgcagggcccatgccagtagggtta

SEQ ID NO: 618203 - DNA, 25 bp, Rattus norvegicus
tgcagggccgcgacttcacgggcaa

SEQ ID NO: 618204 - DNA, 25 bp, Rattus norvegicus
tgcagggccgcgtcttcacgggcaa

SEQ ID NO: 618205 - DNA, 25 bp, Rattus norvegicus
tgcagggctaaccactgggtaccat

SEQ ID NO: 618206 - DNA, 25 bp, Rattus norvegicus
tgcagggctaacgactgggtaccat

SEQ ID NO: 618207 - DNA, 25 bp, Rattus norvegicus
tgcagggcttctaggatcgctgtca

SEQ ID NO: 618208 - DNA, 25 bp, Rattus norvegicus
tgcagggcttctcaggaatggcttc

SEQ ID NO: 618209 - DNA, 25 bp, Rattus norvegicus
tgcagggcttctgaggaatggcttc

SEQ ID NO: 618210 - DNA, 25 bp, Rattus norvegicus
tgcagggcttcttggatcgctgtca

SEQ ID NO: 618211 - DNA, 25 bp, Rattus norvegicus
tgcagggtactgcttacctgtccta

SEQ ID NO: 618212 - DNA, 25 bp, Rattus norvegicus
tgcagggtactggttacctgtccta

SEQ ID NO: 618213 - DNA, 25 bp, Rattus norvegicus
tgcagggtcacaccgtggatgctca

SEQ ID NO: 618214 - DNA, 25 bp, Rattus norvegicus
tgcagggtcacagcgtggatgctca

SEQ ID NO: 618215 - DNA, 25 bp, Rattus norvegicus
tgcagggtcattcactcagatgtaa

SEQ ID NO: 618216 - DNA, 25 bp, Rattus norvegicus
tgcagggtcattgactcagatgtaa

SEQ ID NO: 618217 - DNA, 25 bp, Rattus norvegicus
tgcagggtgaacacccggccacaga

SEQ ID NO: 618218 - DNA, 25 bp, Rattus norvegicus
tgcagggtgaactcccggccacaga

SEQ ID NO: 618219 - DNA, 25 bp, Rattus norvegicus
tgcagggtgagcacagtgttagcaa

SEQ ID NO: 618220 - DNA, 25 bp, Rattus norvegicus
tgcagggtgagctcagtgttagcaa

SEQ ID NO: 618221 - DNA, 25 bp, Rattus norvegicus
tgcagggtggacatccggctacaag

SEQ ID NO: 618222 - DNA, 25 bp, Rattus norvegicus
tgcagggtggacttccggctacaag

SEQ ID NO: 618223 - DNA, 25 bp, Rattus norvegicus
tgcagggttgtcctggtgccaaaaa

SEQ ID NO: 618224 - DNA, 25 bp, Rattus norvegicus
tgcagggttgtcgtggtgccaaaaa

SEQ ID NO: 618225 - DNA, 25 bp, Rattus norvegicus
tgcaggtacagcaggcggttcacca

SEQ ID NO: 618226 - DNA, 25 bp, Rattus norvegicus
tgcaggtacagctggcggttcacca

SEQ ID NO: 618227 - DNA, 25 bp, Rattus norvegicus
tgcaggtatctgacttcaagggcca

SEQ ID NO: 618228 - DNA, 25 bp, Rattus norvegicus
tgcaggtatctgtcttcaagggcca

SEQ ID NO: 618229 - DNA, 25 bp, Rattus norvegicus
tgcaggtatttcatggctccttaag

SEQ ID NO: 618230 - DNA, 25 bp, Rattus norvegicus
tgcaggtatttcttggctccttaag

SEQ ID NO: 618231 - DNA, 25 bp, Rattus norvegicus
tgcaggtcaatcaaagggcttattt

SEQ ID NO: 618232 - DNA, 25 bp, Rattus norvegicus
tgcaggtcaatctaagggcttattt

SEQ ID NO: 618233 - DNA, 25 bp, Rattus norvegicus
tgcaggtcatatagaatgccacgct

SEQ ID NO: 618234 - DNA, 25 bp, Rattus norvegicus
tgcaggtcatattgaatgccacgct

SEQ ID NO: 618235 - DNA, 25 bp, Rattus norvegicus
tgcaggtccacaatgccccaaggtg

SEQ ID NO: 618236 - DNA, 25 bp, Rattus norvegicus
tgcaggtccacattgccccaaggtg

SEQ ID NO: 618237 - DNA, 25 bp, Rattus norvegicus
tgcaggtccctaccactattttgtg

SEQ ID NO: 618238 - DNA, 25 bp, Rattus norvegicus
tgcaggtccctagcactattttgtg

SEQ ID NO: 618239 - DNA, 25 bp, Rattus norvegicus
tgcaggtcccttcagtgtggtgaac

SEQ ID NO: 618240 - DNA, 25 bp, Rattus norvegicus
tgcaggtcccttgagtgtggtgaac

SEQ ID NO: 618241 - DNA, 25 bp, Rattus norvegicus
tgcaggtcggacacccttgaggaca

SEQ ID NO: 618242 - DNA, 25 bp, Rattus norvegicus
tgcaggtcggactcccttgaggaca

SEQ ID NO: 618243 - DNA, 25 bp, Rattus norvegicus
tgcaggtcgtgccaaagccttgtgt

SEQ ID NO: 618244 - DNA, 25 bp, Rattus norvegicus
tgcaggtcgtgcgaaagccttgtgt

SEQ ID NO: 618245 - DNA, 25 bp, Rattus norvegicus
tgcaggtctaaccatgcctagcatc

SEQ ID NO: 618246 - DNA, 25 bp, Rattus norvegicus
tgcaggtctaacgatgcctagcatc

SEQ ID NO: 618247 - DNA, 25 bp, Rattus norvegicus
tgcaggtctggtaggtagtttttac

SEQ ID NO: 618248 - DNA, 25 bp, Rattus norvegicus
tgcaggtctggttggtagtttttac

SEQ ID NO: 618249 - DNA, 25 bp, Rattus norvegicus
tgcaggtgaaggaggtcaaagtcaa

SEQ ID NO: 618250 - DNA, 25 bp, Rattus norvegicus
tgcaggtgaaggtggtcaaagtcaa

SEQ ID NO: 618251 - DNA, 25 bp, Rattus norvegicus
tgcaggtgactgacttgagcctcga

SEQ ID NO: 618252 - DNA, 25 bp, Rattus norvegicus
tgcaggtgactgtcttgagcctcga

SEQ ID NO: 618253 - DNA, 25 bp, Rattus norvegicus
tgcaggtgccagagccagccttgag

SEQ ID NO: 618254 - DNA, 25 bp, Rattus norvegicus
tgcaggtgccagtgccagccttgag

SEQ ID NO: 618255 - DNA, 25 bp, Rattus norvegicus
tgcaggtgccccaaaaggtgaactt

SEQ ID NO: 618256 - DNA, 25 bp, Rattus norvegicus
tgcaggtgccccatgtgcagagttc

SEQ ID NO: 618257 - DNA, 25 bp, Rattus norvegicus
tgcaggtgcccctaaaggtgaactt

SEQ ID NO: 618258 - DNA, 25 bp, Rattus norvegicus
tgcaggtgccccttgtgcagagttc

SEQ ID NO: 618259 - DNA, 25 bp, Rattus norvegicus
tgcaggtgccgcacacaaacaatgc

SEQ ID NO: 618260 - DNA, 25 bp, Rattus norvegicus
tgcaggtgccgctcacaaacaatgc

SEQ ID NO: 618261 - DNA, 25 bp, Rattus norvegicus
tgcaggtgtgcaacaggtgccccaa

SEQ ID NO: 618262 - DNA, 25 bp, Rattus norvegicus
tgcaggtgtgcatcaggtgccccaa

SEQ ID NO: 618263 - DNA, 25 bp, Rattus norvegicus
tgcaggtgtgtgctcccaggacaaa

SEQ ID NO: 618264 - DNA, 25 bp, Rattus norvegicus
tgcaggtgtgtggtcccaggacaaa

SEQ ID NO: 618265 - DNA, 25 bp, Rattus norvegicus
tgcaggttcaggattggccctcaga

SEQ ID NO: 618266 - DNA, 25 bp, Rattus norvegicus
tgcaggttcaggtttggccctcaga

SEQ ID NO: 618267 - DNA, 25 bp, Rattus norvegicus
tgcaggttcagtctcagcagcaccg

SEQ ID NO: 618268 - DNA, 25 bp, Rattus norvegicus
tgcaggttcagtgtcagcagcaccg

SEQ ID NO: 618269 - DNA, 25 bp, Rattus norvegicus
tgcaggttccttcattatcaatctc

SEQ ID NO: 618270 - DNA, 25 bp, Rattus norvegicus
tgcaggttccttgattatcaatctc

SEQ ID NO: 618271 - DNA, 25 bp, Rattus norvegicus
tgcaggttctgaccagcgctgtcac

SEQ ID NO: 618272 - DNA, 25 bp, Rattus norvegicus
tgcaggttctgagcagcgctgtcac

SEQ ID NO: 618273 - DNA, 25 bp, Rattus norvegicus
tgcaggttgaccacatgcgctggga

SEQ ID NO: 618274 - DNA, 25 bp, Rattus norvegicus
tgcaggttgacctcatgcgctggga

SEQ ID NO: 618275 - DNA, 25 bp, Rattus norvegicus
tgcaggttgccgaccgagtagtcag

SEQ ID NO: 618276 - DNA, 25 bp, Rattus norvegicus
tgcaggttgccgtccgagtagtcag

SEQ ID NO: 618277 - DNA, 25 bp, Rattus norvegicus
tgcaggttgttactctggaccaaaa

SEQ ID NO: 618278 - DNA, 25 bp, Rattus norvegicus
tgcaggttgttagtctggaccaaaa

SEQ ID NO: 618279 - DNA, 25 bp, Rattus norvegicus
tgcaggtttcgccacatttggacaa

SEQ ID NO: 618280 - DNA, 25 bp, Rattus norvegicus
tgcaggtttcgcgacatttggacaa

SEQ ID NO: 618281 - DNA, 25 bp, Rattus norvegicus
tgcaggtttgccctaacgctcaatg

SEQ ID NO: 618282 - DNA, 25 bp, Rattus norvegicus
tgcaggtttgccgtaacgctcaatg

SEQ ID NO: 618283 - DNA, 25 bp, Rattus norvegicus
tgcagtaaaccaacccacagttctg

SEQ ID NO: 618284 - DNA, 25 bp, Rattus norvegicus
tgcagtaaaccatcccacagttctg

SEQ ID NO: 618285 - DNA, 25 bp, Rattus norvegicus
tgcagtaattttcttcactcctggg

SEQ ID NO: 618286 - DNA, 25 bp, Rattus norvegicus
tgcagtaattttgttcactcctggg

SEQ ID NO: 618287 - DNA, 25 bp, Rattus norvegicus
tgcagtacagcactccaattggaaa

SEQ ID NO: 618288 - DNA, 25 bp, Rattus norvegicus
tgcagtacagcagtccaattggaaa

SEQ ID NO: 618289 - DNA, 25 bp, Rattus norvegicus
tgcagtaccgtgcatttcggtcgat

SEQ ID NO: 618290 - DNA, 25 bp, Rattus norvegicus
tgcagtaccgtggatttcggtcgat

SEQ ID NO: 618291 - DNA, 25 bp, Rattus norvegicus
tgcagtacgattcaagttcacgtgt

SEQ ID NO: 618292 - DNA, 25 bp, Rattus norvegicus
tgcagtacgattgaagttcacgtgt

SEQ ID NO: 618293 - DNA, 25 bp, Rattus norvegicus
tgcagtactgagaggcgtttcccag

SEQ ID NO: 618294 - DNA, 25 bp, Rattus norvegicus
tgcagtactgagtggcgtttcccag

SEQ ID NO: 618295 - DNA, 25 bp, Rattus norvegicus
tgcagtagcagcaggcaacagcctg

SEQ ID NO: 618296 - DNA, 25 bp, Rattus norvegicus
tgcagtagcagctggcaacagcctg

SEQ ID NO: 618297 - DNA, 25 bp, Rattus norvegicus
tgcagtagccttcatttaaaccacg

SEQ ID NO: 618298 - DNA, 25 bp, Rattus norvegicus
tgcagtagccttgatttaaaccacg

SEQ ID NO: 618299 - DNA, 25 bp, Rattus norvegicus
tgcagtagctcaaattaaacttttt

SEQ ID NO: 618300 - DNA, 25 bp, Rattus norvegicus
tgcagtagctcatattaaacttttt

SEQ ID NO: 618301 - DNA, 25 bp, Rattus norvegicus
tgcagtaggtacaacacggctatct

SEQ ID NO: 618302 - DNA, 25 bp, Rattus norvegicus
tgcagtaggtactacacggctatct

SEQ ID NO: 618303 - DNA, 25 bp, Rattus norvegicus
tgcagtataacaacctctcaatcca

SEQ ID NO: 618304 - DNA, 25 bp, Rattus norvegicus
tgcagtataacatcctctcaatcca

SEQ ID NO: 618305 - DNA, 25 bp, Rattus norvegicus
tgcagtatccacagttcaaggcgaa

SEQ ID NO: 618306 - DNA, 25 bp, Rattus norvegicus
tgcagtatccactgttcaaggcgaa

SEQ ID NO: 618307 - DNA, 25 bp, Rattus norvegicus
tgcagtatctctacttggagcccaa

SEQ ID NO: 618308 - DNA, 25 bp, Rattus norvegicus
tgcagtatctcttcttggagcccaa

SEQ ID NO: 618309 - DNA, 25 bp, Rattus norvegicus
tgcagtattaagagccttttcctct

SEQ ID NO: 618310 - DNA, 25 bp, Rattus norvegicus
tgcagtattaagtgccttttcctct

SEQ ID NO: 618311 - DNA, 25 bp, Rattus norvegicus
tgcagtcaacttaccaaggcgtggt

SEQ ID NO: 618312 - DNA, 25 bp, Rattus norvegicus
tgcagtcaactttccaaggcgtggt

SEQ ID NO: 618313 - DNA, 25 bp, Rattus norvegicus
tgcagtcacaggactcaaaggctca

SEQ ID NO: 618314 - DNA, 25 bp, Rattus norvegicus
tgcagtcacaggtctcaaaggctca

SEQ ID NO: 618315 - DNA, 25 bp, Rattus norvegicus
tgcagtcacataagctccagggatt

SEQ ID NO: 618316 - DNA, 25 bp, Rattus norvegicus
tgcagtcacatatgctccagggatt

SEQ ID NO: 618317 - DNA, 25 bp, Rattus norvegicus
tgcagtcaccccaggcgtctaaaga

SEQ ID NO: 618318 - DNA, 25 bp, Rattus norvegicus
tgcagtcacccctggcgtctaaaga

SEQ ID NO: 618319 - DNA, 25 bp, Rattus norvegicus
tgcagtcactgtaccagtggccgtt

SEQ ID NO: 618320 - DNA, 25 bp, Rattus norvegicus
tgcagtcactgttccagtggccgtt

SEQ ID NO: 618321 - DNA, 25 bp, Rattus norvegicus
tgcagtcactttatatcatgttaac

SEQ ID NO: 618322 - DNA, 25 bp, Rattus norvegicus
tgcagtcactttttatcatgttaac

SEQ ID NO: 618323 - DNA, 25 bp, Rattus norvegicus
tgcagtcagagcaccttctcccaag

SEQ ID NO: 618324 - DNA, 25 bp, Rattus norvegicus
tgcagtcagagctccttctcccaag

SEQ ID NO: 618325 - DNA, 25 bp, Rattus norvegicus
tgcagtcagcctcccctcatgaaga

SEQ ID NO: 618326 - DNA, 25 bp, Rattus norvegicus
tgcagtcagcctgccctcatgaaga

SEQ ID NO: 618327 - DNA, 25 bp, Rattus norvegicus
tgcagtcagtgtatgcagctccacc

SEQ ID NO: 618328 - DNA, 25 bp, Rattus norvegicus
tgcagtcagtgtttgcagctccacc

SEQ ID NO: 618329 - DNA, 25 bp, Rattus norvegicus
tgcagtcatctgactcatggagaac

SEQ ID NO: 618330 - DNA, 25 bp, Rattus norvegicus
tgcagtcatctgtctcatggagaac

SEQ ID NO: 618331 - DNA, 25 bp, Rattus norvegicus
tgcagtcatgttcccatcagatgta

SEQ ID NO: 618332 - DNA, 25 bp, Rattus norvegicus
tgcagtcatgttgccatcagatgta

SEQ ID NO: 618333 - DNA, 25 bp, Rattus norvegicus
tgcagtccagacagaatcccagtgt

SEQ ID NO: 618334 - DNA, 25 bp, Rattus norvegicus
tgcagtccagactgaatcccagtgt

SEQ ID NO: 618335 - DNA, 25 bp, Rattus norvegicus
tgcagtccagccctgaggaactgga

SEQ ID NO: 618336 - DNA, 25 bp, Rattus norvegicus
tgcagtccagccgtgaggaactgga

SEQ ID NO: 618337 - DNA, 25 bp, Rattus norvegicus
tgcagtcccgcaacctgcagatgtt

SEQ ID NO: 618338 - DNA, 25 bp, Rattus norvegicus
tgcagtcccgcatcctgcagatgtt

SEQ ID NO: 618339 - DNA, 25 bp, Rattus norvegicus
tgcagtccgaagacacagagagcct

SEQ ID NO: 618340 - DNA, 25 bp, Rattus norvegicus
tgcagtccgaagtcacagagagcct

SEQ ID NO: 618341 - DNA, 25 bp, Rattus norvegicus
tgcagtccttacacaggcaaattgt

SEQ ID NO: 618342 - DNA, 25 bp, Rattus norvegicus
tgcagtccttactcaggcaaattgt

SEQ ID NO: 618343 - DNA, 25 bp, Rattus norvegicus
tgcagtcgcacaagatgatcccaat

SEQ ID NO: 618344 - DNA, 25 bp, Rattus norvegicus
tgcagtcgcacatgatgatcccaat

SEQ ID NO: 618345 - DNA, 25 bp, Rattus norvegicus
tgcagtcggacgatgttatctggaa

SEQ ID NO: 618346 - DNA, 25 bp, Rattus norvegicus
tgcagtcggacgttgttatctggaa

SEQ ID NO: 618347 - DNA, 25 bp, Rattus norvegicus
tgcagtctacccctcttttaaactt

SEQ ID NO: 618348 - DNA, 25 bp, Rattus norvegicus
tgcagtctacccgtcttttaaactt

SEQ ID NO: 618349 - DNA, 25 bp, Rattus norvegicus
tgcagtctagatatccttacaatgt

SEQ ID NO: 618350 - DNA, 25 bp, Rattus norvegicus
tgcagtctagatttccttacaatgt

SEQ ID NO: 618351 - DNA, 25 bp, Rattus norvegicus
tgcagtctcaatcaaccagggtcaa

SEQ ID NO: 618352 - DNA, 25 bp, Rattus norvegicus
tgcagtctcaatgaaccagggtcaa

SEQ ID NO: 618353 - DNA, 25 bp, Rattus norvegicus
tgcagtctcactcatttcaaatgtg

SEQ ID NO: 618354 - DNA, 25 bp, Rattus norvegicus
tgcagtctcactgatttcaaatgtg

SEQ ID NO: 618355 - DNA, 25 bp, Rattus norvegicus
tgcagtctcagcatcaaagccggat

SEQ ID NO: 618356 - DNA, 25 bp, Rattus norvegicus
tgcagtctcagcttcaaagccggat

SEQ ID NO: 618357 - DNA, 25 bp, Rattus norvegicus
tgcagtctctctagtacccggatga

SEQ ID NO: 618358 - DNA, 25 bp, Rattus norvegicus
tgcagtctctcttgtacccggatga

SEQ ID NO: 618359 - DNA, 25 bp, Rattus norvegicus
tgcagtctgagacgctgagcaccca

SEQ ID NO: 618360 - DNA, 25 bp, Rattus norvegicus
tgcagtctgagaggctgagcaccca

SEQ ID NO: 618361 - DNA, 25 bp, Rattus norvegicus
tgcagtctgagcacatccagttcca

SEQ ID NO: 618362 - DNA, 25 bp, Rattus norvegicus
tgcagtctgagctcatccagttcca

SEQ ID NO: 618363 - DNA, 25 bp, Rattus norvegicus
tgcagtctgggcacaccttcaggag

SEQ ID NO: 618364 - DNA, 25 bp, Rattus norvegicus
tgcagtctgggccattaggactcaa

SEQ ID NO: 618365 - DNA, 25 bp, Rattus norvegicus
tgcagtctgggcgattaggactcaa

SEQ ID NO: 618366 - DNA, 25 bp, Rattus norvegicus
tgcagtctgggctcaccttcaggag

SEQ ID NO: 618367 - DNA, 25 bp, Rattus norvegicus
tgcagtctgtgaatgcttctgtaaa

SEQ ID NO: 618368 - DNA, 25 bp, Rattus norvegicus
tgcagtctgtgattgcttctgtaaa

SEQ ID NO: 618369 - DNA, 25 bp, Rattus norvegicus
tgcagtctttcccagtgaaaacggt

SEQ ID NO: 618370 - DNA, 25 bp, Rattus norvegicus
tgcagtctttccgagtgaaaacggt

SEQ ID NO: 618371 - DNA, 25 bp, Rattus norvegicus
tgcagtctttgtaagttccttgtct

SEQ ID NO: 618372 - DNA, 25 bp, Rattus norvegicus
tgcagtctttgttagttccttgtct

SEQ ID NO: 618373 - DNA, 25 bp, Rattus norvegicus
tgcagtgaaacccagtctacagtat

SEQ ID NO: 618374 - DNA, 25 bp, Rattus norvegicus
tgcagtgaaaccgagtctacagtat

SEQ ID NO: 618375 - DNA, 25 bp, Rattus norvegicus
tgcagtgacagtagcccatacagag

SEQ ID NO: 618376 - DNA, 25 bp, Rattus norvegicus
tgcagtgacagttgcccatacagag

SEQ ID NO: 618377 - DNA, 25 bp, Rattus norvegicus
tgcagtgactccaaggctgatgccc

SEQ ID NO: 618378 - DNA, 25 bp, Rattus norvegicus
tgcagtgactcctaggctgatgccc

SEQ ID NO: 618379 - DNA, 25 bp, Rattus norvegicus
tgcagtgatgccaggacacctaatt

SEQ ID NO: 618380 - DNA, 25 bp, Rattus norvegicus
tgcagtgatgcccagctccttctga

SEQ ID NO: 618381 - DNA, 25 bp, Rattus norvegicus
tgcagtgatgccgagctccttctga

SEQ ID NO: 618382 - DNA, 25 bp, Rattus norvegicus
tgcagtgatgcctggacacctaatt

SEQ ID NO: 618383 - DNA, 25 bp, Rattus norvegicus
tgcagtgcacacaaactcgggcatg

SEQ ID NO: 618384 - DNA, 25 bp, Rattus norvegicus
tgcagtgcacactaactcgggcatg

SEQ ID NO: 618385 - DNA, 25 bp, Rattus norvegicus
tgcagtgcatgcaggccacgctgat

SEQ ID NO: 618386 - DNA, 25 bp, Rattus norvegicus
tgcagtgcatgcctaccgatgcata

SEQ ID NO: 618387 - DNA, 25 bp, Rattus norvegicus
tgcagtgcatgcgtaccgatgcata

SEQ ID NO: 618388 - DNA, 25 bp, Rattus norvegicus
tgcagtgcatgctggccacgctgat

SEQ ID NO: 618389 - DNA, 25 bp, Rattus norvegicus
tgcagtgcattcctgactaattcgt

SEQ ID NO: 618390 - DNA, 25 bp, Rattus norvegicus
tgcagtgcattcgtgactaattcgt

SEQ ID NO: 618391 - DNA, 25 bp, Rattus norvegicus
tgcagtgcccagacagaaacttctc

SEQ ID NO: 618392 - DNA, 25 bp, Rattus norvegicus
tgcagtgcccagtcagaaacttctc

SEQ ID NO: 618393 - DNA, 25 bp, Rattus norvegicus
tgcagtgcccctaggacagatgttt

SEQ ID NO: 618394 - DNA, 25 bp, Rattus norvegicus
tgcagtgccccttggacagatgttt

SEQ ID NO: 618395 - DNA, 25 bp, Rattus norvegicus
tgcagtgcctataacatccaggtaa

SEQ ID NO: 618396 - DNA, 25 bp, Rattus norvegicus
tgcagtgcctattacatccaggtaa

SEQ ID NO: 618397 - DNA, 25 bp, Rattus norvegicus
tgcagtgcctgacaagcatgggttt

SEQ ID NO: 618398 - DNA, 25 bp, Rattus norvegicus
tgcagtgcctgagaagcatgggttt

SEQ ID NO: 618399 - DNA, 25 bp, Rattus norvegicus
tgcagtgcgcacatgtcaatttcct

SEQ ID NO: 618400 - DNA, 25 bp, Rattus norvegicus
tgcagtgcgcacttgtcaatttcct

SEQ ID NO: 618401 - DNA, 25 bp, Rattus norvegicus
tgcagtgcgcttagtgggtttccca

SEQ ID NO: 618402 - DNA, 25 bp, Rattus norvegicus
tgcagtgcgctttgtgggtttccca

SEQ ID NO: 618403 - DNA, 25 bp, Rattus norvegicus
tgcagtgctagccttcggaattaca

SEQ ID NO: 618404 - DNA, 25 bp, Rattus norvegicus
tgcagtgctagcgttcggaattaca

SEQ ID NO: 618405 - DNA, 25 bp, Rattus norvegicus
tgcagtgctgaaagagggacccctc

SEQ ID NO: 618406 - DNA, 25 bp, Rattus norvegicus
tgcagtgctgaatgagggacccctc

SEQ ID NO: 618407 - DNA, 25 bp, Rattus norvegicus
tgcagtgctgagattcatcctctcc

SEQ ID NO: 618408 - DNA, 25 bp, Rattus norvegicus
tgcagtgctgagtttcatcctctcc

SEQ ID NO: 618409 - DNA, 25 bp, Rattus norvegicus
tgcagtgctgctacacaaagagctt

SEQ ID NO: 618410 - DNA, 25 bp, Rattus norvegicus
tgcagtgctgcttcacaaagagctt

SEQ ID NO: 618411 - DNA, 25 bp, Rattus norvegicus
tgcagtgctgggacaccagagcaat

SEQ ID NO: 618412 - DNA, 25 bp, Rattus norvegicus
tgcagtgctgggtcaccagagcaat

SEQ ID NO: 618413 - DNA, 25 bp, Rattus norvegicus
tgcagtgctgttcctgggagatact

SEQ ID NO: 618414 - DNA, 25 bp, Rattus norvegicus
tgcagtgctgttgctgggagatact

SEQ ID NO: 618415 - DNA, 25 bp, Rattus norvegicus
tgcagtgcttttctataggccatct

SEQ ID NO: 618416 - DNA, 25 bp, Rattus norvegicus
tgcagtgcttttgtataggccatct

SEQ ID NO: 618417 - DNA, 25 bp, Rattus norvegicus
tgcagtggactgctttctggaccgc

SEQ ID NO: 618418 - DNA, 25 bp, Rattus norvegicus
tgcagtggactggtttctggaccgc

SEQ ID NO: 618419 - DNA, 25 bp, Rattus norvegicus
tgcagtggcagaacacacacctgtg

SEQ ID NO: 618420 - DNA, 25 bp, Rattus norvegicus
tgcagtggcagatcacacacctgtg

SEQ ID NO: 618421 - DNA, 25 bp, Rattus norvegicus
tgcagtggtcacagcttctcaggga

SEQ ID NO: 618422 - DNA, 25 bp, Rattus norvegicus
tgcagtggtcactgcttctcaggga

SEQ ID NO: 618423 - DNA, 25 bp, Rattus norvegicus
tgcagtgtatagacccagttgtaaa

SEQ ID NO: 618424 - DNA, 25 bp, Rattus norvegicus
tgcagtgtatagtcccagttgtaaa

SEQ ID NO: 618425 - DNA, 25 bp, Rattus norvegicus
tgcagtgtatgtcgcgcagctctac

SEQ ID NO: 618426 - DNA, 25 bp, Rattus norvegicus
tgcagtgtatgtggcgcagctctac

SEQ ID NO: 618427 - DNA, 25 bp, Rattus norvegicus
tgcagtgtcagaagtccagccctgt

SEQ ID NO: 618428 - DNA, 25 bp, Rattus norvegicus
tgcagtgtcagatgtccagccctgt

SEQ ID NO: 618429 - DNA, 25 bp, Rattus norvegicus
tgcagtgtccttcctaagatcaggt

SEQ ID NO: 618430 - DNA, 25 bp, Rattus norvegicus
tgcagtgtccttgctaagatcaggt

SEQ ID NO: 618431 - DNA, 25 bp, Rattus norvegicus
tgcagtgtctgcacagggctgtacc

SEQ ID NO: 618432 - DNA, 25 bp, Rattus norvegicus
tgcagtgtctgctcagggctgtacc

SEQ ID NO: 618433 - DNA, 25 bp, Rattus norvegicus
tgcagtgtctggcactgggccataa

SEQ ID NO: 618434 - DNA, 25 bp, Rattus norvegicus
tgcagtgtctgggactgggccataa

SEQ ID NO: 618435 - DNA, 25 bp, Rattus norvegicus
tgcagtgttcacatgagcctacaga

SEQ ID NO: 618436 - DNA, 25 bp, Rattus norvegicus
tgcagtgttcacttgagcctacaga

SEQ ID NO: 618437 - DNA, 25 bp, Rattus norvegicus
tgcagtgttgctcacgtggtgccta

SEQ ID NO: 618438 - DNA, 25 bp, Rattus norvegicus
tgcagtgttgctgacgtggtgccta

SEQ ID NO: 618439 - DNA, 25 bp, Rattus norvegicus
tgcagtgttgtgaaagagccccgct

SEQ ID NO: 618440 - DNA, 25 bp, Rattus norvegicus
tgcagtgttgtgtaagagccccgct

SEQ ID NO: 618441 - DNA, 25 bp, Rattus norvegicus
tgcagtgtttgaatcctcaacattt

SEQ ID NO: 618442 - DNA, 25 bp, Rattus norvegicus
tgcagtgtttgattcctcaacattt

SEQ ID NO: 618443 - DNA, 25 bp, Rattus norvegicus
tgcagttacctccttctgaaactct

SEQ ID NO: 618444 - DNA, 25 bp, Rattus norvegicus
tgcagttacctcgttctgaaactct

SEQ ID NO: 618445 - DNA, 25 bp, Rattus norvegicus
tgcagttactctctagaaatgggta

SEQ ID NO: 618446 - DNA, 25 bp, Rattus norvegicus
tgcagttactctgtagaaatgggta

SEQ ID NO: 618447 - DNA, 25 bp, Rattus norvegicus
tgcagttcaagcagcagcatcacta

SEQ ID NO: 618448 - DNA, 25 bp, Rattus norvegicus
tgcagttcaagctgcagcatcacta

SEQ ID NO: 618449 - DNA, 25 bp, Rattus norvegicus
tgcagttcactcatctcccaagtgc

SEQ ID NO: 618450 - DNA, 25 bp, Rattus norvegicus
tgcagttcactcttctcccaagtgc

SEQ ID NO: 618451 - DNA, 25 bp, Rattus norvegicus
tgcagttcagacagttaccaatatg

SEQ ID NO: 618452 - DNA, 25 bp, Rattus norvegicus
tgcagttcagactgttaccaatatg

SEQ ID NO: 618453 - DNA, 25 bp, Rattus norvegicus
tgcagttccagaagacgcggtgccc

SEQ ID NO: 618454 - DNA, 25 bp, Rattus norvegicus
tgcagttccagatgacgcggtgccc

SEQ ID NO: 618455 - DNA, 25 bp, Rattus norvegicus
tgcagttcctcaaggagcagcgcgt

SEQ ID NO: 618456 - DNA, 25 bp, Rattus norvegicus
tgcagttcctcatggagcagcgcgt

SEQ ID NO: 618457 - DNA, 25 bp, Rattus norvegicus
tgcagttcctggactgtgtacacca

SEQ ID NO: 618458 - DNA, 25 bp, Rattus norvegicus
tgcagttcctggtctgtgtacacca

SEQ ID NO: 618459 - DNA, 25 bp, Rattus norvegicus
tgcagttcctgtccgtctctgtcat

SEQ ID NO: 618460 - DNA, 25 bp, Rattus norvegicus
tgcagttcctgtgcgtctctgtcat

SEQ ID NO: 618461 - DNA, 25 bp, Rattus norvegicus
tgcagttcgagtctcaggtgctcac

SEQ ID NO: 618462 - DNA, 25 bp, Rattus norvegicus
tgcagttcgagtgtcaggtgctcac

SEQ ID NO: 618463 - DNA, 25 bp, Rattus norvegicus
tgcagttctaagaaaccccactctt

SEQ ID NO: 618464 - DNA, 25 bp, Rattus norvegicus
tgcagttctaagtaaccccactctt

SEQ ID NO: 618465 - DNA, 25 bp, Rattus norvegicus
tgcagttctaccatcccgagaagtg

SEQ ID NO: 618466 - DNA, 25 bp, Rattus norvegicus
tgcagttctaccttcccgagaagtg

SEQ ID NO: 618467 - DNA, 25 bp, Rattus norvegicus
tgcagttctctaatttgttttcggg

SEQ ID NO: 618468 - DNA, 25 bp, Rattus norvegicus
tgcagttctctattttgttttcggg

SEQ ID NO: 618469 - DNA, 25 bp, Rattus norvegicus
tgcagttgaaatctcgactcccact

SEQ ID NO: 618470 - DNA, 25 bp, Rattus norvegicus
tgcagttgaaatgtcgactcccact

SEQ ID NO: 618471 - DNA, 25 bp, Rattus norvegicus
tgcagttgaatccacacagtccaca

SEQ ID NO: 618472 - DNA, 25 bp, Rattus norvegicus
tgcagttgaatcgacacagtccaca

SEQ ID NO: 618473 - DNA, 25 bp, Rattus norvegicus
tgcagttgccgaagagtgggttctt

SEQ ID NO: 618474 - DNA, 25 bp, Rattus norvegicus
tgcagttgccgatgagtgggttctt

SEQ ID NO: 618475 - DNA, 25 bp, Rattus norvegicus
tgcagttgccttacatgcaggaact

SEQ ID NO: 618476 - DNA, 25 bp, Rattus norvegicus
tgcagttgcctttcatgcaggaact

SEQ ID NO: 618477 - DNA, 25 bp, Rattus norvegicus
tgcagttgctctacagtaccatgaa

SEQ ID NO: 618478 - DNA, 25 bp, Rattus norvegicus
tgcagttgctcttcagtaccatgaa

SEQ ID NO: 618479 - DNA, 25 bp, Rattus norvegicus
tgcagttggcctcagagaccgcaaa

SEQ ID NO: 618480 - DNA, 25 bp, Rattus norvegicus
tgcagttggcctgagagaccgcaaa

SEQ ID NO: 618481 - DNA, 25 bp, Rattus norvegicus
tgcagttggtgaagtgcctgcctgc

SEQ ID NO: 618482 - DNA, 25 bp, Rattus norvegicus
tgcagttggtgatgtgcctgcctgc

SEQ ID NO: 618483 - DNA, 25 bp, Rattus norvegicus
tgcagttgtccaatccacagtcaga

SEQ ID NO: 618484 - DNA, 25 bp, Rattus norvegicus
tgcagttgtccattccacagtcaga

SEQ ID NO: 618485 - DNA, 25 bp, Rattus norvegicus
tgcagtttaccgatccaaactctct

SEQ ID NO: 618486 - DNA, 25 bp, Rattus norvegicus
tgcagtttaccgttccaaactctct

SEQ ID NO: 618487 - DNA, 25 bp, Rattus norvegicus
tgcagtttagacaagcttcagaatc

SEQ ID NO: 618488 - DNA, 25 bp, Rattus norvegicus
tgcagtttagactagcttcagaatc

SEQ ID NO: 618489 - DNA, 25 bp, Rattus norvegicus
tgcagtttatctactttcttagtgg

SEQ ID NO: 618490 - DNA, 25 bp, Rattus norvegicus
tgcagtttatcttctttcttagtgg

SEQ ID NO: 618491 - DNA, 25 bp, Rattus norvegicus
tgcagtttatgcagctggctccctt

SEQ ID NO: 618492 - DNA, 25 bp, Rattus norvegicus
tgcagtttatgctgctggctccctt

SEQ ID NO: 618493 - DNA, 25 bp, Rattus norvegicus
tgcagtttcagtcatgaggccctcc

SEQ ID NO: 618494 - DNA, 25 bp, Rattus norvegicus
tgcagtttcagtgatgaggccctcc

SEQ ID NO: 618495 - DNA, 25 bp, Rattus norvegicus
tgcagtttccccaaagtctcaagtt

SEQ ID NO: 618496 - DNA, 25 bp, Rattus norvegicus
tgcagtttcccctaagtctcaagtt

SEQ ID NO: 618497 - DNA, 25 bp, Rattus norvegicus
tgcagtttccttcattgtcccgata

SEQ ID NO: 618498 - DNA, 25 bp, Rattus norvegicus
tgcagtttccttgattgtcccgata

SEQ ID NO: 618499 - DNA, 25 bp, Rattus norvegicus
tgcagtttcgccaagcttcagatac

SEQ ID NO: 618500 - DNA, 25 bp, Rattus norvegicus
tgcagtttcgccatcactcacatgc

SEQ ID NO: 618501 - DNA, 25 bp, Rattus norvegicus
tgcagtttcgcctagcttcagatac

SEQ ID NO: 618502 - DNA, 25 bp, Rattus norvegicus
tgcagtttcgccttcactcacatgc

SEQ ID NO: 618503 - DNA, 25 bp, Rattus norvegicus
tgcagtttctctccggccgccaaag

SEQ ID NO: 618504 - DNA, 25 bp, Rattus norvegicus
tgcagtttctctgcggccgccaaag

SEQ ID NO: 618505 - DNA, 25 bp, Rattus norvegicus
tgcagtttctgcagtattactacca

SEQ ID NO: 618506 - DNA, 25 bp, Rattus norvegicus
tgcagtttctgctgtattactacca

SEQ ID NO: 618507 - DNA, 25 bp, Rattus norvegicus
tgcagtttgagtaccacctcccagt

SEQ ID NO: 618508 - DNA, 25 bp, Rattus norvegicus
tgcagtttgagttccacctcccagt

SEQ ID NO: 618509 - DNA, 25 bp, Rattus norvegicus
tgcagtttgcccatatcctgtaggg

SEQ ID NO: 618510 - DNA, 25 bp, Rattus norvegicus
tgcagtttgcccttatcctgtaggg

SEQ ID NO: 618511 - DNA, 25 bp, Rattus norvegicus
tgcagtttgctacaacgctgtgaaa

SEQ ID NO: 618512 - DNA, 25 bp, Rattus norvegicus
tgcagtttgctagaacgctgtgaaa

SEQ ID NO: 618513 - DNA, 25 bp, Rattus norvegicus
tgcagtttgtttcccctctaaagta

SEQ ID NO: 618514 - DNA, 25 bp, Rattus norvegicus
tgcagtttgtttgccctctaaagta

SEQ ID NO: 618515 - DNA, 25 bp, Rattus norvegicus
tgcagttttgcaaggtatccattat

SEQ ID NO: 618516 - DNA, 25 bp, Rattus norvegicus
tgcagttttgcatggtatccattat

SEQ ID NO: 618517 - DNA, 25 bp, Rattus norvegicus
tgcagttttgtactccacttggttt

SEQ ID NO: 618518 - DNA, 25 bp, Rattus norvegicus
tgcagttttgtagtccacttggttt

SEQ ID NO: 618519 - DNA, 25 bp, Rattus norvegicus
tgcataaacaaaacctcagagggcc

SEQ ID NO: 618520 - DNA, 25 bp, Rattus norvegicus
tgcataaacaaatcctcagagggcc

SEQ ID NO: 618521 - DNA, 25 bp, Rattus norvegicus
tgcataaaggcccatacacactctc

SEQ ID NO: 618522 - DNA, 25 bp, Rattus norvegicus
tgcataaaggccgatacacactctc

SEQ ID NO: 618523 - DNA, 25 bp, Rattus norvegicus
tgcataaataacaccacacacctac

SEQ ID NO: 618524 - DNA, 25 bp, Rattus norvegicus
tgcataaataactccacacacctac

SEQ ID NO: 618525 - DNA, 25 bp, Rattus norvegicus
tgcataaccatcacgggcaccatgg

SEQ ID NO: 618526 - DNA, 25 bp, Rattus norvegicus
tgcataaccatctcgggcaccatgg

SEQ ID NO: 618527 - DNA, 25 bp, Rattus norvegicus
tgcataacgcgcatctttgaggagt

SEQ ID NO: 618528 - DNA, 25 bp, Rattus norvegicus
tgcataacgcgcttctttgaggagt

SEQ ID NO: 618529 - DNA, 25 bp, Rattus norvegicus
tgcataagctccagggttcccaaaa

SEQ ID NO: 618530 - DNA, 25 bp, Rattus norvegicus
tgcataagctcctgggttcccaaaa

SEQ ID NO: 618531 - DNA, 25 bp, Rattus norvegicus
tgcataagcttgagatcagatcggt

SEQ ID NO: 618532 - DNA, 25 bp, Rattus norvegicus
tgcataagcttgtgatcagatcggt

SEQ ID NO: 618533 - DNA, 25 bp, Rattus norvegicus
tgcataaggcccatggttcaatccc

SEQ ID NO: 618534 - DNA, 25 bp, Rattus norvegicus
tgcataaggcccttggttcaatccc

SEQ ID NO: 618535 - DNA, 25 bp, Rattus norvegicus
tgcataatccgacgttcaagcccca

SEQ ID NO: 618536 - DNA, 25 bp, Rattus norvegicus
tgcataatccgaggttcaagcccca

SEQ ID NO: 618537 - DNA, 25 bp, Rattus norvegicus
tgcataatgcttacttcctcagggt

SEQ ID NO: 618538 - DNA, 25 bp, Rattus norvegicus
tgcataatgctttcttcctcagggt

SEQ ID NO: 618539 - DNA, 25 bp, Rattus norvegicus
tgcataattccaactcctcgagatg

SEQ ID NO: 618540 - DNA, 25 bp, Rattus norvegicus
tgcataattccatctcctcgagatg

SEQ ID NO: 618541 - DNA, 25 bp, Rattus norvegicus
tgcataattttcactggctgtcatt

SEQ ID NO: 618542 - DNA, 25 bp, Rattus norvegicus
tgcataattttctctggctgtcatt

SEQ ID NO: 618543 - DNA, 25 bp, Rattus norvegicus
tgcatacaacctactaatggagttt

SEQ ID NO: 618544 - DNA, 25 bp, Rattus norvegicus
tgcatacaaccttctaatggagttt

SEQ ID NO: 618545 - DNA, 25 bp, Rattus norvegicus
tgcatacacatgagcccctgttata

SEQ ID NO: 618546 - DNA, 25 bp, Rattus norvegicus
tgcatacacatgtgcccctgttata

SEQ ID NO: 618547 - DNA, 25 bp, Rattus norvegicus
tgcatacacgcaagcccgagtgtag

SEQ ID NO: 618548 - DNA, 25 bp, Rattus norvegicus
tgcatacacgcatgcccgagtgtag

SEQ ID NO: 618549 - DNA, 25 bp, Rattus norvegicus
tgcatacactacattatgtgctgtg

SEQ ID NO: 618550 - DNA, 25 bp, Rattus norvegicus
tgcatacactactttatgtgctgtg

SEQ ID NO: 618551 - DNA, 25 bp, Rattus norvegicus
tgcatacattcacattcacgctcat

SEQ ID NO: 618552 - DNA, 25 bp, Rattus norvegicus
tgcatacattcagattcacgctcat

SEQ ID NO: 618553 - DNA, 25 bp, Rattus norvegicus
tgcataccacacacggcatggctat

SEQ ID NO: 618554 - DNA, 25 bp, Rattus norvegicus
tgcataccacactcggcatggctat

SEQ ID NO: 618555 - DNA, 25 bp, Rattus norvegicus
tgcataccccagacattggaggcca

SEQ ID NO: 618556 - DNA, 25 bp, Rattus norvegicus
tgcataccccagtcattggaggcca

SEQ ID NO: 618557 - DNA, 25 bp, Rattus norvegicus
tgcataccctacacattgctagatt

SEQ ID NO: 618558 - DNA, 25 bp, Rattus norvegicus
tgcataccctactcattgctagatt

SEQ ID NO: 618559 - DNA, 25 bp, Rattus norvegicus
tgcatacctgtaactccatggaaat

SEQ ID NO: 618560 - DNA, 25 bp, Rattus norvegicus
tgcatacctgtatctccatggaaat

SEQ ID NO: 618561 - DNA, 25 bp, Rattus norvegicus
tgcatacgccaaaggagacccacag

SEQ ID NO: 618562 - DNA, 25 bp, Rattus norvegicus
tgcatacgccaaagtctgaaaccac

SEQ ID NO: 618563 - DNA, 25 bp, Rattus norvegicus
tgcatacgccaatggagacccacag

SEQ ID NO: 618564 - DNA, 25 bp, Rattus norvegicus
tgcatacgccaatgtctgaaaccac

SEQ ID NO: 618565 - DNA, 25 bp, Rattus norvegicus
tgcatacgtgccaagctccgacctg

SEQ ID NO: 618566 - DNA, 25 bp, Rattus norvegicus
tgcatacgtgcctagctccgacctg

SEQ ID NO: 618567 - DNA, 25 bp, Rattus norvegicus
tgcatacttggcatatggcaagggt

SEQ ID NO: 618568 - DNA, 25 bp, Rattus norvegicus
tgcatacttggcttatggcaagggt

SEQ ID NO: 618569 - DNA, 25 bp, Rattus norvegicus
tgcatagaccggcacgagctgctca

SEQ ID NO: 618570 - DNA, 25 bp, Rattus norvegicus
tgcatagaccgggacgagctgctca

SEQ ID NO: 618571 - DNA, 25 bp, Rattus norvegicus
tgcatagcaagtacgcctgtgattt

SEQ ID NO: 618572 - DNA, 25 bp, Rattus norvegicus
tgcatagcaagttcgcctgtgattt

SEQ ID NO: 618573 - DNA, 25 bp, Rattus norvegicus
tgcatagcacaacggacattttagt

SEQ ID NO: 618574 - DNA, 25 bp, Rattus norvegicus
tgcatagcacaagggacattttagt

SEQ ID NO: 618575 - DNA, 25 bp, Rattus norvegicus
tgcatagcactgcatgaaccccgat

SEQ ID NO: 618576 - DNA, 25 bp, Rattus norvegicus
tgcatagcactggatgaaccccgat

SEQ ID NO: 618577 - DNA, 25 bp, Rattus norvegicus
tgcatagccctccaagtacggaata

SEQ ID NO: 618578 - DNA, 25 bp, Rattus norvegicus
tgcatagccctcgaagtacggaata

SEQ ID NO: 618579 - DNA, 25 bp, Rattus norvegicus
tgcatagctgctaccctactagaat

SEQ ID NO: 618580 - DNA, 25 bp, Rattus norvegicus
tgcatagctgcttccctactagaat

SEQ ID NO: 618581 - DNA, 25 bp, Rattus norvegicus
tgcataggccagcaggaatttcctt

SEQ ID NO: 618582 - DNA, 25 bp, Rattus norvegicus
tgcataggccaggaggaatttcctt

SEQ ID NO: 618583 - DNA, 25 bp, Rattus norvegicus
tgcatagggactagaaagactgacc

SEQ ID NO: 618584 - DNA, 25 bp, Rattus norvegicus
tgcatagggacttgaaagactgacc

SEQ ID NO: 618585 - DNA, 25 bp, Rattus norvegicus
tgcatagggcctaaaacaggttttc

SEQ ID NO: 618586 - DNA, 25 bp, Rattus norvegicus
tgcatagggccttaaacaggttttc

SEQ ID NO: 618587 - DNA, 25 bp, Rattus norvegicus
tgcataggttccagaggctctgcac

SEQ ID NO: 618588 - DNA, 25 bp, Rattus norvegicus
tgcataggttcctgaggctctgcac

SEQ ID NO: 618589 - DNA, 25 bp, Rattus norvegicus
tgcatagtaagtagtacctcatggg

SEQ ID NO: 618590 - DNA, 25 bp, Rattus norvegicus
tgcatagtaagttgtacctcatggg

SEQ ID NO: 618591 - DNA, 25 bp, Rattus norvegicus
tgcatagtccccactaaggcaggca

SEQ ID NO: 618592 - DNA, 25 bp, Rattus norvegicus
tgcatagtccccatacgttttttat

SEQ ID NO: 618593 - DNA, 25 bp, Rattus norvegicus
tgcatagtcccctctaaggcaggca

SEQ ID NO: 618594 - DNA, 25 bp, Rattus norvegicus
tgcatagtccccttacgttttttat

SEQ ID NO: 618595 - DNA, 25 bp, Rattus norvegicus
tgcatagtctctctacctgactatt

SEQ ID NO: 618596 - DNA, 25 bp, Rattus norvegicus
tgcatagtctctgtacctgactatt

SEQ ID NO: 618597 - DNA, 25 bp, Rattus norvegicus
tgcatagtctggcatggcctgagtc

SEQ ID NO: 618598 - DNA, 25 bp, Rattus norvegicus
tgcatagtctgggatggcctgagtc

SEQ ID NO: 618599 - DNA, 25 bp, Rattus norvegicus
tgcatagtgattactgggccagctt

SEQ ID NO: 618600 - DNA, 25 bp, Rattus norvegicus
tgcatagtgatttctgggccagctt

SEQ ID NO: 618601 - DNA, 25 bp, Rattus norvegicus
tgcatagtggatcctcgggtccctt

SEQ ID NO: 618602 - DNA, 25 bp, Rattus norvegicus
tgcatagtggatgctcgggtccctt

SEQ ID NO: 618603 - DNA, 25 bp, Rattus norvegicus
tgcatagtggtccgtctgacacatc

SEQ ID NO: 618604 - DNA, 25 bp, Rattus norvegicus
tgcatagtggtcggtctgacacatc

SEQ ID NO: 618605 - DNA, 25 bp, Rattus norvegicus
tgcatagtgttcatcgtgtctgacc

SEQ ID NO: 618606 - DNA, 25 bp, Rattus norvegicus
tgcatagtgttcttcgtgtctgacc

SEQ ID NO: 618607 - DNA, 25 bp, Rattus norvegicus
tgcatagtttgcctggagaatccac

SEQ ID NO: 618608 - DNA, 25 bp, Rattus norvegicus
tgcatagtttgcgtggagaatccac

SEQ ID NO: 618609 - DNA, 25 bp, Rattus norvegicus
tgcatataaggacaggccaggactt

SEQ ID NO: 618610 - DNA, 25 bp, Rattus norvegicus
tgcatataaggagaggccaggactt

SEQ ID NO: 618611 - DNA, 25 bp, Rattus norvegicus
tgcatataggccacactcagacatc

SEQ ID NO: 618612 - DNA, 25 bp, Rattus norvegicus
tgcatataggcctcactcagacatc

SEQ ID NO: 618613 - DNA, 25 bp, Rattus norvegicus
tgcatatattgaccctttggagaca

SEQ ID NO: 618614 - DNA, 25 bp, Rattus norvegicus
tgcatatattgagcctttggagaca

SEQ ID NO: 618615 - DNA, 25 bp, Rattus norvegicus
tgcatatcaaaacaaccccgactat

SEQ ID NO: 618616 - DNA, 25 bp, Rattus norvegicus
tgcatatcaaaagaaccccgactat

SEQ ID NO: 618617 - DNA, 25 bp, Rattus norvegicus
tgcatatccatgagtttccatccgg

SEQ ID NO: 618618 - DNA, 25 bp, Rattus norvegicus
tgcatatccatgtgtttccatccgg

SEQ ID NO: 618619 - DNA, 25 bp, Rattus norvegicus
tgcatatctcacacaacactacgtt

SEQ ID NO: 618620 - DNA, 25 bp, Rattus norvegicus
tgcatatctcactcaacactacgtt

SEQ ID NO: 618621 - DNA, 25 bp, Rattus norvegicus
tgcatatcttccagctcttggagct

SEQ ID NO: 618622 - DNA, 25 bp, Rattus norvegicus
tgcatatcttcctgctcttggagct

SEQ ID NO: 618623 - DNA, 25 bp, Rattus norvegicus
tgcatatgcctaattttgagctttg

SEQ ID NO: 618624 - DNA, 25 bp, Rattus norvegicus
tgcatatgcctatttttgagctttg

SEQ ID NO: 618625 - DNA, 25 bp, Rattus norvegicus
tgcatatgcttaaacaatcgcttag

SEQ ID NO: 618626 - DNA, 25 bp, Rattus norvegicus
tgcatatgcttatacaatcgcttag

SEQ ID NO: 618627 - DNA, 25 bp, Rattus norvegicus
tgcatatgcttgaatttcctcttcc

SEQ ID NO: 618628 - DNA, 25 bp, Rattus norvegicus
tgcatatgcttgtatttcctcttcc

SEQ ID NO: 618629 - DNA, 25 bp, Rattus norvegicus
tgcatatgtgtaatccaagcccttg

SEQ ID NO: 618630 - DNA, 25 bp, Rattus norvegicus
tgcatatgtgtattccaagcccttg

SEQ ID NO: 618631 - DNA, 25 bp, Rattus norvegicus
tgcatatgtgttccccagtcctggg

SEQ ID NO: 618632 - DNA, 25 bp, Rattus norvegicus
tgcatatgtgttgcccagtcctggg

SEQ ID NO: 618633 - DNA, 25 bp, Rattus norvegicus
tgcatattcttcagcgagttccacc

SEQ ID NO: 618634 - DNA, 25 bp, Rattus norvegicus
tgcatattcttcattctcttcctga

SEQ ID NO: 618635 - DNA, 25 bp, Rattus norvegicus
tgcatattcttctgcgagttccacc

SEQ ID NO: 618636 - DNA, 25 bp, Rattus norvegicus
tgcatattcttctttctcttcctga

SEQ ID NO: 618637 - DNA, 25 bp, Rattus norvegicus
tgcatatttcatcgctctcctgctc

SEQ ID NO: 618638 - DNA, 25 bp, Rattus norvegicus
tgcatatttcatggctctcctgctc

SEQ ID NO: 618639 - DNA, 25 bp, Rattus norvegicus
tgcatatttgtaaagcctcccgaaa

SEQ ID NO: 618640 - DNA, 25 bp, Rattus norvegicus
tgcatatttgtatagcctcccgaaa

SEQ ID NO: 618641 - DNA, 25 bp, Rattus norvegicus
tgcatcaaaaagatccaggaccacc

SEQ ID NO: 618642 - DNA, 25 bp, Rattus norvegicus
tgcatcaaaaagttccaggaccacc

SEQ ID NO: 618643 - DNA, 25 bp, Rattus norvegicus
tgcatcaaacctccagacacagact

SEQ ID NO: 618644 - DNA, 25 bp, Rattus norvegicus
tgcatcaaacctgcagacacagact

SEQ ID NO: 618645 - DNA, 25 bp, Rattus norvegicus
tgcatcaactatcaggccttcctga

SEQ ID NO: 618646 - DNA, 25 bp, Rattus norvegicus
tgcatcaactatgaggccttcctga

SEQ ID NO: 618647 - DNA, 25 bp, Rattus norvegicus
tgcatcaactgtagctgcacgacgg

SEQ ID NO: 618648 - DNA, 25 bp, Rattus norvegicus
tgcatcaactgttgctgcacgacgg

SEQ ID NO: 618649 - DNA, 25 bp, Rattus norvegicus
tgcatcaagtacataatgaccaagt

SEQ ID NO: 618650 - DNA, 25 bp, Rattus norvegicus
tgcatcaagtacttaatgaccaagt

SEQ ID NO: 618651 - DNA, 25 bp, Rattus norvegicus
tgcatcaatccaaggcacctgagag

SEQ ID NO: 618652 - DNA, 25 bp, Rattus norvegicus
tgcatcaatccatggcacctgagag

SEQ ID NO: 618653 - DNA, 25 bp, Rattus norvegicus
tgcatcacactcactgtttctaatg

SEQ ID NO: 618654 - DNA, 25 bp, Rattus norvegicus
tgcatcacactctctgtttctaatg

SEQ ID NO: 618655 - DNA, 25 bp, Rattus norvegicus
tgcatcacagtaccctcaggttcgt

SEQ ID NO: 618656 - DNA, 25 bp, Rattus norvegicus
tgcatcacagtagcctcaggttcgt

SEQ ID NO: 618657 - DNA, 25 bp, Rattus norvegicus
tgcatcacctcaaattccacctggt

SEQ ID NO: 618658 - DNA, 25 bp, Rattus norvegicus
tgcatcacctcatattccacctggt

SEQ ID NO: 618659 - DNA, 25 bp, Rattus norvegicus
tgcatcacttaaactcaacttgtat

SEQ ID NO: 618660 - DNA, 25 bp, Rattus norvegicus
tgcatcacttaatctcaacttgtat

SEQ ID NO: 618661 - DNA, 25 bp, Rattus norvegicus
tgcatcacttccatgtggagaatac

SEQ ID NO: 618662 - DNA, 25 bp, Rattus norvegicus
tgcatcacttccttgtggagaatac

SEQ ID NO: 618663 - DNA, 25 bp, Rattus norvegicus
tgcatcagagccatgggcggaccaa

SEQ ID NO: 618664 - DNA, 25 bp, Rattus norvegicus
tgcatcagagccttgggcggaccaa

SEQ ID NO: 618665 - DNA, 25 bp, Rattus norvegicus
tgcatcagcgtgaggagcagctcac

SEQ ID NO: 618666 - DNA, 25 bp, Rattus norvegicus
tgcatcagcgtgtggagcagctcac

SEQ ID NO: 618667 - DNA, 25 bp, Rattus norvegicus
tgcatcaggtacaggcatctgccaa

SEQ ID NO: 618668 - DNA, 25 bp, Rattus norvegicus
tgcatcaggtactggcatctgccaa

SEQ ID NO: 618669 - DNA, 25 bp, Rattus norvegicus
tgcatcagtattatctcgaccagag

SEQ ID NO: 618670 - DNA, 25 bp, Rattus norvegicus
tgcatcagtattttctcgaccagag

SEQ ID NO: 618671 - DNA, 25 bp, Rattus norvegicus
tgcatcagtcttccctagaagcagg

SEQ ID NO: 618672 - DNA, 25 bp, Rattus norvegicus
tgcatcagtcttgcctagaagcagg

SEQ ID NO: 618673 - DNA, 25 bp, Rattus norvegicus
tgcatcatcataactttccccagaa

SEQ ID NO: 618674 - DNA, 25 bp, Rattus norvegicus
tgcatcatcatatctttccccagaa

SEQ ID NO: 618675 - DNA, 25 bp, Rattus norvegicus
tgcatcatgtccactggcagtgcca

SEQ ID NO: 618676 - DNA, 25 bp, Rattus norvegicus
tgcatcatgtccctgggagtgccag

SEQ ID NO: 618677 - DNA, 25 bp, Rattus norvegicus
tgcatcatgtccgtgggagtgccag

SEQ ID NO: 618678 - DNA, 25 bp, Rattus norvegicus
tgcatcatgtcctctggcagtgcca

SEQ ID NO: 618679 - DNA, 25 bp, Rattus norvegicus
tgcatcattcagatgtctggaaaca

SEQ ID NO: 618680 - DNA, 25 bp, Rattus norvegicus
tgcatcattcagttgtctggaaaca

SEQ ID NO: 618681 - DNA, 25 bp, Rattus norvegicus
tgcatcattttaaaggcctcggctg

SEQ ID NO: 618682 - DNA, 25 bp, Rattus norvegicus
tgcatcattttataggcctcggctg

SEQ ID NO: 618683 - DNA, 25 bp, Rattus norvegicus
tgcatccaacatccaagtgtacctg

SEQ ID NO: 618684 - DNA, 25 bp, Rattus norvegicus
tgcatccaacatgcaagtgtacctg

SEQ ID NO: 618685 - DNA, 25 bp, Rattus norvegicus
tgcatccaataacgagcttgtccgc

SEQ ID NO: 618686 - DNA, 25 bp, Rattus norvegicus
tgcatccaataaggagcttgtccgc

SEQ ID NO: 618687 - DNA, 25 bp, Rattus norvegicus
tgcatccacgtccttcaaaacatgt

SEQ ID NO: 618688 - DNA, 25 bp, Rattus norvegicus
tgcatccacgtcgttcaaaacatgt

SEQ ID NO: 618689 - DNA, 25 bp, Rattus norvegicus
tgcatccactcacccaatgattgtc

SEQ ID NO: 618690 - DNA, 25 bp, Rattus norvegicus
tgcatccactcagccaatgattgtc

SEQ ID NO: 618691 - DNA, 25 bp, Rattus norvegicus
tgcatccattgacccgtactgtagg

SEQ ID NO: 618692 - DNA, 25 bp, Rattus norvegicus
tgcatccattgagccgtactgtagg

SEQ ID NO: 618693 - DNA, 25 bp, Rattus norvegicus
tgcatcccatccacaagaaagtgtt

SEQ ID NO: 618694 - DNA, 25 bp, Rattus norvegicus
tgcatcccatccacatgaacatcag

SEQ ID NO: 618695 - DNA, 25 bp, Rattus norvegicus
tgcatcccatccacatgaacatcat

SEQ ID NO: 618696 - DNA, 25 bp, Rattus norvegicus
tgcatcccatcctcaagaaagtgtt

SEQ ID NO: 618697 - DNA, 25 bp, Rattus norvegicus
tgcatcccatcctcatgaacatcag

SEQ ID NO: 618698 - DNA, 25 bp, Rattus norvegicus
tgcatcccatcctcatgaacatcat

SEQ ID NO: 618699 - DNA, 25 bp, Rattus norvegicus
tgcatccccattccagcagtggagg

SEQ ID NO: 618700 - DNA, 25 bp, Rattus norvegicus
tgcatccccattgcagcagtggagg

SEQ ID NO: 618701 - DNA, 25 bp, Rattus norvegicus
tgcatccccgataactggtacgaga

SEQ ID NO: 618702 - DNA, 25 bp, Rattus norvegicus
tgcatccccgattactggtacgaga

SEQ ID NO: 618703 - DNA, 25 bp, Rattus norvegicus
tgcatcccctgcagtgtaaggttga

SEQ ID NO: 618704 - DNA, 25 bp, Rattus norvegicus
tgcatcccctgctgtgtaaggttga

SEQ ID NO: 618705 - DNA, 25 bp, Rattus norvegicus
tgcatccctctgaatgtagccattt

SEQ ID NO: 618706 - DNA, 25 bp, Rattus norvegicus
tgcatccctctgtatgtagccattt

SEQ ID NO: 618707 - DNA, 25 bp, Rattus norvegicus
tgcatccctgagcaagcccaattag

SEQ ID NO: 618708 - DNA, 25 bp, Rattus norvegicus
tgcatccctgaggaagcccaattag

SEQ ID NO: 618709 - DNA, 25 bp, Rattus norvegicus
tgcatccgctagacccttctgaagg

SEQ ID NO: 618710 - DNA, 25 bp, Rattus norvegicus
tgcatccgctagactcggaatctac

SEQ ID NO: 618711 - DNA, 25 bp, Rattus norvegicus
tgcatccgctagtcccttctgaagg

SEQ ID NO: 618712 - DNA, 25 bp, Rattus norvegicus
tgcatccgctagtctcggaatctac

SEQ ID NO: 618713 - DNA, 25 bp, Rattus norvegicus
tgcatccggcagaagggtggctact

SEQ ID NO: 618714 - DNA, 25 bp, Rattus norvegicus
tgcatccggcagtagggtggctact

SEQ ID NO: 618715 - DNA, 25 bp, Rattus norvegicus
tgcatccgggttaccctgggaaatg

SEQ ID NO: 618716 - DNA, 25 bp, Rattus norvegicus
tgcatccgggtttccctgggaaatg

SEQ ID NO: 618717 - DNA, 25 bp, Rattus norvegicus
tgcatcctcagacagcgagcgctca

SEQ ID NO: 618718 - DNA, 25 bp, Rattus norvegicus
tgcatcctcagagagcgagcgctca

SEQ ID NO: 618719 - DNA, 25 bp, Rattus norvegicus
tgcatcctgaaaactccctgaattt

SEQ ID NO: 618720 - DNA, 25 bp, Rattus norvegicus
tgcatcctgaaatctccctgaattt

SEQ ID NO: 618721 - DNA, 25 bp, Rattus norvegicus
tgcatcctgagcaatggcttccaaa

SEQ ID NO: 618722 - DNA, 25 bp, Rattus norvegicus
tgcatcctgagctatggcttccaaa

SEQ ID NO: 618723 - DNA, 25 bp, Rattus norvegicus
tgcatcctgcaaacagctctggatc

SEQ ID NO: 618724 - DNA, 25 bp, Rattus norvegicus
tgcatcctgcaatcagctctggatc

SEQ ID NO: 618725 - DNA, 25 bp, Rattus norvegicus
tgcatcctgcctagactacggtgaa

SEQ ID NO: 618726 - DNA, 25 bp, Rattus norvegicus
tgcatcctgccttgactacggtgaa

SEQ ID NO: 618727 - DNA, 25 bp, Rattus norvegicus
tgcatcctgtatatctgtcgtgaga

SEQ ID NO: 618728 - DNA, 25 bp, Rattus norvegicus
tgcatcctgtatttctgtcgtgaga

SEQ ID NO: 618729 - DNA, 25 bp, Rattus norvegicus
tgcatcctgtctcccagttgagaaa

SEQ ID NO: 618730 - DNA, 25 bp, Rattus norvegicus
tgcatcctgtctgccagttgagaaa

SEQ ID NO: 618731 - DNA, 25 bp, Rattus norvegicus
tgcatcctgttactctgtgctgccc

SEQ ID NO: 618732 - DNA, 25 bp, Rattus norvegicus
tgcatcctgttagtctgtgctgccc

SEQ ID NO: 618733 - DNA, 25 bp, Rattus norvegicus
tgcatcctttctcatgtccaatgtg

SEQ ID NO: 618734 - DNA, 25 bp, Rattus norvegicus
tgcatcctttctgatgtccaatgtg

SEQ ID NO: 618735 - DNA, 25 bp, Rattus norvegicus
tgcatcgatccactcgacaggcgag

SEQ ID NO: 618736 - DNA, 25 bp, Rattus norvegicus
tgcatcgatccagtcgacaggcgag

SEQ ID NO: 618737 - DNA, 25 bp, Rattus norvegicus
tgcatcgccttgagtgtgctgaaga

SEQ ID NO: 618738 - DNA, 25 bp, Rattus norvegicus
tgcatcgccttgtgtgtgctgaaga

SEQ ID NO: 618739 - DNA, 25 bp, Rattus norvegicus
tgcatcgctgcaactgtacctgtga

SEQ ID NO: 618740 - DNA, 25 bp, Rattus norvegicus
tgcatcgctgcatctgtacctgtga

SEQ ID NO: 618741 - DNA, 25 bp, Rattus norvegicus
tgcatcgggtgcacgcagagaccag

SEQ ID NO: 618742 - DNA, 25 bp, Rattus norvegicus
tgcatcgggtgctcgcagagaccag

SEQ ID NO: 618743 - DNA, 25 bp, Rattus norvegicus
tgcatcggtcctacatcaaaactag

SEQ ID NO: 618744 - DNA, 25 bp, Rattus norvegicus
tgcatcggtccttcatcaaaactag

SEQ ID NO: 618745 - DNA, 25 bp, Rattus norvegicus
tgcatcgtagttcccgcgtttctta

SEQ ID NO: 618746 - DNA, 25 bp, Rattus norvegicus
tgcatcgtagttgccgcgtttctta

SEQ ID NO: 618747 - DNA, 25 bp, Rattus norvegicus
tgcatcgttgggacgtggtcgtcca

SEQ ID NO: 618748 - DNA, 25 bp, Rattus norvegicus
tgcatcgttgggtcgtggtcgtcca

SEQ ID NO: 618749 - DNA, 25 bp, Rattus norvegicus
tgcatctaactacagcctcatggga

SEQ ID NO: 618750 - DNA, 25 bp, Rattus norvegicus
tgcatctaactagagcctcatggga

SEQ ID NO: 618751 - DNA, 25 bp, Rattus norvegicus
tgcatctacgtcaacacaagctgga

SEQ ID NO: 618752 - DNA, 25 bp, Rattus norvegicus
tgcatctacgtctacacaagctgga

SEQ ID NO: 618753 - DNA, 25 bp, Rattus norvegicus
tgcatctatgccactgacctgtttg

SEQ ID NO: 618754 - DNA, 25 bp, Rattus norvegicus
tgcatctatgcctctgacctgtttg

SEQ ID NO: 618755 - DNA, 25 bp, Rattus norvegicus
tgcatctcagtcatgccctttgttt

SEQ ID NO: 618756 - DNA, 25 bp, Rattus norvegicus
tgcatctcagtcttgccctttgttt

SEQ ID NO: 618757 - DNA, 25 bp, Rattus norvegicus
tgcatctcagtgagtaggttccagg

SEQ ID NO: 618758 - DNA, 25 bp, Rattus norvegicus
tgcatctcagtgtgtaggttccagg

SEQ ID NO: 618759 - DNA, 25 bp, Rattus norvegicus
tgcatctccaggattcctggtatgt

SEQ ID NO: 618760 - DNA, 25 bp, Rattus norvegicus
tgcatctccaggtttcctggtatgt

SEQ ID NO: 618761 - DNA, 25 bp, Rattus norvegicus
tgcatctcctggatgcggcgcttgg

SEQ ID NO: 618762 - DNA, 25 bp, Rattus norvegicus
tgcatctcctggttgcggcgcttgg

SEQ ID NO: 618763 - DNA, 25 bp, Rattus norvegicus
tgcatctcggcacatccttgaagca

SEQ ID NO: 618764 - DNA, 25 bp, Rattus norvegicus
tgcatctcggcagatccttgaagca

SEQ ID NO: 618765 - DNA, 25 bp, Rattus norvegicus
tgcatctcgtcgacagtcgtccgct

SEQ ID NO: 618766 - DNA, 25 bp, Rattus norvegicus
tgcatctcgtcgtcagtcgtccgct

SEQ ID NO: 618767 - DNA, 25 bp, Rattus norvegicus
tgcatctctacacgcaatcagggat

SEQ ID NO: 618768 - DNA, 25 bp, Rattus norvegicus
tgcatctctacaggcaatcagggat

SEQ ID NO: 618769 - DNA, 25 bp, Rattus norvegicus
tgcatctctgcaatctctaagtcag

SEQ ID NO: 618770 - DNA, 25 bp, Rattus norvegicus
tgcatctctgcattctctaagtcag

SEQ ID NO: 618771 - DNA, 25 bp, Rattus norvegicus
tgcatctctgttcggtgttttgtgt

SEQ ID NO: 618772 - DNA, 25 bp, Rattus norvegicus
tgcatctctgttgggtgttttgtgt

SEQ ID NO: 618773 - DNA, 25 bp, Rattus norvegicus
tgcatctgagagaaatcacgcctcc

SEQ ID NO: 618774 - DNA, 25 bp, Rattus norvegicus
tgcatctgagagtaatcacgcctcc

SEQ ID NO: 618775 - DNA, 25 bp, Rattus norvegicus
tgcatctgatccatgttgctcggaa

SEQ ID NO: 618776 - DNA, 25 bp, Rattus norvegicus
tgcatctgatccttgttgctcggaa

SEQ ID NO: 618777 - DNA, 25 bp, Rattus norvegicus
tgcatctgcaatcatcatcctacca

SEQ ID NO: 618778 - DNA, 25 bp, Rattus norvegicus
tgcatctgcaatgatcatcctacca

SEQ ID NO: 618779 - DNA, 25 bp, Rattus norvegicus
tgcatctgcagaactccacagtgaa

SEQ ID NO: 618780 - DNA, 25 bp, Rattus norvegicus
tgcatctgcagatctccacagtgaa

SEQ ID NO: 618781 - DNA, 25 bp, Rattus norvegicus
tgcatctgcagcaagttgcctaatg

SEQ ID NO: 618782 - DNA, 25 bp, Rattus norvegicus
tgcatctgcagctagttgcctaatg

SEQ ID NO: 618783 - DNA, 25 bp, Rattus norvegicus
tgcatctgcatcactttccatgttc

SEQ ID NO: 618784 - DNA, 25 bp, Rattus norvegicus
tgcatctgcatctctttccatgttc

SEQ ID NO: 618785 - DNA, 25 bp, Rattus norvegicus
tgcatctgcctccagacttgtcaga

SEQ ID NO: 618786 - DNA, 25 bp, Rattus norvegicus
tgcatctgcctcgagacttgtcaga

SEQ ID NO: 618787 - DNA, 25 bp, Rattus norvegicus
tgcatctgctttacctgtaagactc

SEQ ID NO: 618788 - DNA, 25 bp, Rattus norvegicus
tgcatctgcttttcctgtaagactc

SEQ ID NO: 618789 - DNA, 25 bp, Rattus norvegicus
tgcatctggaagaacgcgagcctgt

SEQ ID NO: 618790 - DNA, 25 bp, Rattus norvegicus
tgcatctggaagtacgcgagcctgt

SEQ ID NO: 618791 - DNA, 25 bp, Rattus norvegicus
tgcatctggaatccctgcatttggg

SEQ ID NO: 618792 - DNA, 25 bp, Rattus norvegicus
tgcatctggaatgcctgcatttggg

SEQ ID NO: 618793 - DNA, 25 bp, Rattus norvegicus
tgcatcttcaagactcagctgagct

SEQ ID NO: 618794 - DNA, 25 bp, Rattus norvegicus
tgcatcttcaagtctcagctgagct

SEQ ID NO: 618795 - DNA, 25 bp, Rattus norvegicus
tgcatcttcactcaatgtcccgaga

SEQ ID NO: 618796 - DNA, 25 bp, Rattus norvegicus
tgcatcttcactgaatgtcccgaga

SEQ ID NO: 618797 - DNA, 25 bp, Rattus norvegicus
tgcatcttgcacattgacattccca

SEQ ID NO: 618798 - DNA, 25 bp, Rattus norvegicus
tgcatcttgcactttgacattccca

SEQ ID NO: 618799 - DNA, 25 bp, Rattus norvegicus
tgcatcttggcacttacagggtgga

SEQ ID NO: 618800 - DNA, 25 bp, Rattus norvegicus
tgcatcttggcagttacagggtgga

SEQ ID NO: 618801 - DNA, 25 bp, Rattus norvegicus
tgcatcttggttctgttgtttcgct

SEQ ID NO: 618802 - DNA, 25 bp, Rattus norvegicus
tgcatcttggttgtgttgtttcgct

SEQ ID NO: 618803 - DNA, 25 bp, Rattus norvegicus
tgcatcttgtctcagtcactggtct

SEQ ID NO: 618804 - DNA, 25 bp, Rattus norvegicus
tgcatcttgtctgagtcactggtct

SEQ ID NO: 618805 - DNA, 25 bp, Rattus norvegicus
tgcatctttgcacagctggccaatg

SEQ ID NO: 618806 - DNA, 25 bp, Rattus norvegicus
tgcatctttgcagagctggccaatg

SEQ ID NO: 618807 - DNA, 25 bp, Rattus norvegicus
tgcatcttttccacagcatatctgg

SEQ ID NO: 618808 - DNA, 25 bp, Rattus norvegicus
tgcatcttttcctcagcatatctgg

SEQ ID NO: 618809 - DNA, 25 bp, Rattus norvegicus
tgcatcttttggagcacgcagatcc

SEQ ID NO: 618810 - DNA, 25 bp, Rattus norvegicus
tgcatcttttggtgcacgcagatcc

SEQ ID NO: 618811 - DNA, 25 bp, Rattus norvegicus
tgcatgaaggtgcattggctttgct

SEQ ID NO: 618812 - DNA, 25 bp, Rattus norvegicus
tgcatgaaggtggattggctttgct

SEQ ID NO: 618813 - DNA, 25 bp, Rattus norvegicus
tgcatgaccaagcatttacccctct

SEQ ID NO: 618814 - DNA, 25 bp, Rattus norvegicus
tgcatgaccaaggatttacccctct

SEQ ID NO: 618815 - DNA, 25 bp, Rattus norvegicus
tgcatgacccatatctaaccacagt

SEQ ID NO: 618816 - DNA, 25 bp, Rattus norvegicus
tgcatgacccatttctaaccacagt

SEQ ID NO: 618817 - DNA, 25 bp, Rattus norvegicus
tgcatgactcaaactccagaattta

SEQ ID NO: 618818 - DNA, 25 bp, Rattus norvegicus
tgcatgactcaatctccagaattta

SEQ ID NO: 618819 - DNA, 25 bp, Rattus norvegicus
tgcatgactggtcccagacaggtca

SEQ ID NO: 618820 - DNA, 25 bp, Rattus norvegicus
tgcatgactggtgccagacaggtca

SEQ ID NO: 618821 - DNA, 25 bp, Rattus norvegicus
tgcatgactgtgatgttgctgctgc

SEQ ID NO: 618822 - DNA, 25 bp, Rattus norvegicus
tgcatgactgtgttgttgctgctgc

SEQ ID NO: 618823 - DNA, 25 bp, Rattus norvegicus
tgcatgagaccgagccctcagatga

SEQ ID NO: 618824 - DNA, 25 bp, Rattus norvegicus
tgcatgagaccgtgccctcagatga

SEQ ID NO: 618825 - DNA, 25 bp, Rattus norvegicus
tgcatgagacgcacaacctctttga

SEQ ID NO: 618826 - DNA, 25 bp, Rattus norvegicus
tgcatgagacgctcaacctctttga

SEQ ID NO: 618827 - DNA, 25 bp, Rattus norvegicus
tgcatgagatccagcgcttcatcag

SEQ ID NO: 618828 - DNA, 25 bp, Rattus norvegicus
tgcatgagatcctgcgcttcatcag

SEQ ID NO: 618829 - DNA, 25 bp, Rattus norvegicus
tgcatgatcctcacgaagcagctct

SEQ ID NO: 618830 - DNA, 25 bp, Rattus norvegicus
tgcatgatcctctcgaagcagctct

SEQ ID NO: 618831 - DNA, 25 bp, Rattus norvegicus
tgcatgatgccgagagactcaaccg

SEQ ID NO: 618832 - DNA, 25 bp, Rattus norvegicus
tgcatgatgccgtgagactcaaccg

SEQ ID NO: 618833 - DNA, 25 bp, Rattus norvegicus
tgcatgatgcgcaggaggacttccc

SEQ ID NO: 618834 - DNA, 25 bp, Rattus norvegicus
tgcatgatgcgctggaggacttccc

SEQ ID NO: 618835 - DNA, 25 bp, Rattus norvegicus
tgcatgattgcacgtgaccttgggt

SEQ ID NO: 618836 - DNA, 25 bp, Rattus norvegicus
tgcatgattgcaggtgaccttgggt

SEQ ID NO: 618837 - DNA, 25 bp, Rattus norvegicus
tgcatgcaagacactaccagactca

SEQ ID NO: 618838 - DNA, 25 bp, Rattus norvegicus
tgcatgcaagactctaccagactca

SEQ ID NO: 618839 - DNA, 25 bp, Rattus norvegicus
tgcatgcacactacctatttctaaa

SEQ ID NO: 618840 - DNA, 25 bp, Rattus norvegicus
tgcatgcacacttcctatttctaaa

SEQ ID NO: 618841 - DNA, 25 bp, Rattus norvegicus
tgcatgcagactcgtgcaactcctg

SEQ ID NO: 618842 - DNA, 25 bp, Rattus norvegicus
tgcatgcagactggtgcaactcctg

SEQ ID NO: 618843 - DNA, 25 bp, Rattus norvegicus
tgcatgcagcagattttccccaaac

SEQ ID NO: 618844 - DNA, 25 bp, Rattus norvegicus
tgcatgcagcagtttttccccaaac

SEQ ID NO: 618845 - DNA, 25 bp, Rattus norvegicus
tgcatgcagtacactggatctccct

SEQ ID NO: 618846 - DNA, 25 bp, Rattus norvegicus
tgcatgcagtactctggatctccct

SEQ ID NO: 618847 - DNA, 25 bp, Rattus norvegicus
tgcatgcatggactgtattatttac

SEQ ID NO: 618848 - DNA, 25 bp, Rattus norvegicus
tgcatgcatggagtgtattatttac

SEQ ID NO: 618849 - DNA, 25 bp, Rattus norvegicus
tgcatgcatgttagtcagctttcat

SEQ ID NO: 618850 - DNA, 25 bp, Rattus norvegicus
tgcatgcatgtttgtcagctttcat

SEQ ID NO: 618851 - DNA, 25 bp, Rattus norvegicus
tgcatgcattccaagaccatctttc

SEQ ID NO: 618852 - DNA, 25 bp, Rattus norvegicus
tgcatgcattcctagaccatctttc

SEQ ID NO: 618853 - DNA, 25 bp, Rattus norvegicus
tgcatgccagagagacctacaccta

SEQ ID NO: 618854 - DNA, 25 bp, Rattus norvegicus
tgcatgccagagtgacctacaccta

SEQ ID NO: 618855 - DNA, 25 bp, Rattus norvegicus
tgcatgcccagtcccgacacaggag

SEQ ID NO: 618856 - DNA, 25 bp, Rattus norvegicus
tgcatgcccagtgccgacacaggag

SEQ ID NO: 618857 - DNA, 25 bp, Rattus norvegicus
tgcatgcccgatacgccgagtgtgg

SEQ ID NO: 618858 - DNA, 25 bp, Rattus norvegicus
tgcatgcccgattcgccgagtgtgg

SEQ ID NO: 618859 - DNA, 25 bp, Rattus norvegicus
tgcatgcccttacgtgacagcaggc

SEQ ID NO: 618860 - DNA, 25 bp, Rattus norvegicus
tgcatgcccttaggtgacagcaggc

SEQ ID NO: 618861 - DNA, 25 bp, Rattus norvegicus
tgcatgcctggcacagtgctggata

SEQ ID NO: 618862 - DNA, 25 bp, Rattus norvegicus
tgcatgcctggctcagtgctggata

SEQ ID NO: 618863 - DNA, 25 bp, Rattus norvegicus
tgcatgcctgtcaccttctgaggaa

SEQ ID NO: 618864 - DNA, 25 bp, Rattus norvegicus
tgcatgcctgtctccttctgaggaa

SEQ ID NO: 618865 - DNA, 25 bp, Rattus norvegicus
tgcatgcctttacttccaggactcg

SEQ ID NO: 618866 - DNA, 25 bp, Rattus norvegicus
tgcatgcctttagttccaggactcg

SEQ ID NO: 618867 - DNA, 25 bp, Rattus norvegicus
tgcatgcgtactacgggatctgtgg

SEQ ID NO: 618868 - DNA, 25 bp, Rattus norvegicus
tgcatgcgtacttcgggatctgtgg

SEQ ID NO: 618869 - DNA, 25 bp, Rattus norvegicus
tgcatgctaagcatcctaccactga

SEQ ID NO: 618870 - DNA, 25 bp, Rattus norvegicus
tgcatgctaagcttcctaccactga

SEQ ID NO: 618871 - DNA, 25 bp, Rattus norvegicus
tgcatgctacaaaacgtcattcttt

SEQ ID NO: 618872 - DNA, 25 bp, Rattus norvegicus
tgcatgctacaatacgtcattcttt

SEQ ID NO: 618873 - DNA, 25 bp, Rattus norvegicus
tgcatgctagccatgcccagagcca

SEQ ID NO: 618874 - DNA, 25 bp, Rattus norvegicus
tgcatgctagccttgcccagagcca

SEQ ID NO: 618875 - DNA, 25 bp, Rattus norvegicus
tgcatgctcagacttcttacagcgc

SEQ ID NO: 618876 - DNA, 25 bp, Rattus norvegicus
tgcatgctcagagttcttacagcgc

SEQ ID NO: 618877 - DNA, 25 bp, Rattus norvegicus
tgcatgctcttccccagtacggctt

SEQ ID NO: 618878 - DNA, 25 bp, Rattus norvegicus
tgcatgctcttcgccagtacggctt

SEQ ID NO: 618879 - DNA, 25 bp, Rattus norvegicus
tgcatgctgccacgcacatttaaat

SEQ ID NO: 618880 - DNA, 25 bp, Rattus norvegicus
tgcatgctgccaggcacatttaaat

SEQ ID NO: 618881 - DNA, 25 bp, Rattus norvegicus
tgcatgctgggcaaactgtctacca

SEQ ID NO: 618882 - DNA, 25 bp, Rattus norvegicus
tgcatgctgggctaactgtctacca

SEQ ID NO: 618883 - DNA, 25 bp, Rattus norvegicus
tgcatggaagccacatttcccagac

SEQ ID NO: 618884 - DNA, 25 bp, Rattus norvegicus
tgcatggaagcctcatttcccagac

SEQ ID NO: 618885 - DNA, 25 bp, Rattus norvegicus
tgcatggaccagaccattttcccaa

SEQ ID NO: 618886 - DNA, 25 bp, Rattus norvegicus
tgcatggaccagtccattttcccaa

SEQ ID NO: 618887 - DNA, 25 bp, Rattus norvegicus
tgcatggactccagaaaccgtaggg

SEQ ID NO: 618888 - DNA, 25 bp, Rattus norvegicus
tgcatggactcctgaaaccgtaggg

SEQ ID NO: 618889 - DNA, 25 bp, Rattus norvegicus
tgcatggactgactagccgtggtca

SEQ ID NO: 618890 - DNA, 25 bp, Rattus norvegicus
tgcatggactgagtagccgtggtca

SEQ ID NO: 618891 - DNA, 25 bp, Rattus norvegicus
tgcatggacttcagctgtacctgct

SEQ ID NO: 618892 - DNA, 25 bp, Rattus norvegicus
tgcatggacttctgctgtacctgct

SEQ ID NO: 618893 - DNA, 25 bp, Rattus norvegicus
tgcatggcagaaccgtctcccttgg

SEQ ID NO: 618894 - DNA, 25 bp, Rattus norvegicus
tgcatggcagaagcgtctcccttgg

SEQ ID NO: 618895 - DNA, 25 bp, Rattus norvegicus
tgcatggccacacaccagggtcagg

SEQ ID NO: 618896 - DNA, 25 bp, Rattus norvegicus
tgcatggccacagaccagggtcagg

SEQ ID NO: 618897 - DNA, 25 bp, Rattus norvegicus
tgcatggccgcaatctggaggctaa

SEQ ID NO: 618898 - DNA, 25 bp, Rattus norvegicus
tgcatggccgcattctggaggctaa

SEQ ID NO: 618899 - DNA, 25 bp, Rattus norvegicus
tgcatggctgccacgggaaacctca

SEQ ID NO: 618900 - DNA, 25 bp, Rattus norvegicus
tgcatggctgcctcgggaaacctca

SEQ ID NO: 618901 - DNA, 25 bp, Rattus norvegicus
tgcatgggacggatacgcctgcgct

SEQ ID NO: 618902 - DNA, 25 bp, Rattus norvegicus
tgcatgggacggttacgcctgcgct

SEQ ID NO: 618903 - DNA, 25 bp, Rattus norvegicus
tgcatgggcgagctgatgacctcta

SEQ ID NO: 618904 - DNA, 25 bp, Rattus norvegicus
tgcatgggcgaggtgatgacctcta

SEQ ID NO: 618905 - DNA, 25 bp, Rattus norvegicus
tgcatgggcttcatgtccatcagta

SEQ ID NO: 618906 - DNA, 25 bp, Rattus norvegicus
tgcatgggcttcttgtccatcagta

SEQ ID NO: 618907 - DNA, 25 bp, Rattus norvegicus
tgcatgggtcacagtgccaccagga

SEQ ID NO: 618908 - DNA, 25 bp, Rattus norvegicus
tgcatgggtcactgtgccaccagga

SEQ ID NO: 618909 - DNA, 25 bp, Rattus norvegicus
tgcatgggtgagatccttggacaac

SEQ ID NO: 618910 - DNA, 25 bp, Rattus norvegicus
tgcatgggtgagttccttggacaac

SEQ ID NO: 618911 - DNA, 25 bp, Rattus norvegicus
tgcatggtaagccacacaccttgga

SEQ ID NO: 618912 - DNA, 25 bp, Rattus norvegicus
tgcatggtaagcgacacaccttgga

SEQ ID NO: 618913 - DNA, 25 bp, Rattus norvegicus
tgcatggttgcacagtggttgctcc

SEQ ID NO: 618914 - DNA, 25 bp, Rattus norvegicus
tgcatggttgcagagtggttgctcc

SEQ ID NO: 618915 - DNA, 25 bp, Rattus norvegicus
tgcatgtaagcacacgcacacactc

SEQ ID NO: 618916 - DNA, 25 bp, Rattus norvegicus
tgcatgtaagcagacgcacacactc

SEQ ID NO: 618917 - DNA, 25 bp, Rattus norvegicus
tgcatgtacaggctcacacgggtat

SEQ ID NO: 618918 - DNA, 25 bp, Rattus norvegicus
tgcatgtacagggtcacacgggtat

SEQ ID NO: 618919 - DNA, 25 bp, Rattus norvegicus
tgcatgtaggacactgaaaagcagt

SEQ ID NO: 618920 - DNA, 25 bp, Rattus norvegicus
tgcatgtaggactctgaaaagcagt

SEQ ID NO: 618921 - DNA, 25 bp, Rattus norvegicus
tgcatgtcatatcactgtacacaaa

SEQ ID NO: 618922 - DNA, 25 bp, Rattus norvegicus
tgcatgtcatatgactgtacacaaa

SEQ ID NO: 618923 - DNA, 25 bp, Rattus norvegicus
tgcatgtcccatcgtgtcacgagtc

SEQ ID NO: 618924 - DNA, 25 bp, Rattus norvegicus
tgcatgtcccatggtgtcacgagtc

SEQ ID NO: 618925 - DNA, 25 bp, Rattus norvegicus
tgcatgtcctttcttaatacactag

SEQ ID NO: 618926 - DNA, 25 bp, Rattus norvegicus
tgcatgtcctttgttaatacactag

SEQ ID NO: 618927 - DNA, 25 bp, Rattus norvegicus
tgcatgtcgggccactgctccatga

SEQ ID NO: 618928 - DNA, 25 bp, Rattus norvegicus
tgcatgtcgggcgactgctccatga

SEQ ID NO: 618929 - DNA, 25 bp, Rattus norvegicus
tgcatgtctcagactagcttcactt

SEQ ID NO: 618930 - DNA, 25 bp, Rattus norvegicus
tgcatgtctcagtctagcttcactt

SEQ ID NO: 618931 - DNA, 25 bp, Rattus norvegicus
tgcatgtctttaacattgtcctcct

SEQ ID NO: 618932 - DNA, 25 bp, Rattus norvegicus
tgcatgtctttatcattgtcctcct

SEQ ID NO: 618933 - DNA, 25 bp, Rattus norvegicus
tgcatgtctttcctaggtgcctagc

SEQ ID NO: 618934 - DNA, 25 bp, Rattus norvegicus
tgcatgtctttcgtaggtgcctagc

SEQ ID NO: 618935 - DNA, 25 bp, Rattus norvegicus
tgcatgtgagttcccaggtgacccc

SEQ ID NO: 618936 - DNA, 25 bp, Rattus norvegicus
tgcatgtgagttgccaggtgacccc

SEQ ID NO: 618937 - DNA, 25 bp, Rattus norvegicus
tgcatgtgatttctgcctgggtcaa

SEQ ID NO: 618938 - DNA, 25 bp, Rattus norvegicus
tgcatgtgatttgtgcctgggtcaa

SEQ ID NO: 618939 - DNA, 25 bp, Rattus norvegicus
tgcatgtgcacacctctggaaagat

SEQ ID NO: 618940 - DNA, 25 bp, Rattus norvegicus
tgcatgtgcacagctctggaaagat

SEQ ID NO: 618941 - DNA, 25 bp, Rattus norvegicus
tgcatgtgcatcaaggccagtcctg

SEQ ID NO: 618942 - DNA, 25 bp, Rattus norvegicus
tgcatgtgcatctaggccagtcctg

SEQ ID NO: 618943 - DNA, 25 bp, Rattus norvegicus
tgcatgtggcccactgagcgacgac

SEQ ID NO: 618944 - DNA, 25 bp, Rattus norvegicus
tgcatgtggccctctgagcgacgac

SEQ ID NO: 618945 - DNA, 25 bp, Rattus norvegicus
tgcatgtgtacaagtccatggtgtt

SEQ ID NO: 618946 - DNA, 25 bp, Rattus norvegicus
tgcatgtgtacatgtccatggtgtt

SEQ ID NO: 618947 - DNA, 25 bp, Rattus norvegicus
tgcatgtgtccaccctactgtttca

SEQ ID NO: 618948 - DNA, 25 bp, Rattus norvegicus
tgcatgtgtccagcctactgtttca

SEQ ID NO: 618949 - DNA, 25 bp, Rattus norvegicus
tgcatgtgtgcgagtctggttacca

SEQ ID NO: 618950 - DNA, 25 bp, Rattus norvegicus
tgcatgtgtgcgtgtctggttacca

SEQ ID NO: 618951 - DNA, 25 bp, Rattus norvegicus
tgcatgttagagagagccccaagcc

SEQ ID NO: 618952 - DNA, 25 bp, Rattus norvegicus
tgcatgttagagtgagccccaagcc

SEQ ID NO: 618953 - DNA, 25 bp, Rattus norvegicus
tgcatgttcacacttaggtcctaaa

SEQ ID NO: 618954 - DNA, 25 bp, Rattus norvegicus
tgcatgttcacagttaggtcctaaa

SEQ ID NO: 618955 - DNA, 25 bp, Rattus norvegicus
tgcatgttgtgtcaaggcccctcga

SEQ ID NO: 618956 - DNA, 25 bp, Rattus norvegicus
tgcatgttgtgtgaaggcccctcga

SEQ ID NO: 618957 - DNA, 25 bp, Rattus norvegicus
tgcatgtttgccatcctgggagaaa

SEQ ID NO: 618958 - DNA, 25 bp, Rattus norvegicus
tgcatgtttgccttcctgggagaaa

SEQ ID NO: 618959 - DNA, 25 bp, Rattus norvegicus
tgcattaacccaaagccacattttc

SEQ ID NO: 618960 - DNA, 25 bp, Rattus norvegicus
tgcattaacccatagccacattttc

SEQ ID NO: 618961 - DNA, 25 bp, Rattus norvegicus
tgcattaatgttacccaagatgtaa

SEQ ID NO: 618962 - DNA, 25 bp, Rattus norvegicus
tgcattaatgtttcccaagatgtaa

SEQ ID NO: 618963 - DNA, 25 bp, Rattus norvegicus
tgcattaattacaggctgccctcag

SEQ ID NO: 618964 - DNA, 25 bp, Rattus norvegicus
tgcattaattactggctgccctcag

SEQ ID NO: 618965 - DNA, 25 bp, Rattus norvegicus
tgcattactgttaccctgggtaccg

SEQ ID NO: 618966 - DNA, 25 bp, Rattus norvegicus
tgcattactgtttccctgggtaccg

SEQ ID NO: 618967 - DNA, 25 bp, Rattus norvegicus
tgcattagctgcacatccagttctc

SEQ ID NO: 618968 - DNA, 25 bp, Rattus norvegicus
tgcattagctgctcatccagttctc

SEQ ID NO: 618969 - DNA, 25 bp, Rattus norvegicus
tgcattatcctgaggcaaacaacct

SEQ ID NO: 618970 - DNA, 25 bp, Rattus norvegicus
tgcattatcctgtggcaaacaacct

SEQ ID NO: 618971 - DNA, 25 bp, Rattus norvegicus
tgcattcaatgccacatcattccta

SEQ ID NO: 618972 - DNA, 25 bp, Rattus norvegicus
tgcattcaatgcgacatcattccta

SEQ ID NO: 618973 - DNA, 25 bp, Rattus norvegicus
tgcattcagtgcatttacctaaatc

SEQ ID NO: 618974 - DNA, 25 bp, Rattus norvegicus
tgcattcagtgcttttacctaaatc

SEQ ID NO: 618975 - DNA, 25 bp, Rattus norvegicus
tgcattcatatgcatatgcctgaac

SEQ ID NO: 618976 - DNA, 25 bp, Rattus norvegicus
tgcattcatatggatatgcctgaac

SEQ ID NO: 618977 - DNA, 25 bp, Rattus norvegicus
tgcattccagcaatcattgagtgtt

SEQ ID NO: 618978 - DNA, 25 bp, Rattus norvegicus
tgcattccagcattcattgagtgtt

SEQ ID NO: 618979 - DNA, 25 bp, Rattus norvegicus
tgcattccagccaaattctcaggta

SEQ ID NO: 618980 - DNA, 25 bp, Rattus norvegicus
tgcattccagcctaattctcaggta

SEQ ID NO: 618981 - DNA, 25 bp, Rattus norvegicus
tgcattccatttccgcatgagtaca

SEQ ID NO: 618982 - DNA, 25 bp, Rattus norvegicus
tgcattccatttgcgcatgagtaca

SEQ ID NO: 618983 - DNA, 25 bp, Rattus norvegicus
tgcattcccagcactgattggtaga

SEQ ID NO: 618984 - DNA, 25 bp, Rattus norvegicus
tgcattcccagctctgattggtaga

SEQ ID NO: 618985 - DNA, 25 bp, Rattus norvegicus
tgcattcccataaataaacccgatg

SEQ ID NO: 618986 - DNA, 25 bp, Rattus norvegicus
tgcattcccatatataaacccgatg

SEQ ID NO: 618987 - DNA, 25 bp, Rattus norvegicus
tgcattcccatgctatctgcacgga

SEQ ID NO: 618988 - DNA, 25 bp, Rattus norvegicus
tgcattcccatggtatctgcacgga

SEQ ID NO: 618989 - DNA, 25 bp, Rattus norvegicus
tgcattcccattactagatacccaa

SEQ ID NO: 618990 - DNA, 25 bp, Rattus norvegicus
tgcattcccatttctagatacccaa

SEQ ID NO: 618991 - DNA, 25 bp, Rattus norvegicus
tgcattccttttccgcttttaattc

SEQ ID NO: 618992 - DNA, 25 bp, Rattus norvegicus
tgcattccttttgcgcttttaattc

SEQ ID NO: 618993 - DNA, 25 bp, Rattus norvegicus
tgcattcgcattcccggaggtggaa

SEQ ID NO: 618994 - DNA, 25 bp, Rattus norvegicus
tgcattcgcattgccggaggtggaa

SEQ ID NO: 618995 - DNA, 25 bp, Rattus norvegicus
tgcattcgctccctagcagcacata

SEQ ID NO: 618996 - DNA, 25 bp, Rattus norvegicus
tgcattcgctccgtagcagcacata

SEQ ID NO: 618997 - DNA, 25 bp, Rattus norvegicus
tgcattcggaacacacttgagacaa

SEQ ID NO: 618998 - DNA, 25 bp, Rattus norvegicus
tgcattcggaactcacttgagacaa

SEQ ID NO: 618999 - DNA, 25 bp, Rattus norvegicus
tgcattcggtcaccccaaggaccga

SEQ ID NO: 619000 - DNA, 25 bp, Rattus norvegicus
tgcattcggtcagcccaaggaccga

SEQ ID NO: 619001 - DNA, 25 bp, Rattus norvegicus
tgcattcgtttaccgtgggctgaga

SEQ ID NO: 619002 - DNA, 25 bp, Rattus norvegicus
tgcattcgtttagcgtgggctgaga

SEQ ID NO: 619003 - DNA, 25 bp, Rattus norvegicus
tgcattctatttaaccctgattccc

SEQ ID NO: 619004 - DNA, 25 bp, Rattus norvegicus
tgcattctattttaccctgattccc

SEQ ID NO: 619005 - DNA, 25 bp, Rattus norvegicus
tgcattctcgcacatataaacaatt

SEQ ID NO: 619006 - DNA, 25 bp, Rattus norvegicus
tgcattctcgcagatataaacaatt

SEQ ID NO: 619007 - DNA, 25 bp, Rattus norvegicus
tgcattctcggcagattaatccttg

SEQ ID NO: 619008 - DNA, 25 bp, Rattus norvegicus
tgcattctcggctgattaatccttg

SEQ ID NO: 619009 - DNA, 25 bp, Rattus norvegicus
tgcattctctgcatcttctcttgga

SEQ ID NO: 619010 - DNA, 25 bp, Rattus norvegicus
tgcattctctgcttcttctcttgga

SEQ ID NO: 619011 - DNA, 25 bp, Rattus norvegicus
tgcattctggctagtgaccattcag

SEQ ID NO: 619012 - DNA, 25 bp, Rattus norvegicus
tgcattctggcttgtgaccattcag

SEQ ID NO: 619013 - DNA, 25 bp, Rattus norvegicus
tgcattctgttgctctttcctgaaa

SEQ ID NO: 619014 - DNA, 25 bp, Rattus norvegicus
tgcattctgttggtctttcctgaaa

SEQ ID NO: 619015 - DNA, 25 bp, Rattus norvegicus
tgcattcttcatcgagggcattgaa

SEQ ID NO: 619016 - DNA, 25 bp, Rattus norvegicus
tgcattcttcatggagggcattgaa

SEQ ID NO: 619017 - DNA, 25 bp, Rattus norvegicus
tgcattgaaacccttttagtcctaa

SEQ ID NO: 619018 - DNA, 25 bp, Rattus norvegicus
tgcattgaaaccgttttagtcctaa

SEQ ID NO: 619019 - DNA, 25 bp, Rattus norvegicus
tgcattgaccgtcattctcgttttc

SEQ ID NO: 619020 - DNA, 25 bp, Rattus norvegicus
tgcattgaccgtgattctcgttttc

SEQ ID NO: 619021 - DNA, 25 bp, Rattus norvegicus
tgcattgagttcatccaggtcacac

SEQ ID NO: 619022 - DNA, 25 bp, Rattus norvegicus
tgcattgagttcttccaggtcacac

SEQ ID NO: 619023 - DNA, 25 bp, Rattus norvegicus
tgcattgcaagtacaggccagctgt

SEQ ID NO: 619024 - DNA, 25 bp, Rattus norvegicus
tgcattgcaagttcaggccagctgt

SEQ ID NO: 619025 - DNA, 25 bp, Rattus norvegicus
tgcattgcagccagctgtgttctgg

SEQ ID NO: 619026 - DNA, 25 bp, Rattus norvegicus
tgcattgcagcctgctgtgttctgg

SEQ ID NO: 619027 - DNA, 25 bp, Rattus norvegicus
tgcattgcatcgctcggaagtcgaa

SEQ ID NO: 619028 - DNA, 25 bp, Rattus norvegicus
tgcattgcatcggtcggaagtcgaa

SEQ ID NO: 619029 - DNA, 25 bp, Rattus norvegicus
tgcattgccaaccttgcagctccaa

SEQ ID NO: 619030 - DNA, 25 bp, Rattus norvegicus
tgcattgccaacgttgcagctccaa

SEQ ID NO: 619031 - DNA, 25 bp, Rattus norvegicus
tgcattgcccggatagcatcacttc

SEQ ID NO: 619032 - DNA, 25 bp, Rattus norvegicus
tgcattgcccggttagcatcacttc

SEQ ID NO: 619033 - DNA, 25 bp, Rattus norvegicus
tgcattgccgagaccagaagccccg

SEQ ID NO: 619034 - DNA, 25 bp, Rattus norvegicus
tgcattgccgagtccagaagccccg

SEQ ID NO: 619035 - DNA, 25 bp, Rattus norvegicus
tgcattgccgcccttgtgtaaataa

SEQ ID NO: 619036 - DNA, 25 bp, Rattus norvegicus
tgcattgccgccgttgtgtaaataa

SEQ ID NO: 619037 - DNA, 25 bp, Rattus norvegicus
tgcattgctaagaacccatcccaga

SEQ ID NO: 619038 - DNA, 25 bp, Rattus norvegicus
tgcattgctaagtacccatcccaga

SEQ ID NO: 619039 - DNA, 25 bp, Rattus norvegicus
tgcattgctttgattagcctcaaac

SEQ ID NO: 619040 - DNA, 25 bp, Rattus norvegicus
tgcattgctttgtttagcctcaaac

SEQ ID NO: 619041 - DNA, 25 bp, Rattus norvegicus
tgcattggctttccctaatatttcc

SEQ ID NO: 619042 - DNA, 25 bp, Rattus norvegicus
tgcattggctttgcctaatatttcc

SEQ ID NO: 619043 - DNA, 25 bp, Rattus norvegicus
tgcattgggaaacaactgtcacatc

SEQ ID NO: 619044 - DNA, 25 bp, Rattus norvegicus
tgcattgggaaagaactgtcacatc

SEQ ID NO: 619045 - DNA, 25 bp, Rattus norvegicus
tgcattggtgtcagctgtcctccat

SEQ ID NO: 619046 - DNA, 25 bp, Rattus norvegicus
tgcattggtgtctgctgtcctccat

SEQ ID NO: 619047 - DNA, 25 bp, Rattus norvegicus
tgcattggttagatctgcccgcatg

SEQ ID NO: 619048 - DNA, 25 bp, Rattus norvegicus
tgcattggttagttctgcccgcatg

SEQ ID NO: 619049 - DNA, 25 bp, Rattus norvegicus
tgcattgtaactcctgtcctcgttt

SEQ ID NO: 619050 - DNA, 25 bp, Rattus norvegicus
tgcattgtaactgctgtcctcgttt

SEQ ID NO: 619051 - DNA, 25 bp, Rattus norvegicus
tgcattgtatttatgtaaccctgaa

SEQ ID NO: 619052 - DNA, 25 bp, Rattus norvegicus
tgcattgtatttttgtaaccctgaa

SEQ ID NO: 619053 - DNA, 25 bp, Rattus norvegicus
tgcattgtcatcatcccgaacggaa

SEQ ID NO: 619054 - DNA, 25 bp, Rattus norvegicus
tgcattgtcatcttcccgaacggaa

SEQ ID NO: 619055 - DNA, 25 bp, Rattus norvegicus
tgcattgtccctaaggctgttacgg

SEQ ID NO: 619056 - DNA, 25 bp, Rattus norvegicus
tgcattgtcccttaggctgttacgg

SEQ ID NO: 619057 - DNA, 25 bp, Rattus norvegicus
tgcattgtgaacacacgttgcggaa

SEQ ID NO: 619058 - DNA, 25 bp, Rattus norvegicus
tgcattgtgaactcacgttgcggaa

SEQ ID NO: 619059 - DNA, 25 bp, Rattus norvegicus
tgcattgttgggaaacgtgggcttc

SEQ ID NO: 619060 - DNA, 25 bp, Rattus norvegicus
tgcattgttgggtaacgtgggcttc

SEQ ID NO: 619061 - DNA, 25 bp, Rattus norvegicus
tgcattgtttctaactgaactttta

SEQ ID NO: 619062 - DNA, 25 bp, Rattus norvegicus
tgcattgtttcttactgaactttta

SEQ ID NO: 619063 - DNA, 25 bp, Rattus norvegicus
tgcattgtttgcatcaccacctatg

SEQ ID NO: 619064 - DNA, 25 bp, Rattus norvegicus
tgcattgtttgcttcaccacctatg

SEQ ID NO: 619065 - DNA, 25 bp, Rattus norvegicus
tgcattgttttgactgtgtcctgat

SEQ ID NO: 619066 - DNA, 25 bp, Rattus norvegicus
tgcattgttttgagtctgtcatcca

SEQ ID NO: 619067 - DNA, 25 bp, Rattus norvegicus
tgcattgttttgtctgtgtcctgat

SEQ ID NO: 619068 - DNA, 25 bp, Rattus norvegicus
tgcattgttttgtgtctgtcatcca

SEQ ID NO: 619069 - DNA, 25 bp, Rattus norvegicus
tgcatttaaataccccagccaagaa

SEQ ID NO: 619070 - DNA, 25 bp, Rattus norvegicus
tgcatttaaatagcccagccaagaa

SEQ ID NO: 619071 - DNA, 25 bp, Rattus norvegicus
tgcatttacactcggagggtccttg

SEQ ID NO: 619072 - DNA, 25 bp, Rattus norvegicus
tgcatttacactgggagggtccttg

SEQ ID NO: 619073 - DNA, 25 bp, Rattus norvegicus
tgcatttacagaatgacccgaggaa

SEQ ID NO: 619074 - DNA, 25 bp, Rattus norvegicus
tgcatttacagattgacccgaggaa

SEQ ID NO: 619075 - DNA, 25 bp, Rattus norvegicus
tgcatttactataccaaagccctct

SEQ ID NO: 619076 - DNA, 25 bp, Rattus norvegicus
tgcatttactattccaaagccctct

SEQ ID NO: 619077 - DNA, 25 bp, Rattus norvegicus
tgcatttagctcacgcctcaaatag

SEQ ID NO: 619078 - DNA, 25 bp, Rattus norvegicus
tgcatttagctctcgcctcaaatag

SEQ ID NO: 619079 - DNA, 25 bp, Rattus norvegicus
tgcatttagtaaccactgccctgga

SEQ ID NO: 619080 - DNA, 25 bp, Rattus norvegicus
tgcatttagtaagcactgccctgga

SEQ ID NO: 619081 - DNA, 25 bp, Rattus norvegicus
tgcatttagtgtcctcgtgctgaaa

SEQ ID NO: 619082 - DNA, 25 bp, Rattus norvegicus
tgcatttagtgtgctcgtgctgaaa

SEQ ID NO: 619083 - DNA, 25 bp, Rattus norvegicus
tgcatttcaggacctcagcatggag

SEQ ID NO: 619084 - DNA, 25 bp, Rattus norvegicus
tgcatttcaggagctcagcatggag

SEQ ID NO: 619085 - DNA, 25 bp, Rattus norvegicus
tgcatttccaagacattttcacctg

SEQ ID NO: 619086 - DNA, 25 bp, Rattus norvegicus
tgcatttccaagtcattttcacctg

SEQ ID NO: 619087 - DNA, 25 bp, Rattus norvegicus
tgcatttccagaagcactgaggccc

SEQ ID NO: 619088 - DNA, 25 bp, Rattus norvegicus
tgcatttccagatgcactgaggccc

SEQ ID NO: 619089 - DNA, 25 bp, Rattus norvegicus
tgcatttcccacagctcaatgagca

SEQ ID NO: 619090 - DNA, 25 bp, Rattus norvegicus
tgcatttcccactgctcaatgagca

SEQ ID NO: 619091 - DNA, 25 bp, Rattus norvegicus
tgcatttcctggaggccaacgacaa

SEQ ID NO: 619092 - DNA, 25 bp, Rattus norvegicus
tgcatttcctggtggccaacgacaa

SEQ ID NO: 619093 - DNA, 25 bp, Rattus norvegicus
tgcatttctgctcaatggagcccca

SEQ ID NO: 619094 - DNA, 25 bp, Rattus norvegicus
tgcatttctgctgaatggagcccca

SEQ ID NO: 619095 - DNA, 25 bp, Rattus norvegicus
tgcatttctggcaatcacttgtaac

SEQ ID NO: 619096 - DNA, 25 bp, Rattus norvegicus
tgcatttctggctatcacttgtaac

SEQ ID NO: 619097 - DNA, 25 bp, Rattus norvegicus
tgcatttcttgtatggttagccttg

SEQ ID NO: 619098 - DNA, 25 bp, Rattus norvegicus
tgcatttcttgtttggttagccttg

SEQ ID NO: 619099 - DNA, 25 bp, Rattus norvegicus
tgcatttgcagaacagctctaccag

SEQ ID NO: 619100 - DNA, 25 bp, Rattus norvegicus
tgcatttgcagatcagctctaccag

SEQ ID NO: 619101 - DNA, 25 bp, Rattus norvegicus
tgcatttgcctaaacactctgtatc

SEQ ID NO: 619102 - DNA, 25 bp, Rattus norvegicus
tgcatttgcctatacactctgtatc

SEQ ID NO: 619103 - DNA, 25 bp, Rattus norvegicus
tgcatttgcgtgagtgttgtgtcca

SEQ ID NO: 619104 - DNA, 25 bp, Rattus norvegicus
tgcatttgcgtgtgtgttgtgtcca

SEQ ID NO: 619105 - DNA, 25 bp, Rattus norvegicus
tgcatttggattagtcagacttggt

SEQ ID NO: 619106 - DNA, 25 bp, Rattus norvegicus
tgcatttggatttgtcagacttggt

SEQ ID NO: 619107 - DNA, 25 bp, Rattus norvegicus
tgcatttgtcaaagaggtaatctca

SEQ ID NO: 619108 - DNA, 25 bp, Rattus norvegicus
tgcatttgtcaatgaggtaatctca

SEQ ID NO: 619109 - DNA, 25 bp, Rattus norvegicus
tgcatttgtgcccttttgcaggtta

SEQ ID NO: 619110 - DNA, 25 bp, Rattus norvegicus
tgcatttgtgccgttttgcaggtta

SEQ ID NO: 619111 - DNA, 25 bp, Rattus norvegicus
tgcattttaaccaaccaacacacac

SEQ ID NO: 619112 - DNA, 25 bp, Rattus norvegicus
tgcattttaacctaccaacacacac

SEQ ID NO: 619113 - DNA, 25 bp, Rattus norvegicus
tgcattttaatgctcgttttgcggg

SEQ ID NO: 619114 - DNA, 25 bp, Rattus norvegicus
tgcattttaatggtcgttttgcggg

SEQ ID NO: 619115 - DNA, 25 bp, Rattus norvegicus
tgcattttcattcggcagtacgcct

SEQ ID NO: 619116 - DNA, 25 bp, Rattus norvegicus
tgcattttcattgggcagtacgcct

SEQ ID NO: 619117 - DNA, 25 bp, Rattus norvegicus
tgcattttctaaattcaacctcggg

SEQ ID NO: 619118 - DNA, 25 bp, Rattus norvegicus
tgcattttctaatttcaacctcggg

SEQ ID NO: 619119 - DNA, 25 bp, Rattus norvegicus
tgcattttgcaaacccactaagcca

SEQ ID NO: 619120 - DNA, 25 bp, Rattus norvegicus
tgcattttgcaatcccactaagcca

SEQ ID NO: 619121 - DNA, 25 bp, Rattus norvegicus
tgcattttgcacagaacctgttggg

SEQ ID NO: 619122 - DNA, 25 bp, Rattus norvegicus
tgcattttgcactgaacctgttggg

SEQ ID NO: 619123 - DNA, 25 bp, Rattus norvegicus
tgcattttgtccatatcttcctccg

SEQ ID NO: 619124 - DNA, 25 bp, Rattus norvegicus
tgcattttgtccttatcttcctccg

SEQ ID NO: 619125 - DNA, 25 bp, Rattus norvegicus
tgcatttttaccattattgcctaat

SEQ ID NO: 619126 - DNA, 25 bp, Rattus norvegicus
tgcatttttacctttattgcctaat

SEQ ID NO: 619127 - DNA, 25 bp, Rattus norvegicus
tgcatttttcttccctcaatcacaa

SEQ ID NO: 619128 - DNA, 25 bp, Rattus norvegicus
tgcatttttcttgcctcaatcacaa

SEQ ID NO: 619129 - DNA, 25 bp, Rattus norvegicus
tgccaaacaaacacagccaattctc

SEQ ID NO: 619130 - DNA, 25 bp, Rattus norvegicus
tgccaaacaaactcagccaattctc

SEQ ID NO: 619131 - DNA, 25 bp, Rattus norvegicus
tgccaaacatttactttgtccaagt

SEQ ID NO: 619132 - DNA, 25 bp, Rattus norvegicus
tgccaaacattttctttgtccaagt

SEQ ID NO: 619133 - DNA, 25 bp, Rattus norvegicus
tgccaaactggacctgcagcaggga

SEQ ID NO: 619134 - DNA, 25 bp, Rattus norvegicus
tgccaaactggagctgcagcaggga

SEQ ID NO: 619135 - DNA, 25 bp, Rattus norvegicus
tgccaaagaatcatgaccctttccg

SEQ ID NO: 619136 - DNA, 25 bp, Rattus norvegicus
tgccaaagaatcttgaccctttccg

SEQ ID NO: 619137 - DNA, 25 bp, Rattus norvegicus
tgccaaagatgcaggtgtgccctgc

SEQ ID NO: 619138 - DNA, 25 bp, Rattus norvegicus
tgccaaagatgctggtgtgccctgc

SEQ ID NO: 619139 - DNA, 25 bp, Rattus norvegicus
tgccaaagcgagctgcacgagcgat

SEQ ID NO: 619140 - DNA, 25 bp, Rattus norvegicus
tgccaaagcgaggtgcacgagcgat

SEQ ID NO: 619141 - DNA, 25 bp, Rattus norvegicus
tgccaaagtcccagtgctcatggga

SEQ ID NO: 619142 - DNA, 25 bp, Rattus norvegicus
tgccaaagtccctgtgctcatggga

SEQ ID NO: 619143 - DNA, 25 bp, Rattus norvegicus
tgccaaatatgtctgcagccctggg

SEQ ID NO: 619144 - DNA, 25 bp, Rattus norvegicus
tgccaaatatgtgtgcagccctggg

SEQ ID NO: 619145 - DNA, 25 bp, Rattus norvegicus
tgccaaatgtgactccgcattcctt

SEQ ID NO: 619146 - DNA, 25 bp, Rattus norvegicus
tgccaaatgtgagtccgcattcctt

SEQ ID NO: 619147 - DNA, 25 bp, Rattus norvegicus
tgccaacaaaagctagacgtcagtg

SEQ ID NO: 619148 - DNA, 25 bp, Rattus norvegicus
tgccaacaaaaggtagacgtcagtg

SEQ ID NO: 619149 - DNA, 25 bp, Rattus norvegicus
tgccaacacagtcctgtctggtggc

SEQ ID NO: 619150 - DNA, 25 bp, Rattus norvegicus
tgccaacacagtgctgtctggtggc

SEQ ID NO: 619151 - DNA, 25 bp, Rattus norvegicus
tgccaacaccctatttctgtagagg

SEQ ID NO: 619152 - DNA, 25 bp, Rattus norvegicus
tgccaacaccctttttctgtagagg

SEQ ID NO: 619153 - DNA, 25 bp, Rattus norvegicus
tgccaacactcgactcttatgtgag

SEQ ID NO: 619154 - DNA, 25 bp, Rattus norvegicus
tgccaacactcgtctcttatgtgag

SEQ ID NO: 619155 - DNA, 25 bp, Rattus norvegicus
tgccaacagatgaccaaccacaagt

SEQ ID NO: 619156 - DNA, 25 bp, Rattus norvegicus
tgccaacagatgtccaaccacaagt

SEQ ID NO: 619157 - DNA, 25 bp, Rattus norvegicus
tgccaacaggttaacttcacaaata

SEQ ID NO: 619158 - DNA, 25 bp, Rattus norvegicus
tgccaacaggtttacttcacaaata

SEQ ID NO: 619159 - DNA, 25 bp, Rattus norvegicus
tgccaacatagacacctgacctttt

SEQ ID NO: 619160 - DNA, 25 bp, Rattus norvegicus
tgccaacatagagacctgacctttt

SEQ ID NO: 619161 - DNA, 25 bp, Rattus norvegicus
tgccaacatcgacagccctggaatt

SEQ ID NO: 619162 - DNA, 25 bp, Rattus norvegicus
tgccaacatcgagagccctggaatt

SEQ ID NO: 619163 - DNA, 25 bp, Rattus norvegicus
tgccaacattgtactccatttcagt

SEQ ID NO: 619164 - DNA, 25 bp, Rattus norvegicus
tgccaacattgttctccatttcagt

SEQ ID NO: 619165 - DNA, 25 bp, Rattus norvegicus
tgccaaccacgtctaccatgtgtag

SEQ ID NO: 619166 - DNA, 25 bp, Rattus norvegicus
tgccaaccacgtgtaccatgtgtag

SEQ ID NO: 619167 - DNA, 25 bp, Rattus norvegicus
tgccaaccatctagaactgtcatgc

SEQ ID NO: 619168 - DNA, 25 bp, Rattus norvegicus
tgccaaccatcttgaactgtcatgc

SEQ ID NO: 619169 - DNA, 25 bp, Rattus norvegicus
tgccaaccgatgctacgaccctgtg

SEQ ID NO: 619170 - DNA, 25 bp, Rattus norvegicus
tgccaaccgatggtacgaccctgtg

SEQ ID NO: 619171 - DNA, 25 bp, Rattus norvegicus
tgccaacctcctctaagatgttttg

SEQ ID NO: 619172 - DNA, 25 bp, Rattus norvegicus
tgccaacctcctgtaagatgttttg

SEQ ID NO: 619173 - DNA, 25 bp, Rattus norvegicus
tgccaacctcttacgtgcgcctttc

SEQ ID NO: 619174 - DNA, 25 bp, Rattus norvegicus
tgccaacctctttcgtgcgcctttc

SEQ ID NO: 619175 - DNA, 25 bp, Rattus norvegicus
tgccaacctgagattgaaggccaag

SEQ ID NO: 619176 - DNA, 25 bp, Rattus norvegicus
tgccaacctgagtttgaaggccaag

SEQ ID NO: 619177 - DNA, 25 bp, Rattus norvegicus
tgccaacctgtccttaagacacgat

SEQ ID NO: 619178 - DNA, 25 bp, Rattus norvegicus
tgccaacctgtcgttaagacacgat

SEQ ID NO: 619179 - DNA, 25 bp, Rattus norvegicus
tgccaacggtgcacctgtcggcttc

SEQ ID NO: 619180 - DNA, 25 bp, Rattus norvegicus
tgccaacggtgctcctgtcggcttc

SEQ ID NO: 619181 - DNA, 25 bp, Rattus norvegicus
tgccaactacatctgacaccttcaa

SEQ ID NO: 619182 - DNA, 25 bp, Rattus norvegicus
tgccaactacatgtgacaccttcaa

SEQ ID NO: 619183 - DNA, 25 bp, Rattus norvegicus
tgccaactatttagaggatgttgag

SEQ ID NO: 619184 - DNA, 25 bp, Rattus norvegicus
tgccaactattttgaggatgttgag

SEQ ID NO: 619185 - DNA, 25 bp, Rattus norvegicus
tgccaactcatgcagccgccgaagg

SEQ ID NO: 619186 - DNA, 25 bp, Rattus norvegicus
tgccaactcatggagccgccgaagg

SEQ ID NO: 619187 - DNA, 25 bp, Rattus norvegicus
tgccaactccatcgtcgtggtcgga

SEQ ID NO: 619188 - DNA, 25 bp, Rattus norvegicus
tgccaactccatggtcgtggtcgga

SEQ ID NO: 619189 - DNA, 25 bp, Rattus norvegicus
tgccaactctatcgtggtcgtagga

SEQ ID NO: 619190 - DNA, 25 bp, Rattus norvegicus
tgccaactctatggtggtcgtagga

SEQ ID NO: 619191 - DNA, 25 bp, Rattus norvegicus
tgccaactctgccagtggtaaaaac

SEQ ID NO: 619192 - DNA, 25 bp, Rattus norvegicus
tgccaactctgcgagtggtaaaaac

SEQ ID NO: 619193 - DNA, 25 bp, Rattus norvegicus
tgccaactgacgctccttagcagga

SEQ ID NO: 619194 - DNA, 25 bp, Rattus norvegicus
tgccaactgacggtccttagcagga

SEQ ID NO: 619195 - DNA, 25 bp, Rattus norvegicus
tgccaacttcagactttgtgtcctg

SEQ ID NO: 619196 - DNA, 25 bp, Rattus norvegicus
tgccaacttcagtctttgtgtcctg

SEQ ID NO: 619197 - DNA, 25 bp, Rattus norvegicus
tgccaagaagctaccacgtatctgg

SEQ ID NO: 619198 - DNA, 25 bp, Rattus norvegicus
tgccaagaagcttccacgtatctgg

SEQ ID NO: 619199 - DNA, 25 bp, Rattus norvegicus
tgccaagagccacactgcagtgaaa

SEQ ID NO: 619200 - DNA, 25 bp, Rattus norvegicus
tgccaagagccagactgcagtgaaa

SEQ ID NO: 619201 - DNA, 25 bp, Rattus norvegicus
tgccaagaggatccttcactctgag

SEQ ID NO: 619202 - DNA, 25 bp, Rattus norvegicus
tgccaagaggatgcttcactctgag

SEQ ID NO: 619203 - DNA, 25 bp, Rattus norvegicus
tgccaagagtcaatctgctcagctc

SEQ ID NO: 619204 - DNA, 25 bp, Rattus norvegicus
tgccaagagtcattctgctcagctc

SEQ ID NO: 619205 - DNA, 25 bp, Rattus norvegicus
tgccaagatcagagttccctcaaaa

SEQ ID NO: 619206 - DNA, 25 bp, Rattus norvegicus
tgccaagatcagtgttccctcaaaa

SEQ ID NO: 619207 - DNA, 25 bp, Rattus norvegicus
tgccaagattatcccaaagcctgtt

SEQ ID NO: 619208 - DNA, 25 bp, Rattus norvegicus
tgccaagattatgccaaagcctgtt

SEQ ID NO: 619209 - DNA, 25 bp, Rattus norvegicus
tgccaagcagcacagatccatgttc

SEQ ID NO: 619210 - DNA, 25 bp, Rattus norvegicus
tgccaagcagcagagatccatgttc

SEQ ID NO: 619211 - DNA, 25 bp, Rattus norvegicus
tgccaagccactataggtccttttt

SEQ ID NO: 619212 - DNA, 25 bp, Rattus norvegicus
tgccaagccactttaggtccttttt

SEQ ID NO: 619213 - DNA, 25 bp, Rattus norvegicus
tgccaagcccaaatcttcacggaga

SEQ ID NO: 619214 - DNA, 25 bp, Rattus norvegicus
tgccaagcccaattcttcacggaga

SEQ ID NO: 619215 - DNA, 25 bp, Rattus norvegicus
tgccaagcccaccttaactatgttt

SEQ ID NO: 619216 - DNA, 25 bp, Rattus norvegicus
tgccaagcccacgttaactatgttt

SEQ ID NO: 619217 - DNA, 25 bp, Rattus norvegicus
tgccaagcctccagcactgagggca

SEQ ID NO: 619218 - DNA, 25 bp, Rattus norvegicus
tgccaagcctcctgcactgagggca

SEQ ID NO: 619219 - DNA, 25 bp, Rattus norvegicus
tgccaagcgtgcctttgtgcactgg

SEQ ID NO: 619220 - DNA, 25 bp, Rattus norvegicus
tgccaagcgtgcgtttgtgcactgg

SEQ ID NO: 619221 - DNA, 25 bp, Rattus norvegicus
tgccaaggctctcagcgctctatag

SEQ ID NO: 619222 - DNA, 25 bp, Rattus norvegicus
tgccaaggctctgagcgctctatag

SEQ ID NO: 619223 - DNA, 25 bp, Rattus norvegicus
tgccaagggctcagaaggcctcata

SEQ ID NO: 619224 - DNA, 25 bp, Rattus norvegicus
tgccaagggctctgaaggcctcata

SEQ ID NO: 619225 - DNA, 25 bp, Rattus norvegicus
tgccaaggggataccgctgtgcgcc

SEQ ID NO: 619226 - DNA, 25 bp, Rattus norvegicus
tgccaaggggattccgctgtgcgcc

SEQ ID NO: 619227 - DNA, 25 bp, Rattus norvegicus
tgccaaggtccgctctggttgtaag

SEQ ID NO: 619228 - DNA, 25 bp, Rattus norvegicus
tgccaaggtccggtctggttgtaag

SEQ ID NO: 619229 - DNA, 25 bp, Rattus norvegicus
tgccaaggtgacaacgttcgtgtgc

SEQ ID NO: 619230 - DNA, 25 bp, Rattus norvegicus
tgccaaggtgactacgttcgtgtgc

SEQ ID NO: 619231 - DNA, 25 bp, Rattus norvegicus
tgccaaggttttaggcggcttccaa

SEQ ID NO: 619232 - DNA, 25 bp, Rattus norvegicus
tgccaaggtttttggcggcttccaa

SEQ ID NO: 619233 - DNA, 25 bp, Rattus norvegicus
tgccaagtatttactgctaatttat

SEQ ID NO: 619234 - DNA, 25 bp, Rattus norvegicus
tgccaagtattttctgctaatttat

SEQ ID NO: 619235 - DNA, 25 bp, Rattus norvegicus
tgccaagtccctcgatcacagtgat

SEQ ID NO: 619236 - DNA, 25 bp, Rattus norvegicus
tgccaagtccctggatcacagtgat

SEQ ID NO: 619237 - DNA, 25 bp, Rattus norvegicus
tgccaagtgaatccctttagtccca

SEQ ID NO: 619238 - DNA, 25 bp, Rattus norvegicus
tgccaagtgaatgcctttagtccca

SEQ ID NO: 619239 - DNA, 25 bp, Rattus norvegicus
tgccaagtgtcgcaaccgtcgacgt

SEQ ID NO: 619240 - DNA, 25 bp, Rattus norvegicus
tgccaagtgtcggaaccgtcgacgt

SEQ ID NO: 619241 - DNA, 25 bp, Rattus norvegicus
tgccaagtgtgcacacatacgtgtt

SEQ ID NO: 619242 - DNA, 25 bp, Rattus norvegicus
tgccaagtgtgccagttacttttct

SEQ ID NO: 619243 - DNA, 25 bp, Rattus norvegicus
tgccaagtgtgcgagttacttttct

SEQ ID NO: 619244 - DNA, 25 bp, Rattus norvegicus
tgccaagtgtgctcacatacgtgtt

SEQ ID NO: 619245 - DNA, 25 bp, Rattus norvegicus
tgccaagttctcagcgtacatcaag

SEQ ID NO: 619246 - DNA, 25 bp, Rattus norvegicus
tgccaagttctctgcgtacatcaag

SEQ ID NO: 619247 - DNA, 25 bp, Rattus norvegicus
tgccaatatctaactgtacaccctg

SEQ ID NO: 619248 - DNA, 25 bp, Rattus norvegicus
tgccaatatctatctgtacaccctg

SEQ ID NO: 619249 - DNA, 25 bp, Rattus norvegicus
tgccaatattctcttgctatcccaa

SEQ ID NO: 619250 - DNA, 25 bp, Rattus norvegicus
tgccaatattctgttgctatcccaa

SEQ ID NO: 619251 - DNA, 25 bp, Rattus norvegicus
tgccaatctattaatgccttacatt

SEQ ID NO: 619252 - DNA, 25 bp, Rattus norvegicus
tgccaatctatttatgccttacatt

SEQ ID NO: 619253 - DNA, 25 bp, Rattus norvegicus
tgccaatgccagcatggatactcgg

SEQ ID NO: 619254 - DNA, 25 bp, Rattus norvegicus
tgccaatgccaggatggatactcgg

SEQ ID NO: 619255 - DNA, 25 bp, Rattus norvegicus
tgccaatggccccagatgacaaatc

SEQ ID NO: 619256 - DNA, 25 bp, Rattus norvegicus
tgccaatggcccgagatgacaaatc

SEQ ID NO: 619257 - DNA, 25 bp, Rattus norvegicus
tgccaatgggtcagggcctcttctg

SEQ ID NO: 619258 - DNA, 25 bp, Rattus norvegicus
tgccaatgggtctgggcctcttctg

SEQ ID NO: 619259 - DNA, 25 bp, Rattus norvegicus
tgccaatgttgtctgttgcacttaa

SEQ ID NO: 619260 - DNA, 25 bp, Rattus norvegicus
tgccaatgttgtgtgttgcacttaa

SEQ ID NO: 619261 - DNA, 25 bp, Rattus norvegicus
tgccaattaatgatggatggtaacc

SEQ ID NO: 619262 - DNA, 25 bp, Rattus norvegicus
tgccaattaatgttggatggtaacc

SEQ ID NO: 619263 - DNA, 25 bp, Rattus norvegicus
tgccaattttgaccagttcctccag

SEQ ID NO: 619264 - DNA, 25 bp, Rattus norvegicus
tgccaattttgagcagttcctccag

SEQ ID NO: 619265 - DNA, 25 bp, Rattus norvegicus
tgccaattttgtattctgagctgaa

SEQ ID NO: 619266 - DNA, 25 bp, Rattus norvegicus
tgccaattttgttttctgagctgaa

SEQ ID NO: 619267 - DNA, 25 bp, Rattus norvegicus
tgccacaacctcatagacgctagaa

SEQ ID NO: 619268 - DNA, 25 bp, Rattus norvegicus
tgccacaacctcttagacgctagaa

SEQ ID NO: 619269 - DNA, 25 bp, Rattus norvegicus
tgccacaactggaaatgctcaagaa

SEQ ID NO: 619270 - DNA, 25 bp, Rattus norvegicus
tgccacaactggtaatgctcaagaa

SEQ ID NO: 619271 - DNA, 25 bp, Rattus norvegicus
tgccacaatgcaagaagactgaatt

SEQ ID NO: 619272 - DNA, 25 bp, Rattus norvegicus
tgccacaatgcatgaagactgaatt

SEQ ID NO: 619273 - DNA, 25 bp, Rattus norvegicus
tgccacacaaggcttctttccaaga

SEQ ID NO: 619274 - DNA, 25 bp, Rattus norvegicus
tgccacacaagggttctttccaaga

SEQ ID NO: 619275 - DNA, 25 bp, Rattus norvegicus
tgccacacagcaatgtacccagggt

SEQ ID NO: 619276 - DNA, 25 bp, Rattus norvegicus
tgccacacagcattgtacccagggt

SEQ ID NO: 619277 - DNA, 25 bp, Rattus norvegicus
tgccacacctggagctgagcagaga

SEQ ID NO: 619278 - DNA, 25 bp, Rattus norvegicus
tgccacacctggatctgtctgttgc

SEQ ID NO: 619279 - DNA, 25 bp, Rattus norvegicus
tgccacacctggtgctgagcagaga

SEQ ID NO: 619280 - DNA, 25 bp, Rattus norvegicus
tgccacacctggttctgtctgttgc

SEQ ID NO: 619281 - DNA, 25 bp, Rattus norvegicus
tgccacacggccctggtgtaaaggc

SEQ ID NO: 619282 - DNA, 25 bp, Rattus norvegicus
tgccacacggccgtggtgtaaaggc

SEQ ID NO: 619283 - DNA, 25 bp, Rattus norvegicus
tgccacacgtgcctttgatttggga

SEQ ID NO: 619284 - DNA, 25 bp, Rattus norvegicus
tgccacacgtgcgtttgatttggga

SEQ ID NO: 619285 - DNA, 25 bp, Rattus norvegicus
tgccacactcaccaaaactgaagct

SEQ ID NO: 619286 - DNA, 25 bp, Rattus norvegicus
tgccacactcacgaaaactgaagct

SEQ ID NO: 619287 - DNA, 25 bp, Rattus norvegicus
tgccacactcttctgttttgaggtt

SEQ ID NO: 619288 - DNA, 25 bp, Rattus norvegicus
tgccacactcttgtgttttgaggtt

SEQ ID NO: 619289 - DNA, 25 bp, Rattus norvegicus
tgccacactgttactccactgtttc

SEQ ID NO: 619290 - DNA, 25 bp, Rattus norvegicus
tgccacactgtttctccactgtttc

SEQ ID NO: 619291 - DNA, 25 bp, Rattus norvegicus
tgccacacttggaaggctccttgga

SEQ ID NO: 619292 - DNA, 25 bp, Rattus norvegicus
tgccacacttggtaggctccttgga

SEQ ID NO: 619293 - DNA, 25 bp, Rattus norvegicus
tgccacagaaaaccccagccatgat

SEQ ID NO: 619294 - DNA, 25 bp, Rattus norvegicus
tgccacagaaaagcccagccatgat

SEQ ID NO: 619295 - DNA, 25 bp, Rattus norvegicus
tgccacagcacacgaatactcagaa

SEQ ID NO: 619296 - DNA, 25 bp, Rattus norvegicus
tgccacagcacaggaatactcagaa

SEQ ID NO: 619297 - DNA, 25 bp, Rattus norvegicus
tgccacagccgaatgtataaactat

SEQ ID NO: 619298 - DNA, 25 bp, Rattus norvegicus
tgccacagccgattgtataaactat

SEQ ID NO: 619299 - DNA, 25 bp, Rattus norvegicus
tgccacagccgtcttcgggacgaga

SEQ ID NO: 619300 - DNA, 25 bp, Rattus norvegicus
tgccacagccgtgttcgggacgaga

SEQ ID NO: 619301 - DNA, 25 bp, Rattus norvegicus
tgccacagccttcagcggatcgaac

SEQ ID NO: 619302 - DNA, 25 bp, Rattus norvegicus
tgccacagccttgagcggatcgaac

SEQ ID NO: 619303 - DNA, 25 bp, Rattus norvegicus
tgccacaggcccagtggatcatgga

SEQ ID NO: 619304 - DNA, 25 bp, Rattus norvegicus
tgccacaggccctgtggatcatgga

SEQ ID NO: 619305 - DNA, 25 bp, Rattus norvegicus
tgccacaggtgacatgccaacttac

SEQ ID NO: 619306 - DNA, 25 bp, Rattus norvegicus
tgccacaggtgagatgccaacttac

SEQ ID NO: 619307 - DNA, 25 bp, Rattus norvegicus
tgccacatacacagtctcacattta

SEQ ID NO: 619308 - DNA, 25 bp, Rattus norvegicus
tgccacatacactgtctcacattta

SEQ ID NO: 619309 - DNA, 25 bp, Rattus norvegicus
tgccacatattcagtttcctgctgg

SEQ ID NO: 619310 - DNA, 25 bp, Rattus norvegicus
tgccacatattctgtttcctgctgg

SEQ ID NO: 619311 - DNA, 25 bp, Rattus norvegicus
tgccacatcctacactgaacgcagt

SEQ ID NO: 619312 - DNA, 25 bp, Rattus norvegicus
tgccacatcctagactgaacgcagt

SEQ ID NO: 619313 - DNA, 25 bp, Rattus norvegicus
tgccacatgcatatgccacatacat

SEQ ID NO: 619314 - DNA, 25 bp, Rattus norvegicus
tgccacatgcatttgccacatacat

SEQ ID NO: 619315 - DNA, 25 bp, Rattus norvegicus
tgccacatgcccagccaataattaa

SEQ ID NO: 619316 - DNA, 25 bp, Rattus norvegicus
tgccacatgccctgccaataattaa

SEQ ID NO: 619317 - DNA, 25 bp, Rattus norvegicus
tgccacatgcttctgtccctgggag

SEQ ID NO: 619318 - DNA, 25 bp, Rattus norvegicus
tgccacatgcttgtgtccctgggag

SEQ ID NO: 619319 - DNA, 25 bp, Rattus norvegicus
tgccacatggcgcaggaggaaactt

SEQ ID NO: 619320 - DNA, 25 bp, Rattus norvegicus
tgccacatggcggaggaggaaactt

SEQ ID NO: 619321 - DNA, 25 bp, Rattus norvegicus
tgccacatgggtcacattgatcctt

SEQ ID NO: 619322 - DNA, 25 bp, Rattus norvegicus
tgccacatgggtgacattgatcctt

SEQ ID NO: 619323 - DNA, 25 bp, Rattus norvegicus
tgccaccaacacacagaattacgct

SEQ ID NO: 619324 - DNA, 25 bp, Rattus norvegicus
tgccaccaacactcagaattacgct

SEQ ID NO: 619325 - DNA, 25 bp, Rattus norvegicus
tgccaccaagccaaacaagttgagt

SEQ ID NO: 619326 - DNA, 25 bp, Rattus norvegicus
tgccaccaagcctaacaagttgagt

SEQ ID NO: 619327 - DNA, 25 bp, Rattus norvegicus
tgccaccaaggcagaacacctgagt

SEQ ID NO: 619328 - DNA, 25 bp, Rattus norvegicus
tgccaccaaggctgaacacctgagt

SEQ ID NO: 619329 - DNA, 25 bp, Rattus norvegicus
tgccaccaattccagtctctaagaa

SEQ ID NO: 619330 - DNA, 25 bp, Rattus norvegicus
tgccaccaattcgagtctctaagaa

SEQ ID NO: 619331 - DNA, 25 bp, Rattus norvegicus
tgccaccacggactgacatggaagt

SEQ ID NO: 619332 - DNA, 25 bp, Rattus norvegicus
tgccaccacggagtgacatggaagt

SEQ ID NO: 619333 - DNA, 25 bp, Rattus norvegicus
tgccaccactccatagttgatgtga

SEQ ID NO: 619334 - DNA, 25 bp, Rattus norvegicus
tgccaccactccttagttgatgtga

SEQ ID NO: 619335 - DNA, 25 bp, Rattus norvegicus
tgccaccagaatctctaccatgtag

SEQ ID NO: 619336 - DNA, 25 bp, Rattus norvegicus
tgccaccagaatgtctaccatgtag

SEQ ID NO: 619337 - DNA, 25 bp, Rattus norvegicus
tgccaccagcacctgttttctgcag

SEQ ID NO: 619338 - DNA, 25 bp, Rattus norvegicus
tgccaccagcacgtgttttctgcag

SEQ ID NO: 619339 - DNA, 25 bp, Rattus norvegicus
tgccaccagcagactgtaagtcaaa

SEQ ID NO: 619340 - DNA, 25 bp, Rattus norvegicus
tgccaccagcagtctgtaagtcaaa

SEQ ID NO: 619341 - DNA, 25 bp, Rattus norvegicus
tgccaccagcgaagtcaagcgagga

SEQ ID NO: 619342 - DNA, 25 bp, Rattus norvegicus
tgccaccagcgatgtcaagcgagga

SEQ ID NO: 619343 - DNA, 25 bp, Rattus norvegicus
tgccaccagtggatgctgacagaaa

SEQ ID NO: 619344 - DNA, 25 bp, Rattus norvegicus
tgccaccagtggttgctgacagaaa

SEQ ID NO: 619345 - DNA, 25 bp, Rattus norvegicus
tgccaccatatcagggtgctaagaa

SEQ ID NO: 619346 - DNA, 25 bp, Rattus norvegicus
tgccaccatatctgggtgctaagaa

SEQ ID NO: 619347 - DNA, 25 bp, Rattus norvegicus
tgccaccatgtcaggtctgctagga

SEQ ID NO: 619348 - DNA, 25 bp, Rattus norvegicus
tgccaccatgtctggtctgctagga

SEQ ID NO: 619349 - DNA, 25 bp, Rattus norvegicus
tgccaccattaaacagctggagcaa

SEQ ID NO: 619350 - DNA, 25 bp, Rattus norvegicus
tgccaccattaatcagctggagcaa

SEQ ID NO: 619351 - DNA, 25 bp, Rattus norvegicus
tgccaccatttgatcttcattccat

SEQ ID NO: 619352 - DNA, 25 bp, Rattus norvegicus
tgccaccatttgttcttcattccat

SEQ ID NO: 619353 - DNA, 25 bp, Rattus norvegicus
tgccaccattttctactcgtgaggt

SEQ ID NO: 619354 - DNA, 25 bp, Rattus norvegicus
tgccaccattttgtactcgtgaggt

SEQ ID NO: 619355 - DNA, 25 bp, Rattus norvegicus
tgccacccactgatcagatttggag

SEQ ID NO: 619356 - DNA, 25 bp, Rattus norvegicus
tgccacccactgttcagatttggag

SEQ ID NO: 619357 - DNA, 25 bp, Rattus norvegicus
tgccacccagaaacccaaagattca

SEQ ID NO: 619358 - DNA, 25 bp, Rattus norvegicus
tgccacccagaaaggaaacttggaa

SEQ ID NO: 619359 - DNA, 25 bp, Rattus norvegicus
tgccacccagaatcccaaagattca

SEQ ID NO: 619360 - DNA, 25 bp, Rattus norvegicus
tgccacccagaatggaaacttggaa

SEQ ID NO: 619361 - DNA, 25 bp, Rattus norvegicus
tgccacccaggtactgattggaacg

SEQ ID NO: 619362 - DNA, 25 bp, Rattus norvegicus
tgccacccaggttctgattggaacg

SEQ ID NO: 619363 - DNA, 25 bp, Rattus norvegicus
tgccacccatatactgttgagctaa

SEQ ID NO: 619364 - DNA, 25 bp, Rattus norvegicus
tgccacccatattctgttgagctaa

SEQ ID NO: 619365 - DNA, 25 bp, Rattus norvegicus
tgccacccatttctgtcttggaggg

SEQ ID NO: 619366 - DNA, 25 bp, Rattus norvegicus
tgccacccatttgtgtcttggaggg

SEQ ID NO: 619367 - DNA, 25 bp, Rattus norvegicus
tgccaccccaaacctgtgcaagtga

SEQ ID NO: 619368 - DNA, 25 bp, Rattus norvegicus
tgccaccccaaagctgtgcaagtga

SEQ ID NO: 619369 - DNA, 25 bp, Rattus norvegicus
tgccaccctcagatcatgaattcaa

SEQ ID NO: 619370 - DNA, 25 bp, Rattus norvegicus
tgccaccctcagttcatgaattcaa

SEQ ID NO: 619371 - DNA, 25 bp, Rattus norvegicus
tgccaccctgcaagtatatgtttgt

SEQ ID NO: 619372 - DNA, 25 bp, Rattus norvegicus
tgccaccctgcatgtatatgtttgt

SEQ ID NO: 619373 - DNA, 25 bp, Rattus norvegicus
tgccacccttgacgaggtcctgtag

SEQ ID NO: 619374 - DNA, 25 bp, Rattus norvegicus
tgccacccttgaggaggtcctgtag

SEQ ID NO: 619375 - DNA, 25 bp, Rattus norvegicus
tgccaccctttcaggaagtctatgg

SEQ ID NO: 619376 - DNA, 25 bp, Rattus norvegicus
tgccaccctttctggaagtctatgg

SEQ ID NO: 619377 - DNA, 25 bp, Rattus norvegicus
tgccaccgaaccatctggaagcgga

SEQ ID NO: 619378 - DNA, 25 bp, Rattus norvegicus
tgccaccgaaccttctggaagcgga

SEQ ID NO: 619379 - DNA, 25 bp, Rattus norvegicus
tgccaccgatcaccatttactattg

SEQ ID NO: 619380 - DNA, 25 bp, Rattus norvegicus
tgccaccgatcagcatttactattg

SEQ ID NO: 619381 - DNA, 25 bp, Rattus norvegicus
tgccaccgggatattagcttttcta

SEQ ID NO: 619382 - DNA, 25 bp, Rattus norvegicus
tgccaccgggattttagcttttcta

SEQ ID NO: 619383 - DNA, 25 bp, Rattus norvegicus
tgccaccgtgtgagaccttgagaat

SEQ ID NO: 619384 - DNA, 25 bp, Rattus norvegicus
tgccaccgtgtgtgaccttgagaat

SEQ ID NO: 619385 - DNA, 25 bp, Rattus norvegicus
tgccacctaataatcttgcctttta

SEQ ID NO: 619386 - DNA, 25 bp, Rattus norvegicus
tgccacctaatattcttgcctttta

SEQ ID NO: 619387 - DNA, 25 bp, Rattus norvegicus
tgccacctcactatactgacataaa

SEQ ID NO: 619388 - DNA, 25 bp, Rattus norvegicus
tgccacctcactttactgacataaa

SEQ ID NO: 619389 - DNA, 25 bp, Rattus norvegicus
tgccacctctctagtatctctgctt

SEQ ID NO: 619390 - DNA, 25 bp, Rattus norvegicus
tgccacctctcttgtatctctgctt

SEQ ID NO: 619391 - DNA, 25 bp, Rattus norvegicus
tgccacctgctgctttgggtaattg

SEQ ID NO: 619392 - DNA, 25 bp, Rattus norvegicus
tgccacctgctggtttgggtaattg

SEQ ID NO: 619393 - DNA, 25 bp, Rattus norvegicus
tgccaccttatcctctgaagcaagt

SEQ ID NO: 619394 - DNA, 25 bp, Rattus norvegicus
tgccaccttatcgtctgaagcaagt

SEQ ID NO: 619395 - DNA, 25 bp, Rattus norvegicus
tgccacctttaacgtttgagcttaa

SEQ ID NO: 619396 - DNA, 25 bp, Rattus norvegicus
tgccacctttaaggtttgagcttaa

SEQ ID NO: 619397 - DNA, 25 bp, Rattus norvegicus
tgccacctttgcataagcctgcaga

SEQ ID NO: 619398 - DNA, 25 bp, Rattus norvegicus
tgccacctttgcttaagcctgcaga

SEQ ID NO: 619399 - DNA, 25 bp, Rattus norvegicus
tgccacgaagctaccatgagtccaa

SEQ ID NO: 619400 - DNA, 25 bp, Rattus norvegicus
tgccacgaagcttccatgagtccaa

SEQ ID NO: 619401 - DNA, 25 bp, Rattus norvegicus
tgccacgatgcccagcttgaaaatt

SEQ ID NO: 619402 - DNA, 25 bp, Rattus norvegicus
tgccacgatgccgagcttgaaaatt

SEQ ID NO: 619403 - DNA, 25 bp, Rattus norvegicus
tgccacgatgtgatcgctacgagaa

SEQ ID NO: 619404 - DNA, 25 bp, Rattus norvegicus
tgccacgatgtgttcgctacgagaa

SEQ ID NO: 619405 - DNA, 25 bp, Rattus norvegicus
tgccacgcaatgatttacacacctt

SEQ ID NO: 619406 - DNA, 25 bp, Rattus norvegicus
tgccacgcaatgttttacacacctt

SEQ ID NO: 619407 - DNA, 25 bp, Rattus norvegicus
tgccacgcatctacatgaagggcgc

SEQ ID NO: 619408 - DNA, 25 bp, Rattus norvegicus
tgccacgcatcttcatgaagggcgc

SEQ ID NO: 619409 - DNA, 25 bp, Rattus norvegicus
tgccacgcatggagtttcacagctg

SEQ ID NO: 619410 - DNA, 25 bp, Rattus norvegicus
tgccacgcatggtgtttcacagctg

SEQ ID NO: 619411 - DNA, 25 bp, Rattus norvegicus
tgccacgcgcacacttggattctta

SEQ ID NO: 619412 - DNA, 25 bp, Rattus norvegicus
tgccacgcgcactcttggattctta

SEQ ID NO: 619413 - DNA, 25 bp, Rattus norvegicus
tgccacgcggacacgagggacagca

SEQ ID NO: 619414 - DNA, 25 bp, Rattus norvegicus
tgccacgcggactcgagggacagca

SEQ ID NO: 619415 - DNA, 25 bp, Rattus norvegicus
tgccacgcttggcttcttgcctcaa

SEQ ID NO: 619416 - DNA, 25 bp, Rattus norvegicus
tgccacgcttgggttcttgcctcaa

SEQ ID NO: 619417 - DNA, 25 bp, Rattus norvegicus
tgccacggaaaactgaaccttttat

SEQ ID NO: 619418 - DNA, 25 bp, Rattus norvegicus
tgccacggaaaagtgaaccttttat

SEQ ID NO: 619419 - DNA, 25 bp, Rattus norvegicus
tgccacggcatacgacagtcacatt

SEQ ID NO: 619420 - DNA, 25 bp, Rattus norvegicus
tgccacggcataggacagtcacatt

SEQ ID NO: 619421 - DNA, 25 bp, Rattus norvegicus
tgccacgtaaccctgtcagtttaac

SEQ ID NO: 619422 - DNA, 25 bp, Rattus norvegicus
tgccacgtaaccgtgtcagtttaac

SEQ ID NO: 619423 - DNA, 25 bp, Rattus norvegicus
tgccacgtgacaaccaggtctgaag

SEQ ID NO: 619424 - DNA, 25 bp, Rattus norvegicus
tgccacgtgacatccaggtctgaag

SEQ ID NO: 619425 - DNA, 25 bp, Rattus norvegicus
tgccacgtgtgcacaacagtcgtgt

SEQ ID NO: 619426 - DNA, 25 bp, Rattus norvegicus
tgccacgtgtgctcaacagtcgtgt

SEQ ID NO: 619427 - DNA, 25 bp, Rattus norvegicus
tgccacgttgttatctctttattta

SEQ ID NO: 619428 - DNA, 25 bp, Rattus norvegicus
tgccacgttgttttctctttattta

SEQ ID NO: 619429 - DNA, 25 bp, Rattus norvegicus
tgccactaccaacgaagagaccttt

SEQ ID NO: 619430 - DNA, 25 bp, Rattus norvegicus
tgccactaccaaggaagagaccttt

SEQ ID NO: 619431 - DNA, 25 bp, Rattus norvegicus
tgccactactccatgatacatcagt

SEQ ID NO: 619432 - DNA, 25 bp, Rattus norvegicus
tgccactactccttgatacatcagt

SEQ ID NO: 619433 - DNA, 25 bp, Rattus norvegicus
tgccactatcttcgcgctcaggtgt

SEQ ID NO: 619434 - DNA, 25 bp, Rattus norvegicus
tgccactatcttggcgctcaggtgt

SEQ ID NO: 619435 - DNA, 25 bp, Rattus norvegicus
tgccactcactcagtgcctttaaaa

SEQ ID NO: 619436 - DNA, 25 bp, Rattus norvegicus
tgccactcactctgtgcctttaaaa

SEQ ID NO: 619437 - DNA, 25 bp, Rattus norvegicus
tgccactcacttatcctaattctag

SEQ ID NO: 619438 - DNA, 25 bp, Rattus norvegicus
tgccactcacttttcctaattctag

SEQ ID NO: 619439 - DNA, 25 bp, Rattus norvegicus
tgccactcagagcaatgaccaggat

SEQ ID NO: 619440 - DNA, 25 bp, Rattus norvegicus
tgccactcagaggaatgaccaggat

SEQ ID NO: 619441 - DNA, 25 bp, Rattus norvegicus
tgccactccattactgtacagttct

SEQ ID NO: 619442 - DNA, 25 bp, Rattus norvegicus
tgccactccatttctgtacagttct

SEQ ID NO: 619443 - DNA, 25 bp, Rattus norvegicus
tgccactcccagacgctgtgctatt

SEQ ID NO: 619444 - DNA, 25 bp, Rattus norvegicus
tgccactcccagtcgctgtgctatt

SEQ ID NO: 619445 - DNA, 25 bp, Rattus norvegicus
tgccactccctaattttgtccctaa

SEQ ID NO: 619446 - DNA, 25 bp, Rattus norvegicus
tgccactccctatttttgtccctaa

SEQ ID NO: 619447 - DNA, 25 bp, Rattus norvegicus
tgccactctctgctgactcttgagc

SEQ ID NO: 619448 - DNA, 25 bp, Rattus norvegicus
tgccactctctggtgactcttgagc

SEQ ID NO: 619449 - DNA, 25 bp, Rattus norvegicus
tgccactctgccctgggaggttaaa

SEQ ID NO: 619450 - DNA, 25 bp, Rattus norvegicus
tgccactctgccgtgggaggttaaa

SEQ ID NO: 619451 - DNA, 25 bp, Rattus norvegicus
tgccactctgttcttggccaggagt

SEQ ID NO: 619452 - DNA, 25 bp, Rattus norvegicus
tgccactctgttgttggccaggagt

SEQ ID NO: 619453 - DNA, 25 bp, Rattus norvegicus
tgccactcttgcagtaacagggctt

SEQ ID NO: 619454 - DNA, 25 bp, Rattus norvegicus
tgccactcttgctgtaacagggctt

SEQ ID NO: 619455 - DNA, 25 bp, Rattus norvegicus
tgccactgaactccttaggacgctg

SEQ ID NO: 619456 - DNA, 25 bp, Rattus norvegicus
tgccactgaactgcttaggacgctg

SEQ ID NO: 619457 - DNA, 25 bp, Rattus norvegicus
tgccactgaagcaatttggtcccat

SEQ ID NO: 619458 - DNA, 25 bp, Rattus norvegicus
tgccactgaagctatttggtcccat

SEQ ID NO: 619459 - DNA, 25 bp, Rattus norvegicus
tgccactgactaattctatccgaag

SEQ ID NO: 619460 - DNA, 25 bp, Rattus norvegicus
tgccactgactatttctatccgaag

SEQ ID NO: 619461 - DNA, 25 bp, Rattus norvegicus
tgccactgattaagccttcttgtag

SEQ ID NO: 619462 - DNA, 25 bp, Rattus norvegicus
tgccactgattatgccttcttgtag

SEQ ID NO: 619463 - DNA, 25 bp, Rattus norvegicus
tgccactgcaaacatgttgcctgga

SEQ ID NO: 619464 - DNA, 25 bp, Rattus norvegicus
tgccactgcaaagatgttgcctgga

SEQ ID NO: 619465 - DNA, 25 bp, Rattus norvegicus
tgccactgcaggacggagacactgt

SEQ ID NO: 619466 - DNA, 25 bp, Rattus norvegicus
tgccactgcaggtcggagacactgt

SEQ ID NO: 619467 - DNA, 25 bp, Rattus norvegicus
tgccactgcgtccatataaagctgt

SEQ ID NO: 619468 - DNA, 25 bp, Rattus norvegicus
tgccactgcgtcgatataaagctgt

SEQ ID NO: 619469 - DNA, 25 bp, Rattus norvegicus
tgccactgggtaatactgcctcata

SEQ ID NO: 619470 - DNA, 25 bp, Rattus norvegicus
tgccactgggtattactgcctcata

SEQ ID NO: 619471 - DNA, 25 bp, Rattus norvegicus
tgccactgtactactctacacagaa

SEQ ID NO: 619472 - DNA, 25 bp, Rattus norvegicus
tgccactgtacttctctacacagaa

SEQ ID NO: 619473 - DNA, 25 bp, Rattus norvegicus
tgccactgtagtatggtgatccctt

SEQ ID NO: 619474 - DNA, 25 bp, Rattus norvegicus
tgccactgtagtttggtgatccctt

SEQ ID NO: 619475 - DNA, 25 bp, Rattus norvegicus
tgccactgtcctcgctcagagagag

SEQ ID NO: 619476 - DNA, 25 bp, Rattus norvegicus
tgccactgtcctggctcagagagag

SEQ ID NO: 619477 - DNA, 25 bp, Rattus norvegicus
tgccactgtgaaacgggagcccaga

SEQ ID NO: 619478 - DNA, 25 bp, Rattus norvegicus
tgccactgtgaatcgggagcccaga

SEQ ID NO: 619479 - DNA, 25 bp, Rattus norvegicus
tgccactgtgtgattgccagcagag

SEQ ID NO: 619480 - DNA, 25 bp, Rattus norvegicus
tgccactgtgtgtttgccagcagag

SEQ ID NO: 619481 - DNA, 25 bp, Rattus norvegicus
tgccactgttgccagcccagttgct

SEQ ID NO: 619482 - DNA, 25 bp, Rattus norvegicus
tgccactgttgcgagcccagttgct

SEQ ID NO: 619483 - DNA, 25 bp, Rattus norvegicus
tgccacttaaagcactcttcctggt

SEQ ID NO: 619484 - DNA, 25 bp, Rattus norvegicus
tgccacttaaaggactcttcctggt

SEQ ID NO: 619485 - DNA, 25 bp, Rattus norvegicus
tgccacttcaccacacagggagaag

SEQ ID NO: 619486 - DNA, 25 bp, Rattus norvegicus
tgccacttcacctcacagggagaag

SEQ ID NO: 619487 - DNA, 25 bp, Rattus norvegicus
tgccacttcactccctattaagact

SEQ ID NO: 619488 - DNA, 25 bp, Rattus norvegicus
tgccacttcactgcctattaagact

SEQ ID NO: 619489 - DNA, 25 bp, Rattus norvegicus
tgccacttcatacctgacaaacctt

SEQ ID NO: 619490 - DNA, 25 bp, Rattus norvegicus
tgccacttcatagctgacaaacctt

SEQ ID NO: 619491 - DNA, 25 bp, Rattus norvegicus
tgccacttctagagccccttctggg

SEQ ID NO: 619492 - DNA, 25 bp, Rattus norvegicus
tgccacttctagtgccccttctggg

SEQ ID NO: 619493 - DNA, 25 bp, Rattus norvegicus
tgccacttcttgacttcctaatttg

SEQ ID NO: 619494 - DNA, 25 bp, Rattus norvegicus
tgccacttcttgtcttcctaatttg

SEQ ID NO: 619495 - DNA, 25 bp, Rattus norvegicus
tgccacttgaggcacggagagcctt

SEQ ID NO: 619496 - DNA, 25 bp, Rattus norvegicus
tgccacttgagggacggagagcctt

SEQ ID NO: 619497 - DNA, 25 bp, Rattus norvegicus
tgccacttgctgacacattcataaa

SEQ ID NO: 619498 - DNA, 25 bp, Rattus norvegicus
tgccacttgctgtcacattcataaa

SEQ ID NO: 619499 - DNA, 25 bp, Rattus norvegicus
tgccacttggcaatttcatttcaat

SEQ ID NO: 619500 - DNA, 25 bp, Rattus norvegicus
tgccacttggcattttcatttcaat

SEQ ID NO: 619501 - DNA, 25 bp, Rattus norvegicus
tgccacttggtcacttactgattta

SEQ ID NO: 619502 - DNA, 25 bp, Rattus norvegicus
tgccacttggtctcttactgattta

SEQ ID NO: 619503 - DNA, 25 bp, Rattus norvegicus
tgccacttgtagctgaattccatag

SEQ ID NO: 619504 - DNA, 25 bp, Rattus norvegicus
tgccacttgtaggtgaattccatag

SEQ ID NO: 619505 - DNA, 25 bp, Rattus norvegicus
tgccactttctcaaatgtgctggaa

SEQ ID NO: 619506 - DNA, 25 bp, Rattus norvegicus
tgccactttctctaatgtgctggaa

SEQ ID NO: 619507 - DNA, 25 bp, Rattus norvegicus
tgccactttgagagttcagcctagt

SEQ ID NO: 619508 - DNA, 25 bp, Rattus norvegicus
tgccactttgagtgttcagcctagt

SEQ ID NO: 619509 - DNA, 25 bp, Rattus norvegicus
tgccactttgtgctgccaaggattt

SEQ ID NO: 619510 - DNA, 25 bp, Rattus norvegicus
tgccactttgtggtgccaaggattt

SEQ ID NO: 619511 - DNA, 25 bp, Rattus norvegicus
tgccacttttgtcacacttaaccaa

SEQ ID NO: 619512 - DNA, 25 bp, Rattus norvegicus
tgccacttttgtgacacttaaccaa

SEQ ID NO: 619513 - DNA, 25 bp, Rattus norvegicus
tgccagaaagttcatctgcacccat

SEQ ID NO: 619514 - DNA, 25 bp, Rattus norvegicus
tgccagaaagttgatctgcacccat

SEQ ID NO: 619515 - DNA, 25 bp, Rattus norvegicus
tgccagaacatcacaggcgaccttt

SEQ ID NO: 619516 - DNA, 25 bp, Rattus norvegicus
tgccagaacatctcaggcgaccttt

SEQ ID NO: 619517 - DNA, 25 bp, Rattus norvegicus
tgccagaaccatacacaaacagctt

SEQ ID NO: 619518 - DNA, 25 bp, Rattus norvegicus
tgccagaaccattcacaaacagctt

SEQ ID NO: 619519 - DNA, 25 bp, Rattus norvegicus
tgccagaaccgcactttaagttttt

SEQ ID NO: 619520 - DNA, 25 bp, Rattus norvegicus
tgccagaaccgctctttaagttttt

SEQ ID NO: 619521 - DNA, 25 bp, Rattus norvegicus
tgccagaagcgcaccttgtcgggct

SEQ ID NO: 619522 - DNA, 25 bp, Rattus norvegicus
tgccagaagcgctccttgtcgggct

SEQ ID NO: 619523 - DNA, 25 bp, Rattus norvegicus
tgccagaagggtactgactgctctt

SEQ ID NO: 619524 - DNA, 25 bp, Rattus norvegicus
tgccagaagggttctgactgctctt

SEQ ID NO: 619525 - DNA, 25 bp, Rattus norvegicus
tgccagaagtcccatccagattgtg

SEQ ID NO: 619526 - DNA, 25 bp, Rattus norvegicus
tgccagaagtccgatccagattgtg

SEQ ID NO: 619527 - DNA, 25 bp, Rattus norvegicus
tgccagaatttcaaccaggcggccg

SEQ ID NO: 619528 - DNA, 25 bp, Rattus norvegicus
tgccagaatttctaccaggcggccg

SEQ ID NO: 619529 - DNA, 25 bp, Rattus norvegicus
tgccagacactaccatgcgctgaca

SEQ ID NO: 619530 - DNA, 25 bp, Rattus norvegicus
tgccagacactagcatgcgctgaca

SEQ ID NO: 619531 - DNA, 25 bp, Rattus norvegicus
tgccagaccaggacccaagagctga

SEQ ID NO: 619532 - DNA, 25 bp, Rattus norvegicus
tgccagaccaggtcccaagagctga

SEQ ID NO: 619533 - DNA, 25 bp, Rattus norvegicus
tgccagaccctcagaatatttctct

SEQ ID NO: 619534 - DNA, 25 bp, Rattus norvegicus
tgccagaccctctgaatatttctct

SEQ ID NO: 619535 - DNA, 25 bp, Rattus norvegicus
tgccagactcctcagcagatcacaa

SEQ ID NO: 619536 - DNA, 25 bp, Rattus norvegicus
tgccagactcctgagcagatcacaa

SEQ ID NO: 619537 - DNA, 25 bp, Rattus norvegicus
tgccagactcttcctcacaatatag

SEQ ID NO: 619538 - DNA, 25 bp, Rattus norvegicus
tgccagactcttgctcacaatatag

SEQ ID NO: 619539 - DNA, 25 bp, Rattus norvegicus
tgccagactggacggcttaacgagt

SEQ ID NO: 619540 - DNA, 25 bp, Rattus norvegicus
tgccagactggagggcttaacgagt

SEQ ID NO: 619541 - DNA, 25 bp, Rattus norvegicus
tgccagagactgatgccttcatata

SEQ ID NO: 619542 - DNA, 25 bp, Rattus norvegicus
tgccagagactgttgccttcatata

SEQ ID NO: 619543 - DNA, 25 bp, Rattus norvegicus
tgccagagattgcacggatctataa

SEQ ID NO: 619544 - DNA, 25 bp, Rattus norvegicus
tgccagagattggacggatctataa

SEQ ID NO: 619545 - DNA, 25 bp, Rattus norvegicus
tgccagagcattataaccccaagac

SEQ ID NO: 619546 - DNA, 25 bp, Rattus norvegicus
tgccagagcattttaaccccaagac

SEQ ID NO: 619547 - DNA, 25 bp, Rattus norvegicus
tgccagagccctccaattacagtgg

SEQ ID NO: 619548 - DNA, 25 bp, Rattus norvegicus
tgccagagccctgcaattacagtgg

SEQ ID NO: 619549 - DNA, 25 bp, Rattus norvegicus
tgccagaggccaatgcttctagttg

SEQ ID NO: 619550 - DNA, 25 bp, Rattus norvegicus
tgccagaggccattgcttctagttg

SEQ ID NO: 619551 - DNA, 25 bp, Rattus norvegicus
tgccagaggctacacaagaagattc

SEQ ID NO: 619552 - DNA, 25 bp, Rattus norvegicus
tgccagaggctagacaagaagattc

SEQ ID NO: 619553 - DNA, 25 bp, Rattus norvegicus
tgccagaggctgatcaccttggaga

SEQ ID NO: 619554 - DNA, 25 bp, Rattus norvegicus
tgccagaggctgttcaccttggaga

SEQ ID NO: 619555 - DNA, 25 bp, Rattus norvegicus
tgccagagtaagaaacccaccgaaa

SEQ ID NO: 619556 - DNA, 25 bp, Rattus norvegicus
tgccagagtaagtaacccaccgaaa

SEQ ID NO: 619557 - DNA, 25 bp, Rattus norvegicus
tgccagagtcaacccatgttacaag

SEQ ID NO: 619558 - DNA, 25 bp, Rattus norvegicus
tgccagagtcaagccatgttacaag

SEQ ID NO: 619559 - DNA, 25 bp, Rattus norvegicus
tgccagagtccaattccatagcttt

SEQ ID NO: 619560 - DNA, 25 bp, Rattus norvegicus
tgccagagtccatttccatagcttt

SEQ ID NO: 619561 - DNA, 25 bp, Rattus norvegicus
tgccagatactgagccgagtgtaac

SEQ ID NO: 619562 - DNA, 25 bp, Rattus norvegicus
tgccagatactgtgccgagtgtaac

SEQ ID NO: 619563 - DNA, 25 bp, Rattus norvegicus
tgccagatcactcataatttcccaa

SEQ ID NO: 619564 - DNA, 25 bp, Rattus norvegicus
tgccagatcactgataatttcccaa

SEQ ID NO: 619565 - DNA, 25 bp, Rattus norvegicus
tgccagatcatcattccacagaacc

SEQ ID NO: 619566 - DNA, 25 bp, Rattus norvegicus
tgccagatcatctttccacagaacc

SEQ ID NO: 619567 - DNA, 25 bp, Rattus norvegicus
tgccagatcggactcatcccaaatt

SEQ ID NO: 619568 - DNA, 25 bp, Rattus norvegicus
tgccagatcggagtcatcccaaatt

SEQ ID NO: 619569 - DNA, 25 bp, Rattus norvegicus
tgccagattactccatgctagcaca

SEQ ID NO: 619570 - DNA, 25 bp, Rattus norvegicus
tgccagattactgcatgctagcaca

SEQ ID NO: 619571 - DNA, 25 bp, Rattus norvegicus
tgccagatttatctcgtttgcccaa

SEQ ID NO: 619572 - DNA, 25 bp, Rattus norvegicus
tgccagatttatgtcgtttgcccaa

SEQ ID NO: 619573 - DNA, 25 bp, Rattus norvegicus
tgccagcaacggagccacatctgtt

SEQ ID NO: 619574 - DNA, 25 bp, Rattus norvegicus
tgccagcaacggtgccacatctgtt

SEQ ID NO: 619575 - DNA, 25 bp, Rattus norvegicus
tgccagcaactgaattaagcctctt

SEQ ID NO: 619576 - DNA, 25 bp, Rattus norvegicus
tgccagcaactgtattaagcctctt

SEQ ID NO: 619577 - DNA, 25 bp, Rattus norvegicus
tgccagcaatgtaagggccccaggt

SEQ ID NO: 619578 - DNA, 25 bp, Rattus norvegicus
tgccagcaatgttagggccccaggt

SEQ ID NO: 619579 - DNA, 25 bp, Rattus norvegicus
tgccagcacatcacttttcttactg

SEQ ID NO: 619580 - DNA, 25 bp, Rattus norvegicus
tgccagcacatctcttttcttactg

SEQ ID NO: 619581 - DNA, 25 bp, Rattus norvegicus
tgccagcacttcacattttgccttt

SEQ ID NO: 619582 - DNA, 25 bp, Rattus norvegicus
tgccagcacttctcattttgccttt

SEQ ID NO: 619583 - DNA, 25 bp, Rattus norvegicus
tgccagcagaagagtccaccaaaga

SEQ ID NO: 619584 - DNA, 25 bp, Rattus norvegicus
tgccagcagaagtgtccaccaaaga

SEQ ID NO: 619585 - DNA, 25 bp, Rattus norvegicus
tgccagcagaggagtcaggacatgt

SEQ ID NO: 619586 - DNA, 25 bp, Rattus norvegicus
tgccagcagaggtgtcaggacatgt

SEQ ID NO: 619587 - DNA, 25 bp, Rattus norvegicus
tgccagcaggccattaacttacatt

SEQ ID NO: 619588 - DNA, 25 bp, Rattus norvegicus
tgccagcaggcctttaacttacatt

SEQ ID NO: 619589 - DNA, 25 bp, Rattus norvegicus
tgccagcaggcgctcttccatgggc

SEQ ID NO: 619590 - DNA, 25 bp, Rattus norvegicus
tgccagcaggcggtcttccatgggc

SEQ ID NO: 619591 - DNA, 25 bp, Rattus norvegicus
tgccagcatcagatttgccgaagct

SEQ ID NO: 619592 - DNA, 25 bp, Rattus norvegicus
tgccagcatcagttttgccgaagct

SEQ ID NO: 619593 - DNA, 25 bp, Rattus norvegicus
tgccagccacttacctgcaagtaat

SEQ ID NO: 619594 - DNA, 25 bp, Rattus norvegicus
tgccagccactttcctgcaagtaat

SEQ ID NO: 619595 - DNA, 25 bp, Rattus norvegicus
tgccagccagtgaggatcactgatt

SEQ ID NO: 619596 - DNA, 25 bp, Rattus norvegicus
tgccagccagtgtggatcactgatt

SEQ ID NO: 619597 - DNA, 25 bp, Rattus norvegicus
tgccagccatcgagcactggagaag

SEQ ID NO: 619598 - DNA, 25 bp, Rattus norvegicus
tgccagccatcgtgcactggagaag

SEQ ID NO: 619599 - DNA, 25 bp, Rattus norvegicus
tgccagccatttacgccaaggacag

SEQ ID NO: 619600 - DNA, 25 bp, Rattus norvegicus
tgccagccattttcgccaaggacag

SEQ ID NO: 619601 - DNA, 25 bp, Rattus norvegicus
tgccagcccaacaagataacctaca

SEQ ID NO: 619602 - DNA, 25 bp, Rattus norvegicus
tgccagcccaactagataacctaca

SEQ ID NO: 619603 - DNA, 25 bp, Rattus norvegicus
tgccagcccagacgtcggaactgtc

SEQ ID NO: 619604 - DNA, 25 bp, Rattus norvegicus
tgccagcccagaggtcggaactgtc

SEQ ID NO: 619605 - DNA, 25 bp, Rattus norvegicus
tgccagcccatcctgaagacagtgg

SEQ ID NO: 619606 - DNA, 25 bp, Rattus norvegicus
tgccagcccatcgtgaagacagtgg

SEQ ID NO: 619607 - DNA, 25 bp, Rattus norvegicus
tgccagccccacaggttttaagtga

SEQ ID NO: 619608 - DNA, 25 bp, Rattus norvegicus
tgccagccccactggttttaagtga

SEQ ID NO: 619609 - DNA, 25 bp, Rattus norvegicus
tgccagccccagagatttgagtcaa

SEQ ID NO: 619610 - DNA, 25 bp, Rattus norvegicus
tgccagccccagcatcttaaattca

SEQ ID NO: 619611 - DNA, 25 bp, Rattus norvegicus
tgccagccccaggatcttaaattca

SEQ ID NO: 619612 - DNA, 25 bp, Rattus norvegicus
tgccagccccagtgatttgagtcaa

SEQ ID NO: 619613 - DNA, 25 bp, Rattus norvegicus
tgccagccctacagctgtagatagg

SEQ ID NO: 619614 - DNA, 25 bp, Rattus norvegicus
tgccagccctactgctgtagatagg

SEQ ID NO: 619615 - DNA, 25 bp, Rattus norvegicus
tgccagcctcggaatcagcttaatg

SEQ ID NO: 619616 - DNA, 25 bp, Rattus norvegicus
tgccagcctcggtatcagcttaatg

SEQ ID NO: 619617 - DNA, 25 bp, Rattus norvegicus
tgccagcctgcacgtggaccacagt

SEQ ID NO: 619618 - DNA, 25 bp, Rattus norvegicus
tgccagcctgcaggtggaccacagt

SEQ ID NO: 619619 - DNA, 25 bp, Rattus norvegicus
tgccagcctggtctcaaatgattgt

SEQ ID NO: 619620 - DNA, 25 bp, Rattus norvegicus
tgccagcctggtgtcaaatgattgt

SEQ ID NO: 619621 - DNA, 25 bp, Rattus norvegicus
tgccagcgatcgaccgtcttcacga

SEQ ID NO: 619622 - DNA, 25 bp, Rattus norvegicus
tgccagcgatcgtccgtcttcacga

SEQ ID NO: 619623 - DNA, 25 bp, Rattus norvegicus
tgccagcgcctgatggagcagagta

SEQ ID NO: 619624 - DNA, 25 bp, Rattus norvegicus
tgccagcgcctgttggagcagagta

SEQ ID NO: 619625 - DNA, 25 bp, Rattus norvegicus
tgccagcgcgcgagaagccgcatgc

SEQ ID NO: 619626 - DNA, 25 bp, Rattus norvegicus
tgccagcgcgcgtgaagccgcatgc

SEQ ID NO: 619627 - DNA, 25 bp, Rattus norvegicus
tgccagcgctggcatcacaaacaaa

SEQ ID NO: 619628 - DNA, 25 bp, Rattus norvegicus
tgccagcgctgggatcacaaacaaa

SEQ ID NO: 619629 - DNA, 25 bp, Rattus norvegicus
tgccagcggctcctggagatgcaca

SEQ ID NO: 619630 - DNA, 25 bp, Rattus norvegicus
tgccagcggctcgtggagatgcaca

SEQ ID NO: 619631 - DNA, 25 bp, Rattus norvegicus
tgccagcgggaaaaacaaacacatt

SEQ ID NO: 619632 - DNA, 25 bp, Rattus norvegicus
tgccagcgggaataacaaacacatt

SEQ ID NO: 619633 - DNA, 25 bp, Rattus norvegicus
tgccagctacacacaagagcattat

SEQ ID NO: 619634 - DNA, 25 bp, Rattus norvegicus
tgccagctacactcaagagcattat

SEQ ID NO: 619635 - DNA, 25 bp, Rattus norvegicus
tgccagctccggcatttctaaataa

SEQ ID NO: 619636 - DNA, 25 bp, Rattus norvegicus
tgccagctccgggatttctaaataa

SEQ ID NO: 619637 - DNA, 25 bp, Rattus norvegicus
tgccagctctccacggaagtcggaa

SEQ ID NO: 619638 - DNA, 25 bp, Rattus norvegicus
tgccagctctcctcggaagtcggaa

SEQ ID NO: 619639 - DNA, 25 bp, Rattus norvegicus
tgccaggaacccataggatcagagg

SEQ ID NO: 619640 - DNA, 25 bp, Rattus norvegicus
tgccaggaacccttaggatcagagg

SEQ ID NO: 619641 - DNA, 25 bp, Rattus norvegicus
tgccaggaactgcaatctgccttgt

SEQ ID NO: 619642 - DNA, 25 bp, Rattus norvegicus
tgccaggaactggaatctgccttgt

SEQ ID NO: 619643 - DNA, 25 bp, Rattus norvegicus
tgccaggacagacccagcttcaagg

SEQ ID NO: 619644 - DNA, 25 bp, Rattus norvegicus
tgccaggacagagccagcttcaagg

SEQ ID NO: 619645 - DNA, 25 bp, Rattus norvegicus
tgccaggagcccagagtgccaggta

SEQ ID NO: 619646 - DNA, 25 bp, Rattus norvegicus
tgccaggagccctgagtgccaggta

SEQ ID NO: 619647 - DNA, 25 bp, Rattus norvegicus
tgccaggatagcacattgggcccca

SEQ ID NO: 619648 - DNA, 25 bp, Rattus norvegicus
tgccaggatagctcattgggcccca

SEQ ID NO: 619649 - DNA, 25 bp, Rattus norvegicus
tgccaggatgccatgcgcaccggct

SEQ ID NO: 619650 - DNA, 25 bp, Rattus norvegicus
tgccaggatgcccatggttcacaag

SEQ ID NO: 619651 - DNA, 25 bp, Rattus norvegicus
tgccaggatgccgatggttcacaag

SEQ ID NO: 619652 - DNA, 25 bp, Rattus norvegicus
tgccaggatgccttgcgcaccggct

SEQ ID NO: 619653 - DNA, 25 bp, Rattus norvegicus
tgccaggattcaatcagctctttca

SEQ ID NO: 619654 - DNA, 25 bp, Rattus norvegicus
tgccaggattcattcagctctttca

SEQ ID NO: 619655 - DNA, 25 bp, Rattus norvegicus
tgccaggcacagcatcgggagtttc

SEQ ID NO: 619656 - DNA, 25 bp, Rattus norvegicus
tgccaggcacaggatcgggagtttc

SEQ ID NO: 619657 - DNA, 25 bp, Rattus norvegicus
tgccaggcagcccaaggacagtatg

SEQ ID NO: 619658 - DNA, 25 bp, Rattus norvegicus
tgccaggcagccgaaggacagtatg

SEQ ID NO: 619659 - DNA, 25 bp, Rattus norvegicus
tgccaggcatcacagatcccagaag

SEQ ID NO: 619660 - DNA, 25 bp, Rattus norvegicus
tgccaggcatcagagatcccagaag

SEQ ID NO: 619661 - DNA, 25 bp, Rattus norvegicus
tgccaggcctagaaacagttctttg

SEQ ID NO: 619662 - DNA, 25 bp, Rattus norvegicus
tgccaggcctagtaacagttctttg

SEQ ID NO: 619663 - DNA, 25 bp, Rattus norvegicus
tgccaggcctttctatttcaacttt

SEQ ID NO: 619664 - DNA, 25 bp, Rattus norvegicus
tgccaggcctttgtatttcaacttt

SEQ ID NO: 619665 - DNA, 25 bp, Rattus norvegicus
tgccaggcgctacacatgtacagag

SEQ ID NO: 619666 - DNA, 25 bp, Rattus norvegicus
tgccaggcgctagacatgtacagag

SEQ ID NO: 619667 - DNA, 25 bp, Rattus norvegicus
tgccaggctccaccaggatgaggat

SEQ ID NO: 619668 - DNA, 25 bp, Rattus norvegicus
tgccaggctccagcaggatgaggat

SEQ ID NO: 619669 - DNA, 25 bp, Rattus norvegicus
tgccaggctcccactagttgacagt

SEQ ID NO: 619670 - DNA, 25 bp, Rattus norvegicus
tgccaggctccctctagttgacagt

SEQ ID NO: 619671 - DNA, 25 bp, Rattus norvegicus
tgccaggctcggctttggctgaagc

SEQ ID NO: 619672 - DNA, 25 bp, Rattus norvegicus
tgccaggctcgggtttggctgaagc

SEQ ID NO: 619673 - DNA, 25 bp, Rattus norvegicus
tgccaggctcttcattttaaacatc

SEQ ID NO: 619674 - DNA, 25 bp, Rattus norvegicus
tgccaggctcttgattttaaacatc

SEQ ID NO: 619675 - DNA, 25 bp, Rattus norvegicus
tgccagggccagactttacaggctg

SEQ ID NO: 619676 - DNA, 25 bp, Rattus norvegicus
tgccagggccagtctttacaggctg

SEQ ID NO: 619677 - DNA, 25 bp, Rattus norvegicus
tgccagggcccaagttaggaagctt

SEQ ID NO: 619678 - DNA, 25 bp, Rattus norvegicus
tgccagggcccatgttaggaagctt

SEQ ID NO: 619679 - DNA, 25 bp, Rattus norvegicus
tgccagggccgaactcatcaacatc

SEQ ID NO: 619680 - DNA, 25 bp, Rattus norvegicus
tgccagggccgatctcatcaacatc

SEQ ID NO: 619681 - DNA, 25 bp, Rattus norvegicus
tgccagggcgagatctcaggtgtct

SEQ ID NO: 619682 - DNA, 25 bp, Rattus norvegicus
tgccagggcgagttctcaggtgtct

SEQ ID NO: 619683 - DNA, 25 bp, Rattus norvegicus
tgccagggctcaaagtggacctcag

SEQ ID NO: 619684 - DNA, 25 bp, Rattus norvegicus
tgccagggctcatagtggacctcag

SEQ ID NO: 619685 - DNA, 25 bp, Rattus norvegicus
tgccagggtgaaaagcatctaccat

SEQ ID NO: 619686 - DNA, 25 bp, Rattus norvegicus
tgccagggtgaatagcatctaccat

SEQ ID NO: 619687 - DNA, 25 bp, Rattus norvegicus
tgccaggtccgcagcttgagagcaa

SEQ ID NO: 619688 - DNA, 25 bp, Rattus norvegicus
tgccaggtccgctgcttgagagcaa

SEQ ID NO: 619689 - DNA, 25 bp, Rattus norvegicus
tgccaggtctgcctacagtcagaga

SEQ ID NO: 619690 - DNA, 25 bp, Rattus norvegicus
tgccaggtctgcgtacagtcagaga

SEQ ID NO: 619691 - DNA, 25 bp, Rattus norvegicus
tgccaggtgcaacaatttctttttt

SEQ ID NO: 619692 - DNA, 25 bp, Rattus norvegicus
tgccaggtgcaagaatttctttttt

SEQ ID NO: 619693 - DNA, 25 bp, Rattus norvegicus
tgccaggtgtgaactctccaggaca

SEQ ID NO: 619694 - DNA, 25 bp, Rattus norvegicus
tgccaggtgtgatctctccaggaca

SEQ ID NO: 619695 - DNA, 25 bp, Rattus norvegicus
tgccaggtgtgcaccgactctgcca

SEQ ID NO: 619696 - DNA, 25 bp, Rattus norvegicus
tgccaggtgtgctccgactctgcca

SEQ ID NO: 619697 - DNA, 25 bp, Rattus norvegicus
tgccaggttccgagggttacagtaa

SEQ ID NO: 619698 - DNA, 25 bp, Rattus norvegicus
tgccaggttccgtgggttacagtaa

SEQ ID NO: 619699 - DNA, 25 bp, Rattus norvegicus
tgccagtcaaatctgcctgcttact

SEQ ID NO: 619700 - DNA, 25 bp, Rattus norvegicus
tgccagtcaaatgtgcctgcttact

SEQ ID NO: 619701 - DNA, 25 bp, Rattus norvegicus
tgccagtcacatccttctgataaca

SEQ ID NO: 619702 - DNA, 25 bp, Rattus norvegicus
tgccagtcacatgcttctgataaca

SEQ ID NO: 619703 - DNA, 25 bp, Rattus norvegicus
tgccagtcagagctccagcagcctt

SEQ ID NO: 619704 - DNA, 25 bp, Rattus norvegicus
tgccagtcagaggtccagcagcctt

SEQ ID NO: 619705 - DNA, 25 bp, Rattus norvegicus
tgccagtccccaagtatgactcaga

SEQ ID NO: 619706 - DNA, 25 bp, Rattus norvegicus
tgccagtccccatgtatgactcaga

SEQ ID NO: 619707 - DNA, 25 bp, Rattus norvegicus
tgccagtccttaatcagagtctttg

SEQ ID NO: 619708 - DNA, 25 bp, Rattus norvegicus
tgccagtccttattcagagtctttg

SEQ ID NO: 619709 - DNA, 25 bp, Rattus norvegicus
tgccagtcggctaccgcgaaaacga

SEQ ID NO: 619710 - DNA, 25 bp, Rattus norvegicus
tgccagtcggcttccgcgaaaacga

SEQ ID NO: 619711 - DNA, 25 bp, Rattus norvegicus
tgccagtcgggcctccaggctaaat

SEQ ID NO: 619712 - DNA, 25 bp, Rattus norvegicus
tgccagtcgggcgtccaggctaaat

SEQ ID NO: 619713 - DNA, 25 bp, Rattus norvegicus
tgccagtctccaaaaaccctgattt

SEQ ID NO: 619714 - DNA, 25 bp, Rattus norvegicus
tgccagtctccataaaccctgattt

SEQ ID NO: 619715 - DNA, 25 bp, Rattus norvegicus
tgccagtgaacccagttgccagaaa

SEQ ID NO: 619716 - DNA, 25 bp, Rattus norvegicus
tgccagtgaaccgagttgccagaaa

SEQ ID NO: 619717 - DNA, 25 bp, Rattus norvegicus
tgccagtgaatgacgctgaactctt

SEQ ID NO: 619718 - DNA, 25 bp, Rattus norvegicus
tgccagtgaatgtcgctgaactctt

SEQ ID NO: 619719 - DNA, 25 bp, Rattus norvegicus
tgccagtgagacctaccagcgaata

SEQ ID NO: 619720 - DNA, 25 bp, Rattus norvegicus
tgccagtgagacgtaccagcgaata

SEQ ID NO: 619721 - DNA, 25 bp, Rattus norvegicus
tgccagtgagctccaaatccacaaa

SEQ ID NO: 619722 - DNA, 25 bp, Rattus norvegicus
tgccagtgagctgcaaatccacaaa

SEQ ID NO: 619723 - DNA, 25 bp, Rattus norvegicus
tgccagtgattgatgtccttggagc

SEQ ID NO: 619724 - DNA, 25 bp, Rattus norvegicus
tgccagtgattgttgtccttggagc

SEQ ID NO: 619725 - DNA, 25 bp, Rattus norvegicus
tgccagtgccagacaaccagttgag

SEQ ID NO: 619726 - DNA, 25 bp, Rattus norvegicus
tgccagtgccagtcaaccagttgag

SEQ ID NO: 619727 - DNA, 25 bp, Rattus norvegicus
tgccagtgccgtatcttcggcagcg

SEQ ID NO: 619728 - DNA, 25 bp, Rattus norvegicus
tgccagtgccgtttcttcggcagcg

SEQ ID NO: 619729 - DNA, 25 bp, Rattus norvegicus
tgccagtgccttagctcagccgtaa

SEQ ID NO: 619730 - DNA, 25 bp, Rattus norvegicus
tgccagtgcctttgctcagccgtaa

SEQ ID NO: 619731 - DNA, 25 bp, Rattus norvegicus
tgccagtgctcgactttgctaacaa

SEQ ID NO: 619732 - DNA, 25 bp, Rattus norvegicus
tgccagtgctcgtctttgctaacaa

SEQ ID NO: 619733 - DNA, 25 bp, Rattus norvegicus
tgccagtgtcaacagagcccatgct

SEQ ID NO: 619734 - DNA, 25 bp, Rattus norvegicus
tgccagtgtcaagagagcccatgct

SEQ ID NO: 619735 - DNA, 25 bp, Rattus norvegicus
tgccagtgtctactggagctgtcca

SEQ ID NO: 619736 - DNA, 25 bp, Rattus norvegicus
tgccagtgtctagtggagctgtcca

SEQ ID NO: 619737 - DNA, 25 bp, Rattus norvegicus
tgccagtgtgatatgtgccgtctct

SEQ ID NO: 619738 - DNA, 25 bp, Rattus norvegicus
tgccagtgtgatttgtgccgtctct

SEQ ID NO: 619739 - DNA, 25 bp, Rattus norvegicus
tgccagtgtgtcatccttctgaggg

SEQ ID NO: 619740 - DNA, 25 bp, Rattus norvegicus
tgccagtgtgtcttccttctgaggg

SEQ ID NO: 619741 - DNA, 25 bp, Rattus norvegicus
tgccagttaccaaaggctgttttaa

SEQ ID NO: 619742 - DNA, 25 bp, Rattus norvegicus
tgccagttaccataggctgttttaa

SEQ ID NO: 619743 - DNA, 25 bp, Rattus norvegicus
tgccagttacttagtgtcttcgatt

SEQ ID NO: 619744 - DNA, 25 bp, Rattus norvegicus
tgccagttactttgtgtcttcgatt

SEQ ID NO: 619745 - DNA, 25 bp, Rattus norvegicus
tgccagttagttactcctgtgtccc

SEQ ID NO: 619746 - DNA, 25 bp, Rattus norvegicus
tgccagttagtttctcctgtgtccc

SEQ ID NO: 619747 - DNA, 25 bp, Rattus norvegicus
tgccagttatccatagggtgccttg

SEQ ID NO: 619748 - DNA, 25 bp, Rattus norvegicus
tgccagttatccttagggtgccttg

SEQ ID NO: 619749 - DNA, 25 bp, Rattus norvegicus
tgccagttcctgctacggtcaaaag

SEQ ID NO: 619750 - DNA, 25 bp, Rattus norvegicus
tgccagttcctggtacggtcaaaag

SEQ ID NO: 619751 - DNA, 25 bp, Rattus norvegicus
tgccagttccttaatgctcctgtaa

SEQ ID NO: 619752 - DNA, 25 bp, Rattus norvegicus
tgccagttcctttatgctcctgtaa

SEQ ID NO: 619753 - DNA, 25 bp, Rattus norvegicus
tgccagttgaccagagtccacagaa

SEQ ID NO: 619754 - DNA, 25 bp, Rattus norvegicus
tgccagttgacctgagtccacagaa

SEQ ID NO: 619755 - DNA, 25 bp, Rattus norvegicus
tgccagttgcttcatcttgggtaat

SEQ ID NO: 619756 - DNA, 25 bp, Rattus norvegicus
tgccagttgcttgatcttgggtaat

SEQ ID NO: 619757 - DNA, 25 bp, Rattus norvegicus
tgccagtttaagcaagccggtgaaa

SEQ ID NO: 619758 - DNA, 25 bp, Rattus norvegicus
tgccagtttaagccaaccctttcca

SEQ ID NO: 619759 - DNA, 25 bp, Rattus norvegicus
tgccagtttaaggaagccggtgaaa

SEQ ID NO: 619760 - DNA, 25 bp, Rattus norvegicus
tgccagtttaaggcaaccctttcca

SEQ ID NO: 619761 - DNA, 25 bp, Rattus norvegicus
tgccagtttgaaaccttctgtaagt

SEQ ID NO: 619762 - DNA, 25 bp, Rattus norvegicus
tgccagtttgaatccttctgtaagt

SEQ ID NO: 619763 - DNA, 25 bp, Rattus norvegicus
tgccagtttggccttcctgcagagg

SEQ ID NO: 619764 - DNA, 25 bp, Rattus norvegicus
tgccagtttggcgttcctgcagagg

SEQ ID NO: 619765 - DNA, 25 bp, Rattus norvegicus
tgccataatcttctaaccttcaaca

SEQ ID NO: 619766 - DNA, 25 bp, Rattus norvegicus
tgccataatcttgtaaccttcaaca

SEQ ID NO: 619767 - DNA, 25 bp, Rattus norvegicus
tgccataatggtcgcccggcttatc

SEQ ID NO: 619768 - DNA, 25 bp, Rattus norvegicus
tgccataatggtggcccggcttatc

SEQ ID NO: 619769 - DNA, 25 bp, Rattus norvegicus
tgccatacagacactttcttggaac

SEQ ID NO: 619770 - DNA, 25 bp, Rattus norvegicus
tgccatacagactctttcttggaac

SEQ ID NO: 619771 - DNA, 25 bp, Rattus norvegicus
tgccatatgcaaccacagacagtaa

SEQ ID NO: 619772 - DNA, 25 bp, Rattus norvegicus
tgccatatgcaagcacagacagtaa

SEQ ID NO: 619773 - DNA, 25 bp, Rattus norvegicus
tgccatatggcccagcagaactgag

SEQ ID NO: 619774 - DNA, 25 bp, Rattus norvegicus
tgccatatggccgagcagaactgag

SEQ ID NO: 619775 - DNA, 25 bp, Rattus norvegicus
tgccatcaaaccagagcctcgatat

SEQ ID NO: 619776 - DNA, 25 bp, Rattus norvegicus
tgccatcaaacctgagcctcgatat

SEQ ID NO: 619777 - DNA, 25 bp, Rattus norvegicus
tgccatcaaactcagggagccgctg

SEQ ID NO: 619778 - DNA, 25 bp, Rattus norvegicus
tgccatcaaactgagggagccgctg

SEQ ID NO: 619779 - DNA, 25 bp, Rattus norvegicus
tgccatcaacgacgtggtgacccga

SEQ ID NO: 619780 - DNA, 25 bp, Rattus norvegicus
tgccatcaacgaggtggtgacccga

SEQ ID NO: 619781 - DNA, 25 bp, Rattus norvegicus
tgccatcaacgtctaggagcctaga

SEQ ID NO: 619782 - DNA, 25 bp, Rattus norvegicus
tgccatcaacgtgtaggagcctaga

SEQ ID NO: 619783 - DNA, 25 bp, Rattus norvegicus
tgccatcaactccatgttggatcag

SEQ ID NO: 619784 - DNA, 25 bp, Rattus norvegicus
tgccatcaactcgatgttggatcag

SEQ ID NO: 619785 - DNA, 25 bp, Rattus norvegicus
tgccatcaaggcactccctaattat

SEQ ID NO: 619786 - DNA, 25 bp, Rattus norvegicus
tgccatcaaggctctccctaattat

SEQ ID NO: 619787 - DNA, 25 bp, Rattus norvegicus
tgccatcaatggcaacccatcctgg

SEQ ID NO: 619788 - DNA, 25 bp, Rattus norvegicus
tgccatcaatgggaacccatcctgg

SEQ ID NO: 619789 - DNA, 25 bp, Rattus norvegicus
tgccatcacactccttgtcagagaa

SEQ ID NO: 619790 - DNA, 25 bp, Rattus norvegicus
tgccatcacactgcttgtcagagaa

SEQ ID NO: 619791 - DNA, 25 bp, Rattus norvegicus
tgccatcaccatacagccattattg

SEQ ID NO: 619792 - DNA, 25 bp, Rattus norvegicus
tgccatcaccattcagccattattg

SEQ ID NO: 619793 - DNA, 25 bp, Rattus norvegicus
tgccatcaccctcaaggccattaat

SEQ ID NO: 619794 - DNA, 25 bp, Rattus norvegicus
tgccatcaccctgaaggccattaat

SEQ ID NO: 619795 - DNA, 25 bp, Rattus norvegicus
tgccatcaggcaactgttcatagaa

SEQ ID NO: 619796 - DNA, 25 bp, Rattus norvegicus
tgccatcaggcatctgttcatagaa

SEQ ID NO: 619797 - DNA, 25 bp, Rattus norvegicus
tgccatccaaatacaagccttactc

SEQ ID NO: 619798 - DNA, 25 bp, Rattus norvegicus
tgccatccaaattcaagccttactc

SEQ ID NO: 619799 - DNA, 25 bp, Rattus norvegicus
tgccatccagagccagaccacatgg

SEQ ID NO: 619800 - DNA, 25 bp, Rattus norvegicus
tgccatccagaggcagaccacatgg

SEQ ID NO: 619801 - DNA, 25 bp, Rattus norvegicus
tgccatccatggagtgttaagcctt

SEQ ID NO: 619802 - DNA, 25 bp, Rattus norvegicus
tgccatccatggtgtgttaagcctt

SEQ ID NO: 619803 - DNA, 25 bp, Rattus norvegicus
tgccatcccagcaggccggaaagag

SEQ ID NO: 619804 - DNA, 25 bp, Rattus norvegicus
tgccatcccagctggccggaaagag

SEQ ID NO: 619805 - DNA, 25 bp, Rattus norvegicus
tgccatccccgtatactagtctctt

SEQ ID NO: 619806 - DNA, 25 bp, Rattus norvegicus
tgccatccccgtttactagtctctt

SEQ ID NO: 619807 - DNA, 25 bp, Rattus norvegicus
tgccatccctctaaactgtgcagga

SEQ ID NO: 619808 - DNA, 25 bp, Rattus norvegicus
tgccatccctcttaactgtgcagga

SEQ ID NO: 619809 - DNA, 25 bp, Rattus norvegicus
tgccatccctgcatggaaagagctg

SEQ ID NO: 619810 - DNA, 25 bp, Rattus norvegicus
tgccatccctgcttggaaagagctg

SEQ ID NO: 619811 - DNA, 25 bp, Rattus norvegicus
tgccatccctggcagctgagcagga

SEQ ID NO: 619812 - DNA, 25 bp, Rattus norvegicus
tgccatccctgggagctgagcagga

SEQ ID NO: 619813 - DNA, 25 bp, Rattus norvegicus
tgccatccctttcgtttgttcggtt

SEQ ID NO: 619814 - DNA, 25 bp, Rattus norvegicus
tgccatccctttggtttgttcggtt

SEQ ID NO: 619815 - DNA, 25 bp, Rattus norvegicus
tgccatccggacagagtgagatctt

SEQ ID NO: 619816 - DNA, 25 bp, Rattus norvegicus
tgccatccggactgagtgagatctt

SEQ ID NO: 619817 - DNA, 25 bp, Rattus norvegicus
tgccatcctgaaccgtctgtgtgtg

SEQ ID NO: 619818 - DNA, 25 bp, Rattus norvegicus
tgccatcctgaagcgtctgtgtgtg

SEQ ID NO: 619819 - DNA, 25 bp, Rattus norvegicus
tgccatcctgcaactgggaagttgt

SEQ ID NO: 619820 - DNA, 25 bp, Rattus norvegicus
tgccatcctgcatctgggaagttgt

SEQ ID NO: 619821 - DNA, 25 bp, Rattus norvegicus
tgccatccttagcagagtgtcagtc

SEQ ID NO: 619822 - DNA, 25 bp, Rattus norvegicus
tgccatccttaggagagtgtcagtc

SEQ ID NO: 619823 - DNA, 25 bp, Rattus norvegicus
tgccatccttctagcttactaaggt

SEQ ID NO: 619824 - DNA, 25 bp, Rattus norvegicus
tgccatccttcttgcttactaaggt

SEQ ID NO: 619825 - DNA, 25 bp, Rattus norvegicus
tgccatcgcctccaaagacagtggt

SEQ ID NO: 619826 - DNA, 25 bp, Rattus norvegicus
tgccatcgcctcgaaagacagtggt

SEQ ID NO: 619827 - DNA, 25 bp, Rattus norvegicus
tgccatcgctgccatcaagacgaag

SEQ ID NO: 619828 - DNA, 25 bp, Rattus norvegicus
tgccatcgctgcgatcaagacgaag

SEQ ID NO: 619829 - DNA, 25 bp, Rattus norvegicus
tgccatcgtctccagaggccaggct

SEQ ID NO: 619830 - DNA, 25 bp, Rattus norvegicus
tgccatcgtctcgagaggccaggct

SEQ ID NO: 619831 - DNA, 25 bp, Rattus norvegicus
tgccatctcagaactccagactatg

SEQ ID NO: 619832 - DNA, 25 bp, Rattus norvegicus
tgccatctcagatctccagactatg

SEQ ID NO: 619833 - DNA, 25 bp, Rattus norvegicus
tgccatctccggatctaaatctgaa

SEQ ID NO: 619834 - DNA, 25 bp, Rattus norvegicus
tgccatctccggttctaaatctgaa

SEQ ID NO: 619835 - DNA, 25 bp, Rattus norvegicus
tgccatctgcttcccaaatgaaggc

SEQ ID NO: 619836 - DNA, 25 bp, Rattus norvegicus
tgccatctgcttgccaaatgaaggc

SEQ ID NO: 619837 - DNA, 25 bp, Rattus norvegicus
tgccatctggctatgcaacatgtgg

SEQ ID NO: 619838 - DNA, 25 bp, Rattus norvegicus
tgccatctggctttgcaacatgtgg

SEQ ID NO: 619839 - DNA, 25 bp, Rattus norvegicus
tgccatcttccacttatgtgcgagg

SEQ ID NO: 619840 - DNA, 25 bp, Rattus norvegicus
tgccatcttccagttatgtgcgagg

SEQ ID NO: 619841 - DNA, 25 bp, Rattus norvegicus
tgccatcttcccaagtgacgacatg

SEQ ID NO: 619842 - DNA, 25 bp, Rattus norvegicus
tgccatcttccctagtgacgacatg

SEQ ID NO: 619843 - DNA, 25 bp, Rattus norvegicus
tgccatcttggactacagctccagg

SEQ ID NO: 619844 - DNA, 25 bp, Rattus norvegicus
tgccatcttggagtacagctccagg

SEQ ID NO: 619845 - DNA, 25 bp, Rattus norvegicus
tgccatcttgtgaacatgtcagaaa

SEQ ID NO: 619846 - DNA, 25 bp, Rattus norvegicus
tgccatcttgtgtacatgtcagaaa

SEQ ID NO: 619847 - DNA, 25 bp, Rattus norvegicus
tgccatgaaggcagacgccagcaga

SEQ ID NO: 619848 - DNA, 25 bp, Rattus norvegicus
tgccatgaaggctgacgccagcaga

SEQ ID NO: 619849 - DNA, 25 bp, Rattus norvegicus
tgccatgagtcacggtttcctcaaa

SEQ ID NO: 619850 - DNA, 25 bp, Rattus norvegicus
tgccatgagtcagggtttcctcaaa

SEQ ID NO: 619851 - DNA, 25 bp, Rattus norvegicus
tgccatgagtgtcaccccagaggtg

SEQ ID NO: 619852 - DNA, 25 bp, Rattus norvegicus
tgccatgagtgtgaccccagaggtg

SEQ ID NO: 619853 - DNA, 25 bp, Rattus norvegicus
tgccatgatgaacctgtcagaatct

SEQ ID NO: 619854 - DNA, 25 bp, Rattus norvegicus
tgccatgatgaagctgtcagaatct

SEQ ID NO: 619855 - DNA, 25 bp, Rattus norvegicus
tgccatgcactgatcactgtagatt

SEQ ID NO: 619856 - DNA, 25 bp, Rattus norvegicus
tgccatgcactgttcactgtagatt

SEQ ID NO: 619857 - DNA, 25 bp, Rattus norvegicus
tgccatgcagatctccctgcaggga

SEQ ID NO: 619858 - DNA, 25 bp, Rattus norvegicus
tgccatgcagatctgcaccatcatc

SEQ ID NO: 619859 - DNA, 25 bp, Rattus norvegicus
tgccatgcagatgtccctgcaggga

SEQ ID NO: 619860 - DNA, 25 bp, Rattus norvegicus
tgccatgcagatgtgcaccatcatc

SEQ ID NO: 619861 - DNA, 25 bp, Rattus norvegicus
tgccatgcagcgattctttaagaat

SEQ ID NO: 619862 - DNA, 25 bp, Rattus norvegicus
tgccatgcagcgtttctttaagaat

SEQ ID NO: 619863 - DNA, 25 bp, Rattus norvegicus
tgccatgccaagaccagaacacttg

SEQ ID NO: 619864 - DNA, 25 bp, Rattus norvegicus
tgccatgccaagtccagaacacttg

SEQ ID NO: 619865 - DNA, 25 bp, Rattus norvegicus
tgccatgctcccagtaagatgccat

SEQ ID NO: 619866 - DNA, 25 bp, Rattus norvegicus
tgccatgctccctgtaagatgccat

SEQ ID NO: 619867 - DNA, 25 bp, Rattus norvegicus
tgccatgctggcagacttcattgat

SEQ ID NO: 619868 - DNA, 25 bp, Rattus norvegicus
tgccatgctggctgacttcattgat

SEQ ID NO: 619869 - DNA, 25 bp, Rattus norvegicus
tgccatgcttagaaaaggccccagt

SEQ ID NO: 619870 - DNA, 25 bp, Rattus norvegicus
tgccatgcttagtaaaggccccagt

SEQ ID NO: 619871 - DNA, 25 bp, Rattus norvegicus
tgccatggaacacttgctacagctg

SEQ ID NO: 619872 - DNA, 25 bp, Rattus norvegicus
tgccatggaacagttgctacagctg

SEQ ID NO: 619873 - DNA, 25 bp, Rattus norvegicus
tgccatggaactccaccgtgggcac

SEQ ID NO: 619874 - DNA, 25 bp, Rattus norvegicus
tgccatggaactgcaccgtgggcac

SEQ ID NO: 619875 - DNA, 25 bp, Rattus norvegicus
tgccatggaatcacatacctaaccc

SEQ ID NO: 619876 - DNA, 25 bp, Rattus norvegicus
tgccatggaatctcatacctaaccc

SEQ ID NO: 619877 - DNA, 25 bp, Rattus norvegicus
tgccatggactcaggcctgtccaag

SEQ ID NO: 619878 - DNA, 25 bp, Rattus norvegicus
tgccatggactctggcctgtccaag

SEQ ID NO: 619879 - DNA, 25 bp, Rattus norvegicus
tgccatggcaagcaacagccacctg

SEQ ID NO: 619880 - DNA, 25 bp, Rattus norvegicus
tgccatggcaaggaacagccacctg

SEQ ID NO: 619881 - DNA, 25 bp, Rattus norvegicus
tgccatggcctgcaactgactgggt

SEQ ID NO: 619882 - DNA, 25 bp, Rattus norvegicus
tgccatggcctggaactgactgggt

SEQ ID NO: 619883 - DNA, 25 bp, Rattus norvegicus
tgccatggccttaggtgggaacaga

SEQ ID NO: 619884 - DNA, 25 bp, Rattus norvegicus
tgccatggcctttggtgggaacaga

SEQ ID NO: 619885 - DNA, 25 bp, Rattus norvegicus
tgccatggcttgaacctgtaatcac

SEQ ID NO: 619886 - DNA, 25 bp, Rattus norvegicus
tgccatggcttgtacctgtaatcac

SEQ ID NO: 619887 - DNA, 25 bp, Rattus norvegicus
tgccatgggcttcactgggaactag

SEQ ID NO: 619888 - DNA, 25 bp, Rattus norvegicus
tgccatgggcttgactgggaactag

SEQ ID NO: 619889 - DNA, 25 bp, Rattus norvegicus
tgccatgggtgtacgctcagtcctt

SEQ ID NO: 619890 - DNA, 25 bp, Rattus norvegicus
tgccatgggtgttcgctcagtcctt

SEQ ID NO: 619891 - DNA, 25 bp, Rattus norvegicus
tgccatgggtttagtgcctcatctg

SEQ ID NO: 619892 - DNA, 25 bp, Rattus norvegicus
tgccatgggttttgtgcctcatctg

SEQ ID NO: 619893 - DNA, 25 bp, Rattus norvegicus
tgccatggtgacaaaaacttttcaa

SEQ ID NO: 619894 - DNA, 25 bp, Rattus norvegicus
tgccatggtgacaggcacgcacagt

SEQ ID NO: 619895 - DNA, 25 bp, Rattus norvegicus
tgccatggtgactaaaacttttcaa

SEQ ID NO: 619896 - DNA, 25 bp, Rattus norvegicus
tgccatggtgactggcacgcacagt

SEQ ID NO: 619897 - DNA, 25 bp, Rattus norvegicus
tgccatgtaactcgaggatgtgcta

SEQ ID NO: 619898 - DNA, 25 bp, Rattus norvegicus
tgccatgtaactggaggatgtgcta

SEQ ID NO: 619899 - DNA, 25 bp, Rattus norvegicus
tgccatgtaccacagcccagtaagg

SEQ ID NO: 619900 - DNA, 25 bp, Rattus norvegicus
tgccatgtaccagagcccagtaagg

SEQ ID NO: 619901 - DNA, 25 bp, Rattus norvegicus
tgccatgtatatctgtttagcacac

SEQ ID NO: 619902 - DNA, 25 bp, Rattus norvegicus
tgccatgtatatgtgtttagcacac

SEQ ID NO: 619903 - DNA, 25 bp, Rattus norvegicus
tgccatgtatgcagatatgtcgcga

SEQ ID NO: 619904 - DNA, 25 bp, Rattus norvegicus
tgccatgtatgctgatatgtcgcga

SEQ ID NO: 619905 - DNA, 25 bp, Rattus norvegicus
tgccatgtctacacctctcatgtgt

SEQ ID NO: 619906 - DNA, 25 bp, Rattus norvegicus
tgccatgtctactcctctcatgtgt

SEQ ID NO: 619907 - DNA, 25 bp, Rattus norvegicus
tgccatgtctgtcggccatctgcag

SEQ ID NO: 619908 - DNA, 25 bp, Rattus norvegicus
tgccatgtctgtgggccatctgcag

SEQ ID NO: 619909 - DNA, 25 bp, Rattus norvegicus
tgccatgtgacgatctggtcagccg

SEQ ID NO: 619910 - DNA, 25 bp, Rattus norvegicus
tgccatgtgacgttctggtcagccg

SEQ ID NO: 619911 - DNA, 25 bp, Rattus norvegicus
tgccatgtgcggaacccgctatctg

SEQ ID NO: 619912 - DNA, 25 bp, Rattus norvegicus
tgccatgtgcggaatctgatgctgt

SEQ ID NO: 619913 - DNA, 25 bp, Rattus norvegicus
tgccatgtgcggtacccgctatctg

SEQ ID NO: 619914 - DNA, 25 bp, Rattus norvegicus
tgccatgtgcggtatctgatgctgt

SEQ ID NO: 619915 - DNA, 25 bp, Rattus norvegicus
tgccatgtggctcgtctgttgaagc

SEQ ID NO: 619916 - DNA, 25 bp, Rattus norvegicus
tgccatgtggctggtctgttgaagc

SEQ ID NO: 619917 - DNA, 25 bp, Rattus norvegicus
tgccatgtggtgactgtgccacaaa

SEQ ID NO: 619918 - DNA, 25 bp, Rattus norvegicus
tgccatgtggtgtctgtgccacaaa

SEQ ID NO: 619919 - DNA, 25 bp, Rattus norvegicus
tgccatgttggaccgcatcagaaca

SEQ ID NO: 619920 - DNA, 25 bp, Rattus norvegicus
tgccatgttggagcgcatcagaaca

SEQ ID NO: 619921 - DNA, 25 bp, Rattus norvegicus
tgccattaccttcggaatcttctgc

SEQ ID NO: 619922 - DNA, 25 bp, Rattus norvegicus
tgccattaccttgggaatcttctgc

SEQ ID NO: 619923 - DNA, 25 bp, Rattus norvegicus
tgccattactatacaaggttcataa

SEQ ID NO: 619924 - DNA, 25 bp, Rattus norvegicus
tgccattactattcaaggttcataa

SEQ ID NO: 619925 - DNA, 25 bp, Rattus norvegicus
tgccattcatctactgctcaaaagg

SEQ ID NO: 619926 - DNA, 25 bp, Rattus norvegicus
tgccattcatcttctgctcaaaagg

SEQ ID NO: 619927 - DNA, 25 bp, Rattus norvegicus
tgccattcccagcatgagccatgta

SEQ ID NO: 619928 - DNA, 25 bp, Rattus norvegicus
tgccattcccaggatgagccatgta

SEQ ID NO: 619929 - DNA, 25 bp, Rattus norvegicus
tgccattcccatattccttgccttt

SEQ ID NO: 619930 - DNA, 25 bp, Rattus norvegicus
tgccattcccattttccttgccttt

SEQ ID NO: 619931 - DNA, 25 bp, Rattus norvegicus
tgccattccgtacccaagaattgtt

SEQ ID NO: 619932 - DNA, 25 bp, Rattus norvegicus
tgccattccgtagccaagaattgtt

SEQ ID NO: 619933 - DNA, 25 bp, Rattus norvegicus
tgccattccttaatctagacccaga

SEQ ID NO: 619934 - DNA, 25 bp, Rattus norvegicus
tgccattccttattctagacccaga

SEQ ID NO: 619935 - DNA, 25 bp, Rattus norvegicus
tgccattcgagcatgtattctgtct

SEQ ID NO: 619936 - DNA, 25 bp, Rattus norvegicus
tgccattcgagcttgtattctgtct

SEQ ID NO: 619937 - DNA, 25 bp, Rattus norvegicus
tgccattctactccatttggttcat

SEQ ID NO: 619938 - DNA, 25 bp, Rattus norvegicus
tgccattctactgcatttggttcat

SEQ ID NO: 619939 - DNA, 25 bp, Rattus norvegicus
tgccattctagcaggtcctcaatga

SEQ ID NO: 619940 - DNA, 25 bp, Rattus norvegicus
tgccattctagctggtcctcaatga

SEQ ID NO: 619941 - DNA, 25 bp, Rattus norvegicus
tgccattctcacactggtagtttgt

SEQ ID NO: 619942 - DNA, 25 bp, Rattus norvegicus
tgccattctcactctggtagtttgt

SEQ ID NO: 619943 - DNA, 25 bp, Rattus norvegicus
tgccattctgatccaaatcttccag

SEQ ID NO: 619944 - DNA, 25 bp, Rattus norvegicus
tgccattctgatgcaaatcttccag

SEQ ID NO: 619945 - DNA, 25 bp, Rattus norvegicus
tgccattctgggatgtacgtctttg

SEQ ID NO: 619946 - DNA, 25 bp, Rattus norvegicus
tgccattctgggatttgtgtgtgtg

SEQ ID NO: 619947 - DNA, 25 bp, Rattus norvegicus
tgccattctgggttgtacgtctttg

SEQ ID NO: 619948 - DNA, 25 bp, Rattus norvegicus
tgccattctgggttttgtgtgtgtg

SEQ ID NO: 619949 - DNA, 25 bp, Rattus norvegicus
tgccattgccaccatcaagaccaag

SEQ ID NO: 619950 - DNA, 25 bp, Rattus norvegicus
tgccattgccacgatcaagaccaag

SEQ ID NO: 619951 - DNA, 25 bp, Rattus norvegicus
tgccattgccctagtggatacacaa

SEQ ID NO: 619952 - DNA, 25 bp, Rattus norvegicus
tgccattgcccttgtggatacacaa

SEQ ID NO: 619953 - DNA, 25 bp, Rattus norvegicus
tgccattgctacagctgcagaggct

SEQ ID NO: 619954 - DNA, 25 bp, Rattus norvegicus
tgccattgctactgctgcagaggct

SEQ ID NO: 619955 - DNA, 25 bp, Rattus norvegicus
tgccattggcacaaccctctggtgg

SEQ ID NO: 619956 - DNA, 25 bp, Rattus norvegicus
tgccattggcactaccctctggtgg

SEQ ID NO: 619957 - DNA, 25 bp, Rattus norvegicus
tgccattgtatcacatctgtcctga

SEQ ID NO: 619958 - DNA, 25 bp, Rattus norvegicus
tgccattgtatctcatctgtcctga

SEQ ID NO: 619959 - DNA, 25 bp, Rattus norvegicus
tgccatttcagcatctctatttcaa

SEQ ID NO: 619960 - DNA, 25 bp, Rattus norvegicus
tgccatttcagcttctctatttcaa

SEQ ID NO: 619961 - DNA, 25 bp, Rattus norvegicus
tgccatttctcacgtgctacggaag

SEQ ID NO: 619962 - DNA, 25 bp, Rattus norvegicus
tgccatttctcaggtgctacggaag

SEQ ID NO: 619963 - DNA, 25 bp, Rattus norvegicus
tgccatttctggaagtacccctttg

SEQ ID NO: 619964 - DNA, 25 bp, Rattus norvegicus
tgccatttctggtagtacccctttg

SEQ ID NO: 619965 - DNA, 25 bp, Rattus norvegicus
tgccatttcttcacctgaaaccaca

SEQ ID NO: 619966 - DNA, 25 bp, Rattus norvegicus
tgccatttcttctcctgaaaccaca

SEQ ID NO: 619967 - DNA, 25 bp, Rattus norvegicus
tgccatttgcacaccagttttacat

SEQ ID NO: 619968 - DNA, 25 bp, Rattus norvegicus
tgccatttgcactccagttttacat

SEQ ID NO: 619969 - DNA, 25 bp, Rattus norvegicus
tgccatttgtctatctgtcagtcac

SEQ ID NO: 619970 - DNA, 25 bp, Rattus norvegicus
tgccatttgtctttctgtcagtcac

SEQ ID NO: 619971 - DNA, 25 bp, Rattus norvegicus
tgccattttatacttactacgtgaa

SEQ ID NO: 619972 - DNA, 25 bp, Rattus norvegicus
tgccattttatagttactacgtgaa

SEQ ID NO: 619973 - DNA, 25 bp, Rattus norvegicus
tgccattttcacagttgggtcttta

SEQ ID NO: 619974 - DNA, 25 bp, Rattus norvegicus
tgccattttcactgttgggtcttta

SEQ ID NO: 619975 - DNA, 25 bp, Rattus norvegicus
tgccattttgtacctgtgactccag

SEQ ID NO: 619976 - DNA, 25 bp, Rattus norvegicus
tgccattttgtagctgtgactccag

SEQ ID NO: 619977 - DNA, 25 bp, Rattus norvegicus
tgccatttttctctacacctgtggg

SEQ ID NO: 619978 - DNA, 25 bp, Rattus norvegicus
tgccatttttctgtacacctgtggg

SEQ ID NO: 619979 - DNA, 25 bp, Rattus norvegicus
tgccatttttgcacccgattgtaaa

SEQ ID NO: 619980 - DNA, 25 bp, Rattus norvegicus
tgccatttttgctcccgattgtaaa

SEQ ID NO: 619981 - DNA, 25 bp, Rattus norvegicus
tgcccaaacagcactatttctcaaa

SEQ ID NO: 619982 - DNA, 25 bp, Rattus norvegicus
tgcccaaacagctctatttctcaaa

SEQ ID NO: 619983 - DNA, 25 bp, Rattus norvegicus
tgcccaaaccctctggatgctgaaa

SEQ ID NO: 619984 - DNA, 25 bp, Rattus norvegicus
tgcccaaaccctgtggatgctgaaa

SEQ ID NO: 619985 - DNA, 25 bp, Rattus norvegicus
tgcccaaacctgctctgtcagtatt

SEQ ID NO: 619986 - DNA, 25 bp, Rattus norvegicus
tgcccaaacctggtctgtcagtatt

SEQ ID NO: 619987 - DNA, 25 bp, Rattus norvegicus
tgcccaaagctcacaagccgaagaa

SEQ ID NO: 619988 - DNA, 25 bp, Rattus norvegicus
tgcccaaagctctcaagccgaagaa

SEQ ID NO: 619989 - DNA, 25 bp, Rattus norvegicus
tgcccaaaggcaccatttcttttgt

SEQ ID NO: 619990 - DNA, 25 bp, Rattus norvegicus
tgcccaaaggcagcatttcttttgt

SEQ ID NO: 619991 - DNA, 25 bp, Rattus norvegicus
tgcccaaatatgcatgctcattcct

SEQ ID NO: 619992 - DNA, 25 bp, Rattus norvegicus
tgcccaaatatggatgctcattcct

SEQ ID NO: 619993 - DNA, 25 bp, Rattus norvegicus
tgcccaacatggaggctaccgaatg

SEQ ID NO: 619994 - DNA, 25 bp, Rattus norvegicus
tgcccaacatggtggctaccgaatg

SEQ ID NO: 619995 - DNA, 25 bp, Rattus norvegicus
tgcccaacattcagtatacgctgtg

SEQ ID NO: 619996 - DNA, 25 bp, Rattus norvegicus
tgcccaacattctgtatacgctgtg

SEQ ID NO: 619997 - DNA, 25 bp, Rattus norvegicus
tgcccaacctagctgacttggtaag

SEQ ID NO: 619998 - DNA, 25 bp, Rattus norvegicus
tgcccaacctaggtgacttggtaag

SEQ ID NO: 619999 - DNA, 25 bp, Rattus norvegicus
tgcccaacgacaacagacaataaag

SEQ ID NO: 620000 - DNA, 25 bp, Rattus norvegicus
tgcccaacgacatcagacaataaag

SEQ ID NO: 620001 - DNA, 25 bp, Rattus norvegicus
tgcccaacggcacttttccagatgt

SEQ ID NO: 620002 - DNA, 25 bp, Rattus norvegicus
tgcccaacggcagttttccagatgt

SEQ ID NO: 620003 - DNA, 25 bp, Rattus norvegicus
tgcccaactaccacaatggctttga

SEQ ID NO: 620004 - DNA, 25 bp, Rattus norvegicus
tgcccaactacctcaatggctttga

SEQ ID NO: 620005 - DNA, 25 bp, Rattus norvegicus
tgcccaactcttccagacctgggtt

SEQ ID NO: 620006 - DNA, 25 bp, Rattus norvegicus
tgcccaactcttgcagacctgggtt

SEQ ID NO: 620007 - DNA, 25 bp, Rattus norvegicus
tgcccaactggcagtcaaaagctgg

SEQ ID NO: 620008 - DNA, 25 bp, Rattus norvegicus
tgcccaactggctgtcaaaagctgg

SEQ ID NO: 620009 - DNA, 25 bp, Rattus norvegicus
tgcccaactgtgaccgcaaaggatt

SEQ ID NO: 620010 - DNA, 25 bp, Rattus norvegicus
tgcccaactgtgtccgcaaaggatt

SEQ ID NO: 620011 - DNA, 25 bp, Rattus norvegicus
tgcccaacttgtatggctcacagat

SEQ ID NO: 620012 - DNA, 25 bp, Rattus norvegicus
tgcccaacttgtttggctcacagat

SEQ ID NO: 620013 - DNA, 25 bp, Rattus norvegicus
tgcccaagactcacatgttaaaaga

SEQ ID NO: 620014 - DNA, 25 bp, Rattus norvegicus
tgcccaagactctcatgttaaaaga

SEQ ID NO: 620015 - DNA, 25 bp, Rattus norvegicus
tgcccaagagccaagatttgaccct

SEQ ID NO: 620016 - DNA, 25 bp, Rattus norvegicus
tgcccaagagcctagatttgaccct

SEQ ID NO: 620017 - DNA, 25 bp, Rattus norvegicus
tgcccaagattgacgaagagaaact

SEQ ID NO: 620018 - DNA, 25 bp, Rattus norvegicus
tgcccaagattgtcgaagagaaact

SEQ ID NO: 620019 - DNA, 25 bp, Rattus norvegicus
tgcccaagctgcagggcctttttaa

SEQ ID NO: 620020 - DNA, 25 bp, Rattus norvegicus
tgcccaagctgctgggcctttttaa

SEQ ID NO: 620021 - DNA, 25 bp, Rattus norvegicus
tgcccaagctgtcttcactgccaat

SEQ ID NO: 620022 - DNA, 25 bp, Rattus norvegicus
tgcccaagctgtgttcactgccaat

SEQ ID NO: 620023 - DNA, 25 bp, Rattus norvegicus
tgcccaagcttcacattgtcaaggt

SEQ ID NO: 620024 - DNA, 25 bp, Rattus norvegicus
tgcccaagcttctcattgtcaaggt

SEQ ID NO: 620025 - DNA, 25 bp, Rattus norvegicus
tgcccaaggaccaggatactcacaa

SEQ ID NO: 620026 - DNA, 25 bp, Rattus norvegicus
tgcccaaggacctggatactcacaa

SEQ ID NO: 620027 - DNA, 25 bp, Rattus norvegicus
tgcccaaggtgccagaacagagcag

SEQ ID NO: 620028 - DNA, 25 bp, Rattus norvegicus
tgcccaaggtgcgagaacagagcag

SEQ ID NO: 620029 - DNA, 25 bp, Rattus norvegicus
tgcccaatcttcattatgaggtcag

SEQ ID NO: 620030 - DNA, 25 bp, Rattus norvegicus
tgcccaatcttctttatgaggtcag

SEQ ID NO: 620031 - DNA, 25 bp, Rattus norvegicus
tgcccaatgacacatctttgaccag

SEQ ID NO: 620032 - DNA, 25 bp, Rattus norvegicus
tgcccaatgacagatctttgaccag

SEQ ID NO: 620033 - DNA, 25 bp, Rattus norvegicus
tgcccaatgatgctacaacctgaga

SEQ ID NO: 620034 - DNA, 25 bp, Rattus norvegicus
tgcccaatgatggtacaacctgaga

SEQ ID NO: 620035 - DNA, 25 bp, Rattus norvegicus
tgcccaatgcagaaggatatccact

SEQ ID NO: 620036 - DNA, 25 bp, Rattus norvegicus
tgcccaatgcagtaggatatccact

SEQ ID NO: 620037 - DNA, 25 bp, Rattus norvegicus
tgcccaattggcacacagtgacttg

SEQ ID NO: 620038 - DNA, 25 bp, Rattus norvegicus
tgcccaattggctcacagtgacttg

SEQ ID NO: 620039 - DNA, 25 bp, Rattus norvegicus
tgcccacaaaaacacaatcagcctt

SEQ ID NO: 620040 - DNA, 25 bp, Rattus norvegicus
tgcccacaaaaagacaatcagcctt

SEQ ID NO: 620041 - DNA, 25 bp, Rattus norvegicus
tgcccacaaacaactgtatatgcat

SEQ ID NO: 620042 - DNA, 25 bp, Rattus norvegicus
tgcccacaaacatctgtatatgcat

SEQ ID NO: 620043 - DNA, 25 bp, Rattus norvegicus
tgcccacaagccctttatgtggcta

SEQ ID NO: 620044 - DNA, 25 bp, Rattus norvegicus
tgcccacaagccgtttatgtggcta

SEQ ID NO: 620045 - DNA, 25 bp, Rattus norvegicus
tgcccacacctaattatctgtctgt

SEQ ID NO: 620046 - DNA, 25 bp, Rattus norvegicus
tgcccacacctatttatctgtctgt

SEQ ID NO: 620047 - DNA, 25 bp, Rattus norvegicus
tgcccacacttaccgcaggcgtata

SEQ ID NO: 620048 - DNA, 25 bp, Rattus norvegicus
tgcccacacttagcgcaggcgtata

SEQ ID NO: 620049 - DNA, 25 bp, Rattus norvegicus
tgcccacagagaaactagtgttact

SEQ ID NO: 620050 - DNA, 25 bp, Rattus norvegicus
tgcccacagagatactagtgttact

SEQ ID NO: 620051 - DNA, 25 bp, Rattus norvegicus
tgcccacagattccacgtgtaggga

SEQ ID NO: 620052 - DNA, 25 bp, Rattus norvegicus
tgcccacagattgcacgtgtaggga

SEQ ID NO: 620053 - DNA, 25 bp, Rattus norvegicus
tgcccacagtacagctggacgagat

SEQ ID NO: 620054 - DNA, 25 bp, Rattus norvegicus
tgcccacagtactgctggacgagat

SEQ ID NO: 620055 - DNA, 25 bp, Rattus norvegicus
tgcccacatactcgtttcatacact

SEQ ID NO: 620056 - DNA, 25 bp, Rattus norvegicus
tgcccacatactggtttcatacact

SEQ ID NO: 620057 - DNA, 25 bp, Rattus norvegicus
tgcccacatggaccagcacacttga

SEQ ID NO: 620058 - DNA, 25 bp, Rattus norvegicus
tgcccacatggagcagcacacttga

SEQ ID NO: 620059 - DNA, 25 bp, Rattus norvegicus
tgcccacattgcagagatgctagat

SEQ ID NO: 620060 - DNA, 25 bp, Rattus norvegicus
tgcccacattgctgagatgctagat

SEQ ID NO: 620061 - DNA, 25 bp, Rattus norvegicus
tgcccaccacgacctaattttgggt

SEQ ID NO: 620062 - DNA, 25 bp, Rattus norvegicus
tgcccaccacgagctaattttgggt

SEQ ID NO: 620063 - DNA, 25 bp, Rattus norvegicus
tgcccaccaggtctctaagggacaa

SEQ ID NO: 620064 - DNA, 25 bp, Rattus norvegicus
tgcccaccaggtgtctaagggacaa

SEQ ID NO: 620065 - DNA, 25 bp, Rattus norvegicus
tgcccaccagtgagtttgctcataa

SEQ ID NO: 620066 - DNA, 25 bp, Rattus norvegicus
tgcccaccagtgtgtttgctcataa

SEQ ID NO: 620067 - DNA, 25 bp, Rattus norvegicus
tgcccaccattgctctttgtaacac

SEQ ID NO: 620068 - DNA, 25 bp, Rattus norvegicus
tgcccaccattggtctttgtaacac

SEQ ID NO: 620069 - DNA, 25 bp, Rattus norvegicus
tgcccacccaaaagatccagtctat

SEQ ID NO: 620070 - DNA, 25 bp, Rattus norvegicus
tgcccacccaaatgatccagtctat

SEQ ID NO: 620071 - DNA, 25 bp, Rattus norvegicus
tgcccacccaacagatttcacagta

SEQ ID NO: 620072 - DNA, 25 bp, Rattus norvegicus
tgcccacccaactgatttcacagta

SEQ ID NO: 620073 - DNA, 25 bp, Rattus norvegicus
tgcccacccacaaaaatctcataaa

SEQ ID NO: 620074 - DNA, 25 bp, Rattus norvegicus
tgcccacccacataaatctcataaa

SEQ ID NO: 620075 - DNA, 25 bp, Rattus norvegicus
tgcccacccatacctgattgagcag

SEQ ID NO: 620076 - DNA, 25 bp, Rattus norvegicus
tgcccacccatagctgattgagcag

SEQ ID NO: 620077 - DNA, 25 bp, Rattus norvegicus
tgcccacccatgcaggtctacgagt

SEQ ID NO: 620078 - DNA, 25 bp, Rattus norvegicus
tgcccacccatggaggtctacgagt

SEQ ID NO: 620079 - DNA, 25 bp, Rattus norvegicus
tgcccacccctaaacaagagtcttt

SEQ ID NO: 620080 - DNA, 25 bp, Rattus norvegicus
tgcccacccctatacaagagtcttt

SEQ ID NO: 620081 - DNA, 25 bp, Rattus norvegicus
tgcccacccttaaaatcgattcttt

SEQ ID NO: 620082 - DNA, 25 bp, Rattus norvegicus
tgcccacccttataatcgattcttt

SEQ ID NO: 620083 - DNA, 25 bp, Rattus norvegicus
tgcccaccgatgacgacagttatga

SEQ ID NO: 620084 - DNA, 25 bp, Rattus norvegicus
tgcccaccgatgtcgacagttatga

SEQ ID NO: 620085 - DNA, 25 bp, Rattus norvegicus
tgcccaccgcctcgtatttgttggg

SEQ ID NO: 620086 - DNA, 25 bp, Rattus norvegicus
tgcccaccgcctggtatttgttggg

SEQ ID NO: 620087 - DNA, 25 bp, Rattus norvegicus
tgcccaccgggcatttgctgatgac

SEQ ID NO: 620088 - DNA, 25 bp, Rattus norvegicus
tgcccaccgggcttttgctgatgac

SEQ ID NO: 620089 - DNA, 25 bp, Rattus norvegicus
tgcccaccgtgtacgcttttcagaa

SEQ ID NO: 620090 - DNA, 25 bp, Rattus norvegicus
tgcccaccgtgttcgcttttcagaa

SEQ ID NO: 620091 - DNA, 25 bp, Rattus norvegicus
tgcccacctcatcggagtctgtcaa

SEQ ID NO: 620092 - DNA, 25 bp, Rattus norvegicus
tgcccacctcatgggagtctgtcaa

SEQ ID NO: 620093 - DNA, 25 bp, Rattus norvegicus
tgcccacctctaacatcctgataaa

SEQ ID NO: 620094 - DNA, 25 bp, Rattus norvegicus
tgcccacctctatcatcctgataaa

SEQ ID NO: 620095 - DNA, 25 bp, Rattus norvegicus
tgcccacgaccaacagtgacttcaa

SEQ ID NO: 620096 - DNA, 25 bp, Rattus norvegicus
tgcccacgaccatcagtgacttcaa

SEQ ID NO: 620097 - DNA, 25 bp, Rattus norvegicus
tgcccacggccactgggagcaacag

SEQ ID NO: 620098 - DNA, 25 bp, Rattus norvegicus
tgcccacggccagtgggagcaacag

SEQ ID NO: 620099 - DNA, 25 bp, Rattus norvegicus
tgcccacggtaacttttctgtttgt

SEQ ID NO: 620100 - DNA, 25 bp, Rattus norvegicus
tgcccacggtaagttttctgtttgt

SEQ ID NO: 620101 - DNA, 25 bp, Rattus norvegicus
tgcccacgttcaccttttgagggta

SEQ ID NO: 620102 - DNA, 25 bp, Rattus norvegicus
tgcccacgttcagcttttgagggta

SEQ ID NO: 620103 - DNA, 25 bp, Rattus norvegicus
tgcccactcaatagttacctgttgc

SEQ ID NO: 620104 - DNA, 25 bp, Rattus norvegicus
tgcccactcaattgttacctgttgc

SEQ ID NO: 620105 - DNA, 25 bp, Rattus norvegicus
tgcccactcctaagttcactcagat

SEQ ID NO: 620106 - DNA, 25 bp, Rattus norvegicus
tgcccactcctatgttcactcagat

SEQ ID NO: 620107 - DNA, 25 bp, Rattus norvegicus
tgcccactctccctttgtatgagga

SEQ ID NO: 620108 - DNA, 25 bp, Rattus norvegicus
tgcccactctccgtttgtatgagga

SEQ ID NO: 620109 - DNA, 25 bp, Rattus norvegicus
tgcccactctttcttatcatcaatt

SEQ ID NO: 620110 - DNA, 25 bp, Rattus norvegicus
tgcccactctttgttatcatcaatt

SEQ ID NO: 620111 - DNA, 25 bp, Rattus norvegicus
tgcccactgatacagtgcttagcta

SEQ ID NO: 620112 - DNA, 25 bp, Rattus norvegicus
tgcccactgatagagtgcttagcta

SEQ ID NO: 620113 - DNA, 25 bp, Rattus norvegicus
tgcccactgattctcaacatgttcc

SEQ ID NO: 620114 - DNA, 25 bp, Rattus norvegicus
tgcccactgattgtcaacatgttcc

SEQ ID NO: 620115 - DNA, 25 bp, Rattus norvegicus
tgcccactgcctacaacacagatta

SEQ ID NO: 620116 - DNA, 25 bp, Rattus norvegicus
tgcccactgccttcaacacagatta

SEQ ID NO: 620117 - DNA, 25 bp, Rattus norvegicus
tgcccactgctcacaatatagactt

SEQ ID NO: 620118 - DNA, 25 bp, Rattus norvegicus
tgcccactgctctcaatatagactt

SEQ ID NO: 620119 - DNA, 25 bp, Rattus norvegicus
tgcccactgcttactttattcttgt

SEQ ID NO: 620120 - DNA, 25 bp, Rattus norvegicus
tgcccactgcttcagccataattgt

SEQ ID NO: 620121 - DNA, 25 bp, Rattus norvegicus
tgcccactgcttccaaaaggacaat

SEQ ID NO: 620122 - DNA, 25 bp, Rattus norvegicus
tgcccactgcttgagccataattgt

SEQ ID NO: 620123 - DNA, 25 bp, Rattus norvegicus
tgcccactgcttgcaaaaggacaat

SEQ ID NO: 620124 - DNA, 25 bp, Rattus norvegicus
tgcccactgctttctttattcttgt

SEQ ID NO: 620125 - DNA, 25 bp, Rattus norvegicus
tgcccactggaacgtctacatcgta

SEQ ID NO: 620126 - DNA, 25 bp, Rattus norvegicus
tgcccactggaaggtctacatcgta

SEQ ID NO: 620127 - DNA, 25 bp, Rattus norvegicus
tgcccactgggcagttacagacctg

SEQ ID NO: 620128 - DNA, 25 bp, Rattus norvegicus
tgcccactgggctgttacagacctg

SEQ ID NO: 620129 - DNA, 25 bp, Rattus norvegicus
tgcccactggtgagtgttcggaaca

SEQ ID NO: 620130 - DNA, 25 bp, Rattus norvegicus
tgcccactggtgtgtgttcggaaca

SEQ ID NO: 620131 - DNA, 25 bp, Rattus norvegicus
tgcccactgtcaagtcaaatctcta

SEQ ID NO: 620132 - DNA, 25 bp, Rattus norvegicus
tgcccactgtcatgtcaaatctcta

SEQ ID NO: 620133 - DNA, 25 bp, Rattus norvegicus
tgcccactgttcacacacaaggagg

SEQ ID NO: 620134 - DNA, 25 bp, Rattus norvegicus
tgcccactgttctcacacaaggagg

SEQ ID NO: 620135 - DNA, 25 bp, Rattus norvegicus
tgcccacttcaaacagccagttctt

SEQ ID NO: 620136 - DNA, 25 bp, Rattus norvegicus
tgcccacttcaatcagccagttctt

SEQ ID NO: 620137 - DNA, 25 bp, Rattus norvegicus
tgcccacttcatcatgactgacgat

SEQ ID NO: 620138 - DNA, 25 bp, Rattus norvegicus
tgcccacttcatgatgactgacgat

SEQ ID NO: 620139 - DNA, 25 bp, Rattus norvegicus
tgcccacttggcaatacggattcag

SEQ ID NO: 620140 - DNA, 25 bp, Rattus norvegicus
tgcccacttggctatacggattcag

SEQ ID NO: 620141 - DNA, 25 bp, Rattus norvegicus
tgcccactttgccaggagccttttc

SEQ ID NO: 620142 - DNA, 25 bp, Rattus norvegicus
tgcccactttgcgaggagccttttc

SEQ ID NO: 620143 - DNA, 25 bp, Rattus norvegicus
tgcccagaaataccaatatccccat

SEQ ID NO: 620144 - DNA, 25 bp, Rattus norvegicus
tgcccagaaatagcaatatccccat

SEQ ID NO: 620145 - DNA, 25 bp, Rattus norvegicus
tgcccagaacccacttaaaggcgga

SEQ ID NO: 620146 - DNA, 25 bp, Rattus norvegicus
tgcccagaaccctcttaaaggcgga

SEQ ID NO: 620147 - DNA, 25 bp, Rattus norvegicus
tgcccagaacttccagcgcaggtaa

SEQ ID NO: 620148 - DNA, 25 bp, Rattus norvegicus
tgcccagaacttgcagcgcaggtaa

SEQ ID NO: 620149 - DNA, 25 bp, Rattus norvegicus
tgcccagaatccactaacagctaat

SEQ ID NO: 620150 - DNA, 25 bp, Rattus norvegicus
tgcccagaatcctctaacagctaat

SEQ ID NO: 620151 - DNA, 25 bp, Rattus norvegicus
tgcccagaatctcatgtccacacaa

SEQ ID NO: 620152 - DNA, 25 bp, Rattus norvegicus
tgcccagaatctgatgtccacacaa

SEQ ID NO: 620153 - DNA, 25 bp, Rattus norvegicus
tgcccagacggccagcctcttggat

SEQ ID NO: 620154 - DNA, 25 bp, Rattus norvegicus
tgcccagacggcgagcctcttggat

SEQ ID NO: 620155 - DNA, 25 bp, Rattus norvegicus
tgcccagactctcaggatctgagct

SEQ ID NO: 620156 - DNA, 25 bp, Rattus norvegicus
tgcccagactctgaggatctgagct

SEQ ID NO: 620157 - DNA, 25 bp, Rattus norvegicus
tgcccagagccaaaccctgtaggtg

SEQ ID NO: 620158 - DNA, 25 bp, Rattus norvegicus
tgcccagagccataccctgtaggtg

SEQ ID NO: 620159 - DNA, 25 bp, Rattus norvegicus
tgcccagagctgcataggcacctgt

SEQ ID NO: 620160 - DNA, 25 bp, Rattus norvegicus
tgcccagagctggataggcacctgt

SEQ ID NO: 620161 - DNA, 25 bp, Rattus norvegicus
tgcccagaggtccttgagtctccat

SEQ ID NO: 620162 - DNA, 25 bp, Rattus norvegicus
tgcccagaggtcgttgagtctccat

SEQ ID NO: 620163 - DNA, 25 bp, Rattus norvegicus
tgcccagataagcagccccggaaga

SEQ ID NO: 620164 - DNA, 25 bp, Rattus norvegicus
tgcccagataaggagccccggaaga

SEQ ID NO: 620165 - DNA, 25 bp, Rattus norvegicus
tgcccagatattcgcctctgtcaaa

SEQ ID NO: 620166 - DNA, 25 bp, Rattus norvegicus
tgcccagatattggcctctgtcaaa

SEQ ID NO: 620167 - DNA, 25 bp, Rattus norvegicus
tgcccagatcaacctactcttagaa

SEQ ID NO: 620168 - DNA, 25 bp, Rattus norvegicus
tgcccagatcaagctactcttagaa

SEQ ID NO: 620169 - DNA, 25 bp, Rattus norvegicus
tgcccagatcttaataacaacccct

SEQ ID NO: 620170 - DNA, 25 bp, Rattus norvegicus
tgcccagatctttataacaacccct

SEQ ID NO: 620171 - DNA, 25 bp, Rattus norvegicus
tgcccagatgcacacctgggtgagc

SEQ ID NO: 620172 - DNA, 25 bp, Rattus norvegicus
tgcccagatgcagacctgggtgagc

SEQ ID NO: 620173 - DNA, 25 bp, Rattus norvegicus
tgcccagcactcagtttcaactgag

SEQ ID NO: 620174 - DNA, 25 bp, Rattus norvegicus
tgcccagcactctgtttcaactgag

SEQ ID NO: 620175 - DNA, 25 bp, Rattus norvegicus
tgcccagcacttcgattttccttaa

SEQ ID NO: 620176 - DNA, 25 bp, Rattus norvegicus
tgcccagcacttggattttccttaa

SEQ ID NO: 620177 - DNA, 25 bp, Rattus norvegicus
tgcccagcagataatccatttccta

SEQ ID NO: 620178 - DNA, 25 bp, Rattus norvegicus
tgcccagcagattatccatttccta

SEQ ID NO: 620179 - DNA, 25 bp, Rattus norvegicus
tgcccagcatatcctgtccttcgaa

SEQ ID NO: 620180 - DNA, 25 bp, Rattus norvegicus
tgcccagcatatgctgtccttcgaa

SEQ ID NO: 620181 - DNA, 25 bp, Rattus norvegicus
tgcccagccaagaattacaatgtgt

SEQ ID NO: 620182 - DNA, 25 bp, Rattus norvegicus
tgcccagccaagtattacaatgtgt

SEQ ID NO: 620183 - DNA, 25 bp, Rattus norvegicus
tgcccagcctcacaagtggctaaca

SEQ ID NO: 620184 - DNA, 25 bp, Rattus norvegicus
tgcccagcctcagaagtggctaaca

SEQ ID NO: 620185 - DNA, 25 bp, Rattus norvegicus
tgcccagcctccatgcaagaatgaa

SEQ ID NO: 620186 - DNA, 25 bp, Rattus norvegicus
tgcccagcctccttgcaagaatgaa

SEQ ID NO: 620187 - DNA, 25 bp, Rattus norvegicus
tgcccagcctgaagactgtgcagac

SEQ ID NO: 620188 - DNA, 25 bp, Rattus norvegicus
tgcccagcctgacagcttgagattg

SEQ ID NO: 620189 - DNA, 25 bp, Rattus norvegicus
tgcccagcctgagagcttgagattg

SEQ ID NO: 620190 - DNA, 25 bp, Rattus norvegicus
tgcccagcctgatgactgtgcagac

SEQ ID NO: 620191 - DNA, 25 bp, Rattus norvegicus
tgcccagcctgcagttgagaaccac

SEQ ID NO: 620192 - DNA, 25 bp, Rattus norvegicus
tgcccagcctgctgttgagaaccac

SEQ ID NO: 620193 - DNA, 25 bp, Rattus norvegicus
tgcccagcctggaaggtgtcagcga

SEQ ID NO: 620194 - DNA, 25 bp, Rattus norvegicus
tgcccagcctggtaggtgtcagcga

SEQ ID NO: 620195 - DNA, 25 bp, Rattus norvegicus
tgcccagcctttcaaacggactcag

SEQ ID NO: 620196 - DNA, 25 bp, Rattus norvegicus
tgcccagcctttcagcagcttaata

SEQ ID NO: 620197 - DNA, 25 bp, Rattus norvegicus
tgcccagcctttcgctgagggtaag

SEQ ID NO: 620198 - DNA, 25 bp, Rattus norvegicus
tgcccagcctttgaaacggactcag

SEQ ID NO: 620199 - DNA, 25 bp, Rattus norvegicus
tgcccagcctttgagcagcttaata

SEQ ID NO: 620200 - DNA, 25 bp, Rattus norvegicus
tgcccagcctttggctgagggtaag

SEQ ID NO: 620201 - DNA, 25 bp, Rattus norvegicus
tgcccagcgaagctatgcgtgagtt

SEQ ID NO: 620202 - DNA, 25 bp, Rattus norvegicus
tgcccagcgaaggtatgcgtgagtt

SEQ ID NO: 620203 - DNA, 25 bp, Rattus norvegicus
tgcccagcgtagatcaaaccatgtt

SEQ ID NO: 620204 - DNA, 25 bp, Rattus norvegicus
tgcccagcgtagttcaaaccatgtt

SEQ ID NO: 620205 - DNA, 25 bp, Rattus norvegicus
tgcccagctcccagagtttatttat

SEQ ID NO: 620206 - DNA, 25 bp, Rattus norvegicus
tgcccagctccctgagtttatttat

SEQ ID NO: 620207 - DNA, 25 bp, Rattus norvegicus
tgcccagctggccaaagcaatcaaa

SEQ ID NO: 620208 - DNA, 25 bp, Rattus norvegicus
tgcccagctggcgaaagcaatcaaa

SEQ ID NO: 620209 - DNA, 25 bp, Rattus norvegicus
tgcccagctgggagtttagagatgt

SEQ ID NO: 620210 - DNA, 25 bp, Rattus norvegicus
tgcccagctgggtgtttagagatgt

SEQ ID NO: 620211 - DNA, 25 bp, Rattus norvegicus
tgcccagcttccaaaacacgtatga

SEQ ID NO: 620212 - DNA, 25 bp, Rattus norvegicus
tgcccagcttcctaaacacgtatga

SEQ ID NO: 620213 - DNA, 25 bp, Rattus norvegicus
tgcccagcttctcatggcgcagaaa

SEQ ID NO: 620214 - DNA, 25 bp, Rattus norvegicus
tgcccagcttctgatggcgcagaaa

SEQ ID NO: 620215 - DNA, 25 bp, Rattus norvegicus
tgcccagcttttaccttcctgtatc

SEQ ID NO: 620216 - DNA, 25 bp, Rattus norvegicus
tgcccagctttttccttcctgtatc

SEQ ID NO: 620217 - DNA, 25 bp, Rattus norvegicus
tgcccaggaaacagcctgcacgtga

SEQ ID NO: 620218 - DNA, 25 bp, Rattus norvegicus
tgcccaggaaactgcctgcacgtga

SEQ ID NO: 620219 - DNA, 25 bp, Rattus norvegicus
tgcccaggaacaattcccagatgtg

SEQ ID NO: 620220 - DNA, 25 bp, Rattus norvegicus
tgcccaggaacatttcccagatgtg

SEQ ID NO: 620221 - DNA, 25 bp, Rattus norvegicus
tgcccaggagctaggcatgaggtct

SEQ ID NO: 620222 - DNA, 25 bp, Rattus norvegicus
tgcccaggagcttggcatgaggtct

SEQ ID NO: 620223 - DNA, 25 bp, Rattus norvegicus
tgcccaggattccttcctttgttat

SEQ ID NO: 620224 - DNA, 25 bp, Rattus norvegicus
tgcccaggattcgttcctttgttat

SEQ ID NO: 620225 - DNA, 25 bp, Rattus norvegicus
tgcccaggcaaacatgccccaaggg

SEQ ID NO: 620226 - DNA, 25 bp, Rattus norvegicus
tgcccaggcaaagatgccccaaggg

SEQ ID NO: 620227 - DNA, 25 bp, Rattus norvegicus
tgcccaggcagcactagtaggccat

SEQ ID NO: 620228 - DNA, 25 bp, Rattus norvegicus
tgcccaggcagctctagtaggccat

SEQ ID NO: 620229 - DNA, 25 bp, Rattus norvegicus
tgcccaggctacagtccgaaatgaa

SEQ ID NO: 620230 - DNA, 25 bp, Rattus norvegicus
tgcccaggctactgtccgaaatgaa

SEQ ID NO: 620231 - DNA, 25 bp, Rattus norvegicus
tgcccaggctctacagctgaagcca

SEQ ID NO: 620232 - DNA, 25 bp, Rattus norvegicus
tgcccaggctcttcagctgaagcca

SEQ ID NO: 620233 - DNA, 25 bp, Rattus norvegicus
tgcccagggagcagcttaaactgca

SEQ ID NO: 620234 - DNA, 25 bp, Rattus norvegicus
tgcccagggagctgcttaaactgca

SEQ ID NO: 620235 - DNA, 25 bp, Rattus norvegicus
tgcccagggcgcagattacgtagta

SEQ ID NO: 620236 - DNA, 25 bp, Rattus norvegicus
tgcccagggcgctgattacgtagta

SEQ ID NO: 620237 - DNA, 25 bp, Rattus norvegicus
tgcccagggctgagtctgcaaaggt

SEQ ID NO: 620238 - DNA, 25 bp, Rattus norvegicus
tgcccagggctgtgtctgcaaaggt

SEQ ID NO: 620239 - DNA, 25 bp, Rattus norvegicus
tgcccagggttgactctggttcaga

SEQ ID NO: 620240 - DNA, 25 bp, Rattus norvegicus
tgcccagggttgtctctggttcaga

SEQ ID NO: 620241 - DNA, 25 bp, Rattus norvegicus
tgcccaggtctcaaggctggtgaga

SEQ ID NO: 620242 - DNA, 25 bp, Rattus norvegicus
tgcccaggtctctaggctggtgaga

SEQ ID NO: 620243 - DNA, 25 bp, Rattus norvegicus
tgcccagtaacgagccagagcagct

SEQ ID NO: 620244 - DNA, 25 bp, Rattus norvegicus
tgcccagtaacgtgccagagcagct

SEQ ID NO: 620245 - DNA, 25 bp, Rattus norvegicus
tgcccagtacttactcagcttgtga

SEQ ID NO: 620246 - DNA, 25 bp, Rattus norvegicus
tgcccagtactttctcagcttgtga

SEQ ID NO: 620247 - DNA, 25 bp, Rattus norvegicus
tgcccagtcactaggtgctagttag

SEQ ID NO: 620248 - DNA, 25 bp, Rattus norvegicus
tgcccagtcacttggtgctagttag

SEQ ID NO: 620249 - DNA, 25 bp, Rattus norvegicus
tgcccagtcagtctcagattctaga

SEQ ID NO: 620250 - DNA, 25 bp, Rattus norvegicus
tgcccagtcagtgtcagattctaga

SEQ ID NO: 620251 - DNA, 25 bp, Rattus norvegicus
tgcccagtccatacagctagtgaag

SEQ ID NO: 620252 - DNA, 25 bp, Rattus norvegicus
tgcccagtccattcagctagtgaag

SEQ ID NO: 620253 - DNA, 25 bp, Rattus norvegicus
tgcccagtcccgcatgtatattaat

SEQ ID NO: 620254 - DNA, 25 bp, Rattus norvegicus
tgcccagtcccggatgtatattaat

SEQ ID NO: 620255 - DNA, 25 bp, Rattus norvegicus
tgcccagtctgtcgaccctgaggaa

SEQ ID NO: 620256 - DNA, 25 bp, Rattus norvegicus
tgcccagtctgtggaccctgaggaa

SEQ ID NO: 620257 - DNA, 25 bp, Rattus norvegicus
tgcccagtgaacaccagaagtctta

SEQ ID NO: 620258 - DNA, 25 bp, Rattus norvegicus
tgcccagtgaactccagaagtctta

SEQ ID NO: 620259 - DNA, 25 bp, Rattus norvegicus
tgcccagtgcaccaaatcctatatg

SEQ ID NO: 620260 - DNA, 25 bp, Rattus norvegicus
tgcccagtgcacgaaatcctatatg

SEQ ID NO: 620261 - DNA, 25 bp, Rattus norvegicus
tgcccagtgctgagcaggccggtta

SEQ ID NO: 620262 - DNA, 25 bp, Rattus norvegicus
tgcccagtgctgtgcaggccggtta

SEQ ID NO: 620263 - DNA, 25 bp, Rattus norvegicus
tgcccagtgtagcttttgttgatta

SEQ ID NO: 620264 - DNA, 25 bp, Rattus norvegicus
tgcccagtgtaggttttgttgatta

SEQ ID NO: 620265 - DNA, 25 bp, Rattus norvegicus
tgcccagttcagaggtgacaagact

SEQ ID NO: 620266 - DNA, 25 bp, Rattus norvegicus
tgcccagttcagtggtgacaagact

SEQ ID NO: 620267 - DNA, 25 bp, Rattus norvegicus
tgcccagttctcacatggatgctgt

SEQ ID NO: 620268 - DNA, 25 bp, Rattus norvegicus
tgcccagttctctcatggatgctgt

SEQ ID NO: 620269 - DNA, 25 bp, Rattus norvegicus
tgcccagtttggagctgcagaccgt

SEQ ID NO: 620270 - DNA, 25 bp, Rattus norvegicus
tgcccagtttggtgctgcagaccgt

SEQ ID NO: 620271 - DNA, 25 bp, Rattus norvegicus
tgcccataatcaacaggaagttgtt

SEQ ID NO: 620272 - DNA, 25 bp, Rattus norvegicus
tgcccataatcatcaggaagttgtt

SEQ ID NO: 620273 - DNA, 25 bp, Rattus norvegicus
tgcccatagggtacaatgagcagac

SEQ ID NO: 620274 - DNA, 25 bp, Rattus norvegicus
tgcccatagggttcaatgagcagac

SEQ ID NO: 620275 - DNA, 25 bp, Rattus norvegicus
tgcccatatactcaagcgactcctt

SEQ ID NO: 620276 - DNA, 25 bp, Rattus norvegicus
tgcccatatactgaagcgactcctt

SEQ ID NO: 620277 - DNA, 25 bp, Rattus norvegicus
tgcccatatgacctttgccatcatt

SEQ ID NO: 620278 - DNA, 25 bp, Rattus norvegicus
tgcccatatgacgtttgccatcatt

SEQ ID NO: 620279 - DNA, 25 bp, Rattus norvegicus
tgcccatcacgacgaccctgaattt

SEQ ID NO: 620280 - DNA, 25 bp, Rattus norvegicus
tgcccatcacgaggaccctgaattt

SEQ ID NO: 620281 - DNA, 25 bp, Rattus norvegicus
tgcccatcatcacaacatcatttat

SEQ ID NO: 620282 - DNA, 25 bp, Rattus norvegicus
tgcccatcatcactgagtccaggtc

SEQ ID NO: 620283 - DNA, 25 bp, Rattus norvegicus
tgcccatcatcagaacatcatttat

SEQ ID NO: 620284 - DNA, 25 bp, Rattus norvegicus
tgcccatcatcagtgagtccaggtc

SEQ ID NO: 620285 - DNA, 25 bp, Rattus norvegicus
tgcccatcatcgactctgtggagtg

SEQ ID NO: 620286 - DNA, 25 bp, Rattus norvegicus
tgcccatcatcgtctctgtggagtg

SEQ ID NO: 620287 - DNA, 25 bp, Rattus norvegicus
tgcccatcatctactggcaggatgc

SEQ ID NO: 620288 - DNA, 25 bp, Rattus norvegicus
tgcccatcatcttctggcaggatgc

SEQ ID NO: 620289 - DNA, 25 bp, Rattus norvegicus
tgcccatcattcagaggacttctga

SEQ ID NO: 620290 - DNA, 25 bp, Rattus norvegicus
tgcccatcattctgaggacttctga

SEQ ID NO: 620291 - DNA, 25 bp, Rattus norvegicus
tgcccatcccttagactaacatcaa

SEQ ID NO: 620292 - DNA, 25 bp, Rattus norvegicus
tgcccatccctttgactaacatcaa

SEQ ID NO: 620293 - DNA, 25 bp, Rattus norvegicus
tgcccatcctgcagtggtctgaaga

SEQ ID NO: 620294 - DNA, 25 bp, Rattus norvegicus
tgcccatcctgctgtggtctgaaga

SEQ ID NO: 620295 - DNA, 25 bp, Rattus norvegicus
tgcccatcgactatccagaagagaa

SEQ ID NO: 620296 - DNA, 25 bp, Rattus norvegicus
tgcccatcgactttccagaagagaa

SEQ ID NO: 620297 - DNA, 25 bp, Rattus norvegicus
tgcccatcgtatcctttaacttact

SEQ ID NO: 620298 - DNA, 25 bp, Rattus norvegicus
tgcccatcgtatgctttaacttact

SEQ ID NO: 620299 - DNA, 25 bp, Rattus norvegicus
tgcccatcgtccactttgaagtaga

SEQ ID NO: 620300 - DNA, 25 bp, Rattus norvegicus
tgcccatcgtcctctttgaagtaga

SEQ ID NO: 620301 - DNA, 25 bp, Rattus norvegicus
tgcccatctcataccaaactacaag

SEQ ID NO: 620302 - DNA, 25 bp, Rattus norvegicus
tgcccatctcattccaaactacaag

SEQ ID NO: 620303 - DNA, 25 bp, Rattus norvegicus
tgcccatctgcccaagtagagactg

SEQ ID NO: 620304 - DNA, 25 bp, Rattus norvegicus
tgcccatctgccgaagtagagactg

SEQ ID NO: 620305 - DNA, 25 bp, Rattus norvegicus
tgcccatcttcaccactgaatgtga

SEQ ID NO: 620306 - DNA, 25 bp, Rattus norvegicus
tgcccatcttcagcactgaatgtga

SEQ ID NO: 620307 - DNA, 25 bp, Rattus norvegicus
tgcccatcttggagttgactgtaaa

SEQ ID NO: 620308 - DNA, 25 bp, Rattus norvegicus
tgcccatcttggtgttgactgtaaa

SEQ ID NO: 620309 - DNA, 25 bp, Rattus norvegicus
tgcccatgatcaactttgccaagga

SEQ ID NO: 620310 - DNA, 25 bp, Rattus norvegicus
tgcccatgatcatctttgccaagga

SEQ ID NO: 620311 - DNA, 25 bp, Rattus norvegicus
tgcccatggagaccccacgaaggat

SEQ ID NO: 620312 - DNA, 25 bp, Rattus norvegicus
tgcccatggagagcccacgaaggat

SEQ ID NO: 620313 - DNA, 25 bp, Rattus norvegicus
tgcccatggccaatgcttaacgttg

SEQ ID NO: 620314 - DNA, 25 bp, Rattus norvegicus
tgcccatggccattgcttaacgttg

SEQ ID NO: 620315 - DNA, 25 bp, Rattus norvegicus
tgcccatgggcactgtggttcattg

SEQ ID NO: 620316 - DNA, 25 bp, Rattus norvegicus
tgcccatgggcagtgtggttcattg

SEQ ID NO: 620317 - DNA, 25 bp, Rattus norvegicus
tgcccatgtacccatctttctaaga

SEQ ID NO: 620318 - DNA, 25 bp, Rattus norvegicus
tgcccatgtaccgatctttctaaga

SEQ ID NO: 620319 - DNA, 25 bp, Rattus norvegicus
tgcccatgtcatataggtagccagg

SEQ ID NO: 620320 - DNA, 25 bp, Rattus norvegicus
tgcccatgtcatttaggtagccagg

SEQ ID NO: 620321 - DNA, 25 bp, Rattus norvegicus
tgcccatgtcttctgcccaggagag

SEQ ID NO: 620322 - DNA, 25 bp, Rattus norvegicus
tgcccatgtcttgtgcccaggagag

SEQ ID NO: 620323 - DNA, 25 bp, Rattus norvegicus
tgcccatgtgtactgtatgtgcccc

SEQ ID NO: 620324 - DNA, 25 bp, Rattus norvegicus
tgcccatgtgtagtgtatgtgcccc

SEQ ID NO: 620325 - DNA, 25 bp, Rattus norvegicus
tgcccatgtttgaccgactgcaaaa

SEQ ID NO: 620326 - DNA, 25 bp, Rattus norvegicus
tgcccatgtttgtccgactgcaaaa

SEQ ID NO: 620327 - DNA, 25 bp, Rattus norvegicus
tgcccattagttactttcacagtat

SEQ ID NO: 620328 - DNA, 25 bp, Rattus norvegicus
tgcccattagtttctttcacagtat

SEQ ID NO: 620329 - DNA, 25 bp, Rattus norvegicus
tgcccattccacagatattctgaac

SEQ ID NO: 620330 - DNA, 25 bp, Rattus norvegicus
tgcccattccactgatattctgaac

SEQ ID NO: 620331 - DNA, 25 bp, Rattus norvegicus
tgcccattcccacctatttatttat

SEQ ID NO: 620332 - DNA, 25 bp, Rattus norvegicus
tgcccattcccagctatttatttat

SEQ ID NO: 620333 - DNA, 25 bp, Rattus norvegicus
tgcccattccccaaaacgaagttga

SEQ ID NO: 620334 - DNA, 25 bp, Rattus norvegicus
tgcccattcccctaaacgaagttga

SEQ ID NO: 620335 - DNA, 25 bp, Rattus norvegicus
tgcccattctgaagacaaccacaat

SEQ ID NO: 620336 - DNA, 25 bp, Rattus norvegicus
tgcccattctgatgacaaccacaat

SEQ ID NO: 620337 - DNA, 25 bp, Rattus norvegicus
tgcccattgtgcactctgtaatagg

SEQ ID NO: 620338 - DNA, 25 bp, Rattus norvegicus
tgcccattgtgctctctgtaatagg

SEQ ID NO: 620339 - DNA, 25 bp, Rattus norvegicus
tgcccattgtgtactcggagttgac

SEQ ID NO: 620340 - DNA, 25 bp, Rattus norvegicus
tgcccattgtgttctcggagttgac

SEQ ID NO: 620341 - DNA, 25 bp, Rattus norvegicus
tgcccatttaaactttgctttctcc

SEQ ID NO: 620342 - DNA, 25 bp, Rattus norvegicus
tgcccatttaaagtttgctttctcc

SEQ ID NO: 620343 - DNA, 25 bp, Rattus norvegicus
tgcccatttctacctgtgagacaga

SEQ ID NO: 620344 - DNA, 25 bp, Rattus norvegicus
tgcccatttctagctgtgagacaga

SEQ ID NO: 620345 - DNA, 25 bp, Rattus norvegicus
tgcccatttgggataacttgtcttt

SEQ ID NO: 620346 - DNA, 25 bp, Rattus norvegicus
tgcccatttgggttaacttgtcttt

SEQ ID NO: 620347 - DNA, 25 bp, Rattus norvegicus
tgccccaaaccaactgcttagaata

SEQ ID NO: 620348 - DNA, 25 bp, Rattus norvegicus
tgccccaaaccatctgcttagaata

SEQ ID NO: 620349 - DNA, 25 bp, Rattus norvegicus
tgccccaacggacttccaaatgaat

SEQ ID NO: 620350 - DNA, 25 bp, Rattus norvegicus
tgccccaacggagttccaaatgaat

SEQ ID NO: 620351 - DNA, 25 bp, Rattus norvegicus
tgccccaactacaggactcatattc

SEQ ID NO: 620352 - DNA, 25 bp, Rattus norvegicus
tgccccaactactggactcatattc

SEQ ID NO: 620353 - DNA, 25 bp, Rattus norvegicus
tgccccaactctagtctgtcagaag

SEQ ID NO: 620354 - DNA, 25 bp, Rattus norvegicus
tgccccaactcttgtctgtcagaag

SEQ ID NO: 620355 - DNA, 25 bp, Rattus norvegicus
tgccccaactgaactgcggtgatta

SEQ ID NO: 620356 - DNA, 25 bp, Rattus norvegicus
tgccccaactgatctgcggtgatta

SEQ ID NO: 620357 - DNA, 25 bp, Rattus norvegicus
tgccccaacttgcacatgatcttgg

SEQ ID NO: 620358 - DNA, 25 bp, Rattus norvegicus
tgccccaacttggacatgatcttgg

SEQ ID NO: 620359 - DNA, 25 bp, Rattus norvegicus
tgccccaagcatctccacggaagag

SEQ ID NO: 620360 - DNA, 25 bp, Rattus norvegicus
tgccccaagcatgtccacggaagag

SEQ ID NO: 620361 - DNA, 25 bp, Rattus norvegicus
tgccccaaggctaggtctgtgacga

SEQ ID NO: 620362 - DNA, 25 bp, Rattus norvegicus
tgccccaaggcttggtctgtgacga

SEQ ID NO: 620363 - DNA, 25 bp, Rattus norvegicus
tgccccaaggttcccagctttatga

SEQ ID NO: 620364 - DNA, 25 bp, Rattus norvegicus
tgccccaaggttgccagctttatga

SEQ ID NO: 620365 - DNA, 25 bp, Rattus norvegicus
tgccccaagtcaatctcacaagaaa

SEQ ID NO: 620366 - DNA, 25 bp, Rattus norvegicus
tgccccaagtcattctcacaagaaa

SEQ ID NO: 620367 - DNA, 25 bp, Rattus norvegicus
tgccccaatccgacctgaggaatac

SEQ ID NO: 620368 - DNA, 25 bp, Rattus norvegicus
tgccccaatccgtcctgaggaatac

SEQ ID NO: 620369 - DNA, 25 bp, Rattus norvegicus
tgccccaattctctatgtcttcaaa

SEQ ID NO: 620370 - DNA, 25 bp, Rattus norvegicus
tgccccaattctgtatgtcttcaaa

SEQ ID NO: 620371 - DNA, 25 bp, Rattus norvegicus
tgccccacaatgctacttgagagga

SEQ ID NO: 620372 - DNA, 25 bp, Rattus norvegicus
tgccccacaatggtacttgagagga

SEQ ID NO: 620373 - DNA, 25 bp, Rattus norvegicus
tgccccacagttcacaatcagtatg

SEQ ID NO: 620374 - DNA, 25 bp, Rattus norvegicus
tgccccacagttgacaatcagtatg

SEQ ID NO: 620375 - DNA, 25 bp, Rattus norvegicus
tgccccacatttcaagtctcggagg

SEQ ID NO: 620376 - DNA, 25 bp, Rattus norvegicus
tgccccacatttgaagtctcggagg

SEQ ID NO: 620377 - DNA, 25 bp, Rattus norvegicus
tgccccaccctgctataggtggtat

SEQ ID NO: 620378 - DNA, 25 bp, Rattus norvegicus
tgccccaccctggtataggtggtat

SEQ ID NO: 620379 - DNA, 25 bp, Rattus norvegicus
tgccccaccgagagggcacacgtgt

SEQ ID NO: 620380 - DNA, 25 bp, Rattus norvegicus
tgccccaccgagtgggcacacgtgt

SEQ ID NO: 620381 - DNA, 25 bp, Rattus norvegicus
tgccccacctctaattttgcatgtg

SEQ ID NO: 620382 - DNA, 25 bp, Rattus norvegicus
tgccccacctctcaaaacgatagtg

SEQ ID NO: 620383 - DNA, 25 bp, Rattus norvegicus
tgccccacctctgaaaacgatagtg

SEQ ID NO: 620384 - DNA, 25 bp, Rattus norvegicus
tgccccacctcttattttgcatgtg

SEQ ID NO: 620385 - DNA, 25 bp, Rattus norvegicus
tgccccacctgaaagtagcagtagc

SEQ ID NO: 620386 - DNA, 25 bp, Rattus norvegicus
tgccccacctgatagtagcagtagc

SEQ ID NO: 620387 - DNA, 25 bp, Rattus norvegicus
tgccccacctgtctaactgtaggaa

SEQ ID NO: 620388 - DNA, 25 bp, Rattus norvegicus
tgccccacctgtgtaactgtaggaa

SEQ ID NO: 620389 - DNA, 25 bp, Rattus norvegicus
tgccccactcagaacttacttaaga

SEQ ID NO: 620390 - DNA, 25 bp, Rattus norvegicus
tgccccactcagtacttacttaaga

SEQ ID NO: 620391 - DNA, 25 bp, Rattus norvegicus
tgccccagaaaacctgccttggtag

SEQ ID NO: 620392 - DNA, 25 bp, Rattus norvegicus
tgccccagaaaagctgccttggtag

SEQ ID NO: 620393 - DNA, 25 bp, Rattus norvegicus
tgccccagaagcagggtggcctaga

SEQ ID NO: 620394 - DNA, 25 bp, Rattus norvegicus
tgccccagaagctgggtggcctaga

SEQ ID NO: 620395 - DNA, 25 bp, Rattus norvegicus
tgccccagagacagaaggctatctt

SEQ ID NO: 620396 - DNA, 25 bp, Rattus norvegicus
tgccccagagactgaaggctatctt

SEQ ID NO: 620397 - DNA, 25 bp, Rattus norvegicus
tgccccagagcacaaccaggaagtg

SEQ ID NO: 620398 - DNA, 25 bp, Rattus norvegicus
tgccccagagcagaaccaggaagtg

SEQ ID NO: 620399 - DNA, 25 bp, Rattus norvegicus
tgccccagatttcatcttccaaaca

SEQ ID NO: 620400 - DNA, 25 bp, Rattus norvegicus
tgccccagatttgatcttccaaaca

SEQ ID NO: 620401 - DNA, 25 bp, Rattus norvegicus
tgccccagcagccaagtggccgtag

SEQ ID NO: 620402 - DNA, 25 bp, Rattus norvegicus
tgccccagcagcgaagtggccgtag

SEQ ID NO: 620403 - DNA, 25 bp, Rattus norvegicus
tgccccagcagtcagcctgtgaaag

SEQ ID NO: 620404 - DNA, 25 bp, Rattus norvegicus
tgccccagcagtgagcctgtgaaag

SEQ ID NO: 620405 - DNA, 25 bp, Rattus norvegicus
tgccccagctgacgtgttaggctaa

SEQ ID NO: 620406 - DNA, 25 bp, Rattus norvegicus
tgccccagctgaggtgttaggctaa

SEQ ID NO: 620407 - DNA, 25 bp, Rattus norvegicus
tgccccagctttagtgttaccaata

SEQ ID NO: 620408 - DNA, 25 bp, Rattus norvegicus
tgccccagcttttgtgttaccaata

SEQ ID NO: 620409 - DNA, 25 bp, Rattus norvegicus
tgccccaggaaaccaagtcacttta

SEQ ID NO: 620410 - DNA, 25 bp, Rattus norvegicus
tgccccaggaaagcaagtcacttta

SEQ ID NO: 620411 - DNA, 25 bp, Rattus norvegicus
tgccccaggacaacagatcagactg

SEQ ID NO: 620412 - DNA, 25 bp, Rattus norvegicus
tgccccaggacatcagatcagactg

SEQ ID NO: 620413 - DNA, 25 bp, Rattus norvegicus
tgccccaggaggaagaagattggct

SEQ ID NO: 620414 - DNA, 25 bp, Rattus norvegicus
tgccccaggaggtagaagattggct

SEQ ID NO: 620415 - DNA, 25 bp, Rattus norvegicus
tgccccagggcacactagcagagct

SEQ ID NO: 620416 - DNA, 25 bp, Rattus norvegicus
tgccccagggcagactagcagagct

SEQ ID NO: 620417 - DNA, 25 bp, Rattus norvegicus
tgccccagggcgagaagatccaact

SEQ ID NO: 620418 - DNA, 25 bp, Rattus norvegicus
tgccccagggcgtgaagatccaact

SEQ ID NO: 620419 - DNA, 25 bp, Rattus norvegicus
tgccccagtaccagatgaacacatt

SEQ ID NO: 620420 - DNA, 25 bp, Rattus norvegicus
tgccccagtacctgatgaacacatt

SEQ ID NO: 620421 - DNA, 25 bp, Rattus norvegicus
tgccccagtccacggccttggtgag

SEQ ID NO: 620422 - DNA, 25 bp, Rattus norvegicus
tgccccagtccagggccttggtgag

SEQ ID NO: 620423 - DNA, 25 bp, Rattus norvegicus
tgccccagtgcacaaagcctaaagt

SEQ ID NO: 620424 - DNA, 25 bp, Rattus norvegicus
tgccccagtgcagaaagcctaaagt

SEQ ID NO: 620425 - DNA, 25 bp, Rattus norvegicus
tgccccagtggcaatctattagact

SEQ ID NO: 620426 - DNA, 25 bp, Rattus norvegicus
tgccccagtggccaccagaaatggt

SEQ ID NO: 620427 - DNA, 25 bp, Rattus norvegicus
tgccccagtggcgaccagaaatggt

SEQ ID NO: 620428 - DNA, 25 bp, Rattus norvegicus
tgccccagtggctatctattagact

SEQ ID NO: 620429 - DNA, 25 bp, Rattus norvegicus
tgccccagtgggattgtcaacgagg

SEQ ID NO: 620430 - DNA, 25 bp, Rattus norvegicus
tgccccagtgggtttgtcaacgagg

SEQ ID NO: 620431 - DNA, 25 bp, Rattus norvegicus
tgccccagttccacctgttaatgaa

SEQ ID NO: 620432 - DNA, 25 bp, Rattus norvegicus
tgccccagttcctcctgttaatgaa

SEQ ID NO: 620433 - DNA, 25 bp, Rattus norvegicus
tgccccatcagtaaagtcttgtccc

SEQ ID NO: 620434 - DNA, 25 bp, Rattus norvegicus
tgccccatcagttaagtcttgtccc

SEQ ID NO: 620435 - DNA, 25 bp, Rattus norvegicus
tgccccatctcaccgacttgattgt

SEQ ID NO: 620436 - DNA, 25 bp, Rattus norvegicus
tgccccatctcagcgacttgattgt

SEQ ID NO: 620437 - DNA, 25 bp, Rattus norvegicus
tgccccatcttaaactctaggactg

SEQ ID NO: 620438 - DNA, 25 bp, Rattus norvegicus
tgccccatcttatactctaggactg

SEQ ID NO: 620439 - DNA, 25 bp, Rattus norvegicus
tgccccatgacaagaccaagtgctt

SEQ ID NO: 620440 - DNA, 25 bp, Rattus norvegicus
tgccccatgacatgaccaagtgctt

SEQ ID NO: 620441 - DNA, 25 bp, Rattus norvegicus
tgccccatgaccctttttgggaaga

SEQ ID NO: 620442 - DNA, 25 bp, Rattus norvegicus
tgccccatgaccgtttttgggaaga

SEQ ID NO: 620443 - DNA, 25 bp, Rattus norvegicus
tgccccatgagtatgaacaccgtgc

SEQ ID NO: 620444 - DNA, 25 bp, Rattus norvegicus
tgccccatgagtttgaacaccgtgc

SEQ ID NO: 620445 - DNA, 25 bp, Rattus norvegicus
tgccccatgtgcaatatttgtcaac

SEQ ID NO: 620446 - DNA, 25 bp, Rattus norvegicus
tgccccatgtgctatatttgtcaac

SEQ ID NO: 620447 - DNA, 25 bp, Rattus norvegicus
tgccccattctgctgaggtgtgttt

SEQ ID NO: 620448 - DNA, 25 bp, Rattus norvegicus
tgccccattctggtgaggtgtgttt

SEQ ID NO: 620449 - DNA, 25 bp, Rattus norvegicus
tgccccattgctagctgagaccttc

SEQ ID NO: 620450 - DNA, 25 bp, Rattus norvegicus
tgccccattgcttgctgagaccttc

SEQ ID NO: 620451 - DNA, 25 bp, Rattus norvegicus
tgcccccaggttaggcagtgaagga

SEQ ID NO: 620452 - DNA, 25 bp, Rattus norvegicus
tgcccccaggtttggcagtgaagga

SEQ ID NO: 620453 - DNA, 25 bp, Rattus norvegicus
tgccccctgttaattggacctcttt

SEQ ID NO: 620454 - DNA, 25 bp, Rattus norvegicus
tgccccctgttatttggacctcttt

SEQ ID NO: 620455 - DNA, 25 bp, Rattus norvegicus
tgccccgacgaacgacccaaaatga

SEQ ID NO: 620456 - DNA, 25 bp, Rattus norvegicus
tgccccgacgaaggacccaaaatga

SEQ ID NO: 620457 - DNA, 25 bp, Rattus norvegicus
tgccccgagagcactgcctggagaa

SEQ ID NO: 620458 - DNA, 25 bp, Rattus norvegicus
tgccccgagagctctgcctggagaa

SEQ ID NO: 620459 - DNA, 25 bp, Rattus norvegicus
tgccccgatattccctgtttggaaa

SEQ ID NO: 620460 - DNA, 25 bp, Rattus norvegicus
tgccccgatattgcctgtttggaaa

SEQ ID NO: 620461 - DNA, 25 bp, Rattus norvegicus
tgccccgcggcacaaaattacaaaa

SEQ ID NO: 620462 - DNA, 25 bp, Rattus norvegicus
tgccccgcggcagaaaattacaaaa

SEQ ID NO: 620463 - DNA, 25 bp, Rattus norvegicus
tgccccgctggacgcagcaaagctg

SEQ ID NO: 620464 - DNA, 25 bp, Rattus norvegicus
tgccccgctggaggcagcaaagctg

SEQ ID NO: 620465 - DNA, 25 bp, Rattus norvegicus
tgccccggaagaacctcagctgaga

SEQ ID NO: 620466 - DNA, 25 bp, Rattus norvegicus
tgccccggaagatcctcagctgaga

SEQ ID NO: 620467 - DNA, 25 bp, Rattus norvegicus
tgccccggacagacattttaacctt

SEQ ID NO: 620468 - DNA, 25 bp, Rattus norvegicus
tgccccggacagtcattttaacctt

SEQ ID NO: 620469 - DNA, 25 bp, Rattus norvegicus
tgccccggagcacataaccttaagt

SEQ ID NO: 620470 - DNA, 25 bp, Rattus norvegicus
tgccccggagcagataaccttaagt

SEQ ID NO: 620471 - DNA, 25 bp, Rattus norvegicus
tgccccggcaacagaccgaaaaaga

SEQ ID NO: 620472 - DNA, 25 bp, Rattus norvegicus
tgccccggcaactgaccgaaaaaga

SEQ ID NO: 620473 - DNA, 25 bp, Rattus norvegicus
tgccccgggaatactgaagtactgg

SEQ ID NO: 620474 - DNA, 25 bp, Rattus norvegicus
tgccccgggaattctgaagtactgg

SEQ ID NO: 620475 - DNA, 25 bp, Rattus norvegicus
tgccccggtgcaagaggtcacaaaa

SEQ ID NO: 620476 - DNA, 25 bp, Rattus norvegicus
tgccccggtgcatgaggtcacaaaa

SEQ ID NO: 620477 - DNA, 25 bp, Rattus norvegicus
tgccccgtgagcagtggccagtatg

SEQ ID NO: 620478 - DNA, 25 bp, Rattus norvegicus
tgccccgtgagctgtggccagtatg

SEQ ID NO: 620479 - DNA, 25 bp, Rattus norvegicus
tgccccgtgtgtagtagtgttttga

SEQ ID NO: 620480 - DNA, 25 bp, Rattus norvegicus
tgccccgtgtgttgtagtgttttga

SEQ ID NO: 620481 - DNA, 25 bp, Rattus norvegicus
tgccccgttggcaaggatttcaaac

SEQ ID NO: 620482 - DNA, 25 bp, Rattus norvegicus
tgccccgttggctaggatttcaaac

SEQ ID NO: 620483 - DNA, 25 bp, Rattus norvegicus
tgcccctaacccaggtttcatgtaa

SEQ ID NO: 620484 - DNA, 25 bp, Rattus norvegicus
tgcccctaaccctggtttcatgtaa

SEQ ID NO: 620485 - DNA, 25 bp, Rattus norvegicus
tgcccctaactactgacccatggaa

SEQ ID NO: 620486 - DNA, 25 bp, Rattus norvegicus
tgcccctaactagtgacccatggaa

SEQ ID NO: 620487 - DNA, 25 bp, Rattus norvegicus
tgcccctaacttacgggacttagtg

SEQ ID NO: 620488 - DNA, 25 bp, Rattus norvegicus
tgcccctaactttcgggacttagtg

SEQ ID NO: 620489 - DNA, 25 bp, Rattus norvegicus
tgcccctacacaagtggcattctct

SEQ ID NO: 620490 - DNA, 25 bp, Rattus norvegicus
tgcccctacacatgtggcattctct

SEQ ID NO: 620491 - DNA, 25 bp, Rattus norvegicus
tgcccctacattaggagcctggaca

SEQ ID NO: 620492 - DNA, 25 bp, Rattus norvegicus
tgcccctacatttggagcctggaca

SEQ ID NO: 620493 - DNA, 25 bp, Rattus norvegicus
tgcccctactccagagaacattaaa

SEQ ID NO: 620494 - DNA, 25 bp, Rattus norvegicus
tgcccctactcctgagaacattaaa

SEQ ID NO: 620495 - DNA, 25 bp, Rattus norvegicus
tgcccctagaaccacagatgacctg

SEQ ID NO: 620496 - DNA, 25 bp, Rattus norvegicus
tgcccctagaacgacagatgacctg

SEQ ID NO: 620497 - DNA, 25 bp, Rattus norvegicus
tgcccctagcctcttggagaagcat

SEQ ID NO: 620498 - DNA, 25 bp, Rattus norvegicus
tgcccctagcctgttggagaagcat

SEQ ID NO: 620499 - DNA, 25 bp, Rattus norvegicus
tgcccctatactactgtcgaaggaa

SEQ ID NO: 620500 - DNA, 25 bp, Rattus norvegicus
tgcccctatacttctgtcgaaggaa

SEQ ID NO: 620501 - DNA, 25 bp, Rattus norvegicus
tgcccctatttcatgacactgtaaa

SEQ ID NO: 620502 - DNA, 25 bp, Rattus norvegicus
tgcccctatttcttgacactgtaaa

SEQ ID NO: 620503 - DNA, 25 bp, Rattus norvegicus
tgcccctcaatcaaggaccatgttt

SEQ ID NO: 620504 - DNA, 25 bp, Rattus norvegicus
tgcccctcaatctaggaccatgttt

SEQ ID NO: 620505 - DNA, 25 bp, Rattus norvegicus
tgcccctcaggtattcctagagcgg

SEQ ID NO: 620506 - DNA, 25 bp, Rattus norvegicus
tgcccctcaggttttcctagagcgg

SEQ ID NO: 620507 - DNA, 25 bp, Rattus norvegicus
tgcccctcatgcctgtgagttttgt

SEQ ID NO: 620508 - DNA, 25 bp, Rattus norvegicus
tgcccctcatgcgtgtgagttttgt

SEQ ID NO: 620509 - DNA, 25 bp, Rattus norvegicus
tgcccctcatttagacaggacggat

SEQ ID NO: 620510 - DNA, 25 bp, Rattus norvegicus
tgcccctcattttgacaggacggat

SEQ ID NO: 620511 - DNA, 25 bp, Rattus norvegicus
tgcccctcccagcactaattgaaga

SEQ ID NO: 620512 - DNA, 25 bp, Rattus norvegicus
tgcccctcccaggactaattgaaga

SEQ ID NO: 620513 - DNA, 25 bp, Rattus norvegicus
tgcccctcccctaggcatgtataaa

SEQ ID NO: 620514 - DNA, 25 bp, Rattus norvegicus
tgcccctccccttggcatgtataaa

SEQ ID NO: 620515 - DNA, 25 bp, Rattus norvegicus
tgcccctcctacattaatcatcaag

SEQ ID NO: 620516 - DNA, 25 bp, Rattus norvegicus
tgcccctcctactttaatcatcaag

SEQ ID NO: 620517 - DNA, 25 bp, Rattus norvegicus
tgcccctccttgaattattgtctct

SEQ ID NO: 620518 - DNA, 25 bp, Rattus norvegicus
tgcccctccttgtattattgtctct

SEQ ID NO: 620519 - DNA, 25 bp, Rattus norvegicus
tgcccctcgaagcacagagatacag

SEQ ID NO: 620520 - DNA, 25 bp, Rattus norvegicus
tgcccctcgaaggacagagatacag

SEQ ID NO: 620521 - DNA, 25 bp, Rattus norvegicus
tgcccctctctgagagtgttaataa

SEQ ID NO: 620522 - DNA, 25 bp, Rattus norvegicus
tgcccctctctgtgagtgttaataa

SEQ ID NO: 620523 - DNA, 25 bp, Rattus norvegicus
tgcccctctgtgagtacttttctcc

SEQ ID NO: 620524 - DNA, 25 bp, Rattus norvegicus
tgcccctctgtgtgtacttttctcc

SEQ ID NO: 620525 - DNA, 25 bp, Rattus norvegicus
tgcccctgacctagtgaagttccaa

SEQ ID NO: 620526 - DNA, 25 bp, Rattus norvegicus
tgcccctgaccttgtgaagttccaa

SEQ ID NO: 620527 - DNA, 25 bp, Rattus norvegicus
tgcccctgagagatgatgtgcatca

SEQ ID NO: 620528 - DNA, 25 bp, Rattus norvegicus
tgcccctgagagttgatgtgcatca

SEQ ID NO: 620529 - DNA, 25 bp, Rattus norvegicus
tgcccctgaggcattgctttgtctt

SEQ ID NO: 620530 - DNA, 25 bp, Rattus norvegicus
tgcccctgaggctttgctttgtctt

SEQ ID NO: 620531 - DNA, 25 bp, Rattus norvegicus
tgcccctgatccagttgttatgttt

SEQ ID NO: 620532 - DNA, 25 bp, Rattus norvegicus
tgcccctgatcctgttgttatgttt

SEQ ID NO: 620533 - DNA, 25 bp, Rattus norvegicus
tgcccctgattaaccatctctagaa

SEQ ID NO: 620534 - DNA, 25 bp, Rattus norvegicus
tgcccctgattatccatctctagaa

SEQ ID NO: 620535 - DNA, 25 bp, Rattus norvegicus
tgcccctgcagaaagtttaccctgg

SEQ ID NO: 620536 - DNA, 25 bp, Rattus norvegicus
tgcccctgcagatagtttaccctgg

SEQ ID NO: 620537 - DNA, 25 bp, Rattus norvegicus
tgcccctgcagtccctggtgaagga

SEQ ID NO: 620538 - DNA, 25 bp, Rattus norvegicus
tgcccctgcagtgcctggtgaagga

SEQ ID NO: 620539 - DNA, 25 bp, Rattus norvegicus
tgcccctgcgaaacatcttcaaaaa

SEQ ID NO: 620540 - DNA, 25 bp, Rattus norvegicus
tgcccctgcgaatcatcttcaaaaa

SEQ ID NO: 620541 - DNA, 25 bp, Rattus norvegicus
tgcccctgctgacggacttgatcaa

SEQ ID NO: 620542 - DNA, 25 bp, Rattus norvegicus
tgcccctgctgagggacttgatcaa

SEQ ID NO: 620543 - DNA, 25 bp, Rattus norvegicus
tgcccctggagccacgcttagaaga

SEQ ID NO: 620544 - DNA, 25 bp, Rattus norvegicus
tgcccctggagcgacgcttagaaga

SEQ ID NO: 620545 - DNA, 25 bp, Rattus norvegicus
tgcccctggcctcatagctttgtga

SEQ ID NO: 620546 - DNA, 25 bp, Rattus norvegicus
tgcccctggcctgatagctttgtga

SEQ ID NO: 620547 - DNA, 25 bp, Rattus norvegicus
tgcccctggcttccatatttgatta

SEQ ID NO: 620548 - DNA, 25 bp, Rattus norvegicus
tgcccctggcttgcatatttgatta

SEQ ID NO: 620549 - DNA, 25 bp, Rattus norvegicus
tgcccctgggaacgcttgtgtaaat

SEQ ID NO: 620550 - DNA, 25 bp, Rattus norvegicus
tgcccctgggaaggcttgtgtaaat

SEQ ID NO: 620551 - DNA, 25 bp, Rattus norvegicus
tgcccctgttcaaggtctacgtaga

SEQ ID NO: 620552 - DNA, 25 bp, Rattus norvegicus
tgcccctgttcatggtctacgtaga

SEQ ID NO: 620553 - DNA, 25 bp, Rattus norvegicus
tgccccttacacaggtgcagtggaa

SEQ ID NO: 620554 - DNA, 25 bp, Rattus norvegicus
tgccccttacactggtgcagtggaa

SEQ ID NO: 620555 - DNA, 25 bp, Rattus norvegicus
tgccccttcaaacttctgttttctt

SEQ ID NO: 620556 - DNA, 25 bp, Rattus norvegicus
tgccccttcaaagttctgttttctt

SEQ ID NO: 620557 - DNA, 25 bp, Rattus norvegicus
tgccccttcaccctgtcagagaaaa

SEQ ID NO: 620558 - DNA, 25 bp, Rattus norvegicus
tgccccttcaccgtgtcagagaaaa

SEQ ID NO: 620559 - DNA, 25 bp, Rattus norvegicus
tgccccttcctccaaaatatctagt

SEQ ID NO: 620560 - DNA, 25 bp, Rattus norvegicus
tgccccttcctcgaaaatatctagt

SEQ ID NO: 620561 - DNA, 25 bp, Rattus norvegicus
tgccccttgagtccctgacgagatt

SEQ ID NO: 620562 - DNA, 25 bp, Rattus norvegicus
tgccccttgagtgcctgacgagatt

SEQ ID NO: 620563 - DNA, 25 bp, Rattus norvegicus
tgccccttgggtatacctttggaat

SEQ ID NO: 620564 - DNA, 25 bp, Rattus norvegicus
tgccccttgggtttacctttggaat

SEQ ID NO: 620565 - DNA, 25 bp, Rattus norvegicus
tgccccttgtttcttactagtttct

SEQ ID NO: 620566 - DNA, 25 bp, Rattus norvegicus
tgccccttgtttgttactagtttct

SEQ ID NO: 620567 - DNA, 25 bp, Rattus norvegicus
tgcccctttaacagccttaggtggc

SEQ ID NO: 620568 - DNA, 25 bp, Rattus norvegicus
tgcccctttaactgccttaggtggc

SEQ ID NO: 620569 - DNA, 25 bp, Rattus norvegicus
tgcccctttactaattgttgtttag

SEQ ID NO: 620570 - DNA, 25 bp, Rattus norvegicus
tgcccctttacttattgttgtttag

SEQ ID NO: 620571 - DNA, 25 bp, Rattus norvegicus
tgcccctttatccaacatttcaaat

SEQ ID NO: 620572 - DNA, 25 bp, Rattus norvegicus
tgcccctttatcgaacatttcaaat

SEQ ID NO: 620573 - DNA, 25 bp, Rattus norvegicus
tgcccctttggtcgcaaagccgatg

SEQ ID NO: 620574 - DNA, 25 bp, Rattus norvegicus
tgcccctttggtggcaaagccgatg

SEQ ID NO: 620575 - DNA, 25 bp, Rattus norvegicus
tgccccttttcaatttttaccatgt

SEQ ID NO: 620576 - DNA, 25 bp, Rattus norvegicus
tgccccttttcattttttaccatgt

SEQ ID NO: 620577 - DNA, 25 bp, Rattus norvegicus
tgcccctttttaatttgtgccgtgg

SEQ ID NO: 620578 - DNA, 25 bp, Rattus norvegicus
tgcccctttttattttgtgccgtgg

SEQ ID NO: 620579 - DNA, 25 bp, Rattus norvegicus
tgcccgaagcagcagaggactctgc

SEQ ID NO: 620580 - DNA, 25 bp, Rattus norvegicus
tgcccgaagcaggagaggactctgc

SEQ ID NO: 620581 - DNA, 25 bp, Rattus norvegicus
tgcccgaagcctcgtgactctctga

SEQ ID NO: 620582 - DNA, 25 bp, Rattus norvegicus
tgcccgaagcctggtgactctctga

SEQ ID NO: 620583 - DNA, 25 bp, Rattus norvegicus
tgcccgaagctcagaaggactaagt

SEQ ID NO: 620584 - DNA, 25 bp, Rattus norvegicus
tgcccgaagctctgaaggactaagt

SEQ ID NO: 620585 - DNA, 25 bp, Rattus norvegicus
tgcccgagattgatagcccgaattc

SEQ ID NO: 620586 - DNA, 25 bp, Rattus norvegicus
tgcccgagattgttagcccgaattc

SEQ ID NO: 620587 - DNA, 25 bp, Rattus norvegicus
tgcccgagccctaacagtagtgtag

SEQ ID NO: 620588 - DNA, 25 bp, Rattus norvegicus
tgcccgagcccttacagtagtgtag

SEQ ID NO: 620589 - DNA, 25 bp, Rattus norvegicus
tgcccgagctctcaaaacactatat

SEQ ID NO: 620590 - DNA, 25 bp, Rattus norvegicus
tgcccgagctctgaaaacactatat

SEQ ID NO: 620591 - DNA, 25 bp, Rattus norvegicus
tgcccgatagggagccattaactgt

SEQ ID NO: 620592 - DNA, 25 bp, Rattus norvegicus
tgcccgatagggtgccattaactgt

SEQ ID NO: 620593 - DNA, 25 bp, Rattus norvegicus
tgcccgcaaactcagagtgagctcc

SEQ ID NO: 620594 - DNA, 25 bp, Rattus norvegicus
tgcccgcaaactgagagtgagctcc

SEQ ID NO: 620595 - DNA, 25 bp, Rattus norvegicus
tgcccgcaatgaccacttgttacac

SEQ ID NO: 620596 - DNA, 25 bp, Rattus norvegicus
tgcccgcaatgagcacttgttacac

SEQ ID NO: 620597 - DNA, 25 bp, Rattus norvegicus
tgcccgcagcgcagctagctacatg

SEQ ID NO: 620598 - DNA, 25 bp, Rattus norvegicus
tgcccgcagcgctgctagctacatg

SEQ ID NO: 620599 - DNA, 25 bp, Rattus norvegicus
tgcccgcagctcctggatacagagg

SEQ ID NO: 620600 - DNA, 25 bp, Rattus norvegicus
tgcccgcagctcgtggatacagagg

SEQ ID NO: 620601 - DNA, 25 bp, Rattus norvegicus
tgcccgcagggacatgcttgatgcc

SEQ ID NO: 620602 - DNA, 25 bp, Rattus norvegicus
tgcccgcagggagatgcttgatgcc

SEQ ID NO: 620603 - DNA, 25 bp, Rattus norvegicus
tgcccgcatccaccagtgatatgga

SEQ ID NO: 620604 - DNA, 25 bp, Rattus norvegicus
tgcccgcatccagcagtgatatgga

SEQ ID NO: 620605 - DNA, 25 bp, Rattus norvegicus
tgcccgcatttcaggtgacagtgtc

SEQ ID NO: 620606 - DNA, 25 bp, Rattus norvegicus
tgcccgcatttctggtgacagtgtc

SEQ ID NO: 620607 - DNA, 25 bp, Rattus norvegicus
tgcccgccactgatctgtgagaaga

SEQ ID NO: 620608 - DNA, 25 bp, Rattus norvegicus
tgcccgccactgttctgtgagaaga

SEQ ID NO: 620609 - DNA, 25 bp, Rattus norvegicus
tgcccgccagaaatccagctatttg

SEQ ID NO: 620610 - DNA, 25 bp, Rattus norvegicus
tgcccgccagaattccagctatttg

SEQ ID NO: 620611 - DNA, 25 bp, Rattus norvegicus
tgcccgccatgtatcttagatgcaa

SEQ ID NO: 620612 - DNA, 25 bp, Rattus norvegicus
tgcccgccatgtttcttagatgcaa

SEQ ID NO: 620613 - DNA, 25 bp, Rattus norvegicus
tgcccgcccatccttaaaaggaaga

SEQ ID NO: 620614 - DNA, 25 bp, Rattus norvegicus
tgcccgcccatcgttaaaaggaaga

SEQ ID NO: 620615 - DNA, 25 bp, Rattus norvegicus
tgcccgcccatgcatgcagtacaaa

SEQ ID NO: 620616 - DNA, 25 bp, Rattus norvegicus
tgcccgcccatggatgcagtacaaa

SEQ ID NO: 620617 - DNA, 25 bp, Rattus norvegicus
tgcccgccccatctaagtggcgaaa

SEQ ID NO: 620618 - DNA, 25 bp, Rattus norvegicus
tgcccgccccatgtaagtggcgaaa

SEQ ID NO: 620619 - DNA, 25 bp, Rattus norvegicus
tgcccgcctcataaataaagtggat

SEQ ID NO: 620620 - DNA, 25 bp, Rattus norvegicus
tgcccgcctcattaataaagtggat

SEQ ID NO: 620621 - DNA, 25 bp, Rattus norvegicus
tgcccgcgcgctacttgtgaggcgt

SEQ ID NO: 620622 - DNA, 25 bp, Rattus norvegicus
tgcccgcgcgcttcttgtgaggcgt

SEQ ID NO: 620623 - DNA, 25 bp, Rattus norvegicus
tgcccgcggtacacttcatcatatg

SEQ ID NO: 620624 - DNA, 25 bp, Rattus norvegicus
tgcccgcggtactcttcatcatatg

SEQ ID NO: 620625 - DNA, 25 bp, Rattus norvegicus
tgcccgctatgtaatctcgtgatct

SEQ ID NO: 620626 - DNA, 25 bp, Rattus norvegicus
tgcccgctatgttatctcgtgatct

SEQ ID NO: 620627 - DNA, 25 bp, Rattus norvegicus
tgcccgctcctgatttggattctaa

SEQ ID NO: 620628 - DNA, 25 bp, Rattus norvegicus
tgcccgctcctgttttggattctaa

SEQ ID NO: 620629 - DNA, 25 bp, Rattus norvegicus
tgcccgctgctaaaaaggtctctgc

SEQ ID NO: 620630 - DNA, 25 bp, Rattus norvegicus
tgcccgctgctataaaggtctctgc

SEQ ID NO: 620631 - DNA, 25 bp, Rattus norvegicus
tgcccgcttgggagattatgtaaat

SEQ ID NO: 620632 - DNA, 25 bp, Rattus norvegicus
tgcccgcttgggtgattatgtaaat

SEQ ID NO: 620633 - DNA, 25 bp, Rattus norvegicus
tgcccgctttggagtctctgttggt

SEQ ID NO: 620634 - DNA, 25 bp, Rattus norvegicus
tgcccgctttggtgtctctgttggt

SEQ ID NO: 620635 - DNA, 25 bp, Rattus norvegicus
tgcccggaactgaggtcctctgaca

SEQ ID NO: 620636 - DNA, 25 bp, Rattus norvegicus
tgcccggaactgtggtcctctgaca

SEQ ID NO: 620637 - DNA, 25 bp, Rattus norvegicus
tgcccggacggactggatgtttact

SEQ ID NO: 620638 - DNA, 25 bp, Rattus norvegicus
tgcccggacggagtggatgtttact

SEQ ID NO: 620639 - DNA, 25 bp, Rattus norvegicus
tgcccggcaaaacagctcagacaaa

SEQ ID NO: 620640 - DNA, 25 bp, Rattus norvegicus
tgcccggcaaaagagctcagacaaa

SEQ ID NO: 620641 - DNA, 25 bp, Rattus norvegicus
tgcccggcacatcggcatgtgtact

SEQ ID NO: 620642 - DNA, 25 bp, Rattus norvegicus
tgcccggcacatgggcatgtgtact

SEQ ID NO: 620643 - DNA, 25 bp, Rattus norvegicus
tgcccggcctataggtacatgcatt

SEQ ID NO: 620644 - DNA, 25 bp, Rattus norvegicus
tgcccggcctattggtacatgcatt

SEQ ID NO: 620645 - DNA, 25 bp, Rattus norvegicus
tgcccggcctttctgatatttcagg

SEQ ID NO: 620646 - DNA, 25 bp, Rattus norvegicus
tgcccggcctttgtgatatttcagg

SEQ ID NO: 620647 - DNA, 25 bp, Rattus norvegicus
tgcccggctccaagtgaatgtagca

SEQ ID NO: 620648 - DNA, 25 bp, Rattus norvegicus
tgcccggctccatgtgaatgtagca

SEQ ID NO: 620649 - DNA, 25 bp, Rattus norvegicus
tgcccggcttcaccgtggagaccat

SEQ ID NO: 620650 - DNA, 25 bp, Rattus norvegicus
tgcccggcttcagcgtggagaccat

SEQ ID NO: 620651 - DNA, 25 bp, Rattus norvegicus
tgcccgggaaacagttctccgcttc

SEQ ID NO: 620652 - DNA, 25 bp, Rattus norvegicus
tgcccgggaaactgttctccgcttc

SEQ ID NO: 620653 - DNA, 25 bp, Rattus norvegicus
tgcccgggagccacggaatgtgaca

SEQ ID NO: 620654 - DNA, 25 bp, Rattus norvegicus
tgcccgggagcctcggaatgtgaca

SEQ ID NO: 620655 - DNA, 25 bp, Rattus norvegicus
tgcccgggttggaaacacagttact

SEQ ID NO: 620656 - DNA, 25 bp, Rattus norvegicus
tgcccgggttggtaacacagttact

SEQ ID NO: 620657 - DNA, 25 bp, Rattus norvegicus
tgcccggtaggcctgcagatgtaaa

SEQ ID NO: 620658 - DNA, 25 bp, Rattus norvegicus
tgcccggtaggcgtgcagatgtaaa

SEQ ID NO: 620659 - DNA, 25 bp, Rattus norvegicus
tgcccggtgaataggccaagcacgc

SEQ ID NO: 620660 - DNA, 25 bp, Rattus norvegicus
tgcccggtgaattggccaagcacgc

SEQ ID NO: 620661 - DNA, 25 bp, Rattus norvegicus
tgcccggtgtggacacgtggctcac

SEQ ID NO: 620662 - DNA, 25 bp, Rattus norvegicus
tgcccggtgtggtcacgtggctcac

SEQ ID NO: 620663 - DNA, 25 bp, Rattus norvegicus
tgcccggttggacgataacgttctt

SEQ ID NO: 620664 - DNA, 25 bp, Rattus norvegicus
tgcccggttggaggataacgttctt

SEQ ID NO: 620665 - DNA, 25 bp, Rattus norvegicus
tgcccgtaattaacccatttcatga

SEQ ID NO: 620666 - DNA, 25 bp, Rattus norvegicus
tgcccgtaattatcccatttcatga

SEQ ID NO: 620667 - DNA, 25 bp, Rattus norvegicus
tgcccgtacgatagtacaccacgta

SEQ ID NO: 620668 - DNA, 25 bp, Rattus norvegicus
tgcccgtacgattgtacaccacgta

SEQ ID NO: 620669 - DNA, 25 bp, Rattus norvegicus
tgcccgtactatacgataccctgat

SEQ ID NO: 620670 - DNA, 25 bp, Rattus norvegicus
tgcccgtactattcgataccctgat

SEQ ID NO: 620671 - DNA, 25 bp, Rattus norvegicus
tgcccgtatgtaaagacagtcgcta

SEQ ID NO: 620672 - DNA, 25 bp, Rattus norvegicus
tgcccgtatgtatagacagtcgcta

SEQ ID NO: 620673 - DNA, 25 bp, Rattus norvegicus
tgcccgtcagtccagtccggagtga

SEQ ID NO: 620674 - DNA, 25 bp, Rattus norvegicus
tgcccgtcagtcgagtccggagtga

SEQ ID NO: 620675 - DNA, 25 bp, Rattus norvegicus
tgcccgtcatagagctgcacattag

SEQ ID NO: 620676 - DNA, 25 bp, Rattus norvegicus
tgcccgtcatagtgctgcacattag

SEQ ID NO: 620677 - DNA, 25 bp, Rattus norvegicus
tgcccgtctgtgatcccaataaaga

SEQ ID NO: 620678 - DNA, 25 bp, Rattus norvegicus
tgcccgtctgtgttcccaataaaga

SEQ ID NO: 620679 - DNA, 25 bp, Rattus norvegicus
tgcccgtctgttataacccttgaga

SEQ ID NO: 620680 - DNA, 25 bp, Rattus norvegicus
tgcccgtctgttttaacccttgaga

SEQ ID NO: 620681 - DNA, 25 bp, Rattus norvegicus
tgcccgtcttctatcagatctgaaa

SEQ ID NO: 620682 - DNA, 25 bp, Rattus norvegicus
tgcccgtcttctttcagatctgaaa

SEQ ID NO: 620683 - DNA, 25 bp, Rattus norvegicus
tgcccgtgcagcctgagaatgctct

SEQ ID NO: 620684 - DNA, 25 bp, Rattus norvegicus
tgcccgtgcagcgtgagaatgctct

SEQ ID NO: 620685 - DNA, 25 bp, Rattus norvegicus
tgcccgtgtgtacttttgtaggtta

SEQ ID NO: 620686 - DNA, 25 bp, Rattus norvegicus
tgcccgtgtgtagttttgtaggtta

SEQ ID NO: 620687 - DNA, 25 bp, Rattus norvegicus
tgcccgtgtgttacttttctaatca

SEQ ID NO: 620688 - DNA, 25 bp, Rattus norvegicus
tgcccgtgtgtttcttttctaatca

SEQ ID NO: 620689 - DNA, 25 bp, Rattus norvegicus
tgcccgttcccaataaacagtcagt

SEQ ID NO: 620690 - DNA, 25 bp, Rattus norvegicus
tgcccgttcccattaaacagtcagt

SEQ ID NO: 620691 - DNA, 25 bp, Rattus norvegicus
tgcccgttctttctttacttttcag

SEQ ID NO: 620692 - DNA, 25 bp, Rattus norvegicus
tgcccgttctttgtttacttttcag

SEQ ID NO: 620693 - DNA, 25 bp, Rattus norvegicus
tgccctaaccacctgctgagagtgc

SEQ ID NO: 620694 - DNA, 25 bp, Rattus norvegicus
tgccctaaccacgtgctgagagtgc

SEQ ID NO: 620695 - DNA, 25 bp, Rattus norvegicus
tgccctaaccgtataccatgttggg

SEQ ID NO: 620696 - DNA, 25 bp, Rattus norvegicus
tgccctaaccgtttaccatgttggg

SEQ ID NO: 620697 - DNA, 25 bp, Rattus norvegicus
tgccctaaggccatgctagtttatt

SEQ ID NO: 620698 - DNA, 25 bp, Rattus norvegicus
tgccctaaggccttgctagtttatt

SEQ ID NO: 620699 - DNA, 25 bp, Rattus norvegicus
tgccctaatttgaactgaagccctt

SEQ ID NO: 620700 - DNA, 25 bp, Rattus norvegicus
tgccctaatttgtactgaagccctt

SEQ ID NO: 620701 - DNA, 25 bp, Rattus norvegicus
tgccctacagtgagctgtgtttgat

SEQ ID NO: 620702 - DNA, 25 bp, Rattus norvegicus
tgccctacagtgtgctgtgtttgat

SEQ ID NO: 620703 - DNA, 25 bp, Rattus norvegicus
tgccctacccttaatctaggctgga

SEQ ID NO: 620704 - DNA, 25 bp, Rattus norvegicus
tgccctaccctttatctaggctgga

SEQ ID NO: 620705 - DNA, 25 bp, Rattus norvegicus
tgccctacctctcagacaaagaatg

SEQ ID NO: 620706 - DNA, 25 bp, Rattus norvegicus
tgccctacctctcgactttaaagat

SEQ ID NO: 620707 - DNA, 25 bp, Rattus norvegicus
tgccctacctctgagacaaagaatg

SEQ ID NO: 620708 - DNA, 25 bp, Rattus norvegicus
tgccctacctctggactttaaagat

SEQ ID NO: 620709 - DNA, 25 bp, Rattus norvegicus
tgccctacggcgacgagaagctgag

SEQ ID NO: 620710 - DNA, 25 bp, Rattus norvegicus
tgccctacggcgtcgagaagctgag

SEQ ID NO: 620711 - DNA, 25 bp, Rattus norvegicus
tgccctagacttcgagcaagagatg

SEQ ID NO: 620712 - DNA, 25 bp, Rattus norvegicus
tgccctagacttggagcaagagatg

SEQ ID NO: 620713 - DNA, 25 bp, Rattus norvegicus
tgccctaggaggatggctttgccca

SEQ ID NO: 620714 - DNA, 25 bp, Rattus norvegicus
tgccctaggaggttggctttgccca

SEQ ID NO: 620715 - DNA, 25 bp, Rattus norvegicus
tgccctagtaggatttctcaaaaag

SEQ ID NO: 620716 - DNA, 25 bp, Rattus norvegicus
tgccctagtaggttttctcaaaaag

SEQ ID NO: 620717 - DNA, 25 bp, Rattus norvegicus
tgccctatggctctgtgcttgtgca

SEQ ID NO: 620718 - DNA, 25 bp, Rattus norvegicus
tgccctatggctgtgtgcttgtgca

SEQ ID NO: 620719 - DNA, 25 bp, Rattus norvegicus
tgccctatttccagcattctctgct

SEQ ID NO: 620720 - DNA, 25 bp, Rattus norvegicus
tgccctatttcctgcattctctgct

SEQ ID NO: 620721 - DNA, 25 bp, Rattus norvegicus
tgccctcaaccgagtgggtcaggaa

SEQ ID NO: 620722 - DNA, 25 bp, Rattus norvegicus
tgccctcaaccgtgtgggtcaggaa

SEQ ID NO: 620723 - DNA, 25 bp, Rattus norvegicus
tgccctcaagatctgagatctctca

SEQ ID NO: 620724 - DNA, 25 bp, Rattus norvegicus
tgccctcaagatgtgagatctctca

SEQ ID NO: 620725 - DNA, 25 bp, Rattus norvegicus
tgccctcaagggaccacttaaacca

SEQ ID NO: 620726 - DNA, 25 bp, Rattus norvegicus
tgccctcaagggtccacttaaacca

SEQ ID NO: 620727 - DNA, 25 bp, Rattus norvegicus
tgccctcaatatccccacgtggagg

SEQ ID NO: 620728 - DNA, 25 bp, Rattus norvegicus
tgccctcaatatgcccacgtggagg

SEQ ID NO: 620729 - DNA, 25 bp, Rattus norvegicus
tgccctcacctgcacggaagtgtgg

SEQ ID NO: 620730 - DNA, 25 bp, Rattus norvegicus
tgccctcacctggacggaagtgtgg

SEQ ID NO: 620731 - DNA, 25 bp, Rattus norvegicus
tgccctcactgtagcagttatctca

SEQ ID NO: 620732 - DNA, 25 bp, Rattus norvegicus
tgccctcactgttgcagttatctca

SEQ ID NO: 620733 - DNA, 25 bp, Rattus norvegicus
tgccctcagctgaggtcaggtgacc

SEQ ID NO: 620734 - DNA, 25 bp, Rattus norvegicus
tgccctcagctgtggtcaggtgacc

SEQ ID NO: 620735 - DNA, 25 bp, Rattus norvegicus
tgccctcaggagcatttgcagctga

SEQ ID NO: 620736 - DNA, 25 bp, Rattus norvegicus
tgccctcaggaggatttgcagctga

SEQ ID NO: 620737 - DNA, 25 bp, Rattus norvegicus
tgccctcagggaaggccaaggcctt

SEQ ID NO: 620738 - DNA, 25 bp, Rattus norvegicus
tgccctcagggatggccaaggcctt

SEQ ID NO: 620739 - DNA, 25 bp, Rattus norvegicus
tgccctcagggcagtacagctggga

SEQ ID NO: 620740 - DNA, 25 bp, Rattus norvegicus
tgccctcagggctgtacagctggga

SEQ ID NO: 620741 - DNA, 25 bp, Rattus norvegicus
tgccctcatactacagctctggtag

SEQ ID NO: 620742 - DNA, 25 bp, Rattus norvegicus
tgccctcatacttcagctctggtag

SEQ ID NO: 620743 - DNA, 25 bp, Rattus norvegicus
tgccctcatatcctgtcttaaatca

SEQ ID NO: 620744 - DNA, 25 bp, Rattus norvegicus
tgccctcatatcgtgtcttaaatca

SEQ ID NO: 620745 - DNA, 25 bp, Rattus norvegicus
tgccctcatcaacgatccatgttta

SEQ ID NO: 620746 - DNA, 25 bp, Rattus norvegicus
tgccctcatcaaggatccatgttta

SEQ ID NO: 620747 - DNA, 25 bp, Rattus norvegicus
tgccctcatcggatagtatgtctct

SEQ ID NO: 620748 - DNA, 25 bp, Rattus norvegicus
tgccctcatcggttagtatgtctct

SEQ ID NO: 620749 - DNA, 25 bp, Rattus norvegicus
tgccctccaaagatcgggaccagga

SEQ ID NO: 620750 - DNA, 25 bp, Rattus norvegicus
tgccctccaaagttcgggaccagga

SEQ ID NO: 620751 - DNA, 25 bp, Rattus norvegicus
tgccctccaacaccctgagaaaata

SEQ ID NO: 620752 - DNA, 25 bp, Rattus norvegicus
tgccctccaacagcctgagaaaata

SEQ ID NO: 620753 - DNA, 25 bp, Rattus norvegicus
tgccctccaaggacgtgtacaagta

SEQ ID NO: 620754 - DNA, 25 bp, Rattus norvegicus
tgccctccaaggtcgtgtacaagta

SEQ ID NO: 620755 - DNA, 25 bp, Rattus norvegicus
tgccctccagatcttcaagtacaaa

SEQ ID NO: 620756 - DNA, 25 bp, Rattus norvegicus
tgccctccagatgttcaagtacaaa

SEQ ID NO: 620757 - DNA, 25 bp, Rattus norvegicus
tgccctccagctatgatctctgaga

SEQ ID NO: 620758 - DNA, 25 bp, Rattus norvegicus
tgccctccagctttgatctctgaga

SEQ ID NO: 620759 - DNA, 25 bp, Rattus norvegicus
tgccctccagggatcactcagatat

SEQ ID NO: 620760 - DNA, 25 bp, Rattus norvegicus
tgccctccagggttcactcagatat

SEQ ID NO: 620761 - DNA, 25 bp, Rattus norvegicus
tgccctccaggtagcttaaatcaga

SEQ ID NO: 620762 - DNA, 25 bp, Rattus norvegicus
tgccctccaggttgcttaaatcaga

SEQ ID NO: 620763 - DNA, 25 bp, Rattus norvegicus
tgccctcccaacagagcatgacttt

SEQ ID NO: 620764 - DNA, 25 bp, Rattus norvegicus
tgccctcccaacatgggttgtactt

SEQ ID NO: 620765 - DNA, 25 bp, Rattus norvegicus
tgccctcccaactgagcatgacttt

SEQ ID NO: 620766 - DNA, 25 bp, Rattus norvegicus
tgccctcccaacttgggttgtactt

SEQ ID NO: 620767 - DNA, 25 bp, Rattus norvegicus
tgccctccctgaactgtaatggtgg

SEQ ID NO: 620768 - DNA, 25 bp, Rattus norvegicus
tgccctccctgatctgtaatggtgg

SEQ ID NO: 620769 - DNA, 25 bp, Rattus norvegicus
tgccctccgaaacagcttggtgtat

SEQ ID NO: 620770 - DNA, 25 bp, Rattus norvegicus
tgccctccgaaagagcttggtgtat

SEQ ID NO: 620771 - DNA, 25 bp, Rattus norvegicus
tgccctcctatcaatggttgtgttg

SEQ ID NO: 620772 - DNA, 25 bp, Rattus norvegicus
tgccctcctatctatggttgtgttg

SEQ ID NO: 620773 - DNA, 25 bp, Rattus norvegicus
tgccctcctatgaagccagactttg

SEQ ID NO: 620774 - DNA, 25 bp, Rattus norvegicus
tgccctcctatgtagccagactttg

SEQ ID NO: 620775 - DNA, 25 bp, Rattus norvegicus
tgccctcctctaaacgacagcagga

SEQ ID NO: 620776 - DNA, 25 bp, Rattus norvegicus
tgccctcctctatacgacagcagga

SEQ ID NO: 620777 - DNA, 25 bp, Rattus norvegicus
tgccctcctggaataaaagttgatg

SEQ ID NO: 620778 - DNA, 25 bp, Rattus norvegicus
tgccctcctggattaaaagttgatg

SEQ ID NO: 620779 - DNA, 25 bp, Rattus norvegicus
tgccctcctggtatgtggaagctat

SEQ ID NO: 620780 - DNA, 25 bp, Rattus norvegicus
tgccctcctggtttgtggaagctat

SEQ ID NO: 620781 - DNA, 25 bp, Rattus norvegicus
tgccctcctgtaaccttatataggt

SEQ ID NO: 620782 - DNA, 25 bp, Rattus norvegicus
tgccctcctgtaagctttcatggtt

SEQ ID NO: 620783 - DNA, 25 bp, Rattus norvegicus
tgccctcctgtatccttatataggt

SEQ ID NO: 620784 - DNA, 25 bp, Rattus norvegicus
tgccctcctgtatgctttcatggtt

SEQ ID NO: 620785 - DNA, 25 bp, Rattus norvegicus
tgccctccttctaccaggatttcag

SEQ ID NO: 620786 - DNA, 25 bp, Rattus norvegicus
tgccctccttcttccaggatttcag

SEQ ID NO: 620787 - DNA, 25 bp, Rattus norvegicus
tgccctccttggatagcagagagca

SEQ ID NO: 620788 - DNA, 25 bp, Rattus norvegicus
tgccctccttggttagcagagagca

SEQ ID NO: 620789 - DNA, 25 bp, Rattus norvegicus
tgccctcgctctaataactgcaggt

SEQ ID NO: 620790 - DNA, 25 bp, Rattus norvegicus
tgccctcgctcttataactgcaggt

SEQ ID NO: 620791 - DNA, 25 bp, Rattus norvegicus
tgccctcggacaagctgagcaagat

SEQ ID NO: 620792 - DNA, 25 bp, Rattus norvegicus
tgccctcggacatgctgagcaagat

SEQ ID NO: 620793 - DNA, 25 bp, Rattus norvegicus
tgccctcgtaacagcaaccagagag

SEQ ID NO: 620794 - DNA, 25 bp, Rattus norvegicus
tgccctcgtaactgcaaccagagag

SEQ ID NO: 620795 - DNA, 25 bp, Rattus norvegicus
tgccctcgtacgcttcatggtagag

SEQ ID NO: 620796 - DNA, 25 bp, Rattus norvegicus
tgccctcgtacggttcatggtagag

SEQ ID NO: 620797 - DNA, 25 bp, Rattus norvegicus
tgccctcgtgccatgacttcagaaa

SEQ ID NO: 620798 - DNA, 25 bp, Rattus norvegicus
tgccctcgtgccttgacttcagaaa

SEQ ID NO: 620799 - DNA, 25 bp, Rattus norvegicus
tgccctcgttgtaagaggccatgtg

SEQ ID NO: 620800 - DNA, 25 bp, Rattus norvegicus
tgccctcgttgttagaggccatgtg

SEQ ID NO: 620801 - DNA, 25 bp, Rattus norvegicus
tgccctctcagaaggtaacagtatg

SEQ ID NO: 620802 - DNA, 25 bp, Rattus norvegicus
tgccctctcagatggtaacagtatg

SEQ ID NO: 620803 - DNA, 25 bp, Rattus norvegicus
tgccctctcctcataaagttcaggc

SEQ ID NO: 620804 - DNA, 25 bp, Rattus norvegicus
tgccctctcctcttaaagttcaggc

SEQ ID NO: 620805 - DNA, 25 bp, Rattus norvegicus
tgccctctccttagatacatacttt

SEQ ID NO: 620806 - DNA, 25 bp, Rattus norvegicus
tgccctctcctttgatacatacttt

SEQ ID NO: 620807 - DNA, 25 bp, Rattus norvegicus
tgccctctgaagacctaacggactt

SEQ ID NO: 620808 - DNA, 25 bp, Rattus norvegicus
tgccctctgaagtcctaacggactt

SEQ ID NO: 620809 - DNA, 25 bp, Rattus norvegicus
tgccctctgatcacatcagtctggg

SEQ ID NO: 620810 - DNA, 25 bp, Rattus norvegicus
tgccctctgatctcatcagtctggg

SEQ ID NO: 620811 - DNA, 25 bp, Rattus norvegicus
tgccctctggatcgatgcttactat

SEQ ID NO: 620812 - DNA, 25 bp, Rattus norvegicus
tgccctctggatggatgcttactat

SEQ ID NO: 620813 - DNA, 25 bp, Rattus norvegicus
tgccctctgggaagcaggagatggg

SEQ ID NO: 620814 - DNA, 25 bp, Rattus norvegicus
tgccctctgggactgttttgcagta

SEQ ID NO: 620815 - DNA, 25 bp, Rattus norvegicus
tgccctctgggagtgttttgcagta

SEQ ID NO: 620816 - DNA, 25 bp, Rattus norvegicus
tgccctctgggatgcaggagatggg

SEQ ID NO: 620817 - DNA, 25 bp, Rattus norvegicus
tgccctctgtccagcattactgggt

SEQ ID NO: 620818 - DNA, 25 bp, Rattus norvegicus
tgccctctgtcctgcattactgggt

SEQ ID NO: 620819 - DNA, 25 bp, Rattus norvegicus
tgccctctgtctaatacactcgtaa

SEQ ID NO: 620820 - DNA, 25 bp, Rattus norvegicus
tgccctctgtcttatacactcgtaa

SEQ ID NO: 620821 - DNA, 25 bp, Rattus norvegicus
tgccctctgtgtaccaggctgagtg

SEQ ID NO: 620822 - DNA, 25 bp, Rattus norvegicus
tgccctctgtgttccaggctgagtg

SEQ ID NO: 620823 - DNA, 25 bp, Rattus norvegicus
tgccctctgttaatctgtttgacca

SEQ ID NO: 620824 - DNA, 25 bp, Rattus norvegicus
tgccctctgttattctgtttgacca

SEQ ID NO: 620825 - DNA, 25 bp, Rattus norvegicus
tgccctctgtttcgtgctgcattca

SEQ ID NO: 620826 - DNA, 25 bp, Rattus norvegicus
tgccctctgtttggtgctgcattca

SEQ ID NO: 620827 - DNA, 25 bp, Rattus norvegicus
tgccctcttgggatccattatttgc

SEQ ID NO: 620828 - DNA, 25 bp, Rattus norvegicus
tgccctcttgggttccattatttgc

SEQ ID NO: 620829 - DNA, 25 bp, Rattus norvegicus
tgccctctttttcatctttgatgta

SEQ ID NO: 620830 - DNA, 25 bp, Rattus norvegicus
tgccctctttttgatctttgatgta

SEQ ID NO: 620831 - DNA, 25 bp, Rattus norvegicus
tgccctgaaccgactacagttggag

SEQ ID NO: 620832 - DNA, 25 bp, Rattus norvegicus
tgccctgaaccgtctacagttggag

SEQ ID NO: 620833 - DNA, 25 bp, Rattus norvegicus
tgccctgaagagacgtgcctacagt

SEQ ID NO: 620834 - DNA, 25 bp, Rattus norvegicus
tgccctgaagagtcgtgcctacagt

SEQ ID NO: 620835 - DNA, 25 bp, Rattus norvegicus
tgccctgaagctactcagcgtagta

SEQ ID NO: 620836 - DNA, 25 bp, Rattus norvegicus
tgccctgaagctaggtctacagtga

SEQ ID NO: 620837 - DNA, 25 bp, Rattus norvegicus
tgccctgaagcttctcagcgtagta

SEQ ID NO: 620838 - DNA, 25 bp, Rattus norvegicus
tgccctgaagcttggtctacagtga

SEQ ID NO: 620839 - DNA, 25 bp, Rattus norvegicus
tgccctgaaggaaagcccccttctg

SEQ ID NO: 620840 - DNA, 25 bp, Rattus norvegicus
tgccctgaaggatagcccccttctg

SEQ ID NO: 620841 - DNA, 25 bp, Rattus norvegicus
tgccctgaagtgagcagctcctctg

SEQ ID NO: 620842 - DNA, 25 bp, Rattus norvegicus
tgccctgaagtgtgcagctcctctg

SEQ ID NO: 620843 - DNA, 25 bp, Rattus norvegicus
tgccctgaatggactgtcacagtct

SEQ ID NO: 620844 - DNA, 25 bp, Rattus norvegicus
tgccctgaatggtctgtcacagtct

SEQ ID NO: 620845 - DNA, 25 bp, Rattus norvegicus
tgccctgacagaatctcctcctgag

SEQ ID NO: 620846 - DNA, 25 bp, Rattus norvegicus
tgccctgacagattctcctcctgag

SEQ ID NO: 620847 - DNA, 25 bp, Rattus norvegicus
tgccctgaccatcctccggaaggag

SEQ ID NO: 620848 - DNA, 25 bp, Rattus norvegicus
tgccctgaccatgctccggaaggag

SEQ ID NO: 620849 - DNA, 25 bp, Rattus norvegicus
tgccctgacgtgagtaactcttggg

SEQ ID NO: 620850 - DNA, 25 bp, Rattus norvegicus
tgccctgacgtgtgtaactcttggg

SEQ ID NO: 620851 - DNA, 25 bp, Rattus norvegicus
tgccctgactccagggtatctgagt

SEQ ID NO: 620852 - DNA, 25 bp, Rattus norvegicus
tgccctgactcctgggtatctgagt

SEQ ID NO: 620853 - DNA, 25 bp, Rattus norvegicus
tgccctgactctcttgaaactcctt

SEQ ID NO: 620854 - DNA, 25 bp, Rattus norvegicus
tgccctgactctgttgaaactcctt

SEQ ID NO: 620855 - DNA, 25 bp, Rattus norvegicus
tgccctgagaagctggacctgaacc

SEQ ID NO: 620856 - DNA, 25 bp, Rattus norvegicus
tgccctgagaaggtggacctgaacc

SEQ ID NO: 620857 - DNA, 25 bp, Rattus norvegicus
tgccctgagcacatagagtctttgg

SEQ ID NO: 620858 - DNA, 25 bp, Rattus norvegicus
tgccctgagcacttagagtctttgg

SEQ ID NO: 620859 - DNA, 25 bp, Rattus norvegicus
tgccctgagcctccctaggtttagg

SEQ ID NO: 620860 - DNA, 25 bp, Rattus norvegicus
tgccctgagcctgcctaggtttagg

SEQ ID NO: 620861 - DNA, 25 bp, Rattus norvegicus
tgccctgagcggcagacgactgtca

SEQ ID NO: 620862 - DNA, 25 bp, Rattus norvegicus
tgccctgagcgggagacgactgtca

SEQ ID NO: 620863 - DNA, 25 bp, Rattus norvegicus
tgccctgaggctatctggagaccta

SEQ ID NO: 620864 - DNA, 25 bp, Rattus norvegicus
tgccctgaggctcaggacacaccaa

SEQ ID NO: 620865 - DNA, 25 bp, Rattus norvegicus
tgccctgaggctgaggacacaccaa

SEQ ID NO: 620866 - DNA, 25 bp, Rattus norvegicus
tgccctgaggctttctggagaccta

SEQ ID NO: 620867 - DNA, 25 bp, Rattus norvegicus
tgccctgagtgaagtcctcgtagaa

SEQ ID NO: 620868 - DNA, 25 bp, Rattus norvegicus
tgccctgagtgatgtcctcgtagaa

SEQ ID NO: 620869 - DNA, 25 bp, Rattus norvegicus
tgccctgagtttaatttgatctgct

SEQ ID NO: 620870 - DNA, 25 bp, Rattus norvegicus
tgccctgagttttatttgatctgct

SEQ ID NO: 620871 - DNA, 25 bp, Rattus norvegicus
tgccctgcacagacttatagcacaa

SEQ ID NO: 620872 - DNA, 25 bp, Rattus norvegicus
tgccctgcacagtcttatagcacaa

SEQ ID NO: 620873 - DNA, 25 bp, Rattus norvegicus
tgccctgcagtgaggttgccagaaa

SEQ ID NO: 620874 - DNA, 25 bp, Rattus norvegicus
tgccctgcagtgtggttgccagaaa

SEQ ID NO: 620875 - DNA, 25 bp, Rattus norvegicus
tgccctgcatccctgtgtgtctgca

SEQ ID NO: 620876 - DNA, 25 bp, Rattus norvegicus
tgccctgcatccgtgtgtgtctgca

SEQ ID NO: 620877 - DNA, 25 bp, Rattus norvegicus
tgccctgccaagcacaagtgagtct

SEQ ID NO: 620878 - DNA, 25 bp, Rattus norvegicus
tgccctgccaaggacaagtgagtct

SEQ ID NO: 620879 - DNA, 25 bp, Rattus norvegicus
tgccctgccataacttgatgtggat

SEQ ID NO: 620880 - DNA, 25 bp, Rattus norvegicus
tgccctgccatatcttgatgtggat

SEQ ID NO: 620881 - DNA, 25 bp, Rattus norvegicus
tgccctgccatgaatatgctcttaa

SEQ ID NO: 620882 - DNA, 25 bp, Rattus norvegicus
tgccctgccatgtatatgctcttaa

SEQ ID NO: 620883 - DNA, 25 bp, Rattus norvegicus
tgccctgcccaaatccgaggatgag

SEQ ID NO: 620884 - DNA, 25 bp, Rattus norvegicus
tgccctgcccaattccgaggatgag

SEQ ID NO: 620885 - DNA, 25 bp, Rattus norvegicus
tgccctgcctgaagactcagttcaa

SEQ ID NO: 620886 - DNA, 25 bp, Rattus norvegicus
tgccctgcctgatgactcagttcaa

SEQ ID NO: 620887 - DNA, 25 bp, Rattus norvegicus
tgccctgctagcatctccagaaaag

SEQ ID NO: 620888 - DNA, 25 bp, Rattus norvegicus
tgccctgctagcttctccagaaaag

SEQ ID NO: 620889 - DNA, 25 bp, Rattus norvegicus
tgccctgctctcataaacgtagatt

SEQ ID NO: 620890 - DNA, 25 bp, Rattus norvegicus
tgccctgctctcttaaacgtagatt

SEQ ID NO: 620891 - DNA, 25 bp, Rattus norvegicus
tgccctgctgagatttgatatcctg

SEQ ID NO: 620892 - DNA, 25 bp, Rattus norvegicus
tgccctgctgagttttgatatcctg

SEQ ID NO: 620893 - DNA, 25 bp, Rattus norvegicus
tgccctgctgatcccctgtgaaata

SEQ ID NO: 620894 - DNA, 25 bp, Rattus norvegicus
tgccctgctgatgccctgtgaaata

SEQ ID NO: 620895 - DNA, 25 bp, Rattus norvegicus
tgccctgctggcacttgtagagttg

SEQ ID NO: 620896 - DNA, 25 bp, Rattus norvegicus
tgccctgctggctcttgtagagttg

SEQ ID NO: 620897 - DNA, 25 bp, Rattus norvegicus
tgccctgctgtgactacaagctgaa

SEQ ID NO: 620898 - DNA, 25 bp, Rattus norvegicus
tgccctgctgtgtctacaagctgaa

SEQ ID NO: 620899 - DNA, 25 bp, Rattus norvegicus
tgccctgctgttccttgacagtctg

SEQ ID NO: 620900 - DNA, 25 bp, Rattus norvegicus
tgccctgctgttgcttgacagtctg

SEQ ID NO: 620901 - DNA, 25 bp, Rattus norvegicus
tgccctgctttcaggttacttacat

SEQ ID NO: 620902 - DNA, 25 bp, Rattus norvegicus
tgccctgctttctggttacttacat

SEQ ID NO: 620903 - DNA, 25 bp, Rattus norvegicus
tgccctggacacagtattacttaga

SEQ ID NO: 620904 - DNA, 25 bp, Rattus norvegicus
tgccctggacactgtattacttaga

SEQ ID NO: 620905 - DNA, 25 bp, Rattus norvegicus
tgccctggagtcagttctcgagata

SEQ ID NO: 620906 - DNA, 25 bp, Rattus norvegicus
tgccctggagtctgttctcgagata

SEQ ID NO: 620907 - DNA, 25 bp, Rattus norvegicus
tgccctggattaatacagtcttaag

SEQ ID NO: 620908 - DNA, 25 bp, Rattus norvegicus
tgccctggattattacagtcttaag

SEQ ID NO: 620909 - DNA, 25 bp, Rattus norvegicus
tgccctggcgccagtggtaagcaga

SEQ ID NO: 620910 - DNA, 25 bp, Rattus norvegicus
tgccctggcgcctgtggtaagcaga

SEQ ID NO: 620911 - DNA, 25 bp, Rattus norvegicus
tgccctggctccaagcaccatgaag

SEQ ID NO: 620912 - DNA, 25 bp, Rattus norvegicus
tgccctggctcctagcaccatgaag

SEQ ID NO: 620913 - DNA, 25 bp, Rattus norvegicus
tgccctgggacgagtgacgtacaga

SEQ ID NO: 620914 - DNA, 25 bp, Rattus norvegicus
tgccctgggacgtgtgacgtacaga

SEQ ID NO: 620915 - DNA, 25 bp, Rattus norvegicus
tgccctgggatcctgtcatacagat

SEQ ID NO: 620916 - DNA, 25 bp, Rattus norvegicus
tgccctgggatcgtgtcatacagat

SEQ ID NO: 620917 - DNA, 25 bp, Rattus norvegicus
tgccctgggcagaaactccgagtgc

SEQ ID NO: 620918 - DNA, 25 bp, Rattus norvegicus
tgccctgggcagtaactccgagtgc

SEQ ID NO: 620919 - DNA, 25 bp, Rattus norvegicus
tgccctgggtcacgtgctcacctgt

SEQ ID NO: 620920 - DNA, 25 bp, Rattus norvegicus
tgccctgggtcaggtgctcacctgt

SEQ ID NO: 620921 - DNA, 25 bp, Rattus norvegicus
tgccctgggtgaacgctgcacagtg

SEQ ID NO: 620922 - DNA, 25 bp, Rattus norvegicus
tgccctgggtgatcgctgcacagtg

SEQ ID NO: 620923 - DNA, 25 bp, Rattus norvegicus
tgccctggtcggactacttgaaaat

SEQ ID NO: 620924 - DNA, 25 bp, Rattus norvegicus
tgccctggtcggtctacttgaaaat

SEQ ID NO: 620925 - DNA, 25 bp, Rattus norvegicus
tgccctggttctaggtgccaccatc

SEQ ID NO: 620926 - DNA, 25 bp, Rattus norvegicus
tgccctggttcttggtgccaccatc

SEQ ID NO: 620927 - DNA, 25 bp, Rattus norvegicus
tgccctgtacccacaaagattttgt

SEQ ID NO: 620928 - DNA, 25 bp, Rattus norvegicus
tgccctgtaccctcaaagattttgt

SEQ ID NO: 620929 - DNA, 25 bp, Rattus norvegicus
tgccctgtatttccgtgtgttttat

SEQ ID NO: 620930 - DNA, 25 bp, Rattus norvegicus
tgccctgtatttgcgtgtgttttat

SEQ ID NO: 620931 - DNA, 25 bp, Rattus norvegicus
tgccctgtcacgctgtgatgtgaaa

SEQ ID NO: 620932 - DNA, 25 bp, Rattus norvegicus
tgccctgtcacggtgtgatgtgaaa

SEQ ID NO: 620933 - DNA, 25 bp, Rattus norvegicus
tgccctgtcagcaactgttcataaa

SEQ ID NO: 620934 - DNA, 25 bp, Rattus norvegicus
tgccctgtcagctactgttcataaa

SEQ ID NO: 620935 - DNA, 25 bp, Rattus norvegicus
tgccctgtcctcatgaactttagag

SEQ ID NO: 620936 - DNA, 25 bp, Rattus norvegicus
tgccctgtcctcttgaactttagag

SEQ ID NO: 620937 - DNA, 25 bp, Rattus norvegicus
tgccctgtctctcgaaggtactgaa

SEQ ID NO: 620938 - DNA, 25 bp, Rattus norvegicus
tgccctgtctctggaaggtactgaa

SEQ ID NO: 620939 - DNA, 25 bp, Rattus norvegicus
tgccctgtcttcagtttttctatga

SEQ ID NO: 620940 - DNA, 25 bp, Rattus norvegicus
tgccctgtcttctgtttttctatga

SEQ ID NO: 620941 - DNA, 25 bp, Rattus norvegicus
tgccctgtgatgagctgccctggtc

SEQ ID NO: 620942 - DNA, 25 bp, Rattus norvegicus
tgccctgtgatgtgctgccctggtc

SEQ ID NO: 620943 - DNA, 25 bp, Rattus norvegicus
tgccctgtggccatggactgaccag

SEQ ID NO: 620944 - DNA, 25 bp, Rattus norvegicus
tgccctgtggccttggactgaccag

SEQ ID NO: 620945 - DNA, 25 bp, Rattus norvegicus
tgccctgtggcgaaaactttcgtat

SEQ ID NO: 620946 - DNA, 25 bp, Rattus norvegicus
tgccctgtggcgtaaactttcgtat

SEQ ID NO: 620947 - DNA, 25 bp, Rattus norvegicus
tgccctgtgggcagttgtctgtcac

SEQ ID NO: 620948 - DNA, 25 bp, Rattus norvegicus
tgccctgtgggctgttgtctgtcac

SEQ ID NO: 620949 - DNA, 25 bp, Rattus norvegicus
tgccctgtgtatagcagcttgtatt

SEQ ID NO: 620950 - DNA, 25 bp, Rattus norvegicus
tgccctgtgtattgcagcttgtatt

SEQ ID NO: 620951 - DNA, 25 bp, Rattus norvegicus
tgccctgtgtcacaccttatgagtg

SEQ ID NO: 620952 - DNA, 25 bp, Rattus norvegicus
tgccctgtgtcagaccttatgagtg

SEQ ID NO: 620953 - DNA, 25 bp, Rattus norvegicus
tgccctgtgtggaagactatctgtc

SEQ ID NO: 620954 - DNA, 25 bp, Rattus norvegicus
tgccctgtgtggtagactatctgtc

SEQ ID NO: 620955 - DNA, 25 bp, Rattus norvegicus
tgccctgttacaagaccgtggagga

SEQ ID NO: 620956 - DNA, 25 bp, Rattus norvegicus
tgccctgttacatgaccgtggagga

SEQ ID NO: 620957 - DNA, 25 bp, Rattus norvegicus
tgccctgttactatgtcctttttat

SEQ ID NO: 620958 - DNA, 25 bp, Rattus norvegicus
tgccctgttactttgtcctttttat

SEQ ID NO: 620959 - DNA, 25 bp, Rattus norvegicus
tgccctgttagccatgcttatacta

SEQ ID NO: 620960 - DNA, 25 bp, Rattus norvegicus
tgccctgttagcgatgcttatacta

SEQ ID NO: 620961 - DNA, 25 bp, Rattus norvegicus
tgccctgttcctctctggaaatcaa

SEQ ID NO: 620962 - DNA, 25 bp, Rattus norvegicus
tgccctgttcctgtctggaaatcaa

SEQ ID NO: 620963 - DNA, 25 bp, Rattus norvegicus
tgccctgttgtacatgcctttatca

SEQ ID NO: 620964 - DNA, 25 bp, Rattus norvegicus
tgccctgttgtagatgcctttatca

SEQ ID NO: 620965 - DNA, 25 bp, Rattus norvegicus
tgccctgtttggctttttatcagcc

SEQ ID NO: 620966 - DNA, 25 bp, Rattus norvegicus
tgccctgtttgggtttttatcagcc

SEQ ID NO: 620967 - DNA, 25 bp, Rattus norvegicus
tgccctgttttaaaggtgccttttt

SEQ ID NO: 620968 - DNA, 25 bp, Rattus norvegicus
tgccctgttttataggtgccttttt

SEQ ID NO: 620969 - DNA, 25 bp, Rattus norvegicus
tgccctgttttcactcagtgatgaa

SEQ ID NO: 620970 - DNA, 25 bp, Rattus norvegicus
tgccctgttttctctcagtgatgaa

SEQ ID NO: 620971 - DNA, 25 bp, Rattus norvegicus
tgcccttaaacacctgcttcagtag

SEQ ID NO: 620972 - DNA, 25 bp, Rattus norvegicus
tgcccttaaacagctgcttcagtag

SEQ ID NO: 620973 - DNA, 25 bp, Rattus norvegicus
tgcccttaacacatactcaaaacgc

SEQ ID NO: 620974 - DNA, 25 bp, Rattus norvegicus
tgcccttaacacttactcaaaacgc

SEQ ID NO: 620975 - DNA, 25 bp, Rattus norvegicus
tgcccttaatagacccacagtgaca

SEQ ID NO: 620976 - DNA, 25 bp, Rattus norvegicus
tgcccttaatagtcccacagtgaca

SEQ ID NO: 620977 - DNA, 25 bp, Rattus norvegicus
tgcccttaccatccaacttatgttt

SEQ ID NO: 620978 - DNA, 25 bp, Rattus norvegicus
tgcccttaccatcttccgggtagag

SEQ ID NO: 620979 - DNA, 25 bp, Rattus norvegicus
tgcccttaccatgcaacttatgttt

SEQ ID NO: 620980 - DNA, 25 bp, Rattus norvegicus
tgcccttaccatgttccgggtagag

SEQ ID NO: 620981 - DNA, 25 bp, Rattus norvegicus
tgcccttagcacacatgatcactta

SEQ ID NO: 620982 - DNA, 25 bp, Rattus norvegicus
tgcccttagcactcatgatcactta

SEQ ID NO: 620983 - DNA, 25 bp, Rattus norvegicus
tgcccttagcagagcaactggacat

SEQ ID NO: 620984 - DNA, 25 bp, Rattus norvegicus
tgcccttagcagtgcaactggacat

SEQ ID NO: 620985 - DNA, 25 bp, Rattus norvegicus
tgcccttatgcacggaactgtttct

SEQ ID NO: 620986 - DNA, 25 bp, Rattus norvegicus
tgcccttatgcagggaactgtttct

SEQ ID NO: 620987 - DNA, 25 bp, Rattus norvegicus
tgcccttcaaggatgctctctaata

SEQ ID NO: 620988 - DNA, 25 bp, Rattus norvegicus
tgcccttcaaggttgctctctaata

SEQ ID NO: 620989 - DNA, 25 bp, Rattus norvegicus
tgcccttcactgacttgtcggagga

SEQ ID NO: 620990 - DNA, 25 bp, Rattus norvegicus
tgcccttcactgtcttgtcggagga

SEQ ID NO: 620991 - DNA, 25 bp, Rattus norvegicus
tgcccttcagacacatgacagtggg

SEQ ID NO: 620992 - DNA, 25 bp, Rattus norvegicus
tgcccttcagactcatgacagtggg

SEQ ID NO: 620993 - DNA, 25 bp, Rattus norvegicus
tgcccttcagttagacattccctag

SEQ ID NO: 620994 - DNA, 25 bp, Rattus norvegicus
tgcccttcagtttgacattccctag

SEQ ID NO: 620995 - DNA, 25 bp, Rattus norvegicus
tgcccttcatacattaatctcagcg

SEQ ID NO: 620996 - DNA, 25 bp, Rattus norvegicus
tgcccttcatactttaatctcagcg

SEQ ID NO: 620997 - DNA, 25 bp, Rattus norvegicus
tgcccttcatgaacttcctgacaga

SEQ ID NO: 620998 - DNA, 25 bp, Rattus norvegicus
tgcccttcatgatcttcctgacaga

SEQ ID NO: 620999 - DNA, 25 bp, Rattus norvegicus
tgcccttcattcatattgccttaaa

SEQ ID NO: 621000 - DNA, 25 bp, Rattus norvegicus
tgcccttcattcttattgccttaaa

SEQ ID NO: 621001 - DNA, 25 bp, Rattus norvegicus
tgcccttccctgctgaagccagaaa

SEQ ID NO: 621002 - DNA, 25 bp, Rattus norvegicus
tgcccttccctggtgaagccagaaa

SEQ ID NO: 621003 - DNA, 25 bp, Rattus norvegicus
tgcccttcctgaagaaaccctggag

SEQ ID NO: 621004 - DNA, 25 bp, Rattus norvegicus
tgcccttcctgatgaaaccctggag

SEQ ID NO: 621005 - DNA, 25 bp, Rattus norvegicus
tgcccttctatcatacaactgttta

SEQ ID NO: 621006 - DNA, 25 bp, Rattus norvegicus
tgcccttctatcttacaactgttta

SEQ ID NO: 621007 - DNA, 25 bp, Rattus norvegicus
tgcccttcttttatgtcctgggagg

SEQ ID NO: 621008 - DNA, 25 bp, Rattus norvegicus
tgcccttcttttttgtcctgggagg

SEQ ID NO: 621009 - DNA, 25 bp, Rattus norvegicus
tgcccttgaccaaggcagtgccagt

SEQ ID NO: 621010 - DNA, 25 bp, Rattus norvegicus
tgcccttgaccatggcagtgccagt

SEQ ID NO: 621011 - DNA, 25 bp, Rattus norvegicus
tgcccttgcactaggctgccaaaga

SEQ ID NO: 621012 - DNA, 25 bp, Rattus norvegicus
tgcccttgcacttggctgccaaaga

SEQ ID NO: 621013 - DNA, 25 bp, Rattus norvegicus
tgcccttgcatgagcagcccaggac

SEQ ID NO: 621014 - DNA, 25 bp, Rattus norvegicus
tgcccttgcatgtgcagcccaggac

SEQ ID NO: 621015 - DNA, 25 bp, Rattus norvegicus
tgcccttgcattcttttattggtag

SEQ ID NO: 621016 - DNA, 25 bp, Rattus norvegicus
tgcccttgcattgttttattggtag

SEQ ID NO: 621017 - DNA, 25 bp, Rattus norvegicus
tgcccttgcctgagaactctgtgaa

SEQ ID NO: 621018 - DNA, 25 bp, Rattus norvegicus
tgcccttgcctgtgaactctgtgaa

SEQ ID NO: 621019 - DNA, 25 bp, Rattus norvegicus
tgcccttggatgctaatattcttta

SEQ ID NO: 621020 - DNA, 25 bp, Rattus norvegicus
tgcccttggatggtaatattcttta

SEQ ID NO: 621021 - DNA, 25 bp, Rattus norvegicus
tgcccttggattccacgatagctcc

SEQ ID NO: 621022 - DNA, 25 bp, Rattus norvegicus
tgcccttggattgcacgatagctcc

SEQ ID NO: 621023 - DNA, 25 bp, Rattus norvegicus
tgcccttggctcagtgtcaacagaa

SEQ ID NO: 621024 - DNA, 25 bp, Rattus norvegicus
tgcccttggctctgtgtcaacagaa

SEQ ID NO: 621025 - DNA, 25 bp, Rattus norvegicus
tgcccttgggacactgttttcccgg

SEQ ID NO: 621026 - DNA, 25 bp, Rattus norvegicus
tgcccttgggactctgttttcccgg

SEQ ID NO: 621027 - DNA, 25 bp, Rattus norvegicus
tgcccttggttaacactagctacct

SEQ ID NO: 621028 - DNA, 25 bp, Rattus norvegicus
tgcccttggttatcactagctacct

SEQ ID NO: 621029 - DNA, 25 bp, Rattus norvegicus
tgcccttggttcacctttggaatct

SEQ ID NO: 621030 - DNA, 25 bp, Rattus norvegicus
tgcccttggttctcctttggaatct

SEQ ID NO: 621031 - DNA, 25 bp, Rattus norvegicus
tgcccttggtttccagctttagcac

SEQ ID NO: 621032 - DNA, 25 bp, Rattus norvegicus
tgcccttggtttgcagctttagcac

SEQ ID NO: 621033 - DNA, 25 bp, Rattus norvegicus
tgcccttgtagactcccaggtcatc

SEQ ID NO: 621034 - DNA, 25 bp, Rattus norvegicus
tgcccttgtagagtcccaggtcatc

SEQ ID NO: 621035 - DNA, 25 bp, Rattus norvegicus
tgcccttgtcccatgaagtcattat

SEQ ID NO: 621036 - DNA, 25 bp, Rattus norvegicus
tgcccttgtcccttgaagtcattat

SEQ ID NO: 621037 - DNA, 25 bp, Rattus norvegicus
tgcccttgtctgaacctcgtgtgta

SEQ ID NO: 621038 - DNA, 25 bp, Rattus norvegicus
tgcccttgtctgtacctcgtgtgta

SEQ ID NO: 621039 - DNA, 25 bp, Rattus norvegicus
tgccctttaaaaactgttagagcct

SEQ ID NO: 621040 - DNA, 25 bp, Rattus norvegicus
tgccctttaaaatctgttagagcct

SEQ ID NO: 621041 - DNA, 25 bp, Rattus norvegicus
tgccctttacagacagttgaccggt

SEQ ID NO: 621042 - DNA, 25 bp, Rattus norvegicus
tgccctttacagtcagttgaccggt

SEQ ID NO: 621043 - DNA, 25 bp, Rattus norvegicus
tgccctttcccactggacataactt

SEQ ID NO: 621044 - DNA, 25 bp, Rattus norvegicus
tgccctttcccagtggacataactt

SEQ ID NO: 621045 - DNA, 25 bp, Rattus norvegicus
tgccctttccctagtagagttttct

SEQ ID NO: 621046 - DNA, 25 bp, Rattus norvegicus
tgccctttcccttgtagagttttct

SEQ ID NO: 621047 - DNA, 25 bp, Rattus norvegicus
tgccctttcgttatttacagctcaa

SEQ ID NO: 621048 - DNA, 25 bp, Rattus norvegicus
tgccctttcgttttttacagctcaa

SEQ ID NO: 621049 - DNA, 25 bp, Rattus norvegicus
tgccctttctgactcagtcacaact

SEQ ID NO: 621050 - DNA, 25 bp, Rattus norvegicus
tgccctttctgagtcagtcacaact

SEQ ID NO: 621051 - DNA, 25 bp, Rattus norvegicus
tgccctttcttacctttctttacat

SEQ ID NO: 621052 - DNA, 25 bp, Rattus norvegicus
tgccctttcttagctttctttacat

SEQ ID NO: 621053 - DNA, 25 bp, Rattus norvegicus
tgccctttctttatgccggaccagt

SEQ ID NO: 621054 - DNA, 25 bp, Rattus norvegicus
tgccctttctttttgccggaccagt

SEQ ID NO: 621055 - DNA, 25 bp, Rattus norvegicus
tgccctttgaacatctcagttgact

SEQ ID NO: 621056 - DNA, 25 bp, Rattus norvegicus
tgccctttgaacttctcagttgact

SEQ ID NO: 621057 - DNA, 25 bp, Rattus norvegicus
tgccctttgcatacatctgtcatac

SEQ ID NO: 621058 - DNA, 25 bp, Rattus norvegicus
tgccctttgcatatttcttcacaga

SEQ ID NO: 621059 - DNA, 25 bp, Rattus norvegicus
tgccctttgcattcatctgtcatac

SEQ ID NO: 621060 - DNA, 25 bp, Rattus norvegicus
tgccctttgcatttttcttcacaga

SEQ ID NO: 621061 - DNA, 25 bp, Rattus norvegicus
tgccctttgcctcctaagctaatga

SEQ ID NO: 621062 - DNA, 25 bp, Rattus norvegicus
tgccctttgcctgctaagctaatga

SEQ ID NO: 621063 - DNA, 25 bp, Rattus norvegicus
tgccctttgctactcatcattatca

SEQ ID NO: 621064 - DNA, 25 bp, Rattus norvegicus
tgccctttgctagtcatcattatca

SEQ ID NO: 621065 - DNA, 25 bp, Rattus norvegicus
tgccctttgctgacctttctaatat

SEQ ID NO: 621066 - DNA, 25 bp, Rattus norvegicus
tgccctttgctgtcctttctaatat

SEQ ID NO: 621067 - DNA, 25 bp, Rattus norvegicus
tgccctttgggtcccttgaaactga

SEQ ID NO: 621068 - DNA, 25 bp, Rattus norvegicus
tgccctttgggtgccttgaaactga

SEQ ID NO: 621069 - DNA, 25 bp, Rattus norvegicus
tgccctttggtaaagctcttggtaa

SEQ ID NO: 621070 - DNA, 25 bp, Rattus norvegicus
tgccctttggtatagctcttggtaa

SEQ ID NO: 621071 - DNA, 25 bp, Rattus norvegicus
tgccctttttacacagacatttatg

SEQ ID NO: 621072 - DNA, 25 bp, Rattus norvegicus
tgccctttttactcagacatttatg

SEQ ID NO: 621073 - DNA, 25 bp, Rattus norvegicus
tgccctttttgtatcatgatgtatt

SEQ ID NO: 621074 - DNA, 25 bp, Rattus norvegicus
tgccctttttgtccttagttaccat

SEQ ID NO: 621075 - DNA, 25 bp, Rattus norvegicus
tgccctttttgtgcttagttaccat

SEQ ID NO: 621076 - DNA, 25 bp, Rattus norvegicus
tgccctttttgtttcatgatgtatt

SEQ ID NO: 621077 - DNA, 25 bp, Rattus norvegicus
tgccgaaatctcaattccattcata

SEQ ID NO: 621078 - DNA, 25 bp, Rattus norvegicus
tgccgaaatctctattccattcata

SEQ ID NO: 621079 - DNA, 25 bp, Rattus norvegicus
tgccgaaatctgatatgccgagtgt

SEQ ID NO: 621080 - DNA, 25 bp, Rattus norvegicus
tgccgaaatctgttatgccgagtgt

SEQ ID NO: 621081 - DNA, 25 bp, Rattus norvegicus
tgccgaaatgttcaagtttacccaa

SEQ ID NO: 621082 - DNA, 25 bp, Rattus norvegicus
tgccgaaatgttgaagtttacccaa

SEQ ID NO: 621083 - DNA, 25 bp, Rattus norvegicus
tgccgaacatttacaaagccctatg

SEQ ID NO: 621084 - DNA, 25 bp, Rattus norvegicus
tgccgaacattttcaaagccctatg

SEQ ID NO: 621085 - DNA, 25 bp, Rattus norvegicus
tgccgaagatttattcgctgcggat

SEQ ID NO: 621086 - DNA, 25 bp, Rattus norvegicus
tgccgaagattttttcgctgcggat

SEQ ID NO: 621087 - DNA, 25 bp, Rattus norvegicus
tgccgaagccagaaacagcactttt

SEQ ID NO: 621088 - DNA, 25 bp, Rattus norvegicus
tgccgaagccagtaacagcactttt

SEQ ID NO: 621089 - DNA, 25 bp, Rattus norvegicus
tgccgaatgcttctgccttgacaga

SEQ ID NO: 621090 - DNA, 25 bp, Rattus norvegicus
tgccgaatgcttgtgccttgacaga

SEQ ID NO: 621091 - DNA, 25 bp, Rattus norvegicus
tgccgaattccgcattgtcgaaagg

SEQ ID NO: 621092 - DNA, 25 bp, Rattus norvegicus
tgccgaattccggattgtcgaaagg

SEQ ID NO: 621093 - DNA, 25 bp, Rattus norvegicus
tgccgaatttctcgttttcctctta

SEQ ID NO: 621094 - DNA, 25 bp, Rattus norvegicus
tgccgaatttctggttttcctctta

SEQ ID NO: 621095 - DNA, 25 bp, Rattus norvegicus
tgccgacactcacattctttctgca

SEQ ID NO: 621096 - DNA, 25 bp, Rattus norvegicus
tgccgacactcagattctttctgca

SEQ ID NO: 621097 - DNA, 25 bp, Rattus norvegicus
tgccgacactgtagcacgcattgga

SEQ ID NO: 621098 - DNA, 25 bp, Rattus norvegicus
tgccgacactgttgcacgcattgga

SEQ ID NO: 621099 - DNA, 25 bp, Rattus norvegicus
tgccgacagcctacaacactgatta

SEQ ID NO: 621100 - DNA, 25 bp, Rattus norvegicus
tgccgacagccttcaacactgatta

SEQ ID NO: 621101 - DNA, 25 bp, Rattus norvegicus
tgccgacatctaagactccagagga

SEQ ID NO: 621102 - DNA, 25 bp, Rattus norvegicus
tgccgacatctatgactccagagga

SEQ ID NO: 621103 - DNA, 25 bp, Rattus norvegicus
tgccgaccccctaagatattgtatt

SEQ ID NO: 621104 - DNA, 25 bp, Rattus norvegicus
tgccgacccccttagatattgtatt

SEQ ID NO: 621105 - DNA, 25 bp, Rattus norvegicus
tgccgaccttccagttctataaaaa

SEQ ID NO: 621106 - DNA, 25 bp, Rattus norvegicus
tgccgaccttcctgttctataaaaa

SEQ ID NO: 621107 - DNA, 25 bp, Rattus norvegicus
tgccgacgacgcagcttgaaaccaa

SEQ ID NO: 621108 - DNA, 25 bp, Rattus norvegicus
tgccgacgacgctgcttgaaaccaa

SEQ ID NO: 621109 - DNA, 25 bp, Rattus norvegicus
tgccgacggtgtcctgcagctagaa

SEQ ID NO: 621110 - DNA, 25 bp, Rattus norvegicus
tgccgacggtgtgctgcagctagaa

SEQ ID NO: 621111 - DNA, 25 bp, Rattus norvegicus
tgccgactacgacgacttcgtgaat

SEQ ID NO: 621112 - DNA, 25 bp, Rattus norvegicus
tgccgactacgaggacttcgtgaat

SEQ ID NO: 621113 - DNA, 25 bp, Rattus norvegicus
tgccgactccccagcaagtgagaaa

SEQ ID NO: 621114 - DNA, 25 bp, Rattus norvegicus
tgccgactcccctgcaagtgagaaa

SEQ ID NO: 621115 - DNA, 25 bp, Rattus norvegicus
tgccgagaaagcctaccacgagcag

SEQ ID NO: 621116 - DNA, 25 bp, Rattus norvegicus
tgccgagaaagcgtaccacgagcag

SEQ ID NO: 621117 - DNA, 25 bp, Rattus norvegicus
tgccgagcaactaggtgtctgttaa

SEQ ID NO: 621118 - DNA, 25 bp, Rattus norvegicus
tgccgagcaacttggtgtctgttaa

SEQ ID NO: 621119 - DNA, 25 bp, Rattus norvegicus
tgccgagcaccacatcaacctgata

SEQ ID NO: 621120 - DNA, 25 bp, Rattus norvegicus
tgccgagcaccagatcaacctgata

SEQ ID NO: 621121 - DNA, 25 bp, Rattus norvegicus
tgccgaggagaccagattcaagtaa

SEQ ID NO: 621122 - DNA, 25 bp, Rattus norvegicus
tgccgaggagacgagattcaagtaa

SEQ ID NO: 621123 - DNA, 25 bp, Rattus norvegicus
tgccgagggctcaactctggtcctg

SEQ ID NO: 621124 - DNA, 25 bp, Rattus norvegicus
tgccgagggctctactctggtcctg

SEQ ID NO: 621125 - DNA, 25 bp, Rattus norvegicus
tgccgaggtctgatgttcacagcat

SEQ ID NO: 621126 - DNA, 25 bp, Rattus norvegicus
tgccgaggtctgttgttcacagcat

SEQ ID NO: 621127 - DNA, 25 bp, Rattus norvegicus
tgccgaggttccctgtttttgagcc

SEQ ID NO: 621128 - DNA, 25 bp, Rattus norvegicus
tgccgaggttccgtgtttttgagcc

SEQ ID NO: 621129 - DNA, 25 bp, Rattus norvegicus
tgccgagtaagcaggtggccctctg

SEQ ID NO: 621130 - DNA, 25 bp, Rattus norvegicus
tgccgagtaagctggtggccctctg

SEQ ID NO: 621131 - DNA, 25 bp, Rattus norvegicus
tgccgagtacggatccccgctgagg

SEQ ID NO: 621132 - DNA, 25 bp, Rattus norvegicus
tgccgagtacggttccccgctgagg

SEQ ID NO: 621133 - DNA, 25 bp, Rattus norvegicus
tgccgagtgggtatccagcactgtt

SEQ ID NO: 621134 - DNA, 25 bp, Rattus norvegicus
tgccgagtgggtttccagcactgtt

SEQ ID NO: 621135 - DNA, 25 bp, Rattus norvegicus
tgccgatctcgtactgactggttca

SEQ ID NO: 621136 - DNA, 25 bp, Rattus norvegicus
tgccgatctcgttctgactggttca

SEQ ID NO: 621137 - DNA, 25 bp, Rattus norvegicus
tgccgatctggtcatacagcaggtt

SEQ ID NO: 621138 - DNA, 25 bp, Rattus norvegicus
tgccgatctggtgatacagcaggtt

SEQ ID NO: 621139 - DNA, 25 bp, Rattus norvegicus
tgccgatgccgtaaaagcaagtgct

SEQ ID NO: 621140 - DNA, 25 bp, Rattus norvegicus
tgccgatgccgtattttccttcctg

SEQ ID NO: 621141 - DNA, 25 bp, Rattus norvegicus
tgccgatgccgttaaagcaagtgct

SEQ ID NO: 621142 - DNA, 25 bp, Rattus norvegicus
tgccgatgccgttttttccttcctg

SEQ ID NO: 621143 - DNA, 25 bp, Rattus norvegicus
tgccgatgtggcacagttagttagt

SEQ ID NO: 621144 - DNA, 25 bp, Rattus norvegicus
tgccgatgtggctcagttagttagt

SEQ ID NO: 621145 - DNA, 25 bp, Rattus norvegicus
tgccgatgttgcagggaaggtttct

SEQ ID NO: 621146 - DNA, 25 bp, Rattus norvegicus
tgccgatgttgctgggaaggtttct

SEQ ID NO: 621147 - DNA, 25 bp, Rattus norvegicus
tgccgatttgagatcgcgacactat

SEQ ID NO: 621148 - DNA, 25 bp, Rattus norvegicus
tgccgatttgagttcgcgacactat

SEQ ID NO: 621149 - DNA, 25 bp, Rattus norvegicus
tgccgcaatgctccctgatgctgct

SEQ ID NO: 621150 - DNA, 25 bp, Rattus norvegicus
tgccgcaatgctgcctgatgctgct

SEQ ID NO: 621151 - DNA, 25 bp, Rattus norvegicus
tgccgcacagctcgcacttgtaggg

SEQ ID NO: 621152 - DNA, 25 bp, Rattus norvegicus
tgccgcacagctggcacttgtaggg

SEQ ID NO: 621153 - DNA, 25 bp, Rattus norvegicus
tgccgcacagggacacatggatgaa

SEQ ID NO: 621154 - DNA, 25 bp, Rattus norvegicus
tgccgcacagggtcacatggatgaa

SEQ ID NO: 621155 - DNA, 25 bp, Rattus norvegicus
tgccgcagacacatggattcagtac

SEQ ID NO: 621156 - DNA, 25 bp, Rattus norvegicus
tgccgcagacacttggattcagtac

SEQ ID NO: 621157 - DNA, 25 bp, Rattus norvegicus
tgccgcagccccaggatgggcgagc

SEQ ID NO: 621158 - DNA, 25 bp, Rattus norvegicus
tgccgcagcccctggatgggcgagc

SEQ ID NO: 621159 - DNA, 25 bp, Rattus norvegicus
tgccgcagcctcctaaaacaaaagt

SEQ ID NO: 621160 - DNA, 25 bp, Rattus norvegicus
tgccgcagcctcgtaaaacaaaagt

SEQ ID NO: 621161 - DNA, 25 bp, Rattus norvegicus
tgccgcagccttctttctgaacagg

SEQ ID NO: 621162 - DNA, 25 bp, Rattus norvegicus
tgccgcagccttgtttctgaacagg

SEQ ID NO: 621163 - DNA, 25 bp, Rattus norvegicus
tgccgcaggagtaccaagtctttta

SEQ ID NO: 621164 - DNA, 25 bp, Rattus norvegicus
tgccgcaggagttccaagtctttta

SEQ ID NO: 621165 - DNA, 25 bp, Rattus norvegicus
tgccgcagggtcagtgaacctttac

SEQ ID NO: 621166 - DNA, 25 bp, Rattus norvegicus
tgccgcagggtctgtgaacctttac

SEQ ID NO: 621167 - DNA, 25 bp, Rattus norvegicus
tgccgcagtgtgacatgtctctaat

SEQ ID NO: 621168 - DNA, 25 bp, Rattus norvegicus
tgccgcagtgtgtcatgtctctaat

SEQ ID NO: 621169 - DNA, 25 bp, Rattus norvegicus
tgccgcattgtgactactcagaagt

SEQ ID NO: 621170 - DNA, 25 bp, Rattus norvegicus
tgccgcattgtgtctactcagaagt

SEQ ID NO: 621171 - DNA, 25 bp, Rattus norvegicus
tgccgccaaaacatccactttgtgg

SEQ ID NO: 621172 - DNA, 25 bp, Rattus norvegicus
tgccgccaaaacttccactttgtgg

SEQ ID NO: 621173 - DNA, 25 bp, Rattus norvegicus
tgccgccaaatgattacatgacctt

SEQ ID NO: 621174 - DNA, 25 bp, Rattus norvegicus
tgccgccaaatgtttacatgacctt

SEQ ID NO: 621175 - DNA, 25 bp, Rattus norvegicus
tgccgccaccaacatcatcaatgag

SEQ ID NO: 621176 - DNA, 25 bp, Rattus norvegicus
tgccgccaccaagatcatcaatgag

SEQ ID NO: 621177 - DNA, 25 bp, Rattus norvegicus
tgccgccagcgtcttgtcatggaga

SEQ ID NO: 621178 - DNA, 25 bp, Rattus norvegicus
tgccgccagcgtgttgtcatggaga

SEQ ID NO: 621179 - DNA, 25 bp, Rattus norvegicus
tgccgccagctaaggagttggcgct

SEQ ID NO: 621180 - DNA, 25 bp, Rattus norvegicus
tgccgccagctatggagttggcgct

SEQ ID NO: 621181 - DNA, 25 bp, Rattus norvegicus
tgccgcccacgtagatgatgatctt

SEQ ID NO: 621182 - DNA, 25 bp, Rattus norvegicus
tgccgcccacgttgatgatgatctt

SEQ ID NO: 621183 - DNA, 25 bp, Rattus norvegicus
tgccgcccgcaacgagaagctcaga

SEQ ID NO: 621184 - DNA, 25 bp, Rattus norvegicus
tgccgcccgcaaggagaagctcaga

SEQ ID NO: 621185 - DNA, 25 bp, Rattus norvegicus
tgccgcccggaaagaccatcaattt

SEQ ID NO: 621186 - DNA, 25 bp, Rattus norvegicus
tgccgcccggaatgaccatcaattt

SEQ ID NO: 621187 - DNA, 25 bp, Rattus norvegicus
tgccgcccgggaaaagctagctcag

SEQ ID NO: 621188 - DNA, 25 bp, Rattus norvegicus
tgccgcccgggataagctagctcag

SEQ ID NO: 621189 - DNA, 25 bp, Rattus norvegicus
tgccgccgcgctccaattgctaggg

SEQ ID NO: 621190 - DNA, 25 bp, Rattus norvegicus
tgccgccgcgctgcaattgctaggg

SEQ ID NO: 621191 - DNA, 25 bp, Rattus norvegicus
tgccgccgggctctgggtgaggagc

SEQ ID NO: 621192 - DNA, 25 bp, Rattus norvegicus
tgccgccgggctgtgggtgaggagc

SEQ ID NO: 621193 - DNA, 25 bp, Rattus norvegicus
tgccgccgtagaaggcctgtgtata

SEQ ID NO: 621194 - DNA, 25 bp, Rattus norvegicus
tgccgccgtagatggcctgtgtata

SEQ ID NO: 621195 - DNA, 25 bp, Rattus norvegicus
tgccgccgtcggcttgcgtcgtaat

SEQ ID NO: 621196 - DNA, 25 bp, Rattus norvegicus
tgccgccgtcgggttgcgtcgtaat

SEQ ID NO: 621197 - DNA, 25 bp, Rattus norvegicus
tgccgcctacatagaaaccacatag

SEQ ID NO: 621198 - DNA, 25 bp, Rattus norvegicus
tgccgcctacattgaaaccacatag

SEQ ID NO: 621199 - DNA, 25 bp, Rattus norvegicus
tgccgcctatggagcacgaggatga

SEQ ID NO: 621200 - DNA, 25 bp, Rattus norvegicus
tgccgcctatggtgcacgaggatga

SEQ ID NO: 621201 - DNA, 25 bp, Rattus norvegicus
tgccgcctgaacctgtaaatgctgg

SEQ ID NO: 621202 - DNA, 25 bp, Rattus norvegicus
tgccgcctgaacgtgtaaatgctgg

SEQ ID NO: 621203 - DNA, 25 bp, Rattus norvegicus
tgccgcctgagtcccgaaatgagct

SEQ ID NO: 621204 - DNA, 25 bp, Rattus norvegicus
tgccgcctgagtgccgaaatgagct

SEQ ID NO: 621205 - DNA, 25 bp, Rattus norvegicus
tgccgcctgggcagagtattacaga

SEQ ID NO: 621206 - DNA, 25 bp, Rattus norvegicus
tgccgcctgggctgagtattacaga

SEQ ID NO: 621207 - DNA, 25 bp, Rattus norvegicus
tgccgcgagataaaatcaaagacaa

SEQ ID NO: 621208 - DNA, 25 bp, Rattus norvegicus
tgccgcgagatataatcaaagacaa

SEQ ID NO: 621209 - DNA, 25 bp, Rattus norvegicus
tgccgctacctcactaaatgacaag

SEQ ID NO: 621210 - DNA, 25 bp, Rattus norvegicus
tgccgctacctctctaaatgacaag

SEQ ID NO: 621211 - DNA, 25 bp, Rattus norvegicus
tgccgctcagtcatctgtgcaggaa

SEQ ID NO: 621212 - DNA, 25 bp, Rattus norvegicus
tgccgctcagtcttctgtgcaggaa

SEQ ID NO: 621213 - DNA, 25 bp, Rattus norvegicus
tgccgctcggctcggacttgaccag

SEQ ID NO: 621214 - DNA, 25 bp, Rattus norvegicus
tgccgctcggctgggacttgaccag

SEQ ID NO: 621215 - DNA, 25 bp, Rattus norvegicus
tgccgctcgggtaggttatccgatt

SEQ ID NO: 621216 - DNA, 25 bp, Rattus norvegicus
tgccgctcgggttggttatccgatt

SEQ ID NO: 621217 - DNA, 25 bp, Rattus norvegicus
tgccgctctgttactggagtgaatt

SEQ ID NO: 621218 - DNA, 25 bp, Rattus norvegicus
tgccgctctgtttctggagtgaatt

SEQ ID NO: 621219 - DNA, 25 bp, Rattus norvegicus
tgccgctcttcacggtggttgacat

SEQ ID NO: 621220 - DNA, 25 bp, Rattus norvegicus
tgccgctcttcagggtggttgacat

SEQ ID NO: 621221 - DNA, 25 bp, Rattus norvegicus
tgccgctgcataacttgaactgtat

SEQ ID NO: 621222 - DNA, 25 bp, Rattus norvegicus
tgccgctgcatatcttgaactgtat

SEQ ID NO: 621223 - DNA, 25 bp, Rattus norvegicus
tgccgctgctatcgtcaccagaaat

SEQ ID NO: 621224 - DNA, 25 bp, Rattus norvegicus
tgccgctgctatggtcaccagaaat

SEQ ID NO: 621225 - DNA, 25 bp, Rattus norvegicus
tgccgctgctctagcctggagagga

SEQ ID NO: 621226 - DNA, 25 bp, Rattus norvegicus
tgccgctgctcttgcctggagagga

SEQ ID NO: 621227 - DNA, 25 bp, Rattus norvegicus
tgccgctgggttaccgaaatccgat

SEQ ID NO: 621228 - DNA, 25 bp, Rattus norvegicus
tgccgctgggtttccgaaatccgat

SEQ ID NO: 621229 - DNA, 25 bp, Rattus norvegicus
tgccgctggtctaggtccgaggaca

SEQ ID NO: 621230 - DNA, 25 bp, Rattus norvegicus
tgccgctggtcttggtccgaggaca

SEQ ID NO: 621231 - DNA, 25 bp, Rattus norvegicus
tgccgctgtcgcctggatggtctcc

SEQ ID NO: 621232 - DNA, 25 bp, Rattus norvegicus
tgccgctgtcgcgtggatggtctcc

SEQ ID NO: 621233 - DNA, 25 bp, Rattus norvegicus
tgccgctgtcttcacaaaggacctg

SEQ ID NO: 621234 - DNA, 25 bp, Rattus norvegicus
tgccgctgtcttgacaaaggacctg

SEQ ID NO: 621235 - DNA, 25 bp, Rattus norvegicus
tgccgctgttctaatatttttctaa

SEQ ID NO: 621236 - DNA, 25 bp, Rattus norvegicus
tgccgctgttcttatatttttctaa

SEQ ID NO: 621237 - DNA, 25 bp, Rattus norvegicus
tgccgctttccacaggacttagaat

SEQ ID NO: 621238 - DNA, 25 bp, Rattus norvegicus
tgccgctttccagaggacttagaat

SEQ ID NO: 621239 - DNA, 25 bp, Rattus norvegicus
tgccgcttttccataaccctgtagt

SEQ ID NO: 621240 - DNA, 25 bp, Rattus norvegicus
tgccgcttttccttaaccctgtagt

SEQ ID NO: 621241 - DNA, 25 bp, Rattus norvegicus
tgccggaagtaaaaaccccactctg

SEQ ID NO: 621242 - DNA, 25 bp, Rattus norvegicus
tgccggaagtaataaccccactctg

SEQ ID NO: 621243 - DNA, 25 bp, Rattus norvegicus
tgccggaatatcagcaggcggctat

SEQ ID NO: 621244 - DNA, 25 bp, Rattus norvegicus
tgccggaatatctgcaggcggctat

SEQ ID NO: 621245 - DNA, 25 bp, Rattus norvegicus
tgccggacactcagtacttcataga

SEQ ID NO: 621246 - DNA, 25 bp, Rattus norvegicus
tgccggacactctgtacttcataga

SEQ ID NO: 621247 - DNA, 25 bp, Rattus norvegicus
tgccggacattgacacgcttcagat

SEQ ID NO: 621248 - DNA, 25 bp, Rattus norvegicus
tgccggacattgtcacgcttcagat

SEQ ID NO: 621249 - DNA, 25 bp, Rattus norvegicus
tgccggaccctgctgaagagactag

SEQ ID NO: 621250 - DNA, 25 bp, Rattus norvegicus
tgccggaccctggtgaagagactag

SEQ ID NO: 621251 - DNA, 25 bp, Rattus norvegicus
tgccggaccttgctgatcagtctca

SEQ ID NO: 621252 - DNA, 25 bp, Rattus norvegicus
tgccggaccttggtgatcagtctca

SEQ ID NO: 621253 - DNA, 25 bp, Rattus norvegicus
tgccggacgtgtatggcgtgttcca

SEQ ID NO: 621254 - DNA, 25 bp, Rattus norvegicus
tgccggacgtgtttggcgtgttcca

SEQ ID NO: 621255 - DNA, 25 bp, Rattus norvegicus
tgccggatgaaactgcacagtgttg

SEQ ID NO: 621256 - DNA, 25 bp, Rattus norvegicus
tgccggatgaaagtgcacagtgttg

SEQ ID NO: 621257 - DNA, 25 bp, Rattus norvegicus
tgccggatgatgctcctggcttcca

SEQ ID NO: 621258 - DNA, 25 bp, Rattus norvegicus
tgccggatgatggtcctggcttcca

SEQ ID NO: 621259 - DNA, 25 bp, Rattus norvegicus
tgccggcaactgctgtactgtctac

SEQ ID NO: 621260 - DNA, 25 bp, Rattus norvegicus
tgccggcaactggtgtactgtctac

SEQ ID NO: 621261 - DNA, 25 bp, Rattus norvegicus
tgccggcatcatatctgatcagtga

SEQ ID NO: 621262 - DNA, 25 bp, Rattus norvegicus
tgccggcatcatttctgatcagtga

SEQ ID NO: 621263 - DNA, 25 bp, Rattus norvegicus
tgccggcatctacacatcgtggagc

SEQ ID NO: 621264 - DNA, 25 bp, Rattus norvegicus
tgccggcatctagacatcgtggagc

SEQ ID NO: 621265 - DNA, 25 bp, Rattus norvegicus
tgccggcattgtccctgccatgtgg

SEQ ID NO: 621266 - DNA, 25 bp, Rattus norvegicus
tgccggcattgtgcctgccatgtgg

SEQ ID NO: 621267 - DNA, 25 bp, Rattus norvegicus
tgccggcccttacaactctgatgaa

SEQ ID NO: 621268 - DNA, 25 bp, Rattus norvegicus
tgccggcccttagaactctgatgaa

SEQ ID NO: 621269 - DNA, 25 bp, Rattus norvegicus
tgccggcctgtaaccagcgtagctg

SEQ ID NO: 621270 - DNA, 25 bp, Rattus norvegicus
tgccggcctgtatccagcgtagctg

SEQ ID NO: 621271 - DNA, 25 bp, Rattus norvegicus
tgccggctagccaggaagcttgctc

SEQ ID NO: 621272 - DNA, 25 bp, Rattus norvegicus
tgccggctagcctggaagcttgctc

SEQ ID NO: 621273 - DNA, 25 bp, Rattus norvegicus
tgccggctgtgactgtcattgtcaa

SEQ ID NO: 621274 - DNA, 25 bp, Rattus norvegicus
tgccggctgtgagtgtcattgtcaa

SEQ ID NO: 621275 - DNA, 25 bp, Rattus norvegicus
tgccggctgtggactccaagcaatc

SEQ ID NO: 621276 - DNA, 25 bp, Rattus norvegicus
tgccggctgtggtctccaagcaatc

SEQ ID NO: 621277 - DNA, 25 bp, Rattus norvegicus
tgccggctttgtagaaggccagaaa

SEQ ID NO: 621278 - DNA, 25 bp, Rattus norvegicus
tgccggctttgttgaaggccagaaa

SEQ ID NO: 621279 - DNA, 25 bp, Rattus norvegicus
tgccgggaaccacagtgccagagtt

SEQ ID NO: 621280 - DNA, 25 bp, Rattus norvegicus
tgccgggaaccagagtgccagagtt

SEQ ID NO: 621281 - DNA, 25 bp, Rattus norvegicus
tgccgggacaatccccagttcaggt

SEQ ID NO: 621282 - DNA, 25 bp, Rattus norvegicus
tgccgggacaatgcccagttcaggt

SEQ ID NO: 621283 - DNA, 25 bp, Rattus norvegicus
tgccgggatcaaagtctgttctggc

SEQ ID NO: 621284 - DNA, 25 bp, Rattus norvegicus
tgccgggatcaatgtctgttctggc

SEQ ID NO: 621285 - DNA, 25 bp, Rattus norvegicus
tgccgggatgacctacgctgccaac

SEQ ID NO: 621286 - DNA, 25 bp, Rattus norvegicus
tgccgggatgacgtacgctgccaac

SEQ ID NO: 621287 - DNA, 25 bp, Rattus norvegicus
tgccgggcatgtctgtgcttagaaa

SEQ ID NO: 621288 - DNA, 25 bp, Rattus norvegicus
tgccgggcatgtgtgtgcttagaaa

SEQ ID NO: 621289 - DNA, 25 bp, Rattus norvegicus
tgccgggcccttcgacaaaatggac

SEQ ID NO: 621290 - DNA, 25 bp, Rattus norvegicus
tgccgggcccttggacaaaatggac

SEQ ID NO: 621291 - DNA, 25 bp, Rattus norvegicus
tgccgggccttcctagagcccttgg

SEQ ID NO: 621292 - DNA, 25 bp, Rattus norvegicus
tgccgggccttcgtagagcccttgg

SEQ ID NO: 621293 - DNA, 25 bp, Rattus norvegicus
tgccgggcgccacatagacgaagta

SEQ ID NO: 621294 - DNA, 25 bp, Rattus norvegicus
tgccgggcgccagatagacgaagta

SEQ ID NO: 621295 - DNA, 25 bp, Rattus norvegicus
tgccgggctcctaaaatgacatgta

SEQ ID NO: 621296 - DNA, 25 bp, Rattus norvegicus
tgccgggctccttaaatgacatgta

SEQ ID NO: 621297 - DNA, 25 bp, Rattus norvegicus
tgccgggtattaattgactccattc

SEQ ID NO: 621298 - DNA, 25 bp, Rattus norvegicus
tgccgggtattatttgactccattc

SEQ ID NO: 621299 - DNA, 25 bp, Rattus norvegicus
tgccgggttactcctactatctcac

SEQ ID NO: 621300 - DNA, 25 bp, Rattus norvegicus
tgccgggttactgctactatctcac

SEQ ID NO: 621301 - DNA, 25 bp, Rattus norvegicus
tgccgggttattagttgtgtgtgtt

SEQ ID NO: 621302 - DNA, 25 bp, Rattus norvegicus
tgccgggttatttgttgtgtgtgtt

SEQ ID NO: 621303 - DNA, 25 bp, Rattus norvegicus
tgccggtcacatcctttccaaagga

SEQ ID NO: 621304 - DNA, 25 bp, Rattus norvegicus
tgccggtcacatgctttccaaagga

SEQ ID NO: 621305 - DNA, 25 bp, Rattus norvegicus
tgccggtcacttacgcctgttttgg

SEQ ID NO: 621306 - DNA, 25 bp, Rattus norvegicus
tgccggtcactttcgcctgttttgg

SEQ ID NO: 621307 - DNA, 25 bp, Rattus norvegicus
tgccggtcagggaaatagggtttat

SEQ ID NO: 621308 - DNA, 25 bp, Rattus norvegicus
tgccggtcagggtaatagggtttat

SEQ ID NO: 621309 - DNA, 25 bp, Rattus norvegicus
tgccggtcatcaccaaggtggagac

SEQ ID NO: 621310 - DNA, 25 bp, Rattus norvegicus
tgccggtcatcagcaaggtggagac

SEQ ID NO: 621311 - DNA, 25 bp, Rattus norvegicus
tgccggtgggacacctatctctgaa

SEQ ID NO: 621312 - DNA, 25 bp, Rattus norvegicus
tgccggtgggactcctatctctgaa

SEQ ID NO: 621313 - DNA, 25 bp, Rattus norvegicus
tgccggttccccattgcgggaagag

SEQ ID NO: 621314 - DNA, 25 bp, Rattus norvegicus
tgccggttcccctttgcgggaagag

SEQ ID NO: 621315 - DNA, 25 bp, Rattus norvegicus
tgccggttgattacctccaacgttg

SEQ ID NO: 621316 - DNA, 25 bp, Rattus norvegicus
tgccggttgatttcctccaacgttg

SEQ ID NO: 621317 - DNA, 25 bp, Rattus norvegicus
tgccggttttgtcgttcaggtaaca

SEQ ID NO: 621318 - DNA, 25 bp, Rattus norvegicus
tgccggttttgtggttcaggtaaca

SEQ ID NO: 621319 - DNA, 25 bp, Rattus norvegicus
tgccgtaacatcattgccactacaa

SEQ ID NO: 621320 - DNA, 25 bp, Rattus norvegicus
tgccgtaacatctttgccactacaa

SEQ ID NO: 621321 - DNA, 25 bp, Rattus norvegicus
tgccgtaagcagacatgaactccaa

SEQ ID NO: 621322 - DNA, 25 bp, Rattus norvegicus
tgccgtaagcagtcatgaactccaa

SEQ ID NO: 621323 - DNA, 25 bp, Rattus norvegicus
tgccgtaaggcacaatcactgtttc

SEQ ID NO: 621324 - DNA, 25 bp, Rattus norvegicus
tgccgtaaggcagaatcactgtttc

SEQ ID NO: 621325 - DNA, 25 bp, Rattus norvegicus
tgccgtacagagatccattcaggga

SEQ ID NO: 621326 - DNA, 25 bp, Rattus norvegicus
tgccgtacagagttccattcaggga

SEQ ID NO: 621327 - DNA, 25 bp, Rattus norvegicus
tgccgtagagtgagttccgtaggta

SEQ ID NO: 621328 - DNA, 25 bp, Rattus norvegicus
tgccgtagagtgtgttccgtaggta

SEQ ID NO: 621329 - DNA, 25 bp, Rattus norvegicus
tgccgtaggcagagtttttaaccca

SEQ ID NO: 621330 - DNA, 25 bp, Rattus norvegicus
tgccgtaggcagtgtttttaaccca

SEQ ID NO: 621331 - DNA, 25 bp, Rattus norvegicus
tgccgtagtggcagttgtctggttt

SEQ ID NO: 621332 - DNA, 25 bp, Rattus norvegicus
tgccgtagtggctgttgtctggttt

SEQ ID NO: 621333 - DNA, 25 bp, Rattus norvegicus
tgccgtcaatagagcagcagccaca

SEQ ID NO: 621334 - DNA, 25 bp, Rattus norvegicus
tgccgtcaatagtgcagcagccaca

SEQ ID NO: 621335 - DNA, 25 bp, Rattus norvegicus
tgccgtcaatttaactacactggat

SEQ ID NO: 621336 - DNA, 25 bp, Rattus norvegicus
tgccgtcaattttactacactggat

SEQ ID NO: 621337 - DNA, 25 bp, Rattus norvegicus
tgccgtcacctcacaggagggctga

SEQ ID NO: 621338 - DNA, 25 bp, Rattus norvegicus
tgccgtcacctctcaggagggctga

SEQ ID NO: 621339 - DNA, 25 bp, Rattus norvegicus
tgccgtcactcacttggtatggttt

SEQ ID NO: 621340 - DNA, 25 bp, Rattus norvegicus
tgccgtcactcagttggtatggttt

SEQ ID NO: 621341 - DNA, 25 bp, Rattus norvegicus
tgccgtcatctgaggctaacgggca

SEQ ID NO: 621342 - DNA, 25 bp, Rattus norvegicus
tgccgtcatctgtggctaacgggca

SEQ ID NO: 621343 - DNA, 25 bp, Rattus norvegicus
tgccgtcattcactcatccaaggga

SEQ ID NO: 621344 - DNA, 25 bp, Rattus norvegicus
tgccgtcattcagtcatccaaggga

SEQ ID NO: 621345 - DNA, 25 bp, Rattus norvegicus
tgccgtccacgaaggtacagctaga

SEQ ID NO: 621346 - DNA, 25 bp, Rattus norvegicus
tgccgtccacgatggtacagctaga

SEQ ID NO: 621347 - DNA, 25 bp, Rattus norvegicus
tgccgtccacggagatctccatgta

SEQ ID NO: 621348 - DNA, 25 bp, Rattus norvegicus
tgccgtccacggtgatctccatgta

SEQ ID NO: 621349 - DNA, 25 bp, Rattus norvegicus
tgccgtccacttcttgtaagctgta

SEQ ID NO: 621350 - DNA, 25 bp, Rattus norvegicus
tgccgtccacttgttgtaagctgta

SEQ ID NO: 621351 - DNA, 25 bp, Rattus norvegicus
tgccgtccgctgagagcttctagca

SEQ ID NO: 621352 - DNA, 25 bp, Rattus norvegicus
tgccgtccgctgtgagcttctagca

SEQ ID NO: 621353 - DNA, 25 bp, Rattus norvegicus
tgccgtcctgcacagggtagctgtt

SEQ ID NO: 621354 - DNA, 25 bp, Rattus norvegicus
tgccgtcctgcagagggtagctgtt

SEQ ID NO: 621355 - DNA, 25 bp, Rattus norvegicus
tgccgtctagggaaccttatttccg

SEQ ID NO: 621356 - DNA, 25 bp, Rattus norvegicus
tgccgtctagggtaccttatttccg

SEQ ID NO: 621357 - DNA, 25 bp, Rattus norvegicus
tgccgtctatacaattttcttacag

SEQ ID NO: 621358 - DNA, 25 bp, Rattus norvegicus
tgccgtctatactattttcttacag

SEQ ID NO: 621359 - DNA, 25 bp, Rattus norvegicus
tgccgtctcagtagctctgactgtg

SEQ ID NO: 621360 - DNA, 25 bp, Rattus norvegicus
tgccgtctcagttgctctgactgtg

SEQ ID NO: 621361 - DNA, 25 bp, Rattus norvegicus
tgccgtctcgtgaaaagctttgtgg

SEQ ID NO: 621362 - DNA, 25 bp, Rattus norvegicus
tgccgtctcgtgtaaagctttgtgg

SEQ ID NO: 621363 - DNA, 25 bp, Rattus norvegicus
tgccgtctctgcattgaggtgttac

SEQ ID NO: 621364 - DNA, 25 bp, Rattus norvegicus
tgccgtctctgctttgaggtgttac

SEQ ID NO: 621365 - DNA, 25 bp, Rattus norvegicus
tgccgtctctgtacttatgtttata

SEQ ID NO: 621366 - DNA, 25 bp, Rattus norvegicus
tgccgtctctgttcttatgtttata

SEQ ID NO: 621367 - DNA, 25 bp, Rattus norvegicus
tgccgtctctttagccaagagcaag

SEQ ID NO: 621368 - DNA, 25 bp, Rattus norvegicus
tgccgtctcttttgccaagagcaag

SEQ ID NO: 621369 - DNA, 25 bp, Rattus norvegicus
tgccgtctgcaaccacactgtataa

SEQ ID NO: 621370 - DNA, 25 bp, Rattus norvegicus
tgccgtctgcaagcacactgtataa

SEQ ID NO: 621371 - DNA, 25 bp, Rattus norvegicus
tgccgtctgccaacatgtggttaaa

SEQ ID NO: 621372 - DNA, 25 bp, Rattus norvegicus
tgccgtctgccatcatgtggttaaa

SEQ ID NO: 621373 - DNA, 25 bp, Rattus norvegicus
tgccgtctgtggatatctggttgaa

SEQ ID NO: 621374 - DNA, 25 bp, Rattus norvegicus
tgccgtctgtggttatctggttgaa

SEQ ID NO: 621375 - DNA, 25 bp, Rattus norvegicus
tgccgtcttcagatcactatgggaa

SEQ ID NO: 621376 - DNA, 25 bp, Rattus norvegicus
tgccgtcttcagttcactatgggaa

SEQ ID NO: 621377 - DNA, 25 bp, Rattus norvegicus
tgccgtcttggcacaagaggcccaa

SEQ ID NO: 621378 - DNA, 25 bp, Rattus norvegicus
tgccgtcttggctcaagaggcccaa

SEQ ID NO: 621379 - DNA, 25 bp, Rattus norvegicus
tgccgtgcccatcagtggatgtaaa

SEQ ID NO: 621380 - DNA, 25 bp, Rattus norvegicus
tgccgtgcccatgagtggatgtaaa

SEQ ID NO: 621381 - DNA, 25 bp, Rattus norvegicus
tgccgtgcctggctccaaagatgaa

SEQ ID NO: 621382 - DNA, 25 bp, Rattus norvegicus
tgccgtgcctgggtccaaagatgaa

SEQ ID NO: 621383 - DNA, 25 bp, Rattus norvegicus
tgccgtgcgcttagtgcctccaagc

SEQ ID NO: 621384 - DNA, 25 bp, Rattus norvegicus
tgccgtgcgctttgtgcctccaagc

SEQ ID NO: 621385 - DNA, 25 bp, Rattus norvegicus
tgccgtgctttgaaatgccaggatt

SEQ ID NO: 621386 - DNA, 25 bp, Rattus norvegicus
tgccgtgctttgtaatgccaggatt

SEQ ID NO: 621387 - DNA, 25 bp, Rattus norvegicus
tgccgtggaccaccgttttgtgttt

SEQ ID NO: 621388 - DNA, 25 bp, Rattus norvegicus
tgccgtggaccagcgttttgtgttt

SEQ ID NO: 621389 - DNA, 25 bp, Rattus norvegicus
tgccgtggtttcagtggtactgctg

SEQ ID NO: 621390 - DNA, 25 bp, Rattus norvegicus
tgccgtggtttctgtggtactgctg

SEQ ID NO: 621391 - DNA, 25 bp, Rattus norvegicus
tgccgtgtagcaaaactgtctttag

SEQ ID NO: 621392 - DNA, 25 bp, Rattus norvegicus
tgccgtgtagcataactgtctttag

SEQ ID NO: 621393 - DNA, 25 bp, Rattus norvegicus
tgccgtgtatttaagctttgttcaa

SEQ ID NO: 621394 - DNA, 25 bp, Rattus norvegicus
tgccgtgtattttagctttgttcaa

SEQ ID NO: 621395 - DNA, 25 bp, Rattus norvegicus
tgccgtgtgaccctcaggttaagac

SEQ ID NO: 621396 - DNA, 25 bp, Rattus norvegicus
tgccgtgtgaccgtcaggttaagac

SEQ ID NO: 621397 - DNA, 25 bp, Rattus norvegicus
tgccgttaccttatgattccaggtt

SEQ ID NO: 621398 - DNA, 25 bp, Rattus norvegicus
tgccgttaccttttgattccaggtt

SEQ ID NO: 621399 - DNA, 25 bp, Rattus norvegicus
tgccgttactcacactcaagcttgg

SEQ ID NO: 621400 - DNA, 25 bp, Rattus norvegicus
tgccgttactcagactcaagcttgg

SEQ ID NO: 621401 - DNA, 25 bp, Rattus norvegicus
tgccgttagcccacgaagctggaaa

SEQ ID NO: 621402 - DNA, 25 bp, Rattus norvegicus
tgccgttagccctcgaagctggaaa

SEQ ID NO: 621403 - DNA, 25 bp, Rattus norvegicus
tgccgttcacctatcagcatctgta

SEQ ID NO: 621404 - DNA, 25 bp, Rattus norvegicus
tgccgttcacctttcagcatctgta

SEQ ID NO: 621405 - DNA, 25 bp, Rattus norvegicus
tgccgttccgcaaatattcagttta

SEQ ID NO: 621406 - DNA, 25 bp, Rattus norvegicus
tgccgttccgcatatattcagttta

SEQ ID NO: 621407 - DNA, 25 bp, Rattus norvegicus
tgccgttcctgcaaatatgcgctgt

SEQ ID NO: 621408 - DNA, 25 bp, Rattus norvegicus
tgccgttcctgctaatatgcgctgt

SEQ ID NO: 621409 - DNA, 25 bp, Rattus norvegicus
tgccgttctgttagatcgctgacta

SEQ ID NO: 621410 - DNA, 25 bp, Rattus norvegicus
tgccgttctgttctgttgtgtgctg

SEQ ID NO: 621411 - DNA, 25 bp, Rattus norvegicus
tgccgttctgttgtgttgtgtgctg

SEQ ID NO: 621412 - DNA, 25 bp, Rattus norvegicus
tgccgttctgtttgatcgctgacta

SEQ ID NO: 621413 - DNA, 25 bp, Rattus norvegicus
tgccgttgacaaagacagcttctat

SEQ ID NO: 621414 - DNA, 25 bp, Rattus norvegicus
tgccgttgacaatgacagcttctat

SEQ ID NO: 621415 - DNA, 25 bp, Rattus norvegicus
tgccgttgatggactagtttctagg

SEQ ID NO: 621416 - DNA, 25 bp, Rattus norvegicus
tgccgttgatggtctagtttctagg

SEQ ID NO: 621417 - DNA, 25 bp, Rattus norvegicus
tgccgttgttggacactcacaaatg

SEQ ID NO: 621418 - DNA, 25 bp, Rattus norvegicus
tgccgttgttggtcactcacaaatg

SEQ ID NO: 621419 - DNA, 25 bp, Rattus norvegicus
tgccgtttatttattgattgcttct

SEQ ID NO: 621420 - DNA, 25 bp, Rattus norvegicus
tgccgtttattttttgattgcttct

SEQ ID NO: 621421 - DNA, 25 bp, Rattus norvegicus
tgccgtttgcacatttgagtcatct

SEQ ID NO: 621422 - DNA, 25 bp, Rattus norvegicus
tgccgtttgcacttttgagtcatct

SEQ ID NO: 621423 - DNA, 25 bp, Rattus norvegicus
tgccgtttggagaggcgcacttact

SEQ ID NO: 621424 - DNA, 25 bp, Rattus norvegicus
tgccgtttggagtggcgcacttact

SEQ ID NO: 621425 - DNA, 25 bp, Rattus norvegicus
tgcctaaaaccactagactgcattt

SEQ ID NO: 621426 - DNA, 25 bp, Rattus norvegicus
tgcctaaaaccagtagactgcattt

SEQ ID NO: 621427 - DNA, 25 bp, Rattus norvegicus
tgcctaaaactgagcctagaaattt

SEQ ID NO: 621428 - DNA, 25 bp, Rattus norvegicus
tgcctaaaactgtgcctagaaattt

SEQ ID NO: 621429 - DNA, 25 bp, Rattus norvegicus
tgcctaaagattccgccgctaatat

SEQ ID NO: 621430 - DNA, 25 bp, Rattus norvegicus
tgcctaaagattgcgccgctaatat

SEQ ID NO: 621431 - DNA, 25 bp, Rattus norvegicus
tgcctaaatatgcacgctcaccttt

SEQ ID NO: 621432 - DNA, 25 bp, Rattus norvegicus
tgcctaaatatggacgctcaccttt

SEQ ID NO: 621433 - DNA, 25 bp, Rattus norvegicus
tgcctaactaaaaccgtgtgccctt

SEQ ID NO: 621434 - DNA, 25 bp, Rattus norvegicus
tgcctaactaaatccgtgtgccctt

SEQ ID NO: 621435 - DNA, 25 bp, Rattus norvegicus
tgcctaagaagcatgcgctgctgaa

SEQ ID NO: 621436 - DNA, 25 bp, Rattus norvegicus
tgcctaagaagcttgcgctgctgaa

SEQ ID NO: 621437 - DNA, 25 bp, Rattus norvegicus
tgcctaagcagacttactccatcat

SEQ ID NO: 621438 - DNA, 25 bp, Rattus norvegicus
tgcctaagcagagttactccatcat

SEQ ID NO: 621439 - DNA, 25 bp, Rattus norvegicus
tgcctaagcagtatcatagcctgta

SEQ ID NO: 621440 - DNA, 25 bp, Rattus norvegicus
tgcctaagcagtttcatagcctgta

SEQ ID NO: 621441 - DNA, 25 bp, Rattus norvegicus
tgcctaatcttacgtgattttggaa

SEQ ID NO: 621442 - DNA, 25 bp, Rattus norvegicus
tgcctaatcttaggtgattttggaa

SEQ ID NO: 621443 - DNA, 25 bp, Rattus norvegicus
tgcctaatgataacacaaacttgtg

SEQ ID NO: 621444 - DNA, 25 bp, Rattus norvegicus
tgcctaatgatatcacaaacttgtg

SEQ ID NO: 621445 - DNA, 25 bp, Rattus norvegicus
tgcctaattggcacatattctccct

SEQ ID NO: 621446 - DNA, 25 bp, Rattus norvegicus
tgcctaattggctcatattctccct

SEQ ID NO: 621447 - DNA, 25 bp, Rattus norvegicus
tgcctaattttcaaagggttaagtg

SEQ ID NO: 621448 - DNA, 25 bp, Rattus norvegicus
tgcctaattttctaagggttaagtg

SEQ ID NO: 621449 - DNA, 25 bp, Rattus norvegicus
tgcctacaccatcctcggagtaaac

SEQ ID NO: 621450 - DNA, 25 bp, Rattus norvegicus
tgcctacaccatgctcggagtaaac

SEQ ID NO: 621451 - DNA, 25 bp, Rattus norvegicus
tgcctacacctcagtgagagacttg

SEQ ID NO: 621452 - DNA, 25 bp, Rattus norvegicus
tgcctacacctctgtgagagacttg

SEQ ID NO: 621453 - DNA, 25 bp, Rattus norvegicus
tgcctacagggactagccgtgtcaa

SEQ ID NO: 621454 - DNA, 25 bp, Rattus norvegicus
tgcctacagggagtagccgtgtcaa

SEQ ID NO: 621455 - DNA, 25 bp, Rattus norvegicus
tgcctacatcctattctatgagcag

SEQ ID NO: 621456 - DNA, 25 bp, Rattus norvegicus
tgcctacatccttttctatgagcag

SEQ ID NO: 621457 - DNA, 25 bp, Rattus norvegicus
tgcctaccagttcgagattacccga

SEQ ID NO: 621458 - DNA, 25 bp, Rattus norvegicus
tgcctaccagttggagattacccga

SEQ ID NO: 621459 - DNA, 25 bp, Rattus norvegicus
tgcctaccatgcatgattgcctctg

SEQ ID NO: 621460 - DNA, 25 bp, Rattus norvegicus
tgcctaccatgcttgattgcctctg

SEQ ID NO: 621461 - DNA, 25 bp, Rattus norvegicus
tgcctacccagtcctaggactacaa

SEQ ID NO: 621462 - DNA, 25 bp, Rattus norvegicus
tgcctacccagtgctaggactacaa

SEQ ID NO: 621463 - DNA, 25 bp, Rattus norvegicus
tgcctaccccagaaagtttgcgtga

SEQ ID NO: 621464 - DNA, 25 bp, Rattus norvegicus
tgcctaccccagtaagtttgcgtga

SEQ ID NO: 621465 - DNA, 25 bp, Rattus norvegicus
tgcctacctcacagtgctttagaaa

SEQ ID NO: 621466 - DNA, 25 bp, Rattus norvegicus
tgcctacctcactgtgctttagaaa

SEQ ID NO: 621467 - DNA, 25 bp, Rattus norvegicus
tgcctacctgaccattcctaaaatc

SEQ ID NO: 621468 - DNA, 25 bp, Rattus norvegicus
tgcctacctgacgattcctaaaatc

SEQ ID NO: 621469 - DNA, 25 bp, Rattus norvegicus
tgcctacctggtagtttctgtctca

SEQ ID NO: 621470 - DNA, 25 bp, Rattus norvegicus
tgcctacctggttgtttctgtctca

SEQ ID NO: 621471 - DNA, 25 bp, Rattus norvegicus
tgcctacctgtgagtgcagatctgt

SEQ ID NO: 621472 - DNA, 25 bp, Rattus norvegicus
tgcctacctgtgtgtgcagatctgt

SEQ ID NO: 621473 - DNA, 25 bp, Rattus norvegicus
tgcctaccttctctgtgcagtttaa

SEQ ID NO: 621474 - DNA, 25 bp, Rattus norvegicus
tgcctaccttctgtgtgcagtttaa

SEQ ID NO: 621475 - DNA, 25 bp, Rattus norvegicus
tgcctacgactgatactatgacccc

SEQ ID NO: 621476 - DNA, 25 bp, Rattus norvegicus
tgcctacgactgttactatgacccc

SEQ ID NO: 621477 - DNA, 25 bp, Rattus norvegicus
tgcctacgctttacatctgaaaccg

SEQ ID NO: 621478 - DNA, 25 bp, Rattus norvegicus
tgcctacgcttttcatctgaaaccg

SEQ ID NO: 621479 - DNA, 25 bp, Rattus norvegicus
tgcctactgtccctgagttctgagc

SEQ ID NO: 621480 - DNA, 25 bp, Rattus norvegicus
tgcctactgtccgtgagttctgagc

SEQ ID NO: 621481 - DNA, 25 bp, Rattus norvegicus
tgcctagaaggtcatctgaagcatt

SEQ ID NO: 621482 - DNA, 25 bp, Rattus norvegicus
tgcctagaaggtgatctgaagcatt

SEQ ID NO: 621483 - DNA, 25 bp, Rattus norvegicus
tgcctagagcccactgtttctggag

SEQ ID NO: 621484 - DNA, 25 bp, Rattus norvegicus
tgcctagagccctctgtttctggag

SEQ ID NO: 621485 - DNA, 25 bp, Rattus norvegicus
tgcctagatcagaccttctccaaaa

SEQ ID NO: 621486 - DNA, 25 bp, Rattus norvegicus
tgcctagatcagtccttctccaaaa

SEQ ID NO: 621487 - DNA, 25 bp, Rattus norvegicus
tgcctagatccacccgggtcagtgg

SEQ ID NO: 621488 - DNA, 25 bp, Rattus norvegicus
tgcctagatccagccgggtcagtgg

SEQ ID NO: 621489 - DNA, 25 bp, Rattus norvegicus
tgcctagcatagacaagccctgaga

SEQ ID NO: 621490 - DNA, 25 bp, Rattus norvegicus
tgcctagcatagtcaagccctgaga

SEQ ID NO: 621491 - DNA, 25 bp, Rattus norvegicus
tgcctagcctctcactaattttatt

SEQ ID NO: 621492 - DNA, 25 bp, Rattus norvegicus
tgcctagcctctgactaattttatt

SEQ ID NO: 621493 - DNA, 25 bp, Rattus norvegicus
tgcctagcctttctgttcatacagt

SEQ ID NO: 621494 - DNA, 25 bp, Rattus norvegicus
tgcctagcctttgtgttcatacagt

SEQ ID NO: 621495 - DNA, 25 bp, Rattus norvegicus
tgcctagcggctaccggaagtttct

SEQ ID NO: 621496 - DNA, 25 bp, Rattus norvegicus
tgcctagcggcttccggaagtttct

SEQ ID NO: 621497 - DNA, 25 bp, Rattus norvegicus
tgcctagcgtttacattcccaagaa

SEQ ID NO: 621498 - DNA, 25 bp, Rattus norvegicus
tgcctagcgttttcattcccaagaa

SEQ ID NO: 621499 - DNA, 25 bp, Rattus norvegicus
tgcctagctaaccacttattcttta

SEQ ID NO: 621500 - DNA, 25 bp, Rattus norvegicus
tgcctagctaacgacttattcttta

SEQ ID NO: 621501 - DNA, 25 bp, Rattus norvegicus
tgcctagctacacagggcgccagta

SEQ ID NO: 621502 - DNA, 25 bp, Rattus norvegicus
tgcctagctacagagggcgccagta

SEQ ID NO: 621503 - DNA, 25 bp, Rattus norvegicus
tgcctaggaggtagagtcctcccgc

SEQ ID NO: 621504 - DNA, 25 bp, Rattus norvegicus
tgcctaggaggttgagtcctcccgc

SEQ ID NO: 621505 - DNA, 25 bp, Rattus norvegicus
tgcctaggcagtccaaccagagagg

SEQ ID NO: 621506 - DNA, 25 bp, Rattus norvegicus
tgcctaggcagtgcaaccagagagg

SEQ ID NO: 621507 - DNA, 25 bp, Rattus norvegicus
tgcctaggctctagcctgagaaggt

SEQ ID NO: 621508 - DNA, 25 bp, Rattus norvegicus
tgcctaggctcttgcctgagaaggt

SEQ ID NO: 621509 - DNA, 25 bp, Rattus norvegicus
tgcctagtaatacccactgtgccaa

SEQ ID NO: 621510 - DNA, 25 bp, Rattus norvegicus
tgcctagtaatagccactgtgccaa

SEQ ID NO: 621511 - DNA, 25 bp, Rattus norvegicus
tgcctagtactacaccacttggtta

SEQ ID NO: 621512 - DNA, 25 bp, Rattus norvegicus
tgcctagtactagaccacttggtta

SEQ ID NO: 621513 - DNA, 25 bp, Rattus norvegicus
tgcctagttgccacatctcagggaa

SEQ ID NO: 621514 - DNA, 25 bp, Rattus norvegicus
tgcctagttgcctcatctcagggaa

SEQ ID NO: 621515 - DNA, 25 bp, Rattus norvegicus
tgcctagttggtcagtggttctcag

SEQ ID NO: 621516 - DNA, 25 bp, Rattus norvegicus
tgcctagttggtgagtggttctcag

SEQ ID NO: 621517 - DNA, 25 bp, Rattus norvegicus
tgcctataatctcaggctgaggtat

SEQ ID NO: 621518 - DNA, 25 bp, Rattus norvegicus
tgcctataatctgaggctgaggtat

SEQ ID NO: 621519 - DNA, 25 bp, Rattus norvegicus
tgcctatagccaattagctctctct

SEQ ID NO: 621520 - DNA, 25 bp, Rattus norvegicus
tgcctatagccatttagctctctct

SEQ ID NO: 621521 - DNA, 25 bp, Rattus norvegicus
tgcctatatttaactgagtgctgtc

SEQ ID NO: 621522 - DNA, 25 bp, Rattus norvegicus
tgcctatatttatctgagtgctgtc

SEQ ID NO: 621523 - DNA, 25 bp, Rattus norvegicus
tgcctatcacagatatcgccgctcg

SEQ ID NO: 621524 - DNA, 25 bp, Rattus norvegicus
tgcctatcacagttatcgccgctcg

SEQ ID NO: 621525 - DNA, 25 bp, Rattus norvegicus
tgcctatccatcactgagactcatt

SEQ ID NO: 621526 - DNA, 25 bp, Rattus norvegicus
tgcctatccatctctgagactcatt

SEQ ID NO: 621527 - DNA, 25 bp, Rattus norvegicus
tgcctatccttgctgatcctaagcg

SEQ ID NO: 621528 - DNA, 25 bp, Rattus norvegicus
tgcctatccttggtgatcctaagcg

SEQ ID NO: 621529 - DNA, 25 bp, Rattus norvegicus
tgcctatctatgatcctcaaactgt

SEQ ID NO: 621530 - DNA, 25 bp, Rattus norvegicus
tgcctatctatgttcctcaaactgt

SEQ ID NO: 621531 - DNA, 25 bp, Rattus norvegicus
tgcctatctcctcctgcaagagagg

SEQ ID NO: 621532 - DNA, 25 bp, Rattus norvegicus
tgcctatctcctgctgcaagagagg

SEQ ID NO: 621533 - DNA, 25 bp, Rattus norvegicus
tgcctatctggtcgtccatgagaac

SEQ ID NO: 621534 - DNA, 25 bp, Rattus norvegicus
tgcctatctggtggtccatgagaac

SEQ ID NO: 621535 - DNA, 25 bp, Rattus norvegicus
tgcctatgccctatggagtctagaa

SEQ ID NO: 621536 - DNA, 25 bp, Rattus norvegicus
tgcctatgccctttggagtctagaa

SEQ ID NO: 621537 - DNA, 25 bp, Rattus norvegicus
tgcctatggctgactctggacttga

SEQ ID NO: 621538 - DNA, 25 bp, Rattus norvegicus
tgcctatggctgtctctggacttga

SEQ ID NO: 621539 - DNA, 25 bp, Rattus norvegicus
tgcctatgtgcacagcccactgggc

SEQ ID NO: 621540 - DNA, 25 bp, Rattus norvegicus
tgcctatgtgcagagcccactgggc

SEQ ID NO: 621541 - DNA, 25 bp, Rattus norvegicus
tgcctatgtggcagggtacctcaaa

SEQ ID NO: 621542 - DNA, 25 bp, Rattus norvegicus
tgcctatgtggccttcaaatgctgg

SEQ ID NO: 621543 - DNA, 25 bp, Rattus norvegicus
tgcctatgtggcgttcaaatgctgg

SEQ ID NO: 621544 - DNA, 25 bp, Rattus norvegicus
tgcctatgtggctgggtacctcaaa

SEQ ID NO: 621545 - DNA, 25 bp, Rattus norvegicus
tgcctatgtgtaatctgctttgtaa

SEQ ID NO: 621546 - DNA, 25 bp, Rattus norvegicus
tgcctatgtgtattctgctttgtaa

SEQ ID NO: 621547 - DNA, 25 bp, Rattus norvegicus
tgcctatgtgtcctgtgcagaattg

SEQ ID NO: 621548 - DNA, 25 bp, Rattus norvegicus
tgcctatgtgtcgtgtgcagaattg

SEQ ID NO: 621549 - DNA, 25 bp, Rattus norvegicus
tgcctatgtttgcacctgcggaaag

SEQ ID NO: 621550 - DNA, 25 bp, Rattus norvegicus
tgcctatgtttggacctgcggaaag

SEQ ID NO: 621551 - DNA, 25 bp, Rattus norvegicus
tgcctattcactcttggtaccttgc

SEQ ID NO: 621552 - DNA, 25 bp, Rattus norvegicus
tgcctattcactgttggtaccttgc

SEQ ID NO: 621553 - DNA, 25 bp, Rattus norvegicus
tgcctattctgtatcctcaggtgaa

SEQ ID NO: 621554 - DNA, 25 bp, Rattus norvegicus
tgcctattctgtttcctcaggtgaa

SEQ ID NO: 621555 - DNA, 25 bp, Rattus norvegicus
tgcctatttgttagtctgtattgcc

SEQ ID NO: 621556 - DNA, 25 bp, Rattus norvegicus
tgcctatttgtttgtctgtattgcc

SEQ ID NO: 621557 - DNA, 25 bp, Rattus norvegicus
tgcctcaaaaagcattcctgtctga

SEQ ID NO: 621558 - DNA, 25 bp, Rattus norvegicus
tgcctcaaaaaggattcctgtctga

SEQ ID NO: 621559 - DNA, 25 bp, Rattus norvegicus
tgcctcaacacccacaccgatgact

SEQ ID NO: 621560 - DNA, 25 bp, Rattus norvegicus
tgcctcaacaccgacaccgatgact

SEQ ID NO: 621561 - DNA, 25 bp, Rattus norvegicus
tgcctcaacctcagaagagttgttt

SEQ ID NO: 621562 - DNA, 25 bp, Rattus norvegicus
tgcctcaacctctgaagagttgttt

SEQ ID NO: 621563 - DNA, 25 bp, Rattus norvegicus
tgcctcaagcatcggagactccagc

SEQ ID NO: 621564 - DNA, 25 bp, Rattus norvegicus
tgcctcaagcatgggagactccagc

SEQ ID NO: 621565 - DNA, 25 bp, Rattus norvegicus
tgcctcaaggaaccaaccggctttg

SEQ ID NO: 621566 - DNA, 25 bp, Rattus norvegicus
tgcctcaaggaagcaaccggctttg

SEQ ID NO: 621567 - DNA, 25 bp, Rattus norvegicus
tgcctcaatcttctgtacatatgtt

SEQ ID NO: 621568 - DNA, 25 bp, Rattus norvegicus
tgcctcaatcttgtgtacatatgtt

SEQ ID NO: 621569 - DNA, 25 bp, Rattus norvegicus
tgcctcaattccaccatttgtgaaa

SEQ ID NO: 621570 - DNA, 25 bp, Rattus norvegicus
tgcctcaattcctccatttgtgaaa

SEQ ID NO: 621571 - DNA, 25 bp, Rattus norvegicus
tgcctcacaagaaaccatggctgtt

SEQ ID NO: 621572 - DNA, 25 bp, Rattus norvegicus
tgcctcacaagataccatggctgtt

SEQ ID NO: 621573 - DNA, 25 bp, Rattus norvegicus
tgcctcacagaacctgccagtggta

SEQ ID NO: 621574 - DNA, 25 bp, Rattus norvegicus
tgcctcacagaagctgccagtggta

SEQ ID NO: 621575 - DNA, 25 bp, Rattus norvegicus
tgcctcaccacgagagtctgtctta

SEQ ID NO: 621576 - DNA, 25 bp, Rattus norvegicus
tgcctcaccacgtgagtctgtctta

SEQ ID NO: 621577 - DNA, 25 bp, Rattus norvegicus
tgcctcacccgtcctagaagtaagg

SEQ ID NO: 621578 - DNA, 25 bp, Rattus norvegicus
tgcctcacccgtgctagaagtaagg

SEQ ID NO: 621579 - DNA, 25 bp, Rattus norvegicus
tgcctcaccggtccagaagaagaaa

SEQ ID NO: 621580 - DNA, 25 bp, Rattus norvegicus
tgcctcaccggtgcagaagaagaaa

SEQ ID NO: 621581 - DNA, 25 bp, Rattus norvegicus
tgcctcactgccataatgtcacaaa

SEQ ID NO: 621582 - DNA, 25 bp, Rattus norvegicus
tgcctcactgccttaatgtcacaaa

SEQ ID NO: 621583 - DNA, 25 bp, Rattus norvegicus
tgcctcacttgtagcaatgccatga

SEQ ID NO: 621584 - DNA, 25 bp, Rattus norvegicus
tgcctcacttgttgcaatgccatga

SEQ ID NO: 621585 - DNA, 25 bp, Rattus norvegicus
tgcctcacttttctcacctgtgaga

SEQ ID NO: 621586 - DNA, 25 bp, Rattus norvegicus
tgcctcacttttgtcacctgtgaga

SEQ ID NO: 621587 - DNA, 25 bp, Rattus norvegicus
tgcctcagaactcatttgcttctct

SEQ ID NO: 621588 - DNA, 25 bp, Rattus norvegicus
tgcctcagaactgatttgcttctct

SEQ ID NO: 621589 - DNA, 25 bp, Rattus norvegicus
tgcctcagaggaccctgggatgcaa

SEQ ID NO: 621590 - DNA, 25 bp, Rattus norvegicus
tgcctcagaggagcctgggatgcaa

SEQ ID NO: 621591 - DNA, 25 bp, Rattus norvegicus
tgcctcagcaggattggcgcctcag

SEQ ID NO: 621592 - DNA, 25 bp, Rattus norvegicus
tgcctcagcaggtttggcgcctcag

SEQ ID NO: 621593 - DNA, 25 bp, Rattus norvegicus
tgcctcagcctactgggttacaggt

SEQ ID NO: 621594 - DNA, 25 bp, Rattus norvegicus
tgcctcagcctagtgggttacaggt

SEQ ID NO: 621595 - DNA, 25 bp, Rattus norvegicus
tgcctcagctatcgcctgcatatca

SEQ ID NO: 621596 - DNA, 25 bp, Rattus norvegicus
tgcctcagctatggcctgcatatca

SEQ ID NO: 621597 - DNA, 25 bp, Rattus norvegicus
tgcctcagcttcctaattacaggga

SEQ ID NO: 621598 - DNA, 25 bp, Rattus norvegicus
tgcctcagcttcgtaattacaggga

SEQ ID NO: 621599 - DNA, 25 bp, Rattus norvegicus
tgcctcaggcctagaagtcctggag

SEQ ID NO: 621600 - DNA, 25 bp, Rattus norvegicus
tgcctcaggccttgaagtcctggag

SEQ ID NO: 621601 - DNA, 25 bp, Rattus norvegicus
tgcctcaggcttatcctggtgtctc

SEQ ID NO: 621602 - DNA, 25 bp, Rattus norvegicus
tgcctcaggcttttcctggtgtctc

SEQ ID NO: 621603 - DNA, 25 bp, Rattus norvegicus
tgcctcagggctagttagttcctgg

SEQ ID NO: 621604 - DNA, 25 bp, Rattus norvegicus
tgcctcagggctcctgcgtgctgac

SEQ ID NO: 621605 - DNA, 25 bp, Rattus norvegicus
tgcctcagggctgctgcgtgctgac

SEQ ID NO: 621606 - DNA, 25 bp, Rattus norvegicus
tgcctcagggcttgttagttcctgg

SEQ ID NO: 621607 - DNA, 25 bp, Rattus norvegicus
tgcctcagtcctagaaagcacttgt

SEQ ID NO: 621608 - DNA, 25 bp, Rattus norvegicus
tgcctcagtccttgaaagcacttgt

SEQ ID NO: 621609 - DNA, 25 bp, Rattus norvegicus
tgcctcagtttaccttatcctttta

SEQ ID NO: 621610 - DNA, 25 bp, Rattus norvegicus
tgcctcagtttagcttatcctttta

SEQ ID NO: 621611 - DNA, 25 bp, Rattus norvegicus
tgcctcataagccaactacacttct

SEQ ID NO: 621612 - DNA, 25 bp, Rattus norvegicus
tgcctcataagcgaactacacttct

SEQ ID NO: 621613 - DNA, 25 bp, Rattus norvegicus
tgcctcatactcatacttactgttg

SEQ ID NO: 621614 - DNA, 25 bp, Rattus norvegicus
tgcctcatactcttacttactgttg

SEQ ID NO: 621615 - DNA, 25 bp, Rattus norvegicus
tgcctcatatttaagctgctgctct

SEQ ID NO: 621616 - DNA, 25 bp, Rattus norvegicus
tgcctcatattttagctgctgctct

SEQ ID NO: 621617 - DNA, 25 bp, Rattus norvegicus
tgcctcatgatgatttttctctctc

SEQ ID NO: 621618 - DNA, 25 bp, Rattus norvegicus
tgcctcatgatgttttttctctctc

SEQ ID NO: 621619 - DNA, 25 bp, Rattus norvegicus
tgcctcatggcgctgaaagtgccca

SEQ ID NO: 621620 - DNA, 25 bp, Rattus norvegicus
tgcctcatggcggtgaaagtgccca

SEQ ID NO: 621621 - DNA, 25 bp, Rattus norvegicus
tgcctcattctgagcgcgaagactt

SEQ ID NO: 621622 - DNA, 25 bp, Rattus norvegicus
tgcctcattctgtgcgcgaagactt

SEQ ID NO: 621623 - DNA, 25 bp, Rattus norvegicus
tgcctccaaatgcttgacatctgcc

SEQ ID NO: 621624 - DNA, 25 bp, Rattus norvegicus
tgcctccaaatggttgacatctgcc

SEQ ID NO: 621625 - DNA, 25 bp, Rattus norvegicus
tgcctccacctcaaagtactgtgat

SEQ ID NO: 621626 - DNA, 25 bp, Rattus norvegicus
tgcctccacctctaagtactgtgat

SEQ ID NO: 621627 - DNA, 25 bp, Rattus norvegicus
tgcctccaccttacttgagagttag

SEQ ID NO: 621628 - DNA, 25 bp, Rattus norvegicus
tgcctccacctttcttgagagttag

SEQ ID NO: 621629 - DNA, 25 bp, Rattus norvegicus
tgcctccagacaacgatcggtacaa

SEQ ID NO: 621630 - DNA, 25 bp, Rattus norvegicus
tgcctccagacatcgatcggtacaa

SEQ ID NO: 621631 - DNA, 25 bp, Rattus norvegicus
tgcctccagaccatgatccgggtat

SEQ ID NO: 621632 - DNA, 25 bp, Rattus norvegicus
tgcctccagaccttgatccgggtat

SEQ ID NO: 621633 - DNA, 25 bp, Rattus norvegicus
tgcctccaggatcaacaccttgaag

SEQ ID NO: 621634 - DNA, 25 bp, Rattus norvegicus
tgcctccaggatgaacaccttgaag

SEQ ID NO: 621635 - DNA, 25 bp, Rattus norvegicus
tgcctccatctaccttagtgcagag

SEQ ID NO: 621636 - DNA, 25 bp, Rattus norvegicus
tgcctccatctagcttagtgcagag

SEQ ID NO: 621637 - DNA, 25 bp, Rattus norvegicus
tgcctccatgaaagcaaccctggat

SEQ ID NO: 621638 - DNA, 25 bp, Rattus norvegicus
tgcctccatgaatgcaaccctggat

SEQ ID NO: 621639 - DNA, 25 bp, Rattus norvegicus
tgcctccattttcggtctgtttata

SEQ ID NO: 621640 - DNA, 25 bp, Rattus norvegicus
tgcctccattttgggtctgtttata

SEQ ID NO: 621641 - DNA, 25 bp, Rattus norvegicus
tgcctcccaaaacctgtattctgat

SEQ ID NO: 621642 - DNA, 25 bp, Rattus norvegicus
tgcctcccaaaagctgtattctgat

SEQ ID NO: 621643 - DNA, 25 bp, Rattus norvegicus
tgcctcccaaccactagggttatag

SEQ ID NO: 621644 - DNA, 25 bp, Rattus norvegicus
tgcctcccaacctctagggttatag

SEQ ID NO: 621645 - DNA, 25 bp, Rattus norvegicus
tgcctcccaaggcaactaatgttct

SEQ ID NO: 621646 - DNA, 25 bp, Rattus norvegicus
tgcctcccaagggaactaatgttct

SEQ ID NO: 621647 - DNA, 25 bp, Rattus norvegicus
tgcctcccacttatacttaggaaga

SEQ ID NO: 621648 - DNA, 25 bp, Rattus norvegicus
tgcctcccacttttacttaggaaga

SEQ ID NO: 621649 - DNA, 25 bp, Rattus norvegicus
tgcctcccagacacttagatgcagg

SEQ ID NO: 621650 - DNA, 25 bp, Rattus norvegicus
tgcctcccagactcttagatgcagg

SEQ ID NO: 621651 - DNA, 25 bp, Rattus norvegicus
tgcctcccatgcctgattgtaaaag

SEQ ID NO: 621652 - DNA, 25 bp, Rattus norvegicus
tgcctcccatgcgtgattgtaaaag

SEQ ID NO: 621653 - DNA, 25 bp, Rattus norvegicus
tgcctcccatttaggtttgccttaa

SEQ ID NO: 621654 - DNA, 25 bp, Rattus norvegicus
tgcctcccattttggtttgccttaa

SEQ ID NO: 621655 - DNA, 25 bp, Rattus norvegicus
tgcctccccaagagttgagactaaa

SEQ ID NO: 621656 - DNA, 25 bp, Rattus norvegicus
tgcctccccaagtgttgagactaaa

SEQ ID NO: 621657 - DNA, 25 bp, Rattus norvegicus
tgcctccccaggctacttgggaatg

SEQ ID NO: 621658 - DNA, 25 bp, Rattus norvegicus
tgcctccccagggtacttgggaatg

SEQ ID NO: 621659 - DNA, 25 bp, Rattus norvegicus
tgcctccccatcatggttattataa

SEQ ID NO: 621660 - DNA, 25 bp, Rattus norvegicus
tgcctccccatcttggttattataa

SEQ ID NO: 621661 - DNA, 25 bp, Rattus norvegicus
tgcctccccgctcttgtgtaaaaaa

SEQ ID NO: 621662 - DNA, 25 bp, Rattus norvegicus
tgcctccccgctgttgtgtaaaaaa

SEQ ID NO: 621663 - DNA, 25 bp, Rattus norvegicus
tgcctcccctggatagacgcaggtt

SEQ ID NO: 621664 - DNA, 25 bp, Rattus norvegicus
tgcctcccctggttagacgcaggtt

SEQ ID NO: 621665 - DNA, 25 bp, Rattus norvegicus
tgcctcccgattatccggagacctt

SEQ ID NO: 621666 - DNA, 25 bp, Rattus norvegicus
tgcctcccgattttccggagacctt

SEQ ID NO: 621667 - DNA, 25 bp, Rattus norvegicus
tgcctccctaagaattgagcccagg

SEQ ID NO: 621668 - DNA, 25 bp, Rattus norvegicus
tgcctccctaagtattgagcccagg

SEQ ID NO: 621669 - DNA, 25 bp, Rattus norvegicus
tgcctccctccgcaaaatggtgaag

SEQ ID NO: 621670 - DNA, 25 bp, Rattus norvegicus
tgcctccctccggaaaatggtgaag

SEQ ID NO: 621671 - DNA, 25 bp, Rattus norvegicus
tgcctccctgagcactggaattaaa

SEQ ID NO: 621672 - DNA, 25 bp, Rattus norvegicus
tgcctccctgaggactggaattaaa

SEQ ID NO: 621673 - DNA, 25 bp, Rattus norvegicus
tgcctccctgggagaatgcgaagat

SEQ ID NO: 621674 - DNA, 25 bp, Rattus norvegicus
tgcctccctgggtgaatgcgaagat

SEQ ID NO: 621675 - DNA, 25 bp, Rattus norvegicus
tgcctcccttaacccctatgaagta

SEQ ID NO: 621676 - DNA, 25 bp, Rattus norvegicus
tgcctcccttaagccctatgaagta

SEQ ID NO: 621677 - DNA, 25 bp, Rattus norvegicus
tgcctcccttcactatcggaagtac

SEQ ID NO: 621678 - DNA, 25 bp, Rattus norvegicus
tgcctcccttcagtatcggaagtac

SEQ ID NO: 621679 - DNA, 25 bp, Rattus norvegicus
tgcctcctagcaatagtagtcagtt

SEQ ID NO: 621680 - DNA, 25 bp, Rattus norvegicus
tgcctcctagcacagaagtgtgtgt

SEQ ID NO: 621681 - DNA, 25 bp, Rattus norvegicus
tgcctcctagcagagaagtgtgtgt

SEQ ID NO: 621682 - DNA, 25 bp, Rattus norvegicus
tgcctcctagcattagtagtcagtt

SEQ ID NO: 621683 - DNA, 25 bp, Rattus norvegicus
tgcctcctcagccattatagattgt

SEQ ID NO: 621684 - DNA, 25 bp, Rattus norvegicus
tgcctcctcagcgattatagattgt

SEQ ID NO: 621685 - DNA, 25 bp, Rattus norvegicus
tgcctcctcaggctacaacttcagg

SEQ ID NO: 621686 - DNA, 25 bp, Rattus norvegicus
tgcctcctcagggtacaacttcagg

SEQ ID NO: 621687 - DNA, 25 bp, Rattus norvegicus
tgcctcctccaaatcagatggtttg

SEQ ID NO: 621688 - DNA, 25 bp, Rattus norvegicus
tgcctcctccaattcagatggtttg

SEQ ID NO: 621689 - DNA, 25 bp, Rattus norvegicus
tgcctcctccttattggagtcttag

SEQ ID NO: 621690 - DNA, 25 bp, Rattus norvegicus
tgcctcctccttcacttttataaag

SEQ ID NO: 621691 - DNA, 25 bp, Rattus norvegicus
tgcctcctccttgacttttataaag

SEQ ID NO: 621692 - DNA, 25 bp, Rattus norvegicus
tgcctcctcctttttggagtcttag

SEQ ID NO: 621693 - DNA, 25 bp, Rattus norvegicus
tgcctcctctaaccttgtatctgca

SEQ ID NO: 621694 - DNA, 25 bp, Rattus norvegicus
tgcctcctctaagcttgtatctgca

SEQ ID NO: 621695 - DNA, 25 bp, Rattus norvegicus
tgcctcctctggctatatggctaag

SEQ ID NO: 621696 - DNA, 25 bp, Rattus norvegicus
tgcctcctctgggtatatggctaag

SEQ ID NO: 621697 - DNA, 25 bp, Rattus norvegicus
tgcctcctctttattggttttgctg

SEQ ID NO: 621698 - DNA, 25 bp, Rattus norvegicus
tgcctcctcttttttggttttgctg

SEQ ID NO: 621699 - DNA, 25 bp, Rattus norvegicus
tgcctcctgagaagactcatccttt

SEQ ID NO: 621700 - DNA, 25 bp, Rattus norvegicus
tgcctcctgagatgactcatccttt

SEQ ID NO: 621701 - DNA, 25 bp, Rattus norvegicus
tgcctcctgatgcacttatcattga

SEQ ID NO: 621702 - DNA, 25 bp, Rattus norvegicus
tgcctcctgatggacttatcattga

SEQ ID NO: 621703 - DNA, 25 bp, Rattus norvegicus
tgcctcctgcagacaatgaagcact

SEQ ID NO: 621704 - DNA, 25 bp, Rattus norvegicus
tgcctcctgcagtcaatgaagcact

SEQ ID NO: 621705 - DNA, 25 bp, Rattus norvegicus
tgcctcctgctactgaaatctgcag

SEQ ID NO: 621706 - DNA, 25 bp, Rattus norvegicus
tgcctcctgctagtgaaatctgcag

SEQ ID NO: 621707 - DNA, 25 bp, Rattus norvegicus
tgcctcctgcttaacatgcagattc

SEQ ID NO: 621708 - DNA, 25 bp, Rattus norvegicus
tgcctcctgctttacatgcagattc

SEQ ID NO: 621709 - DNA, 25 bp, Rattus norvegicus
tgcctcctggtgctgagggaccacc

SEQ ID NO: 621710 - DNA, 25 bp, Rattus norvegicus
tgcctcctggtggtgagggaccacc

SEQ ID NO: 621711 - DNA, 25 bp, Rattus norvegicus
tgcctcctgttcacaatacactctg

SEQ ID NO: 621712 - DNA, 25 bp, Rattus norvegicus
tgcctcctgttctcaatacactctg

SEQ ID NO: 621713 - DNA, 25 bp, Rattus norvegicus
tgcctcctgtttctgggagttaata

SEQ ID NO: 621714 - DNA, 25 bp, Rattus norvegicus
tgcctcctgtttgtgggagttaata

SEQ ID NO: 621715 - DNA, 25 bp, Rattus norvegicus
tgcctccttgatacatccattcttt

SEQ ID NO: 621716 - DNA, 25 bp, Rattus norvegicus
tgcctccttgattcatccattcttt

SEQ ID NO: 621717 - DNA, 25 bp, Rattus norvegicus
tgcctccttggtctctagaggtatt

SEQ ID NO: 621718 - DNA, 25 bp, Rattus norvegicus
tgcctccttggtgtctagaggtatt

SEQ ID NO: 621719 - DNA, 25 bp, Rattus norvegicus
tgcctcctttgtacgaacagctgtt

SEQ ID NO: 621720 - DNA, 25 bp, Rattus norvegicus
tgcctcctttgttcgaacagctgtt

SEQ ID NO: 621721 - DNA, 25 bp, Rattus norvegicus
tgcctcgaaactccttttaccttaa

SEQ ID NO: 621722 - DNA, 25 bp, Rattus norvegicus
tgcctcgaaactgcttttaccttaa

SEQ ID NO: 621723 - DNA, 25 bp, Rattus norvegicus
tgcctcgaagttataagcatttcat

SEQ ID NO: 621724 - DNA, 25 bp, Rattus norvegicus
tgcctcgaagttttaagcatttcat

SEQ ID NO: 621725 - DNA, 25 bp, Rattus norvegicus
tgcctcgagataccgggttcaacca

SEQ ID NO: 621726 - DNA, 25 bp, Rattus norvegicus
tgcctcgagatagcgggttcaacca

SEQ ID NO: 621727 - DNA, 25 bp, Rattus norvegicus
tgcctcgagattcccctggaaatga

SEQ ID NO: 621728 - DNA, 25 bp, Rattus norvegicus
tgcctcgagattgccctggaaatga

SEQ ID NO: 621729 - DNA, 25 bp, Rattus norvegicus
tgcctcgatgaacagcaccacgatg

SEQ ID NO: 621730 - DNA, 25 bp, Rattus norvegicus
tgcctcgatgaagagcaccacgatg

SEQ ID NO: 621731 - DNA, 25 bp, Rattus norvegicus
tgcctcgcatttctgtaatctggac

SEQ ID NO: 621732 - DNA, 25 bp, Rattus norvegicus
tgcctcgcatttgtgtaatctggac

SEQ ID NO: 621733 - DNA, 25 bp, Rattus norvegicus
tgcctcgcgtgccaaacttgatgca

SEQ ID NO: 621734 - DNA, 25 bp, Rattus norvegicus
tgcctcgcgtgcgaaacttgatgca

SEQ ID NO: 621735 - DNA, 25 bp, Rattus norvegicus
tgcctcggcacacccaagggaaaca

SEQ ID NO: 621736 - DNA, 25 bp, Rattus norvegicus
tgcctcggcacagccaagggaaaca

SEQ ID NO: 621737 - DNA, 25 bp, Rattus norvegicus
tgcctcggcggaataccttttagac

SEQ ID NO: 621738 - DNA, 25 bp, Rattus norvegicus
tgcctcggcggattaccttttagac

SEQ ID NO: 621739 - DNA, 25 bp, Rattus norvegicus
tgcctcgggagtatgttctctacct

SEQ ID NO: 621740 - DNA, 25 bp, Rattus norvegicus
tgcctcgggagtttgttctctacct

SEQ ID NO: 621741 - DNA, 25 bp, Rattus norvegicus
tgcctcgggtccactgacccgggtg

SEQ ID NO: 621742 - DNA, 25 bp, Rattus norvegicus
tgcctcgggtcctctgacccgggtg

SEQ ID NO: 621743 - DNA, 25 bp, Rattus norvegicus
tgcctcgggtgcacagtgaatcaag

SEQ ID NO: 621744 - DNA, 25 bp, Rattus norvegicus
tgcctcgggtgctcagtgaatcaag

SEQ ID NO: 621745 - DNA, 25 bp, Rattus norvegicus
tgcctcggttttactacctcgaaag

SEQ ID NO: 621746 - DNA, 25 bp, Rattus norvegicus
tgcctcggtttttctacctcgaaag

SEQ ID NO: 621747 - DNA, 25 bp, Rattus norvegicus
tgcctcgtgaacatcttcctaagta

SEQ ID NO: 621748 - DNA, 25 bp, Rattus norvegicus
tgcctcgtgaacttcttcctaagta

SEQ ID NO: 621749 - DNA, 25 bp, Rattus norvegicus
tgcctcgttcctcacagctatgttt

SEQ ID NO: 621750 - DNA, 25 bp, Rattus norvegicus
tgcctcgttcctgacagctatgttt

SEQ ID NO: 621751 - DNA, 25 bp, Rattus norvegicus
tgcctcgttgatctttctctttaat

SEQ ID NO: 621752 - DNA, 25 bp, Rattus norvegicus
tgcctcgttgatgtttctctttaat

SEQ ID NO: 621753 - DNA, 25 bp, Rattus norvegicus
tgcctcgttgttcttgttcttcttc

SEQ ID NO: 621754 - DNA, 25 bp, Rattus norvegicus
tgcctcgttgttgttgttcttcttc

SEQ ID NO: 621755 - DNA, 25 bp, Rattus norvegicus
tgcctctacagaacacacacttttg

SEQ ID NO: 621756 - DNA, 25 bp, Rattus norvegicus
tgcctctacagatcacacacttttg

SEQ ID NO: 621757 - DNA, 25 bp, Rattus norvegicus
tgcctctacatcatgagtgctgaga

SEQ ID NO: 621758 - DNA, 25 bp, Rattus norvegicus
tgcctctacatcttgagtgctgaga

SEQ ID NO: 621759 - DNA, 25 bp, Rattus norvegicus
tgcctctacctgatggtggcagtca

SEQ ID NO: 621760 - DNA, 25 bp, Rattus norvegicus
tgcctctacctgttggtggcagtca

SEQ ID NO: 621761 - DNA, 25 bp, Rattus norvegicus
tgcctctactctccaagtgttaggt

SEQ ID NO: 621762 - DNA, 25 bp, Rattus norvegicus
tgcctctactctgcaagtgttaggt

SEQ ID NO: 621763 - DNA, 25 bp, Rattus norvegicus
tgcctctagaggatgaagctctcat

SEQ ID NO: 621764 - DNA, 25 bp, Rattus norvegicus
tgcctctagaggttgaagctctcat

SEQ ID NO: 621765 - DNA, 25 bp, Rattus norvegicus
tgcctctagcctccacaaggattga

SEQ ID NO: 621766 - DNA, 25 bp, Rattus norvegicus
tgcctctagcctgcacaaggattga

SEQ ID NO: 621767 - DNA, 25 bp, Rattus norvegicus
tgcctctaggctctcagcagactgc

SEQ ID NO: 621768 - DNA, 25 bp, Rattus norvegicus
tgcctctaggctgtcagcagactgc

SEQ ID NO: 621769 - DNA, 25 bp, Rattus norvegicus
tgcctctaggtacccaggaatgtct

SEQ ID NO: 621770 - DNA, 25 bp, Rattus norvegicus
tgcctctaggtagccaggaatgtct

SEQ ID NO: 621771 - DNA, 25 bp, Rattus norvegicus
tgcctctcaaatccccaacggaatg

SEQ ID NO: 621772 - DNA, 25 bp, Rattus norvegicus
tgcctctcaaatgcccaacggaatg

SEQ ID NO: 621773 - DNA, 25 bp, Rattus norvegicus
tgcctctcaagcatcacatggtgac

SEQ ID NO: 621774 - DNA, 25 bp, Rattus norvegicus
tgcctctcaagcttcacatggtgac

SEQ ID NO: 621775 - DNA, 25 bp, Rattus norvegicus
tgcctctcaattagacatccttttc

SEQ ID NO: 621776 - DNA, 25 bp, Rattus norvegicus
tgcctctcaatttgacatccttttc

SEQ ID NO: 621777 - DNA, 25 bp, Rattus norvegicus
tgcctctcacatccagattgctgag

SEQ ID NO: 621778 - DNA, 25 bp, Rattus norvegicus
tgcctctcacatgcagattgctgag

SEQ ID NO: 621779 - DNA, 25 bp, Rattus norvegicus
tgcctctcacttactattttgcttt

SEQ ID NO: 621780 - DNA, 25 bp, Rattus norvegicus
tgcctctcactttctattttgcttt

SEQ ID NO: 621781 - DNA, 25 bp, Rattus norvegicus
tgcctctcagttatcaacctcatga

SEQ ID NO: 621782 - DNA, 25 bp, Rattus norvegicus
tgcctctcagttttcaacctcatga

SEQ ID NO: 621783 - DNA, 25 bp, Rattus norvegicus
tgcctctcatgaacaactttgacaa

SEQ ID NO: 621784 - DNA, 25 bp, Rattus norvegicus
tgcctctcatgatcaactttgacaa

SEQ ID NO: 621785 - DNA, 25 bp, Rattus norvegicus
tgcctctcattactgtacttgctac

SEQ ID NO: 621786 - DNA, 25 bp, Rattus norvegicus
tgcctctcattagtgtacttgctac

SEQ ID NO: 621787 - DNA, 25 bp, Rattus norvegicus
tgcctctccaccattgctaatgcta

SEQ ID NO: 621788 - DNA, 25 bp, Rattus norvegicus
tgcctctccacctttgctaatgcta

SEQ ID NO: 621789 - DNA, 25 bp, Rattus norvegicus
tgcctctccagaatccaggtagtca

SEQ ID NO: 621790 - DNA, 25 bp, Rattus norvegicus
tgcctctccagattccaggtagtca

SEQ ID NO: 621791 - DNA, 25 bp, Rattus norvegicus
tgcctctccagccactctgggattt

SEQ ID NO: 621792 - DNA, 25 bp, Rattus norvegicus
tgcctctccagcgactctgggattt

SEQ ID NO: 621793 - DNA, 25 bp, Rattus norvegicus
tgcctctcccagaattttcatggta

SEQ ID NO: 621794 - DNA, 25 bp, Rattus norvegicus
tgcctctcccagtattttcatggta

SEQ ID NO: 621795 - DNA, 25 bp, Rattus norvegicus
tgcctctcggatattcaacttgaag

SEQ ID NO: 621796 - DNA, 25 bp, Rattus norvegicus
tgcctctcggattttcaacttgaag

SEQ ID NO: 621797 - DNA, 25 bp, Rattus norvegicus
tgcctctcgtttaaatgctcagctg

SEQ ID NO: 621798 - DNA, 25 bp, Rattus norvegicus
tgcctctcgttttaatgctcagctg

SEQ ID NO: 621799 - DNA, 25 bp, Rattus norvegicus
tgcctctctaagcagacacgcctgg

SEQ ID NO: 621800 - DNA, 25 bp, Rattus norvegicus
tgcctctctaaggagacacgcctgg

SEQ ID NO: 621801 - DNA, 25 bp, Rattus norvegicus
tgcctctctactactcaaatgctga

SEQ ID NO: 621802 - DNA, 25 bp, Rattus norvegicus
tgcctctctacttctcaaatgctga

SEQ ID NO: 621803 - DNA, 25 bp, Rattus norvegicus
tgcctctctcaactgtgtatgtaca

SEQ ID NO: 621804 - DNA, 25 bp, Rattus norvegicus
tgcctctctcaagtgtgtatgtaca

SEQ ID NO: 621805 - DNA, 25 bp, Rattus norvegicus
tgcctctctcgtcccataacgaata

SEQ ID NO: 621806 - DNA, 25 bp, Rattus norvegicus
tgcctctctcgtgccataacgaata

SEQ ID NO: 621807 - DNA, 25 bp, Rattus norvegicus
tgcctctctgccaccattttatgag

SEQ ID NO: 621808 - DNA, 25 bp, Rattus norvegicus
tgcctctctgccatttcatgaggtg

SEQ ID NO: 621809 - DNA, 25 bp, Rattus norvegicus
tgcctctctgcctccattttatgag

SEQ ID NO: 621810 - DNA, 25 bp, Rattus norvegicus
tgcctctctgccttttcatgaggtg

SEQ ID NO: 621811 - DNA, 25 bp, Rattus norvegicus
tgcctctcttgcaaaagctgggcta

SEQ ID NO: 621812 - DNA, 25 bp, Rattus norvegicus
tgcctctcttgctaaagctgggcta

SEQ ID NO: 621813 - DNA, 25 bp, Rattus norvegicus
tgcctctgaacccagattccatggg

SEQ ID NO: 621814 - DNA, 25 bp, Rattus norvegicus
tgcctctgaaccgagattccatggg

SEQ ID NO: 621815 - DNA, 25 bp, Rattus norvegicus
tgcctctgactcagactttttgaga

SEQ ID NO: 621816 - DNA, 25 bp, Rattus norvegicus
tgcctctgactctgactttttgaga

SEQ ID NO: 621817 - DNA, 25 bp, Rattus norvegicus
tgcctctgagagacacaagcctggg

SEQ ID NO: 621818 - DNA, 25 bp, Rattus norvegicus
tgcctctgagagtcacaagcctggg

SEQ ID NO: 621819 - DNA, 25 bp, Rattus norvegicus
tgcctctgagctcccgaatcattga

SEQ ID NO: 621820 - DNA, 25 bp, Rattus norvegicus
tgcctctgagctgccgaatcattga

SEQ ID NO: 621821 - DNA, 25 bp, Rattus norvegicus
tgcctctgagtgactgacccagcac

SEQ ID NO: 621822 - DNA, 25 bp, Rattus norvegicus
tgcctctgagtgtctgacccagcac

SEQ ID NO: 621823 - DNA, 25 bp, Rattus norvegicus
tgcctctgatgtcaaagctgctgtc

SEQ ID NO: 621824 - DNA, 25 bp, Rattus norvegicus
tgcctctgatgtgaaagctgctgtc

SEQ ID NO: 621825 - DNA, 25 bp, Rattus norvegicus
tgcctctgcaagcagtctcccaaat

SEQ ID NO: 621826 - DNA, 25 bp, Rattus norvegicus
tgcctctgcaaggagtctcccaaat

SEQ ID NO: 621827 - DNA, 25 bp, Rattus norvegicus
tgcctctgcacaaggtactggttgt

SEQ ID NO: 621828 - DNA, 25 bp, Rattus norvegicus
tgcctctgcacatggtactggttgt

SEQ ID NO: 621829 - DNA, 25 bp, Rattus norvegicus
tgcctctgccaactgctgaaattga

SEQ ID NO: 621830 - DNA, 25 bp, Rattus norvegicus
tgcctctgccaagtgctgaaattga

SEQ ID NO: 621831 - DNA, 25 bp, Rattus norvegicus
tgcctctgccccaagacgtggaagg

SEQ ID NO: 621832 - DNA, 25 bp, Rattus norvegicus
tgcctctgcccctagacgtggaagg

SEQ ID NO: 621833 - DNA, 25 bp, Rattus norvegicus
tgcctctgccctcagtgtcgtggaa

SEQ ID NO: 621834 - DNA, 25 bp, Rattus norvegicus
tgcctctgccctgagtgtcgtggaa

SEQ ID NO: 621835 - DNA, 25 bp, Rattus norvegicus
tgcctctgccggattgccgattaag

SEQ ID NO: 621836 - DNA, 25 bp, Rattus norvegicus
tgcctctgccggtttgccgattaag

SEQ ID NO: 621837 - DNA, 25 bp, Rattus norvegicus
tgcctctgccttcaaatgtcttaga

SEQ ID NO: 621838 - DNA, 25 bp, Rattus norvegicus
tgcctctgccttcagagctctggaa

SEQ ID NO: 621839 - DNA, 25 bp, Rattus norvegicus
tgcctctgccttgaaatgtcttaga

SEQ ID NO: 621840 - DNA, 25 bp, Rattus norvegicus
tgcctctgccttgagagctctggaa

SEQ ID NO: 621841 - DNA, 25 bp, Rattus norvegicus
tgcctctggagacttgagccacctg

SEQ ID NO: 621842 - DNA, 25 bp, Rattus norvegicus
tgcctctggagagttgagccacctg

SEQ ID NO: 621843 - DNA, 25 bp, Rattus norvegicus
tgcctctggcagcttgttgagatac

SEQ ID NO: 621844 - DNA, 25 bp, Rattus norvegicus
tgcctctggcaggttgttgagatac

SEQ ID NO: 621845 - DNA, 25 bp, Rattus norvegicus
tgcctctggctcatgatgtggttga

SEQ ID NO: 621846 - DNA, 25 bp, Rattus norvegicus
tgcctctggctcttgatgtggttga

SEQ ID NO: 621847 - DNA, 25 bp, Rattus norvegicus
tgcctctgggcaaacgtacaaatcg

SEQ ID NO: 621848 - DNA, 25 bp, Rattus norvegicus
tgcctctgggcacctagctcagttc

SEQ ID NO: 621849 - DNA, 25 bp, Rattus norvegicus
tgcctctgggcagctagctcagttc

SEQ ID NO: 621850 - DNA, 25 bp, Rattus norvegicus
tgcctctgggcatacgtacaaatcg

SEQ ID NO: 621851 - DNA, 25 bp, Rattus norvegicus
tgcctctgggccaaacggtctggaa

SEQ ID NO: 621852 - DNA, 25 bp, Rattus norvegicus
tgcctctgggcctaacggtctggaa

SEQ ID NO: 621853 - DNA, 25 bp, Rattus norvegicus
tgcctctgtattactaacctgcagg

SEQ ID NO: 621854 - DNA, 25 bp, Rattus norvegicus
tgcctctgtatttctaacctgcagg

SEQ ID NO: 621855 - DNA, 25 bp, Rattus norvegicus
tgcctctgtcttacaaagccctggt

SEQ ID NO: 621856 - DNA, 25 bp, Rattus norvegicus
tgcctctgtctttcaaagccctggt

SEQ ID NO: 621857 - DNA, 25 bp, Rattus norvegicus
tgcctctgtgcaaacccaattaaac

SEQ ID NO: 621858 - DNA, 25 bp, Rattus norvegicus
tgcctctgtgcatacccaattaaac

SEQ ID NO: 621859 - DNA, 25 bp, Rattus norvegicus
tgcctctgtggcaaggtcaacaagt

SEQ ID NO: 621860 - DNA, 25 bp, Rattus norvegicus
tgcctctgtggctaggtcaacaagt

SEQ ID NO: 621861 - DNA, 25 bp, Rattus norvegicus
tgcctctgtgggatacctgtaggat

SEQ ID NO: 621862 - DNA, 25 bp, Rattus norvegicus
tgcctctgtgggttacctgtaggat

SEQ ID NO: 621863 - DNA, 25 bp, Rattus norvegicus
tgcctctgtgttctgtaccagaata

SEQ ID NO: 621864 - DNA, 25 bp, Rattus norvegicus
tgcctctgtgttgtgtaccagaata

SEQ ID NO: 621865 - DNA, 25 bp, Rattus norvegicus
tgcctctgttctattaggtccatga

SEQ ID NO: 621866 - DNA, 25 bp, Rattus norvegicus
tgcctctgttcttttaggtccatga

SEQ ID NO: 621867 - DNA, 25 bp, Rattus norvegicus
tgcctcttacctcatttcaagtggg

SEQ ID NO: 621868 - DNA, 25 bp, Rattus norvegicus
tgcctcttacctgatttcaagtggg

SEQ ID NO: 621869 - DNA, 25 bp, Rattus norvegicus
tgcctcttccttactgagcagatcc

SEQ ID NO: 621870 - DNA, 25 bp, Rattus norvegicus
tgcctcttcctttctgagcagatcc

SEQ ID NO: 621871 - DNA, 25 bp, Rattus norvegicus
tgcctcttctgcagatcattctgaa

SEQ ID NO: 621872 - DNA, 25 bp, Rattus norvegicus
tgcctcttctgctgatcattctgaa

SEQ ID NO: 621873 - DNA, 25 bp, Rattus norvegicus
tgcctcttctggacaaaccacagag

SEQ ID NO: 621874 - DNA, 25 bp, Rattus norvegicus
tgcctcttctggtcaaaccacagag

SEQ ID NO: 621875 - DNA, 25 bp, Rattus norvegicus
tgcctcttctttcgtcaacttggac

SEQ ID NO: 621876 - DNA, 25 bp, Rattus norvegicus
tgcctcttctttcgttctgtttaaa

SEQ ID NO: 621877 - DNA, 25 bp, Rattus norvegicus
tgcctcttctttggtcaacttggac

SEQ ID NO: 621878 - DNA, 25 bp, Rattus norvegicus
tgcctcttctttggttctgtttaaa

SEQ ID NO: 621879 - DNA, 25 bp, Rattus norvegicus
tgcctcttgatcctgggagttgaca

SEQ ID NO: 621880 - DNA, 25 bp, Rattus norvegicus
tgcctcttgatcgtgggagttgaca

SEQ ID NO: 621881 - DNA, 25 bp, Rattus norvegicus
tgcctcttgattagcctggattgtt

SEQ ID NO: 621882 - DNA, 25 bp, Rattus norvegicus
tgcctcttgatttgcctggattgtt

SEQ ID NO: 621883 - DNA, 25 bp, Rattus norvegicus
tgcctcttgcccattgtggagcaaa

SEQ ID NO: 621884 - DNA, 25 bp, Rattus norvegicus
tgcctcttgccctttgtggagcaaa

SEQ ID NO: 621885 - DNA, 25 bp, Rattus norvegicus
tgcctcttggagctcagcattgcaa

SEQ ID NO: 621886 - DNA, 25 bp, Rattus norvegicus
tgcctcttggaggtcagcattgcaa

SEQ ID NO: 621887 - DNA, 25 bp, Rattus norvegicus
tgcctcttggccactgacctttgaa

SEQ ID NO: 621888 - DNA, 25 bp, Rattus norvegicus
tgcctcttggccatcagttcctgag

SEQ ID NO: 621889 - DNA, 25 bp, Rattus norvegicus
tgcctcttggcctctgacctttgaa

SEQ ID NO: 621890 - DNA, 25 bp, Rattus norvegicus
tgcctcttggccttcagttcctgag

SEQ ID NO: 621891 - DNA, 25 bp, Rattus norvegicus
tgcctcttgggaacacacagtcaga

SEQ ID NO: 621892 - DNA, 25 bp, Rattus norvegicus
tgcctcttgggaatcagtatcatgt

SEQ ID NO: 621893 - DNA, 25 bp, Rattus norvegicus
tgcctcttgggatcacacagtcaga

SEQ ID NO: 621894 - DNA, 25 bp, Rattus norvegicus
tgcctcttgggattcagtatcatgt

SEQ ID NO: 621895 - DNA, 25 bp, Rattus norvegicus
tgcctcttgggcagtgagattccaa

SEQ ID NO: 621896 - DNA, 25 bp, Rattus norvegicus
tgcctcttgggctgtgagattccaa

SEQ ID NO: 621897 - DNA, 25 bp, Rattus norvegicus
tgcctcttggttacatctcgagatg

SEQ ID NO: 621898 - DNA, 25 bp, Rattus norvegicus
tgcctcttggtttcatctcgagatg

SEQ ID NO: 621899 - DNA, 25 bp, Rattus norvegicus
tgcctcttgtccctcggtgagagag

SEQ ID NO: 621900 - DNA, 25 bp, Rattus norvegicus
tgcctcttgtccgtcggtgagagag

SEQ ID NO: 621901 - DNA, 25 bp, Rattus norvegicus
tgcctctttatgagctccagctatt

SEQ ID NO: 621902 - DNA, 25 bp, Rattus norvegicus
tgcctctttatgtgctccagctatt

SEQ ID NO: 621903 - DNA, 25 bp, Rattus norvegicus
tgcctcttttcaccctgtaagtgaa

SEQ ID NO: 621904 - DNA, 25 bp, Rattus norvegicus
tgcctcttttcagcctgtaagtgaa

SEQ ID NO: 621905 - DNA, 25 bp, Rattus norvegicus
tgcctgaaatctctggcctcatcct

SEQ ID NO: 621906 - DNA, 25 bp, Rattus norvegicus
tgcctgaaatctgtggcctcatcct

SEQ ID NO: 621907 - DNA, 25 bp, Rattus norvegicus
tgcctgaaccacatggctcaaacag

SEQ ID NO: 621908 - DNA, 25 bp, Rattus norvegicus
tgcctgaaccacttggctcaaacag

SEQ ID NO: 621909 - DNA, 25 bp, Rattus norvegicus
tgcctgaagacacttgaccctggag

SEQ ID NO: 621910 - DNA, 25 bp, Rattus norvegicus
tgcctgaagacagttgaccctggag

SEQ ID NO: 621911 - DNA, 25 bp, Rattus norvegicus
tgcctgaaggttatgcagctgtgtt

SEQ ID NO: 621912 - DNA, 25 bp, Rattus norvegicus
tgcctgaaggttttgcagctgtgtt

SEQ ID NO: 621913 - DNA, 25 bp, Rattus norvegicus
tgcctgaatgcgaaagagacccaat

SEQ ID NO: 621914 - DNA, 25 bp, Rattus norvegicus
tgcctgaatgcgtaagagacccaat

SEQ ID NO: 621915 - DNA, 25 bp, Rattus norvegicus
tgcctgacacagcacctgagtggat

SEQ ID NO: 621916 - DNA, 25 bp, Rattus norvegicus
tgcctgacacaggacctgagtggat

SEQ ID NO: 621917 - DNA, 25 bp, Rattus norvegicus
tgcctgacagacaggctcctgatgt

SEQ ID NO: 621918 - DNA, 25 bp, Rattus norvegicus
tgcctgacagactggctcctgatgt

SEQ ID NO: 621919 - DNA, 25 bp, Rattus norvegicus
tgcctgacagcacccatgtcggaaa

SEQ ID NO: 621920 - DNA, 25 bp, Rattus norvegicus
tgcctgacagcagccatgtcggaaa

SEQ ID NO: 621921 - DNA, 25 bp, Rattus norvegicus
tgcctgacatctccgcttttggaaa

SEQ ID NO: 621922 - DNA, 25 bp, Rattus norvegicus
tgcctgacatctgcgcttttggaaa

SEQ ID NO: 621923 - DNA, 25 bp, Rattus norvegicus
tgcctgaccgaactccactgggaag

SEQ ID NO: 621924 - DNA, 25 bp, Rattus norvegicus
tgcctgaccgaagtccactgggaag

SEQ ID NO: 621925 - DNA, 25 bp, Rattus norvegicus
tgcctgaccttcaaggagggagcct

SEQ ID NO: 621926 - DNA, 25 bp, Rattus norvegicus
tgcctgaccttctaggagggagcct

SEQ ID NO: 621927 - DNA, 25 bp, Rattus norvegicus
tgcctgagaactaccggactgtaca

SEQ ID NO: 621928 - DNA, 25 bp, Rattus norvegicus
tgcctgagaacttccggactgtaca

SEQ ID NO: 621929 - DNA, 25 bp, Rattus norvegicus
tgcctgagacggctcagctgttaaa

SEQ ID NO: 621930 - DNA, 25 bp, Rattus norvegicus
tgcctgagacgggtcagctgttaaa

SEQ ID NO: 621931 - DNA, 25 bp, Rattus norvegicus
tgcctgagagttagcactgccttct

SEQ ID NO: 621932 - DNA, 25 bp, Rattus norvegicus
tgcctgagagtttgcactgccttct

SEQ ID NO: 621933 - DNA, 25 bp, Rattus norvegicus
tgcctgagccacagtgactgcagac

SEQ ID NO: 621934 - DNA, 25 bp, Rattus norvegicus
tgcctgagccactgtgactgcagac

SEQ ID NO: 621935 - DNA, 25 bp, Rattus norvegicus
tgcctgagcctacaaccttttgttg

SEQ ID NO: 621936 - DNA, 25 bp, Rattus norvegicus
tgcctgagcctagaaccttttgttg

SEQ ID NO: 621937 - DNA, 25 bp, Rattus norvegicus
tgcctgaggatacactcacctttga

SEQ ID NO: 621938 - DNA, 25 bp, Rattus norvegicus
tgcctgaggatagactcacctttga

SEQ ID NO: 621939 - DNA, 25 bp, Rattus norvegicus
tgcctgagggttactgtttcctttc

SEQ ID NO: 621940 - DNA, 25 bp, Rattus norvegicus
tgcctgagggtttctgtttcctttc

SEQ ID NO: 621941 - DNA, 25 bp, Rattus norvegicus
tgcctgagtcccacagaggtggaag

SEQ ID NO: 621942 - DNA, 25 bp, Rattus norvegicus
tgcctgagtccctcagaggtggaag

SEQ ID NO: 621943 - DNA, 25 bp, Rattus norvegicus
tgcctgatacctcaaactttgggag

SEQ ID NO: 621944 - DNA, 25 bp, Rattus norvegicus
tgcctgatacctgaaactttgggag

SEQ ID NO: 621945 - DNA, 25 bp, Rattus norvegicus
tgcctgatactgagacctgaatgtc

SEQ ID NO: 621946 - DNA, 25 bp, Rattus norvegicus
tgcctgatactgtgacctgaatgtc

SEQ ID NO: 621947 - DNA, 25 bp, Rattus norvegicus
tgcctgatattgatggcatcatctt

SEQ ID NO: 621948 - DNA, 25 bp, Rattus norvegicus
tgcctgatattgttggcatcatctt

SEQ ID NO: 621949 - DNA, 25 bp, Rattus norvegicus
tgcctgatatttctgtgagccctac

SEQ ID NO: 621950 - DNA, 25 bp, Rattus norvegicus
tgcctgatatttgtgtgagccctac

SEQ ID NO: 621951 - DNA, 25 bp, Rattus norvegicus
tgcctgatcctcataaccaacaatt

SEQ ID NO: 621952 - DNA, 25 bp, Rattus norvegicus
tgcctgatcctcttaaccaacaatt

SEQ ID NO: 621953 - DNA, 25 bp, Rattus norvegicus
tgcctgatctgccactcatttgggt

SEQ ID NO: 621954 - DNA, 25 bp, Rattus norvegicus
tgcctgatctgcgactcatttgggt

SEQ ID NO: 621955 - DNA, 25 bp, Rattus norvegicus
tgcctgatgcagaaaagccagctca

SEQ ID NO: 621956 - DNA, 25 bp, Rattus norvegicus
tgcctgatgcagtaaagccagctca

SEQ ID NO: 621957 - DNA, 25 bp, Rattus norvegicus
tgcctgatggcactagaaacaagag

SEQ ID NO: 621958 - DNA, 25 bp, Rattus norvegicus
tgcctgatggcagtagaaacaagag

SEQ ID NO: 621959 - DNA, 25 bp, Rattus norvegicus
tgcctgatggttcttcctttacaaa

SEQ ID NO: 621960 - DNA, 25 bp, Rattus norvegicus
tgcctgatggttgttcctttacaaa

SEQ ID NO: 621961 - DNA, 25 bp, Rattus norvegicus
tgcctgattctgcactgggtcccca

SEQ ID NO: 621962 - DNA, 25 bp, Rattus norvegicus
tgcctgattctggactgggtcccca

SEQ ID NO: 621963 - DNA, 25 bp, Rattus norvegicus
tgcctgcaaattacaagacaccttc

SEQ ID NO: 621964 - DNA, 25 bp, Rattus norvegicus
tgcctgcaaatttcaagacaccttc

SEQ ID NO: 621965 - DNA, 25 bp, Rattus norvegicus
tgcctgcaaggtcgagttctagccc

SEQ ID NO: 621966 - DNA, 25 bp, Rattus norvegicus
tgcctgcaaggtggagttctagccc

SEQ ID NO: 621967 - DNA, 25 bp, Rattus norvegicus
tgcctgcaagtcaccattctagatt

SEQ ID NO: 621968 - DNA, 25 bp, Rattus norvegicus
tgcctgcaagtctccattctagatt

SEQ ID NO: 621969 - DNA, 25 bp, Rattus norvegicus
tgcctgcaatttaacttcacaacca

SEQ ID NO: 621970 - DNA, 25 bp, Rattus norvegicus
tgcctgcaattttacttcacaacca

SEQ ID NO: 621971 - DNA, 25 bp, Rattus norvegicus
tgcctgcacaccagcctataagaac

SEQ ID NO: 621972 - DNA, 25 bp, Rattus norvegicus
tgcctgcacacctgcctataagaac

SEQ ID NO: 621973 - DNA, 25 bp, Rattus norvegicus
tgcctgcacagacacatcttcttgt

SEQ ID NO: 621974 - DNA, 25 bp, Rattus norvegicus
tgcctgcacagagacatcttcttgt

SEQ ID NO: 621975 - DNA, 25 bp, Rattus norvegicus
tgcctgcaccaaccttaacattaaa

SEQ ID NO: 621976 - DNA, 25 bp, Rattus norvegicus
tgcctgcaccaagcttaacattaaa

SEQ ID NO: 621977 - DNA, 25 bp, Rattus norvegicus
tgcctgcaccagactctcggggagg

SEQ ID NO: 621978 - DNA, 25 bp, Rattus norvegicus
tgcctgcaccagtctctcggggagg

SEQ ID NO: 621979 - DNA, 25 bp, Rattus norvegicus
tgcctgcacctgactttgagtggta

SEQ ID NO: 621980 - DNA, 25 bp, Rattus norvegicus
tgcctgcacctgtctttgagtggta

SEQ ID NO: 621981 - DNA, 25 bp, Rattus norvegicus
tgcctgcactgactgtcttacacaa

SEQ ID NO: 621982 - DNA, 25 bp, Rattus norvegicus
tgcctgcactgagtgtcttacacaa

SEQ ID NO: 621983 - DNA, 25 bp, Rattus norvegicus
tgcctgcagcctaggaagtgtgtgt

SEQ ID NO: 621984 - DNA, 25 bp, Rattus norvegicus
tgcctgcagccttggaagtgtgtgt

SEQ ID NO: 621985 - DNA, 25 bp, Rattus norvegicus
tgcctgcaggttcccttgaatgtag

SEQ ID NO: 621986 - DNA, 25 bp, Rattus norvegicus
tgcctgcaggttctcctttgaagta

SEQ ID NO: 621987 - DNA, 25 bp, Rattus norvegicus
tgcctgcaggttgccttgaatgtag

SEQ ID NO: 621988 - DNA, 25 bp, Rattus norvegicus
tgcctgcaggttgtcctttgaagta

SEQ ID NO: 621989 - DNA, 25 bp, Rattus norvegicus
tgcctgcagtgccaggccaagatgg

SEQ ID NO: 621990 - DNA, 25 bp, Rattus norvegicus
tgcctgcagtgcgaggccaagatgg

SEQ ID NO: 621991 - DNA, 25 bp, Rattus norvegicus
tgcctgccaacacccttggaaagga

SEQ ID NO: 621992 - DNA, 25 bp, Rattus norvegicus
tgcctgccaacagccttggaaagga

SEQ ID NO: 621993 - DNA, 25 bp, Rattus norvegicus
tgcctgccaatcagagtctagcatg

SEQ ID NO: 621994 - DNA, 25 bp, Rattus norvegicus
tgcctgccaatctgagtctagcatg

SEQ ID NO: 621995 - DNA, 25 bp, Rattus norvegicus
tgcctgccactacaaacaaaatttt

SEQ ID NO: 621996 - DNA, 25 bp, Rattus norvegicus
tgcctgccactagaaacaaaatttt

SEQ ID NO: 621997 - DNA, 25 bp, Rattus norvegicus
tgcctgccagacagagttctcatca

SEQ ID NO: 621998 - DNA, 25 bp, Rattus norvegicus
tgcctgccagactgagttctcatca

SEQ ID NO: 621999 - DNA, 25 bp, Rattus norvegicus
tgcctgccagcaccaagtataattc

SEQ ID NO: 622000 - DNA, 25 bp, Rattus norvegicus
tgcctgccagcagcaagtataattc

SEQ ID NO: 622001 - DNA, 25 bp, Rattus norvegicus
tgcctgccagtgattgatgccaaaa

SEQ ID NO: 622002 - DNA, 25 bp, Rattus norvegicus
tgcctgccagtgtttgatgccaaaa

SEQ ID NO: 622003 - DNA, 25 bp, Rattus norvegicus
tgcctgccatgtctttgtgtctgaa

SEQ ID NO: 622004 - DNA, 25 bp, Rattus norvegicus
tgcctgccatgtgtttgtgtctgaa

SEQ ID NO: 622005 - DNA, 25 bp, Rattus norvegicus
tgcctgccattactgcttttttata

SEQ ID NO: 622006 - DNA, 25 bp, Rattus norvegicus
tgcctgccattagtgcttttttata

SEQ ID NO: 622007 - DNA, 25 bp, Rattus norvegicus
tgcctgcccaggactgcatatgtat

SEQ ID NO: 622008 - DNA, 25 bp, Rattus norvegicus
tgcctgcccaggaggactactacag

SEQ ID NO: 622009 - DNA, 25 bp, Rattus norvegicus
tgcctgcccaggtctgcatatgtat

SEQ ID NO: 622010 - DNA, 25 bp, Rattus norvegicus
tgcctgcccaggtggactactacag

SEQ ID NO: 622011 - DNA, 25 bp, Rattus norvegicus
tgcctgcccgatctgttcagaaggg

SEQ ID NO: 622012 - DNA, 25 bp, Rattus norvegicus
tgcctgcccgatgtgttcagaaggg

SEQ ID NO: 622013 - DNA, 25 bp, Rattus norvegicus
tgcctgcccgcgatgaagacagtct

SEQ ID NO: 622014 - DNA, 25 bp, Rattus norvegicus
tgcctgcccgcgttgaagacagtct

SEQ ID NO: 622015 - DNA, 25 bp, Rattus norvegicus
tgcctgcccgtgatttaactactga

SEQ ID NO: 622016 - DNA, 25 bp, Rattus norvegicus
tgcctgcccgtgttttaactactga

SEQ ID NO: 622017 - DNA, 25 bp, Rattus norvegicus
tgcctgccctgcaaactatgtttgg

SEQ ID NO: 622018 - DNA, 25 bp, Rattus norvegicus
tgcctgccctgctaactatgtttgg

SEQ ID NO: 622019 - DNA, 25 bp, Rattus norvegicus
tgcctgccctttagtttgtggagtg

SEQ ID NO: 622020 - DNA, 25 bp, Rattus norvegicus
tgcctgccctttctcttgtgattgg

SEQ ID NO: 622021 - DNA, 25 bp, Rattus norvegicus
tgcctgccctttgtcttgtgattgg

SEQ ID NO: 622022 - DNA, 25 bp, Rattus norvegicus
tgcctgcccttttgtttgtggagtg

SEQ ID NO: 622023 - DNA, 25 bp, Rattus norvegicus
tgcctgccgtccagcagtcatgtgt

SEQ ID NO: 622024 - DNA, 25 bp, Rattus norvegicus
tgcctgccgtcctgcagtcatgtgt

SEQ ID NO: 622025 - DNA, 25 bp, Rattus norvegicus
tgcctgcctaccagttttaaaagtt

SEQ ID NO: 622026 - DNA, 25 bp, Rattus norvegicus
tgcctgcctacctgttttaaaagtt

SEQ ID NO: 622027 - DNA, 25 bp, Rattus norvegicus
tgcctgcctatgagagctttgagaa

SEQ ID NO: 622028 - DNA, 25 bp, Rattus norvegicus
tgcctgcctatgcattttgggtacc

SEQ ID NO: 622029 - DNA, 25 bp, Rattus norvegicus
tgcctgcctatggattttgggtacc

SEQ ID NO: 622030 - DNA, 25 bp, Rattus norvegicus
tgcctgcctatgtgagctttgagaa

SEQ ID NO: 622031 - DNA, 25 bp, Rattus norvegicus
tgcctgcctcgcatatatatcagtg

SEQ ID NO: 622032 - DNA, 25 bp, Rattus norvegicus
tgcctgcctcgcttatatatcagtg

SEQ ID NO: 622033 - DNA, 25 bp, Rattus norvegicus
tgcctgcctcgtcgctcaacttttt

SEQ ID NO: 622034 - DNA, 25 bp, Rattus norvegicus
tgcctgcctcgtggctcaacttttt

SEQ ID NO: 622035 - DNA, 25 bp, Rattus norvegicus
tgcctgcctggactatcttcacagt

SEQ ID NO: 622036 - DNA, 25 bp, Rattus norvegicus
tgcctgcctggagtatcttcacagt

SEQ ID NO: 622037 - DNA, 25 bp, Rattus norvegicus
tgcctgccttatatcctggagacag

SEQ ID NO: 622038 - DNA, 25 bp, Rattus norvegicus
tgcctgccttatttcctggagacag

SEQ ID NO: 622039 - DNA, 25 bp, Rattus norvegicus
tgcctgccttttaacctacatgcat

SEQ ID NO: 622040 - DNA, 25 bp, Rattus norvegicus
tgcctgcctttttacctacatgcat

SEQ ID NO: 622041 - DNA, 25 bp, Rattus norvegicus
tgcctgcgaaggctacacaacctac

SEQ ID NO: 622042 - DNA, 25 bp, Rattus norvegicus
tgcctgcgaagggtacacaacctac

SEQ ID NO: 622043 - DNA, 25 bp, Rattus norvegicus
tgcctgcgagcacaggagcttccac

SEQ ID NO: 622044 - DNA, 25 bp, Rattus norvegicus
tgcctgcgagcagaggagcttccac

SEQ ID NO: 622045 - DNA, 25 bp, Rattus norvegicus
tgcctgcgaggcattttcttgactg

SEQ ID NO: 622046 - DNA, 25 bp, Rattus norvegicus
tgcctgcgaggctttttcttgactg

SEQ ID NO: 622047 - DNA, 25 bp, Rattus norvegicus
tgcctgcgattgagcatgagcacct

SEQ ID NO: 622048 - DNA, 25 bp, Rattus norvegicus
tgcctgcgattgtgcatgagcacct

SEQ ID NO: 622049 - DNA, 25 bp, Rattus norvegicus
tgcctgcggctccatgggatctgaa

SEQ ID NO: 622050 - DNA, 25 bp, Rattus norvegicus
tgcctgcggctcgatgggatctgaa

SEQ ID NO: 622051 - DNA, 25 bp, Rattus norvegicus
tgcctgcgggtcaaactgtgcttca

SEQ ID NO: 622052 - DNA, 25 bp, Rattus norvegicus
tgcctgcgggtcacgtttctttgga

SEQ ID NO: 622053 - DNA, 25 bp, Rattus norvegicus
tgcctgcgggtctaactgtgcttca

SEQ ID NO: 622054 - DNA, 25 bp, Rattus norvegicus
tgcctgcgggtctcgtttctttgga

SEQ ID NO: 622055 - DNA, 25 bp, Rattus norvegicus
tgcctgcgggttccttttttagaag

SEQ ID NO: 622056 - DNA, 25 bp, Rattus norvegicus
tgcctgcgggttgcttttttagaag

SEQ ID NO: 622057 - DNA, 25 bp, Rattus norvegicus
tgcctgcgtgtgatagcacctagct

SEQ ID NO: 622058 - DNA, 25 bp, Rattus norvegicus
tgcctgcgtgtgttagcacctagct

SEQ ID NO: 622059 - DNA, 25 bp, Rattus norvegicus
tgcctgctatcacagacgctgagac

SEQ ID NO: 622060 - DNA, 25 bp, Rattus norvegicus
tgcctgctatcagagacgctgagac

SEQ ID NO: 622061 - DNA, 25 bp, Rattus norvegicus
tgcctgctattccatgtgtgcttat

SEQ ID NO: 622062 - DNA, 25 bp, Rattus norvegicus
tgcctgctattcgatgtgtgcttat

SEQ ID NO: 622063 - DNA, 25 bp, Rattus norvegicus
tgcctgctcaagcaacagatccgga

SEQ ID NO: 622064 - DNA, 25 bp, Rattus norvegicus
tgcctgctcaaggaacagatccgga

SEQ ID NO: 622065 - DNA, 25 bp, Rattus norvegicus
tgcctgctccaacaagccggtgctt

SEQ ID NO: 622066 - DNA, 25 bp, Rattus norvegicus
tgcctgctccaagaagccggtgctt

SEQ ID NO: 622067 - DNA, 25 bp, Rattus norvegicus
tgcctgctcgttcatgaccatatac

SEQ ID NO: 622068 - DNA, 25 bp, Rattus norvegicus
tgcctgctcgttgatgaccatatac

SEQ ID NO: 622069 - DNA, 25 bp, Rattus norvegicus
tgcctgctgacgagtgcaacaagct

SEQ ID NO: 622070 - DNA, 25 bp, Rattus norvegicus
tgcctgctgacgtgtgcaacaagct

SEQ ID NO: 622071 - DNA, 25 bp, Rattus norvegicus
tgcctgctgattccaagcacgagaa

SEQ ID NO: 622072 - DNA, 25 bp, Rattus norvegicus
tgcctgctgattgcaagcacgagaa

SEQ ID NO: 622073 - DNA, 25 bp, Rattus norvegicus
tgcctgctgggcacctgcatgatga

SEQ ID NO: 622074 - DNA, 25 bp, Rattus norvegicus
tgcctgctgggctcctgcatgatga

SEQ ID NO: 622075 - DNA, 25 bp, Rattus norvegicus
tgcctgctgggtcaccttgtaaagc

SEQ ID NO: 622076 - DNA, 25 bp, Rattus norvegicus
tgcctgctgggtgaccttgtaaagc

SEQ ID NO: 622077 - DNA, 25 bp, Rattus norvegicus
tgcctgctggtacatctgtgcatca

SEQ ID NO: 622078 - DNA, 25 bp, Rattus norvegicus
tgcctgctggtagatctgtgcatca

SEQ ID NO: 622079 - DNA, 25 bp, Rattus norvegicus
tgcctgctgtggatggttcttcata

SEQ ID NO: 622080 - DNA, 25 bp, Rattus norvegicus
tgcctgctgtggttggttcttcata

SEQ ID NO: 622081 - DNA, 25 bp, Rattus norvegicus
tgcctgctgtttatgtgagcccaag

SEQ ID NO: 622082 - DNA, 25 bp, Rattus norvegicus
tgcctgctgtttttgtgagcccaag

SEQ ID NO: 622083 - DNA, 25 bp, Rattus norvegicus
tgcctgcttcacatgttgacctgtt

SEQ ID NO: 622084 - DNA, 25 bp, Rattus norvegicus
tgcctgcttcacttgttgacctgtt

SEQ ID NO: 622085 - DNA, 25 bp, Rattus norvegicus
tgcctgcttgccacagaaagactgg

SEQ ID NO: 622086 - DNA, 25 bp, Rattus norvegicus
tgcctgcttgcctcagaaagactgg

SEQ ID NO: 622087 - DNA, 25 bp, Rattus norvegicus
tgcctgcttggccagtgtgaataaa

SEQ ID NO: 622088 - DNA, 25 bp, Rattus norvegicus
tgcctgcttggcgagtgtgaataaa

SEQ ID NO: 622089 - DNA, 25 bp, Rattus norvegicus
tgcctgcttgtactatgtgctctca

SEQ ID NO: 622090 - DNA, 25 bp, Rattus norvegicus
tgcctgcttgtagtatgtgctctca

SEQ ID NO: 622091 - DNA, 25 bp, Rattus norvegicus
tgcctgctttccagggtattggtga

SEQ ID NO: 622092 - DNA, 25 bp, Rattus norvegicus
tgcctgctttcctgggtattggtga

SEQ ID NO: 622093 - DNA, 25 bp, Rattus norvegicus
tgcctgctttgcacgagggtagcaa

SEQ ID NO: 622094 - DNA, 25 bp, Rattus norvegicus
tgcctgctttgctcgagggtagcaa

SEQ ID NO: 622095 - DNA, 25 bp, Rattus norvegicus
tgcctgcttttgatggtagttatag

SEQ ID NO: 622096 - DNA, 25 bp, Rattus norvegicus
tgcctgcttttgttggtagttatag

SEQ ID NO: 622097 - DNA, 25 bp, Rattus norvegicus
tgcctggaacagaaacgtcatcctg

SEQ ID NO: 622098 - DNA, 25 bp, Rattus norvegicus
tgcctggaacagtaacgtcatcctg

SEQ ID NO: 622099 - DNA, 25 bp, Rattus norvegicus
tgcctggaacggacacacatttgtg

SEQ ID NO: 622100 - DNA, 25 bp, Rattus norvegicus
tgcctggaacggtcacacatttgtg

SEQ ID NO: 622101 - DNA, 25 bp, Rattus norvegicus
tgcctggaagacagctggagcatcc

SEQ ID NO: 622102 - DNA, 25 bp, Rattus norvegicus
tgcctggaagactgctggagcatcc

SEQ ID NO: 622103 - DNA, 25 bp, Rattus norvegicus
tgcctggaagtcagccttcaaatga

SEQ ID NO: 622104 - DNA, 25 bp, Rattus norvegicus
tgcctggaagtctgccttcaaatga

SEQ ID NO: 622105 - DNA, 25 bp, Rattus norvegicus
tgcctggaattcagtctttcactag

SEQ ID NO: 622106 - DNA, 25 bp, Rattus norvegicus
tgcctggaattctgtctttcactag

SEQ ID NO: 622107 - DNA, 25 bp, Rattus norvegicus
tgcctggaccggatttttgtgtgta

SEQ ID NO: 622108 - DNA, 25 bp, Rattus norvegicus
tgcctggaccggttttttgtgtgta

SEQ ID NO: 622109 - DNA, 25 bp, Rattus norvegicus
tgcctggactgtagatacgctctct

SEQ ID NO: 622110 - DNA, 25 bp, Rattus norvegicus
tgcctggactgttgatacgctctct

SEQ ID NO: 622111 - DNA, 25 bp, Rattus norvegicus
tgcctggagaatacaaagtcacttc

SEQ ID NO: 622112 - DNA, 25 bp, Rattus norvegicus
tgcctggagaattcaaagtcacttc

SEQ ID NO: 622113 - DNA, 25 bp, Rattus norvegicus
tgcctggagagacgcagttcctcaa

SEQ ID NO: 622114 - DNA, 25 bp, Rattus norvegicus
tgcctggagagaggcagttcctcaa

SEQ ID NO: 622115 - DNA, 25 bp, Rattus norvegicus
tgcctggagcacagtcctgtaatgc

SEQ ID NO: 622116 - DNA, 25 bp, Rattus norvegicus
tgcctggagcactgtcctgtaatgc

SEQ ID NO: 622117 - DNA, 25 bp, Rattus norvegicus
tgcctggagcagcacgacagcggag

SEQ ID NO: 622118 - DNA, 25 bp, Rattus norvegicus
tgcctggagcaggacgacagcggag

SEQ ID NO: 622119 - DNA, 25 bp, Rattus norvegicus
tgcctggagcttcctccacagagag

SEQ ID NO: 622120 - DNA, 25 bp, Rattus norvegicus
tgcctggagcttgctccacagagag

SEQ ID NO: 622121 - DNA, 25 bp, Rattus norvegicus
tgcctggatcgaacacttagtcatc

SEQ ID NO: 622122 - DNA, 25 bp, Rattus norvegicus
tgcctggatcgatcacttagtcatc

SEQ ID NO: 622123 - DNA, 25 bp, Rattus norvegicus
tgcctggcaactcctgggaggtctc

SEQ ID NO: 622124 - DNA, 25 bp, Rattus norvegicus
tgcctggcaactgctgggaggtctc

SEQ ID NO: 622125 - DNA, 25 bp, Rattus norvegicus
tgcctggcaggcagtagatcttcca

SEQ ID NO: 622126 - DNA, 25 bp, Rattus norvegicus
tgcctggcaggctgtagatcttcca

SEQ ID NO: 622127 - DNA, 25 bp, Rattus norvegicus
tgcctggcagttatgcccatgtcat

SEQ ID NO: 622128 - DNA, 25 bp, Rattus norvegicus
tgcctggcagttttgcccatgtcat

SEQ ID NO: 622129 - DNA, 25 bp, Rattus norvegicus
tgcctggccagcctggaatgtccat

SEQ ID NO: 622130 - DNA, 25 bp, Rattus norvegicus
tgcctggccagcgtggaatgtccat

SEQ ID NO: 622131 - DNA, 25 bp, Rattus norvegicus
tgcctggccatgcaggaatcctgag

SEQ ID NO: 622132 - DNA, 25 bp, Rattus norvegicus
tgcctggccatggaggaatcctgag

SEQ ID NO: 622133 - DNA, 25 bp, Rattus norvegicus
tgcctggccctcagtaacacatggg

SEQ ID NO: 622134 - DNA, 25 bp, Rattus norvegicus
tgcctggccctctgtaacacatggg

SEQ ID NO: 622135 - DNA, 25 bp, Rattus norvegicus
tgcctggcccttcccatttctgtgt

SEQ ID NO: 622136 - DNA, 25 bp, Rattus norvegicus
tgcctggcccttgccatttctgtgt

SEQ ID NO: 622137 - DNA, 25 bp, Rattus norvegicus
tgcctggcctgtctgcttctgaggt

SEQ ID NO: 622138 - DNA, 25 bp, Rattus norvegicus
tgcctggcctgtgtgcttctgaggt

SEQ ID NO: 622139 - DNA, 25 bp, Rattus norvegicus
tgcctggccttcagaaacactttaa

SEQ ID NO: 622140 - DNA, 25 bp, Rattus norvegicus
tgcctggccttctgaaacactttaa

SEQ ID NO: 622141 - DNA, 25 bp, Rattus norvegicus
tgcctggcctttccgggagtgaaaa

SEQ ID NO: 622142 - DNA, 25 bp, Rattus norvegicus
tgcctggcctttgcgggagtgaaaa

SEQ ID NO: 622143 - DNA, 25 bp, Rattus norvegicus
tgcctggcgcttagcaaatgttcct

SEQ ID NO: 622144 - DNA, 25 bp, Rattus norvegicus
tgcctggcgcttctgagtcagtctg

SEQ ID NO: 622145 - DNA, 25 bp, Rattus norvegicus
tgcctggcgcttgtgagtcagtctg

SEQ ID NO: 622146 - DNA, 25 bp, Rattus norvegicus
tgcctggcgctttgcaaatgttcct

SEQ ID NO: 622147 - DNA, 25 bp, Rattus norvegicus
tgcctggctcatcccaattatttaa

SEQ ID NO: 622148 - DNA, 25 bp, Rattus norvegicus
tgcctggctcatgccaattatttaa

SEQ ID NO: 622149 - DNA, 25 bp, Rattus norvegicus
tgcctggctctacctgatgacagaa

SEQ ID NO: 622150 - DNA, 25 bp, Rattus norvegicus
tgcctggctctagctgatgacagaa

SEQ ID NO: 622151 - DNA, 25 bp, Rattus norvegicus
tgcctggctggcatctagcttttta

SEQ ID NO: 622152 - DNA, 25 bp, Rattus norvegicus
tgcctggctggcttctagcttttta

SEQ ID NO: 622153 - DNA, 25 bp, Rattus norvegicus
tgcctggctgtcaatgcgagaatta

SEQ ID NO: 622154 - DNA, 25 bp, Rattus norvegicus
tgcctggctgtctatgcgagaatta

SEQ ID NO: 622155 - DNA, 25 bp, Rattus norvegicus
tgcctggcttccaacttgggtatag

SEQ ID NO: 622156 - DNA, 25 bp, Rattus norvegicus
tgcctggcttccacatagccataga

SEQ ID NO: 622157 - DNA, 25 bp, Rattus norvegicus
tgcctggcttcctacttgggtatag

SEQ ID NO: 622158 - DNA, 25 bp, Rattus norvegicus
tgcctggcttcctcatagccataga

SEQ ID NO: 622159 - DNA, 25 bp, Rattus norvegicus
tgcctggctttaactgtgtcttaaa

SEQ ID NO: 622160 - DNA, 25 bp, Rattus norvegicus
tgcctggctttatctgtgtcttaaa

SEQ ID NO: 622161 - DNA, 25 bp, Rattus norvegicus
tgcctggcttttaagctgaaacaga

SEQ ID NO: 622162 - DNA, 25 bp, Rattus norvegicus
tgcctggcttttatgacccgtgtgt

SEQ ID NO: 622163 - DNA, 25 bp, Rattus norvegicus
tgcctggctttttagctgaaacaga

SEQ ID NO: 622164 - DNA, 25 bp, Rattus norvegicus
tgcctggcttttttgacccgtgtgt

SEQ ID NO: 622165 - DNA, 25 bp, Rattus norvegicus
tgcctgggaacaacagcctgaactt

SEQ ID NO: 622166 - DNA, 25 bp, Rattus norvegicus
tgcctgggaacatcagcctgaactt

SEQ ID NO: 622167 - DNA, 25 bp, Rattus norvegicus
tgcctgggtaacactccctgaagga

SEQ ID NO: 622168 - DNA, 25 bp, Rattus norvegicus
tgcctgggtaactctccctgaagga

SEQ ID NO: 622169 - DNA, 25 bp, Rattus norvegicus
tgcctgggtctcactatttatatat

SEQ ID NO: 622170 - DNA, 25 bp, Rattus norvegicus
tgcctgggtctctctatttatatat

SEQ ID NO: 622171 - DNA, 25 bp, Rattus norvegicus
tgcctgggttggattcagctcacta

SEQ ID NO: 622172 - DNA, 25 bp, Rattus norvegicus
tgcctgggttggtttcagctcacta

SEQ ID NO: 622173 - DNA, 25 bp, Rattus norvegicus
tgcctggtcaaccagggtgcccgta

SEQ ID NO: 622174 - DNA, 25 bp, Rattus norvegicus
tgcctggtcaacgagggtgcccgta

SEQ ID NO: 622175 - DNA, 25 bp, Rattus norvegicus
tgcctggtccataggtgttctgaga

SEQ ID NO: 622176 - DNA, 25 bp, Rattus norvegicus
tgcctggtccattggtgttctgaga

SEQ ID NO: 622177 - DNA, 25 bp, Rattus norvegicus
tgcctggtctgtacacaagtgctca

SEQ ID NO: 622178 - DNA, 25 bp, Rattus norvegicus
tgcctggtctgttcacaagtgctca

SEQ ID NO: 622179 - DNA, 25 bp, Rattus norvegicus
tgcctggtgaccagctcagcggcga

SEQ ID NO: 622180 - DNA, 25 bp, Rattus norvegicus
tgcctggtgacctgctcagcggcga

SEQ ID NO: 622181 - DNA, 25 bp, Rattus norvegicus
tgcctggtgacgagaaaacttgtgt

SEQ ID NO: 622182 - DNA, 25 bp, Rattus norvegicus
tgcctggtgacgtgaaaacttgtgt

SEQ ID NO: 622183 - DNA, 25 bp, Rattus norvegicus
tgcctggtgcccacaagagacagag

SEQ ID NO: 622184 - DNA, 25 bp, Rattus norvegicus
tgcctggtgccctcaagagacagag

SEQ ID NO: 622185 - DNA, 25 bp, Rattus norvegicus
tgcctggtgtctctaacaagtacgt

SEQ ID NO: 622186 - DNA, 25 bp, Rattus norvegicus
tgcctggtgtctgtaacaagtacgt

SEQ ID NO: 622187 - DNA, 25 bp, Rattus norvegicus
tgcctggtgtgcacaatactatagg

SEQ ID NO: 622188 - DNA, 25 bp, Rattus norvegicus
tgcctggtgtgctcaatactatagg

SEQ ID NO: 622189 - DNA, 25 bp, Rattus norvegicus
tgcctggttggacactacatcacat

SEQ ID NO: 622190 - DNA, 25 bp, Rattus norvegicus
tgcctggttggagactacatcacat

SEQ ID NO: 622191 - DNA, 25 bp, Rattus norvegicus
tgcctgtaaaggctgtgtcttgtcc

SEQ ID NO: 622192 - DNA, 25 bp, Rattus norvegicus
tgcctgtaaagggtgtgtcttgtcc

SEQ ID NO: 622193 - DNA, 25 bp, Rattus norvegicus
tgcctgtaacaccaataaacccatt

SEQ ID NO: 622194 - DNA, 25 bp, Rattus norvegicus
tgcctgtaacacgaataaacccatt

SEQ ID NO: 622195 - DNA, 25 bp, Rattus norvegicus
tgcctgtaatagcaacatttaggag

SEQ ID NO: 622196 - DNA, 25 bp, Rattus norvegicus
tgcctgtaataggaacatttaggag

SEQ ID NO: 622197 - DNA, 25 bp, Rattus norvegicus
tgcctgtaattgcagccccaggaaa

SEQ ID NO: 622198 - DNA, 25 bp, Rattus norvegicus
tgcctgtaattggagccccaggaaa

SEQ ID NO: 622199 - DNA, 25 bp, Rattus norvegicus
tgcctgtacccccattttgttttga

SEQ ID NO: 622200 - DNA, 25 bp, Rattus norvegicus
tgcctgtaccccgattttgttttga

SEQ ID NO: 622201 - DNA, 25 bp, Rattus norvegicus
tgcctgtactctcgtggattcggta

SEQ ID NO: 622202 - DNA, 25 bp, Rattus norvegicus
tgcctgtactctggtggattcggta

SEQ ID NO: 622203 - DNA, 25 bp, Rattus norvegicus
tgcctgtaggccaagcattcaagaa

SEQ ID NO: 622204 - DNA, 25 bp, Rattus norvegicus
tgcctgtaggcctagcattcaagaa

SEQ ID NO: 622205 - DNA, 25 bp, Rattus norvegicus
tgcctgtaggtcatccagcagcagg

SEQ ID NO: 622206 - DNA, 25 bp, Rattus norvegicus
tgcctgtaggtcttccagcagcagg

SEQ ID NO: 622207 - DNA, 25 bp, Rattus norvegicus
tgcctgtagtgccatgtgtcttgag

SEQ ID NO: 622208 - DNA, 25 bp, Rattus norvegicus
tgcctgtagtgcgatgtgtcttgag

SEQ ID NO: 622209 - DNA, 25 bp, Rattus norvegicus
tgcctgtagttcaagcactaaagaa

SEQ ID NO: 622210 - DNA, 25 bp, Rattus norvegicus
tgcctgtagttctagcactaaagaa

SEQ ID NO: 622211 - DNA, 25 bp, Rattus norvegicus
tgcctgtattacaagttgaaatctt

SEQ ID NO: 622212 - DNA, 25 bp, Rattus norvegicus
tgcctgtattacactgtgccggaag

SEQ ID NO: 622213 - DNA, 25 bp, Rattus norvegicus
tgcctgtattactagttgaaatctt

SEQ ID NO: 622214 - DNA, 25 bp, Rattus norvegicus
tgcctgtattactctgtgccggaag

SEQ ID NO: 622215 - DNA, 25 bp, Rattus norvegicus
tgcctgtattccaggcatttaggaa

SEQ ID NO: 622216 - DNA, 25 bp, Rattus norvegicus
tgcctgtattcctggcatttaggaa

SEQ ID NO: 622217 - DNA, 25 bp, Rattus norvegicus
tgcctgtcaaggacggaggatgatt

SEQ ID NO: 622218 - DNA, 25 bp, Rattus norvegicus
tgcctgtcaaggtcggaggatgatt

SEQ ID NO: 622219 - DNA, 25 bp, Rattus norvegicus
tgcctgtcagctattctttattttt

SEQ ID NO: 622220 - DNA, 25 bp, Rattus norvegicus
tgcctgtcagcttttctttattttt

SEQ ID NO: 622221 - DNA, 25 bp, Rattus norvegicus
tgcctgtcatccagcttgacgaggc

SEQ ID NO: 622222 - DNA, 25 bp, Rattus norvegicus
tgcctgtcatcctgcttgacgaggc

SEQ ID NO: 622223 - DNA, 25 bp, Rattus norvegicus
tgcctgtcattgaagctcattgctg

SEQ ID NO: 622224 - DNA, 25 bp, Rattus norvegicus
tgcctgtcattgtagctcattgctg

SEQ ID NO: 622225 - DNA, 25 bp, Rattus norvegicus
tgcctgtccctacaagaggctaaaa

SEQ ID NO: 622226 - DNA, 25 bp, Rattus norvegicus
tgcctgtccctagaagaggctaaaa

SEQ ID NO: 622227 - DNA, 25 bp, Rattus norvegicus
tgcctgtccttgaatcatgtgctaa

SEQ ID NO: 622228 - DNA, 25 bp, Rattus norvegicus
tgcctgtccttgcacacgtgtgtat

SEQ ID NO: 622229 - DNA, 25 bp, Rattus norvegicus
tgcctgtccttggacacgtgtgtat

SEQ ID NO: 622230 - DNA, 25 bp, Rattus norvegicus
tgcctgtccttgtatcatgtgctaa

SEQ ID NO: 622231 - DNA, 25 bp, Rattus norvegicus
tgcctgtcggctatggtatccggaa

SEQ ID NO: 622232 - DNA, 25 bp, Rattus norvegicus
tgcctgtcggctttggtatccggaa

SEQ ID NO: 622233 - DNA, 25 bp, Rattus norvegicus
tgcctgtcggtgagcagtaaccaat

SEQ ID NO: 622234 - DNA, 25 bp, Rattus norvegicus
tgcctgtcggtgtgcagtaaccaat

SEQ ID NO: 622235 - DNA, 25 bp, Rattus norvegicus
tgcctgtctccacgcaagaagttat

SEQ ID NO: 622236 - DNA, 25 bp, Rattus norvegicus
tgcctgtctccaggcaagaagttat

SEQ ID NO: 622237 - DNA, 25 bp, Rattus norvegicus
tgcctgtctgatcttctgagctcat

SEQ ID NO: 622238 - DNA, 25 bp, Rattus norvegicus
tgcctgtctgatgttctgagctcat

SEQ ID NO: 622239 - DNA, 25 bp, Rattus norvegicus
tgcctgtctgtgacttggaaaccta

SEQ ID NO: 622240 - DNA, 25 bp, Rattus norvegicus
tgcctgtctgtgtcttggaaaccta

SEQ ID NO: 622241 - DNA, 25 bp, Rattus norvegicus
tgcctgtgacagctcgctacgctag

SEQ ID NO: 622242 - DNA, 25 bp, Rattus norvegicus
tgcctgtgacaggtcgctacgctag

SEQ ID NO: 622243 - DNA, 25 bp, Rattus norvegicus
tgcctgtgcacaaacgtcaaataat

SEQ ID NO: 622244 - DNA, 25 bp, Rattus norvegicus
tgcctgtgcacatacgtcaaataat

SEQ ID NO: 622245 - DNA, 25 bp, Rattus norvegicus
tgcctgtgcaccagagcaacgacat

SEQ ID NO: 622246 - DNA, 25 bp, Rattus norvegicus
tgcctgtgcacctgagcaacgacat

SEQ ID NO: 622247 - DNA, 25 bp, Rattus norvegicus
tgcctgtgcatgcagtgctctgcaa

SEQ ID NO: 622248 - DNA, 25 bp, Rattus norvegicus
tgcctgtgcatggagtgctctgcaa

SEQ ID NO: 622249 - DNA, 25 bp, Rattus norvegicus
tgcctgtgcgcaagcctggtacttt

SEQ ID NO: 622250 - DNA, 25 bp, Rattus norvegicus
tgcctgtgcgcatgcctggtacttt

SEQ ID NO: 622251 - DNA, 25 bp, Rattus norvegicus
tgcctgtgctctccgaagagttcac

SEQ ID NO: 622252 - DNA, 25 bp, Rattus norvegicus
tgcctgtgctctgcgaagagttcac

SEQ ID NO: 622253 - DNA, 25 bp, Rattus norvegicus
tgcctgtggcaactcagctgagctt

SEQ ID NO: 622254 - DNA, 25 bp, Rattus norvegicus
tgcctgtggcaagtcagctgagctt

SEQ ID NO: 622255 - DNA, 25 bp, Rattus norvegicus
tgcctgtggcacagacaaagtccta

SEQ ID NO: 622256 - DNA, 25 bp, Rattus norvegicus
tgcctgtggcactgacaaagtccta

SEQ ID NO: 622257 - DNA, 25 bp, Rattus norvegicus
tgcctgtgggtgagcatgaagtcct

SEQ ID NO: 622258 - DNA, 25 bp, Rattus norvegicus
tgcctgtgggtgtgcatgaagtcct

SEQ ID NO: 622259 - DNA, 25 bp, Rattus norvegicus
tgcctgtggtttctcctacaagtga

SEQ ID NO: 622260 - DNA, 25 bp, Rattus norvegicus
tgcctgtggtttgtcctacaagtga

SEQ ID NO: 622261 - DNA, 25 bp, Rattus norvegicus
tgcctgtgttaccttccacattcaa

SEQ ID NO: 622262 - DNA, 25 bp, Rattus norvegicus
tgcctgtgttacgttccacattcaa

SEQ ID NO: 622263 - DNA, 25 bp, Rattus norvegicus
tgcctgtgttcacacttctgtgtaa

SEQ ID NO: 622264 - DNA, 25 bp, Rattus norvegicus
tgcctgtgttcagacttctgtgtaa

SEQ ID NO: 622265 - DNA, 25 bp, Rattus norvegicus
tgcctgtgttgcctaccacattcag

SEQ ID NO: 622266 - DNA, 25 bp, Rattus norvegicus
tgcctgtgttgcgtaccacattcag

SEQ ID NO: 622267 - DNA, 25 bp, Rattus norvegicus
tgcctgttaaacacattacccgctt

SEQ ID NO: 622268 - DNA, 25 bp, Rattus norvegicus
tgcctgttaaactcattacccgctt

SEQ ID NO: 622269 - DNA, 25 bp, Rattus norvegicus
tgcctgttacacctgctctgaaggt

SEQ ID NO: 622270 - DNA, 25 bp, Rattus norvegicus
tgcctgttacacgtgctctgaaggt

SEQ ID NO: 622271 - DNA, 25 bp, Rattus norvegicus
tgcctgttacagaatcatgagtttc

SEQ ID NO: 622272 - DNA, 25 bp, Rattus norvegicus
tgcctgttacagtatcatgagtttc

SEQ ID NO: 622273 - DNA, 25 bp, Rattus norvegicus
tgcctgttacctcgatgctcgcaaa

SEQ ID NO: 622274 - DNA, 25 bp, Rattus norvegicus
tgcctgttacctggatgctcgcaaa

SEQ ID NO: 622275 - DNA, 25 bp, Rattus norvegicus
tgcctgttccacatgcaataccaaa

SEQ ID NO: 622276 - DNA, 25 bp, Rattus norvegicus
tgcctgttccacttgcaataccaaa

SEQ ID NO: 622277 - DNA, 25 bp, Rattus norvegicus
tgcctgttccagagagtattgtctt

SEQ ID NO: 622278 - DNA, 25 bp, Rattus norvegicus
tgcctgttccagtgagtattgtctt

SEQ ID NO: 622279 - DNA, 25 bp, Rattus norvegicus
tgcctgttcctgacagatacactca

SEQ ID NO: 622280 - DNA, 25 bp, Rattus norvegicus
tgcctgttcctgtcagatacactca

SEQ ID NO: 622281 - DNA, 25 bp, Rattus norvegicus
tgcctgttgcggacactgctcatgg

SEQ ID NO: 622282 - DNA, 25 bp, Rattus norvegicus
tgcctgttgcggtcactgctcatgg

SEQ ID NO: 622283 - DNA, 25 bp, Rattus norvegicus
tgcctgtttgatatttgaagccaac

SEQ ID NO: 622284 - DNA, 25 bp, Rattus norvegicus
tgcctgtttgatttttgaagccaac

SEQ ID NO: 622285 - DNA, 25 bp, Rattus norvegicus
tgcctgttttagcaagaaccacttc

SEQ ID NO: 622286 - DNA, 25 bp, Rattus norvegicus
tgcctgttttaggaagaaccacttc

SEQ ID NO: 622287 - DNA, 25 bp, Rattus norvegicus
tgcctgttttccatccatatcaaaa

SEQ ID NO: 622288 - DNA, 25 bp, Rattus norvegicus
tgcctgttttccttccatatcaaaa

SEQ ID NO: 622289 - DNA, 25 bp, Rattus norvegicus
tgccttaaaacaccctgtatcctgt

SEQ ID NO: 622290 - DNA, 25 bp, Rattus norvegicus
tgccttaaaacagcctgtatcctgt

SEQ ID NO: 622291 - DNA, 25 bp, Rattus norvegicus
tgccttaaaagccatcattgccatg

SEQ ID NO: 622292 - DNA, 25 bp, Rattus norvegicus
tgccttaaaagcgatcattgccatg

SEQ ID NO: 622293 - DNA, 25 bp, Rattus norvegicus
tgccttaacgttaccaaccatgcag

SEQ ID NO: 622294 - DNA, 25 bp, Rattus norvegicus
tgccttaacgtttccaaccatgcag

SEQ ID NO: 622295 - DNA, 25 bp, Rattus norvegicus
tgccttaactccaaagccggttcag

SEQ ID NO: 622296 - DNA, 25 bp, Rattus norvegicus
tgccttaactcctaagccggttcag

SEQ ID NO: 622297 - DNA, 25 bp, Rattus norvegicus
tgccttaagtgtcctgtgagtttac

SEQ ID NO: 622298 - DNA, 25 bp, Rattus norvegicus
tgccttaagtgtgctgtgagtttac

SEQ ID NO: 622299 - DNA, 25 bp, Rattus norvegicus
tgccttaatccgactaacagttgga

SEQ ID NO: 622300 - DNA, 25 bp, Rattus norvegicus
tgccttaatccgtctaacagttgga

SEQ ID NO: 622301 - DNA, 25 bp, Rattus norvegicus
tgccttacactcactattctatatt

SEQ ID NO: 622302 - DNA, 25 bp, Rattus norvegicus
tgccttacactctctattctatatt

SEQ ID NO: 622303 - DNA, 25 bp, Rattus norvegicus
tgccttacagaccttgtggtgcata

SEQ ID NO: 622304 - DNA, 25 bp, Rattus norvegicus
tgccttacagacgttgtggtgcata

SEQ ID NO: 622305 - DNA, 25 bp, Rattus norvegicus
tgccttacaggaagcctttattgta

SEQ ID NO: 622306 - DNA, 25 bp, Rattus norvegicus
tgccttacaggatgcctttattgta

SEQ ID NO: 622307 - DNA, 25 bp, Rattus norvegicus
tgccttaccaacctcactgataata

SEQ ID NO: 622308 - DNA, 25 bp, Rattus norvegicus
tgccttaccaacgtcactgataata

SEQ ID NO: 622309 - DNA, 25 bp, Rattus norvegicus
tgccttaccaagcttgtgtcacgaa

SEQ ID NO: 622310 - DNA, 25 bp, Rattus norvegicus
tgccttaccaaggttgtgtcacgaa

SEQ ID NO: 622311 - DNA, 25 bp, Rattus norvegicus
tgccttacccaacatgaaattccct

SEQ ID NO: 622312 - DNA, 25 bp, Rattus norvegicus
tgccttacccaagatgaaattccct

SEQ ID NO: 622313 - DNA, 25 bp, Rattus norvegicus
tgccttacttggagacatcggtggt

SEQ ID NO: 622314 - DNA, 25 bp, Rattus norvegicus
tgccttacttggtgacatcggtggt

SEQ ID NO: 622315 - DNA, 25 bp, Rattus norvegicus
tgccttagacacagcagcacttaag

SEQ ID NO: 622316 - DNA, 25 bp, Rattus norvegicus
tgccttagacactgcagcacttaag

SEQ ID NO: 622317 - DNA, 25 bp, Rattus norvegicus
tgccttagagtgagcaagctgggct

SEQ ID NO: 622318 - DNA, 25 bp, Rattus norvegicus
tgccttagagtgtgcaagctgggct

SEQ ID NO: 622319 - DNA, 25 bp, Rattus norvegicus
tgccttagggacctggctatccata

SEQ ID NO: 622320 - DNA, 25 bp, Rattus norvegicus
tgccttagggacgtggctatccata

SEQ ID NO: 622321 - DNA, 25 bp, Rattus norvegicus
tgccttagggttactggagtaatgt

SEQ ID NO: 622322 - DNA, 25 bp, Rattus norvegicus
tgccttagggtttctggagtaatgt

SEQ ID NO: 622323 - DNA, 25 bp, Rattus norvegicus
tgccttatataactgctcctgtccc

SEQ ID NO: 622324 - DNA, 25 bp, Rattus norvegicus
tgccttatataagtgctcctgtccc

SEQ ID NO: 622325 - DNA, 25 bp, Rattus norvegicus
tgccttatatatcctctcttcacac

SEQ ID NO: 622326 - DNA, 25 bp, Rattus norvegicus
tgccttatatatgctctcttcacac

SEQ ID NO: 622327 - DNA, 25 bp, Rattus norvegicus
tgccttatccaaacatgcttcagag

SEQ ID NO: 622328 - DNA, 25 bp, Rattus norvegicus
tgccttatccaatcatgcttcagag

SEQ ID NO: 622329 - DNA, 25 bp, Rattus norvegicus
tgccttatccttaatccgttcatat

SEQ ID NO: 622330 - DNA, 25 bp, Rattus norvegicus
tgccttatcctttatccgttcatat

SEQ ID NO: 622331 - DNA, 25 bp, Rattus norvegicus
tgccttattcctagaactgcatcct

SEQ ID NO: 622332 - DNA, 25 bp, Rattus norvegicus
tgccttattccttgaactgcatcct

SEQ ID NO: 622333 - DNA, 25 bp, Rattus norvegicus
tgccttatttgtctctccatctttc

SEQ ID NO: 622334 - DNA, 25 bp, Rattus norvegicus
tgccttatttgtgtctccatctttc

SEQ ID NO: 622335 - DNA, 25 bp, Rattus norvegicus
tgccttcaaagaacaccagcagttg

SEQ ID NO: 622336 - DNA, 25 bp, Rattus norvegicus
tgccttcaaagatcaccagcagttg

SEQ ID NO: 622337 - DNA, 25 bp, Rattus norvegicus
tgccttcaaatacctaacccaaact

SEQ ID NO: 622338 - DNA, 25 bp, Rattus norvegicus
tgccttcaaatagctaacccaaact

SEQ ID NO: 622339 - DNA, 25 bp, Rattus norvegicus
tgccttcacatcctctgagagtagc

SEQ ID NO: 622340 - DNA, 25 bp, Rattus norvegicus
tgccttcacatcgtctgagagtagc

SEQ ID NO: 622341 - DNA, 25 bp, Rattus norvegicus
tgccttcactatcagctctcgagag

SEQ ID NO: 622342 - DNA, 25 bp, Rattus norvegicus
tgccttcactatgagctctcgagag

SEQ ID NO: 622343 - DNA, 25 bp, Rattus norvegicus
tgccttcactctaactcaaatcaaa

SEQ ID NO: 622344 - DNA, 25 bp, Rattus norvegicus
tgccttcactcttactcaaatcaaa

SEQ ID NO: 622345 - DNA, 25 bp, Rattus norvegicus
tgccttcactgcacacatgctgaat

SEQ ID NO: 622346 - DNA, 25 bp, Rattus norvegicus
tgccttcactgctcacatgctgaat

SEQ ID NO: 622347 - DNA, 25 bp, Rattus norvegicus
tgccttcagaagctgcccgtcctga

SEQ ID NO: 622348 - DNA, 25 bp, Rattus norvegicus
tgccttcagaaggtgcccgtcctga

SEQ ID NO: 622349 - DNA, 25 bp, Rattus norvegicus
tgccttcagggaccttccagtcaaa

SEQ ID NO: 622350 - DNA, 25 bp, Rattus norvegicus
tgccttcagggagcttccagtcaaa

SEQ ID NO: 622351 - DNA, 25 bp, Rattus norvegicus
tgccttcagtctcaactctcaagag

SEQ ID NO: 622352 - DNA, 25 bp, Rattus norvegicus
tgccttcagtctgaactctcaagag

SEQ ID NO: 622353 - DNA, 25 bp, Rattus norvegicus
tgccttcatatgattcatggccaat

SEQ ID NO: 622354 - DNA, 25 bp, Rattus norvegicus
tgccttcatatgtttcatggccaat

SEQ ID NO: 622355 - DNA, 25 bp, Rattus norvegicus
tgccttcatcatagggtggagtcat

SEQ ID NO: 622356 - DNA, 25 bp, Rattus norvegicus
tgccttcatcattgggtggagtcat

SEQ ID NO: 622357 - DNA, 25 bp, Rattus norvegicus
tgccttcatccccagaacttggagg

SEQ ID NO: 622358 - DNA, 25 bp, Rattus norvegicus
tgccttcatccccttggagattctc

SEQ ID NO: 622359 - DNA, 25 bp, Rattus norvegicus
tgccttcatcccgagaacttggagg

SEQ ID NO: 622360 - DNA, 25 bp, Rattus norvegicus
tgccttcatcccgttggagattctc

SEQ ID NO: 622361 - DNA, 25 bp, Rattus norvegicus
tgccttcatcttaccacatactggg

SEQ ID NO: 622362 - DNA, 25 bp, Rattus norvegicus
tgccttcatctttccacatactggg

SEQ ID NO: 622363 - DNA, 25 bp, Rattus norvegicus
tgccttcattaaattggtccctaat

SEQ ID NO: 622364 - DNA, 25 bp, Rattus norvegicus
tgccttcattaatttggtccctaat

SEQ ID NO: 622365 - DNA, 25 bp, Rattus norvegicus
tgccttcattctctgtggcctacag

SEQ ID NO: 622366 - DNA, 25 bp, Rattus norvegicus
tgccttcattctgtgtggcctacag

SEQ ID NO: 622367 - DNA, 25 bp, Rattus norvegicus
tgccttcattttcaaccagcatgtt

SEQ ID NO: 622368 - DNA, 25 bp, Rattus norvegicus
tgccttcattttgaaccagcatgtt

SEQ ID NO: 622369 - DNA, 25 bp, Rattus norvegicus
tgccttccaaaacacttacttcaca

SEQ ID NO: 622370 - DNA, 25 bp, Rattus norvegicus
tgccttccaaaagacttacttcaca

SEQ ID NO: 622371 - DNA, 25 bp, Rattus norvegicus
tgccttccaaacagcaggtccaaag

SEQ ID NO: 622372 - DNA, 25 bp, Rattus norvegicus
tgccttccaaactgcaggtccaaag

SEQ ID NO: 622373 - DNA, 25 bp, Rattus norvegicus
tgccttccactgaagatgatggcca

SEQ ID NO: 622374 - DNA, 25 bp, Rattus norvegicus
tgccttccactgtagatgatggcca

SEQ ID NO: 622375 - DNA, 25 bp, Rattus norvegicus
tgccttccagggataccatacggtt

SEQ ID NO: 622376 - DNA, 25 bp, Rattus norvegicus
tgccttccagggttaccatacggtt

SEQ ID NO: 622377 - DNA, 25 bp, Rattus norvegicus
tgccttccatgtctcctagagacaa

SEQ ID NO: 622378 - DNA, 25 bp, Rattus norvegicus
tgccttccatgtgtcctagagacaa

SEQ ID NO: 622379 - DNA, 25 bp, Rattus norvegicus
tgccttccctttaccgtacacgaag

SEQ ID NO: 622380 - DNA, 25 bp, Rattus norvegicus
tgccttcccttttccgtacacgaag

SEQ ID NO: 622381 - DNA, 25 bp, Rattus norvegicus
tgccttccgaacacgagatccctgg

SEQ ID NO: 622382 - DNA, 25 bp, Rattus norvegicus
tgccttccgaactcgagatccctgg

SEQ ID NO: 622383 - DNA, 25 bp, Rattus norvegicus
tgccttccggctcagaacagctttg

SEQ ID NO: 622384 - DNA, 25 bp, Rattus norvegicus
tgccttccggctctaggtgtctgag

SEQ ID NO: 622385 - DNA, 25 bp, Rattus norvegicus
tgccttccggctgagaacagctttg

SEQ ID NO: 622386 - DNA, 25 bp, Rattus norvegicus
tgccttccggctgtaggtgtctgag

SEQ ID NO: 622387 - DNA, 25 bp, Rattus norvegicus
tgccttcctaccacgtgtggataag

SEQ ID NO: 622388 - DNA, 25 bp, Rattus norvegicus
tgccttcctacctcgtgtggataag

SEQ ID NO: 622389 - DNA, 25 bp, Rattus norvegicus
tgccttcctcaacatagccgtcaag

SEQ ID NO: 622390 - DNA, 25 bp, Rattus norvegicus
tgccttcctcaagatagccgtcaag

SEQ ID NO: 622391 - DNA, 25 bp, Rattus norvegicus
tgccttcctgaacaacgggctgaaa

SEQ ID NO: 622392 - DNA, 25 bp, Rattus norvegicus
tgccttcctgaagaacgggctgaaa

SEQ ID NO: 622393 - DNA, 25 bp, Rattus norvegicus
tgccttcctggtcacctcaggtaag

SEQ ID NO: 622394 - DNA, 25 bp, Rattus norvegicus
tgccttcctggtgacctcaggtaag

SEQ ID NO: 622395 - DNA, 25 bp, Rattus norvegicus
tgccttccttaacgcacaagtgtgc

SEQ ID NO: 622396 - DNA, 25 bp, Rattus norvegicus
tgccttccttaaggcacaagtgtgc

SEQ ID NO: 622397 - DNA, 25 bp, Rattus norvegicus
tgccttcctttaacctctgtaatgt

SEQ ID NO: 622398 - DNA, 25 bp, Rattus norvegicus
tgccttcctttacggtgttcttaga

SEQ ID NO: 622399 - DNA, 25 bp, Rattus norvegicus
tgccttcctttagggtgttcttaga

SEQ ID NO: 622400 - DNA, 25 bp, Rattus norvegicus
tgccttcctttatcctctgtaatgt

SEQ ID NO: 622401 - DNA, 25 bp, Rattus norvegicus
tgccttcggactccttactctagtg

SEQ ID NO: 622402 - DNA, 25 bp, Rattus norvegicus
tgccttcggactgcttactctagtg

SEQ ID NO: 622403 - DNA, 25 bp, Rattus norvegicus
tgccttcggagtaagttccagtatt

SEQ ID NO: 622404 - DNA, 25 bp, Rattus norvegicus
tgccttcggagttagttccagtatt

SEQ ID NO: 622405 - DNA, 25 bp, Rattus norvegicus
tgccttcgggttcctgccccaagtt

SEQ ID NO: 622406 - DNA, 25 bp, Rattus norvegicus
tgccttcgggttgctgccccaagtt

SEQ ID NO: 622407 - DNA, 25 bp, Rattus norvegicus
tgccttcgtaccacagatatttcag

SEQ ID NO: 622408 - DNA, 25 bp, Rattus norvegicus
tgccttcgtacctcagatatttcag

SEQ ID NO: 622409 - DNA, 25 bp, Rattus norvegicus
tgccttctacatacaaccatggagc

SEQ ID NO: 622410 - DNA, 25 bp, Rattus norvegicus
tgccttctacattcaaccatggagc

SEQ ID NO: 622411 - DNA, 25 bp, Rattus norvegicus
tgccttctaggcatctttcagagct

SEQ ID NO: 622412 - DNA, 25 bp, Rattus norvegicus
tgccttctaggcttctttcagagct

SEQ ID NO: 622413 - DNA, 25 bp, Rattus norvegicus
tgccttctcccgagtatgcacataa

SEQ ID NO: 622414 - DNA, 25 bp, Rattus norvegicus
tgccttctcccgtgtatgcacataa

SEQ ID NO: 622415 - DNA, 25 bp, Rattus norvegicus
tgccttctcctgacagtaacagctg

SEQ ID NO: 622416 - DNA, 25 bp, Rattus norvegicus
tgccttctcctgtcagtaacagctg

SEQ ID NO: 622417 - DNA, 25 bp, Rattus norvegicus
tgccttctctagctatcttcggaaa

SEQ ID NO: 622418 - DNA, 25 bp, Rattus norvegicus
tgccttctctaggtatcttcggaaa

SEQ ID NO: 622419 - DNA, 25 bp, Rattus norvegicus
tgccttctctatattctctgacact

SEQ ID NO: 622420 - DNA, 25 bp, Rattus norvegicus
tgccttctctattttctctgacact

SEQ ID NO: 622421 - DNA, 25 bp, Rattus norvegicus
tgccttctctcacggtctggatgac

SEQ ID NO: 622422 - DNA, 25 bp, Rattus norvegicus
tgccttctctcagggtctggatgac

SEQ ID NO: 622423 - DNA, 25 bp, Rattus norvegicus
tgccttctctggaaaactgtgggta

SEQ ID NO: 622424 - DNA, 25 bp, Rattus norvegicus
tgccttctctggtaaactgtgggta

SEQ ID NO: 622425 - DNA, 25 bp, Rattus norvegicus
tgccttctctgtaccttgtttgaaa

SEQ ID NO: 622426 - DNA, 25 bp, Rattus norvegicus
tgccttctctgttccttgtttgaaa

SEQ ID NO: 622427 - DNA, 25 bp, Rattus norvegicus
tgccttctctttactgttttgttaa

SEQ ID NO: 622428 - DNA, 25 bp, Rattus norvegicus
tgccttctcttttctgttttgttaa

SEQ ID NO: 622429 - DNA, 25 bp, Rattus norvegicus
tgccttctgacacagcaacagcttt

SEQ ID NO: 622430 - DNA, 25 bp, Rattus norvegicus
tgccttctgacagagcaacagcttt

SEQ ID NO: 622431 - DNA, 25 bp, Rattus norvegicus
tgccttctgagactatgccatgtcc

SEQ ID NO: 622432 - DNA, 25 bp, Rattus norvegicus
tgccttctgagagtatgccatgtcc

SEQ ID NO: 622433 - DNA, 25 bp, Rattus norvegicus
tgccttctgctcagtgttatttttc

SEQ ID NO: 622434 - DNA, 25 bp, Rattus norvegicus
tgccttctgctctgtgttatttttc

SEQ ID NO: 622435 - DNA, 25 bp, Rattus norvegicus
tgccttctgcttagaagccagtgta

SEQ ID NO: 622436 - DNA, 25 bp, Rattus norvegicus
tgccttctgcttctcaggacagaca

SEQ ID NO: 622437 - DNA, 25 bp, Rattus norvegicus
tgccttctgcttgtcaggacagaca

SEQ ID NO: 622438 - DNA, 25 bp, Rattus norvegicus
tgccttctgctttgaagccagtgta

SEQ ID NO: 622439 - DNA, 25 bp, Rattus norvegicus
tgccttctgtctagtgcctttaaac

SEQ ID NO: 622440 - DNA, 25 bp, Rattus norvegicus
tgccttctgtcttgtgcctttaaac

SEQ ID NO: 622441 - DNA, 25 bp, Rattus norvegicus
tgccttctgtgaccctcgggatcag

SEQ ID NO: 622442 - DNA, 25 bp, Rattus norvegicus
tgccttctgtgagcctcgggatcag

SEQ ID NO: 622443 - DNA, 25 bp, Rattus norvegicus
tgccttctgtttaagcactttaagt

SEQ ID NO: 622444 - DNA, 25 bp, Rattus norvegicus
tgccttctgttttagcactttaagt

SEQ ID NO: 622445 - DNA, 25 bp, Rattus norvegicus
tgccttcttacgagttgcgactgag

SEQ ID NO: 622446 - DNA, 25 bp, Rattus norvegicus
tgccttcttacgtgttgcgactgag

SEQ ID NO: 622447 - DNA, 25 bp, Rattus norvegicus
tgccttcttctcactggagttaata

SEQ ID NO: 622448 - DNA, 25 bp, Rattus norvegicus
tgccttcttctctctggagttaata

SEQ ID NO: 622449 - DNA, 25 bp, Rattus norvegicus
tgccttcttgcaatgtcttgcaatg

SEQ ID NO: 622450 - DNA, 25 bp, Rattus norvegicus
tgccttcttgcattgtcttgcaatg

SEQ ID NO: 622451 - DNA, 25 bp, Rattus norvegicus
tgccttcttgctacttggttaggaa

SEQ ID NO: 622452 - DNA, 25 bp, Rattus norvegicus
tgccttcttgcttcttggttaggaa

SEQ ID NO: 622453 - DNA, 25 bp, Rattus norvegicus
tgccttcttttaatccgggagttga

SEQ ID NO: 622454 - DNA, 25 bp, Rattus norvegicus
tgccttcttttattccgggagttga

SEQ ID NO: 622455 - DNA, 25 bp, Rattus norvegicus
tgccttgaacctagacgggaacttt

SEQ ID NO: 622456 - DNA, 25 bp, Rattus norvegicus
tgccttgaacctcggccggcttaga

SEQ ID NO: 622457 - DNA, 25 bp, Rattus norvegicus
tgccttgaacctgggccggcttaga

SEQ ID NO: 622458 - DNA, 25 bp, Rattus norvegicus
tgccttgaaccttgacgggaacttt

SEQ ID NO: 622459 - DNA, 25 bp, Rattus norvegicus
tgccttgaagaaagctgtgtctatc

SEQ ID NO: 622460 - DNA, 25 bp, Rattus norvegicus
tgccttgaagaatgctgtgtctatc

SEQ ID NO: 622461 - DNA, 25 bp, Rattus norvegicus
tgccttgaatttcgtatatgtgtat

SEQ ID NO: 622462 - DNA, 25 bp, Rattus norvegicus
tgccttgaatttggtatatgtgtat

SEQ ID NO: 622463 - DNA, 25 bp, Rattus norvegicus
tgccttgagcaacaggaacgccaat

SEQ ID NO: 622464 - DNA, 25 bp, Rattus norvegicus
tgccttgagcaagaggaacgccaat

SEQ ID NO: 622465 - DNA, 25 bp, Rattus norvegicus
tgccttgatatgagatttgctcttc

SEQ ID NO: 622466 - DNA, 25 bp, Rattus norvegicus
tgccttgatatgtgatttgctcttc

SEQ ID NO: 622467 - DNA, 25 bp, Rattus norvegicus
tgccttgatttccatttcatgtttg

SEQ ID NO: 622468 - DNA, 25 bp, Rattus norvegicus
tgccttgatttcgatttcatgtttg

SEQ ID NO: 622469 - DNA, 25 bp, Rattus norvegicus
tgccttgcacgcctggataactaga

SEQ ID NO: 622470 - DNA, 25 bp, Rattus norvegicus
tgccttgcacgcgtggataactaga

SEQ ID NO: 622471 - DNA, 25 bp, Rattus norvegicus
tgccttgcacttattaactctgtct

SEQ ID NO: 622472 - DNA, 25 bp, Rattus norvegicus
tgccttgcactttttaactctgtct

SEQ ID NO: 622473 - DNA, 25 bp, Rattus norvegicus
tgccttgcagcaaataaacaattat

SEQ ID NO: 622474 - DNA, 25 bp, Rattus norvegicus
tgccttgcagcatataaacaattat

SEQ ID NO: 622475 - DNA, 25 bp, Rattus norvegicus
tgccttgcagtgacttgtgactatc

SEQ ID NO: 622476 - DNA, 25 bp, Rattus norvegicus
tgccttgcagtgtcttgtgactatc

SEQ ID NO: 622477 - DNA, 25 bp, Rattus norvegicus
tgccttgcatacattaggcgcccaa

SEQ ID NO: 622478 - DNA, 25 bp, Rattus norvegicus
tgccttgcatactttaggcgcccaa

SEQ ID NO: 622479 - DNA, 25 bp, Rattus norvegicus
tgccttgccctcagagatgctgaaa

SEQ ID NO: 622480 - DNA, 25 bp, Rattus norvegicus
tgccttgccctcctactgaaagatt

SEQ ID NO: 622481 - DNA, 25 bp, Rattus norvegicus
tgccttgccctcgtactgaaagatt

SEQ ID NO: 622482 - DNA, 25 bp, Rattus norvegicus
tgccttgccctctgagatgctgaaa

SEQ ID NO: 622483 - DNA, 25 bp, Rattus norvegicus
tgccttgcctccataaatgcatatg

SEQ ID NO: 622484 - DNA, 25 bp, Rattus norvegicus
tgccttgcctccttaaatgcatatg

SEQ ID NO: 622485 - DNA, 25 bp, Rattus norvegicus
tgccttgcctgtactgtgttgtaaa

SEQ ID NO: 622486 - DNA, 25 bp, Rattus norvegicus
tgccttgcctgttctgtgttgtaaa

SEQ ID NO: 622487 - DNA, 25 bp, Rattus norvegicus
tgccttgcctttcgttattggtctt

SEQ ID NO: 622488 - DNA, 25 bp, Rattus norvegicus
tgccttgcctttggttattggtctt

SEQ ID NO: 622489 - DNA, 25 bp, Rattus norvegicus
tgccttgcgaagcaacgcatctgtg

SEQ ID NO: 622490 - DNA, 25 bp, Rattus norvegicus
tgccttgcgaaggaacgcatctgtg

SEQ ID NO: 622491 - DNA, 25 bp, Rattus norvegicus
tgccttgcgcacacaggaacctgca

SEQ ID NO: 622492 - DNA, 25 bp, Rattus norvegicus
tgccttgcgcactcaggaacctgca

SEQ ID NO: 622493 - DNA, 25 bp, Rattus norvegicus
tgccttgcgctaagtcaaaccacat

SEQ ID NO: 622494 - DNA, 25 bp, Rattus norvegicus
tgccttgcgctatgtcaaaccacat

SEQ ID NO: 622495 - DNA, 25 bp, Rattus norvegicus
tgccttgctgatcattcctagggtg

SEQ ID NO: 622496 - DNA, 25 bp, Rattus norvegicus
tgccttgctgatgattcctagggtg

SEQ ID NO: 622497 - DNA, 25 bp, Rattus norvegicus
tgccttgctgccagctacaaggaaa

SEQ ID NO: 622498 - DNA, 25 bp, Rattus norvegicus
tgccttgctgcctgctacaaggaaa

SEQ ID NO: 622499 - DNA, 25 bp, Rattus norvegicus
tgccttgcttataccgagcgatggt

SEQ ID NO: 622500 - DNA, 25 bp, Rattus norvegicus
tgccttgcttattccgagcgatggt

SEQ ID NO: 622501 - DNA, 25 bp, Rattus norvegicus
tgccttgctttgcttgcattcctat

SEQ ID NO: 622502 - DNA, 25 bp, Rattus norvegicus
tgccttgctttggttgcattcctat

SEQ ID NO: 622503 - DNA, 25 bp, Rattus norvegicus
tgccttggactcaccatagcataca

SEQ ID NO: 622504 - DNA, 25 bp, Rattus norvegicus
tgccttggactctccatagcataca

SEQ ID NO: 622505 - DNA, 25 bp, Rattus norvegicus
tgccttggacttcacctggaatctc

SEQ ID NO: 622506 - DNA, 25 bp, Rattus norvegicus
tgccttggacttgacctggaatctc

SEQ ID NO: 622507 - DNA, 25 bp, Rattus norvegicus
tgccttggagtgaccggtttcctgt

SEQ ID NO: 622508 - DNA, 25 bp, Rattus norvegicus
tgccttggagtgtccggtttcctgt

SEQ ID NO: 622509 - DNA, 25 bp, Rattus norvegicus
tgccttggcattactgtcttattat

SEQ ID NO: 622510 - DNA, 25 bp, Rattus norvegicus
tgccttggcattcctcagccctgtt

SEQ ID NO: 622511 - DNA, 25 bp, Rattus norvegicus
tgccttggcattgctcagccctgtt

SEQ ID NO: 622512 - DNA, 25 bp, Rattus norvegicus
tgccttggcatttctgtcttattat

SEQ ID NO: 622513 - DNA, 25 bp, Rattus norvegicus
tgccttggccaacctcagtgaactg

SEQ ID NO: 622514 - DNA, 25 bp, Rattus norvegicus
tgccttggccaagctcagtgaactg

SEQ ID NO: 622515 - DNA, 25 bp, Rattus norvegicus
tgccttggcccaagaatcaagaggg

SEQ ID NO: 622516 - DNA, 25 bp, Rattus norvegicus
tgccttggcccatgaatcaagaggg

SEQ ID NO: 622517 - DNA, 25 bp, Rattus norvegicus
tgccttggcctcacatgtactagga

SEQ ID NO: 622518 - DNA, 25 bp, Rattus norvegicus
tgccttggcctctcatgtactagga

SEQ ID NO: 622519 - DNA, 25 bp, Rattus norvegicus
tgccttggctgacctttggacgatg

SEQ ID NO: 622520 - DNA, 25 bp, Rattus norvegicus
tgccttggctgagctttggacgatg

SEQ ID NO: 622521 - DNA, 25 bp, Rattus norvegicus
tgccttgggaccaatctgattatag

SEQ ID NO: 622522 - DNA, 25 bp, Rattus norvegicus
tgccttgggacctatctgattatag

SEQ ID NO: 622523 - DNA, 25 bp, Rattus norvegicus
tgccttgggagcacacctgagctga

SEQ ID NO: 622524 - DNA, 25 bp, Rattus norvegicus
tgccttgggagctcacctgagctga

SEQ ID NO: 622525 - DNA, 25 bp, Rattus norvegicus
tgccttggtccactcacaaaacatg

SEQ ID NO: 622526 - DNA, 25 bp, Rattus norvegicus
tgccttggtccagtcacaaaacatg

SEQ ID NO: 622527 - DNA, 25 bp, Rattus norvegicus
tgccttggtcccagtcagcggtggt

SEQ ID NO: 622528 - DNA, 25 bp, Rattus norvegicus
tgccttggtccctgtcagcggtggt

SEQ ID NO: 622529 - DNA, 25 bp, Rattus norvegicus
tgccttggtctcagccattggatcc

SEQ ID NO: 622530 - DNA, 25 bp, Rattus norvegicus
tgccttggtctctgccattggatcc

SEQ ID NO: 622531 - DNA, 25 bp, Rattus norvegicus
tgccttggtgaaagccgagtgagcc

SEQ ID NO: 622532 - DNA, 25 bp, Rattus norvegicus
tgccttggtgaatgccgagtgagcc

SEQ ID NO: 622533 - DNA, 25 bp, Rattus norvegicus
tgccttgtcatcattatgtgctgtt

SEQ ID NO: 622534 - DNA, 25 bp, Rattus norvegicus
tgccttgtcatctttatgtgctgtt

SEQ ID NO: 622535 - DNA, 25 bp, Rattus norvegicus
tgccttgtcattatggttccttacc

SEQ ID NO: 622536 - DNA, 25 bp, Rattus norvegicus
tgccttgtcattttggttccttacc

SEQ ID NO: 622537 - DNA, 25 bp, Rattus norvegicus
tgccttgtccacctagcggcggtat

SEQ ID NO: 622538 - DNA, 25 bp, Rattus norvegicus
tgccttgtccacgtagcggcggtat

SEQ ID NO: 622539 - DNA, 25 bp, Rattus norvegicus
tgccttgtcctcagtccctgggtgg

SEQ ID NO: 622540 - DNA, 25 bp, Rattus norvegicus
tgccttgtcctctgtccctgggtgg

SEQ ID NO: 622541 - DNA, 25 bp, Rattus norvegicus
tgccttgtctatactcgggatgcta

SEQ ID NO: 622542 - DNA, 25 bp, Rattus norvegicus
tgccttgtctattctcgggatgcta

SEQ ID NO: 622543 - DNA, 25 bp, Rattus norvegicus
tgccttgtctgccttcaatgggaga

SEQ ID NO: 622544 - DNA, 25 bp, Rattus norvegicus
tgccttgtctgcgttcaatgggaga

SEQ ID NO: 622545 - DNA, 25 bp, Rattus norvegicus
tgccttgtgacacctggtacctttg

SEQ ID NO: 622546 - DNA, 25 bp, Rattus norvegicus
tgccttgtgacagctggtacctttg

SEQ ID NO: 622547 - DNA, 25 bp, Rattus norvegicus
tgccttgtgcttagtaccttaaacc

SEQ ID NO: 622548 - DNA, 25 bp, Rattus norvegicus
tgccttgtgctttgtaccttaaacc

SEQ ID NO: 622549 - DNA, 25 bp, Rattus norvegicus
tgccttgtgggccaaacgtatccgt

SEQ ID NO: 622550 - DNA, 25 bp, Rattus norvegicus
tgccttgtgggcgaaacgtatccgt

SEQ ID NO: 622551 - DNA, 25 bp, Rattus norvegicus
tgccttgttcctaccgtatttataa

SEQ ID NO: 622552 - DNA, 25 bp, Rattus norvegicus
tgccttgttccttccgtatttataa

SEQ ID NO: 622553 - DNA, 25 bp, Rattus norvegicus
tgccttgtttctagcttagggaact

SEQ ID NO: 622554 - DNA, 25 bp, Rattus norvegicus
tgccttgtttcttgcttagggaact

SEQ ID NO: 622555 - DNA, 25 bp, Rattus norvegicus
tgcctttaagcccatagcccacgga

SEQ ID NO: 622556 - DNA, 25 bp, Rattus norvegicus
tgcctttaagccgatagcccacgga

SEQ ID NO: 622557 - DNA, 25 bp, Rattus norvegicus
tgcctttactcccagtattctggta

SEQ ID NO: 622558 - DNA, 25 bp, Rattus norvegicus
tgcctttactccgagtattctggta

SEQ ID NO: 622559 - DNA, 25 bp, Rattus norvegicus
tgcctttagattccggcttttcttc

SEQ ID NO: 622560 - DNA, 25 bp, Rattus norvegicus
tgcctttagattgcggcttttcttc

SEQ ID NO: 622561 - DNA, 25 bp, Rattus norvegicus
tgcctttagcatatcgattactgta

SEQ ID NO: 622562 - DNA, 25 bp, Rattus norvegicus
tgcctttagcatttcgattactgta

SEQ ID NO: 622563 - DNA, 25 bp, Rattus norvegicus
tgcctttatgaaactccagacctgg

SEQ ID NO: 622564 - DNA, 25 bp, Rattus norvegicus
tgcctttatgaatctccagacctgg

SEQ ID NO: 622565 - DNA, 25 bp, Rattus norvegicus
tgcctttcacggatgtttgaaccca

SEQ ID NO: 622566 - DNA, 25 bp, Rattus norvegicus
tgcctttcacggttgtttgaaccca

SEQ ID NO: 622567 - DNA, 25 bp, Rattus norvegicus
tgcctttcaggacgatggtagaaca

SEQ ID NO: 622568 - DNA, 25 bp, Rattus norvegicus
tgcctttcaggaggatggtagaaca

SEQ ID NO: 622569 - DNA, 25 bp, Rattus norvegicus
tgcctttcatgccttaggttacttc

SEQ ID NO: 622570 - DNA, 25 bp, Rattus norvegicus
tgcctttcatgcgttaggttacttc

SEQ ID NO: 622571 - DNA, 25 bp, Rattus norvegicus
tgcctttccacactgtaactcagaa

SEQ ID NO: 622572 - DNA, 25 bp, Rattus norvegicus
tgcctttccacagtgtaactcagaa

SEQ ID NO: 622573 - DNA, 25 bp, Rattus norvegicus
tgcctttccagtacagctctgaaaa

SEQ ID NO: 622574 - DNA, 25 bp, Rattus norvegicus
tgcctttccagtccattgctttaag

SEQ ID NO: 622575 - DNA, 25 bp, Rattus norvegicus
tgcctttccagtgcattgctttaag

SEQ ID NO: 622576 - DNA, 25 bp, Rattus norvegicus
tgcctttccagttcagctctgaaaa

SEQ ID NO: 622577 - DNA, 25 bp, Rattus norvegicus
tgcctttccgaactgtagactgtca

SEQ ID NO: 622578 - DNA, 25 bp, Rattus norvegicus
tgcctttccgaagtgtagactgtca

SEQ ID NO: 622579 - DNA, 25 bp, Rattus norvegicus
tgcctttcctccaatgaaaatccag

SEQ ID NO: 622580 - DNA, 25 bp, Rattus norvegicus
tgcctttcctcccagggatttgtga

SEQ ID NO: 622581 - DNA, 25 bp, Rattus norvegicus
tgcctttcctccgagggatttgtga

SEQ ID NO: 622582 - DNA, 25 bp, Rattus norvegicus
tgcctttcctcctatgaaaatccag

SEQ ID NO: 622583 - DNA, 25 bp, Rattus norvegicus
tgcctttcctgaaacttttggatct

SEQ ID NO: 622584 - DNA, 25 bp, Rattus norvegicus
tgcctttcctgatacttttggatct

SEQ ID NO: 622585 - DNA, 25 bp, Rattus norvegicus
tgcctttccttcagtgatcagcaag

SEQ ID NO: 622586 - DNA, 25 bp, Rattus norvegicus
tgcctttccttctgtgatcagcaag

SEQ ID NO: 622587 - DNA, 25 bp, Rattus norvegicus
tgcctttctactcatggctgtacga

SEQ ID NO: 622588 - DNA, 25 bp, Rattus norvegicus
tgcctttctactgatggctgtacga

SEQ ID NO: 622589 - DNA, 25 bp, Rattus norvegicus
tgcctttctgcactgttgggattaa

SEQ ID NO: 622590 - DNA, 25 bp, Rattus norvegicus
tgcctttctgcagtgttgggattaa

SEQ ID NO: 622591 - DNA, 25 bp, Rattus norvegicus
tgcctttctgctagttgttgttctc

SEQ ID NO: 622592 - DNA, 25 bp, Rattus norvegicus
tgcctttctgcttgttgttgttctc

SEQ ID NO: 622593 - DNA, 25 bp, Rattus norvegicus
tgcctttctttcataccttaattcc

SEQ ID NO: 622594 - DNA, 25 bp, Rattus norvegicus
tgcctttctttcttaccttaattcc

SEQ ID NO: 622595 - DNA, 25 bp, Rattus norvegicus
tgcctttgaaggcagcgtgcgcaat

SEQ ID NO: 622596 - DNA, 25 bp, Rattus norvegicus
tgcctttgaagggagcgtgcgcaat

SEQ ID NO: 622597 - DNA, 25 bp, Rattus norvegicus
tgcctttgaagtccactcagtcatt

SEQ ID NO: 622598 - DNA, 25 bp, Rattus norvegicus
tgcctttgaagtgcactcagtcatt

SEQ ID NO: 622599 - DNA, 25 bp, Rattus norvegicus
tgcctttgcactcccacagagagga

SEQ ID NO: 622600 - DNA, 25 bp, Rattus norvegicus
tgcctttgcactgccacagagagga

SEQ ID NO: 622601 - DNA, 25 bp, Rattus norvegicus
tgcctttgccaaccccatatggaag

SEQ ID NO: 622602 - DNA, 25 bp, Rattus norvegicus
tgcctttgccaagcccatatggaag

SEQ ID NO: 622603 - DNA, 25 bp, Rattus norvegicus
tgcctttgccagagttttctgggtt

SEQ ID NO: 622604 - DNA, 25 bp, Rattus norvegicus
tgcctttgccagtgttttctgggtt

SEQ ID NO: 622605 - DNA, 25 bp, Rattus norvegicus
tgcctttgcctgcaatcccagaaga

SEQ ID NO: 622606 - DNA, 25 bp, Rattus norvegicus
tgcctttgcctggaatcccagaaga

SEQ ID NO: 622607 - DNA, 25 bp, Rattus norvegicus
tgcctttgcgcaaggtggtacttac

SEQ ID NO: 622608 - DNA, 25 bp, Rattus norvegicus
tgcctttgcgcatggtggtacttac

SEQ ID NO: 622609 - DNA, 25 bp, Rattus norvegicus
tgcctttgctgaacctttctgtgtc

SEQ ID NO: 622610 - DNA, 25 bp, Rattus norvegicus
tgcctttgctgatcctttctgtgtc

SEQ ID NO: 622611 - DNA, 25 bp, Rattus norvegicus
tgcctttgctggcacttgtgcaata

SEQ ID NO: 622612 - DNA, 25 bp, Rattus norvegicus
tgcctttgctgggacttgtgcaata

SEQ ID NO: 622613 - DNA, 25 bp, Rattus norvegicus
tgcctttggagcaggtgccttctgg

SEQ ID NO: 622614 - DNA, 25 bp, Rattus norvegicus
tgcctttggagctggtgccttctgg

SEQ ID NO: 622615 - DNA, 25 bp, Rattus norvegicus
tgcctttggccaattagttcctgga

SEQ ID NO: 622616 - DNA, 25 bp, Rattus norvegicus
tgcctttggccatttagttcctgga

SEQ ID NO: 622617 - DNA, 25 bp, Rattus norvegicus
tgcctttggctaaaattttggaaca

SEQ ID NO: 622618 - DNA, 25 bp, Rattus norvegicus
tgcctttggctataattttggaaca

SEQ ID NO: 622619 - DNA, 25 bp, Rattus norvegicus
tgcctttgggctcatgtgagcagat

SEQ ID NO: 622620 - DNA, 25 bp, Rattus norvegicus
tgcctttgggctgatgtgagcagat

SEQ ID NO: 622621 - DNA, 25 bp, Rattus norvegicus
tgcctttggtctaccagctgatgga

SEQ ID NO: 622622 - DNA, 25 bp, Rattus norvegicus
tgcctttggtcttccagctgatgga

SEQ ID NO: 622623 - DNA, 25 bp, Rattus norvegicus
tgcctttgtggtcggagacagctct

SEQ ID NO: 622624 - DNA, 25 bp, Rattus norvegicus
tgcctttgtggtgggagacagctct

SEQ ID NO: 622625 - DNA, 25 bp, Rattus norvegicus
tgcctttgtgtaaccttttctttct

SEQ ID NO: 622626 - DNA, 25 bp, Rattus norvegicus
tgcctttgtgtatccttttctttct

SEQ ID NO: 622627 - DNA, 25 bp, Rattus norvegicus
tgcctttgtgtcacaataatgtaaa

SEQ ID NO: 622628 - DNA, 25 bp, Rattus norvegicus
tgcctttgtgtcagtccagtgcgat

SEQ ID NO: 622629 - DNA, 25 bp, Rattus norvegicus
tgcctttgtgtctcaataatgtaaa

SEQ ID NO: 622630 - DNA, 25 bp, Rattus norvegicus
tgcctttgtgtctgtccagtgcgat

SEQ ID NO: 622631 - DNA, 25 bp, Rattus norvegicus
tgcctttgttttactgtatgctcaa

SEQ ID NO: 622632 - DNA, 25 bp, Rattus norvegicus
tgcctttgtttttctgtatgctcaa

SEQ ID NO: 622633 - DNA, 25 bp, Rattus norvegicus
tgccttttacttaccgctgagaaca

SEQ ID NO: 622634 - DNA, 25 bp, Rattus norvegicus
tgccttttactttccgctgagaaca

SEQ ID NO: 622635 - DNA, 25 bp, Rattus norvegicus
tgccttttagccaactccacaaagc

SEQ ID NO: 622636 - DNA, 25 bp, Rattus norvegicus
tgccttttagcctactccacaaagc

SEQ ID NO: 622637 - DNA, 25 bp, Rattus norvegicus
tgccttttaggaaccttgcctgtga

SEQ ID NO: 622638 - DNA, 25 bp, Rattus norvegicus
tgccttttaggatccttgcctgtga

SEQ ID NO: 622639 - DNA, 25 bp, Rattus norvegicus
tgccttttattcatcagtcttcaga

SEQ ID NO: 622640 - DNA, 25 bp, Rattus norvegicus
tgccttttattcttcagtcttcaga

SEQ ID NO: 622641 - DNA, 25 bp, Rattus norvegicus
tgccttttcaagatgttcagtccac

SEQ ID NO: 622642 - DNA, 25 bp, Rattus norvegicus
tgccttttcaagttgttcagtccac

SEQ ID NO: 622643 - DNA, 25 bp, Rattus norvegicus
tgccttttcacacaccaagctctaa

SEQ ID NO: 622644 - DNA, 25 bp, Rattus norvegicus
tgccttttcacagaccaagctctaa

SEQ ID NO: 622645 - DNA, 25 bp, Rattus norvegicus
tgccttttcagcacacgttgatttg

SEQ ID NO: 622646 - DNA, 25 bp, Rattus norvegicus
tgccttttcagctcacgttgatttg

SEQ ID NO: 622647 - DNA, 25 bp, Rattus norvegicus
tgccttttcctgactcaatctgaaa

SEQ ID NO: 622648 - DNA, 25 bp, Rattus norvegicus
tgccttttcctgtctcaatctgaaa

SEQ ID NO: 622649 - DNA, 25 bp, Rattus norvegicus
tgccttttcggccaactttggatta

SEQ ID NO: 622650 - DNA, 25 bp, Rattus norvegicus
tgccttttcggcgaactttggatta

SEQ ID NO: 622651 - DNA, 25 bp, Rattus norvegicus
tgccttttctttcagaaagggttga

SEQ ID NO: 622652 - DNA, 25 bp, Rattus norvegicus
tgccttttctttgagaaagggttga

SEQ ID NO: 622653 - DNA, 25 bp, Rattus norvegicus
tgccttttgaaccagcagtgccaca

SEQ ID NO: 622654 - DNA, 25 bp, Rattus norvegicus
tgccttttgaacgagcagtgccaca

SEQ ID NO: 622655 - DNA, 25 bp, Rattus norvegicus
tgccttttgaccaagtaactttctg

SEQ ID NO: 622656 - DNA, 25 bp, Rattus norvegicus
tgccttttgacctagtaactttctg

SEQ ID NO: 622657 - DNA, 25 bp, Rattus norvegicus
tgccttttgcgtcatttgcctggtc

SEQ ID NO: 622658 - DNA, 25 bp, Rattus norvegicus
tgccttttgcgtgatttgcctggtc

SEQ ID NO: 622659 - DNA, 25 bp, Rattus norvegicus
tgccttttgcttaccttgttttgta

SEQ ID NO: 622660 - DNA, 25 bp, Rattus norvegicus
tgccttttgctttccttgttttgta

SEQ ID NO: 622661 - DNA, 25 bp, Rattus norvegicus
tgccttttggaccagcggtgccctg

SEQ ID NO: 622662 - DNA, 25 bp, Rattus norvegicus
tgccttttggacgagcggtgccctg

SEQ ID NO: 622663 - DNA, 25 bp, Rattus norvegicus
tgccttttggcgagcagcatctgaa

SEQ ID NO: 622664 - DNA, 25 bp, Rattus norvegicus
tgccttttggcgtgcagcatctgaa

SEQ ID NO: 622665 - DNA, 25 bp, Rattus norvegicus
tgcctttttagtcagcttcatgcca

SEQ ID NO: 622666 - DNA, 25 bp, Rattus norvegicus
tgcctttttagtgagcttcatgcca

SEQ ID NO: 622667 - DNA, 25 bp, Rattus norvegicus
tgcctttttattcataacccagctg

SEQ ID NO: 622668 - DNA, 25 bp, Rattus norvegicus
tgcctttttattgataacccagctg

SEQ ID NO: 622669 - DNA, 25 bp, Rattus norvegicus
tgcctttttgttacaggatcctttt

SEQ ID NO: 622670 - DNA, 25 bp, Rattus norvegicus
tgcctttttgtttcaggatcctttt

SEQ ID NO: 622671 - DNA, 25 bp, Rattus norvegicus
tgcgaaagtcgacatcctggtgcca

SEQ ID NO: 622672 - DNA, 25 bp, Rattus norvegicus
tgcgaaagtcgagatcctggtgcca

SEQ ID NO: 622673 - DNA, 25 bp, Rattus norvegicus
tgcgaaagttcgagagcctcatctt

SEQ ID NO: 622674 - DNA, 25 bp, Rattus norvegicus
tgcgaaagttcgtgagcctcatctt

SEQ ID NO: 622675 - DNA, 25 bp, Rattus norvegicus
tgcgaaatctgcaagcacagtcacc

SEQ ID NO: 622676 - DNA, 25 bp, Rattus norvegicus
tgcgaaatctgctagcacagtcacc

SEQ ID NO: 622677 - DNA, 25 bp, Rattus norvegicus
tgcgaacagaacctgaccaccgtgg

SEQ ID NO: 622678 - DNA, 25 bp, Rattus norvegicus
tgcgaacagaacgtgaccaccgtgg

SEQ ID NO: 622679 - DNA, 25 bp, Rattus norvegicus
tgcgaaccagaacaccccaaagaag

SEQ ID NO: 622680 - DNA, 25 bp, Rattus norvegicus
tgcgaaccagaagaccccaaagaag

SEQ ID NO: 622681 - DNA, 25 bp, Rattus norvegicus
tgcgaaccagttagggctcccaggg

SEQ ID NO: 622682 - DNA, 25 bp, Rattus norvegicus
tgcgaaccagtttgggctcccaggg

SEQ ID NO: 622683 - DNA, 25 bp, Rattus norvegicus
tgcgaaccgtcgaggcagtgattct

SEQ ID NO: 622684 - DNA, 25 bp, Rattus norvegicus
tgcgaaccgtcgtggcagtgattct

SEQ ID NO: 622685 - DNA, 25 bp, Rattus norvegicus
tgcgaacctaacagccatatttatg

SEQ ID NO: 622686 - DNA, 25 bp, Rattus norvegicus
tgcgaacctaactgccatatttatg

SEQ ID NO: 622687 - DNA, 25 bp, Rattus norvegicus
tgcgaacctcgacgatcactctcag

SEQ ID NO: 622688 - DNA, 25 bp, Rattus norvegicus
tgcgaacctcgaggatcactctcag

SEQ ID NO: 622689 - DNA, 25 bp, Rattus norvegicus
tgcgaacctgtgaggagacctctca

SEQ ID NO: 622690 - DNA, 25 bp, Rattus norvegicus
tgcgaacctgtgtggagacctctca

SEQ ID NO: 622691 - DNA, 25 bp, Rattus norvegicus
tgcgaacctttccagactgctcaaa

SEQ ID NO: 622692 - DNA, 25 bp, Rattus norvegicus
tgcgaacctttcgagactgctcaaa

SEQ ID NO: 622693 - DNA, 25 bp, Rattus norvegicus
tgcgaactgtgccttgatgataccc

SEQ ID NO: 622694 - DNA, 25 bp, Rattus norvegicus
tgcgaactgtgcgttgatgataccc

SEQ ID NO: 622695 - DNA, 25 bp, Rattus norvegicus
tgcgaagaagccaagtcaccggccg

SEQ ID NO: 622696 - DNA, 25 bp, Rattus norvegicus
tgcgaagaagcctagtcaccggccg

SEQ ID NO: 622697 - DNA, 25 bp, Rattus norvegicus
tgcgaagacctcattggccagtagt

SEQ ID NO: 622698 - DNA, 25 bp, Rattus norvegicus
tgcgaagacctctttggccagtagt

SEQ ID NO: 622699 - DNA, 25 bp, Rattus norvegicus
tgcgaagactctctctggaggttca

SEQ ID NO: 622700 - DNA, 25 bp, Rattus norvegicus
tgcgaagactctgtctggaggttca

SEQ ID NO: 622701 - DNA, 25 bp, Rattus norvegicus
tgcgaagcaagccttacagaatgaa

SEQ ID NO: 622702 - DNA, 25 bp, Rattus norvegicus
tgcgaagcaagcgttacagaatgaa

SEQ ID NO: 622703 - DNA, 25 bp, Rattus norvegicus
tgcgaagcgcaaacgttttagaaag

SEQ ID NO: 622704 - DNA, 25 bp, Rattus norvegicus
tgcgaagcgcaatcgttttagaaag

SEQ ID NO: 622705 - DNA, 25 bp, Rattus norvegicus
tgcgaagtcttccatcttgttagat

SEQ ID NO: 622706 - DNA, 25 bp, Rattus norvegicus
tgcgaagtcttcgatcttgttagat

SEQ ID NO: 622707 - DNA, 25 bp, Rattus norvegicus
tgcgaatagctcatgcatcccaagt

SEQ ID NO: 622708 - DNA, 25 bp, Rattus norvegicus
tgcgaatagctcttgcatcccaagt

SEQ ID NO: 622709 - DNA, 25 bp, Rattus norvegicus
tgcgaattctccatacctagctaca

SEQ ID NO: 622710 - DNA, 25 bp, Rattus norvegicus
tgcgaattctccttacctagctaca

SEQ ID NO: 622711 - DNA, 25 bp, Rattus norvegicus
tgcgaattctggattatagcctaaa

SEQ ID NO: 622712 - DNA, 25 bp, Rattus norvegicus
tgcgaattctggtttatagcctaaa

SEQ ID NO: 622713 - DNA, 25 bp, Rattus norvegicus
tgcgacaagtatcgccaggcgctga

SEQ ID NO: 622714 - DNA, 25 bp, Rattus norvegicus
tgcgacaagtatggccaggcgctga

SEQ ID NO: 622715 - DNA, 25 bp, Rattus norvegicus
tgcgacaatggcaccggactggtga

SEQ ID NO: 622716 - DNA, 25 bp, Rattus norvegicus
tgcgacaatggctccggactggtga

SEQ ID NO: 622717 - DNA, 25 bp, Rattus norvegicus
tgcgacactacaacaatctcatcac

SEQ ID NO: 622718 - DNA, 25 bp, Rattus norvegicus
tgcgacactacatcaatctcatcac

SEQ ID NO: 622719 - DNA, 25 bp, Rattus norvegicus
tgcgacactccacacgagaggctaa

SEQ ID NO: 622720 - DNA, 25 bp, Rattus norvegicus
tgcgacactccagacgagaggctaa

SEQ ID NO: 622721 - DNA, 25 bp, Rattus norvegicus
tgcgacagcagacctcagattccaa

SEQ ID NO: 622722 - DNA, 25 bp, Rattus norvegicus
tgcgacagcagagctcagattccaa

SEQ ID NO: 622723 - DNA, 25 bp, Rattus norvegicus
tgcgacagtgtcagtagcctgccta

SEQ ID NO: 622724 - DNA, 25 bp, Rattus norvegicus
tgcgacagtgtctgtagcctgccta

SEQ ID NO: 622725 - DNA, 25 bp, Rattus norvegicus
tgcgaccactacagcctgaggaaga

SEQ ID NO: 622726 - DNA, 25 bp, Rattus norvegicus
tgcgaccactactgcctgaggaaga

SEQ ID NO: 622727 - DNA, 25 bp, Rattus norvegicus
tgcgacccggagcactggccccgaa

SEQ ID NO: 622728 - DNA, 25 bp, Rattus norvegicus
tgcgacccggaggactggccccgaa

SEQ ID NO: 622729 - DNA, 25 bp, Rattus norvegicus
tgcgaccctgacactgaagcagttc

SEQ ID NO: 622730 - DNA, 25 bp, Rattus norvegicus
tgcgaccctgactctgaagcagttc

SEQ ID NO: 622731 - DNA, 25 bp, Rattus norvegicus
tgcgaccctggcctttgataaagtt

SEQ ID NO: 622732 - DNA, 25 bp, Rattus norvegicus
tgcgaccctggcgtttgataaagtt

SEQ ID NO: 622733 - DNA, 25 bp, Rattus norvegicus
tgcgacgcttccacatgagcaaaga

SEQ ID NO: 622734 - DNA, 25 bp, Rattus norvegicus
tgcgacgcttcctcatgagcaaaga

SEQ ID NO: 622735 - DNA, 25 bp, Rattus norvegicus
tgcgacgtcttccagcatttcctga

SEQ ID NO: 622736 - DNA, 25 bp, Rattus norvegicus
tgcgacgtcttcgagcatttcctga

SEQ ID NO: 622737 - DNA, 25 bp, Rattus norvegicus
tgcgactaccatagtctgcttctgc

SEQ ID NO: 622738 - DNA, 25 bp, Rattus norvegicus
tgcgactaccattgtctgcttctgc

SEQ ID NO: 622739 - DNA, 25 bp, Rattus norvegicus
tgcgactcatggaggaggcgtcctt

SEQ ID NO: 622740 - DNA, 25 bp, Rattus norvegicus
tgcgactcatggtggaggcgtcctt

SEQ ID NO: 622741 - DNA, 25 bp, Rattus norvegicus
tgcgactccgccaactaggagagtt

SEQ ID NO: 622742 - DNA, 25 bp, Rattus norvegicus
tgcgactccgcctactaggagagtt

SEQ ID NO: 622743 - DNA, 25 bp, Rattus norvegicus
tgcgactgcccgacatatgtcatga

SEQ ID NO: 622744 - DNA, 25 bp, Rattus norvegicus
tgcgactgcccgtcatatgtcatga

SEQ ID NO: 622745 - DNA, 25 bp, Rattus norvegicus
tgcgactgctctcttaatattgcca

SEQ ID NO: 622746 - DNA, 25 bp, Rattus norvegicus
tgcgactgctctgttaatattgcca

SEQ ID NO: 622747 - DNA, 25 bp, Rattus norvegicus
tgcgactggcacactggactgcaaa

SEQ ID NO: 622748 - DNA, 25 bp, Rattus norvegicus
tgcgactggcactctggactgcaaa

SEQ ID NO: 622749 - DNA, 25 bp, Rattus norvegicus
tgcgacttaactcgtacccaagccg

SEQ ID NO: 622750 - DNA, 25 bp, Rattus norvegicus
tgcgacttaactggtacccaagccg

SEQ ID NO: 622751 - DNA, 25 bp, Rattus norvegicus
tgcgacttccaccaggacgattctg

SEQ ID NO: 622752 - DNA, 25 bp, Rattus norvegicus
tgcgacttccacgaggacgattctg

SEQ ID NO: 622753 - DNA, 25 bp, Rattus norvegicus
tgcgacttctttatggctctcgtga

SEQ ID NO: 622754 - DNA, 25 bp, Rattus norvegicus
tgcgacttctttttggctctcgtga

SEQ ID NO: 622755 - DNA, 25 bp, Rattus norvegicus
tgcgagagggcgcaccgggtcagct

SEQ ID NO: 622756 - DNA, 25 bp, Rattus norvegicus
tgcgagagggcggaccgggtcagct

SEQ ID NO: 622757 - DNA, 25 bp, Rattus norvegicus
tgcgagagttgaaccagcacctgcg

SEQ ID NO: 622758 - DNA, 25 bp, Rattus norvegicus
tgcgagagttgatccagcacctgcg

SEQ ID NO: 622759 - DNA, 25 bp, Rattus norvegicus
tgcgagcacatgaatgcacgccatg

SEQ ID NO: 622760 - DNA, 25 bp, Rattus norvegicus
tgcgagcacatgtatgcacgccatg

SEQ ID NO: 622761 - DNA, 25 bp, Rattus norvegicus
tgcgagcactgcagcctgttttcag

SEQ ID NO: 622762 - DNA, 25 bp, Rattus norvegicus
tgcgagcactgctgcctgttttcag

SEQ ID NO: 622763 - DNA, 25 bp, Rattus norvegicus
tgcgagcagattatgggagccctac

SEQ ID NO: 622764 - DNA, 25 bp, Rattus norvegicus
tgcgagcagattttgggagccctac

SEQ ID NO: 622765 - DNA, 25 bp, Rattus norvegicus
tgcgagcattgcagttgtttttgtt

SEQ ID NO: 622766 - DNA, 25 bp, Rattus norvegicus
tgcgagcattgctgttgtttttgtt

SEQ ID NO: 622767 - DNA, 25 bp, Rattus norvegicus
tgcgagccacacagagagcctggag

SEQ ID NO: 622768 - DNA, 25 bp, Rattus norvegicus
tgcgagccacactgagagcctggag

SEQ ID NO: 622769 - DNA, 25 bp, Rattus norvegicus
tgcgagcccattcagagcgtctatt

SEQ ID NO: 622770 - DNA, 25 bp, Rattus norvegicus
tgcgagcccattgagagcgtctatt

SEQ ID NO: 622771 - DNA, 25 bp, Rattus norvegicus
tgcgagcctcagatcagactgcgga

SEQ ID NO: 622772 - DNA, 25 bp, Rattus norvegicus
tgcgagcctcagttcagactgcgga

SEQ ID NO: 622773 - DNA, 25 bp, Rattus norvegicus
tgcgagctgccaaacccagaacagg

SEQ ID NO: 622774 - DNA, 25 bp, Rattus norvegicus
tgcgagctgccatacccagaacagg

SEQ ID NO: 622775 - DNA, 25 bp, Rattus norvegicus
tgcgaggacaagcacgagaagtcaa

SEQ ID NO: 622776 - DNA, 25 bp, Rattus norvegicus
tgcgaggacaaggacgagaagtcaa

SEQ ID NO: 622777 - DNA, 25 bp, Rattus norvegicus
tgcgaggatcccctctggctaacct

SEQ ID NO: 622778 - DNA, 25 bp, Rattus norvegicus
tgcgaggatcccgtctggctaacct

SEQ ID NO: 622779 - DNA, 25 bp, Rattus norvegicus
tgcgaggtccggactttgccaggat

SEQ ID NO: 622780 - DNA, 25 bp, Rattus norvegicus
tgcgaggtccggtctttgccaggat

SEQ ID NO: 622781 - DNA, 25 bp, Rattus norvegicus
tgcgaggttataaacatgatgggcc

SEQ ID NO: 622782 - DNA, 25 bp, Rattus norvegicus
tgcgaggttatatacatgatgggcc

SEQ ID NO: 622783 - DNA, 25 bp, Rattus norvegicus
tgcgagtcactccatatatcttaaa

SEQ ID NO: 622784 - DNA, 25 bp, Rattus norvegicus
tgcgagtcactcgatatatcttaaa

SEQ ID NO: 622785 - DNA, 25 bp, Rattus norvegicus
tgcgagtcatccagctggtgcgcga

SEQ ID NO: 622786 - DNA, 25 bp, Rattus norvegicus
tgcgagtcatcctgctggtgcgcga

SEQ ID NO: 622787 - DNA, 25 bp, Rattus norvegicus
tgcgagtcgagtcaagcctagctta

SEQ ID NO: 622788 - DNA, 25 bp, Rattus norvegicus
tgcgagtcgagtgaagcctagctta

SEQ ID NO: 622789 - DNA, 25 bp, Rattus norvegicus
tgcgagtgcagccagctagctcttt

SEQ ID NO: 622790 - DNA, 25 bp, Rattus norvegicus
tgcgagtgcagcgagctagctcttt

SEQ ID NO: 622791 - DNA, 25 bp, Rattus norvegicus
tgcgagttccaaatgtgtgcacaac

SEQ ID NO: 622792 - DNA, 25 bp, Rattus norvegicus
tgcgagttccaattgtgtgcacaac

SEQ ID NO: 622793 - DNA, 25 bp, Rattus norvegicus
tgcgagttctccatgtcggacgccc

SEQ ID NO: 622794 - DNA, 25 bp, Rattus norvegicus
tgcgagttctccttgtcggacgccc

SEQ ID NO: 622795 - DNA, 25 bp, Rattus norvegicus
tgcgagttgcctcagatctaacacc

SEQ ID NO: 622796 - DNA, 25 bp, Rattus norvegicus
tgcgagttgcctgagatctaacacc

SEQ ID NO: 622797 - DNA, 25 bp, Rattus norvegicus
tgcgatactgaacatgcaccgctat

SEQ ID NO: 622798 - DNA, 25 bp, Rattus norvegicus
tgcgatactgaagatgcaccgctat

SEQ ID NO: 622799 - DNA, 25 bp, Rattus norvegicus
tgcgatatgaaccactgctacactc

SEQ ID NO: 622800 - DNA, 25 bp, Rattus norvegicus
tgcgatatgaacgactgctacactc

SEQ ID NO: 622801 - DNA, 25 bp, Rattus norvegicus
tgcgatatttttaaatgaccctcaa

SEQ ID NO: 622802 - DNA, 25 bp, Rattus norvegicus
tgcgatattttttaatgaccctcaa

SEQ ID NO: 622803 - DNA, 25 bp, Rattus norvegicus
tgcgatccagggagccagtgctaat

SEQ ID NO: 622804 - DNA, 25 bp, Rattus norvegicus
tgcgatccagggtgccagtgctaat

SEQ ID NO: 622805 - DNA, 25 bp, Rattus norvegicus
tgcgatcggtggctttcccatgcat

SEQ ID NO: 622806 - DNA, 25 bp, Rattus norvegicus
tgcgatcggtgggtttcccatgcat

SEQ ID NO: 622807 - DNA, 25 bp, Rattus norvegicus
tgcgatctgagtacacattcctgtg

SEQ ID NO: 622808 - DNA, 25 bp, Rattus norvegicus
tgcgatctgagttcacattcctgtg

SEQ ID NO: 622809 - DNA, 25 bp, Rattus norvegicus
tgcgatctttgcactgtgacgaaac

SEQ ID NO: 622810 - DNA, 25 bp, Rattus norvegicus
tgcgatctttgctctgtgacgaaac

SEQ ID NO: 622811 - DNA, 25 bp, Rattus norvegicus
tgcgatgcctggaagacttggcctc

SEQ ID NO: 622812 - DNA, 25 bp, Rattus norvegicus
tgcgatgcctggtagacttggcctc

SEQ ID NO: 622813 - DNA, 25 bp, Rattus norvegicus
tgcgatggcttgctgtgtaaagtca

SEQ ID NO: 622814 - DNA, 25 bp, Rattus norvegicus
tgcgatggcttggtgtgtaaagtca

SEQ ID NO: 622815 - DNA, 25 bp, Rattus norvegicus
tgcgatgtcatcatgggcctggtga

SEQ ID NO: 622816 - DNA, 25 bp, Rattus norvegicus
tgcgatgtcatcttgggcctggtga

SEQ ID NO: 622817 - DNA, 25 bp, Rattus norvegicus
tgcgcaaacctacccgtacatgttg

SEQ ID NO: 622818 - DNA, 25 bp, Rattus norvegicus
tgcgcaaacctagccgtacatgttg

SEQ ID NO: 622819 - DNA, 25 bp, Rattus norvegicus
tgcgcaacagctcgccgtcaatttc

SEQ ID NO: 622820 - DNA, 25 bp, Rattus norvegicus
tgcgcaacagctggccgtcaatttc

SEQ ID NO: 622821 - DNA, 25 bp, Rattus norvegicus
tgcgcaacgtgccttctttgtgagg

SEQ ID NO: 622822 - DNA, 25 bp, Rattus norvegicus
tgcgcaacgtgcgttctttgtgagg

SEQ ID NO: 622823 - DNA, 25 bp, Rattus norvegicus
tgcgcaagagcccagataaagccaa

SEQ ID NO: 622824 - DNA, 25 bp, Rattus norvegicus
tgcgcaagagccgagataaagccaa

SEQ ID NO: 622825 - DNA, 25 bp, Rattus norvegicus
tgcgcaagctggagaagcagaacga

SEQ ID NO: 622826 - DNA, 25 bp, Rattus norvegicus
tgcgcaagctggtgaagcagaacga

SEQ ID NO: 622827 - DNA, 25 bp, Rattus norvegicus
tgcgcaatgatcaccaagcctcagg

SEQ ID NO: 622828 - DNA, 25 bp, Rattus norvegicus
tgcgcaatgatctccaagcctcagg

SEQ ID NO: 622829 - DNA, 25 bp, Rattus norvegicus
tgcgcaatgcttcccgtaaggataa

SEQ ID NO: 622830 - DNA, 25 bp, Rattus norvegicus
tgcgcaatgcttgccgtaaggataa

SEQ ID NO: 622831 - DNA, 25 bp, Rattus norvegicus
tgcgcacaagtgcacatgtagggta

SEQ ID NO: 622832 - DNA, 25 bp, Rattus norvegicus
tgcgcacaagtggacatgtagggta

SEQ ID NO: 622833 - DNA, 25 bp, Rattus norvegicus
tgcgcacatcttaccaatagccaat

SEQ ID NO: 622834 - DNA, 25 bp, Rattus norvegicus
tgcgcacatctttccaatagccaat

SEQ ID NO: 622835 - DNA, 25 bp, Rattus norvegicus
tgcgcaccatacaggtctacagacg

SEQ ID NO: 622836 - DNA, 25 bp, Rattus norvegicus
tgcgcaccatactggtctacagacg

SEQ ID NO: 622837 - DNA, 25 bp, Rattus norvegicus
tgcgcaccatgtactttgcttgaca

SEQ ID NO: 622838 - DNA, 25 bp, Rattus norvegicus
tgcgcaccatgttctttgcttgaca

SEQ ID NO: 622839 - DNA, 25 bp, Rattus norvegicus
tgcgcacgctaaccaactgtcctag

SEQ ID NO: 622840 - DNA, 25 bp, Rattus norvegicus
tgcgcacgctaagcaactgtcctag

SEQ ID NO: 622841 - DNA, 25 bp, Rattus norvegicus
tgcgcacgctttagctcagtgaaaa

SEQ ID NO: 622842 - DNA, 25 bp, Rattus norvegicus
tgcgcacgcttttgctcagtgaaaa

SEQ ID NO: 622843 - DNA, 25 bp, Rattus norvegicus
tgcgcacgttgcagtctaagcttgt

SEQ ID NO: 622844 - DNA, 25 bp, Rattus norvegicus
tgcgcacgttgctgtctaagcttgt

SEQ ID NO: 622845 - DNA, 25 bp, Rattus norvegicus
tgcgcactccatccagatcatgaag

SEQ ID NO: 622846 - DNA, 25 bp, Rattus norvegicus
tgcgcactccatgcagatcatgaag

SEQ ID NO: 622847 - DNA, 25 bp, Rattus norvegicus
tgcgcactgaggccgggagcggaga

SEQ ID NO: 622848 - DNA, 25 bp, Rattus norvegicus
tgcgcactgagggcgggagcggaga

SEQ ID NO: 622849 - DNA, 25 bp, Rattus norvegicus
tgcgcactggttcgcggcagctcaa

SEQ ID NO: 622850 - DNA, 25 bp, Rattus norvegicus
tgcgcactggttggcggcagctcaa

SEQ ID NO: 622851 - DNA, 25 bp, Rattus norvegicus
tgcgcagacgctagaaacgatgtga

SEQ ID NO: 622852 - DNA, 25 bp, Rattus norvegicus
tgcgcagacgcttgaaacgatgtga

SEQ ID NO: 622853 - DNA, 25 bp, Rattus norvegicus
tgcgcagagctacgatgccttcttt

SEQ ID NO: 622854 - DNA, 25 bp, Rattus norvegicus
tgcgcagagctaggatgccttcttt

SEQ ID NO: 622855 - DNA, 25 bp, Rattus norvegicus
tgcgcagatctcatggacgccagat

SEQ ID NO: 622856 - DNA, 25 bp, Rattus norvegicus
tgcgcagatctcttggacgccagat

SEQ ID NO: 622857 - DNA, 25 bp, Rattus norvegicus
tgcgcagattctcctgtagcacaaa

SEQ ID NO: 622858 - DNA, 25 bp, Rattus norvegicus
tgcgcagattctgctgtagcacaaa

SEQ ID NO: 622859 - DNA, 25 bp, Rattus norvegicus
tgcgcagcctggagcaggatctcaa

SEQ ID NO: 622860 - DNA, 25 bp, Rattus norvegicus
tgcgcagcctggtgcaggatctcaa

SEQ ID NO: 622861 - DNA, 25 bp, Rattus norvegicus
tgcgcagcgggaagtcggcccctgg

SEQ ID NO: 622862 - DNA, 25 bp, Rattus norvegicus
tgcgcagcgggatgtcggcccctgg

SEQ ID NO: 622863 - DNA, 25 bp, Rattus norvegicus
tgcgcagcgtggacaccgaggaatt

SEQ ID NO: 622864 - DNA, 25 bp, Rattus norvegicus
tgcgcagcgtggtcaccgaggaatt

SEQ ID NO: 622865 - DNA, 25 bp, Rattus norvegicus
tgcgcaggaaccagcagccagggcc

SEQ ID NO: 622866 - DNA, 25 bp, Rattus norvegicus
tgcgcaggaacctgcagccagggcc

SEQ ID NO: 622867 - DNA, 25 bp, Rattus norvegicus
tgcgcaggcaagatcccaaaggtct

SEQ ID NO: 622868 - DNA, 25 bp, Rattus norvegicus
tgcgcaggcaagttcccaaaggtct

SEQ ID NO: 622869 - DNA, 25 bp, Rattus norvegicus
tgcgcaggcatgagtgtgcacacaa

SEQ ID NO: 622870 - DNA, 25 bp, Rattus norvegicus
tgcgcaggcatgtgtgtgcacacaa

SEQ ID NO: 622871 - DNA, 25 bp, Rattus norvegicus
tgcgcagggcacacagatcatttct

SEQ ID NO: 622872 - DNA, 25 bp, Rattus norvegicus
tgcgcagggcactcagatcatttct

SEQ ID NO: 622873 - DNA, 25 bp, Rattus norvegicus
tgcgcagtcgcactgtgtctcagcc

SEQ ID NO: 622874 - DNA, 25 bp, Rattus norvegicus
tgcgcagtcgcagtgtgtctcagcc

SEQ ID NO: 622875 - DNA, 25 bp, Rattus norvegicus
tgcgcagtgataattccgcggccta

SEQ ID NO: 622876 - DNA, 25 bp, Rattus norvegicus
tgcgcagtgatatttccgcggccta

SEQ ID NO: 622877 - DNA, 25 bp, Rattus norvegicus
tgcgcagtgcccatcacacatgagg

SEQ ID NO: 622878 - DNA, 25 bp, Rattus norvegicus
tgcgcagtgcccttcacacatgagg

SEQ ID NO: 622879 - DNA, 25 bp, Rattus norvegicus
tgcgcagtgggcagctgcttcagta

SEQ ID NO: 622880 - DNA, 25 bp, Rattus norvegicus
tgcgcagtgggctgctgcttcagta

SEQ ID NO: 622881 - DNA, 25 bp, Rattus norvegicus
tgcgcatacagaagtgtgggcccgt

SEQ ID NO: 622882 - DNA, 25 bp, Rattus norvegicus
tgcgcatacagatgtgtgggcccgt

SEQ ID NO: 622883 - DNA, 25 bp, Rattus norvegicus
tgcgcatagtatccggcccgggttt

SEQ ID NO: 622884 - DNA, 25 bp, Rattus norvegicus
tgcgcatagtatgcggcccgggttt

SEQ ID NO: 622885 - DNA, 25 bp, Rattus norvegicus
tgcgcatgatcgactttgcacacac

SEQ ID NO: 622886 - DNA, 25 bp, Rattus norvegicus
tgcgcatgatcgtctttgcacacac

SEQ ID NO: 622887 - DNA, 25 bp, Rattus norvegicus
tgcgcatgatctccagtttcctgag

SEQ ID NO: 622888 - DNA, 25 bp, Rattus norvegicus
tgcgcatgatctgcagtttcctgag

SEQ ID NO: 622889 - DNA, 25 bp, Rattus norvegicus
tgcgcatgcgtacggtcgtttcgac

SEQ ID NO: 622890 - DNA, 25 bp, Rattus norvegicus
tgcgcatgcgtagggtcgtttcgac

SEQ ID NO: 622891 - DNA, 25 bp, Rattus norvegicus
tgcgcatgcgttctggagcttgaca

SEQ ID NO: 622892 - DNA, 25 bp, Rattus norvegicus
tgcgcatgcgttgtggagcttgaca

SEQ ID NO: 622893 - DNA, 25 bp, Rattus norvegicus
tgcgcatggaaacctctgccaagat

SEQ ID NO: 622894 - DNA, 25 bp, Rattus norvegicus
tgcgcatggaaagctctgccaagat

SEQ ID NO: 622895 - DNA, 25 bp, Rattus norvegicus
tgcgcattagctatcctgatctgca

SEQ ID NO: 622896 - DNA, 25 bp, Rattus norvegicus
tgcgcattagctttcctgatctgca

SEQ ID NO: 622897 - DNA, 25 bp, Rattus norvegicus
tgcgcatttcttcttgcatctaaaa

SEQ ID NO: 622898 - DNA, 25 bp, Rattus norvegicus
tgcgcatttcttgttgcatctaaaa

SEQ ID NO: 622899 - DNA, 25 bp, Rattus norvegicus
tgcgccaacattcagtttcctgcat

SEQ ID NO: 622900 - DNA, 25 bp, Rattus norvegicus
tgcgccaacattgagtttcctgcat

SEQ ID NO: 622901 - DNA, 25 bp, Rattus norvegicus
tgcgccacagcacaaaagacccaaa

SEQ ID NO: 622902 - DNA, 25 bp, Rattus norvegicus
tgcgccacagcagaaaagacccaaa

SEQ ID NO: 622903 - DNA, 25 bp, Rattus norvegicus
tgcgccacatcaaggtcatctggga

SEQ ID NO: 622904 - DNA, 25 bp, Rattus norvegicus
tgcgccacatcatggtcatctggga

SEQ ID NO: 622905 - DNA, 25 bp, Rattus norvegicus
tgcgccaccactccctagaaagaaa

SEQ ID NO: 622906 - DNA, 25 bp, Rattus norvegicus
tgcgccaccactgcctagaaagaaa

SEQ ID NO: 622907 - DNA, 25 bp, Rattus norvegicus
tgcgccaccggcaggctacgcggtt

SEQ ID NO: 622908 - DNA, 25 bp, Rattus norvegicus
tgcgccaccggctggctacgcggtt

SEQ ID NO: 622909 - DNA, 25 bp, Rattus norvegicus
tgcgccacgaccatctggctttgtg

SEQ ID NO: 622910 - DNA, 25 bp, Rattus norvegicus
tgcgccacgaccttctggctttgtg

SEQ ID NO: 622911 - DNA, 25 bp, Rattus norvegicus
tgcgccacgcgcagagaccaaggct

SEQ ID NO: 622912 - DNA, 25 bp, Rattus norvegicus
tgcgccacgcgctgagaccaaggct

SEQ ID NO: 622913 - DNA, 25 bp, Rattus norvegicus
tgcgccactacgaggacatggtggt

SEQ ID NO: 622914 - DNA, 25 bp, Rattus norvegicus
tgcgccactacgtggacatggtggt

SEQ ID NO: 622915 - DNA, 25 bp, Rattus norvegicus
tgcgccagcttcattttctgtgtat

SEQ ID NO: 622916 - DNA, 25 bp, Rattus norvegicus
tgcgccagcttctttttctgtgtat

SEQ ID NO: 622917 - DNA, 25 bp, Rattus norvegicus
tgcgccaggtccacgggtcccaaga

SEQ ID NO: 622918 - DNA, 25 bp, Rattus norvegicus
tgcgccaggtcctcgggtcccaaga

SEQ ID NO: 622919 - DNA, 25 bp, Rattus norvegicus
tgcgccagtggcacacaaatcatgg

SEQ ID NO: 622920 - DNA, 25 bp, Rattus norvegicus
tgcgccagtggctcacaaatcatgg

SEQ ID NO: 622921 - DNA, 25 bp, Rattus norvegicus
tgcgccatatttactagggttaccc

SEQ ID NO: 622922 - DNA, 25 bp, Rattus norvegicus
tgcgccatattttctagggttaccc

SEQ ID NO: 622923 - DNA, 25 bp, Rattus norvegicus
tgcgccatccgcaggagccgagaaa

SEQ ID NO: 622924 - DNA, 25 bp, Rattus norvegicus
tgcgccatccgctggagccgagaaa

SEQ ID NO: 622925 - DNA, 25 bp, Rattus norvegicus
tgcgccatctgcagggtccaggtga

SEQ ID NO: 622926 - DNA, 25 bp, Rattus norvegicus
tgcgccatctgctgggtccaggtga

SEQ ID NO: 622927 - DNA, 25 bp, Rattus norvegicus
tgcgccatctggactgtttttattt

SEQ ID NO: 622928 - DNA, 25 bp, Rattus norvegicus
tgcgccatctggtctgtttttattt

SEQ ID NO: 622929 - DNA, 25 bp, Rattus norvegicus
tgcgccatgcacattctcaataaat

SEQ ID NO: 622930 - DNA, 25 bp, Rattus norvegicus
tgcgccatgcactttctcaataaat

SEQ ID NO: 622931 - DNA, 25 bp, Rattus norvegicus
tgcgccatgctgcactgttttggga

SEQ ID NO: 622932 - DNA, 25 bp, Rattus norvegicus
tgcgccatgctggactgttttggga

SEQ ID NO: 622933 - DNA, 25 bp, Rattus norvegicus
tgcgcccacagcctagagaactgta

SEQ ID NO: 622934 - DNA, 25 bp, Rattus norvegicus
tgcgcccacagcgtagagaactgta

SEQ ID NO: 622935 - DNA, 25 bp, Rattus norvegicus
tgcgcccagagcagaccctatgtca

SEQ ID NO: 622936 - DNA, 25 bp, Rattus norvegicus
tgcgcccagagctgaccctatgtca

SEQ ID NO: 622937 - DNA, 25 bp, Rattus norvegicus
tgcgccccaaaacgtaccagtgaaa

SEQ ID NO: 622938 - DNA, 25 bp, Rattus norvegicus
tgcgccccaaaaggtaccagtgaaa

SEQ ID NO: 622939 - DNA, 25 bp, Rattus norvegicus
tgcgccccaataaagtggagccctg

SEQ ID NO: 622940 - DNA, 25 bp, Rattus norvegicus
tgcgccccaatatagtggagccctg

SEQ ID NO: 622941 - DNA, 25 bp, Rattus norvegicus
tgcgccccactgatgttttgtacat

SEQ ID NO: 622942 - DNA, 25 bp, Rattus norvegicus
tgcgccccactgttgttttgtacat

SEQ ID NO: 622943 - DNA, 25 bp, Rattus norvegicus
tgcgccccaggtacctagagataag

SEQ ID NO: 622944 - DNA, 25 bp, Rattus norvegicus
tgcgccccaggttcctagagataag

SEQ ID NO: 622945 - DNA, 25 bp, Rattus norvegicus
tgcgcccctacaaggtgtcagatat

SEQ ID NO: 622946 - DNA, 25 bp, Rattus norvegicus
tgcgcccctacatggtgtcagatat

SEQ ID NO: 622947 - DNA, 25 bp, Rattus norvegicus
tgcgcccctggaaagtgatatgccc

SEQ ID NO: 622948 - DNA, 25 bp, Rattus norvegicus
tgcgcccctggatagtgatatgccc

SEQ ID NO: 622949 - DNA, 25 bp, Rattus norvegicus
tgcgcccctgttagctcataaagtc

SEQ ID NO: 622950 - DNA, 25 bp, Rattus norvegicus
tgcgcccctgtttgctcataaagtc

SEQ ID NO: 622951 - DNA, 25 bp, Rattus norvegicus
tgcgccccttgcagtgagttaatgc

SEQ ID NO: 622952 - DNA, 25 bp, Rattus norvegicus
tgcgccccttgctgtgagttaatgc

SEQ ID NO: 622953 - DNA, 25 bp, Rattus norvegicus
tgcgcccggatcaggatgcgcctca

SEQ ID NO: 622954 - DNA, 25 bp, Rattus norvegicus
tgcgcccggatctggatgcgcctca

SEQ ID NO: 622955 - DNA, 25 bp, Rattus norvegicus
tgcgccctcaacagagtggctaata

SEQ ID NO: 622956 - DNA, 25 bp, Rattus norvegicus
tgcgccctcaactgagtggctaata

SEQ ID NO: 622957 - DNA, 25 bp, Rattus norvegicus
tgcgccctctagaggtgaattgaca

SEQ ID NO: 622958 - DNA, 25 bp, Rattus norvegicus
tgcgccctctagtggtgaattgaca

SEQ ID NO: 622959 - DNA, 25 bp, Rattus norvegicus
tgcgccctgtaccacactgggaagt

SEQ ID NO: 622960 - DNA, 25 bp, Rattus norvegicus
tgcgccctgtacgacactgggaagt

SEQ ID NO: 622961 - DNA, 25 bp, Rattus norvegicus
tgcgccgacagcactggctgctggt

SEQ ID NO: 622962 - DNA, 25 bp, Rattus norvegicus
tgcgccgacagctctggctgctggt

SEQ ID NO: 622963 - DNA, 25 bp, Rattus norvegicus
tgcgccgcgcgtacctggagcgctg

SEQ ID NO: 622964 - DNA, 25 bp, Rattus norvegicus
tgcgccgcgcgttcctggagcgctg

SEQ ID NO: 622965 - DNA, 25 bp, Rattus norvegicus
tgcgccgcgttcagcacgaacagct

SEQ ID NO: 622966 - DNA, 25 bp, Rattus norvegicus
tgcgccgcgttctgcacgaacagct

SEQ ID NO: 622967 - DNA, 25 bp, Rattus norvegicus
tgcgccgctcagatgtgtcctggaa

SEQ ID NO: 622968 - DNA, 25 bp, Rattus norvegicus
tgcgccgctcagttgtgtcctggaa

SEQ ID NO: 622969 - DNA, 25 bp, Rattus norvegicus
tgcgccggcatcattggagacacga

SEQ ID NO: 622970 - DNA, 25 bp, Rattus norvegicus
tgcgccggcatctttggagacacga

SEQ ID NO: 622971 - DNA, 25 bp, Rattus norvegicus
tgcgccggtacaatcagcctcgttg

SEQ ID NO: 622972 - DNA, 25 bp, Rattus norvegicus
tgcgccggtacattcagcctcgttg

SEQ ID NO: 622973 - DNA, 25 bp, Rattus norvegicus
tgcgccggtatcagacatggtcatg

SEQ ID NO: 622974 - DNA, 25 bp, Rattus norvegicus
tgcgccggtatctgacatggtcatg

SEQ ID NO: 622975 - DNA, 25 bp, Rattus norvegicus
tgcgcctcaagacctgcaagacagg

SEQ ID NO: 622976 - DNA, 25 bp, Rattus norvegicus
tgcgcctcaagagctgcaagacagg

SEQ ID NO: 622977 - DNA, 25 bp, Rattus norvegicus
tgcgcctcactgagagtgcggacat

SEQ ID NO: 622978 - DNA, 25 bp, Rattus norvegicus
tgcgcctcactgtgagtgcggacat

SEQ ID NO: 622979 - DNA, 25 bp, Rattus norvegicus
tgcgcctcatctaccgcttgggcgg

SEQ ID NO: 622980 - DNA, 25 bp, Rattus norvegicus
tgcgcctcatcttccgcttgggcgg

SEQ ID NO: 622981 - DNA, 25 bp, Rattus norvegicus
tgcgcctcattaccgatactatgtg

SEQ ID NO: 622982 - DNA, 25 bp, Rattus norvegicus
tgcgcctcattagcgatactatgtg

SEQ ID NO: 622983 - DNA, 25 bp, Rattus norvegicus
tgcgcctccagacacctgcgggaga

SEQ ID NO: 622984 - DNA, 25 bp, Rattus norvegicus
tgcgcctccagagacctgcgggaga

SEQ ID NO: 622985 - DNA, 25 bp, Rattus norvegicus
tgcgcctctattacctgtatgagat

SEQ ID NO: 622986 - DNA, 25 bp, Rattus norvegicus
tgcgcctctatttcctgtatgagat

SEQ ID NO: 622987 - DNA, 25 bp, Rattus norvegicus
tgcgcctgacacatggaggttcatt

SEQ ID NO: 622988 - DNA, 25 bp, Rattus norvegicus
tgcgcctgacacttggaggttcatt

SEQ ID NO: 622989 - DNA, 25 bp, Rattus norvegicus
tgcgcctgacatctccatatacagt

SEQ ID NO: 622990 - DNA, 25 bp, Rattus norvegicus
tgcgcctgacatgtccatatacagt

SEQ ID NO: 622991 - DNA, 25 bp, Rattus norvegicus
tgcgcctgtccgagtgtgtgacaac

SEQ ID NO: 622992 - DNA, 25 bp, Rattus norvegicus
tgcgcctgtccgtgtgtgtgacaac

SEQ ID NO: 622993 - DNA, 25 bp, Rattus norvegicus
tgcgcctgtcgtagtgctggctcag

SEQ ID NO: 622994 - DNA, 25 bp, Rattus norvegicus
tgcgcctgtcgttgtgctggctcag

SEQ ID NO: 622995 - DNA, 25 bp, Rattus norvegicus
tgcgccttcctacagctgtttagat

SEQ ID NO: 622996 - DNA, 25 bp, Rattus norvegicus
tgcgccttcctagagctgtttagat

SEQ ID NO: 622997 - DNA, 25 bp, Rattus norvegicus
tgcgccttggacagcatctgcttca

SEQ ID NO: 622998 - DNA, 25 bp, Rattus norvegicus
tgcgccttggactgcatctgcttca

SEQ ID NO: 622999 - DNA, 25 bp, Rattus norvegicus
tgcgcgaagaacattccacgtgtcg

SEQ ID NO: 623000 - DNA, 25 bp, Rattus norvegicus
tgcgcgaagaactttccacgtgtcg

SEQ ID NO: 623001 - DNA, 25 bp, Rattus norvegicus
tgcgcgagcctgacagctttcttga

SEQ ID NO: 623002 - DNA, 25 bp, Rattus norvegicus
tgcgcgagcctgcagcttttgttaa

SEQ ID NO: 623003 - DNA, 25 bp, Rattus norvegicus
tgcgcgagcctggagcttttgttaa

SEQ ID NO: 623004 - DNA, 25 bp, Rattus norvegicus
tgcgcgagcctgtcagctttcttga

SEQ ID NO: 623005 - DNA, 25 bp, Rattus norvegicus
tgcgcgagtgtcagtgcgggatcgg

SEQ ID NO: 623006 - DNA, 25 bp, Rattus norvegicus
tgcgcgagtgtctgtgcgggatcgg

SEQ ID NO: 623007 - DNA, 25 bp, Rattus norvegicus
tgcgcgatcagcacggacaccggcg

SEQ ID NO: 623008 - DNA, 25 bp, Rattus norvegicus
tgcgcgatcagctcggacaccggcg

SEQ ID NO: 623009 - DNA, 25 bp, Rattus norvegicus
tgcgcgcaagaacgcacgagcaatt

SEQ ID NO: 623010 - DNA, 25 bp, Rattus norvegicus
tgcgcgcaagaaggcacgagcaatt

SEQ ID NO: 623011 - DNA, 25 bp, Rattus norvegicus
tgcgcgcagacaacggtgacacaat

SEQ ID NO: 623012 - DNA, 25 bp, Rattus norvegicus
tgcgcgcagacatcggtgacacaat

SEQ ID NO: 623013 - DNA, 25 bp, Rattus norvegicus
tgcgcgcagatcatcttggccaagt

SEQ ID NO: 623014 - DNA, 25 bp, Rattus norvegicus
tgcgcgcagatcttcttggccaagt

SEQ ID NO: 623015 - DNA, 25 bp, Rattus norvegicus
tgcgcgcgcatgaagtgaggttcca

SEQ ID NO: 623016 - DNA, 25 bp, Rattus norvegicus
tgcgcgcgcatgtagtgaggttcca

SEQ ID NO: 623017 - DNA, 25 bp, Rattus norvegicus
tgcgcgctcccgatgctagtgggaa

SEQ ID NO: 623018 - DNA, 25 bp, Rattus norvegicus
tgcgcgctcccgttgctagtgggaa

SEQ ID NO: 623019 - DNA, 25 bp, Rattus norvegicus
tgcgcgctcgtgagtacacctggag

SEQ ID NO: 623020 - DNA, 25 bp, Rattus norvegicus
tgcgcgctcgtgtgtacacctggag

SEQ ID NO: 623021 - DNA, 25 bp, Rattus norvegicus
tgcgcggaaaacaacgatcccgagg

SEQ ID NO: 623022 - DNA, 25 bp, Rattus norvegicus
tgcgcggaaaactacgatcccgagg

SEQ ID NO: 623023 - DNA, 25 bp, Rattus norvegicus
tgcgcggaatgccagaagagcttca

SEQ ID NO: 623024 - DNA, 25 bp, Rattus norvegicus
tgcgcggaatgcgagaagagcttca

SEQ ID NO: 623025 - DNA, 25 bp, Rattus norvegicus
tgcgcggagccaatgaatccctgga

SEQ ID NO: 623026 - DNA, 25 bp, Rattus norvegicus
tgcgcggagccattgaatccctgga

SEQ ID NO: 623027 - DNA, 25 bp, Rattus norvegicus
tgcgcggcggctaaactaatcttgg

SEQ ID NO: 623028 - DNA, 25 bp, Rattus norvegicus
tgcgcggcggcttaactaatcttgg

SEQ ID NO: 623029 - DNA, 25 bp, Rattus norvegicus
tgcgcggctccgattgttttggctt

SEQ ID NO: 623030 - DNA, 25 bp, Rattus norvegicus
tgcgcggctccgtttgttttggctt

SEQ ID NO: 623031 - DNA, 25 bp, Rattus norvegicus
tgcgcgggcttgagagagatacact

SEQ ID NO: 623032 - DNA, 25 bp, Rattus norvegicus
tgcgcgggcttgtgagagatacact

SEQ ID NO: 623033 - DNA, 25 bp, Rattus norvegicus
tgcgcggggcccacaaacgcaaaaa

SEQ ID NO: 623034 - DNA, 25 bp, Rattus norvegicus
tgcgcggggccctcaaacgcaaaaa

SEQ ID NO: 623035 - DNA, 25 bp, Rattus norvegicus
tgcgcggtgctcacagcccttgtat

SEQ ID NO: 623036 - DNA, 25 bp, Rattus norvegicus
tgcgcggtgctctcagcccttgtat

SEQ ID NO: 623037 - DNA, 25 bp, Rattus norvegicus
tgcgcggttttaactgaggcagact

SEQ ID NO: 623038 - DNA, 25 bp, Rattus norvegicus
tgcgcggttttatctgaggcagact

SEQ ID NO: 623039 - DNA, 25 bp, Rattus norvegicus
tgcgcgtccagacgctcggctgcta

SEQ ID NO: 623040 - DNA, 25 bp, Rattus norvegicus
tgcgcgtccagaggctcggctgcta

SEQ ID NO: 623041 - DNA, 25 bp, Rattus norvegicus
tgcgcgtcccggagacttctgggta

SEQ ID NO: 623042 - DNA, 25 bp, Rattus norvegicus
tgcgcgtcccggtgacttctgggta

SEQ ID NO: 623043 - DNA, 25 bp, Rattus norvegicus
tgcgcgtccgttccctttaaactct

SEQ ID NO: 623044 - DNA, 25 bp, Rattus norvegicus
tgcgcgtccgttgcctttaaactct

SEQ ID NO: 623045 - DNA, 25 bp, Rattus norvegicus
tgcgcgtcgagaagcccgctaagga

SEQ ID NO: 623046 - DNA, 25 bp, Rattus norvegicus
tgcgcgtcgagatgcccgctaagga

SEQ ID NO: 623047 - DNA, 25 bp, Rattus norvegicus
tgcgcgtctatcccaggagtgctga

SEQ ID NO: 623048 - DNA, 25 bp, Rattus norvegicus
tgcgcgtctatcgcaggagtgctga

SEQ ID NO: 623049 - DNA, 25 bp, Rattus norvegicus
tgcgcgtgatctcgcacacgagtgt

SEQ ID NO: 623050 - DNA, 25 bp, Rattus norvegicus
tgcgcgtgatctggcacacgagtgt

SEQ ID NO: 623051 - DNA, 25 bp, Rattus norvegicus
tgcgcgtgcgtgagatgctacctca

SEQ ID NO: 623052 - DNA, 25 bp, Rattus norvegicus
tgcgcgtgcgtgtgatgctacctca

SEQ ID NO: 623053 - DNA, 25 bp, Rattus norvegicus
tgcgcgttgctcaaggacactagga

SEQ ID NO: 623054 - DNA, 25 bp, Rattus norvegicus
tgcgcgttgctctaggacactagga

SEQ ID NO: 623055 - DNA, 25 bp, Rattus norvegicus
tgcgcgtttctcaccaagatcaata

SEQ ID NO: 623056 - DNA, 25 bp, Rattus norvegicus
tgcgcgtttctctccaagatcaata

SEQ ID NO: 623057 - DNA, 25 bp, Rattus norvegicus
tgcgctaaatgtcacgctgttcttt

SEQ ID NO: 623058 - DNA, 25 bp, Rattus norvegicus
tgcgctaaatgtgacgctgttcttt

SEQ ID NO: 623059 - DNA, 25 bp, Rattus norvegicus
tgcgctaagggcactgcagctgtct

SEQ ID NO: 623060 - DNA, 25 bp, Rattus norvegicus
tgcgctaagggctctgcagctgtct

SEQ ID NO: 623061 - DNA, 25 bp, Rattus norvegicus
tgcgctacaatcatggcttctcatg

SEQ ID NO: 623062 - DNA, 25 bp, Rattus norvegicus
tgcgctacaatcttggcttctcatg

SEQ ID NO: 623063 - DNA, 25 bp, Rattus norvegicus
tgcgctaccagacctcacatcggtg

SEQ ID NO: 623064 - DNA, 25 bp, Rattus norvegicus
tgcgctaccagagctcacatcggtg

SEQ ID NO: 623065 - DNA, 25 bp, Rattus norvegicus
tgcgctacctgaagatccatctcaa

SEQ ID NO: 623066 - DNA, 25 bp, Rattus norvegicus
tgcgctacctgatgatccatctcaa

SEQ ID NO: 623067 - DNA, 25 bp, Rattus norvegicus
tgcgctacggtgactatgtcatcaa

SEQ ID NO: 623068 - DNA, 25 bp, Rattus norvegicus
tgcgctacggtgtctatgtcatcaa

SEQ ID NO: 623069 - DNA, 25 bp, Rattus norvegicus
tgcgctactgttccttgtcctcggc

SEQ ID NO: 623070 - DNA, 25 bp, Rattus norvegicus
tgcgctactgttgcttgtcctcggc

SEQ ID NO: 623071 - DNA, 25 bp, Rattus norvegicus
tgcgctacttccagatcaaccagga

SEQ ID NO: 623072 - DNA, 25 bp, Rattus norvegicus
tgcgctacttcctgatcaaccagga

SEQ ID NO: 623073 - DNA, 25 bp, Rattus norvegicus
tgcgctagagttacggctttcagaa

SEQ ID NO: 623074 - DNA, 25 bp, Rattus norvegicus
tgcgctagagtttcggctttcagaa

SEQ ID NO: 623075 - DNA, 25 bp, Rattus norvegicus
tgcgctaggcttccctgagcaagag

SEQ ID NO: 623076 - DNA, 25 bp, Rattus norvegicus
tgcgctaggcttgcctgagcaagag

SEQ ID NO: 623077 - DNA, 25 bp, Rattus norvegicus
tgcgctagtggcacgggaatccgaa

SEQ ID NO: 623078 - DNA, 25 bp, Rattus norvegicus
tgcgctagtggctcgggaatccgaa

SEQ ID NO: 623079 - DNA, 25 bp, Rattus norvegicus
tgcgctatgcccacaacaatgatga

SEQ ID NO: 623080 - DNA, 25 bp, Rattus norvegicus
tgcgctatgccctcaacaatgatga

SEQ ID NO: 623081 - DNA, 25 bp, Rattus norvegicus
tgcgctcaggagcaagttctgccga

SEQ ID NO: 623082 - DNA, 25 bp, Rattus norvegicus
tgcgctcaggaggaagttctgccga

SEQ ID NO: 623083 - DNA, 25 bp, Rattus norvegicus
tgcgctcagtttcgaattctccatt

SEQ ID NO: 623084 - DNA, 25 bp, Rattus norvegicus
tgcgctcagtttggaattctccatt

SEQ ID NO: 623085 - DNA, 25 bp, Rattus norvegicus
tgcgctccaagtatgaggccctgca

SEQ ID NO: 623086 - DNA, 25 bp, Rattus norvegicus
tgcgctccaagtttgaggccctgca

SEQ ID NO: 623087 - DNA, 25 bp, Rattus norvegicus
tgcgctcccaggagaaagctctgag

SEQ ID NO: 623088 - DNA, 25 bp, Rattus norvegicus
tgcgctcccaggtgaaagctctgag

SEQ ID NO: 623089 - DNA, 25 bp, Rattus norvegicus
tgcgctccccagcagagctacggag

SEQ ID NO: 623090 - DNA, 25 bp, Rattus norvegicus
tgcgctccccaggagagctacggag

SEQ ID NO: 623091 - DNA, 25 bp, Rattus norvegicus
tgcgctccctgaaggcttctgatgg

SEQ ID NO: 623092 - DNA, 25 bp, Rattus norvegicus
tgcgctccctgatggcttctgatgg

SEQ ID NO: 623093 - DNA, 25 bp, Rattus norvegicus
tgcgctccttttcaaatgtcaccaa

SEQ ID NO: 623094 - DNA, 25 bp, Rattus norvegicus
tgcgctccttttgaaatgtcaccaa

SEQ ID NO: 623095 - DNA, 25 bp, Rattus norvegicus
tgcgctctcggcactgctatctgct

SEQ ID NO: 623096 - DNA, 25 bp, Rattus norvegicus
tgcgctctcggctctgctatctgct

SEQ ID NO: 623097 - DNA, 25 bp, Rattus norvegicus
tgcgctctctgtccctggagtttac

SEQ ID NO: 623098 - DNA, 25 bp, Rattus norvegicus
tgcgctctctgtgcctggagtttac

SEQ ID NO: 623099 - DNA, 25 bp, Rattus norvegicus
tgcgctctgcagcttatgacagtgt

SEQ ID NO: 623100 - DNA, 25 bp, Rattus norvegicus
tgcgctctgcaggttatgacagtgt

SEQ ID NO: 623101 - DNA, 25 bp, Rattus norvegicus
tgcgctctgccgactgacgtgtgag

SEQ ID NO: 623102 - DNA, 25 bp, Rattus norvegicus
tgcgctctgccgtctgacgtgtgag

SEQ ID NO: 623103 - DNA, 25 bp, Rattus norvegicus
tgcgctcttctactgtctaaacata

SEQ ID NO: 623104 - DNA, 25 bp, Rattus norvegicus
tgcgctcttctagtgtctaaacata

SEQ ID NO: 623105 - DNA, 25 bp, Rattus norvegicus
tgcgctgagagcatgttgtaccact

SEQ ID NO: 623106 - DNA, 25 bp, Rattus norvegicus
tgcgctgagagcttgttgtaccact

SEQ ID NO: 623107 - DNA, 25 bp, Rattus norvegicus
tgcgctgaggcgcatctaagcactg

SEQ ID NO: 623108 - DNA, 25 bp, Rattus norvegicus
tgcgctgaggcggatctaagcactg

SEQ ID NO: 623109 - DNA, 25 bp, Rattus norvegicus
tgcgctgcatctactctaatccaaa

SEQ ID NO: 623110 - DNA, 25 bp, Rattus norvegicus
tgcgctgcatcttctctaatccaaa

SEQ ID NO: 623111 - DNA, 25 bp, Rattus norvegicus
tgcgctgccacactggtaagggttt

SEQ ID NO: 623112 - DNA, 25 bp, Rattus norvegicus
tgcgctgccacagtggtaagggttt

SEQ ID NO: 623113 - DNA, 25 bp, Rattus norvegicus
tgcgctgccttgagcgtgggaataa

SEQ ID NO: 623114 - DNA, 25 bp, Rattus norvegicus
tgcgctgccttgtgcgtgggaataa

SEQ ID NO: 623115 - DNA, 25 bp, Rattus norvegicus
tgcgctgcgccgagccatgccgtaa

SEQ ID NO: 623116 - DNA, 25 bp, Rattus norvegicus
tgcgctgcgccgtgccatgccgtaa

SEQ ID NO: 623117 - DNA, 25 bp, Rattus norvegicus
tgcgctgctgccatttattaactca

SEQ ID NO: 623118 - DNA, 25 bp, Rattus norvegicus
tgcgctgctgccttttattaactca

SEQ ID NO: 623119 - DNA, 25 bp, Rattus norvegicus
tgcgctgctgtgaacgttgtagtgt

SEQ ID NO: 623120 - DNA, 25 bp, Rattus norvegicus
tgcgctgctgtgtacgttgtagtgt

SEQ ID NO: 623121 - DNA, 25 bp, Rattus norvegicus
tgcgctggcctaagcaaggcgtgca

SEQ ID NO: 623122 - DNA, 25 bp, Rattus norvegicus
tgcgctggcctatgcaaggcgtgca

SEQ ID NO: 623123 - DNA, 25 bp, Rattus norvegicus
tgcgctggcgttcaccaagttggac

SEQ ID NO: 623124 - DNA, 25 bp, Rattus norvegicus
tgcgctggcgttgaccaagttggac

SEQ ID NO: 623125 - DNA, 25 bp, Rattus norvegicus
tgcgctggctccagcaaatgcaaac

SEQ ID NO: 623126 - DNA, 25 bp, Rattus norvegicus
tgcgctggctcctgcaaatgcaaac

SEQ ID NO: 623127 - DNA, 25 bp, Rattus norvegicus
tgcgctgggccacggcactctatga

SEQ ID NO: 623128 - DNA, 25 bp, Rattus norvegicus
tgcgctgggccagggcactctatga

SEQ ID NO: 623129 - DNA, 25 bp, Rattus norvegicus
tgcgctggttcaaagaggcagacgt

SEQ ID NO: 623130 - DNA, 25 bp, Rattus norvegicus
tgcgctggttcatagaggcagacgt

SEQ ID NO: 623131 - DNA, 25 bp, Rattus norvegicus
tgcgctgtagctctggcttttgacc

SEQ ID NO: 623132 - DNA, 25 bp, Rattus norvegicus
tgcgctgtagctgtggcttttgacc

SEQ ID NO: 623133 - DNA, 25 bp, Rattus norvegicus
tgcgctgtccagagtgagtgttgct

SEQ ID NO: 623134 - DNA, 25 bp, Rattus norvegicus
tgcgctgtccagtgtgagtgttgct

SEQ ID NO: 623135 - DNA, 25 bp, Rattus norvegicus
tgcgctgtggctctggcctcagacc

SEQ ID NO: 623136 - DNA, 25 bp, Rattus norvegicus
tgcgctgtggctgtggcctcagacc

SEQ ID NO: 623137 - DNA, 25 bp, Rattus norvegicus
tgcgctgtgggaattgcttttgtca

SEQ ID NO: 623138 - DNA, 25 bp, Rattus norvegicus
tgcgctgtgggacctgctgaccaat

SEQ ID NO: 623139 - DNA, 25 bp, Rattus norvegicus
tgcgctgtgggagctgctgaccaat

SEQ ID NO: 623140 - DNA, 25 bp, Rattus norvegicus
tgcgctgtgggatttgcttttgtca

SEQ ID NO: 623141 - DNA, 25 bp, Rattus norvegicus
tgcgctgtgtccatggaactctgac

SEQ ID NO: 623142 - DNA, 25 bp, Rattus norvegicus
tgcgctgtgtccttggaactctgac

SEQ ID NO: 623143 - DNA, 25 bp, Rattus norvegicus
tgcgctgttccgcaccctgagaact

SEQ ID NO: 623144 - DNA, 25 bp, Rattus norvegicus
tgcgctgttccggaccctgagaact

SEQ ID NO: 623145 - DNA, 25 bp, Rattus norvegicus
tgcgctgttctcctgactgtgcaat

SEQ ID NO: 623146 - DNA, 25 bp, Rattus norvegicus
tgcgctgttctcgtgactgtgcaat

SEQ ID NO: 623147 - DNA, 25 bp, Rattus norvegicus
tgcgctgttgtacttttctgttcac

SEQ ID NO: 623148 - DNA, 25 bp, Rattus norvegicus
tgcgctgttgtagttttctgttcac

SEQ ID NO: 623149 - DNA, 25 bp, Rattus norvegicus
tgcgcttaatacctcattctcatga

SEQ ID NO: 623150 - DNA, 25 bp, Rattus norvegicus
tgcgcttaatacgtcattctcatga

SEQ ID NO: 623151 - DNA, 25 bp, Rattus norvegicus
tgcgcttaccgtcggccgcaggttt

SEQ ID NO: 623152 - DNA, 25 bp, Rattus norvegicus
tgcgcttaccgtgggccgcaggttt

SEQ ID NO: 623153 - DNA, 25 bp, Rattus norvegicus
tgcgcttcatgaacactaggttgct

SEQ ID NO: 623154 - DNA, 25 bp, Rattus norvegicus
tgcgcttcatgatcactaggttgct

SEQ ID NO: 623155 - DNA, 25 bp, Rattus norvegicus
tgcgcttccagtcaaggcaggctga

SEQ ID NO: 623156 - DNA, 25 bp, Rattus norvegicus
tgcgcttccagtgaaggcaggctga

SEQ ID NO: 623157 - DNA, 25 bp, Rattus norvegicus
tgcgcttccgccaggacctgaggag

SEQ ID NO: 623158 - DNA, 25 bp, Rattus norvegicus
tgcgcttccgcctggacctgaggag

SEQ ID NO: 623159 - DNA, 25 bp, Rattus norvegicus
tgcgcttcctaacctacagaattgt

SEQ ID NO: 623160 - DNA, 25 bp, Rattus norvegicus
tgcgcttcctaagctacagaattgt

SEQ ID NO: 623161 - DNA, 25 bp, Rattus norvegicus
tgcgcttctgtaacacgtggaacac

SEQ ID NO: 623162 - DNA, 25 bp, Rattus norvegicus
tgcgcttctgtatcacgtggaacac

SEQ ID NO: 623163 - DNA, 25 bp, Rattus norvegicus
tgcgcttgagaaatgccagggacct

SEQ ID NO: 623164 - DNA, 25 bp, Rattus norvegicus
tgcgcttgagaattgccagggacct

SEQ ID NO: 623165 - DNA, 25 bp, Rattus norvegicus
tgcgcttgatgtatgtgtctgtggt

SEQ ID NO: 623166 - DNA, 25 bp, Rattus norvegicus
tgcgcttgatgtttgtgtctgtggt

SEQ ID NO: 623167 - DNA, 25 bp, Rattus norvegicus
tgcgcttgcttccagaattgcatgt

SEQ ID NO: 623168 - DNA, 25 bp, Rattus norvegicus
tgcgcttgcttcgagaattgcatgt

SEQ ID NO: 623169 - DNA, 25 bp, Rattus norvegicus
tgcgcttgctttatgtcttacttta

SEQ ID NO: 623170 - DNA, 25 bp, Rattus norvegicus
tgcgcttgctttctactgttttgag

SEQ ID NO: 623171 - DNA, 25 bp, Rattus norvegicus
tgcgcttgctttgtactgttttgag

SEQ ID NO: 623172 - DNA, 25 bp, Rattus norvegicus
tgcgcttgctttttgtcttacttta

SEQ ID NO: 623173 - DNA, 25 bp, Rattus norvegicus
tgcgcttgtacgaccctattttaaa

SEQ ID NO: 623174 - DNA, 25 bp, Rattus norvegicus
tgcgcttgtacgtccctattttaaa

SEQ ID NO: 623175 - DNA, 25 bp, Rattus norvegicus
tgcgctttcctcaggtcaatgttgg

SEQ ID NO: 623176 - DNA, 25 bp, Rattus norvegicus
tgcgctttcctctggtcaatgttgg

SEQ ID NO: 623177 - DNA, 25 bp, Rattus norvegicus
tgcgctttctgtactggccactggt

SEQ ID NO: 623178 - DNA, 25 bp, Rattus norvegicus
tgcgctttctgttctggccactggt

SEQ ID NO: 623179 - DNA, 25 bp, Rattus norvegicus
tgcgcttttacacaaacactcgttc

SEQ ID NO: 623180 - DNA, 25 bp, Rattus norvegicus
tgcgcttttacagaaacactcgttc

SEQ ID NO: 623181 - DNA, 25 bp, Rattus norvegicus
tgcggaactgcgacgagccctgaga

SEQ ID NO: 623182 - DNA, 25 bp, Rattus norvegicus
tgcggaactgcgtcgagccctgaga

SEQ ID NO: 623183 - DNA, 25 bp, Rattus norvegicus
tgcggaagagaactacaactcccgt

SEQ ID NO: 623184 - DNA, 25 bp, Rattus norvegicus
tgcggaagagaagtacaactcccgt

SEQ ID NO: 623185 - DNA, 25 bp, Rattus norvegicus
tgcggaagcgccacaacctggagga

SEQ ID NO: 623186 - DNA, 25 bp, Rattus norvegicus
tgcggaagcgcctcaacctggagga

SEQ ID NO: 623187 - DNA, 25 bp, Rattus norvegicus
tgcggaagctggacgagcgctacca

SEQ ID NO: 623188 - DNA, 25 bp, Rattus norvegicus
tgcggaagctggtcgagcgctacca

SEQ ID NO: 623189 - DNA, 25 bp, Rattus norvegicus
tgcggaataaaccacatgcaggcgt

SEQ ID NO: 623190 - DNA, 25 bp, Rattus norvegicus
tgcggaataaacgacatgcaggcgt

SEQ ID NO: 623191 - DNA, 25 bp, Rattus norvegicus
tgcggaatccagacacaccaaagtg

SEQ ID NO: 623192 - DNA, 25 bp, Rattus norvegicus
tgcggaatccagtcacaccaaagtg

SEQ ID NO: 623193 - DNA, 25 bp, Rattus norvegicus
tgcggaatgagcaacctggccagaa

SEQ ID NO: 623194 - DNA, 25 bp, Rattus norvegicus
tgcggaatgagctacctggccagaa

SEQ ID NO: 623195 - DNA, 25 bp, Rattus norvegicus
tgcggaatgtctcctgcctgcgcct

SEQ ID NO: 623196 - DNA, 25 bp, Rattus norvegicus
tgcggaatgtctgctgcctgcgcct

SEQ ID NO: 623197 - DNA, 25 bp, Rattus norvegicus
tgcggacaaaagcttgccccacttg

SEQ ID NO: 623198 - DNA, 25 bp, Rattus norvegicus
tgcggacaaaaggttgccccacttg

SEQ ID NO: 623199 - DNA, 25 bp, Rattus norvegicus
tgcggacacctccactgtactgata

SEQ ID NO: 623200 - DNA, 25 bp, Rattus norvegicus
tgcggacacctcgactgtactgata

SEQ ID NO: 623201 - DNA, 25 bp, Rattus norvegicus
tgcggacactgaaccatacttctgt

SEQ ID NO: 623202 - DNA, 25 bp, Rattus norvegicus
tgcggacactgatccatacttctgt

SEQ ID NO: 623203 - DNA, 25 bp, Rattus norvegicus
tgcggacacttgctgggctatgact

SEQ ID NO: 623204 - DNA, 25 bp, Rattus norvegicus
tgcggacacttggtgggctatgact

SEQ ID NO: 623205 - DNA, 25 bp, Rattus norvegicus
tgcggacagcagcttggctcaccat

SEQ ID NO: 623206 - DNA, 25 bp, Rattus norvegicus
tgcggacagcaggttggctcaccat

SEQ ID NO: 623207 - DNA, 25 bp, Rattus norvegicus
tgcggaccaacgacatccaggagat

SEQ ID NO: 623208 - DNA, 25 bp, Rattus norvegicus
tgcggaccaacgtcatccaggagat

SEQ ID NO: 623209 - DNA, 25 bp, Rattus norvegicus
tgcggaccagctatgctcagagtga

SEQ ID NO: 623210 - DNA, 25 bp, Rattus norvegicus
tgcggaccagctttgctcagagtga

SEQ ID NO: 623211 - DNA, 25 bp, Rattus norvegicus
tgcggacccggactgaagacagcct

SEQ ID NO: 623212 - DNA, 25 bp, Rattus norvegicus
tgcggacccggagtgaagacagcct

SEQ ID NO: 623213 - DNA, 25 bp, Rattus norvegicus
tgcggaccgctcactcggagtccag

SEQ ID NO: 623214 - DNA, 25 bp, Rattus norvegicus
tgcggaccgctctctcggagtccag

SEQ ID NO: 623215 - DNA, 25 bp, Rattus norvegicus
tgcggacctcgtaggttcttggaga

SEQ ID NO: 623216 - DNA, 25 bp, Rattus norvegicus
tgcggacctcgttggttcttggaga

SEQ ID NO: 623217 - DNA, 25 bp, Rattus norvegicus
tgcggacggttcaggcttttgataa

SEQ ID NO: 623218 - DNA, 25 bp, Rattus norvegicus
tgcggacggttctggcttttgataa

SEQ ID NO: 623219 - DNA, 25 bp, Rattus norvegicus
tgcggactacgtatcccagcgggca

SEQ ID NO: 623220 - DNA, 25 bp, Rattus norvegicus
tgcggactacgtttcccagcgggca

SEQ ID NO: 623221 - DNA, 25 bp, Rattus norvegicus
tgcggactatctacagctgatggta

SEQ ID NO: 623222 - DNA, 25 bp, Rattus norvegicus
tgcggactatcttcagctgatggta

SEQ ID NO: 623223 - DNA, 25 bp, Rattus norvegicus
tgcggactccctcaagagacagcta

SEQ ID NO: 623224 - DNA, 25 bp, Rattus norvegicus
tgcggactccctgaagagacagcta

SEQ ID NO: 623225 - DNA, 25 bp, Rattus norvegicus
tgcggacttggcagcacagatcact

SEQ ID NO: 623226 - DNA, 25 bp, Rattus norvegicus
tgcggacttggctgcacagatcact

SEQ ID NO: 623227 - DNA, 25 bp, Rattus norvegicus
tgcggagaagatagccaccatcacc

SEQ ID NO: 623228 - DNA, 25 bp, Rattus norvegicus
tgcggagaagattgccaccatcacc

SEQ ID NO: 623229 - DNA, 25 bp, Rattus norvegicus
tgcggagaaggacaagactcccctt

SEQ ID NO: 623230 - DNA, 25 bp, Rattus norvegicus
tgcggagaaggagaagactcccctt

SEQ ID NO: 623231 - DNA, 25 bp, Rattus norvegicus
tgcggagaggttccggcaccttcca

SEQ ID NO: 623232 - DNA, 25 bp, Rattus norvegicus
tgcggagaggttgcggcaccttcca

SEQ ID NO: 623233 - DNA, 25 bp, Rattus norvegicus
tgcggagatcatcgacgcctttgat

SEQ ID NO: 623234 - DNA, 25 bp, Rattus norvegicus
tgcggagatcatggacgcctttgat

SEQ ID NO: 623235 - DNA, 25 bp, Rattus norvegicus
tgcggagcagcaccaggcacagact

SEQ ID NO: 623236 - DNA, 25 bp, Rattus norvegicus
tgcggagcagcagcaggcacagact

SEQ ID NO: 623237 - DNA, 25 bp, Rattus norvegicus
tgcggagcctggagcccgagtgaca

SEQ ID NO: 623238 - DNA, 25 bp, Rattus norvegicus
tgcggagcctggtgcccgagtgaca

SEQ ID NO: 623239 - DNA, 25 bp, Rattus norvegicus
tgcggagccttcaccttaatccagc

SEQ ID NO: 623240 - DNA, 25 bp, Rattus norvegicus
tgcggagccttctccttaatccagc

SEQ ID NO: 623241 - DNA, 25 bp, Rattus norvegicus
tgcggaggacatattcggagagatt

SEQ ID NO: 623242 - DNA, 25 bp, Rattus norvegicus
tgcggaggacattttcggagagatt

SEQ ID NO: 623243 - DNA, 25 bp, Rattus norvegicus
tgcggagggagtctctcaaacttct

SEQ ID NO: 623244 - DNA, 25 bp, Rattus norvegicus
tgcggagggagtgtctcaaacttct

SEQ ID NO: 623245 - DNA, 25 bp, Rattus norvegicus
tgcggataaattattccctacccca

SEQ ID NO: 623246 - DNA, 25 bp, Rattus norvegicus
tgcggataaatttttccctacccca

SEQ ID NO: 623247 - DNA, 25 bp, Rattus norvegicus
tgcggatcacttctgcgaaactggt

SEQ ID NO: 623248 - DNA, 25 bp, Rattus norvegicus
tgcggatcacttgtgcgaaactggt

SEQ ID NO: 623249 - DNA, 25 bp, Rattus norvegicus
tgcggatccgcgagaggcaagattc

SEQ ID NO: 623250 - DNA, 25 bp, Rattus norvegicus
tgcggatccgcgtgaggcaagattc

SEQ ID NO: 623251 - DNA, 25 bp, Rattus norvegicus
tgcggatcgcccaaaggatgcgact

SEQ ID NO: 623252 - DNA, 25 bp, Rattus norvegicus
tgcggatcgccctaaggatgcgact

SEQ ID NO: 623253 - DNA, 25 bp, Rattus norvegicus
tgcggatctgagctcgtcccttgca

SEQ ID NO: 623254 - DNA, 25 bp, Rattus norvegicus
tgcggatctgaggtcgtcccttgca

SEQ ID NO: 623255 - DNA, 25 bp, Rattus norvegicus
tgcggatgccctagaattcagtgta

SEQ ID NO: 623256 - DNA, 25 bp, Rattus norvegicus
tgcggatgcccttgaattcagtgta

SEQ ID NO: 623257 - DNA, 25 bp, Rattus norvegicus
tgcggatgctcgagacttactgtca

SEQ ID NO: 623258 - DNA, 25 bp, Rattus norvegicus
tgcggatgctcgtgacttactgtca

SEQ ID NO: 623259 - DNA, 25 bp, Rattus norvegicus
tgcggatggcatcaactggctaagt

SEQ ID NO: 623260 - DNA, 25 bp, Rattus norvegicus
tgcggatggcatgaactggctaagt

SEQ ID NO: 623261 - DNA, 25 bp, Rattus norvegicus
tgcggattctggaagtgcccaagct

SEQ ID NO: 623262 - DNA, 25 bp, Rattus norvegicus
tgcggattctggtagtgcccaagct

SEQ ID NO: 623263 - DNA, 25 bp, Rattus norvegicus
tgcggcaacccaagcgtgcctggtc

SEQ ID NO: 623264 - DNA, 25 bp, Rattus norvegicus
tgcggcaacccatgcgtgcctggtc

SEQ ID NO: 623265 - DNA, 25 bp, Rattus norvegicus
tgcggcaactctagagacacgaaga

SEQ ID NO: 623266 - DNA, 25 bp, Rattus norvegicus
tgcggcaactcttgagacacgaaga

SEQ ID NO: 623267 - DNA, 25 bp, Rattus norvegicus
tgcggcaagaccatctcgcagagct

SEQ ID NO: 623268 - DNA, 25 bp, Rattus norvegicus
tgcggcaagaccttctcgcagagct

SEQ ID NO: 623269 - DNA, 25 bp, Rattus norvegicus
tgcggcaagcgcattagctggagct

SEQ ID NO: 623270 - DNA, 25 bp, Rattus norvegicus
tgcggcaagcgctttagctggagct

SEQ ID NO: 623271 - DNA, 25 bp, Rattus norvegicus
tgcggcacatctacacatgtcatgc

SEQ ID NO: 623272 - DNA, 25 bp, Rattus norvegicus
tgcggcacatcttcacatgtcatgc

SEQ ID NO: 623273 - DNA, 25 bp, Rattus norvegicus
tgcggcacccatatctttgtatgaa

SEQ ID NO: 623274 - DNA, 25 bp, Rattus norvegicus
tgcggcacccatttctttgtatgaa

SEQ ID NO: 623275 - DNA, 25 bp, Rattus norvegicus
tgcggcaccctcagagcgatttgaa

SEQ ID NO: 623276 - DNA, 25 bp, Rattus norvegicus
tgcggcaccctctgagcgatttgaa

SEQ ID NO: 623277 - DNA, 25 bp, Rattus norvegicus
tgcggcagtctcagcagctgtgtga

SEQ ID NO: 623278 - DNA, 25 bp, Rattus norvegicus
tgcggcagtctctgcagctgtgtga

SEQ ID NO: 623279 - DNA, 25 bp, Rattus norvegicus
tgcggcagtggcactgtgtaaatgc

SEQ ID NO: 623280 - DNA, 25 bp, Rattus norvegicus
tgcggcagtggctctgtgtaaatgc

SEQ ID NO: 623281 - DNA, 25 bp, Rattus norvegicus
tgcggcataaggactcggagtccag

SEQ ID NO: 623282 - DNA, 25 bp, Rattus norvegicus
tgcggcataaggtctcggagtccag

SEQ ID NO: 623283 - DNA, 25 bp, Rattus norvegicus
tgcggcatcaaccaaaggtccccaa

SEQ ID NO: 623284 - DNA, 25 bp, Rattus norvegicus
tgcggcatcaacgaaaggtccccaa

SEQ ID NO: 623285 - DNA, 25 bp, Rattus norvegicus
tgcggcatccaaaatggcggacgcg

SEQ ID NO: 623286 - DNA, 25 bp, Rattus norvegicus
tgcggcatccaatatggcggacgcg

SEQ ID NO: 623287 - DNA, 25 bp, Rattus norvegicus
tgcggccaatggctgcctgacacac

SEQ ID NO: 623288 - DNA, 25 bp, Rattus norvegicus
tgcggccaatgggtgcctgacacac

SEQ ID NO: 623289 - DNA, 25 bp, Rattus norvegicus
tgcggccaccaactcaggccagaga

SEQ ID NO: 623290 - DNA, 25 bp, Rattus norvegicus
tgcggccaccaagtcaggccagaga

SEQ ID NO: 623291 - DNA, 25 bp, Rattus norvegicus
tgcggccacggacagatcatacact

SEQ ID NO: 623292 - DNA, 25 bp, Rattus norvegicus
tgcggccacggagagatcatacact

SEQ ID NO: 623293 - DNA, 25 bp, Rattus norvegicus
tgcggccactggatctagacaacag

SEQ ID NO: 623294 - DNA, 25 bp, Rattus norvegicus
tgcggccactggttctagacaacag

SEQ ID NO: 623295 - DNA, 25 bp, Rattus norvegicus
tgcggcccaacgagaccaaaactta

SEQ ID NO: 623296 - DNA, 25 bp, Rattus norvegicus
tgcggcccaacgtgaccaaaactta

SEQ ID NO: 623297 - DNA, 25 bp, Rattus norvegicus
tgcggcccacggcttctgttactgt

SEQ ID NO: 623298 - DNA, 25 bp, Rattus norvegicus
tgcggcccacgggttctgttactgt

SEQ ID NO: 623299 - DNA, 25 bp, Rattus norvegicus
tgcggccccgtcagggtcaggttgg

SEQ ID NO: 623300 - DNA, 25 bp, Rattus norvegicus
tgcggccccgtctgggtcaggttgg

SEQ ID NO: 623301 - DNA, 25 bp, Rattus norvegicus
tgcggccctatcaagactggtatct

SEQ ID NO: 623302 - DNA, 25 bp, Rattus norvegicus
tgcggccctatctagactggtatct

SEQ ID NO: 623303 - DNA, 25 bp, Rattus norvegicus
tgcggccgacgcaacacattgagga

SEQ ID NO: 623304 - DNA, 25 bp, Rattus norvegicus
tgcggccgacgctacacattgagga

SEQ ID NO: 623305 - DNA, 25 bp, Rattus norvegicus
tgcggccggacaaccgcaccaagga

SEQ ID NO: 623306 - DNA, 25 bp, Rattus norvegicus
tgcggccggacatccgcaccaagga

SEQ ID NO: 623307 - DNA, 25 bp, Rattus norvegicus
tgcggcctaccgatgactctgtaca

SEQ ID NO: 623308 - DNA, 25 bp, Rattus norvegicus
tgcggcctaccgttgactctgtaca

SEQ ID NO: 623309 - DNA, 25 bp, Rattus norvegicus
tgcggcctgacaacagagccatgga

SEQ ID NO: 623310 - DNA, 25 bp, Rattus norvegicus
tgcggcctgacatcagagccatgga

SEQ ID NO: 623311 - DNA, 25 bp, Rattus norvegicus
tgcggcctggcacatttgacaagct

SEQ ID NO: 623312 - DNA, 25 bp, Rattus norvegicus
tgcggcctggcagatttgacaagct

SEQ ID NO: 623313 - DNA, 25 bp, Rattus norvegicus
tgcggccttcatcacggtcgggaat

SEQ ID NO: 623314 - DNA, 25 bp, Rattus norvegicus
tgcggccttcatgacggtcgggaat

SEQ ID NO: 623315 - DNA, 25 bp, Rattus norvegicus
tgcggcgacagcattcacgtgtgga

SEQ ID NO: 623316 - DNA, 25 bp, Rattus norvegicus
tgcggcgacagctttcacgtgtgga

SEQ ID NO: 623317 - DNA, 25 bp, Rattus norvegicus
tgcggcgccagcaactgcaggacgc

SEQ ID NO: 623318 - DNA, 25 bp, Rattus norvegicus
tgcggcgccagctactgcaggacgc

SEQ ID NO: 623319 - DNA, 25 bp, Rattus norvegicus
tgcggctagaagacgacacacacag

SEQ ID NO: 623320 - DNA, 25 bp, Rattus norvegicus
tgcggctagaagtcgacacacacag

SEQ ID NO: 623321 - DNA, 25 bp, Rattus norvegicus
tgcggctatcacctggtcatcggaa

SEQ ID NO: 623322 - DNA, 25 bp, Rattus norvegicus
tgcggctatcacgtggtcatcggaa

SEQ ID NO: 623323 - DNA, 25 bp, Rattus norvegicus
tgcggctcaagcatatcgccagcaa

SEQ ID NO: 623324 - DNA, 25 bp, Rattus norvegicus
tgcggctcaagcttatcgccagcaa

SEQ ID NO: 623325 - DNA, 25 bp, Rattus norvegicus
tgcggctcaagtccaagcagcactc

SEQ ID NO: 623326 - DNA, 25 bp, Rattus norvegicus
tgcggctcaagtgcaagcagcactc

SEQ ID NO: 623327 - DNA, 25 bp, Rattus norvegicus
tgcggctcacgtcctatagtaggga

SEQ ID NO: 623328 - DNA, 25 bp, Rattus norvegicus
tgcggctcacgtgctatagtaggga

SEQ ID NO: 623329 - DNA, 25 bp, Rattus norvegicus
tgcggctcagcacaattcaccatgg

SEQ ID NO: 623330 - DNA, 25 bp, Rattus norvegicus
tgcggctcagcagaattcaccatgg

SEQ ID NO: 623331 - DNA, 25 bp, Rattus norvegicus
tgcggctccaaaaggaacgacttca

SEQ ID NO: 623332 - DNA, 25 bp, Rattus norvegicus
tgcggctccaaatggaacgacttca

SEQ ID NO: 623333 - DNA, 25 bp, Rattus norvegicus
tgcggctcccctcttgaagatctta

SEQ ID NO: 623334 - DNA, 25 bp, Rattus norvegicus
tgcggctcccctgttgaagatctta

SEQ ID NO: 623335 - DNA, 25 bp, Rattus norvegicus
tgcggctccctcatctgcggaggag

SEQ ID NO: 623336 - DNA, 25 bp, Rattus norvegicus
tgcggctccctcttctgcggaggag

SEQ ID NO: 623337 - DNA, 25 bp, Rattus norvegicus
tgcggctccggacgcagccaaaata

SEQ ID NO: 623338 - DNA, 25 bp, Rattus norvegicus
tgcggctccggaggcagccaaaata

SEQ ID NO: 623339 - DNA, 25 bp, Rattus norvegicus
tgcggctctggaaatcctccatgaa

SEQ ID NO: 623340 - DNA, 25 bp, Rattus norvegicus
tgcggctctggatatcctccatgaa

SEQ ID NO: 623341 - DNA, 25 bp, Rattus norvegicus
tgcggctgaaacactcggacaaagt

SEQ ID NO: 623342 - DNA, 25 bp, Rattus norvegicus
tgcggctgaaactctcggacaaagt

SEQ ID NO: 623343 - DNA, 25 bp, Rattus norvegicus
tgcggctgaagcaccagggctcctg

SEQ ID NO: 623344 - DNA, 25 bp, Rattus norvegicus
tgcggctgaagcctaccagaaagtt

SEQ ID NO: 623345 - DNA, 25 bp, Rattus norvegicus
tgcggctgaagcgtaccagaaagtt

SEQ ID NO: 623346 - DNA, 25 bp, Rattus norvegicus
tgcggctgaagctccagggctcctg

SEQ ID NO: 623347 - DNA, 25 bp, Rattus norvegicus
tgcggctgccttccagtaaacagga

SEQ ID NO: 623348 - DNA, 25 bp, Rattus norvegicus
tgcggctgccttgcagtaaacagga

SEQ ID NO: 623349 - DNA, 25 bp, Rattus norvegicus
tgcggctgctccatgaacaagttct

SEQ ID NO: 623350 - DNA, 25 bp, Rattus norvegicus
tgcggctgctccttgaacaagttct

SEQ ID NO: 623351 - DNA, 25 bp, Rattus norvegicus
tgcggctgctctaccgcctgcgatt

SEQ ID NO: 623352 - DNA, 25 bp, Rattus norvegicus
tgcggctgctcttccgcctgcgatt

SEQ ID NO: 623353 - DNA, 25 bp, Rattus norvegicus
tgcggctggaggatttcacgctcag

SEQ ID NO: 623354 - DNA, 25 bp, Rattus norvegicus
tgcggctggaggttttcacgctcag

SEQ ID NO: 623355 - DNA, 25 bp, Rattus norvegicus
tgcggctggcaacgactaattttct

SEQ ID NO: 623356 - DNA, 25 bp, Rattus norvegicus
tgcggctggcaaggactaattttct

SEQ ID NO: 623357 - DNA, 25 bp, Rattus norvegicus
tgcggctgtgtcagaagccctggat

SEQ ID NO: 623358 - DNA, 25 bp, Rattus norvegicus
tgcggctgtgtctgaagccctggat

SEQ ID NO: 623359 - DNA, 25 bp, Rattus norvegicus
tgcggcttccatccgttgtgctcta

SEQ ID NO: 623360 - DNA, 25 bp, Rattus norvegicus
tgcggcttccatgcgttgtgctcta

SEQ ID NO: 623361 - DNA, 25 bp, Rattus norvegicus
tgcggcttcggccactccagtggct

SEQ ID NO: 623362 - DNA, 25 bp, Rattus norvegicus
tgcggcttcggcgactccagtggct

SEQ ID NO: 623363 - DNA, 25 bp, Rattus norvegicus
tgcggcttgcttaagacacagtgta

SEQ ID NO: 623364 - DNA, 25 bp, Rattus norvegicus
tgcggcttgctttagacacagtgta

SEQ ID NO: 623365 - DNA, 25 bp, Rattus norvegicus
tgcgggaactcaacggccaggcaca

SEQ ID NO: 623366 - DNA, 25 bp, Rattus norvegicus
tgcgggaactcatcggccaggcaca

SEQ ID NO: 623367 - DNA, 25 bp, Rattus norvegicus
tgcgggaagcgtatcaccaacaagc

SEQ ID NO: 623368 - DNA, 25 bp, Rattus norvegicus
tgcgggaagcgtttcaccaacaagc

SEQ ID NO: 623369 - DNA, 25 bp, Rattus norvegicus
tgcgggacacagaccgggccactgc

SEQ ID NO: 623370 - DNA, 25 bp, Rattus norvegicus
tgcgggacacagtccgggccactgc

SEQ ID NO: 623371 - DNA, 25 bp, Rattus norvegicus
tgcgggacctgtacttactaagtga

SEQ ID NO: 623372 - DNA, 25 bp, Rattus norvegicus
tgcgggacctgttcttactaagtga

SEQ ID NO: 623373 - DNA, 25 bp, Rattus norvegicus
tgcgggactgctctgtacatgtaag

SEQ ID NO: 623374 - DNA, 25 bp, Rattus norvegicus
tgcgggactgctgtgtacatgtaag

SEQ ID NO: 623375 - DNA, 25 bp, Rattus norvegicus
tgcgggagacatcctggcagtcatc

SEQ ID NO: 623376 - DNA, 25 bp, Rattus norvegicus
tgcgggagacatgctggcagtcatc

SEQ ID NO: 623377 - DNA, 25 bp, Rattus norvegicus
tgcgggagctgtcacttcaagctat

SEQ ID NO: 623378 - DNA, 25 bp, Rattus norvegicus
tgcgggagctgtgacttcaagctat

SEQ ID NO: 623379 - DNA, 25 bp, Rattus norvegicus
tgcgggatctgcctgctgaagtttc

SEQ ID NO: 623380 - DNA, 25 bp, Rattus norvegicus
tgcgggatctgcgtgctgaagtttc

SEQ ID NO: 623381 - DNA, 25 bp, Rattus norvegicus
tgcgggatgaacaggccaacacaca

SEQ ID NO: 623382 - DNA, 25 bp, Rattus norvegicus
tgcgggatgaactggccaacacaca

SEQ ID NO: 623383 - DNA, 25 bp, Rattus norvegicus
tgcgggatgagcagagcggcggcct

SEQ ID NO: 623384 - DNA, 25 bp, Rattus norvegicus
tgcgggatgagctgagcggcggcct

SEQ ID NO: 623385 - DNA, 25 bp, Rattus norvegicus
tgcgggcacctacctggattgacac

SEQ ID NO: 623386 - DNA, 25 bp, Rattus norvegicus
tgcgggcacctagctggattgacac

SEQ ID NO: 623387 - DNA, 25 bp, Rattus norvegicus
tgcgggcactcgagaacctgcttgt

SEQ ID NO: 623388 - DNA, 25 bp, Rattus norvegicus
tgcgggcactcgtgaacctgcttgt

SEQ ID NO: 623389 - DNA, 25 bp, Rattus norvegicus
tgcgggcactgaccatgcaggccaa

SEQ ID NO: 623390 - DNA, 25 bp, Rattus norvegicus
tgcgggcactgagcatgcaggccaa

SEQ ID NO: 623391 - DNA, 25 bp, Rattus norvegicus
tgcgggcagcacagatgcagagcca

SEQ ID NO: 623392 - DNA, 25 bp, Rattus norvegicus
tgcgggcagcactgatgcagagcca

SEQ ID NO: 623393 - DNA, 25 bp, Rattus norvegicus
tgcgggcataacaggagctagaatc

SEQ ID NO: 623394 - DNA, 25 bp, Rattus norvegicus
tgcgggcataactggagctagaatc

SEQ ID NO: 623395 - DNA, 25 bp, Rattus norvegicus
tgcgggcatccaacgccatgatgaa

SEQ ID NO: 623396 - DNA, 25 bp, Rattus norvegicus
tgcgggcatccatcgccatgatgaa

SEQ ID NO: 623397 - DNA, 25 bp, Rattus norvegicus
tgcgggccaaggaatgctagctcac

SEQ ID NO: 623398 - DNA, 25 bp, Rattus norvegicus
tgcgggccaaggtatgctagctcac

SEQ ID NO: 623399 - DNA, 25 bp, Rattus norvegicus
tgcgggccactgagcttgctgtcaa

SEQ ID NO: 623400 - DNA, 25 bp, Rattus norvegicus
tgcgggccactgtgcttgctgtcaa

SEQ ID NO: 623401 - DNA, 25 bp, Rattus norvegicus
tgcgggcgtcctacagaagagccaa

SEQ ID NO: 623402 - DNA, 25 bp, Rattus norvegicus
tgcgggcgtccttcagaagagccaa

SEQ ID NO: 623403 - DNA, 25 bp, Rattus norvegicus
tgcgggctgatgagtttctctttga

SEQ ID NO: 623404 - DNA, 25 bp, Rattus norvegicus
tgcgggctgatgtgtttctctttga

SEQ ID NO: 623405 - DNA, 25 bp, Rattus norvegicus
tgcgggtccctaataaatctgatgt

SEQ ID NO: 623406 - DNA, 25 bp, Rattus norvegicus
tgcgggtccctattaaatctgatgt

SEQ ID NO: 623407 - DNA, 25 bp, Rattus norvegicus
tgcgggtcctgcacatctacaaaaa

SEQ ID NO: 623408 - DNA, 25 bp, Rattus norvegicus
tgcgggtcctgctcatctacaaaaa

SEQ ID NO: 623409 - DNA, 25 bp, Rattus norvegicus
tgcgggtctgcaccttaccagggct

SEQ ID NO: 623410 - DNA, 25 bp, Rattus norvegicus
tgcgggtctgcagcttaccagggct

SEQ ID NO: 623411 - DNA, 25 bp, Rattus norvegicus
tgcgggtggtttatccagacttgaa

SEQ ID NO: 623412 - DNA, 25 bp, Rattus norvegicus
tgcgggtggtttttccagacttgaa

SEQ ID NO: 623413 - DNA, 25 bp, Rattus norvegicus
tgcgggtgtcgcaagcacagcaaga

SEQ ID NO: 623414 - DNA, 25 bp, Rattus norvegicus
tgcgggtgtcgctagcacagcaaga

SEQ ID NO: 623415 - DNA, 25 bp, Rattus norvegicus
tgcggtagaaacaaaggccccacct

SEQ ID NO: 623416 - DNA, 25 bp, Rattus norvegicus
tgcggtagaaactaaggccccacct

SEQ ID NO: 623417 - DNA, 25 bp, Rattus norvegicus
tgcggtagtctaaagcctcatgata

SEQ ID NO: 623418 - DNA, 25 bp, Rattus norvegicus
tgcggtagtctatagcctcatgata

SEQ ID NO: 623419 - DNA, 25 bp, Rattus norvegicus
tgcggtcaccgcaagcaaggcgagt

SEQ ID NO: 623420 - DNA, 25 bp, Rattus norvegicus
tgcggtcaccgctagcaaggcgagt

SEQ ID NO: 623421 - DNA, 25 bp, Rattus norvegicus
tgcggtcactccagaagactttgtt

SEQ ID NO: 623422 - DNA, 25 bp, Rattus norvegicus
tgcggtcactcctgaagactttgtt

SEQ ID NO: 623423 - DNA, 25 bp, Rattus norvegicus
tgcggtccagcactgtgacaaggta

SEQ ID NO: 623424 - DNA, 25 bp, Rattus norvegicus
tgcggtccagcagtgtgacaaggta

SEQ ID NO: 623425 - DNA, 25 bp, Rattus norvegicus
tgcggtcccagtcacaggtggctat

SEQ ID NO: 623426 - DNA, 25 bp, Rattus norvegicus
tgcggtcccagtgacaggtggctat

SEQ ID NO: 623427 - DNA, 25 bp, Rattus norvegicus
tgcggtccctaacaattacaagctg

SEQ ID NO: 623428 - DNA, 25 bp, Rattus norvegicus
tgcggtccctaagaattacaagctg

SEQ ID NO: 623429 - DNA, 25 bp, Rattus norvegicus
tgcggtccttcaagagtgttctcta

SEQ ID NO: 623430 - DNA, 25 bp, Rattus norvegicus
tgcggtccttcatgagtgttctcta

SEQ ID NO: 623431 - DNA, 25 bp, Rattus norvegicus
tgcggtcctttgattggcttatttt

SEQ ID NO: 623432 - DNA, 25 bp, Rattus norvegicus
tgcggtcctttgtttggcttatttt

SEQ ID NO: 623433 - DNA, 25 bp, Rattus norvegicus
tgcggtctcctgagaggctttatca

SEQ ID NO: 623434 - DNA, 25 bp, Rattus norvegicus
tgcggtctcctgtgaggctttatca

SEQ ID NO: 623435 - DNA, 25 bp, Rattus norvegicus
tgcggtctcgttctcagcgatgaac

SEQ ID NO: 623436 - DNA, 25 bp, Rattus norvegicus
tgcggtctcgttgtcagcgatgaac

SEQ ID NO: 623437 - DNA, 25 bp, Rattus norvegicus
tgcggtcttgtcacattacaacgtg

SEQ ID NO: 623438 - DNA, 25 bp, Rattus norvegicus
tgcggtcttgtctcattacaacgtg

SEQ ID NO: 623439 - DNA, 25 bp, Rattus norvegicus
tgcggtctttatatccctttgtatt

SEQ ID NO: 623440 - DNA, 25 bp, Rattus norvegicus
tgcggtctttatttccctttgtatt

SEQ ID NO: 623441 - DNA, 25 bp, Rattus norvegicus
tgcggtctttttagttggtgtgaac

SEQ ID NO: 623442 - DNA, 25 bp, Rattus norvegicus
tgcggtcttttttgttggtgtgaac

SEQ ID NO: 623443 - DNA, 25 bp, Rattus norvegicus
tgcggtgacctgcattcagccctgg

SEQ ID NO: 623444 - DNA, 25 bp, Rattus norvegicus
tgcggtgacctggattcagccctgg

SEQ ID NO: 623445 - DNA, 25 bp, Rattus norvegicus
tgcggtgatgaacacgtgccccact

SEQ ID NO: 623446 - DNA, 25 bp, Rattus norvegicus
tgcggtgatgaagacgtgccccact

SEQ ID NO: 623447 - DNA, 25 bp, Rattus norvegicus
tgcggtgcagagatcttctctccaa

SEQ ID NO: 623448 - DNA, 25 bp, Rattus norvegicus
tgcggtgcagagttcttctctccaa

SEQ ID NO: 623449 - DNA, 25 bp, Rattus norvegicus
tgcggtgcatggcatccctggcatc

SEQ ID NO: 623450 - DNA, 25 bp, Rattus norvegicus
tgcggtgcatgggatccctggcatc

SEQ ID NO: 623451 - DNA, 25 bp, Rattus norvegicus
tgcggtgccaagaggatccttcact

SEQ ID NO: 623452 - DNA, 25 bp, Rattus norvegicus
tgcggtgccaagtggatccttcact

SEQ ID NO: 623453 - DNA, 25 bp, Rattus norvegicus
tgcggtgctcggatctgtgacccag

SEQ ID NO: 623454 - DNA, 25 bp, Rattus norvegicus
tgcggtgctcggttctgtgacccag

SEQ ID NO: 623455 - DNA, 25 bp, Rattus norvegicus
tgcggtgtgtctcctcagcttttta

SEQ ID NO: 623456 - DNA, 25 bp, Rattus norvegicus
tgcggtgtgtctgctcagcttttta

SEQ ID NO: 623457 - DNA, 25 bp, Rattus norvegicus
tgcggtgtgtggatcctgaagcctc

SEQ ID NO: 623458 - DNA, 25 bp, Rattus norvegicus
tgcggtgtgtggttcctgaagcctc

SEQ ID NO: 623459 - DNA, 25 bp, Rattus norvegicus
tgcggtgttcttagaagcagaagct

SEQ ID NO: 623460 - DNA, 25 bp, Rattus norvegicus
tgcggtgttctttgaagcagaagct

SEQ ID NO: 623461 - DNA, 25 bp, Rattus norvegicus
tgcggttcacatctttacactctgt

SEQ ID NO: 623462 - DNA, 25 bp, Rattus norvegicus
tgcggttcacatgtttacactctgt

SEQ ID NO: 623463 - DNA, 25 bp, Rattus norvegicus
tgcggttcaccacttcatgattttc

SEQ ID NO: 623464 - DNA, 25 bp, Rattus norvegicus
tgcggttcaccagttcatgattttc

SEQ ID NO: 623465 - DNA, 25 bp, Rattus norvegicus
tgcggttcaggcatccagatcggct

SEQ ID NO: 623466 - DNA, 25 bp, Rattus norvegicus
tgcggttcaggcttccagatcggct

SEQ ID NO: 623467 - DNA, 25 bp, Rattus norvegicus
tgcggttccctgctgtgaagatgtt

SEQ ID NO: 623468 - DNA, 25 bp, Rattus norvegicus
tgcggttccctggtgtgaagatgtt

SEQ ID NO: 623469 - DNA, 25 bp, Rattus norvegicus
tgcggttcctgaacatgactgccaa

SEQ ID NO: 623470 - DNA, 25 bp, Rattus norvegicus
tgcggttcctgatcatgactgccaa

SEQ ID NO: 623471 - DNA, 25 bp, Rattus norvegicus
tgcggttcgggtattggcagtaaca

SEQ ID NO: 623472 - DNA, 25 bp, Rattus norvegicus
tgcggttcgggttttggcagtaaca

SEQ ID NO: 623473 - DNA, 25 bp, Rattus norvegicus
tgcgtaacacagctgattcatctcc

SEQ ID NO: 623474 - DNA, 25 bp, Rattus norvegicus
tgcgtaacacaggtgattcatctcc

SEQ ID NO: 623475 - DNA, 25 bp, Rattus norvegicus
tgcgtaacttgcatgctggcactga

SEQ ID NO: 623476 - DNA, 25 bp, Rattus norvegicus
tgcgtaacttgcttgctggcactga

SEQ ID NO: 623477 - DNA, 25 bp, Rattus norvegicus
tgcgtacaagaaatcctcagccact

SEQ ID NO: 623478 - DNA, 25 bp, Rattus norvegicus
tgcgtacaagaattcctcagccact

SEQ ID NO: 623479 - DNA, 25 bp, Rattus norvegicus
tgcgtacaccaacctagccctagat

SEQ ID NO: 623480 - DNA, 25 bp, Rattus norvegicus
tgcgtacaccaagctagccctagat

SEQ ID NO: 623481 - DNA, 25 bp, Rattus norvegicus
tgcgtaccggctctgcttcaggcat

SEQ ID NO: 623482 - DNA, 25 bp, Rattus norvegicus
tgcgtaccggctgtgcttcaggcat

SEQ ID NO: 623483 - DNA, 25 bp, Rattus norvegicus
tgcgtaccgggcagctacaacaact

SEQ ID NO: 623484 - DNA, 25 bp, Rattus norvegicus
tgcgtaccgggctgctacaacaact

SEQ ID NO: 623485 - DNA, 25 bp, Rattus norvegicus
tgcgtaccttcacttgtctgcaagt

SEQ ID NO: 623486 - DNA, 25 bp, Rattus norvegicus
tgcgtaccttcagttgtctgcaagt

SEQ ID NO: 623487 - DNA, 25 bp, Rattus norvegicus
tgcgtacggcttctctcccgtgtga

SEQ ID NO: 623488 - DNA, 25 bp, Rattus norvegicus
tgcgtacggcttgtctcccgtgtga

SEQ ID NO: 623489 - DNA, 25 bp, Rattus norvegicus
tgcgtatatgtacctcttgttgcat

SEQ ID NO: 623490 - DNA, 25 bp, Rattus norvegicus
tgcgtatatgtagctcttgttgcat

SEQ ID NO: 623491 - DNA, 25 bp, Rattus norvegicus
tgcgtatctacaacaaggcctggtg

SEQ ID NO: 623492 - DNA, 25 bp, Rattus norvegicus
tgcgtatctacatcaaggcctggtg

SEQ ID NO: 623493 - DNA, 25 bp, Rattus norvegicus
tgcgtatctgtaaccctgggcaaca

SEQ ID NO: 623494 - DNA, 25 bp, Rattus norvegicus
tgcgtatctgtatccctgggcaaca

SEQ ID NO: 623495 - DNA, 25 bp, Rattus norvegicus
tgcgtatcttttacacacaaatgtt

SEQ ID NO: 623496 - DNA, 25 bp, Rattus norvegicus
tgcgtatctttttcacacaaatgtt

SEQ ID NO: 623497 - DNA, 25 bp, Rattus norvegicus
tgcgtatgtacacccactctctgaa

SEQ ID NO: 623498 - DNA, 25 bp, Rattus norvegicus
tgcgtatgtacagccactctctgaa

SEQ ID NO: 623499 - DNA, 25 bp, Rattus norvegicus
tgcgtattcaggctgcttttgctgc

SEQ ID NO: 623500 - DNA, 25 bp, Rattus norvegicus
tgcgtattcagggtgcttttgctgc

SEQ ID NO: 623501 - DNA, 25 bp, Rattus norvegicus
tgcgtatttgggactagggccttac

SEQ ID NO: 623502 - DNA, 25 bp, Rattus norvegicus
tgcgtatttgggtctagggccttac

SEQ ID NO: 623503 - DNA, 25 bp, Rattus norvegicus
tgcgtcacgtcaagacgaacctggg

SEQ ID NO: 623504 - DNA, 25 bp, Rattus norvegicus
tgcgtcacgtcatgacgaacctggg

SEQ ID NO: 623505 - DNA, 25 bp, Rattus norvegicus
tgcgtcagtacgaggacgccttctt

SEQ ID NO: 623506 - DNA, 25 bp, Rattus norvegicus
tgcgtcagtacgtggacgccttctt

SEQ ID NO: 623507 - DNA, 25 bp, Rattus norvegicus
tgcgtcatgttaccactgtgattgt

SEQ ID NO: 623508 - DNA, 25 bp, Rattus norvegicus
tgcgtcatgttagcactgtgattgt

SEQ ID NO: 623509 - DNA, 25 bp, Rattus norvegicus
tgcgtccacatgagagggctgccct

SEQ ID NO: 623510 - DNA, 25 bp, Rattus norvegicus
tgcgtccacatgtgagggctgccct

SEQ ID NO: 623511 - DNA, 25 bp, Rattus norvegicus
tgcgtccagctcagtctcagaagag

SEQ ID NO: 623512 - DNA, 25 bp, Rattus norvegicus
tgcgtccagctctgtctcagaagag

SEQ ID NO: 623513 - DNA, 25 bp, Rattus norvegicus
tgcgtcccatgcactgttaaacaca

SEQ ID NO: 623514 - DNA, 25 bp, Rattus norvegicus
tgcgtcccatgctctgttaaacaca

SEQ ID NO: 623515 - DNA, 25 bp, Rattus norvegicus
tgcgtccccaaaaatttagtacaag

SEQ ID NO: 623516 - DNA, 25 bp, Rattus norvegicus
tgcgtccccaaatatttagtacaag

SEQ ID NO: 623517 - DNA, 25 bp, Rattus norvegicus
tgcgtccctaccactggtggaaaaa

SEQ ID NO: 623518 - DNA, 25 bp, Rattus norvegicus
tgcgtccctacctctggtggaaaaa

SEQ ID NO: 623519 - DNA, 25 bp, Rattus norvegicus
tgcgtccctcacagaaaccttgaac

SEQ ID NO: 623520 - DNA, 25 bp, Rattus norvegicus
tgcgtccctcactgaaaccttgaac

SEQ ID NO: 623521 - DNA, 25 bp, Rattus norvegicus
tgcgtccctctaactggatctgaac

SEQ ID NO: 623522 - DNA, 25 bp, Rattus norvegicus
tgcgtccctctatctggatctgaac

SEQ ID NO: 623523 - DNA, 25 bp, Rattus norvegicus
tgcgtcgcatccatcgaggtgagga

SEQ ID NO: 623524 - DNA, 25 bp, Rattus norvegicus
tgcgtcgcatccttcgaggtgagga

SEQ ID NO: 623525 - DNA, 25 bp, Rattus norvegicus
tgcgtctacaggactgacctgtgct

SEQ ID NO: 623526 - DNA, 25 bp, Rattus norvegicus
tgcgtctacaggtctgacctgtgct

SEQ ID NO: 623527 - DNA, 25 bp, Rattus norvegicus
tgcgtctactgcagatgtccagcta

SEQ ID NO: 623528 - DNA, 25 bp, Rattus norvegicus
tgcgtctactgctgatgtccagcta

SEQ ID NO: 623529 - DNA, 25 bp, Rattus norvegicus
tgcgtctaggcgctgacgaacgcca

SEQ ID NO: 623530 - DNA, 25 bp, Rattus norvegicus
tgcgtctaggcggtgacgaacgcca

SEQ ID NO: 623531 - DNA, 25 bp, Rattus norvegicus
tgcgtctcacagatcaccttgagaa

SEQ ID NO: 623532 - DNA, 25 bp, Rattus norvegicus
tgcgtctcacagttcaccttgagaa

SEQ ID NO: 623533 - DNA, 25 bp, Rattus norvegicus
tgcgtctcagttactcacatccagt

SEQ ID NO: 623534 - DNA, 25 bp, Rattus norvegicus
tgcgtctcagtttctcacatccagt

SEQ ID NO: 623535 - DNA, 25 bp, Rattus norvegicus
tgcgtctcatccatgcgccagggaa

SEQ ID NO: 623536 - DNA, 25 bp, Rattus norvegicus
tgcgtctcatccttgcgccagggaa

SEQ ID NO: 623537 - DNA, 25 bp, Rattus norvegicus
tgcgtctcggagcaaacgtctgctt

SEQ ID NO: 623538 - DNA, 25 bp, Rattus norvegicus
tgcgtctcggaggaaacgtctgctt

SEQ ID NO: 623539 - DNA, 25 bp, Rattus norvegicus
tgcgtcttcactatcggaggtagta

SEQ ID NO: 623540 - DNA, 25 bp, Rattus norvegicus
tgcgtcttcactttcggaggtagta

SEQ ID NO: 623541 - DNA, 25 bp, Rattus norvegicus
tgcgtcttggtaacacacagtctgt

SEQ ID NO: 623542 - DNA, 25 bp, Rattus norvegicus
tgcgtcttggtatcacacagtctgt

SEQ ID NO: 623543 - DNA, 25 bp, Rattus norvegicus
tgcgtcttgtggagcgtgccctggg

SEQ ID NO: 623544 - DNA, 25 bp, Rattus norvegicus
tgcgtcttgtggtgcgtgccctggg

SEQ ID NO: 623545 - DNA, 25 bp, Rattus norvegicus
tgcgtgacagaactacggctcttct

SEQ ID NO: 623546 - DNA, 25 bp, Rattus norvegicus
tgcgtgacagaagtacggctcttct

SEQ ID NO: 623547 - DNA, 25 bp, Rattus norvegicus
tgcgtgacccttctccagaaaagga

SEQ ID NO: 623548 - DNA, 25 bp, Rattus norvegicus
tgcgtgacccttgtccagaaaagga

SEQ ID NO: 623549 - DNA, 25 bp, Rattus norvegicus
tgcgtgacctcacttcactttgcca

SEQ ID NO: 623550 - DNA, 25 bp, Rattus norvegicus
tgcgtgacctcagttcactttgcca

SEQ ID NO: 623551 - DNA, 25 bp, Rattus norvegicus
tgcgtgacttttaccggcccttcaa

SEQ ID NO: 623552 - DNA, 25 bp, Rattus norvegicus
tgcgtgactttttccggcccttcaa

SEQ ID NO: 623553 - DNA, 25 bp, Rattus norvegicus
tgcgtgaggagtactctgagaccct

SEQ ID NO: 623554 - DNA, 25 bp, Rattus norvegicus
tgcgtgaggagttctctgagaccct

SEQ ID NO: 623555 - DNA, 25 bp, Rattus norvegicus
tgcgtgattatgcatagcccaaaat

SEQ ID NO: 623556 - DNA, 25 bp, Rattus norvegicus
tgcgtgattatggatagcccaaaat

SEQ ID NO: 623557 - DNA, 25 bp, Rattus norvegicus
tgcgtgcaccacagtgaagctttcg

SEQ ID NO: 623558 - DNA, 25 bp, Rattus norvegicus
tgcgtgcaccactgtgaagctttcg

SEQ ID NO: 623559 - DNA, 25 bp, Rattus norvegicus
tgcgtgcacgctatctactgtacga

SEQ ID NO: 623560 - DNA, 25 bp, Rattus norvegicus
tgcgtgcacgctttctactgtacga

SEQ ID NO: 623561 - DNA, 25 bp, Rattus norvegicus
tgcgtgcaggcgattacaccgcaat

SEQ ID NO: 623562 - DNA, 25 bp, Rattus norvegicus
tgcgtgcaggcgtttacaccgcaat

SEQ ID NO: 623563 - DNA, 25 bp, Rattus norvegicus
tgcgtgcatgatatttcccaccgaa

SEQ ID NO: 623564 - DNA, 25 bp, Rattus norvegicus
tgcgtgcatgatttttcccaccgaa

SEQ ID NO: 623565 - DNA, 25 bp, Rattus norvegicus
tgcgtgccagcccaattggttgaaa

SEQ ID NO: 623566 - DNA, 25 bp, Rattus norvegicus
tgcgtgccagccgaattggttgaaa

SEQ ID NO: 623567 - DNA, 25 bp, Rattus norvegicus
tgcgtgcccggaccactttacaaaa

SEQ ID NO: 623568 - DNA, 25 bp, Rattus norvegicus
tgcgtgcccggagcactttacaaaa

SEQ ID NO: 623569 - DNA, 25 bp, Rattus norvegicus
tgcgtgcccggtattatttctaagc

SEQ ID NO: 623570 - DNA, 25 bp, Rattus norvegicus
tgcgtgcccggttttatttctaagc

SEQ ID NO: 623571 - DNA, 25 bp, Rattus norvegicus
tgcgtgcgctcccagttttctccta

SEQ ID NO: 623572 - DNA, 25 bp, Rattus norvegicus
tgcgtgcgctccgagttttctccta

SEQ ID NO: 623573 - DNA, 25 bp, Rattus norvegicus
tgcgtgctgtcgctcaagttcgctt

SEQ ID NO: 623574 - DNA, 25 bp, Rattus norvegicus
tgcgtgctgtcggtcaagttcgctt

SEQ ID NO: 623575 - DNA, 25 bp, Rattus norvegicus
tgcgtgcttctccagagttctgtat

SEQ ID NO: 623576 - DNA, 25 bp, Rattus norvegicus
tgcgtgcttctcgagagttctgtat

SEQ ID NO: 623577 - DNA, 25 bp, Rattus norvegicus
tgcgtggatggcatcccttgaaaat

SEQ ID NO: 623578 - DNA, 25 bp, Rattus norvegicus
tgcgtggatggcttcccttgaaaat

SEQ ID NO: 623579 - DNA, 25 bp, Rattus norvegicus
tgcgtggcacttcttaatctccata

SEQ ID NO: 623580 - DNA, 25 bp, Rattus norvegicus
tgcgtggcacttgttaatctccata

SEQ ID NO: 623581 - DNA, 25 bp, Rattus norvegicus
tgcgtggccctgaacagtgtgacat

SEQ ID NO: 623582 - DNA, 25 bp, Rattus norvegicus
tgcgtggccctgtacagtgtgacat

SEQ ID NO: 623583 - DNA, 25 bp, Rattus norvegicus
tgcgtggcctctcgctctatggcaa

SEQ ID NO: 623584 - DNA, 25 bp, Rattus norvegicus
tgcgtggcctctggctctatggcaa

SEQ ID NO: 623585 - DNA, 25 bp, Rattus norvegicus
tgcgtggcctttctgtgtaacatag

SEQ ID NO: 623586 - DNA, 25 bp, Rattus norvegicus
tgcgtggcctttgtgtgtaacatag

SEQ ID NO: 623587 - DNA, 25 bp, Rattus norvegicus
tgcgtggcgacaagcagcagctgaa

SEQ ID NO: 623588 - DNA, 25 bp, Rattus norvegicus
tgcgtggcgacatgcagcagctgaa

SEQ ID NO: 623589 - DNA, 25 bp, Rattus norvegicus
tgcgtgggatgtattttctctgctc

SEQ ID NO: 623590 - DNA, 25 bp, Rattus norvegicus
tgcgtgggatgttttttctctgctc

SEQ ID NO: 623591 - DNA, 25 bp, Rattus norvegicus
tgcgtgggccggcaaacacactgca

SEQ ID NO: 623592 - DNA, 25 bp, Rattus norvegicus
tgcgtgggccgggaaacacactgca

SEQ ID NO: 623593 - DNA, 25 bp, Rattus norvegicus
tgcgtggtaccacggctagccaatg

SEQ ID NO: 623594 - DNA, 25 bp, Rattus norvegicus
tgcgtggtaccagggctagccaatg

SEQ ID NO: 623595 - DNA, 25 bp, Rattus norvegicus
tgcgtggttactacctggcaagcac

SEQ ID NO: 623596 - DNA, 25 bp, Rattus norvegicus
tgcgtggttacttcctggcaagcac

SEQ ID NO: 623597 - DNA, 25 bp, Rattus norvegicus
tgcgtggttctcacatctcgtttct

SEQ ID NO: 623598 - DNA, 25 bp, Rattus norvegicus
tgcgtggttctctcatctcgtttct

SEQ ID NO: 623599 - DNA, 25 bp, Rattus norvegicus
tgcgtggttgctcagccgcaagctc

SEQ ID NO: 623600 - DNA, 25 bp, Rattus norvegicus
tgcgtggttgctgagccgcaagctc

SEQ ID NO: 623601 - DNA, 25 bp, Rattus norvegicus
tgcgtgtaactcactgcacttggga

SEQ ID NO: 623602 - DNA, 25 bp, Rattus norvegicus
tgcgtgtaactcatagctcttggac

SEQ ID NO: 623603 - DNA, 25 bp, Rattus norvegicus
tgcgtgtaactctctgcacttggga

SEQ ID NO: 623604 - DNA, 25 bp, Rattus norvegicus
tgcgtgtaactcttagctcttggac

SEQ ID NO: 623605 - DNA, 25 bp, Rattus norvegicus
tgcgtgtcaggcaccgttctgggta

SEQ ID NO: 623606 - DNA, 25 bp, Rattus norvegicus
tgcgtgtcaggctccgttctgggta

SEQ ID NO: 623607 - DNA, 25 bp, Rattus norvegicus
tgcgtgtctgcaattccagcactca

SEQ ID NO: 623608 - DNA, 25 bp, Rattus norvegicus
tgcgtgtctgcatttccagcactca

SEQ ID NO: 623609 - DNA, 25 bp, Rattus norvegicus
tgcgtgtgatctcagaaccgtgcca

SEQ ID NO: 623610 - DNA, 25 bp, Rattus norvegicus
tgcgtgtgatctgagaaccgtgcca

SEQ ID NO: 623611 - DNA, 25 bp, Rattus norvegicus
tgcgtgtgcttcagtttgagtgtga

SEQ ID NO: 623612 - DNA, 25 bp, Rattus norvegicus
tgcgtgtgcttctgtttgagtgtga

SEQ ID NO: 623613 - DNA, 25 bp, Rattus norvegicus
tgcgtgtgggctatgttcttctagc

SEQ ID NO: 623614 - DNA, 25 bp, Rattus norvegicus
tgcgtgtgggctttgttcttctagc

SEQ ID NO: 623615 - DNA, 25 bp, Rattus norvegicus
tgcgtgttcatcactgggtcattga

SEQ ID NO: 623616 - DNA, 25 bp, Rattus norvegicus
tgcgtgttcatctctgggtcattga

SEQ ID NO: 623617 - DNA, 25 bp, Rattus norvegicus
tgcgtgttccggcttcatttaaaaa

SEQ ID NO: 623618 - DNA, 25 bp, Rattus norvegicus
tgcgtgttccgggttcatttaaaaa

SEQ ID NO: 623619 - DNA, 25 bp, Rattus norvegicus
tgcgtgttctgcaccaggccatgga

SEQ ID NO: 623620 - DNA, 25 bp, Rattus norvegicus
tgcgtgttctgctccaggccatgga

SEQ ID NO: 623621 - DNA, 25 bp, Rattus norvegicus
tgcgtgttctgtattagctgcccct

SEQ ID NO: 623622 - DNA, 25 bp, Rattus norvegicus
tgcgtgttctgttttagctgcccct

SEQ ID NO: 623623 - DNA, 25 bp, Rattus norvegicus
tgcgttacggtcactctcatagaaa

SEQ ID NO: 623624 - DNA, 25 bp, Rattus norvegicus
tgcgttacggtctctctcatagaaa

SEQ ID NO: 623625 - DNA, 25 bp, Rattus norvegicus
tgcgttactatgaccaccgagtgga

SEQ ID NO: 623626 - DNA, 25 bp, Rattus norvegicus
tgcgttactatgtccaccgagtgga

SEQ ID NO: 623627 - DNA, 25 bp, Rattus norvegicus
tgcgttatgaatcagcgccatgctt

SEQ ID NO: 623628 - DNA, 25 bp, Rattus norvegicus
tgcgttatgaatgagcgccatgctt

SEQ ID NO: 623629 - DNA, 25 bp, Rattus norvegicus
tgcgttcatacgcatgcgtgtgcat

SEQ ID NO: 623630 - DNA, 25 bp, Rattus norvegicus
tgcgttcatacggatgcgtgtgcat

SEQ ID NO: 623631 - DNA, 25 bp, Rattus norvegicus
tgcgttcattccagcactctcatat

SEQ ID NO: 623632 - DNA, 25 bp, Rattus norvegicus
tgcgttcattcctgcactctcatat

SEQ ID NO: 623633 - DNA, 25 bp, Rattus norvegicus
tgcgttccaggtcagtgttccgatc

SEQ ID NO: 623634 - DNA, 25 bp, Rattus norvegicus
tgcgttccaggtgagtgttccgatc

SEQ ID NO: 623635 - DNA, 25 bp, Rattus norvegicus
tgcgttccgggccatctcaagcaca

SEQ ID NO: 623636 - DNA, 25 bp, Rattus norvegicus
tgcgttccgggcgatctcaagcaca

SEQ ID NO: 623637 - DNA, 25 bp, Rattus norvegicus
tgcgttcctctgctctgggagtgaa

SEQ ID NO: 623638 - DNA, 25 bp, Rattus norvegicus
tgcgttcctctggtctgggagtgaa

SEQ ID NO: 623639 - DNA, 25 bp, Rattus norvegicus
tgcgttcctgagaattatcacactt

SEQ ID NO: 623640 - DNA, 25 bp, Rattus norvegicus
tgcgttcctgagtattatcacactt

SEQ ID NO: 623641 - DNA, 25 bp, Rattus norvegicus
tgcgttcgccgcaacttggacagtg

SEQ ID NO: 623642 - DNA, 25 bp, Rattus norvegicus
tgcgttcgccgctacttggacagtg

SEQ ID NO: 623643 - DNA, 25 bp, Rattus norvegicus
tgcgttcggcggacgaatacatccg

SEQ ID NO: 623644 - DNA, 25 bp, Rattus norvegicus
tgcgttcggcggtcgaatacatccg

SEQ ID NO: 623645 - DNA, 25 bp, Rattus norvegicus
tgcgttctcaacctttctcaaaaag

SEQ ID NO: 623646 - DNA, 25 bp, Rattus norvegicus
tgcgttctcaacgtttctcaaaaag

SEQ ID NO: 623647 - DNA, 25 bp, Rattus norvegicus
tgcgttctgcttctcagagaccatc

SEQ ID NO: 623648 - DNA, 25 bp, Rattus norvegicus
tgcgttctgcttgtcagagaccatc

SEQ ID NO: 623649 - DNA, 25 bp, Rattus norvegicus
tgcgttcttctaatctgaaagatgt

SEQ ID NO: 623650 - DNA, 25 bp, Rattus norvegicus
tgcgttcttctattctgaaagatgt

SEQ ID NO: 623651 - DNA, 25 bp, Rattus norvegicus
tgcgttcttgatcttgtttgccatg

SEQ ID NO: 623652 - DNA, 25 bp, Rattus norvegicus
tgcgttcttgatgttgtttgccatg

SEQ ID NO: 623653 - DNA, 25 bp, Rattus norvegicus
tgcgttgactctcattgcgttgcca

SEQ ID NO: 623654 - DNA, 25 bp, Rattus norvegicus
tgcgttgactctgattgcgttgcca

SEQ ID NO: 623655 - DNA, 25 bp, Rattus norvegicus
tgcgttgagattacgttttccccaa

SEQ ID NO: 623656 - DNA, 25 bp, Rattus norvegicus
tgcgttgagatttcgttttccccaa

SEQ ID NO: 623657 - DNA, 25 bp, Rattus norvegicus
tgcgttgctgctctggcaacttgca

SEQ ID NO: 623658 - DNA, 25 bp, Rattus norvegicus
tgcgttgctgctgtggcaacttgca

SEQ ID NO: 623659 - DNA, 25 bp, Rattus norvegicus
tgcgttgtgatcagaccctaagggt

SEQ ID NO: 623660 - DNA, 25 bp, Rattus norvegicus
tgcgttgtgatctgaccctaagggt

SEQ ID NO: 623661 - DNA, 25 bp, Rattus norvegicus
tgcgtttcctcgagcaggtgctgct

SEQ ID NO: 623662 - DNA, 25 bp, Rattus norvegicus
tgcgtttcctcgtgcaggtgctgct

SEQ ID NO: 623663 - DNA, 25 bp, Rattus norvegicus
tgcgtttcttatataatccctctca

SEQ ID NO: 623664 - DNA, 25 bp, Rattus norvegicus
tgcgtttcttatttaatccctctca

SEQ ID NO: 623665 - DNA, 25 bp, Rattus norvegicus
tgcgtttcttgtatcttttgcgttt

SEQ ID NO: 623666 - DNA, 25 bp, Rattus norvegicus
tgcgtttcttgtttcttttgcgttt

SEQ ID NO: 623667 - DNA, 25 bp, Rattus norvegicus
tgcgttttccatacaacagtgcctg

SEQ ID NO: 623668 - DNA, 25 bp, Rattus norvegicus
tgcgttttccattcaacagtgcctg

SEQ ID NO: 623669 - DNA, 25 bp, Rattus norvegicus
tgcgttttgccaaatcagtctctaa

SEQ ID NO: 623670 - DNA, 25 bp, Rattus norvegicus
tgcgttttgccatatcagtctctaa

SEQ ID NO: 623671 - DNA, 25 bp, Rattus norvegicus
tgcgttttgcttattcactctgaaa

SEQ ID NO: 623672 - DNA, 25 bp, Rattus norvegicus
tgcgttttgctttttcactctgaaa

SEQ ID NO: 623673 - DNA, 25 bp, Rattus norvegicus
tgcgttttgggcatcacatgtttaa

SEQ ID NO: 623674 - DNA, 25 bp, Rattus norvegicus
tgcgttttgggcttcacatgtttaa

SEQ ID NO: 623675 - DNA, 25 bp, Rattus norvegicus
tgctaaaacgtgaccccacattgga

SEQ ID NO: 623676 - DNA, 25 bp, Rattus norvegicus
tgctaaaacgtgtccccacattgga

SEQ ID NO: 623677 - DNA, 25 bp, Rattus norvegicus
tgctaaaaggtaaccacccgacggc

SEQ ID NO: 623678 - DNA, 25 bp, Rattus norvegicus
tgctaaaaggtatccacccgacggc

SEQ ID NO: 623679 - DNA, 25 bp, Rattus norvegicus
tgctaaaatgttactgctacagagg

SEQ ID NO: 623680 - DNA, 25 bp, Rattus norvegicus
tgctaaaatgtttctgctacagagg

SEQ ID NO: 623681 - DNA, 25 bp, Rattus norvegicus
tgctaaacagctaccacacttcagg

SEQ ID NO: 623682 - DNA, 25 bp, Rattus norvegicus
tgctaaacagcttccacacttcagg

SEQ ID NO: 623683 - DNA, 25 bp, Rattus norvegicus
tgctaaacggttctgcgctccattt

SEQ ID NO: 623684 - DNA, 25 bp, Rattus norvegicus
tgctaaacggttgtgcgctccattt

SEQ ID NO: 623685 - DNA, 25 bp, Rattus norvegicus
tgctaaactagtatgctctcatgag

SEQ ID NO: 623686 - DNA, 25 bp, Rattus norvegicus
tgctaaactagtttgctctcatgag

SEQ ID NO: 623687 - DNA, 25 bp, Rattus norvegicus
tgctaaagacaccaagttctcctct

SEQ ID NO: 623688 - DNA, 25 bp, Rattus norvegicus
tgctaaagacacgaagttctcctct

SEQ ID NO: 623689 - DNA, 25 bp, Rattus norvegicus
tgctaaagacccagctcataagcct

SEQ ID NO: 623690 - DNA, 25 bp, Rattus norvegicus
tgctaaagaccctgctcataagcct

SEQ ID NO: 623691 - DNA, 25 bp, Rattus norvegicus
tgctaaagagctaaacattcaggtt

SEQ ID NO: 623692 - DNA, 25 bp, Rattus norvegicus
tgctaaagagcttaacattcaggtt

SEQ ID NO: 623693 - DNA, 25 bp, Rattus norvegicus
tgctaaagattccagaacctcccag

SEQ ID NO: 623694 - DNA, 25 bp, Rattus norvegicus
tgctaaagattcgagaacctcccag

SEQ ID NO: 623695 - DNA, 25 bp, Rattus norvegicus
tgctaaagcaccagcggatccacac

SEQ ID NO: 623696 - DNA, 25 bp, Rattus norvegicus
tgctaaagcacctgcggatccacac

SEQ ID NO: 623697 - DNA, 25 bp, Rattus norvegicus
tgctaaatggagaggccgttcccat

SEQ ID NO: 623698 - DNA, 25 bp, Rattus norvegicus
tgctaaatggagtggccgttcccat

SEQ ID NO: 623699 - DNA, 25 bp, Rattus norvegicus
tgctaaatggcccagtggttccctt

SEQ ID NO: 623700 - DNA, 25 bp, Rattus norvegicus
tgctaaatggccgagtggttccctt

SEQ ID NO: 623701 - DNA, 25 bp, Rattus norvegicus
tgctaaattgccagtattcccctgt

SEQ ID NO: 623702 - DNA, 25 bp, Rattus norvegicus
tgctaaattgcctgtattcccctgt

SEQ ID NO: 623703 - DNA, 25 bp, Rattus norvegicus
tgctaacaacagagacgctctggct

SEQ ID NO: 623704 - DNA, 25 bp, Rattus norvegicus
tgctaacaacagtgacgctctggct

SEQ ID NO: 623705 - DNA, 25 bp, Rattus norvegicus
tgctaacagtgcacagtcaagacct

SEQ ID NO: 623706 - DNA, 25 bp, Rattus norvegicus
tgctaacagtgctcagtcaagacct

SEQ ID NO: 623707 - DNA, 25 bp, Rattus norvegicus
tgctaacattgcacccatgggccat

SEQ ID NO: 623708 - DNA, 25 bp, Rattus norvegicus
tgctaacattgctcccatgggccat

SEQ ID NO: 623709 - DNA, 25 bp, Rattus norvegicus
tgctaaccacatacaccaacatctt

SEQ ID NO: 623710 - DNA, 25 bp, Rattus norvegicus
tgctaaccacattcaccaacatctt

SEQ ID NO: 623711 - DNA, 25 bp, Rattus norvegicus
tgctaacccctcacgtaggagatat

SEQ ID NO: 623712 - DNA, 25 bp, Rattus norvegicus
tgctaacccctctcgtaggagatat

SEQ ID NO: 623713 - DNA, 25 bp, Rattus norvegicus
tgctaacccgagagccctgttgaag

SEQ ID NO: 623714 - DNA, 25 bp, Rattus norvegicus
tgctaacccgagtgccctgttgaag

SEQ ID NO: 623715 - DNA, 25 bp, Rattus norvegicus
tgctaacctagcaatttgccagtgg

SEQ ID NO: 623716 - DNA, 25 bp, Rattus norvegicus
tgctaacctagctatttgccagtgg

SEQ ID NO: 623717 - DNA, 25 bp, Rattus norvegicus
tgctaacctctcaaactatctggag

SEQ ID NO: 623718 - DNA, 25 bp, Rattus norvegicus
tgctaacctctctaactatctggag

SEQ ID NO: 623719 - DNA, 25 bp, Rattus norvegicus
tgctaacctgctccatcatacatgt

SEQ ID NO: 623720 - DNA, 25 bp, Rattus norvegicus
tgctaacctgctgcatcatacatgt

SEQ ID NO: 623721 - DNA, 25 bp, Rattus norvegicus
tgctaacgccgtactgtacaaccta

SEQ ID NO: 623722 - DNA, 25 bp, Rattus norvegicus
tgctaacgccgttctgtacaaccta

SEQ ID NO: 623723 - DNA, 25 bp, Rattus norvegicus
tgctaacggacaccatctgtggatt

SEQ ID NO: 623724 - DNA, 25 bp, Rattus norvegicus
tgctaacggacagcatctgtggatt

SEQ ID NO: 623725 - DNA, 25 bp, Rattus norvegicus
tgctaacgtaacattctcaaggaat

SEQ ID NO: 623726 - DNA, 25 bp, Rattus norvegicus
tgctaacgtaactttctcaaggaat

SEQ ID NO: 623727 - DNA, 25 bp, Rattus norvegicus
tgctaacgtgtacatgagaccttgg

SEQ ID NO: 623728 - DNA, 25 bp, Rattus norvegicus
tgctaacgtgtagatgagaccttgg

SEQ ID NO: 623729 - DNA, 25 bp, Rattus norvegicus
tgctaactatgtatggcctgcccca

SEQ ID NO: 623730 - DNA, 25 bp, Rattus norvegicus
tgctaactatgtttggcctgcccca

SEQ ID NO: 623731 - DNA, 25 bp, Rattus norvegicus
tgctaactcatcaaacgcacctttg

SEQ ID NO: 623732 - DNA, 25 bp, Rattus norvegicus
tgctaactcatctaacgcacctttg

SEQ ID NO: 623733 - DNA, 25 bp, Rattus norvegicus
tgctaactgagtctgaggattacct

SEQ ID NO: 623734 - DNA, 25 bp, Rattus norvegicus
tgctaactgagtgtgaggattacct

SEQ ID NO: 623735 - DNA, 25 bp, Rattus norvegicus
tgctaactgcagaaaagacctccat

SEQ ID NO: 623736 - DNA, 25 bp, Rattus norvegicus
tgctaactgcagtaaagacctccat

SEQ ID NO: 623737 - DNA, 25 bp, Rattus norvegicus
tgctaactgcttaccatgtcctaat

SEQ ID NO: 623738 - DNA, 25 bp, Rattus norvegicus
tgctaactgctttccatgtcctaat

SEQ ID NO: 623739 - DNA, 25 bp, Rattus norvegicus
tgctaactttcacacttcattgctg

SEQ ID NO: 623740 - DNA, 25 bp, Rattus norvegicus
tgctaactttcagacttcattgctg

SEQ ID NO: 623741 - DNA, 25 bp, Rattus norvegicus
tgctaagaacacaacccaccatgat

SEQ ID NO: 623742 - DNA, 25 bp, Rattus norvegicus
tgctaagaacactacccaccatgat

SEQ ID NO: 623743 - DNA, 25 bp, Rattus norvegicus
tgctaagaacagactcttgcgtcat

SEQ ID NO: 623744 - DNA, 25 bp, Rattus norvegicus
tgctaagaacagtctcttgcgtcat

SEQ ID NO: 623745 - DNA, 25 bp, Rattus norvegicus
tgctaagaatgcctgtgaccaccta

SEQ ID NO: 623746 - DNA, 25 bp, Rattus norvegicus
tgctaagaatgcgtgtgaccaccta

SEQ ID NO: 623747 - DNA, 25 bp, Rattus norvegicus
tgctaagactctactctgcagggag

SEQ ID NO: 623748 - DNA, 25 bp, Rattus norvegicus
tgctaagactcttctctgcagggag

SEQ ID NO: 623749 - DNA, 25 bp, Rattus norvegicus
tgctaagagagcaatccagactggt

SEQ ID NO: 623750 - DNA, 25 bp, Rattus norvegicus
tgctaagagagctatccagactggt

SEQ ID NO: 623751 - DNA, 25 bp, Rattus norvegicus
tgctaagagcctcgccacagcttgt

SEQ ID NO: 623752 - DNA, 25 bp, Rattus norvegicus
tgctaagagcctggccacagcttgt

SEQ ID NO: 623753 - DNA, 25 bp, Rattus norvegicus
tgctaagagctactatttgcaatta

SEQ ID NO: 623754 - DNA, 25 bp, Rattus norvegicus
tgctaagagctagtatttgcaatta

SEQ ID NO: 623755 - DNA, 25 bp, Rattus norvegicus
tgctaagccccaaataacaccttta

SEQ ID NO: 623756 - DNA, 25 bp, Rattus norvegicus
tgctaagccccatataacaccttta

SEQ ID NO: 623757 - DNA, 25 bp, Rattus norvegicus
tgctaaggcacgaggaagactgttt

SEQ ID NO: 623758 - DNA, 25 bp, Rattus norvegicus
tgctaaggcacgtggaagactgttt

SEQ ID NO: 623759 - DNA, 25 bp, Rattus norvegicus
tgctaagggacaactctgtggcctg

SEQ ID NO: 623760 - DNA, 25 bp, Rattus norvegicus
tgctaagggacatctctgtggcctg

SEQ ID NO: 623761 - DNA, 25 bp, Rattus norvegicus
tgctaagggactcggctgctcaaga

SEQ ID NO: 623762 - DNA, 25 bp, Rattus norvegicus
tgctaagggactgggctgctcaaga

SEQ ID NO: 623763 - DNA, 25 bp, Rattus norvegicus
tgctaagggccccaggcttccagaa

SEQ ID NO: 623764 - DNA, 25 bp, Rattus norvegicus
tgctaagggcccgaggcttccagaa

SEQ ID NO: 623765 - DNA, 25 bp, Rattus norvegicus
tgctaagtctggaacaaaggcgttc

SEQ ID NO: 623766 - DNA, 25 bp, Rattus norvegicus
tgctaagtctggtacaaaggcgttc

SEQ ID NO: 623767 - DNA, 25 bp, Rattus norvegicus
tgctaagtgcgtagtgctgtctgta

SEQ ID NO: 623768 - DNA, 25 bp, Rattus norvegicus
tgctaagtgcgttgtgctgtctgta

SEQ ID NO: 623769 - DNA, 25 bp, Rattus norvegicus
tgctaatacccgactaacctaacca

SEQ ID NO: 623770 - DNA, 25 bp, Rattus norvegicus
tgctaatacccgtctaacctaacca

SEQ ID NO: 623771 - DNA, 25 bp, Rattus norvegicus
tgctaataggccagtgtgtaccctt

SEQ ID NO: 623772 - DNA, 25 bp, Rattus norvegicus
tgctaataggccatatgcactgtat

SEQ ID NO: 623773 - DNA, 25 bp, Rattus norvegicus
tgctaataggcctgtgtgtaccctt

SEQ ID NO: 623774 - DNA, 25 bp, Rattus norvegicus
tgctaataggccttatgcactgtat

SEQ ID NO: 623775 - DNA, 25 bp, Rattus norvegicus
tgctaatcacggaggcgcatttcca

SEQ ID NO: 623776 - DNA, 25 bp, Rattus norvegicus
tgctaatcacggtggcgcatttcca

SEQ ID NO: 623777 - DNA, 25 bp, Rattus norvegicus
tgctaatcatttctttgttactgtc

SEQ ID NO: 623778 - DNA, 25 bp, Rattus norvegicus
tgctaatcatttgtttgttactgtc

SEQ ID NO: 623779 - DNA, 25 bp, Rattus norvegicus
tgctaatcttagaaggtcctgtgtt

SEQ ID NO: 623780 - DNA, 25 bp, Rattus norvegicus
tgctaatcttagtaggtcctgtgtt

SEQ ID NO: 623781 - DNA, 25 bp, Rattus norvegicus
tgctaatgctatcagttgctggatt

SEQ ID NO: 623782 - DNA, 25 bp, Rattus norvegicus
tgctaatgctatgagttgctggatt

SEQ ID NO: 623783 - DNA, 25 bp, Rattus norvegicus
tgctaatgcttcactttacttgctt

SEQ ID NO: 623784 - DNA, 25 bp, Rattus norvegicus
tgctaatgcttctctttacttgctt

SEQ ID NO: 623785 - DNA, 25 bp, Rattus norvegicus
tgctaatggcctactactttttcag

SEQ ID NO: 623786 - DNA, 25 bp, Rattus norvegicus
tgctaatggccttctactttttcag

SEQ ID NO: 623787 - DNA, 25 bp, Rattus norvegicus
tgctaattcattcccacttacattc

SEQ ID NO: 623788 - DNA, 25 bp, Rattus norvegicus
tgctaattcattgccacttacattc

SEQ ID NO: 623789 - DNA, 25 bp, Rattus norvegicus
tgctacaaactgaactctccagctt

SEQ ID NO: 623790 - DNA, 25 bp, Rattus norvegicus
tgctacaaactgtactctccagctt

SEQ ID NO: 623791 - DNA, 25 bp, Rattus norvegicus
tgctacaatgaaacaccgtgactga

SEQ ID NO: 623792 - DNA, 25 bp, Rattus norvegicus
tgctacaatgaatcaccgtgactga

SEQ ID NO: 623793 - DNA, 25 bp, Rattus norvegicus
tgctacaattaaacctcatccttct

SEQ ID NO: 623794 - DNA, 25 bp, Rattus norvegicus
tgctacaattaatcctcatccttct

SEQ ID NO: 623795 - DNA, 25 bp, Rattus norvegicus
tgctacacagctctcttgcttcttc

SEQ ID NO: 623796 - DNA, 25 bp, Rattus norvegicus
tgctacacagctgtcttgcttcttc

SEQ ID NO: 623797 - DNA, 25 bp, Rattus norvegicus
tgctacaccggtatctgactttata

SEQ ID NO: 623798 - DNA, 25 bp, Rattus norvegicus
tgctacaccggtttctgactttata

SEQ ID NO: 623799 - DNA, 25 bp, Rattus norvegicus
tgctacaccttaaaacgcctgctga

SEQ ID NO: 623800 - DNA, 25 bp, Rattus norvegicus
tgctacaccttataacgcctgctga

SEQ ID NO: 623801 - DNA, 25 bp, Rattus norvegicus
tgctacactacacacccaagatgga

SEQ ID NO: 623802 - DNA, 25 bp, Rattus norvegicus
tgctacactacagacccaagatgga

SEQ ID NO: 623803 - DNA, 25 bp, Rattus norvegicus
tgctacactactccttatatttggt

SEQ ID NO: 623804 - DNA, 25 bp, Rattus norvegicus
tgctacactactgcttatatttggt

SEQ ID NO: 623805 - DNA, 25 bp, Rattus norvegicus
tgctacactgagcaggagtctcaga

SEQ ID NO: 623806 - DNA, 25 bp, Rattus norvegicus
tgctacactgaggaggagtctcaga

SEQ ID NO: 623807 - DNA, 25 bp, Rattus norvegicus
tgctacagaatccagatcaacttca

SEQ ID NO: 623808 - DNA, 25 bp, Rattus norvegicus
tgctacagaatcgagatcaacttca

SEQ ID NO: 623809 - DNA, 25 bp, Rattus norvegicus
tgctacagacagacgacactcctat

SEQ ID NO: 623810 - DNA, 25 bp, Rattus norvegicus
tgctacagacagtcgacactcctat

SEQ ID NO: 623811 - DNA, 25 bp, Rattus norvegicus
tgctacagagccagactcttagccc

SEQ ID NO: 623812 - DNA, 25 bp, Rattus norvegicus
tgctacagagcctgactcttagccc

SEQ ID NO: 623813 - DNA, 25 bp, Rattus norvegicus
tgctacagcagcaggtcaagcagct

SEQ ID NO: 623814 - DNA, 25 bp, Rattus norvegicus
tgctacagcagctggtcaagcagct

SEQ ID NO: 623815 - DNA, 25 bp, Rattus norvegicus
tgctacagcatgatccaagtcgctc

SEQ ID NO: 623816 - DNA, 25 bp, Rattus norvegicus
tgctacagcatgttccaagtcgctc

SEQ ID NO: 623817 - DNA, 25 bp, Rattus norvegicus
tgctacagcccacactggagatcaa

SEQ ID NO: 623818 - DNA, 25 bp, Rattus norvegicus
tgctacagcccagactggagatcaa

SEQ ID NO: 623819 - DNA, 25 bp, Rattus norvegicus
tgctacaggcagagtacaccgaggg

SEQ ID NO: 623820 - DNA, 25 bp, Rattus norvegicus
tgctacaggcagtgtacaccgaggg

SEQ ID NO: 623821 - DNA, 25 bp, Rattus norvegicus
tgctacagtaacattttgttcccgg

SEQ ID NO: 623822 - DNA, 25 bp, Rattus norvegicus
tgctacagtaactttttgttcccgg

SEQ ID NO: 623823 - DNA, 25 bp, Rattus norvegicus
tgctacatagcaactgttcccttac

SEQ ID NO: 623824 - DNA, 25 bp, Rattus norvegicus
tgctacatagcaccctagaaatttc

SEQ ID NO: 623825 - DNA, 25 bp, Rattus norvegicus
tgctacatagcagcctagaaatttc

SEQ ID NO: 623826 - DNA, 25 bp, Rattus norvegicus
tgctacatagcatctgttcccttac

SEQ ID NO: 623827 - DNA, 25 bp, Rattus norvegicus
tgctacatcagcctctggattacac

SEQ ID NO: 623828 - DNA, 25 bp, Rattus norvegicus
tgctacatcagcgtctggattacac

SEQ ID NO: 623829 - DNA, 25 bp, Rattus norvegicus
tgctacatcggcatcgagagctctt

SEQ ID NO: 623830 - DNA, 25 bp, Rattus norvegicus
tgctacatcggcttcgagagctctt

SEQ ID NO: 623831 - DNA, 25 bp, Rattus norvegicus
tgctacatgtctccacgtgagtgct

SEQ ID NO: 623832 - DNA, 25 bp, Rattus norvegicus
tgctacatgtctgcacgtgagtgct

SEQ ID NO: 623833 - DNA, 25 bp, Rattus norvegicus
tgctaccaactcaaccatattctta

SEQ ID NO: 623834 - DNA, 25 bp, Rattus norvegicus
tgctaccaactctaccatattctta

SEQ ID NO: 623835 - DNA, 25 bp, Rattus norvegicus
tgctaccaaggactgcccacacatg

SEQ ID NO: 623836 - DNA, 25 bp, Rattus norvegicus
tgctaccaaggagtgcccacacatg

SEQ ID NO: 623837 - DNA, 25 bp, Rattus norvegicus
tgctaccagattattgacaccacgg

SEQ ID NO: 623838 - DNA, 25 bp, Rattus norvegicus
tgctaccagatttttgacaccacgg

SEQ ID NO: 623839 - DNA, 25 bp, Rattus norvegicus
tgctaccagcagacttcacagtggt

SEQ ID NO: 623840 - DNA, 25 bp, Rattus norvegicus
tgctaccagcagatgcactggctaa

SEQ ID NO: 623841 - DNA, 25 bp, Rattus norvegicus
tgctaccagcagtcttcacagtggt

SEQ ID NO: 623842 - DNA, 25 bp, Rattus norvegicus
tgctaccagcagttgcactggctaa

SEQ ID NO: 623843 - DNA, 25 bp, Rattus norvegicus
tgctaccaggaaatgcataggaatc

SEQ ID NO: 623844 - DNA, 25 bp, Rattus norvegicus
tgctaccaggaattgcataggaatc

SEQ ID NO: 623845 - DNA, 25 bp, Rattus norvegicus
tgctaccattctcacatatcctgtg

SEQ ID NO: 623846 - DNA, 25 bp, Rattus norvegicus
tgctaccattctgacatatcctgtg

SEQ ID NO: 623847 - DNA, 25 bp, Rattus norvegicus
tgctacccacagcagattagtcctt

SEQ ID NO: 623848 - DNA, 25 bp, Rattus norvegicus
tgctacccacaggagattagtcctt

SEQ ID NO: 623849 - DNA, 25 bp, Rattus norvegicus
tgctacccagggaaatattttcata

SEQ ID NO: 623850 - DNA, 25 bp, Rattus norvegicus
tgctacccagggtaatattttcata

SEQ ID NO: 623851 - DNA, 25 bp, Rattus norvegicus
tgctacccctttatgttggacacaa

SEQ ID NO: 623852 - DNA, 25 bp, Rattus norvegicus
tgctacccctttttgttggacacaa

SEQ ID NO: 623853 - DNA, 25 bp, Rattus norvegicus
tgctaccctgatcgctcagtttatt

SEQ ID NO: 623854 - DNA, 25 bp, Rattus norvegicus
tgctaccctgatggctcagtttatt

SEQ ID NO: 623855 - DNA, 25 bp, Rattus norvegicus
tgctaccgcctcatctttttgatag

SEQ ID NO: 623856 - DNA, 25 bp, Rattus norvegicus
tgctaccgcctcttctttttgatag

SEQ ID NO: 623857 - DNA, 25 bp, Rattus norvegicus
tgctaccgtgaccatctgcatgagg

SEQ ID NO: 623858 - DNA, 25 bp, Rattus norvegicus
tgctaccgtgacgatctgcatgagg

SEQ ID NO: 623859 - DNA, 25 bp, Rattus norvegicus
tgctacctagccctccagggctggg

SEQ ID NO: 623860 - DNA, 25 bp, Rattus norvegicus
tgctacctagccgtccagggctggg

SEQ ID NO: 623861 - DNA, 25 bp, Rattus norvegicus
tgctacctcagacctgcatttgtca

SEQ ID NO: 623862 - DNA, 25 bp, Rattus norvegicus
tgctacctcagagctgcatttgtca

SEQ ID NO: 623863 - DNA, 25 bp, Rattus norvegicus
tgctacctccgtcgctggcctagag

SEQ ID NO: 623864 - DNA, 25 bp, Rattus norvegicus
tgctacctccgtggctggcctagag

SEQ ID NO: 623865 - DNA, 25 bp, Rattus norvegicus
tgctacctggcaccttctgaaagga

SEQ ID NO: 623866 - DNA, 25 bp, Rattus norvegicus
tgctacctggcagcttctgaaagga

SEQ ID NO: 623867 - DNA, 25 bp, Rattus norvegicus
tgctacgagactagccactaaacga

SEQ ID NO: 623868 - DNA, 25 bp, Rattus norvegicus
tgctacgagacttgccactaaacga

SEQ ID NO: 623869 - DNA, 25 bp, Rattus norvegicus
tgctacgatggcacagctcaggtgt

SEQ ID NO: 623870 - DNA, 25 bp, Rattus norvegicus
tgctacgatggctcagctcaggtgt

SEQ ID NO: 623871 - DNA, 25 bp, Rattus norvegicus
tgctacgcgtcaaacgtctcgagaa

SEQ ID NO: 623872 - DNA, 25 bp, Rattus norvegicus
tgctacgcgtcatacgtctcgagaa

SEQ ID NO: 623873 - DNA, 25 bp, Rattus norvegicus
tgctacgcttctaccagatttaatt

SEQ ID NO: 623874 - DNA, 25 bp, Rattus norvegicus
tgctacgcttcttccagatttaatt

SEQ ID NO: 623875 - DNA, 25 bp, Rattus norvegicus
tgctacgcttgaacttggtccttga

SEQ ID NO: 623876 - DNA, 25 bp, Rattus norvegicus
tgctacgcttgatcttggtccttga

SEQ ID NO: 623877 - DNA, 25 bp, Rattus norvegicus
tgctacggactcacgacagaactca

SEQ ID NO: 623878 - DNA, 25 bp, Rattus norvegicus
tgctacggactctcgacagaactca

SEQ ID NO: 623879 - DNA, 25 bp, Rattus norvegicus
tgctacgggcggcagactcacgtcc

SEQ ID NO: 623880 - DNA, 25 bp, Rattus norvegicus
tgctacgggcgggagactcacgtcc

SEQ ID NO: 623881 - DNA, 25 bp, Rattus norvegicus
tgctacgtgcccaacatgggaactg

SEQ ID NO: 623882 - DNA, 25 bp, Rattus norvegicus
tgctacgtgccctacatgggaactg

SEQ ID NO: 623883 - DNA, 25 bp, Rattus norvegicus
tgctacgtggtcagcgtgcttacag

SEQ ID NO: 623884 - DNA, 25 bp, Rattus norvegicus
tgctacgtggtctgcgtgcttacag

SEQ ID NO: 623885 - DNA, 25 bp, Rattus norvegicus
tgctactagtagacacttgctctgt

SEQ ID NO: 623886 - DNA, 25 bp, Rattus norvegicus
tgctactagtagtcacttgctctgt

SEQ ID NO: 623887 - DNA, 25 bp, Rattus norvegicus
tgctactcaactacgcagtgcgttt

SEQ ID NO: 623888 - DNA, 25 bp, Rattus norvegicus
tgctactcaacttcgcagtgcgttt

SEQ ID NO: 623889 - DNA, 25 bp, Rattus norvegicus
tgctactccaggatcagggaatcta

SEQ ID NO: 623890 - DNA, 25 bp, Rattus norvegicus
tgctactccaggttcagggaatcta

SEQ ID NO: 623891 - DNA, 25 bp, Rattus norvegicus
tgctactcctcaactgtgagcgaat

SEQ ID NO: 623892 - DNA, 25 bp, Rattus norvegicus
tgctactcctcatctgtgagcgaat

SEQ ID NO: 623893 - DNA, 25 bp, Rattus norvegicus
tgctactcgcgacagttcatcacct

SEQ ID NO: 623894 - DNA, 25 bp, Rattus norvegicus
tgctactcgcgagagttcatcacct

SEQ ID NO: 623895 - DNA, 25 bp, Rattus norvegicus
tgctactctctaaatgttccagatt

SEQ ID NO: 623896 - DNA, 25 bp, Rattus norvegicus
tgctactctctatatgttccagatt

SEQ ID NO: 623897 - DNA, 25 bp, Rattus norvegicus
tgctactgaagaagcccctgcggcc

SEQ ID NO: 623898 - DNA, 25 bp, Rattus norvegicus
tgctactgaagatgcccctgcggcc

SEQ ID NO: 623899 - DNA, 25 bp, Rattus norvegicus
tgctactgacatagctgtccccaga

SEQ ID NO: 623900 - DNA, 25 bp, Rattus norvegicus
tgctactgacattgctgtccccaga

SEQ ID NO: 623901 - DNA, 25 bp, Rattus norvegicus
tgctactgagcaatttcttttggaa

SEQ ID NO: 623902 - DNA, 25 bp, Rattus norvegicus
tgctactgagcattttcttttggaa

SEQ ID NO: 623903 - DNA, 25 bp, Rattus norvegicus
tgctactgcccgctgaattggccaa

SEQ ID NO: 623904 - DNA, 25 bp, Rattus norvegicus
tgctactgcccggtgaattggccaa

SEQ ID NO: 623905 - DNA, 25 bp, Rattus norvegicus
tgctactgctacactgttgtgggtt

SEQ ID NO: 623906 - DNA, 25 bp, Rattus norvegicus
tgctactgctactctgttgtgggtt

SEQ ID NO: 623907 - DNA, 25 bp, Rattus norvegicus
tgctactggaaacttgactaaaatc

SEQ ID NO: 623908 - DNA, 25 bp, Rattus norvegicus
tgctactggaaagttgactaaaatc

SEQ ID NO: 623909 - DNA, 25 bp, Rattus norvegicus
tgctactgtattctcactctctcat

SEQ ID NO: 623910 - DNA, 25 bp, Rattus norvegicus
tgctactgtattgtcactctctcat

SEQ ID NO: 623911 - DNA, 25 bp, Rattus norvegicus
tgctacttcaagcagtgtcccatgt

SEQ ID NO: 623912 - DNA, 25 bp, Rattus norvegicus
tgctacttcaaggagtgtcccatgt

SEQ ID NO: 623913 - DNA, 25 bp, Rattus norvegicus
tgctacttccagaactgcccaagag

SEQ ID NO: 623914 - DNA, 25 bp, Rattus norvegicus
tgctacttccagtactgcccaagag

SEQ ID NO: 623915 - DNA, 25 bp, Rattus norvegicus
tgctacttccgtaacctgggtttgc

SEQ ID NO: 623916 - DNA, 25 bp, Rattus norvegicus
tgctacttccgttacctgggtttgc

SEQ ID NO: 623917 - DNA, 25 bp, Rattus norvegicus
tgctacttggacattggttctcaca

SEQ ID NO: 623918 - DNA, 25 bp, Rattus norvegicus
tgctacttggactttggttctcaca

SEQ ID NO: 623919 - DNA, 25 bp, Rattus norvegicus
tgctacttgggcaacatctggacag

SEQ ID NO: 623920 - DNA, 25 bp, Rattus norvegicus
tgctacttgggctacatctggacag

SEQ ID NO: 623921 - DNA, 25 bp, Rattus norvegicus
tgctacttggtaagtgagggtttca

SEQ ID NO: 623922 - DNA, 25 bp, Rattus norvegicus
tgctacttggtatgtgagggtttca

SEQ ID NO: 623923 - DNA, 25 bp, Rattus norvegicus
tgctactttccaaacccacttagaa

SEQ ID NO: 623924 - DNA, 25 bp, Rattus norvegicus
tgctactttccatacccacttagaa

SEQ ID NO: 623925 - DNA, 25 bp, Rattus norvegicus
tgctactttgcaactaacacctttc

SEQ ID NO: 623926 - DNA, 25 bp, Rattus norvegicus
tgctactttgcatctaacacctttc

SEQ ID NO: 623927 - DNA, 25 bp, Rattus norvegicus
tgctactttttcatcagaggccacg

SEQ ID NO: 623928 - DNA, 25 bp, Rattus norvegicus
tgctactttttcttcagaggccacg

SEQ ID NO: 623929 - DNA, 25 bp, Rattus norvegicus
tgctagaactcacggttagggctgg

SEQ ID NO: 623930 - DNA, 25 bp, Rattus norvegicus
tgctagaactcagggttagggctgg

SEQ ID NO: 623931 - DNA, 25 bp, Rattus norvegicus
tgctagaccatgactgtggctcatt

SEQ ID NO: 623932 - DNA, 25 bp, Rattus norvegicus
tgctagaccatgtctgtggctcatt

SEQ ID NO: 623933 - DNA, 25 bp, Rattus norvegicus
tgctagacctttagttttcttcgcc

SEQ ID NO: 623934 - DNA, 25 bp, Rattus norvegicus
tgctagaccttttgttttcttcgcc

SEQ ID NO: 623935 - DNA, 25 bp, Rattus norvegicus
tgctagacttgaacagagttcctgt

SEQ ID NO: 623936 - DNA, 25 bp, Rattus norvegicus
tgctagacttgatcagagttcctgt

SEQ ID NO: 623937 - DNA, 25 bp, Rattus norvegicus
tgctagagccttaactcaggtggtt

SEQ ID NO: 623938 - DNA, 25 bp, Rattus norvegicus
tgctagagcctttactcaggtggtt

SEQ ID NO: 623939 - DNA, 25 bp, Rattus norvegicus
tgctagaggcacaggcacccctaaa

SEQ ID NO: 623940 - DNA, 25 bp, Rattus norvegicus
tgctagaggcactggcacccctaaa

SEQ ID NO: 623941 - DNA, 25 bp, Rattus norvegicus
tgctagataataccatcatcattac

SEQ ID NO: 623942 - DNA, 25 bp, Rattus norvegicus
tgctagataatagcatcatcattac

SEQ ID NO: 623943 - DNA, 25 bp, Rattus norvegicus
tgctagatccagatgtgcctcagag

SEQ ID NO: 623944 - DNA, 25 bp, Rattus norvegicus
tgctagatccagttgtgcctcagag

SEQ ID NO: 623945 - DNA, 25 bp, Rattus norvegicus
tgctagatgccccagttgagaacca

SEQ ID NO: 623946 - DNA, 25 bp, Rattus norvegicus
tgctagatgcccgagttgagaacca

SEQ ID NO: 623947 - DNA, 25 bp, Rattus norvegicus
tgctagcacacgaaggcctaggcaa

SEQ ID NO: 623948 - DNA, 25 bp, Rattus norvegicus
tgctagcacacgtaggcctaggcaa

SEQ ID NO: 623949 - DNA, 25 bp, Rattus norvegicus
tgctagcagtttatcaggtgtccct

SEQ ID NO: 623950 - DNA, 25 bp, Rattus norvegicus
tgctagcagtttttcaggtgtccct

SEQ ID NO: 623951 - DNA, 25 bp, Rattus norvegicus
tgctagcattataaccaggcctcaa

SEQ ID NO: 623952 - DNA, 25 bp, Rattus norvegicus
tgctagcattattaccaggcctcaa

SEQ ID NO: 623953 - DNA, 25 bp, Rattus norvegicus
tgctagcattggcacccagggcctt

SEQ ID NO: 623954 - DNA, 25 bp, Rattus norvegicus
tgctagcattgggacccagggcctt

SEQ ID NO: 623955 - DNA, 25 bp, Rattus norvegicus
tgctagccaagtactctaccagctc

SEQ ID NO: 623956 - DNA, 25 bp, Rattus norvegicus
tgctagccaagttctctaccagctc

SEQ ID NO: 623957 - DNA, 25 bp, Rattus norvegicus
tgctagccagcaaacgtttcttcat

SEQ ID NO: 623958 - DNA, 25 bp, Rattus norvegicus
tgctagccagcatacgtttcttcat

SEQ ID NO: 623959 - DNA, 25 bp, Rattus norvegicus
tgctagccagttagaacccctttat

SEQ ID NO: 623960 - DNA, 25 bp, Rattus norvegicus
tgctagccagtttgaacccctttat

SEQ ID NO: 623961 - DNA, 25 bp, Rattus norvegicus
tgctagccctgcatctgacctgcaa

SEQ ID NO: 623962 - DNA, 25 bp, Rattus norvegicus
tgctagccctgcttctgacctgcaa

SEQ ID NO: 623963 - DNA, 25 bp, Rattus norvegicus
tgctagcctctaactttatgtgaag

SEQ ID NO: 623964 - DNA, 25 bp, Rattus norvegicus
tgctagcctctatctttatgtgaag

SEQ ID NO: 623965 - DNA, 25 bp, Rattus norvegicus
tgctagcctgtcatggtgggtttga

SEQ ID NO: 623966 - DNA, 25 bp, Rattus norvegicus
tgctagcctgtcttggtgggtttga

SEQ ID NO: 623967 - DNA, 25 bp, Rattus norvegicus
tgctagctagaaatgcttcccgacc

SEQ ID NO: 623968 - DNA, 25 bp, Rattus norvegicus
tgctagctagaattgcttcccgacc

SEQ ID NO: 623969 - DNA, 25 bp, Rattus norvegicus
tgctagctgtcaccattcaaatatt

SEQ ID NO: 623970 - DNA, 25 bp, Rattus norvegicus
tgctagctgtcagcattcaaatatt

SEQ ID NO: 623971 - DNA, 25 bp, Rattus norvegicus
tgctagcttaccagctaggagagaa

SEQ ID NO: 623972 - DNA, 25 bp, Rattus norvegicus
tgctagcttacctgctaggagagaa

SEQ ID NO: 623973 - DNA, 25 bp, Rattus norvegicus
tgctagcttacgacgctgcatgtta

SEQ ID NO: 623974 - DNA, 25 bp, Rattus norvegicus
tgctagcttacgtcgctgcatgtta

SEQ ID NO: 623975 - DNA, 25 bp, Rattus norvegicus
tgctagcttcttcagttctgcctga

SEQ ID NO: 623976 - DNA, 25 bp, Rattus norvegicus
tgctagcttcttgagttctgcctga

SEQ ID NO: 623977 - DNA, 25 bp, Rattus norvegicus
tgctaggaagctcccaaggtcacag

SEQ ID NO: 623978 - DNA, 25 bp, Rattus norvegicus
tgctaggaagctgccaaggtcacag

SEQ ID NO: 623979 - DNA, 25 bp, Rattus norvegicus
tgctaggacctactgtaccagctga

SEQ ID NO: 623980 - DNA, 25 bp, Rattus norvegicus
tgctaggacctagtgtaccagctga

SEQ ID NO: 623981 - DNA, 25 bp, Rattus norvegicus
tgctaggagcagagacttcccgcta

SEQ ID NO: 623982 - DNA, 25 bp, Rattus norvegicus
tgctaggagcagtgacttcccgcta

SEQ ID NO: 623983 - DNA, 25 bp, Rattus norvegicus
tgctaggcaaggcagtgcacactct

SEQ ID NO: 623984 - DNA, 25 bp, Rattus norvegicus
tgctaggcaagggagtgcacactct

SEQ ID NO: 623985 - DNA, 25 bp, Rattus norvegicus
tgctaggcacatcaggtatcacact

SEQ ID NO: 623986 - DNA, 25 bp, Rattus norvegicus
tgctaggcacatgaggtatcacact

SEQ ID NO: 623987 - DNA, 25 bp, Rattus norvegicus
tgctaggcctgcctgctcattaaca

SEQ ID NO: 623988 - DNA, 25 bp, Rattus norvegicus
tgctaggcctgcgtgctcattaaca

SEQ ID NO: 623989 - DNA, 25 bp, Rattus norvegicus
tgctaggcggagcatcctcggagct

SEQ ID NO: 623990 - DNA, 25 bp, Rattus norvegicus
tgctaggcggaggatcctcggagct

SEQ ID NO: 623991 - DNA, 25 bp, Rattus norvegicus
tgctaggctctacactgcctcggtg

SEQ ID NO: 623992 - DNA, 25 bp, Rattus norvegicus
tgctaggctctagactgcctcggtg

SEQ ID NO: 623993 - DNA, 25 bp, Rattus norvegicus
tgctagggcctaatatttttaacca

SEQ ID NO: 623994 - DNA, 25 bp, Rattus norvegicus
tgctagggcctattatttttaacca

SEQ ID NO: 623995 - DNA, 25 bp, Rattus norvegicus
tgctagggttaaaggtgttgtcact

SEQ ID NO: 623996 - DNA, 25 bp, Rattus norvegicus
tgctagggttaatggtgttgtcact

SEQ ID NO: 623997 - DNA, 25 bp, Rattus norvegicus
tgctagtaatttactcctcgtgtaa

SEQ ID NO: 623998 - DNA, 25 bp, Rattus norvegicus
tgctagtaattttctcctcgtgtaa

SEQ ID NO: 623999 - DNA, 25 bp, Rattus norvegicus
tgctagtcccgaaggcgatgacctg

SEQ ID NO: 624000 - DNA, 25 bp, Rattus norvegicus
tgctagtcccgatggcgatgacctg

SEQ ID NO: 624001 - DNA, 25 bp, Rattus norvegicus
tgctagtccggccttgaagagaagt

SEQ ID NO: 624002 - DNA, 25 bp, Rattus norvegicus
tgctagtccggcgttgaagagaagt

SEQ ID NO: 624003 - DNA, 25 bp, Rattus norvegicus
tgctagtctaacaggaagtcggtat

SEQ ID NO: 624004 - DNA, 25 bp, Rattus norvegicus
tgctagtctaactggaagtcggtat

SEQ ID NO: 624005 - DNA, 25 bp, Rattus norvegicus
tgctagtctgcgagttaccccaaaa

SEQ ID NO: 624006 - DNA, 25 bp, Rattus norvegicus
tgctagtctgcgtgttaccccaaaa

SEQ ID NO: 624007 - DNA, 25 bp, Rattus norvegicus
tgctagtcttcactgcttttcatgc

SEQ ID NO: 624008 - DNA, 25 bp, Rattus norvegicus
tgctagtcttcagtgcttttcatgc

SEQ ID NO: 624009 - DNA, 25 bp, Rattus norvegicus
tgctagtgagtaactttcttgtgct

SEQ ID NO: 624010 - DNA, 25 bp, Rattus norvegicus
tgctagtgagtatctttcttgtgct

SEQ ID NO: 624011 - DNA, 25 bp, Rattus norvegicus
tgctagtgcgcaacagtaatcccag

SEQ ID NO: 624012 - DNA, 25 bp, Rattus norvegicus
tgctagtgcgcatcagtaatcccag

SEQ ID NO: 624013 - DNA, 25 bp, Rattus norvegicus
tgctagtggtgaccctatggttttc

SEQ ID NO: 624014 - DNA, 25 bp, Rattus norvegicus
tgctagtggtgagcctatggttttc

SEQ ID NO: 624015 - DNA, 25 bp, Rattus norvegicus
tgctagttaagtcctctacctcgga

SEQ ID NO: 624016 - DNA, 25 bp, Rattus norvegicus
tgctagttaagtgctctacctcgga

SEQ ID NO: 624017 - DNA, 25 bp, Rattus norvegicus
tgctagttacttcggcagtgcttca

SEQ ID NO: 624018 - DNA, 25 bp, Rattus norvegicus
tgctagttacttgggcagtgcttca

SEQ ID NO: 624019 - DNA, 25 bp, Rattus norvegicus
tgctataaaaacagtgactcgctac

SEQ ID NO: 624020 - DNA, 25 bp, Rattus norvegicus
tgctataaaaactgtgactcgctac

SEQ ID NO: 624021 - DNA, 25 bp, Rattus norvegicus
tgctataaaccacagactcaaagat

SEQ ID NO: 624022 - DNA, 25 bp, Rattus norvegicus
tgctataaaccagagactcaaagat

SEQ ID NO: 624023 - DNA, 25 bp, Rattus norvegicus
tgctataacctcctaaaaacccatt

SEQ ID NO: 624024 - DNA, 25 bp, Rattus norvegicus
tgctataacctcgtaaaaacccatt

SEQ ID NO: 624025 - DNA, 25 bp, Rattus norvegicus
tgctataatcctattcacggttcaa

SEQ ID NO: 624026 - DNA, 25 bp, Rattus norvegicus
tgctataatccttttcacggttcaa

SEQ ID NO: 624027 - DNA, 25 bp, Rattus norvegicus
tgctatacagctatggtcccactta

SEQ ID NO: 624028 - DNA, 25 bp, Rattus norvegicus
tgctatacagctttggtcccactta

SEQ ID NO: 624029 - DNA, 25 bp, Rattus norvegicus
tgctatactaatcacaccatttcaa

SEQ ID NO: 624030 - DNA, 25 bp, Rattus norvegicus
tgctatactaatgacaccatttcaa

SEQ ID NO: 624031 - DNA, 25 bp, Rattus norvegicus
tgctatactcttagtgttcttcctt

SEQ ID NO: 624032 - DNA, 25 bp, Rattus norvegicus
tgctatactctttgtgttcttcctt

SEQ ID NO: 624033 - DNA, 25 bp, Rattus norvegicus
tgctatactttaagcatacccctcc

SEQ ID NO: 624034 - DNA, 25 bp, Rattus norvegicus
tgctatactttatgcatacccctcc

SEQ ID NO: 624035 - DNA, 25 bp, Rattus norvegicus
tgctatagccagcatcctgtgattt

SEQ ID NO: 624036 - DNA, 25 bp, Rattus norvegicus
tgctatagccaggatcctgtgattt

SEQ ID NO: 624037 - DNA, 25 bp, Rattus norvegicus
tgctatagggccattcactccagtg

SEQ ID NO: 624038 - DNA, 25 bp, Rattus norvegicus
tgctatagggcctttcactccagtg

SEQ ID NO: 624039 - DNA, 25 bp, Rattus norvegicus
tgctatagggctatcaggctcttgc

SEQ ID NO: 624040 - DNA, 25 bp, Rattus norvegicus
tgctatagggctttcaggctcttgc

SEQ ID NO: 624041 - DNA, 25 bp, Rattus norvegicus
tgctatatattcctggactccttcc

SEQ ID NO: 624042 - DNA, 25 bp, Rattus norvegicus
tgctatatattcgtggactccttcc

SEQ ID NO: 624043 - DNA, 25 bp, Rattus norvegicus
tgctatcaacagagctctatctcct

SEQ ID NO: 624044 - DNA, 25 bp, Rattus norvegicus
tgctatcaacagtgctctatctcct

SEQ ID NO: 624045 - DNA, 25 bp, Rattus norvegicus
tgctatcaccaacctgacagtctgc

SEQ ID NO: 624046 - DNA, 25 bp, Rattus norvegicus
tgctatcaccaagctgacagtctgc

SEQ ID NO: 624047 - DNA, 25 bp, Rattus norvegicus
tgctatcacttcacttgacacttaa

SEQ ID NO: 624048 - DNA, 25 bp, Rattus norvegicus
tgctatcacttctcttgacacttaa

SEQ ID NO: 624049 - DNA, 25 bp, Rattus norvegicus
tgctatcagctaagtacttgacctt

SEQ ID NO: 624050 - DNA, 25 bp, Rattus norvegicus
tgctatcagctatgtacttgacctt

SEQ ID NO: 624051 - DNA, 25 bp, Rattus norvegicus
tgctatcataacaggatgcatgtca

SEQ ID NO: 624052 - DNA, 25 bp, Rattus norvegicus
tgctatcataactggatgcatgtca

SEQ ID NO: 624053 - DNA, 25 bp, Rattus norvegicus
tgctatcatcaaattcccactgacc

SEQ ID NO: 624054 - DNA, 25 bp, Rattus norvegicus
tgctatcatcaatttcccactgacc

SEQ ID NO: 624055 - DNA, 25 bp, Rattus norvegicus
tgctatcattgcatgccgtgtgtcc

SEQ ID NO: 624056 - DNA, 25 bp, Rattus norvegicus
tgctatcattgcttgccgtgtgtcc

SEQ ID NO: 624057 - DNA, 25 bp, Rattus norvegicus
tgctatccacatcaaccactgggta

SEQ ID NO: 624058 - DNA, 25 bp, Rattus norvegicus
tgctatccacatgaaccactgggta

SEQ ID NO: 624059 - DNA, 25 bp, Rattus norvegicus
tgctatccctacaccagaaaacagt

SEQ ID NO: 624060 - DNA, 25 bp, Rattus norvegicus
tgctatccctactccagaaaacagt

SEQ ID NO: 624061 - DNA, 25 bp, Rattus norvegicus
tgctatcctaggaaagccagtgctg

SEQ ID NO: 624062 - DNA, 25 bp, Rattus norvegicus
tgctatcctaggtaagccagtgctg

SEQ ID NO: 624063 - DNA, 25 bp, Rattus norvegicus
tgctatcctttgatcgtctgtatat

SEQ ID NO: 624064 - DNA, 25 bp, Rattus norvegicus
tgctatcctttgttcgtctgtatat

SEQ ID NO: 624065 - DNA, 25 bp, Rattus norvegicus
tgctatcgggtcaggcaccgggatc

SEQ ID NO: 624066 - DNA, 25 bp, Rattus norvegicus
tgctatcgggtctggcaccgggatc

SEQ ID NO: 624067 - DNA, 25 bp, Rattus norvegicus
tgctatcgttgtccagttcatcatc

SEQ ID NO: 624068 - DNA, 25 bp, Rattus norvegicus
tgctatcgttgtgcagttcatcatc

SEQ ID NO: 624069 - DNA, 25 bp, Rattus norvegicus
tgctatcgtttacactttccatccc

SEQ ID NO: 624070 - DNA, 25 bp, Rattus norvegicus
tgctatcgtttagactttccatccc

SEQ ID NO: 624071 - DNA, 25 bp, Rattus norvegicus
tgctatctagcgagtccgcggtaga

SEQ ID NO: 624072 - DNA, 25 bp, Rattus norvegicus
tgctatctagcgtgtccgcggtaga

SEQ ID NO: 624073 - DNA, 25 bp, Rattus norvegicus
tgctatcttacacgctttttgtttg

SEQ ID NO: 624074 - DNA, 25 bp, Rattus norvegicus
tgctatcttacaggctttttgtttg

SEQ ID NO: 624075 - DNA, 25 bp, Rattus norvegicus
tgctatcttcacagaatccatggag

SEQ ID NO: 624076 - DNA, 25 bp, Rattus norvegicus
tgctatcttcactgaatccatggag

SEQ ID NO: 624077 - DNA, 25 bp, Rattus norvegicus
tgctatgacacaaatgttccccaca

SEQ ID NO: 624078 - DNA, 25 bp, Rattus norvegicus
tgctatgacacatatgttccccaca

SEQ ID NO: 624079 - DNA, 25 bp, Rattus norvegicus
tgctatgacattccaagctccaata

SEQ ID NO: 624080 - DNA, 25 bp, Rattus norvegicus
tgctatgacattgcaagctccaata

SEQ ID NO: 624081 - DNA, 25 bp, Rattus norvegicus
tgctatgacgttaaatgacccagtt

SEQ ID NO: 624082 - DNA, 25 bp, Rattus norvegicus
tgctatgacgtttaatgacccagtt

SEQ ID NO: 624083 - DNA, 25 bp, Rattus norvegicus
tgctatgagaacaccttgaccttaa

SEQ ID NO: 624084 - DNA, 25 bp, Rattus norvegicus
tgctatgagaactccttgaccttaa

SEQ ID NO: 624085 - DNA, 25 bp, Rattus norvegicus
tgctatgagccacttgcagaccagt

SEQ ID NO: 624086 - DNA, 25 bp, Rattus norvegicus
tgctatgagccagttgcagaccagt

SEQ ID NO: 624087 - DNA, 25 bp, Rattus norvegicus
tgctatgaggacatcacttccccag

SEQ ID NO: 624088 - DNA, 25 bp, Rattus norvegicus
tgctatgaggacttcacttccccag

SEQ ID NO: 624089 - DNA, 25 bp, Rattus norvegicus
tgctatgcaataactcacccaggta

SEQ ID NO: 624090 - DNA, 25 bp, Rattus norvegicus
tgctatgcaatatctcacccaggta

SEQ ID NO: 624091 - DNA, 25 bp, Rattus norvegicus
tgctatgcagacaccctctgaaatc

SEQ ID NO: 624092 - DNA, 25 bp, Rattus norvegicus
tgctatgcagactccctctgaaatc

SEQ ID NO: 624093 - DNA, 25 bp, Rattus norvegicus
tgctatgcagagcaagccatgttta

SEQ ID NO: 624094 - DNA, 25 bp, Rattus norvegicus
tgctatgcagaggaagccatgttta

SEQ ID NO: 624095 - DNA, 25 bp, Rattus norvegicus
tgctatgcttgaatgccacgcggta

SEQ ID NO: 624096 - DNA, 25 bp, Rattus norvegicus
tgctatgcttgattgccacgcggta

SEQ ID NO: 624097 - DNA, 25 bp, Rattus norvegicus
tgctatggacacacacttttgtact

SEQ ID NO: 624098 - DNA, 25 bp, Rattus norvegicus
tgctatggacactcacttttgtact

SEQ ID NO: 624099 - DNA, 25 bp, Rattus norvegicus
tgctatggtatcatcctatcatgct

SEQ ID NO: 624100 - DNA, 25 bp, Rattus norvegicus
tgctatggtatcttcctatcatgct

SEQ ID NO: 624101 - DNA, 25 bp, Rattus norvegicus
tgctatggtgtgcttcggttcatta

SEQ ID NO: 624102 - DNA, 25 bp, Rattus norvegicus
tgctatggtgtggttcggttcatta

SEQ ID NO: 624103 - DNA, 25 bp, Rattus norvegicus
tgctatggttgcagggtggccccat

SEQ ID NO: 624104 - DNA, 25 bp, Rattus norvegicus
tgctatggttgctgggtggccccat

SEQ ID NO: 624105 - DNA, 25 bp, Rattus norvegicus
tgctatgtatttctctctcaactaa

SEQ ID NO: 624106 - DNA, 25 bp, Rattus norvegicus
tgctatgtatttgtctctcaactaa

SEQ ID NO: 624107 - DNA, 25 bp, Rattus norvegicus
tgctatgtccccaagatgcattctg

SEQ ID NO: 624108 - DNA, 25 bp, Rattus norvegicus
tgctatgtcccctagatgcattctg

SEQ ID NO: 624109 - DNA, 25 bp, Rattus norvegicus
tgctatgtcgaacaatgcacgagga

SEQ ID NO: 624110 - DNA, 25 bp, Rattus norvegicus
tgctatgtcgaagaatgcacgagga

SEQ ID NO: 624111 - DNA, 25 bp, Rattus norvegicus
tgctatgtctgtcatgtacacgctc

SEQ ID NO: 624112 - DNA, 25 bp, Rattus norvegicus
tgctatgtctgtgatgtacacgctc

SEQ ID NO: 624113 - DNA, 25 bp, Rattus norvegicus
tgctatgtgatccaaacccagatga

SEQ ID NO: 624114 - DNA, 25 bp, Rattus norvegicus
tgctatgtgatcgaaacccagatga

SEQ ID NO: 624115 - DNA, 25 bp, Rattus norvegicus
tgctatgtgctaaggtacccggctt

SEQ ID NO: 624116 - DNA, 25 bp, Rattus norvegicus
tgctatgtgctatggtacccggctt

SEQ ID NO: 624117 - DNA, 25 bp, Rattus norvegicus
tgctatgttagcaccattctagttg

SEQ ID NO: 624118 - DNA, 25 bp, Rattus norvegicus
tgctatgttagctccattctagttg

SEQ ID NO: 624119 - DNA, 25 bp, Rattus norvegicus
tgctattaactaccaacccatccta

SEQ ID NO: 624120 - DNA, 25 bp, Rattus norvegicus
tgctattaactagcaacccatccta

SEQ ID NO: 624121 - DNA, 25 bp, Rattus norvegicus
tgctattattttccttaacactcaa

SEQ ID NO: 624122 - DNA, 25 bp, Rattus norvegicus
tgctattattttgcttaacactcaa

SEQ ID NO: 624123 - DNA, 25 bp, Rattus norvegicus
tgctattccaatatgtgctccttac

SEQ ID NO: 624124 - DNA, 25 bp, Rattus norvegicus
tgctattccaatttgtgctccttac

SEQ ID NO: 624125 - DNA, 25 bp, Rattus norvegicus
tgctattccaccatcattaacagac

SEQ ID NO: 624126 - DNA, 25 bp, Rattus norvegicus
tgctattccaccttcattaacagac

SEQ ID NO: 624127 - DNA, 25 bp, Rattus norvegicus
tgctattctacccactcaggaggct

SEQ ID NO: 624128 - DNA, 25 bp, Rattus norvegicus
tgctattctaccgactcaggaggct

SEQ ID NO: 624129 - DNA, 25 bp, Rattus norvegicus
tgctattctcttcagggccaggaaa

SEQ ID NO: 624130 - DNA, 25 bp, Rattus norvegicus
tgctattctcttgagggccaggaaa

SEQ ID NO: 624131 - DNA, 25 bp, Rattus norvegicus
tgctattgcagaatcagctgtcaat

SEQ ID NO: 624132 - DNA, 25 bp, Rattus norvegicus
tgctattgcagattcagctgtcaat

SEQ ID NO: 624133 - DNA, 25 bp, Rattus norvegicus
tgctattgcccacagtcaggacatg

SEQ ID NO: 624134 - DNA, 25 bp, Rattus norvegicus
tgctattgcccagagtcaggacatg

SEQ ID NO: 624135 - DNA, 25 bp, Rattus norvegicus
tgctattgtcttcttgccctagagt

SEQ ID NO: 624136 - DNA, 25 bp, Rattus norvegicus
tgctattgtcttgttgccctagagt

SEQ ID NO: 624137 - DNA, 25 bp, Rattus norvegicus
tgctatttagccacatcatgaatga

SEQ ID NO: 624138 - DNA, 25 bp, Rattus norvegicus
tgctatttagcctcatcatgaatga

SEQ ID NO: 624139 - DNA, 25 bp, Rattus norvegicus
tgctatttccatccaaaaaggccgg

SEQ ID NO: 624140 - DNA, 25 bp, Rattus norvegicus
tgctatttccatgcaaaaaggccgg

SEQ ID NO: 624141 - DNA, 25 bp, Rattus norvegicus
tgctattttaagctacctgggcaaa

SEQ ID NO: 624142 - DNA, 25 bp, Rattus norvegicus
tgctattttaaggtacctgggcaaa

SEQ ID NO: 624143 - DNA, 25 bp, Rattus norvegicus
tgctattttgttccactttaggctt

SEQ ID NO: 624144 - DNA, 25 bp, Rattus norvegicus
tgctattttgttgcactttaggctt

SEQ ID NO: 624145 - DNA, 25 bp, Rattus norvegicus
tgctcaaacgccctgtgcagacaaa

SEQ ID NO: 624146 - DNA, 25 bp, Rattus norvegicus
tgctcaaacgccgtgtgcagacaaa

SEQ ID NO: 624147 - DNA, 25 bp, Rattus norvegicus
tgctcaaagcaaatctctccatgcc

SEQ ID NO: 624148 - DNA, 25 bp, Rattus norvegicus
tgctcaaagcaattctctccatgcc

SEQ ID NO: 624149 - DNA, 25 bp, Rattus norvegicus
tgctcaaagtcacttctcctctact

SEQ ID NO: 624150 - DNA, 25 bp, Rattus norvegicus
tgctcaaagtcagttctcctctact

SEQ ID NO: 624151 - DNA, 25 bp, Rattus norvegicus
tgctcaaagtccaccaggctgaaga

SEQ ID NO: 624152 - DNA, 25 bp, Rattus norvegicus
tgctcaaagtcctccaggctgaaga

SEQ ID NO: 624153 - DNA, 25 bp, Rattus norvegicus
tgctcaaataaacattcattcctat

SEQ ID NO: 624154 - DNA, 25 bp, Rattus norvegicus
tgctcaaataaagattcattcctat

SEQ ID NO: 624155 - DNA, 25 bp, Rattus norvegicus
tgctcaacactgcatcaagcgcggg

SEQ ID NO: 624156 - DNA, 25 bp, Rattus norvegicus
tgctcaacactggatcaagcgcggg

SEQ ID NO: 624157 - DNA, 25 bp, Rattus norvegicus
tgctcaacagcccagtaccgaaatt

SEQ ID NO: 624158 - DNA, 25 bp, Rattus norvegicus
tgctcaacagccgagtaccgaaatt

SEQ ID NO: 624159 - DNA, 25 bp, Rattus norvegicus
tgctcaacctcaaactcactgaatg

SEQ ID NO: 624160 - DNA, 25 bp, Rattus norvegicus
tgctcaacctcatactcactgaatg

SEQ ID NO: 624161 - DNA, 25 bp, Rattus norvegicus
tgctcaacgttacttcccctaaaat

SEQ ID NO: 624162 - DNA, 25 bp, Rattus norvegicus
tgctcaacgttagttcccctaaaat

SEQ ID NO: 624163 - DNA, 25 bp, Rattus norvegicus
tgctcaactagaccctgcgttagaa

SEQ ID NO: 624164 - DNA, 25 bp, Rattus norvegicus
tgctcaactagagcctgcgttagaa

SEQ ID NO: 624165 - DNA, 25 bp, Rattus norvegicus
tgctcaagaaccagctggaccagga

SEQ ID NO: 624166 - DNA, 25 bp, Rattus norvegicus
tgctcaagaacctgctggaccagga

SEQ ID NO: 624167 - DNA, 25 bp, Rattus norvegicus
tgctcaagaaggacaagtactcgct

SEQ ID NO: 624168 - DNA, 25 bp, Rattus norvegicus
tgctcaagaaggtcaagtactcgct

SEQ ID NO: 624169 - DNA, 25 bp, Rattus norvegicus
tgctcaagagggactggactgctga

SEQ ID NO: 624170 - DNA, 25 bp, Rattus norvegicus
tgctcaagagggtctggactgctga

SEQ ID NO: 624171 - DNA, 25 bp, Rattus norvegicus
tgctcaagcatgacctaaagtccgt

SEQ ID NO: 624172 - DNA, 25 bp, Rattus norvegicus
tgctcaagcatgtcctaaagtccgt

SEQ ID NO: 624173 - DNA, 25 bp, Rattus norvegicus
tgctcaagccaacgcgcgtgtgtgt

SEQ ID NO: 624174 - DNA, 25 bp, Rattus norvegicus
tgctcaagccaaggcgcgtgtgtgt

SEQ ID NO: 624175 - DNA, 25 bp, Rattus norvegicus
tgctcaagcgacagcggcttcagaa

SEQ ID NO: 624176 - DNA, 25 bp, Rattus norvegicus
tgctcaagcgactgcggcttcagaa

SEQ ID NO: 624177 - DNA, 25 bp, Rattus norvegicus
tgctcaagcttgataccagtctggt

SEQ ID NO: 624178 - DNA, 25 bp, Rattus norvegicus
tgctcaagcttgttaccagtctggt

SEQ ID NO: 624179 - DNA, 25 bp, Rattus norvegicus
tgctcaaggaacaggcagcttcggt

SEQ ID NO: 624180 - DNA, 25 bp, Rattus norvegicus
tgctcaaggaactggcagcttcggt

SEQ ID NO: 624181 - DNA, 25 bp, Rattus norvegicus
tgctcaaggcaactccagtggcttt

SEQ ID NO: 624182 - DNA, 25 bp, Rattus norvegicus
tgctcaaggcaagtccagtggcttt

SEQ ID NO: 624183 - DNA, 25 bp, Rattus norvegicus
tgctcaaggcggcaggcaccaaagc

SEQ ID NO: 624184 - DNA, 25 bp, Rattus norvegicus
tgctcaaggcgggaggcaccaaagc

SEQ ID NO: 624185 - DNA, 25 bp, Rattus norvegicus
tgctcaagggcccatacgatgatgt

SEQ ID NO: 624186 - DNA, 25 bp, Rattus norvegicus
tgctcaagggccgatacgatgatgt

SEQ ID NO: 624187 - DNA, 25 bp, Rattus norvegicus
tgctcaagggttcaggactctagat

SEQ ID NO: 624188 - DNA, 25 bp, Rattus norvegicus
tgctcaagggttgaggactctagat

SEQ ID NO: 624189 - DNA, 25 bp, Rattus norvegicus
tgctcaagtactcatcaagggccag

SEQ ID NO: 624190 - DNA, 25 bp, Rattus norvegicus
tgctcaagtactgatcaagggccag

SEQ ID NO: 624191 - DNA, 25 bp, Rattus norvegicus
tgctcaatgcatcctagcggcgcaa

SEQ ID NO: 624192 - DNA, 25 bp, Rattus norvegicus
tgctcaatgcatgctagcggcgcaa

SEQ ID NO: 624193 - DNA, 25 bp, Rattus norvegicus
tgctcaatgtacaaggcattccatg

SEQ ID NO: 624194 - DNA, 25 bp, Rattus norvegicus
tgctcaatgtactaggcattccatg

SEQ ID NO: 624195 - DNA, 25 bp, Rattus norvegicus
tgctcacaacaactgtcccagggat

SEQ ID NO: 624196 - DNA, 25 bp, Rattus norvegicus
tgctcacaacaagtgtcccagggat

SEQ ID NO: 624197 - DNA, 25 bp, Rattus norvegicus
tgctcacaacggctcactctgtaag

SEQ ID NO: 624198 - DNA, 25 bp, Rattus norvegicus
tgctcacaacgggtcactctgtaag

SEQ ID NO: 624199 - DNA, 25 bp, Rattus norvegicus
tgctcacaagcaaacgtagtgtctt

SEQ ID NO: 624200 - DNA, 25 bp, Rattus norvegicus
tgctcacaagcatacgtagtgtctt

SEQ ID NO: 624201 - DNA, 25 bp, Rattus norvegicus
tgctcacacagactgcgttagacac

SEQ ID NO: 624202 - DNA, 25 bp, Rattus norvegicus
tgctcacacagagtgcgttagacac

SEQ ID NO: 624203 - DNA, 25 bp, Rattus norvegicus
tgctcacacagcatgcacattgact

SEQ ID NO: 624204 - DNA, 25 bp, Rattus norvegicus
tgctcacacagcttgcacattgact

SEQ ID NO: 624205 - DNA, 25 bp, Rattus norvegicus
tgctcacacaggagggcgcaacaga

SEQ ID NO: 624206 - DNA, 25 bp, Rattus norvegicus
tgctcacacaggtgggcgcaacaga

SEQ ID NO: 624207 - DNA, 25 bp, Rattus norvegicus
tgctcacactgcaatgtccttaaag

SEQ ID NO: 624208 - DNA, 25 bp, Rattus norvegicus
tgctcacactgctatgtccttaaag

SEQ ID NO: 624209 - DNA, 25 bp, Rattus norvegicus
tgctcacagagccactttttcatcc

SEQ ID NO: 624210 - DNA, 25 bp, Rattus norvegicus
tgctcacagagcgactttttcatcc

SEQ ID NO: 624211 - DNA, 25 bp, Rattus norvegicus
tgctcacagtgccatgtgtcactgt

SEQ ID NO: 624212 - DNA, 25 bp, Rattus norvegicus
tgctcacagtgcgatgtgtcactgt

SEQ ID NO: 624213 - DNA, 25 bp, Rattus norvegicus
tgctcacagtgtacatctgctgcaa

SEQ ID NO: 624214 - DNA, 25 bp, Rattus norvegicus
tgctcacagtgttcatctgctgcaa

SEQ ID NO: 624215 - DNA, 25 bp, Rattus norvegicus
tgctcacatcatcaagcgcttactg

SEQ ID NO: 624216 - DNA, 25 bp, Rattus norvegicus
tgctcacatcatgaagcgcttactg

SEQ ID NO: 624217 - DNA, 25 bp, Rattus norvegicus
tgctcacatcttcccagtgcggtga

SEQ ID NO: 624218 - DNA, 25 bp, Rattus norvegicus
tgctcacatcttgccagtgcggtga

SEQ ID NO: 624219 - DNA, 25 bp, Rattus norvegicus
tgctcaccaactcggcagagaattt

SEQ ID NO: 624220 - DNA, 25 bp, Rattus norvegicus
tgctcaccaactgggcagagaattt

SEQ ID NO: 624221 - DNA, 25 bp, Rattus norvegicus
tgctcaccactaatttacagaactt

SEQ ID NO: 624222 - DNA, 25 bp, Rattus norvegicus
tgctcaccactattttacagaactt

SEQ ID NO: 624223 - DNA, 25 bp, Rattus norvegicus
tgctcaccacttcgaacttgcattg

SEQ ID NO: 624224 - DNA, 25 bp, Rattus norvegicus
tgctcaccacttggaacttgcattg

SEQ ID NO: 624225 - DNA, 25 bp, Rattus norvegicus
tgctcaccagctaacagggatatgt

SEQ ID NO: 624226 - DNA, 25 bp, Rattus norvegicus
tgctcaccagcttacagggatatgt

SEQ ID NO: 624227 - DNA, 25 bp, Rattus norvegicus
tgctcaccccaaatatccatttttg

SEQ ID NO: 624228 - DNA, 25 bp, Rattus norvegicus
tgctcaccccaattatccatttttg

SEQ ID NO: 624229 - DNA, 25 bp, Rattus norvegicus
tgctcacccgtcagagctgaatttg

SEQ ID NO: 624230 - DNA, 25 bp, Rattus norvegicus
tgctcacccgtctgagctgaatttg

SEQ ID NO: 624231 - DNA, 25 bp, Rattus norvegicus
tgctcaccctcactgttgagaggtt

SEQ ID NO: 624232 - DNA, 25 bp, Rattus norvegicus
tgctcaccctcagtgttgagaggtt

SEQ ID NO: 624233 - DNA, 25 bp, Rattus norvegicus
tgctcaccgtttctcaaacctctgt

SEQ ID NO: 624234 - DNA, 25 bp, Rattus norvegicus
tgctcaccgtttgtcaaacctctgt

SEQ ID NO: 624235 - DNA, 25 bp, Rattus norvegicus
tgctcacctataaattggtcggtct

SEQ ID NO: 624236 - DNA, 25 bp, Rattus norvegicus
tgctcacctatatattggtcggtct

SEQ ID NO: 624237 - DNA, 25 bp, Rattus norvegicus
tgctcacctcgaagtggccagacct

SEQ ID NO: 624238 - DNA, 25 bp, Rattus norvegicus
tgctcacctcgatgtggccagacct

SEQ ID NO: 624239 - DNA, 25 bp, Rattus norvegicus
tgctcacctgagagccctacatgga

SEQ ID NO: 624240 - DNA, 25 bp, Rattus norvegicus
tgctcacctgagtgccctacatgga

SEQ ID NO: 624241 - DNA, 25 bp, Rattus norvegicus
tgctcacctggcctaaaaattctgt

SEQ ID NO: 624242 - DNA, 25 bp, Rattus norvegicus
tgctcacctggcgtaaaaattctgt

SEQ ID NO: 624243 - DNA, 25 bp, Rattus norvegicus
tgctcacgaaatctgactttctcca

SEQ ID NO: 624244 - DNA, 25 bp, Rattus norvegicus
tgctcacgaaatgtgactttctcca

SEQ ID NO: 624245 - DNA, 25 bp, Rattus norvegicus
tgctcacgcacaatggccaggctgg

SEQ ID NO: 624246 - DNA, 25 bp, Rattus norvegicus
tgctcacgcacattggccaggctgg

SEQ ID NO: 624247 - DNA, 25 bp, Rattus norvegicus
tgctcacgccatactgagggccatg

SEQ ID NO: 624248 - DNA, 25 bp, Rattus norvegicus
tgctcacgccattctgagggccatg

SEQ ID NO: 624249 - DNA, 25 bp, Rattus norvegicus
tgctcacggcttctcaggtttgctg

SEQ ID NO: 624250 - DNA, 25 bp, Rattus norvegicus
tgctcacggcttgtcaggtttgctg

SEQ ID NO: 624251 - DNA, 25 bp, Rattus norvegicus
tgctcacgtaacctgtgcgtaccat

SEQ ID NO: 624252 - DNA, 25 bp, Rattus norvegicus
tgctcacgtaacgtgtgcgtaccat

SEQ ID NO: 624253 - DNA, 25 bp, Rattus norvegicus
tgctcactaagtctttgccaggaaa

SEQ ID NO: 624254 - DNA, 25 bp, Rattus norvegicus
tgctcactaagtgtttgccaggaaa

SEQ ID NO: 624255 - DNA, 25 bp, Rattus norvegicus
tgctcactcaggaggacgtctgcaa

SEQ ID NO: 624256 - DNA, 25 bp, Rattus norvegicus
tgctcactcaggtggacgtctgcaa

SEQ ID NO: 624257 - DNA, 25 bp, Rattus norvegicus
tgctcactccctaatctcttcaagt

SEQ ID NO: 624258 - DNA, 25 bp, Rattus norvegicus
tgctcactcccttatctcttcaagt

SEQ ID NO: 624259 - DNA, 25 bp, Rattus norvegicus
tgctcactccgtcggttgttagtga

SEQ ID NO: 624260 - DNA, 25 bp, Rattus norvegicus
tgctcactccgtgggttgttagtga

SEQ ID NO: 624261 - DNA, 25 bp, Rattus norvegicus
tgctcactcctaatcactgcagagt

SEQ ID NO: 624262 - DNA, 25 bp, Rattus norvegicus
tgctcactcctattcactgcagagt

SEQ ID NO: 624263 - DNA, 25 bp, Rattus norvegicus
tgctcactggcaaatcacattgtaa

SEQ ID NO: 624264 - DNA, 25 bp, Rattus norvegicus
tgctcactggcatatcacattgtaa

SEQ ID NO: 624265 - DNA, 25 bp, Rattus norvegicus
tgctcacttactctcgtggtactaa

SEQ ID NO: 624266 - DNA, 25 bp, Rattus norvegicus
tgctcacttactgtcgtggtactaa

SEQ ID NO: 624267 - DNA, 25 bp, Rattus norvegicus
tgctcacttagcatcgggtttattt

SEQ ID NO: 624268 - DNA, 25 bp, Rattus norvegicus
tgctcacttagcttcgggtttattt

SEQ ID NO: 624269 - DNA, 25 bp, Rattus norvegicus
tgctcacttccaactggcagggact

SEQ ID NO: 624270 - DNA, 25 bp, Rattus norvegicus
tgctcacttccatctggcagggact

SEQ ID NO: 624271 - DNA, 25 bp, Rattus norvegicus
tgctcacttctgcaacctaactgga

SEQ ID NO: 624272 - DNA, 25 bp, Rattus norvegicus
tgctcacttctggaacctaactgga

SEQ ID NO: 624273 - DNA, 25 bp, Rattus norvegicus
tgctcactttagctatcttggactg

SEQ ID NO: 624274 - DNA, 25 bp, Rattus norvegicus
tgctcactttaggtatcttggactg

SEQ ID NO: 624275 - DNA, 25 bp, Rattus norvegicus
tgctcactttcaaattatgtcataa

SEQ ID NO: 624276 - DNA, 25 bp, Rattus norvegicus
tgctcactttcatattatgtcataa

SEQ ID NO: 624277 - DNA, 25 bp, Rattus norvegicus
tgctcagaacagactacaggctctt

SEQ ID NO: 624278 - DNA, 25 bp, Rattus norvegicus
tgctcagaacagtctacaggctctt

SEQ ID NO: 624279 - DNA, 25 bp, Rattus norvegicus
tgctcagaagtgaacccatgccagg

SEQ ID NO: 624280 - DNA, 25 bp, Rattus norvegicus
tgctcagaagtgtacccatgccagg

SEQ ID NO: 624281 - DNA, 25 bp, Rattus norvegicus
tgctcagaccacaatttatttcttg

SEQ ID NO: 624282 - DNA, 25 bp, Rattus norvegicus
tgctcagaccactatttatttcttg

SEQ ID NO: 624283 - DNA, 25 bp, Rattus norvegicus
tgctcagacctacagaacgttttaa

SEQ ID NO: 624284 - DNA, 25 bp, Rattus norvegicus
tgctcagacctagagaacgttttaa

SEQ ID NO: 624285 - DNA, 25 bp, Rattus norvegicus
tgctcagacgttcccacttatcagc

SEQ ID NO: 624286 - DNA, 25 bp, Rattus norvegicus
tgctcagacgttgccacttatcagc

SEQ ID NO: 624287 - DNA, 25 bp, Rattus norvegicus
tgctcagactccagtgaaggcacag

SEQ ID NO: 624288 - DNA, 25 bp, Rattus norvegicus
tgctcagactcctgtgaaggcacag

SEQ ID NO: 624289 - DNA, 25 bp, Rattus norvegicus
tgctcagactctaattctcttcgta

SEQ ID NO: 624290 - DNA, 25 bp, Rattus norvegicus
tgctcagactcttattctcttcgta

SEQ ID NO: 624291 - DNA, 25 bp, Rattus norvegicus
tgctcagactgcaccacaggtttaa

SEQ ID NO: 624292 - DNA, 25 bp, Rattus norvegicus
tgctcagactgctccacaggtttaa

SEQ ID NO: 624293 - DNA, 25 bp, Rattus norvegicus
tgctcagacttactggtcctggcgg

SEQ ID NO: 624294 - DNA, 25 bp, Rattus norvegicus
tgctcagacttagtggtcctggcgg

SEQ ID NO: 624295 - DNA, 25 bp, Rattus norvegicus
tgctcagagcacactcagtcatgtc

SEQ ID NO: 624296 - DNA, 25 bp, Rattus norvegicus
tgctcagagcactctcagtcatgtc

SEQ ID NO: 624297 - DNA, 25 bp, Rattus norvegicus
tgctcagagccgatacgtgaacggt

SEQ ID NO: 624298 - DNA, 25 bp, Rattus norvegicus
tgctcagagccgttacgtgaacggt

SEQ ID NO: 624299 - DNA, 25 bp, Rattus norvegicus
tgctcagagcgcatgcggagtgcac

SEQ ID NO: 624300 - DNA, 25 bp, Rattus norvegicus
tgctcagagcgcttgcggagtgcac

SEQ ID NO: 624301 - DNA, 25 bp, Rattus norvegicus
tgctcagagcttactagacaggaaa

SEQ ID NO: 624302 - DNA, 25 bp, Rattus norvegicus
tgctcagagctttctagacaggaaa

SEQ ID NO: 624303 - DNA, 25 bp, Rattus norvegicus
tgctcagaggcgctgaatcaccagc

SEQ ID NO: 624304 - DNA, 25 bp, Rattus norvegicus
tgctcagaggcggtgaatcaccagc

SEQ ID NO: 624305 - DNA, 25 bp, Rattus norvegicus
tgctcagaggttctttccccttgta

SEQ ID NO: 624306 - DNA, 25 bp, Rattus norvegicus
tgctcagaggttgtttccccttgta

SEQ ID NO: 624307 - DNA, 25 bp, Rattus norvegicus
tgctcagataagagtcctcgtgtcc

SEQ ID NO: 624308 - DNA, 25 bp, Rattus norvegicus
tgctcagataagtgtcctcgtgtcc

SEQ ID NO: 624309 - DNA, 25 bp, Rattus norvegicus
tgctcagcaaatactcccaacttag

SEQ ID NO: 624310 - DNA, 25 bp, Rattus norvegicus
tgctcagcaaattctcccaacttag

SEQ ID NO: 624311 - DNA, 25 bp, Rattus norvegicus
tgctcagcacacactggcctaaagg

SEQ ID NO: 624312 - DNA, 25 bp, Rattus norvegicus
tgctcagcacactctggcctaaagg

SEQ ID NO: 624313 - DNA, 25 bp, Rattus norvegicus
tgctcagcagctagggacttaggcc

SEQ ID NO: 624314 - DNA, 25 bp, Rattus norvegicus
tgctcagcagcttgggacttaggcc

SEQ ID NO: 624315 - DNA, 25 bp, Rattus norvegicus
tgctcagcaggcagtctgccccaaa

SEQ ID NO: 624316 - DNA, 25 bp, Rattus norvegicus
tgctcagcaggctgtctgccccaaa

SEQ ID NO: 624317 - DNA, 25 bp, Rattus norvegicus
tgctcagcaggtcggaactactttt

SEQ ID NO: 624318 - DNA, 25 bp, Rattus norvegicus
tgctcagcaggtgggaactactttt

SEQ ID NO: 624319 - DNA, 25 bp, Rattus norvegicus
tgctcagcatgccagtctttaaggg

SEQ ID NO: 624320 - DNA, 25 bp, Rattus norvegicus
tgctcagcatgcgagtctttaaggg

SEQ ID NO: 624321 - DNA, 25 bp, Rattus norvegicus
tgctcagccacacaggaggccaata

SEQ ID NO: 624322 - DNA, 25 bp, Rattus norvegicus
tgctcagccacagaggaggccaata

SEQ ID NO: 624323 - DNA, 25 bp, Rattus norvegicus
tgctcagccagtcccaacaatagaa

SEQ ID NO: 624324 - DNA, 25 bp, Rattus norvegicus
tgctcagccagtgccaacaatagaa

SEQ ID NO: 624325 - DNA, 25 bp, Rattus norvegicus
tgctcagcccatctgtatatagtac

SEQ ID NO: 624326 - DNA, 25 bp, Rattus norvegicus
tgctcagcccatgtgtatatagtac

SEQ ID NO: 624327 - DNA, 25 bp, Rattus norvegicus
tgctcagccctcagaagacgtggac

SEQ ID NO: 624328 - DNA, 25 bp, Rattus norvegicus
tgctcagccctctgaagacgtggac

SEQ ID NO: 624329 - DNA, 25 bp, Rattus norvegicus
tgctcagcctcaatgaccagcggaa

SEQ ID NO: 624330 - DNA, 25 bp, Rattus norvegicus
tgctcagcctcattgaccagcggaa

SEQ ID NO: 624331 - DNA, 25 bp, Rattus norvegicus
tgctcagcctccaacgacagtaaat

SEQ ID NO: 624332 - DNA, 25 bp, Rattus norvegicus
tgctcagcctcctacgacagtaaat

SEQ ID NO: 624333 - DNA, 25 bp, Rattus norvegicus
tgctcagcctgacacattcgctggg

SEQ ID NO: 624334 - DNA, 25 bp, Rattus norvegicus
tgctcagcctgagacattcgctggg

SEQ ID NO: 624335 - DNA, 25 bp, Rattus norvegicus
tgctcagcgctgaggacatcaagaa

SEQ ID NO: 624336 - DNA, 25 bp, Rattus norvegicus
tgctcagcgctgtggacatcaagaa

SEQ ID NO: 624337 - DNA, 25 bp, Rattus norvegicus
tgctcagcgtgtctcaaggacccat

SEQ ID NO: 624338 - DNA, 25 bp, Rattus norvegicus
tgctcagcgtgtgtcaaggacccat

SEQ ID NO: 624339 - DNA, 25 bp, Rattus norvegicus
tgctcagctcaacgtggtacagact

SEQ ID NO: 624340 - DNA, 25 bp, Rattus norvegicus
tgctcagctcaaggtggtacagact

SEQ ID NO: 624341 - DNA, 25 bp, Rattus norvegicus
tgctcagctgagatgttttcatagt

SEQ ID NO: 624342 - DNA, 25 bp, Rattus norvegicus
tgctcagctgagttgttttcatagt

SEQ ID NO: 624343 - DNA, 25 bp, Rattus norvegicus
tgctcagctgcaattccacagaata

SEQ ID NO: 624344 - DNA, 25 bp, Rattus norvegicus
tgctcagctgcaccaggcaaatctg

SEQ ID NO: 624345 - DNA, 25 bp, Rattus norvegicus
tgctcagctgcagcaggcaaatctg

SEQ ID NO: 624346 - DNA, 25 bp, Rattus norvegicus
tgctcagctgcatttccacagaata

SEQ ID NO: 624347 - DNA, 25 bp, Rattus norvegicus
tgctcagctggactggcgccattag

SEQ ID NO: 624348 - DNA, 25 bp, Rattus norvegicus
tgctcagctggagtggcgccattag

SEQ ID NO: 624349 - DNA, 25 bp, Rattus norvegicus
tgctcagctgttaattagcccgagt

SEQ ID NO: 624350 - DNA, 25 bp, Rattus norvegicus
tgctcagctgttaatttcctgccta

SEQ ID NO: 624351 - DNA, 25 bp, Rattus norvegicus
tgctcagctgtttattagcccgagt

SEQ ID NO: 624352 - DNA, 25 bp, Rattus norvegicus
tgctcagctgtttatttcctgccta

SEQ ID NO: 624353 - DNA, 25 bp, Rattus norvegicus
tgctcagcttgcagtcatgcaggga

SEQ ID NO: 624354 - DNA, 25 bp, Rattus norvegicus
tgctcagcttgctgtcatgcaggga

SEQ ID NO: 624355 - DNA, 25 bp, Rattus norvegicus
tgctcagcttttaatattttcatag

SEQ ID NO: 624356 - DNA, 25 bp, Rattus norvegicus
tgctcagctttttatattttcatag

SEQ ID NO: 624357 - DNA, 25 bp, Rattus norvegicus
tgctcaggaacaagcagctgccaaa

SEQ ID NO: 624358 - DNA, 25 bp, Rattus norvegicus
tgctcaggaacatgcagctgccaaa

SEQ ID NO: 624359 - DNA, 25 bp, Rattus norvegicus
tgctcaggaattagtcggtatctga

SEQ ID NO: 624360 - DNA, 25 bp, Rattus norvegicus
tgctcaggaatttgtcggtatctga

SEQ ID NO: 624361 - DNA, 25 bp, Rattus norvegicus
tgctcaggacatagtagcgccgggt

SEQ ID NO: 624362 - DNA, 25 bp, Rattus norvegicus
tgctcaggacattgtagcgccgggt

SEQ ID NO: 624363 - DNA, 25 bp, Rattus norvegicus
tgctcaggagatagataggccacat

SEQ ID NO: 624364 - DNA, 25 bp, Rattus norvegicus
tgctcaggagattgataggccacat

SEQ ID NO: 624365 - DNA, 25 bp, Rattus norvegicus
tgctcaggccataccagctctgaaa

SEQ ID NO: 624366 - DNA, 25 bp, Rattus norvegicus
tgctcaggccattccagctctgaaa

SEQ ID NO: 624367 - DNA, 25 bp, Rattus norvegicus
tgctcaggcccaacggtgactggag

SEQ ID NO: 624368 - DNA, 25 bp, Rattus norvegicus
tgctcaggcccatcggtgactggag

SEQ ID NO: 624369 - DNA, 25 bp, Rattus norvegicus
tgctcaggcctacgctaggagctaa

SEQ ID NO: 624370 - DNA, 25 bp, Rattus norvegicus
tgctcaggcctaggctaggagctaa

SEQ ID NO: 624371 - DNA, 25 bp, Rattus norvegicus
tgctcaggcctgacaattttaagat

SEQ ID NO: 624372 - DNA, 25 bp, Rattus norvegicus
tgctcaggcctgagatgccactagt

SEQ ID NO: 624373 - DNA, 25 bp, Rattus norvegicus
tgctcaggcctgatctgtatggaaa

SEQ ID NO: 624374 - DNA, 25 bp, Rattus norvegicus
tgctcaggcctgtcaattttaagat

SEQ ID NO: 624375 - DNA, 25 bp, Rattus norvegicus
tgctcaggcctgtgatgccactagt

SEQ ID NO: 624376 - DNA, 25 bp, Rattus norvegicus
tgctcaggcctgttctgtatggaaa

SEQ ID NO: 624377 - DNA, 25 bp, Rattus norvegicus
tgctcaggctaaacggagtctccat

SEQ ID NO: 624378 - DNA, 25 bp, Rattus norvegicus
tgctcaggctaatcggagtctccat

SEQ ID NO: 624379 - DNA, 25 bp, Rattus norvegicus
tgctcaggctgcaagcttaacacag

SEQ ID NO: 624380 - DNA, 25 bp, Rattus norvegicus
tgctcaggctgctagcttaacacag

SEQ ID NO: 624381 - DNA, 25 bp, Rattus norvegicus
tgctcagggtgacacttcccaggaa

SEQ ID NO: 624382 - DNA, 25 bp, Rattus norvegicus
tgctcagggtgagacttcccaggaa

SEQ ID NO: 624383 - DNA, 25 bp, Rattus norvegicus
tgctcaggtgctattcagcccttaa

SEQ ID NO: 624384 - DNA, 25 bp, Rattus norvegicus
tgctcaggtgcttttcagcccttaa

SEQ ID NO: 624385 - DNA, 25 bp, Rattus norvegicus
tgctcagtaccgaccgtgtcaagat

SEQ ID NO: 624386 - DNA, 25 bp, Rattus norvegicus
tgctcagtaccgtccgtgtcaagat

SEQ ID NO: 624387 - DNA, 25 bp, Rattus norvegicus
tgctcagtagctccagcatctgatt

SEQ ID NO: 624388 - DNA, 25 bp, Rattus norvegicus
tgctcagtagctgcagcatctgatt

SEQ ID NO: 624389 - DNA, 25 bp, Rattus norvegicus
tgctcagtccaaatacggtgacgtg

SEQ ID NO: 624390 - DNA, 25 bp, Rattus norvegicus
tgctcagtccaattacggtgacgtg

SEQ ID NO: 624391 - DNA, 25 bp, Rattus norvegicus
tgctcagtctgaaggttagctgcaa

SEQ ID NO: 624392 - DNA, 25 bp, Rattus norvegicus
tgctcagtctgatggttagctgcaa

SEQ ID NO: 624393 - DNA, 25 bp, Rattus norvegicus
tgctcagtgatcattgtccagtcca

SEQ ID NO: 624394 - DNA, 25 bp, Rattus norvegicus
tgctcagtgatctttgtccagtcca

SEQ ID NO: 624395 - DNA, 25 bp, Rattus norvegicus
tgctcagtgcatatacatctttccc

SEQ ID NO: 624396 - DNA, 25 bp, Rattus norvegicus
tgctcagtgcatttacatctttccc

SEQ ID NO: 624397 - DNA, 25 bp, Rattus norvegicus
tgctcagtgccaaaatccaatttca

SEQ ID NO: 624398 - DNA, 25 bp, Rattus norvegicus
tgctcagtgccaagggaatccttgc

SEQ ID NO: 624399 - DNA, 25 bp, Rattus norvegicus
tgctcagtgccataatccaatttca

SEQ ID NO: 624400 - DNA, 25 bp, Rattus norvegicus
tgctcagtgccatgggaatccttgc

SEQ ID NO: 624401 - DNA, 25 bp, Rattus norvegicus
tgctcagtggctaaagacatgtcat

SEQ ID NO: 624402 - DNA, 25 bp, Rattus norvegicus
tgctcagtggcttaagacatgtcat

SEQ ID NO: 624403 - DNA, 25 bp, Rattus norvegicus
tgctcagtgggaccagagcctcctg

SEQ ID NO: 624404 - DNA, 25 bp, Rattus norvegicus
tgctcagtgggagcagagcctcctg

SEQ ID NO: 624405 - DNA, 25 bp, Rattus norvegicus
tgctcagtgggcaaggctaaacctg

SEQ ID NO: 624406 - DNA, 25 bp, Rattus norvegicus
tgctcagtgggctaggctaaacctg

SEQ ID NO: 624407 - DNA, 25 bp, Rattus norvegicus
tgctcagtggttattactccccaaa

SEQ ID NO: 624408 - DNA, 25 bp, Rattus norvegicus
tgctcagtggtttttactccccaaa

SEQ ID NO: 624409 - DNA, 25 bp, Rattus norvegicus
tgctcagttacacccattcagctaa

SEQ ID NO: 624410 - DNA, 25 bp, Rattus norvegicus
tgctcagttacagccattcagctaa

SEQ ID NO: 624411 - DNA, 25 bp, Rattus norvegicus
tgctcataacacaacctctagttcc

SEQ ID NO: 624412 - DNA, 25 bp, Rattus norvegicus
tgctcataacactacctctagttcc

SEQ ID NO: 624413 - DNA, 25 bp, Rattus norvegicus
tgctcatacaccagggcaccgatgg

SEQ ID NO: 624414 - DNA, 25 bp, Rattus norvegicus
tgctcatacacctgggcaccgatgg

SEQ ID NO: 624415 - DNA, 25 bp, Rattus norvegicus
tgctcatactgactctgctgacgag

SEQ ID NO: 624416 - DNA, 25 bp, Rattus norvegicus
tgctcatactgagtctgctgacgag

SEQ ID NO: 624417 - DNA, 25 bp, Rattus norvegicus
tgctcatatcacatacactggtttg

SEQ ID NO: 624418 - DNA, 25 bp, Rattus norvegicus
tgctcatatcacttacactggtttg

SEQ ID NO: 624419 - DNA, 25 bp, Rattus norvegicus
tgctcatatgctcctttctgacaag

SEQ ID NO: 624420 - DNA, 25 bp, Rattus norvegicus
tgctcatatgctgctttctgacaag

SEQ ID NO: 624421 - DNA, 25 bp, Rattus norvegicus
tgctcatcatgtcccagggagtata

SEQ ID NO: 624422 - DNA, 25 bp, Rattus norvegicus
tgctcatcatgtgccagggagtata

SEQ ID NO: 624423 - DNA, 25 bp, Rattus norvegicus
tgctcatccatgcatctggtcggaa

SEQ ID NO: 624424 - DNA, 25 bp, Rattus norvegicus
tgctcatccatggatctggtcggaa

SEQ ID NO: 624425 - DNA, 25 bp, Rattus norvegicus
tgctcatccgagcttacaggaggct

SEQ ID NO: 624426 - DNA, 25 bp, Rattus norvegicus
tgctcatccgaggttacaggaggct

SEQ ID NO: 624427 - DNA, 25 bp, Rattus norvegicus
tgctcatcctctcttgaggtgatca

SEQ ID NO: 624428 - DNA, 25 bp, Rattus norvegicus
tgctcatcctctgttgaggtgatca

SEQ ID NO: 624429 - DNA, 25 bp, Rattus norvegicus
tgctcatccttacgtgactgtctca

SEQ ID NO: 624430 - DNA, 25 bp, Rattus norvegicus
tgctcatccttaggtgactgtctca

SEQ ID NO: 624431 - DNA, 25 bp, Rattus norvegicus
tgctcatcggaaagtagcttctgtt

SEQ ID NO: 624432 - DNA, 25 bp, Rattus norvegicus
tgctcatcggaatgtagcttctgtt

SEQ ID NO: 624433 - DNA, 25 bp, Rattus norvegicus
tgctcatctaccagcgctatctgga

SEQ ID NO: 624434 - DNA, 25 bp, Rattus norvegicus
tgctcatctacctgcgctatctgga

SEQ ID NO: 624435 - DNA, 25 bp, Rattus norvegicus
tgctcatctccgatatggactatga

SEQ ID NO: 624436 - DNA, 25 bp, Rattus norvegicus
tgctcatctccgttatggactatga

SEQ ID NO: 624437 - DNA, 25 bp, Rattus norvegicus
tgctcatctgagaccggaagcgaga

SEQ ID NO: 624438 - DNA, 25 bp, Rattus norvegicus
tgctcatctgagtccggaagcgaga

SEQ ID NO: 624439 - DNA, 25 bp, Rattus norvegicus
tgctcatgagagagccgcgaggcct

SEQ ID NO: 624440 - DNA, 25 bp, Rattus norvegicus
tgctcatgagagtgccgcgaggcct

SEQ ID NO: 624441 - DNA, 25 bp, Rattus norvegicus
tgctcatgcaccatgaccggtttaa

SEQ ID NO: 624442 - DNA, 25 bp, Rattus norvegicus
tgctcatgcaccttgaccggtttaa

SEQ ID NO: 624443 - DNA, 25 bp, Rattus norvegicus
tgctcatgccgtaatttactcccaa

SEQ ID NO: 624444 - DNA, 25 bp, Rattus norvegicus
tgctcatgccgttatttactcccaa

SEQ ID NO: 624445 - DNA, 25 bp, Rattus norvegicus
tgctcatgcctgcttgaagccagta

SEQ ID NO: 624446 - DNA, 25 bp, Rattus norvegicus
tgctcatgcctggttgaagccagta

SEQ ID NO: 624447 - DNA, 25 bp, Rattus norvegicus
tgctcatgcttaccacagtcgctgt

SEQ ID NO: 624448 - DNA, 25 bp, Rattus norvegicus
tgctcatgcttagcacagtcgctgt

SEQ ID NO: 624449 - DNA, 25 bp, Rattus norvegicus
tgctcatgcttcacatatacctagt

SEQ ID NO: 624450 - DNA, 25 bp, Rattus norvegicus
tgctcatgcttctcatatacctagt

SEQ ID NO: 624451 - DNA, 25 bp, Rattus norvegicus
tgctcatggaggaacaagtcagatt

SEQ ID NO: 624452 - DNA, 25 bp, Rattus norvegicus
tgctcatggaggtacaagtcagatt

SEQ ID NO: 624453 - DNA, 25 bp, Rattus norvegicus
tgctcatgggtgctgcaacctagag

SEQ ID NO: 624454 - DNA, 25 bp, Rattus norvegicus
tgctcatgggtggtgcaacctagag

SEQ ID NO: 624455 - DNA, 25 bp, Rattus norvegicus
tgctcatggtctctgacgtcaccag

SEQ ID NO: 624456 - DNA, 25 bp, Rattus norvegicus
tgctcatggtctgtgacgtcaccag

SEQ ID NO: 624457 - DNA, 25 bp, Rattus norvegicus
tgctcatgtgctactcagggccagg

SEQ ID NO: 624458 - DNA, 25 bp, Rattus norvegicus
tgctcatgtgcttctcagggccagg

SEQ ID NO: 624459 - DNA, 25 bp, Rattus norvegicus
tgctcattactgatttctgctcctc

SEQ ID NO: 624460 - DNA, 25 bp, Rattus norvegicus
tgctcattactgttttctgctcctc

SEQ ID NO: 624461 - DNA, 25 bp, Rattus norvegicus
tgctcattcaaaattcatgccctct

SEQ ID NO: 624462 - DNA, 25 bp, Rattus norvegicus
tgctcattcaaatttcatgccctct

SEQ ID NO: 624463 - DNA, 25 bp, Rattus norvegicus
tgctcattctttcccagtgtcatat

SEQ ID NO: 624464 - DNA, 25 bp, Rattus norvegicus
tgctcattctttgccagtgtcatat

SEQ ID NO: 624465 - DNA, 25 bp, Rattus norvegicus
tgctcattgatcatctccttgttct

SEQ ID NO: 624466 - DNA, 25 bp, Rattus norvegicus
tgctcattgatcttctccttgttct

SEQ ID NO: 624467 - DNA, 25 bp, Rattus norvegicus
tgctcattggcgagtgtcctgcggg

SEQ ID NO: 624468 - DNA, 25 bp, Rattus norvegicus
tgctcattggcgtgtgtcctgcggg

SEQ ID NO: 624469 - DNA, 25 bp, Rattus norvegicus
tgctcattgtctagaattcccactt

SEQ ID NO: 624470 - DNA, 25 bp, Rattus norvegicus
tgctcattgtcttgaattcccactt

SEQ ID NO: 624471 - DNA, 25 bp, Rattus norvegicus
tgctcatttgcgctattctatagaa

SEQ ID NO: 624472 - DNA, 25 bp, Rattus norvegicus
tgctcatttgcggtattctatagaa

SEQ ID NO: 624473 - DNA, 25 bp, Rattus norvegicus
tgctcattttccaatggttctgaag

SEQ ID NO: 624474 - DNA, 25 bp, Rattus norvegicus
tgctcattttccaggccaacgattg

SEQ ID NO: 624475 - DNA, 25 bp, Rattus norvegicus
tgctcattttcctatggttctgaag

SEQ ID NO: 624476 - DNA, 25 bp, Rattus norvegicus
tgctcattttcctggccaacgattg

SEQ ID NO: 624477 - DNA, 25 bp, Rattus norvegicus
tgctcatttttacttcttcttcttc

SEQ ID NO: 624478 - DNA, 25 bp, Rattus norvegicus
tgctcatttttagttcttcttcttc

SEQ ID NO: 624479 - DNA, 25 bp, Rattus norvegicus
tgctccaaaagcactgggtctctgg

SEQ ID NO: 624480 - DNA, 25 bp, Rattus norvegicus
tgctccaaaagccagaacatactgt

SEQ ID NO: 624481 - DNA, 25 bp, Rattus norvegicus
tgctccaaaagcgagaacatactgt

SEQ ID NO: 624482 - DNA, 25 bp, Rattus norvegicus
tgctccaaaagctctgggtctctgg

SEQ ID NO: 624483 - DNA, 25 bp, Rattus norvegicus
tgctccaaagatcctgctcatgttt

SEQ ID NO: 624484 - DNA, 25 bp, Rattus norvegicus
tgctccaaagatgctgctcatgttt

SEQ ID NO: 624485 - DNA, 25 bp, Rattus norvegicus
tgctccaaataacagtctgcggttt

SEQ ID NO: 624486 - DNA, 25 bp, Rattus norvegicus
tgctccaaataagagtctgcggttt

SEQ ID NO: 624487 - DNA, 25 bp, Rattus norvegicus
tgctccaagcacaagttccacaagt

SEQ ID NO: 624488 - DNA, 25 bp, Rattus norvegicus
tgctccaagcactagttccacaagt

SEQ ID NO: 624489 - DNA, 25 bp, Rattus norvegicus
tgctccaagtctaatttgaccctgg

SEQ ID NO: 624490 - DNA, 25 bp, Rattus norvegicus
tgctccaagtcttatttgaccctgg

SEQ ID NO: 624491 - DNA, 25 bp, Rattus norvegicus
tgctccaagtgaacttaatgtgctt

SEQ ID NO: 624492 - DNA, 25 bp, Rattus norvegicus
tgctccaagtgatcttaatgtgctt

SEQ ID NO: 624493 - DNA, 25 bp, Rattus norvegicus
tgctccacaacaacaaagtgtcttt

SEQ ID NO: 624494 - DNA, 25 bp, Rattus norvegicus
tgctccacaacatcaaagtgtcttt

SEQ ID NO: 624495 - DNA, 25 bp, Rattus norvegicus
tgctccacactcactggcttggata

SEQ ID NO: 624496 - DNA, 25 bp, Rattus norvegicus
tgctccacactctctggcttggata

SEQ ID NO: 624497 - DNA, 25 bp, Rattus norvegicus
tgctccacaggcagcggcttttaat

SEQ ID NO: 624498 - DNA, 25 bp, Rattus norvegicus
tgctccacaggctgcggcttttaat

SEQ ID NO: 624499 - DNA, 25 bp, Rattus norvegicus
tgctccacatggaccacttaattat

SEQ ID NO: 624500 - DNA, 25 bp, Rattus norvegicus
tgctccacatggtccacttaattat

SEQ ID NO: 624501 - DNA, 25 bp, Rattus norvegicus
tgctccaccaatcgctaccgagaaa

SEQ ID NO: 624502 - DNA, 25 bp, Rattus norvegicus
tgctccaccaatggctaccgagaaa

SEQ ID NO: 624503 - DNA, 25 bp, Rattus norvegicus
tgctccaccacgagcgggaacgttt

SEQ ID NO: 624504 - DNA, 25 bp, Rattus norvegicus
tgctccaccacgtgcgggaacgttt

SEQ ID NO: 624505 - DNA, 25 bp, Rattus norvegicus
tgctccaccaggaagcgaacgactt

SEQ ID NO: 624506 - DNA, 25 bp, Rattus norvegicus
tgctccaccaggtagcgaacgactt

SEQ ID NO: 624507 - DNA, 25 bp, Rattus norvegicus
tgctccaccggaccacagcggcggc

SEQ ID NO: 624508 - DNA, 25 bp, Rattus norvegicus
tgctccaccggagcacagcggcggc

SEQ ID NO: 624509 - DNA, 25 bp, Rattus norvegicus
tgctccacggcaaggctgcggaaga

SEQ ID NO: 624510 - DNA, 25 bp, Rattus norvegicus
tgctccacggcatggctgcggaaga

SEQ ID NO: 624511 - DNA, 25 bp, Rattus norvegicus
tgctccactgacctgacccaatggg

SEQ ID NO: 624512 - DNA, 25 bp, Rattus norvegicus
tgctccactgacgtgacccaatggg

SEQ ID NO: 624513 - DNA, 25 bp, Rattus norvegicus
tgctccacttgtccctcgtatataa

SEQ ID NO: 624514 - DNA, 25 bp, Rattus norvegicus
tgctccacttgtgcctcgtatataa

SEQ ID NO: 624515 - DNA, 25 bp, Rattus norvegicus
tgctccagaagcagcagccgcgagc

SEQ ID NO: 624516 - DNA, 25 bp, Rattus norvegicus
tgctccagaagctgcagccgcgagc

SEQ ID NO: 624517 - DNA, 25 bp, Rattus norvegicus
tgctccagacacattacatcctcat

SEQ ID NO: 624518 - DNA, 25 bp, Rattus norvegicus
tgctccagacactttacatcctcat

SEQ ID NO: 624519 - DNA, 25 bp, Rattus norvegicus
tgctccagaccaagagtaagatccc

SEQ ID NO: 624520 - DNA, 25 bp, Rattus norvegicus
tgctccagaccatgagtaagatccc

SEQ ID NO: 624521 - DNA, 25 bp, Rattus norvegicus
tgctccagatctctcacaatgaact

SEQ ID NO: 624522 - DNA, 25 bp, Rattus norvegicus
tgctccagatctgtcacaatgaact

SEQ ID NO: 624523 - DNA, 25 bp, Rattus norvegicus
tgctccagatgaagaccaggtccag

SEQ ID NO: 624524 - DNA, 25 bp, Rattus norvegicus
tgctccagatgatgaccaggtccag

SEQ ID NO: 624525 - DNA, 25 bp, Rattus norvegicus
tgctccagcagaacactagagtccc

SEQ ID NO: 624526 - DNA, 25 bp, Rattus norvegicus
tgctccagcagatcactagagtccc

SEQ ID NO: 624527 - DNA, 25 bp, Rattus norvegicus
tgctccagcccacaaggttgtcttg

SEQ ID NO: 624528 - DNA, 25 bp, Rattus norvegicus
tgctccagcccagaaggttgtcttg

SEQ ID NO: 624529 - DNA, 25 bp, Rattus norvegicus
tgctccagcctcagaatgttatctt

SEQ ID NO: 624530 - DNA, 25 bp, Rattus norvegicus
tgctccagcctctgaatgttatctt

SEQ ID NO: 624531 - DNA, 25 bp, Rattus norvegicus
tgctccagccttccagttcaagatg

SEQ ID NO: 624532 - DNA, 25 bp, Rattus norvegicus
tgctccagccttgcagttcaagatg

SEQ ID NO: 624533 - DNA, 25 bp, Rattus norvegicus
tgctccagcttcaaggtgacctgag

SEQ ID NO: 624534 - DNA, 25 bp, Rattus norvegicus
tgctccagcttctaggtgacctgag

SEQ ID NO: 624535 - DNA, 25 bp, Rattus norvegicus
tgctccaggccaatggacaacgccg

SEQ ID NO: 624536 - DNA, 25 bp, Rattus norvegicus
tgctccaggccaccgggttatttga

SEQ ID NO: 624537 - DNA, 25 bp, Rattus norvegicus
tgctccaggccagcgggttatttga

SEQ ID NO: 624538 - DNA, 25 bp, Rattus norvegicus
tgctccaggccattggacaacgccg

SEQ ID NO: 624539 - DNA, 25 bp, Rattus norvegicus
tgctccaggctaagtttaccgttcc

SEQ ID NO: 624540 - DNA, 25 bp, Rattus norvegicus
tgctccaggctatgtttaccgttcc

SEQ ID NO: 624541 - DNA, 25 bp, Rattus norvegicus
tgctccagggccaattcactgcaag

SEQ ID NO: 624542 - DNA, 25 bp, Rattus norvegicus
tgctccagggcctattcactgcaag

SEQ ID NO: 624543 - DNA, 25 bp, Rattus norvegicus
tgctccagggttattccaccaggaa

SEQ ID NO: 624544 - DNA, 25 bp, Rattus norvegicus
tgctccagggtttttccaccaggaa

SEQ ID NO: 624545 - DNA, 25 bp, Rattus norvegicus
tgctccaggttaatctcatcacaga

SEQ ID NO: 624546 - DNA, 25 bp, Rattus norvegicus
tgctccaggttattctcatcacaga

SEQ ID NO: 624547 - DNA, 25 bp, Rattus norvegicus
tgctccagtaataaccataccccaa

SEQ ID NO: 624548 - DNA, 25 bp, Rattus norvegicus
tgctccagtaattaccataccccaa

SEQ ID NO: 624549 - DNA, 25 bp, Rattus norvegicus
tgctccagtgacaactccttaggga

SEQ ID NO: 624550 - DNA, 25 bp, Rattus norvegicus
tgctccagtgactactccttaggga

SEQ ID NO: 624551 - DNA, 25 bp, Rattus norvegicus
tgctccagtgatcactccagagatg

SEQ ID NO: 624552 - DNA, 25 bp, Rattus norvegicus
tgctccagtgatgactccagagatg

SEQ ID NO: 624553 - DNA, 25 bp, Rattus norvegicus
tgctccagtgtgaggttccagtaat

SEQ ID NO: 624554 - DNA, 25 bp, Rattus norvegicus
tgctccagtgtgtggttccagtaat

SEQ ID NO: 624555 - DNA, 25 bp, Rattus norvegicus
tgctccatacccaacactactgata

SEQ ID NO: 624556 - DNA, 25 bp, Rattus norvegicus
tgctccataccctacactactgata

SEQ ID NO: 624557 - DNA, 25 bp, Rattus norvegicus
tgctccatagcccagactagcctgg

SEQ ID NO: 624558 - DNA, 25 bp, Rattus norvegicus
tgctccatagccgagactagcctgg

SEQ ID NO: 624559 - DNA, 25 bp, Rattus norvegicus
tgctccatccctcgacagtcatgga

SEQ ID NO: 624560 - DNA, 25 bp, Rattus norvegicus
tgctccatccctggacagtcatgga

SEQ ID NO: 624561 - DNA, 25 bp, Rattus norvegicus
tgctccatcctcaccagatgtacat

SEQ ID NO: 624562 - DNA, 25 bp, Rattus norvegicus
tgctccatcctctccagatgtacat

SEQ ID NO: 624563 - DNA, 25 bp, Rattus norvegicus
tgctccatcctgcacagggtaaact

SEQ ID NO: 624564 - DNA, 25 bp, Rattus norvegicus
tgctccatcctggacagggtaaact

SEQ ID NO: 624565 - DNA, 25 bp, Rattus norvegicus
tgctccatcttccaaccttacagtt

SEQ ID NO: 624566 - DNA, 25 bp, Rattus norvegicus
tgctccatcttcgaaccttacagtt

SEQ ID NO: 624567 - DNA, 25 bp, Rattus norvegicus
tgctccatgccgctgtccagtaggg

SEQ ID NO: 624568 - DNA, 25 bp, Rattus norvegicus
tgctccatgccggtgtccagtaggg

SEQ ID NO: 624569 - DNA, 25 bp, Rattus norvegicus
tgctccatgggaaggctgcagagca

SEQ ID NO: 624570 - DNA, 25 bp, Rattus norvegicus
tgctccatgggatggctgcagagca

SEQ ID NO: 624571 - DNA, 25 bp, Rattus norvegicus
tgctccatgtgtatacccaggtcaa

SEQ ID NO: 624572 - DNA, 25 bp, Rattus norvegicus
tgctccatgtgtttacccaggtcaa

SEQ ID NO: 624573 - DNA, 25 bp, Rattus norvegicus
tgctccattcacaaacagctttgca

SEQ ID NO: 624574 - DNA, 25 bp, Rattus norvegicus
tgctccattcactaacagctttgca

SEQ ID NO: 624575 - DNA, 25 bp, Rattus norvegicus
tgctccattcccaggcaggaggaga

SEQ ID NO: 624576 - DNA, 25 bp, Rattus norvegicus
tgctccattccctggcaggaggaga

SEQ ID NO: 624577 - DNA, 25 bp, Rattus norvegicus
tgctccattttcacatgctgtcatc

SEQ ID NO: 624578 - DNA, 25 bp, Rattus norvegicus
tgctccattttctcatgctgtcatc

SEQ ID NO: 624579 - DNA, 25 bp, Rattus norvegicus
tgctcccacaaactatgccaagaag

SEQ ID NO: 624580 - DNA, 25 bp, Rattus norvegicus
tgctcccacaaagtatgccaagaag

SEQ ID NO: 624581 - DNA, 25 bp, Rattus norvegicus
tgctcccacagcctatccaggagtt

SEQ ID NO: 624582 - DNA, 25 bp, Rattus norvegicus
tgctcccacagcgtatccaggagtt

SEQ ID NO: 624583 - DNA, 25 bp, Rattus norvegicus
tgctcccacatcattcatctcagat

SEQ ID NO: 624584 - DNA, 25 bp, Rattus norvegicus
tgctcccacatctttcatctcagat

SEQ ID NO: 624585 - DNA, 25 bp, Rattus norvegicus
tgctcccacccaagtatctgaaaag

SEQ ID NO: 624586 - DNA, 25 bp, Rattus norvegicus
tgctcccacccatgtatctgaaaag

SEQ ID NO: 624587 - DNA, 25 bp, Rattus norvegicus
tgctcccacgagatcttacagatta

SEQ ID NO: 624588 - DNA, 25 bp, Rattus norvegicus
tgctcccacgagttcttacagatta

SEQ ID NO: 624589 - DNA, 25 bp, Rattus norvegicus
tgctcccactggaaggtactcacag

SEQ ID NO: 624590 - DNA, 25 bp, Rattus norvegicus
tgctcccactggtaggtactcacag

SEQ ID NO: 624591 - DNA, 25 bp, Rattus norvegicus
tgctcccagagcctataaataaaag

SEQ ID NO: 624592 - DNA, 25 bp, Rattus norvegicus
tgctcccagagcgtataaataaaag

SEQ ID NO: 624593 - DNA, 25 bp, Rattus norvegicus
tgctcccagattcatgtgcagcctg

SEQ ID NO: 624594 - DNA, 25 bp, Rattus norvegicus
tgctcccagattgatgtgcagcctg

SEQ ID NO: 624595 - DNA, 25 bp, Rattus norvegicus
tgctcccagcctaaagttgtgagac

SEQ ID NO: 624596 - DNA, 25 bp, Rattus norvegicus
tgctcccagccttaagttgtgagac

SEQ ID NO: 624597 - DNA, 25 bp, Rattus norvegicus
tgctcccagtacagggtgtccagag

SEQ ID NO: 624598 - DNA, 25 bp, Rattus norvegicus
tgctcccagtactgggtgtccagag

SEQ ID NO: 624599 - DNA, 25 bp, Rattus norvegicus
tgctcccagtccactgtaaatacga

SEQ ID NO: 624600 - DNA, 25 bp, Rattus norvegicus
tgctcccagtcctctgtaaatacga

SEQ ID NO: 624601 - DNA, 25 bp, Rattus norvegicus
tgctcccagtgcaagcctgttgtca

SEQ ID NO: 624602 - DNA, 25 bp, Rattus norvegicus
tgctcccagtgctagcctgttgtca

SEQ ID NO: 624603 - DNA, 25 bp, Rattus norvegicus
tgctccccagaaaggtcttgtgtga

SEQ ID NO: 624604 - DNA, 25 bp, Rattus norvegicus
tgctccccagaatggtcttgtgtga

SEQ ID NO: 624605 - DNA, 25 bp, Rattus norvegicus
tgctccccagctaattcatgattga

SEQ ID NO: 624606 - DNA, 25 bp, Rattus norvegicus
tgctccccagcttattcatgattga

SEQ ID NO: 624607 - DNA, 25 bp, Rattus norvegicus
tgctccccaggcatattctaaggca

SEQ ID NO: 624608 - DNA, 25 bp, Rattus norvegicus
tgctccccaggcttattctaaggca

SEQ ID NO: 624609 - DNA, 25 bp, Rattus norvegicus
tgctccccatagcttcacgtttgaa

SEQ ID NO: 624610 - DNA, 25 bp, Rattus norvegicus
tgctccccataggttcacgtttgaa

SEQ ID NO: 624611 - DNA, 25 bp, Rattus norvegicus
tgctccccatttactatgactctgc

SEQ ID NO: 624612 - DNA, 25 bp, Rattus norvegicus
tgctccccattttctatgactctgc

SEQ ID NO: 624613 - DNA, 25 bp, Rattus norvegicus
tgctccccgggcagtacaggaatag

SEQ ID NO: 624614 - DNA, 25 bp, Rattus norvegicus
tgctccccgggctgtacaggaatag

SEQ ID NO: 624615 - DNA, 25 bp, Rattus norvegicus
tgctccccgggtaaactcataactt

SEQ ID NO: 624616 - DNA, 25 bp, Rattus norvegicus
tgctccccgggttaactcataactt

SEQ ID NO: 624617 - DNA, 25 bp, Rattus norvegicus
tgctccccgtgcacagtattagtca

SEQ ID NO: 624618 - DNA, 25 bp, Rattus norvegicus
tgctccccgtgctcagtattagtca

SEQ ID NO: 624619 - DNA, 25 bp, Rattus norvegicus
tgctcccctgccatttggaaacaaa

SEQ ID NO: 624620 - DNA, 25 bp, Rattus norvegicus
tgctcccctgccttttggaaacaaa

SEQ ID NO: 624621 - DNA, 25 bp, Rattus norvegicus
tgctcccctgttctgtatgatgtac

SEQ ID NO: 624622 - DNA, 25 bp, Rattus norvegicus
tgctcccctgttgtgtatgatgtac

SEQ ID NO: 624623 - DNA, 25 bp, Rattus norvegicus
tgctccccttgcagtgcaataaagg

SEQ ID NO: 624624 - DNA, 25 bp, Rattus norvegicus
tgctccccttgctgtgcaataaagg

SEQ ID NO: 624625 - DNA, 25 bp, Rattus norvegicus
tgctcccgacctagttaaggacaga

SEQ ID NO: 624626 - DNA, 25 bp, Rattus norvegicus
tgctcccgaccttgttaaggacaga

SEQ ID NO: 624627 - DNA, 25 bp, Rattus norvegicus
tgctcccgagcgacctgttgctggg

SEQ ID NO: 624628 - DNA, 25 bp, Rattus norvegicus
tgctcccgagcgtcctgttgctggg

SEQ ID NO: 624629 - DNA, 25 bp, Rattus norvegicus
tgctcccgccgtagcaagaagacca

SEQ ID NO: 624630 - DNA, 25 bp, Rattus norvegicus
tgctcccgccgttgcaagaagacca

SEQ ID NO: 624631 - DNA, 25 bp, Rattus norvegicus
tgctcccggaccctgacctagacac

SEQ ID NO: 624632 - DNA, 25 bp, Rattus norvegicus
tgctcccggaccgtgacctagacac

SEQ ID NO: 624633 - DNA, 25 bp, Rattus norvegicus
tgctcccgtcttaaggccatgtcta

SEQ ID NO: 624634 - DNA, 25 bp, Rattus norvegicus
tgctcccgtctttaggccatgtcta

SEQ ID NO: 624635 - DNA, 25 bp, Rattus norvegicus
tgctccctatttatggttgacccta

SEQ ID NO: 624636 - DNA, 25 bp, Rattus norvegicus
tgctccctatttttggttgacccta

SEQ ID NO: 624637 - DNA, 25 bp, Rattus norvegicus
tgctccctcactacaggctgaagag

SEQ ID NO: 624638 - DNA, 25 bp, Rattus norvegicus
tgctccctcacttcaggctgaagag

SEQ ID NO: 624639 - DNA, 25 bp, Rattus norvegicus
tgctccctctggctttttatgagat

SEQ ID NO: 624640 - DNA, 25 bp, Rattus norvegicus
tgctccctctgggtttttatgagat

SEQ ID NO: 624641 - DNA, 25 bp, Rattus norvegicus
tgctccctgatgacctgcattaggg

SEQ ID NO: 624642 - DNA, 25 bp, Rattus norvegicus
tgctccctgatgtcctgcattaggg

SEQ ID NO: 624643 - DNA, 25 bp, Rattus norvegicus
tgctccctgccacatagtcaatttt

SEQ ID NO: 624644 - DNA, 25 bp, Rattus norvegicus
tgctccctgccagatagtcaatttt

SEQ ID NO: 624645 - DNA, 25 bp, Rattus norvegicus
tgctccctgcctcgtttggttttaa

SEQ ID NO: 624646 - DNA, 25 bp, Rattus norvegicus
tgctccctgcctggtttggttttaa

SEQ ID NO: 624647 - DNA, 25 bp, Rattus norvegicus
tgctccctggacagaagtgggcagc

SEQ ID NO: 624648 - DNA, 25 bp, Rattus norvegicus
tgctccctggactgaagtgggcagc

SEQ ID NO: 624649 - DNA, 25 bp, Rattus norvegicus
tgctccctggagcatacggtcgact

SEQ ID NO: 624650 - DNA, 25 bp, Rattus norvegicus
tgctccctggaggatacggtcgact

SEQ ID NO: 624651 - DNA, 25 bp, Rattus norvegicus
tgctccctggcactcttaatataga

SEQ ID NO: 624652 - DNA, 25 bp, Rattus norvegicus
tgctccctggcagtcttaatataga

SEQ ID NO: 624653 - DNA, 25 bp, Rattus norvegicus
tgctccctggcgcttttcggcaatg

SEQ ID NO: 624654 - DNA, 25 bp, Rattus norvegicus
tgctccctggcggttttcggcaatg

SEQ ID NO: 624655 - DNA, 25 bp, Rattus norvegicus
tgctccctgggacatcagtgttgtg

SEQ ID NO: 624656 - DNA, 25 bp, Rattus norvegicus
tgctccctgggagatcagtgttgtg

SEQ ID NO: 624657 - DNA, 25 bp, Rattus norvegicus
tgctccctgtgcatagatgggcagt

SEQ ID NO: 624658 - DNA, 25 bp, Rattus norvegicus
tgctccctgtgcttagatgggcagt

SEQ ID NO: 624659 - DNA, 25 bp, Rattus norvegicus
tgctccctgtgtaacttgtgtttga

SEQ ID NO: 624660 - DNA, 25 bp, Rattus norvegicus
tgctccctgtgttacttgtgtttga

SEQ ID NO: 624661 - DNA, 25 bp, Rattus norvegicus
tgctcccttcccaagattttgaggt

SEQ ID NO: 624662 - DNA, 25 bp, Rattus norvegicus
tgctcccttccctagattttgaggt

SEQ ID NO: 624663 - DNA, 25 bp, Rattus norvegicus
tgctcccttgtcatgaaactcagat

SEQ ID NO: 624664 - DNA, 25 bp, Rattus norvegicus
tgctcccttgtcttgaaactcagat

SEQ ID NO: 624665 - DNA, 25 bp, Rattus norvegicus
tgctcccttgtgctgaggcaaagga

SEQ ID NO: 624666 - DNA, 25 bp, Rattus norvegicus
tgctcccttgtggtgaggcaaagga

SEQ ID NO: 624667 - DNA, 25 bp, Rattus norvegicus
tgctcccttttgacctgtactgatt

SEQ ID NO: 624668 - DNA, 25 bp, Rattus norvegicus
tgctcccttttgtcctgtactgatt

SEQ ID NO: 624669 - DNA, 25 bp, Rattus norvegicus
tgctccgaacacatcagacctgagt

SEQ ID NO: 624670 - DNA, 25 bp, Rattus norvegicus
tgctccgaacacttcagacctgagt

SEQ ID NO: 624671 - DNA, 25 bp, Rattus norvegicus
tgctccgagcacaacgaacacaatg

SEQ ID NO: 624672 - DNA, 25 bp, Rattus norvegicus
tgctccgagcacagggtgacacaga

SEQ ID NO: 624673 - DNA, 25 bp, Rattus norvegicus
tgctccgagcacctgtaacttacat

SEQ ID NO: 624674 - DNA, 25 bp, Rattus norvegicus
tgctccgagcacgtgtaacttacat

SEQ ID NO: 624675 - DNA, 25 bp, Rattus norvegicus
tgctccgagcactacgaacacaatg

SEQ ID NO: 624676 - DNA, 25 bp, Rattus norvegicus
tgctccgagcactgggtgacacaga

SEQ ID NO: 624677 - DNA, 25 bp, Rattus norvegicus
tgctccgagggcaacattcagaact

SEQ ID NO: 624678 - DNA, 25 bp, Rattus norvegicus
tgctccgagggctacattcagaact

SEQ ID NO: 624679 - DNA, 25 bp, Rattus norvegicus
tgctccgccaggaagaagcattgga

SEQ ID NO: 624680 - DNA, 25 bp, Rattus norvegicus
tgctccgccaggtagaagcattgga

SEQ ID NO: 624681 - DNA, 25 bp, Rattus norvegicus
tgctccgccatgattctgaatatct

SEQ ID NO: 624682 - DNA, 25 bp, Rattus norvegicus
tgctccgccatgtttctgaatatct

SEQ ID NO: 624683 - DNA, 25 bp, Rattus norvegicus
tgctccgcctttcaaggagtccaca

SEQ ID NO: 624684 - DNA, 25 bp, Rattus norvegicus
tgctccgcctttgaaggagtccaca

SEQ ID NO: 624685 - DNA, 25 bp, Rattus norvegicus
tgctccgcgccgagaagaagcggct

SEQ ID NO: 624686 - DNA, 25 bp, Rattus norvegicus
tgctccgcgccgtgaagaagcggct

SEQ ID NO: 624687 - DNA, 25 bp, Rattus norvegicus
tgctccgcgtgcaacagcttttggg

SEQ ID NO: 624688 - DNA, 25 bp, Rattus norvegicus
tgctccgcgtgctacagcttttggg

SEQ ID NO: 624689 - DNA, 25 bp, Rattus norvegicus
tgctccgcttgcacgggtagagaga

SEQ ID NO: 624690 - DNA, 25 bp, Rattus norvegicus
tgctccgcttgctcgggtagagaga

SEQ ID NO: 624691 - DNA, 25 bp, Rattus norvegicus
tgctccggacggagttttaaactct

SEQ ID NO: 624692 - DNA, 25 bp, Rattus norvegicus
tgctccggacggtgttttaaactct

SEQ ID NO: 624693 - DNA, 25 bp, Rattus norvegicus
tgctccggagatcatgacgtgctgt

SEQ ID NO: 624694 - DNA, 25 bp, Rattus norvegicus
tgctccggagatgatgacgtgctgt

SEQ ID NO: 624695 - DNA, 25 bp, Rattus norvegicus
tgctccgggattaggtacggtccgc

SEQ ID NO: 624696 - DNA, 25 bp, Rattus norvegicus
tgctccgggatttggtacggtccgc

SEQ ID NO: 624697 - DNA, 25 bp, Rattus norvegicus
tgctccgggtttctgttcaggcacg

SEQ ID NO: 624698 - DNA, 25 bp, Rattus norvegicus
tgctccgggtttgtgttcaggcacg

SEQ ID NO: 624699 - DNA, 25 bp, Rattus norvegicus
tgctccgtcagtcctcggaagtaac

SEQ ID NO: 624700 - DNA, 25 bp, Rattus norvegicus
tgctccgtcagtgctcggaagtaac

SEQ ID NO: 624701 - DNA, 25 bp, Rattus norvegicus
tgctcctaaaccactgttctttaaa

SEQ ID NO: 624702 - DNA, 25 bp, Rattus norvegicus
tgctcctaaacctctgttctttaaa

SEQ ID NO: 624703 - DNA, 25 bp, Rattus norvegicus
tgctcctaatccacttaagccgtgg

SEQ ID NO: 624704 - DNA, 25 bp, Rattus norvegicus
tgctcctaatcctcttaagccgtgg

SEQ ID NO: 624705 - DNA, 25 bp, Rattus norvegicus
tgctcctacccacggaagaagggct

SEQ ID NO: 624706 - DNA, 25 bp, Rattus norvegicus
tgctcctacccagggaagaagggct

SEQ ID NO: 624707 - DNA, 25 bp, Rattus norvegicus
tgctcctactagaggcaccacaaga

SEQ ID NO: 624708 - DNA, 25 bp, Rattus norvegicus
tgctcctactagtggcaccacaaga

SEQ ID NO: 624709 - DNA, 25 bp, Rattus norvegicus
tgctcctactgtaaggctgggtgaa

SEQ ID NO: 624710 - DNA, 25 bp, Rattus norvegicus
tgctcctactgtacaccttgtgagg

SEQ ID NO: 624711 - DNA, 25 bp, Rattus norvegicus
tgctcctactgttaggctgggtgaa

SEQ ID NO: 624712 - DNA, 25 bp, Rattus norvegicus
tgctcctactgttcaccttgtgagg

SEQ ID NO: 624713 - DNA, 25 bp, Rattus norvegicus
tgctcctaggtcattgataaatgct

SEQ ID NO: 624714 - DNA, 25 bp, Rattus norvegicus
tgctcctaggtctttgataaatgct

SEQ ID NO: 624715 - DNA, 25 bp, Rattus norvegicus
tgctcctcaaaaccacctgagtttg

SEQ ID NO: 624716 - DNA, 25 bp, Rattus norvegicus
tgctcctcaaaagcacctgagtttg

SEQ ID NO: 624717 - DNA, 25 bp, Rattus norvegicus
tgctcctcaagaagacctaggtttg

SEQ ID NO: 624718 - DNA, 25 bp, Rattus norvegicus
tgctcctcaagatgacctaggtttg

SEQ ID NO: 624719 - DNA, 25 bp, Rattus norvegicus
tgctcctcaagcattaacctgtttg

SEQ ID NO: 624720 - DNA, 25 bp, Rattus norvegicus
tgctcctcaagctttaacctgtttg

SEQ ID NO: 624721 - DNA, 25 bp, Rattus norvegicus
tgctcctcactaacagacttggtat

SEQ ID NO: 624722 - DNA, 25 bp, Rattus norvegicus
tgctcctcactatcagacttggtat

SEQ ID NO: 624723 - DNA, 25 bp, Rattus norvegicus
tgctcctcacttcttatttagctgt

SEQ ID NO: 624724 - DNA, 25 bp, Rattus norvegicus
tgctcctcacttgttatttagctgt

SEQ ID NO: 624725 - DNA, 25 bp, Rattus norvegicus
tgctcctcaggaaccaagtgggtct

SEQ ID NO: 624726 - DNA, 25 bp, Rattus norvegicus
tgctcctcaggatccaagtgggtct

SEQ ID NO: 624727 - DNA, 25 bp, Rattus norvegicus
tgctcctcagtaacgcttctttttt

SEQ ID NO: 624728 - DNA, 25 bp, Rattus norvegicus
tgctcctcagtacctatcagtgtga

SEQ ID NO: 624729 - DNA, 25 bp, Rattus norvegicus
tgctcctcagtagctatcagtgtga

SEQ ID NO: 624730 - DNA, 25 bp, Rattus norvegicus
tgctcctcagtatcgcttctttttt

SEQ ID NO: 624731 - DNA, 25 bp, Rattus norvegicus
tgctcctcatgtacctactgtacat

SEQ ID NO: 624732 - DNA, 25 bp, Rattus norvegicus
tgctcctcatgttcctactgtacat

SEQ ID NO: 624733 - DNA, 25 bp, Rattus norvegicus
tgctcctcattacctagcttttgga

SEQ ID NO: 624734 - DNA, 25 bp, Rattus norvegicus
tgctcctcattagctagcttttgga

SEQ ID NO: 624735 - DNA, 25 bp, Rattus norvegicus
tgctcctccagaacgcaaatattct

SEQ ID NO: 624736 - DNA, 25 bp, Rattus norvegicus
tgctcctccagatcgcaaatattct

SEQ ID NO: 624737 - DNA, 25 bp, Rattus norvegicus
tgctcctcctcactgtgttataaat

SEQ ID NO: 624738 - DNA, 25 bp, Rattus norvegicus
tgctcctcctcagtgtgttataaat

SEQ ID NO: 624739 - DNA, 25 bp, Rattus norvegicus
tgctcctcctgaccgcaagtactct

SEQ ID NO: 624740 - DNA, 25 bp, Rattus norvegicus
tgctcctcctgagcgcaagtactct

SEQ ID NO: 624741 - DNA, 25 bp, Rattus norvegicus
tgctcctcctgcaactatggaagtg

SEQ ID NO: 624742 - DNA, 25 bp, Rattus norvegicus
tgctcctcctgctactatggaagtg

SEQ ID NO: 624743 - DNA, 25 bp, Rattus norvegicus
tgctcctcgatgaacacaatctgcg

SEQ ID NO: 624744 - DNA, 25 bp, Rattus norvegicus
tgctcctcgatgtacacaatctgcg

SEQ ID NO: 624745 - DNA, 25 bp, Rattus norvegicus
tgctcctcggcacctgtggatgaca

SEQ ID NO: 624746 - DNA, 25 bp, Rattus norvegicus
tgctcctcggcagctgtggatgaca

SEQ ID NO: 624747 - DNA, 25 bp, Rattus norvegicus
tgctcctctctacattttcctgaaa

SEQ ID NO: 624748 - DNA, 25 bp, Rattus norvegicus
tgctcctctctagattttcctgaaa

SEQ ID NO: 624749 - DNA, 25 bp, Rattus norvegicus
tgctcctctgaaccgatgtgggctg

SEQ ID NO: 624750 - DNA, 25 bp, Rattus norvegicus
tgctcctctgaagcgatgtgggctg

SEQ ID NO: 624751 - DNA, 25 bp, Rattus norvegicus
tgctcctctgtccttgaacagtgaa

SEQ ID NO: 624752 - DNA, 25 bp, Rattus norvegicus
tgctcctctgtcgttgaacagtgaa

SEQ ID NO: 624753 - DNA, 25 bp, Rattus norvegicus
tgctcctcttagcttcaaactgcta

SEQ ID NO: 624754 - DNA, 25 bp, Rattus norvegicus
tgctcctcttaggttcaaactgcta

SEQ ID NO: 624755 - DNA, 25 bp, Rattus norvegicus
tgctcctcttctcaacaggaaccta

SEQ ID NO: 624756 - DNA, 25 bp, Rattus norvegicus
tgctcctcttctgaacaggaaccta

SEQ ID NO: 624757 - DNA, 25 bp, Rattus norvegicus
tgctcctcttgacagcctgaaggct

SEQ ID NO: 624758 - DNA, 25 bp, Rattus norvegicus
tgctcctcttgagagcctgaaggct

SEQ ID NO: 624759 - DNA, 25 bp, Rattus norvegicus
tgctcctgagcaaggcctgcaagaa

SEQ ID NO: 624760 - DNA, 25 bp, Rattus norvegicus
tgctcctgagcatggcctgcaagaa

SEQ ID NO: 624761 - DNA, 25 bp, Rattus norvegicus
tgctcctgagctcaaagcgcgacta

SEQ ID NO: 624762 - DNA, 25 bp, Rattus norvegicus
tgctcctgagctgaaagcgcgacta

SEQ ID NO: 624763 - DNA, 25 bp, Rattus norvegicus
tgctcctgagggaggatgcccttca

SEQ ID NO: 624764 - DNA, 25 bp, Rattus norvegicus
tgctcctgagggtggatgcccttca

SEQ ID NO: 624765 - DNA, 25 bp, Rattus norvegicus
tgctcctgcagtagaatcacttttc

SEQ ID NO: 624766 - DNA, 25 bp, Rattus norvegicus
tgctcctgcagttgaatcacttttc

SEQ ID NO: 624767 - DNA, 25 bp, Rattus norvegicus
tgctcctgccggatacggaatggga

SEQ ID NO: 624768 - DNA, 25 bp, Rattus norvegicus
tgctcctgccggttacggaatggga

SEQ ID NO: 624769 - DNA, 25 bp, Rattus norvegicus
tgctcctgcctgaagatttatgctg

SEQ ID NO: 624770 - DNA, 25 bp, Rattus norvegicus
tgctcctgcctgtagatttatgctg

SEQ ID NO: 624771 - DNA, 25 bp, Rattus norvegicus
tgctcctgctagagtgctgccaagg

SEQ ID NO: 624772 - DNA, 25 bp, Rattus norvegicus
tgctcctgctagtgtgctgccaagg

SEQ ID NO: 624773 - DNA, 25 bp, Rattus norvegicus
tgctcctggctgactgtggaagagt

SEQ ID NO: 624774 - DNA, 25 bp, Rattus norvegicus
tgctcctggctgtctgtggaagagt

SEQ ID NO: 624775 - DNA, 25 bp, Rattus norvegicus
tgctcctgggagacattttatttat

SEQ ID NO: 624776 - DNA, 25 bp, Rattus norvegicus
tgctcctgggagtcattttatttat

SEQ ID NO: 624777 - DNA, 25 bp, Rattus norvegicus
tgctcctgggctccaaacattccat

SEQ ID NO: 624778 - DNA, 25 bp, Rattus norvegicus
tgctcctgggctgcaaacattccat

SEQ ID NO: 624779 - DNA, 25 bp, Rattus norvegicus
tgctcctgggtcacattgttagatg

SEQ ID NO: 624780 - DNA, 25 bp, Rattus norvegicus
tgctcctgggtctcattgttagatg

SEQ ID NO: 624781 - DNA, 25 bp, Rattus norvegicus
tgctcctggtgaatcggtgacaaat

SEQ ID NO: 624782 - DNA, 25 bp, Rattus norvegicus
tgctcctggtgattcggtgacaaat

SEQ ID NO: 624783 - DNA, 25 bp, Rattus norvegicus
tgctcctggtttacggtggttgtgc

SEQ ID NO: 624784 - DNA, 25 bp, Rattus norvegicus
tgctcctggttttcggtggttgtgc

SEQ ID NO: 624785 - DNA, 25 bp, Rattus norvegicus
tgctcctgtaatcggctaactgtgg

SEQ ID NO: 624786 - DNA, 25 bp, Rattus norvegicus
tgctcctgtaatgggctaactgtgg

SEQ ID NO: 624787 - DNA, 25 bp, Rattus norvegicus
tgctcctgtaccaacgcagaagaca

SEQ ID NO: 624788 - DNA, 25 bp, Rattus norvegicus
tgctcctgtacctacgcagaagaca

SEQ ID NO: 624789 - DNA, 25 bp, Rattus norvegicus
tgctcctgtccacgcatggagagct

SEQ ID NO: 624790 - DNA, 25 bp, Rattus norvegicus
tgctcctgtccaggcatggagagct

SEQ ID NO: 624791 - DNA, 25 bp, Rattus norvegicus
tgctcctgtgcccaagaagctactg

SEQ ID NO: 624792 - DNA, 25 bp, Rattus norvegicus
tgctcctgtgccgaagaagctactg

SEQ ID NO: 624793 - DNA, 25 bp, Rattus norvegicus
tgctccttacgtatcatcacttgat

SEQ ID NO: 624794 - DNA, 25 bp, Rattus norvegicus
tgctccttacgtttcatcacttgat

SEQ ID NO: 624795 - DNA, 25 bp, Rattus norvegicus
tgctccttagacatgggtacctggt

SEQ ID NO: 624796 - DNA, 25 bp, Rattus norvegicus
tgctccttagacttgggtacctggt

SEQ ID NO: 624797 - DNA, 25 bp, Rattus norvegicus
tgctccttaggaagcctacaaaggt

SEQ ID NO: 624798 - DNA, 25 bp, Rattus norvegicus
tgctccttaggatgcctacaaaggt

SEQ ID NO: 624799 - DNA, 25 bp, Rattus norvegicus
tgctccttaggccatttctgtagtt

SEQ ID NO: 624800 - DNA, 25 bp, Rattus norvegicus
tgctccttaggcgatttctgtagtt

SEQ ID NO: 624801 - DNA, 25 bp, Rattus norvegicus
tgctccttcaagctattggcagaat

SEQ ID NO: 624802 - DNA, 25 bp, Rattus norvegicus
tgctccttcaaggtattggcagaat

SEQ ID NO: 624803 - DNA, 25 bp, Rattus norvegicus
tgctccttcaggaggaagcagcact

SEQ ID NO: 624804 - DNA, 25 bp, Rattus norvegicus
tgctccttcaggatttcagccgcaa

SEQ ID NO: 624805 - DNA, 25 bp, Rattus norvegicus
tgctccttcaggtggaagcagcact

SEQ ID NO: 624806 - DNA, 25 bp, Rattus norvegicus
tgctccttcaggttttcagccgcaa

SEQ ID NO: 624807 - DNA, 25 bp, Rattus norvegicus
tgctccttcctgagcatttatttga

SEQ ID NO: 624808 - DNA, 25 bp, Rattus norvegicus
tgctccttcctgtgcatttatttga

SEQ ID NO: 624809 - DNA, 25 bp, Rattus norvegicus
tgctccttctctccagattgttaga

SEQ ID NO: 624810 - DNA, 25 bp, Rattus norvegicus
tgctccttctctgcagattgttaga

SEQ ID NO: 624811 - DNA, 25 bp, Rattus norvegicus
tgctccttctgtcttcatggatctg

SEQ ID NO: 624812 - DNA, 25 bp, Rattus norvegicus
tgctccttctgtgttcatggatctg

SEQ ID NO: 624813 - DNA, 25 bp, Rattus norvegicus
tgctccttcttacaatccaggacta

SEQ ID NO: 624814 - DNA, 25 bp, Rattus norvegicus
tgctccttcttagaatccaggacta

SEQ ID NO: 624815 - DNA, 25 bp, Rattus norvegicus
tgctccttgattccaagtgccctga

SEQ ID NO: 624816 - DNA, 25 bp, Rattus norvegicus
tgctccttgattgcaagtgccctga

SEQ ID NO: 624817 - DNA, 25 bp, Rattus norvegicus
tgctccttgcacaggaattggtcag

SEQ ID NO: 624818 - DNA, 25 bp, Rattus norvegicus
tgctccttgcactggaattggtcag

SEQ ID NO: 624819 - DNA, 25 bp, Rattus norvegicus
tgctccttgggacgcaccggaagaa

SEQ ID NO: 624820 - DNA, 25 bp, Rattus norvegicus
tgctccttgggaggcaccggaagaa

SEQ ID NO: 624821 - DNA, 25 bp, Rattus norvegicus
tgctccttgggcactttacaacagt

SEQ ID NO: 624822 - DNA, 25 bp, Rattus norvegicus
tgctccttgggctctttacaacagt

SEQ ID NO: 624823 - DNA, 25 bp, Rattus norvegicus
tgctccttggttattcttgatcata

SEQ ID NO: 624824 - DNA, 25 bp, Rattus norvegicus
tgctccttggtttttcttgatcata

SEQ ID NO: 624825 - DNA, 25 bp, Rattus norvegicus
tgctcctttatgctaccccaacaat

SEQ ID NO: 624826 - DNA, 25 bp, Rattus norvegicus
tgctcctttatggtaccccaacaat

SEQ ID NO: 624827 - DNA, 25 bp, Rattus norvegicus
tgctcctttcttaactgccaggatt

SEQ ID NO: 624828 - DNA, 25 bp, Rattus norvegicus
tgctcctttcttatgtaggcagggt

SEQ ID NO: 624829 - DNA, 25 bp, Rattus norvegicus
tgctcctttctttactgccaggatt

SEQ ID NO: 624830 - DNA, 25 bp, Rattus norvegicus
tgctcctttcttttgtaggcagggt

SEQ ID NO: 624831 - DNA, 25 bp, Rattus norvegicus
tgctcctttgtaagtgtcacacaga

SEQ ID NO: 624832 - DNA, 25 bp, Rattus norvegicus
tgctcctttgtatgtgtcacacaga

SEQ ID NO: 624833 - DNA, 25 bp, Rattus norvegicus
tgctcgaaagcccaatgctgctgtt

SEQ ID NO: 624834 - DNA, 25 bp, Rattus norvegicus
tgctcgaaagccgaatgctgctgtt

SEQ ID NO: 624835 - DNA, 25 bp, Rattus norvegicus
tgctcgaacacacacacagggcggg

SEQ ID NO: 624836 - DNA, 25 bp, Rattus norvegicus
tgctcgaacacagacacagggcggg

SEQ ID NO: 624837 - DNA, 25 bp, Rattus norvegicus
tgctcgaacagcactaacagccgtg

SEQ ID NO: 624838 - DNA, 25 bp, Rattus norvegicus
tgctcgaacagctctaacagccgtg

SEQ ID NO: 624839 - DNA, 25 bp, Rattus norvegicus
tgctcgaactccagtcctggtgtgt

SEQ ID NO: 624840 - DNA, 25 bp, Rattus norvegicus
tgctcgaactcctgtcctggtgtgt

SEQ ID NO: 624841 - DNA, 25 bp, Rattus norvegicus
tgctcgaagctcctttgtgtgatgc

SEQ ID NO: 624842 - DNA, 25 bp, Rattus norvegicus
tgctcgaagctcgtttgtgtgatgc

SEQ ID NO: 624843 - DNA, 25 bp, Rattus norvegicus
tgctcgacatttcctgcgcatgcag

SEQ ID NO: 624844 - DNA, 25 bp, Rattus norvegicus
tgctcgacatttgctgcgcatgcag

SEQ ID NO: 624845 - DNA, 25 bp, Rattus norvegicus
tgctcgaccgagagatgcttgctgt

SEQ ID NO: 624846 - DNA, 25 bp, Rattus norvegicus
tgctcgaccgagtgatgcttgctgt

SEQ ID NO: 624847 - DNA, 25 bp, Rattus norvegicus
tgctcgactactatctctagaaggt

SEQ ID NO: 624848 - DNA, 25 bp, Rattus norvegicus
tgctcgactactttctctagaaggt

SEQ ID NO: 624849 - DNA, 25 bp, Rattus norvegicus
tgctcgagcacacggagcagctgca

SEQ ID NO: 624850 - DNA, 25 bp, Rattus norvegicus
tgctcgagcacagggagcagctgca

SEQ ID NO: 624851 - DNA, 25 bp, Rattus norvegicus
tgctcgagcgccaggccagagaaat

SEQ ID NO: 624852 - DNA, 25 bp, Rattus norvegicus
tgctcgagcgcctggccagagaaat

SEQ ID NO: 624853 - DNA, 25 bp, Rattus norvegicus
tgctcgaggcttatttcccgctggg

SEQ ID NO: 624854 - DNA, 25 bp, Rattus norvegicus
tgctcgaggcttttttcccgctggg

SEQ ID NO: 624855 - DNA, 25 bp, Rattus norvegicus
tgctcgagggacacctataggcatg

SEQ ID NO: 624856 - DNA, 25 bp, Rattus norvegicus
tgctcgagggactcctataggcatg

SEQ ID NO: 624857 - DNA, 25 bp, Rattus norvegicus
tgctcgatgctcagtgtgtgaaggt

SEQ ID NO: 624858 - DNA, 25 bp, Rattus norvegicus
tgctcgatgctctgtgtgtgaaggt

SEQ ID NO: 624859 - DNA, 25 bp, Rattus norvegicus
tgctcgcagacccaggatgacattt

SEQ ID NO: 624860 - DNA, 25 bp, Rattus norvegicus
tgctcgcagaccgaggatgacattt

SEQ ID NO: 624861 - DNA, 25 bp, Rattus norvegicus
tgctcgcatgacatccaggttttgg

SEQ ID NO: 624862 - DNA, 25 bp, Rattus norvegicus
tgctcgcatgacttccaggttttgg

SEQ ID NO: 624863 - DNA, 25 bp, Rattus norvegicus
tgctcgccagagcacaactcgctaa

SEQ ID NO: 624864 - DNA, 25 bp, Rattus norvegicus
tgctcgccagaggacaactcgctaa

SEQ ID NO: 624865 - DNA, 25 bp, Rattus norvegicus
tgctcgcccctgaggcaatagtgat

SEQ ID NO: 624866 - DNA, 25 bp, Rattus norvegicus
tgctcgcccctgtggcaatagtgat

SEQ ID NO: 624867 - DNA, 25 bp, Rattus norvegicus
tgctcgcccggcatttggagctaga

SEQ ID NO: 624868 - DNA, 25 bp, Rattus norvegicus
tgctcgcccggcttttggagctaga

SEQ ID NO: 624869 - DNA, 25 bp, Rattus norvegicus
tgctcgcgctgacggaactgctcaa

SEQ ID NO: 624870 - DNA, 25 bp, Rattus norvegicus
tgctcgcgctgagggaactgctcaa

SEQ ID NO: 624871 - DNA, 25 bp, Rattus norvegicus
tgctcgctcacacatcacctggtta

SEQ ID NO: 624872 - DNA, 25 bp, Rattus norvegicus
tgctcgctcacagatcacctggtta

SEQ ID NO: 624873 - DNA, 25 bp, Rattus norvegicus
tgctcgctgcgcagcttcggagcgc

SEQ ID NO: 624874 - DNA, 25 bp, Rattus norvegicus
tgctcgctgcgctgcttcggagcgc

SEQ ID NO: 624875 - DNA, 25 bp, Rattus norvegicus
tgctcgctgtttctgggatgcagac

SEQ ID NO: 624876 - DNA, 25 bp, Rattus norvegicus
tgctcgctgtttgtgggatgcagac

SEQ ID NO: 624877 - DNA, 25 bp, Rattus norvegicus
tgctcggaaagcactacagtcaaac

SEQ ID NO: 624878 - DNA, 25 bp, Rattus norvegicus
tgctcggaaagctctacagtcaaac

SEQ ID NO: 624879 - DNA, 25 bp, Rattus norvegicus
tgctcggaagcaagtacacacctac

SEQ ID NO: 624880 - DNA, 25 bp, Rattus norvegicus
tgctcggaagcatgtacacacctac

SEQ ID NO: 624881 - DNA, 25 bp, Rattus norvegicus
tgctcggaagtcacagcatcggtca

SEQ ID NO: 624882 - DNA, 25 bp, Rattus norvegicus
tgctcggaagtctcagcatcggtca

SEQ ID NO: 624883 - DNA, 25 bp, Rattus norvegicus
tgctcggagcaaaccatcctggttt

SEQ ID NO: 624884 - DNA, 25 bp, Rattus norvegicus
tgctcggagcaatccatcctggttt

SEQ ID NO: 624885 - DNA, 25 bp, Rattus norvegicus
tgctcggatgacacagatgacatta

SEQ ID NO: 624886 - DNA, 25 bp, Rattus norvegicus
tgctcggatgactcagatgacatta

SEQ ID NO: 624887 - DNA, 25 bp, Rattus norvegicus
tgctcggatgtgcacagaaccctgt

SEQ ID NO: 624888 - DNA, 25 bp, Rattus norvegicus
tgctcggatgtggacagaaccctgt

SEQ ID NO: 624889 - DNA, 25 bp, Rattus norvegicus
tgctcggcaccacgaactcttaaaa

SEQ ID NO: 624890 - DNA, 25 bp, Rattus norvegicus
tgctcggcaccaggaactcttaaaa

SEQ ID NO: 624891 - DNA, 25 bp, Rattus norvegicus
tgctcggcagtcataccagggtgtg

SEQ ID NO: 624892 - DNA, 25 bp, Rattus norvegicus
tgctcggcagtcttaccagggtgtg

SEQ ID NO: 624893 - DNA, 25 bp, Rattus norvegicus
tgctcggccctgaagagactctgag

SEQ ID NO: 624894 - DNA, 25 bp, Rattus norvegicus
tgctcggccctgtagagactctgag

SEQ ID NO: 624895 - DNA, 25 bp, Rattus norvegicus
tgctcggctgtgcaaggtaaactta

SEQ ID NO: 624896 - DNA, 25 bp, Rattus norvegicus
tgctcggctgtggaaggtaaactta

SEQ ID NO: 624897 - DNA, 25 bp, Rattus norvegicus
tgctcgggacaacactggactatca

SEQ ID NO: 624898 - DNA, 25 bp, Rattus norvegicus
tgctcgggacaagactggactatca

SEQ ID NO: 624899 - DNA, 25 bp, Rattus norvegicus
tgctcgggccaaattcctggtgtgt

SEQ ID NO: 624900 - DNA, 25 bp, Rattus norvegicus
tgctcgggccaatttcctggtgtgt

SEQ ID NO: 624901 - DNA, 25 bp, Rattus norvegicus
tgctcggtgattcgcatccccagca

SEQ ID NO: 624902 - DNA, 25 bp, Rattus norvegicus
tgctcggtgattggcatccccagca

SEQ ID NO: 624903 - DNA, 25 bp, Rattus norvegicus
tgctcggtgtctctctgatggtaaa

SEQ ID NO: 624904 - DNA, 25 bp, Rattus norvegicus
tgctcggtgtctgtctgatggtaaa

SEQ ID NO: 624905 - DNA, 25 bp, Rattus norvegicus
tgctcggtgtttactgcagtgcaag

SEQ ID NO: 624906 - DNA, 25 bp, Rattus norvegicus
tgctcggtgttttctgcagtgcaag

SEQ ID NO: 624907 - DNA, 25 bp, Rattus norvegicus
tgctcggttcatcagaagatcttgt

SEQ ID NO: 624908 - DNA, 25 bp, Rattus norvegicus
tgctcggttcatgagaagatcttgt

SEQ ID NO: 624909 - DNA, 25 bp, Rattus norvegicus
tgctcgtcctagcagcacctagagt

SEQ ID NO: 624910 - DNA, 25 bp, Rattus norvegicus
tgctcgtcctaggagcacctagagt

SEQ ID NO: 624911 - DNA, 25 bp, Rattus norvegicus
tgctcgtccttccttaaagatcaga

SEQ ID NO: 624912 - DNA, 25 bp, Rattus norvegicus
tgctcgtccttcgttaaagatcaga

SEQ ID NO: 624913 - DNA, 25 bp, Rattus norvegicus
tgctcgtgggcaccaacatggacaa

SEQ ID NO: 624914 - DNA, 25 bp, Rattus norvegicus
tgctcgtgggcagcaacatggacaa

SEQ ID NO: 624915 - DNA, 25 bp, Rattus norvegicus
tgctcgttctatcagcttgctgaat

SEQ ID NO: 624916 - DNA, 25 bp, Rattus norvegicus
tgctcgttctatgagcttgctgaat

SEQ ID NO: 624917 - DNA, 25 bp, Rattus norvegicus
tgctcgtttctgaatattcctttta

SEQ ID NO: 624918 - DNA, 25 bp, Rattus norvegicus
tgctcgtttctgtatattcctttta

SEQ ID NO: 624919 - DNA, 25 bp, Rattus norvegicus
tgctcgtttgtcacagtgtcacagt

SEQ ID NO: 624920 - DNA, 25 bp, Rattus norvegicus
tgctcgtttgtctcagtgtcacagt

SEQ ID NO: 624921 - DNA, 25 bp, Rattus norvegicus
tgctctaactatagtcctgtgctgc

SEQ ID NO: 624922 - DNA, 25 bp, Rattus norvegicus
tgctctaactattgtcctgtgctgc

SEQ ID NO: 624923 - DNA, 25 bp, Rattus norvegicus
tgctctaagtgcagctgggccttta

SEQ ID NO: 624924 - DNA, 25 bp, Rattus norvegicus
tgctctaagtgctgctgggccttta

SEQ ID NO: 624925 - DNA, 25 bp, Rattus norvegicus
tgctctaattcaccatatccctaat

SEQ ID NO: 624926 - DNA, 25 bp, Rattus norvegicus
tgctctaattcagcatatccctaat

SEQ ID NO: 624927 - DNA, 25 bp, Rattus norvegicus
tgctctacaagtcgacttcgcagta

SEQ ID NO: 624928 - DNA, 25 bp, Rattus norvegicus
tgctctacaagtggacttcgcagta

SEQ ID NO: 624929 - DNA, 25 bp, Rattus norvegicus
tgctctacacttcatatttcctgtc

SEQ ID NO: 624930 - DNA, 25 bp, Rattus norvegicus
tgctctacacttgatatttcctgtc

SEQ ID NO: 624931 - DNA, 25 bp, Rattus norvegicus
tgctctacagagcttagctccggga

SEQ ID NO: 624932 - DNA, 25 bp, Rattus norvegicus
tgctctacagaggttagctccggga

SEQ ID NO: 624933 - DNA, 25 bp, Rattus norvegicus
tgctctaccctgactttacgtgaag

SEQ ID NO: 624934 - DNA, 25 bp, Rattus norvegicus
tgctctaccctgtctttacgtgaag

SEQ ID NO: 624935 - DNA, 25 bp, Rattus norvegicus
tgctctacggttaccatctgttaca

SEQ ID NO: 624936 - DNA, 25 bp, Rattus norvegicus
tgctctacggtttccatctgttaca

SEQ ID NO: 624937 - DNA, 25 bp, Rattus norvegicus
tgctctactggactgctgctaggag

SEQ ID NO: 624938 - DNA, 25 bp, Rattus norvegicus
tgctctactggagtgctgctaggag

SEQ ID NO: 624939 - DNA, 25 bp, Rattus norvegicus
tgctctacttttactgcgacactga

SEQ ID NO: 624940 - DNA, 25 bp, Rattus norvegicus
tgctctactttttctgcgacactga

SEQ ID NO: 624941 - DNA, 25 bp, Rattus norvegicus
tgctctagaactatgctccagtgac

SEQ ID NO: 624942 - DNA, 25 bp, Rattus norvegicus
tgctctagaactttgctccagtgac

SEQ ID NO: 624943 - DNA, 25 bp, Rattus norvegicus
tgctctagacctacagggcactaat

SEQ ID NO: 624944 - DNA, 25 bp, Rattus norvegicus
tgctctagaccttcagggcactaat

SEQ ID NO: 624945 - DNA, 25 bp, Rattus norvegicus
tgctctagcctacagggaagcctca

SEQ ID NO: 624946 - DNA, 25 bp, Rattus norvegicus
tgctctagcctagagggaagcctca

SEQ ID NO: 624947 - DNA, 25 bp, Rattus norvegicus
tgctctagctagcatttcaagtact

SEQ ID NO: 624948 - DNA, 25 bp, Rattus norvegicus
tgctctagctaggatttcaagtact

SEQ ID NO: 624949 - DNA, 25 bp, Rattus norvegicus
tgctctaggagcatgcctggcaggc

SEQ ID NO: 624950 - DNA, 25 bp, Rattus norvegicus
tgctctaggagcttgcctggcaggc

SEQ ID NO: 624951 - DNA, 25 bp, Rattus norvegicus
tgctctatccgcaaatggcacttgg

SEQ ID NO: 624952 - DNA, 25 bp, Rattus norvegicus
tgctctatccgctaatggcacttgg

SEQ ID NO: 624953 - DNA, 25 bp, Rattus norvegicus
tgctctatctgcatttcgcctacca

SEQ ID NO: 624954 - DNA, 25 bp, Rattus norvegicus
tgctctatctgcttttcgcctacca

SEQ ID NO: 624955 - DNA, 25 bp, Rattus norvegicus
tgctctatgacgatgggctctcgga

SEQ ID NO: 624956 - DNA, 25 bp, Rattus norvegicus
tgctctatgacgttgggctctcgga

SEQ ID NO: 624957 - DNA, 25 bp, Rattus norvegicus
tgctctatgagcaccatgtacgcca

SEQ ID NO: 624958 - DNA, 25 bp, Rattus norvegicus
tgctctatgagctccatgtacgcca

SEQ ID NO: 624959 - DNA, 25 bp, Rattus norvegicus
tgctctatgcccagcatttgggatg

SEQ ID NO: 624960 - DNA, 25 bp, Rattus norvegicus
tgctctatgcccaggctgggccgag

SEQ ID NO: 624961 - DNA, 25 bp, Rattus norvegicus
tgctctatgccctgcatttgggatg

SEQ ID NO: 624962 - DNA, 25 bp, Rattus norvegicus
tgctctatgccctggctgggccgag

SEQ ID NO: 624963 - DNA, 25 bp, Rattus norvegicus
tgctctatttgcacgtatgccagaa

SEQ ID NO: 624964 - DNA, 25 bp, Rattus norvegicus
tgctctatttgctcgtatgccagaa

SEQ ID NO: 624965 - DNA, 25 bp, Rattus norvegicus
tgctctcaacaccatgggcgttcat

SEQ ID NO: 624966 - DNA, 25 bp, Rattus norvegicus
tgctctcaacacgatgggcgttcat

SEQ ID NO: 624967 - DNA, 25 bp, Rattus norvegicus
tgctctcaatacaaccaaggctcga

SEQ ID NO: 624968 - DNA, 25 bp, Rattus norvegicus
tgctctcaatactaccaaggctcga

SEQ ID NO: 624969 - DNA, 25 bp, Rattus norvegicus
tgctctcaccaacttcaccattgga

SEQ ID NO: 624970 - DNA, 25 bp, Rattus norvegicus
tgctctcaccaagttcaccattgga

SEQ ID NO: 624971 - DNA, 25 bp, Rattus norvegicus
tgctctcaccacagcgtcaggacga

SEQ ID NO: 624972 - DNA, 25 bp, Rattus norvegicus
tgctctcaccactgcgtcaggacga

SEQ ID NO: 624973 - DNA, 25 bp, Rattus norvegicus
tgctctcagaacaagattacacaga

SEQ ID NO: 624974 - DNA, 25 bp, Rattus norvegicus
tgctctcagaactagattacacaga

SEQ ID NO: 624975 - DNA, 25 bp, Rattus norvegicus
tgctctcagattctttcaaagacat

SEQ ID NO: 624976 - DNA, 25 bp, Rattus norvegicus
tgctctcagattgtttcaaagacat

SEQ ID NO: 624977 - DNA, 25 bp, Rattus norvegicus
tgctctcagccaccatgaccggaag

SEQ ID NO: 624978 - DNA, 25 bp, Rattus norvegicus
tgctctcagccagcatgaccggaag

SEQ ID NO: 624979 - DNA, 25 bp, Rattus norvegicus
tgctctcaggccctcagggtcagaa

SEQ ID NO: 624980 - DNA, 25 bp, Rattus norvegicus
tgctctcaggccgtcagggtcagaa

SEQ ID NO: 624981 - DNA, 25 bp, Rattus norvegicus
tgctctcagtgactttgaaggcagg

SEQ ID NO: 624982 - DNA, 25 bp, Rattus norvegicus
tgctctcagtgagtttgaaggcagg

SEQ ID NO: 624983 - DNA, 25 bp, Rattus norvegicus
tgctctcatactaggcctttgaagt

SEQ ID NO: 624984 - DNA, 25 bp, Rattus norvegicus
tgctctcatacttggcctttgaagt

SEQ ID NO: 624985 - DNA, 25 bp, Rattus norvegicus
tgctctcatctccagtaaagaacgt

SEQ ID NO: 624986 - DNA, 25 bp, Rattus norvegicus
tgctctcatctcgagtaaagaacgt

SEQ ID NO: 624987 - DNA, 25 bp, Rattus norvegicus
tgctctcatgccagctgcttgatga

SEQ ID NO: 624988 - DNA, 25 bp, Rattus norvegicus
tgctctcatgcctgctgcttgatga

SEQ ID NO: 624989 - DNA, 25 bp, Rattus norvegicus
tgctctcatttgcatgcacgtcggt

SEQ ID NO: 624990 - DNA, 25 bp, Rattus norvegicus
tgctctcatttggatgcacgtcggt

SEQ ID NO: 624991 - DNA, 25 bp, Rattus norvegicus
tgctctccaactactggacgtcaga

SEQ ID NO: 624992 - DNA, 25 bp, Rattus norvegicus
tgctctccaacttctggacgtcaga

SEQ ID NO: 624993 - DNA, 25 bp, Rattus norvegicus
tgctctccaaggcacctgggtctga

SEQ ID NO: 624994 - DNA, 25 bp, Rattus norvegicus
tgctctccaagggacctgggtctga

SEQ ID NO: 624995 - DNA, 25 bp, Rattus norvegicus
tgctctccaagtcgctgtcagatga

SEQ ID NO: 624996 - DNA, 25 bp, Rattus norvegicus
tgctctccaagtggctgtcagatga

SEQ ID NO: 624997 - DNA, 25 bp, Rattus norvegicus
tgctctccaatcacatcagacagta

SEQ ID NO: 624998 - DNA, 25 bp, Rattus norvegicus
tgctctccaatctcatcagacagta

SEQ ID NO: 624999 - DNA, 25 bp, Rattus norvegicus
tgctctccactgctgctcaataaac

SEQ ID NO: 625000 - DNA, 25 bp, Rattus norvegicus
tgctctccactggtgctcaataaac

SEQ ID NO: 625001 - DNA, 25 bp, Rattus norvegicus
tgctctccagccctttttgttgatg

SEQ ID NO: 625002 - DNA, 25 bp, Rattus norvegicus
tgctctccagccgtttttgttgatg

SEQ ID NO: 625003 - DNA, 25 bp, Rattus norvegicus
tgctctccagggatctactctaaga

SEQ ID NO: 625004 - DNA, 25 bp, Rattus norvegicus
tgctctccagggttctactctaaga

SEQ ID NO: 625005 - DNA, 25 bp, Rattus norvegicus
tgctctccatcacccgggagagaga

SEQ ID NO: 625006 - DNA, 25 bp, Rattus norvegicus
tgctctccatcagccgggagagaga

SEQ ID NO: 625007 - DNA, 25 bp, Rattus norvegicus
tgctctcccaaaacagattagtaga

SEQ ID NO: 625008 - DNA, 25 bp, Rattus norvegicus
tgctctcccaaatcagattagtaga

SEQ ID NO: 625009 - DNA, 25 bp, Rattus norvegicus
tgctctccctaaatcttcacatgag

SEQ ID NO: 625010 - DNA, 25 bp, Rattus norvegicus
tgctctccctaattcttcacatgag

SEQ ID NO: 625011 - DNA, 25 bp, Rattus norvegicus
tgctctccctctcaaccttgtaaat

SEQ ID NO: 625012 - DNA, 25 bp, Rattus norvegicus
tgctctccctctgaaccttgtaaat

SEQ ID NO: 625013 - DNA, 25 bp, Rattus norvegicus
tgctctccctgaagaccttgtggaa

SEQ ID NO: 625014 - DNA, 25 bp, Rattus norvegicus
tgctctccctgatgaccttgtggaa

SEQ ID NO: 625015 - DNA, 25 bp, Rattus norvegicus
tgctctccggagcaagacatctaga

SEQ ID NO: 625016 - DNA, 25 bp, Rattus norvegicus
tgctctccggaggaagacatctaga

SEQ ID NO: 625017 - DNA, 25 bp, Rattus norvegicus
tgctctccgtcaacatcgtgctgga

SEQ ID NO: 625018 - DNA, 25 bp, Rattus norvegicus
tgctctccgtcatcatcgtgctgga

SEQ ID NO: 625019 - DNA, 25 bp, Rattus norvegicus
tgctctccgtgaatactctcaaaga

SEQ ID NO: 625020 - DNA, 25 bp, Rattus norvegicus
tgctctccgtgattactctcaaaga

SEQ ID NO: 625021 - DNA, 25 bp, Rattus norvegicus
tgctctccgtgtctctgtctttgtt

SEQ ID NO: 625022 - DNA, 25 bp, Rattus norvegicus
tgctctccgtgtgtctgtctttgtt

SEQ ID NO: 625023 - DNA, 25 bp, Rattus norvegicus
tgctctcctatgctgcagattcgaa

SEQ ID NO: 625024 - DNA, 25 bp, Rattus norvegicus
tgctctcctatggtgcagattcgaa

SEQ ID NO: 625025 - DNA, 25 bp, Rattus norvegicus
tgctctcctctcagaatataatgtg

SEQ ID NO: 625026 - DNA, 25 bp, Rattus norvegicus
tgctctcctctcctagtggtcagca

SEQ ID NO: 625027 - DNA, 25 bp, Rattus norvegicus
tgctctcctctcgtagtggtcagca

SEQ ID NO: 625028 - DNA, 25 bp, Rattus norvegicus
tgctctcctctctgaatataatgtg

SEQ ID NO: 625029 - DNA, 25 bp, Rattus norvegicus
tgctctcctctgatggacgggcagc

SEQ ID NO: 625030 - DNA, 25 bp, Rattus norvegicus
tgctctcctctgttggacgggcagc

SEQ ID NO: 625031 - DNA, 25 bp, Rattus norvegicus
tgctctcctgagctcttttagacat

SEQ ID NO: 625032 - DNA, 25 bp, Rattus norvegicus
tgctctcctgaggtcttttagacat

SEQ ID NO: 625033 - DNA, 25 bp, Rattus norvegicus
tgctctcctggaatgtgtgaggccc

SEQ ID NO: 625034 - DNA, 25 bp, Rattus norvegicus
tgctctcctggattgtgtgaggccc

SEQ ID NO: 625035 - DNA, 25 bp, Rattus norvegicus
tgctctccttcaaagtacaatccag

SEQ ID NO: 625036 - DNA, 25 bp, Rattus norvegicus
tgctctccttcatagtacaatccag

SEQ ID NO: 625037 - DNA, 25 bp, Rattus norvegicus
tgctctccttgcaagcgaactatgt

SEQ ID NO: 625038 - DNA, 25 bp, Rattus norvegicus
tgctctccttgcactctgatttaaa

SEQ ID NO: 625039 - DNA, 25 bp, Rattus norvegicus
tgctctccttgctagcgaactatgt

SEQ ID NO: 625040 - DNA, 25 bp, Rattus norvegicus
tgctctccttgctctctgatttaaa

SEQ ID NO: 625041 - DNA, 25 bp, Rattus norvegicus
tgctctcgcagacgagctgggctta

SEQ ID NO: 625042 - DNA, 25 bp, Rattus norvegicus
tgctctcgcagaggagctgggctta

SEQ ID NO: 625043 - DNA, 25 bp, Rattus norvegicus
tgctctcggattcgcacttgtgtct

SEQ ID NO: 625044 - DNA, 25 bp, Rattus norvegicus
tgctctcggattggcacttgtgtct

SEQ ID NO: 625045 - DNA, 25 bp, Rattus norvegicus
tgctctcgggccaggtgcgctagac

SEQ ID NO: 625046 - DNA, 25 bp, Rattus norvegicus
tgctctcgggcctggtgcgctagac

SEQ ID NO: 625047 - DNA, 25 bp, Rattus norvegicus
tgctctcggtgactatcagctttag

SEQ ID NO: 625048 - DNA, 25 bp, Rattus norvegicus
tgctctcggtgagtatcagctttag

SEQ ID NO: 625049 - DNA, 25 bp, Rattus norvegicus
tgctctcgtcgaacgcaggcaaggg

SEQ ID NO: 625050 - DNA, 25 bp, Rattus norvegicus
tgctctcgtcgatcgcaggcaaggg

SEQ ID NO: 625051 - DNA, 25 bp, Rattus norvegicus
tgctctcgtctactgcatgagacag

SEQ ID NO: 625052 - DNA, 25 bp, Rattus norvegicus
tgctctcgtctagtgcatgagacag

SEQ ID NO: 625053 - DNA, 25 bp, Rattus norvegicus
tgctctcgttgacgccgaagtggcc

SEQ ID NO: 625054 - DNA, 25 bp, Rattus norvegicus
tgctctcgttgaggccgaagtggcc

SEQ ID NO: 625055 - DNA, 25 bp, Rattus norvegicus
tgctctcgttgccttgggacctatc

SEQ ID NO: 625056 - DNA, 25 bp, Rattus norvegicus
tgctctcgttgcgttgggacctatc

SEQ ID NO: 625057 - DNA, 25 bp, Rattus norvegicus
tgctctctaattcgccctgtacagt

SEQ ID NO: 625058 - DNA, 25 bp, Rattus norvegicus
tgctctctaattggccctgtacagt

SEQ ID NO: 625059 - DNA, 25 bp, Rattus norvegicus
tgctctctacggagtgtgctcggct

SEQ ID NO: 625060 - DNA, 25 bp, Rattus norvegicus
tgctctctacggtgtgtgctcggct

SEQ ID NO: 625061 - DNA, 25 bp, Rattus norvegicus
tgctctctagtgagtgctgactgga

SEQ ID NO: 625062 - DNA, 25 bp, Rattus norvegicus
tgctctctagtgtgtgctgactgga

SEQ ID NO: 625063 - DNA, 25 bp, Rattus norvegicus
tgctctctcattacaggccatcctg

SEQ ID NO: 625064 - DNA, 25 bp, Rattus norvegicus
tgctctctcatttcaggccatcctg

SEQ ID NO: 625065 - DNA, 25 bp, Rattus norvegicus
tgctctctccttcggcttaattgga

SEQ ID NO: 625066 - DNA, 25 bp, Rattus norvegicus
tgctctctccttgggcttaattgga

SEQ ID NO: 625067 - DNA, 25 bp, Rattus norvegicus
tgctctctcgggacaagttgctatc

SEQ ID NO: 625068 - DNA, 25 bp, Rattus norvegicus
tgctctctcgggtcaagttgctatc

SEQ ID NO: 625069 - DNA, 25 bp, Rattus norvegicus
tgctctctctagaccagatgaactg

SEQ ID NO: 625070 - DNA, 25 bp, Rattus norvegicus
tgctctctctagtccagatgaactg

SEQ ID NO: 625071 - DNA, 25 bp, Rattus norvegicus
tgctctctctatattgccttatgga

SEQ ID NO: 625072 - DNA, 25 bp, Rattus norvegicus
tgctctctctattttgccttatgga

SEQ ID NO: 625073 - DNA, 25 bp, Rattus norvegicus
tgctctctctttcttcggcatagaa

SEQ ID NO: 625074 - DNA, 25 bp, Rattus norvegicus
tgctctctctttgttcggcatagaa

SEQ ID NO: 625075 - DNA, 25 bp, Rattus norvegicus
tgctctctgaaaactcggactcctc

SEQ ID NO: 625076 - DNA, 25 bp, Rattus norvegicus
tgctctctgaaatctcggactcctc

SEQ ID NO: 625077 - DNA, 25 bp, Rattus norvegicus
tgctctctgacacggtcccttttta

SEQ ID NO: 625078 - DNA, 25 bp, Rattus norvegicus
tgctctctgacagggtcccttttta

SEQ ID NO: 625079 - DNA, 25 bp, Rattus norvegicus
tgctctctgagtaggaggtcggtct

SEQ ID NO: 625080 - DNA, 25 bp, Rattus norvegicus
tgctctctgagttggaggtcggtct

SEQ ID NO: 625081 - DNA, 25 bp, Rattus norvegicus
tgctctctgattatgtaaactccat

SEQ ID NO: 625082 - DNA, 25 bp, Rattus norvegicus
tgctctctgattttgtaaactccat

SEQ ID NO: 625083 - DNA, 25 bp, Rattus norvegicus
tgctctctgcaacttgatttccacc

SEQ ID NO: 625084 - DNA, 25 bp, Rattus norvegicus
tgctctctgcaagttgatttccacc

SEQ ID NO: 625085 - DNA, 25 bp, Rattus norvegicus
tgctctctgccaactggttcatatc

SEQ ID NO: 625086 - DNA, 25 bp, Rattus norvegicus
tgctctctgccatctggttcatatc

SEQ ID NO: 625087 - DNA, 25 bp, Rattus norvegicus
tgctctctgcgtagtctgggaaact

SEQ ID NO: 625088 - DNA, 25 bp, Rattus norvegicus
tgctctctgcgttgtctgggaaact

SEQ ID NO: 625089 - DNA, 25 bp, Rattus norvegicus
tgctctctgtccatagttgtgagtt

SEQ ID NO: 625090 - DNA, 25 bp, Rattus norvegicus
tgctctctgtccttagttgtgagtt

SEQ ID NO: 625091 - DNA, 25 bp, Rattus norvegicus
tgctctctgtctctgcatttgcaaa

SEQ ID NO: 625092 - DNA, 25 bp, Rattus norvegicus
tgctctctgtctgtgcatttgcaaa

SEQ ID NO: 625093 - DNA, 25 bp, Rattus norvegicus
tgctctctgttcatgtatactcaat

SEQ ID NO: 625094 - DNA, 25 bp, Rattus norvegicus
tgctctctgttcttgtatactcaat

SEQ ID NO: 625095 - DNA, 25 bp, Rattus norvegicus
tgctctcttcacaaacttctacatt

SEQ ID NO: 625096 - DNA, 25 bp, Rattus norvegicus
tgctctcttcacatttctaacattg

SEQ ID NO: 625097 - DNA, 25 bp, Rattus norvegicus
tgctctcttcactaacttctacatt

SEQ ID NO: 625098 - DNA, 25 bp, Rattus norvegicus
tgctctcttcacttttctaacattg

SEQ ID NO: 625099 - DNA, 25 bp, Rattus norvegicus
tgctctcttcagacaagttggtgtc

SEQ ID NO: 625100 - DNA, 25 bp, Rattus norvegicus
tgctctcttcagtcaagttggtgtc

SEQ ID NO: 625101 - DNA, 25 bp, Rattus norvegicus
tgctctcttctgacagctttcaaaa

SEQ ID NO: 625102 - DNA, 25 bp, Rattus norvegicus
tgctctcttctgtcagctttcaaaa

SEQ ID NO: 625103 - DNA, 25 bp, Rattus norvegicus
tgctctcttgccatctagaaacaga

SEQ ID NO: 625104 - DNA, 25 bp, Rattus norvegicus
tgctctcttgccttctagaaacaga

SEQ ID NO: 625105 - DNA, 25 bp, Rattus norvegicus
tgctctctttctacccagcgaagta

SEQ ID NO: 625106 - DNA, 25 bp, Rattus norvegicus
tgctctctttcttcccagcgaagta

SEQ ID NO: 625107 - DNA, 25 bp, Rattus norvegicus
tgctctctttgtctgttactgttaa

SEQ ID NO: 625108 - DNA, 25 bp, Rattus norvegicus
tgctctctttgtgtgttactgttaa

SEQ ID NO: 625109 - DNA, 25 bp, Rattus norvegicus
tgctctgacacgcatatggtcctca

SEQ ID NO: 625110 - DNA, 25 bp, Rattus norvegicus
tgctctgacacggatatggtcctca

SEQ ID NO: 625111 - DNA, 25 bp, Rattus norvegicus
tgctctgaccatacgactcattgta

SEQ ID NO: 625112 - DNA, 25 bp, Rattus norvegicus
tgctctgaccattcgactcattgta

SEQ ID NO: 625113 - DNA, 25 bp, Rattus norvegicus
tgctctgacctcaatctagtgctta

SEQ ID NO: 625114 - DNA, 25 bp, Rattus norvegicus
tgctctgacctctatctagtgctta

SEQ ID NO: 625115 - DNA, 25 bp, Rattus norvegicus
tgctctgactcgcactgtgcactgt

SEQ ID NO: 625116 - DNA, 25 bp, Rattus norvegicus
tgctctgactcggactgtgcactgt

SEQ ID NO: 625117 - DNA, 25 bp, Rattus norvegicus
tgctctgactctagtctggacacaa

SEQ ID NO: 625118 - DNA, 25 bp, Rattus norvegicus
tgctctgactcttgtctggacacaa

SEQ ID NO: 625119 - DNA, 25 bp, Rattus norvegicus
tgctctgagaaaagctgtgcccact

SEQ ID NO: 625120 - DNA, 25 bp, Rattus norvegicus
tgctctgagaaatgctgtgcccact

SEQ ID NO: 625121 - DNA, 25 bp, Rattus norvegicus
tgctctgagaagctgcagccaattc

SEQ ID NO: 625122 - DNA, 25 bp, Rattus norvegicus
tgctctgagaaggtgcagccaattc

SEQ ID NO: 625123 - DNA, 25 bp, Rattus norvegicus
tgctctgagcacagacttctggata

SEQ ID NO: 625124 - DNA, 25 bp, Rattus norvegicus
tgctctgagcactgacttctggata

SEQ ID NO: 625125 - DNA, 25 bp, Rattus norvegicus
tgctctgagcagaggcgggatctta

SEQ ID NO: 625126 - DNA, 25 bp, Rattus norvegicus
tgctctgagcagtggcgggatctta

SEQ ID NO: 625127 - DNA, 25 bp, Rattus norvegicus
tgctctgagctccttttgactcaaa

SEQ ID NO: 625128 - DNA, 25 bp, Rattus norvegicus
tgctctgagctcgttttgactcaaa

SEQ ID NO: 625129 - DNA, 25 bp, Rattus norvegicus
tgctctgatgcccttggtgactttc

SEQ ID NO: 625130 - DNA, 25 bp, Rattus norvegicus
tgctctgatgccgttggtgactttc

SEQ ID NO: 625131 - DNA, 25 bp, Rattus norvegicus
tgctctgcactgcttgacagcattg

SEQ ID NO: 625132 - DNA, 25 bp, Rattus norvegicus
tgctctgcactggttgacagcattg

SEQ ID NO: 625133 - DNA, 25 bp, Rattus norvegicus
tgctctgcagccagtcacgtggtta

SEQ ID NO: 625134 - DNA, 25 bp, Rattus norvegicus
tgctctgcagcctgtcacgtggtta

SEQ ID NO: 625135 - DNA, 25 bp, Rattus norvegicus
tgctctgcatccctgttaacaaaca

SEQ ID NO: 625136 - DNA, 25 bp, Rattus norvegicus
tgctctgcatccgtgttaacaaaca

SEQ ID NO: 625137 - DNA, 25 bp, Rattus norvegicus
tgctctgccactcacttgctgaatg

SEQ ID NO: 625138 - DNA, 25 bp, Rattus norvegicus
tgctctgccactgacttgctgaatg

SEQ ID NO: 625139 - DNA, 25 bp, Rattus norvegicus
tgctctgccagcagataactgttca

SEQ ID NO: 625140 - DNA, 25 bp, Rattus norvegicus
tgctctgccagctgataactgttca

SEQ ID NO: 625141 - DNA, 25 bp, Rattus norvegicus
tgctctgccagtctgctgctggtct

SEQ ID NO: 625142 - DNA, 25 bp, Rattus norvegicus
tgctctgccagtgtgctgctggtct

SEQ ID NO: 625143 - DNA, 25 bp, Rattus norvegicus
tgctctgccatcctggacacttgta

SEQ ID NO: 625144 - DNA, 25 bp, Rattus norvegicus
tgctctgccatcgtggacacttgta

SEQ ID NO: 625145 - DNA, 25 bp, Rattus norvegicus
tgctctgcccggctaggaattgcat

SEQ ID NO: 625146 - DNA, 25 bp, Rattus norvegicus
tgctctgcccgggtaggaattgcat

SEQ ID NO: 625147 - DNA, 25 bp, Rattus norvegicus
tgctctgcccgtcagcttcaagaga

SEQ ID NO: 625148 - DNA, 25 bp, Rattus norvegicus
tgctctgcccgtgagcttcaagaga

SEQ ID NO: 625149 - DNA, 25 bp, Rattus norvegicus
tgctctgccctgacatgccaggtgg

SEQ ID NO: 625150 - DNA, 25 bp, Rattus norvegicus
tgctctgccctgtcatgccaggtgg

SEQ ID NO: 625151 - DNA, 25 bp, Rattus norvegicus
tgctctgcctcacgattaagggaca

SEQ ID NO: 625152 - DNA, 25 bp, Rattus norvegicus
tgctctgcctcaggattaagggaca

SEQ ID NO: 625153 - DNA, 25 bp, Rattus norvegicus
tgctctgccttccattttgtgaata

SEQ ID NO: 625154 - DNA, 25 bp, Rattus norvegicus
tgctctgccttcgattttgtgaata

SEQ ID NO: 625155 - DNA, 25 bp, Rattus norvegicus
tgctctgccttgctgtagaaatcac

SEQ ID NO: 625156 - DNA, 25 bp, Rattus norvegicus
tgctctgccttggtgtagaaatcac

SEQ ID NO: 625157 - DNA, 25 bp, Rattus norvegicus
tgctctgcggcgaaaacactttggc

SEQ ID NO: 625158 - DNA, 25 bp, Rattus norvegicus
tgctctgcggcgtaaacactttggc

SEQ ID NO: 625159 - DNA, 25 bp, Rattus norvegicus
tgctctgcgtatacttggcctcaga

SEQ ID NO: 625160 - DNA, 25 bp, Rattus norvegicus
tgctctgcgtattcttggcctcaga

SEQ ID NO: 625161 - DNA, 25 bp, Rattus norvegicus
tgctctgctcaaattgtcctgtgtg

SEQ ID NO: 625162 - DNA, 25 bp, Rattus norvegicus
tgctctgctcaatttgtcctgtgtg

SEQ ID NO: 625163 - DNA, 25 bp, Rattus norvegicus
tgctctgctcccaaaatactttata

SEQ ID NO: 625164 - DNA, 25 bp, Rattus norvegicus
tgctctgctccctaaatactttata

SEQ ID NO: 625165 - DNA, 25 bp, Rattus norvegicus
tgctctgctcgtcgttggagacaac

SEQ ID NO: 625166 - DNA, 25 bp, Rattus norvegicus
tgctctgctcgtggttggagacaac

SEQ ID NO: 625167 - DNA, 25 bp, Rattus norvegicus
tgctctgctgaactgaaggcatctg

SEQ ID NO: 625168 - DNA, 25 bp, Rattus norvegicus
tgctctgctgaagtgaaggcatctg

SEQ ID NO: 625169 - DNA, 25 bp, Rattus norvegicus
tgctctgctgagagggcttcgagaa

SEQ ID NO: 625170 - DNA, 25 bp, Rattus norvegicus
tgctctgctgagattctgtgatact

SEQ ID NO: 625171 - DNA, 25 bp, Rattus norvegicus
tgctctgctgagtgggcttcgagaa

SEQ ID NO: 625172 - DNA, 25 bp, Rattus norvegicus
tgctctgctgagtttctgtgatact

SEQ ID NO: 625173 - DNA, 25 bp, Rattus norvegicus
tgctctgctgataacactctgtaga

SEQ ID NO: 625174 - DNA, 25 bp, Rattus norvegicus
tgctctgctgattacactctgtaga

SEQ ID NO: 625175 - DNA, 25 bp, Rattus norvegicus
tgctctgctggtaacagtgggctat

SEQ ID NO: 625176 - DNA, 25 bp, Rattus norvegicus
tgctctgctggttacagtgggctat

SEQ ID NO: 625177 - DNA, 25 bp, Rattus norvegicus
tgctctgcttaacatgctctgttga

SEQ ID NO: 625178 - DNA, 25 bp, Rattus norvegicus
tgctctgcttaagatgctctgttga

SEQ ID NO: 625179 - DNA, 25 bp, Rattus norvegicus
tgctctgcttctagctcaagttcag

SEQ ID NO: 625180 - DNA, 25 bp, Rattus norvegicus
tgctctgcttcttgctcaagttcag

SEQ ID NO: 625181 - DNA, 25 bp, Rattus norvegicus
tgctctggaaaactgcccctctggg

SEQ ID NO: 625182 - DNA, 25 bp, Rattus norvegicus
tgctctggaaaagtgcccctctggg

SEQ ID NO: 625183 - DNA, 25 bp, Rattus norvegicus
tgctctggaactctactgtaccttc

SEQ ID NO: 625184 - DNA, 25 bp, Rattus norvegicus
tgctctggaactgtactgtaccttc

SEQ ID NO: 625185 - DNA, 25 bp, Rattus norvegicus
tgctctggaataccacctttgcagg

SEQ ID NO: 625186 - DNA, 25 bp, Rattus norvegicus
tgctctggaatagcacctttgcagg

SEQ ID NO: 625187 - DNA, 25 bp, Rattus norvegicus
tgctctggaccaaattctgctgctg

SEQ ID NO: 625188 - DNA, 25 bp, Rattus norvegicus
tgctctggaccatattctgctgctg

SEQ ID NO: 625189 - DNA, 25 bp, Rattus norvegicus
tgctctggagccacagtgaaaactc

SEQ ID NO: 625190 - DNA, 25 bp, Rattus norvegicus
tgctctggagcctcagtgaaaactc

SEQ ID NO: 625191 - DNA, 25 bp, Rattus norvegicus
tgctctggagctcaagctttgccac

SEQ ID NO: 625192 - DNA, 25 bp, Rattus norvegicus
tgctctggagctgaagctttgccac

SEQ ID NO: 625193 - DNA, 25 bp, Rattus norvegicus
tgctctggccaaccaatacatgcac

SEQ ID NO: 625194 - DNA, 25 bp, Rattus norvegicus
tgctctggccaagcaatacatgcac

SEQ ID NO: 625195 - DNA, 25 bp, Rattus norvegicus
tgctctggccctcgaaggattcaag

SEQ ID NO: 625196 - DNA, 25 bp, Rattus norvegicus
tgctctggccctggaaggattcaag

SEQ ID NO: 625197 - DNA, 25 bp, Rattus norvegicus
tgctctgggactccaagacagacca

SEQ ID NO: 625198 - DNA, 25 bp, Rattus norvegicus
tgctctgggactgcaagacagacca

SEQ ID NO: 625199 - DNA, 25 bp, Rattus norvegicus
tgctctgggcatccacagtgctgaa

SEQ ID NO: 625200 - DNA, 25 bp, Rattus norvegicus
tgctctgggcatgcacagtgctgaa

SEQ ID NO: 625201 - DNA, 25 bp, Rattus norvegicus
tgctctgggccacgatcgacaggtc

SEQ ID NO: 625202 - DNA, 25 bp, Rattus norvegicus
tgctctgggccaggatcgacaggtc

SEQ ID NO: 625203 - DNA, 25 bp, Rattus norvegicus
tgctctgggcttagtttgctagaaa

SEQ ID NO: 625204 - DNA, 25 bp, Rattus norvegicus
tgctctgggctttgtttgctagaaa

SEQ ID NO: 625205 - DNA, 25 bp, Rattus norvegicus
tgctctgggtgcagggcatcgccta

SEQ ID NO: 625206 - DNA, 25 bp, Rattus norvegicus
tgctctgggtgctgggcatcgccta

SEQ ID NO: 625207 - DNA, 25 bp, Rattus norvegicus
tgctctggtaccacatgttctcatg

SEQ ID NO: 625208 - DNA, 25 bp, Rattus norvegicus
tgctctggtacctcatgttctcatg

SEQ ID NO: 625209 - DNA, 25 bp, Rattus norvegicus
tgctctggtcaactcacttgcagaa

SEQ ID NO: 625210 - DNA, 25 bp, Rattus norvegicus
tgctctggtcaagtcacttgcagaa

SEQ ID NO: 625211 - DNA, 25 bp, Rattus norvegicus
tgctctggtcttcgagcagttggca

SEQ ID NO: 625212 - DNA, 25 bp, Rattus norvegicus
tgctctggtcttggagcagttggca

SEQ ID NO: 625213 - DNA, 25 bp, Rattus norvegicus
tgctctggttgcaaatgggcgtctc

SEQ ID NO: 625214 - DNA, 25 bp, Rattus norvegicus
tgctctggttgctaatgggcgtctc

SEQ ID NO: 625215 - DNA, 25 bp, Rattus norvegicus
tgctctgtactgaatttttaccgtt

SEQ ID NO: 625216 - DNA, 25 bp, Rattus norvegicus
tgctctgtactgctctccagtacgt

SEQ ID NO: 625217 - DNA, 25 bp, Rattus norvegicus
tgctctgtactggtctccagtacgt

SEQ ID NO: 625218 - DNA, 25 bp, Rattus norvegicus
tgctctgtactgtatttttaccgtt

SEQ ID NO: 625219 - DNA, 25 bp, Rattus norvegicus
tgctctgtagagctgctcagcctga

SEQ ID NO: 625220 - DNA, 25 bp, Rattus norvegicus
tgctctgtagaggtgctcagcctga

SEQ ID NO: 625221 - DNA, 25 bp, Rattus norvegicus
tgctctgtagcacccagcatgttct

SEQ ID NO: 625222 - DNA, 25 bp, Rattus norvegicus
tgctctgtagcagccagcatgttct

SEQ ID NO: 625223 - DNA, 25 bp, Rattus norvegicus
tgctctgtagctcatgtcggtgcca

SEQ ID NO: 625224 - DNA, 25 bp, Rattus norvegicus
tgctctgtagctgatgtcggtgcca

SEQ ID NO: 625225 - DNA, 25 bp, Rattus norvegicus
tgctctgtaggaagttggttgccca

SEQ ID NO: 625226 - DNA, 25 bp, Rattus norvegicus
tgctctgtaggatgttggttgccca

SEQ ID NO: 625227 - DNA, 25 bp, Rattus norvegicus
tgctctgtatagcataccttcccct

SEQ ID NO: 625228 - DNA, 25 bp, Rattus norvegicus
tgctctgtataggataccttcccct

SEQ ID NO: 625229 - DNA, 25 bp, Rattus norvegicus
tgctctgtattcagtttccaaactg

SEQ ID NO: 625230 - DNA, 25 bp, Rattus norvegicus
tgctctgtattctgtttccaaactg

SEQ ID NO: 625231 - DNA, 25 bp, Rattus norvegicus
tgctctgtctttctgactgaaatca

SEQ ID NO: 625232 - DNA, 25 bp, Rattus norvegicus
tgctctgtctttgtgactgaaatca

SEQ ID NO: 625233 - DNA, 25 bp, Rattus norvegicus
tgctctgtgaaaagacttcgcctat

SEQ ID NO: 625234 - DNA, 25 bp, Rattus norvegicus
tgctctgtgaaatgacttcgcctat

SEQ ID NO: 625235 - DNA, 25 bp, Rattus norvegicus
tgctctgtgaccctgtgtgaacata

SEQ ID NO: 625236 - DNA, 25 bp, Rattus norvegicus
tgctctgtgaccgtgtgtgaacata

SEQ ID NO: 625237 - DNA, 25 bp, Rattus norvegicus
tgctctgtgagcaaaatacgatttc

SEQ ID NO: 625238 - DNA, 25 bp, Rattus norvegicus
tgctctgtgagcctagccagtaatg

SEQ ID NO: 625239 - DNA, 25 bp, Rattus norvegicus
tgctctgtgagcgtagccagtaatg

SEQ ID NO: 625240 - DNA, 25 bp, Rattus norvegicus
tgctctgtgagctaaatacgatttc

SEQ ID NO: 625241 - DNA, 25 bp, Rattus norvegicus
tgctctgtgcctattttctaacctg

SEQ ID NO: 625242 - DNA, 25 bp, Rattus norvegicus
tgctctgtgccttttttctaacctg

SEQ ID NO: 625243 - DNA, 25 bp, Rattus norvegicus
tgctctgtgctccattgactttaag

SEQ ID NO: 625244 - DNA, 25 bp, Rattus norvegicus
tgctctgtgctcgattgactttaag

SEQ ID NO: 625245 - DNA, 25 bp, Rattus norvegicus
tgctctgttaccatggtgcccaact

SEQ ID NO: 625246 - DNA, 25 bp, Rattus norvegicus
tgctctgttaccttggtgcccaact

SEQ ID NO: 625247 - DNA, 25 bp, Rattus norvegicus
tgctctgttcttacattatcctctg

SEQ ID NO: 625248 - DNA, 25 bp, Rattus norvegicus
tgctctgttctttcattatcctctg

SEQ ID NO: 625249 - DNA, 25 bp, Rattus norvegicus
tgctctgttgctcgaggctttcaca

SEQ ID NO: 625250 - DNA, 25 bp, Rattus norvegicus
tgctctgttgctggaggctttcaca

SEQ ID NO: 625251 - DNA, 25 bp, Rattus norvegicus
tgctctgttgtcactgttgcggaac

SEQ ID NO: 625252 - DNA, 25 bp, Rattus norvegicus
tgctctgttgtctctgttgcggaac

SEQ ID NO: 625253 - DNA, 25 bp, Rattus norvegicus
tgctctgtttccagtatgtgcccat

SEQ ID NO: 625254 - DNA, 25 bp, Rattus norvegicus
tgctctgtttcctgtatgtgcccat

SEQ ID NO: 625255 - DNA, 25 bp, Rattus norvegicus
tgctctgttttgattattgcacaac

SEQ ID NO: 625256 - DNA, 25 bp, Rattus norvegicus
tgctctgttttgtttattgcacaac

SEQ ID NO: 625257 - DNA, 25 bp, Rattus norvegicus
tgctcttaaaatatcttcctttggg

SEQ ID NO: 625258 - DNA, 25 bp, Rattus norvegicus
tgctcttaaaatttcttcctttggg

SEQ ID NO: 625259 - DNA, 25 bp, Rattus norvegicus
tgctcttaaattatcctagctgtaa

SEQ ID NO: 625260 - DNA, 25 bp, Rattus norvegicus
tgctcttaaattttcctagctgtaa

SEQ ID NO: 625261 - DNA, 25 bp, Rattus norvegicus
tgctcttaagatactgatcatcctg

SEQ ID NO: 625262 - DNA, 25 bp, Rattus norvegicus
tgctcttaagattctgatcatcctg

SEQ ID NO: 625263 - DNA, 25 bp, Rattus norvegicus
tgctcttacagacgatcggagatca

SEQ ID NO: 625264 - DNA, 25 bp, Rattus norvegicus
tgctcttacagaggatcggagatca

SEQ ID NO: 625265 - DNA, 25 bp, Rattus norvegicus
tgctcttaccctcctcaggacaagg

SEQ ID NO: 625266 - DNA, 25 bp, Rattus norvegicus
tgctcttaccctgctcaggacaagg

SEQ ID NO: 625267 - DNA, 25 bp, Rattus norvegicus
tgctcttaccttccctacggagata

SEQ ID NO: 625268 - DNA, 25 bp, Rattus norvegicus
tgctcttaccttgcctacggagata

SEQ ID NO: 625269 - DNA, 25 bp, Rattus norvegicus
tgctcttactatcctctaccactga

SEQ ID NO: 625270 - DNA, 25 bp, Rattus norvegicus
tgctcttactatgctctaccactga

SEQ ID NO: 625271 - DNA, 25 bp, Rattus norvegicus
tgctcttaggccattgtcatgtata

SEQ ID NO: 625272 - DNA, 25 bp, Rattus norvegicus
tgctcttaggcctttgtcatgtata

SEQ ID NO: 625273 - DNA, 25 bp, Rattus norvegicus
tgctcttcaccaacttggtcttctt

SEQ ID NO: 625274 - DNA, 25 bp, Rattus norvegicus
tgctcttcaccatcttggtcttctt

SEQ ID NO: 625275 - DNA, 25 bp, Rattus norvegicus
tgctcttcacctatttctcaggaat

SEQ ID NO: 625276 - DNA, 25 bp, Rattus norvegicus
tgctcttcacctttttctcaggaat

SEQ ID NO: 625277 - DNA, 25 bp, Rattus norvegicus
tgctcttcagagagcgggtgtaatt

SEQ ID NO: 625278 - DNA, 25 bp, Rattus norvegicus
tgctcttcagagtgcgggtgtaatt

SEQ ID NO: 625279 - DNA, 25 bp, Rattus norvegicus
tgctcttcaggtaatgactccctag

SEQ ID NO: 625280 - DNA, 25 bp, Rattus norvegicus
tgctcttcaggttatgactccctag

SEQ ID NO: 625281 - DNA, 25 bp, Rattus norvegicus
tgctcttcagtgacaatgggagtgg

SEQ ID NO: 625282 - DNA, 25 bp, Rattus norvegicus
tgctcttcagtgtcaatgggagtgg

SEQ ID NO: 625283 - DNA, 25 bp, Rattus norvegicus
tgctcttcagttcggtgtccagatg

SEQ ID NO: 625284 - DNA, 25 bp, Rattus norvegicus
tgctcttcagttgggtgtccagatg

SEQ ID NO: 625285 - DNA, 25 bp, Rattus norvegicus
tgctcttcatggagcatcccgagta

SEQ ID NO: 625286 - DNA, 25 bp, Rattus norvegicus
tgctcttcatggtgcatcccgagta

SEQ ID NO: 625287 - DNA, 25 bp, Rattus norvegicus
tgctcttccacactgtccagagaag

SEQ ID NO: 625288 - DNA, 25 bp, Rattus norvegicus
tgctcttccacagtgtccagagaag

SEQ ID NO: 625289 - DNA, 25 bp, Rattus norvegicus
tgctcttccagcacgtagcgtattc

SEQ ID NO: 625290 - DNA, 25 bp, Rattus norvegicus
tgctcttccagctcgtagcgtattc

SEQ ID NO: 625291 - DNA, 25 bp, Rattus norvegicus
tgctcttccaggagatctgcagtag

SEQ ID NO: 625292 - DNA, 25 bp, Rattus norvegicus
tgctcttccaggtgatctgcagtag

SEQ ID NO: 625293 - DNA, 25 bp, Rattus norvegicus
tgctcttccagtcgaggtgttccat

SEQ ID NO: 625294 - DNA, 25 bp, Rattus norvegicus
tgctcttccagtggaggtgttccat

SEQ ID NO: 625295 - DNA, 25 bp, Rattus norvegicus
tgctcttcccgacgacaggctgtca

SEQ ID NO: 625296 - DNA, 25 bp, Rattus norvegicus
tgctcttcccgaggacaggctgtca

SEQ ID NO: 625297 - DNA, 25 bp, Rattus norvegicus
tgctcttccctcagatcaggaaatt

SEQ ID NO: 625298 - DNA, 25 bp, Rattus norvegicus
tgctcttccctctgatcaggaaatt

SEQ ID NO: 625299 - DNA, 25 bp, Rattus norvegicus
tgctcttccctgctttgttaataac

SEQ ID NO: 625300 - DNA, 25 bp, Rattus norvegicus
tgctcttccctggtttgttaataac

SEQ ID NO: 625301 - DNA, 25 bp, Rattus norvegicus
tgctcttcctatatcaaccatcaga

SEQ ID NO: 625302 - DNA, 25 bp, Rattus norvegicus
tgctcttcctatttcaaccatcaga

SEQ ID NO: 625303 - DNA, 25 bp, Rattus norvegicus
tgctcttcctcaagacctttctcaa

SEQ ID NO: 625304 - DNA, 25 bp, Rattus norvegicus
tgctcttcctcaatttcacatcagt

SEQ ID NO: 625305 - DNA, 25 bp, Rattus norvegicus
tgctcttcctcatgacctttctcaa

SEQ ID NO: 625306 - DNA, 25 bp, Rattus norvegicus
tgctcttcctcattttcacatcagt

SEQ ID NO: 625307 - DNA, 25 bp, Rattus norvegicus
tgctcttcctcgactggtatgacag

SEQ ID NO: 625308 - DNA, 25 bp, Rattus norvegicus
tgctcttcctcgtctggtatgacag

SEQ ID NO: 625309 - DNA, 25 bp, Rattus norvegicus
tgctcttcctggagatgggccagca

SEQ ID NO: 625310 - DNA, 25 bp, Rattus norvegicus
tgctcttcctggtgatgggccagca

SEQ ID NO: 625311 - DNA, 25 bp, Rattus norvegicus
tgctcttctcatcacagtctttctg

SEQ ID NO: 625312 - DNA, 25 bp, Rattus norvegicus
tgctcttctcatgacagtctttctg

SEQ ID NO: 625313 - DNA, 25 bp, Rattus norvegicus
tgctcttctcgaaccacaggtgttg

SEQ ID NO: 625314 - DNA, 25 bp, Rattus norvegicus
tgctcttctcgatccacaggtgttg

SEQ ID NO: 625315 - DNA, 25 bp, Rattus norvegicus
tgctcttctctgaagccagcaaact

SEQ ID NO: 625316 - DNA, 25 bp, Rattus norvegicus
tgctcttctctgagccaagttaaac

SEQ ID NO: 625317 - DNA, 25 bp, Rattus norvegicus
tgctcttctctgtagccagcaaact

SEQ ID NO: 625318 - DNA, 25 bp, Rattus norvegicus
tgctcttctctgtgccaagttaaac

SEQ ID NO: 625319 - DNA, 25 bp, Rattus norvegicus
tgctcttctgaacttgtcctgctca

SEQ ID NO: 625320 - DNA, 25 bp, Rattus norvegicus
tgctcttctgaagttgtcctgctca

SEQ ID NO: 625321 - DNA, 25 bp, Rattus norvegicus
tgctcttctgacactgcctattgca

SEQ ID NO: 625322 - DNA, 25 bp, Rattus norvegicus
tgctcttctgactctgcctattgca

SEQ ID NO: 625323 - DNA, 25 bp, Rattus norvegicus
tgctcttctggcatctcactctggg

SEQ ID NO: 625324 - DNA, 25 bp, Rattus norvegicus
tgctcttctggcttctcactctggg

SEQ ID NO: 625325 - DNA, 25 bp, Rattus norvegicus
tgctcttctggtccagagtctgcaa

SEQ ID NO: 625326 - DNA, 25 bp, Rattus norvegicus
tgctcttctggtgcagagtctgcaa

SEQ ID NO: 625327 - DNA, 25 bp, Rattus norvegicus
tgctcttctgtaccaaacctttgtg

SEQ ID NO: 625328 - DNA, 25 bp, Rattus norvegicus
tgctcttctgtagcaaacctttgtg

SEQ ID NO: 625329 - DNA, 25 bp, Rattus norvegicus
tgctcttcttaactccttgactgga

SEQ ID NO: 625330 - DNA, 25 bp, Rattus norvegicus
tgctcttcttaagtccttgactgga

SEQ ID NO: 625331 - DNA, 25 bp, Rattus norvegicus
tgctcttcttacacggcgctgtaca

SEQ ID NO: 625332 - DNA, 25 bp, Rattus norvegicus
tgctcttcttactcggcgctgtaca

SEQ ID NO: 625333 - DNA, 25 bp, Rattus norvegicus
tgctcttctttgacaatcctggaga

SEQ ID NO: 625334 - DNA, 25 bp, Rattus norvegicus
tgctcttctttgtcaatcctggaga

SEQ ID NO: 625335 - DNA, 25 bp, Rattus norvegicus
tgctcttgaagacgaattcatatga

SEQ ID NO: 625336 - DNA, 25 bp, Rattus norvegicus
tgctcttgaagaggaattcatatga

SEQ ID NO: 625337 - DNA, 25 bp, Rattus norvegicus
tgctcttgactcacatccgtagata

SEQ ID NO: 625338 - DNA, 25 bp, Rattus norvegicus
tgctcttgactctcatccgtagata

SEQ ID NO: 625339 - DNA, 25 bp, Rattus norvegicus
tgctcttgaggaaagggccagtatt

SEQ ID NO: 625340 - DNA, 25 bp, Rattus norvegicus
tgctcttgaggatagggccagtatt

SEQ ID NO: 625341 - DNA, 25 bp, Rattus norvegicus
tgctcttggttcagggtttgtgtca

SEQ ID NO: 625342 - DNA, 25 bp, Rattus norvegicus
tgctcttggttctgggtttgtgtca

SEQ ID NO: 625343 - DNA, 25 bp, Rattus norvegicus
tgctcttgtattactgtgttcctgg

SEQ ID NO: 625344 - DNA, 25 bp, Rattus norvegicus
tgctcttgtatttctgtgttcctgg

SEQ ID NO: 625345 - DNA, 25 bp, Rattus norvegicus
tgctcttgtggccattacatttccc

SEQ ID NO: 625346 - DNA, 25 bp, Rattus norvegicus
tgctcttgtggcgattacatttccc

SEQ ID NO: 625347 - DNA, 25 bp, Rattus norvegicus
tgctctttaaaaacatcctgaccaa

SEQ ID NO: 625348 - DNA, 25 bp, Rattus norvegicus
tgctctttaaaatcatcctgaccaa

SEQ ID NO: 625349 - DNA, 25 bp, Rattus norvegicus
tgctctttaccaaggtgctgtctga

SEQ ID NO: 625350 - DNA, 25 bp, Rattus norvegicus
tgctctttaccatggtgctgtctga

SEQ ID NO: 625351 - DNA, 25 bp, Rattus norvegicus
tgctctttacccaggactctgaagg

SEQ ID NO: 625352 - DNA, 25 bp, Rattus norvegicus
tgctctttaccctggactctgaagg

SEQ ID NO: 625353 - DNA, 25 bp, Rattus norvegicus
tgctctttatccaggtcttttttag

SEQ ID NO: 625354 - DNA, 25 bp, Rattus norvegicus
tgctctttatcctggtcttttttag

SEQ ID NO: 625355 - DNA, 25 bp, Rattus norvegicus
tgctctttatttaggccccacaatt

SEQ ID NO: 625356 - DNA, 25 bp, Rattus norvegicus
tgctctttattttggccccacaatt

SEQ ID NO: 625357 - DNA, 25 bp, Rattus norvegicus
tgctctttccccatgaactatctaa

SEQ ID NO: 625358 - DNA, 25 bp, Rattus norvegicus
tgctctttccccttgaactatctaa

SEQ ID NO: 625359 - DNA, 25 bp, Rattus norvegicus
tgctctttccttactgaagctaagc

SEQ ID NO: 625360 - DNA, 25 bp, Rattus norvegicus
tgctctttcctttctgaagctaagc

SEQ ID NO: 625361 - DNA, 25 bp, Rattus norvegicus
tgctctttctcacttatctacttga

SEQ ID NO: 625362 - DNA, 25 bp, Rattus norvegicus
tgctctttctcagttatctacttga

SEQ ID NO: 625363 - DNA, 25 bp, Rattus norvegicus
tgctctttctctactcaaaggaaac

SEQ ID NO: 625364 - DNA, 25 bp, Rattus norvegicus
tgctctttctcttctcaaaggaaac

SEQ ID NO: 625365 - DNA, 25 bp, Rattus norvegicus
tgctctttcttcacggtgggtgtgg

SEQ ID NO: 625366 - DNA, 25 bp, Rattus norvegicus
tgctctttcttctcggtgggtgtgg

SEQ ID NO: 625367 - DNA, 25 bp, Rattus norvegicus
tgctctttgattctgctctgtgcaa

SEQ ID NO: 625368 - DNA, 25 bp, Rattus norvegicus
tgctctttgattgtgctctgtgcaa

SEQ ID NO: 625369 - DNA, 25 bp, Rattus norvegicus
tgctctttgcctactaaaaagccat

SEQ ID NO: 625370 - DNA, 25 bp, Rattus norvegicus
tgctctttgccttctaaaaagccat

SEQ ID NO: 625371 - DNA, 25 bp, Rattus norvegicus
tgctctttgtctccgttcaggaaga

SEQ ID NO: 625372 - DNA, 25 bp, Rattus norvegicus
tgctctttgtctgcgttcaggaaga

SEQ ID NO: 625373 - DNA, 25 bp, Rattus norvegicus
tgctctttgttgaccattgtctgtt

SEQ ID NO: 625374 - DNA, 25 bp, Rattus norvegicus
tgctctttgttgtccattgtctgtt

SEQ ID NO: 625375 - DNA, 25 bp, Rattus norvegicus
tgctcttttcccacaaatgttttct

SEQ ID NO: 625376 - DNA, 25 bp, Rattus norvegicus
tgctcttttccctcaaatgttttct

SEQ ID NO: 625377 - DNA, 25 bp, Rattus norvegicus
tgctctttttgtactgtgttgctct

SEQ ID NO: 625378 - DNA, 25 bp, Rattus norvegicus
tgctctttttgttctgtgttgctct

SEQ ID NO: 625379 - DNA, 25 bp, Rattus norvegicus
tgctgaaaaggcaactgatgatggc

SEQ ID NO: 625380 - DNA, 25 bp, Rattus norvegicus
tgctgaaaaggctactgatgatggc

SEQ ID NO: 625381 - DNA, 25 bp, Rattus norvegicus
tgctgaaagggtcggcccgcaccac

SEQ ID NO: 625382 - DNA, 25 bp, Rattus norvegicus
tgctgaaagggtgggcccgcaccac

SEQ ID NO: 625383 - DNA, 25 bp, Rattus norvegicus
tgctgaaatgtcaaccaagagaatt

SEQ ID NO: 625384 - DNA, 25 bp, Rattus norvegicus
tgctgaaatgtctaccaagagaatt

SEQ ID NO: 625385 - DNA, 25 bp, Rattus norvegicus
tgctgaacacccaaattatccatat

SEQ ID NO: 625386 - DNA, 25 bp, Rattus norvegicus
tgctgaacaccctaattatccatat

SEQ ID NO: 625387 - DNA, 25 bp, Rattus norvegicus
tgctgaaccagcaatcccaactaaa

SEQ ID NO: 625388 - DNA, 25 bp, Rattus norvegicus
tgctgaaccagctatcccaactaaa

SEQ ID NO: 625389 - DNA, 25 bp, Rattus norvegicus
tgctgaaccttgatggcatcaaaat

SEQ ID NO: 625390 - DNA, 25 bp, Rattus norvegicus
tgctgaaccttgttggcatcaaaat

SEQ ID NO: 625391 - DNA, 25 bp, Rattus norvegicus
tgctgaacgtcaaggcccacctgga

SEQ ID NO: 625392 - DNA, 25 bp, Rattus norvegicus
tgctgaacgtcatggcccacctgga

SEQ ID NO: 625393 - DNA, 25 bp, Rattus norvegicus
tgctgaactaatactgcctctggaa

SEQ ID NO: 625394 - DNA, 25 bp, Rattus norvegicus
tgctgaactaattctgcctctggaa

SEQ ID NO: 625395 - DNA, 25 bp, Rattus norvegicus
tgctgaagaatcagctccagctctc

SEQ ID NO: 625396 - DNA, 25 bp, Rattus norvegicus
tgctgaagaatctgctccagctctc

SEQ ID NO: 625397 - DNA, 25 bp, Rattus norvegicus
tgctgaagatcaagaactacctgga

SEQ ID NO: 625398 - DNA, 25 bp, Rattus norvegicus
tgctgaagatcatgaactacctgga

SEQ ID NO: 625399 - DNA, 25 bp, Rattus norvegicus
tgctgaagcacgaacctgaaatccc

SEQ ID NO: 625400 - DNA, 25 bp, Rattus norvegicus
tgctgaagcacgtacctgaaatccc

SEQ ID NO: 625401 - DNA, 25 bp, Rattus norvegicus
tgctgaagccctacggaagtgtgat

SEQ ID NO: 625402 - DNA, 25 bp, Rattus norvegicus
tgctgaagcccttcggaagtgtgat

SEQ ID NO: 625403 - DNA, 25 bp, Rattus norvegicus
tgctgaagctccagatggctccaga

SEQ ID NO: 625404 - DNA, 25 bp, Rattus norvegicus
tgctgaagctcctgatggctccaga

SEQ ID NO: 625405 - DNA, 25 bp, Rattus norvegicus
tgctgaagctttacgtatttgcttt

SEQ ID NO: 625406 - DNA, 25 bp, Rattus norvegicus
tgctgaagcttttcgtatttgcttt

SEQ ID NO: 625407 - DNA, 25 bp, Rattus norvegicus
tgctgaaggagcacaccaagaggaa

SEQ ID NO: 625408 - DNA, 25 bp, Rattus norvegicus
tgctgaaggagctcaccaagaggaa

SEQ ID NO: 625409 - DNA, 25 bp, Rattus norvegicus
tgctgaaggtcaaggatcggtactc

SEQ ID NO: 625410 - DNA, 25 bp, Rattus norvegicus
tgctgaaggtcatggatcggtactc

SEQ ID NO: 625411 - DNA, 25 bp, Rattus norvegicus
tgctgaagttcactttagtcctgct

SEQ ID NO: 625412 - DNA, 25 bp, Rattus norvegicus
tgctgaagttcagtttagtcctgct

SEQ ID NO: 625413 - DNA, 25 bp, Rattus norvegicus
tgctgaatccccacaggctatgcgg

SEQ ID NO: 625414 - DNA, 25 bp, Rattus norvegicus
tgctgaatcccctcaggctatgcgg

SEQ ID NO: 625415 - DNA, 25 bp, Rattus norvegicus
tgctgaatctttctggccaccagga

SEQ ID NO: 625416 - DNA, 25 bp, Rattus norvegicus
tgctgaatctttgtggccaccagga

SEQ ID NO: 625417 - DNA, 25 bp, Rattus norvegicus
tgctgaatgtatcctgaggctccta

SEQ ID NO: 625418 - DNA, 25 bp, Rattus norvegicus
tgctgaatgtatgctgaggctccta

SEQ ID NO: 625419 - DNA, 25 bp, Rattus norvegicus
tgctgacaacagcatagcctgtcct

SEQ ID NO: 625420 - DNA, 25 bp, Rattus norvegicus
tgctgacaacaggatagcctgtcct

SEQ ID NO: 625421 - DNA, 25 bp, Rattus norvegicus
tgctgacacacaattccctggatta

SEQ ID NO: 625422 - DNA, 25 bp, Rattus norvegicus
tgctgacacacatttccctggatta

SEQ ID NO: 625423 - DNA, 25 bp, Rattus norvegicus
tgctgacaccgtaggtctctacagt

SEQ ID NO: 625424 - DNA, 25 bp, Rattus norvegicus
tgctgacaccgttggtctctacagt

SEQ ID NO: 625425 - DNA, 25 bp, Rattus norvegicus
tgctgacactctcccataacaatga

SEQ ID NO: 625426 - DNA, 25 bp, Rattus norvegicus
tgctgacactctgccataacaatga

SEQ ID NO: 625427 - DNA, 25 bp, Rattus norvegicus
tgctgacactgacgtgctgacgccg

SEQ ID NO: 625428 - DNA, 25 bp, Rattus norvegicus
tgctgacactgaggtgctgacgccg

SEQ ID NO: 625429 - DNA, 25 bp, Rattus norvegicus
tgctgacagagcatgaccctttcaa

SEQ ID NO: 625430 - DNA, 25 bp, Rattus norvegicus
tgctgacagagcttgaccctttcaa

SEQ ID NO: 625431 - DNA, 25 bp, Rattus norvegicus
tgctgacagattccttactgcagga

SEQ ID NO: 625432 - DNA, 25 bp, Rattus norvegicus
tgctgacagattgcttactgcagga

SEQ ID NO: 625433 - DNA, 25 bp, Rattus norvegicus
tgctgacagggcatagctacatgaa

SEQ ID NO: 625434 - DNA, 25 bp, Rattus norvegicus
tgctgacagggcttagctacatgaa

SEQ ID NO: 625435 - DNA, 25 bp, Rattus norvegicus
tgctgacagggtccatcttccagga

SEQ ID NO: 625436 - DNA, 25 bp, Rattus norvegicus
tgctgacagggtgcatcttccagga

SEQ ID NO: 625437 - DNA, 25 bp, Rattus norvegicus
tgctgacagtgcagactcctctgtg

SEQ ID NO: 625438 - DNA, 25 bp, Rattus norvegicus
tgctgacagtgctgactcctctgtg

SEQ ID NO: 625439 - DNA, 25 bp, Rattus norvegicus
tgctgacatcagctgttgtgactcc

SEQ ID NO: 625440 - DNA, 25 bp, Rattus norvegicus
tgctgacatcaggtgttgtgactcc

SEQ ID NO: 625441 - DNA, 25 bp, Rattus norvegicus
tgctgacatggacgcagttgatgct

SEQ ID NO: 625442 - DNA, 25 bp, Rattus norvegicus
tgctgacatggaggcagttgatgct

SEQ ID NO: 625443 - DNA, 25 bp, Rattus norvegicus
tgctgaccactgaggtcctcacaat

SEQ ID NO: 625444 - DNA, 25 bp, Rattus norvegicus
tgctgaccactgtggtcctcacaat

SEQ ID NO: 625445 - DNA, 25 bp, Rattus norvegicus
tgctgaccagctatatgaggacttc

SEQ ID NO: 625446 - DNA, 25 bp, Rattus norvegicus
tgctgaccagctttatgaggacttc

SEQ ID NO: 625447 - DNA, 25 bp, Rattus norvegicus
tgctgaccaggcctgcagatgcaag

SEQ ID NO: 625448 - DNA, 25 bp, Rattus norvegicus
tgctgaccaggcgtgcagatgcaag

SEQ ID NO: 625449 - DNA, 25 bp, Rattus norvegicus
tgctgaccctgacgttgataaaaag

SEQ ID NO: 625450 - DNA, 25 bp, Rattus norvegicus
tgctgaccctgaggttgataaaaag

SEQ ID NO: 625451 - DNA, 25 bp, Rattus norvegicus
tgctgaccgcacacgacgcagtcgg

SEQ ID NO: 625452 - DNA, 25 bp, Rattus norvegicus
tgctgaccgcactcgacgcagtcgg

SEQ ID NO: 625453 - DNA, 25 bp, Rattus norvegicus
tgctgacctactcaccagaaatgca

SEQ ID NO: 625454 - DNA, 25 bp, Rattus norvegicus
tgctgacctactgaccagaaatgca

SEQ ID NO: 625455 - DNA, 25 bp, Rattus norvegicus
tgctgacctcaacaatcactgtatt

SEQ ID NO: 625456 - DNA, 25 bp, Rattus norvegicus
tgctgacctcaagaatcactgtatt

SEQ ID NO: 625457 - DNA, 25 bp, Rattus norvegicus
tgctgacctcagaggagctagctct

SEQ ID NO: 625458 - DNA, 25 bp, Rattus norvegicus
tgctgacctcagtggagctagctct

SEQ ID NO: 625459 - DNA, 25 bp, Rattus norvegicus
tgctgacctctcactagagtgttgg

SEQ ID NO: 625460 - DNA, 25 bp, Rattus norvegicus
tgctgacctctctctagagtgttgg

SEQ ID NO: 625461 - DNA, 25 bp, Rattus norvegicus
tgctgacctgtgagtaaaaatgtta

SEQ ID NO: 625462 - DNA, 25 bp, Rattus norvegicus
tgctgacctgtgtgtaaaaatgtta

SEQ ID NO: 625463 - DNA, 25 bp, Rattus norvegicus
tgctgacctttcaggccatggagtg

SEQ ID NO: 625464 - DNA, 25 bp, Rattus norvegicus
tgctgacctttctggccatggagtg

SEQ ID NO: 625465 - DNA, 25 bp, Rattus norvegicus
tgctgacgacatcccatgccatgat

SEQ ID NO: 625466 - DNA, 25 bp, Rattus norvegicus
tgctgacgacatgccatgccatgat

SEQ ID NO: 625467 - DNA, 25 bp, Rattus norvegicus
tgctgacgatccactcacagatgag

SEQ ID NO: 625468 - DNA, 25 bp, Rattus norvegicus
tgctgacgatcctctcacagatgag

SEQ ID NO: 625469 - DNA, 25 bp, Rattus norvegicus
tgctgacgcaggctccaatgtggac

SEQ ID NO: 625470 - DNA, 25 bp, Rattus norvegicus
tgctgacgcagggtccaatgtggac

SEQ ID NO: 625471 - DNA, 25 bp, Rattus norvegicus
tgctgacgcgtcacgagacttagtt

SEQ ID NO: 625472 - DNA, 25 bp, Rattus norvegicus
tgctgacgcgtctcgagacttagtt

SEQ ID NO: 625473 - DNA, 25 bp, Rattus norvegicus
tgctgacgtccactgtacagtgaac

SEQ ID NO: 625474 - DNA, 25 bp, Rattus norvegicus
tgctgacgtccagtgtacagtgaac

SEQ ID NO: 625475 - DNA, 25 bp, Rattus norvegicus
tgctgacgtctgcacactgggaaca

SEQ ID NO: 625476 - DNA, 25 bp, Rattus norvegicus
tgctgacgtctggacactgggaaca

SEQ ID NO: 625477 - DNA, 25 bp, Rattus norvegicus
tgctgacgtgctactttgtcttaaa

SEQ ID NO: 625478 - DNA, 25 bp, Rattus norvegicus
tgctgacgtgcttctttgtcttaaa

SEQ ID NO: 625479 - DNA, 25 bp, Rattus norvegicus
tgctgactaactattcttggctcgg

SEQ ID NO: 625480 - DNA, 25 bp, Rattus norvegicus
tgctgactaacttttcttggctcgg

SEQ ID NO: 625481 - DNA, 25 bp, Rattus norvegicus
tgctgactcagaagaaacacaacat

SEQ ID NO: 625482 - DNA, 25 bp, Rattus norvegicus
tgctgactcagatgaaacacaacat

SEQ ID NO: 625483 - DNA, 25 bp, Rattus norvegicus
tgctgactctggctgggtatcatgt

SEQ ID NO: 625484 - DNA, 25 bp, Rattus norvegicus
tgctgactctgggtgggtatcatgt

SEQ ID NO: 625485 - DNA, 25 bp, Rattus norvegicus
tgctgactggcacgaagtgccccag

SEQ ID NO: 625486 - DNA, 25 bp, Rattus norvegicus
tgctgactggcaggaagtgccccag

SEQ ID NO: 625487 - DNA, 25 bp, Rattus norvegicus
tgctgacttcagacaaacgtttctt

SEQ ID NO: 625488 - DNA, 25 bp, Rattus norvegicus
tgctgacttcagtcaaacgtttctt

SEQ ID NO: 625489 - DNA, 25 bp, Rattus norvegicus
tgctgacttcctattccaaggtgta

SEQ ID NO: 625490 - DNA, 25 bp, Rattus norvegicus
tgctgacttccttttccaaggtgta

SEQ ID NO: 625491 - DNA, 25 bp, Rattus norvegicus
tgctgacttctcagagactcagagg

SEQ ID NO: 625492 - DNA, 25 bp, Rattus norvegicus
tgctgacttctctgagactcagagg

SEQ ID NO: 625493 - DNA, 25 bp, Rattus norvegicus
tgctgacttgagatacagttttaaa

SEQ ID NO: 625494 - DNA, 25 bp, Rattus norvegicus
tgctgacttgagttacagttttaaa

SEQ ID NO: 625495 - DNA, 25 bp, Rattus norvegicus
tgctgacttgtcaactgttatacaa

SEQ ID NO: 625496 - DNA, 25 bp, Rattus norvegicus
tgctgacttgtctactgttatacaa

SEQ ID NO: 625497 - DNA, 25 bp, Rattus norvegicus
tgctgacttttaccctcatactaaa

SEQ ID NO: 625498 - DNA, 25 bp, Rattus norvegicus
tgctgacttttactttcatctccat

SEQ ID NO: 625499 - DNA, 25 bp, Rattus norvegicus
tgctgacttttagcctcatactaaa

SEQ ID NO: 625500 - DNA, 25 bp, Rattus norvegicus
tgctgacttttagtttcatctccat

SEQ ID NO: 625501 - DNA, 25 bp, Rattus norvegicus
tgctgagaactgaatctggttcctc

SEQ ID NO: 625502 - DNA, 25 bp, Rattus norvegicus
tgctgagaactgtatctggttcctc

SEQ ID NO: 625503 - DNA, 25 bp, Rattus norvegicus
tgctgagaagccaagcctctatctg

SEQ ID NO: 625504 - DNA, 25 bp, Rattus norvegicus
tgctgagaagcctagcctctatctg

SEQ ID NO: 625505 - DNA, 25 bp, Rattus norvegicus
tgctgagaatctctgggctacgtgc

SEQ ID NO: 625506 - DNA, 25 bp, Rattus norvegicus
tgctgagaatctgtgggctacgtgc

SEQ ID NO: 625507 - DNA, 25 bp, Rattus norvegicus
tgctgagacccacctgacggagaaa

SEQ ID NO: 625508 - DNA, 25 bp, Rattus norvegicus
tgctgagacccagctgacggagaaa

SEQ ID NO: 625509 - DNA, 25 bp, Rattus norvegicus
tgctgagaccccagaagtgcgctgt

SEQ ID NO: 625510 - DNA, 25 bp, Rattus norvegicus
tgctgagacccctgaagtgcgctgt

SEQ ID NO: 625511 - DNA, 25 bp, Rattus norvegicus
tgctgagaggcaatgtgttgtcact

SEQ ID NO: 625512 - DNA, 25 bp, Rattus norvegicus
tgctgagaggcattgtgttgtcact

SEQ ID NO: 625513 - DNA, 25 bp, Rattus norvegicus
tgctgagaggccaaagggccccagt

SEQ ID NO: 625514 - DNA, 25 bp, Rattus norvegicus
tgctgagaggcctaagggccccagt

SEQ ID NO: 625515 - DNA, 25 bp, Rattus norvegicus
tgctgagatgttcctctgagcatca

SEQ ID NO: 625516 - DNA, 25 bp, Rattus norvegicus
tgctgagatgttgctctgagcatca

SEQ ID NO: 625517 - DNA, 25 bp, Rattus norvegicus
tgctgagcaagtaccgttgggcttt

SEQ ID NO: 625518 - DNA, 25 bp, Rattus norvegicus
tgctgagcaagttccgttgggcttt

SEQ ID NO: 625519 - DNA, 25 bp, Rattus norvegicus
tgctgagcaatgagctcactttgct

SEQ ID NO: 625520 - DNA, 25 bp, Rattus norvegicus
tgctgagcaatgtgctcactttgct

SEQ ID NO: 625521 - DNA, 25 bp, Rattus norvegicus
tgctgagcagccagtgtggcacgca

SEQ ID NO: 625522 - DNA, 25 bp, Rattus norvegicus
tgctgagcagcctgtgtggcacgca

SEQ ID NO: 625523 - DNA, 25 bp, Rattus norvegicus
tgctgagccacaaccagtgagtgat

SEQ ID NO: 625524 - DNA, 25 bp, Rattus norvegicus
tgctgagccacatccagtgagtgat

SEQ ID NO: 625525 - DNA, 25 bp, Rattus norvegicus
tgctgagcccagctgatgcatgtga

SEQ ID NO: 625526 - DNA, 25 bp, Rattus norvegicus
tgctgagcccaggtgatgcatgtga

SEQ ID NO: 625527 - DNA, 25 bp, Rattus norvegicus
tgctgagccgatcttctgggagatc

SEQ ID NO: 625528 - DNA, 25 bp, Rattus norvegicus
tgctgagccgatgttctgggagatc

SEQ ID NO: 625529 - DNA, 25 bp, Rattus norvegicus
tgctgagccttcagaacaggacgct

SEQ ID NO: 625530 - DNA, 25 bp, Rattus norvegicus
tgctgagccttctgaacaggacgct

SEQ ID NO: 625531 - DNA, 25 bp, Rattus norvegicus
tgctgagcggatctattgttccctc

SEQ ID NO: 625532 - DNA, 25 bp, Rattus norvegicus
tgctgagcggatgtattgttccctc

SEQ ID NO: 625533 - DNA, 25 bp, Rattus norvegicus
tgctgagcggtaagtgctgtttcac

SEQ ID NO: 625534 - DNA, 25 bp, Rattus norvegicus
tgctgagcggtatgtgctgtttcac

SEQ ID NO: 625535 - DNA, 25 bp, Rattus norvegicus
tgctgagcggtgaggcttttcaagc

SEQ ID NO: 625536 - DNA, 25 bp, Rattus norvegicus
tgctgagcggtgtggcttttcaagc

SEQ ID NO: 625537 - DNA, 25 bp, Rattus norvegicus
tgctgagctagccaacaggacacct

SEQ ID NO: 625538 - DNA, 25 bp, Rattus norvegicus
tgctgagctagcgaacaggacacct

SEQ ID NO: 625539 - DNA, 25 bp, Rattus norvegicus
tgctgagctcaacggctccatgtac

SEQ ID NO: 625540 - DNA, 25 bp, Rattus norvegicus
tgctgagctcaagggctccatgtac

SEQ ID NO: 625541 - DNA, 25 bp, Rattus norvegicus
tgctgagctctccttgtgggatcat

SEQ ID NO: 625542 - DNA, 25 bp, Rattus norvegicus
tgctgagctctcgttgtgggatcat

SEQ ID NO: 625543 - DNA, 25 bp, Rattus norvegicus
tgctgagctgcccagtagtggataa

SEQ ID NO: 625544 - DNA, 25 bp, Rattus norvegicus
tgctgagctgccgagtagtggataa

SEQ ID NO: 625545 - DNA, 25 bp, Rattus norvegicus
tgctgagcttaacgtgcctatcgac

SEQ ID NO: 625546 - DNA, 25 bp, Rattus norvegicus
tgctgagcttaaggtgcctatcgac

SEQ ID NO: 625547 - DNA, 25 bp, Rattus norvegicus
tgctgaggaagcacttgctcggtat

SEQ ID NO: 625548 - DNA, 25 bp, Rattus norvegicus
tgctgaggaagctcttgctcggtat

SEQ ID NO: 625549 - DNA, 25 bp, Rattus norvegicus
tgctgaggatgcagtggcccagcca

SEQ ID NO: 625550 - DNA, 25 bp, Rattus norvegicus
tgctgaggatgctgtggcccagcca

SEQ ID NO: 625551 - DNA, 25 bp, Rattus norvegicus
tgctgaggcagcatcttggtccacg

SEQ ID NO: 625552 - DNA, 25 bp, Rattus norvegicus
tgctgaggcagcttcttggtccacg

SEQ ID NO: 625553 - DNA, 25 bp, Rattus norvegicus
tgctgaggtctccatggcacagtgc

SEQ ID NO: 625554 - DNA, 25 bp, Rattus norvegicus
tgctgaggtctcgatggcacagtgc

SEQ ID NO: 625555 - DNA, 25 bp, Rattus norvegicus
tgctgaggtgtactcttgttgcttc

SEQ ID NO: 625556 - DNA, 25 bp, Rattus norvegicus
tgctgaggtgtagtcttgttgcttc

SEQ ID NO: 625557 - DNA, 25 bp, Rattus norvegicus
tgctgaggttacatcctccaagcaa

SEQ ID NO: 625558 - DNA, 25 bp, Rattus norvegicus
tgctgaggttacttcctccaagcaa

SEQ ID NO: 625559 - DNA, 25 bp, Rattus norvegicus
tgctgagtaccgcttccctgaagag

SEQ ID NO: 625560 - DNA, 25 bp, Rattus norvegicus
tgctgagtaccggttccctgaagag

SEQ ID NO: 625561 - DNA, 25 bp, Rattus norvegicus
tgctgagtctgcagttgccggctag

SEQ ID NO: 625562 - DNA, 25 bp, Rattus norvegicus
tgctgagtctgctgttgccggctag

SEQ ID NO: 625563 - DNA, 25 bp, Rattus norvegicus
tgctgagtgagcactgatgctccgt

SEQ ID NO: 625564 - DNA, 25 bp, Rattus norvegicus
tgctgagtgagctctgatgctccgt

SEQ ID NO: 625565 - DNA, 25 bp, Rattus norvegicus
tgctgagtgatgacagccctcggtt

SEQ ID NO: 625566 - DNA, 25 bp, Rattus norvegicus
tgctgagtgatgtcagccctcggtt

SEQ ID NO: 625567 - DNA, 25 bp, Rattus norvegicus
tgctgagtgcccaatggctgccatg

SEQ ID NO: 625568 - DNA, 25 bp, Rattus norvegicus
tgctgagtgccctatggctgccatg

SEQ ID NO: 625569 - DNA, 25 bp, Rattus norvegicus
tgctgagtgctgaccgcctgtgcca

SEQ ID NO: 625570 - DNA, 25 bp, Rattus norvegicus
tgctgagtgctgtccgcctgtgcca

SEQ ID NO: 625571 - DNA, 25 bp, Rattus norvegicus
tgctgagtgttgcagtgccctgaaa

SEQ ID NO: 625572 - DNA, 25 bp, Rattus norvegicus
tgctgagtgttggagtgccctgaaa

SEQ ID NO: 625573 - DNA, 25 bp, Rattus norvegicus
tgctgagttgatcccaggagcttca

SEQ ID NO: 625574 - DNA, 25 bp, Rattus norvegicus
tgctgagttgatgccaggagcttca

SEQ ID NO: 625575 - DNA, 25 bp, Rattus norvegicus
tgctgagtttgtatcctgtccacaa

SEQ ID NO: 625576 - DNA, 25 bp, Rattus norvegicus
tgctgagtttgtttcctgtccacaa

SEQ ID NO: 625577 - DNA, 25 bp, Rattus norvegicus
tgctgataaagcatcgcacggctgc

SEQ ID NO: 625578 - DNA, 25 bp, Rattus norvegicus
tgctgataaagcttcgcacggctgc

SEQ ID NO: 625579 - DNA, 25 bp, Rattus norvegicus
tgctgataagtaccctgagctgcct

SEQ ID NO: 625580 - DNA, 25 bp, Rattus norvegicus
tgctgataagtagcctgagctgcct

SEQ ID NO: 625581 - DNA, 25 bp, Rattus norvegicus
tgctgataattcatcttctgtcctt

SEQ ID NO: 625582 - DNA, 25 bp, Rattus norvegicus
tgctgataattcttcttctgtcctt

SEQ ID NO: 625583 - DNA, 25 bp, Rattus norvegicus
tgctgataccttcggctcagtttta

SEQ ID NO: 625584 - DNA, 25 bp, Rattus norvegicus
tgctgataccttgggctcagtttta

SEQ ID NO: 625585 - DNA, 25 bp, Rattus norvegicus
tgctgatactcacaagccaggaata

SEQ ID NO: 625586 - DNA, 25 bp, Rattus norvegicus
tgctgatactcagaagccaggaata

SEQ ID NO: 625587 - DNA, 25 bp, Rattus norvegicus
tgctgatagacgctggagtcctcca

SEQ ID NO: 625588 - DNA, 25 bp, Rattus norvegicus
tgctgatagacggtggagtcctcca

SEQ ID NO: 625589 - DNA, 25 bp, Rattus norvegicus
tgctgatatgaacgctgggcatgag

SEQ ID NO: 625590 - DNA, 25 bp, Rattus norvegicus
tgctgatatgaaggctgggcatgag

SEQ ID NO: 625591 - DNA, 25 bp, Rattus norvegicus
tgctgatcacaaacagatccctgaa

SEQ ID NO: 625592 - DNA, 25 bp, Rattus norvegicus
tgctgatcacaatcagatccctgaa

SEQ ID NO: 625593 - DNA, 25 bp, Rattus norvegicus
tgctgatccaggatcattaggaatg

SEQ ID NO: 625594 - DNA, 25 bp, Rattus norvegicus
tgctgatccaggttcattaggaatg

SEQ ID NO: 625595 - DNA, 25 bp, Rattus norvegicus
tgctgatcgtctccttcatcaagag

SEQ ID NO: 625596 - DNA, 25 bp, Rattus norvegicus
tgctgatcgtctgcttcatcaagag

SEQ ID NO: 625597 - DNA, 25 bp, Rattus norvegicus
tgctgatctgtaagtgtccctaaat

SEQ ID NO: 625598 - DNA, 25 bp, Rattus norvegicus
tgctgatctgtatgtgtccctaaat

SEQ ID NO: 625599 - DNA, 25 bp, Rattus norvegicus
tgctgatgatctacctctccttaag

SEQ ID NO: 625600 - DNA, 25 bp, Rattus norvegicus
tgctgatgatcttcctctccttaag

SEQ ID NO: 625601 - DNA, 25 bp, Rattus norvegicus
tgctgatggatactggtgctccctc

SEQ ID NO: 625602 - DNA, 25 bp, Rattus norvegicus
tgctgatggatagtggtgctccctc

SEQ ID NO: 625603 - DNA, 25 bp, Rattus norvegicus
tgctgatggccactccggcaggaaa

SEQ ID NO: 625604 - DNA, 25 bp, Rattus norvegicus
tgctgatggccagtccggcaggaaa

SEQ ID NO: 625605 - DNA, 25 bp, Rattus norvegicus
tgctgatgtctgcagaaggatttct

SEQ ID NO: 625606 - DNA, 25 bp, Rattus norvegicus
tgctgatgtctggagaaggatttct

SEQ ID NO: 625607 - DNA, 25 bp, Rattus norvegicus
tgctgattcaaacacatctctctca

SEQ ID NO: 625608 - DNA, 25 bp, Rattus norvegicus
tgctgattcaaagacatctctctca

SEQ ID NO: 625609 - DNA, 25 bp, Rattus norvegicus
tgctgattcaacaatgtctcctttc

SEQ ID NO: 625610 - DNA, 25 bp, Rattus norvegicus
tgctgattcaactatgtctcctttc

SEQ ID NO: 625611 - DNA, 25 bp, Rattus norvegicus
tgctgattcactcgccactgaggaa

SEQ ID NO: 625612 - DNA, 25 bp, Rattus norvegicus
tgctgattcactggccactgaggaa

SEQ ID NO: 625613 - DNA, 25 bp, Rattus norvegicus
tgctgattgttaccttccaggccca

SEQ ID NO: 625614 - DNA, 25 bp, Rattus norvegicus
tgctgattgttagcttccaggccca

SEQ ID NO: 625615 - DNA, 25 bp, Rattus norvegicus
tgctgatttcctcacagtgcagatg

SEQ ID NO: 625616 - DNA, 25 bp, Rattus norvegicus
tgctgatttcctgacagtgcagatg

SEQ ID NO: 625617 - DNA, 25 bp, Rattus norvegicus
tgctgatttgcacataggccacttc

SEQ ID NO: 625618 - DNA, 25 bp, Rattus norvegicus
tgctgatttgcagataggccacttc

SEQ ID NO: 625619 - DNA, 25 bp, Rattus norvegicus
tgctgcaagaggcactgggaaaatt

SEQ ID NO: 625620 - DNA, 25 bp, Rattus norvegicus
tgctgcaagagggactgggaaaatt

SEQ ID NO: 625621 - DNA, 25 bp, Rattus norvegicus
tgctgcaaggctacctcgagagtgg

SEQ ID NO: 625622 - DNA, 25 bp, Rattus norvegicus
tgctgcaaggcttcctcgagagtgg

SEQ ID NO: 625623 - DNA, 25 bp, Rattus norvegicus
tgctgcaataagagatttatgtcct

SEQ ID NO: 625624 - DNA, 25 bp, Rattus norvegicus
tgctgcaataagtgatttatgtcct

SEQ ID NO: 625625 - DNA, 25 bp, Rattus norvegicus
tgctgcaatttgctgatttcttcac

SEQ ID NO: 625626 - DNA, 25 bp, Rattus norvegicus
tgctgcaatttggtgatttcttcac

SEQ ID NO: 625627 - DNA, 25 bp, Rattus norvegicus
tgctgcacagccaatctcagaagga

SEQ ID NO: 625628 - DNA, 25 bp, Rattus norvegicus
tgctgcacagcctatctcagaagga

SEQ ID NO: 625629 - DNA, 25 bp, Rattus norvegicus
tgctgcaccatcattaatcagtgtt

SEQ ID NO: 625630 - DNA, 25 bp, Rattus norvegicus
tgctgcaccatctttaatcagtgtt

SEQ ID NO: 625631 - DNA, 25 bp, Rattus norvegicus
tgctgcacctccaaatgcagacgtg

SEQ ID NO: 625632 - DNA, 25 bp, Rattus norvegicus
tgctgcacctcctaatgcagacgtg

SEQ ID NO: 625633 - DNA, 25 bp, Rattus norvegicus
tgctgcacgcagaccgaggatattg

SEQ ID NO: 625634 - DNA, 25 bp, Rattus norvegicus
tgctgcacgcagtccgaggatattg

SEQ ID NO: 625635 - DNA, 25 bp, Rattus norvegicus
tgctgcactaccaggccatgcagaa

SEQ ID NO: 625636 - DNA, 25 bp, Rattus norvegicus
tgctgcactacctggccatgcagaa

SEQ ID NO: 625637 - DNA, 25 bp, Rattus norvegicus
tgctgcactcatcaactgtttgggc

SEQ ID NO: 625638 - DNA, 25 bp, Rattus norvegicus
tgctgcactcatgaactgtttgggc

SEQ ID NO: 625639 - DNA, 25 bp, Rattus norvegicus
tgctgcactgaaatcttggcctgac

SEQ ID NO: 625640 - DNA, 25 bp, Rattus norvegicus
tgctgcactgaattcttggcctgac

SEQ ID NO: 625641 - DNA, 25 bp, Rattus norvegicus
tgctgcactgatattcccgttatct

SEQ ID NO: 625642 - DNA, 25 bp, Rattus norvegicus
tgctgcactgattttcccgttatct

SEQ ID NO: 625643 - DNA, 25 bp, Rattus norvegicus
tgctgcactgggattctcttttccc

SEQ ID NO: 625644 - DNA, 25 bp, Rattus norvegicus
tgctgcactgggtttctcttttccc

SEQ ID NO: 625645 - DNA, 25 bp, Rattus norvegicus
tgctgcagaataatttccaggctct

SEQ ID NO: 625646 - DNA, 25 bp, Rattus norvegicus
tgctgcagaatattttccaggctct

SEQ ID NO: 625647 - DNA, 25 bp, Rattus norvegicus
tgctgcagacacagcctaggtacta

SEQ ID NO: 625648 - DNA, 25 bp, Rattus norvegicus
tgctgcagacactgcctaggtacta

SEQ ID NO: 625649 - DNA, 25 bp, Rattus norvegicus
tgctgcagacccaaataaaattcat

SEQ ID NO: 625650 - DNA, 25 bp, Rattus norvegicus
tgctgcagaccctaataaaattcat

SEQ ID NO: 625651 - DNA, 25 bp, Rattus norvegicus
tgctgcagatggaacctagggtttc

SEQ ID NO: 625652 - DNA, 25 bp, Rattus norvegicus
tgctgcagatggctaggacgcccac

SEQ ID NO: 625653 - DNA, 25 bp, Rattus norvegicus
tgctgcagatgggtaggacgcccac

SEQ ID NO: 625654 - DNA, 25 bp, Rattus norvegicus
tgctgcagatggtacctagggtttc

SEQ ID NO: 625655 - DNA, 25 bp, Rattus norvegicus
tgctgcagcaagagcctgatcgggc

SEQ ID NO: 625656 - DNA, 25 bp, Rattus norvegicus
tgctgcagcaagtgcctgatcgggc

SEQ ID NO: 625657 - DNA, 25 bp, Rattus norvegicus
tgctgcagcagcaagctggtgacaa

SEQ ID NO: 625658 - DNA, 25 bp, Rattus norvegicus
tgctgcagcagctagctggtgacaa

SEQ ID NO: 625659 - DNA, 25 bp, Rattus norvegicus
tgctgcagcattagaccagagctct

SEQ ID NO: 625660 - DNA, 25 bp, Rattus norvegicus
tgctgcagcatttgaccagagctct

SEQ ID NO: 625661 - DNA, 25 bp, Rattus norvegicus
tgctgcagctacactgtcttctaga

SEQ ID NO: 625662 - DNA, 25 bp, Rattus norvegicus
tgctgcagctactctgtcttctaga

SEQ ID NO: 625663 - DNA, 25 bp, Rattus norvegicus
tgctgcagctatcagtcctggaact

SEQ ID NO: 625664 - DNA, 25 bp, Rattus norvegicus
tgctgcagctatgagtcctggaact

SEQ ID NO: 625665 - DNA, 25 bp, Rattus norvegicus
tgctgcaggccacaggtgagaccat

SEQ ID NO: 625666 - DNA, 25 bp, Rattus norvegicus
tgctgcaggccagaggtgagaccat

SEQ ID NO: 625667 - DNA, 25 bp, Rattus norvegicus
tgctgcaggcgtagtcagaccgata

SEQ ID NO: 625668 - DNA, 25 bp, Rattus norvegicus
tgctgcaggcgttgtcagaccgata

SEQ ID NO: 625669 - DNA, 25 bp, Rattus norvegicus
tgctgcaggctgagtccagaagtcg

SEQ ID NO: 625670 - DNA, 25 bp, Rattus norvegicus
tgctgcaggctgtgtccagaagtcg

SEQ ID NO: 625671 - DNA, 25 bp, Rattus norvegicus
tgctgcagggtgagctatgcccatg

SEQ ID NO: 625672 - DNA, 25 bp, Rattus norvegicus
tgctgcagggtgtgctatgcccatg

SEQ ID NO: 625673 - DNA, 25 bp, Rattus norvegicus
tgctgcagtatcagggcgtcattga

SEQ ID NO: 625674 - DNA, 25 bp, Rattus norvegicus
tgctgcagtatctgggcgtcattga

SEQ ID NO: 625675 - DNA, 25 bp, Rattus norvegicus
tgctgcagtcgcacgcctggttcaa

SEQ ID NO: 625676 - DNA, 25 bp, Rattus norvegicus
tgctgcagtcgctcgcctggttcaa

SEQ ID NO: 625677 - DNA, 25 bp, Rattus norvegicus
tgctgcagtctcactaggctgtgag

SEQ ID NO: 625678 - DNA, 25 bp, Rattus norvegicus
tgctgcagtctcataggtctcactc

SEQ ID NO: 625679 - DNA, 25 bp, Rattus norvegicus
tgctgcagtctctctaggctgtgag

SEQ ID NO: 625680 - DNA, 25 bp, Rattus norvegicus
tgctgcagtctcttaggtctcactc

SEQ ID NO: 625681 - DNA, 25 bp, Rattus norvegicus
tgctgcagttcacacacttggaaac

SEQ ID NO: 625682 - DNA, 25 bp, Rattus norvegicus
tgctgcagttcagacacttggaaac

SEQ ID NO: 625683 - DNA, 25 bp, Rattus norvegicus
tgctgcagttcccttttctgaggag

SEQ ID NO: 625684 - DNA, 25 bp, Rattus norvegicus
tgctgcagttccgttttctgaggag

SEQ ID NO: 625685 - DNA, 25 bp, Rattus norvegicus
tgctgcagtttcctttgtcacgaat

SEQ ID NO: 625686 - DNA, 25 bp, Rattus norvegicus
tgctgcagtttcgtttgtcacgaat

SEQ ID NO: 625687 - DNA, 25 bp, Rattus norvegicus
tgctgcatactgagttccagaccaa

SEQ ID NO: 625688 - DNA, 25 bp, Rattus norvegicus
tgctgcatactgtgttccagaccaa

SEQ ID NO: 625689 - DNA, 25 bp, Rattus norvegicus
tgctgcatagttaccggccctgtcc

SEQ ID NO: 625690 - DNA, 25 bp, Rattus norvegicus
tgctgcatagtttccggccctgtcc

SEQ ID NO: 625691 - DNA, 25 bp, Rattus norvegicus
tgctgcatcaagaggagagtctggt

SEQ ID NO: 625692 - DNA, 25 bp, Rattus norvegicus
tgctgcatcaagtggagagtctggt

SEQ ID NO: 625693 - DNA, 25 bp, Rattus norvegicus
tgctgcatctctatgactcgctgaa

SEQ ID NO: 625694 - DNA, 25 bp, Rattus norvegicus
tgctgcatctctttgactcgctgaa

SEQ ID NO: 625695 - DNA, 25 bp, Rattus norvegicus
tgctgcatctggatgttactaacag

SEQ ID NO: 625696 - DNA, 25 bp, Rattus norvegicus
tgctgcatctggttgttactaacag

SEQ ID NO: 625697 - DNA, 25 bp, Rattus norvegicus
tgctgcatgaggagcccacaggaga

SEQ ID NO: 625698 - DNA, 25 bp, Rattus norvegicus
tgctgcatgaggtgcccacaggaga

SEQ ID NO: 625699 - DNA, 25 bp, Rattus norvegicus
tgctgcatgatcataacttttccga

SEQ ID NO: 625700 - DNA, 25 bp, Rattus norvegicus
tgctgcatgatcttaacttttccga

SEQ ID NO: 625701 - DNA, 25 bp, Rattus norvegicus
tgctgcatgcatagagcattcctgt

SEQ ID NO: 625702 - DNA, 25 bp, Rattus norvegicus
tgctgcatgcattgagcattcctgt

SEQ ID NO: 625703 - DNA, 25 bp, Rattus norvegicus
tgctgcattcgacgcatggaccatt

SEQ ID NO: 625704 - DNA, 25 bp, Rattus norvegicus
tgctgcattcgaggcatggaccatt

SEQ ID NO: 625705 - DNA, 25 bp, Rattus norvegicus
tgctgcattgagacttgaaaccttt

SEQ ID NO: 625706 - DNA, 25 bp, Rattus norvegicus
tgctgcattgagtcttgaaaccttt

SEQ ID NO: 625707 - DNA, 25 bp, Rattus norvegicus
tgctgcattgcacttggcccatggc

SEQ ID NO: 625708 - DNA, 25 bp, Rattus norvegicus
tgctgcattgcagttggcccatggc

SEQ ID NO: 625709 - DNA, 25 bp, Rattus norvegicus
tgctgcatttgcattttggaattgt

SEQ ID NO: 625710 - DNA, 25 bp, Rattus norvegicus
tgctgcatttgctttttggaattgt

SEQ ID NO: 625711 - DNA, 25 bp, Rattus norvegicus
tgctgccaacctagatgctgacgat

SEQ ID NO: 625712 - DNA, 25 bp, Rattus norvegicus
tgctgccaaccttgatgctgacgat

SEQ ID NO: 625713 - DNA, 25 bp, Rattus norvegicus
tgctgccaataccagtgccgtgagt

SEQ ID NO: 625714 - DNA, 25 bp, Rattus norvegicus
tgctgccaatacgagtgccgtgagt

SEQ ID NO: 625715 - DNA, 25 bp, Rattus norvegicus
tgctgccaatggctctgggcctctt

SEQ ID NO: 625716 - DNA, 25 bp, Rattus norvegicus
tgctgccaatgggtctgggcctctt

SEQ ID NO: 625717 - DNA, 25 bp, Rattus norvegicus
tgctgccacaagctcatgtccaatg

SEQ ID NO: 625718 - DNA, 25 bp, Rattus norvegicus
tgctgccacaaggtcatgtccaatg

SEQ ID NO: 625719 - DNA, 25 bp, Rattus norvegicus
tgctgccacagaaggcctcttatta

SEQ ID NO: 625720 - DNA, 25 bp, Rattus norvegicus
tgctgccacagatggcctcttatta

SEQ ID NO: 625721 - DNA, 25 bp, Rattus norvegicus
tgctgccacctcctgggcactaaaa

SEQ ID NO: 625722 - DNA, 25 bp, Rattus norvegicus
tgctgccacctcgtgggcactaaaa

SEQ ID NO: 625723 - DNA, 25 bp, Rattus norvegicus
tgctgccactcacattatcaaacat

SEQ ID NO: 625724 - DNA, 25 bp, Rattus norvegicus
tgctgccactcagattatcaaacat

SEQ ID NO: 625725 - DNA, 25 bp, Rattus norvegicus
tgctgccagcaaaaaagtgacctgt

SEQ ID NO: 625726 - DNA, 25 bp, Rattus norvegicus
tgctgccagcaataaagtgacctgt

SEQ ID NO: 625727 - DNA, 25 bp, Rattus norvegicus
tgctgccaggacaaggtctccttgg

SEQ ID NO: 625728 - DNA, 25 bp, Rattus norvegicus
tgctgccaggactaggtctccttgg

SEQ ID NO: 625729 - DNA, 25 bp, Rattus norvegicus
tgctgccagggcctggattccatca

SEQ ID NO: 625730 - DNA, 25 bp, Rattus norvegicus
tgctgccagggcgtggattccatca

SEQ ID NO: 625731 - DNA, 25 bp, Rattus norvegicus
tgctgccatcctagtaatcctagca

SEQ ID NO: 625732 - DNA, 25 bp, Rattus norvegicus
tgctgccatccttgtaatcctagca

SEQ ID NO: 625733 - DNA, 25 bp, Rattus norvegicus
tgctgccatgaaactgagaagctgg

SEQ ID NO: 625734 - DNA, 25 bp, Rattus norvegicus
tgctgccatgaatctgagaagctgg

SEQ ID NO: 625735 - DNA, 25 bp, Rattus norvegicus
tgctgccatgacattgcatgccgag

SEQ ID NO: 625736 - DNA, 25 bp, Rattus norvegicus
tgctgccatgactttgcatgccgag

SEQ ID NO: 625737 - DNA, 25 bp, Rattus norvegicus
tgctgccatggccagttaccaaaag

SEQ ID NO: 625738 - DNA, 25 bp, Rattus norvegicus
tgctgccatggcgagttaccaaaag

SEQ ID NO: 625739 - DNA, 25 bp, Rattus norvegicus
tgctgccatgttatctaacccagag

SEQ ID NO: 625740 - DNA, 25 bp, Rattus norvegicus
tgctgccatgttttctaacccagag

SEQ ID NO: 625741 - DNA, 25 bp, Rattus norvegicus
tgctgccattccctgtggtgccaga

SEQ ID NO: 625742 - DNA, 25 bp, Rattus norvegicus
tgctgccattccgtgtggtgccaga

SEQ ID NO: 625743 - DNA, 25 bp, Rattus norvegicus
tgctgcccacatctatagccagaaa

SEQ ID NO: 625744 - DNA, 25 bp, Rattus norvegicus
tgctgcccacatgtatagccagaaa

SEQ ID NO: 625745 - DNA, 25 bp, Rattus norvegicus
tgctgcccactcattaacaaactgt

SEQ ID NO: 625746 - DNA, 25 bp, Rattus norvegicus
tgctgcccactctttaacaaactgt

SEQ ID NO: 625747 - DNA, 25 bp, Rattus norvegicus
tgctgcccagccaataaagccagaa

SEQ ID NO: 625748 - DNA, 25 bp, Rattus norvegicus
tgctgcccagcctataaagccagaa

SEQ ID NO: 625749 - DNA, 25 bp, Rattus norvegicus
tgctgcccagggactctgagggttt

SEQ ID NO: 625750 - DNA, 25 bp, Rattus norvegicus
tgctgcccagggtctctgagggttt

SEQ ID NO: 625751 - DNA, 25 bp, Rattus norvegicus
tgctgcccctatccttctttgggat

SEQ ID NO: 625752 - DNA, 25 bp, Rattus norvegicus
tgctgcccctatgcttctttgggat

SEQ ID NO: 625753 - DNA, 25 bp, Rattus norvegicus
tgctgcccctggatttactttgatg

SEQ ID NO: 625754 - DNA, 25 bp, Rattus norvegicus
tgctgcccctggttttactttgatg

SEQ ID NO: 625755 - DNA, 25 bp, Rattus norvegicus
tgctgcccgaagatgaacccaaatt

SEQ ID NO: 625756 - DNA, 25 bp, Rattus norvegicus
tgctgcccgaagttgaacccaaatt

SEQ ID NO: 625757 - DNA, 25 bp, Rattus norvegicus
tgctgcccgagtcggacgatctatt

SEQ ID NO: 625758 - DNA, 25 bp, Rattus norvegicus
tgctgcccgagtgggacgatctatt

SEQ ID NO: 625759 - DNA, 25 bp, Rattus norvegicus
tgctgccctacgctatagttaatta

SEQ ID NO: 625760 - DNA, 25 bp, Rattus norvegicus
tgctgccctacggtatagttaatta

SEQ ID NO: 625761 - DNA, 25 bp, Rattus norvegicus
tgctgccctagtacaggatactgtt

SEQ ID NO: 625762 - DNA, 25 bp, Rattus norvegicus
tgctgccctagttcaggatactgtt

SEQ ID NO: 625763 - DNA, 25 bp, Rattus norvegicus
tgctgccctatactgtctagtggtt

SEQ ID NO: 625764 - DNA, 25 bp, Rattus norvegicus
tgctgccctatagtgtctagtggtt

SEQ ID NO: 625765 - DNA, 25 bp, Rattus norvegicus
tgctgccctgacaagagtggaacaa

SEQ ID NO: 625766 - DNA, 25 bp, Rattus norvegicus
tgctgccctgactagagtggaacaa

SEQ ID NO: 625767 - DNA, 25 bp, Rattus norvegicus
tgctgccctggtcgagtatgcattt

SEQ ID NO: 625768 - DNA, 25 bp, Rattus norvegicus
tgctgccctggtggagtatgcattt

SEQ ID NO: 625769 - DNA, 25 bp, Rattus norvegicus
tgctgccctgttatctgtatcgttg

SEQ ID NO: 625770 - DNA, 25 bp, Rattus norvegicus
tgctgccctgttttctgtatcgttg

SEQ ID NO: 625771 - DNA, 25 bp, Rattus norvegicus
tgctgccgcagtctgagaggctaca

SEQ ID NO: 625772 - DNA, 25 bp, Rattus norvegicus
tgctgccgcagtgtgagaggctaca

SEQ ID NO: 625773 - DNA, 25 bp, Rattus norvegicus
tgctgccgcgctcctcttaggtttg

SEQ ID NO: 625774 - DNA, 25 bp, Rattus norvegicus
tgctgccgcgctgctcttaggtttg

SEQ ID NO: 625775 - DNA, 25 bp, Rattus norvegicus
tgctgccggcggagcgtgcgaacag

SEQ ID NO: 625776 - DNA, 25 bp, Rattus norvegicus
tgctgccggcggtgcgtgcgaacag

SEQ ID NO: 625777 - DNA, 25 bp, Rattus norvegicus
tgctgccgggcgaggacatcaccac

SEQ ID NO: 625778 - DNA, 25 bp, Rattus norvegicus
tgctgccgggcgtggacatcaccac

SEQ ID NO: 625779 - DNA, 25 bp, Rattus norvegicus
tgctgccggttcattgagggtctaa

SEQ ID NO: 625780 - DNA, 25 bp, Rattus norvegicus
tgctgccggttctttgagggtctaa

SEQ ID NO: 625781 - DNA, 25 bp, Rattus norvegicus
tgctgccgtgggatactctataaac

SEQ ID NO: 625782 - DNA, 25 bp, Rattus norvegicus
tgctgccgtgggttactctataaac

SEQ ID NO: 625783 - DNA, 25 bp, Rattus norvegicus
tgctgccgttttagtcttctatgaa

SEQ ID NO: 625784 - DNA, 25 bp, Rattus norvegicus
tgctgccgtttttgtcttctatgaa

SEQ ID NO: 625785 - DNA, 25 bp, Rattus norvegicus
tgctgcctacacacgtttgtgttga

SEQ ID NO: 625786 - DNA, 25 bp, Rattus norvegicus
tgctgcctacactcgtttgtgttga

SEQ ID NO: 625787 - DNA, 25 bp, Rattus norvegicus
tgctgcctacctctaatttactgat

SEQ ID NO: 625788 - DNA, 25 bp, Rattus norvegicus
tgctgcctacctgtaatttactgat

SEQ ID NO: 625789 - DNA, 25 bp, Rattus norvegicus
tgctgcctactgagccaggaagata

SEQ ID NO: 625790 - DNA, 25 bp, Rattus norvegicus
tgctgcctactgtgccaggaagata

SEQ ID NO: 625791 - DNA, 25 bp, Rattus norvegicus
tgctgcctatttatgtctgtgtttt

SEQ ID NO: 625792 - DNA, 25 bp, Rattus norvegicus
tgctgcctatttttgtctgtgtttt

SEQ ID NO: 625793 - DNA, 25 bp, Rattus norvegicus
tgctgcctcagtatctcattttcgt

SEQ ID NO: 625794 - DNA, 25 bp, Rattus norvegicus
tgctgcctcagtttctcattttcgt

SEQ ID NO: 625795 - DNA, 25 bp, Rattus norvegicus
tgctgcctccacatttaactgctga

SEQ ID NO: 625796 - DNA, 25 bp, Rattus norvegicus
tgctgcctccacttttaactgctga

SEQ ID NO: 625797 - DNA, 25 bp, Rattus norvegicus
tgctgcctccagaagacgtggtttt

SEQ ID NO: 625798 - DNA, 25 bp, Rattus norvegicus
tgctgcctccagtagacgtggtttt

SEQ ID NO: 625799 - DNA, 25 bp, Rattus norvegicus
tgctgcctccgaaggttgctctaag

SEQ ID NO: 625800 - DNA, 25 bp, Rattus norvegicus
tgctgcctccgatggttgctctaag

SEQ ID NO: 625801 - DNA, 25 bp, Rattus norvegicus
tgctgcctccttaataaccattcat

SEQ ID NO: 625802 - DNA, 25 bp, Rattus norvegicus
tgctgcctcctttataaccattcat

SEQ ID NO: 625803 - DNA, 25 bp, Rattus norvegicus
tgctgcctcggcacgtcagtacatt

SEQ ID NO: 625804 - DNA, 25 bp, Rattus norvegicus
tgctgcctcggctcgtcagtacatt

SEQ ID NO: 625805 - DNA, 25 bp, Rattus norvegicus
tgctgcctctgtacagactcaaaaa

SEQ ID NO: 625806 - DNA, 25 bp, Rattus norvegicus
tgctgcctctgttcagactcaaaaa

SEQ ID NO: 625807 - DNA, 25 bp, Rattus norvegicus
tgctgcctcttgactaggtcaagga

SEQ ID NO: 625808 - DNA, 25 bp, Rattus norvegicus
tgctgcctcttgacttatgacctaa

SEQ ID NO: 625809 - DNA, 25 bp, Rattus norvegicus
tgctgcctcttgtctaggtcaagga

SEQ ID NO: 625810 - DNA, 25 bp, Rattus norvegicus
tgctgcctcttgtcttatgacctaa

SEQ ID NO: 625811 - DNA, 25 bp, Rattus norvegicus
tgctgcctctttatagtacctgaag

SEQ ID NO: 625812 - DNA, 25 bp, Rattus norvegicus
tgctgcctctttttagtacctgaag

SEQ ID NO: 625813 - DNA, 25 bp, Rattus norvegicus
tgctgcctgaccctgaggactgaag

SEQ ID NO: 625814 - DNA, 25 bp, Rattus norvegicus
tgctgcctgaccgtgaggactgaag

SEQ ID NO: 625815 - DNA, 25 bp, Rattus norvegicus
tgctgcctgagcatctgaatcacag

SEQ ID NO: 625816 - DNA, 25 bp, Rattus norvegicus
tgctgcctgagcttctgaatcacag

SEQ ID NO: 625817 - DNA, 25 bp, Rattus norvegicus
tgctgcctgatcattgccaaagtgg

SEQ ID NO: 625818 - DNA, 25 bp, Rattus norvegicus
tgctgcctgatctttgccaaagtgg

SEQ ID NO: 625819 - DNA, 25 bp, Rattus norvegicus
tgctgcctgcaacacatacatctgt

SEQ ID NO: 625820 - DNA, 25 bp, Rattus norvegicus
tgctgcctgcaagacatacatctgt

SEQ ID NO: 625821 - DNA, 25 bp, Rattus norvegicus
tgctgcctgcacaagaggaagagct

SEQ ID NO: 625822 - DNA, 25 bp, Rattus norvegicus
tgctgcctgcactagaggaagagct

SEQ ID NO: 625823 - DNA, 25 bp, Rattus norvegicus
tgctgcctgccccaaaaacaggaag

SEQ ID NO: 625824 - DNA, 25 bp, Rattus norvegicus
tgctgcctgcccgaaaaacaggaag

SEQ ID NO: 625825 - DNA, 25 bp, Rattus norvegicus
tgctgcctgcctattggaccctttc

SEQ ID NO: 625826 - DNA, 25 bp, Rattus norvegicus
tgctgcctgcctcccgggattactg

SEQ ID NO: 625827 - DNA, 25 bp, Rattus norvegicus
tgctgcctgcctgccgggattactg

SEQ ID NO: 625828 - DNA, 25 bp, Rattus norvegicus
tgctgcctgccttttggaccctttc

SEQ ID NO: 625829 - DNA, 25 bp, Rattus norvegicus
tgctgcctgctcaacttcagtgata

SEQ ID NO: 625830 - DNA, 25 bp, Rattus norvegicus
tgctgcctgctcctttgcctttgtc

SEQ ID NO: 625831 - DNA, 25 bp, Rattus norvegicus
tgctgcctgctcgtttgcctttgtc

SEQ ID NO: 625832 - DNA, 25 bp, Rattus norvegicus
tgctgcctgctctacttcagtgata

SEQ ID NO: 625833 - DNA, 25 bp, Rattus norvegicus
tgctgcctgctgaaggtccttgctg

SEQ ID NO: 625834 - DNA, 25 bp, Rattus norvegicus
tgctgcctgctgatcgaagctggga

SEQ ID NO: 625835 - DNA, 25 bp, Rattus norvegicus
tgctgcctgctgtaggtccttgctg

SEQ ID NO: 625836 - DNA, 25 bp, Rattus norvegicus
tgctgcctgctgttcgaagctggga

SEQ ID NO: 625837 - DNA, 25 bp, Rattus norvegicus
tgctgcctggagactcgagccagac

SEQ ID NO: 625838 - DNA, 25 bp, Rattus norvegicus
tgctgcctggagtctcgagccagac

SEQ ID NO: 625839 - DNA, 25 bp, Rattus norvegicus
tgctgcctggatccaagcctttttt

SEQ ID NO: 625840 - DNA, 25 bp, Rattus norvegicus
tgctgcctggatgcaagcctttttt

SEQ ID NO: 625841 - DNA, 25 bp, Rattus norvegicus
tgctgcctgggcacagactgtaaag

SEQ ID NO: 625842 - DNA, 25 bp, Rattus norvegicus
tgctgcctgggctcagactgtaaag

SEQ ID NO: 625843 - DNA, 25 bp, Rattus norvegicus
tgctgcctgtggatccccgggaccg

SEQ ID NO: 625844 - DNA, 25 bp, Rattus norvegicus
tgctgcctgtggttccccgggaccg

SEQ ID NO: 625845 - DNA, 25 bp, Rattus norvegicus
tgctgccttcagatgccgcattaat

SEQ ID NO: 625846 - DNA, 25 bp, Rattus norvegicus
tgctgccttcagttgccgcattaat

SEQ ID NO: 625847 - DNA, 25 bp, Rattus norvegicus
tgctgccttctaccatgtgctgaca

SEQ ID NO: 625848 - DNA, 25 bp, Rattus norvegicus
tgctgccttctagcatgtgctgaca

SEQ ID NO: 625849 - DNA, 25 bp, Rattus norvegicus
tgctgccttctgaggctgacacctt

SEQ ID NO: 625850 - DNA, 25 bp, Rattus norvegicus
tgctgccttctgtggctgacacctt

SEQ ID NO: 625851 - DNA, 25 bp, Rattus norvegicus
tgctgccttcttctggtgtccagag

SEQ ID NO: 625852 - DNA, 25 bp, Rattus norvegicus
tgctgccttcttgtggtgtccagag

SEQ ID NO: 625853 - DNA, 25 bp, Rattus norvegicus
tgctgccttgttccaaacatgcgga

SEQ ID NO: 625854 - DNA, 25 bp, Rattus norvegicus
tgctgccttgttccagaatgaggat

SEQ ID NO: 625855 - DNA, 25 bp, Rattus norvegicus
tgctgccttgttgcaaacatgcgga

SEQ ID NO: 625856 - DNA, 25 bp, Rattus norvegicus
tgctgccttgttgcagaatgaggat

SEQ ID NO: 625857 - DNA, 25 bp, Rattus norvegicus
tgctgcgagtgcagagaacgtacct

SEQ ID NO: 625858 - DNA, 25 bp, Rattus norvegicus
tgctgcgagtgctgagaacgtacct

SEQ ID NO: 625859 - DNA, 25 bp, Rattus norvegicus
tgctgcgcagctcgtacgagaagaa

SEQ ID NO: 625860 - DNA, 25 bp, Rattus norvegicus
tgctgcgcagctggtacgagaagaa

SEQ ID NO: 625861 - DNA, 25 bp, Rattus norvegicus
tgctgcgcagttctgcctccagagg

SEQ ID NO: 625862 - DNA, 25 bp, Rattus norvegicus
tgctgcgcagttgtgcctccagagg

SEQ ID NO: 625863 - DNA, 25 bp, Rattus norvegicus
tgctgcgcatctatcctaaagagat

SEQ ID NO: 625864 - DNA, 25 bp, Rattus norvegicus
tgctgcgcatctttcctaaagagat

SEQ ID NO: 625865 - DNA, 25 bp, Rattus norvegicus
tgctgcgcccaacctgtaaagaagt

SEQ ID NO: 625866 - DNA, 25 bp, Rattus norvegicus
tgctgcgcccaagctgtaaagaagt

SEQ ID NO: 625867 - DNA, 25 bp, Rattus norvegicus
tgctgcgcgcccaggagaagtccga

SEQ ID NO: 625868 - DNA, 25 bp, Rattus norvegicus
tgctgcgcgccctggagaagtccga

SEQ ID NO: 625869 - DNA, 25 bp, Rattus norvegicus
tgctgcgcgtccacaaagacaagat

SEQ ID NO: 625870 - DNA, 25 bp, Rattus norvegicus
tgctgcgcgtcctcaaagacaagat

SEQ ID NO: 625871 - DNA, 25 bp, Rattus norvegicus
tgctgcgctgttagtatttgtggcc

SEQ ID NO: 625872 - DNA, 25 bp, Rattus norvegicus
tgctgcgctgtttgtatttgtggcc

SEQ ID NO: 625873 - DNA, 25 bp, Rattus norvegicus
tgctgcggacagcacttgagtatat

SEQ ID NO: 625874 - DNA, 25 bp, Rattus norvegicus
tgctgcggacaggacttgagtatat

SEQ ID NO: 625875 - DNA, 25 bp, Rattus norvegicus
tgctgcggacccagctagagctagc

SEQ ID NO: 625876 - DNA, 25 bp, Rattus norvegicus
tgctgcggaccctgctagagctagc

SEQ ID NO: 625877 - DNA, 25 bp, Rattus norvegicus
tgctgcggatgccatggattgctat

SEQ ID NO: 625878 - DNA, 25 bp, Rattus norvegicus
tgctgcggatgcgatggattgctat

SEQ ID NO: 625879 - DNA, 25 bp, Rattus norvegicus
tgctgcggcagcagcgtgactttta

SEQ ID NO: 625880 - DNA, 25 bp, Rattus norvegicus
tgctgcggcagctgcgtgactttta

SEQ ID NO: 625881 - DNA, 25 bp, Rattus norvegicus
tgctgcggctgcctggaccagtaaa

SEQ ID NO: 625882 - DNA, 25 bp, Rattus norvegicus
tgctgcggctgcgtggaccagtaaa

SEQ ID NO: 625883 - DNA, 25 bp, Rattus norvegicus
tgctgcggtaggactcatgtcgcgt

SEQ ID NO: 625884 - DNA, 25 bp, Rattus norvegicus
tgctgcggtaggtctcatgtcgcgt

SEQ ID NO: 625885 - DNA, 25 bp, Rattus norvegicus
tgctgcggtttcctcagttaatgtt

SEQ ID NO: 625886 - DNA, 25 bp, Rattus norvegicus
tgctgcggtttcgtcagttaatgtt

SEQ ID NO: 625887 - DNA, 25 bp, Rattus norvegicus
tgctgcgtatgccaccctggctgaa

SEQ ID NO: 625888 - DNA, 25 bp, Rattus norvegicus
tgctgcgtatgcgaccctggctgaa

SEQ ID NO: 625889 - DNA, 25 bp, Rattus norvegicus
tgctgcgtcggtcgaagagcttaaa

SEQ ID NO: 625890 - DNA, 25 bp, Rattus norvegicus
tgctgcgtcggtggaagagcttaaa

SEQ ID NO: 625891 - DNA, 25 bp, Rattus norvegicus
tgctgcgttggacaaatcaaagtgt

SEQ ID NO: 625892 - DNA, 25 bp, Rattus norvegicus
tgctgcgttggagaaatcaaagtgt

SEQ ID NO: 625893 - DNA, 25 bp, Rattus norvegicus
tgctgctaaaccagacaatctgagt

SEQ ID NO: 625894 - DNA, 25 bp, Rattus norvegicus
tgctgctaaacctgacaatctgagt

SEQ ID NO: 625895 - DNA, 25 bp, Rattus norvegicus
tgctgctaacacatgtgctgagtca

SEQ ID NO: 625896 - DNA, 25 bp, Rattus norvegicus
tgctgctaacacttgtgctgagtca

SEQ ID NO: 625897 - DNA, 25 bp, Rattus norvegicus
tgctgctaacagcactgcctgtgtt

SEQ ID NO: 625898 - DNA, 25 bp, Rattus norvegicus
tgctgctaacaggactgcctgtgtt

SEQ ID NO: 625899 - DNA, 25 bp, Rattus norvegicus
tgctgctaagctaggtcctcccagg

SEQ ID NO: 625900 - DNA, 25 bp, Rattus norvegicus
tgctgctaagcttggtcctcccagg

SEQ ID NO: 625901 - DNA, 25 bp, Rattus norvegicus
tgctgctacacgctacttttctttt

SEQ ID NO: 625902 - DNA, 25 bp, Rattus norvegicus
tgctgctacacggtacttttctttt

SEQ ID NO: 625903 - DNA, 25 bp, Rattus norvegicus
tgctgctaggtaaatgtggctgtca

SEQ ID NO: 625904 - DNA, 25 bp, Rattus norvegicus
tgctgctaggtatatgtggctgtca

SEQ ID NO: 625905 - DNA, 25 bp, Rattus norvegicus
tgctgctatgctatcctgaaggtca

SEQ ID NO: 625906 - DNA, 25 bp, Rattus norvegicus
tgctgctatgctttcctgaaggtca

SEQ ID NO: 625907 - DNA, 25 bp, Rattus norvegicus
tgctgctattttcctgtcttaagta

SEQ ID NO: 625908 - DNA, 25 bp, Rattus norvegicus
tgctgctattttgctgtcttaagta

SEQ ID NO: 625909 - DNA, 25 bp, Rattus norvegicus
tgctgctcaaaaatggtaccctgtt

SEQ ID NO: 625910 - DNA, 25 bp, Rattus norvegicus
tgctgctcaaaattggtaccctgtt

SEQ ID NO: 625911 - DNA, 25 bp, Rattus norvegicus
tgctgctcagagcacttccttttta

SEQ ID NO: 625912 - DNA, 25 bp, Rattus norvegicus
tgctgctcagaggacttccttttta

SEQ ID NO: 625913 - DNA, 25 bp, Rattus norvegicus
tgctgctcagctacacggttatgga

SEQ ID NO: 625914 - DNA, 25 bp, Rattus norvegicus
tgctgctcagctagtctgtgagagt

SEQ ID NO: 625915 - DNA, 25 bp, Rattus norvegicus
tgctgctcagcttcacggttatgga

SEQ ID NO: 625916 - DNA, 25 bp, Rattus norvegicus
tgctgctcagcttgtctgtgagagt

SEQ ID NO: 625917 - DNA, 25 bp, Rattus norvegicus
tgctgctcagggaaccgttctattg

SEQ ID NO: 625918 - DNA, 25 bp, Rattus norvegicus
tgctgctcagggtaccgttctattg

SEQ ID NO: 625919 - DNA, 25 bp, Rattus norvegicus
tgctgctcatccagactcttgacca

SEQ ID NO: 625920 - DNA, 25 bp, Rattus norvegicus
tgctgctcatcctgactcttgacca

SEQ ID NO: 625921 - DNA, 25 bp, Rattus norvegicus
tgctgctcatttacatgccagccaa

SEQ ID NO: 625922 - DNA, 25 bp, Rattus norvegicus
tgctgctcattttcatgccagccaa

SEQ ID NO: 625923 - DNA, 25 bp, Rattus norvegicus
tgctgctccctactacagctagtag

SEQ ID NO: 625924 - DNA, 25 bp, Rattus norvegicus
tgctgctccctagtacagctagtag

SEQ ID NO: 625925 - DNA, 25 bp, Rattus norvegicus
tgctgctcctcacaacatggacaaa

SEQ ID NO: 625926 - DNA, 25 bp, Rattus norvegicus
tgctgctcctcagaacatggacaaa

SEQ ID NO: 625927 - DNA, 25 bp, Rattus norvegicus
tgctgctcctggagtctgcaatagc

SEQ ID NO: 625928 - DNA, 25 bp, Rattus norvegicus
tgctgctcctggtgtctgcaatagc

SEQ ID NO: 625929 - DNA, 25 bp, Rattus norvegicus
tgctgctccttacctggtctaaata

SEQ ID NO: 625930 - DNA, 25 bp, Rattus norvegicus
tgctgctccttagctggtctaaata

SEQ ID NO: 625931 - DNA, 25 bp, Rattus norvegicus
tgctgctcctttattcagaaattgt

SEQ ID NO: 625932 - DNA, 25 bp, Rattus norvegicus
tgctgctcctttcggtcttgttctc

SEQ ID NO: 625933 - DNA, 25 bp, Rattus norvegicus
tgctgctcctttgggtcttgttctc

SEQ ID NO: 625934 - DNA, 25 bp, Rattus norvegicus
tgctgctccttttttcagaaattgt

SEQ ID NO: 625935 - DNA, 25 bp, Rattus norvegicus
tgctgctcgctgacgaaatgggcaa

SEQ ID NO: 625936 - DNA, 25 bp, Rattus norvegicus
tgctgctcgctgtcgaaatgggcaa

SEQ ID NO: 625937 - DNA, 25 bp, Rattus norvegicus
tgctgctcgtatctgtatgggtgtc

SEQ ID NO: 625938 - DNA, 25 bp, Rattus norvegicus
tgctgctcgtatgtgtatgggtgtc

SEQ ID NO: 625939 - DNA, 25 bp, Rattus norvegicus
tgctgctcgtggacactctggaaaa

SEQ ID NO: 625940 - DNA, 25 bp, Rattus norvegicus
tgctgctcgtggtcactctggaaaa

SEQ ID NO: 625941 - DNA, 25 bp, Rattus norvegicus
tgctgctctcatctggtgccaaaag

SEQ ID NO: 625942 - DNA, 25 bp, Rattus norvegicus
tgctgctctcatgtggtgccaaaag

SEQ ID NO: 625943 - DNA, 25 bp, Rattus norvegicus
tgctgctctctgaaaactcggactc

SEQ ID NO: 625944 - DNA, 25 bp, Rattus norvegicus
tgctgctctctgtaaactcggactc

SEQ ID NO: 625945 - DNA, 25 bp, Rattus norvegicus
tgctgctctcttacagtatctgtga

SEQ ID NO: 625946 - DNA, 25 bp, Rattus norvegicus
tgctgctctctttcagtatctgtga

SEQ ID NO: 625947 - DNA, 25 bp, Rattus norvegicus
tgctgctctgagctcacacttaaga

SEQ ID NO: 625948 - DNA, 25 bp, Rattus norvegicus
tgctgctctgagctgcaactcctca

SEQ ID NO: 625949 - DNA, 25 bp, Rattus norvegicus
tgctgctctgaggtcacacttaaga

SEQ ID NO: 625950 - DNA, 25 bp, Rattus norvegicus
tgctgctctgaggtgcaactcctca

SEQ ID NO: 625951 - DNA, 25 bp, Rattus norvegicus
tgctgctctgccctgctgggaagtt

SEQ ID NO: 625952 - DNA, 25 bp, Rattus norvegicus
tgctgctctgccgtgctgggaagtt

SEQ ID NO: 625953 - DNA, 25 bp, Rattus norvegicus
tgctgctctgctagggcttgctgaa

SEQ ID NO: 625954 - DNA, 25 bp, Rattus norvegicus
tgctgctctgcttgggcttgctgaa

SEQ ID NO: 625955 - DNA, 25 bp, Rattus norvegicus
tgctgctctggaaggctgaaggctc

SEQ ID NO: 625956 - DNA, 25 bp, Rattus norvegicus
tgctgctctggatggctgaaggctc

SEQ ID NO: 625957 - DNA, 25 bp, Rattus norvegicus
tgctgctctgtaaggacacatccta

SEQ ID NO: 625958 - DNA, 25 bp, Rattus norvegicus
tgctgctctgtatggacacatccta

SEQ ID NO: 625959 - DNA, 25 bp, Rattus norvegicus
tgctgctctgttctgtttctgatca

SEQ ID NO: 625960 - DNA, 25 bp, Rattus norvegicus
tgctgctctgttgtgtttctgatca

SEQ ID NO: 625961 - DNA, 25 bp, Rattus norvegicus
tgctgctcttgaagacctgactttg

SEQ ID NO: 625962 - DNA, 25 bp, Rattus norvegicus
tgctgctcttgatgacctgactttg

SEQ ID NO: 625963 - DNA, 25 bp, Rattus norvegicus
tgctgctcttgtagactggtgcgaa

SEQ ID NO: 625964 - DNA, 25 bp, Rattus norvegicus
tgctgctcttgttgactggtgcgaa

SEQ ID NO: 625965 - DNA, 25 bp, Rattus norvegicus
tgctgctgacagagtgctttaggct

SEQ ID NO: 625966 - DNA, 25 bp, Rattus norvegicus
tgctgctgacagtgtgctttaggct

SEQ ID NO: 625967 - DNA, 25 bp, Rattus norvegicus
tgctgctgagttcctaagccccaaa

SEQ ID NO: 625968 - DNA, 25 bp, Rattus norvegicus
tgctgctgagttgctaagccccaaa

SEQ ID NO: 625969 - DNA, 25 bp, Rattus norvegicus
tgctgctgcaccagacacatgtttt

SEQ ID NO: 625970 - DNA, 25 bp, Rattus norvegicus
tgctgctgcacctgacacatgtttt

SEQ ID NO: 625971 - DNA, 25 bp, Rattus norvegicus
tgctgctgcagcatgatgggtcaac

SEQ ID NO: 625972 - DNA, 25 bp, Rattus norvegicus
tgctgctgcagcttgatgggtcaac

SEQ ID NO: 625973 - DNA, 25 bp, Rattus norvegicus
tgctgctgcatacaggtcagctctc

SEQ ID NO: 625974 - DNA, 25 bp, Rattus norvegicus
tgctgctgcatagaggtcagctctc

SEQ ID NO: 625975 - DNA, 25 bp, Rattus norvegicus
tgctgctgcattaatcccaagaaaa

SEQ ID NO: 625976 - DNA, 25 bp, Rattus norvegicus
tgctgctgcatttatcccaagaaaa

SEQ ID NO: 625977 - DNA, 25 bp, Rattus norvegicus
tgctgctgccaaagatggagtctct

SEQ ID NO: 625978 - DNA, 25 bp, Rattus norvegicus
tgctgctgccaatgatggagtctct

SEQ ID NO: 625979 - DNA, 25 bp, Rattus norvegicus
tgctgctgccacagttgcgagccca

SEQ ID NO: 625980 - DNA, 25 bp, Rattus norvegicus
tgctgctgccactgttgcgagccca

SEQ ID NO: 625981 - DNA, 25 bp, Rattus norvegicus
tgctgctgccatcgctgtggtaaag

SEQ ID NO: 625982 - DNA, 25 bp, Rattus norvegicus
tgctgctgccatggctgtggtaaag

SEQ ID NO: 625983 - DNA, 25 bp, Rattus norvegicus
tgctgctgccctcaggtgtaaataa

SEQ ID NO: 625984 - DNA, 25 bp, Rattus norvegicus
tgctgctgccctgaggtgtaaataa

SEQ ID NO: 625985 - DNA, 25 bp, Rattus norvegicus
tgctgctgctagaccattattttaa

SEQ ID NO: 625986 - DNA, 25 bp, Rattus norvegicus
tgctgctgctagtccattattttaa

SEQ ID NO: 625987 - DNA, 25 bp, Rattus norvegicus
tgctgctggcacacctactgagtcg

SEQ ID NO: 625988 - DNA, 25 bp, Rattus norvegicus
tgctgctggcacatgtggtgtaata

SEQ ID NO: 625989 - DNA, 25 bp, Rattus norvegicus
tgctgctggcactcctactgagtcg

SEQ ID NO: 625990 - DNA, 25 bp, Rattus norvegicus
tgctgctggcacttgtggtgtaata

SEQ ID NO: 625991 - DNA, 25 bp, Rattus norvegicus
tgctgctggctcacaggagttctta

SEQ ID NO: 625992 - DNA, 25 bp, Rattus norvegicus
tgctgctggctctcaggagttctta

SEQ ID NO: 625993 - DNA, 25 bp, Rattus norvegicus
tgctgctggctgacaagggacctag

SEQ ID NO: 625994 - DNA, 25 bp, Rattus norvegicus
tgctgctggctgtcaagggacctag

SEQ ID NO: 625995 - DNA, 25 bp, Rattus norvegicus
tgctgctgggatagactggcaccaa

SEQ ID NO: 625996 - DNA, 25 bp, Rattus norvegicus
tgctgctgggattgactggcaccaa

SEQ ID NO: 625997 - DNA, 25 bp, Rattus norvegicus
tgctgctgtcctagccctagggcat

SEQ ID NO: 625998 - DNA, 25 bp, Rattus norvegicus
tgctgctgtccttgccctagggcat

SEQ ID NO: 625999 - DNA, 25 bp, Rattus norvegicus
tgctgctgtgagctgtacctcctga

SEQ ID NO: 626000 - DNA, 25 bp, Rattus norvegicus
tgctgctgtgaggtgtacctcctga

SEQ ID NO: 626001 - DNA, 25 bp, Rattus norvegicus
tgctgctgtggcagaacttaaacct

SEQ ID NO: 626002 - DNA, 25 bp, Rattus norvegicus
tgctgctgtggctgaacttaaacct

SEQ ID NO: 626003 - DNA, 25 bp, Rattus norvegicus
tgctgctgtgtgagatggtttattg

SEQ ID NO: 626004 - DNA, 25 bp, Rattus norvegicus
tgctgctgtgtgtgatggtttattg

SEQ ID NO: 626005 - DNA, 25 bp, Rattus norvegicus
tgctgctgtttgctgctgacggtaa

SEQ ID NO: 626006 - DNA, 25 bp, Rattus norvegicus
tgctgctgtttggtgctgacggtaa

SEQ ID NO: 626007 - DNA, 25 bp, Rattus norvegicus
tgctgcttacagctgtctgattccg

SEQ ID NO: 626008 - DNA, 25 bp, Rattus norvegicus
tgctgcttacaggtgtctgattccg

SEQ ID NO: 626009 - DNA, 25 bp, Rattus norvegicus
tgctgcttccacagatacccttttg

SEQ ID NO: 626010 - DNA, 25 bp, Rattus norvegicus
tgctgcttccactgatacccttttg

SEQ ID NO: 626011 - DNA, 25 bp, Rattus norvegicus
tgctgcttcgccctgtggaaagaac

SEQ ID NO: 626012 - DNA, 25 bp, Rattus norvegicus
tgctgcttcgccgtgtggaaagaac

SEQ ID NO: 626013 - DNA, 25 bp, Rattus norvegicus
tgctgcttctacattcaatgggttc

SEQ ID NO: 626014 - DNA, 25 bp, Rattus norvegicus
tgctgcttctactttcaatgggttc

SEQ ID NO: 626015 - DNA, 25 bp, Rattus norvegicus
tgctgcttctagctgcaactcctca

SEQ ID NO: 626016 - DNA, 25 bp, Rattus norvegicus
tgctgcttctaggtgcaactcctca

SEQ ID NO: 626017 - DNA, 25 bp, Rattus norvegicus
tgctgcttctccaatggacggcaaa

SEQ ID NO: 626018 - DNA, 25 bp, Rattus norvegicus
tgctgcttctcctatggacggcaaa

SEQ ID NO: 626019 - DNA, 25 bp, Rattus norvegicus
tgctgcttcttaatgacactgccta

SEQ ID NO: 626020 - DNA, 25 bp, Rattus norvegicus
tgctgcttcttattgacactgccta

SEQ ID NO: 626021 - DNA, 25 bp, Rattus norvegicus
tgctgcttgaccacacgggatttac

SEQ ID NO: 626022 - DNA, 25 bp, Rattus norvegicus
tgctgcttgaccagctagcgctgta

SEQ ID NO: 626023 - DNA, 25 bp, Rattus norvegicus
tgctgcttgacctcacgggatttac

SEQ ID NO: 626024 - DNA, 25 bp, Rattus norvegicus
tgctgcttgacctgctagcgctgta

SEQ ID NO: 626025 - DNA, 25 bp, Rattus norvegicus
tgctgcttgagcagatggacttcac

SEQ ID NO: 626026 - DNA, 25 bp, Rattus norvegicus
tgctgcttgagctgatggacttcac

SEQ ID NO: 626027 - DNA, 25 bp, Rattus norvegicus
tgctgcttgcagcactgtagggcct

SEQ ID NO: 626028 - DNA, 25 bp, Rattus norvegicus
tgctgcttgcaggactgtagggcct

SEQ ID NO: 626029 - DNA, 25 bp, Rattus norvegicus
tgctgcttgcttaattctttacctt

SEQ ID NO: 626030 - DNA, 25 bp, Rattus norvegicus
tgctgcttgcttcttttctcaccag

SEQ ID NO: 626031 - DNA, 25 bp, Rattus norvegicus
tgctgcttgcttgttttctcaccag

SEQ ID NO: 626032 - DNA, 25 bp, Rattus norvegicus
tgctgcttgctttattctttacctt

SEQ ID NO: 626033 - DNA, 25 bp, Rattus norvegicus
tgctgcttgtgcagtacagttgccc

SEQ ID NO: 626034 - DNA, 25 bp, Rattus norvegicus
tgctgcttgtgcagtgggccctgct

SEQ ID NO: 626035 - DNA, 25 bp, Rattus norvegicus
tgctgcttgtgctgtacagttgccc

SEQ ID NO: 626036 - DNA, 25 bp, Rattus norvegicus
tgctgcttgtgctgtgggccctgct

SEQ ID NO: 626037 - DNA, 25 bp, Rattus norvegicus
tgctgcttgttgctgattgttgccg

SEQ ID NO: 626038 - DNA, 25 bp, Rattus norvegicus
tgctgcttgttggtgattgttgccg

SEQ ID NO: 626039 - DNA, 25 bp, Rattus norvegicus
tgctgctttaccaagatctcctaaa

SEQ ID NO: 626040 - DNA, 25 bp, Rattus norvegicus
tgctgctttacctagatctcctaaa

SEQ ID NO: 626041 - DNA, 25 bp, Rattus norvegicus
tgctgctttcctcggaagccgcaag

SEQ ID NO: 626042 - DNA, 25 bp, Rattus norvegicus
tgctgctttcctgggaagccgcaag

SEQ ID NO: 626043 - DNA, 25 bp, Rattus norvegicus
tgctgctttctgactcactgaaatt

SEQ ID NO: 626044 - DNA, 25 bp, Rattus norvegicus
tgctgctttctgtctcactgaaatt

SEQ ID NO: 626045 - DNA, 25 bp, Rattus norvegicus
tgctgctttgaaccttcaattcaaa

SEQ ID NO: 626046 - DNA, 25 bp, Rattus norvegicus
tgctgctttgaagcttcaattcaaa

SEQ ID NO: 626047 - DNA, 25 bp, Rattus norvegicus
tgctgcttttgcaactcaccattac

SEQ ID NO: 626048 - DNA, 25 bp, Rattus norvegicus
tgctgcttttgcacggtaccatgaa

SEQ ID NO: 626049 - DNA, 25 bp, Rattus norvegicus
tgctgcttttgctactcaccattac

SEQ ID NO: 626050 - DNA, 25 bp, Rattus norvegicus
tgctgcttttgctcggtaccatgaa

SEQ ID NO: 626051 - DNA, 25 bp, Rattus norvegicus
tgctggaaccagatacgactgaagt

SEQ ID NO: 626052 - DNA, 25 bp, Rattus norvegicus
tgctggaaccagttacgactgaagt

SEQ ID NO: 626053 - DNA, 25 bp, Rattus norvegicus
tgctggaagccactctttaactttg

SEQ ID NO: 626054 - DNA, 25 bp, Rattus norvegicus
tgctggaagccagtctttaactttg

SEQ ID NO: 626055 - DNA, 25 bp, Rattus norvegicus
tgctggaagccgcactctgctcact

SEQ ID NO: 626056 - DNA, 25 bp, Rattus norvegicus
tgctggaagccggactctgctcact

SEQ ID NO: 626057 - DNA, 25 bp, Rattus norvegicus
tgctggaagttcagccatccttcat

SEQ ID NO: 626058 - DNA, 25 bp, Rattus norvegicus
tgctggaagttctgccatccttcat

SEQ ID NO: 626059 - DNA, 25 bp, Rattus norvegicus
tgctggacagtcaatgatcatagct

SEQ ID NO: 626060 - DNA, 25 bp, Rattus norvegicus
tgctggacagtctatgatcatagct

SEQ ID NO: 626061 - DNA, 25 bp, Rattus norvegicus
tgctggacatcaaaacacggctgga

SEQ ID NO: 626062 - DNA, 25 bp, Rattus norvegicus
tgctggacatcataacacggctgga

SEQ ID NO: 626063 - DNA, 25 bp, Rattus norvegicus
tgctggacccaaactgtgagaagat

SEQ ID NO: 626064 - DNA, 25 bp, Rattus norvegicus
tgctggacccaatctgtgagaagat

SEQ ID NO: 626065 - DNA, 25 bp, Rattus norvegicus
tgctggacctccctgggaagttcaa

SEQ ID NO: 626066 - DNA, 25 bp, Rattus norvegicus
tgctggacctccgtgggaagttcaa

SEQ ID NO: 626067 - DNA, 25 bp, Rattus norvegicus
tgctggactccaaacacatgtttcc

SEQ ID NO: 626068 - DNA, 25 bp, Rattus norvegicus
tgctggactccatacacatgtttcc

SEQ ID NO: 626069 - DNA, 25 bp, Rattus norvegicus
tgctggactgctatgtgaacaccga

SEQ ID NO: 626070 - DNA, 25 bp, Rattus norvegicus
tgctggactgctttgtgaacaccga

SEQ ID NO: 626071 - DNA, 25 bp, Rattus norvegicus
tgctggactttgatgtggacatgaa

SEQ ID NO: 626072 - DNA, 25 bp, Rattus norvegicus
tgctggactttgttgtggacatgaa

SEQ ID NO: 626073 - DNA, 25 bp, Rattus norvegicus
tgctggagaaccagtcctgtgtggt

SEQ ID NO: 626074 - DNA, 25 bp, Rattus norvegicus
tgctggagaacctgtcctgtgtggt

SEQ ID NO: 626075 - DNA, 25 bp, Rattus norvegicus
tgctggagacctctttgttgacaag

SEQ ID NO: 626076 - DNA, 25 bp, Rattus norvegicus
tgctggagacctgtttgttgacaag

SEQ ID NO: 626077 - DNA, 25 bp, Rattus norvegicus
tgctggagagcaacatggtcttctt

SEQ ID NO: 626078 - DNA, 25 bp, Rattus norvegicus
tgctggagagcatcatggtcttctt

SEQ ID NO: 626079 - DNA, 25 bp, Rattus norvegicus
tgctggagatatcccatgcgtgctg

SEQ ID NO: 626080 - DNA, 25 bp, Rattus norvegicus
tgctggagatatgccatgcgtgctg

SEQ ID NO: 626081 - DNA, 25 bp, Rattus norvegicus
tgctggagatcacttcgggaaattc

SEQ ID NO: 626082 - DNA, 25 bp, Rattus norvegicus
tgctggagatcagttcgggaaattc

SEQ ID NO: 626083 - DNA, 25 bp, Rattus norvegicus
tgctggagcataagactggaccggt

SEQ ID NO: 626084 - DNA, 25 bp, Rattus norvegicus
tgctggagcatatgactggaccggt

SEQ ID NO: 626085 - DNA, 25 bp, Rattus norvegicus
tgctggagcatcctgaccacatcat

SEQ ID NO: 626086 - DNA, 25 bp, Rattus norvegicus
tgctggagcatcgtgaccacatcat

SEQ ID NO: 626087 - DNA, 25 bp, Rattus norvegicus
tgctggagcccaatccatacgaatt

SEQ ID NO: 626088 - DNA, 25 bp, Rattus norvegicus
tgctggagcccattccatacgaatt

SEQ ID NO: 626089 - DNA, 25 bp, Rattus norvegicus
tgctggagcctaatacacatgtgta

SEQ ID NO: 626090 - DNA, 25 bp, Rattus norvegicus
tgctggagcctattacacatgtgta

SEQ ID NO: 626091 - DNA, 25 bp, Rattus norvegicus
tgctggagctcacttgggaccctga

SEQ ID NO: 626092 - DNA, 25 bp, Rattus norvegicus
tgctggagctcagttgggaccctga

SEQ ID NO: 626093 - DNA, 25 bp, Rattus norvegicus
tgctggaggctgagtcaattggccc

SEQ ID NO: 626094 - DNA, 25 bp, Rattus norvegicus
tgctggaggctgtgtcaattggccc

SEQ ID NO: 626095 - DNA, 25 bp, Rattus norvegicus
tgctggaggtccaagttaggccttt

SEQ ID NO: 626096 - DNA, 25 bp, Rattus norvegicus
tgctggaggtcctagttaggccttt

SEQ ID NO: 626097 - DNA, 25 bp, Rattus norvegicus
tgctggaggtgaacaaccgcatcat

SEQ ID NO: 626098 - DNA, 25 bp, Rattus norvegicus
tgctggaggtgatcaaccgcatcat

SEQ ID NO: 626099 - DNA, 25 bp, Rattus norvegicus
tgctggagtccacgctagcgctcga

SEQ ID NO: 626100 - DNA, 25 bp, Rattus norvegicus
tgctggagtccaggctagcgctcga

SEQ ID NO: 626101 - DNA, 25 bp, Rattus norvegicus
tgctggagtcctcgcgaagtttcga

SEQ ID NO: 626102 - DNA, 25 bp, Rattus norvegicus
tgctggagtcctggcgaagtttcga

SEQ ID NO: 626103 - DNA, 25 bp, Rattus norvegicus
tgctggagtgtcatcggtggcctat

SEQ ID NO: 626104 - DNA, 25 bp, Rattus norvegicus
tgctggagtgtcttcggtggcctat

SEQ ID NO: 626105 - DNA, 25 bp, Rattus norvegicus
tgctggatctaacgcttacaccaca

SEQ ID NO: 626106 - DNA, 25 bp, Rattus norvegicus
tgctggatctaaggcttacaccaca

SEQ ID NO: 626107 - DNA, 25 bp, Rattus norvegicus
tgctggattctcaccaacgtagttg

SEQ ID NO: 626108 - DNA, 25 bp, Rattus norvegicus
tgctggattctctccaacgtagttg

SEQ ID NO: 626109 - DNA, 25 bp, Rattus norvegicus
tgctggatttatcggtgggccaaca

SEQ ID NO: 626110 - DNA, 25 bp, Rattus norvegicus
tgctggatttatgggtgggccaaca

SEQ ID NO: 626111 - DNA, 25 bp, Rattus norvegicus
tgctggcaagtgcaagactccgctt

SEQ ID NO: 626112 - DNA, 25 bp, Rattus norvegicus
tgctggcaagtggaagactccgctt

SEQ ID NO: 626113 - DNA, 25 bp, Rattus norvegicus
tgctggcaatgactgaggcctgctt

SEQ ID NO: 626114 - DNA, 25 bp, Rattus norvegicus
tgctggcaatgagtgaggcctgctt

SEQ ID NO: 626115 - DNA, 25 bp, Rattus norvegicus
tgctggcagaaccagttcctggcat

SEQ ID NO: 626116 - DNA, 25 bp, Rattus norvegicus
tgctggcagaacgagttcctggcat

SEQ ID NO: 626117 - DNA, 25 bp, Rattus norvegicus
tgctggcagactccatcaggacact

SEQ ID NO: 626118 - DNA, 25 bp, Rattus norvegicus
tgctggcagactgcatcaggacact

SEQ ID NO: 626119 - DNA, 25 bp, Rattus norvegicus
tgctggccaagcaggtacgcatgga

SEQ ID NO: 626120 - DNA, 25 bp, Rattus norvegicus
tgctggccaagctggtacgcatgga

SEQ ID NO: 626121 - DNA, 25 bp, Rattus norvegicus
tgctggccacagacagatgctatcc

SEQ ID NO: 626122 - DNA, 25 bp, Rattus norvegicus
tgctggccacagtcagatgctatcc

SEQ ID NO: 626123 - DNA, 25 bp, Rattus norvegicus
tgctggccattgctgctgggaacta

SEQ ID NO: 626124 - DNA, 25 bp, Rattus norvegicus
tgctggccattggtgctgggaacta

SEQ ID NO: 626125 - DNA, 25 bp, Rattus norvegicus
tgctggcccagaaggcctgggcata

SEQ ID NO: 626126 - DNA, 25 bp, Rattus norvegicus
tgctggcccagatggcctgggcata

SEQ ID NO: 626127 - DNA, 25 bp, Rattus norvegicus
tgctggcccatgcactatatgcttc

SEQ ID NO: 626128 - DNA, 25 bp, Rattus norvegicus
tgctggcccatggactatatgcttc

SEQ ID NO: 626129 - DNA, 25 bp, Rattus norvegicus
tgctggcccctgatttggtgtgaat

SEQ ID NO: 626130 - DNA, 25 bp, Rattus norvegicus
tgctggcccctgttttggtgtgaat

SEQ ID NO: 626131 - DNA, 25 bp, Rattus norvegicus
tgctggccgaccagaaagtgcagtt

SEQ ID NO: 626132 - DNA, 25 bp, Rattus norvegicus
tgctggccgacctgaaagtgcagtt

SEQ ID NO: 626133 - DNA, 25 bp, Rattus norvegicus
tgctggccgcacatggttacaagaa

SEQ ID NO: 626134 - DNA, 25 bp, Rattus norvegicus
tgctggccgcacttggttacaagaa

SEQ ID NO: 626135 - DNA, 25 bp, Rattus norvegicus
tgctggccgctgcagaaccagatga

SEQ ID NO: 626136 - DNA, 25 bp, Rattus norvegicus
tgctggccgctggagaaccagatga

SEQ ID NO: 626137 - DNA, 25 bp, Rattus norvegicus
tgctggccgtataccatttggactg

SEQ ID NO: 626138 - DNA, 25 bp, Rattus norvegicus
tgctggccgtattccatttggactg

SEQ ID NO: 626139 - DNA, 25 bp, Rattus norvegicus
tgctggcctccaacccacagagtta

SEQ ID NO: 626140 - DNA, 25 bp, Rattus norvegicus
tgctggcctccatcccacagagtta

SEQ ID NO: 626141 - DNA, 25 bp, Rattus norvegicus
tgctggcctcttaacaacccttgaa

SEQ ID NO: 626142 - DNA, 25 bp, Rattus norvegicus
tgctggcctctttacaacccttgaa

SEQ ID NO: 626143 - DNA, 25 bp, Rattus norvegicus
tgctggcctggaaatggaccctgag

SEQ ID NO: 626144 - DNA, 25 bp, Rattus norvegicus
tgctggcctggatatggaccctgag

SEQ ID NO: 626145 - DNA, 25 bp, Rattus norvegicus
tgctggccttaaccttccattttct

SEQ ID NO: 626146 - DNA, 25 bp, Rattus norvegicus
tgctggccttaagcttccattttct

SEQ ID NO: 626147 - DNA, 25 bp, Rattus norvegicus
tgctggccttacaggtgagacgtcg

SEQ ID NO: 626148 - DNA, 25 bp, Rattus norvegicus
tgctggccttactggtgagacgtcg

SEQ ID NO: 626149 - DNA, 25 bp, Rattus norvegicus
tgctggccttggacttcatgtgctt

SEQ ID NO: 626150 - DNA, 25 bp, Rattus norvegicus
tgctggccttggtcttcatgtgctt

SEQ ID NO: 626151 - DNA, 25 bp, Rattus norvegicus
tgctggcctttcatctggaggagaa

SEQ ID NO: 626152 - DNA, 25 bp, Rattus norvegicus
tgctggcctttcatgactttacaat

SEQ ID NO: 626153 - DNA, 25 bp, Rattus norvegicus
tgctggcctttcttctggaggagaa

SEQ ID NO: 626154 - DNA, 25 bp, Rattus norvegicus
tgctggcctttcttgactttacaat

SEQ ID NO: 626155 - DNA, 25 bp, Rattus norvegicus
tgctggcggagtacaatacgggaca

SEQ ID NO: 626156 - DNA, 25 bp, Rattus norvegicus
tgctggcggagttcaatacgggaca

SEQ ID NO: 626157 - DNA, 25 bp, Rattus norvegicus
tgctggcgttgcaccagatcatcct

SEQ ID NO: 626158 - DNA, 25 bp, Rattus norvegicus
tgctggcgttgctccagatcatcct

SEQ ID NO: 626159 - DNA, 25 bp, Rattus norvegicus
tgctggcgtttgagtgtgtgcccac

SEQ ID NO: 626160 - DNA, 25 bp, Rattus norvegicus
tgctggcgtttgtgtgtgtgcccac

SEQ ID NO: 626161 - DNA, 25 bp, Rattus norvegicus
tgctggctactgagtgatcacctac

SEQ ID NO: 626162 - DNA, 25 bp, Rattus norvegicus
tgctggctactgtgtgatcacctac

SEQ ID NO: 626163 - DNA, 25 bp, Rattus norvegicus
tgctggctacttactgcttggcgca

SEQ ID NO: 626164 - DNA, 25 bp, Rattus norvegicus
tgctggctactttctgcttggcgca

SEQ ID NO: 626165 - DNA, 25 bp, Rattus norvegicus
tgctggctcaatccctttgctgaaa

SEQ ID NO: 626166 - DNA, 25 bp, Rattus norvegicus
tgctggctcaatgcctttgctgaaa

SEQ ID NO: 626167 - DNA, 25 bp, Rattus norvegicus
tgctggctcattcgtcaactaacat

SEQ ID NO: 626168 - DNA, 25 bp, Rattus norvegicus
tgctggctcattggtcaactaacat

SEQ ID NO: 626169 - DNA, 25 bp, Rattus norvegicus
tgctggctccacaaaatgtcttaga

SEQ ID NO: 626170 - DNA, 25 bp, Rattus norvegicus
tgctggctccactaaatgtcttaga

SEQ ID NO: 626171 - DNA, 25 bp, Rattus norvegicus
tgctggctctgaaacatgtggaaca

SEQ ID NO: 626172 - DNA, 25 bp, Rattus norvegicus
tgctggctctgaagtggccttggca

SEQ ID NO: 626173 - DNA, 25 bp, Rattus norvegicus
tgctggctctgatacatgtggaaca

SEQ ID NO: 626174 - DNA, 25 bp, Rattus norvegicus
tgctggctctgatgtggccttggca

SEQ ID NO: 626175 - DNA, 25 bp, Rattus norvegicus
tgctggctctgcacaaactgggact

SEQ ID NO: 626176 - DNA, 25 bp, Rattus norvegicus
tgctggctctgctcaaactgggact

SEQ ID NO: 626177 - DNA, 25 bp, Rattus norvegicus
tgctggctgaagctgcccacggcaa

SEQ ID NO: 626178 - DNA, 25 bp, Rattus norvegicus
tgctggctgaaggtgcccacggcaa

SEQ ID NO: 626179 - DNA, 25 bp, Rattus norvegicus
tgctggctgcacacaagctgatgta

SEQ ID NO: 626180 - DNA, 25 bp, Rattus norvegicus
tgctggctgcactcaagctgatgta

SEQ ID NO: 626181 - DNA, 25 bp, Rattus norvegicus
tgctggctgctgagctcggctcccg

SEQ ID NO: 626182 - DNA, 25 bp, Rattus norvegicus
tgctggctgctgtgctcggctcccg

SEQ ID NO: 626183 - DNA, 25 bp, Rattus norvegicus
tgctggctgcttacaaaagcaactt

SEQ ID NO: 626184 - DNA, 25 bp, Rattus norvegicus
tgctggctgctttcaaaagcaactt

SEQ ID NO: 626185 - DNA, 25 bp, Rattus norvegicus
tgctggctggacagctcaagaagga

SEQ ID NO: 626186 - DNA, 25 bp, Rattus norvegicus
tgctggctggactgctcaagaagga

SEQ ID NO: 626187 - DNA, 25 bp, Rattus norvegicus
tgctggctggtcaactgaacacatt

SEQ ID NO: 626188 - DNA, 25 bp, Rattus norvegicus
tgctggctggtctactgaacacatt

SEQ ID NO: 626189 - DNA, 25 bp, Rattus norvegicus
tgctggctggtgaaagcccgcacag

SEQ ID NO: 626190 - DNA, 25 bp, Rattus norvegicus
tgctggctggtgtaagcccgcacag

SEQ ID NO: 626191 - DNA, 25 bp, Rattus norvegicus
tgctggctgtccattattctcattt

SEQ ID NO: 626192 - DNA, 25 bp, Rattus norvegicus
tgctggctgtcctttattctcattt

SEQ ID NO: 626193 - DNA, 25 bp, Rattus norvegicus
tgctggctgtgcacactgccatgtt

SEQ ID NO: 626194 - DNA, 25 bp, Rattus norvegicus
tgctggctgtgctcactgccatgtt

SEQ ID NO: 626195 - DNA, 25 bp, Rattus norvegicus
tgctggctgttcagaagtattcctc

SEQ ID NO: 626196 - DNA, 25 bp, Rattus norvegicus
tgctggctgttctgaagtattcctc

SEQ ID NO: 626197 - DNA, 25 bp, Rattus norvegicus
tgctggcttattatattggtctcaa

SEQ ID NO: 626198 - DNA, 25 bp, Rattus norvegicus
tgctggcttattttattggtctcaa

SEQ ID NO: 626199 - DNA, 25 bp, Rattus norvegicus
tgctggcttctcattattcattccc

SEQ ID NO: 626200 - DNA, 25 bp, Rattus norvegicus
tgctggcttctctttattcattccc

SEQ ID NO: 626201 - DNA, 25 bp, Rattus norvegicus
tgctggcttgctatgtgatgtggaa

SEQ ID NO: 626202 - DNA, 25 bp, Rattus norvegicus
tgctggcttgctttgtgatgtggaa

SEQ ID NO: 626203 - DNA, 25 bp, Rattus norvegicus
tgctggcttgtaaggcatctgccat

SEQ ID NO: 626204 - DNA, 25 bp, Rattus norvegicus
tgctggcttgtatggcatctgccat

SEQ ID NO: 626205 - DNA, 25 bp, Rattus norvegicus
tgctggctttgaagtccacaaggac

SEQ ID NO: 626206 - DNA, 25 bp, Rattus norvegicus
tgctggctttgatgtccacaaggac

SEQ ID NO: 626207 - DNA, 25 bp, Rattus norvegicus
tgctggctttgcaagaattggatac

SEQ ID NO: 626208 - DNA, 25 bp, Rattus norvegicus
tgctggctttgctagaattggatac

SEQ ID NO: 626209 - DNA, 25 bp, Rattus norvegicus
tgctgggaacccagctgcaggagta

SEQ ID NO: 626210 - DNA, 25 bp, Rattus norvegicus
tgctgggaaccctgctgcaggagta

SEQ ID NO: 626211 - DNA, 25 bp, Rattus norvegicus
tgctgggaagcaactgtacacatac

SEQ ID NO: 626212 - DNA, 25 bp, Rattus norvegicus
tgctgggaagcatctgtacacatac

SEQ ID NO: 626213 - DNA, 25 bp, Rattus norvegicus
tgctgggactcaaacaaggtccttt

SEQ ID NO: 626214 - DNA, 25 bp, Rattus norvegicus
tgctgggactcatacaaggtccttt

SEQ ID NO: 626215 - DNA, 25 bp, Rattus norvegicus
tgctgggagagaacccctggcttgc

SEQ ID NO: 626216 - DNA, 25 bp, Rattus norvegicus
tgctgggagagatcccctggcttgc

SEQ ID NO: 626217 - DNA, 25 bp, Rattus norvegicus
tgctgggagctcactggccaggtct

SEQ ID NO: 626218 - DNA, 25 bp, Rattus norvegicus
tgctgggagctctctggccaggtct

SEQ ID NO: 626219 - DNA, 25 bp, Rattus norvegicus
tgctgggatcaaagtattttaaaac

SEQ ID NO: 626220 - DNA, 25 bp, Rattus norvegicus
tgctgggatcaatgtattttaaaac

SEQ ID NO: 626221 - DNA, 25 bp, Rattus norvegicus
tgctgggatcttaggcctgtggccc

SEQ ID NO: 626222 - DNA, 25 bp, Rattus norvegicus
tgctgggatctttggcctgtggccc

SEQ ID NO: 626223 - DNA, 25 bp, Rattus norvegicus
tgctgggattaacagacccggctca

SEQ ID NO: 626224 - DNA, 25 bp, Rattus norvegicus
tgctgggattaagagacccggctca

SEQ ID NO: 626225 - DNA, 25 bp, Rattus norvegicus
tgctgggattagacatctgacctgt

SEQ ID NO: 626226 - DNA, 25 bp, Rattus norvegicus
tgctgggattagtcatctgacctgt

SEQ ID NO: 626227 - DNA, 25 bp, Rattus norvegicus
tgctgggattcgaggcctacttcac

SEQ ID NO: 626228 - DNA, 25 bp, Rattus norvegicus
tgctgggattcgtggcctacttcac

SEQ ID NO: 626229 - DNA, 25 bp, Rattus norvegicus
tgctgggcaaagagacgatcgcgca

SEQ ID NO: 626230 - DNA, 25 bp, Rattus norvegicus
tgctgggcaaagtgacgatcgcgca

SEQ ID NO: 626231 - DNA, 25 bp, Rattus norvegicus
tgctgggcaagacatctgccatctt

SEQ ID NO: 626232 - DNA, 25 bp, Rattus norvegicus
tgctgggcaagagatctgccatctt

SEQ ID NO: 626233 - DNA, 25 bp, Rattus norvegicus
tgctgggcactcacctaatgattta

SEQ ID NO: 626234 - DNA, 25 bp, Rattus norvegicus
tgctgggcactctcctaatgattta

SEQ ID NO: 626235 - DNA, 25 bp, Rattus norvegicus
tgctgggcatgtacacctggatcga

SEQ ID NO: 626236 - DNA, 25 bp, Rattus norvegicus
tgctgggcatgttcacctggatcga

SEQ ID NO: 626237 - DNA, 25 bp, Rattus norvegicus
tgctgggcattgacaggactggacc

SEQ ID NO: 626238 - DNA, 25 bp, Rattus norvegicus
tgctgggcattgtcaggactggacc

SEQ ID NO: 626239 - DNA, 25 bp, Rattus norvegicus
tgctgggccatacctgctttggaga

SEQ ID NO: 626240 - DNA, 25 bp, Rattus norvegicus
tgctgggccatagctgctttggaga

SEQ ID NO: 626241 - DNA, 25 bp, Rattus norvegicus
tgctgggcccagatgtccaggaaca

SEQ ID NO: 626242 - DNA, 25 bp, Rattus norvegicus
tgctgggcccagttgtccaggaaca

SEQ ID NO: 626243 - DNA, 25 bp, Rattus norvegicus
tgctgggcccgaattgcagaaccat

SEQ ID NO: 626244 - DNA, 25 bp, Rattus norvegicus
tgctgggcccgatttgcagaaccat

SEQ ID NO: 626245 - DNA, 25 bp, Rattus norvegicus
tgctgggcccttaggctgcaaatga

SEQ ID NO: 626246 - DNA, 25 bp, Rattus norvegicus
tgctgggccctttggctgcaaatga

SEQ ID NO: 626247 - DNA, 25 bp, Rattus norvegicus
tgctgggcctgtacctagtgaaggt

SEQ ID NO: 626248 - DNA, 25 bp, Rattus norvegicus
tgctgggcctgttcctagtgaaggt

SEQ ID NO: 626249 - DNA, 25 bp, Rattus norvegicus
tgctgggctccacttctgaagaagg

SEQ ID NO: 626250 - DNA, 25 bp, Rattus norvegicus
tgctgggctccagttctgaagaagg

SEQ ID NO: 626251 - DNA, 25 bp, Rattus norvegicus
tgctgggctctaagcagggctacat

SEQ ID NO: 626252 - DNA, 25 bp, Rattus norvegicus
tgctgggctctatgcagggctacat

SEQ ID NO: 626253 - DNA, 25 bp, Rattus norvegicus
tgctgggctctgcaatcacatggtc

SEQ ID NO: 626254 - DNA, 25 bp, Rattus norvegicus
tgctgggctctggaatcacatggtc

SEQ ID NO: 626255 - DNA, 25 bp, Rattus norvegicus
tgctgggctgacagctagaccactt

SEQ ID NO: 626256 - DNA, 25 bp, Rattus norvegicus
tgctgggctgactgctagaccactt

SEQ ID NO: 626257 - DNA, 25 bp, Rattus norvegicus
tgctgggctgatagtgaggcaccaa

SEQ ID NO: 626258 - DNA, 25 bp, Rattus norvegicus
tgctgggctgattgtgaggcaccaa

SEQ ID NO: 626259 - DNA, 25 bp, Rattus norvegicus
tgctgggctggaattcactacgaag

SEQ ID NO: 626260 - DNA, 25 bp, Rattus norvegicus
tgctgggctggatttcactacgaag

SEQ ID NO: 626261 - DNA, 25 bp, Rattus norvegicus
tgctgggctttgacatcgtcctgag

SEQ ID NO: 626262 - DNA, 25 bp, Rattus norvegicus
tgctgggctttgctacttcaattac

SEQ ID NO: 626263 - DNA, 25 bp, Rattus norvegicus
tgctgggctttggtacttcaattac

SEQ ID NO: 626264 - DNA, 25 bp, Rattus norvegicus
tgctgggctttgtcatcgtcctgag

SEQ ID NO: 626265 - DNA, 25 bp, Rattus norvegicus
tgctgggtcccacggtacttcagaa

SEQ ID NO: 626266 - DNA, 25 bp, Rattus norvegicus
tgctgggtcccagggtacttcagaa

SEQ ID NO: 626267 - DNA, 25 bp, Rattus norvegicus
tgctgggtctccatgcagaggacat

SEQ ID NO: 626268 - DNA, 25 bp, Rattus norvegicus
tgctgggtctccttgcagaggacat

SEQ ID NO: 626269 - DNA, 25 bp, Rattus norvegicus
tgctgggtcttacttttctttaaga

SEQ ID NO: 626270 - DNA, 25 bp, Rattus norvegicus
tgctgggtcttagttttctttaaga

SEQ ID NO: 626271 - DNA, 25 bp, Rattus norvegicus
tgctgggtgagcctttcctagaaac

SEQ ID NO: 626272 - DNA, 25 bp, Rattus norvegicus
tgctgggtgagcgtttcctagaaac

SEQ ID NO: 626273 - DNA, 25 bp, Rattus norvegicus
tgctgggtgcgcagctgttcgtcaa

SEQ ID NO: 626274 - DNA, 25 bp, Rattus norvegicus
tgctgggtgcgctgctgttcgtcaa

SEQ ID NO: 626275 - DNA, 25 bp, Rattus norvegicus
tgctgggtgctgatctcccttgcaa

SEQ ID NO: 626276 - DNA, 25 bp, Rattus norvegicus
tgctgggtgctgttctcccttgcaa

SEQ ID NO: 626277 - DNA, 25 bp, Rattus norvegicus
tgctgggtggcgactttgctaaaat

SEQ ID NO: 626278 - DNA, 25 bp, Rattus norvegicus
tgctgggtggcgtctttgctaaaat

SEQ ID NO: 626279 - DNA, 25 bp, Rattus norvegicus
tgctgggttgctcccatccttgtaa

SEQ ID NO: 626280 - DNA, 25 bp, Rattus norvegicus
tgctgggttgctgccatccttgtaa

SEQ ID NO: 626281 - DNA, 25 bp, Rattus norvegicus
tgctgggttgggactttaaaacata

SEQ ID NO: 626282 - DNA, 25 bp, Rattus norvegicus
tgctgggttgggtctttaaaacata

SEQ ID NO: 626283 - DNA, 25 bp, Rattus norvegicus
tgctgggtttctactgctgcttcat

SEQ ID NO: 626284 - DNA, 25 bp, Rattus norvegicus
tgctgggtttcttctgctgcttcat

SEQ ID NO: 626285 - DNA, 25 bp, Rattus norvegicus
tgctgggtttggatctcctatatat

SEQ ID NO: 626286 - DNA, 25 bp, Rattus norvegicus
tgctgggtttggttctcctatatat

SEQ ID NO: 626287 - DNA, 25 bp, Rattus norvegicus
tgctggtaaaccaagtctcaaattt

SEQ ID NO: 626288 - DNA, 25 bp, Rattus norvegicus
tgctggtaaacctagtctcaaattt

SEQ ID NO: 626289 - DNA, 25 bp, Rattus norvegicus
tgctggtaagatatcttctgcccac

SEQ ID NO: 626290 - DNA, 25 bp, Rattus norvegicus
tgctggtaagatttcttctgcccac

SEQ ID NO: 626291 - DNA, 25 bp, Rattus norvegicus
tgctggtattccataacgtctctaa

SEQ ID NO: 626292 - DNA, 25 bp, Rattus norvegicus
tgctggtattccttaacgtctctaa

SEQ ID NO: 626293 - DNA, 25 bp, Rattus norvegicus
tgctggtcacggacactggctgtga

SEQ ID NO: 626294 - DNA, 25 bp, Rattus norvegicus
tgctggtcacggtcactggctgtga

SEQ ID NO: 626295 - DNA, 25 bp, Rattus norvegicus
tgctggtccagaacgcagcctgcaa

SEQ ID NO: 626296 - DNA, 25 bp, Rattus norvegicus
tgctggtccagacgtagcccttggc

SEQ ID NO: 626297 - DNA, 25 bp, Rattus norvegicus
tgctggtccagaggtagcccttggc

SEQ ID NO: 626298 - DNA, 25 bp, Rattus norvegicus
tgctggtccagatcgcagcctgcaa

SEQ ID NO: 626299 - DNA, 25 bp, Rattus norvegicus
tgctggtccagtcccataccttcta

SEQ ID NO: 626300 - DNA, 25 bp, Rattus norvegicus
tgctggtccagtgccataccttcta

SEQ ID NO: 626301 - DNA, 25 bp, Rattus norvegicus
tgctggtccccacgaactcaggaag

SEQ ID NO: 626302 - DNA, 25 bp, Rattus norvegicus
tgctggtccccaggaactcaggaag

SEQ ID NO: 626303 - DNA, 25 bp, Rattus norvegicus
tgctggtcccttacattcgcctgga

SEQ ID NO: 626304 - DNA, 25 bp, Rattus norvegicus
tgctggtccctttcattcgcctgga

SEQ ID NO: 626305 - DNA, 25 bp, Rattus norvegicus
tgctggtcctggcaacagatggctt

SEQ ID NO: 626306 - DNA, 25 bp, Rattus norvegicus
tgctggtcctgggaacagatggctt

SEQ ID NO: 626307 - DNA, 25 bp, Rattus norvegicus
tgctggtcctgtcgcacatccggaa

SEQ ID NO: 626308 - DNA, 25 bp, Rattus norvegicus
tgctggtcctgtggcacatccggaa

SEQ ID NO: 626309 - DNA, 25 bp, Rattus norvegicus
tgctggtctatgacttcagagctgt

SEQ ID NO: 626310 - DNA, 25 bp, Rattus norvegicus
tgctggtctatgtcttcagagctgt

SEQ ID NO: 626311 - DNA, 25 bp, Rattus norvegicus
tgctggtctccaatctgctgctcag

SEQ ID NO: 626312 - DNA, 25 bp, Rattus norvegicus
tgctggtctccattctgctgctcag

SEQ ID NO: 626313 - DNA, 25 bp, Rattus norvegicus
tgctggtctcctcagcgatcagagc

SEQ ID NO: 626314 - DNA, 25 bp, Rattus norvegicus
tgctggtctcctgagcgatcagagc

SEQ ID NO: 626315 - DNA, 25 bp, Rattus norvegicus
tgctggtcttacctctcctttgtaa

SEQ ID NO: 626316 - DNA, 25 bp, Rattus norvegicus
tgctggtcttacgtctcctttgtaa

SEQ ID NO: 626317 - DNA, 25 bp, Rattus norvegicus
tgctggtgagctccttgcacatttg

SEQ ID NO: 626318 - DNA, 25 bp, Rattus norvegicus
tgctggtgagctgcttgcacatttg

SEQ ID NO: 626319 - DNA, 25 bp, Rattus norvegicus
tgctggtgagtcatgcggtgtttcc

SEQ ID NO: 626320 - DNA, 25 bp, Rattus norvegicus
tgctggtgagtcttgcggtgtttcc

SEQ ID NO: 626321 - DNA, 25 bp, Rattus norvegicus
tgctggtgatagaagacgtggccct

SEQ ID NO: 626322 - DNA, 25 bp, Rattus norvegicus
tgctggtgatagtagacgtggccct

SEQ ID NO: 626323 - DNA, 25 bp, Rattus norvegicus
tgctggtgattgatgtggtcctctt

SEQ ID NO: 626324 - DNA, 25 bp, Rattus norvegicus
tgctggtgattgttgtggtcctctt

SEQ ID NO: 626325 - DNA, 25 bp, Rattus norvegicus
tgctggtgcccgacaaggtgcttaa

SEQ ID NO: 626326 - DNA, 25 bp, Rattus norvegicus
tgctggtgcccgtcaaggtgcttaa

SEQ ID NO: 626327 - DNA, 25 bp, Rattus norvegicus
tgctggtgcctaccatacacggaaa

SEQ ID NO: 626328 - DNA, 25 bp, Rattus norvegicus
tgctggtgcctagcatacacggaaa

SEQ ID NO: 626329 - DNA, 25 bp, Rattus norvegicus
tgctggtgccttagcccaaggagga

SEQ ID NO: 626330 - DNA, 25 bp, Rattus norvegicus
tgctggtgcctttgcccaaggagga

SEQ ID NO: 626331 - DNA, 25 bp, Rattus norvegicus
tgctggtgctctacctgggaccctt

SEQ ID NO: 626332 - DNA, 25 bp, Rattus norvegicus
tgctggtgctcttcctgggaccctt

SEQ ID NO: 626333 - DNA, 25 bp, Rattus norvegicus
tgctggtgctttctacgacaaatcc

SEQ ID NO: 626334 - DNA, 25 bp, Rattus norvegicus
tgctggtgctttgtacgacaaatcc

SEQ ID NO: 626335 - DNA, 25 bp, Rattus norvegicus
tgctggtggcacagtgtatgcacaa

SEQ ID NO: 626336 - DNA, 25 bp, Rattus norvegicus
tgctggtggcactgtgtatgcacaa

SEQ ID NO: 626337 - DNA, 25 bp, Rattus norvegicus
tgctggtggtcgaccctgagaccga

SEQ ID NO: 626338 - DNA, 25 bp, Rattus norvegicus
tgctggtggtcgtccctgagaccga

SEQ ID NO: 626339 - DNA, 25 bp, Rattus norvegicus
tgctggtgtacgctcagggtattct

SEQ ID NO: 626340 - DNA, 25 bp, Rattus norvegicus
tgctggtgtacggtcagggtattct

SEQ ID NO: 626341 - DNA, 25 bp, Rattus norvegicus
tgctggtgtgtaatgtgtatatgcc

SEQ ID NO: 626342 - DNA, 25 bp, Rattus norvegicus
tgctggtgtgtattgtgtatatgcc

SEQ ID NO: 626343 - DNA, 25 bp, Rattus norvegicus
tgctggtgttgcaggcgtttgcctt

SEQ ID NO: 626344 - DNA, 25 bp, Rattus norvegicus
tgctggtgttgctggcgtttgcctt

SEQ ID NO: 626345 - DNA, 25 bp, Rattus norvegicus
tgctggttaaacagacgaggcagac

SEQ ID NO: 626346 - DNA, 25 bp, Rattus norvegicus
tgctggttaaactgacgaggcagac

SEQ ID NO: 626347 - DNA, 25 bp, Rattus norvegicus
tgctggttacatcctcctctgtgct

SEQ ID NO: 626348 - DNA, 25 bp, Rattus norvegicus
tgctggttacatgctcctctgtgct

SEQ ID NO: 626349 - DNA, 25 bp, Rattus norvegicus
tgctggttactcacgtatggtcaaa

SEQ ID NO: 626350 - DNA, 25 bp, Rattus norvegicus
tgctggttactctcgtatggtcaaa

SEQ ID NO: 626351 - DNA, 25 bp, Rattus norvegicus
tgctggttcagaccctctttacaat

SEQ ID NO: 626352 - DNA, 25 bp, Rattus norvegicus
tgctggttcagagcctctttacaat

SEQ ID NO: 626353 - DNA, 25 bp, Rattus norvegicus
tgctggttcatcactgttgtcattt

SEQ ID NO: 626354 - DNA, 25 bp, Rattus norvegicus
tgctggttcatctctgttgtcattt

SEQ ID NO: 626355 - DNA, 25 bp, Rattus norvegicus
tgctggttcccgagaccgttttgtt

SEQ ID NO: 626356 - DNA, 25 bp, Rattus norvegicus
tgctggttcccgtgaccgttttgtt

SEQ ID NO: 626357 - DNA, 25 bp, Rattus norvegicus
tgctggttctttattactcaagccc

SEQ ID NO: 626358 - DNA, 25 bp, Rattus norvegicus
tgctggttcttttttactcaagccc

SEQ ID NO: 626359 - DNA, 25 bp, Rattus norvegicus
tgctggttgacacttgcacaattta

SEQ ID NO: 626360 - DNA, 25 bp, Rattus norvegicus
tgctggttgacagttgcacaattta

SEQ ID NO: 626361 - DNA, 25 bp, Rattus norvegicus
tgctggttgcttatgtcactttggt

SEQ ID NO: 626362 - DNA, 25 bp, Rattus norvegicus
tgctggttgcttttgtcactttggt

SEQ ID NO: 626363 - DNA, 25 bp, Rattus norvegicus
tgctggtttaccacagaacgttgct

SEQ ID NO: 626364 - DNA, 25 bp, Rattus norvegicus
tgctggtttacctcagaacgttgct

SEQ ID NO: 626365 - DNA, 25 bp, Rattus norvegicus
tgctggtttcagatgagttcttcat

SEQ ID NO: 626366 - DNA, 25 bp, Rattus norvegicus
tgctggtttcagttgagttcttcat

SEQ ID NO: 626367 - DNA, 25 bp, Rattus norvegicus
tgctggtttcgtaaaggaggccttt

SEQ ID NO: 626368 - DNA, 25 bp, Rattus norvegicus
tgctggtttcgttaaggaggccttt

SEQ ID NO: 626369 - DNA, 25 bp, Rattus norvegicus
tgctggtttgcacattgcctctgta

SEQ ID NO: 626370 - DNA, 25 bp, Rattus norvegicus
tgctggtttgcagattgcctctgta

SEQ ID NO: 626371 - DNA, 25 bp, Rattus norvegicus
tgctggttttggatttaccttcgct

SEQ ID NO: 626372 - DNA, 25 bp, Rattus norvegicus
tgctggttttggttttaccttcgct

SEQ ID NO: 626373 - DNA, 25 bp, Rattus norvegicus
tgctgtaacattaactcctgagtct

SEQ ID NO: 626374 - DNA, 25 bp, Rattus norvegicus
tgctgtaacatttactcctgagtct

SEQ ID NO: 626375 - DNA, 25 bp, Rattus norvegicus
tgctgtaacctcatctacttctgat

SEQ ID NO: 626376 - DNA, 25 bp, Rattus norvegicus
tgctgtaacctcttctacttctgat

SEQ ID NO: 626377 - DNA, 25 bp, Rattus norvegicus
tgctgtaagagcatcagtcacatct

SEQ ID NO: 626378 - DNA, 25 bp, Rattus norvegicus
tgctgtaagagcttcagtcacatct

SEQ ID NO: 626379 - DNA, 25 bp, Rattus norvegicus
tgctgtaagtatctgagcccttcca

SEQ ID NO: 626380 - DNA, 25 bp, Rattus norvegicus
tgctgtaagtatgtgagcccttcca

SEQ ID NO: 626381 - DNA, 25 bp, Rattus norvegicus
tgctgtacaagcaatcctgttaaac

SEQ ID NO: 626382 - DNA, 25 bp, Rattus norvegicus
tgctgtacaagctatcctgttaaac

SEQ ID NO: 626383 - DNA, 25 bp, Rattus norvegicus
tgctgtacaggtaaagtcctcccca

SEQ ID NO: 626384 - DNA, 25 bp, Rattus norvegicus
tgctgtacaggttaagtcctcccca

SEQ ID NO: 626385 - DNA, 25 bp, Rattus norvegicus
tgctgtaccaatcagaaggcgctgt

SEQ ID NO: 626386 - DNA, 25 bp, Rattus norvegicus
tgctgtaccaatgagaaggcgctgt

SEQ ID NO: 626387 - DNA, 25 bp, Rattus norvegicus
tgctgtaccgtactcattgtttttt

SEQ ID NO: 626388 - DNA, 25 bp, Rattus norvegicus
tgctgtaccgtagtcattgtttttt

SEQ ID NO: 626389 - DNA, 25 bp, Rattus norvegicus
tgctgtaccgtgatcaacaatcgga

SEQ ID NO: 626390 - DNA, 25 bp, Rattus norvegicus
tgctgtaccgtgttcaacaatcgga

SEQ ID NO: 626391 - DNA, 25 bp, Rattus norvegicus
tgctgtacctcccactatcggataa

SEQ ID NO: 626392 - DNA, 25 bp, Rattus norvegicus
tgctgtacctccgactatcggataa

SEQ ID NO: 626393 - DNA, 25 bp, Rattus norvegicus
tgctgtaccttgactcctggagata

SEQ ID NO: 626394 - DNA, 25 bp, Rattus norvegicus
tgctgtaccttgtctcctggagata

SEQ ID NO: 626395 - DNA, 25 bp, Rattus norvegicus
tgctgtactgttaactttcttcccg

SEQ ID NO: 626396 - DNA, 25 bp, Rattus norvegicus
tgctgtactgtttactttcttcccg

SEQ ID NO: 626397 - DNA, 25 bp, Rattus norvegicus
tgctgtacttgtctcatgcgtgata

SEQ ID NO: 626398 - DNA, 25 bp, Rattus norvegicus
tgctgtacttgtgtcatgcgtgata

SEQ ID NO: 626399 - DNA, 25 bp, Rattus norvegicus
tgctgtagaagcacgggcttcttct

SEQ ID NO: 626400 - DNA, 25 bp, Rattus norvegicus
tgctgtagaagctcgggcttcttct

SEQ ID NO: 626401 - DNA, 25 bp, Rattus norvegicus
tgctgtagaataaagaactccccat

SEQ ID NO: 626402 - DNA, 25 bp, Rattus norvegicus
tgctgtagaatatagaactccccat

SEQ ID NO: 626403 - DNA, 25 bp, Rattus norvegicus
tgctgtagagcacgcgatgtttctg

SEQ ID NO: 626404 - DNA, 25 bp, Rattus norvegicus
tgctgtagagcaggcgatgtttctg

SEQ ID NO: 626405 - DNA, 25 bp, Rattus norvegicus
tgctgtagcatgcttaaagttctct

SEQ ID NO: 626406 - DNA, 25 bp, Rattus norvegicus
tgctgtagcatggttaaagttctct

SEQ ID NO: 626407 - DNA, 25 bp, Rattus norvegicus
tgctgtagccaaatgcatcttctaa

SEQ ID NO: 626408 - DNA, 25 bp, Rattus norvegicus
tgctgtagccaattgcatcttctaa

SEQ ID NO: 626409 - DNA, 25 bp, Rattus norvegicus
tgctgtaggaagcattccacctaga

SEQ ID NO: 626410 - DNA, 25 bp, Rattus norvegicus
tgctgtaggaaggattccacctaga

SEQ ID NO: 626411 - DNA, 25 bp, Rattus norvegicus
tgctgtataagcacgagggcctata

SEQ ID NO: 626412 - DNA, 25 bp, Rattus norvegicus
tgctgtataagctcgagggcctata

SEQ ID NO: 626413 - DNA, 25 bp, Rattus norvegicus
tgctgtatacatctgtctgtgcata

SEQ ID NO: 626414 - DNA, 25 bp, Rattus norvegicus
tgctgtatacatgtgtctgtgcata

SEQ ID NO: 626415 - DNA, 25 bp, Rattus norvegicus
tgctgtatctgtaactcttctactt

SEQ ID NO: 626416 - DNA, 25 bp, Rattus norvegicus
tgctgtatctgttactcttctactt

SEQ ID NO: 626417 - DNA, 25 bp, Rattus norvegicus
tgctgtatgagcactcaccaatgat

SEQ ID NO: 626418 - DNA, 25 bp, Rattus norvegicus
tgctgtatgagctctcaccaatgat

SEQ ID NO: 626419 - DNA, 25 bp, Rattus norvegicus
tgctgtattccaattgctgatttat

SEQ ID NO: 626420 - DNA, 25 bp, Rattus norvegicus
tgctgtattccatttgctgatttat

SEQ ID NO: 626421 - DNA, 25 bp, Rattus norvegicus
tgctgtcaaggcagaacccctggtc

SEQ ID NO: 626422 - DNA, 25 bp, Rattus norvegicus
tgctgtcaaggctgaacccctggtc

SEQ ID NO: 626423 - DNA, 25 bp, Rattus norvegicus
tgctgtcaatatataacccgcctgc

SEQ ID NO: 626424 - DNA, 25 bp, Rattus norvegicus
tgctgtcaatatttaacccgcctgc

SEQ ID NO: 626425 - DNA, 25 bp, Rattus norvegicus
tgctgtcaccatacttaatcacgtc

SEQ ID NO: 626426 - DNA, 25 bp, Rattus norvegicus
tgctgtcaccattcttaatcacgtc

SEQ ID NO: 626427 - DNA, 25 bp, Rattus norvegicus
tgctgtcacctgaacactgaattgg

SEQ ID NO: 626428 - DNA, 25 bp, Rattus norvegicus
tgctgtcacctgtacactgaattgg

SEQ ID NO: 626429 - DNA, 25 bp, Rattus norvegicus
tgctgtcacttgaaccatattcctc

SEQ ID NO: 626430 - DNA, 25 bp, Rattus norvegicus
tgctgtcacttgtaccatattcctc

SEQ ID NO: 626431 - DNA, 25 bp, Rattus norvegicus
tgctgtcagaggatgcccagggtat

SEQ ID NO: 626432 - DNA, 25 bp, Rattus norvegicus
tgctgtcagaggttgcccagggtat

SEQ ID NO: 626433 - DNA, 25 bp, Rattus norvegicus
tgctgtcagcaaaatcctcattgct

SEQ ID NO: 626434 - DNA, 25 bp, Rattus norvegicus
tgctgtcagcaatatcctcattgct

SEQ ID NO: 626435 - DNA, 25 bp, Rattus norvegicus
tgctgtcagcccagctgctgccaga

SEQ ID NO: 626436 - DNA, 25 bp, Rattus norvegicus
tgctgtcagccccagtatttattat

SEQ ID NO: 626437 - DNA, 25 bp, Rattus norvegicus
tgctgtcagcccgagtatttattat

SEQ ID NO: 626438 - DNA, 25 bp, Rattus norvegicus
tgctgtcagccctgctgctgccaga

SEQ ID NO: 626439 - DNA, 25 bp, Rattus norvegicus
tgctgtcagctcacagaggcatgct

SEQ ID NO: 626440 - DNA, 25 bp, Rattus norvegicus
tgctgtcagctctcagaggcatgct

SEQ ID NO: 626441 - DNA, 25 bp, Rattus norvegicus
tgctgtcagtgactccacacaaagg

SEQ ID NO: 626442 - DNA, 25 bp, Rattus norvegicus
tgctgtcagtgagtccacacaaagg

SEQ ID NO: 626443 - DNA, 25 bp, Rattus norvegicus
tgctgtcagttgaccttagtgttaa

SEQ ID NO: 626444 - DNA, 25 bp, Rattus norvegicus
tgctgtcagttgtccttagtgttaa

SEQ ID NO: 626445 - DNA, 25 bp, Rattus norvegicus
tgctgtcatccaacatcacataagt

SEQ ID NO: 626446 - DNA, 25 bp, Rattus norvegicus
tgctgtcatccatcatcacataagt

SEQ ID NO: 626447 - DNA, 25 bp, Rattus norvegicus
tgctgtcatggtatgcaactgttga

SEQ ID NO: 626448 - DNA, 25 bp, Rattus norvegicus
tgctgtcatggtttgcaactgttga

SEQ ID NO: 626449 - DNA, 25 bp, Rattus norvegicus
tgctgtcattgaccctcttgttctt

SEQ ID NO: 626450 - DNA, 25 bp, Rattus norvegicus
tgctgtcattgagcctcttgttctt

SEQ ID NO: 626451 - DNA, 25 bp, Rattus norvegicus
tgctgtccaaacaaaactctcctgg

SEQ ID NO: 626452 - DNA, 25 bp, Rattus norvegicus
tgctgtccaaactaaactctcctgg

SEQ ID NO: 626453 - DNA, 25 bp, Rattus norvegicus
tgctgtccaacacaggttccttcta

SEQ ID NO: 626454 - DNA, 25 bp, Rattus norvegicus
tgctgtccaacagaggttccttcta

SEQ ID NO: 626455 - DNA, 25 bp, Rattus norvegicus
tgctgtccacatagccagccgtgaa

SEQ ID NO: 626456 - DNA, 25 bp, Rattus norvegicus
tgctgtccacattgccagccgtgaa

SEQ ID NO: 626457 - DNA, 25 bp, Rattus norvegicus
tgctgtccactaccttttgtaagag

SEQ ID NO: 626458 - DNA, 25 bp, Rattus norvegicus
tgctgtccactagcttttgtaagag

SEQ ID NO: 626459 - DNA, 25 bp, Rattus norvegicus
tgctgtccagctaccttgtttttga

SEQ ID NO: 626460 - DNA, 25 bp, Rattus norvegicus
tgctgtccagcttccttgtttttga

SEQ ID NO: 626461 - DNA, 25 bp, Rattus norvegicus
tgctgtcccaccattggatggtata

SEQ ID NO: 626462 - DNA, 25 bp, Rattus norvegicus
tgctgtcccacctttggatggtata

SEQ ID NO: 626463 - DNA, 25 bp, Rattus norvegicus
tgctgtcccacgaattagcatccaa

SEQ ID NO: 626464 - DNA, 25 bp, Rattus norvegicus
tgctgtcccacgtattagcatccaa

SEQ ID NO: 626465 - DNA, 25 bp, Rattus norvegicus
tgctgtcccgagcaacacagaccat

SEQ ID NO: 626466 - DNA, 25 bp, Rattus norvegicus
tgctgtcccgaggaacacagaccat

SEQ ID NO: 626467 - DNA, 25 bp, Rattus norvegicus
tgctgtcccgtgaagtgatttggtg

SEQ ID NO: 626468 - DNA, 25 bp, Rattus norvegicus
tgctgtcccgtgctattgctgagtt

SEQ ID NO: 626469 - DNA, 25 bp, Rattus norvegicus
tgctgtcccgtggtattgctgagtt

SEQ ID NO: 626470 - DNA, 25 bp, Rattus norvegicus
tgctgtcccgtgtagtgatttggtg

SEQ ID NO: 626471 - DNA, 25 bp, Rattus norvegicus
tgctgtcccgttatttgtaaatcaa

SEQ ID NO: 626472 - DNA, 25 bp, Rattus norvegicus
tgctgtcccgttttttgtaaatcaa

SEQ ID NO: 626473 - DNA, 25 bp, Rattus norvegicus
tgctgtccctaaccatagaggccag

SEQ ID NO: 626474 - DNA, 25 bp, Rattus norvegicus
tgctgtccctaagcatagaggccag

SEQ ID NO: 626475 - DNA, 25 bp, Rattus norvegicus
tgctgtcccttcagtgacagagcat

SEQ ID NO: 626476 - DNA, 25 bp, Rattus norvegicus
tgctgtcccttctgtgacagagcat

SEQ ID NO: 626477 - DNA, 25 bp, Rattus norvegicus
tgctgtcctagcaggcgatgagaat

SEQ ID NO: 626478 - DNA, 25 bp, Rattus norvegicus
tgctgtcctagctggcgatgagaat

SEQ ID NO: 626479 - DNA, 25 bp, Rattus norvegicus
tgctgtcctatcatcctagctggag

SEQ ID NO: 626480 - DNA, 25 bp, Rattus norvegicus
tgctgtcctatcttcctagctggag

SEQ ID NO: 626481 - DNA, 25 bp, Rattus norvegicus
tgctgtcctcatagtggccaagaag

SEQ ID NO: 626482 - DNA, 25 bp, Rattus norvegicus
tgctgtcctcattgtggccaagaag

SEQ ID NO: 626483 - DNA, 25 bp, Rattus norvegicus
tgctgtcctctaaccagagtgctgc

SEQ ID NO: 626484 - DNA, 25 bp, Rattus norvegicus
tgctgtcctctatccagagtgctgc

SEQ ID NO: 626485 - DNA, 25 bp, Rattus norvegicus
tgctgtcctgaacccacgaatgtaa

SEQ ID NO: 626486 - DNA, 25 bp, Rattus norvegicus
tgctgtcctgaagccacgaatgtaa

SEQ ID NO: 626487 - DNA, 25 bp, Rattus norvegicus
tgctgtcctgacagtgtcccatgag

SEQ ID NO: 626488 - DNA, 25 bp, Rattus norvegicus
tgctgtcctgactgtgtcccatgag

SEQ ID NO: 626489 - DNA, 25 bp, Rattus norvegicus
tgctgtcctgcacaattttgggcta

SEQ ID NO: 626490 - DNA, 25 bp, Rattus norvegicus
tgctgtcctgcagaattttgggcta

SEQ ID NO: 626491 - DNA, 25 bp, Rattus norvegicus
tgctgtcctgctaaaggcatcatag

SEQ ID NO: 626492 - DNA, 25 bp, Rattus norvegicus
tgctgtcctgcttaaggcatcatag

SEQ ID NO: 626493 - DNA, 25 bp, Rattus norvegicus
tgctgtcctggcactgatgttgctg

SEQ ID NO: 626494 - DNA, 25 bp, Rattus norvegicus
tgctgtcctggctctgatgttgctg

SEQ ID NO: 626495 - DNA, 25 bp, Rattus norvegicus
tgctgtcctgtgagtctttactttg

SEQ ID NO: 626496 - DNA, 25 bp, Rattus norvegicus
tgctgtcctgtgtgtctttactttg

SEQ ID NO: 626497 - DNA, 25 bp, Rattus norvegicus
tgctgtccttcccttgtacaacaat

SEQ ID NO: 626498 - DNA, 25 bp, Rattus norvegicus
tgctgtccttccgttgtacaacaat

SEQ ID NO: 626499 - DNA, 25 bp, Rattus norvegicus
tgctgtcctttcaagacacttgctg

SEQ ID NO: 626500 - DNA, 25 bp, Rattus norvegicus
tgctgtcctttctagacacttgctg

SEQ ID NO: 626501 - DNA, 25 bp, Rattus norvegicus
tgctgtcgagtcattcaaggtgaga

SEQ ID NO: 626502 - DNA, 25 bp, Rattus norvegicus
tgctgtcgagtctttcaaggtgaga

SEQ ID NO: 626503 - DNA, 25 bp, Rattus norvegicus
tgctgtcgcctccaggaaaaaatca

SEQ ID NO: 626504 - DNA, 25 bp, Rattus norvegicus
tgctgtcgcctcgaggaaaaaatca

SEQ ID NO: 626505 - DNA, 25 bp, Rattus norvegicus
tgctgtcgctctatggaaacacttt

SEQ ID NO: 626506 - DNA, 25 bp, Rattus norvegicus
tgctgtcgctctttggaaacacttt

SEQ ID NO: 626507 - DNA, 25 bp, Rattus norvegicus
tgctgtcgctgaaacaacgctctaa

SEQ ID NO: 626508 - DNA, 25 bp, Rattus norvegicus
tgctgtcgctgatacaacgctctaa

SEQ ID NO: 626509 - DNA, 25 bp, Rattus norvegicus
tgctgtcgtgtcacctacaccatga

SEQ ID NO: 626510 - DNA, 25 bp, Rattus norvegicus
tgctgtcgtgtctcctacaccatga

SEQ ID NO: 626511 - DNA, 25 bp, Rattus norvegicus
tgctgtctagatccactgtgtaact

SEQ ID NO: 626512 - DNA, 25 bp, Rattus norvegicus
tgctgtctagatgcactgtgtaact

SEQ ID NO: 626513 - DNA, 25 bp, Rattus norvegicus
tgctgtctcagcaaagctcaggact

SEQ ID NO: 626514 - DNA, 25 bp, Rattus norvegicus
tgctgtctcagctaagctcaggact

SEQ ID NO: 626515 - DNA, 25 bp, Rattus norvegicus
tgctgtctcagtctgcaaggcacgg

SEQ ID NO: 626516 - DNA, 25 bp, Rattus norvegicus
tgctgtctcagtgtgcaaggcacgg

SEQ ID NO: 626517 - DNA, 25 bp, Rattus norvegicus
tgctgtctccgtcctatgcagtaga

SEQ ID NO: 626518 - DNA, 25 bp, Rattus norvegicus
tgctgtctccgtgctatgcagtaga

SEQ ID NO: 626519 - DNA, 25 bp, Rattus norvegicus
tgctgtctcctcacatttgaaccga

SEQ ID NO: 626520 - DNA, 25 bp, Rattus norvegicus
tgctgtctcctctcatttgaaccga

SEQ ID NO: 626521 - DNA, 25 bp, Rattus norvegicus
tgctgtctcgtgcttgcttaatgga

SEQ ID NO: 626522 - DNA, 25 bp, Rattus norvegicus
tgctgtctcgtggttgcttaatgga

SEQ ID NO: 626523 - DNA, 25 bp, Rattus norvegicus
tgctgtctctaaagtgtgccatctc

SEQ ID NO: 626524 - DNA, 25 bp, Rattus norvegicus
tgctgtctctaatgtgtgccatctc

SEQ ID NO: 626525 - DNA, 25 bp, Rattus norvegicus
tgctgtctctggcagattcagccaa

SEQ ID NO: 626526 - DNA, 25 bp, Rattus norvegicus
tgctgtctctgggagattcagccaa

SEQ ID NO: 626527 - DNA, 25 bp, Rattus norvegicus
tgctgtctctgtagtaggcgctgta

SEQ ID NO: 626528 - DNA, 25 bp, Rattus norvegicus
tgctgtctctgtccctcaagtatat

SEQ ID NO: 626529 - DNA, 25 bp, Rattus norvegicus
tgctgtctctgtgcctcaagtatat

SEQ ID NO: 626530 - DNA, 25 bp, Rattus norvegicus
tgctgtctctgttgtaggcgctgta

SEQ ID NO: 626531 - DNA, 25 bp, Rattus norvegicus
tgctgtctcttgaaatataaacttg

SEQ ID NO: 626532 - DNA, 25 bp, Rattus norvegicus
tgctgtctcttgtaatataaacttg

SEQ ID NO: 626533 - DNA, 25 bp, Rattus norvegicus
tgctgtctgaccacttatgtgcaca

SEQ ID NO: 626534 - DNA, 25 bp, Rattus norvegicus
tgctgtctgaccataaccttatcat

SEQ ID NO: 626535 - DNA, 25 bp, Rattus norvegicus
tgctgtctgacctcttatgtgcaca

SEQ ID NO: 626536 - DNA, 25 bp, Rattus norvegicus
tgctgtctgaccttaaccttatcat

SEQ ID NO: 626537 - DNA, 25 bp, Rattus norvegicus
tgctgtctgaggaaaggatctgccc

SEQ ID NO: 626538 - DNA, 25 bp, Rattus norvegicus
tgctgtctgaggtaaggatctgccc

SEQ ID NO: 626539 - DNA, 25 bp, Rattus norvegicus
tgctgtctgcagaactcggtcttca

SEQ ID NO: 626540 - DNA, 25 bp, Rattus norvegicus
tgctgtctgcagtactcggtcttca

SEQ ID NO: 626541 - DNA, 25 bp, Rattus norvegicus
tgctgtctgcatccctaagtatgat

SEQ ID NO: 626542 - DNA, 25 bp, Rattus norvegicus
tgctgtctgcatgcctaagtatgat

SEQ ID NO: 626543 - DNA, 25 bp, Rattus norvegicus
tgctgtctgcctaggaatccttcaa

SEQ ID NO: 626544 - DNA, 25 bp, Rattus norvegicus
tgctgtctgccttggaatccttcaa

SEQ ID NO: 626545 - DNA, 25 bp, Rattus norvegicus
tgctgtctgctaccctgagatgata

SEQ ID NO: 626546 - DNA, 25 bp, Rattus norvegicus
tgctgtctgctagcctgagatgata

SEQ ID NO: 626547 - DNA, 25 bp, Rattus norvegicus
tgctgtctgtctagggactatgtct

SEQ ID NO: 626548 - DNA, 25 bp, Rattus norvegicus
tgctgtctgtcttgggactatgtct

SEQ ID NO: 626549 - DNA, 25 bp, Rattus norvegicus
tgctgtctgtgaacttacctgttcc

SEQ ID NO: 626550 - DNA, 25 bp, Rattus norvegicus
tgctgtctgtgatcttacctgttcc

SEQ ID NO: 626551 - DNA, 25 bp, Rattus norvegicus
tgctgtcttatgaacacaagggcca

SEQ ID NO: 626552 - DNA, 25 bp, Rattus norvegicus
tgctgtcttatgtacacaagggcca

SEQ ID NO: 626553 - DNA, 25 bp, Rattus norvegicus
tgctgtcttcacaagccaggtggga

SEQ ID NO: 626554 - DNA, 25 bp, Rattus norvegicus
tgctgtcttcacagcctgcgtccat

SEQ ID NO: 626555 - DNA, 25 bp, Rattus norvegicus
tgctgtcttcactagccaggtggga

SEQ ID NO: 626556 - DNA, 25 bp, Rattus norvegicus
tgctgtcttcactgcctgcgtccat

SEQ ID NO: 626557 - DNA, 25 bp, Rattus norvegicus
tgctgtctttgcagctgatgctgtg

SEQ ID NO: 626558 - DNA, 25 bp, Rattus norvegicus
tgctgtctttgctgctgatgctgtg

SEQ ID NO: 626559 - DNA, 25 bp, Rattus norvegicus
tgctgtctttttctgatctatcctc

SEQ ID NO: 626560 - DNA, 25 bp, Rattus norvegicus
tgctgtctttttgtgatctatcctc

SEQ ID NO: 626561 - DNA, 25 bp, Rattus norvegicus
tgctgtgaaattcggttggagtcct

SEQ ID NO: 626562 - DNA, 25 bp, Rattus norvegicus
tgctgtgaaattgggttggagtcct

SEQ ID NO: 626563 - DNA, 25 bp, Rattus norvegicus
tgctgtgaactgatgcttccacggc

SEQ ID NO: 626564 - DNA, 25 bp, Rattus norvegicus
tgctgtgaactgttgcttccacggc

SEQ ID NO: 626565 - DNA, 25 bp, Rattus norvegicus
tgctgtgaagacaaagccccattcg

SEQ ID NO: 626566 - DNA, 25 bp, Rattus norvegicus
tgctgtgaagactaagccccattcg

SEQ ID NO: 626567 - DNA, 25 bp, Rattus norvegicus
tgctgtgacagaagaccggttcttc

SEQ ID NO: 626568 - DNA, 25 bp, Rattus norvegicus
tgctgtgacagatgaccggttcttc

SEQ ID NO: 626569 - DNA, 25 bp, Rattus norvegicus
tgctgtgacagccttgacgtctcta

SEQ ID NO: 626570 - DNA, 25 bp, Rattus norvegicus
tgctgtgacagcgttgacgtctcta

SEQ ID NO: 626571 - DNA, 25 bp, Rattus norvegicus
tgctgtgacatcctgggcactgcaa

SEQ ID NO: 626572 - DNA, 25 bp, Rattus norvegicus
tgctgtgacatcgtgggcactgcaa

SEQ ID NO: 626573 - DNA, 25 bp, Rattus norvegicus
tgctgtgacattaacttccaagggg

SEQ ID NO: 626574 - DNA, 25 bp, Rattus norvegicus
tgctgtgacatttacttccaagggg

SEQ ID NO: 626575 - DNA, 25 bp, Rattus norvegicus
tgctgtgaccctacattagaattct

SEQ ID NO: 626576 - DNA, 25 bp, Rattus norvegicus
tgctgtgaccctataggtactgtgt

SEQ ID NO: 626577 - DNA, 25 bp, Rattus norvegicus
tgctgtgacccttcattagaattct

SEQ ID NO: 626578 - DNA, 25 bp, Rattus norvegicus
tgctgtgaccctttaggtactgtgt

SEQ ID NO: 626579 - DNA, 25 bp, Rattus norvegicus
tgctgtgacctccaacgtggccata

SEQ ID NO: 626580 - DNA, 25 bp, Rattus norvegicus
tgctgtgacctcgaacgtggccata

SEQ ID NO: 626581 - DNA, 25 bp, Rattus norvegicus
tgctgtgactccagaagggatgctt

SEQ ID NO: 626582 - DNA, 25 bp, Rattus norvegicus
tgctgtgactcctgaagggatgctt

SEQ ID NO: 626583 - DNA, 25 bp, Rattus norvegicus
tgctgtgacttcagggatccaccag

SEQ ID NO: 626584 - DNA, 25 bp, Rattus norvegicus
tgctgtgacttctgggatccaccag

SEQ ID NO: 626585 - DNA, 25 bp, Rattus norvegicus
tgctgtgagacacgctatggcattg

SEQ ID NO: 626586 - DNA, 25 bp, Rattus norvegicus
tgctgtgagacaggctatggcattg

SEQ ID NO: 626587 - DNA, 25 bp, Rattus norvegicus
tgctgtgagcctcgtgccgtcttgc

SEQ ID NO: 626588 - DNA, 25 bp, Rattus norvegicus
tgctgtgagcctggtgccgtcttgc

SEQ ID NO: 626589 - DNA, 25 bp, Rattus norvegicus
tgctgtgagctgagtactgttaccc

SEQ ID NO: 626590 - DNA, 25 bp, Rattus norvegicus
tgctgtgagctgtgtactgttaccc

SEQ ID NO: 626591 - DNA, 25 bp, Rattus norvegicus
tgctgtgataggaaatgtctgctct

SEQ ID NO: 626592 - DNA, 25 bp, Rattus norvegicus
tgctgtgataggtaatgtctgctct

SEQ ID NO: 626593 - DNA, 25 bp, Rattus norvegicus
tgctgtgatcttcgtttgatggaat

SEQ ID NO: 626594 - DNA, 25 bp, Rattus norvegicus
tgctgtgatcttggtttgatggaat

SEQ ID NO: 626595 - DNA, 25 bp, Rattus norvegicus
tgctgtgcaactccaggacctggaa

SEQ ID NO: 626596 - DNA, 25 bp, Rattus norvegicus
tgctgtgcaactgcaggacctggaa

SEQ ID NO: 626597 - DNA, 25 bp, Rattus norvegicus
tgctgtgcacacactacatcagttg

SEQ ID NO: 626598 - DNA, 25 bp, Rattus norvegicus
tgctgtgcacactctacatcagttg

SEQ ID NO: 626599 - DNA, 25 bp, Rattus norvegicus
tgctgtgcaccacgcgttggcttaa

SEQ ID NO: 626600 - DNA, 25 bp, Rattus norvegicus
tgctgtgcaccaggcgttggcttaa

SEQ ID NO: 626601 - DNA, 25 bp, Rattus norvegicus
tgctgtgcactcattcagtggaatt

SEQ ID NO: 626602 - DNA, 25 bp, Rattus norvegicus
tgctgtgcactctttcagtggaatt

SEQ ID NO: 626603 - DNA, 25 bp, Rattus norvegicus
tgctgtgcagaaccagtaaccacat

SEQ ID NO: 626604 - DNA, 25 bp, Rattus norvegicus
tgctgtgcagaagcagtaaccacat

SEQ ID NO: 626605 - DNA, 25 bp, Rattus norvegicus
tgctgtgcatttctattgtgccctt

SEQ ID NO: 626606 - DNA, 25 bp, Rattus norvegicus
tgctgtgcatttgtattgtgccctt

SEQ ID NO: 626607 - DNA, 25 bp, Rattus norvegicus
tgctgtgccacacggatgaaactca

SEQ ID NO: 626608 - DNA, 25 bp, Rattus norvegicus
tgctgtgccacagggatgaaactca

SEQ ID NO: 626609 - DNA, 25 bp, Rattus norvegicus
tgctgtgccctaaagtgtatttttt

SEQ ID NO: 626610 - DNA, 25 bp, Rattus norvegicus
tgctgtgccctaactgcaggatggg

SEQ ID NO: 626611 - DNA, 25 bp, Rattus norvegicus
tgctgtgccctatagtgtatttttt

SEQ ID NO: 626612 - DNA, 25 bp, Rattus norvegicus
tgctgtgccctatctgcaggatggg

SEQ ID NO: 626613 - DNA, 25 bp, Rattus norvegicus
tgctgtgccctgaatgctggtttaa

SEQ ID NO: 626614 - DNA, 25 bp, Rattus norvegicus
tgctgtgccctgatggtaccaagaa

SEQ ID NO: 626615 - DNA, 25 bp, Rattus norvegicus
tgctgtgccctgtatgctggtttaa

SEQ ID NO: 626616 - DNA, 25 bp, Rattus norvegicus
tgctgtgccctgttggtaccaagaa

SEQ ID NO: 626617 - DNA, 25 bp, Rattus norvegicus
tgctgtgccgtcactcagaaataag

SEQ ID NO: 626618 - DNA, 25 bp, Rattus norvegicus
tgctgtgccgtctctcagaaataag

SEQ ID NO: 626619 - DNA, 25 bp, Rattus norvegicus
tgctgtgccgttagaagcctttgag

SEQ ID NO: 626620 - DNA, 25 bp, Rattus norvegicus
tgctgtgccgtttgaagcctttgag

SEQ ID NO: 626621 - DNA, 25 bp, Rattus norvegicus
tgctgtgcctggcaaatacaatagt

SEQ ID NO: 626622 - DNA, 25 bp, Rattus norvegicus
tgctgtgcctgggaaatacaatagt

SEQ ID NO: 626623 - DNA, 25 bp, Rattus norvegicus
tgctgtgcggcactgtgacaactta

SEQ ID NO: 626624 - DNA, 25 bp, Rattus norvegicus
tgctgtgcggcagtgtgacaactta

SEQ ID NO: 626625 - DNA, 25 bp, Rattus norvegicus
tgctgtgcgtctcaggagctttaca

SEQ ID NO: 626626 - DNA, 25 bp, Rattus norvegicus
tgctgtgcgtctgaggagctttaca

SEQ ID NO: 626627 - DNA, 25 bp, Rattus norvegicus
tgctgtgctagaagaggtacctttc

SEQ ID NO: 626628 - DNA, 25 bp, Rattus norvegicus
tgctgtgctagatgaggtacctttc

SEQ ID NO: 626629 - DNA, 25 bp, Rattus norvegicus
tgctgtgctatcagcctgtggctgc

SEQ ID NO: 626630 - DNA, 25 bp, Rattus norvegicus
tgctgtgctatctgcctgtggctgc

SEQ ID NO: 626631 - DNA, 25 bp, Rattus norvegicus
tgctgtgctcccagcgggcttgaga

SEQ ID NO: 626632 - DNA, 25 bp, Rattus norvegicus
tgctgtgctccctgcgggcttgaga

SEQ ID NO: 626633 - DNA, 25 bp, Rattus norvegicus
tgctgtgctcggctcccggcaagtc

SEQ ID NO: 626634 - DNA, 25 bp, Rattus norvegicus
tgctgtgctcgggtcccggcaagtc

SEQ ID NO: 626635 - DNA, 25 bp, Rattus norvegicus
tgctgtgctgctaaccaatcatatt

SEQ ID NO: 626636 - DNA, 25 bp, Rattus norvegicus
tgctgtgctgctaactgaagtattg

SEQ ID NO: 626637 - DNA, 25 bp, Rattus norvegicus
tgctgtgctgcttaccaatcatatt

SEQ ID NO: 626638 - DNA, 25 bp, Rattus norvegicus
tgctgtgctgcttactgaagtattg

SEQ ID NO: 626639 - DNA, 25 bp, Rattus norvegicus
tgctgtgctgtgcacactcatgcag

SEQ ID NO: 626640 - DNA, 25 bp, Rattus norvegicus
tgctgtgctgtggacactcatgcag

SEQ ID NO: 626641 - DNA, 25 bp, Rattus norvegicus
tgctgtgcttccagttttaacctac

SEQ ID NO: 626642 - DNA, 25 bp, Rattus norvegicus
tgctgtgcttcctgttttaacctac

SEQ ID NO: 626643 - DNA, 25 bp, Rattus norvegicus
tgctgtgcttgcagtttttcagacc

SEQ ID NO: 626644 - DNA, 25 bp, Rattus norvegicus
tgctgtgcttgctgtttttcagacc

SEQ ID NO: 626645 - DNA, 25 bp, Rattus norvegicus
tgctgtggacaaagacggctctgta

SEQ ID NO: 626646 - DNA, 25 bp, Rattus norvegicus
tgctgtggacaatgacggctctgta

SEQ ID NO: 626647 - DNA, 25 bp, Rattus norvegicus
tgctgtggagatctctgtctgtgtc

SEQ ID NO: 626648 - DNA, 25 bp, Rattus norvegicus
tgctgtggagatgtctgtctgtgtc

SEQ ID NO: 626649 - DNA, 25 bp, Rattus norvegicus
tgctgtggaggcctggcttcataca

SEQ ID NO: 626650 - DNA, 25 bp, Rattus norvegicus
tgctgtggaggcgtggcttcataca

SEQ ID NO: 626651 - DNA, 25 bp, Rattus norvegicus
tgctgtggcagcactccgggaagaa

SEQ ID NO: 626652 - DNA, 25 bp, Rattus norvegicus
tgctgtggcagctctccgggaagaa

SEQ ID NO: 626653 - DNA, 25 bp, Rattus norvegicus
tgctgtgggagcatctgcggctaca

SEQ ID NO: 626654 - DNA, 25 bp, Rattus norvegicus
tgctgtgggagcttctgcggctaca

SEQ ID NO: 626655 - DNA, 25 bp, Rattus norvegicus
tgctgtgggattctccaaccagtca

SEQ ID NO: 626656 - DNA, 25 bp, Rattus norvegicus
tgctgtgggattgtccaaccagtca

SEQ ID NO: 626657 - DNA, 25 bp, Rattus norvegicus
tgctgtgggcctcgttagtgctaac

SEQ ID NO: 626658 - DNA, 25 bp, Rattus norvegicus
tgctgtgggcctggttagtgctaac

SEQ ID NO: 626659 - DNA, 25 bp, Rattus norvegicus
tgctgtgggtgcactctaatcacaa

SEQ ID NO: 626660 - DNA, 25 bp, Rattus norvegicus
tgctgtgggtgctctctaatcacaa

SEQ ID NO: 626661 - DNA, 25 bp, Rattus norvegicus
tgctgtggtcacaggctggtacaaa

SEQ ID NO: 626662 - DNA, 25 bp, Rattus norvegicus
tgctgtggtcactggctggtacaaa

SEQ ID NO: 626663 - DNA, 25 bp, Rattus norvegicus
tgctgtggttgcaccattcaaatgt

SEQ ID NO: 626664 - DNA, 25 bp, Rattus norvegicus
tgctgtggttgctccattcaaatgt

SEQ ID NO: 626665 - DNA, 25 bp, Rattus norvegicus
tgctgtggttggcagcacccattca

SEQ ID NO: 626666 - DNA, 25 bp, Rattus norvegicus
tgctgtggttgggagcacccattca

SEQ ID NO: 626667 - DNA, 25 bp, Rattus norvegicus
tgctgtgtacctagcagatgctcaa

SEQ ID NO: 626668 - DNA, 25 bp, Rattus norvegicus
tgctgtgtaccttgcagatgctcaa

SEQ ID NO: 626669 - DNA, 25 bp, Rattus norvegicus
tgctgtgtacttatcctctttgaca

SEQ ID NO: 626670 - DNA, 25 bp, Rattus norvegicus
tgctgtgtacttttcctctttgaca

SEQ ID NO: 626671 - DNA, 25 bp, Rattus norvegicus
tgctgtgtctttagtggccatagat

SEQ ID NO: 626672 - DNA, 25 bp, Rattus norvegicus
tgctgtgtcttttgtggccatagat

SEQ ID NO: 626673 - DNA, 25 bp, Rattus norvegicus
tgctgtgtgctcagtcttacatgtg

SEQ ID NO: 626674 - DNA, 25 bp, Rattus norvegicus
tgctgtgtgctctgtcttacatgtg

SEQ ID NO: 626675 - DNA, 25 bp, Rattus norvegicus
tgctgtgtgctgacttatgtatgag

SEQ ID NO: 626676 - DNA, 25 bp, Rattus norvegicus
tgctgtgtgctgtcttatgtatgag

SEQ ID NO: 626677 - DNA, 25 bp, Rattus norvegicus
tgctgtgtggccaggttatttggaa

SEQ ID NO: 626678 - DNA, 25 bp, Rattus norvegicus
tgctgtgtggcctggttatttggaa

SEQ ID NO: 626679 - DNA, 25 bp, Rattus norvegicus
tgctgtgtggtcaggtacctgagat

SEQ ID NO: 626680 - DNA, 25 bp, Rattus norvegicus
tgctgtgtggtctggtacctgagat

SEQ ID NO: 626681 - DNA, 25 bp, Rattus norvegicus
tgctgtgtgtgtacctgcctgccta

SEQ ID NO: 626682 - DNA, 25 bp, Rattus norvegicus
tgctgtgtgtgtcctcatcctcacc

SEQ ID NO: 626683 - DNA, 25 bp, Rattus norvegicus
tgctgtgtgtgtgctcatcctcacc

SEQ ID NO: 626684 - DNA, 25 bp, Rattus norvegicus
tgctgtgtgtgttcctgcctgccta

SEQ ID NO: 626685 - DNA, 25 bp, Rattus norvegicus
tgctgtgtgttgaggtgtgcacatt

SEQ ID NO: 626686 - DNA, 25 bp, Rattus norvegicus
tgctgtgtgttgtggtgtgcacatt

SEQ ID NO: 626687 - DNA, 25 bp, Rattus norvegicus
tgctgtgttcacagcaagtcccttg

SEQ ID NO: 626688 - DNA, 25 bp, Rattus norvegicus
tgctgtgttcactgcaagtcccttg

SEQ ID NO: 626689 - DNA, 25 bp, Rattus norvegicus
tgctgtgttcctcggatccatttat

SEQ ID NO: 626690 - DNA, 25 bp, Rattus norvegicus
tgctgtgttcctgggatccatttat

SEQ ID NO: 626691 - DNA, 25 bp, Rattus norvegicus
tgctgtgttctaagtctcttctttc

SEQ ID NO: 626692 - DNA, 25 bp, Rattus norvegicus
tgctgtgttctatgtctcttctttc

SEQ ID NO: 626693 - DNA, 25 bp, Rattus norvegicus
tgctgtgttggtcaatgtaccctgt

SEQ ID NO: 626694 - DNA, 25 bp, Rattus norvegicus
tgctgtgttggtgaatgtaccctgt

SEQ ID NO: 626695 - DNA, 25 bp, Rattus norvegicus
tgctgtgttttactccattcggaag

SEQ ID NO: 626696 - DNA, 25 bp, Rattus norvegicus
tgctgtgttttagtccattcggaag

SEQ ID NO: 626697 - DNA, 25 bp, Rattus norvegicus
tgctgtgttttgacctatggaaaat

SEQ ID NO: 626698 - DNA, 25 bp, Rattus norvegicus
tgctgtgttttgtcctatggaaaat

SEQ ID NO: 626699 - DNA, 25 bp, Rattus norvegicus
tgctgtgtttttaattcttggatac

SEQ ID NO: 626700 - DNA, 25 bp, Rattus norvegicus
tgctgtgttttttattcttggatac

SEQ ID NO: 626701 - DNA, 25 bp, Rattus norvegicus
tgctgttaaattctctgattccaga

SEQ ID NO: 626702 - DNA, 25 bp, Rattus norvegicus
tgctgttaaattgtctgattccaga

SEQ ID NO: 626703 - DNA, 25 bp, Rattus norvegicus
tgctgttaaccacagtctgccaggg

SEQ ID NO: 626704 - DNA, 25 bp, Rattus norvegicus
tgctgttaaccagagtctgccaggg

SEQ ID NO: 626705 - DNA, 25 bp, Rattus norvegicus
tgctgttaataacctgttaggaaac

SEQ ID NO: 626706 - DNA, 25 bp, Rattus norvegicus
tgctgttaataagctgttaggaaac

SEQ ID NO: 626707 - DNA, 25 bp, Rattus norvegicus
tgctgttacagcagcatgctttgtt

SEQ ID NO: 626708 - DNA, 25 bp, Rattus norvegicus
tgctgttacagctgcatgctttgtt

SEQ ID NO: 626709 - DNA, 25 bp, Rattus norvegicus
tgctgttacctgctgctgccaagtg

SEQ ID NO: 626710 - DNA, 25 bp, Rattus norvegicus
tgctgttacctggtgctgccaagtg

SEQ ID NO: 626711 - DNA, 25 bp, Rattus norvegicus
tgctgttacgggaggtttcgtctac

SEQ ID NO: 626712 - DNA, 25 bp, Rattus norvegicus
tgctgttacgggtggtttcgtctac

SEQ ID NO: 626713 - DNA, 25 bp, Rattus norvegicus
tgctgttatcatactactatctcct

SEQ ID NO: 626714 - DNA, 25 bp, Rattus norvegicus
tgctgttatcattctactatctcct

SEQ ID NO: 626715 - DNA, 25 bp, Rattus norvegicus
tgctgttattccctgccatgatgac

SEQ ID NO: 626716 - DNA, 25 bp, Rattus norvegicus
tgctgttattccgtgccatgatgac

SEQ ID NO: 626717 - DNA, 25 bp, Rattus norvegicus
tgctgttattgtcgatgctgacgac

SEQ ID NO: 626718 - DNA, 25 bp, Rattus norvegicus
tgctgttattgtggatgctgacgac

SEQ ID NO: 626719 - DNA, 25 bp, Rattus norvegicus
tgctgttcaaccaggtctattgggt

SEQ ID NO: 626720 - DNA, 25 bp, Rattus norvegicus
tgctgttcaacctggtctattgggt

SEQ ID NO: 626721 - DNA, 25 bp, Rattus norvegicus
tgctgttcaactaaggtgtcactcc

SEQ ID NO: 626722 - DNA, 25 bp, Rattus norvegicus
tgctgttcaacttaggtgtcactcc

SEQ ID NO: 626723 - DNA, 25 bp, Rattus norvegicus
tgctgttcacatcggcctggctagg

SEQ ID NO: 626724 - DNA, 25 bp, Rattus norvegicus
tgctgttcacatgggcctggctagg

SEQ ID NO: 626725 - DNA, 25 bp, Rattus norvegicus
tgctgttcaccgcttgacccaaaga

SEQ ID NO: 626726 - DNA, 25 bp, Rattus norvegicus
tgctgttcaccggttgacccaaaga

SEQ ID NO: 626727 - DNA, 25 bp, Rattus norvegicus
tgctgttcactcacagcctgtgagc

SEQ ID NO: 626728 - DNA, 25 bp, Rattus norvegicus
tgctgttcactctcagcctgtgagc

SEQ ID NO: 626729 - DNA, 25 bp, Rattus norvegicus
tgctgttcatctccaactggagacc

SEQ ID NO: 626730 - DNA, 25 bp, Rattus norvegicus
tgctgttcatctgcaactggagacc

SEQ ID NO: 626731 - DNA, 25 bp, Rattus norvegicus
tgctgttcatggagactcatgatga

SEQ ID NO: 626732 - DNA, 25 bp, Rattus norvegicus
tgctgttcatggtgactcatgatga

SEQ ID NO: 626733 - DNA, 25 bp, Rattus norvegicus
tgctgttccaagctgctggatatcc

SEQ ID NO: 626734 - DNA, 25 bp, Rattus norvegicus
tgctgttccaaggtgctggatatcc

SEQ ID NO: 626735 - DNA, 25 bp, Rattus norvegicus
tgctgttcccggcaagcgcagtcag

SEQ ID NO: 626736 - DNA, 25 bp, Rattus norvegicus
tgctgttcccgggaagcgcagtcag

SEQ ID NO: 626737 - DNA, 25 bp, Rattus norvegicus
tgctgttcctcacaaatttccggga

SEQ ID NO: 626738 - DNA, 25 bp, Rattus norvegicus
tgctgttcctcagaaatttccggga

SEQ ID NO: 626739 - DNA, 25 bp, Rattus norvegicus
tgctgttcctgaaatggagttgtga

SEQ ID NO: 626740 - DNA, 25 bp, Rattus norvegicus
tgctgttcctgatatggagttgtga

SEQ ID NO: 626741 - DNA, 25 bp, Rattus norvegicus
tgctgttcctgtcaacgttgtgtag

SEQ ID NO: 626742 - DNA, 25 bp, Rattus norvegicus
tgctgttcctgtgaacgttgtgtag

SEQ ID NO: 626743 - DNA, 25 bp, Rattus norvegicus
tgctgttcgcccaatgtcttaataa

SEQ ID NO: 626744 - DNA, 25 bp, Rattus norvegicus
tgctgttcgccctatgtcttaataa

SEQ ID NO: 626745 - DNA, 25 bp, Rattus norvegicus
tgctgttcgggacgctactgatgaa

SEQ ID NO: 626746 - DNA, 25 bp, Rattus norvegicus
tgctgttcgggaggctactgatgaa

SEQ ID NO: 626747 - DNA, 25 bp, Rattus norvegicus
tgctgttctcagcattatggtccaa

SEQ ID NO: 626748 - DNA, 25 bp, Rattus norvegicus
tgctgttctcaggattatggtccaa

SEQ ID NO: 626749 - DNA, 25 bp, Rattus norvegicus
tgctgttctctgacactgttcccgg

SEQ ID NO: 626750 - DNA, 25 bp, Rattus norvegicus
tgctgttctctgtcactgttcccgg

SEQ ID NO: 626751 - DNA, 25 bp, Rattus norvegicus
tgctgttctgaacccctacattaag

SEQ ID NO: 626752 - DNA, 25 bp, Rattus norvegicus
tgctgttctgaagccctacattaag

SEQ ID NO: 626753 - DNA, 25 bp, Rattus norvegicus
tgctgttctgtgatagtgcttagtc

SEQ ID NO: 626754 - DNA, 25 bp, Rattus norvegicus
tgctgttctgtgttagtgcttagtc

SEQ ID NO: 626755 - DNA, 25 bp, Rattus norvegicus
tgctgttcttacatgctagaaccat

SEQ ID NO: 626756 - DNA, 25 bp, Rattus norvegicus
tgctgttcttacttgctagaaccat

SEQ ID NO: 626757 - DNA, 25 bp, Rattus norvegicus
tgctgttgaattctgggccttgtcc

SEQ ID NO: 626758 - DNA, 25 bp, Rattus norvegicus
tgctgttgaattgtgggccttgtcc

SEQ ID NO: 626759 - DNA, 25 bp, Rattus norvegicus
tgctgttgagccctacacgaagaaa

SEQ ID NO: 626760 - DNA, 25 bp, Rattus norvegicus
tgctgttgagccgtacacgaagaaa

SEQ ID NO: 626761 - DNA, 25 bp, Rattus norvegicus
tgctgttgccgcagttcacaaaaaa

SEQ ID NO: 626762 - DNA, 25 bp, Rattus norvegicus
tgctgttgccgctgttcacaaaaaa

SEQ ID NO: 626763 - DNA, 25 bp, Rattus norvegicus
tgctgttgctacagtttgcctcaaa

SEQ ID NO: 626764 - DNA, 25 bp, Rattus norvegicus
tgctgttgctactgtttgcctcaaa

SEQ ID NO: 626765 - DNA, 25 bp, Rattus norvegicus
tgctgttgcttcaccgggtctggct

SEQ ID NO: 626766 - DNA, 25 bp, Rattus norvegicus
tgctgttgcttctccgggtctggct

SEQ ID NO: 626767 - DNA, 25 bp, Rattus norvegicus
tgctgtttagaacagctgctttctt

SEQ ID NO: 626768 - DNA, 25 bp, Rattus norvegicus
tgctgtttagaagagctgctttctt

SEQ ID NO: 626769 - DNA, 25 bp, Rattus norvegicus
tgctgtttcatgaaaggagatatga

SEQ ID NO: 626770 - DNA, 25 bp, Rattus norvegicus
tgctgtttcatgtaaggagatatga

SEQ ID NO: 626771 - DNA, 25 bp, Rattus norvegicus
tgctgtttccatagtgacaagccta

SEQ ID NO: 626772 - DNA, 25 bp, Rattus norvegicus
tgctgtttccattgtgacaagccta

SEQ ID NO: 626773 - DNA, 25 bp, Rattus norvegicus
tgctgtttctagaacttgcttcata

SEQ ID NO: 626774 - DNA, 25 bp, Rattus norvegicus
tgctgtttctagtacttgcttcata

SEQ ID NO: 626775 - DNA, 25 bp, Rattus norvegicus
tgctgtttctgcacccagatatggg

SEQ ID NO: 626776 - DNA, 25 bp, Rattus norvegicus
tgctgtttctgctcccagatatggg

SEQ ID NO: 626777 - DNA, 25 bp, Rattus norvegicus
tgctgtttcttgaggcgctagggac

SEQ ID NO: 626778 - DNA, 25 bp, Rattus norvegicus
tgctgtttcttgtggcgctagggac

SEQ ID NO: 626779 - DNA, 25 bp, Rattus norvegicus
tgctgtttctttaccgaggcacatg

SEQ ID NO: 626780 - DNA, 25 bp, Rattus norvegicus
tgctgtttcttttccgaggcacatg

SEQ ID NO: 626781 - DNA, 25 bp, Rattus norvegicus
tgctgtttgataatcccgtctttca

SEQ ID NO: 626782 - DNA, 25 bp, Rattus norvegicus
tgctgtttgatattcccgtctttca

SEQ ID NO: 626783 - DNA, 25 bp, Rattus norvegicus
tgctgtttgcacatactgtatggtc

SEQ ID NO: 626784 - DNA, 25 bp, Rattus norvegicus
tgctgtttgcacttactgtatggtc

SEQ ID NO: 626785 - DNA, 25 bp, Rattus norvegicus
tgctgtttgctacatgtcttcctgc

SEQ ID NO: 626786 - DNA, 25 bp, Rattus norvegicus
tgctgtttgctagatgtcttcctgc

SEQ ID NO: 626787 - DNA, 25 bp, Rattus norvegicus
tgctgtttgtagaggcaattctgca

SEQ ID NO: 626788 - DNA, 25 bp, Rattus norvegicus
tgctgtttgtagtggcaattctgca

SEQ ID NO: 626789 - DNA, 25 bp, Rattus norvegicus
tgctgtttgtcactcatctttccag

SEQ ID NO: 626790 - DNA, 25 bp, Rattus norvegicus
tgctgtttgtcagtcatctttccag

SEQ ID NO: 626791 - DNA, 25 bp, Rattus norvegicus
tgctgtttgtttccagaacacccaa

SEQ ID NO: 626792 - DNA, 25 bp, Rattus norvegicus
tgctgtttgtttgcagaacacccaa

SEQ ID NO: 626793 - DNA, 25 bp, Rattus norvegicus
tgctgttttaaaagcagtcttccgt

SEQ ID NO: 626794 - DNA, 25 bp, Rattus norvegicus
tgctgttttaaactttgcccttcct

SEQ ID NO: 626795 - DNA, 25 bp, Rattus norvegicus
tgctgttttaaacttttttctactg

SEQ ID NO: 626796 - DNA, 25 bp, Rattus norvegicus
tgctgttttaaagtttgcccttcct

SEQ ID NO: 626797 - DNA, 25 bp, Rattus norvegicus
tgctgttttaaagttttttctactg

SEQ ID NO: 626798 - DNA, 25 bp, Rattus norvegicus
tgctgttttaaatgcagtcttccgt

SEQ ID NO: 626799 - DNA, 25 bp, Rattus norvegicus
tgctgttttattattctgtctcctg

SEQ ID NO: 626800 - DNA, 25 bp, Rattus norvegicus
tgctgttttatttttctgtctcctg

SEQ ID NO: 626801 - DNA, 25 bp, Rattus norvegicus
tgctgttttcagctgcacgtaaagg

SEQ ID NO: 626802 - DNA, 25 bp, Rattus norvegicus
tgctgttttcaggtgcacgtaaagg

SEQ ID NO: 626803 - DNA, 25 bp, Rattus norvegicus
tgctgtttttcacacccccttacaa

SEQ ID NO: 626804 - DNA, 25 bp, Rattus norvegicus
tgctgtttttcagacccccttacaa

SEQ ID NO: 626805 - DNA, 25 bp, Rattus norvegicus
tgctgtttttccaccttggacaact

SEQ ID NO: 626806 - DNA, 25 bp, Rattus norvegicus
tgctgtttttcctccttggacaact

SEQ ID NO: 626807 - DNA, 25 bp, Rattus norvegicus
tgcttaaaaagaatacccacagggt

SEQ ID NO: 626808 - DNA, 25 bp, Rattus norvegicus
tgcttaaaaagattacccacagggt

SEQ ID NO: 626809 - DNA, 25 bp, Rattus norvegicus
tgcttaaaacctcttgggtggtcca

SEQ ID NO: 626810 - DNA, 25 bp, Rattus norvegicus
tgcttaaaacctgttgggtggtcca

SEQ ID NO: 626811 - DNA, 25 bp, Rattus norvegicus
tgcttaaaactactccctctgatct

SEQ ID NO: 626812 - DNA, 25 bp, Rattus norvegicus
tgcttaaaactagtccctctgatct

SEQ ID NO: 626813 - DNA, 25 bp, Rattus norvegicus
tgcttaaagcgcactgtgattccca

SEQ ID NO: 626814 - DNA, 25 bp, Rattus norvegicus
tgcttaaagcgctctgtgattccca

SEQ ID NO: 626815 - DNA, 25 bp, Rattus norvegicus
tgcttaacacttcttctctgttctt

SEQ ID NO: 626816 - DNA, 25 bp, Rattus norvegicus
tgcttaacacttgttctctgttctt

SEQ ID NO: 626817 - DNA, 25 bp, Rattus norvegicus
tgcttaaccaacagacgggcgctga

SEQ ID NO: 626818 - DNA, 25 bp, Rattus norvegicus
tgcttaaccaactgacgggcgctga

SEQ ID NO: 626819 - DNA, 25 bp, Rattus norvegicus
tgcttaactgtcaggaagtcctctc

SEQ ID NO: 626820 - DNA, 25 bp, Rattus norvegicus
tgcttaactgtctggaagtcctctc

SEQ ID NO: 626821 - DNA, 25 bp, Rattus norvegicus
tgcttaagaagcacattttagttat

SEQ ID NO: 626822 - DNA, 25 bp, Rattus norvegicus
tgcttaagaagctcattttagttat

SEQ ID NO: 626823 - DNA, 25 bp, Rattus norvegicus
tgcttaatctgaccctggcggactt

SEQ ID NO: 626824 - DNA, 25 bp, Rattus norvegicus
tgcttaatctgagcctggcggactt

SEQ ID NO: 626825 - DNA, 25 bp, Rattus norvegicus
tgcttacaatgaatttcttcttgct

SEQ ID NO: 626826 - DNA, 25 bp, Rattus norvegicus
tgcttacaatgattttcttcttgct

SEQ ID NO: 626827 - DNA, 25 bp, Rattus norvegicus
tgcttacactgaactccggcagata

SEQ ID NO: 626828 - DNA, 25 bp, Rattus norvegicus
tgcttacactgatctccggcagata

SEQ ID NO: 626829 - DNA, 25 bp, Rattus norvegicus
tgcttacagcctagaaccctttatt

SEQ ID NO: 626830 - DNA, 25 bp, Rattus norvegicus
tgcttacagccttgaaccctttatt

SEQ ID NO: 626831 - DNA, 25 bp, Rattus norvegicus
tgcttacagggcctggcaatcaccc

SEQ ID NO: 626832 - DNA, 25 bp, Rattus norvegicus
tgcttacagggcgtggcaatcaccc

SEQ ID NO: 626833 - DNA, 25 bp, Rattus norvegicus
tgcttacatccactgccagtttgaa

SEQ ID NO: 626834 - DNA, 25 bp, Rattus norvegicus
tgcttacatccagtgccagtttgaa

SEQ ID NO: 626835 - DNA, 25 bp, Rattus norvegicus
tgcttacattggactgggaacctaa

SEQ ID NO: 626836 - DNA, 25 bp, Rattus norvegicus
tgcttacattggtctgggaacctaa

SEQ ID NO: 626837 - DNA, 25 bp, Rattus norvegicus
tgcttaccacagacgctgtgtggac

SEQ ID NO: 626838 - DNA, 25 bp, Rattus norvegicus
tgcttaccacagtcgctgtgtggac

SEQ ID NO: 626839 - DNA, 25 bp, Rattus norvegicus
tgcttaccaggtatgccaggcttga

SEQ ID NO: 626840 - DNA, 25 bp, Rattus norvegicus
tgcttaccaggtttgccaggcttga

SEQ ID NO: 626841 - DNA, 25 bp, Rattus norvegicus
tgcttacccacacaattcacatagg

SEQ ID NO: 626842 - DNA, 25 bp, Rattus norvegicus
tgcttacccacagaattcacatagg

SEQ ID NO: 626843 - DNA, 25 bp, Rattus norvegicus
tgcttaccgcaaccttggtcagaat

SEQ ID NO: 626844 - DNA, 25 bp, Rattus norvegicus
tgcttaccgcaagcttggtcagaat

SEQ ID NO: 626845 - DNA, 25 bp, Rattus norvegicus
tgcttaccgccgatgaatctaggta

SEQ ID NO: 626846 - DNA, 25 bp, Rattus norvegicus
tgcttaccgccgttgaatctaggta

SEQ ID NO: 626847 - DNA, 25 bp, Rattus norvegicus
tgcttaccttacacctttaatctag

SEQ ID NO: 626848 - DNA, 25 bp, Rattus norvegicus
tgcttaccttacctcctgtgttaac

SEQ ID NO: 626849 - DNA, 25 bp, Rattus norvegicus
tgcttaccttacgtcctgtgttaac

SEQ ID NO: 626850 - DNA, 25 bp, Rattus norvegicus
tgcttaccttactcctttaatctag

SEQ ID NO: 626851 - DNA, 25 bp, Rattus norvegicus
tgcttacgctaaaaacccattcttt

SEQ ID NO: 626852 - DNA, 25 bp, Rattus norvegicus
tgcttacgctaataacccattcttt

SEQ ID NO: 626853 - DNA, 25 bp, Rattus norvegicus
tgcttactcagtcgccacagctggg

SEQ ID NO: 626854 - DNA, 25 bp, Rattus norvegicus
tgcttactcagtggccacagctggg

SEQ ID NO: 626855 - DNA, 25 bp, Rattus norvegicus
tgcttactctaacaagatggctcag

SEQ ID NO: 626856 - DNA, 25 bp, Rattus norvegicus
tgcttactctaagaagatggctcag

SEQ ID NO: 626857 - DNA, 25 bp, Rattus norvegicus
tgcttactctccactgagttgggaa

SEQ ID NO: 626858 - DNA, 25 bp, Rattus norvegicus
tgcttactctcctctgagttgggaa

SEQ ID NO: 626859 - DNA, 25 bp, Rattus norvegicus
tgcttactgtggctattacattcat

SEQ ID NO: 626860 - DNA, 25 bp, Rattus norvegicus
tgcttactgtgggtattacattcat

SEQ ID NO: 626861 - DNA, 25 bp, Rattus norvegicus
tgcttagagcctcgtcctggtaaaa

SEQ ID NO: 626862 - DNA, 25 bp, Rattus norvegicus
tgcttagagcctggtcctggtaaaa

SEQ ID NO: 626863 - DNA, 25 bp, Rattus norvegicus
tgcttagaggccaatccagggtccc

SEQ ID NO: 626864 - DNA, 25 bp, Rattus norvegicus
tgcttagaggcctatccagggtccc

SEQ ID NO: 626865 - DNA, 25 bp, Rattus norvegicus
tgcttagcacacatagtacctattt

SEQ ID NO: 626866 - DNA, 25 bp, Rattus norvegicus
tgcttagcacacttagtacctattt

SEQ ID NO: 626867 - DNA, 25 bp, Rattus norvegicus
tgcttagcatgcagggaggctcatc

SEQ ID NO: 626868 - DNA, 25 bp, Rattus norvegicus
tgcttagcatgctgggaggctcatc

SEQ ID NO: 626869 - DNA, 25 bp, Rattus norvegicus
tgcttagccaccacaattagtattt

SEQ ID NO: 626870 - DNA, 25 bp, Rattus norvegicus
tgcttagccacctcaattagtattt

SEQ ID NO: 626871 - DNA, 25 bp, Rattus norvegicus
tgcttagctagcatggtcacggagc

SEQ ID NO: 626872 - DNA, 25 bp, Rattus norvegicus
tgcttagctagcttggtcacggagc

SEQ ID NO: 626873 - DNA, 25 bp, Rattus norvegicus
tgcttaggaccaatcccaggaagac

SEQ ID NO: 626874 - DNA, 25 bp, Rattus norvegicus
tgcttaggaccattcccaggaagac

SEQ ID NO: 626875 - DNA, 25 bp, Rattus norvegicus
tgcttagtgcggcttcccagtgttt

SEQ ID NO: 626876 - DNA, 25 bp, Rattus norvegicus
tgcttagtgcgggttcccagtgttt

SEQ ID NO: 626877 - DNA, 25 bp, Rattus norvegicus
tgcttagtgtcgattcctgttttta

SEQ ID NO: 626878 - DNA, 25 bp, Rattus norvegicus
tgcttagtgtcgtttcctgttttta

SEQ ID NO: 626879 - DNA, 25 bp, Rattus norvegicus
tgcttagttagccttactctctctg

SEQ ID NO: 626880 - DNA, 25 bp, Rattus norvegicus
tgcttagttagcgttactctctctg

SEQ ID NO: 626881 - DNA, 25 bp, Rattus norvegicus
tgcttataagtgattttgcccctgt

SEQ ID NO: 626882 - DNA, 25 bp, Rattus norvegicus
tgcttataagtgtttttgcccctgt

SEQ ID NO: 626883 - DNA, 25 bp, Rattus norvegicus
tgcttatcaaagacgctgtaatggg

SEQ ID NO: 626884 - DNA, 25 bp, Rattus norvegicus
tgcttatcaaagtcgctgtaatggg

SEQ ID NO: 626885 - DNA, 25 bp, Rattus norvegicus
tgcttatcagacatgagtccctctt

SEQ ID NO: 626886 - DNA, 25 bp, Rattus norvegicus
tgcttatcagacttgagtccctctt

SEQ ID NO: 626887 - DNA, 25 bp, Rattus norvegicus
tgcttatcccctaatgggtctgagg

SEQ ID NO: 626888 - DNA, 25 bp, Rattus norvegicus
tgcttatccccttatgggtctgagg

SEQ ID NO: 626889 - DNA, 25 bp, Rattus norvegicus
tgcttatctctgcatgtccttcatt

SEQ ID NO: 626890 - DNA, 25 bp, Rattus norvegicus
tgcttatctctggatgtccttcatt

SEQ ID NO: 626891 - DNA, 25 bp, Rattus norvegicus
tgcttatgaggcagacatgcacatg

SEQ ID NO: 626892 - DNA, 25 bp, Rattus norvegicus
tgcttatgaggctgacatgcacatg

SEQ ID NO: 626893 - DNA, 25 bp, Rattus norvegicus
tgcttatgctaacgctctgagactc

SEQ ID NO: 626894 - DNA, 25 bp, Rattus norvegicus
tgcttatgctaaggctctgagactc

SEQ ID NO: 626895 - DNA, 25 bp, Rattus norvegicus
tgcttatggtgcactgggaacccag

SEQ ID NO: 626896 - DNA, 25 bp, Rattus norvegicus
tgcttatggtgctctgggaacccag

SEQ ID NO: 626897 - DNA, 25 bp, Rattus norvegicus
tgcttatgtgtgcactgagcagtcg

SEQ ID NO: 626898 - DNA, 25 bp, Rattus norvegicus
tgcttatgtgtggactgagcagtcg

SEQ ID NO: 626899 - DNA, 25 bp, Rattus norvegicus
tgcttatgtttgactcccttgggaa

SEQ ID NO: 626900 - DNA, 25 bp, Rattus norvegicus
tgcttatgtttgtctcccttgggaa

SEQ ID NO: 626901 - DNA, 25 bp, Rattus norvegicus
tgcttattacttcggtgccgtgtga

SEQ ID NO: 626902 - DNA, 25 bp, Rattus norvegicus
tgcttattacttgggtgccgtgtga

SEQ ID NO: 626903 - DNA, 25 bp, Rattus norvegicus
tgcttatttagcctattcacaaagt

SEQ ID NO: 626904 - DNA, 25 bp, Rattus norvegicus
tgcttatttagcgtattcacaaagt

SEQ ID NO: 626905 - DNA, 25 bp, Rattus norvegicus
tgcttatttgtacaatggccttttc

SEQ ID NO: 626906 - DNA, 25 bp, Rattus norvegicus
tgcttatttgtagaatggccttttc

SEQ ID NO: 626907 - DNA, 25 bp, Rattus norvegicus
tgcttattttctaatcgacctgctc

SEQ ID NO: 626908 - DNA, 25 bp, Rattus norvegicus
tgcttattttcttatcgacctgctc

SEQ ID NO: 626909 - DNA, 25 bp, Rattus norvegicus
tgcttcaacaacatcagcctggcgg

SEQ ID NO: 626910 - DNA, 25 bp, Rattus norvegicus
tgcttcaacaacttcagcctggcgg

SEQ ID NO: 626911 - DNA, 25 bp, Rattus norvegicus
tgcttcaagatgagcttctcctaca

SEQ ID NO: 626912 - DNA, 25 bp, Rattus norvegicus
tgcttcaagatgtgcttctcctaca

SEQ ID NO: 626913 - DNA, 25 bp, Rattus norvegicus
tgcttcaatgatccctaaatcccgg

SEQ ID NO: 626914 - DNA, 25 bp, Rattus norvegicus
tgcttcaatgatgcctaaatcccgg

SEQ ID NO: 626915 - DNA, 25 bp, Rattus norvegicus
tgcttcaattctacctttatcataa

SEQ ID NO: 626916 - DNA, 25 bp, Rattus norvegicus
tgcttcaattcttcctttatcataa

SEQ ID NO: 626917 - DNA, 25 bp, Rattus norvegicus
tgcttcacagcaccaagggtacaga

SEQ ID NO: 626918 - DNA, 25 bp, Rattus norvegicus
tgcttcacagcagcaagggtacaga

SEQ ID NO: 626919 - DNA, 25 bp, Rattus norvegicus
tgcttcacccagacaggaatcttat

SEQ ID NO: 626920 - DNA, 25 bp, Rattus norvegicus
tgcttcacccagtcaggaatcttat

SEQ ID NO: 626921 - DNA, 25 bp, Rattus norvegicus
tgcttcacgggtcgcacctggaaat

SEQ ID NO: 626922 - DNA, 25 bp, Rattus norvegicus
tgcttcacgggtggcacctggaaat

SEQ ID NO: 626923 - DNA, 25 bp, Rattus norvegicus
tgcttcacttcaccggaatgttcca

SEQ ID NO: 626924 - DNA, 25 bp, Rattus norvegicus
tgcttcacttcagcggaatgttcca

SEQ ID NO: 626925 - DNA, 25 bp, Rattus norvegicus
tgcttcagaccaagccatgtggttt

SEQ ID NO: 626926 - DNA, 25 bp, Rattus norvegicus
tgcttcagaccatgccatgtggttt

SEQ ID NO: 626927 - DNA, 25 bp, Rattus norvegicus
tgcttcagactgactaactcagcga

SEQ ID NO: 626928 - DNA, 25 bp, Rattus norvegicus
tgcttcagactgtctaactcagcga

SEQ ID NO: 626929 - DNA, 25 bp, Rattus norvegicus
tgcttcagagcacttcgtgctggta

SEQ ID NO: 626930 - DNA, 25 bp, Rattus norvegicus
tgcttcagagcagttcgtgctggta

SEQ ID NO: 626931 - DNA, 25 bp, Rattus norvegicus
tgcttcagagccagcttggagagga

SEQ ID NO: 626932 - DNA, 25 bp, Rattus norvegicus
tgcttcagagcctgcttggagagga

SEQ ID NO: 626933 - DNA, 25 bp, Rattus norvegicus
tgcttcagatggagcaagcttccct

SEQ ID NO: 626934 - DNA, 25 bp, Rattus norvegicus
tgcttcagatggtgcaagcttccct

SEQ ID NO: 626935 - DNA, 25 bp, Rattus norvegicus
tgcttcagcagtctcgggtctctac

SEQ ID NO: 626936 - DNA, 25 bp, Rattus norvegicus
tgcttcagcagtgtcgggtctctac

SEQ ID NO: 626937 - DNA, 25 bp, Rattus norvegicus
tgcttcagccatatcagagtatctg

SEQ ID NO: 626938 - DNA, 25 bp, Rattus norvegicus
tgcttcagccatttcagagtatctg

SEQ ID NO: 626939 - DNA, 25 bp, Rattus norvegicus
tgcttcagccttctactgtgtatat

SEQ ID NO: 626940 - DNA, 25 bp, Rattus norvegicus
tgcttcagccttgtactgtgtatat

SEQ ID NO: 626941 - DNA, 25 bp, Rattus norvegicus
tgcttcagctgtcatgtccctataa

SEQ ID NO: 626942 - DNA, 25 bp, Rattus norvegicus
tgcttcagctgtgatgtccctataa

SEQ ID NO: 626943 - DNA, 25 bp, Rattus norvegicus
tgcttcagcttcatcatcggcatac

SEQ ID NO: 626944 - DNA, 25 bp, Rattus norvegicus
tgcttcagcttcttcatcggcatac

SEQ ID NO: 626945 - DNA, 25 bp, Rattus norvegicus
tgcttcagcttgaatgaactcacgt

SEQ ID NO: 626946 - DNA, 25 bp, Rattus norvegicus
tgcttcagcttgtatgaactcacgt

SEQ ID NO: 626947 - DNA, 25 bp, Rattus norvegicus
tgcttcaggcagctatgggacccta

SEQ ID NO: 626948 - DNA, 25 bp, Rattus norvegicus
tgcttcaggcaggtatgggacccta

SEQ ID NO: 626949 - DNA, 25 bp, Rattus norvegicus
tgcttcagggagatcgggaaccctt

SEQ ID NO: 626950 - DNA, 25 bp, Rattus norvegicus
tgcttcagggagttcgggaaccctt

SEQ ID NO: 626951 - DNA, 25 bp, Rattus norvegicus
tgcttcagggccagcatttccagct

SEQ ID NO: 626952 - DNA, 25 bp, Rattus norvegicus
tgcttcagggcctgcatttccagct

SEQ ID NO: 626953 - DNA, 25 bp, Rattus norvegicus
tgcttcataacccagggccaatgag

SEQ ID NO: 626954 - DNA, 25 bp, Rattus norvegicus
tgcttcataaccgagggccaatgag

SEQ ID NO: 626955 - DNA, 25 bp, Rattus norvegicus
tgcttcatcacacacatacaccagt

SEQ ID NO: 626956 - DNA, 25 bp, Rattus norvegicus
tgcttcatcacagacatacaccagt

SEQ ID NO: 626957 - DNA, 25 bp, Rattus norvegicus
tgcttcatcatcattgtgcttggcc

SEQ ID NO: 626958 - DNA, 25 bp, Rattus norvegicus
tgcttcatcatctttgtgcttggcc

SEQ ID NO: 626959 - DNA, 25 bp, Rattus norvegicus
tgcttcatgcatcagtcacaggatc

SEQ ID NO: 626960 - DNA, 25 bp, Rattus norvegicus
tgcttcatgcatgagtcacaggatc

SEQ ID NO: 626961 - DNA, 25 bp, Rattus norvegicus
tgcttcatgcttagtcactccagaa

SEQ ID NO: 626962 - DNA, 25 bp, Rattus norvegicus
tgcttcatgctttgtcactccagaa

SEQ ID NO: 626963 - DNA, 25 bp, Rattus norvegicus
tgcttcattagtattccagatatcg

SEQ ID NO: 626964 - DNA, 25 bp, Rattus norvegicus
tgcttcattagttttccagatatcg

SEQ ID NO: 626965 - DNA, 25 bp, Rattus norvegicus
tgcttcattctcatatttgggcaag

SEQ ID NO: 626966 - DNA, 25 bp, Rattus norvegicus
tgcttcattctcttatttgggcaag

SEQ ID NO: 626967 - DNA, 25 bp, Rattus norvegicus
tgcttcattctgacttcctgtgtaa

SEQ ID NO: 626968 - DNA, 25 bp, Rattus norvegicus
tgcttcattctgtcttcctgtgtaa

SEQ ID NO: 626969 - DNA, 25 bp, Rattus norvegicus
tgcttccaacaccagagtcctggga

SEQ ID NO: 626970 - DNA, 25 bp, Rattus norvegicus
tgcttccaacacgagagtcctggga

SEQ ID NO: 626971 - DNA, 25 bp, Rattus norvegicus
tgcttccaattgcagggtgctgtaa

SEQ ID NO: 626972 - DNA, 25 bp, Rattus norvegicus
tgcttccaattggagggtgctgtaa

SEQ ID NO: 626973 - DNA, 25 bp, Rattus norvegicus
tgcttccacacacttgcatgcagtg

SEQ ID NO: 626974 - DNA, 25 bp, Rattus norvegicus
tgcttccacacagttgcatgcagtg

SEQ ID NO: 626975 - DNA, 25 bp, Rattus norvegicus
tgcttccacccaacttttctattaa

SEQ ID NO: 626976 - DNA, 25 bp, Rattus norvegicus
tgcttccacccatcttttctattaa

SEQ ID NO: 626977 - DNA, 25 bp, Rattus norvegicus
tgcttccaccttacttttgacagaa

SEQ ID NO: 626978 - DNA, 25 bp, Rattus norvegicus
tgcttccacctttcttttgacagaa

SEQ ID NO: 626979 - DNA, 25 bp, Rattus norvegicus
tgcttccacgttcagaggcatgtgc

SEQ ID NO: 626980 - DNA, 25 bp, Rattus norvegicus
tgcttccacgttgagaggcatgtgc

SEQ ID NO: 626981 - DNA, 25 bp, Rattus norvegicus
tgcttccacttgaactgtgtcacaa

SEQ ID NO: 626982 - DNA, 25 bp, Rattus norvegicus
tgcttccacttgtactgtgtcacaa

SEQ ID NO: 626983 - DNA, 25 bp, Rattus norvegicus
tgcttccagctaacaggccaacgat

SEQ ID NO: 626984 - DNA, 25 bp, Rattus norvegicus
tgcttccagctatcaggccaacgat

SEQ ID NO: 626985 - DNA, 25 bp, Rattus norvegicus
tgcttccagctcctgccttgagttc

SEQ ID NO: 626986 - DNA, 25 bp, Rattus norvegicus
tgcttccagctcgtgccttgagttc

SEQ ID NO: 626987 - DNA, 25 bp, Rattus norvegicus
tgcttccagtcactgttctgagcac

SEQ ID NO: 626988 - DNA, 25 bp, Rattus norvegicus
tgcttccagtcagtgttctgagcac

SEQ ID NO: 626989 - DNA, 25 bp, Rattus norvegicus
tgcttccagtcgatacagaccacta

SEQ ID NO: 626990 - DNA, 25 bp, Rattus norvegicus
tgcttccagtcgttacagaccacta

SEQ ID NO: 626991 - DNA, 25 bp, Rattus norvegicus
tgcttccatattcagctgcctggag

SEQ ID NO: 626992 - DNA, 25 bp, Rattus norvegicus
tgcttccatattgagctgcctggag

SEQ ID NO: 626993 - DNA, 25 bp, Rattus norvegicus
tgcttccatcggaggcatctcaggc

SEQ ID NO: 626994 - DNA, 25 bp, Rattus norvegicus
tgcttccatcggtggcatctcaggc

SEQ ID NO: 626995 - DNA, 25 bp, Rattus norvegicus
tgcttccatcgtagctacttgaagt

SEQ ID NO: 626996 - DNA, 25 bp, Rattus norvegicus
tgcttccatcgttgctacttgaagt

SEQ ID NO: 626997 - DNA, 25 bp, Rattus norvegicus
tgcttccatggacgccagaatcaag

SEQ ID NO: 626998 - DNA, 25 bp, Rattus norvegicus
tgcttccatggaggccagaatcaag

SEQ ID NO: 626999 - DNA, 25 bp, Rattus norvegicus
tgcttcccagatactgtggttaatg

SEQ ID NO: 627000 - DNA, 25 bp, Rattus norvegicus
tgcttcccagattctgtggttaatg

SEQ ID NO: 627001 - DNA, 25 bp, Rattus norvegicus
tgcttcccaggaatgcatgctccgt

SEQ ID NO: 627002 - DNA, 25 bp, Rattus norvegicus
tgcttcccaggattgcatgctccgt

SEQ ID NO: 627003 - DNA, 25 bp, Rattus norvegicus
tgcttccccaaacatgtgaccagat

SEQ ID NO: 627004 - DNA, 25 bp, Rattus norvegicus
tgcttccccaaagatgtgaccagat

SEQ ID NO: 627005 - DNA, 25 bp, Rattus norvegicus
tgcttccccactatatcagactaga

SEQ ID NO: 627006 - DNA, 25 bp, Rattus norvegicus
tgcttccccactttatcagactaga

SEQ ID NO: 627007 - DNA, 25 bp, Rattus norvegicus
tgcttccccaggagtgtgccctaaa

SEQ ID NO: 627008 - DNA, 25 bp, Rattus norvegicus
tgcttccccaggtgtgtgccctaaa

SEQ ID NO: 627009 - DNA, 25 bp, Rattus norvegicus
tgcttccccatacagattctaaatg

SEQ ID NO: 627010 - DNA, 25 bp, Rattus norvegicus
tgcttccccatagagattctaaatg

SEQ ID NO: 627011 - DNA, 25 bp, Rattus norvegicus
tgcttccccattataggcgacaatt

SEQ ID NO: 627012 - DNA, 25 bp, Rattus norvegicus
tgcttccccattttaggcgacaatt

SEQ ID NO: 627013 - DNA, 25 bp, Rattus norvegicus
tgcttccccgttaaactctgcggtg

SEQ ID NO: 627014 - DNA, 25 bp, Rattus norvegicus
tgcttccccgtttaactctgcggtg

SEQ ID NO: 627015 - DNA, 25 bp, Rattus norvegicus
tgcttcccctctaacaggagacaaa

SEQ ID NO: 627016 - DNA, 25 bp, Rattus norvegicus
tgcttcccctcttacaggagacaaa

SEQ ID NO: 627017 - DNA, 25 bp, Rattus norvegicus
tgcttccccttgcatggaggatagt

SEQ ID NO: 627018 - DNA, 25 bp, Rattus norvegicus
tgcttccccttggatggaggatagt

SEQ ID NO: 627019 - DNA, 25 bp, Rattus norvegicus
tgcttcccctttctcaagtgcctta

SEQ ID NO: 627020 - DNA, 25 bp, Rattus norvegicus
tgcttcccctttgtcaagtgcctta

SEQ ID NO: 627021 - DNA, 25 bp, Rattus norvegicus
tgcttcccgagtccggagactaaaa

SEQ ID NO: 627022 - DNA, 25 bp, Rattus norvegicus
tgcttcccgagtgcggagactaaaa

SEQ ID NO: 627023 - DNA, 25 bp, Rattus norvegicus
tgcttcccgcacatgtgaaactcag

SEQ ID NO: 627024 - DNA, 25 bp, Rattus norvegicus
tgcttcccgcacttgtgaaactcag

SEQ ID NO: 627025 - DNA, 25 bp, Rattus norvegicus
tgcttcccggtgatactctgtaaga

SEQ ID NO: 627026 - DNA, 25 bp, Rattus norvegicus
tgcttcccggtgttactctgtaaga

SEQ ID NO: 627027 - DNA, 25 bp, Rattus norvegicus
tgcttccctgggattcaaggtgtga

SEQ ID NO: 627028 - DNA, 25 bp, Rattus norvegicus
tgcttccctgggtttcaaggtgtga

SEQ ID NO: 627029 - DNA, 25 bp, Rattus norvegicus
tgcttccctggtagtgcagtgtaaa

SEQ ID NO: 627030 - DNA, 25 bp, Rattus norvegicus
tgcttccctggttgtgcagtgtaaa

SEQ ID NO: 627031 - DNA, 25 bp, Rattus norvegicus
tgcttcccttccattgggtttccag

SEQ ID NO: 627032 - DNA, 25 bp, Rattus norvegicus
tgcttcccttcctttgggtttccag

SEQ ID NO: 627033 - DNA, 25 bp, Rattus norvegicus
tgcttccctttcaataaagccgtgc

SEQ ID NO: 627034 - DNA, 25 bp, Rattus norvegicus
tgcttccctttctataaagccgtgc

SEQ ID NO: 627035 - DNA, 25 bp, Rattus norvegicus
tgcttccgattacctagacgcctat

SEQ ID NO: 627036 - DNA, 25 bp, Rattus norvegicus
tgcttccgattagctagacgcctat

SEQ ID NO: 627037 - DNA, 25 bp, Rattus norvegicus
tgcttccgggttcctgccttatgct

SEQ ID NO: 627038 - DNA, 25 bp, Rattus norvegicus
tgcttccgggttgctgccttatgct

SEQ ID NO: 627039 - DNA, 25 bp, Rattus norvegicus
tgcttcctaagaactggtgctctag

SEQ ID NO: 627040 - DNA, 25 bp, Rattus norvegicus
tgcttcctaagatctggtgctctag

SEQ ID NO: 627041 - DNA, 25 bp, Rattus norvegicus
tgcttcctaagcatcaggcgcagag

SEQ ID NO: 627042 - DNA, 25 bp, Rattus norvegicus
tgcttcctaagcttcaggcgcagag

SEQ ID NO: 627043 - DNA, 25 bp, Rattus norvegicus
tgcttcctaaggataattcactggg

SEQ ID NO: 627044 - DNA, 25 bp, Rattus norvegicus
tgcttcctaaggttaattcactggg

SEQ ID NO: 627045 - DNA, 25 bp, Rattus norvegicus
tgcttcctaccaatgtttactgtaa

SEQ ID NO: 627046 - DNA, 25 bp, Rattus norvegicus
tgcttcctaccattgtttactgtaa

SEQ ID NO: 627047 - DNA, 25 bp, Rattus norvegicus
tgcttcctacccaagatgttggtgt

SEQ ID NO: 627048 - DNA, 25 bp, Rattus norvegicus
tgcttcctaccctagatgttggtgt

SEQ ID NO: 627049 - DNA, 25 bp, Rattus norvegicus
tgcttcctagcacaaccatggtctg

SEQ ID NO: 627050 - DNA, 25 bp, Rattus norvegicus
tgcttcctagcagaaccatggtctg

SEQ ID NO: 627051 - DNA, 25 bp, Rattus norvegicus
tgcttcctatggctcccttagtgac

SEQ ID NO: 627052 - DNA, 25 bp, Rattus norvegicus
tgcttcctatgggtcccttagtgac

SEQ ID NO: 627053 - DNA, 25 bp, Rattus norvegicus
tgcttcctcaagagactctgagaat

SEQ ID NO: 627054 - DNA, 25 bp, Rattus norvegicus
tgcttcctcaagagagtgagaccaa

SEQ ID NO: 627055 - DNA, 25 bp, Rattus norvegicus
tgcttcctcaagtgactctgagaat

SEQ ID NO: 627056 - DNA, 25 bp, Rattus norvegicus
tgcttcctcaagtgagtgagaccaa

SEQ ID NO: 627057 - DNA, 25 bp, Rattus norvegicus
tgcttcctccagaccagagctagaa

SEQ ID NO: 627058 - DNA, 25 bp, Rattus norvegicus
tgcttcctccagagggcctctgaaa

SEQ ID NO: 627059 - DNA, 25 bp, Rattus norvegicus
tgcttcctccagtccagagctagaa

SEQ ID NO: 627060 - DNA, 25 bp, Rattus norvegicus
tgcttcctccagtgggcctctgaaa

SEQ ID NO: 627061 - DNA, 25 bp, Rattus norvegicus
tgcttcctcccacataactttagtg

SEQ ID NO: 627062 - DNA, 25 bp, Rattus norvegicus
tgcttcctcccagataactttagtg

SEQ ID NO: 627063 - DNA, 25 bp, Rattus norvegicus
tgcttcctcttaatcttcctattag

SEQ ID NO: 627064 - DNA, 25 bp, Rattus norvegicus
tgcttcctcttattcttcctattag

SEQ ID NO: 627065 - DNA, 25 bp, Rattus norvegicus
tgcttcctgccgagtgaattcgaga

SEQ ID NO: 627066 - DNA, 25 bp, Rattus norvegicus
tgcttcctgccgtgtgaattcgaga

SEQ ID NO: 627067 - DNA, 25 bp, Rattus norvegicus
tgcttcctggaactgctgtaactaa

SEQ ID NO: 627068 - DNA, 25 bp, Rattus norvegicus
tgcttcctggaagtgctgtaactaa

SEQ ID NO: 627069 - DNA, 25 bp, Rattus norvegicus
tgcttcctggcactcactgacatgt

SEQ ID NO: 627070 - DNA, 25 bp, Rattus norvegicus
tgcttcctggcagtcactgacatgt

SEQ ID NO: 627071 - DNA, 25 bp, Rattus norvegicus
tgcttcctgggaccatgttgatggc

SEQ ID NO: 627072 - DNA, 25 bp, Rattus norvegicus
tgcttcctgggagcatgttgatggc

SEQ ID NO: 627073 - DNA, 25 bp, Rattus norvegicus
tgcttcctgggcagttacagtcaat

SEQ ID NO: 627074 - DNA, 25 bp, Rattus norvegicus
tgcttcctgggctgttacagtcaat

SEQ ID NO: 627075 - DNA, 25 bp, Rattus norvegicus
tgcttcctggtcattcttgctaaca

SEQ ID NO: 627076 - DNA, 25 bp, Rattus norvegicus
tgcttcctggtctttcttgctaaca

SEQ ID NO: 627077 - DNA, 25 bp, Rattus norvegicus
tgcttcctgtatatccttttactac

SEQ ID NO: 627078 - DNA, 25 bp, Rattus norvegicus
tgcttcctgtatttccttttactac

SEQ ID NO: 627079 - DNA, 25 bp, Rattus norvegicus
tgcttcctgtcccagaggcatgtgc

SEQ ID NO: 627080 - DNA, 25 bp, Rattus norvegicus
tgcttcctgtccgagaggcatgtgc

SEQ ID NO: 627081 - DNA, 25 bp, Rattus norvegicus
tgcttcctgtctcgctagactctaa

SEQ ID NO: 627082 - DNA, 25 bp, Rattus norvegicus
tgcttcctgtctggctagactctaa

SEQ ID NO: 627083 - DNA, 25 bp, Rattus norvegicus
tgcttccttagaaaatcagccaaag

SEQ ID NO: 627084 - DNA, 25 bp, Rattus norvegicus
tgcttccttagataatcagccaaag

SEQ ID NO: 627085 - DNA, 25 bp, Rattus norvegicus
tgcttccttcttcgctatcagatga

SEQ ID NO: 627086 - DNA, 25 bp, Rattus norvegicus
tgcttccttcttggctatcagatga

SEQ ID NO: 627087 - DNA, 25 bp, Rattus norvegicus
tgcttccttgagaccagattgtcga

SEQ ID NO: 627088 - DNA, 25 bp, Rattus norvegicus
tgcttccttgagtccagattgtcga

SEQ ID NO: 627089 - DNA, 25 bp, Rattus norvegicus
tgcttccttgctcctatgatggatt

SEQ ID NO: 627090 - DNA, 25 bp, Rattus norvegicus
tgcttccttgctgctatgatggatt

SEQ ID NO: 627091 - DNA, 25 bp, Rattus norvegicus
tgcttccttttcagtttcagggttt

SEQ ID NO: 627092 - DNA, 25 bp, Rattus norvegicus
tgcttccttttctgtttcagggttt

SEQ ID NO: 627093 - DNA, 25 bp, Rattus norvegicus
tgcttccttttgatctgtgggacat

SEQ ID NO: 627094 - DNA, 25 bp, Rattus norvegicus
tgcttccttttgttctgtgggacat

SEQ ID NO: 627095 - DNA, 25 bp, Rattus norvegicus
tgcttcgaaactcgcaattcacaat

SEQ ID NO: 627096 - DNA, 25 bp, Rattus norvegicus
tgcttcgaaactggcaattcacaat

SEQ ID NO: 627097 - DNA, 25 bp, Rattus norvegicus
tgcttcgagatacctgtgcgtttaa

SEQ ID NO: 627098 - DNA, 25 bp, Rattus norvegicus
tgcttcgagatagctgtgcgtttaa

SEQ ID NO: 627099 - DNA, 25 bp, Rattus norvegicus
tgcttcgagcctccaagagtaactt

SEQ ID NO: 627100 - DNA, 25 bp, Rattus norvegicus
tgcttcgagcctgcaagagtaactt

SEQ ID NO: 627101 - DNA, 25 bp, Rattus norvegicus
tgcttcgcaggcacccataagagga

SEQ ID NO: 627102 - DNA, 25 bp, Rattus norvegicus
tgcttcgcaggctcccataagagga

SEQ ID NO: 627103 - DNA, 25 bp, Rattus norvegicus
tgcttcggaacccttactacaagtt

SEQ ID NO: 627104 - DNA, 25 bp, Rattus norvegicus
tgcttcggaaccgttactacaagtt

SEQ ID NO: 627105 - DNA, 25 bp, Rattus norvegicus
tgcttcggagacactacgacagccg

SEQ ID NO: 627106 - DNA, 25 bp, Rattus norvegicus
tgcttcggagactctacgacagccg

SEQ ID NO: 627107 - DNA, 25 bp, Rattus norvegicus
tgcttcggcttcacgctacagagct

SEQ ID NO: 627108 - DNA, 25 bp, Rattus norvegicus
tgcttcggcttctcgctacagagct

SEQ ID NO: 627109 - DNA, 25 bp, Rattus norvegicus
tgcttcgggtttcgtattccagtct

SEQ ID NO: 627110 - DNA, 25 bp, Rattus norvegicus
tgcttcgggtttggtattccagtct

SEQ ID NO: 627111 - DNA, 25 bp, Rattus norvegicus
tgcttcgtggccatcacctttatgg

SEQ ID NO: 627112 - DNA, 25 bp, Rattus norvegicus
tgcttcgtggccttcacctttatgg

SEQ ID NO: 627113 - DNA, 25 bp, Rattus norvegicus
tgcttcgtttccatggtcactggga

SEQ ID NO: 627114 - DNA, 25 bp, Rattus norvegicus
tgcttcgtttccttggtcactggga

SEQ ID NO: 627115 - DNA, 25 bp, Rattus norvegicus
tgcttctactgtcaatactgaggtt

SEQ ID NO: 627116 - DNA, 25 bp, Rattus norvegicus
tgcttctactgtgaatactgaggtt

SEQ ID NO: 627117 - DNA, 25 bp, Rattus norvegicus
tgcttctacttgagatttcctttag

SEQ ID NO: 627118 - DNA, 25 bp, Rattus norvegicus
tgcttctacttgtgatttcctttag

SEQ ID NO: 627119 - DNA, 25 bp, Rattus norvegicus
tgcttctaggcgcactgttactgag

SEQ ID NO: 627120 - DNA, 25 bp, Rattus norvegicus
tgcttctaggcggactgttactgag

SEQ ID NO: 627121 - DNA, 25 bp, Rattus norvegicus
tgcttctatggcaggtgtacacttt

SEQ ID NO: 627122 - DNA, 25 bp, Rattus norvegicus
tgcttctatggctggtgtacacttt

SEQ ID NO: 627123 - DNA, 25 bp, Rattus norvegicus
tgcttctatgtcagccgtatactgc

SEQ ID NO: 627124 - DNA, 25 bp, Rattus norvegicus
tgcttctatgtctgccgtatactgc

SEQ ID NO: 627125 - DNA, 25 bp, Rattus norvegicus
tgcttctcacctctcatttgaataa

SEQ ID NO: 627126 - DNA, 25 bp, Rattus norvegicus
tgcttctcacctgtcatttgaataa

SEQ ID NO: 627127 - DNA, 25 bp, Rattus norvegicus
tgcttctcagctctaaccattgtgt

SEQ ID NO: 627128 - DNA, 25 bp, Rattus norvegicus
tgcttctcagctctcagtagcctta

SEQ ID NO: 627129 - DNA, 25 bp, Rattus norvegicus
tgcttctcagctgtaaccattgtgt

SEQ ID NO: 627130 - DNA, 25 bp, Rattus norvegicus
tgcttctcagctgtcagtagcctta

SEQ ID NO: 627131 - DNA, 25 bp, Rattus norvegicus
tgcttctcatagacaccttcattat

SEQ ID NO: 627132 - DNA, 25 bp, Rattus norvegicus
tgcttctcatagtcaccttcattat

SEQ ID NO: 627133 - DNA, 25 bp, Rattus norvegicus
tgcttctcatcgcagagtatccgga

SEQ ID NO: 627134 - DNA, 25 bp, Rattus norvegicus
tgcttctcatcggagagtatccgga

SEQ ID NO: 627135 - DNA, 25 bp, Rattus norvegicus
tgcttctccacaacacagtgatctt

SEQ ID NO: 627136 - DNA, 25 bp, Rattus norvegicus
tgcttctccacacgtgtgcgggtga

SEQ ID NO: 627137 - DNA, 25 bp, Rattus norvegicus
tgcttctccacaggtgtgcgggtga

SEQ ID NO: 627138 - DNA, 25 bp, Rattus norvegicus
tgcttctccacatcacagtgatctt

SEQ ID NO: 627139 - DNA, 25 bp, Rattus norvegicus
tgcttctccagcacaagagtcagag

SEQ ID NO: 627140 - DNA, 25 bp, Rattus norvegicus
tgcttctccagctcaagagtcagag

SEQ ID NO: 627141 - DNA, 25 bp, Rattus norvegicus
tgcttctcccatacatggagcctgt

SEQ ID NO: 627142 - DNA, 25 bp, Rattus norvegicus
tgcttctcccattcatggagcctgt

SEQ ID NO: 627143 - DNA, 25 bp, Rattus norvegicus
tgcttctcccctaatattaaacaca

SEQ ID NO: 627144 - DNA, 25 bp, Rattus norvegicus
tgcttctccccttatattaaacaca

SEQ ID NO: 627145 - DNA, 25 bp, Rattus norvegicus
tgcttctccgggaaccatgttgtga

SEQ ID NO: 627146 - DNA, 25 bp, Rattus norvegicus
tgcttctccgggtaccatgttgtga

SEQ ID NO: 627147 - DNA, 25 bp, Rattus norvegicus
tgcttctcctacatccagaggaaga

SEQ ID NO: 627148 - DNA, 25 bp, Rattus norvegicus
tgcttctcctacttccagaggaaga

SEQ ID NO: 627149 - DNA, 25 bp, Rattus norvegicus
tgcttctcctggctggaaccaagac

SEQ ID NO: 627150 - DNA, 25 bp, Rattus norvegicus
tgcttctcctgggtggaaccaagac

SEQ ID NO: 627151 - DNA, 25 bp, Rattus norvegicus
tgcttctccttaaaactgtttcaca

SEQ ID NO: 627152 - DNA, 25 bp, Rattus norvegicus
tgcttctccttataactgtttcaca

SEQ ID NO: 627153 - DNA, 25 bp, Rattus norvegicus
tgcttctcggcaacagagctggcag

SEQ ID NO: 627154 - DNA, 25 bp, Rattus norvegicus
tgcttctcggcatcagagctggcag

SEQ ID NO: 627155 - DNA, 25 bp, Rattus norvegicus
tgcttctctatgctgtacccagaca

SEQ ID NO: 627156 - DNA, 25 bp, Rattus norvegicus
tgcttctctatggtgtacccagaca

SEQ ID NO: 627157 - DNA, 25 bp, Rattus norvegicus
tgcttctctattcctcacagtgaga

SEQ ID NO: 627158 - DNA, 25 bp, Rattus norvegicus
tgcttctctattgctcacagtgaga

SEQ ID NO: 627159 - DNA, 25 bp, Rattus norvegicus
tgcttctctcgcattgttctcaagt

SEQ ID NO: 627160 - DNA, 25 bp, Rattus norvegicus
tgcttctctcgctttgttctcaagt

SEQ ID NO: 627161 - DNA, 25 bp, Rattus norvegicus
tgcttctctctcactgagagggaaa

SEQ ID NO: 627162 - DNA, 25 bp, Rattus norvegicus
tgcttctctctctctgagagggaaa

SEQ ID NO: 627163 - DNA, 25 bp, Rattus norvegicus
tgcttctctgggagctcatgacgag

SEQ ID NO: 627164 - DNA, 25 bp, Rattus norvegicus
tgcttctctgggtgctcatgacgag

SEQ ID NO: 627165 - DNA, 25 bp, Rattus norvegicus
tgcttctcttcaaccatttcttagt

SEQ ID NO: 627166 - DNA, 25 bp, Rattus norvegicus
tgcttctcttcatccatttcttagt

SEQ ID NO: 627167 - DNA, 25 bp, Rattus norvegicus
tgcttctcttgaagacctgacaaga

SEQ ID NO: 627168 - DNA, 25 bp, Rattus norvegicus
tgcttctcttgatgacctgacaaga

SEQ ID NO: 627169 - DNA, 25 bp, Rattus norvegicus
tgcttctcttgtagcactgctagac

SEQ ID NO: 627170 - DNA, 25 bp, Rattus norvegicus
tgcttctcttgttgcactgctagac

SEQ ID NO: 627171 - DNA, 25 bp, Rattus norvegicus
tgcttctgactgacgttctgtagga

SEQ ID NO: 627172 - DNA, 25 bp, Rattus norvegicus
tgcttctgactgtcgttctgtagga

SEQ ID NO: 627173 - DNA, 25 bp, Rattus norvegicus
tgcttctgagaacccgtcaggttct

SEQ ID NO: 627174 - DNA, 25 bp, Rattus norvegicus
tgcttctgagaagccgtcaggttct

SEQ ID NO: 627175 - DNA, 25 bp, Rattus norvegicus
tgcttctgatctactaccgcaactt

SEQ ID NO: 627176 - DNA, 25 bp, Rattus norvegicus
tgcttctgatcttctaccgcaactt

SEQ ID NO: 627177 - DNA, 25 bp, Rattus norvegicus
tgcttctgattcctttctgtccaat

SEQ ID NO: 627178 - DNA, 25 bp, Rattus norvegicus
tgcttctgattcgtttctgtccaat

SEQ ID NO: 627179 - DNA, 25 bp, Rattus norvegicus
tgcttctgccgtacagtcatagctc

SEQ ID NO: 627180 - DNA, 25 bp, Rattus norvegicus
tgcttctgccgttcagtcatagctc

SEQ ID NO: 627181 - DNA, 25 bp, Rattus norvegicus
tgcttctgctacactctgtacagga

SEQ ID NO: 627182 - DNA, 25 bp, Rattus norvegicus
tgcttctgctactctctgtacagga

SEQ ID NO: 627183 - DNA, 25 bp, Rattus norvegicus
tgcttctgctctatgggctcctagt

SEQ ID NO: 627184 - DNA, 25 bp, Rattus norvegicus
tgcttctgctctcggaggtgaccac

SEQ ID NO: 627185 - DNA, 25 bp, Rattus norvegicus
tgcttctgctctgggaggtgaccac

SEQ ID NO: 627186 - DNA, 25 bp, Rattus norvegicus
tgcttctgctctttgggctcctagt

SEQ ID NO: 627187 - DNA, 25 bp, Rattus norvegicus
tgcttctggacgcatgccgctgaca

SEQ ID NO: 627188 - DNA, 25 bp, Rattus norvegicus
tgcttctggacggatgccgctgaca

SEQ ID NO: 627189 - DNA, 25 bp, Rattus norvegicus
tgcttctggcccacaggcatcatcg

SEQ ID NO: 627190 - DNA, 25 bp, Rattus norvegicus
tgcttctggccctcaggcatcatcg

SEQ ID NO: 627191 - DNA, 25 bp, Rattus norvegicus
tgcttctgtagacggccatgtgctt

SEQ ID NO: 627192 - DNA, 25 bp, Rattus norvegicus
tgcttctgtagagggccatgtgctt

SEQ ID NO: 627193 - DNA, 25 bp, Rattus norvegicus
tgcttctgtcggctatgtggtcaca

SEQ ID NO: 627194 - DNA, 25 bp, Rattus norvegicus
tgcttctgtcgggtatgtggtcaca

SEQ ID NO: 627195 - DNA, 25 bp, Rattus norvegicus
tgcttctgtgtgatcatttactccc

SEQ ID NO: 627196 - DNA, 25 bp, Rattus norvegicus
tgcttctgtgtgttcatttactccc

SEQ ID NO: 627197 - DNA, 25 bp, Rattus norvegicus
tgcttctgtgttagtcaacgtgact

SEQ ID NO: 627198 - DNA, 25 bp, Rattus norvegicus
tgcttctgtgtttgtcaacgtgact

SEQ ID NO: 627199 - DNA, 25 bp, Rattus norvegicus
tgcttcttaattcacgcccacattg

SEQ ID NO: 627200 - DNA, 25 bp, Rattus norvegicus
tgcttcttaattgacgcccacattg

SEQ ID NO: 627201 - DNA, 25 bp, Rattus norvegicus
tgcttcttagatcttctcagctgaa

SEQ ID NO: 627202 - DNA, 25 bp, Rattus norvegicus
tgcttcttagatgttctcagctgaa

SEQ ID NO: 627203 - DNA, 25 bp, Rattus norvegicus
tgcttcttataaaacatctgtgtca

SEQ ID NO: 627204 - DNA, 25 bp, Rattus norvegicus
tgcttcttataatacatctgtgtca

SEQ ID NO: 627205 - DNA, 25 bp, Rattus norvegicus
tgcttcttatacaggccacatacaa

SEQ ID NO: 627206 - DNA, 25 bp, Rattus norvegicus
tgcttcttatactggccacatacaa

SEQ ID NO: 627207 - DNA, 25 bp, Rattus norvegicus
tgcttcttcaacagcagtgatcctg

SEQ ID NO: 627208 - DNA, 25 bp, Rattus norvegicus
tgcttcttcaactgcagtgatcctg

SEQ ID NO: 627209 - DNA, 25 bp, Rattus norvegicus
tgcttcttccccattcgaagaaata

SEQ ID NO: 627210 - DNA, 25 bp, Rattus norvegicus
tgcttcttcccctttcgaagaaata

SEQ ID NO: 627211 - DNA, 25 bp, Rattus norvegicus
tgcttcttcctgacacctagaagag

SEQ ID NO: 627212 - DNA, 25 bp, Rattus norvegicus
tgcttcttcctgtcacctagaagag

SEQ ID NO: 627213 - DNA, 25 bp, Rattus norvegicus
tgcttcttcgcgctcagcgtgaaga

SEQ ID NO: 627214 - DNA, 25 bp, Rattus norvegicus
tgcttcttcgcggtcagcgtgaaga

SEQ ID NO: 627215 - DNA, 25 bp, Rattus norvegicus
tgcttcttctctcccggtggaaaaa

SEQ ID NO: 627216 - DNA, 25 bp, Rattus norvegicus
tgcttcttctctgccggtggaaaaa

SEQ ID NO: 627217 - DNA, 25 bp, Rattus norvegicus
tgcttcttcttcatgcgacccataa

SEQ ID NO: 627218 - DNA, 25 bp, Rattus norvegicus
tgcttcttcttcttgcgacccataa

SEQ ID NO: 627219 - DNA, 25 bp, Rattus norvegicus
tgcttcttgagccatatgcccatac

SEQ ID NO: 627220 - DNA, 25 bp, Rattus norvegicus
tgcttcttgagcgatatgcccatac

SEQ ID NO: 627221 - DNA, 25 bp, Rattus norvegicus
tgcttcttgctacttcagcagactg

SEQ ID NO: 627222 - DNA, 25 bp, Rattus norvegicus
tgcttcttgctagttcagcagactg

SEQ ID NO: 627223 - DNA, 25 bp, Rattus norvegicus
tgcttcttgctgatattggtggact

SEQ ID NO: 627224 - DNA, 25 bp, Rattus norvegicus
tgcttcttgctgttattggtggact

SEQ ID NO: 627225 - DNA, 25 bp, Rattus norvegicus
tgcttcttggcaaattctggtcccg

SEQ ID NO: 627226 - DNA, 25 bp, Rattus norvegicus
tgcttcttggcatattctggtcccg

SEQ ID NO: 627227 - DNA, 25 bp, Rattus norvegicus
tgcttcttgtgcaaagcctctaaat

SEQ ID NO: 627228 - DNA, 25 bp, Rattus norvegicus
tgcttcttgtgctaagcctctaaat

SEQ ID NO: 627229 - DNA, 25 bp, Rattus norvegicus
tgcttcttgtgtcggttggttctta

SEQ ID NO: 627230 - DNA, 25 bp, Rattus norvegicus
tgcttcttgtgtgggttggttctta

SEQ ID NO: 627231 - DNA, 25 bp, Rattus norvegicus
tgcttcttgttcactacgactcgtg

SEQ ID NO: 627232 - DNA, 25 bp, Rattus norvegicus
tgcttcttgttctctacgactcgtg

SEQ ID NO: 627233 - DNA, 25 bp, Rattus norvegicus
tgcttctttaccaacattccttgag

SEQ ID NO: 627234 - DNA, 25 bp, Rattus norvegicus
tgcttctttacctacattccttgag

SEQ ID NO: 627235 - DNA, 25 bp, Rattus norvegicus
tgcttctttcggctcacatttcaaa

SEQ ID NO: 627236 - DNA, 25 bp, Rattus norvegicus
tgcttctttcgggtcacatttcaaa

SEQ ID NO: 627237 - DNA, 25 bp, Rattus norvegicus
tgcttctttggcctccagagtgcag

SEQ ID NO: 627238 - DNA, 25 bp, Rattus norvegicus
tgcttctttggcgtccagagtgcag

SEQ ID NO: 627239 - DNA, 25 bp, Rattus norvegicus
tgcttgaagaccaggctgctggact

SEQ ID NO: 627240 - DNA, 25 bp, Rattus norvegicus
tgcttgaagacctggctgctggact

SEQ ID NO: 627241 - DNA, 25 bp, Rattus norvegicus
tgcttgacaggcactcactctaaaa

SEQ ID NO: 627242 - DNA, 25 bp, Rattus norvegicus
tgcttgacaggctctcactctaaaa

SEQ ID NO: 627243 - DNA, 25 bp, Rattus norvegicus
tgcttgacaggtcccagcttcttca

SEQ ID NO: 627244 - DNA, 25 bp, Rattus norvegicus
tgcttgacaggtgccagcttcttca

SEQ ID NO: 627245 - DNA, 25 bp, Rattus norvegicus
tgcttgacctggaaagtggcctcag

SEQ ID NO: 627246 - DNA, 25 bp, Rattus norvegicus
tgcttgacctggtaagtggcctcag

SEQ ID NO: 627247 - DNA, 25 bp, Rattus norvegicus
tgcttgaccttcaccatggcagctt

SEQ ID NO: 627248 - DNA, 25 bp, Rattus norvegicus
tgcttgaccttctccatggcagctt

SEQ ID NO: 627249 - DNA, 25 bp, Rattus norvegicus
tgcttgactactaccagccaagaat

SEQ ID NO: 627250 - DNA, 25 bp, Rattus norvegicus
tgcttgactacttccagccaagaat

SEQ ID NO: 627251 - DNA, 25 bp, Rattus norvegicus
tgcttgactgggagtacgagacgct

SEQ ID NO: 627252 - DNA, 25 bp, Rattus norvegicus
tgcttgactgggtgtacgagacgct

SEQ ID NO: 627253 - DNA, 25 bp, Rattus norvegicus
tgcttgagaggcacggccgcgaaca

SEQ ID NO: 627254 - DNA, 25 bp, Rattus norvegicus
tgcttgagaggctcggccgcgaaca

SEQ ID NO: 627255 - DNA, 25 bp, Rattus norvegicus
tgcttgagctttagaccccagactt

SEQ ID NO: 627256 - DNA, 25 bp, Rattus norvegicus
tgcttgagcttttgaccccagactt

SEQ ID NO: 627257 - DNA, 25 bp, Rattus norvegicus
tgcttgaggtagaccactgtctgat

SEQ ID NO: 627258 - DNA, 25 bp, Rattus norvegicus
tgcttgaggtagtccactgtctgat

SEQ ID NO: 627259 - DNA, 25 bp, Rattus norvegicus
tgcttgatcagcactgacgaggccc

SEQ ID NO: 627260 - DNA, 25 bp, Rattus norvegicus
tgcttgatcagctctgacgaggccc

SEQ ID NO: 627261 - DNA, 25 bp, Rattus norvegicus
tgcttgatggtcatcttgggtgaga

SEQ ID NO: 627262 - DNA, 25 bp, Rattus norvegicus
tgcttgatggtcttcttgggtgaga

SEQ ID NO: 627263 - DNA, 25 bp, Rattus norvegicus
tgcttgcaatatcagacccagtacc

SEQ ID NO: 627264 - DNA, 25 bp, Rattus norvegicus
tgcttgcaatatgagacccagtacc

SEQ ID NO: 627265 - DNA, 25 bp, Rattus norvegicus
tgcttgcacggacctattcgcgtct

SEQ ID NO: 627266 - DNA, 25 bp, Rattus norvegicus
tgcttgcacggagctattcgcgtct

SEQ ID NO: 627267 - DNA, 25 bp, Rattus norvegicus
tgcttgcagtctctctgcagcagtg

SEQ ID NO: 627268 - DNA, 25 bp, Rattus norvegicus
tgcttgcagtctgtctgcagcagtg

SEQ ID NO: 627269 - DNA, 25 bp, Rattus norvegicus
tgcttgcagtgcactggcgcttgcg

SEQ ID NO: 627270 - DNA, 25 bp, Rattus norvegicus
tgcttgcagtgctctggcgcttgcg

SEQ ID NO: 627271 - DNA, 25 bp, Rattus norvegicus
tgcttgcataatatgacttcaggct

SEQ ID NO: 627272 - DNA, 25 bp, Rattus norvegicus
tgcttgcataatttgacttcaggct

SEQ ID NO: 627273 - DNA, 25 bp, Rattus norvegicus
tgcttgcatctgactcgcacaaaga

SEQ ID NO: 627274 - DNA, 25 bp, Rattus norvegicus
tgcttgcatctgtctcgcacaaaga

SEQ ID NO: 627275 - DNA, 25 bp, Rattus norvegicus
tgcttgcattccaatacacagactc

SEQ ID NO: 627276 - DNA, 25 bp, Rattus norvegicus
tgcttgcattccagtgagaccgtgt

SEQ ID NO: 627277 - DNA, 25 bp, Rattus norvegicus
tgcttgcattcctatacacagactc

SEQ ID NO: 627278 - DNA, 25 bp, Rattus norvegicus
tgcttgcattcctgtgagaccgtgt

SEQ ID NO: 627279 - DNA, 25 bp, Rattus norvegicus
tgcttgccagttacagccttcagca

SEQ ID NO: 627280 - DNA, 25 bp, Rattus norvegicus
tgcttgccagtttcagccttcagca

SEQ ID NO: 627281 - DNA, 25 bp, Rattus norvegicus
tgcttgcccctcagattggatgctt

SEQ ID NO: 627282 - DNA, 25 bp, Rattus norvegicus
tgcttgcccctctgattggatgctt

SEQ ID NO: 627283 - DNA, 25 bp, Rattus norvegicus
tgcttgccctctcagtggaagccaa

SEQ ID NO: 627284 - DNA, 25 bp, Rattus norvegicus
tgcttgccctctgagtggaagccaa

SEQ ID NO: 627285 - DNA, 25 bp, Rattus norvegicus
tgcttgccgggactattggacctac

SEQ ID NO: 627286 - DNA, 25 bp, Rattus norvegicus
tgcttgccgggagtattggacctac

SEQ ID NO: 627287 - DNA, 25 bp, Rattus norvegicus
tgcttgcctaatctgtgcagagaga

SEQ ID NO: 627288 - DNA, 25 bp, Rattus norvegicus
tgcttgcctaatgtgtgcagagaga

SEQ ID NO: 627289 - DNA, 25 bp, Rattus norvegicus
tgcttgcctcaaacctaccaaatat

SEQ ID NO: 627290 - DNA, 25 bp, Rattus norvegicus
tgcttgcctcaatcctaccaaatat

SEQ ID NO: 627291 - DNA, 25 bp, Rattus norvegicus
tgcttgcctgagatagaattgccta

SEQ ID NO: 627292 - DNA, 25 bp, Rattus norvegicus
tgcttgcctgagttagaattgccta

SEQ ID NO: 627293 - DNA, 25 bp, Rattus norvegicus
tgcttgcctgtgacttgattggaat

SEQ ID NO: 627294 - DNA, 25 bp, Rattus norvegicus
tgcttgcctgtgtcttgattggaat

SEQ ID NO: 627295 - DNA, 25 bp, Rattus norvegicus
tgcttgcctgttccttgacttgatt

SEQ ID NO: 627296 - DNA, 25 bp, Rattus norvegicus
tgcttgcctgttgcttgacttgatt

SEQ ID NO: 627297 - DNA, 25 bp, Rattus norvegicus
tgcttgcctttcagtttcacaggaa

SEQ ID NO: 627298 - DNA, 25 bp, Rattus norvegicus
tgcttgcctttctgtttcacaggaa

SEQ ID NO: 627299 - DNA, 25 bp, Rattus norvegicus
tgcttgcctttgctggtcccaaata

SEQ ID NO: 627300 - DNA, 25 bp, Rattus norvegicus
tgcttgcctttggtggtcccaaata

SEQ ID NO: 627301 - DNA, 25 bp, Rattus norvegicus
tgcttgccttttccttcagaagcat

SEQ ID NO: 627302 - DNA, 25 bp, Rattus norvegicus
tgcttgccttttgcttcagaagcat

SEQ ID NO: 627303 - DNA, 25 bp, Rattus norvegicus
tgcttgcgtgaccagaattctccat

SEQ ID NO: 627304 - DNA, 25 bp, Rattus norvegicus
tgcttgcgtgacgagaattctccat

SEQ ID NO: 627305 - DNA, 25 bp, Rattus norvegicus
tgcttgctaacacagggacaccgct

SEQ ID NO: 627306 - DNA, 25 bp, Rattus norvegicus
tgcttgctaacagagggacaccgct

SEQ ID NO: 627307 - DNA, 25 bp, Rattus norvegicus
tgcttgctcatcaccaaacgtggat

SEQ ID NO: 627308 - DNA, 25 bp, Rattus norvegicus
tgcttgctcatctccaaacgtggat

SEQ ID NO: 627309 - DNA, 25 bp, Rattus norvegicus
tgcttgctcgcaaaagtccggttac

SEQ ID NO: 627310 - DNA, 25 bp, Rattus norvegicus
tgcttgctcgcataagtccggttac

SEQ ID NO: 627311 - DNA, 25 bp, Rattus norvegicus
tgcttgctcttaagagtttgctcag

SEQ ID NO: 627312 - DNA, 25 bp, Rattus norvegicus
tgcttgctcttatgagtttgctcag

SEQ ID NO: 627313 - DNA, 25 bp, Rattus norvegicus
tgcttgctggaccaatgggaccatt

SEQ ID NO: 627314 - DNA, 25 bp, Rattus norvegicus
tgcttgctggacgaatgggaccatt

SEQ ID NO: 627315 - DNA, 25 bp, Rattus norvegicus
tgcttgctgtggacgaacactcagg

SEQ ID NO: 627316 - DNA, 25 bp, Rattus norvegicus
tgcttgctgtggtcgaacactcagg

SEQ ID NO: 627317 - DNA, 25 bp, Rattus norvegicus
tgcttgcttaacaatatgcattcaa

SEQ ID NO: 627318 - DNA, 25 bp, Rattus norvegicus
tgcttgcttaactatatgcattcaa

SEQ ID NO: 627319 - DNA, 25 bp, Rattus norvegicus
tgcttgcttcctagttacttgccag

SEQ ID NO: 627320 - DNA, 25 bp, Rattus norvegicus
tgcttgcttccttgttacttgccag

SEQ ID NO: 627321 - DNA, 25 bp, Rattus norvegicus
tgcttgcttctaagtaattcctgtc

SEQ ID NO: 627322 - DNA, 25 bp, Rattus norvegicus
tgcttgcttctacaattcctcagac

SEQ ID NO: 627323 - DNA, 25 bp, Rattus norvegicus
tgcttgcttctagaattcctcagac

SEQ ID NO: 627324 - DNA, 25 bp, Rattus norvegicus
tgcttgcttctatgtaattcctgtc

SEQ ID NO: 627325 - DNA, 25 bp, Rattus norvegicus
tgcttgcttcttcgacagggcttgc

SEQ ID NO: 627326 - DNA, 25 bp, Rattus norvegicus
tgcttgcttcttggacagggcttgc

SEQ ID NO: 627327 - DNA, 25 bp, Rattus norvegicus
tgcttgcttgatcagagcccggttt

SEQ ID NO: 627328 - DNA, 25 bp, Rattus norvegicus
tgcttgcttgatgagagcccggttt

SEQ ID NO: 627329 - DNA, 25 bp, Rattus norvegicus
tgcttgcttttccagtcagtccaca

SEQ ID NO: 627330 - DNA, 25 bp, Rattus norvegicus
tgcttgcttttcgagtcagtccaca

SEQ ID NO: 627331 - DNA, 25 bp, Rattus norvegicus
tgcttggaagagcagttccccggat

SEQ ID NO: 627332 - DNA, 25 bp, Rattus norvegicus
tgcttggaagaggagttccccggat

SEQ ID NO: 627333 - DNA, 25 bp, Rattus norvegicus
tgcttggaagccagttgactattat

SEQ ID NO: 627334 - DNA, 25 bp, Rattus norvegicus
tgcttggaagcctgttgactattat

SEQ ID NO: 627335 - DNA, 25 bp, Rattus norvegicus
tgcttggaggcccagtacgaccagg

SEQ ID NO: 627336 - DNA, 25 bp, Rattus norvegicus
tgcttggaggccgagtacgaccagg

SEQ ID NO: 627337 - DNA, 25 bp, Rattus norvegicus
tgcttggatataccccatctgagag

SEQ ID NO: 627338 - DNA, 25 bp, Rattus norvegicus
tgcttggatatagcccatctgagag

SEQ ID NO: 627339 - DNA, 25 bp, Rattus norvegicus
tgcttggattccatcatgcgaacaa

SEQ ID NO: 627340 - DNA, 25 bp, Rattus norvegicus
tgcttggattccttcatgcgaacaa

SEQ ID NO: 627341 - DNA, 25 bp, Rattus norvegicus
tgcttggcaactcaatctgactcat

SEQ ID NO: 627342 - DNA, 25 bp, Rattus norvegicus
tgcttggcaactgaatctgactcat

SEQ ID NO: 627343 - DNA, 25 bp, Rattus norvegicus
tgcttggcacaccaggacatgttct

SEQ ID NO: 627344 - DNA, 25 bp, Rattus norvegicus
tgcttggcacacgaggacatgttct

SEQ ID NO: 627345 - DNA, 25 bp, Rattus norvegicus
tgcttggccagacctggagccccgt

SEQ ID NO: 627346 - DNA, 25 bp, Rattus norvegicus
tgcttggccagagctggagccccgt

SEQ ID NO: 627347 - DNA, 25 bp, Rattus norvegicus
tgcttggcctgcacagggacatgaa

SEQ ID NO: 627348 - DNA, 25 bp, Rattus norvegicus
tgcttggcctgctcagggacatgaa

SEQ ID NO: 627349 - DNA, 25 bp, Rattus norvegicus
tgcttggctactatgcttctgaatt

SEQ ID NO: 627350 - DNA, 25 bp, Rattus norvegicus
tgcttggctactttgcttctgaatt

SEQ ID NO: 627351 - DNA, 25 bp, Rattus norvegicus
tgcttgggactgacctaaggcctct

SEQ ID NO: 627352 - DNA, 25 bp, Rattus norvegicus
tgcttgggactgtcctaaggcctct

SEQ ID NO: 627353 - DNA, 25 bp, Rattus norvegicus
tgcttgggagcaacatgccttcctg

SEQ ID NO: 627354 - DNA, 25 bp, Rattus norvegicus
tgcttgggagcatcatgccttcctg

SEQ ID NO: 627355 - DNA, 25 bp, Rattus norvegicus
tgcttgggtcacagtcaccttgaac

SEQ ID NO: 627356 - DNA, 25 bp, Rattus norvegicus
tgcttgggtcactgtcaccttgaac

SEQ ID NO: 627357 - DNA, 25 bp, Rattus norvegicus
tgcttggtaatgctggagctctcct

SEQ ID NO: 627358 - DNA, 25 bp, Rattus norvegicus
tgcttggtaatggtggagctctcct

SEQ ID NO: 627359 - DNA, 25 bp, Rattus norvegicus
tgcttggtcaaaactgtaacagtcg

SEQ ID NO: 627360 - DNA, 25 bp, Rattus norvegicus
tgcttggtcaaatctgtaacagtcg

SEQ ID NO: 627361 - DNA, 25 bp, Rattus norvegicus
tgcttggtcactagctctgcaaaaa

SEQ ID NO: 627362 - DNA, 25 bp, Rattus norvegicus
tgcttggtcacttgctctgcaaaaa

SEQ ID NO: 627363 - DNA, 25 bp, Rattus norvegicus
tgcttggtcatgaggctttccagaa

SEQ ID NO: 627364 - DNA, 25 bp, Rattus norvegicus
tgcttggtcatgtggctttccagaa

SEQ ID NO: 627365 - DNA, 25 bp, Rattus norvegicus
tgcttggtccccagtgagtggtgcc

SEQ ID NO: 627366 - DNA, 25 bp, Rattus norvegicus
tgcttggtcccctgtgagtggtgcc

SEQ ID NO: 627367 - DNA, 25 bp, Rattus norvegicus
tgcttggtcttgcagagcggtctct

SEQ ID NO: 627368 - DNA, 25 bp, Rattus norvegicus
tgcttggtcttggagagcggtctct

SEQ ID NO: 627369 - DNA, 25 bp, Rattus norvegicus
tgcttggtgcctatggcggccaaaa

SEQ ID NO: 627370 - DNA, 25 bp, Rattus norvegicus
tgcttggtgcctttggcggccaaaa

SEQ ID NO: 627371 - DNA, 25 bp, Rattus norvegicus
tgcttgtaagcgctgcctctgtaac

SEQ ID NO: 627372 - DNA, 25 bp, Rattus norvegicus
tgcttgtaagcggtgcctctgtaac

SEQ ID NO: 627373 - DNA, 25 bp, Rattus norvegicus
tgcttgtaatttacaggttcctctt

SEQ ID NO: 627374 - DNA, 25 bp, Rattus norvegicus
tgcttgtaattttcaggttcctctt

SEQ ID NO: 627375 - DNA, 25 bp, Rattus norvegicus
tgcttgtacaaactgcctgacctta

SEQ ID NO: 627376 - DNA, 25 bp, Rattus norvegicus
tgcttgtacaaagtgcctgacctta

SEQ ID NO: 627377 - DNA, 25 bp, Rattus norvegicus
tgcttgtacagacggcctacgtgtt

SEQ ID NO: 627378 - DNA, 25 bp, Rattus norvegicus
tgcttgtacagagggcctacgtgtt

SEQ ID NO: 627379 - DNA, 25 bp, Rattus norvegicus
tgcttgtagtagataactccaccat

SEQ ID NO: 627380 - DNA, 25 bp, Rattus norvegicus
tgcttgtagtagttaactccaccat

SEQ ID NO: 627381 - DNA, 25 bp, Rattus norvegicus
tgcttgtcacgcacagcagctgagg

SEQ ID NO: 627382 - DNA, 25 bp, Rattus norvegicus
tgcttgtcacgctcagcagctgagg

SEQ ID NO: 627383 - DNA, 25 bp, Rattus norvegicus
tgcttgtcatcaacctgttcgcctg

SEQ ID NO: 627384 - DNA, 25 bp, Rattus norvegicus
tgcttgtcatcatcctgttcgcctg

SEQ ID NO: 627385 - DNA, 25 bp, Rattus norvegicus
tgcttgtccatgaagttccattcct

SEQ ID NO: 627386 - DNA, 25 bp, Rattus norvegicus
tgcttgtccatgtagttccattcct

SEQ ID NO: 627387 - DNA, 25 bp, Rattus norvegicus
tgcttgtcccatagcaaaacctagc

SEQ ID NO: 627388 - DNA, 25 bp, Rattus norvegicus
tgcttgtcccattgcaaaacctagc

SEQ ID NO: 627389 - DNA, 25 bp, Rattus norvegicus
tgcttgtcccttctatgaactgcga

SEQ ID NO: 627390 - DNA, 25 bp, Rattus norvegicus
tgcttgtcccttgtatgaactgcga

SEQ ID NO: 627391 - DNA, 25 bp, Rattus norvegicus
tgcttgtcgggaagcgattcgcagt

SEQ ID NO: 627392 - DNA, 25 bp, Rattus norvegicus
tgcttgtcgggatgcgattcgcagt

SEQ ID NO: 627393 - DNA, 25 bp, Rattus norvegicus
tgcttgtctaatctctgctctgaac

SEQ ID NO: 627394 - DNA, 25 bp, Rattus norvegicus
tgcttgtctaatgtctgctctgaac

SEQ ID NO: 627395 - DNA, 25 bp, Rattus norvegicus
tgcttgtgacacaggacagtccttt

SEQ ID NO: 627396 - DNA, 25 bp, Rattus norvegicus
tgcttgtgacactggacagtccttt

SEQ ID NO: 627397 - DNA, 25 bp, Rattus norvegicus
tgcttgtgggttatgcgacctacta

SEQ ID NO: 627398 - DNA, 25 bp, Rattus norvegicus
tgcttgtgggttttgcgacctacta

SEQ ID NO: 627399 - DNA, 25 bp, Rattus norvegicus
tgcttgtgttcacccaggcccggtt

SEQ ID NO: 627400 - DNA, 25 bp, Rattus norvegicus
tgcttgtgttcagccaggcccggtt

SEQ ID NO: 627401 - DNA, 25 bp, Rattus norvegicus
tgcttgttgcctacgggtaactaaa

SEQ ID NO: 627402 - DNA, 25 bp, Rattus norvegicus
tgcttgttgcctatgttcatgagac

SEQ ID NO: 627403 - DNA, 25 bp, Rattus norvegicus
tgcttgttgccttcgggtaactaaa

SEQ ID NO: 627404 - DNA, 25 bp, Rattus norvegicus
tgcttgttgcctttgttcatgagac

SEQ ID NO: 627405 - DNA, 25 bp, Rattus norvegicus
tgcttgtttacaagcccggacaaac

SEQ ID NO: 627406 - DNA, 25 bp, Rattus norvegicus
tgcttgtttacatgcccggacaaac

SEQ ID NO: 627407 - DNA, 25 bp, Rattus norvegicus
tgcttgtttctcatgcattctacat

SEQ ID NO: 627408 - DNA, 25 bp, Rattus norvegicus
tgcttgtttctcttgcattctacat

SEQ ID NO: 627409 - DNA, 25 bp, Rattus norvegicus
tgcttgtttgaaatagggtctcact

SEQ ID NO: 627410 - DNA, 25 bp, Rattus norvegicus
tgcttgtttgaattagggtctcact

SEQ ID NO: 627411 - DNA, 25 bp, Rattus norvegicus
tgcttgtttgctagcctctataaat

SEQ ID NO: 627412 - DNA, 25 bp, Rattus norvegicus
tgcttgtttgcttgcctctataaat

SEQ ID NO: 627413 - DNA, 25 bp, Rattus norvegicus
tgcttgtttggaaggcacagggccc

SEQ ID NO: 627414 - DNA, 25 bp, Rattus norvegicus
tgcttgtttggatggcacagggccc

SEQ ID NO: 627415 - DNA, 25 bp, Rattus norvegicus
tgcttgttttccacccttaaatata

SEQ ID NO: 627416 - DNA, 25 bp, Rattus norvegicus
tgcttgttttcctcccttaaatata

SEQ ID NO: 627417 - DNA, 25 bp, Rattus norvegicus
tgctttaaccccaggtgctctgagc

SEQ ID NO: 627418 - DNA, 25 bp, Rattus norvegicus
tgctttaacccctggtgctctgagc

SEQ ID NO: 627419 - DNA, 25 bp, Rattus norvegicus
tgctttaactacctgctgcttgtaa

SEQ ID NO: 627420 - DNA, 25 bp, Rattus norvegicus
tgctttaactacgtgctgcttgtaa

SEQ ID NO: 627421 - DNA, 25 bp, Rattus norvegicus
tgctttaatctgaccaacttttcaa

SEQ ID NO: 627422 - DNA, 25 bp, Rattus norvegicus
tgctttaatctgtccaacttttcaa

SEQ ID NO: 627423 - DNA, 25 bp, Rattus norvegicus
tgctttaatgcaacgcagtccctac

SEQ ID NO: 627424 - DNA, 25 bp, Rattus norvegicus
tgctttaatgcatcgcagtccctac

SEQ ID NO: 627425 - DNA, 25 bp, Rattus norvegicus
tgctttaattctagaccacatctcc

SEQ ID NO: 627426 - DNA, 25 bp, Rattus norvegicus
tgctttaattcttgaccacatctcc

SEQ ID NO: 627427 - DNA, 25 bp, Rattus norvegicus
tgctttaatttcctatttcagtaaa

SEQ ID NO: 627428 - DNA, 25 bp, Rattus norvegicus
tgctttaatttcgtatttcagtaaa

SEQ ID NO: 627429 - DNA, 25 bp, Rattus norvegicus
tgctttacaacacgccgggcacagt

SEQ ID NO: 627430 - DNA, 25 bp, Rattus norvegicus
tgctttacaacaggccgggcacagt

SEQ ID NO: 627431 - DNA, 25 bp, Rattus norvegicus
tgctttaccaataatcccactaggc

SEQ ID NO: 627432 - DNA, 25 bp, Rattus norvegicus
tgctttaccaattatcccactaggc

SEQ ID NO: 627433 - DNA, 25 bp, Rattus norvegicus
tgctttacctccaaaaaatgggcgg

SEQ ID NO: 627434 - DNA, 25 bp, Rattus norvegicus
tgctttacctcctaaaaatgggcgg

SEQ ID NO: 627435 - DNA, 25 bp, Rattus norvegicus
tgctttactcctaggacacgagcta

SEQ ID NO: 627436 - DNA, 25 bp, Rattus norvegicus
tgctttactccttggacacgagcta

SEQ ID NO: 627437 - DNA, 25 bp, Rattus norvegicus
tgctttagacagacacgacactctc

SEQ ID NO: 627438 - DNA, 25 bp, Rattus norvegicus
tgctttagacagtcacgacactctc

SEQ ID NO: 627439 - DNA, 25 bp, Rattus norvegicus
tgctttagcctaatgaatgctggga

SEQ ID NO: 627440 - DNA, 25 bp, Rattus norvegicus
tgctttagcctattgaatgctggga

SEQ ID NO: 627441 - DNA, 25 bp, Rattus norvegicus
tgctttagtcagagtatcttgcttt

SEQ ID NO: 627442 - DNA, 25 bp, Rattus norvegicus
tgctttagtcagtgtatcttgcttt

SEQ ID NO: 627443 - DNA, 25 bp, Rattus norvegicus
tgctttagttgaaccacctagtcct

SEQ ID NO: 627444 - DNA, 25 bp, Rattus norvegicus
tgctttagttgatccacctagtcct

SEQ ID NO: 627445 - DNA, 25 bp, Rattus norvegicus
tgctttatccataatgtgcccacag

SEQ ID NO: 627446 - DNA, 25 bp, Rattus norvegicus
tgctttatccattatgtgcccacag

SEQ ID NO: 627447 - DNA, 25 bp, Rattus norvegicus
tgctttatggcaagtcaccggtatt

SEQ ID NO: 627448 - DNA, 25 bp, Rattus norvegicus
tgctttatggcatgtcaccggtatt

SEQ ID NO: 627449 - DNA, 25 bp, Rattus norvegicus
tgctttcaacttccaggttccaaaa

SEQ ID NO: 627450 - DNA, 25 bp, Rattus norvegicus
tgctttcaacttgcaggttccaaaa

SEQ ID NO: 627451 - DNA, 25 bp, Rattus norvegicus
tgctttcaattgaatattcttcctt

SEQ ID NO: 627452 - DNA, 25 bp, Rattus norvegicus
tgctttcaattgtatattcttcctt

SEQ ID NO: 627453 - DNA, 25 bp, Rattus norvegicus
tgctttcacagccagtgagggccat

SEQ ID NO: 627454 - DNA, 25 bp, Rattus norvegicus
tgctttcacagcgagtgagggccat

SEQ ID NO: 627455 - DNA, 25 bp, Rattus norvegicus
tgctttcacccactcttagatttta

SEQ ID NO: 627456 - DNA, 25 bp, Rattus norvegicus
tgctttcacccagtcttagatttta

SEQ ID NO: 627457 - DNA, 25 bp, Rattus norvegicus
tgctttcactgaacgtgtctgctta

SEQ ID NO: 627458 - DNA, 25 bp, Rattus norvegicus
tgctttcactgatcgtgtctgctta

SEQ ID NO: 627459 - DNA, 25 bp, Rattus norvegicus
tgctttcactgcagcttgctagcca

SEQ ID NO: 627460 - DNA, 25 bp, Rattus norvegicus
tgctttcactgctgcttgctagcca

SEQ ID NO: 627461 - DNA, 25 bp, Rattus norvegicus
tgctttcaggcaactcgttttccta

SEQ ID NO: 627462 - DNA, 25 bp, Rattus norvegicus
tgctttcaggcatctcgttttccta

SEQ ID NO: 627463 - DNA, 25 bp, Rattus norvegicus
tgctttcagtagacatgcctttgcc

SEQ ID NO: 627464 - DNA, 25 bp, Rattus norvegicus
tgctttcagtagtcatgcctttgcc

SEQ ID NO: 627465 - DNA, 25 bp, Rattus norvegicus
tgctttcagtctattgcctcgtggg

SEQ ID NO: 627466 - DNA, 25 bp, Rattus norvegicus
tgctttcagtcttttgcctcgtggg

SEQ ID NO: 627467 - DNA, 25 bp, Rattus norvegicus
tgctttcatgttctcactgtggtca

SEQ ID NO: 627468 - DNA, 25 bp, Rattus norvegicus
tgctttcatgttgtcactgtggtca

SEQ ID NO: 627469 - DNA, 25 bp, Rattus norvegicus
tgctttcatttacacagatatccat

SEQ ID NO: 627470 - DNA, 25 bp, Rattus norvegicus
tgctttcatttagacagatatccat

SEQ ID NO: 627471 - DNA, 25 bp, Rattus norvegicus
tgctttccaactcacaccttttgta

SEQ ID NO: 627472 - DNA, 25 bp, Rattus norvegicus
tgctttccaactgacaccttttgta

SEQ ID NO: 627473 - DNA, 25 bp, Rattus norvegicus
tgctttccaaggctctaactgtgag

SEQ ID NO: 627474 - DNA, 25 bp, Rattus norvegicus
tgctttccaagggtctaactgtgag

SEQ ID NO: 627475 - DNA, 25 bp, Rattus norvegicus
tgctttccaggaattcttatgaata

SEQ ID NO: 627476 - DNA, 25 bp, Rattus norvegicus
tgctttccaggatttcttatgaata

SEQ ID NO: 627477 - DNA, 25 bp, Rattus norvegicus
tgctttccaggtccttaggaggcct

SEQ ID NO: 627478 - DNA, 25 bp, Rattus norvegicus
tgctttccaggtgcttaggaggcct

SEQ ID NO: 627479 - DNA, 25 bp, Rattus norvegicus
tgctttccatccctcaaaggcatat

SEQ ID NO: 627480 - DNA, 25 bp, Rattus norvegicus
tgctttccatccgtcaaaggcatat

SEQ ID NO: 627481 - DNA, 25 bp, Rattus norvegicus
tgctttcccagacaatcccagcggg

SEQ ID NO: 627482 - DNA, 25 bp, Rattus norvegicus
tgctttcccagagaatcccagcggg

SEQ ID NO: 627483 - DNA, 25 bp, Rattus norvegicus
tgctttcccatacccttggacataa

SEQ ID NO: 627484 - DNA, 25 bp, Rattus norvegicus
tgctttcccatagccttggacataa

SEQ ID NO: 627485 - DNA, 25 bp, Rattus norvegicus
tgctttccccagactccggtgagag

SEQ ID NO: 627486 - DNA, 25 bp, Rattus norvegicus
tgctttccccagtctccggtgagag

SEQ ID NO: 627487 - DNA, 25 bp, Rattus norvegicus
tgctttcccccgcttgtcgctggga

SEQ ID NO: 627488 - DNA, 25 bp, Rattus norvegicus
tgctttcccccggttgtcgctggga

SEQ ID NO: 627489 - DNA, 25 bp, Rattus norvegicus
tgctttcccgaaaattcatggcaaa

SEQ ID NO: 627490 - DNA, 25 bp, Rattus norvegicus
tgctttcccgaatattcatggcaaa

SEQ ID NO: 627491 - DNA, 25 bp, Rattus norvegicus
tgctttccctaactaactattgctg

SEQ ID NO: 627492 - DNA, 25 bp, Rattus norvegicus
tgctttccctaagtaactattgctg

SEQ ID NO: 627493 - DNA, 25 bp, Rattus norvegicus
tgctttccctatatgtttacacaag

SEQ ID NO: 627494 - DNA, 25 bp, Rattus norvegicus
tgctttccctatttgtttacacaag

SEQ ID NO: 627495 - DNA, 25 bp, Rattus norvegicus
tgctttcctcaaagtcttgtctcat

SEQ ID NO: 627496 - DNA, 25 bp, Rattus norvegicus
tgctttcctcaatgtcttgtctcat

SEQ ID NO: 627497 - DNA, 25 bp, Rattus norvegicus
tgctttcctcacactggaaggacaa

SEQ ID NO: 627498 - DNA, 25 bp, Rattus norvegicus
tgctttcctcactctggaaggacaa

SEQ ID NO: 627499 - DNA, 25 bp, Rattus norvegicus
tgctttcctctgaagaatgtaaact

SEQ ID NO: 627500 - DNA, 25 bp, Rattus norvegicus
tgctttcctctgtagaatgtaaact

SEQ ID NO: 627501 - DNA, 25 bp, Rattus norvegicus
tgctttcctgagactctgagaggga

SEQ ID NO: 627502 - DNA, 25 bp, Rattus norvegicus
tgctttcctgagcaggccttgtaaa

SEQ ID NO: 627503 - DNA, 25 bp, Rattus norvegicus
tgctttcctgaggaggccttgtaaa

SEQ ID NO: 627504 - DNA, 25 bp, Rattus norvegicus
tgctttcctgagtctctgagaggga

SEQ ID NO: 627505 - DNA, 25 bp, Rattus norvegicus
tgctttcctgcacttgagtttccgt

SEQ ID NO: 627506 - DNA, 25 bp, Rattus norvegicus
tgctttcctgcagttgagtttccgt

SEQ ID NO: 627507 - DNA, 25 bp, Rattus norvegicus
tgctttccttcacattaaatcgctc

SEQ ID NO: 627508 - DNA, 25 bp, Rattus norvegicus
tgctttccttcagattaaatcgctc

SEQ ID NO: 627509 - DNA, 25 bp, Rattus norvegicus
tgctttcgcagaacaccagttttta

SEQ ID NO: 627510 - DNA, 25 bp, Rattus norvegicus
tgctttcgcagatcaccagttttta

SEQ ID NO: 627511 - DNA, 25 bp, Rattus norvegicus
tgctttcgcctgataaccctggttg

SEQ ID NO: 627512 - DNA, 25 bp, Rattus norvegicus
tgctttcgcctgttaaccctggttg

SEQ ID NO: 627513 - DNA, 25 bp, Rattus norvegicus
tgctttctaaaaaatactgtttcct

SEQ ID NO: 627514 - DNA, 25 bp, Rattus norvegicus
tgctttctaaaatatactgtttcct

SEQ ID NO: 627515 - DNA, 25 bp, Rattus norvegicus
tgctttctaagtaaccagggtcggt

SEQ ID NO: 627516 - DNA, 25 bp, Rattus norvegicus
tgctttctaagttaccagggtcggt

SEQ ID NO: 627517 - DNA, 25 bp, Rattus norvegicus
tgctttctaggcaggcgctatctca

SEQ ID NO: 627518 - DNA, 25 bp, Rattus norvegicus
tgctttctaggctggcgctatctca

SEQ ID NO: 627519 - DNA, 25 bp, Rattus norvegicus
tgctttctaggtctctcagtaaggt

SEQ ID NO: 627520 - DNA, 25 bp, Rattus norvegicus
tgctttctaggtgtctcagtaaggt

SEQ ID NO: 627521 - DNA, 25 bp, Rattus norvegicus
tgctttctagtaaacctcggtcctc

SEQ ID NO: 627522 - DNA, 25 bp, Rattus norvegicus
tgctttctagtatacctcggtcctc

SEQ ID NO: 627523 - DNA, 25 bp, Rattus norvegicus
tgctttctatacaagacagaggaat

SEQ ID NO: 627524 - DNA, 25 bp, Rattus norvegicus
tgctttctatactagacagaggaat

SEQ ID NO: 627525 - DNA, 25 bp, Rattus norvegicus
tgctttctcaatccatgcttcagat

SEQ ID NO: 627526 - DNA, 25 bp, Rattus norvegicus
tgctttctcaatgcatgcttcagat

SEQ ID NO: 627527 - DNA, 25 bp, Rattus norvegicus
tgctttctccatacaaagatttcta

SEQ ID NO: 627528 - DNA, 25 bp, Rattus norvegicus
tgctttctccattcaaagatttcta

SEQ ID NO: 627529 - DNA, 25 bp, Rattus norvegicus
tgctttctctctactcggcacactt

SEQ ID NO: 627530 - DNA, 25 bp, Rattus norvegicus
tgctttctctcttctcggcacactt

SEQ ID NO: 627531 - DNA, 25 bp, Rattus norvegicus
tgctttctctgcacagttggcatat

SEQ ID NO: 627532 - DNA, 25 bp, Rattus norvegicus
tgctttctctgctcagttggcatat

SEQ ID NO: 627533 - DNA, 25 bp, Rattus norvegicus
tgctttctgattcactaatccctca

SEQ ID NO: 627534 - DNA, 25 bp, Rattus norvegicus
tgctttctgattgactaatccctca

SEQ ID NO: 627535 - DNA, 25 bp, Rattus norvegicus
tgctttctgcttaattttttccatt

SEQ ID NO: 627536 - DNA, 25 bp, Rattus norvegicus
tgctttctgcttacccttttcatgt

SEQ ID NO: 627537 - DNA, 25 bp, Rattus norvegicus
tgctttctgcttatccagatataat

SEQ ID NO: 627538 - DNA, 25 bp, Rattus norvegicus
tgctttctgctttattttttccatt

SEQ ID NO: 627539 - DNA, 25 bp, Rattus norvegicus
tgctttctgctttcccttttcatgt

SEQ ID NO: 627540 - DNA, 25 bp, Rattus norvegicus
tgctttctgcttttccagatataat

SEQ ID NO: 627541 - DNA, 25 bp, Rattus norvegicus
tgctttctggctagggtcttctaca

SEQ ID NO: 627542 - DNA, 25 bp, Rattus norvegicus
tgctttctggcttgggtcttctaca

SEQ ID NO: 627543 - DNA, 25 bp, Rattus norvegicus
tgctttctgggtataattttctctg

SEQ ID NO: 627544 - DNA, 25 bp, Rattus norvegicus
tgctttctgggtttaattttctctg

SEQ ID NO: 627545 - DNA, 25 bp, Rattus norvegicus
tgctttctgtccacatctaacatag

SEQ ID NO: 627546 - DNA, 25 bp, Rattus norvegicus
tgctttctgtcctcatctaacatag

SEQ ID NO: 627547 - DNA, 25 bp, Rattus norvegicus
tgctttcttagtcgtagtcatgaat

SEQ ID NO: 627548 - DNA, 25 bp, Rattus norvegicus
tgctttcttagtggtagtcatgaat

SEQ ID NO: 627549 - DNA, 25 bp, Rattus norvegicus
tgctttcttatgagtaggcccttca

SEQ ID NO: 627550 - DNA, 25 bp, Rattus norvegicus
tgctttcttatgtgtaggcccttca

SEQ ID NO: 627551 - DNA, 25 bp, Rattus norvegicus
tgctttcttcccagaaggtgttctt

SEQ ID NO: 627552 - DNA, 25 bp, Rattus norvegicus
tgctttcttccctgaaggtgttctt

SEQ ID NO: 627553 - DNA, 25 bp, Rattus norvegicus
tgctttcttcctcctagactaagtg

SEQ ID NO: 627554 - DNA, 25 bp, Rattus norvegicus
tgctttcttcctgctagactaagtg

SEQ ID NO: 627555 - DNA, 25 bp, Rattus norvegicus
tgctttcttctcatgcctctgagaa

SEQ ID NO: 627556 - DNA, 25 bp, Rattus norvegicus
tgctttcttctcttgcctctgagaa

SEQ ID NO: 627557 - DNA, 25 bp, Rattus norvegicus
tgctttgaactgcagctcctcacta

SEQ ID NO: 627558 - DNA, 25 bp, Rattus norvegicus
tgctttgaactggagctcctcacta

SEQ ID NO: 627559 - DNA, 25 bp, Rattus norvegicus
tgctttgaagtaacgagccccacgc

SEQ ID NO: 627560 - DNA, 25 bp, Rattus norvegicus
tgctttgaagtatcgagccccacgc

SEQ ID NO: 627561 - DNA, 25 bp, Rattus norvegicus
tgctttgaatctatctttttggatc

SEQ ID NO: 627562 - DNA, 25 bp, Rattus norvegicus
tgctttgaatctttctttttggatc

SEQ ID NO: 627563 - DNA, 25 bp, Rattus norvegicus
tgctttgactcaaaatcgctcctcc

SEQ ID NO: 627564 - DNA, 25 bp, Rattus norvegicus
tgctttgactcataatcgctcctcc

SEQ ID NO: 627565 - DNA, 25 bp, Rattus norvegicus
tgctttgactgccacaacatcctgg

SEQ ID NO: 627566 - DNA, 25 bp, Rattus norvegicus
tgctttgactgcgacaacatcctgg

SEQ ID NO: 627567 - DNA, 25 bp, Rattus norvegicus
tgctttgacttgagcattaaacttc

SEQ ID NO: 627568 - DNA, 25 bp, Rattus norvegicus
tgctttgacttgtgcattaaacttc

SEQ ID NO: 627569 - DNA, 25 bp, Rattus norvegicus
tgctttgagcacatgcagcgtgtta

SEQ ID NO: 627570 - DNA, 25 bp, Rattus norvegicus
tgctttgagcacttgcagcgtgtta

SEQ ID NO: 627571 - DNA, 25 bp, Rattus norvegicus
tgctttgagcagagtttaattcttc

SEQ ID NO: 627572 - DNA, 25 bp, Rattus norvegicus
tgctttgagcagtgtttaattcttc

SEQ ID NO: 627573 - DNA, 25 bp, Rattus norvegicus
tgctttgagtttatcttatgcctaa

SEQ ID NO: 627574 - DNA, 25 bp, Rattus norvegicus
tgctttgagtttttcttatgcctaa

SEQ ID NO: 627575 - DNA, 25 bp, Rattus norvegicus
tgctttgcagcaaacgtgtgagtga

SEQ ID NO: 627576 - DNA, 25 bp, Rattus norvegicus
tgctttgcagcatacgtgtgagtga

SEQ ID NO: 627577 - DNA, 25 bp, Rattus norvegicus
tgctttgcaggccatgagaccggaa

SEQ ID NO: 627578 - DNA, 25 bp, Rattus norvegicus
tgctttgcaggcgatgagaccggaa

SEQ ID NO: 627579 - DNA, 25 bp, Rattus norvegicus
tgctttgcagggagtctcagtggaa

SEQ ID NO: 627580 - DNA, 25 bp, Rattus norvegicus
tgctttgcagggtgtctcagtggaa

SEQ ID NO: 627581 - DNA, 25 bp, Rattus norvegicus
tgctttgccaggatctttttggttt

SEQ ID NO: 627582 - DNA, 25 bp, Rattus norvegicus
tgctttgccaggttctttttggttt

SEQ ID NO: 627583 - DNA, 25 bp, Rattus norvegicus
tgctttgcctcaatgctgaccaaaa

SEQ ID NO: 627584 - DNA, 25 bp, Rattus norvegicus
tgctttgcctcattgctgaccaaaa

SEQ ID NO: 627585 - DNA, 25 bp, Rattus norvegicus
tgctttgctgtcacagactttcaag

SEQ ID NO: 627586 - DNA, 25 bp, Rattus norvegicus
tgctttgctgtctcagactttcaag

SEQ ID NO: 627587 - DNA, 25 bp, Rattus norvegicus
tgctttggataacacccagcgccag

SEQ ID NO: 627588 - DNA, 25 bp, Rattus norvegicus
tgctttggataagacccagcgccag

SEQ ID NO: 627589 - DNA, 25 bp, Rattus norvegicus
tgctttggcaacacacatactaaaa

SEQ ID NO: 627590 - DNA, 25 bp, Rattus norvegicus
tgctttggcaactcacatactaaaa

SEQ ID NO: 627591 - DNA, 25 bp, Rattus norvegicus
tgctttgggcagatatcacatgtca

SEQ ID NO: 627592 - DNA, 25 bp, Rattus norvegicus
tgctttgggcagttatcacatgtca

SEQ ID NO: 627593 - DNA, 25 bp, Rattus norvegicus
tgctttgggcggacatgtccacagc

SEQ ID NO: 627594 - DNA, 25 bp, Rattus norvegicus
tgctttgggcggtcatgtccacagc

SEQ ID NO: 627595 - DNA, 25 bp, Rattus norvegicus
tgctttggtttcagtgactgtgctc

SEQ ID NO: 627596 - DNA, 25 bp, Rattus norvegicus
tgctttggtttctgtgactgtgctc

SEQ ID NO: 627597 - DNA, 25 bp, Rattus norvegicus
tgctttgtaatcagaagcctgcaaa

SEQ ID NO: 627598 - DNA, 25 bp, Rattus norvegicus
tgctttgtaatctgaagcctgcaaa

SEQ ID NO: 627599 - DNA, 25 bp, Rattus norvegicus
tgctttgtaattattccagttcttt

SEQ ID NO: 627600 - DNA, 25 bp, Rattus norvegicus
tgctttgtaatttttccagttcttt

SEQ ID NO: 627601 - DNA, 25 bp, Rattus norvegicus
tgctttgtactcatcgggctgtgct

SEQ ID NO: 627602 - DNA, 25 bp, Rattus norvegicus
tgctttgtactcttcgggctgtgct

SEQ ID NO: 627603 - DNA, 25 bp, Rattus norvegicus
tgctttgtatttcaggcgttctatc

SEQ ID NO: 627604 - DNA, 25 bp, Rattus norvegicus
tgctttgtatttgaggcgttctatc

SEQ ID NO: 627605 - DNA, 25 bp, Rattus norvegicus
tgctttgtcataatgcagtctgaag

SEQ ID NO: 627606 - DNA, 25 bp, Rattus norvegicus
tgctttgtcatattgcagtctgaag

SEQ ID NO: 627607 - DNA, 25 bp, Rattus norvegicus
tgctttgtctgcatccctatggtct

SEQ ID NO: 627608 - DNA, 25 bp, Rattus norvegicus
tgctttgtctgcttccctatggtct

SEQ ID NO: 627609 - DNA, 25 bp, Rattus norvegicus
tgctttgtctttctccagacgaata

SEQ ID NO: 627610 - DNA, 25 bp, Rattus norvegicus
tgctttgtctttgtccagacgaata

SEQ ID NO: 627611 - DNA, 25 bp, Rattus norvegicus
tgctttgtgatcacttattgctcca

SEQ ID NO: 627612 - DNA, 25 bp, Rattus norvegicus
tgctttgtgatctcttattgctcca

SEQ ID NO: 627613 - DNA, 25 bp, Rattus norvegicus
tgctttgtgccccaagaacctgtca

SEQ ID NO: 627614 - DNA, 25 bp, Rattus norvegicus
tgctttgtgcccgaagaacctgtca

SEQ ID NO: 627615 - DNA, 25 bp, Rattus norvegicus
tgctttgtggccacagtcgggtaaa

SEQ ID NO: 627616 - DNA, 25 bp, Rattus norvegicus
tgctttgtggcctcagtcgggtaaa

SEQ ID NO: 627617 - DNA, 25 bp, Rattus norvegicus
tgctttgtgtgtattcacagccaca

SEQ ID NO: 627618 - DNA, 25 bp, Rattus norvegicus
tgctttgtgtgttttcacagccaca

SEQ ID NO: 627619 - DNA, 25 bp, Rattus norvegicus
tgctttgttctgacactcatgggat

SEQ ID NO: 627620 - DNA, 25 bp, Rattus norvegicus
tgctttgttctgtcactcatgggat

SEQ ID NO: 627621 - DNA, 25 bp, Rattus norvegicus
tgctttgttggccttctcaaatgtt

SEQ ID NO: 627622 - DNA, 25 bp, Rattus norvegicus
tgctttgttggcgttctcaaatgtt

SEQ ID NO: 627623 - DNA, 25 bp, Rattus norvegicus
tgctttgtttctccagtgctgacaa

SEQ ID NO: 627624 - DNA, 25 bp, Rattus norvegicus
tgctttgtttctgcagtgctgacaa

SEQ ID NO: 627625 - DNA, 25 bp, Rattus norvegicus
tgctttgtttttctttaattcctgg

SEQ ID NO: 627626 - DNA, 25 bp, Rattus norvegicus
tgctttgtttttgtttaattcctgg

SEQ ID NO: 627627 - DNA, 25 bp, Rattus norvegicus
tgcttttactgcctgatctttgaga

SEQ ID NO: 627628 - DNA, 25 bp, Rattus norvegicus
tgcttttactgcgtgatctttgaga

SEQ ID NO: 627629 - DNA, 25 bp, Rattus norvegicus
tgcttttatattcctgtaccagaca

SEQ ID NO: 627630 - DNA, 25 bp, Rattus norvegicus
tgcttttatattctttcctcctttt

SEQ ID NO: 627631 - DNA, 25 bp, Rattus norvegicus
tgcttttatattgctgtaccagaca

SEQ ID NO: 627632 - DNA, 25 bp, Rattus norvegicus
tgcttttatattgtttcctcctttt

SEQ ID NO: 627633 - DNA, 25 bp, Rattus norvegicus
tgcttttcaaaaacttctctccttc

SEQ ID NO: 627634 - DNA, 25 bp, Rattus norvegicus
tgcttttcaaaatcttctctccttc

SEQ ID NO: 627635 - DNA, 25 bp, Rattus norvegicus
tgcttttcacacacaacaaggcagt

SEQ ID NO: 627636 - DNA, 25 bp, Rattus norvegicus
tgcttttcacactcaacaaggcagt

SEQ ID NO: 627637 - DNA, 25 bp, Rattus norvegicus
tgcttttcatctcgttctccagttt

SEQ ID NO: 627638 - DNA, 25 bp, Rattus norvegicus
tgcttttcatctggttctccagttt

SEQ ID NO: 627639 - DNA, 25 bp, Rattus norvegicus
tgcttttccaacctgatcttcgaag

SEQ ID NO: 627640 - DNA, 25 bp, Rattus norvegicus
tgcttttccaacgtgatcttcgaag

SEQ ID NO: 627641 - DNA, 25 bp, Rattus norvegicus
tgcttttccactaattcatgccttt

SEQ ID NO: 627642 - DNA, 25 bp, Rattus norvegicus
tgcttttccacttattcatgccttt

SEQ ID NO: 627643 - DNA, 25 bp, Rattus norvegicus
tgcttttccattcctcagatatgaa

SEQ ID NO: 627644 - DNA, 25 bp, Rattus norvegicus
tgcttttccattgctcagatatgaa

SEQ ID NO: 627645 - DNA, 25 bp, Rattus norvegicus
tgcttttccctgaaaaccaagacct

SEQ ID NO: 627646 - DNA, 25 bp, Rattus norvegicus
tgcttttccctgtaaaccaagacct

SEQ ID NO: 627647 - DNA, 25 bp, Rattus norvegicus
tgcttttcctttcgtacttacttca

SEQ ID NO: 627648 - DNA, 25 bp, Rattus norvegicus
tgcttttcctttggtacttacttca

SEQ ID NO: 627649 - DNA, 25 bp, Rattus norvegicus
tgcttttctataaagccccatgctg

SEQ ID NO: 627650 - DNA, 25 bp, Rattus norvegicus
tgcttttctatatagccccatgctg

SEQ ID NO: 627651 - DNA, 25 bp, Rattus norvegicus
tgcttttctcacagccagctttggt

SEQ ID NO: 627652 - DNA, 25 bp, Rattus norvegicus
tgcttttctcactgccagctttggt

SEQ ID NO: 627653 - DNA, 25 bp, Rattus norvegicus
tgcttttctctaccattgctgatca

SEQ ID NO: 627654 - DNA, 25 bp, Rattus norvegicus
tgcttttctctagcattgctgatca

SEQ ID NO: 627655 - DNA, 25 bp, Rattus norvegicus
tgcttttctctgctgtaccgaggca

SEQ ID NO: 627656 - DNA, 25 bp, Rattus norvegicus
tgcttttctctggtgtaccgaggca

SEQ ID NO: 627657 - DNA, 25 bp, Rattus norvegicus
tgcttttctgcacccaccaaaattg

SEQ ID NO: 627658 - DNA, 25 bp, Rattus norvegicus
tgcttttctgcagccaccaaaattg

SEQ ID NO: 627659 - DNA, 25 bp, Rattus norvegicus
tgcttttctgccatggaaccattca

SEQ ID NO: 627660 - DNA, 25 bp, Rattus norvegicus
tgcttttctgccttggaaccattca

SEQ ID NO: 627661 - DNA, 25 bp, Rattus norvegicus
tgcttttctggcagagatcacgtca

SEQ ID NO: 627662 - DNA, 25 bp, Rattus norvegicus
tgcttttctggctgagatcacgtca

SEQ ID NO: 627663 - DNA, 25 bp, Rattus norvegicus
tgcttttctggtcatcctggtttga

SEQ ID NO: 627664 - DNA, 25 bp, Rattus norvegicus
tgcttttctggtgatcctggtttga

SEQ ID NO: 627665 - DNA, 25 bp, Rattus norvegicus
tgcttttctgttattgtacccacca

SEQ ID NO: 627666 - DNA, 25 bp, Rattus norvegicus
tgcttttctgttcccctttcaaaat

SEQ ID NO: 627667 - DNA, 25 bp, Rattus norvegicus
tgcttttctgttgccctttcaaaat

SEQ ID NO: 627668 - DNA, 25 bp, Rattus norvegicus
tgcttttctgtttttgtacccacca

SEQ ID NO: 627669 - DNA, 25 bp, Rattus norvegicus
tgcttttcttcacttgttgtcttct

SEQ ID NO: 627670 - DNA, 25 bp, Rattus norvegicus
tgcttttcttcagttgttgtcttct

SEQ ID NO: 627671 - DNA, 25 bp, Rattus norvegicus
tgcttttcttgaagctctttgcttt

SEQ ID NO: 627672 - DNA, 25 bp, Rattus norvegicus
tgcttttcttgatgctctttgcttt

SEQ ID NO: 627673 - DNA, 25 bp, Rattus norvegicus
tgcttttcttttcgaatggccctgt

SEQ ID NO: 627674 - DNA, 25 bp, Rattus norvegicus
tgcttttcttttggaatggccctgt

SEQ ID NO: 627675 - DNA, 25 bp, Rattus norvegicus
tgcttttgaacactgtcttcaatgt

SEQ ID NO: 627676 - DNA, 25 bp, Rattus norvegicus
tgcttttgaacagtgtcttcaatgt

SEQ ID NO: 627677 - DNA, 25 bp, Rattus norvegicus
tgcttttgacttctctccttctttt

SEQ ID NO: 627678 - DNA, 25 bp, Rattus norvegicus
tgcttttgacttgtctccttctttt

SEQ ID NO: 627679 - DNA, 25 bp, Rattus norvegicus
tgcttttgaggccttctagccaaaa

SEQ ID NO: 627680 - DNA, 25 bp, Rattus norvegicus
tgcttttgaggcgttctagccaaaa

SEQ ID NO: 627681 - DNA, 25 bp, Rattus norvegicus
tgcttttgagttcctgcttgtggac

SEQ ID NO: 627682 - DNA, 25 bp, Rattus norvegicus
tgcttttgagttgctgcttgtggac

SEQ ID NO: 627683 - DNA, 25 bp, Rattus norvegicus
tgcttttgatatctctccaggttag

SEQ ID NO: 627684 - DNA, 25 bp, Rattus norvegicus
tgcttttgatatgtctccaggttag

SEQ ID NO: 627685 - DNA, 25 bp, Rattus norvegicus
tgcttttgcagcagatgcccaaagt

SEQ ID NO: 627686 - DNA, 25 bp, Rattus norvegicus
tgcttttgcagctgatgcccaaagt

SEQ ID NO: 627687 - DNA, 25 bp, Rattus norvegicus
tgcttttgcagtatatcccatcttg

SEQ ID NO: 627688 - DNA, 25 bp, Rattus norvegicus
tgcttttgcagtttatcccatcttg

SEQ ID NO: 627689 - DNA, 25 bp, Rattus norvegicus
tgcttttgccctcagcatccaggaa

SEQ ID NO: 627690 - DNA, 25 bp, Rattus norvegicus
tgcttttgccctgagcatccaggaa

SEQ ID NO: 627691 - DNA, 25 bp, Rattus norvegicus
tgcttttggagacgacccaggtcca

SEQ ID NO: 627692 - DNA, 25 bp, Rattus norvegicus
tgcttttggagaggacccaggtcca

SEQ ID NO: 627693 - DNA, 25 bp, Rattus norvegicus
tgcttttggcaaaacagtgccatta

SEQ ID NO: 627694 - DNA, 25 bp, Rattus norvegicus
tgcttttggcaatacagtgccatta

SEQ ID NO: 627695 - DNA, 25 bp, Rattus norvegicus
tgctttttaaccatcctggaatcca

SEQ ID NO: 627696 - DNA, 25 bp, Rattus norvegicus
tgctttttaaccttcctggaatcca

SEQ ID NO: 627697 - DNA, 25 bp, Rattus norvegicus
tgctttttaataatgcaccgaaggt

SEQ ID NO: 627698 - DNA, 25 bp, Rattus norvegicus
tgctttttaatattgcaccgaaggt

SEQ ID NO: 627699 - DNA, 25 bp, Rattus norvegicus
tgctttttacttcccaggtttgact

SEQ ID NO: 627700 - DNA, 25 bp, Rattus norvegicus
tgctttttacttgccaggtttgact

SEQ ID NO: 627701 - DNA, 25 bp, Rattus norvegicus
tgctttttatccacagtacctcagg

SEQ ID NO: 627702 - DNA, 25 bp, Rattus norvegicus
tgctttttatcctcagtacctcagg

SEQ ID NO: 627703 - DNA, 25 bp, Rattus norvegicus
tgctttttcaagaaaccacccacaa

SEQ ID NO: 627704 - DNA, 25 bp, Rattus norvegicus
tgctttttcaagtaaccacccacaa

SEQ ID NO: 627705 - DNA, 25 bp, Rattus norvegicus
tgctttttcaccctaggtctagaca

SEQ ID NO: 627706 - DNA, 25 bp, Rattus norvegicus
tgctttttcaccgtaggtctagaca

SEQ ID NO: 627707 - DNA, 25 bp, Rattus norvegicus
tgctttttcagaagaccctgttgtg

SEQ ID NO: 627708 - DNA, 25 bp, Rattus norvegicus
tgctttttcagatgaccctgttgtg

SEQ ID NO: 627709 - DNA, 25 bp, Rattus norvegicus
tgctttttcagtacatttgctccaa

SEQ ID NO: 627710 - DNA, 25 bp, Rattus norvegicus
tgctttttcagttcatttgctccaa

SEQ ID NO: 627711 - DNA, 25 bp, Rattus norvegicus
tgctttttcctcagttgacagacag

SEQ ID NO: 627712 - DNA, 25 bp, Rattus norvegicus
tgctttttcctctgttgacagacag

SEQ ID NO: 627713 - DNA, 25 bp, Rattus norvegicus
tgctttttccttaaaggtagccatc

SEQ ID NO: 627714 - DNA, 25 bp, Rattus norvegicus
tgctttttcctttaaggtagccatc

SEQ ID NO: 627715 - DNA, 25 bp, Rattus norvegicus
tgctttttcgacatcaccaaaacca

SEQ ID NO: 627716 - DNA, 25 bp, Rattus norvegicus
tgctttttcgacttcaccaaaacca

SEQ ID NO: 627717 - DNA, 25 bp, Rattus norvegicus
tgctttttgccaatcacagctacaa

SEQ ID NO: 627718 - DNA, 25 bp, Rattus norvegicus
tgctttttgccattcacagctacaa

SEQ ID NO: 627719 - DNA, 25 bp, Rattus norvegicus
tgctttttgcttacaatttgggcac

SEQ ID NO: 627720 - DNA, 25 bp, Rattus norvegicus
tgctttttgctttcaatttgggcac

SEQ ID NO: 627721 - DNA, 25 bp, Rattus norvegicus
tgctttttggcaccaggacaaccct

SEQ ID NO: 627722 - DNA, 25 bp, Rattus norvegicus
tgctttttggcagcaggacaaccct

SEQ ID NO: 627723 - DNA, 25 bp, Rattus norvegicus
tgctttttgttgcttgaattttgtc

SEQ ID NO: 627724 - DNA, 25 bp, Rattus norvegicus
tgctttttgttggttgaattttgtc

SEQ ID NO: 627725 - DNA, 25 bp, Rattus norvegicus
tgcttttttcatctagcatcaggaa

SEQ ID NO: 627726 - DNA, 25 bp, Rattus norvegicus
tgcttttttcatgtagcatcaggaa

SEQ ID NO: 627727 - DNA, 25 bp, Rattus norvegicus
tgcttttttctaaccataggccagg

SEQ ID NO: 627728 - DNA, 25 bp, Rattus norvegicus
tgcttttttctatccataggccagg

SEQ ID NO: 627729 - DNA, 25 bp, Rattus norvegicus
tgctttttttccagatgcctccctg

SEQ ID NO: 627730 - DNA, 25 bp, Rattus norvegicus
tgctttttttcctgatgcctccctg

SEQ ID NO: 627731 - DNA, 25 bp, Rattus norvegicus
tggaaaaacaatcccaggctcccgg

SEQ ID NO: 627732 - DNA, 25 bp, Rattus norvegicus
tggaaaaacaatgccaggctcccgg

SEQ ID NO: 627733 - DNA, 25 bp, Rattus norvegicus
tggaaaaactggaatccccatctct

SEQ ID NO: 627734 - DNA, 25 bp, Rattus norvegicus
tggaaaaactggtatccccatctct

SEQ ID NO: 627735 - DNA, 25 bp, Rattus norvegicus
tggaaaaactgtaacctctcccatg

SEQ ID NO: 627736 - DNA, 25 bp, Rattus norvegicus
tggaaaaactgttacctctcccatg

SEQ ID NO: 627737 - DNA, 25 bp, Rattus norvegicus
tggaaaaagctgacacctctggctc

SEQ ID NO: 627738 - DNA, 25 bp, Rattus norvegicus
tggaaaaagctgtcacctctggctc

SEQ ID NO: 627739 - DNA, 25 bp, Rattus norvegicus
tggaaaaagtccatcctcgtggctt

SEQ ID NO: 627740 - DNA, 25 bp, Rattus norvegicus
tggaaaaagtccttcctcgtggctt

SEQ ID NO: 627741 - DNA, 25 bp, Rattus norvegicus
tggaaaaattgtacccttgtccagg

SEQ ID NO: 627742 - DNA, 25 bp, Rattus norvegicus
tggaaaaattgttcccttgtccagg

SEQ ID NO: 627743 - DNA, 25 bp, Rattus norvegicus
tggaaaacaactacacggccctgat

SEQ ID NO: 627744 - DNA, 25 bp, Rattus norvegicus
tggaaaacaacttcacggccctgat

SEQ ID NO: 627745 - DNA, 25 bp, Rattus norvegicus
tggaaaacacaaccgctgggctcta

SEQ ID NO: 627746 - DNA, 25 bp, Rattus norvegicus
tggaaaacacaagcgctgggctcta

SEQ ID NO: 627747 - DNA, 25 bp, Rattus norvegicus
tggaaaacacccacgtttagcagcg

SEQ ID NO: 627748 - DNA, 25 bp, Rattus norvegicus
tggaaaacaccctcgtttagcagcg

SEQ ID NO: 627749 - DNA, 25 bp, Rattus norvegicus
tggaaaacacttcacctacccgaag

SEQ ID NO: 627750 - DNA, 25 bp, Rattus norvegicus
tggaaaacacttgacctacccgaag

SEQ ID NO: 627751 - DNA, 25 bp, Rattus norvegicus
tggaaaacagaaacccttagggtat

SEQ ID NO: 627752 - DNA, 25 bp, Rattus norvegicus
tggaaaacagaatcccttagggtat

SEQ ID NO: 627753 - DNA, 25 bp, Rattus norvegicus
tggaaaaccagtcaggccccacact

SEQ ID NO: 627754 - DNA, 25 bp, Rattus norvegicus
tggaaaaccagtgaggccccacact

SEQ ID NO: 627755 - DNA, 25 bp, Rattus norvegicus
tggaaaaccatacaacactaacagt

SEQ ID NO: 627756 - DNA, 25 bp, Rattus norvegicus
tggaaaaccatagaacactaacagt

SEQ ID NO: 627757 - DNA, 25 bp, Rattus norvegicus
tggaaaaccctaatctactcttggt

SEQ ID NO: 627758 - DNA, 25 bp, Rattus norvegicus
tggaaaaccctattctactcttggt

SEQ ID NO: 627759 - DNA, 25 bp, Rattus norvegicus
tggaaaaccctcagcagatcattgt

SEQ ID NO: 627760 - DNA, 25 bp, Rattus norvegicus
tggaaaaccctctgcagatcattgt

SEQ ID NO: 627761 - DNA, 25 bp, Rattus norvegicus
tggaaaacccttacttcttcagaat

SEQ ID NO: 627762 - DNA, 25 bp, Rattus norvegicus
tggaaaaccctttcttcttcagaat

SEQ ID NO: 627763 - DNA, 25 bp, Rattus norvegicus
tggaaaaccgcaagcagaggcagca

SEQ ID NO: 627764 - DNA, 25 bp, Rattus norvegicus
tggaaaaccgcatgcagaggcagca

SEQ ID NO: 627765 - DNA, 25 bp, Rattus norvegicus
tggaaaacgcccataaaactgtcat

SEQ ID NO: 627766 - DNA, 25 bp, Rattus norvegicus
tggaaaacgcccttaaaactgtcat

SEQ ID NO: 627767 - DNA, 25 bp, Rattus norvegicus
tggaaaactgttcatggtccccagc

SEQ ID NO: 627768 - DNA, 25 bp, Rattus norvegicus
tggaaaactgttgatggtccccagc

SEQ ID NO: 627769 - DNA, 25 bp, Rattus norvegicus
tggaaaagcaggatctaccacttgc

SEQ ID NO: 627770 - DNA, 25 bp, Rattus norvegicus
tggaaaagcaggttctaccacttgc

SEQ ID NO: 627771 - DNA, 25 bp, Rattus norvegicus
tggaaaaggcaactccttctctcgt

SEQ ID NO: 627772 - DNA, 25 bp, Rattus norvegicus
tggaaaaggcaagtccttctctcgt

SEQ ID NO: 627773 - DNA, 25 bp, Rattus norvegicus
tggaaaagtccccaggaggtccacg

SEQ ID NO: 627774 - DNA, 25 bp, Rattus norvegicus
tggaaaagtcccgaggaggtccacg

SEQ ID NO: 627775 - DNA, 25 bp, Rattus norvegicus
tggaaaagttaacaagcccctcagg

SEQ ID NO: 627776 - DNA, 25 bp, Rattus norvegicus
tggaaaagttaagaagcccctcagg

SEQ ID NO: 627777 - DNA, 25 bp, Rattus norvegicus
tggaaaagttagacacccaggccac

SEQ ID NO: 627778 - DNA, 25 bp, Rattus norvegicus
tggaaaagttagtcacccaggccac

SEQ ID NO: 627779 - DNA, 25 bp, Rattus norvegicus
tggaaaatagaccaccgcccgcaaa

SEQ ID NO: 627780 - DNA, 25 bp, Rattus norvegicus
tggaaaatagacgaccgcccgcaaa

SEQ ID NO: 627781 - DNA, 25 bp, Rattus norvegicus
tggaaaatcttcagacgctgcccga

SEQ ID NO: 627782 - DNA, 25 bp, Rattus norvegicus
tggaaaatcttctgacgctgcccga

SEQ ID NO: 627783 - DNA, 25 bp, Rattus norvegicus
tggaaacaaaccctgtgcttagtgt

SEQ ID NO: 627784 - DNA, 25 bp, Rattus norvegicus
tggaaacaaaccgtgtgcttagtgt

SEQ ID NO: 627785 - DNA, 25 bp, Rattus norvegicus
tggaaacaaactagccggctagccg

SEQ ID NO: 627786 - DNA, 25 bp, Rattus norvegicus
tggaaacaaacttgccggctagccg

SEQ ID NO: 627787 - DNA, 25 bp, Rattus norvegicus
tggaaacaaagcagtgacgccctca

SEQ ID NO: 627788 - DNA, 25 bp, Rattus norvegicus
tggaaacaaagctgtgacgccctca

SEQ ID NO: 627789 - DNA, 25 bp, Rattus norvegicus
tggaaacaaccccaatgccctttga

SEQ ID NO: 627790 - DNA, 25 bp, Rattus norvegicus
tggaaacaacccgaatgccctttga

SEQ ID NO: 627791 - DNA, 25 bp, Rattus norvegicus
tggaaacaatggacccccgagaaat

SEQ ID NO: 627792 - DNA, 25 bp, Rattus norvegicus
tggaaacaatggtcccccgagaaat

SEQ ID NO: 627793 - DNA, 25 bp, Rattus norvegicus
tggaaacacactaagaccacaccct

SEQ ID NO: 627794 - DNA, 25 bp, Rattus norvegicus
tggaaacacacttagaccacaccct

SEQ ID NO: 627795 - DNA, 25 bp, Rattus norvegicus
tggaaacaccgcaagactcaccagc

SEQ ID NO: 627796 - DNA, 25 bp, Rattus norvegicus
tggaaacaccgctagactcaccagc

SEQ ID NO: 627797 - DNA, 25 bp, Rattus norvegicus
tggaaacagacacaggccccactgt

SEQ ID NO: 627798 - DNA, 25 bp, Rattus norvegicus
tggaaacagacagaggccccactgt

SEQ ID NO: 627799 - DNA, 25 bp, Rattus norvegicus
tggaaacagcagaggctttgccttt

SEQ ID NO: 627800 - DNA, 25 bp, Rattus norvegicus
tggaaacagcagtggctttgccttt

SEQ ID NO: 627801 - DNA, 25 bp, Rattus norvegicus
tggaaacagcctactagtcccaggg

SEQ ID NO: 627802 - DNA, 25 bp, Rattus norvegicus
tggaaacagccttctagtcccaggg

SEQ ID NO: 627803 - DNA, 25 bp, Rattus norvegicus
tggaaacagctacttcagccacctc

SEQ ID NO: 627804 - DNA, 25 bp, Rattus norvegicus
tggaaacagctagttcagccacctc

SEQ ID NO: 627805 - DNA, 25 bp, Rattus norvegicus
tggaaacatcagaagctgccgccat

SEQ ID NO: 627806 - DNA, 25 bp, Rattus norvegicus
tggaaacatcagtagctgccgccat

SEQ ID NO: 627807 - DNA, 25 bp, Rattus norvegicus
tggaaacatcgtcctcacatgcagg

SEQ ID NO: 627808 - DNA, 25 bp, Rattus norvegicus
tggaaacatcgtgctcacatgcagg

SEQ ID NO: 627809 - DNA, 25 bp, Rattus norvegicus
tggaaaccaactctactctgtagcc

SEQ ID NO: 627810 - DNA, 25 bp, Rattus norvegicus
tggaaaccaactgtactctgtagcc

SEQ ID NO: 627811 - DNA, 25 bp, Rattus norvegicus
tggaaaccaagtactctccacgtag

SEQ ID NO: 627812 - DNA, 25 bp, Rattus norvegicus
tggaaaccaagttctctccacgtag

SEQ ID NO: 627813 - DNA, 25 bp, Rattus norvegicus
tggaaaccacctcacatgggtccta

SEQ ID NO: 627814 - DNA, 25 bp, Rattus norvegicus
tggaaaccacctgacatgggtccta

SEQ ID NO: 627815 - DNA, 25 bp, Rattus norvegicus
tggaaaccatgaaggctgtagctga

SEQ ID NO: 627816 - DNA, 25 bp, Rattus norvegicus
tggaaaccatgatggctgtagctga

SEQ ID NO: 627817 - DNA, 25 bp, Rattus norvegicus
tggaaaccatgcaaggatcacctga

SEQ ID NO: 627818 - DNA, 25 bp, Rattus norvegicus
tggaaaccatgctaggatcacctga

SEQ ID NO: 627819 - DNA, 25 bp, Rattus norvegicus
tggaaaccatggatcccctttgtaa

SEQ ID NO: 627820 - DNA, 25 bp, Rattus norvegicus
tggaaaccatggttcccctttgtaa

SEQ ID NO: 627821 - DNA, 25 bp, Rattus norvegicus
tggaaacccagacatgcgcagagct

SEQ ID NO: 627822 - DNA, 25 bp, Rattus norvegicus
tggaaacccagagatgcgcagagct

SEQ ID NO: 627823 - DNA, 25 bp, Rattus norvegicus
tggaaacccatcagtcctgtgtgaa

SEQ ID NO: 627824 - DNA, 25 bp, Rattus norvegicus
tggaaacccatctgtcctgtgtgaa

SEQ ID NO: 627825 - DNA, 25 bp, Rattus norvegicus
tggaaaccccagactttcatttgaa

SEQ ID NO: 627826 - DNA, 25 bp, Rattus norvegicus
tggaaaccccagtctttcatttgaa

SEQ ID NO: 627827 - DNA, 25 bp, Rattus norvegicus
tggaaacccgtgaacttttgaatcg

SEQ ID NO: 627828 - DNA, 25 bp, Rattus norvegicus
tggaaacccgtgtacttttgaatcg

SEQ ID NO: 627829 - DNA, 25 bp, Rattus norvegicus
tggaaaccctcacacaccagatcaa

SEQ ID NO: 627830 - DNA, 25 bp, Rattus norvegicus
tggaaaccctcagacaccagatcaa

SEQ ID NO: 627831 - DNA, 25 bp, Rattus norvegicus
tggaaaccctgtacgcaaaattcct

SEQ ID NO: 627832 - DNA, 25 bp, Rattus norvegicus
tggaaaccctgtctataattcccgg

SEQ ID NO: 627833 - DNA, 25 bp, Rattus norvegicus
tggaaaccctgtgtataattcccgg

SEQ ID NO: 627834 - DNA, 25 bp, Rattus norvegicus
tggaaaccctgttcgcaaaattcct

SEQ ID NO: 627835 - DNA, 25 bp, Rattus norvegicus
tggaaacctagcacccattttgtac

SEQ ID NO: 627836 - DNA, 25 bp, Rattus norvegicus
tggaaacctagctcccattttgtac

SEQ ID NO: 627837 - DNA, 25 bp, Rattus norvegicus
tggaaacctattacaccagagtttt

SEQ ID NO: 627838 - DNA, 25 bp, Rattus norvegicus
tggaaacctatttcaccagagtttt

SEQ ID NO: 627839 - DNA, 25 bp, Rattus norvegicus
tggaaacctctgaaccgtacactgc

SEQ ID NO: 627840 - DNA, 25 bp, Rattus norvegicus
tggaaacctctgtaccgtacactgc

SEQ ID NO: 627841 - DNA, 25 bp, Rattus norvegicus
tggaaacctgacaaagcgcgcctgc

SEQ ID NO: 627842 - DNA, 25 bp, Rattus norvegicus
tggaaacctgactaagcgcgcctgc

SEQ ID NO: 627843 - DNA, 25 bp, Rattus norvegicus
tggaaacctgccatgtaaccagcct

SEQ ID NO: 627844 - DNA, 25 bp, Rattus norvegicus
tggaaacctgccttgtaaccagcct

SEQ ID NO: 627845 - DNA, 25 bp, Rattus norvegicus
tggaaaccttgtattctagagaact

SEQ ID NO: 627846 - DNA, 25 bp, Rattus norvegicus
tggaaaccttgttttctagagaact

SEQ ID NO: 627847 - DNA, 25 bp, Rattus norvegicus
tggaaaccttttagcccattctgtc

SEQ ID NO: 627848 - DNA, 25 bp, Rattus norvegicus
tggaaacctttttgcccattctgtc

SEQ ID NO: 627849 - DNA, 25 bp, Rattus norvegicus
tggaaacgccacctaactactaagt

SEQ ID NO: 627850 - DNA, 25 bp, Rattus norvegicus
tggaaacgccacgtaactactaagt

SEQ ID NO: 627851 - DNA, 25 bp, Rattus norvegicus
tggaaacggagcagcaccgcgtgtc

SEQ ID NO: 627852 - DNA, 25 bp, Rattus norvegicus
tggaaacggagctgcaccgcgtgtc

SEQ ID NO: 627853 - DNA, 25 bp, Rattus norvegicus
tggaaacggtccctggtccagatgc

SEQ ID NO: 627854 - DNA, 25 bp, Rattus norvegicus
tggaaacggtccgtggtccagatgc

SEQ ID NO: 627855 - DNA, 25 bp, Rattus norvegicus
tggaaacgttccatgtgtataaact

SEQ ID NO: 627856 - DNA, 25 bp, Rattus norvegicus
tggaaacgttccttgtgtataaact

SEQ ID NO: 627857 - DNA, 25 bp, Rattus norvegicus
tggaaactcaaactcgcctatcaga

SEQ ID NO: 627858 - DNA, 25 bp, Rattus norvegicus
tggaaactcaaagtcgcctatcaga

SEQ ID NO: 627859 - DNA, 25 bp, Rattus norvegicus
tggaaactgaggctccgagaggctt

SEQ ID NO: 627860 - DNA, 25 bp, Rattus norvegicus
tggaaactgagggtccgagaggctt

SEQ ID NO: 627861 - DNA, 25 bp, Rattus norvegicus
tggaaactggttctctgtccaccgt

SEQ ID NO: 627862 - DNA, 25 bp, Rattus norvegicus
tggaaactggttgtctgtccaccgt

SEQ ID NO: 627863 - DNA, 25 bp, Rattus norvegicus
tggaaactgtcactactacctatct

SEQ ID NO: 627864 - DNA, 25 bp, Rattus norvegicus
tggaaactgtcagtactacctatct

SEQ ID NO: 627865 - DNA, 25 bp, Rattus norvegicus
tggaaacttgatcggccagcactta

SEQ ID NO: 627866 - DNA, 25 bp, Rattus norvegicus
tggaaacttgatgggccagcactta

SEQ ID NO: 627867 - DNA, 25 bp, Rattus norvegicus
tggaaagaacaacctctgtctcccc

SEQ ID NO: 627868 - DNA, 25 bp, Rattus norvegicus
tggaaagaacaagctctgtctcccc

SEQ ID NO: 627869 - DNA, 25 bp, Rattus norvegicus
tggaaagaaccccttctcttggagc

SEQ ID NO: 627870 - DNA, 25 bp, Rattus norvegicus
tggaaagaacccgttctcttggagc

SEQ ID NO: 627871 - DNA, 25 bp, Rattus norvegicus
tggaaagaaggtatcccctccctag

SEQ ID NO: 627872 - DNA, 25 bp, Rattus norvegicus
tggaaagaaggtttcccctccctag

SEQ ID NO: 627873 - DNA, 25 bp, Rattus norvegicus
tggaaagacaaccttctgcatcacc

SEQ ID NO: 627874 - DNA, 25 bp, Rattus norvegicus
tggaaagacaacgttctgcatcacc

SEQ ID NO: 627875 - DNA, 25 bp, Rattus norvegicus
tggaaagacatgatcgctcgtcccc

SEQ ID NO: 627876 - DNA, 25 bp, Rattus norvegicus
tggaaagacatgttcgctcgtcccc

SEQ ID NO: 627877 - DNA, 25 bp, Rattus norvegicus
tggaaagactctaccctctagttag

SEQ ID NO: 627878 - DNA, 25 bp, Rattus norvegicus
tggaaagactcttccctctagttag

SEQ ID NO: 627879 - DNA, 25 bp, Rattus norvegicus
tggaaagacttcatccctactggaa

SEQ ID NO: 627880 - DNA, 25 bp, Rattus norvegicus
tggaaagacttcttccctactggaa

SEQ ID NO: 627881 - DNA, 25 bp, Rattus norvegicus
tggaaagaggcactaccccaaccct

SEQ ID NO: 627882 - DNA, 25 bp, Rattus norvegicus
tggaaagaggcagtaccccaaccct

SEQ ID NO: 627883 - DNA, 25 bp, Rattus norvegicus
tggaaagaggtcatacgccacccag

SEQ ID NO: 627884 - DNA, 25 bp, Rattus norvegicus
tggaaagaggtcttacgccacccag

SEQ ID NO: 627885 - DNA, 25 bp, Rattus norvegicus
tggaaagatcctcccctctgctgta

SEQ ID NO: 627886 - DNA, 25 bp, Rattus norvegicus
tggaaagatcctcttgtctcaagaa

SEQ ID NO: 627887 - DNA, 25 bp, Rattus norvegicus
tggaaagatcctgccctctgctgta

SEQ ID NO: 627888 - DNA, 25 bp, Rattus norvegicus
tggaaagatcctgttgtctcaagaa

SEQ ID NO: 627889 - DNA, 25 bp, Rattus norvegicus
tggaaagatctgacccgcatcggga

SEQ ID NO: 627890 - DNA, 25 bp, Rattus norvegicus
tggaaagatctgtcccgcatcggga

SEQ ID NO: 627891 - DNA, 25 bp, Rattus norvegicus
tggaaagatggcacaacactgaaga

SEQ ID NO: 627892 - DNA, 25 bp, Rattus norvegicus
tggaaagatggctcaacactgaaga

SEQ ID NO: 627893 - DNA, 25 bp, Rattus norvegicus
tggaaagatgtgacttccccatctc

SEQ ID NO: 627894 - DNA, 25 bp, Rattus norvegicus
tggaaagatgtgtcttccccatctc

SEQ ID NO: 627895 - DNA, 25 bp, Rattus norvegicus
tggaaagcacagacctctaaggagc

SEQ ID NO: 627896 - DNA, 25 bp, Rattus norvegicus
tggaaagcacagagttctcccatgg

SEQ ID NO: 627897 - DNA, 25 bp, Rattus norvegicus
tggaaagcacagtcctctaaggagc

SEQ ID NO: 627898 - DNA, 25 bp, Rattus norvegicus
tggaaagcacagtgttctcccatgg

SEQ ID NO: 627899 - DNA, 25 bp, Rattus norvegicus
tggaaagcacggcacttggcactga

SEQ ID NO: 627900 - DNA, 25 bp, Rattus norvegicus
tggaaagcacgggacttggcactga

SEQ ID NO: 627901 - DNA, 25 bp, Rattus norvegicus
tggaaagcactacccttcgtggaag

SEQ ID NO: 627902 - DNA, 25 bp, Rattus norvegicus
tggaaagcactagccttcgtggaag

SEQ ID NO: 627903 - DNA, 25 bp, Rattus norvegicus
tggaaagcatctatctccttctgtg

SEQ ID NO: 627904 - DNA, 25 bp, Rattus norvegicus
tggaaagcatctcaccagtccattc

SEQ ID NO: 627905 - DNA, 25 bp, Rattus norvegicus
tggaaagcatctgaccagtccattc

SEQ ID NO: 627906 - DNA, 25 bp, Rattus norvegicus
tggaaagcatctttctccttctgtg

SEQ ID NO: 627907 - DNA, 25 bp, Rattus norvegicus
tggaaagccgttaccattcttggtt

SEQ ID NO: 627908 - DNA, 25 bp, Rattus norvegicus
tggaaagccgtttccattcttggtt

SEQ ID NO: 627909 - DNA, 25 bp, Rattus norvegicus
tggaaagctaatacctgcgtctccc

SEQ ID NO: 627910 - DNA, 25 bp, Rattus norvegicus
tggaaagctaattcctgcgtctccc

SEQ ID NO: 627911 - DNA, 25 bp, Rattus norvegicus
tggaaagctctcagcgagttcgcac

SEQ ID NO: 627912 - DNA, 25 bp, Rattus norvegicus
tggaaagctctctgcgagttcgcac

SEQ ID NO: 627913 - DNA, 25 bp, Rattus norvegicus
tggaaagcttctccacacgctggaa

SEQ ID NO: 627914 - DNA, 25 bp, Rattus norvegicus
tggaaagcttctgcacacgctggaa

SEQ ID NO: 627915 - DNA, 25 bp, Rattus norvegicus
tggaaaggaaaactcccagccctca

SEQ ID NO: 627916 - DNA, 25 bp, Rattus norvegicus
tggaaaggaaaagtcccagccctca

SEQ ID NO: 627917 - DNA, 25 bp, Rattus norvegicus
tggaaaggacccagctcagttcctg

SEQ ID NO: 627918 - DNA, 25 bp, Rattus norvegicus
tggaaaggaccctgctcagttcctg

SEQ ID NO: 627919 - DNA, 25 bp, Rattus norvegicus
tggaaaggacttcagaacatcgatc

SEQ ID NO: 627920 - DNA, 25 bp, Rattus norvegicus
tggaaaggacttgagaacatcgatc

SEQ ID NO: 627921 - DNA, 25 bp, Rattus norvegicus
tggaaaggatcgaccatcacacctc

SEQ ID NO: 627922 - DNA, 25 bp, Rattus norvegicus
tggaaaggatcgtccatcacacctc

SEQ ID NO: 627923 - DNA, 25 bp, Rattus norvegicus
tggaaaggcagcatttgcccttcta

SEQ ID NO: 627924 - DNA, 25 bp, Rattus norvegicus
tggaaaggcagcttttgcccttcta

SEQ ID NO: 627925 - DNA, 25 bp, Rattus norvegicus
tggaaaggcctgacctacatcgtgg

SEQ ID NO: 627926 - DNA, 25 bp, Rattus norvegicus
tggaaaggcctgtcctacatcgtgg

SEQ ID NO: 627927 - DNA, 25 bp, Rattus norvegicus
tggaaaggctttatgttgacatatc

SEQ ID NO: 627928 - DNA, 25 bp, Rattus norvegicus
tggaaaggctttttgttgacatatc

SEQ ID NO: 627929 - DNA, 25 bp, Rattus norvegicus
tggaaagggctcaacacctgcacag

SEQ ID NO: 627930 - DNA, 25 bp, Rattus norvegicus
tggaaagggctctacacctgcacag

SEQ ID NO: 627931 - DNA, 25 bp, Rattus norvegicus
tggaaagggtgtatggcttccctgt

SEQ ID NO: 627932 - DNA, 25 bp, Rattus norvegicus
tggaaagggtgtttggcttccctgt

SEQ ID NO: 627933 - DNA, 25 bp, Rattus norvegicus
tggaaagtactgacactactcataa

SEQ ID NO: 627934 - DNA, 25 bp, Rattus norvegicus
tggaaagtactgtcactactcataa

SEQ ID NO: 627935 - DNA, 25 bp, Rattus norvegicus
tggaaagtctccattcgcgatgacg

SEQ ID NO: 627936 - DNA, 25 bp, Rattus norvegicus
tggaaagtctcctttcgcgatgacg

SEQ ID NO: 627937 - DNA, 25 bp, Rattus norvegicus
tggaaagtgggcctttaccgctcct

SEQ ID NO: 627938 - DNA, 25 bp, Rattus norvegicus
tggaaagtgggcgtttaccgctcct

SEQ ID NO: 627939 - DNA, 25 bp, Rattus norvegicus
tggaaagtgtgtaccctatccgcat

SEQ ID NO: 627940 - DNA, 25 bp, Rattus norvegicus
tggaaagtgtgttccctatccgcat

SEQ ID NO: 627941 - DNA, 25 bp, Rattus norvegicus
tggaaagtgtttagtaatactgcaa

SEQ ID NO: 627942 - DNA, 25 bp, Rattus norvegicus
tggaaagtgttttgtaatactgcaa

SEQ ID NO: 627943 - DNA, 25 bp, Rattus norvegicus
tggaaagttcacacagcaggacatt

SEQ ID NO: 627944 - DNA, 25 bp, Rattus norvegicus
tggaaagttcactcagcaggacatt

SEQ ID NO: 627945 - DNA, 25 bp, Rattus norvegicus
tggaaagtttttcttctggaattat

SEQ ID NO: 627946 - DNA, 25 bp, Rattus norvegicus
tggaaagtttttgttctggaattat

SEQ ID NO: 627947 - DNA, 25 bp, Rattus norvegicus
tggaaataaactcacgcctggcatt

SEQ ID NO: 627948 - DNA, 25 bp, Rattus norvegicus
tggaaataaactgacgcctggcatt

SEQ ID NO: 627949 - DNA, 25 bp, Rattus norvegicus
tggaaataccccacaggatacaatt

SEQ ID NO: 627950 - DNA, 25 bp, Rattus norvegicus
tggaaatacccctcaggatacaatt

SEQ ID NO: 627951 - DNA, 25 bp, Rattus norvegicus
tggaaatactcccaaagcctttctt

SEQ ID NO: 627952 - DNA, 25 bp, Rattus norvegicus
tggaaatactccgaaagcctttctt

SEQ ID NO: 627953 - DNA, 25 bp, Rattus norvegicus
tggaaatactgcacactagcctctg

SEQ ID NO: 627954 - DNA, 25 bp, Rattus norvegicus
tggaaatactgctcactagcctctg

SEQ ID NO: 627955 - DNA, 25 bp, Rattus norvegicus
tggaaatagagcaccctgctgagct

SEQ ID NO: 627956 - DNA, 25 bp, Rattus norvegicus
tggaaatagagctccctgctgagct

SEQ ID NO: 627957 - DNA, 25 bp, Rattus norvegicus
tggaaatcatccctgactgggcctt

SEQ ID NO: 627958 - DNA, 25 bp, Rattus norvegicus
tggaaatcatccgtgactgggcctt

SEQ ID NO: 627959 - DNA, 25 bp, Rattus norvegicus
tggaaatcatgtagcctgggatgcc

SEQ ID NO: 627960 - DNA, 25 bp, Rattus norvegicus
tggaaatcatgttgcctgggatgcc

SEQ ID NO: 627961 - DNA, 25 bp, Rattus norvegicus
tggaaatccacaccagtacaagaat

SEQ ID NO: 627962 - DNA, 25 bp, Rattus norvegicus
tggaaatccacagcagtacaagaat

SEQ ID NO: 627963 - DNA, 25 bp, Rattus norvegicus
tggaaatcccaccaggcccaaagcg

SEQ ID NO: 627964 - DNA, 25 bp, Rattus norvegicus
tggaaatcccacgaggcccaaagcg

SEQ ID NO: 627965 - DNA, 25 bp, Rattus norvegicus
tggaaatcctaccaacctctgatgt

SEQ ID NO: 627966 - DNA, 25 bp, Rattus norvegicus
tggaaatcctacgaacctctgatgt

SEQ ID NO: 627967 - DNA, 25 bp, Rattus norvegicus
tggaaatcgggactacccacgtcct

SEQ ID NO: 627968 - DNA, 25 bp, Rattus norvegicus
tggaaatcgggagtacccacgtcct

SEQ ID NO: 627969 - DNA, 25 bp, Rattus norvegicus
tggaaatctaacactctcctctgac

SEQ ID NO: 627970 - DNA, 25 bp, Rattus norvegicus
tggaaatctaactctctcctctgac

SEQ ID NO: 627971 - DNA, 25 bp, Rattus norvegicus
tggaaatctaccattcctcattaac

SEQ ID NO: 627972 - DNA, 25 bp, Rattus norvegicus
tggaaatctacctttcctcattaac

SEQ ID NO: 627973 - DNA, 25 bp, Rattus norvegicus
tggaaatctcatatccgtacctacc

SEQ ID NO: 627974 - DNA, 25 bp, Rattus norvegicus
tggaaatctcatttccgtacctacc

SEQ ID NO: 627975 - DNA, 25 bp, Rattus norvegicus
tggaaatctgagatcagcctggaaa

SEQ ID NO: 627976 - DNA, 25 bp, Rattus norvegicus
tggaaatctgagttcagcctggaaa

SEQ ID NO: 627977 - DNA, 25 bp, Rattus norvegicus
tggaaatctgccacctgctggaaat

SEQ ID NO: 627978 - DNA, 25 bp, Rattus norvegicus
tggaaatctgcctcctgctggaaat

SEQ ID NO: 627979 - DNA, 25 bp, Rattus norvegicus
tggaaatgcactcgcctacgggcaa

SEQ ID NO: 627980 - DNA, 25 bp, Rattus norvegicus
tggaaatgcactggcctacgggcaa

SEQ ID NO: 627981 - DNA, 25 bp, Rattus norvegicus
tggaaatgccaacgacgctgtcagt

SEQ ID NO: 627982 - DNA, 25 bp, Rattus norvegicus
tggaaatgccaaggacgctgtcagt

SEQ ID NO: 627983 - DNA, 25 bp, Rattus norvegicus
tggaaatgtctcaccctgctggatg

SEQ ID NO: 627984 - DNA, 25 bp, Rattus norvegicus
tggaaatgtctctccctgctggatg

SEQ ID NO: 627985 - DNA, 25 bp, Rattus norvegicus
tggaaatgtgtgatccttggcacgg

SEQ ID NO: 627986 - DNA, 25 bp, Rattus norvegicus
tggaaatgtgtgttccttggcacgg

SEQ ID NO: 627987 - DNA, 25 bp, Rattus norvegicus
tggaaatgttgacctgttctccttc

SEQ ID NO: 627988 - DNA, 25 bp, Rattus norvegicus
tggaaatgttgagctgttctccttc

SEQ ID NO: 627989 - DNA, 25 bp, Rattus norvegicus
tggaaattattcagcctggcttgga

SEQ ID NO: 627990 - DNA, 25 bp, Rattus norvegicus
tggaaattattctgcctggcttgga

SEQ ID NO: 627991 - DNA, 25 bp, Rattus norvegicus
tggaaattcatcacactcctgggaa

SEQ ID NO: 627992 - DNA, 25 bp, Rattus norvegicus
tggaaattcatctcactcctgggaa

SEQ ID NO: 627993 - DNA, 25 bp, Rattus norvegicus
tggaaattccgccagcaacaagccc

SEQ ID NO: 627994 - DNA, 25 bp, Rattus norvegicus
tggaaattccgcgagcaacaagccc

SEQ ID NO: 627995 - DNA, 25 bp, Rattus norvegicus
tggaaattctatcccttggatcaca

SEQ ID NO: 627996 - DNA, 25 bp, Rattus norvegicus
tggaaattctatcttgtccccacac

SEQ ID NO: 627997 - DNA, 25 bp, Rattus norvegicus
tggaaattctatgccttggatcaca

SEQ ID NO: 627998 - DNA, 25 bp, Rattus norvegicus
tggaaattctatgttgtccccacac

SEQ ID NO: 627999 - DNA, 25 bp, Rattus norvegicus
tggaaattctggcttttatgtctaa

SEQ ID NO: 628000 - DNA, 25 bp, Rattus norvegicus
tggaaattctgggttttatgtctaa

SEQ ID NO: 628001 - DNA, 25 bp, Rattus norvegicus
tggaaattgcttctaaaacacagat

SEQ ID NO: 628002 - DNA, 25 bp, Rattus norvegicus
tggaaattgcttctcaggtggctta

SEQ ID NO: 628003 - DNA, 25 bp, Rattus norvegicus
tggaaattgcttgtaaaacacagat

SEQ ID NO: 628004 - DNA, 25 bp, Rattus norvegicus
tggaaattgcttgtcaggtggctta

SEQ ID NO: 628005 - DNA, 25 bp, Rattus norvegicus
tggaaattgtaaccctgagccatta

SEQ ID NO: 628006 - DNA, 25 bp, Rattus norvegicus
tggaaattgtaagcctgagccatta

SEQ ID NO: 628007 - DNA, 25 bp, Rattus norvegicus
tggaaattgttaactgctcctcttt

SEQ ID NO: 628008 - DNA, 25 bp, Rattus norvegicus
tggaaattgttatctgctcctcttt

SEQ ID NO: 628009 - DNA, 25 bp, Rattus norvegicus
tggaacaaagttcctctccctggaa

SEQ ID NO: 628010 - DNA, 25 bp, Rattus norvegicus
tggaacaaagttgctctccctggaa

SEQ ID NO: 628011 - DNA, 25 bp, Rattus norvegicus
tggaacaaatgcctccttcagaaaa

SEQ ID NO: 628012 - DNA, 25 bp, Rattus norvegicus
tggaacaaatgcgtccttcagaaaa

SEQ ID NO: 628013 - DNA, 25 bp, Rattus norvegicus
tggaacaagatgcttcttcagctaa

SEQ ID NO: 628014 - DNA, 25 bp, Rattus norvegicus
tggaacaagatggttcttcagctaa

SEQ ID NO: 628015 - DNA, 25 bp, Rattus norvegicus
tggaacaagcccagcggaagcacaa

SEQ ID NO: 628016 - DNA, 25 bp, Rattus norvegicus
tggaacaagccctgcggaagcacaa

SEQ ID NO: 628017 - DNA, 25 bp, Rattus norvegicus
tggaacaattgtaggacccctcttc

SEQ ID NO: 628018 - DNA, 25 bp, Rattus norvegicus
tggaacaattgttggacccctcttc

SEQ ID NO: 628019 - DNA, 25 bp, Rattus norvegicus
tggaacacactacgatctgcctctg

SEQ ID NO: 628020 - DNA, 25 bp, Rattus norvegicus
tggaacacactaggatctgcctctg

SEQ ID NO: 628021 - DNA, 25 bp, Rattus norvegicus
tggaacacagctacgagacagccag

SEQ ID NO: 628022 - DNA, 25 bp, Rattus norvegicus
tggaacacagcttcgagacagccag

SEQ ID NO: 628023 - DNA, 25 bp, Rattus norvegicus
tggaacacagttccatggttagttt

SEQ ID NO: 628024 - DNA, 25 bp, Rattus norvegicus
tggaacacagttgcatggttagttt

SEQ ID NO: 628025 - DNA, 25 bp, Rattus norvegicus
tggaacacatctactggccattgac

SEQ ID NO: 628026 - DNA, 25 bp, Rattus norvegicus
tggaacacatcttctggccattgac

SEQ ID NO: 628027 - DNA, 25 bp, Rattus norvegicus
tggaacactcccatttgtacctcaa

SEQ ID NO: 628028 - DNA, 25 bp, Rattus norvegicus
tggaacactcccttttgtacctcaa

SEQ ID NO: 628029 - DNA, 25 bp, Rattus norvegicus
tggaacactgcacttgcctgttgag

SEQ ID NO: 628030 - DNA, 25 bp, Rattus norvegicus
tggaacactgcagttgcctgttgag

SEQ ID NO: 628031 - DNA, 25 bp, Rattus norvegicus
tggaacactgctctggctgcgtgca

SEQ ID NO: 628032 - DNA, 25 bp, Rattus norvegicus
tggaacactgctgtggctgcgtgca

SEQ ID NO: 628033 - DNA, 25 bp, Rattus norvegicus
tggaacactggcacgggaggaagac

SEQ ID NO: 628034 - DNA, 25 bp, Rattus norvegicus
tggaacactggctcgggaggaagac

SEQ ID NO: 628035 - DNA, 25 bp, Rattus norvegicus
tggaacactgtcactattcttcagc

SEQ ID NO: 628036 - DNA, 25 bp, Rattus norvegicus
tggaacactgtctctattcttcagc

SEQ ID NO: 628037 - DNA, 25 bp, Rattus norvegicus
tggaacagaaaacccctgctgcacc

SEQ ID NO: 628038 - DNA, 25 bp, Rattus norvegicus
tggaacagaaaagccctgctgcacc

SEQ ID NO: 628039 - DNA, 25 bp, Rattus norvegicus
tggaacagccctccgagggaagcct

SEQ ID NO: 628040 - DNA, 25 bp, Rattus norvegicus
tggaacagccctgcgagggaagcct

SEQ ID NO: 628041 - DNA, 25 bp, Rattus norvegicus
tggaacagctgtcccggcgggatca

SEQ ID NO: 628042 - DNA, 25 bp, Rattus norvegicus
tggaacagctgtgccggcgggatca

SEQ ID NO: 628043 - DNA, 25 bp, Rattus norvegicus
tggaacaggcccatgatgcctcctt

SEQ ID NO: 628044 - DNA, 25 bp, Rattus norvegicus
tggaacaggcccttgatgcctcctt

SEQ ID NO: 628045 - DNA, 25 bp, Rattus norvegicus
tggaacagtcccagcagaccaggga

SEQ ID NO: 628046 - DNA, 25 bp, Rattus norvegicus
tggaacagtccctgcagaccaggga

SEQ ID NO: 628047 - DNA, 25 bp, Rattus norvegicus
tggaacatagcgacttgccccgtta

SEQ ID NO: 628048 - DNA, 25 bp, Rattus norvegicus
tggaacatagcgtcttgccccgtta

SEQ ID NO: 628049 - DNA, 25 bp, Rattus norvegicus
tggaacatctctactccctgcatat

SEQ ID NO: 628050 - DNA, 25 bp, Rattus norvegicus
tggaacatctcttctccctgcatat

SEQ ID NO: 628051 - DNA, 25 bp, Rattus norvegicus
tggaacatggtacaccttctgctct

SEQ ID NO: 628052 - DNA, 25 bp, Rattus norvegicus
tggaacatggtagaccttctgctct

SEQ ID NO: 628053 - DNA, 25 bp, Rattus norvegicus
tggaacatgttgacaccccagcacc

SEQ ID NO: 628054 - DNA, 25 bp, Rattus norvegicus
tggaacatgttgtcaccccagcacc

SEQ ID NO: 628055 - DNA, 25 bp, Rattus norvegicus
tggaacattccactggtcttccgca

SEQ ID NO: 628056 - DNA, 25 bp, Rattus norvegicus
tggaacattccagtggtcttccgca

SEQ ID NO: 628057 - DNA, 25 bp, Rattus norvegicus
tggaacattctgcagtcggccatcc

SEQ ID NO: 628058 - DNA, 25 bp, Rattus norvegicus
tggaacattctggagtcggccatcc

SEQ ID NO: 628059 - DNA, 25 bp, Rattus norvegicus
tggaacattcttcgctcagcaggaa

SEQ ID NO: 628060 - DNA, 25 bp, Rattus norvegicus
tggaacattcttggctcagcaggaa

SEQ ID NO: 628061 - DNA, 25 bp, Rattus norvegicus
tggaaccaagggactcacaccgttg

SEQ ID NO: 628062 - DNA, 25 bp, Rattus norvegicus
tggaaccaagggtctcacaccgttg

SEQ ID NO: 628063 - DNA, 25 bp, Rattus norvegicus
tggaaccaccacagctaccaatggg

SEQ ID NO: 628064 - DNA, 25 bp, Rattus norvegicus
tggaaccaccactgctaccaatggg

SEQ ID NO: 628065 - DNA, 25 bp, Rattus norvegicus
tggaaccagcaactgaatcaagtga

SEQ ID NO: 628066 - DNA, 25 bp, Rattus norvegicus
tggaaccagcaagtgaatcaagtga

SEQ ID NO: 628067 - DNA, 25 bp, Rattus norvegicus
tggaaccaggagatgaagtctacat

SEQ ID NO: 628068 - DNA, 25 bp, Rattus norvegicus
tggaaccaggagttgaagtctacat

SEQ ID NO: 628069 - DNA, 25 bp, Rattus norvegicus
tggaaccatcgccaacgtgacagta

SEQ ID NO: 628070 - DNA, 25 bp, Rattus norvegicus
tggaaccatcgcgaacgtgacagta

SEQ ID NO: 628071 - DNA, 25 bp, Rattus norvegicus
tggaacccacagaggcgaaggagaa

SEQ ID NO: 628072 - DNA, 25 bp, Rattus norvegicus
tggaacccacagtggcgaaggagaa

SEQ ID NO: 628073 - DNA, 25 bp, Rattus norvegicus
tggaacccagcacttgacgcacatt

SEQ ID NO: 628074 - DNA, 25 bp, Rattus norvegicus
tggaacccagcagttgacgcacatt

SEQ ID NO: 628075 - DNA, 25 bp, Rattus norvegicus
tggaacccagccaggtccaaacact

SEQ ID NO: 628076 - DNA, 25 bp, Rattus norvegicus
tggaacccagcctggtccaaacact

SEQ ID NO: 628077 - DNA, 25 bp, Rattus norvegicus
tggaacccagggaggaaaagtattg

SEQ ID NO: 628078 - DNA, 25 bp, Rattus norvegicus
tggaacccagggtggaaaagtattg

SEQ ID NO: 628079 - DNA, 25 bp, Rattus norvegicus
tggaacccaggtcccactaagtttt

SEQ ID NO: 628080 - DNA, 25 bp, Rattus norvegicus
tggaacccaggtgccactaagtttt

SEQ ID NO: 628081 - DNA, 25 bp, Rattus norvegicus
tggaacccattaaatagatcaggct

SEQ ID NO: 628082 - DNA, 25 bp, Rattus norvegicus
tggaacccattatatagatcaggct

SEQ ID NO: 628083 - DNA, 25 bp, Rattus norvegicus
tggaaccccaaacaagaccctgact

SEQ ID NO: 628084 - DNA, 25 bp, Rattus norvegicus
tggaaccccaaacccttttattatg

SEQ ID NO: 628085 - DNA, 25 bp, Rattus norvegicus
tggaaccccaaagaagaccctgact

SEQ ID NO: 628086 - DNA, 25 bp, Rattus norvegicus
tggaaccccaaagccttttattatg

SEQ ID NO: 628087 - DNA, 25 bp, Rattus norvegicus
tggaaccccgagaactgcctaacta

SEQ ID NO: 628088 - DNA, 25 bp, Rattus norvegicus
tggaaccccgagtactgcctaacta

SEQ ID NO: 628089 - DNA, 25 bp, Rattus norvegicus
tggaacccctccacatagcagtggg

SEQ ID NO: 628090 - DNA, 25 bp, Rattus norvegicus
tggaacccctcctcatagcagtggg

SEQ ID NO: 628091 - DNA, 25 bp, Rattus norvegicus
tggaaccctcaacggccttagtaag

SEQ ID NO: 628092 - DNA, 25 bp, Rattus norvegicus
tggaaccctcaagggccttagtaag

SEQ ID NO: 628093 - DNA, 25 bp, Rattus norvegicus
tggaaccctcatcccataagcagtt

SEQ ID NO: 628094 - DNA, 25 bp, Rattus norvegicus
tggaaccctcatgccataagcagtt

SEQ ID NO: 628095 - DNA, 25 bp, Rattus norvegicus
tggaaccctggcagctgatgacgaa

SEQ ID NO: 628096 - DNA, 25 bp, Rattus norvegicus
tggaaccctggctgctgatgacgaa

SEQ ID NO: 628097 - DNA, 25 bp, Rattus norvegicus
tggaaccctgggacaaggaacctct

SEQ ID NO: 628098 - DNA, 25 bp, Rattus norvegicus
tggaaccctgggtcaaggaacctct

SEQ ID NO: 628099 - DNA, 25 bp, Rattus norvegicus
tggaaccctggtaatgttgttgatg

SEQ ID NO: 628100 - DNA, 25 bp, Rattus norvegicus
tggaaccctggttatgttgttgatg

SEQ ID NO: 628101 - DNA, 25 bp, Rattus norvegicus
tggaaccgggtgcttggtgccgccg

SEQ ID NO: 628102 - DNA, 25 bp, Rattus norvegicus
tggaaccgggtggttggtgccgccg

SEQ ID NO: 628103 - DNA, 25 bp, Rattus norvegicus
tggaaccgtagcaagtttgcagtat

SEQ ID NO: 628104 - DNA, 25 bp, Rattus norvegicus
tggaaccgtagctagtttgcagtat

SEQ ID NO: 628105 - DNA, 25 bp, Rattus norvegicus
tggaacctaacaaccagacactctc

SEQ ID NO: 628106 - DNA, 25 bp, Rattus norvegicus
tggaacctaacatccagacactctc

SEQ ID NO: 628107 - DNA, 25 bp, Rattus norvegicus
tggaacctacatattactcagccca

SEQ ID NO: 628108 - DNA, 25 bp, Rattus norvegicus
tggaacctacattttactcagccca

SEQ ID NO: 628109 - DNA, 25 bp, Rattus norvegicus
tggaacctacttataagctccttag

SEQ ID NO: 628110 - DNA, 25 bp, Rattus norvegicus
tggaacctacttttaagctccttag

SEQ ID NO: 628111 - DNA, 25 bp, Rattus norvegicus
tggaacctcaaacatcctcatgctc

SEQ ID NO: 628112 - DNA, 25 bp, Rattus norvegicus
tggaacctcaaagatcctcatgctc

SEQ ID NO: 628113 - DNA, 25 bp, Rattus norvegicus
tggaacctcagcctgaccaaacagg

SEQ ID NO: 628114 - DNA, 25 bp, Rattus norvegicus
tggaacctcagcgtgaccaaacagg

SEQ ID NO: 628115 - DNA, 25 bp, Rattus norvegicus
tggaacctcagtcccagacacattt

SEQ ID NO: 628116 - DNA, 25 bp, Rattus norvegicus
tggaacctcagtgccagacacattt

SEQ ID NO: 628117 - DNA, 25 bp, Rattus norvegicus
tggaacctcccaacatgcttatgtg

SEQ ID NO: 628118 - DNA, 25 bp, Rattus norvegicus
tggaacctcccacagagagtccctg

SEQ ID NO: 628119 - DNA, 25 bp, Rattus norvegicus
tggaacctcccagagagagtccctg

SEQ ID NO: 628120 - DNA, 25 bp, Rattus norvegicus
tggaacctcccatcatgcttatgtg

SEQ ID NO: 628121 - DNA, 25 bp, Rattus norvegicus
tggaacctgaccagcaagaacttgt

SEQ ID NO: 628122 - DNA, 25 bp, Rattus norvegicus
tggaacctgacctgcaagaacttgt

SEQ ID NO: 628123 - DNA, 25 bp, Rattus norvegicus
tggaacctggccaatcttgtcactt

SEQ ID NO: 628124 - DNA, 25 bp, Rattus norvegicus
tggaacctggcctatcttgtcactt

SEQ ID NO: 628125 - DNA, 25 bp, Rattus norvegicus
tggaacctggttactccactgccat

SEQ ID NO: 628126 - DNA, 25 bp, Rattus norvegicus
tggaacctggtttctccactgccat

SEQ ID NO: 628127 - DNA, 25 bp, Rattus norvegicus
tggaacctgtacacatatgtcatgt

SEQ ID NO: 628128 - DNA, 25 bp, Rattus norvegicus
tggaacctgtactcatatgtcatgt

SEQ ID NO: 628129 - DNA, 25 bp, Rattus norvegicus
tggaacctgtgaccctcctttacct

SEQ ID NO: 628130 - DNA, 25 bp, Rattus norvegicus
tggaacctgtgagcctcctttacct

SEQ ID NO: 628131 - DNA, 25 bp, Rattus norvegicus
tggaaccttctgagtgccttacaca

SEQ ID NO: 628132 - DNA, 25 bp, Rattus norvegicus
tggaaccttctgtgtgccttacaca

SEQ ID NO: 628133 - DNA, 25 bp, Rattus norvegicus
tggaaccttggaaggagcccagctc

SEQ ID NO: 628134 - DNA, 25 bp, Rattus norvegicus
tggaaccttggatggagcccagctc

SEQ ID NO: 628135 - DNA, 25 bp, Rattus norvegicus
tggaacctttccaactggatcctaa

SEQ ID NO: 628136 - DNA, 25 bp, Rattus norvegicus
tggaacctttcctactggatcctaa

SEQ ID NO: 628137 - DNA, 25 bp, Rattus norvegicus
tggaacgagagcacaccatggccag

SEQ ID NO: 628138 - DNA, 25 bp, Rattus norvegicus
tggaacgagagctcaccatggccag

SEQ ID NO: 628139 - DNA, 25 bp, Rattus norvegicus
tggaacgagtggcacgccaaccagc

SEQ ID NO: 628140 - DNA, 25 bp, Rattus norvegicus
tggaacgagtgggacgccaaccagc

SEQ ID NO: 628141 - DNA, 25 bp, Rattus norvegicus
tggaacgagtgtccccatcacttgt

SEQ ID NO: 628142 - DNA, 25 bp, Rattus norvegicus
tggaacgagtgtgcccatcacttgt

SEQ ID NO: 628143 - DNA, 25 bp, Rattus norvegicus
tggaacgattagatctcgcacacta

SEQ ID NO: 628144 - DNA, 25 bp, Rattus norvegicus
tggaacgattagttctcgcacacta

SEQ ID NO: 628145 - DNA, 25 bp, Rattus norvegicus
tggaacgcacggaggaagacctcgt

SEQ ID NO: 628146 - DNA, 25 bp, Rattus norvegicus
tggaacgcacggtggaagacctcgt

SEQ ID NO: 628147 - DNA, 25 bp, Rattus norvegicus
tggaacgcataacaccacctgcagc

SEQ ID NO: 628148 - DNA, 25 bp, Rattus norvegicus
tggaacgcataagaccacctgcagc

SEQ ID NO: 628149 - DNA, 25 bp, Rattus norvegicus
tggaacgccccgagttaataacttg

SEQ ID NO: 628150 - DNA, 25 bp, Rattus norvegicus
tggaacgccccgtgttaataacttg

SEQ ID NO: 628151 - DNA, 25 bp, Rattus norvegicus
tggaacgcggtcatttttgggcccg

SEQ ID NO: 628152 - DNA, 25 bp, Rattus norvegicus
tggaacgcggtcttttttgggcccg

SEQ ID NO: 628153 - DNA, 25 bp, Rattus norvegicus
tggaacggacgacacaaaccctggg

SEQ ID NO: 628154 - DNA, 25 bp, Rattus norvegicus
tggaacggacgagacaaaccctggg

SEQ ID NO: 628155 - DNA, 25 bp, Rattus norvegicus
tggaacggatgcaggctcacctgac

SEQ ID NO: 628156 - DNA, 25 bp, Rattus norvegicus
tggaacggatgctggctcacctgac

SEQ ID NO: 628157 - DNA, 25 bp, Rattus norvegicus
tggaacggtaaaactctgggacttg

SEQ ID NO: 628158 - DNA, 25 bp, Rattus norvegicus
tggaacggtaaatctctgggacttg

SEQ ID NO: 628159 - DNA, 25 bp, Rattus norvegicus
tggaacggttccaccttcgcttgag

SEQ ID NO: 628160 - DNA, 25 bp, Rattus norvegicus
tggaacggttcctccttcgcttgag

SEQ ID NO: 628161 - DNA, 25 bp, Rattus norvegicus
tggaacgtgaacactgccctgctac

SEQ ID NO: 628162 - DNA, 25 bp, Rattus norvegicus
tggaacgtgaactctgccctgctac

SEQ ID NO: 628163 - DNA, 25 bp, Rattus norvegicus
tggaacgttataactggcatctctt

SEQ ID NO: 628164 - DNA, 25 bp, Rattus norvegicus
tggaacgttatatctggcatctctt

SEQ ID NO: 628165 - DNA, 25 bp, Rattus norvegicus
tggaactaccaacggacacgcattt

SEQ ID NO: 628166 - DNA, 25 bp, Rattus norvegicus
tggaactaccaagggacacgcattt

SEQ ID NO: 628167 - DNA, 25 bp, Rattus norvegicus
tggaactacccaaatgacaatctgt

SEQ ID NO: 628168 - DNA, 25 bp, Rattus norvegicus
tggaactacccatatgacaatctgt

SEQ ID NO: 628169 - DNA, 25 bp, Rattus norvegicus
tggaactagctgaggactgccatgt

SEQ ID NO: 628170 - DNA, 25 bp, Rattus norvegicus
tggaactagctgtggactgccatgt

SEQ ID NO: 628171 - DNA, 25 bp, Rattus norvegicus
tggaactatttcacaacagtcccct

SEQ ID NO: 628172 - DNA, 25 bp, Rattus norvegicus
tggaactatttctcaacagtcccct

SEQ ID NO: 628173 - DNA, 25 bp, Rattus norvegicus
tggaactcaattacggctctgctga

SEQ ID NO: 628174 - DNA, 25 bp, Rattus norvegicus
tggaactcaatttcggctctgctga

SEQ ID NO: 628175 - DNA, 25 bp, Rattus norvegicus
tggaactcacacaacgtctttcact

SEQ ID NO: 628176 - DNA, 25 bp, Rattus norvegicus
tggaactcacactacgtctttcact

SEQ ID NO: 628177 - DNA, 25 bp, Rattus norvegicus
tggaactcactgagatatttccaca

SEQ ID NO: 628178 - DNA, 25 bp, Rattus norvegicus
tggaactcactgtgatatttccaca

SEQ ID NO: 628179 - DNA, 25 bp, Rattus norvegicus
tggaactcaggcatcatctcggtca

SEQ ID NO: 628180 - DNA, 25 bp, Rattus norvegicus
tggaactcaggcttcatctcggtca

SEQ ID NO: 628181 - DNA, 25 bp, Rattus norvegicus
tggaactccagaactaatgcctctt

SEQ ID NO: 628182 - DNA, 25 bp, Rattus norvegicus
tggaactccagatctaatgcctctt

SEQ ID NO: 628183 - DNA, 25 bp, Rattus norvegicus
tggaactccaggcacaactccctgg

SEQ ID NO: 628184 - DNA, 25 bp, Rattus norvegicus
tggaactccagggacaactccctgg

SEQ ID NO: 628185 - DNA, 25 bp, Rattus norvegicus
tggaactcccgtatagaccacatgc

SEQ ID NO: 628186 - DNA, 25 bp, Rattus norvegicus
tggaactcccgtttagaccacatgc

SEQ ID NO: 628187 - DNA, 25 bp, Rattus norvegicus
tggaactcctgacatctgcctggac

SEQ ID NO: 628188 - DNA, 25 bp, Rattus norvegicus
tggaactcctgagatctgcctggac

SEQ ID NO: 628189 - DNA, 25 bp, Rattus norvegicus
tggaactcctgccagaagtcccgtg

SEQ ID NO: 628190 - DNA, 25 bp, Rattus norvegicus
tggaactcctgcgagaagtcccgtg

SEQ ID NO: 628191 - DNA, 25 bp, Rattus norvegicus
tggaactcctttctgcccatggact

SEQ ID NO: 628192 - DNA, 25 bp, Rattus norvegicus
tggaactcctttgtgcccatggact

SEQ ID NO: 628193 - DNA, 25 bp, Rattus norvegicus
tggaactctaatctcagactctctc

SEQ ID NO: 628194 - DNA, 25 bp, Rattus norvegicus
tggaactctaatgtcagactctctc

SEQ ID NO: 628195 - DNA, 25 bp, Rattus norvegicus
tggaactctcagagcaaaacgtcgc

SEQ ID NO: 628196 - DNA, 25 bp, Rattus norvegicus
tggaactctcagtgcaaaacgtcgc

SEQ ID NO: 628197 - DNA, 25 bp, Rattus norvegicus
tggaactctgacctatgtccctctt

SEQ ID NO: 628198 - DNA, 25 bp, Rattus norvegicus
tggaactctgacgtatgtccctctt

SEQ ID NO: 628199 - DNA, 25 bp, Rattus norvegicus
tggaactctggccatcattggaatt

SEQ ID NO: 628200 - DNA, 25 bp, Rattus norvegicus
tggaactctggcgatcattggaatt

SEQ ID NO: 628201 - DNA, 25 bp, Rattus norvegicus
tggaactctggtctattcttctggc

SEQ ID NO: 628202 - DNA, 25 bp, Rattus norvegicus
tggaactctggtgtattcttctggc

SEQ ID NO: 628203 - DNA, 25 bp, Rattus norvegicus
tggaactctttcaacagaccaggcc

SEQ ID NO: 628204 - DNA, 25 bp, Rattus norvegicus
tggaactctttctacagaccaggcc

SEQ ID NO: 628205 - DNA, 25 bp, Rattus norvegicus
tggaactgactaaagggccacctag

SEQ ID NO: 628206 - DNA, 25 bp, Rattus norvegicus
tggaactgactatagggccacctag

SEQ ID NO: 628207 - DNA, 25 bp, Rattus norvegicus
tggaactgcactaacgatcggccgc

SEQ ID NO: 628208 - DNA, 25 bp, Rattus norvegicus
tggaactgcacttacgatcggccgc

SEQ ID NO: 628209 - DNA, 25 bp, Rattus norvegicus
tggaactgcagaacctgggtgccgt

SEQ ID NO: 628210 - DNA, 25 bp, Rattus norvegicus
tggaactgcagatcctgggtgccgt

SEQ ID NO: 628211 - DNA, 25 bp, Rattus norvegicus
tggaactgcagcaatgggcaactgt

SEQ ID NO: 628212 - DNA, 25 bp, Rattus norvegicus
tggaactgcagctatgggcaactgt

SEQ ID NO: 628213 - DNA, 25 bp, Rattus norvegicus
tggaactgccgtattttcttttaag

SEQ ID NO: 628214 - DNA, 25 bp, Rattus norvegicus
tggaactgccgttttttcttttaag

SEQ ID NO: 628215 - DNA, 25 bp, Rattus norvegicus
tggaactggccaatgcacttagcaa

SEQ ID NO: 628216 - DNA, 25 bp, Rattus norvegicus
tggaactggccattgcacttagcaa

SEQ ID NO: 628217 - DNA, 25 bp, Rattus norvegicus
tggaactggctgctctggaagcata

SEQ ID NO: 628218 - DNA, 25 bp, Rattus norvegicus
tggaactggctggtctggaagcata

SEQ ID NO: 628219 - DNA, 25 bp, Rattus norvegicus
tggaactgggctacagtccagccgt

SEQ ID NO: 628220 - DNA, 25 bp, Rattus norvegicus
tggaactgggcttcagtccagccgt

SEQ ID NO: 628221 - DNA, 25 bp, Rattus norvegicus
tggaactgtcctatacctgtattgc

SEQ ID NO: 628222 - DNA, 25 bp, Rattus norvegicus
tggaactgtcctttacctgtattgc

SEQ ID NO: 628223 - DNA, 25 bp, Rattus norvegicus
tggaactgtctcacttgaacccagg

SEQ ID NO: 628224 - DNA, 25 bp, Rattus norvegicus
tggaactgtctctcttgaacccagg

SEQ ID NO: 628225 - DNA, 25 bp, Rattus norvegicus
tggaactgtgttcgacaaagctctg

SEQ ID NO: 628226 - DNA, 25 bp, Rattus norvegicus
tggaactgtgttggacaaagctctg

SEQ ID NO: 628227 - DNA, 25 bp, Rattus norvegicus
tggaactgttgcagcctctctcagg

SEQ ID NO: 628228 - DNA, 25 bp, Rattus norvegicus
tggaactgttgctgcctctctcagg

SEQ ID NO: 628229 - DNA, 25 bp, Rattus norvegicus
tggaacttcctaccagtatttttct

SEQ ID NO: 628230 - DNA, 25 bp, Rattus norvegicus
tggaacttcctagcagtatttttct

SEQ ID NO: 628231 - DNA, 25 bp, Rattus norvegicus
tggaacttcctgctactctgcacag

SEQ ID NO: 628232 - DNA, 25 bp, Rattus norvegicus
tggaacttcctggtactctgcacag

SEQ ID NO: 628233 - DNA, 25 bp, Rattus norvegicus
tggaacttccttactaaggctccca

SEQ ID NO: 628234 - DNA, 25 bp, Rattus norvegicus
tggaacttcctttctaaggctccca

SEQ ID NO: 628235 - DNA, 25 bp, Rattus norvegicus
tggaacttgaggacttcctctcagc

SEQ ID NO: 628236 - DNA, 25 bp, Rattus norvegicus
tggaacttgaggtcttcctctcagc

SEQ ID NO: 628237 - DNA, 25 bp, Rattus norvegicus
tggaacttgggtattagccagtctt

SEQ ID NO: 628238 - DNA, 25 bp, Rattus norvegicus
tggaacttgggttttagccagtctt

SEQ ID NO: 628239 - DNA, 25 bp, Rattus norvegicus
tggaacttgtgtcctattggcccag

SEQ ID NO: 628240 - DNA, 25 bp, Rattus norvegicus
tggaacttgtgtgctattggcccag

SEQ ID NO: 628241 - DNA, 25 bp, Rattus norvegicus
tggaactttatcaccaggccttgga

SEQ ID NO: 628242 - DNA, 25 bp, Rattus norvegicus
tggaactttatctccaggccttgga

SEQ ID NO: 628243 - DNA, 25 bp, Rattus norvegicus
tggaactttccaagctggctctcta

SEQ ID NO: 628244 - DNA, 25 bp, Rattus norvegicus
tggaactttccatgctggctctcta

SEQ ID NO: 628245 - DNA, 25 bp, Rattus norvegicus
tggaactttgacatcgccactgaga

SEQ ID NO: 628246 - DNA, 25 bp, Rattus norvegicus
tggaactttgacttcgccactgaga

SEQ ID NO: 628247 - DNA, 25 bp, Rattus norvegicus
tggaactttgtgcatctgtctttgg

SEQ ID NO: 628248 - DNA, 25 bp, Rattus norvegicus
tggaactttgtggatctgtctttgg

SEQ ID NO: 628249 - DNA, 25 bp, Rattus norvegicus
tggaagaaacaaccagtataccctt

SEQ ID NO: 628250 - DNA, 25 bp, Rattus norvegicus
tggaagaaacaagcagtataccctt

SEQ ID NO: 628251 - DNA, 25 bp, Rattus norvegicus
tggaagaaatgacctcgcgtagctc

SEQ ID NO: 628252 - DNA, 25 bp, Rattus norvegicus
tggaagaaatgagctcgcgtagctc

SEQ ID NO: 628253 - DNA, 25 bp, Rattus norvegicus
tggaagaacccacaagactcatctg

SEQ ID NO: 628254 - DNA, 25 bp, Rattus norvegicus
tggaagaacccagaagactcatctg

SEQ ID NO: 628255 - DNA, 25 bp, Rattus norvegicus
tggaagaacccgagtctactgaaaa

SEQ ID NO: 628256 - DNA, 25 bp, Rattus norvegicus
tggaagaacccgtgtctactgaaaa

SEQ ID NO: 628257 - DNA, 25 bp, Rattus norvegicus
tggaagaacctcctcttaccatttt

SEQ ID NO: 628258 - DNA, 25 bp, Rattus norvegicus
tggaagaacctcgtcttaccatttt

SEQ ID NO: 628259 - DNA, 25 bp, Rattus norvegicus
tggaagaactctcatgctgcctagc

SEQ ID NO: 628260 - DNA, 25 bp, Rattus norvegicus
tggaagaactctgatgctgcctagc

SEQ ID NO: 628261 - DNA, 25 bp, Rattus norvegicus
tggaagaagctacctggctccggct

SEQ ID NO: 628262 - DNA, 25 bp, Rattus norvegicus
tggaagaagctagctggctccggct

SEQ ID NO: 628263 - DNA, 25 bp, Rattus norvegicus
tggaagaagcttaacgtcaccggca

SEQ ID NO: 628264 - DNA, 25 bp, Rattus norvegicus
tggaagaagctttacgtcaccggca

SEQ ID NO: 628265 - DNA, 25 bp, Rattus norvegicus
tggaagaagtgcctgtttgccccag

SEQ ID NO: 628266 - DNA, 25 bp, Rattus norvegicus
tggaagaagtgcgtgtttgccccag

SEQ ID NO: 628267 - DNA, 25 bp, Rattus norvegicus
tggaagaatagtcattatgcaatct

SEQ ID NO: 628268 - DNA, 25 bp, Rattus norvegicus
tggaagaatagtgattatgcaatct

SEQ ID NO: 628269 - DNA, 25 bp, Rattus norvegicus
tggaagaatgcaaccctggccgagc

SEQ ID NO: 628270 - DNA, 25 bp, Rattus norvegicus
tggaagaatgcatccctggccgagc

SEQ ID NO: 628271 - DNA, 25 bp, Rattus norvegicus
tggaagacacacaaaatcctctcct

SEQ ID NO: 628272 - DNA, 25 bp, Rattus norvegicus
tggaagacacactaaatcctctcct

SEQ ID NO: 628273 - DNA, 25 bp, Rattus norvegicus
tggaagaccaggcacggctccacct

SEQ ID NO: 628274 - DNA, 25 bp, Rattus norvegicus
tggaagaccagggacggctccacct

SEQ ID NO: 628275 - DNA, 25 bp, Rattus norvegicus
tggaagacccttctgtcctggacaa

SEQ ID NO: 628276 - DNA, 25 bp, Rattus norvegicus
tggaagacccttgtgtcctggacaa

SEQ ID NO: 628277 - DNA, 25 bp, Rattus norvegicus
tggaagacctcaagtagcaaagact

SEQ ID NO: 628278 - DNA, 25 bp, Rattus norvegicus
tggaagacctcatgtagcaaagact

SEQ ID NO: 628279 - DNA, 25 bp, Rattus norvegicus
tggaagacctgcatggtgccctgtc

SEQ ID NO: 628280 - DNA, 25 bp, Rattus norvegicus
tggaagacctgcttggtgccctgtc

SEQ ID NO: 628281 - DNA, 25 bp, Rattus norvegicus
tggaagacgaccacatctttaccag

SEQ ID NO: 628282 - DNA, 25 bp, Rattus norvegicus
tggaagacgacctcatctttaccag

SEQ ID NO: 628283 - DNA, 25 bp, Rattus norvegicus
tggaagacgcatattccgggtgaat

SEQ ID NO: 628284 - DNA, 25 bp, Rattus norvegicus
tggaagacgcattttccgggtgaat

SEQ ID NO: 628285 - DNA, 25 bp, Rattus norvegicus
tggaagactcctagaggcagcgcaa

SEQ ID NO: 628286 - DNA, 25 bp, Rattus norvegicus
tggaagactccttgaggcagcgcaa

SEQ ID NO: 628287 - DNA, 25 bp, Rattus norvegicus
tggaagactgccatacagagttctc

SEQ ID NO: 628288 - DNA, 25 bp, Rattus norvegicus
tggaagactgccttacagagttctc

SEQ ID NO: 628289 - DNA, 25 bp, Rattus norvegicus
tggaagagaacccttttgtgtcccg

SEQ ID NO: 628290 - DNA, 25 bp, Rattus norvegicus
tggaagagaaccgttttgtgtcccg

SEQ ID NO: 628291 - DNA, 25 bp, Rattus norvegicus
tggaagagagccagctcctggctgt

SEQ ID NO: 628292 - DNA, 25 bp, Rattus norvegicus
tggaagagagcctgctcctggctgt

SEQ ID NO: 628293 - DNA, 25 bp, Rattus norvegicus
tggaagagatcccagtggcccagac

SEQ ID NO: 628294 - DNA, 25 bp, Rattus norvegicus
tggaagagatccgagtggcccagac

SEQ ID NO: 628295 - DNA, 25 bp, Rattus norvegicus
tggaagagcctcagcttcttatctg

SEQ ID NO: 628296 - DNA, 25 bp, Rattus norvegicus
tggaagagcctctgcttcttatctg

SEQ ID NO: 628297 - DNA, 25 bp, Rattus norvegicus
tggaagagcgtcactacagccaact

SEQ ID NO: 628298 - DNA, 25 bp, Rattus norvegicus
tggaagagcgtctctacagccaact

SEQ ID NO: 628299 - DNA, 25 bp, Rattus norvegicus
tggaagagctggaccccagcgcttt

SEQ ID NO: 628300 - DNA, 25 bp, Rattus norvegicus
tggaagagctggtccccagcgcttt

SEQ ID NO: 628301 - DNA, 25 bp, Rattus norvegicus
tggaagaggaacaagctgcagctaa

SEQ ID NO: 628302 - DNA, 25 bp, Rattus norvegicus
tggaagaggaactagctgcagctaa

SEQ ID NO: 628303 - DNA, 25 bp, Rattus norvegicus
tggaagagtgccatgtgtcccctga

SEQ ID NO: 628304 - DNA, 25 bp, Rattus norvegicus
tggaagagtgccttgtgtcccctga

SEQ ID NO: 628305 - DNA, 25 bp, Rattus norvegicus
tggaagagtgttcttagccctcccc

SEQ ID NO: 628306 - DNA, 25 bp, Rattus norvegicus
tggaagagtgttgttagccctcccc

SEQ ID NO: 628307 - DNA, 25 bp, Rattus norvegicus
tggaagatatctagtctggctgcaa

SEQ ID NO: 628308 - DNA, 25 bp, Rattus norvegicus
tggaagatatcttgtctggctgcaa

SEQ ID NO: 628309 - DNA, 25 bp, Rattus norvegicus
tggaagatggctccaccgcctacat

SEQ ID NO: 628310 - DNA, 25 bp, Rattus norvegicus
tggaagatggctgcaccgcctacat

SEQ ID NO: 628311 - DNA, 25 bp, Rattus norvegicus
tggaagattccaaagctcccaccga

SEQ ID NO: 628312 - DNA, 25 bp, Rattus norvegicus
tggaagattccatagctcccaccga

SEQ ID NO: 628313 - DNA, 25 bp, Rattus norvegicus
tggaagcaaacaccaggattctctg

SEQ ID NO: 628314 - DNA, 25 bp, Rattus norvegicus
tggaagcaaacagcaggattctctg

SEQ ID NO: 628315 - DNA, 25 bp, Rattus norvegicus
tggaagcaatgacgtggagacacac

SEQ ID NO: 628316 - DNA, 25 bp, Rattus norvegicus
tggaagcaatgaggtggagacacac

SEQ ID NO: 628317 - DNA, 25 bp, Rattus norvegicus
tggaagcacagtcggtcaccctcac

SEQ ID NO: 628318 - DNA, 25 bp, Rattus norvegicus
tggaagcacagtgggtcaccctcac

SEQ ID NO: 628319 - DNA, 25 bp, Rattus norvegicus
tggaagcaccccaaaggctttgagt

SEQ ID NO: 628320 - DNA, 25 bp, Rattus norvegicus
tggaagcacccctaaggctttgagt

SEQ ID NO: 628321 - DNA, 25 bp, Rattus norvegicus
tggaagcacgccatcttggtcctaa

SEQ ID NO: 628322 - DNA, 25 bp, Rattus norvegicus
tggaagcacgccttcttggtcctaa

SEQ ID NO: 628323 - DNA, 25 bp, Rattus norvegicus
tggaagcacggtagcctggcattaa

SEQ ID NO: 628324 - DNA, 25 bp, Rattus norvegicus
tggaagcacggttgcctggcattaa

SEQ ID NO: 628325 - DNA, 25 bp, Rattus norvegicus
tggaagcactaaacacaggacagat

SEQ ID NO: 628326 - DNA, 25 bp, Rattus norvegicus
tggaagcactaatcacaggacagat

SEQ ID NO: 628327 - DNA, 25 bp, Rattus norvegicus
tggaagcactgtcggacgtcctaat

SEQ ID NO: 628328 - DNA, 25 bp, Rattus norvegicus
tggaagcactgtgggacgtcctaat

SEQ ID NO: 628329 - DNA, 25 bp, Rattus norvegicus
tggaagcacttaacggttgtttttg

SEQ ID NO: 628330 - DNA, 25 bp, Rattus norvegicus
tggaagcacttatcggttgtttttg

SEQ ID NO: 628331 - DNA, 25 bp, Rattus norvegicus
tggaagcagccaatcagaacctcac

SEQ ID NO: 628332 - DNA, 25 bp, Rattus norvegicus
tggaagcagccattcagaacctcac

SEQ ID NO: 628333 - DNA, 25 bp, Rattus norvegicus
tggaagcaggacaacagggactatg

SEQ ID NO: 628334 - DNA, 25 bp, Rattus norvegicus
tggaagcaggactacagggactatg

SEQ ID NO: 628335 - DNA, 25 bp, Rattus norvegicus
tggaagcaggttccccagcatcaga

SEQ ID NO: 628336 - DNA, 25 bp, Rattus norvegicus
tggaagcaggttgcccagcatcaga

SEQ ID NO: 628337 - DNA, 25 bp, Rattus norvegicus
tggaagcagtgaatcagctgacccc

SEQ ID NO: 628338 - DNA, 25 bp, Rattus norvegicus
tggaagcagtgattcagctgacccc

SEQ ID NO: 628339 - DNA, 25 bp, Rattus norvegicus
tggaagcatccaccgtgtgtgaccc

SEQ ID NO: 628340 - DNA, 25 bp, Rattus norvegicus
tggaagcatccagcgtgtgtgaccc

SEQ ID NO: 628341 - DNA, 25 bp, Rattus norvegicus
tggaagcatcgccaattccaccaac

SEQ ID NO: 628342 - DNA, 25 bp, Rattus norvegicus
tggaagcatcgcgaattccaccaac

SEQ ID NO: 628343 - DNA, 25 bp, Rattus norvegicus
tggaagccaggaaccctacaaagat

SEQ ID NO: 628344 - DNA, 25 bp, Rattus norvegicus
tggaagccaggatccctacaaagat

SEQ ID NO: 628345 - DNA, 25 bp, Rattus norvegicus
tggaagcccaggctcttgctactca

SEQ ID NO: 628346 - DNA, 25 bp, Rattus norvegicus
tggaagcccagggtcttgctactca

SEQ ID NO: 628347 - DNA, 25 bp, Rattus norvegicus
tggaagcccctcataatcttacttt

SEQ ID NO: 628348 - DNA, 25 bp, Rattus norvegicus
tggaagcccctcttaatcttacttt

SEQ ID NO: 628349 - DNA, 25 bp, Rattus norvegicus
tggaagcccctgactgaactctatt

SEQ ID NO: 628350 - DNA, 25 bp, Rattus norvegicus
tggaagcccctgtctgaactctatt

SEQ ID NO: 628351 - DNA, 25 bp, Rattus norvegicus
tggaagccctctctctgaagtcaat

SEQ ID NO: 628352 - DNA, 25 bp, Rattus norvegicus
tggaagccctctgtctgaagtcaat

SEQ ID NO: 628353 - DNA, 25 bp, Rattus norvegicus
tggaagccctttacttgggcagaaa

SEQ ID NO: 628354 - DNA, 25 bp, Rattus norvegicus
tggaagcccttttcttgggcagaaa

SEQ ID NO: 628355 - DNA, 25 bp, Rattus norvegicus
tggaagccgctgaatgagcctgcag

SEQ ID NO: 628356 - DNA, 25 bp, Rattus norvegicus
tggaagccgctgtatgagcctgcag

SEQ ID NO: 628357 - DNA, 25 bp, Rattus norvegicus
tggaagccgggacaagccccagaaa

SEQ ID NO: 628358 - DNA, 25 bp, Rattus norvegicus
tggaagccgggagaagccccagaaa

SEQ ID NO: 628359 - DNA, 25 bp, Rattus norvegicus
tggaagccggtaccgactcagcagc

SEQ ID NO: 628360 - DNA, 25 bp, Rattus norvegicus
tggaagccggtagcgactcagcagc

SEQ ID NO: 628361 - DNA, 25 bp, Rattus norvegicus
tggaagcctatcactgtttacacac

SEQ ID NO: 628362 - DNA, 25 bp, Rattus norvegicus
tggaagcctatctctgtttacacac

SEQ ID NO: 628363 - DNA, 25 bp, Rattus norvegicus
tggaagcctcggatcattgacaatc

SEQ ID NO: 628364 - DNA, 25 bp, Rattus norvegicus
tggaagcctcggttcattgacaatc

SEQ ID NO: 628365 - DNA, 25 bp, Rattus norvegicus
tggaagccttcgaggagagcctgct

SEQ ID NO: 628366 - DNA, 25 bp, Rattus norvegicus
tggaagccttcgtggagagcctgct

SEQ ID NO: 628367 - DNA, 25 bp, Rattus norvegicus
tggaagccttttcctaaccaagaca

SEQ ID NO: 628368 - DNA, 25 bp, Rattus norvegicus
tggaagccttttgctaaccaagaca

SEQ ID NO: 628369 - DNA, 25 bp, Rattus norvegicus
tggaagcgacttatgcatgcaatgc

SEQ ID NO: 628370 - DNA, 25 bp, Rattus norvegicus
tggaagcgacttttgcatgcaatgc

SEQ ID NO: 628371 - DNA, 25 bp, Rattus norvegicus
tggaagcggaccagggaccagccaa

SEQ ID NO: 628372 - DNA, 25 bp, Rattus norvegicus
tggaagcggacctgggaccagccaa

SEQ ID NO: 628373 - DNA, 25 bp, Rattus norvegicus
tggaagcggcagaaatccggacctc

SEQ ID NO: 628374 - DNA, 25 bp, Rattus norvegicus
tggaagcggcagtaatccggacctc

SEQ ID NO: 628375 - DNA, 25 bp, Rattus norvegicus
tggaagctaacacccttctgatctt

SEQ ID NO: 628376 - DNA, 25 bp, Rattus norvegicus
tggaagctaacagccttctgatctt

SEQ ID NO: 628377 - DNA, 25 bp, Rattus norvegicus
tggaagctatggatcagaccccaca

SEQ ID NO: 628378 - DNA, 25 bp, Rattus norvegicus
tggaagctatggttcagaccccaca

SEQ ID NO: 628379 - DNA, 25 bp, Rattus norvegicus
tggaagctcagcctggtacttagct

SEQ ID NO: 628380 - DNA, 25 bp, Rattus norvegicus
tggaagctcagcgtggtacttagct

SEQ ID NO: 628381 - DNA, 25 bp, Rattus norvegicus
tggaagctccgaccgacatcacgga

SEQ ID NO: 628382 - DNA, 25 bp, Rattus norvegicus
tggaagctccgagcgacatcacgga

SEQ ID NO: 628383 - DNA, 25 bp, Rattus norvegicus
tggaagctcctgctgttaatcccag

SEQ ID NO: 628384 - DNA, 25 bp, Rattus norvegicus
tggaagctcctggtgttaatcccag

SEQ ID NO: 628385 - DNA, 25 bp, Rattus norvegicus
tggaagctgacaccctagctggcac

SEQ ID NO: 628386 - DNA, 25 bp, Rattus norvegicus
tggaagctgacagcctagctggcac

SEQ ID NO: 628387 - DNA, 25 bp, Rattus norvegicus
tggaagctgagtcttccctcagatg

SEQ ID NO: 628388 - DNA, 25 bp, Rattus norvegicus
tggaagctgagtgttccctcagatg

SEQ ID NO: 628389 - DNA, 25 bp, Rattus norvegicus
tggaagctgctaacacacaccggct

SEQ ID NO: 628390 - DNA, 25 bp, Rattus norvegicus
tggaagctgctaaccgcgccaaatt

SEQ ID NO: 628391 - DNA, 25 bp, Rattus norvegicus
tggaagctgctatcacacaccggct

SEQ ID NO: 628392 - DNA, 25 bp, Rattus norvegicus
tggaagctgctatccgcgccaaatt

SEQ ID NO: 628393 - DNA, 25 bp, Rattus norvegicus
tggaagctgctcaccgagtcggaga

SEQ ID NO: 628394 - DNA, 25 bp, Rattus norvegicus
tggaagctgctctccgagtcggaga

SEQ ID NO: 628395 - DNA, 25 bp, Rattus norvegicus
tggaagctggaaagcgtccgctcct

SEQ ID NO: 628396 - DNA, 25 bp, Rattus norvegicus
tggaagctggaatgcgtccgctcct

SEQ ID NO: 628397 - DNA, 25 bp, Rattus norvegicus
tggaagctggcaagctcggcaccca

SEQ ID NO: 628398 - DNA, 25 bp, Rattus norvegicus
tggaagctggcatgctcggcaccca

SEQ ID NO: 628399 - DNA, 25 bp, Rattus norvegicus
tggaagctgtacatttagccccagg

SEQ ID NO: 628400 - DNA, 25 bp, Rattus norvegicus
tggaagctgtacttttagccccagg

SEQ ID NO: 628401 - DNA, 25 bp, Rattus norvegicus
tggaagctgtgaatcctctcagaac

SEQ ID NO: 628402 - DNA, 25 bp, Rattus norvegicus
tggaagctgtgattcctctcagaac

SEQ ID NO: 628403 - DNA, 25 bp, Rattus norvegicus
tggaagctgtggcacctggcacacc

SEQ ID NO: 628404 - DNA, 25 bp, Rattus norvegicus
tggaagctgtgggacctggcacacc

SEQ ID NO: 628405 - DNA, 25 bp, Rattus norvegicus
tggaagcttctaccaagccctatgc

SEQ ID NO: 628406 - DNA, 25 bp, Rattus norvegicus
tggaagcttctagcaagccctatgc

SEQ ID NO: 628407 - DNA, 25 bp, Rattus norvegicus
tggaagcttcttaatgctgacctcc

SEQ ID NO: 628408 - DNA, 25 bp, Rattus norvegicus
tggaagcttctttatgctgacctcc

SEQ ID NO: 628409 - DNA, 25 bp, Rattus norvegicus
tggaagcttgcaaagttaacccctt

SEQ ID NO: 628410 - DNA, 25 bp, Rattus norvegicus
tggaagcttgcatagttaacccctt

SEQ ID NO: 628411 - DNA, 25 bp, Rattus norvegicus
tggaagcttggccagcgacagacaa

SEQ ID NO: 628412 - DNA, 25 bp, Rattus norvegicus
tggaagcttggcgagcgacagacaa

SEQ ID NO: 628413 - DNA, 25 bp, Rattus norvegicus
tggaaggaacttctctggaccctgg

SEQ ID NO: 628414 - DNA, 25 bp, Rattus norvegicus
tggaaggaacttgtctggaccctgg

SEQ ID NO: 628415 - DNA, 25 bp, Rattus norvegicus
tggaaggacagaacaggcttgccct

SEQ ID NO: 628416 - DNA, 25 bp, Rattus norvegicus
tggaaggacagatcaggcttgccct

SEQ ID NO: 628417 - DNA, 25 bp, Rattus norvegicus
tggaaggacctgcaagccccatcag

SEQ ID NO: 628418 - DNA, 25 bp, Rattus norvegicus
tggaaggacctggaagccccatcag

SEQ ID NO: 628419 - DNA, 25 bp, Rattus norvegicus
tggaaggactcactctttgctgccc

SEQ ID NO: 628420 - DNA, 25 bp, Rattus norvegicus
tggaaggactcagtctttgctgccc

SEQ ID NO: 628421 - DNA, 25 bp, Rattus norvegicus
tggaaggagaagcatattgtcatat

SEQ ID NO: 628422 - DNA, 25 bp, Rattus norvegicus
tggaaggagaaggatattgtcatat

SEQ ID NO: 628423 - DNA, 25 bp, Rattus norvegicus
tggaaggagctcacagtggactgaa

SEQ ID NO: 628424 - DNA, 25 bp, Rattus norvegicus
tggaaggagctctcagtggactgaa

SEQ ID NO: 628425 - DNA, 25 bp, Rattus norvegicus
tggaaggagtcaagaccctcaggtt

SEQ ID NO: 628426 - DNA, 25 bp, Rattus norvegicus
tggaaggagtcatgaccctcaggtt

SEQ ID NO: 628427 - DNA, 25 bp, Rattus norvegicus
tggaaggcactccagttcccgagac

SEQ ID NO: 628428 - DNA, 25 bp, Rattus norvegicus
tggaaggcactcgagttcccgagac

SEQ ID NO: 628429 - DNA, 25 bp, Rattus norvegicus
tggaaggcatgtacccaactcctga

SEQ ID NO: 628430 - DNA, 25 bp, Rattus norvegicus
tggaaggcatgttcccaactcctga

SEQ ID NO: 628431 - DNA, 25 bp, Rattus norvegicus
tggaaggcctccaatacccagtcag

SEQ ID NO: 628432 - DNA, 25 bp, Rattus norvegicus
tggaaggcctcctatacccagtcag

SEQ ID NO: 628433 - DNA, 25 bp, Rattus norvegicus
tggaaggcgtcaagaccaggcaccc

SEQ ID NO: 628434 - DNA, 25 bp, Rattus norvegicus
tggaaggcgtcatgaccaggcaccc

SEQ ID NO: 628435 - DNA, 25 bp, Rattus norvegicus
tggaaggcgttcaccagagccccaa

SEQ ID NO: 628436 - DNA, 25 bp, Rattus norvegicus
tggaaggcgttctccagagccccaa

SEQ ID NO: 628437 - DNA, 25 bp, Rattus norvegicus
tggaaggcgtttaacttcacaccga

SEQ ID NO: 628438 - DNA, 25 bp, Rattus norvegicus
tggaaggcgttttacttcacaccga

SEQ ID NO: 628439 - DNA, 25 bp, Rattus norvegicus
tggaaggctctaaaacccaccctgg

SEQ ID NO: 628440 - DNA, 25 bp, Rattus norvegicus
tggaaggctctataacccaccctgg

SEQ ID NO: 628441 - DNA, 25 bp, Rattus norvegicus
tggaaggctgctcgcagtttttcct

SEQ ID NO: 628442 - DNA, 25 bp, Rattus norvegicus
tggaaggctgctggcagtttttcct

SEQ ID NO: 628443 - DNA, 25 bp, Rattus norvegicus
tggaagggaaagacccaccgagatt

SEQ ID NO: 628444 - DNA, 25 bp, Rattus norvegicus
tggaagggaaagtcccaccgagatt

SEQ ID NO: 628445 - DNA, 25 bp, Rattus norvegicus
tggaagggaagcaggccctccaact

SEQ ID NO: 628446 - DNA, 25 bp, Rattus norvegicus
tggaagggaagctggccctccaact

SEQ ID NO: 628447 - DNA, 25 bp, Rattus norvegicus
tggaagggaaggagtccctgtcacc

SEQ ID NO: 628448 - DNA, 25 bp, Rattus norvegicus
tggaagggaaggtgtccctgtcacc

SEQ ID NO: 628449 - DNA, 25 bp, Rattus norvegicus
tggaagggctcaagaccacagtcca

SEQ ID NO: 628450 - DNA, 25 bp, Rattus norvegicus
tggaagggctcatgaccacagtcca

SEQ ID NO: 628451 - DNA, 25 bp, Rattus norvegicus
tggaagggctccactccggtcgtct

SEQ ID NO: 628452 - DNA, 25 bp, Rattus norvegicus
tggaagggctcctctccggtcgtct

SEQ ID NO: 628453 - DNA, 25 bp, Rattus norvegicus
tggaagggcttcatgctttgttccc

SEQ ID NO: 628454 - DNA, 25 bp, Rattus norvegicus
tggaagggcttcttgctttgttccc

SEQ ID NO: 628455 - DNA, 25 bp, Rattus norvegicus
tggaaggtaaccaccgtcaggatcc

SEQ ID NO: 628456 - DNA, 25 bp, Rattus norvegicus
tggaaggtaacctccgtcaggatcc

SEQ ID NO: 628457 - DNA, 25 bp, Rattus norvegicus
tggaaggtcactacgttcatgccgg

SEQ ID NO: 628458 - DNA, 25 bp, Rattus norvegicus
tggaaggtcacttcgttcatgccgg

SEQ ID NO: 628459 - DNA, 25 bp, Rattus norvegicus
tggaaggtccttctctggtctcaat

SEQ ID NO: 628460 - DNA, 25 bp, Rattus norvegicus
tggaaggtccttgtctggtctcaat

SEQ ID NO: 628461 - DNA, 25 bp, Rattus norvegicus
tggaaggttccacgtgttccactca

SEQ ID NO: 628462 - DNA, 25 bp, Rattus norvegicus
tggaaggttccaggtgttccactca

SEQ ID NO: 628463 - DNA, 25 bp, Rattus norvegicus
tggaaggtttttcttcctgtcaact

SEQ ID NO: 628464 - DNA, 25 bp, Rattus norvegicus
tggaaggtttttgttcctgtcaact

SEQ ID NO: 628465 - DNA, 25 bp, Rattus norvegicus
tggaagtaacaaatttctcttcttt

SEQ ID NO: 628466 - DNA, 25 bp, Rattus norvegicus
tggaagtaacaattttctcttcttt

SEQ ID NO: 628467 - DNA, 25 bp, Rattus norvegicus
tggaagtacctactggccccagacg

SEQ ID NO: 628468 - DNA, 25 bp, Rattus norvegicus
tggaagtacctagtggccccagacg

SEQ ID NO: 628469 - DNA, 25 bp, Rattus norvegicus
tggaagtactgacaactactcataa

SEQ ID NO: 628470 - DNA, 25 bp, Rattus norvegicus
tggaagtactgagaactactcataa

SEQ ID NO: 628471 - DNA, 25 bp, Rattus norvegicus
tggaagtagagtatttccaccacga

SEQ ID NO: 628472 - DNA, 25 bp, Rattus norvegicus
tggaagtagagtttttccaccacga

SEQ ID NO: 628473 - DNA, 25 bp, Rattus norvegicus
tggaagtagcacaggctcccgagga

SEQ ID NO: 628474 - DNA, 25 bp, Rattus norvegicus
tggaagtagcactggctcccgagga

SEQ ID NO: 628475 - DNA, 25 bp, Rattus norvegicus
tggaagtatcctaggctattgccac

SEQ ID NO: 628476 - DNA, 25 bp, Rattus norvegicus
tggaagtatccttggctattgccac

SEQ ID NO: 628477 - DNA, 25 bp, Rattus norvegicus
tggaagtatcgtcgtcctcgtgact

SEQ ID NO: 628478 - DNA, 25 bp, Rattus norvegicus
tggaagtatcgtggtcctcgtgact

SEQ ID NO: 628479 - DNA, 25 bp, Rattus norvegicus
tggaagtcaaacaccctttgtattc

SEQ ID NO: 628480 - DNA, 25 bp, Rattus norvegicus
tggaagtcaaactccctttgtattc

SEQ ID NO: 628481 - DNA, 25 bp, Rattus norvegicus
tggaagtcacacctttacaccttta

SEQ ID NO: 628482 - DNA, 25 bp, Rattus norvegicus
tggaagtcacacgtttacaccttta

SEQ ID NO: 628483 - DNA, 25 bp, Rattus norvegicus
tggaagtcaccgagatgccgccacc

SEQ ID NO: 628484 - DNA, 25 bp, Rattus norvegicus
tggaagtcaccgtgatgccgccacc

SEQ ID NO: 628485 - DNA, 25 bp, Rattus norvegicus
tggaagtcactaacacacagatatg

SEQ ID NO: 628486 - DNA, 25 bp, Rattus norvegicus
tggaagtcactatcacacagatatg

SEQ ID NO: 628487 - DNA, 25 bp, Rattus norvegicus
tggaagtcacttctcaaaaggttta

SEQ ID NO: 628488 - DNA, 25 bp, Rattus norvegicus
tggaagtcacttgtcaaaaggttta

SEQ ID NO: 628489 - DNA, 25 bp, Rattus norvegicus
tggaagtcagtgcattctccccagc

SEQ ID NO: 628490 - DNA, 25 bp, Rattus norvegicus
tggaagtcagtggattctccccagc

SEQ ID NO: 628491 - DNA, 25 bp, Rattus norvegicus
tggaagtcatataagccctctgccg

SEQ ID NO: 628492 - DNA, 25 bp, Rattus norvegicus
tggaagtcatattagccctctgccg

SEQ ID NO: 628493 - DNA, 25 bp, Rattus norvegicus
tggaagtccaacactcggctgaagc

SEQ ID NO: 628494 - DNA, 25 bp, Rattus norvegicus
tggaagtccaaccaaccgactttgc

SEQ ID NO: 628495 - DNA, 25 bp, Rattus norvegicus
tggaagtccaacgaaccgactttgc

SEQ ID NO: 628496 - DNA, 25 bp, Rattus norvegicus
tggaagtccaactctcggctgaagc

SEQ ID NO: 628497 - DNA, 25 bp, Rattus norvegicus
tggaagtccactcctactcttaaga

SEQ ID NO: 628498 - DNA, 25 bp, Rattus norvegicus
tggaagtccactgctactcttaaga

SEQ ID NO: 628499 - DNA, 25 bp, Rattus norvegicus
tggaagtcctatctacaaccacctc

SEQ ID NO: 628500 - DNA, 25 bp, Rattus norvegicus
tggaagtcctatctgagacctctct

SEQ ID NO: 628501 - DNA, 25 bp, Rattus norvegicus
tggaagtcctatgtacaaccacctc

SEQ ID NO: 628502 - DNA, 25 bp, Rattus norvegicus
tggaagtcctatgtgagacctctct

SEQ ID NO: 628503 - DNA, 25 bp, Rattus norvegicus
tggaagtcggcaacacgtgcgtctt

SEQ ID NO: 628504 - DNA, 25 bp, Rattus norvegicus
tggaagtcggcatcacgtgcgtctt

SEQ ID NO: 628505 - DNA, 25 bp, Rattus norvegicus
tggaagtcggccaagcatgctggaa

SEQ ID NO: 628506 - DNA, 25 bp, Rattus norvegicus
tggaagtcggcctagcatgctggaa

SEQ ID NO: 628507 - DNA, 25 bp, Rattus norvegicus
tggaagtctgctctgtacctgggaa

SEQ ID NO: 628508 - DNA, 25 bp, Rattus norvegicus
tggaagtctgctgtgtacctgggaa

SEQ ID NO: 628509 - DNA, 25 bp, Rattus norvegicus
tggaagtctggccatctgcattctg

SEQ ID NO: 628510 - DNA, 25 bp, Rattus norvegicus
tggaagtctggcgatctgcattctg

SEQ ID NO: 628511 - DNA, 25 bp, Rattus norvegicus
tggaagtgacccctgtgacgatgac

SEQ ID NO: 628512 - DNA, 25 bp, Rattus norvegicus
tggaagtgacccgtgtgacgatgac

SEQ ID NO: 628513 - DNA, 25 bp, Rattus norvegicus
tggaagtgctatacagggtctcctc

SEQ ID NO: 628514 - DNA, 25 bp, Rattus norvegicus
tggaagtgctattcagggtctcctc

SEQ ID NO: 628515 - DNA, 25 bp, Rattus norvegicus
tggaagtggagcagttctctgctgc

SEQ ID NO: 628516 - DNA, 25 bp, Rattus norvegicus
tggaagtggagctgttctctgctgc

SEQ ID NO: 628517 - DNA, 25 bp, Rattus norvegicus
tggaagtggcagatcttggctcatt

SEQ ID NO: 628518 - DNA, 25 bp, Rattus norvegicus
tggaagtggcagttcttggctcatt

SEQ ID NO: 628519 - DNA, 25 bp, Rattus norvegicus
tggaagtgggttatccgtctacctg

SEQ ID NO: 628520 - DNA, 25 bp, Rattus norvegicus
tggaagtgggttttccgtctacctg

SEQ ID NO: 628521 - DNA, 25 bp, Rattus norvegicus
tggaagtggtcgacctggtcctgaa

SEQ ID NO: 628522 - DNA, 25 bp, Rattus norvegicus
tggaagtggtcgtcctggtcctgaa

SEQ ID NO: 628523 - DNA, 25 bp, Rattus norvegicus
tggaagttcactaatcatgagatat

SEQ ID NO: 628524 - DNA, 25 bp, Rattus norvegicus
tggaagttcacttatcatgagatat

SEQ ID NO: 628525 - DNA, 25 bp, Rattus norvegicus
tggaagttccttccacttctaggac

SEQ ID NO: 628526 - DNA, 25 bp, Rattus norvegicus
tggaagttccttcgcaattggctgc

SEQ ID NO: 628527 - DNA, 25 bp, Rattus norvegicus
tggaagttccttgcacttctaggac

SEQ ID NO: 628528 - DNA, 25 bp, Rattus norvegicus
tggaagttccttggcaattggctgc

SEQ ID NO: 628529 - DNA, 25 bp, Rattus norvegicus
tggaagttcgagaaatcccacccca

SEQ ID NO: 628530 - DNA, 25 bp, Rattus norvegicus
tggaagttcgagtaatcccacccca

SEQ ID NO: 628531 - DNA, 25 bp, Rattus norvegicus
tggaagtttatacatgcctcactgc

SEQ ID NO: 628532 - DNA, 25 bp, Rattus norvegicus
tggaagtttatagatgcctcactgc

SEQ ID NO: 628533 - DNA, 25 bp, Rattus norvegicus
tggaagtttcccatatgaccccggg

SEQ ID NO: 628534 - DNA, 25 bp, Rattus norvegicus
tggaagtttcccttatgaccccggg

SEQ ID NO: 628535 - DNA, 25 bp, Rattus norvegicus
tggaagttttccatcagtgtcacat

SEQ ID NO: 628536 - DNA, 25 bp, Rattus norvegicus
tggaagttttccttcagtgtcacat

SEQ ID NO: 628537 - DNA, 25 bp, Rattus norvegicus
tggaataaaactccgctccctcaag

SEQ ID NO: 628538 - DNA, 25 bp, Rattus norvegicus
tggaataaaactgcgctccctcaag

SEQ ID NO: 628539 - DNA, 25 bp, Rattus norvegicus
tggaataacagtacaacgtgagtgg

SEQ ID NO: 628540 - DNA, 25 bp, Rattus norvegicus
tggaataacagttcaacgtgagtgg

SEQ ID NO: 628541 - DNA, 25 bp, Rattus norvegicus
tggaataactggcattggcctgctg

SEQ ID NO: 628542 - DNA, 25 bp, Rattus norvegicus
tggaataactgggattggcctgctg

SEQ ID NO: 628543 - DNA, 25 bp, Rattus norvegicus
tggaataagggtccccagaggcctt

SEQ ID NO: 628544 - DNA, 25 bp, Rattus norvegicus
tggaataagggtgcccagaggcctt

SEQ ID NO: 628545 - DNA, 25 bp, Rattus norvegicus
tggaataataccatccctctttctt

SEQ ID NO: 628546 - DNA, 25 bp, Rattus norvegicus
tggaataataccttccctctttctt

SEQ ID NO: 628547 - DNA, 25 bp, Rattus norvegicus
tggaatacacccctctttgctcagt

SEQ ID NO: 628548 - DNA, 25 bp, Rattus norvegicus
tggaatacacccgtctttgctcagt

SEQ ID NO: 628549 - DNA, 25 bp, Rattus norvegicus
tggaatacagctctccctcatgagc

SEQ ID NO: 628550 - DNA, 25 bp, Rattus norvegicus
tggaatacagctgtccctcatgagc

SEQ ID NO: 628551 - DNA, 25 bp, Rattus norvegicus
tggaatacccaaaccagctcctatt

SEQ ID NO: 628552 - DNA, 25 bp, Rattus norvegicus
tggaatacccaatccagctcctatt

SEQ ID NO: 628553 - DNA, 25 bp, Rattus norvegicus
tggaatactgctacacctgcctggg

SEQ ID NO: 628554 - DNA, 25 bp, Rattus norvegicus
tggaatactgcttcacctgcctggg

SEQ ID NO: 628555 - DNA, 25 bp, Rattus norvegicus
tggaatagtgagctcccagacctgc

SEQ ID NO: 628556 - DNA, 25 bp, Rattus norvegicus
tggaatagtgaggtcccagacctgc

SEQ ID NO: 628557 - DNA, 25 bp, Rattus norvegicus
tggaatagtgccaccttgctgagtg

SEQ ID NO: 628558 - DNA, 25 bp, Rattus norvegicus
tggaatagtgcctccttgctgagtg

SEQ ID NO: 628559 - DNA, 25 bp, Rattus norvegicus
tggaatagtggacgccttcaactga

SEQ ID NO: 628560 - DNA, 25 bp, Rattus norvegicus
tggaatagtggaggccttcaactga

SEQ ID NO: 628561 - DNA, 25 bp, Rattus norvegicus
tggaatatactgcagctgccctgaa

SEQ ID NO: 628562 - DNA, 25 bp, Rattus norvegicus
tggaatatactggagctgccctgaa

SEQ ID NO: 628563 - DNA, 25 bp, Rattus norvegicus
tggaatatgacgactcctatgccca

SEQ ID NO: 628564 - DNA, 25 bp, Rattus norvegicus
tggaatatgacgtctcctatgccca

SEQ ID NO: 628565 - DNA, 25 bp, Rattus norvegicus
tggaatatgggacaagcggtggcct

SEQ ID NO: 628566 - DNA, 25 bp, Rattus norvegicus
tggaatatgggagaagcggtggcct

SEQ ID NO: 628567 - DNA, 25 bp, Rattus norvegicus
tggaatatttaacaacctccggatt

SEQ ID NO: 628568 - DNA, 25 bp, Rattus norvegicus
tggaatatttaagaacctccggatt

SEQ ID NO: 628569 - DNA, 25 bp, Rattus norvegicus
tggaatcaagtcatcatttttctca

SEQ ID NO: 628570 - DNA, 25 bp, Rattus norvegicus
tggaatcaagtcttcatttttctca

SEQ ID NO: 628571 - DNA, 25 bp, Rattus norvegicus
tggaatcacaggcatctgctaccac

SEQ ID NO: 628572 - DNA, 25 bp, Rattus norvegicus
tggaatcacagggatctgctaccac

SEQ ID NO: 628573 - DNA, 25 bp, Rattus norvegicus
tggaatcacatcacccgacagagcg

SEQ ID NO: 628574 - DNA, 25 bp, Rattus norvegicus
tggaatcacatctcccgacagagcg

SEQ ID NO: 628575 - DNA, 25 bp, Rattus norvegicus
tggaatcagaccactttggcagact

SEQ ID NO: 628576 - DNA, 25 bp, Rattus norvegicus
tggaatcagacctctttggcagact

SEQ ID NO: 628577 - DNA, 25 bp, Rattus norvegicus
tggaatcatccaaaagcatctcaag

SEQ ID NO: 628578 - DNA, 25 bp, Rattus norvegicus
tggaatcatccataagcatctcaag

SEQ ID NO: 628579 - DNA, 25 bp, Rattus norvegicus
tggaatcatgttcatgcagccctcc

SEQ ID NO: 628580 - DNA, 25 bp, Rattus norvegicus
tggaatcatgttgatgcagccctcc

SEQ ID NO: 628581 - DNA, 25 bp, Rattus norvegicus
tggaatccaagcaggagcacctcac

SEQ ID NO: 628582 - DNA, 25 bp, Rattus norvegicus
tggaatccaagctggagcacctcac

SEQ ID NO: 628583 - DNA, 25 bp, Rattus norvegicus
tggaatccacctaggcttgcacatg

SEQ ID NO: 628584 - DNA, 25 bp, Rattus norvegicus
tggaatccaccttggcttgcacatg

SEQ ID NO: 628585 - DNA, 25 bp, Rattus norvegicus
tggaatcccaagcatagtagacatt

SEQ ID NO: 628586 - DNA, 25 bp, Rattus norvegicus
tggaatcccaaggatagtagacatt

SEQ ID NO: 628587 - DNA, 25 bp, Rattus norvegicus
tggaatcccagccagcatttaggag

SEQ ID NO: 628588 - DNA, 25 bp, Rattus norvegicus
tggaatcccagcgagcatttaggag

SEQ ID NO: 628589 - DNA, 25 bp, Rattus norvegicus
tggaatcccatcattgtgtttcttt

SEQ ID NO: 628590 - DNA, 25 bp, Rattus norvegicus
tggaatcccatctttgtgtttcttt

SEQ ID NO: 628591 - DNA, 25 bp, Rattus norvegicus
tggaatccccaaatggcagtgtctt

SEQ ID NO: 628592 - DNA, 25 bp, Rattus norvegicus
tggaatccccaattggcagtgtctt

SEQ ID NO: 628593 - DNA, 25 bp, Rattus norvegicus
tggaatcctctaaacattttgtatc

SEQ ID NO: 628594 - DNA, 25 bp, Rattus norvegicus
tggaatcctctatacattttgtatc

SEQ ID NO: 628595 - DNA, 25 bp, Rattus norvegicus
tggaatcctggcactcttcagggat

SEQ ID NO: 628596 - DNA, 25 bp, Rattus norvegicus
tggaatcctggccagaactacttca

SEQ ID NO: 628597 - DNA, 25 bp, Rattus norvegicus
tggaatcctggcgagaactacttca

SEQ ID NO: 628598 - DNA, 25 bp, Rattus norvegicus
tggaatcctggctctcttcagggat

SEQ ID NO: 628599 - DNA, 25 bp, Rattus norvegicus
tggaatcctttaacgcttttttact

SEQ ID NO: 628600 - DNA, 25 bp, Rattus norvegicus
tggaatcctttatcgcttttttact

SEQ ID NO: 628601 - DNA, 25 bp, Rattus norvegicus
tggaatcctttcacttatgaagcat

SEQ ID NO: 628602 - DNA, 25 bp, Rattus norvegicus
tggaatcctttctcttatgaagcat

SEQ ID NO: 628603 - DNA, 25 bp, Rattus norvegicus
tggaatcgtcccagcatgttcagac

SEQ ID NO: 628604 - DNA, 25 bp, Rattus norvegicus
tggaatcgtccctgcatgttcagac

SEQ ID NO: 628605 - DNA, 25 bp, Rattus norvegicus
tggaatctcagcaacacggtgggtt

SEQ ID NO: 628606 - DNA, 25 bp, Rattus norvegicus
tggaatctcagctacacggtgggtt

SEQ ID NO: 628607 - DNA, 25 bp, Rattus norvegicus
tggaatctcagtctcttttcctaac

SEQ ID NO: 628608 - DNA, 25 bp, Rattus norvegicus
tggaatctcagtgtcttttcctaac

SEQ ID NO: 628609 - DNA, 25 bp, Rattus norvegicus
tggaatctcatgacaccttcagggt

SEQ ID NO: 628610 - DNA, 25 bp, Rattus norvegicus
tggaatctcatgtcaccttcagggt

SEQ ID NO: 628611 - DNA, 25 bp, Rattus norvegicus
tggaatctcttcacctgttgttctt

SEQ ID NO: 628612 - DNA, 25 bp, Rattus norvegicus
tggaatctcttctcctgttgttctt

SEQ ID NO: 628613 - DNA, 25 bp, Rattus norvegicus
tggaatcttaaacgcgcggcttgct

SEQ ID NO: 628614 - DNA, 25 bp, Rattus norvegicus
tggaatcttaaaggcgcggcttgct

SEQ ID NO: 628615 - DNA, 25 bp, Rattus norvegicus
tggaatcttaccaccaccagatgag

SEQ ID NO: 628616 - DNA, 25 bp, Rattus norvegicus
tggaatcttacctccaccagatgag

SEQ ID NO: 628617 - DNA, 25 bp, Rattus norvegicus
tggaatctttgcattgctccaggat

SEQ ID NO: 628618 - DNA, 25 bp, Rattus norvegicus
tggaatctttgctttgctccaggat

SEQ ID NO: 628619 - DNA, 25 bp, Rattus norvegicus
tggaatgaaaacagagctcgtcttt

SEQ ID NO: 628620 - DNA, 25 bp, Rattus norvegicus
tggaatgaaaactgagctcgtcttt

SEQ ID NO: 628621 - DNA, 25 bp, Rattus norvegicus
tggaatgaacatactcgcgctgtcc

SEQ ID NO: 628622 - DNA, 25 bp, Rattus norvegicus
tggaatgaacattctcgcgctgtcc

SEQ ID NO: 628623 - DNA, 25 bp, Rattus norvegicus
tggaatgaagccctcagtctcacac

SEQ ID NO: 628624 - DNA, 25 bp, Rattus norvegicus
tggaatgaagccgtcagtctcacac

SEQ ID NO: 628625 - DNA, 25 bp, Rattus norvegicus
tggaatgaattccacgcctgtgcct

SEQ ID NO: 628626 - DNA, 25 bp, Rattus norvegicus
tggaatgaattcgacgcctgtgcct

SEQ ID NO: 628627 - DNA, 25 bp, Rattus norvegicus
tggaatgacaaacgccgtgctgcta

SEQ ID NO: 628628 - DNA, 25 bp, Rattus norvegicus
tggaatgacaaaggccgtgctgcta

SEQ ID NO: 628629 - DNA, 25 bp, Rattus norvegicus
tggaatgacaccctggctttaagct

SEQ ID NO: 628630 - DNA, 25 bp, Rattus norvegicus
tggaatgacaccgtggctttaagct

SEQ ID NO: 628631 - DNA, 25 bp, Rattus norvegicus
tggaatgaccagctttacctcaaac

SEQ ID NO: 628632 - DNA, 25 bp, Rattus norvegicus
tggaatgaccaggtttacctcaaac

SEQ ID NO: 628633 - DNA, 25 bp, Rattus norvegicus
tggaatgactctctcccttagttac

SEQ ID NO: 628634 - DNA, 25 bp, Rattus norvegicus
tggaatgactctgtcccttagttac

SEQ ID NO: 628635 - DNA, 25 bp, Rattus norvegicus
tggaatgactggattgtggctcccc

SEQ ID NO: 628636 - DNA, 25 bp, Rattus norvegicus
tggaatgactggtttgtggctcccc

SEQ ID NO: 628637 - DNA, 25 bp, Rattus norvegicus
tggaatgcaactatttggtctggct

SEQ ID NO: 628638 - DNA, 25 bp, Rattus norvegicus
tggaatgcaactttttggtctggct

SEQ ID NO: 628639 - DNA, 25 bp, Rattus norvegicus
tggaatgcacttacgatcttggcct

SEQ ID NO: 628640 - DNA, 25 bp, Rattus norvegicus
tggaatgcactttcgatcttggcct

SEQ ID NO: 628641 - DNA, 25 bp, Rattus norvegicus
tggaatgcatcaacactttcccatt

SEQ ID NO: 628642 - DNA, 25 bp, Rattus norvegicus
tggaatgcatcatcactttcccatt

SEQ ID NO: 628643 - DNA, 25 bp, Rattus norvegicus
tggaatgcccagatctgctgtcaga

SEQ ID NO: 628644 - DNA, 25 bp, Rattus norvegicus
tggaatgcccagttctgctgtcaga

SEQ ID NO: 628645 - DNA, 25 bp, Rattus norvegicus
tggaatgcgaagcactgcccagaaa

SEQ ID NO: 628646 - DNA, 25 bp, Rattus norvegicus
tggaatgcgaaggactgcccagaaa

SEQ ID NO: 628647 - DNA, 25 bp, Rattus norvegicus
tggaatggacccagcagaaccttct

SEQ ID NO: 628648 - DNA, 25 bp, Rattus norvegicus
tggaatggaccctgcagaaccttct

SEQ ID NO: 628649 - DNA, 25 bp, Rattus norvegicus
tggaatggactcctgccatggctcg

SEQ ID NO: 628650 - DNA, 25 bp, Rattus norvegicus
tggaatggactcgtgccatggctcg

SEQ ID NO: 628651 - DNA, 25 bp, Rattus norvegicus
tggaatggagacattgaagctgctc

SEQ ID NO: 628652 - DNA, 25 bp, Rattus norvegicus
tggaatggagactttgaagctgctc

SEQ ID NO: 628653 - DNA, 25 bp, Rattus norvegicus
tggaatggtatcacccaaggcctct

SEQ ID NO: 628654 - DNA, 25 bp, Rattus norvegicus
tggaatggtatctcccaaggcctct

SEQ ID NO: 628655 - DNA, 25 bp, Rattus norvegicus
tggaatgtctgaatatatttgcaac

SEQ ID NO: 628656 - DNA, 25 bp, Rattus norvegicus
tggaatgtctgattatatttgcaac

SEQ ID NO: 628657 - DNA, 25 bp, Rattus norvegicus
tggaatgtgaagaggctccccaacc

SEQ ID NO: 628658 - DNA, 25 bp, Rattus norvegicus
tggaatgtgaagtggctccccaacc

SEQ ID NO: 628659 - DNA, 25 bp, Rattus norvegicus
tggaatgtgacgctacttttacaaa

SEQ ID NO: 628660 - DNA, 25 bp, Rattus norvegicus
tggaatgtgacggtacttttacaaa

SEQ ID NO: 628661 - DNA, 25 bp, Rattus norvegicus
tggaatgtggagacacttcaccccg

SEQ ID NO: 628662 - DNA, 25 bp, Rattus norvegicus
tggaatgtggagtcacttcaccccg

SEQ ID NO: 628663 - DNA, 25 bp, Rattus norvegicus
tggaatgtggtcctgctcactaaca

SEQ ID NO: 628664 - DNA, 25 bp, Rattus norvegicus
tggaatgtggtcgtgctcactaaca

SEQ ID NO: 628665 - DNA, 25 bp, Rattus norvegicus
tggaatgtgtcgcatccatgctaaa

SEQ ID NO: 628666 - DNA, 25 bp, Rattus norvegicus
tggaatgtgtcggatccatgctaaa

SEQ ID NO: 628667 - DNA, 25 bp, Rattus norvegicus
tggaatgtgtgaagcctttcttggc

SEQ ID NO: 628668 - DNA, 25 bp, Rattus norvegicus
tggaatgtgtgatgcctttcttggc

SEQ ID NO: 628669 - DNA, 25 bp, Rattus norvegicus
tggaattaaaggatgcccgtgctgc

SEQ ID NO: 628670 - DNA, 25 bp, Rattus norvegicus
tggaattaaaggttgcccgtgctgc

SEQ ID NO: 628671 - DNA, 25 bp, Rattus norvegicus
tggaattacagacgtacactgccag

SEQ ID NO: 628672 - DNA, 25 bp, Rattus norvegicus
tggaattacagaggtacactgccag

SEQ ID NO: 628673 - DNA, 25 bp, Rattus norvegicus
tggaattacatgctcccaaggccag

SEQ ID NO: 628674 - DNA, 25 bp, Rattus norvegicus
tggaattacatggtcccaaggccag

SEQ ID NO: 628675 - DNA, 25 bp, Rattus norvegicus
tggaattagagcacacacctacctg

SEQ ID NO: 628676 - DNA, 25 bp, Rattus norvegicus
tggaattagagctcacacctacctg

SEQ ID NO: 628677 - DNA, 25 bp, Rattus norvegicus
tggaattatacaccccttcctggtt

SEQ ID NO: 628678 - DNA, 25 bp, Rattus norvegicus
tggaattatacagcccttcctggtt

SEQ ID NO: 628679 - DNA, 25 bp, Rattus norvegicus
tggaattcacacctgcgcactttta

SEQ ID NO: 628680 - DNA, 25 bp, Rattus norvegicus
tggaattcacacgtgcgcactttta

SEQ ID NO: 628681 - DNA, 25 bp, Rattus norvegicus
tggaattcccaaaaaggaccacctt

SEQ ID NO: 628682 - DNA, 25 bp, Rattus norvegicus
tggaattcccaacgctttactcggc

SEQ ID NO: 628683 - DNA, 25 bp, Rattus norvegicus
tggaattcccaaggctttactcggc

SEQ ID NO: 628684 - DNA, 25 bp, Rattus norvegicus
tggaattcccaataaggaccacctt

SEQ ID NO: 628685 - DNA, 25 bp, Rattus norvegicus
tggaattcccttattcccactgagt

SEQ ID NO: 628686 - DNA, 25 bp, Rattus norvegicus
tggaattccctttttcccactgagt

SEQ ID NO: 628687 - DNA, 25 bp, Rattus norvegicus
tggaattcctccatggtcacagcct

SEQ ID NO: 628688 - DNA, 25 bp, Rattus norvegicus
tggaattcctccttggtcacagcct

SEQ ID NO: 628689 - DNA, 25 bp, Rattus norvegicus
tggaattccttaaatgaggtttgaa

SEQ ID NO: 628690 - DNA, 25 bp, Rattus norvegicus
tggaattccttatatgaggtttgaa

SEQ ID NO: 628691 - DNA, 25 bp, Rattus norvegicus
tggaattcggctcggtaccatgctt

SEQ ID NO: 628692 - DNA, 25 bp, Rattus norvegicus
tggaattcggctgggtaccatgctt

SEQ ID NO: 628693 - DNA, 25 bp, Rattus norvegicus
tggaattctgggatctcctggctca

SEQ ID NO: 628694 - DNA, 25 bp, Rattus norvegicus
tggaattctgggttctcctggctca

SEQ ID NO: 628695 - DNA, 25 bp, Rattus norvegicus
tggaattcttagaccaaggccctgt

SEQ ID NO: 628696 - DNA, 25 bp, Rattus norvegicus
tggaattcttagtccaaggccctgt

SEQ ID NO: 628697 - DNA, 25 bp, Rattus norvegicus
tggaattcttttacaggacggacaa

SEQ ID NO: 628698 - DNA, 25 bp, Rattus norvegicus
tggaattctttttcaggacggacaa

SEQ ID NO: 628699 - DNA, 25 bp, Rattus norvegicus
tggaattgaagacgctggcctgcct

SEQ ID NO: 628700 - DNA, 25 bp, Rattus norvegicus
tggaattgaagaggctggcctgcct

SEQ ID NO: 628701 - DNA, 25 bp, Rattus norvegicus
tggaattgactcaatttgtggcgta

SEQ ID NO: 628702 - DNA, 25 bp, Rattus norvegicus
tggaattgactctatttgtggcgta

SEQ ID NO: 628703 - DNA, 25 bp, Rattus norvegicus
tggaattgccacagaacctagctgt

SEQ ID NO: 628704 - DNA, 25 bp, Rattus norvegicus
tggaattgccactgaacctagctgt

SEQ ID NO: 628705 - DNA, 25 bp, Rattus norvegicus
tggaattgcccgctcttaggaaact

SEQ ID NO: 628706 - DNA, 25 bp, Rattus norvegicus
tggaattgcccggtcttaggaaact

SEQ ID NO: 628707 - DNA, 25 bp, Rattus norvegicus
tggaattgctctcgctcagctactg

SEQ ID NO: 628708 - DNA, 25 bp, Rattus norvegicus
tggaattgctctggctcagctactg

SEQ ID NO: 628709 - DNA, 25 bp, Rattus norvegicus
tggaattggaaacaggccctcctca

SEQ ID NO: 628710 - DNA, 25 bp, Rattus norvegicus
tggaattggaaagaggccctcctca

SEQ ID NO: 628711 - DNA, 25 bp, Rattus norvegicus
tggaattggtctcctatgtcccaca

SEQ ID NO: 628712 - DNA, 25 bp, Rattus norvegicus
tggaattggtctgctatgtcccaca

SEQ ID NO: 628713 - DNA, 25 bp, Rattus norvegicus
tggaattgtaccagcaggccagctt

SEQ ID NO: 628714 - DNA, 25 bp, Rattus norvegicus
tggaattgtacctgcaggccagctt

SEQ ID NO: 628715 - DNA, 25 bp, Rattus norvegicus
tggaattgtatcactcactgtttag

SEQ ID NO: 628716 - DNA, 25 bp, Rattus norvegicus
tggaattgtatctctcactgtttag

SEQ ID NO: 628717 - DNA, 25 bp, Rattus norvegicus
tggaatttcaggagctactgctcct

SEQ ID NO: 628718 - DNA, 25 bp, Rattus norvegicus
tggaatttcaggtgctactgctcct

SEQ ID NO: 628719 - DNA, 25 bp, Rattus norvegicus
tggaatttcgtcagggacccttgtc

SEQ ID NO: 628720 - DNA, 25 bp, Rattus norvegicus
tggaatttcgtctgggacccttgtc

SEQ ID NO: 628721 - DNA, 25 bp, Rattus norvegicus
tggaatttctaccaagcgtcttctt

SEQ ID NO: 628722 - DNA, 25 bp, Rattus norvegicus
tggaatttctacgaagcgtcttctt

SEQ ID NO: 628723 - DNA, 25 bp, Rattus norvegicus
tggaatttcttgcacactctctcgt

SEQ ID NO: 628724 - DNA, 25 bp, Rattus norvegicus
tggaatttcttggacactctctcgt

SEQ ID NO: 628725 - DNA, 25 bp, Rattus norvegicus
tggaatttgcatctgggtcctttgg

SEQ ID NO: 628726 - DNA, 25 bp, Rattus norvegicus
tggaatttgcatgtgggtcctttgg

SEQ ID NO: 628727 - DNA, 25 bp, Rattus norvegicus
tggaattttatcattgccagcccca

SEQ ID NO: 628728 - DNA, 25 bp, Rattus norvegicus
tggaattttatctttgccagcccca

SEQ ID NO: 628729 - DNA, 25 bp, Rattus norvegicus
tggaattttggacccatcagccatt

SEQ ID NO: 628730 - DNA, 25 bp, Rattus norvegicus
tggaattttggagccatcagccatt

SEQ ID NO: 628731 - DNA, 25 bp, Rattus norvegicus
tggacaaacccgaagaccgcgtgag

SEQ ID NO: 628732 - DNA, 25 bp, Rattus norvegicus
tggacaaacccgtagaccgcgtgag

SEQ ID NO: 628733 - DNA, 25 bp, Rattus norvegicus
tggacaaacctgaaattgctgggat

SEQ ID NO: 628734 - DNA, 25 bp, Rattus norvegicus
tggacaaacctgtaattgctgggat

SEQ ID NO: 628735 - DNA, 25 bp, Rattus norvegicus
tggacaacaccaccgggcttaccta

SEQ ID NO: 628736 - DNA, 25 bp, Rattus norvegicus
tggacaacaccagcgggcttaccta

SEQ ID NO: 628737 - DNA, 25 bp, Rattus norvegicus
tggacaacatacctaaaagctctag

SEQ ID NO: 628738 - DNA, 25 bp, Rattus norvegicus
tggacaacatacgtaaaagctctag

SEQ ID NO: 628739 - DNA, 25 bp, Rattus norvegicus
tggacaacatcactaccaccagcat

SEQ ID NO: 628740 - DNA, 25 bp, Rattus norvegicus
tggacaacatcagtaccaccagcat

SEQ ID NO: 628741 - DNA, 25 bp, Rattus norvegicus
tggacaaccttgaggttcctcatga

SEQ ID NO: 628742 - DNA, 25 bp, Rattus norvegicus
tggacaaccttgtggttcctcatga

SEQ ID NO: 628743 - DNA, 25 bp, Rattus norvegicus
tggacaacggtcatctcgatgagga

SEQ ID NO: 628744 - DNA, 25 bp, Rattus norvegicus
tggacaacggtcttctcgatgagga

SEQ ID NO: 628745 - DNA, 25 bp, Rattus norvegicus
tggacaactacaagctctcaagaaa

SEQ ID NO: 628746 - DNA, 25 bp, Rattus norvegicus
tggacaactacatgctctcaagaaa

SEQ ID NO: 628747 - DNA, 25 bp, Rattus norvegicus
tggacaactccacaacggttcagta

SEQ ID NO: 628748 - DNA, 25 bp, Rattus norvegicus
tggacaactccagaacggttcagta

SEQ ID NO: 628749 - DNA, 25 bp, Rattus norvegicus
tggacaactggaccaggcctagttt

SEQ ID NO: 628750 - DNA, 25 bp, Rattus norvegicus
tggacaactggagcaggcctagttt

SEQ ID NO: 628751 - DNA, 25 bp, Rattus norvegicus
tggacaacttcgacacgcagttcac

SEQ ID NO: 628752 - DNA, 25 bp, Rattus norvegicus
tggacaacttcgtcacgcagttcac

SEQ ID NO: 628753 - DNA, 25 bp, Rattus norvegicus
tggacaagacctaccactggattgt

SEQ ID NO: 628754 - DNA, 25 bp, Rattus norvegicus
tggacaagaccttccactggattgt

SEQ ID NO: 628755 - DNA, 25 bp, Rattus norvegicus
tggacaagcctacctggcagcatca

SEQ ID NO: 628756 - DNA, 25 bp, Rattus norvegicus
tggacaagcctagctggcagcatca

SEQ ID NO: 628757 - DNA, 25 bp, Rattus norvegicus
tggacaagctccaccataaattccc

SEQ ID NO: 628758 - DNA, 25 bp, Rattus norvegicus
tggacaagctcctccataaattccc

SEQ ID NO: 628759 - DNA, 25 bp, Rattus norvegicus
tggacaaggaccagcgggccattga

SEQ ID NO: 628760 - DNA, 25 bp, Rattus norvegicus
tggacaaggacctgcgggccattga

SEQ ID NO: 628761 - DNA, 25 bp, Rattus norvegicus
tggacaaggactcaggccaccgctg

SEQ ID NO: 628762 - DNA, 25 bp, Rattus norvegicus
tggacaaggactgaggccaccgctg

SEQ ID NO: 628763 - DNA, 25 bp, Rattus norvegicus
tggacaaggcatcgccagactcgcg

SEQ ID NO: 628764 - DNA, 25 bp, Rattus norvegicus
tggacaaggcatggccagactcgcg

SEQ ID NO: 628765 - DNA, 25 bp, Rattus norvegicus
tggacaaggcccactggacaacact

SEQ ID NO: 628766 - DNA, 25 bp, Rattus norvegicus
tggacaaggccctctggacaacact

SEQ ID NO: 628767 - DNA, 25 bp, Rattus norvegicus
tggacaagggcaagttcccttccta

SEQ ID NO: 628768 - DNA, 25 bp, Rattus norvegicus
tggacaagggcatgttcccttccta

SEQ ID NO: 628769 - DNA, 25 bp, Rattus norvegicus
tggacaaggtcaacatctctatccc

SEQ ID NO: 628770 - DNA, 25 bp, Rattus norvegicus
tggacaaggtcatcatctctatccc

SEQ ID NO: 628771 - DNA, 25 bp, Rattus norvegicus
tggacaagtcagaccacccggagaa

SEQ ID NO: 628772 - DNA, 25 bp, Rattus norvegicus
tggacaagtcagtccacccggagaa

SEQ ID NO: 628773 - DNA, 25 bp, Rattus norvegicus
tggacaagttgaaaccaccaggttt

SEQ ID NO: 628774 - DNA, 25 bp, Rattus norvegicus
tggacaagttgataccaccaggttt

SEQ ID NO: 628775 - DNA, 25 bp, Rattus norvegicus
tggacaatcggcacacaaacctggg

SEQ ID NO: 628776 - DNA, 25 bp, Rattus norvegicus
tggacaatcggctcacaaacctggg

SEQ ID NO: 628777 - DNA, 25 bp, Rattus norvegicus
tggacaatctctacgaggcctctga

SEQ ID NO: 628778 - DNA, 25 bp, Rattus norvegicus
tggacaatctcttcgaggcctctga

SEQ ID NO: 628779 - DNA, 25 bp, Rattus norvegicus
tggacaatgcccctaacctaggatt

SEQ ID NO: 628780 - DNA, 25 bp, Rattus norvegicus
tggacaatgcccgtaacctaggatt

SEQ ID NO: 628781 - DNA, 25 bp, Rattus norvegicus
tggacaatgtccaccacactttcct

SEQ ID NO: 628782 - DNA, 25 bp, Rattus norvegicus
tggacaatgtcctccacactttcct

SEQ ID NO: 628783 - DNA, 25 bp, Rattus norvegicus
tggacaattaaacctaccccgaaag

SEQ ID NO: 628784 - DNA, 25 bp, Rattus norvegicus
tggacaattaaagctaccccgaaag

SEQ ID NO: 628785 - DNA, 25 bp, Rattus norvegicus
tggacacaacggctaccccaatggt

SEQ ID NO: 628786 - DNA, 25 bp, Rattus norvegicus
tggacacaacgggtaccccaatggt

SEQ ID NO: 628787 - DNA, 25 bp, Rattus norvegicus
tggacacaacttagacagcagcctc

SEQ ID NO: 628788 - DNA, 25 bp, Rattus norvegicus
tggacacaactttgacagcagcctc

SEQ ID NO: 628789 - DNA, 25 bp, Rattus norvegicus
tggacacaatcgcaagcaggaactt

SEQ ID NO: 628790 - DNA, 25 bp, Rattus norvegicus
tggacacaatcggaagcaggaactt

SEQ ID NO: 628791 - DNA, 25 bp, Rattus norvegicus
tggacacaatctcctgctggtcagt

SEQ ID NO: 628792 - DNA, 25 bp, Rattus norvegicus
tggacacaatctgctgctggtcagt

SEQ ID NO: 628793 - DNA, 25 bp, Rattus norvegicus
tggacacacaccatagtgcatttat

SEQ ID NO: 628794 - DNA, 25 bp, Rattus norvegicus
tggacacacaccttagtgcatttat

SEQ ID NO: 628795 - DNA, 25 bp, Rattus norvegicus
tggacacactcaccgagcactatga

SEQ ID NO: 628796 - DNA, 25 bp, Rattus norvegicus
tggacacactcagcgagcactatga

SEQ ID NO: 628797 - DNA, 25 bp, Rattus norvegicus
tggacacagccgaatcttgtatccg

SEQ ID NO: 628798 - DNA, 25 bp, Rattus norvegicus
tggacacagccgtatcttgtatccg

SEQ ID NO: 628799 - DNA, 25 bp, Rattus norvegicus
tggacacaggcgaggacaaagcact

SEQ ID NO: 628800 - DNA, 25 bp, Rattus norvegicus
tggacacaggcgtggacaaagcact

SEQ ID NO: 628801 - DNA, 25 bp, Rattus norvegicus
tggacacatactaacccaccatgaa

SEQ ID NO: 628802 - DNA, 25 bp, Rattus norvegicus
tggacacatacttacccaccatgaa

SEQ ID NO: 628803 - DNA, 25 bp, Rattus norvegicus
tggacacatagcaaccaagcagatt

SEQ ID NO: 628804 - DNA, 25 bp, Rattus norvegicus
tggacacatagctaccaagcagatt

SEQ ID NO: 628805 - DNA, 25 bp, Rattus norvegicus
tggacacatggcatcccaggttctg

SEQ ID NO: 628806 - DNA, 25 bp, Rattus norvegicus
tggacacatggcttcccaggttctg

SEQ ID NO: 628807 - DNA, 25 bp, Rattus norvegicus
tggacacatgtcactgcaatggtct

SEQ ID NO: 628808 - DNA, 25 bp, Rattus norvegicus
tggacacatgtctctgcaatggtct

SEQ ID NO: 628809 - DNA, 25 bp, Rattus norvegicus
tggacacattgcagctggagacccc

SEQ ID NO: 628810 - DNA, 25 bp, Rattus norvegicus
tggacacattgctgctggagacccc

SEQ ID NO: 628811 - DNA, 25 bp, Rattus norvegicus
tggacacattttcccttgaaacgct

SEQ ID NO: 628812 - DNA, 25 bp, Rattus norvegicus
tggacacattttgccttgaaacgct

SEQ ID NO: 628813 - DNA, 25 bp, Rattus norvegicus
tggacaccaccgaggagaggcccta

SEQ ID NO: 628814 - DNA, 25 bp, Rattus norvegicus
tggacaccaccgtggagaggcccta

SEQ ID NO: 628815 - DNA, 25 bp, Rattus norvegicus
tggacaccactcatgactctggagt

SEQ ID NO: 628816 - DNA, 25 bp, Rattus norvegicus
tggacaccactcttgactctggagt

SEQ ID NO: 628817 - DNA, 25 bp, Rattus norvegicus
tggacaccaggcactgcagtgtggt

SEQ ID NO: 628818 - DNA, 25 bp, Rattus norvegicus
tggacaccaggctctgcagtgtggt

SEQ ID NO: 628819 - DNA, 25 bp, Rattus norvegicus
tggacaccatcaacacgtgcatcaa

SEQ ID NO: 628820 - DNA, 25 bp, Rattus norvegicus
tggacaccatcatcacgtgcatcaa

SEQ ID NO: 628821 - DNA, 25 bp, Rattus norvegicus
tggacaccatgtccttttccagaca

SEQ ID NO: 628822 - DNA, 25 bp, Rattus norvegicus
tggacaccatgtgcttttccagaca

SEQ ID NO: 628823 - DNA, 25 bp, Rattus norvegicus
tggacacccaacatctccagagatg

SEQ ID NO: 628824 - DNA, 25 bp, Rattus norvegicus
tggacacccaacttctccagagatg

SEQ ID NO: 628825 - DNA, 25 bp, Rattus norvegicus
tggacacccacaatagcttttaccc

SEQ ID NO: 628826 - DNA, 25 bp, Rattus norvegicus
tggacacccacattagcttttaccc

SEQ ID NO: 628827 - DNA, 25 bp, Rattus norvegicus
tggacacccagaacagtctctcaga

SEQ ID NO: 628828 - DNA, 25 bp, Rattus norvegicus
tggacacccagatcagtctctcaga

SEQ ID NO: 628829 - DNA, 25 bp, Rattus norvegicus
tggacacccagtcgccctctatggt

SEQ ID NO: 628830 - DNA, 25 bp, Rattus norvegicus
tggacacccagtggccctctatggt

SEQ ID NO: 628831 - DNA, 25 bp, Rattus norvegicus
tggacacccgatccagtattctgaa

SEQ ID NO: 628832 - DNA, 25 bp, Rattus norvegicus
tggacacccgatgcagtattctgaa

SEQ ID NO: 628833 - DNA, 25 bp, Rattus norvegicus
tggacacccgcgaccgggagctgct

SEQ ID NO: 628834 - DNA, 25 bp, Rattus norvegicus
tggacacccgcgtccgggagctgct

SEQ ID NO: 628835 - DNA, 25 bp, Rattus norvegicus
tggacaccgccgacaattgggcccg

SEQ ID NO: 628836 - DNA, 25 bp, Rattus norvegicus
tggacaccgccgtcaattgggcccg

SEQ ID NO: 628837 - DNA, 25 bp, Rattus norvegicus
tggacaccggatatacacaggataa

SEQ ID NO: 628838 - DNA, 25 bp, Rattus norvegicus
tggacaccggatttacacaggataa

SEQ ID NO: 628839 - DNA, 25 bp, Rattus norvegicus
tggacacctaatcccctctgaaaga

SEQ ID NO: 628840 - DNA, 25 bp, Rattus norvegicus
tggacacctaatgccctctgaaaga

SEQ ID NO: 628841 - DNA, 25 bp, Rattus norvegicus
tggacacctcagcagtggccgccag

SEQ ID NO: 628842 - DNA, 25 bp, Rattus norvegicus
tggacacctcaggagtggccgccag

SEQ ID NO: 628843 - DNA, 25 bp, Rattus norvegicus
tggacacctcgcaagggagccaaat

SEQ ID NO: 628844 - DNA, 25 bp, Rattus norvegicus
tggacacctcgctagggagccaaat

SEQ ID NO: 628845 - DNA, 25 bp, Rattus norvegicus
tggacacctctgcatgcggcagcta

SEQ ID NO: 628846 - DNA, 25 bp, Rattus norvegicus
tggacacctctggatgcggcagcta

SEQ ID NO: 628847 - DNA, 25 bp, Rattus norvegicus
tggacacctgacatcacaacagaaa

SEQ ID NO: 628848 - DNA, 25 bp, Rattus norvegicus
tggacacctgacttcacaacagaaa

SEQ ID NO: 628849 - DNA, 25 bp, Rattus norvegicus
tggacacctgagctacaccagctaa

SEQ ID NO: 628850 - DNA, 25 bp, Rattus norvegicus
tggacacctgaggtacaccagctaa

SEQ ID NO: 628851 - DNA, 25 bp, Rattus norvegicus
tggacacctgcacttacacacacat

SEQ ID NO: 628852 - DNA, 25 bp, Rattus norvegicus
tggacacctgcagttacacacacat

SEQ ID NO: 628853 - DNA, 25 bp, Rattus norvegicus
tggacacgctcaccaaggagttggc

SEQ ID NO: 628854 - DNA, 25 bp, Rattus norvegicus
tggacacgctcagcaaggagttggc

SEQ ID NO: 628855 - DNA, 25 bp, Rattus norvegicus
tggacacgcttgctggcttgtacaa

SEQ ID NO: 628856 - DNA, 25 bp, Rattus norvegicus
tggacacgcttggtggcttgtacaa

SEQ ID NO: 628857 - DNA, 25 bp, Rattus norvegicus
tggacacggagcctgcacctaagag

SEQ ID NO: 628858 - DNA, 25 bp, Rattus norvegicus
tggacacggagcgtgcacctaagag

SEQ ID NO: 628859 - DNA, 25 bp, Rattus norvegicus
tggacacggtgcacaaatatctgcc

SEQ ID NO: 628860 - DNA, 25 bp, Rattus norvegicus
tggacacggtgctcaaatatctgcc

SEQ ID NO: 628861 - DNA, 25 bp, Rattus norvegicus
tggacacgtctcacaaaagccatgt

SEQ ID NO: 628862 - DNA, 25 bp, Rattus norvegicus
tggacacgtctctcaaaagccatgt

SEQ ID NO: 628863 - DNA, 25 bp, Rattus norvegicus
tggacactaactactggactgcttg

SEQ ID NO: 628864 - DNA, 25 bp, Rattus norvegicus
tggacactaacttctggactgcttg

SEQ ID NO: 628865 - DNA, 25 bp, Rattus norvegicus
tggacactatgacttgcctccagta

SEQ ID NO: 628866 - DNA, 25 bp, Rattus norvegicus
tggacactatgagttgcctccagta

SEQ ID NO: 628867 - DNA, 25 bp, Rattus norvegicus
tggacactatttcatccggcacaaa

SEQ ID NO: 628868 - DNA, 25 bp, Rattus norvegicus
tggacactatttgatccggcacaaa

SEQ ID NO: 628869 - DNA, 25 bp, Rattus norvegicus
tggacactcagcacaccaaacggat

SEQ ID NO: 628870 - DNA, 25 bp, Rattus norvegicus
tggacactcagctcaccaaacggat

SEQ ID NO: 628871 - DNA, 25 bp, Rattus norvegicus
tggacactgcttaccttgtcgtgac

SEQ ID NO: 628872 - DNA, 25 bp, Rattus norvegicus
tggacactgctttccttgtcgtgac

SEQ ID NO: 628873 - DNA, 25 bp, Rattus norvegicus
tggacactggtacgtttcccatgtg

SEQ ID NO: 628874 - DNA, 25 bp, Rattus norvegicus
tggacactggtaggtttcccatgtg

SEQ ID NO: 628875 - DNA, 25 bp, Rattus norvegicus
tggacactggttacccaggagctat

SEQ ID NO: 628876 - DNA, 25 bp, Rattus norvegicus
tggacactggtttcccaggagctat

SEQ ID NO: 628877 - DNA, 25 bp, Rattus norvegicus
tggacactgtcaatgttcatagctt

SEQ ID NO: 628878 - DNA, 25 bp, Rattus norvegicus
tggacactgtcattgttcatagctt

SEQ ID NO: 628879 - DNA, 25 bp, Rattus norvegicus
tggacacttaaaacggaacctcata

SEQ ID NO: 628880 - DNA, 25 bp, Rattus norvegicus
tggacacttaaatcggaacctcata

SEQ ID NO: 628881 - DNA, 25 bp, Rattus norvegicus
tggacacttctgatacccaggcagt

SEQ ID NO: 628882 - DNA, 25 bp, Rattus norvegicus
tggacacttctgttacccaggcagt

SEQ ID NO: 628883 - DNA, 25 bp, Rattus norvegicus
tggacacttggcctgctcctgagaa

SEQ ID NO: 628884 - DNA, 25 bp, Rattus norvegicus
tggacacttggcgtgctcctgagaa

SEQ ID NO: 628885 - DNA, 25 bp, Rattus norvegicus
tggacacttgtgattggagcagcca

SEQ ID NO: 628886 - DNA, 25 bp, Rattus norvegicus
tggacacttgtgtttggagcagcca

SEQ ID NO: 628887 - DNA, 25 bp, Rattus norvegicus
tggacactttcacggtggttggttt

SEQ ID NO: 628888 - DNA, 25 bp, Rattus norvegicus
tggacactttcagggtggttggttt

SEQ ID NO: 628889 - DNA, 25 bp, Rattus norvegicus
tggacactttcccacaatgcagttc

SEQ ID NO: 628890 - DNA, 25 bp, Rattus norvegicus
tggacactttccgacaatgcagttc

SEQ ID NO: 628891 - DNA, 25 bp, Rattus norvegicus
tggacactttggaacgatgagagaa

SEQ ID NO: 628892 - DNA, 25 bp, Rattus norvegicus
tggacactttggtacgatgagagaa

SEQ ID NO: 628893 - DNA, 25 bp, Rattus norvegicus
tggacagaagccctactaagccatc

SEQ ID NO: 628894 - DNA, 25 bp, Rattus norvegicus
tggacagaagccgtactaagccatc

SEQ ID NO: 628895 - DNA, 25 bp, Rattus norvegicus
tggacagaaggaccgagctcagccc

SEQ ID NO: 628896 - DNA, 25 bp, Rattus norvegicus
tggacagaaggagcgagctcagccc

SEQ ID NO: 628897 - DNA, 25 bp, Rattus norvegicus
tggacagaagttatcactgcttagt

SEQ ID NO: 628898 - DNA, 25 bp, Rattus norvegicus
tggacagaagttttcactgcttagt

SEQ ID NO: 628899 - DNA, 25 bp, Rattus norvegicus
tggacagacactcgcacagctcctg

SEQ ID NO: 628900 - DNA, 25 bp, Rattus norvegicus
tggacagacactggcacagctcctg

SEQ ID NO: 628901 - DNA, 25 bp, Rattus norvegicus
tggacagactgcaccggaggaatac

SEQ ID NO: 628902 - DNA, 25 bp, Rattus norvegicus
tggacagactgctccggaggaatac

SEQ ID NO: 628903 - DNA, 25 bp, Rattus norvegicus
tggacagactttataggaaactcgg

SEQ ID NO: 628904 - DNA, 25 bp, Rattus norvegicus
tggacagactttttaggaaactcgg

SEQ ID NO: 628905 - DNA, 25 bp, Rattus norvegicus
tggacagagccccactcgcagaaaa

SEQ ID NO: 628906 - DNA, 25 bp, Rattus norvegicus
tggacagagcccgactcgcagaaaa

SEQ ID NO: 628907 - DNA, 25 bp, Rattus norvegicus
tggacagatcatccccactcaattc

SEQ ID NO: 628908 - DNA, 25 bp, Rattus norvegicus
tggacagatcatgcccactcaattc

SEQ ID NO: 628909 - DNA, 25 bp, Rattus norvegicus
tggacagatccaaccaacgtaatct

SEQ ID NO: 628910 - DNA, 25 bp, Rattus norvegicus
tggacagatccatccaacgtaatct

SEQ ID NO: 628911 - DNA, 25 bp, Rattus norvegicus
tggacagcaagtctgtcgtgtgttc

SEQ ID NO: 628912 - DNA, 25 bp, Rattus norvegicus
tggacagcaagtgtgtcgtgtgttc

SEQ ID NO: 628913 - DNA, 25 bp, Rattus norvegicus
tggacagcacgacgaagaggcataa

SEQ ID NO: 628914 - DNA, 25 bp, Rattus norvegicus
tggacagcacgaggaagaggcataa

SEQ ID NO: 628915 - DNA, 25 bp, Rattus norvegicus
tggacagcacgtaaggctttcttcc

SEQ ID NO: 628916 - DNA, 25 bp, Rattus norvegicus
tggacagcacgttaggctttcttcc

SEQ ID NO: 628917 - DNA, 25 bp, Rattus norvegicus
tggacagcagcaacatcgatgacaa

SEQ ID NO: 628918 - DNA, 25 bp, Rattus norvegicus
tggacagcagcatcatcgatgacaa

SEQ ID NO: 628919 - DNA, 25 bp, Rattus norvegicus
tggacagcagctacctcagagagta

SEQ ID NO: 628920 - DNA, 25 bp, Rattus norvegicus
tggacagcagctctacacttcctgt

SEQ ID NO: 628921 - DNA, 25 bp, Rattus norvegicus
tggacagcagctgtacacttcctgt

SEQ ID NO: 628922 - DNA, 25 bp, Rattus norvegicus
tggacagcagcttcctcagagagta

SEQ ID NO: 628923 - DNA, 25 bp, Rattus norvegicus
tggacagcagtccattgggctccgc

SEQ ID NO: 628924 - DNA, 25 bp, Rattus norvegicus
tggacagcagtcgattgggctccgc

SEQ ID NO: 628925 - DNA, 25 bp, Rattus norvegicus
tggacagccaatacattcccgttag

SEQ ID NO: 628926 - DNA, 25 bp, Rattus norvegicus
tggacagccaattcattcccgttag

SEQ ID NO: 628927 - DNA, 25 bp, Rattus norvegicus
tggacagccacactgccattgtagt

SEQ ID NO: 628928 - DNA, 25 bp, Rattus norvegicus
tggacagccacagtgccattgtagt

SEQ ID NO: 628929 - DNA, 25 bp, Rattus norvegicus
tggacagccagccttcttgtgggtc

SEQ ID NO: 628930 - DNA, 25 bp, Rattus norvegicus
tggacagccagcgttcttgtgggtc

SEQ ID NO: 628931 - DNA, 25 bp, Rattus norvegicus
tggacagccagtctagccacattgg

SEQ ID NO: 628932 - DNA, 25 bp, Rattus norvegicus
tggacagccagtgtagccacattgg

SEQ ID NO: 628933 - DNA, 25 bp, Rattus norvegicus
tggacagccccgatttaagtaaaat

SEQ ID NO: 628934 - DNA, 25 bp, Rattus norvegicus
tggacagccccgttttaagtaaaat

SEQ ID NO: 628935 - DNA, 25 bp, Rattus norvegicus
tggacagccgcacgcttggagacat

SEQ ID NO: 628936 - DNA, 25 bp, Rattus norvegicus
tggacagccgcaggcttggagacat

SEQ ID NO: 628937 - DNA, 25 bp, Rattus norvegicus
tggacagcctcaagcaaattccttc

SEQ ID NO: 628938 - DNA, 25 bp, Rattus norvegicus
tggacagcctcatgcaaattccttc

SEQ ID NO: 628939 - DNA, 25 bp, Rattus norvegicus
tggacagcggctacaggtcgatgat

SEQ ID NO: 628940 - DNA, 25 bp, Rattus norvegicus
tggacagcggcttcaggtcgatgat

SEQ ID NO: 628941 - DNA, 25 bp, Rattus norvegicus
tggacagctagccaaggaattcctc

SEQ ID NO: 628942 - DNA, 25 bp, Rattus norvegicus
tggacagctagcgaaggaattcctc

SEQ ID NO: 628943 - DNA, 25 bp, Rattus norvegicus
tggacagctccaacccgtcttggtg

SEQ ID NO: 628944 - DNA, 25 bp, Rattus norvegicus
tggacagctccactgaagtgaccca

SEQ ID NO: 628945 - DNA, 25 bp, Rattus norvegicus
tggacagctccagtgaagtgaccca

SEQ ID NO: 628946 - DNA, 25 bp, Rattus norvegicus
tggacagctccatcccgtcttggtg

SEQ ID NO: 628947 - DNA, 25 bp, Rattus norvegicus
tggacagctctcatgcaacaagatt

SEQ ID NO: 628948 - DNA, 25 bp, Rattus norvegicus
tggacagctctcttgcaacaagatt

SEQ ID NO: 628949 - DNA, 25 bp, Rattus norvegicus
tggacagctggcaaacgcgcacatt

SEQ ID NO: 628950 - DNA, 25 bp, Rattus norvegicus
tggacagctggcaaagcacacagtt

SEQ ID NO: 628951 - DNA, 25 bp, Rattus norvegicus
tggacagctggctaacgcgcacatt

SEQ ID NO: 628952 - DNA, 25 bp, Rattus norvegicus
tggacagctggctaagcacacagtt

SEQ ID NO: 628953 - DNA, 25 bp, Rattus norvegicus
tggacaggaaccattggtggccacc

SEQ ID NO: 628954 - DNA, 25 bp, Rattus norvegicus
tggacaggaacctttggtggccacc

SEQ ID NO: 628955 - DNA, 25 bp, Rattus norvegicus
tggacaggaccccagtctattaccg

SEQ ID NO: 628956 - DNA, 25 bp, Rattus norvegicus
tggacaggacccgagtctattaccg

SEQ ID NO: 628957 - DNA, 25 bp, Rattus norvegicus
tggacaggccatcttttctcagacc

SEQ ID NO: 628958 - DNA, 25 bp, Rattus norvegicus
tggacaggccatgttttctcagacc

SEQ ID NO: 628959 - DNA, 25 bp, Rattus norvegicus
tggacaggccctatgacgagactac

SEQ ID NO: 628960 - DNA, 25 bp, Rattus norvegicus
tggacaggccctttgacgagactac

SEQ ID NO: 628961 - DNA, 25 bp, Rattus norvegicus
tggacaggccgcagttgctgtgtct

SEQ ID NO: 628962 - DNA, 25 bp, Rattus norvegicus
tggacaggccgctgttgctgtgtct

SEQ ID NO: 628963 - DNA, 25 bp, Rattus norvegicus
tggacaggctgcagtttcgcatcta

SEQ ID NO: 628964 - DNA, 25 bp, Rattus norvegicus
tggacaggctgctgtttcgcatcta

SEQ ID NO: 628965 - DNA, 25 bp, Rattus norvegicus
tggacaggtaaactatgacagggct

SEQ ID NO: 628966 - DNA, 25 bp, Rattus norvegicus
tggacaggtaaagtatgacagggct

SEQ ID NO: 628967 - DNA, 25 bp, Rattus norvegicus
tggacaggtcatagagccttcgttg

SEQ ID NO: 628968 - DNA, 25 bp, Rattus norvegicus
tggacaggtcattgagccttcgttg

SEQ ID NO: 628969 - DNA, 25 bp, Rattus norvegicus
tggacagtactcacaacagagcctc

SEQ ID NO: 628970 - DNA, 25 bp, Rattus norvegicus
tggacagtactctcaacagagcctc

SEQ ID NO: 628971 - DNA, 25 bp, Rattus norvegicus
tggacagtagctattcccgcatgag

SEQ ID NO: 628972 - DNA, 25 bp, Rattus norvegicus
tggacagtagcttttcccgcatgag

SEQ ID NO: 628973 - DNA, 25 bp, Rattus norvegicus
tggacagtcagaaacacagttaagg

SEQ ID NO: 628974 - DNA, 25 bp, Rattus norvegicus
tggacagtcagatacacagttaagg

SEQ ID NO: 628975 - DNA, 25 bp, Rattus norvegicus
tggacagtcatcagtacctgctggc

SEQ ID NO: 628976 - DNA, 25 bp, Rattus norvegicus
tggacagtcatctgtacctgctggc

SEQ ID NO: 628977 - DNA, 25 bp, Rattus norvegicus
tggacagtctgaccagtatcttcct

SEQ ID NO: 628978 - DNA, 25 bp, Rattus norvegicus
tggacagtctgagcagtatcttcct

SEQ ID NO: 628979 - DNA, 25 bp, Rattus norvegicus
tggacagtgaatatccctcaggaac

SEQ ID NO: 628980 - DNA, 25 bp, Rattus norvegicus
tggacagtgaatttccctcaggaac

SEQ ID NO: 628981 - DNA, 25 bp, Rattus norvegicus
tggacagtggaacctggtagcattt

SEQ ID NO: 628982 - DNA, 25 bp, Rattus norvegicus
tggacagtggaagctggtagcattt

SEQ ID NO: 628983 - DNA, 25 bp, Rattus norvegicus
tggacagtggcactttccaggcact

SEQ ID NO: 628984 - DNA, 25 bp, Rattus norvegicus
tggacagtggcagtttccaggcact

SEQ ID NO: 628985 - DNA, 25 bp, Rattus norvegicus
tggacagtggctccctccacctgta

SEQ ID NO: 628986 - DNA, 25 bp, Rattus norvegicus
tggacagtggctgcctccacctgta

SEQ ID NO: 628987 - DNA, 25 bp, Rattus norvegicus
tggacagtggtgacccgggccacta

SEQ ID NO: 628988 - DNA, 25 bp, Rattus norvegicus
tggacagtggtgtcccgggccacta

SEQ ID NO: 628989 - DNA, 25 bp, Rattus norvegicus
tggacagtgtctcgttctctttcaa

SEQ ID NO: 628990 - DNA, 25 bp, Rattus norvegicus
tggacagtgtctggttctctttcaa

SEQ ID NO: 628991 - DNA, 25 bp, Rattus norvegicus
tggacagttggaacccacctgataa

SEQ ID NO: 628992 - DNA, 25 bp, Rattus norvegicus
tggacagttggatcccacctgataa

SEQ ID NO: 628993 - DNA, 25 bp, Rattus norvegicus
tggacagtttatacccaaggacggt

SEQ ID NO: 628994 - DNA, 25 bp, Rattus norvegicus
tggacagtttatcctctgaccagag

SEQ ID NO: 628995 - DNA, 25 bp, Rattus norvegicus
tggacagtttatgctctgaccagag

SEQ ID NO: 628996 - DNA, 25 bp, Rattus norvegicus
tggacagtttattcccaaggacggt

SEQ ID NO: 628997 - DNA, 25 bp, Rattus norvegicus
tggacagtttccatgttcaaccact

SEQ ID NO: 628998 - DNA, 25 bp, Rattus norvegicus
tggacagtttccttgttcaaccact

SEQ ID NO: 628999 - DNA, 25 bp, Rattus norvegicus
tggacatactacacacagttaaact

SEQ ID NO: 629000 - DNA, 25 bp, Rattus norvegicus
tggacatactactcacagttaaact

SEQ ID NO: 629001 - DNA, 25 bp, Rattus norvegicus
tggacatactgtacaaggtagaggt

SEQ ID NO: 629002 - DNA, 25 bp, Rattus norvegicus
tggacatactgttcaaggtagaggt

SEQ ID NO: 629003 - DNA, 25 bp, Rattus norvegicus
tggacatagccaaatccagcgtctt

SEQ ID NO: 629004 - DNA, 25 bp, Rattus norvegicus
tggacatagccaccaactgctacag

SEQ ID NO: 629005 - DNA, 25 bp, Rattus norvegicus
tggacatagccagcaactgctacag

SEQ ID NO: 629006 - DNA, 25 bp, Rattus norvegicus
tggacatagccatatccagcgtctt

SEQ ID NO: 629007 - DNA, 25 bp, Rattus norvegicus
tggacatagcctcacccaaagatga

SEQ ID NO: 629008 - DNA, 25 bp, Rattus norvegicus
tggacatagcctgacccaaagatga

SEQ ID NO: 629009 - DNA, 25 bp, Rattus norvegicus
tggacataggacaccttttaagagt

SEQ ID NO: 629010 - DNA, 25 bp, Rattus norvegicus
tggacataggactccttttaagagt

SEQ ID NO: 629011 - DNA, 25 bp, Rattus norvegicus
tggacatatcagagacccgcacaaa

SEQ ID NO: 629012 - DNA, 25 bp, Rattus norvegicus
tggacatatcagtgacccgcacaaa

SEQ ID NO: 629013 - DNA, 25 bp, Rattus norvegicus
tggacatattccactggcaggtcat

SEQ ID NO: 629014 - DNA, 25 bp, Rattus norvegicus
tggacatattcctctggcaggtcat

SEQ ID NO: 629015 - DNA, 25 bp, Rattus norvegicus
tggacatcaaatccacagcttagtg

SEQ ID NO: 629016 - DNA, 25 bp, Rattus norvegicus
tggacatcaaatccagggccccatc

SEQ ID NO: 629017 - DNA, 25 bp, Rattus norvegicus
tggacatcaaatgcacagcttagtg

SEQ ID NO: 629018 - DNA, 25 bp, Rattus norvegicus
tggacatcaaatgcagggccccatc

SEQ ID NO: 629019 - DNA, 25 bp, Rattus norvegicus
tggacatcagcaagatcctctcaga

SEQ ID NO: 629020 - DNA, 25 bp, Rattus norvegicus
tggacatcagcatgatcctctcaga

SEQ ID NO: 629021 - DNA, 25 bp, Rattus norvegicus
tggacatcagccacgggttcaagaa

SEQ ID NO: 629022 - DNA, 25 bp, Rattus norvegicus
tggacatcagcctcgggttcaagaa

SEQ ID NO: 629023 - DNA, 25 bp, Rattus norvegicus
tggacatcaggtaccaactgcactc

SEQ ID NO: 629024 - DNA, 25 bp, Rattus norvegicus
tggacatcaggttccaactgcactc

SEQ ID NO: 629025 - DNA, 25 bp, Rattus norvegicus
tggacatccatcagctacaacgaca

SEQ ID NO: 629026 - DNA, 25 bp, Rattus norvegicus
tggacatccatctgctacaacgaca

SEQ ID NO: 629027 - DNA, 25 bp, Rattus norvegicus
tggacatccgacctgagttcaagaa

SEQ ID NO: 629028 - DNA, 25 bp, Rattus norvegicus
tggacatccgacgtgagttcaagaa

SEQ ID NO: 629029 - DNA, 25 bp, Rattus norvegicus
tggacatccgccagatctatgacaa

SEQ ID NO: 629030 - DNA, 25 bp, Rattus norvegicus
tggacatccgcctgatctatgacaa

SEQ ID NO: 629031 - DNA, 25 bp, Rattus norvegicus
tggacatcgacaaggccgaggccga

SEQ ID NO: 629032 - DNA, 25 bp, Rattus norvegicus
tggacatcgacatggccgaggccga

SEQ ID NO: 629033 - DNA, 25 bp, Rattus norvegicus
tggacatctagcagaacttcccagt

SEQ ID NO: 629034 - DNA, 25 bp, Rattus norvegicus
tggacatctagctgaacttcccagt

SEQ ID NO: 629035 - DNA, 25 bp, Rattus norvegicus
tggacatgactcacacctcacgaag

SEQ ID NO: 629036 - DNA, 25 bp, Rattus norvegicus
tggacatgactctcacctcacgaag

SEQ ID NO: 629037 - DNA, 25 bp, Rattus norvegicus
tggacatgatgcacattgtaccttg

SEQ ID NO: 629038 - DNA, 25 bp, Rattus norvegicus
tggacatgatgctcattgtaccttg

SEQ ID NO: 629039 - DNA, 25 bp, Rattus norvegicus
tggacatgctggaacacaacactca

SEQ ID NO: 629040 - DNA, 25 bp, Rattus norvegicus
tggacatgctggtacacaacactca

SEQ ID NO: 629041 - DNA, 25 bp, Rattus norvegicus
tggacatgcttcaaggtacctgact

SEQ ID NO: 629042 - DNA, 25 bp, Rattus norvegicus
tggacatgcttctaggtacctgact

SEQ ID NO: 629043 - DNA, 25 bp, Rattus norvegicus
tggacatggaatcttgactcctccc

SEQ ID NO: 629044 - DNA, 25 bp, Rattus norvegicus
tggacatggaatgttgactcctccc

SEQ ID NO: 629045 - DNA, 25 bp, Rattus norvegicus
tggacatgttctctgtgctctgtga

SEQ ID NO: 629046 - DNA, 25 bp, Rattus norvegicus
tggacatgttctgtgtgctctgtga

SEQ ID NO: 629047 - DNA, 25 bp, Rattus norvegicus
tggacattagcccagagtctctgag

SEQ ID NO: 629048 - DNA, 25 bp, Rattus norvegicus
tggacattagccgagagtctctgag

SEQ ID NO: 629049 - DNA, 25 bp, Rattus norvegicus
tggacattatcaaccgagtccccat

SEQ ID NO: 629050 - DNA, 25 bp, Rattus norvegicus
tggacattatcatccgagtccccat

SEQ ID NO: 629051 - DNA, 25 bp, Rattus norvegicus
tggacattatttcggcagctaggtt

SEQ ID NO: 629052 - DNA, 25 bp, Rattus norvegicus
tggacattatttgggcagctaggtt

SEQ ID NO: 629053 - DNA, 25 bp, Rattus norvegicus
tggacattcctcactgtggtcagaa

SEQ ID NO: 629054 - DNA, 25 bp, Rattus norvegicus
tggacattcctctctgtggtcagaa

SEQ ID NO: 629055 - DNA, 25 bp, Rattus norvegicus
tggacattctagctgcagttctcat

SEQ ID NO: 629056 - DNA, 25 bp, Rattus norvegicus
tggacattctaggtgcagttctcat

SEQ ID NO: 629057 - DNA, 25 bp, Rattus norvegicus
tggacattctgacatcaccagctga

SEQ ID NO: 629058 - DNA, 25 bp, Rattus norvegicus
tggacattctgagatcaccagctga

SEQ ID NO: 629059 - DNA, 25 bp, Rattus norvegicus
tggacattgaacagttctccacagt

SEQ ID NO: 629060 - DNA, 25 bp, Rattus norvegicus
tggacattgaactgttctccacagt

SEQ ID NO: 629061 - DNA, 25 bp, Rattus norvegicus
tggacattgtgacctctccaggagc

SEQ ID NO: 629062 - DNA, 25 bp, Rattus norvegicus
tggacattgtgagctctccaggagc

SEQ ID NO: 629063 - DNA, 25 bp, Rattus norvegicus
tggacatttaccacagcgctgaacc

SEQ ID NO: 629064 - DNA, 25 bp, Rattus norvegicus
tggacatttacctcagcgctgaacc

SEQ ID NO: 629065 - DNA, 25 bp, Rattus norvegicus
tggacatttcccagcgacctgatgg

SEQ ID NO: 629066 - DNA, 25 bp, Rattus norvegicus
tggacatttccctgcgacctgatgg

SEQ ID NO: 629067 - DNA, 25 bp, Rattus norvegicus
tggacatttgaactgcacattctgc

SEQ ID NO: 629068 - DNA, 25 bp, Rattus norvegicus
tggacatttgaagtgcacattctgc

SEQ ID NO: 629069 - DNA, 25 bp, Rattus norvegicus
tggaccaaaacgatgtgcgcctagt

SEQ ID NO: 629070 - DNA, 25 bp, Rattus norvegicus
tggaccaaaacgttgtgcgcctagt

SEQ ID NO: 629071 - DNA, 25 bp, Rattus norvegicus
tggaccaaacctattgtctttagag

SEQ ID NO: 629072 - DNA, 25 bp, Rattus norvegicus
tggaccaaaccttttgtctttagag

SEQ ID NO: 629073 - DNA, 25 bp, Rattus norvegicus
tggaccaaatgcagctctgccatcg

SEQ ID NO: 629074 - DNA, 25 bp, Rattus norvegicus
tggaccaaatgctgctctgccatcg

SEQ ID NO: 629075 - DNA, 25 bp, Rattus norvegicus
tggaccaacataccagggctaccat

SEQ ID NO: 629076 - DNA, 25 bp, Rattus norvegicus
tggaccaacatagcagggctaccat

SEQ ID NO: 629077 - DNA, 25 bp, Rattus norvegicus
tggaccaagaccacgtggatgcccc

SEQ ID NO: 629078 - DNA, 25 bp, Rattus norvegicus
tggaccaagacctcgtggatgcccc

SEQ ID NO: 629079 - DNA, 25 bp, Rattus norvegicus
tggaccaagcatatccaacccatga

SEQ ID NO: 629080 - DNA, 25 bp, Rattus norvegicus
tggaccaagcatttccaacccatga

SEQ ID NO: 629081 - DNA, 25 bp, Rattus norvegicus
tggaccaaggtcactgctctttata

SEQ ID NO: 629082 - DNA, 25 bp, Rattus norvegicus
tggaccaaggtctctgctctttata

SEQ ID NO: 629083 - DNA, 25 bp, Rattus norvegicus
tggaccaaggttccacctttctaag

SEQ ID NO: 629084 - DNA, 25 bp, Rattus norvegicus
tggaccaaggttgcacctttctaag

SEQ ID NO: 629085 - DNA, 25 bp, Rattus norvegicus
tggaccaatggaccgcccagaagga

SEQ ID NO: 629086 - DNA, 25 bp, Rattus norvegicus
tggaccaatggagcgcccagaagga

SEQ ID NO: 629087 - DNA, 25 bp, Rattus norvegicus
tggaccacaagcacgctggtactgg

SEQ ID NO: 629088 - DNA, 25 bp, Rattus norvegicus
tggaccacaagctcgctggtactgg

SEQ ID NO: 629089 - DNA, 25 bp, Rattus norvegicus
tggaccacacaacagaaggcagctg

SEQ ID NO: 629090 - DNA, 25 bp, Rattus norvegicus
tggaccacacaagagaaggcagctg

SEQ ID NO: 629091 - DNA, 25 bp, Rattus norvegicus
tggaccaccagcagatgtttacaag

SEQ ID NO: 629092 - DNA, 25 bp, Rattus norvegicus
tggaccaccagctgatgtttacaag

SEQ ID NO: 629093 - DNA, 25 bp, Rattus norvegicus
tggaccacctcacggtttcaggaga

SEQ ID NO: 629094 - DNA, 25 bp, Rattus norvegicus
tggaccacctcagggtttcaggaga

SEQ ID NO: 629095 - DNA, 25 bp, Rattus norvegicus
tggaccacctggataggcctcagtg

SEQ ID NO: 629096 - DNA, 25 bp, Rattus norvegicus
tggaccacctggttaggcctcagtg

SEQ ID NO: 629097 - DNA, 25 bp, Rattus norvegicus
tggaccacgccacggagatcagcgt

SEQ ID NO: 629098 - DNA, 25 bp, Rattus norvegicus
tggaccacgccagggagatcagcgt

SEQ ID NO: 629099 - DNA, 25 bp, Rattus norvegicus
tggaccacgcccacaatgacatgac

SEQ ID NO: 629100 - DNA, 25 bp, Rattus norvegicus
tggaccacgccctcaatgacatgac

SEQ ID NO: 629101 - DNA, 25 bp, Rattus norvegicus
tggaccacgccgcacttggcttcag

SEQ ID NO: 629102 - DNA, 25 bp, Rattus norvegicus
tggaccacgccggacttggcttcag

SEQ ID NO: 629103 - DNA, 25 bp, Rattus norvegicus
tggaccacggaaacgggaccttcag

SEQ ID NO: 629104 - DNA, 25 bp, Rattus norvegicus
tggaccacggaatcgggaccttcag

SEQ ID NO: 629105 - DNA, 25 bp, Rattus norvegicus
tggaccactgtcaccagtagggaaa

SEQ ID NO: 629106 - DNA, 25 bp, Rattus norvegicus
tggaccactgtctccagtagggaaa

SEQ ID NO: 629107 - DNA, 25 bp, Rattus norvegicus
tggaccacttcgacttacgtgtaaa

SEQ ID NO: 629108 - DNA, 25 bp, Rattus norvegicus
tggaccacttcgtcttacgtgtaaa

SEQ ID NO: 629109 - DNA, 25 bp, Rattus norvegicus
tggaccacttgcagtgcatgcatct

SEQ ID NO: 629110 - DNA, 25 bp, Rattus norvegicus
tggaccacttgctgtgcatgcatct

SEQ ID NO: 629111 - DNA, 25 bp, Rattus norvegicus
tggaccactttgcagctggcacatc

SEQ ID NO: 629112 - DNA, 25 bp, Rattus norvegicus
tggaccactttggagctggcacatc

SEQ ID NO: 629113 - DNA, 25 bp, Rattus norvegicus
tggaccagacagaaaagccaaagtg

SEQ ID NO: 629114 - DNA, 25 bp, Rattus norvegicus
tggaccagacagtaaagccaaagtg

SEQ ID NO: 629115 - DNA, 25 bp, Rattus norvegicus
tggaccagacccatctggaactcaa

SEQ ID NO: 629116 - DNA, 25 bp, Rattus norvegicus
tggaccagacccttctggaactcaa

SEQ ID NO: 629117 - DNA, 25 bp, Rattus norvegicus
tggaccagcagtacatcttctgaaa

SEQ ID NO: 629118 - DNA, 25 bp, Rattus norvegicus
tggaccagcagttcatcttctgaaa

SEQ ID NO: 629119 - DNA, 25 bp, Rattus norvegicus
tggaccagccaacgcagacggtagt

SEQ ID NO: 629120 - DNA, 25 bp, Rattus norvegicus
tggaccagccaaggcagacggtagt

SEQ ID NO: 629121 - DNA, 25 bp, Rattus norvegicus
tggaccagccagaacagcctcagca

SEQ ID NO: 629122 - DNA, 25 bp, Rattus norvegicus
tggaccagccagtacagcctcagca

SEQ ID NO: 629123 - DNA, 25 bp, Rattus norvegicus
tggaccagcgcaatcagcggctaga

SEQ ID NO: 629124 - DNA, 25 bp, Rattus norvegicus
tggaccagcgcattcagcggctaga

SEQ ID NO: 629125 - DNA, 25 bp, Rattus norvegicus
tggaccagctgaccctgatgaagcc

SEQ ID NO: 629126 - DNA, 25 bp, Rattus norvegicus
tggaccagctgagcctgatgaagcc

SEQ ID NO: 629127 - DNA, 25 bp, Rattus norvegicus
tggaccaggacaacctcagcaggga

SEQ ID NO: 629128 - DNA, 25 bp, Rattus norvegicus
tggaccaggacatcctcagcaggga

SEQ ID NO: 629129 - DNA, 25 bp, Rattus norvegicus
tggaccaggactcctgcttcgacgg

SEQ ID NO: 629130 - DNA, 25 bp, Rattus norvegicus
tggaccaggactgctgcttcgacgg

SEQ ID NO: 629131 - DNA, 25 bp, Rattus norvegicus
tggaccaggagaacacagtgaaccc

SEQ ID NO: 629132 - DNA, 25 bp, Rattus norvegicus
tggaccaggagatcacagtgaaccc

SEQ ID NO: 629133 - DNA, 25 bp, Rattus norvegicus
tggaccaggctacccaggaagtcag

SEQ ID NO: 629134 - DNA, 25 bp, Rattus norvegicus
tggaccaggctagccaggaagtcag

SEQ ID NO: 629135 - DNA, 25 bp, Rattus norvegicus
tggaccaggcttccaggctgccaga

SEQ ID NO: 629136 - DNA, 25 bp, Rattus norvegicus
tggaccaggcttgcaggctgccaga

SEQ ID NO: 629137 - DNA, 25 bp, Rattus norvegicus
tggaccagggctataaccacaaagc

SEQ ID NO: 629138 - DNA, 25 bp, Rattus norvegicus
tggaccagggctttaaccacaaagc

SEQ ID NO: 629139 - DNA, 25 bp, Rattus norvegicus
tggaccagtgtcagagtcacatcac

SEQ ID NO: 629140 - DNA, 25 bp, Rattus norvegicus
tggaccagtgtctgagtcacatcac

SEQ ID NO: 629141 - DNA, 25 bp, Rattus norvegicus
tggaccagttaacccattctactcg

SEQ ID NO: 629142 - DNA, 25 bp, Rattus norvegicus
tggaccagttaagccattctactcg

SEQ ID NO: 629143 - DNA, 25 bp, Rattus norvegicus
tggaccatcaaaccccatctgttat

SEQ ID NO: 629144 - DNA, 25 bp, Rattus norvegicus
tggaccatcaaagcccatctgttat

SEQ ID NO: 629145 - DNA, 25 bp, Rattus norvegicus
tggaccatccacagtgtctgggcca

SEQ ID NO: 629146 - DNA, 25 bp, Rattus norvegicus
tggaccatccactgtgtctgggcca

SEQ ID NO: 629147 - DNA, 25 bp, Rattus norvegicus
tggaccatcgcgacatcctgggaga

SEQ ID NO: 629148 - DNA, 25 bp, Rattus norvegicus
tggaccatcgcgtcatcctgggaga

SEQ ID NO: 629149 - DNA, 25 bp, Rattus norvegicus
tggaccatggacagacccttctgac

SEQ ID NO: 629150 - DNA, 25 bp, Rattus norvegicus
tggaccatggactgacccttctgac

SEQ ID NO: 629151 - DNA, 25 bp, Rattus norvegicus
tggaccatgggtcctttttactcac

SEQ ID NO: 629152 - DNA, 25 bp, Rattus norvegicus
tggaccatgggtgctttttactcac

SEQ ID NO: 629153 - DNA, 25 bp, Rattus norvegicus
tggaccatgtccaggtcaacctgtt

SEQ ID NO: 629154 - DNA, 25 bp, Rattus norvegicus
tggaccatgtcctggtcaacctgtt

SEQ ID NO: 629155 - DNA, 25 bp, Rattus norvegicus
tggaccatgtggctctggccttcag

SEQ ID NO: 629156 - DNA, 25 bp, Rattus norvegicus
tggaccatgtgggtctggccttcag

SEQ ID NO: 629157 - DNA, 25 bp, Rattus norvegicus
tggaccattccccaagtgtacctgg

SEQ ID NO: 629158 - DNA, 25 bp, Rattus norvegicus
tggaccattcccgaagtgtacctgg

SEQ ID NO: 629159 - DNA, 25 bp, Rattus norvegicus
tggacccaacccaagggtgcagagg

SEQ ID NO: 629160 - DNA, 25 bp, Rattus norvegicus
tggacccaaccctagggtgcagagg

SEQ ID NO: 629161 - DNA, 25 bp, Rattus norvegicus
tggacccaagaaaacatctcaagtt

SEQ ID NO: 629162 - DNA, 25 bp, Rattus norvegicus
tggacccaagaatacatctcaagtt

SEQ ID NO: 629163 - DNA, 25 bp, Rattus norvegicus
tggacccaagacactggatcctggc

SEQ ID NO: 629164 - DNA, 25 bp, Rattus norvegicus
tggacccaagactctggatcctggc

SEQ ID NO: 629165 - DNA, 25 bp, Rattus norvegicus
tggacccaatgacagcagcttactt

SEQ ID NO: 629166 - DNA, 25 bp, Rattus norvegicus
tggacccaatgagagcagcttactt

SEQ ID NO: 629167 - DNA, 25 bp, Rattus norvegicus
tggacccaatggattctacctacct

SEQ ID NO: 629168 - DNA, 25 bp, Rattus norvegicus
tggacccaatggtttctacctacct

SEQ ID NO: 629169 - DNA, 25 bp, Rattus norvegicus
tggacccaccacattctgggtaata

SEQ ID NO: 629170 - DNA, 25 bp, Rattus norvegicus
tggacccaccactttctgggtaata

SEQ ID NO: 629171 - DNA, 25 bp, Rattus norvegicus
tggacccacgcaaggactcacagag

SEQ ID NO: 629172 - DNA, 25 bp, Rattus norvegicus
tggacccacgcatggactcacagag

SEQ ID NO: 629173 - DNA, 25 bp, Rattus norvegicus
tggacccacggacgcaggagttact

SEQ ID NO: 629174 - DNA, 25 bp, Rattus norvegicus
tggacccacggaggcaggagttact

SEQ ID NO: 629175 - DNA, 25 bp, Rattus norvegicus
tggacccactggataaggtgctatc

SEQ ID NO: 629176 - DNA, 25 bp, Rattus norvegicus
tggacccactggttaaggtgctatc

SEQ ID NO: 629177 - DNA, 25 bp, Rattus norvegicus
tggacccagcccctgagagttatgg

SEQ ID NO: 629178 - DNA, 25 bp, Rattus norvegicus
tggacccagcccgtgagagttatgg

SEQ ID NO: 629179 - DNA, 25 bp, Rattus norvegicus
tggacccagtcaccaagatcctgtc

SEQ ID NO: 629180 - DNA, 25 bp, Rattus norvegicus
tggacccagtcagcaagatcctgtc

SEQ ID NO: 629181 - DNA, 25 bp, Rattus norvegicus
tggacccattatatccaagaacctg

SEQ ID NO: 629182 - DNA, 25 bp, Rattus norvegicus
tggacccattatttccaagaacctg

SEQ ID NO: 629183 - DNA, 25 bp, Rattus norvegicus
tggaccccaaagacatgtctcgcaa

SEQ ID NO: 629184 - DNA, 25 bp, Rattus norvegicus
tggaccccaaagtcatgtctcgcaa

SEQ ID NO: 629185 - DNA, 25 bp, Rattus norvegicus
tggaccccaactccgatgacgagaa

SEQ ID NO: 629186 - DNA, 25 bp, Rattus norvegicus
tggaccccaactgcgatgacgagaa

SEQ ID NO: 629187 - DNA, 25 bp, Rattus norvegicus
tggaccccatgcaggatgactcggt

SEQ ID NO: 629188 - DNA, 25 bp, Rattus norvegicus
tggaccccatgctggatgactcggt

SEQ ID NO: 629189 - DNA, 25 bp, Rattus norvegicus
tggaccccatttatgatgggccttt

SEQ ID NO: 629190 - DNA, 25 bp, Rattus norvegicus
tggaccccatttttgatgggccttt

SEQ ID NO: 629191 - DNA, 25 bp, Rattus norvegicus
tggaccccgcgacctgactgagcat

SEQ ID NO: 629192 - DNA, 25 bp, Rattus norvegicus
tggaccccgcgagctgactgagcat

SEQ ID NO: 629193 - DNA, 25 bp, Rattus norvegicus
tggacccctgggagttctgggacct

SEQ ID NO: 629194 - DNA, 25 bp, Rattus norvegicus
tggacccctgggtgttctgggacct

SEQ ID NO: 629195 - DNA, 25 bp, Rattus norvegicus
tggacccggctgcatgtccaccgga

SEQ ID NO: 629196 - DNA, 25 bp, Rattus norvegicus
tggacccggctggatgtccaccgga

SEQ ID NO: 629197 - DNA, 25 bp, Rattus norvegicus
tggaccctaggaacacagtggcttg

SEQ ID NO: 629198 - DNA, 25 bp, Rattus norvegicus
tggaccctaggatcacagtggcttg

SEQ ID NO: 629199 - DNA, 25 bp, Rattus norvegicus
tggaccctatacacttgaatcctgc

SEQ ID NO: 629200 - DNA, 25 bp, Rattus norvegicus
tggaccctatactcttgaatcctgc

SEQ ID NO: 629201 - DNA, 25 bp, Rattus norvegicus
tggaccctcataagcacagcggtgc

SEQ ID NO: 629202 - DNA, 25 bp, Rattus norvegicus
tggaccctcatatgcacagcggtgc

SEQ ID NO: 629203 - DNA, 25 bp, Rattus norvegicus
tggaccctccacagcggaattgaag

SEQ ID NO: 629204 - DNA, 25 bp, Rattus norvegicus
tggaccctccactgcggaattgaag

SEQ ID NO: 629205 - DNA, 25 bp, Rattus norvegicus
tggaccctcctcaaacagtcattga

SEQ ID NO: 629206 - DNA, 25 bp, Rattus norvegicus
tggaccctcctctaacagtcattga

SEQ ID NO: 629207 - DNA, 25 bp, Rattus norvegicus
tggaccctcctgatcaaagcttttg

SEQ ID NO: 629208 - DNA, 25 bp, Rattus norvegicus
tggaccctcctgttcaaagcttttg

SEQ ID NO: 629209 - DNA, 25 bp, Rattus norvegicus
tggaccctcgttcctgtcacttatg

SEQ ID NO: 629210 - DNA, 25 bp, Rattus norvegicus
tggaccctcgttgctgtcacttatg

SEQ ID NO: 629211 - DNA, 25 bp, Rattus norvegicus
tggaccctgagaaatgtatgcattt

SEQ ID NO: 629212 - DNA, 25 bp, Rattus norvegicus
tggaccctgagatatgtatgcattt

SEQ ID NO: 629213 - DNA, 25 bp, Rattus norvegicus
tggaccctgcatacactgagcaaag

SEQ ID NO: 629214 - DNA, 25 bp, Rattus norvegicus
tggaccctgcattcactgagcaaag

SEQ ID NO: 629215 - DNA, 25 bp, Rattus norvegicus
tggaccctggtgcactcttaagtga

SEQ ID NO: 629216 - DNA, 25 bp, Rattus norvegicus
tggaccctggtggactcttaagtga

SEQ ID NO: 629217 - DNA, 25 bp, Rattus norvegicus
tggacccttgtcaccctatattctg

SEQ ID NO: 629218 - DNA, 25 bp, Rattus norvegicus
tggacccttgtctccctatattctg

SEQ ID NO: 629219 - DNA, 25 bp, Rattus norvegicus
tggaccgacgttactgctggagaag

SEQ ID NO: 629220 - DNA, 25 bp, Rattus norvegicus
tggaccgacgtttctgctggagaag

SEQ ID NO: 629221 - DNA, 25 bp, Rattus norvegicus
tggaccgagaaaagtccctcttctt

SEQ ID NO: 629222 - DNA, 25 bp, Rattus norvegicus
tggaccgagaaatgtccctcttctt

SEQ ID NO: 629223 - DNA, 25 bp, Rattus norvegicus
tggaccgagatcactgcagggatat

SEQ ID NO: 629224 - DNA, 25 bp, Rattus norvegicus
tggaccgagatctctgcagggatat

SEQ ID NO: 629225 - DNA, 25 bp, Rattus norvegicus
tggaccgagccgactctgtagtctt

SEQ ID NO: 629226 - DNA, 25 bp, Rattus norvegicus
tggaccgagccgtctctgtagtctt

SEQ ID NO: 629227 - DNA, 25 bp, Rattus norvegicus
tggaccgaggacaccgaagtgactc

SEQ ID NO: 629228 - DNA, 25 bp, Rattus norvegicus
tggaccgaggactccgaagtgactc

SEQ ID NO: 629229 - DNA, 25 bp, Rattus norvegicus
tggaccgatacacggacagtcatga

SEQ ID NO: 629230 - DNA, 25 bp, Rattus norvegicus
tggaccgatacagggacagtcatga

SEQ ID NO: 629231 - DNA, 25 bp, Rattus norvegicus
tggaccgcaccaaagtggagtctca

SEQ ID NO: 629232 - DNA, 25 bp, Rattus norvegicus
tggaccgcaccatagtggagtctca

SEQ ID NO: 629233 - DNA, 25 bp, Rattus norvegicus
tggaccgcactcagtaaacctagct

SEQ ID NO: 629234 - DNA, 25 bp, Rattus norvegicus
tggaccgcactctgtaaacctagct

SEQ ID NO: 629235 - DNA, 25 bp, Rattus norvegicus
tggaccgcagatacccagcagctgg

SEQ ID NO: 629236 - DNA, 25 bp, Rattus norvegicus
tggaccgcagattcccagcagctgg

SEQ ID NO: 629237 - DNA, 25 bp, Rattus norvegicus
tggaccgccagcaagaactctgcat

SEQ ID NO: 629238 - DNA, 25 bp, Rattus norvegicus
tggaccgccagctagaactctgcat

SEQ ID NO: 629239 - DNA, 25 bp, Rattus norvegicus
tggaccgcgggaccctgagatataa

SEQ ID NO: 629240 - DNA, 25 bp, Rattus norvegicus
tggaccgcgggagcctgagatataa

SEQ ID NO: 629241 - DNA, 25 bp, Rattus norvegicus
tggaccgcgtctctcaaaagctcga

SEQ ID NO: 629242 - DNA, 25 bp, Rattus norvegicus
tggaccgcgtctgtcaaaagctcga

SEQ ID NO: 629243 - DNA, 25 bp, Rattus norvegicus
tggaccggatgcaggccagacaatg

SEQ ID NO: 629244 - DNA, 25 bp, Rattus norvegicus
tggaccggatgctggccagacaatg

SEQ ID NO: 629245 - DNA, 25 bp, Rattus norvegicus
tggaccggctgaagttgacttttga

SEQ ID NO: 629246 - DNA, 25 bp, Rattus norvegicus
tggaccggctgatgttgacttttga

SEQ ID NO: 629247 - DNA, 25 bp, Rattus norvegicus
tggaccggtacaaggacgcctggaa

SEQ ID NO: 629248 - DNA, 25 bp, Rattus norvegicus
tggaccggtacatggacgcctggaa

SEQ ID NO: 629249 - DNA, 25 bp, Rattus norvegicus
tggaccgtcacgctcggaaacaaaa

SEQ ID NO: 629250 - DNA, 25 bp, Rattus norvegicus
tggaccgtcacggtcggaaacaaaa

SEQ ID NO: 629251 - DNA, 25 bp, Rattus norvegicus
tggaccgtgacaatatacctgcttg

SEQ ID NO: 629252 - DNA, 25 bp, Rattus norvegicus
tggaccgtgacattatacctgcttg

SEQ ID NO: 629253 - DNA, 25 bp, Rattus norvegicus
tggaccgttattacaaattctcttt

SEQ ID NO: 629254 - DNA, 25 bp, Rattus norvegicus
tggaccgttatttcaaattctcttt

SEQ ID NO: 629255 - DNA, 25 bp, Rattus norvegicus
tggacctagtgcattctggttggga

SEQ ID NO: 629256 - DNA, 25 bp, Rattus norvegicus
tggacctagtgctttctggttggga

SEQ ID NO: 629257 - DNA, 25 bp, Rattus norvegicus
tggacctagttcaacactcagctgt

SEQ ID NO: 629258 - DNA, 25 bp, Rattus norvegicus
tggacctagttctacactcagctgt

SEQ ID NO: 629259 - DNA, 25 bp, Rattus norvegicus
tggacctatgcacggaggccaagcc

SEQ ID NO: 629260 - DNA, 25 bp, Rattus norvegicus
tggacctatgcagggaggccaagcc

SEQ ID NO: 629261 - DNA, 25 bp, Rattus norvegicus
tggacctcaaagacctgccgcaagc

SEQ ID NO: 629262 - DNA, 25 bp, Rattus norvegicus
tggacctcaaagtcctgccgcaagc

SEQ ID NO: 629263 - DNA, 25 bp, Rattus norvegicus
tggacctcagcacatcacagttacc

SEQ ID NO: 629264 - DNA, 25 bp, Rattus norvegicus
tggacctcagcagatcacagttacc

SEQ ID NO: 629265 - DNA, 25 bp, Rattus norvegicus
tggacctcaggcaagccctgtacta

SEQ ID NO: 629266 - DNA, 25 bp, Rattus norvegicus
tggacctcaggctagccctgtacta

SEQ ID NO: 629267 - DNA, 25 bp, Rattus norvegicus
tggacctcagggaacctgcacttga

SEQ ID NO: 629268 - DNA, 25 bp, Rattus norvegicus
tggacctcagggtacctgcacttga

SEQ ID NO: 629269 - DNA, 25 bp, Rattus norvegicus
tggacctcagtgaatgcagcagcat

SEQ ID NO: 629270 - DNA, 25 bp, Rattus norvegicus
tggacctcagtgtatgcagcagcat

SEQ ID NO: 629271 - DNA, 25 bp, Rattus norvegicus
tggacctcagttacatcacagcctt

SEQ ID NO: 629272 - DNA, 25 bp, Rattus norvegicus
tggacctcagtttcatcacagcctt

SEQ ID NO: 629273 - DNA, 25 bp, Rattus norvegicus
tggacctcatgacggcagttcccaa

SEQ ID NO: 629274 - DNA, 25 bp, Rattus norvegicus
tggacctcatgagggcagttcccaa

SEQ ID NO: 629275 - DNA, 25 bp, Rattus norvegicus
tggacctcatgtactagggtagcct

SEQ ID NO: 629276 - DNA, 25 bp, Rattus norvegicus
tggacctcatgttctagggtagcct

SEQ ID NO: 629277 - DNA, 25 bp, Rattus norvegicus
tggacctccaaacgccaagaccaga

SEQ ID NO: 629278 - DNA, 25 bp, Rattus norvegicus
tggacctccaaactgagccagtgtt

SEQ ID NO: 629279 - DNA, 25 bp, Rattus norvegicus
tggacctccaaactgctatgtagtc

SEQ ID NO: 629280 - DNA, 25 bp, Rattus norvegicus
tggacctccaaaggccaagaccaga

SEQ ID NO: 629281 - DNA, 25 bp, Rattus norvegicus
tggacctccaaagtgagccagtgtt

SEQ ID NO: 629282 - DNA, 25 bp, Rattus norvegicus
tggacctccaaagtgctatgtagtc

SEQ ID NO: 629283 - DNA, 25 bp, Rattus norvegicus
tggacctccagaaggtgccttaggt

SEQ ID NO: 629284 - DNA, 25 bp, Rattus norvegicus
tggacctccagatggtgccttaggt

SEQ ID NO: 629285 - DNA, 25 bp, Rattus norvegicus
tggacctccatgatccagagaaaag

SEQ ID NO: 629286 - DNA, 25 bp, Rattus norvegicus
tggacctccatgttccagagaaaag

SEQ ID NO: 629287 - DNA, 25 bp, Rattus norvegicus
tggacctccgtgctgctgcaagtta

SEQ ID NO: 629288 - DNA, 25 bp, Rattus norvegicus
tggacctccgtggtgctgcaagtta

SEQ ID NO: 629289 - DNA, 25 bp, Rattus norvegicus
tggacctctaccatgttccttcaaa

SEQ ID NO: 629290 - DNA, 25 bp, Rattus norvegicus
tggacctctaccttgttccttcaaa

SEQ ID NO: 629291 - DNA, 25 bp, Rattus norvegicus
tggacctctctcagctatgccctga

SEQ ID NO: 629292 - DNA, 25 bp, Rattus norvegicus
tggacctctctctgctatgccctga

SEQ ID NO: 629293 - DNA, 25 bp, Rattus norvegicus
tggacctctgccaaaaaaccacgag

SEQ ID NO: 629294 - DNA, 25 bp, Rattus norvegicus
tggacctctgcctaaaaaccacgag

SEQ ID NO: 629295 - DNA, 25 bp, Rattus norvegicus
tggacctctgcgactgcctggacga

SEQ ID NO: 629296 - DNA, 25 bp, Rattus norvegicus
tggacctctgcgtctgcctggacga

SEQ ID NO: 629297 - DNA, 25 bp, Rattus norvegicus
tggacctctgctcggatcgcctacg

SEQ ID NO: 629298 - DNA, 25 bp, Rattus norvegicus
tggacctctgctgggatcgcctacg

SEQ ID NO: 629299 - DNA, 25 bp, Rattus norvegicus
tggacctctgggatgttttcaaggg

SEQ ID NO: 629300 - DNA, 25 bp, Rattus norvegicus
tggacctctgggttgttttcaaggg

SEQ ID NO: 629301 - DNA, 25 bp, Rattus norvegicus
tggacctcttctcatgtacatagtg

SEQ ID NO: 629302 - DNA, 25 bp, Rattus norvegicus
tggacctcttctgatgtacatagtg

SEQ ID NO: 629303 - DNA, 25 bp, Rattus norvegicus
tggacctgaacacagtttactgtaa

SEQ ID NO: 629304 - DNA, 25 bp, Rattus norvegicus
tggacctgaacagagtttactgtaa

SEQ ID NO: 629305 - DNA, 25 bp, Rattus norvegicus
tggacctgaccacagttctgaccaa

SEQ ID NO: 629306 - DNA, 25 bp, Rattus norvegicus
tggacctgaccagagttctgaccaa

SEQ ID NO: 629307 - DNA, 25 bp, Rattus norvegicus
tggacctgagttccccaatcttaag

SEQ ID NO: 629308 - DNA, 25 bp, Rattus norvegicus
tggacctgagttgcccaatcttaag

SEQ ID NO: 629309 - DNA, 25 bp, Rattus norvegicus
tggacctgccaactcatggtctact

SEQ ID NO: 629310 - DNA, 25 bp, Rattus norvegicus
tggacctgccaagtcatggtctact

SEQ ID NO: 629311 - DNA, 25 bp, Rattus norvegicus
tggacctgccttcttgtgcggattg

SEQ ID NO: 629312 - DNA, 25 bp, Rattus norvegicus
tggacctgccttgttgtgcggattg

SEQ ID NO: 629313 - DNA, 25 bp, Rattus norvegicus
tggacctgcgacctacctttgtctt

SEQ ID NO: 629314 - DNA, 25 bp, Rattus norvegicus
tggacctgcgacgtacctttgtctt

SEQ ID NO: 629315 - DNA, 25 bp, Rattus norvegicus
tggacctgcttcaaggacgttggtt

SEQ ID NO: 629316 - DNA, 25 bp, Rattus norvegicus
tggacctgcttctaggacgttggtt

SEQ ID NO: 629317 - DNA, 25 bp, Rattus norvegicus
tggacctgggatctgcatgaatgct

SEQ ID NO: 629318 - DNA, 25 bp, Rattus norvegicus
tggacctgggatgtgcatgaatgct

SEQ ID NO: 629319 - DNA, 25 bp, Rattus norvegicus
tggacctgggtcactatgcacttgt

SEQ ID NO: 629320 - DNA, 25 bp, Rattus norvegicus
tggacctgggtctctatgcacttgt

SEQ ID NO: 629321 - DNA, 25 bp, Rattus norvegicus
tggacctggtcccttaggactgcat

SEQ ID NO: 629322 - DNA, 25 bp, Rattus norvegicus
tggacctggtccgttaggactgcat

SEQ ID NO: 629323 - DNA, 25 bp, Rattus norvegicus
tggacctggtgcctgggcacaccat

SEQ ID NO: 629324 - DNA, 25 bp, Rattus norvegicus
tggacctggtgcgtgggcacaccat

SEQ ID NO: 629325 - DNA, 25 bp, Rattus norvegicus
tggacctgtccactgagttcctcag

SEQ ID NO: 629326 - DNA, 25 bp, Rattus norvegicus
tggacctgtccagtgagttcctcag

SEQ ID NO: 629327 - DNA, 25 bp, Rattus norvegicus
tggaccttacgtagatccgaggaaa

SEQ ID NO: 629328 - DNA, 25 bp, Rattus norvegicus
tggaccttacgttgatccgaggaaa

SEQ ID NO: 629329 - DNA, 25 bp, Rattus norvegicus
tggaccttccacaatctgtcatgaa

SEQ ID NO: 629330 - DNA, 25 bp, Rattus norvegicus
tggaccttccacagcggagtgaatt

SEQ ID NO: 629331 - DNA, 25 bp, Rattus norvegicus
tggaccttccactatctgtcatgaa

SEQ ID NO: 629332 - DNA, 25 bp, Rattus norvegicus
tggaccttccactgcggagtgaatt

SEQ ID NO: 629333 - DNA, 25 bp, Rattus norvegicus
tggaccttcctgctctgtgtaatac

SEQ ID NO: 629334 - DNA, 25 bp, Rattus norvegicus
tggaccttcctggtctgtgtaatac

SEQ ID NO: 629335 - DNA, 25 bp, Rattus norvegicus
tggaccttctgcagtaatcactcgg

SEQ ID NO: 629336 - DNA, 25 bp, Rattus norvegicus
tggaccttctgctgtaatcactcgg

SEQ ID NO: 629337 - DNA, 25 bp, Rattus norvegicus
tggaccttgatgaaaccgtatgaac

SEQ ID NO: 629338 - DNA, 25 bp, Rattus norvegicus
tggaccttgatgtaaccgtatgaac

SEQ ID NO: 629339 - DNA, 25 bp, Rattus norvegicus
tggaccttgctgactgggtggctcc

SEQ ID NO: 629340 - DNA, 25 bp, Rattus norvegicus
tggaccttgctgtctgggtggctcc

SEQ ID NO: 629341 - DNA, 25 bp, Rattus norvegicus
tggaccttgtaaacctgctgctgac

SEQ ID NO: 629342 - DNA, 25 bp, Rattus norvegicus
tggaccttgtaatcctgctgctgac

SEQ ID NO: 629343 - DNA, 25 bp, Rattus norvegicus
tggacctttggcattctggactagt

SEQ ID NO: 629344 - DNA, 25 bp, Rattus norvegicus
tggacctttggctttctggactagt

SEQ ID NO: 629345 - DNA, 25 bp, Rattus norvegicus
tggacgacatcacgccctgctgaga

SEQ ID NO: 629346 - DNA, 25 bp, Rattus norvegicus
tggacgacatcaggccctgctgaga

SEQ ID NO: 629347 - DNA, 25 bp, Rattus norvegicus
tggacgacccgaagagtctgctcta

SEQ ID NO: 629348 - DNA, 25 bp, Rattus norvegicus
tggacgacccgatgagtctgctcta

SEQ ID NO: 629349 - DNA, 25 bp, Rattus norvegicus
tggacgaccggcattactgcgtcta

SEQ ID NO: 629350 - DNA, 25 bp, Rattus norvegicus
tggacgaccggctttactgcgtcta

SEQ ID NO: 629351 - DNA, 25 bp, Rattus norvegicus
tggacgacctatatgcacagcactg

SEQ ID NO: 629352 - DNA, 25 bp, Rattus norvegicus
tggacgacctatttgcacagcactg

SEQ ID NO: 629353 - DNA, 25 bp, Rattus norvegicus
tggacgacctctatctgaagcgcta

SEQ ID NO: 629354 - DNA, 25 bp, Rattus norvegicus
tggacgacctctttctgaagcgcta

SEQ ID NO: 629355 - DNA, 25 bp, Rattus norvegicus
tggacgacttcaagcgcttcaaggc

SEQ ID NO: 629356 - DNA, 25 bp, Rattus norvegicus
tggacgacttcatgcgcttcaaggc

SEQ ID NO: 629357 - DNA, 25 bp, Rattus norvegicus
tggacgagatccacaagctcttgcc

SEQ ID NO: 629358 - DNA, 25 bp, Rattus norvegicus
tggacgagatcctcaagctcttgcc

SEQ ID NO: 629359 - DNA, 25 bp, Rattus norvegicus
tggacgagatcgaagctgccgagct

SEQ ID NO: 629360 - DNA, 25 bp, Rattus norvegicus
tggacgagatcgtagctgccgagct

SEQ ID NO: 629361 - DNA, 25 bp, Rattus norvegicus
tggacgaggcagagcagatcgccct

SEQ ID NO: 629362 - DNA, 25 bp, Rattus norvegicus
tggacgaggcagtgcagatcgccct

SEQ ID NO: 629363 - DNA, 25 bp, Rattus norvegicus
tggacgaggcttccctcagagtcac

SEQ ID NO: 629364 - DNA, 25 bp, Rattus norvegicus
tggacgaggcttgcctcagagtcac

SEQ ID NO: 629365 - DNA, 25 bp, Rattus norvegicus
tggacgagtaagatcccattgggat

SEQ ID NO: 629366 - DNA, 25 bp, Rattus norvegicus
tggacgagtaagttcccattgggat

SEQ ID NO: 629367 - DNA, 25 bp, Rattus norvegicus
tggacgagttccagggctacgacga

SEQ ID NO: 629368 - DNA, 25 bp, Rattus norvegicus
tggacgagttcctgggctacgacga

SEQ ID NO: 629369 - DNA, 25 bp, Rattus norvegicus
tggacgataggtccccttcatggtc

SEQ ID NO: 629370 - DNA, 25 bp, Rattus norvegicus
tggacgataggtgcccttcatggtc

SEQ ID NO: 629371 - DNA, 25 bp, Rattus norvegicus
tggacgatatttaactagcactagc

SEQ ID NO: 629372 - DNA, 25 bp, Rattus norvegicus
tggacgatattttactagcactagc

SEQ ID NO: 629373 - DNA, 25 bp, Rattus norvegicus
tggacgatctatccaggactctggt

SEQ ID NO: 629374 - DNA, 25 bp, Rattus norvegicus
tggacgatctatgcaggactctggt

SEQ ID NO: 629375 - DNA, 25 bp, Rattus norvegicus
tggacgcacggacggagaccctcct

SEQ ID NO: 629376 - DNA, 25 bp, Rattus norvegicus
tggacgcacggagggagaccctcct

SEQ ID NO: 629377 - DNA, 25 bp, Rattus norvegicus
tggacgccaatacctgcgactatga

SEQ ID NO: 629378 - DNA, 25 bp, Rattus norvegicus
tggacgccaatagctgcgactatga

SEQ ID NO: 629379 - DNA, 25 bp, Rattus norvegicus
tggacgccccgcagaccggacagta

SEQ ID NO: 629380 - DNA, 25 bp, Rattus norvegicus
tggacgccccgctgaccggacagta

SEQ ID NO: 629381 - DNA, 25 bp, Rattus norvegicus
tggacgcctcatctctgagctcaaa

SEQ ID NO: 629382 - DNA, 25 bp, Rattus norvegicus
tggacgcctcatgtctgagctcaaa

SEQ ID NO: 629383 - DNA, 25 bp, Rattus norvegicus
tggacgcctcggagatgtacagaaa

SEQ ID NO: 629384 - DNA, 25 bp, Rattus norvegicus
tggacgcctcggtgatgtacagaaa

SEQ ID NO: 629385 - DNA, 25 bp, Rattus norvegicus
tggacgcctttcatcgtggtgcaca

SEQ ID NO: 629386 - DNA, 25 bp, Rattus norvegicus
tggacgcctttcttcgtggtgcaca

SEQ ID NO: 629387 - DNA, 25 bp, Rattus norvegicus
tggacgctaagaccccaagctgcta

SEQ ID NO: 629388 - DNA, 25 bp, Rattus norvegicus
tggacgctaagagcccaagctgcta

SEQ ID NO: 629389 - DNA, 25 bp, Rattus norvegicus
tggacgctaatgatccttccacttt

SEQ ID NO: 629390 - DNA, 25 bp, Rattus norvegicus
tggacgctaatgttccttccacttt

SEQ ID NO: 629391 - DNA, 25 bp, Rattus norvegicus
tggacgctccagagctgcagctgtg

SEQ ID NO: 629392 - DNA, 25 bp, Rattus norvegicus
tggacgctccagtgctgcagctgtg

SEQ ID NO: 629393 - DNA, 25 bp, Rattus norvegicus
tggacgcttgcactgtagctaggtc

SEQ ID NO: 629394 - DNA, 25 bp, Rattus norvegicus
tggacgcttgcagtgtagctaggtc

SEQ ID NO: 629395 - DNA, 25 bp, Rattus norvegicus
tggacggaaacaatcgggctggctt

SEQ ID NO: 629396 - DNA, 25 bp, Rattus norvegicus
tggacggaaacattcgggctggctt

SEQ ID NO: 629397 - DNA, 25 bp, Rattus norvegicus
tggacggaaatgcttctgccacgtg

SEQ ID NO: 629398 - DNA, 25 bp, Rattus norvegicus
tggacggaaatggttctgccacgtg

SEQ ID NO: 629399 - DNA, 25 bp, Rattus norvegicus
tggacggacaggacatgtgatagct

SEQ ID NO: 629400 - DNA, 25 bp, Rattus norvegicus
tggacggacaggtcatgtgatagct

SEQ ID NO: 629401 - DNA, 25 bp, Rattus norvegicus
tggacggagtgaagctactcattga

SEQ ID NO: 629402 - DNA, 25 bp, Rattus norvegicus
tggacggagtgatgctactcattga

SEQ ID NO: 629403 - DNA, 25 bp, Rattus norvegicus
tggacggcatttcagcagtctcaga

SEQ ID NO: 629404 - DNA, 25 bp, Rattus norvegicus
tggacggcatttgagcagtctcaga

SEQ ID NO: 629405 - DNA, 25 bp, Rattus norvegicus
tggacggcgggccaaggcgccgcgg

SEQ ID NO: 629406 - DNA, 25 bp, Rattus norvegicus
tggacggcgggcgaaggcgccgcgg

SEQ ID NO: 629407 - DNA, 25 bp, Rattus norvegicus
tggacggctacaactcggcgctcct

SEQ ID NO: 629408 - DNA, 25 bp, Rattus norvegicus
tggacggctacatctcggcgctcct

SEQ ID NO: 629409 - DNA, 25 bp, Rattus norvegicus
tggacggctgaccttgtccgaagcc

SEQ ID NO: 629410 - DNA, 25 bp, Rattus norvegicus
tggacggctgacgttgtccgaagcc

SEQ ID NO: 629411 - DNA, 25 bp, Rattus norvegicus
tggacgggatttccggtgaatttca

SEQ ID NO: 629412 - DNA, 25 bp, Rattus norvegicus
tggacgggatttgcggtgaatttca

SEQ ID NO: 629413 - DNA, 25 bp, Rattus norvegicus
tggacgggcgccatactattgtgcc

SEQ ID NO: 629414 - DNA, 25 bp, Rattus norvegicus
tggacgggcgccttactattgtgcc

SEQ ID NO: 629415 - DNA, 25 bp, Rattus norvegicus
tggacgggtcttactagtattttct

SEQ ID NO: 629416 - DNA, 25 bp, Rattus norvegicus
tggacgggtctttctagtattttct

SEQ ID NO: 629417 - DNA, 25 bp, Rattus norvegicus
tggacggtaccaaacccctgataag

SEQ ID NO: 629418 - DNA, 25 bp, Rattus norvegicus
tggacggtaccatacccctgataag

SEQ ID NO: 629419 - DNA, 25 bp, Rattus norvegicus
tggacggtactaaggtcccctctga

SEQ ID NO: 629420 - DNA, 25 bp, Rattus norvegicus
tggacggtactatggtcccctctga

SEQ ID NO: 629421 - DNA, 25 bp, Rattus norvegicus
tggacggtagtaaccaggccttctc

SEQ ID NO: 629422 - DNA, 25 bp, Rattus norvegicus
tggacggtagtatccaggccttctc

SEQ ID NO: 629423 - DNA, 25 bp, Rattus norvegicus
tggacggtgcttctcattcccaggc

SEQ ID NO: 629424 - DNA, 25 bp, Rattus norvegicus
tggacggtgcttgtcattcccaggc

SEQ ID NO: 629425 - DNA, 25 bp, Rattus norvegicus
tggacggtgtttatcttctcaggac

SEQ ID NO: 629426 - DNA, 25 bp, Rattus norvegicus
tggacggtgtttttcttctcaggac

SEQ ID NO: 629427 - DNA, 25 bp, Rattus norvegicus
tggacggttgcactcattcatattc

SEQ ID NO: 629428 - DNA, 25 bp, Rattus norvegicus
tggacggttgcagtcattcatattc

SEQ ID NO: 629429 - DNA, 25 bp, Rattus norvegicus
tggacgtatcttctacagtacccat

SEQ ID NO: 629430 - DNA, 25 bp, Rattus norvegicus
tggacgtatcttgtacagtacccat

SEQ ID NO: 629431 - DNA, 25 bp, Rattus norvegicus
tggacgtcagcaccacaagcagtga

SEQ ID NO: 629432 - DNA, 25 bp, Rattus norvegicus
tggacgtcagcagcacaagcagtga

SEQ ID NO: 629433 - DNA, 25 bp, Rattus norvegicus
tggacgtctaccagcgcagctattg

SEQ ID NO: 629434 - DNA, 25 bp, Rattus norvegicus
tggacgtctacctgcgcagctattg

SEQ ID NO: 629435 - DNA, 25 bp, Rattus norvegicus
tggacgtctcaacggccggcagggc

SEQ ID NO: 629436 - DNA, 25 bp, Rattus norvegicus
tggacgtctcaagggccggcagggc

SEQ ID NO: 629437 - DNA, 25 bp, Rattus norvegicus
tggacgtcttccatcttctcaggtc

SEQ ID NO: 629438 - DNA, 25 bp, Rattus norvegicus
tggacgtcttccttcttctcaggtc

SEQ ID NO: 629439 - DNA, 25 bp, Rattus norvegicus
tggacgtgaagtctccactgtcgcc

SEQ ID NO: 629440 - DNA, 25 bp, Rattus norvegicus
tggacgtgaagtgtccactgtcgcc

SEQ ID NO: 629441 - DNA, 25 bp, Rattus norvegicus
tggacgtgagtaatctagcagcata

SEQ ID NO: 629442 - DNA, 25 bp, Rattus norvegicus
tggacgtgagtattctagcagcata

SEQ ID NO: 629443 - DNA, 25 bp, Rattus norvegicus
tggacgtgctggagtcctctgccag

SEQ ID NO: 629444 - DNA, 25 bp, Rattus norvegicus
tggacgtgctggtgtcctctgccag

SEQ ID NO: 629445 - DNA, 25 bp, Rattus norvegicus
tggacgtggtggacccaaagcagct

SEQ ID NO: 629446 - DNA, 25 bp, Rattus norvegicus
tggacgtggtggtcccaaagcagct

SEQ ID NO: 629447 - DNA, 25 bp, Rattus norvegicus
tggacgttaaagctcctcactaaag

SEQ ID NO: 629448 - DNA, 25 bp, Rattus norvegicus
tggacgttaaaggtcctcactaaag

SEQ ID NO: 629449 - DNA, 25 bp, Rattus norvegicus
tggacgttctccaactgctataaga

SEQ ID NO: 629450 - DNA, 25 bp, Rattus norvegicus
tggacgttctcctactgctataaga

SEQ ID NO: 629451 - DNA, 25 bp, Rattus norvegicus
tggacgttcttgaggtcactcttaa

SEQ ID NO: 629452 - DNA, 25 bp, Rattus norvegicus
tggacgttcttgtggtcactcttaa

SEQ ID NO: 629453 - DNA, 25 bp, Rattus norvegicus
tggacgttgcgcacaagcaggcagc

SEQ ID NO: 629454 - DNA, 25 bp, Rattus norvegicus
tggacgttgcgctcaagcaggcagc

SEQ ID NO: 629455 - DNA, 25 bp, Rattus norvegicus
tggacgttggtcagcgagcagacac

SEQ ID NO: 629456 - DNA, 25 bp, Rattus norvegicus
tggacgttggtctgcgagcagacac

SEQ ID NO: 629457 - DNA, 25 bp, Rattus norvegicus
tggacgtttgtgagacccatcttca

SEQ ID NO: 629458 - DNA, 25 bp, Rattus norvegicus
tggacgtttgtgtgacccatcttca

SEQ ID NO: 629459 - DNA, 25 bp, Rattus norvegicus
tggacgttttggagaaccaggctat

SEQ ID NO: 629460 - DNA, 25 bp, Rattus norvegicus
tggacgttttggtgaaccaggctat

SEQ ID NO: 629461 - DNA, 25 bp, Rattus norvegicus
tggacgtttttcctaggcccttgtg

SEQ ID NO: 629462 - DNA, 25 bp, Rattus norvegicus
tggacgtttttcgtaggcccttgtg

SEQ ID NO: 629463 - DNA, 25 bp, Rattus norvegicus
tggactaaatttcttgccattcttt

SEQ ID NO: 629464 - DNA, 25 bp, Rattus norvegicus
tggactaaatttgttgccattcttt

SEQ ID NO: 629465 - DNA, 25 bp, Rattus norvegicus
tggactaaccacagttgctaccact

SEQ ID NO: 629466 - DNA, 25 bp, Rattus norvegicus
tggactaaccactgttgctaccact

SEQ ID NO: 629467 - DNA, 25 bp, Rattus norvegicus
tggactaagctgaccggagccagcc

SEQ ID NO: 629468 - DNA, 25 bp, Rattus norvegicus
tggactaagctgtccggagccagcc

SEQ ID NO: 629469 - DNA, 25 bp, Rattus norvegicus
tggactacaagacagccgagcagaa

SEQ ID NO: 629470 - DNA, 25 bp, Rattus norvegicus
tggactacaagagagccgagcagaa

SEQ ID NO: 629471 - DNA, 25 bp, Rattus norvegicus
tggactacatacaccactggccaaa

SEQ ID NO: 629472 - DNA, 25 bp, Rattus norvegicus
tggactacatactccactggccaaa

SEQ ID NO: 629473 - DNA, 25 bp, Rattus norvegicus
tggactaccactatctgcgtgactt

SEQ ID NO: 629474 - DNA, 25 bp, Rattus norvegicus
tggactaccactttctgcgtgactt

SEQ ID NO: 629475 - DNA, 25 bp, Rattus norvegicus
tggactaccagcattcccaggagct

SEQ ID NO: 629476 - DNA, 25 bp, Rattus norvegicus
tggactaccagctttcccaggagct

SEQ ID NO: 629477 - DNA, 25 bp, Rattus norvegicus
tggactacccgtccggattccgagg

SEQ ID NO: 629478 - DNA, 25 bp, Rattus norvegicus
tggactacccgtgcggattccgagg

SEQ ID NO: 629479 - DNA, 25 bp, Rattus norvegicus
tggactaccctcagagcgcaagaga

SEQ ID NO: 629480 - DNA, 25 bp, Rattus norvegicus
tggactaccctctgagcgcaagaga

SEQ ID NO: 629481 - DNA, 25 bp, Rattus norvegicus
tggactacgctccagctgtatggaa

SEQ ID NO: 629482 - DNA, 25 bp, Rattus norvegicus
tggactacgctcgagctgtatggaa

SEQ ID NO: 629483 - DNA, 25 bp, Rattus norvegicus
tggactacgtggctttctctagtgc

SEQ ID NO: 629484 - DNA, 25 bp, Rattus norvegicus
tggactacgtgggtttctctagtgc

SEQ ID NO: 629485 - DNA, 25 bp, Rattus norvegicus
tggactactagcagacatcacaggc

SEQ ID NO: 629486 - DNA, 25 bp, Rattus norvegicus
tggactactagctgacatcacaggc

SEQ ID NO: 629487 - DNA, 25 bp, Rattus norvegicus
tggactactcagatgacgctctagc

SEQ ID NO: 629488 - DNA, 25 bp, Rattus norvegicus
tggactactcagttgacgctctagc

SEQ ID NO: 629489 - DNA, 25 bp, Rattus norvegicus
tggactactcttccaggaaacctgg

SEQ ID NO: 629490 - DNA, 25 bp, Rattus norvegicus
tggactactcttgcaggaaacctgg

SEQ ID NO: 629491 - DNA, 25 bp, Rattus norvegicus
tggactactgccacatgctgggctc

SEQ ID NO: 629492 - DNA, 25 bp, Rattus norvegicus
tggactactgcctcatgctgggctc

SEQ ID NO: 629493 - DNA, 25 bp, Rattus norvegicus
tggactactggtcggcttcggccaa

SEQ ID NO: 629494 - DNA, 25 bp, Rattus norvegicus
tggactactggtgggcttcggccaa

SEQ ID NO: 629495 - DNA, 25 bp, Rattus norvegicus
tggactagcattctttgctgctgct

SEQ ID NO: 629496 - DNA, 25 bp, Rattus norvegicus
tggactagcattgtttgctgctgct

SEQ ID NO: 629497 - DNA, 25 bp, Rattus norvegicus
tggactaggcgtcactgtcagccct

SEQ ID NO: 629498 - DNA, 25 bp, Rattus norvegicus
tggactaggcgtgactgtcagccct

SEQ ID NO: 629499 - DNA, 25 bp, Rattus norvegicus
tggactagtttcatgggtaaccctg

SEQ ID NO: 629500 - DNA, 25 bp, Rattus norvegicus
tggactagtttcttgggtaaccctg

SEQ ID NO: 629501 - DNA, 25 bp, Rattus norvegicus
tggactatccacagcacggtcgtta

SEQ ID NO: 629502 - DNA, 25 bp, Rattus norvegicus
tggactatccactgcacggtcgtta

SEQ ID NO: 629503 - DNA, 25 bp, Rattus norvegicus
tggactatgaatacaccctcaggct

SEQ ID NO: 629504 - DNA, 25 bp, Rattus norvegicus
tggactatgaattcaccctcaggct

SEQ ID NO: 629505 - DNA, 25 bp, Rattus norvegicus
tggactatgtgtaccacggcgagcg

SEQ ID NO: 629506 - DNA, 25 bp, Rattus norvegicus
tggactatgtgttccacggcgagcg

SEQ ID NO: 629507 - DNA, 25 bp, Rattus norvegicus
tggactatgttgagaatttcaggct

SEQ ID NO: 629508 - DNA, 25 bp, Rattus norvegicus
tggactatgttgtgaatttcaggct

SEQ ID NO: 629509 - DNA, 25 bp, Rattus norvegicus
tggactatttacacagaaccggcaa

SEQ ID NO: 629510 - DNA, 25 bp, Rattus norvegicus
tggactatttactcagaaccggcaa

SEQ ID NO: 629511 - DNA, 25 bp, Rattus norvegicus
tggactcaagttcaaccctgacaac

SEQ ID NO: 629512 - DNA, 25 bp, Rattus norvegicus
tggactcaagttgaaccctgacaac

SEQ ID NO: 629513 - DNA, 25 bp, Rattus norvegicus
tggactcaatgaaaccttctctgct

SEQ ID NO: 629514 - DNA, 25 bp, Rattus norvegicus
tggactcaatgataccttctctgct

SEQ ID NO: 629515 - DNA, 25 bp, Rattus norvegicus
tggactcaccaaatccttcgggttt

SEQ ID NO: 629516 - DNA, 25 bp, Rattus norvegicus
tggactcaccaattccttcgggttt

SEQ ID NO: 629517 - DNA, 25 bp, Rattus norvegicus
tggactcagaggattgctgcatttg

SEQ ID NO: 629518 - DNA, 25 bp, Rattus norvegicus
tggactcagaggtttgctgcatttg

SEQ ID NO: 629519 - DNA, 25 bp, Rattus norvegicus
tggactcagagtaacaccatggtgt

SEQ ID NO: 629520 - DNA, 25 bp, Rattus norvegicus
tggactcagagttacaccatggtgt

SEQ ID NO: 629521 - DNA, 25 bp, Rattus norvegicus
tggactcagatgagtcctacttcct

SEQ ID NO: 629522 - DNA, 25 bp, Rattus norvegicus
tggactcagatgtgtcctacttcct

SEQ ID NO: 629523 - DNA, 25 bp, Rattus norvegicus
tggactcagcgacgagctcacggaa

SEQ ID NO: 629524 - DNA, 25 bp, Rattus norvegicus
tggactcagcgaggagctcacggaa

SEQ ID NO: 629525 - DNA, 25 bp, Rattus norvegicus
tggactcagctcacctgtcatggag

SEQ ID NO: 629526 - DNA, 25 bp, Rattus norvegicus
tggactcagctctcctgtcatggag

SEQ ID NO: 629527 - DNA, 25 bp, Rattus norvegicus
tggactcagggcacgtgtactgcca

SEQ ID NO: 629528 - DNA, 25 bp, Rattus norvegicus
tggactcagggctcgtgtactgcca

SEQ ID NO: 629529 - DNA, 25 bp, Rattus norvegicus
tggactcagtgtacttccttgcgac

SEQ ID NO: 629530 - DNA, 25 bp, Rattus norvegicus
tggactcagtgttcttccttgcgac

SEQ ID NO: 629531 - DNA, 25 bp, Rattus norvegicus
tggactcatgcacgacttgggactt

SEQ ID NO: 629532 - DNA, 25 bp, Rattus norvegicus
tggactcatgcaggacttgggactt

SEQ ID NO: 629533 - DNA, 25 bp, Rattus norvegicus
tggactcatgtccaacagtgctgga

SEQ ID NO: 629534 - DNA, 25 bp, Rattus norvegicus
tggactcatgtcgaacagtgctgga

SEQ ID NO: 629535 - DNA, 25 bp, Rattus norvegicus
tggactcattgactcactcatctac

SEQ ID NO: 629536 - DNA, 25 bp, Rattus norvegicus
tggactcattgagtcactcatctac

SEQ ID NO: 629537 - DNA, 25 bp, Rattus norvegicus
tggactccaaatcaatcccgctgtg

SEQ ID NO: 629538 - DNA, 25 bp, Rattus norvegicus
tggactccaaatgaatcccgctgtg

SEQ ID NO: 629539 - DNA, 25 bp, Rattus norvegicus
tggactccaccaatgttgagctagc

SEQ ID NO: 629540 - DNA, 25 bp, Rattus norvegicus
tggactccaccattgttgagctagc

SEQ ID NO: 629541 - DNA, 25 bp, Rattus norvegicus
tggactccacgcctttttctttttg

SEQ ID NO: 629542 - DNA, 25 bp, Rattus norvegicus
tggactccacgcgtttttctttttg

SEQ ID NO: 629543 - DNA, 25 bp, Rattus norvegicus
tggactccagaactcaagcatttct

SEQ ID NO: 629544 - DNA, 25 bp, Rattus norvegicus
tggactccagaagtcaagcatttct

SEQ ID NO: 629545 - DNA, 25 bp, Rattus norvegicus
tggactccatggataccctatgaca

SEQ ID NO: 629546 - DNA, 25 bp, Rattus norvegicus
tggactccatggttaccctatgaca

SEQ ID NO: 629547 - DNA, 25 bp, Rattus norvegicus
tggactccattcagctctttctaag

SEQ ID NO: 629548 - DNA, 25 bp, Rattus norvegicus
tggactccattctgctctttctaag

SEQ ID NO: 629549 - DNA, 25 bp, Rattus norvegicus
tggactcccatactgcacctttgag

SEQ ID NO: 629550 - DNA, 25 bp, Rattus norvegicus
tggactcccatagtgcacctttgag

SEQ ID NO: 629551 - DNA, 25 bp, Rattus norvegicus
tggactccccgaagctttggaagcc

SEQ ID NO: 629552 - DNA, 25 bp, Rattus norvegicus
tggactccccgatgctttggaagcc

SEQ ID NO: 629553 - DNA, 25 bp, Rattus norvegicus
tggactccccttatgtttattctca

SEQ ID NO: 629554 - DNA, 25 bp, Rattus norvegicus
tggactccccttttgtttattctca

SEQ ID NO: 629555 - DNA, 25 bp, Rattus norvegicus
tggactcccggacaaatcagaaact

SEQ ID NO: 629556 - DNA, 25 bp, Rattus norvegicus
tggactcccggagaaatcagaaact

SEQ ID NO: 629557 - DNA, 25 bp, Rattus norvegicus
tggactccctgtacaaccgtgagga

SEQ ID NO: 629558 - DNA, 25 bp, Rattus norvegicus
tggactccctgttcaaccgtgagga

SEQ ID NO: 629559 - DNA, 25 bp, Rattus norvegicus
tggactccgggaagggcaacacgtt

SEQ ID NO: 629560 - DNA, 25 bp, Rattus norvegicus
tggactccgggatgggcaacacgtt

SEQ ID NO: 629561 - DNA, 25 bp, Rattus norvegicus
tggactccggggaagcagcgcacca

SEQ ID NO: 629562 - DNA, 25 bp, Rattus norvegicus
tggactccggggtagcagcgcacca

SEQ ID NO: 629563 - DNA, 25 bp, Rattus norvegicus
tggactccgtagctattcgtgcagt

SEQ ID NO: 629564 - DNA, 25 bp, Rattus norvegicus
tggactccgtaggtattcgtgcagt

SEQ ID NO: 629565 - DNA, 25 bp, Rattus norvegicus
tggactcctactactactgctgaga

SEQ ID NO: 629566 - DNA, 25 bp, Rattus norvegicus
tggactcctactattcttctgtaag

SEQ ID NO: 629567 - DNA, 25 bp, Rattus norvegicus
tggactcctacttctactgctgaga

SEQ ID NO: 629568 - DNA, 25 bp, Rattus norvegicus
tggactcctacttttcttctgtaag

SEQ ID NO: 629569 - DNA, 25 bp, Rattus norvegicus
tggactcctcaacgcagcatttcac

SEQ ID NO: 629570 - DNA, 25 bp, Rattus norvegicus
tggactcctcaaggcagcatttcac

SEQ ID NO: 629571 - DNA, 25 bp, Rattus norvegicus
tggactcctgaaaatgcacatgcac

SEQ ID NO: 629572 - DNA, 25 bp, Rattus norvegicus
tggactcctgaatatgcacatgcac

SEQ ID NO: 629573 - DNA, 25 bp, Rattus norvegicus
tggactcctgatccccatattctgg

SEQ ID NO: 629574 - DNA, 25 bp, Rattus norvegicus
tggactcctgatgcccatattctgg

SEQ ID NO: 629575 - DNA, 25 bp, Rattus norvegicus
tggactccttgcagagactgtttaa

SEQ ID NO: 629576 - DNA, 25 bp, Rattus norvegicus
tggactccttgctgagactgtttaa

SEQ ID NO: 629577 - DNA, 25 bp, Rattus norvegicus
tggactccttttccatggcagtggg

SEQ ID NO: 629578 - DNA, 25 bp, Rattus norvegicus
tggactccttttgcatggcagtggg

SEQ ID NO: 629579 - DNA, 25 bp, Rattus norvegicus
tggactcgagagacacaatctgatt

SEQ ID NO: 629580 - DNA, 25 bp, Rattus norvegicus
tggactcgagagtcacaatctgatt

SEQ ID NO: 629581 - DNA, 25 bp, Rattus norvegicus
tggactcgcagcagaagcggtatgt

SEQ ID NO: 629582 - DNA, 25 bp, Rattus norvegicus
tggactcgcagctgaagcggtatgt

SEQ ID NO: 629583 - DNA, 25 bp, Rattus norvegicus
tggactcgtgtccttagcacaagaa

SEQ ID NO: 629584 - DNA, 25 bp, Rattus norvegicus
tggactcgtgtcgttagcacaagaa

SEQ ID NO: 629585 - DNA, 25 bp, Rattus norvegicus
tggactctaaaacccatttcagcat

SEQ ID NO: 629586 - DNA, 25 bp, Rattus norvegicus
tggactctaaaagccatttcagcat

SEQ ID NO: 629587 - DNA, 25 bp, Rattus norvegicus
tggactctacagcactgcttccctt

SEQ ID NO: 629588 - DNA, 25 bp, Rattus norvegicus
tggactctacaggactgcttccctt

SEQ ID NO: 629589 - DNA, 25 bp, Rattus norvegicus
tggactctagtcacgagggacccct

SEQ ID NO: 629590 - DNA, 25 bp, Rattus norvegicus
tggactctagtctcgagggacccct

SEQ ID NO: 629591 - DNA, 25 bp, Rattus norvegicus
tggactctcagtatgatgagattga

SEQ ID NO: 629592 - DNA, 25 bp, Rattus norvegicus
tggactctcagtttgatgagattga

SEQ ID NO: 629593 - DNA, 25 bp, Rattus norvegicus
tggactctcctgacttcataggctc

SEQ ID NO: 629594 - DNA, 25 bp, Rattus norvegicus
tggactctcctgtcttcataggctc

SEQ ID NO: 629595 - DNA, 25 bp, Rattus norvegicus
tggactctcgagaagcagacaattc

SEQ ID NO: 629596 - DNA, 25 bp, Rattus norvegicus
tggactctcgagtagcagacaattc

SEQ ID NO: 629597 - DNA, 25 bp, Rattus norvegicus
tggactctctccatttttagcaaat

SEQ ID NO: 629598 - DNA, 25 bp, Rattus norvegicus
tggactctctccttttttagcaaat

SEQ ID NO: 629599 - DNA, 25 bp, Rattus norvegicus
tggactctcttgacctggacaacac

SEQ ID NO: 629600 - DNA, 25 bp, Rattus norvegicus
tggactctcttgtcctggacaacac

SEQ ID NO: 629601 - DNA, 25 bp, Rattus norvegicus
tggactctgagcataggagatccga

SEQ ID NO: 629602 - DNA, 25 bp, Rattus norvegicus
tggactctgagcattcaggctggga

SEQ ID NO: 629603 - DNA, 25 bp, Rattus norvegicus
tggactctgagcttaggagatccga

SEQ ID NO: 629604 - DNA, 25 bp, Rattus norvegicus
tggactctgagctttcaggctggga

SEQ ID NO: 629605 - DNA, 25 bp, Rattus norvegicus
tggactctgcagagttcgccgcgcg

SEQ ID NO: 629606 - DNA, 25 bp, Rattus norvegicus
tggactctgcagatttccatattta

SEQ ID NO: 629607 - DNA, 25 bp, Rattus norvegicus
tggactctgcagtgttcgccgcgcg

SEQ ID NO: 629608 - DNA, 25 bp, Rattus norvegicus
tggactctgcagttttccatattta

SEQ ID NO: 629609 - DNA, 25 bp, Rattus norvegicus
tggactctgccaatattgtactgca

SEQ ID NO: 629610 - DNA, 25 bp, Rattus norvegicus
tggactctgccaatgaagatgggtt

SEQ ID NO: 629611 - DNA, 25 bp, Rattus norvegicus
tggactctgccattattgtactgca

SEQ ID NO: 629612 - DNA, 25 bp, Rattus norvegicus
tggactctgccattgaagatgggtt

SEQ ID NO: 629613 - DNA, 25 bp, Rattus norvegicus
tggactctgcccatacacagtagta

SEQ ID NO: 629614 - DNA, 25 bp, Rattus norvegicus
tggactctgcccttacacagtagta

SEQ ID NO: 629615 - DNA, 25 bp, Rattus norvegicus
tggactctgcctctgaggttgccca

SEQ ID NO: 629616 - DNA, 25 bp, Rattus norvegicus
tggactctgcctgtgaggttgccca

SEQ ID NO: 629617 - DNA, 25 bp, Rattus norvegicus
tggactcttaggactcatcaacaga

SEQ ID NO: 629618 - DNA, 25 bp, Rattus norvegicus
tggactcttaggtctcatcaacaga

SEQ ID NO: 629619 - DNA, 25 bp, Rattus norvegicus
tggactcttcacacagacggcaaaa

SEQ ID NO: 629620 - DNA, 25 bp, Rattus norvegicus
tggactcttcactcagacggcaaaa

SEQ ID NO: 629621 - DNA, 25 bp, Rattus norvegicus
tggactcttcagagcaatgctttca

SEQ ID NO: 629622 - DNA, 25 bp, Rattus norvegicus
tggactcttcagtgcaatgctttca

SEQ ID NO: 629623 - DNA, 25 bp, Rattus norvegicus
tggactcttcccaacagggttagtg

SEQ ID NO: 629624 - DNA, 25 bp, Rattus norvegicus
tggactcttccctacagggttagtg

SEQ ID NO: 629625 - DNA, 25 bp, Rattus norvegicus
tggactcttgtcctttccctgggag

SEQ ID NO: 629626 - DNA, 25 bp, Rattus norvegicus
tggactcttgtcgtttccctgggag

SEQ ID NO: 629627 - DNA, 25 bp, Rattus norvegicus
tggactcttgttagacactcaccag

SEQ ID NO: 629628 - DNA, 25 bp, Rattus norvegicus
tggactcttgtttgacactcaccag

SEQ ID NO: 629629 - DNA, 25 bp, Rattus norvegicus
tggactctttatataattgctgcag

SEQ ID NO: 629630 - DNA, 25 bp, Rattus norvegicus
tggactctttatttaattgctgcag

SEQ ID NO: 629631 - DNA, 25 bp, Rattus norvegicus
tggactctttgactgtggcagctga

SEQ ID NO: 629632 - DNA, 25 bp, Rattus norvegicus
tggactctttgagtgtggcagctga

SEQ ID NO: 629633 - DNA, 25 bp, Rattus norvegicus
tggactcttttcatggctgctgtca

SEQ ID NO: 629634 - DNA, 25 bp, Rattus norvegicus
tggactcttttcttggctgctgtca

SEQ ID NO: 629635 - DNA, 25 bp, Rattus norvegicus
tggactgaagtcagtgttctctgcc

SEQ ID NO: 629636 - DNA, 25 bp, Rattus norvegicus
tggactgaagtctgtgttctctgcc

SEQ ID NO: 629637 - DNA, 25 bp, Rattus norvegicus
tggactgactccaaatcagatgcat

SEQ ID NO: 629638 - DNA, 25 bp, Rattus norvegicus
tggactgactcctaatcagatgcat

SEQ ID NO: 629639 - DNA, 25 bp, Rattus norvegicus
tggactgagaatccgtgaccccgga

SEQ ID NO: 629640 - DNA, 25 bp, Rattus norvegicus
tggactgagaatgcgtgaccccgga

SEQ ID NO: 629641 - DNA, 25 bp, Rattus norvegicus
tggactgagccaccaaagccttgaa

SEQ ID NO: 629642 - DNA, 25 bp, Rattus norvegicus
tggactgagccagcaaagccttgaa

SEQ ID NO: 629643 - DNA, 25 bp, Rattus norvegicus
tggactgagcctctggcttctgaac

SEQ ID NO: 629644 - DNA, 25 bp, Rattus norvegicus
tggactgagcctgtggcttctgaac

SEQ ID NO: 629645 - DNA, 25 bp, Rattus norvegicus
tggactgagtgacgcagccgctcaa

SEQ ID NO: 629646 - DNA, 25 bp, Rattus norvegicus
tggactgagtgaggcagccgctcaa

SEQ ID NO: 629647 - DNA, 25 bp, Rattus norvegicus
tggactgagttcaagctgctcacat

SEQ ID NO: 629648 - DNA, 25 bp, Rattus norvegicus
tggactgagttctagctgctcacat

SEQ ID NO: 629649 - DNA, 25 bp, Rattus norvegicus
tggactgataatcacctctgaggta

SEQ ID NO: 629650 - DNA, 25 bp, Rattus norvegicus
tggactgataatgacctctgaggta

SEQ ID NO: 629651 - DNA, 25 bp, Rattus norvegicus
tggactgatggtcccattgtggact

SEQ ID NO: 629652 - DNA, 25 bp, Rattus norvegicus
tggactgatggtgccattgtggact

SEQ ID NO: 629653 - DNA, 25 bp, Rattus norvegicus
tggactgcaagtactcagagccgct

SEQ ID NO: 629654 - DNA, 25 bp, Rattus norvegicus
tggactgcaagttctcagagccgct

SEQ ID NO: 629655 - DNA, 25 bp, Rattus norvegicus
tggactgcaccacataggcgacttg

SEQ ID NO: 629656 - DNA, 25 bp, Rattus norvegicus
tggactgcaccagataggcgacttg

SEQ ID NO: 629657 - DNA, 25 bp, Rattus norvegicus
tggactgcagccctactatggaatg

SEQ ID NO: 629658 - DNA, 25 bp, Rattus norvegicus
tggactgcagccgtactatggaatg

SEQ ID NO: 629659 - DNA, 25 bp, Rattus norvegicus
tggactgcccatacttttgctgtca

SEQ ID NO: 629660 - DNA, 25 bp, Rattus norvegicus
tggactgcccattcttttgctgtca

SEQ ID NO: 629661 - DNA, 25 bp, Rattus norvegicus
tggactgcgagtccacccagggttc

SEQ ID NO: 629662 - DNA, 25 bp, Rattus norvegicus
tggactgcgagtgcacccagggttc

SEQ ID NO: 629663 - DNA, 25 bp, Rattus norvegicus
tggactgctctacgcactacagggt

SEQ ID NO: 629664 - DNA, 25 bp, Rattus norvegicus
tggactgctctaggcactacagggt

SEQ ID NO: 629665 - DNA, 25 bp, Rattus norvegicus
tggactgctctgatctgcttttatc

SEQ ID NO: 629666 - DNA, 25 bp, Rattus norvegicus
tggactgctctgttctgcttttatc

SEQ ID NO: 629667 - DNA, 25 bp, Rattus norvegicus
tggactgctggacctgaaagccctg

SEQ ID NO: 629668 - DNA, 25 bp, Rattus norvegicus
tggactgctggagctgaaagccctg

SEQ ID NO: 629669 - DNA, 25 bp, Rattus norvegicus
tggactgctgtgatattggcttcaa

SEQ ID NO: 629670 - DNA, 25 bp, Rattus norvegicus
tggactgctgtgttattggcttcaa

SEQ ID NO: 629671 - DNA, 25 bp, Rattus norvegicus
tggactgcttgacggcttaccactc

SEQ ID NO: 629672 - DNA, 25 bp, Rattus norvegicus
tggactgcttgagggcttaccactc

SEQ ID NO: 629673 - DNA, 25 bp, Rattus norvegicus
tggactggacaaccaacctcctgag

SEQ ID NO: 629674 - DNA, 25 bp, Rattus norvegicus
tggactggacaagcaacctcctgag

SEQ ID NO: 629675 - DNA, 25 bp, Rattus norvegicus
tggactggacccagctcttgtggag

SEQ ID NO: 629676 - DNA, 25 bp, Rattus norvegicus
tggactggaccctgctcttgtggag

SEQ ID NO: 629677 - DNA, 25 bp, Rattus norvegicus
tggactggacctaggatggcagcct

SEQ ID NO: 629678 - DNA, 25 bp, Rattus norvegicus
tggactggaccttggatggcagcct

SEQ ID NO: 629679 - DNA, 25 bp, Rattus norvegicus
tggactggactcagcagttttccat

SEQ ID NO: 629680 - DNA, 25 bp, Rattus norvegicus
tggactggactctgcagttttccat

SEQ ID NO: 629681 - DNA, 25 bp, Rattus norvegicus
tggactggcacaaccatccaaatac

SEQ ID NO: 629682 - DNA, 25 bp, Rattus norvegicus
tggactggcacatccatccaaatac

SEQ ID NO: 629683 - DNA, 25 bp, Rattus norvegicus
tggactggcagtaatcgagattctt

SEQ ID NO: 629684 - DNA, 25 bp, Rattus norvegicus
tggactggcagttatcgagattctt

SEQ ID NO: 629685 - DNA, 25 bp, Rattus norvegicus
tggactggcattcattcctctgagg

SEQ ID NO: 629686 - DNA, 25 bp, Rattus norvegicus
tggactggcattgattcctctgagg

SEQ ID NO: 629687 - DNA, 25 bp, Rattus norvegicus
tggactggccacatgaatgcttagt

SEQ ID NO: 629688 - DNA, 25 bp, Rattus norvegicus
tggactggccacttgaatgcttagt

SEQ ID NO: 629689 - DNA, 25 bp, Rattus norvegicus
tggactggccgcagggtacattcgc

SEQ ID NO: 629690 - DNA, 25 bp, Rattus norvegicus
tggactggccgctgggtacattcgc

SEQ ID NO: 629691 - DNA, 25 bp, Rattus norvegicus
tggactggctctcaaaagacccttc

SEQ ID NO: 629692 - DNA, 25 bp, Rattus norvegicus
tggactggctctgaaaagacccttc

SEQ ID NO: 629693 - DNA, 25 bp, Rattus norvegicus
tggactggctgcagtggtcacagct

SEQ ID NO: 629694 - DNA, 25 bp, Rattus norvegicus
tggactggctgctgtggtcacagct

SEQ ID NO: 629695 - DNA, 25 bp, Rattus norvegicus
tggactgggccacggcgcgcgcgag

SEQ ID NO: 629696 - DNA, 25 bp, Rattus norvegicus
tggactgggccagggcgcgcgcgag

SEQ ID NO: 629697 - DNA, 25 bp, Rattus norvegicus
tggactgggcgtcatagtgcacacc

SEQ ID NO: 629698 - DNA, 25 bp, Rattus norvegicus
tggactgggcgtgatagtgcacacc

SEQ ID NO: 629699 - DNA, 25 bp, Rattus norvegicus
tggactgtaagcatcagccatgata

SEQ ID NO: 629700 - DNA, 25 bp, Rattus norvegicus
tggactgtaagcttcagccatgata

SEQ ID NO: 629701 - DNA, 25 bp, Rattus norvegicus
tggactgtatctagatggcgcacgc

SEQ ID NO: 629702 - DNA, 25 bp, Rattus norvegicus
tggactgtatcttgatggcgcacgc

SEQ ID NO: 629703 - DNA, 25 bp, Rattus norvegicus
tggactgtcacgcatttgaattcat

SEQ ID NO: 629704 - DNA, 25 bp, Rattus norvegicus
tggactgtcacggatttgaattcat

SEQ ID NO: 629705 - DNA, 25 bp, Rattus norvegicus
tggactgtcagaccttatgcataca

SEQ ID NO: 629706 - DNA, 25 bp, Rattus norvegicus
tggactgtcagagcttatgcataca

SEQ ID NO: 629707 - DNA, 25 bp, Rattus norvegicus
tggactgtccagaaagcccacccaa

SEQ ID NO: 629708 - DNA, 25 bp, Rattus norvegicus
tggactgtccagtaagcccacccaa

SEQ ID NO: 629709 - DNA, 25 bp, Rattus norvegicus
tggactgtctctactgcctgagaac

SEQ ID NO: 629710 - DNA, 25 bp, Rattus norvegicus
tggactgtctcttctgcctgagaac

SEQ ID NO: 629711 - DNA, 25 bp, Rattus norvegicus
tggactgtctgtacgccaagtgtat

SEQ ID NO: 629712 - DNA, 25 bp, Rattus norvegicus
tggactgtctgttcgccaagtgtat

SEQ ID NO: 629713 - DNA, 25 bp, Rattus norvegicus
tggactgtgcccaaagacggttctc

SEQ ID NO: 629714 - DNA, 25 bp, Rattus norvegicus
tggactgtgccctaagacggttctc

SEQ ID NO: 629715 - DNA, 25 bp, Rattus norvegicus
tggactgtgcgtccctcaaggaaaa

SEQ ID NO: 629716 - DNA, 25 bp, Rattus norvegicus
tggactgtgcgtgcctcaaggaaaa

SEQ ID NO: 629717 - DNA, 25 bp, Rattus norvegicus
tggactgtgtggacccacctctggc

SEQ ID NO: 629718 - DNA, 25 bp, Rattus norvegicus
tggactgtgtggtcccacctctggc

SEQ ID NO: 629719 - DNA, 25 bp, Rattus norvegicus
tggactgttatcaaccacccggatg

SEQ ID NO: 629720 - DNA, 25 bp, Rattus norvegicus
tggactgttatctaccacccggatg

SEQ ID NO: 629721 - DNA, 25 bp, Rattus norvegicus
tggactgttgctagatagtgtatca

SEQ ID NO: 629722 - DNA, 25 bp, Rattus norvegicus
tggactgttgcttgatagtgtatca

SEQ ID NO: 629723 - DNA, 25 bp, Rattus norvegicus
tggacttaaagtagggccccgccat

SEQ ID NO: 629724 - DNA, 25 bp, Rattus norvegicus
tggacttaaagttgggccccgccat

SEQ ID NO: 629725 - DNA, 25 bp, Rattus norvegicus
tggacttaacctaacttggacttgg

SEQ ID NO: 629726 - DNA, 25 bp, Rattus norvegicus
tggacttaaccttacttggacttgg

SEQ ID NO: 629727 - DNA, 25 bp, Rattus norvegicus
tggacttactctcttgggcgacaga

SEQ ID NO: 629728 - DNA, 25 bp, Rattus norvegicus
tggacttactctgttgggcgacaga

SEQ ID NO: 629729 - DNA, 25 bp, Rattus norvegicus
tggacttagaataacaggcagttgt

SEQ ID NO: 629730 - DNA, 25 bp, Rattus norvegicus
tggacttagaattacaggcagttgt

SEQ ID NO: 629731 - DNA, 25 bp, Rattus norvegicus
tggacttagacaaaccactgccaag

SEQ ID NO: 629732 - DNA, 25 bp, Rattus norvegicus
tggacttagacataccactgccaag

SEQ ID NO: 629733 - DNA, 25 bp, Rattus norvegicus
tggacttagctgaagcctgacggat

SEQ ID NO: 629734 - DNA, 25 bp, Rattus norvegicus
tggacttagctgtagcctgacggat

SEQ ID NO: 629735 - DNA, 25 bp, Rattus norvegicus
tggacttagtgtcgaagatctcccc

SEQ ID NO: 629736 - DNA, 25 bp, Rattus norvegicus
tggacttagtgtggaagatctcccc

SEQ ID NO: 629737 - DNA, 25 bp, Rattus norvegicus
tggacttcacctcggacgagtggca

SEQ ID NO: 629738 - DNA, 25 bp, Rattus norvegicus
tggacttcacctgggacgagtggca

SEQ ID NO: 629739 - DNA, 25 bp, Rattus norvegicus
tggacttcactgattattcttgtac

SEQ ID NO: 629740 - DNA, 25 bp, Rattus norvegicus
tggacttcactgtttattcttgtac

SEQ ID NO: 629741 - DNA, 25 bp, Rattus norvegicus
tggacttcagaacgctgcactcatg

SEQ ID NO: 629742 - DNA, 25 bp, Rattus norvegicus
tggacttcagaaggctgcactcatg

SEQ ID NO: 629743 - DNA, 25 bp, Rattus norvegicus
tggacttcagagagcctccacgggt

SEQ ID NO: 629744 - DNA, 25 bp, Rattus norvegicus
tggacttcagagtgcctccacgggt

SEQ ID NO: 629745 - DNA, 25 bp, Rattus norvegicus
tggacttcagttagcagccctgcgt

SEQ ID NO: 629746 - DNA, 25 bp, Rattus norvegicus
tggacttcagtttgcagccctgcgt

SEQ ID NO: 629747 - DNA, 25 bp, Rattus norvegicus
tggacttccctgcagatcgtgacca

SEQ ID NO: 629748 - DNA, 25 bp, Rattus norvegicus
tggacttccctggagatcgtgacca

SEQ ID NO: 629749 - DNA, 25 bp, Rattus norvegicus
tggacttcccttcttttcatttgta

SEQ ID NO: 629750 - DNA, 25 bp, Rattus norvegicus
tggacttcccttgttttcatttgta

SEQ ID NO: 629751 - DNA, 25 bp, Rattus norvegicus
tggacttccgggagtgcagagcgct

SEQ ID NO: 629752 - DNA, 25 bp, Rattus norvegicus
tggacttccgggtgtgcagagcgct

SEQ ID NO: 629753 - DNA, 25 bp, Rattus norvegicus
tggacttcctgaaagccaaggcggc

SEQ ID NO: 629754 - DNA, 25 bp, Rattus norvegicus
tggacttcctgaaattgttgataca

SEQ ID NO: 629755 - DNA, 25 bp, Rattus norvegicus
tggacttcctgacttctgacagcac

SEQ ID NO: 629756 - DNA, 25 bp, Rattus norvegicus
tggacttcctgagttctgacagcac

SEQ ID NO: 629757 - DNA, 25 bp, Rattus norvegicus
tggacttcctgatagccaaggcggc

SEQ ID NO: 629758 - DNA, 25 bp, Rattus norvegicus
tggacttcctgatattgttgataca

SEQ ID NO: 629759 - DNA, 25 bp, Rattus norvegicus
tggacttcctgcacctttggaaacc

SEQ ID NO: 629760 - DNA, 25 bp, Rattus norvegicus
tggacttcctgctcctttggaaacc

SEQ ID NO: 629761 - DNA, 25 bp, Rattus norvegicus
tggacttcgggtagccttattttct

SEQ ID NO: 629762 - DNA, 25 bp, Rattus norvegicus
tggacttcgggttgccttattttct

SEQ ID NO: 629763 - DNA, 25 bp, Rattus norvegicus
tggacttcgttacactcttcaggaa

SEQ ID NO: 629764 - DNA, 25 bp, Rattus norvegicus
tggacttcgttagactcttcaggaa

SEQ ID NO: 629765 - DNA, 25 bp, Rattus norvegicus
tggacttctagacttcccctcctgt

SEQ ID NO: 629766 - DNA, 25 bp, Rattus norvegicus
tggacttctagagttcccctcctgt

SEQ ID NO: 629767 - DNA, 25 bp, Rattus norvegicus
tggacttctaggcacgctccttggc

SEQ ID NO: 629768 - DNA, 25 bp, Rattus norvegicus
tggacttctagggacgctccttggc

SEQ ID NO: 629769 - DNA, 25 bp, Rattus norvegicus
tggacttctcaactcacagacctag

SEQ ID NO: 629770 - DNA, 25 bp, Rattus norvegicus
tggacttctcaagtcacagacctag

SEQ ID NO: 629771 - DNA, 25 bp, Rattus norvegicus
tggacttctgtcagtcccgctaaaa

SEQ ID NO: 629772 - DNA, 25 bp, Rattus norvegicus
tggacttctgtctgtcccgctaaaa

SEQ ID NO: 629773 - DNA, 25 bp, Rattus norvegicus
tggacttcttttcagccagcctgat

SEQ ID NO: 629774 - DNA, 25 bp, Rattus norvegicus
tggacttcttttgagccagcctgat

SEQ ID NO: 629775 - DNA, 25 bp, Rattus norvegicus
tggacttgaagacgaccctcctgac

SEQ ID NO: 629776 - DNA, 25 bp, Rattus norvegicus
tggacttgaagaggaccctcctgac

SEQ ID NO: 629777 - DNA, 25 bp, Rattus norvegicus
tggacttgacagattcagattttca

SEQ ID NO: 629778 - DNA, 25 bp, Rattus norvegicus
tggacttgacagtttcagattttca

SEQ ID NO: 629779 - DNA, 25 bp, Rattus norvegicus
tggacttgcagcagcaatcgcggga

SEQ ID NO: 629780 - DNA, 25 bp, Rattus norvegicus
tggacttgcagctgcaatcgcggga

SEQ ID NO: 629781 - DNA, 25 bp, Rattus norvegicus
tggacttgccatcatagctgcccat

SEQ ID NO: 629782 - DNA, 25 bp, Rattus norvegicus
tggacttgccatgatagctgcccat

SEQ ID NO: 629783 - DNA, 25 bp, Rattus norvegicus
tggacttgctagcagcctctgtcag

SEQ ID NO: 629784 - DNA, 25 bp, Rattus norvegicus
tggacttgctaggagcctctgtcag

SEQ ID NO: 629785 - DNA, 25 bp, Rattus norvegicus
tggacttgctctcccaacagtggtc

SEQ ID NO: 629786 - DNA, 25 bp, Rattus norvegicus
tggacttgctctgccaacagtggtc

SEQ ID NO: 629787 - DNA, 25 bp, Rattus norvegicus
tggacttgctgcaggaagccgtgac

SEQ ID NO: 629788 - DNA, 25 bp, Rattus norvegicus
tggacttgctgctggaagccgtgac

SEQ ID NO: 629789 - DNA, 25 bp, Rattus norvegicus
tggacttgcttgcaagccgaccgac

SEQ ID NO: 629790 - DNA, 25 bp, Rattus norvegicus
tggacttgcttggaagccgaccgac

SEQ ID NO: 629791 - DNA, 25 bp, Rattus norvegicus
tggacttggtgtcaaatcgccatcc

SEQ ID NO: 629792 - DNA, 25 bp, Rattus norvegicus
tggacttggtgtgaaatcgccatcc

SEQ ID NO: 629793 - DNA, 25 bp, Rattus norvegicus
tggacttgtttcacccgtcaggaag

SEQ ID NO: 629794 - DNA, 25 bp, Rattus norvegicus
tggacttgtttctcccgtcaggaag

SEQ ID NO: 629795 - DNA, 25 bp, Rattus norvegicus
tggactttacatcttcacctgacat

SEQ ID NO: 629796 - DNA, 25 bp, Rattus norvegicus
tggactttacatgttcacctgacat

SEQ ID NO: 629797 - DNA, 25 bp, Rattus norvegicus
tggactttacccagtggctcatggt

SEQ ID NO: 629798 - DNA, 25 bp, Rattus norvegicus
tggactttaccctgtggctcatggt

SEQ ID NO: 629799 - DNA, 25 bp, Rattus norvegicus
tggactttagcgacattgcccagaa

SEQ ID NO: 629800 - DNA, 25 bp, Rattus norvegicus
tggactttagcgtcattgcccagaa

SEQ ID NO: 629801 - DNA, 25 bp, Rattus norvegicus
tggactttctgacctcctgatcctg

SEQ ID NO: 629802 - DNA, 25 bp, Rattus norvegicus
tggactttctgagctcctgatcctg

SEQ ID NO: 629803 - DNA, 25 bp, Rattus norvegicus
tggactttcttaccttaacctctga

SEQ ID NO: 629804 - DNA, 25 bp, Rattus norvegicus
tggactttcttagcttaacctctga

SEQ ID NO: 629805 - DNA, 25 bp, Rattus norvegicus
tggactttgacaccctggtttgagc

SEQ ID NO: 629806 - DNA, 25 bp, Rattus norvegicus
tggactttgacagcctggtttgagc

SEQ ID NO: 629807 - DNA, 25 bp, Rattus norvegicus
tggactttgcccagacgcctctggc

SEQ ID NO: 629808 - DNA, 25 bp, Rattus norvegicus
tggactttgccctgacgcctctggc

SEQ ID NO: 629809 - DNA, 25 bp, Rattus norvegicus
tggactttgggaatgtgctcctgtc

SEQ ID NO: 629810 - DNA, 25 bp, Rattus norvegicus
tggactttgggattgtgctcctgtc

SEQ ID NO: 629811 - DNA, 25 bp, Rattus norvegicus
tggactttggtaaactttggctctt

SEQ ID NO: 629812 - DNA, 25 bp, Rattus norvegicus
tggactttggtatactttggctctt

SEQ ID NO: 629813 - DNA, 25 bp, Rattus norvegicus
tggactttgtccacagacttctctg

SEQ ID NO: 629814 - DNA, 25 bp, Rattus norvegicus
tggactttgtcctcagacttctctg

SEQ ID NO: 629815 - DNA, 25 bp, Rattus norvegicus
tggacttttaacagatcagcaggga

SEQ ID NO: 629816 - DNA, 25 bp, Rattus norvegicus
tggacttttaactgatcagcaggga

SEQ ID NO: 629817 - DNA, 25 bp, Rattus norvegicus
tggacttttactaaggccagttgta

SEQ ID NO: 629818 - DNA, 25 bp, Rattus norvegicus
tggacttttactactgttggcctta

SEQ ID NO: 629819 - DNA, 25 bp, Rattus norvegicus
tggacttttacttaggccagttgta

SEQ ID NO: 629820 - DNA, 25 bp, Rattus norvegicus
tggacttttacttctgttggcctta

SEQ ID NO: 629821 - DNA, 25 bp, Rattus norvegicus
tggacttttaggctgctgctaggaa

SEQ ID NO: 629822 - DNA, 25 bp, Rattus norvegicus
tggacttttagggtgctgctaggaa

SEQ ID NO: 629823 - DNA, 25 bp, Rattus norvegicus
tggacttttcctacatgccaatgat

SEQ ID NO: 629824 - DNA, 25 bp, Rattus norvegicus
tggacttttcctcctgaagcaaagc

SEQ ID NO: 629825 - DNA, 25 bp, Rattus norvegicus
tggacttttcctgctgaagcaaagc

SEQ ID NO: 629826 - DNA, 25 bp, Rattus norvegicus
tggacttttccttcatgccaatgat

SEQ ID NO: 629827 - DNA, 25 bp, Rattus norvegicus
tggacttttgctcagccaaaccggg

SEQ ID NO: 629828 - DNA, 25 bp, Rattus norvegicus
tggacttttgctgagccaaaccggg

SEQ ID NO: 629829 - DNA, 25 bp, Rattus norvegicus
tggagaaacgtgacctggtcttgaa

SEQ ID NO: 629830 - DNA, 25 bp, Rattus norvegicus
tggagaaacgtgtcctggtcttgaa

SEQ ID NO: 629831 - DNA, 25 bp, Rattus norvegicus
tggagaaagctaccctttgctgaaa

SEQ ID NO: 629832 - DNA, 25 bp, Rattus norvegicus
tggagaaagctagcctttgctgaaa

SEQ ID NO: 629833 - DNA, 25 bp, Rattus norvegicus
tggagaaagtacctacacctggact

SEQ ID NO: 629834 - DNA, 25 bp, Rattus norvegicus
tggagaaagtacgtacacctggact

SEQ ID NO: 629835 - DNA, 25 bp, Rattus norvegicus
tggagaaatgtgacacctgtcccca

SEQ ID NO: 629836 - DNA, 25 bp, Rattus norvegicus
tggagaaatgtgtcacctgtcccca

SEQ ID NO: 629837 - DNA, 25 bp, Rattus norvegicus
tggagaaattctaccgcgatgcgaa

SEQ ID NO: 629838 - DNA, 25 bp, Rattus norvegicus
tggagaaattcttccgcgatgcgaa

SEQ ID NO: 629839 - DNA, 25 bp, Rattus norvegicus
tggagaacacctccatcaaggtggg

SEQ ID NO: 629840 - DNA, 25 bp, Rattus norvegicus
tggagaacacctgcatcaaggtggg

SEQ ID NO: 629841 - DNA, 25 bp, Rattus norvegicus
tggagaaccaccaatcccagtttag

SEQ ID NO: 629842 - DNA, 25 bp, Rattus norvegicus
tggagaaccacccagtgatccgaac

SEQ ID NO: 629843 - DNA, 25 bp, Rattus norvegicus
tggagaaccaccgagtgatccgaac

SEQ ID NO: 629844 - DNA, 25 bp, Rattus norvegicus
tggagaaccacctatcccagtttag

SEQ ID NO: 629845 - DNA, 25 bp, Rattus norvegicus
tggagaacgacaagagccccgctga

SEQ ID NO: 629846 - DNA, 25 bp, Rattus norvegicus
tggagaacgacatgagccccgctga

SEQ ID NO: 629847 - DNA, 25 bp, Rattus norvegicus
tggagaacgcgacgtttctttccct

SEQ ID NO: 629848 - DNA, 25 bp, Rattus norvegicus
tggagaacgcgaggtttctttccct

SEQ ID NO: 629849 - DNA, 25 bp, Rattus norvegicus
tggagaacgtggacaaagccctgca

SEQ ID NO: 629850 - DNA, 25 bp, Rattus norvegicus
tggagaacgtggtcaaagccctgca

SEQ ID NO: 629851 - DNA, 25 bp, Rattus norvegicus
tggagaactcacaagtactgccctg

SEQ ID NO: 629852 - DNA, 25 bp, Rattus norvegicus
tggagaactcactagtactgccctg

SEQ ID NO: 629853 - DNA, 25 bp, Rattus norvegicus
tggagaactcagcagatcctcactg

SEQ ID NO: 629854 - DNA, 25 bp, Rattus norvegicus
tggagaactcaggagatcctcactg

SEQ ID NO: 629855 - DNA, 25 bp, Rattus norvegicus
tggagaactctaccccagaaacttc

SEQ ID NO: 629856 - DNA, 25 bp, Rattus norvegicus
tggagaactctagcccagaaacttc

SEQ ID NO: 629857 - DNA, 25 bp, Rattus norvegicus
tggagaacttccctgtgacaaacgc

SEQ ID NO: 629858 - DNA, 25 bp, Rattus norvegicus
tggagaacttccgtgtgacaaacgc

SEQ ID NO: 629859 - DNA, 25 bp, Rattus norvegicus
tggagaagaaccaacactgtccttg

SEQ ID NO: 629860 - DNA, 25 bp, Rattus norvegicus
tggagaagaacctacactgtccttg

SEQ ID NO: 629861 - DNA, 25 bp, Rattus norvegicus
tggagaagaccgcagctgcacgcct

SEQ ID NO: 629862 - DNA, 25 bp, Rattus norvegicus
tggagaagaccggagctgcacgcct

SEQ ID NO: 629863 - DNA, 25 bp, Rattus norvegicus
tggagaagacctatgggcccgcctg

SEQ ID NO: 629864 - DNA, 25 bp, Rattus norvegicus
tggagaagacctttgggcccgcctg

SEQ ID NO: 629865 - DNA, 25 bp, Rattus norvegicus
tggagaagagcaccattcagacccc

SEQ ID NO: 629866 - DNA, 25 bp, Rattus norvegicus
tggagaagagcagcattcagacccc

SEQ ID NO: 629867 - DNA, 25 bp, Rattus norvegicus
tggagaagatccaaggacccatccc

SEQ ID NO: 629868 - DNA, 25 bp, Rattus norvegicus
tggagaagatccagctttcggtggt

SEQ ID NO: 629869 - DNA, 25 bp, Rattus norvegicus
tggagaagatcctaggacccatccc

SEQ ID NO: 629870 - DNA, 25 bp, Rattus norvegicus
tggagaagatcctgctttcggtggt

SEQ ID NO: 629871 - DNA, 25 bp, Rattus norvegicus
tggagaagcaccagccatttcaact

SEQ ID NO: 629872 - DNA, 25 bp, Rattus norvegicus
tggagaagcacctgccatttcaact

SEQ ID NO: 629873 - DNA, 25 bp, Rattus norvegicus
tggagaagcagcctgccacaggcct

SEQ ID NO: 629874 - DNA, 25 bp, Rattus norvegicus
tggagaagcagcgtgccacaggcct

SEQ ID NO: 629875 - DNA, 25 bp, Rattus norvegicus
tggagaagccataggcctctctgaa

SEQ ID NO: 629876 - DNA, 25 bp, Rattus norvegicus
tggagaagccattggcctctctgaa

SEQ ID NO: 629877 - DNA, 25 bp, Rattus norvegicus
tggagaagctgacccgacgtcagcc

SEQ ID NO: 629878 - DNA, 25 bp, Rattus norvegicus
tggagaagctgagccgacgtcagcc

SEQ ID NO: 629879 - DNA, 25 bp, Rattus norvegicus
tggagaagggctacatccctgcgct

SEQ ID NO: 629880 - DNA, 25 bp, Rattus norvegicus
tggagaagggcttcatccctgcgct

SEQ ID NO: 629881 - DNA, 25 bp, Rattus norvegicus
tggagaaggtccagcctcgggtcat

SEQ ID NO: 629882 - DNA, 25 bp, Rattus norvegicus
tggagaaggtcctgcctcgggtcat

SEQ ID NO: 629883 - DNA, 25 bp, Rattus norvegicus
tggagaagtatcagcccattcctag

SEQ ID NO: 629884 - DNA, 25 bp, Rattus norvegicus
tggagaagtatctgcccattcctag

SEQ ID NO: 629885 - DNA, 25 bp, Rattus norvegicus
tggagaagtgtcagttctctctgcc

SEQ ID NO: 629886 - DNA, 25 bp, Rattus norvegicus
tggagaagtgtctgttctctctgcc

SEQ ID NO: 629887 - DNA, 25 bp, Rattus norvegicus
tggagaataacaccttcgccgtctt

SEQ ID NO: 629888 - DNA, 25 bp, Rattus norvegicus
tggagaataacagcttcgccgtctt

SEQ ID NO: 629889 - DNA, 25 bp, Rattus norvegicus
tggagaatacccacctgctagaggt

SEQ ID NO: 629890 - DNA, 25 bp, Rattus norvegicus
tggagaataccctcctgctagaggt

SEQ ID NO: 629891 - DNA, 25 bp, Rattus norvegicus
tggagaatccttcctgaatctgatt

SEQ ID NO: 629892 - DNA, 25 bp, Rattus norvegicus
tggagaatccttgctgaatctgatt

SEQ ID NO: 629893 - DNA, 25 bp, Rattus norvegicus
tggagaatgccactccacagccctt

SEQ ID NO: 629894 - DNA, 25 bp, Rattus norvegicus
tggagaatgccagtccacagccctt

SEQ ID NO: 629895 - DNA, 25 bp, Rattus norvegicus
tggagaatggttctgccctccttgc

SEQ ID NO: 629896 - DNA, 25 bp, Rattus norvegicus
tggagaatggttgtgccctccttgc

SEQ ID NO: 629897 - DNA, 25 bp, Rattus norvegicus
tggagaatgtccatgcaccctgaaa

SEQ ID NO: 629898 - DNA, 25 bp, Rattus norvegicus
tggagaatgtccttgcaccctgaaa

SEQ ID NO: 629899 - DNA, 25 bp, Rattus norvegicus
tggagaatgttcatgcacatccccg

SEQ ID NO: 629900 - DNA, 25 bp, Rattus norvegicus
tggagaatgttcttgcacatccccg

SEQ ID NO: 629901 - DNA, 25 bp, Rattus norvegicus
tggagaatgtttccactctccttca

SEQ ID NO: 629902 - DNA, 25 bp, Rattus norvegicus
tggagaatgtttgcactctccttca

SEQ ID NO: 629903 - DNA, 25 bp, Rattus norvegicus
tggagaattcctcgcggcgtcacag

SEQ ID NO: 629904 - DNA, 25 bp, Rattus norvegicus
tggagaattcctggcggcgtcacag

SEQ ID NO: 629905 - DNA, 25 bp, Rattus norvegicus
tggagaattttcacacaccccttta

SEQ ID NO: 629906 - DNA, 25 bp, Rattus norvegicus
tggagaattttctcacaccccttta

SEQ ID NO: 629907 - DNA, 25 bp, Rattus norvegicus
tggagaatttttcgtgacacacact

SEQ ID NO: 629908 - DNA, 25 bp, Rattus norvegicus
tggagaatttttggtgacacacact

SEQ ID NO: 629909 - DNA, 25 bp, Rattus norvegicus
tggagacaactccaacttttccctg

SEQ ID NO: 629910 - DNA, 25 bp, Rattus norvegicus
tggagacaactcgaacttttccctg

SEQ ID NO: 629911 - DNA, 25 bp, Rattus norvegicus
tggagacaagaacccctgatatcaa

SEQ ID NO: 629912 - DNA, 25 bp, Rattus norvegicus
tggagacaagaagccctgatatcaa

SEQ ID NO: 629913 - DNA, 25 bp, Rattus norvegicus
tggagacaaggcctagacccgagct

SEQ ID NO: 629914 - DNA, 25 bp, Rattus norvegicus
tggagacaaggcgtagacccgagct

SEQ ID NO: 629915 - DNA, 25 bp, Rattus norvegicus
tggagacaatccaggccttatgcat

SEQ ID NO: 629916 - DNA, 25 bp, Rattus norvegicus
tggagacaatcctggccttatgcat

SEQ ID NO: 629917 - DNA, 25 bp, Rattus norvegicus
tggagacacatcacagggtgggcct

SEQ ID NO: 629918 - DNA, 25 bp, Rattus norvegicus
tggagacacatctcagggtgggcct

SEQ ID NO: 629919 - DNA, 25 bp, Rattus norvegicus
tggagacaccttcaatgcctctgtc

SEQ ID NO: 629920 - DNA, 25 bp, Rattus norvegicus
tggagacaccttgaatgcctctgtc

SEQ ID NO: 629921 - DNA, 25 bp, Rattus norvegicus
tggagacactggcagcttcatccct

SEQ ID NO: 629922 - DNA, 25 bp, Rattus norvegicus
tggagacactgggagcttcatccct

SEQ ID NO: 629923 - DNA, 25 bp, Rattus norvegicus
tggagacactttcccacaagcctgt

SEQ ID NO: 629924 - DNA, 25 bp, Rattus norvegicus
tggagacactttgccacaagcctgt

SEQ ID NO: 629925 - DNA, 25 bp, Rattus norvegicus
tggagacagacacccatcttgttga

SEQ ID NO: 629926 - DNA, 25 bp, Rattus norvegicus
tggagacagacagccatcttgttga

SEQ ID NO: 629927 - DNA, 25 bp, Rattus norvegicus
tggagacagtcacctgccatgttca

SEQ ID NO: 629928 - DNA, 25 bp, Rattus norvegicus
tggagacagtcagctgccatgttca

SEQ ID NO: 629929 - DNA, 25 bp, Rattus norvegicus
tggagacatgatcctgtgcactcat

SEQ ID NO: 629930 - DNA, 25 bp, Rattus norvegicus
tggagacatgatgctgtgcactcat

SEQ ID NO: 629931 - DNA, 25 bp, Rattus norvegicus
tggagacatggtcccacgcagcctt

SEQ ID NO: 629932 - DNA, 25 bp, Rattus norvegicus
tggagacatggtgccacgcagcctt

SEQ ID NO: 629933 - DNA, 25 bp, Rattus norvegicus
tggagacatgtgaggcgtctgcact

SEQ ID NO: 629934 - DNA, 25 bp, Rattus norvegicus
tggagacatgtgtggcgtctgcact

SEQ ID NO: 629935 - DNA, 25 bp, Rattus norvegicus
tggagacattcacttgacctgggat

SEQ ID NO: 629936 - DNA, 25 bp, Rattus norvegicus
tggagacattcagttgacctgggat

SEQ ID NO: 629937 - DNA, 25 bp, Rattus norvegicus
tggagacattgaccgcattcaacca

SEQ ID NO: 629938 - DNA, 25 bp, Rattus norvegicus
tggagacattgagcgcattcaacca

SEQ ID NO: 629939 - DNA, 25 bp, Rattus norvegicus
tggagacatttaatgccacccgtgc

SEQ ID NO: 629940 - DNA, 25 bp, Rattus norvegicus
tggagacatttattgccacccgtgc

SEQ ID NO: 629941 - DNA, 25 bp, Rattus norvegicus
tggagaccaacacccacgtgaggaa

SEQ ID NO: 629942 - DNA, 25 bp, Rattus norvegicus
tggagaccaacagccacgtgaggaa

SEQ ID NO: 629943 - DNA, 25 bp, Rattus norvegicus
tggagaccacccagtggagctgctg

SEQ ID NO: 629944 - DNA, 25 bp, Rattus norvegicus
tggagaccaccctgtggagctgctg

SEQ ID NO: 629945 - DNA, 25 bp, Rattus norvegicus
tggagaccagcaacctgtgttgtca

SEQ ID NO: 629946 - DNA, 25 bp, Rattus norvegicus
tggagaccagcaacttttagagaag

SEQ ID NO: 629947 - DNA, 25 bp, Rattus norvegicus
tggagaccagcatcctgtgttgtca

SEQ ID NO: 629948 - DNA, 25 bp, Rattus norvegicus
tggagaccagcatcttttagagaag

SEQ ID NO: 629949 - DNA, 25 bp, Rattus norvegicus
tggagacccagtcccctgagagcag

SEQ ID NO: 629950 - DNA, 25 bp, Rattus norvegicus
tggagacccagtgccctgagagcag

SEQ ID NO: 629951 - DNA, 25 bp, Rattus norvegicus
tggagacccctcatggtgtcccgga

SEQ ID NO: 629952 - DNA, 25 bp, Rattus norvegicus
tggagacccctcttggtgtcccgga

SEQ ID NO: 629953 - DNA, 25 bp, Rattus norvegicus
tggagaccctgaagagctatcgcct

SEQ ID NO: 629954 - DNA, 25 bp, Rattus norvegicus
tggagaccctgatgagctatcgcct

SEQ ID NO: 629955 - DNA, 25 bp, Rattus norvegicus
tggagaccgtcaattcttccatcta

SEQ ID NO: 629956 - DNA, 25 bp, Rattus norvegicus
tggagaccgtcatttcttccatcta

SEQ ID NO: 629957 - DNA, 25 bp, Rattus norvegicus
tggagaccgtgaactgagcgtgcct

SEQ ID NO: 629958 - DNA, 25 bp, Rattus norvegicus
tggagaccgtgatctgagcgtgcct

SEQ ID NO: 629959 - DNA, 25 bp, Rattus norvegicus
tggagaccgtttagagagcagctct

SEQ ID NO: 629960 - DNA, 25 bp, Rattus norvegicus
tggagaccgttttgagagcagctct

SEQ ID NO: 629961 - DNA, 25 bp, Rattus norvegicus
tggagacctacaccagcctgatgtc

SEQ ID NO: 629962 - DNA, 25 bp, Rattus norvegicus
tggagacctacacgcagcgtgccaa

SEQ ID NO: 629963 - DNA, 25 bp, Rattus norvegicus
tggagacctacagcagcctgatgtc

SEQ ID NO: 629964 - DNA, 25 bp, Rattus norvegicus
tggagacctacaggcagcgtgccaa

SEQ ID NO: 629965 - DNA, 25 bp, Rattus norvegicus
tggagacctggtattcctatcggtt

SEQ ID NO: 629966 - DNA, 25 bp, Rattus norvegicus
tggagacctggttttcctatcggtt

SEQ ID NO: 629967 - DNA, 25 bp, Rattus norvegicus
tggagaccttctcagagttcctcga

SEQ ID NO: 629968 - DNA, 25 bp, Rattus norvegicus
tggagaccttctgagagttcctcga

SEQ ID NO: 629969 - DNA, 25 bp, Rattus norvegicus
tggagacgagttagagacccgcttc

SEQ ID NO: 629970 - DNA, 25 bp, Rattus norvegicus
tggagacgagtttgagacccgcttc

SEQ ID NO: 629971 - DNA, 25 bp, Rattus norvegicus
tggagacgatcaccgatcaccggca

SEQ ID NO: 629972 - DNA, 25 bp, Rattus norvegicus
tggagacgatcagcgatcaccggca

SEQ ID NO: 629973 - DNA, 25 bp, Rattus norvegicus
tggagacgcaagagccctgatctgg

SEQ ID NO: 629974 - DNA, 25 bp, Rattus norvegicus
tggagacgcaagtgccctgatctgg

SEQ ID NO: 629975 - DNA, 25 bp, Rattus norvegicus
tggagacgccctcccaaatggatgg

SEQ ID NO: 629976 - DNA, 25 bp, Rattus norvegicus
tggagacgccctgccaaatggatgg

SEQ ID NO: 629977 - DNA, 25 bp, Rattus norvegicus
tggagacggcctagtctacagagca

SEQ ID NO: 629978 - DNA, 25 bp, Rattus norvegicus
tggagacggccttgtctacagagca

SEQ ID NO: 629979 - DNA, 25 bp, Rattus norvegicus
tggagacgtctgatttccagtgctc

SEQ ID NO: 629980 - DNA, 25 bp, Rattus norvegicus
tggagacgtctgttttccagtgctc

SEQ ID NO: 629981 - DNA, 25 bp, Rattus norvegicus
tggagacgtggtcaagtcctcagaa

SEQ ID NO: 629982 - DNA, 25 bp, Rattus norvegicus
tggagacgtggtgaagtcctcagaa

SEQ ID NO: 629983 - DNA, 25 bp, Rattus norvegicus
tggagacgttcgagtttcaaccccg

SEQ ID NO: 629984 - DNA, 25 bp, Rattus norvegicus
tggagacgttcgtgtttcaaccccg

SEQ ID NO: 629985 - DNA, 25 bp, Rattus norvegicus
tggagactagttcatctgcgcctct

SEQ ID NO: 629986 - DNA, 25 bp, Rattus norvegicus
tggagactagttgatctgcgcctct

SEQ ID NO: 629987 - DNA, 25 bp, Rattus norvegicus
tggagactcaccagcaaatgtagat

SEQ ID NO: 629988 - DNA, 25 bp, Rattus norvegicus
tggagactcacccagctgtttctca

SEQ ID NO: 629989 - DNA, 25 bp, Rattus norvegicus
tggagactcaccgagctgtttctca

SEQ ID NO: 629990 - DNA, 25 bp, Rattus norvegicus
tggagactcacctgcaaatgtagat

SEQ ID NO: 629991 - DNA, 25 bp, Rattus norvegicus
tggagactcactaaccacctgtaac

SEQ ID NO: 629992 - DNA, 25 bp, Rattus norvegicus
tggagactcacttaccacctgtaac

SEQ ID NO: 629993 - DNA, 25 bp, Rattus norvegicus
tggagactcagaccccagttagaaa

SEQ ID NO: 629994 - DNA, 25 bp, Rattus norvegicus
tggagactcagagcccagttagaaa

SEQ ID NO: 629995 - DNA, 25 bp, Rattus norvegicus
tggagactcatgaagaacaggattc

SEQ ID NO: 629996 - DNA, 25 bp, Rattus norvegicus
tggagactcatgtagaacaggattc

SEQ ID NO: 629997 - DNA, 25 bp, Rattus norvegicus
tggagactccaccaactccagcgag

SEQ ID NO: 629998 - DNA, 25 bp, Rattus norvegicus
tggagactccacgaactccagcgag

SEQ ID NO: 629999 - DNA, 25 bp, Rattus norvegicus
tggagactcgggacccggcctggga

SEQ ID NO: 630000 - DNA, 25 bp, Rattus norvegicus
tggagactcgggtcccggcctggga

SEQ ID NO: 630001 - DNA, 25 bp, Rattus norvegicus
tggagactctcacctgacatgttgt

SEQ ID NO: 630002 - DNA, 25 bp, Rattus norvegicus
tggagactctcagctgacatgttgt

SEQ ID NO: 630003 - DNA, 25 bp, Rattus norvegicus
tggagactctgaattgctgtgacaa

SEQ ID NO: 630004 - DNA, 25 bp, Rattus norvegicus
tggagactctgatttgctgtgacaa

SEQ ID NO: 630005 - DNA, 25 bp, Rattus norvegicus
tggagactgaaccagggtcctctgc

SEQ ID NO: 630006 - DNA, 25 bp, Rattus norvegicus
tggagactgaacgagggtcctctgc

SEQ ID NO: 630007 - DNA, 25 bp, Rattus norvegicus
tggagactgacaatctgagagcccc

SEQ ID NO: 630008 - DNA, 25 bp, Rattus norvegicus
tggagactgacacattagcctgaaa

SEQ ID NO: 630009 - DNA, 25 bp, Rattus norvegicus
tggagactgacagattagcctgaaa

SEQ ID NO: 630010 - DNA, 25 bp, Rattus norvegicus
tggagactgacattctgagagcccc

SEQ ID NO: 630011 - DNA, 25 bp, Rattus norvegicus
tggagactgcagaccgccccaggtt

SEQ ID NO: 630012 - DNA, 25 bp, Rattus norvegicus
tggagactgcagtccgccccaggtt

SEQ ID NO: 630013 - DNA, 25 bp, Rattus norvegicus
tggagactgccacccggaggaacat

SEQ ID NO: 630014 - DNA, 25 bp, Rattus norvegicus
tggagactgccacctgacacctgac

SEQ ID NO: 630015 - DNA, 25 bp, Rattus norvegicus
tggagactgccagccggaggaacat

SEQ ID NO: 630016 - DNA, 25 bp, Rattus norvegicus
tggagactgccagctgacacctgac

SEQ ID NO: 630017 - DNA, 25 bp, Rattus norvegicus
tggagactgccgaactaactctact

SEQ ID NO: 630018 - DNA, 25 bp, Rattus norvegicus
tggagactgccgtactaactctact

SEQ ID NO: 630019 - DNA, 25 bp, Rattus norvegicus
tggagactggcacagtgctcactct

SEQ ID NO: 630020 - DNA, 25 bp, Rattus norvegicus
tggagactggcagagtgctcactct

SEQ ID NO: 630021 - DNA, 25 bp, Rattus norvegicus
tggagactggctacccttatagcaa

SEQ ID NO: 630022 - DNA, 25 bp, Rattus norvegicus
tggagactggcttcccttatagcaa

SEQ ID NO: 630023 - DNA, 25 bp, Rattus norvegicus
tggagactgtttagtgtttggcttc

SEQ ID NO: 630024 - DNA, 25 bp, Rattus norvegicus
tggagactgttttgtgtttggcttc

SEQ ID NO: 630025 - DNA, 25 bp, Rattus norvegicus
tggagacttcagaagcctcccacat

SEQ ID NO: 630026 - DNA, 25 bp, Rattus norvegicus
tggagacttcagtagcctcccacat

SEQ ID NO: 630027 - DNA, 25 bp, Rattus norvegicus
tggagacttccactacctggatggg

SEQ ID NO: 630028 - DNA, 25 bp, Rattus norvegicus
tggagacttccagtacctggatggg

SEQ ID NO: 630029 - DNA, 25 bp, Rattus norvegicus
tggagacttctcactgtttcatcaa

SEQ ID NO: 630030 - DNA, 25 bp, Rattus norvegicus
tggagacttctctctgtttcatcaa

SEQ ID NO: 630031 - DNA, 25 bp, Rattus norvegicus
tggagacttctgagcgctaatctgc

SEQ ID NO: 630032 - DNA, 25 bp, Rattus norvegicus
tggagacttctgtgcgctaatctgc

SEQ ID NO: 630033 - DNA, 25 bp, Rattus norvegicus
tggagactttaaacccagcatctgg

SEQ ID NO: 630034 - DNA, 25 bp, Rattus norvegicus
tggagactttaacacttgggtcagt

SEQ ID NO: 630035 - DNA, 25 bp, Rattus norvegicus
tggagactttaagacttgggtcagt

SEQ ID NO: 630036 - DNA, 25 bp, Rattus norvegicus
tggagactttaatcccagcatctgg

SEQ ID NO: 630037 - DNA, 25 bp, Rattus norvegicus
tggagactttcaactttccgtcatg

SEQ ID NO: 630038 - DNA, 25 bp, Rattus norvegicus
tggagactttcatctttccgtcatg

SEQ ID NO: 630039 - DNA, 25 bp, Rattus norvegicus
tggagactttgaatcctacacgaag

SEQ ID NO: 630040 - DNA, 25 bp, Rattus norvegicus
tggagactttgaccacacaatcttc

SEQ ID NO: 630041 - DNA, 25 bp, Rattus norvegicus
tggagactttgagcacacaatcttc

SEQ ID NO: 630042 - DNA, 25 bp, Rattus norvegicus
tggagactttgattcctacacgaag

SEQ ID NO: 630043 - DNA, 25 bp, Rattus norvegicus
tggagagaagccaacgtcgctgtca

SEQ ID NO: 630044 - DNA, 25 bp, Rattus norvegicus
tggagagaagcctacgtcgctgtca

SEQ ID NO: 630045 - DNA, 25 bp, Rattus norvegicus
tggagagacacaaccagggtgcgct

SEQ ID NO: 630046 - DNA, 25 bp, Rattus norvegicus
tggagagacacatccagggtgcgct

SEQ ID NO: 630047 - DNA, 25 bp, Rattus norvegicus
tggagagaccacagcctcaccagaa

SEQ ID NO: 630048 - DNA, 25 bp, Rattus norvegicus
tggagagaccactgcctcaccagaa

SEQ ID NO: 630049 - DNA, 25 bp, Rattus norvegicus
tggagagaccgcacagagcgcactg

SEQ ID NO: 630050 - DNA, 25 bp, Rattus norvegicus
tggagagaccgctcagagcgcactg

SEQ ID NO: 630051 - DNA, 25 bp, Rattus norvegicus
tggagagacctgagggccctgcttt

SEQ ID NO: 630052 - DNA, 25 bp, Rattus norvegicus
tggagagacctgtgggccctgcttt

SEQ ID NO: 630053 - DNA, 25 bp, Rattus norvegicus
tggagagactgcacttgcctcttct

SEQ ID NO: 630054 - DNA, 25 bp, Rattus norvegicus
tggagagactgctcttgcctcttct

SEQ ID NO: 630055 - DNA, 25 bp, Rattus norvegicus
tggagagagaccctcttaagcccct

SEQ ID NO: 630056 - DNA, 25 bp, Rattus norvegicus
tggagagagaccgtcttaagcccct

SEQ ID NO: 630057 - DNA, 25 bp, Rattus norvegicus
tggagagagctcctttccacatgat

SEQ ID NO: 630058 - DNA, 25 bp, Rattus norvegicus
tggagagagctcgtttccacatgat

SEQ ID NO: 630059 - DNA, 25 bp, Rattus norvegicus
tggagagaggcgacttccgcagctt

SEQ ID NO: 630060 - DNA, 25 bp, Rattus norvegicus
tggagagaggcgtcttccgcagctt

SEQ ID NO: 630061 - DNA, 25 bp, Rattus norvegicus
tggagagaggtcaccttccttcgtt

SEQ ID NO: 630062 - DNA, 25 bp, Rattus norvegicus
tggagagaggtctccttccttcgtt

SEQ ID NO: 630063 - DNA, 25 bp, Rattus norvegicus
tggagagatggcagcccttacccag

SEQ ID NO: 630064 - DNA, 25 bp, Rattus norvegicus
tggagagatggctgcccttacccag

SEQ ID NO: 630065 - DNA, 25 bp, Rattus norvegicus
tggagagattcaaattcatttgtat

SEQ ID NO: 630066 - DNA, 25 bp, Rattus norvegicus
tggagagattcatattcatttgtat

SEQ ID NO: 630067 - DNA, 25 bp, Rattus norvegicus
tggagagcaaagctgcccactgtcc

SEQ ID NO: 630068 - DNA, 25 bp, Rattus norvegicus
tggagagcaaaggtgcccactgtcc

SEQ ID NO: 630069 - DNA, 25 bp, Rattus norvegicus
tggagagcaaccatacaaatgtagt

SEQ ID NO: 630070 - DNA, 25 bp, Rattus norvegicus
tggagagcaaccttacaaatgtagt

SEQ ID NO: 630071 - DNA, 25 bp, Rattus norvegicus
tggagagcactcagtctcgactgga

SEQ ID NO: 630072 - DNA, 25 bp, Rattus norvegicus
tggagagcactctgtctcgactgga

SEQ ID NO: 630073 - DNA, 25 bp, Rattus norvegicus
tggagagcagctcgtgacacacgaa

SEQ ID NO: 630074 - DNA, 25 bp, Rattus norvegicus
tggagagcagctggtgacacacgaa

SEQ ID NO: 630075 - DNA, 25 bp, Rattus norvegicus
tggagagccaccagcgggaccatga

SEQ ID NO: 630076 - DNA, 25 bp, Rattus norvegicus
tggagagccacctgcgggaccatga

SEQ ID NO: 630077 - DNA, 25 bp, Rattus norvegicus
tggagagccactcaatgtgtacctt

SEQ ID NO: 630078 - DNA, 25 bp, Rattus norvegicus
tggagagccactcggtgctcccata

SEQ ID NO: 630079 - DNA, 25 bp, Rattus norvegicus
tggagagccactgaatgtgtacctt

SEQ ID NO: 630080 - DNA, 25 bp, Rattus norvegicus
tggagagccactgggtgctcccata

SEQ ID NO: 630081 - DNA, 25 bp, Rattus norvegicus
tggagagccattcctccgtgagcaa

SEQ ID NO: 630082 - DNA, 25 bp, Rattus norvegicus
tggagagccattgctccgtgagcaa

SEQ ID NO: 630083 - DNA, 25 bp, Rattus norvegicus
tggagagcccagaccgatgtggaac

SEQ ID NO: 630084 - DNA, 25 bp, Rattus norvegicus
tggagagcccagtccgatgtggaac

SEQ ID NO: 630085 - DNA, 25 bp, Rattus norvegicus
tggagagccgaccaagtgcctttac

SEQ ID NO: 630086 - DNA, 25 bp, Rattus norvegicus
tggagagccgacgaagtgcctttac

SEQ ID NO: 630087 - DNA, 25 bp, Rattus norvegicus
tggagagccgcaatcgagaagctat

SEQ ID NO: 630088 - DNA, 25 bp, Rattus norvegicus
tggagagccgcattcgagaagctat

SEQ ID NO: 630089 - DNA, 25 bp, Rattus norvegicus
tggagagcctgtagctcacccatta

SEQ ID NO: 630090 - DNA, 25 bp, Rattus norvegicus
tggagagcctgttgctcacccatta

SEQ ID NO: 630091 - DNA, 25 bp, Rattus norvegicus
tggagagcgggaagccgtccatctt

SEQ ID NO: 630092 - DNA, 25 bp, Rattus norvegicus
tggagagcgggatgccgtccatctt

SEQ ID NO: 630093 - DNA, 25 bp, Rattus norvegicus
tggagagctaacatgcaactgccga

SEQ ID NO: 630094 - DNA, 25 bp, Rattus norvegicus
tggagagctaacttgcaactgccga

SEQ ID NO: 630095 - DNA, 25 bp, Rattus norvegicus
tggagagctggcagacacgcccaaa

SEQ ID NO: 630096 - DNA, 25 bp, Rattus norvegicus
tggagagctggctgacacgcccaaa

SEQ ID NO: 630097 - DNA, 25 bp, Rattus norvegicus
tggagaggaatgatctcactccccg

SEQ ID NO: 630098 - DNA, 25 bp, Rattus norvegicus
tggagaggaatgttctcactccccg

SEQ ID NO: 630099 - DNA, 25 bp, Rattus norvegicus
tggagaggatctacctgcttaccag

SEQ ID NO: 630100 - DNA, 25 bp, Rattus norvegicus
tggagaggatcttcctgcttaccag

SEQ ID NO: 630101 - DNA, 25 bp, Rattus norvegicus
tggagaggcaccagtgaaacactgt

SEQ ID NO: 630102 - DNA, 25 bp, Rattus norvegicus
tggagaggcacctgtgaaacactgt

SEQ ID NO: 630103 - DNA, 25 bp, Rattus norvegicus
tggagaggctcaccaggccaccaga

SEQ ID NO: 630104 - DNA, 25 bp, Rattus norvegicus
tggagaggctcagcaggccaccaga

SEQ ID NO: 630105 - DNA, 25 bp, Rattus norvegicus
tggagagggccgagtctgacaccaa

SEQ ID NO: 630106 - DNA, 25 bp, Rattus norvegicus
tggagagggccgtgtctgacaccaa

SEQ ID NO: 630107 - DNA, 25 bp, Rattus norvegicus
tggagaggtgccacttcagccttgc

SEQ ID NO: 630108 - DNA, 25 bp, Rattus norvegicus
tggagaggtgcctcttcagccttgc

SEQ ID NO: 630109 - DNA, 25 bp, Rattus norvegicus
tggagagtaaccctaaaccagtaga

SEQ ID NO: 630110 - DNA, 25 bp, Rattus norvegicus
tggagagtaaccgtaaaccagtaga

SEQ ID NO: 630111 - DNA, 25 bp, Rattus norvegicus
tggagagtactcatgaccccacgaa

SEQ ID NO: 630112 - DNA, 25 bp, Rattus norvegicus
tggagagtactcttgaccccacgaa

SEQ ID NO: 630113 - DNA, 25 bp, Rattus norvegicus
tggagagtcctcaccccaaagcata

SEQ ID NO: 630114 - DNA, 25 bp, Rattus norvegicus
tggagagtcctctccccaaagcata

SEQ ID NO: 630115 - DNA, 25 bp, Rattus norvegicus
tggagagtcctgattgcacatccag

SEQ ID NO: 630116 - DNA, 25 bp, Rattus norvegicus
tggagagtcctgtttgcacatccag

SEQ ID NO: 630117 - DNA, 25 bp, Rattus norvegicus
tggagagtctacacgccaggtcgtg

SEQ ID NO: 630118 - DNA, 25 bp, Rattus norvegicus
tggagagtctactcgccaggtcgtg

SEQ ID NO: 630119 - DNA, 25 bp, Rattus norvegicus
tggagagtctatacccaactgccat

SEQ ID NO: 630120 - DNA, 25 bp, Rattus norvegicus
tggagagtctattcccaactgccat

SEQ ID NO: 630121 - DNA, 25 bp, Rattus norvegicus
tggagagtggccctgtgtcatacca

SEQ ID NO: 630122 - DNA, 25 bp, Rattus norvegicus
tggagagtggccgtgtgtcatacca

SEQ ID NO: 630123 - DNA, 25 bp, Rattus norvegicus
tggagagttcacacctggcagggca

SEQ ID NO: 630124 - DNA, 25 bp, Rattus norvegicus
tggagagttcactcctggcagggca

SEQ ID NO: 630125 - DNA, 25 bp, Rattus norvegicus
tggagagttctgagttgccacccct

SEQ ID NO: 630126 - DNA, 25 bp, Rattus norvegicus
tggagagttctgtgttgccacccct

SEQ ID NO: 630127 - DNA, 25 bp, Rattus norvegicus
tggagagttgttagcgctctgctcc

SEQ ID NO: 630128 - DNA, 25 bp, Rattus norvegicus
tggagagttgtttgcgctctgctcc

SEQ ID NO: 630129 - DNA, 25 bp, Rattus norvegicus
tggagagtttccattcctgaccagc

SEQ ID NO: 630130 - DNA, 25 bp, Rattus norvegicus
tggagagtttcctttcctgaccagc

SEQ ID NO: 630131 - DNA, 25 bp, Rattus norvegicus
tggagagtttctcccaatgaccctc

SEQ ID NO: 630132 - DNA, 25 bp, Rattus norvegicus
tggagagtttctcctcatctcacat

SEQ ID NO: 630133 - DNA, 25 bp, Rattus norvegicus
tggagagtttctgccaatgaccctc

SEQ ID NO: 630134 - DNA, 25 bp, Rattus norvegicus
tggagagtttctgctcatctcacat

SEQ ID NO: 630135 - DNA, 25 bp, Rattus norvegicus
tggagagttttaaggtccctggcca

SEQ ID NO: 630136 - DNA, 25 bp, Rattus norvegicus
tggagagttttatggtccctggcca

SEQ ID NO: 630137 - DNA, 25 bp, Rattus norvegicus
tggagatacctgacaaacgcctaca

SEQ ID NO: 630138 - DNA, 25 bp, Rattus norvegicus
tggagatacctgtcaaacgcctaca

SEQ ID NO: 630139 - DNA, 25 bp, Rattus norvegicus
tggagatactgcagggccgcgactt

SEQ ID NO: 630140 - DNA, 25 bp, Rattus norvegicus
tggagatactgctgggccgcgactt

SEQ ID NO: 630141 - DNA, 25 bp, Rattus norvegicus
tggagatagggtacccaggagccct

SEQ ID NO: 630142 - DNA, 25 bp, Rattus norvegicus
tggagatagggttcccaggagccct

SEQ ID NO: 630143 - DNA, 25 bp, Rattus norvegicus
tggagatcacatcccgtgtttacat

SEQ ID NO: 630144 - DNA, 25 bp, Rattus norvegicus
tggagatcacatgccgtgtttacat

SEQ ID NO: 630145 - DNA, 25 bp, Rattus norvegicus
tggagatcacgtcgctgtgtaccca

SEQ ID NO: 630146 - DNA, 25 bp, Rattus norvegicus
tggagatcacgtggctgtgtaccca

SEQ ID NO: 630147 - DNA, 25 bp, Rattus norvegicus
tggagatcattccaccttgatcatc

SEQ ID NO: 630148 - DNA, 25 bp, Rattus norvegicus
tggagatcattcgaccttgatcatc

SEQ ID NO: 630149 - DNA, 25 bp, Rattus norvegicus
tggagatccagccaggtttcatccg

SEQ ID NO: 630150 - DNA, 25 bp, Rattus norvegicus
tggagatccagcgaggtttcatccg

SEQ ID NO: 630151 - DNA, 25 bp, Rattus norvegicus
tggagatccaggaccgcgcagtgac

SEQ ID NO: 630152 - DNA, 25 bp, Rattus norvegicus
tggagatccaggtccgcgcagtgac

SEQ ID NO: 630153 - DNA, 25 bp, Rattus norvegicus
tggagatccagtagtgagccatgat

SEQ ID NO: 630154 - DNA, 25 bp, Rattus norvegicus
tggagatccagttgtgagccatgat

SEQ ID NO: 630155 - DNA, 25 bp, Rattus norvegicus
tggagatcccagatgatgacgacct

SEQ ID NO: 630156 - DNA, 25 bp, Rattus norvegicus
tggagatcccagttgatgacgacct

SEQ ID NO: 630157 - DNA, 25 bp, Rattus norvegicus
tggagatccctgatcagctggcaaa

SEQ ID NO: 630158 - DNA, 25 bp, Rattus norvegicus
tggagatccctgttcagctggcaaa

SEQ ID NO: 630159 - DNA, 25 bp, Rattus norvegicus
tggagatccggcaacgcatgcagag

SEQ ID NO: 630160 - DNA, 25 bp, Rattus norvegicus
tggagatccggctacgcatgcagag

SEQ ID NO: 630161 - DNA, 25 bp, Rattus norvegicus
tggagatccgtcagttgagccagca

SEQ ID NO: 630162 - DNA, 25 bp, Rattus norvegicus
tggagatccgtctgttgagccagca

SEQ ID NO: 630163 - DNA, 25 bp, Rattus norvegicus
tggagatcctaaatcacagaactgg

SEQ ID NO: 630164 - DNA, 25 bp, Rattus norvegicus
tggagatcctaattcacagaactgg

SEQ ID NO: 630165 - DNA, 25 bp, Rattus norvegicus
tggagatcctatcctcagaacttca

SEQ ID NO: 630166 - DNA, 25 bp, Rattus norvegicus
tggagatcctatgctcagaacttca

SEQ ID NO: 630167 - DNA, 25 bp, Rattus norvegicus
tggagatcctccaactgccaagtca

SEQ ID NO: 630168 - DNA, 25 bp, Rattus norvegicus
tggagatcctccctttgtggccatc

SEQ ID NO: 630169 - DNA, 25 bp, Rattus norvegicus
tggagatcctccgtttgtggccatc

SEQ ID NO: 630170 - DNA, 25 bp, Rattus norvegicus
tggagatcctcctactgccaagtca

SEQ ID NO: 630171 - DNA, 25 bp, Rattus norvegicus
tggagatcctgcagtgtaggcccct

SEQ ID NO: 630172 - DNA, 25 bp, Rattus norvegicus
tggagatcctgctgtgtaggcccct

SEQ ID NO: 630173 - DNA, 25 bp, Rattus norvegicus
tggagatcctgtccagagcgctgca

SEQ ID NO: 630174 - DNA, 25 bp, Rattus norvegicus
tggagatcctgtgcagagcgctgca

SEQ ID NO: 630175 - DNA, 25 bp, Rattus norvegicus
tggagatccttaacgtgctcaggac

SEQ ID NO: 630176 - DNA, 25 bp, Rattus norvegicus
tggagatccttatcgtgctcaggac

SEQ ID NO: 630177 - DNA, 25 bp, Rattus norvegicus
tggagatcgctcagatcagccagta

SEQ ID NO: 630178 - DNA, 25 bp, Rattus norvegicus
tggagatcgctctgatcagccagta

SEQ ID NO: 630179 - DNA, 25 bp, Rattus norvegicus
tggagatctaaaaacagctgctgag

SEQ ID NO: 630180 - DNA, 25 bp, Rattus norvegicus
tggagatctaaatacagctgctgag

SEQ ID NO: 630181 - DNA, 25 bp, Rattus norvegicus
tggagatctcatacagcacccggaa

SEQ ID NO: 630182 - DNA, 25 bp, Rattus norvegicus
tggagatctcattcagcacccggaa

SEQ ID NO: 630183 - DNA, 25 bp, Rattus norvegicus
tggagatctgcacacaccttgtacc

SEQ ID NO: 630184 - DNA, 25 bp, Rattus norvegicus
tggagatctgcagacaccttgtacc

SEQ ID NO: 630185 - DNA, 25 bp, Rattus norvegicus
tggagatctggaagcgcgcgcccgt

SEQ ID NO: 630186 - DNA, 25 bp, Rattus norvegicus
tggagatctggatgcgcgcgcccgt

SEQ ID NO: 630187 - DNA, 25 bp, Rattus norvegicus
tggagatcttccagctgctcaggaa

SEQ ID NO: 630188 - DNA, 25 bp, Rattus norvegicus
tggagatcttccagtcggcgtccac

SEQ ID NO: 630189 - DNA, 25 bp, Rattus norvegicus
tggagatcttcctgctgctcaggaa

SEQ ID NO: 630190 - DNA, 25 bp, Rattus norvegicus
tggagatcttcctgtcggcgtccac

SEQ ID NO: 630191 - DNA, 25 bp, Rattus norvegicus
tggagatgaaacagatgaggagact

SEQ ID NO: 630192 - DNA, 25 bp, Rattus norvegicus
tggagatgaaactgatgaggagact

SEQ ID NO: 630193 - DNA, 25 bp, Rattus norvegicus
tggagatgagctcctccatcaccac

SEQ ID NO: 630194 - DNA, 25 bp, Rattus norvegicus
tggagatgagctgctccatcaccac

SEQ ID NO: 630195 - DNA, 25 bp, Rattus norvegicus
tggagatgatcacccacttctcaga

SEQ ID NO: 630196 - DNA, 25 bp, Rattus norvegicus
tggagatgatcagccacttctcaga

SEQ ID NO: 630197 - DNA, 25 bp, Rattus norvegicus
tggagatgatctaagccacttccct

SEQ ID NO: 630198 - DNA, 25 bp, Rattus norvegicus
tggagatgatcttagccacttccct

SEQ ID NO: 630199 - DNA, 25 bp, Rattus norvegicus
tggagatgcatgagcaggcccacgt

SEQ ID NO: 630200 - DNA, 25 bp, Rattus norvegicus
tggagatgcatgtgcaggcccacgt

SEQ ID NO: 630201 - DNA, 25 bp, Rattus norvegicus
tggagatgctctcactcagtgtaat

SEQ ID NO: 630202 - DNA, 25 bp, Rattus norvegicus
tggagatgctctgactcagtgtaat

SEQ ID NO: 630203 - DNA, 25 bp, Rattus norvegicus
tggagatgctgtcaccttcgacctg

SEQ ID NO: 630204 - DNA, 25 bp, Rattus norvegicus
tggagatgctgtcgaccgccccttc

SEQ ID NO: 630205 - DNA, 25 bp, Rattus norvegicus
tggagatgctgtgaccttcgacctg

SEQ ID NO: 630206 - DNA, 25 bp, Rattus norvegicus
tggagatgctgtggaccgccccttc

SEQ ID NO: 630207 - DNA, 25 bp, Rattus norvegicus
tggagatgcttcagtggacgatgaa

SEQ ID NO: 630208 - DNA, 25 bp, Rattus norvegicus
tggagatgcttctgtggacgatgaa

SEQ ID NO: 630209 - DNA, 25 bp, Rattus norvegicus
tggagatggacgacactactgctac

SEQ ID NO: 630210 - DNA, 25 bp, Rattus norvegicus
tggagatggacgtcactactgctac

SEQ ID NO: 630211 - DNA, 25 bp, Rattus norvegicus
tggagatggccgacagctacctgaa

SEQ ID NO: 630212 - DNA, 25 bp, Rattus norvegicus
tggagatggccgtcagctacctgaa

SEQ ID NO: 630213 - DNA, 25 bp, Rattus norvegicus
tggagatggcgcctcagctttcaaa

SEQ ID NO: 630214 - DNA, 25 bp, Rattus norvegicus
tggagatggcgcgtcagctttcaaa

SEQ ID NO: 630215 - DNA, 25 bp, Rattus norvegicus
tggagatggcttatcccttgtggga

SEQ ID NO: 630216 - DNA, 25 bp, Rattus norvegicus
tggagatggcttttcccttgtggga

SEQ ID NO: 630217 - DNA, 25 bp, Rattus norvegicus
tggagatgtgcaacaccacctctat

SEQ ID NO: 630218 - DNA, 25 bp, Rattus norvegicus
tggagatgtgcatcaccacctctat

SEQ ID NO: 630219 - DNA, 25 bp, Rattus norvegicus
tggagatgtgctactgtctcatcac

SEQ ID NO: 630220 - DNA, 25 bp, Rattus norvegicus
tggagatgtgcttctgtctcatcac

SEQ ID NO: 630221 - DNA, 25 bp, Rattus norvegicus
tggagatgttaaacccttttcccaa

SEQ ID NO: 630222 - DNA, 25 bp, Rattus norvegicus
tggagatgttaatcccttttcccaa

SEQ ID NO: 630223 - DNA, 25 bp, Rattus norvegicus
tggagattcgagagccattcggctg

SEQ ID NO: 630224 - DNA, 25 bp, Rattus norvegicus
tggagattcgagtgccattcggctg

SEQ ID NO: 630225 - DNA, 25 bp, Rattus norvegicus
tggagattgctgagggtgccctaca

SEQ ID NO: 630226 - DNA, 25 bp, Rattus norvegicus
tggagattgctgtgggtgccctaca

SEQ ID NO: 630227 - DNA, 25 bp, Rattus norvegicus
tggagatttaaccacctctctgacg

SEQ ID NO: 630228 - DNA, 25 bp, Rattus norvegicus
tggagatttaacgacctctctgacg

SEQ ID NO: 630229 - DNA, 25 bp, Rattus norvegicus
tggagatttcatcacaccacggcat

SEQ ID NO: 630230 - DNA, 25 bp, Rattus norvegicus
tggagatttcatgacaccacggcat

SEQ ID NO: 630231 - DNA, 25 bp, Rattus norvegicus
tggagatttccaaatgcccaggatg

SEQ ID NO: 630232 - DNA, 25 bp, Rattus norvegicus
tggagatttccatatgcccaggatg

SEQ ID NO: 630233 - DNA, 25 bp, Rattus norvegicus
tggagattttttcttgctctcccct

SEQ ID NO: 630234 - DNA, 25 bp, Rattus norvegicus
tggagattttttgttgctctcccct

SEQ ID NO: 630235 - DNA, 25 bp, Rattus norvegicus
tggagcaaagtaaccaacccctcat

SEQ ID NO: 630236 - DNA, 25 bp, Rattus norvegicus
tggagcaaagtatccaacccctcat

SEQ ID NO: 630237 - DNA, 25 bp, Rattus norvegicus
tggagcaacactctccagtcactgt

SEQ ID NO: 630238 - DNA, 25 bp, Rattus norvegicus
tggagcaacactgtccagtcactgt

SEQ ID NO: 630239 - DNA, 25 bp, Rattus norvegicus
tggagcaagctcatctgacatagga

SEQ ID NO: 630240 - DNA, 25 bp, Rattus norvegicus
tggagcaagctcttctgacatagga

SEQ ID NO: 630241 - DNA, 25 bp, Rattus norvegicus
tggagcaattcacccaagtgtctaa

SEQ ID NO: 630242 - DNA, 25 bp, Rattus norvegicus
tggagcaattcagccaagtgtctaa

SEQ ID NO: 630243 - DNA, 25 bp, Rattus norvegicus
tggagcacaagaccgcccatgcagg

SEQ ID NO: 630244 - DNA, 25 bp, Rattus norvegicus
tggagcacaagagcgcccatgcagg

SEQ ID NO: 630245 - DNA, 25 bp, Rattus norvegicus
tggagcacaatcctggcatgtctgc

SEQ ID NO: 630246 - DNA, 25 bp, Rattus norvegicus
tggagcacaatcgtggcatgtctgc

SEQ ID NO: 630247 - DNA, 25 bp, Rattus norvegicus
tggagcacacagcataaggacttgt

SEQ ID NO: 630248 - DNA, 25 bp, Rattus norvegicus
tggagcacacaggataaggacttgt

SEQ ID NO: 630249 - DNA, 25 bp, Rattus norvegicus
tggagcacagtcagcagccaccttt

SEQ ID NO: 630250 - DNA, 25 bp, Rattus norvegicus
tggagcacagtctgcagccaccttt

SEQ ID NO: 630251 - DNA, 25 bp, Rattus norvegicus
tggagcacccgacccagaaagacat

SEQ ID NO: 630252 - DNA, 25 bp, Rattus norvegicus
tggagcacccgagccagaaagacat

SEQ ID NO: 630253 - DNA, 25 bp, Rattus norvegicus
tggagcaccctgaaaaagccgtgcc

SEQ ID NO: 630254 - DNA, 25 bp, Rattus norvegicus
tggagcaccctgaaccagaatcaga

SEQ ID NO: 630255 - DNA, 25 bp, Rattus norvegicus
tggagcaccctgtaaaagccgtgcc

SEQ ID NO: 630256 - DNA, 25 bp, Rattus norvegicus
tggagcaccctgtaccagaatcaga

SEQ ID NO: 630257 - DNA, 25 bp, Rattus norvegicus
tggagcacctccacaaagttcagtt

SEQ ID NO: 630258 - DNA, 25 bp, Rattus norvegicus
tggagcacctcctcaaagttcagtt

SEQ ID NO: 630259 - DNA, 25 bp, Rattus norvegicus
tggagcaccttcagctaagcaactg

SEQ ID NO: 630260 - DNA, 25 bp, Rattus norvegicus
tggagcaccttctgctaagcaactg

SEQ ID NO: 630261 - DNA, 25 bp, Rattus norvegicus
tggagcacgaccagctcagggatga

SEQ ID NO: 630262 - DNA, 25 bp, Rattus norvegicus
tggagcacgacctgctcagggatga

SEQ ID NO: 630263 - DNA, 25 bp, Rattus norvegicus
tggagcacggtcagtgtccttggca

SEQ ID NO: 630264 - DNA, 25 bp, Rattus norvegicus
tggagcacggtctgtgtccttggca

SEQ ID NO: 630265 - DNA, 25 bp, Rattus norvegicus
tggagcactataccacagcaggact

SEQ ID NO: 630266 - DNA, 25 bp, Rattus norvegicus
tggagcactatagcacagcaggact

SEQ ID NO: 630267 - DNA, 25 bp, Rattus norvegicus
tggagcactgcccatatctagctgt

SEQ ID NO: 630268 - DNA, 25 bp, Rattus norvegicus
tggagcactgccgatatctagctgt

SEQ ID NO: 630269 - DNA, 25 bp, Rattus norvegicus
tggagcactgctaagccttctgcaa

SEQ ID NO: 630270 - DNA, 25 bp, Rattus norvegicus
tggagcactgcttagccttctgcaa

SEQ ID NO: 630271 - DNA, 25 bp, Rattus norvegicus
tggagcactgtgataccctcaagga

SEQ ID NO: 630272 - DNA, 25 bp, Rattus norvegicus
tggagcactgtgttaccctcaagga

SEQ ID NO: 630273 - DNA, 25 bp, Rattus norvegicus
tggagcacttctaactattcccaca

SEQ ID NO: 630274 - DNA, 25 bp, Rattus norvegicus
tggagcacttcttactattcccaca

SEQ ID NO: 630275 - DNA, 25 bp, Rattus norvegicus
tggagcactttcatctttacagagg

SEQ ID NO: 630276 - DNA, 25 bp, Rattus norvegicus
tggagcactttcttctttacagagg

SEQ ID NO: 630277 - DNA, 25 bp, Rattus norvegicus
tggagcacttttctttgacacctga

SEQ ID NO: 630278 - DNA, 25 bp, Rattus norvegicus
tggagcacttttgtttgacacctga

SEQ ID NO: 630279 - DNA, 25 bp, Rattus norvegicus
tggagcagaactacctgcaagataa

SEQ ID NO: 630280 - DNA, 25 bp, Rattus norvegicus
tggagcagaactcatgatccttccc

SEQ ID NO: 630281 - DNA, 25 bp, Rattus norvegicus
tggagcagaactgatgatccttccc

SEQ ID NO: 630282 - DNA, 25 bp, Rattus norvegicus
tggagcagaacttcctgcaagataa

SEQ ID NO: 630283 - DNA, 25 bp, Rattus norvegicus
tggagcagaatactcggcccgtgtc

SEQ ID NO: 630284 - DNA, 25 bp, Rattus norvegicus
tggagcagaatagtcggcccgtgtc

SEQ ID NO: 630285 - DNA, 25 bp, Rattus norvegicus
tggagcagcccaattccccacttgt

SEQ ID NO: 630286 - DNA, 25 bp, Rattus norvegicus
tggagcagcccatttccccacttgt

SEQ ID NO: 630287 - DNA, 25 bp, Rattus norvegicus
tggagcagccctatatacctggtga

SEQ ID NO: 630288 - DNA, 25 bp, Rattus norvegicus
tggagcagccctttatacctggtga

SEQ ID NO: 630289 - DNA, 25 bp, Rattus norvegicus
tggagcagcctgcagtgcccagaat

SEQ ID NO: 630290 - DNA, 25 bp, Rattus norvegicus
tggagcagcctggagtgcccagaat

SEQ ID NO: 630291 - DNA, 25 bp, Rattus norvegicus
tggagcagccttatatctgggcact

SEQ ID NO: 630292 - DNA, 25 bp, Rattus norvegicus
tggagcagccttttatctgggcact

SEQ ID NO: 630293 - DNA, 25 bp, Rattus norvegicus
tggagcagcgagaccctaccggtca

SEQ ID NO: 630294 - DNA, 25 bp, Rattus norvegicus
tggagcagcgagtccctaccggtca

SEQ ID NO: 630295 - DNA, 25 bp, Rattus norvegicus
tggagcagctccaggtccgtttctc

SEQ ID NO: 630296 - DNA, 25 bp, Rattus norvegicus
tggagcagctcctggtccgtttctc

SEQ ID NO: 630297 - DNA, 25 bp, Rattus norvegicus
tggagcagcttcagcctttcttcaa

SEQ ID NO: 630298 - DNA, 25 bp, Rattus norvegicus
tggagcagcttctgcctttcttcaa

SEQ ID NO: 630299 - DNA, 25 bp, Rattus norvegicus
tggagcaggcccctctatactcaag

SEQ ID NO: 630300 - DNA, 25 bp, Rattus norvegicus
tggagcaggcccgtctatactcaag

SEQ ID NO: 630301 - DNA, 25 bp, Rattus norvegicus
tggagcagggatattgaacacagaa

SEQ ID NO: 630302 - DNA, 25 bp, Rattus norvegicus
tggagcagggattttgaacacagaa

SEQ ID NO: 630303 - DNA, 25 bp, Rattus norvegicus
tggagcaggttaacatccctcactg

SEQ ID NO: 630304 - DNA, 25 bp, Rattus norvegicus
tggagcaggttatcatccctcactg

SEQ ID NO: 630305 - DNA, 25 bp, Rattus norvegicus
tggagcagtagtcagggtacccttt

SEQ ID NO: 630306 - DNA, 25 bp, Rattus norvegicus
tggagcagtagtgagggtacccttt

SEQ ID NO: 630307 - DNA, 25 bp, Rattus norvegicus
tggagcagtccactctcctgccaga

SEQ ID NO: 630308 - DNA, 25 bp, Rattus norvegicus
tggagcagtccagtctcctgccaga

SEQ ID NO: 630309 - DNA, 25 bp, Rattus norvegicus
tggagcagtcgcactcgtccatgga

SEQ ID NO: 630310 - DNA, 25 bp, Rattus norvegicus
tggagcagtcgctctcgtccatgga

SEQ ID NO: 630311 - DNA, 25 bp, Rattus norvegicus
tggagcagtgcgcaccaaggtctcc

SEQ ID NO: 630312 - DNA, 25 bp, Rattus norvegicus
tggagcagtgcggaccaaggtctcc

SEQ ID NO: 630313 - DNA, 25 bp, Rattus norvegicus
tggagcatacctactgcacggaaac

SEQ ID NO: 630314 - DNA, 25 bp, Rattus norvegicus
tggagcataccttctgcacggaaac

SEQ ID NO: 630315 - DNA, 25 bp, Rattus norvegicus
tggagcatatcgagccgaacaccga

SEQ ID NO: 630316 - DNA, 25 bp, Rattus norvegicus
tggagcatatcgtgccgaacaccga

SEQ ID NO: 630317 - DNA, 25 bp, Rattus norvegicus
tggagcatccctcaagacctacagt

SEQ ID NO: 630318 - DNA, 25 bp, Rattus norvegicus
tggagcatccctgaagacctacagt

SEQ ID NO: 630319 - DNA, 25 bp, Rattus norvegicus
tggagcatcctcagcacaatgtggg

SEQ ID NO: 630320 - DNA, 25 bp, Rattus norvegicus
tggagcatcctctgcacaatgtggg

SEQ ID NO: 630321 - DNA, 25 bp, Rattus norvegicus
tggagcattttgcacgttagccttg

SEQ ID NO: 630322 - DNA, 25 bp, Rattus norvegicus
tggagcattttggacgttagccttg

SEQ ID NO: 630323 - DNA, 25 bp, Rattus norvegicus
tggagccaaggcaaaggccattctg

SEQ ID NO: 630324 - DNA, 25 bp, Rattus norvegicus
tggagccaaggcagcctggaactca

SEQ ID NO: 630325 - DNA, 25 bp, Rattus norvegicus
tggagccaaggctaaggccattctg

SEQ ID NO: 630326 - DNA, 25 bp, Rattus norvegicus
tggagccaaggctgcctggaactca

SEQ ID NO: 630327 - DNA, 25 bp, Rattus norvegicus
tggagccacagtacagaccggtttg

SEQ ID NO: 630328 - DNA, 25 bp, Rattus norvegicus
tggagccacagttcagaccggtttg

SEQ ID NO: 630329 - DNA, 25 bp, Rattus norvegicus
tggagccaccacagagtggtcctga

SEQ ID NO: 630330 - DNA, 25 bp, Rattus norvegicus
tggagccaccactgagtggtcctga

SEQ ID NO: 630331 - DNA, 25 bp, Rattus norvegicus
tggagccacctcagacatgggtatg

SEQ ID NO: 630332 - DNA, 25 bp, Rattus norvegicus
tggagccacctctgacatgggtatg

SEQ ID NO: 630333 - DNA, 25 bp, Rattus norvegicus
tggagccacgcacatcttgaaactg

SEQ ID NO: 630334 - DNA, 25 bp, Rattus norvegicus
tggagccacgcagatcttgaaactg

SEQ ID NO: 630335 - DNA, 25 bp, Rattus norvegicus
tggagccactggaaaacgacctaac

SEQ ID NO: 630336 - DNA, 25 bp, Rattus norvegicus
tggagccactggtaaacgacctaac

SEQ ID NO: 630337 - DNA, 25 bp, Rattus norvegicus
tggagccagcatatgaaccttgaac

SEQ ID NO: 630338 - DNA, 25 bp, Rattus norvegicus
tggagccagcatttgaaccttgaac

SEQ ID NO: 630339 - DNA, 25 bp, Rattus norvegicus
tggagccagcctctaggaaatgaat

SEQ ID NO: 630340 - DNA, 25 bp, Rattus norvegicus
tggagccagcctgtaggaaatgaat

SEQ ID NO: 630341 - DNA, 25 bp, Rattus norvegicus
tggagccagctgcttgagcacagct

SEQ ID NO: 630342 - DNA, 25 bp, Rattus norvegicus
tggagccagctggttgagcacagct

SEQ ID NO: 630343 - DNA, 25 bp, Rattus norvegicus
tggagccatcatacaagtcagaaac

SEQ ID NO: 630344 - DNA, 25 bp, Rattus norvegicus
tggagccatcataggaactctggcc

SEQ ID NO: 630345 - DNA, 25 bp, Rattus norvegicus
tggagccatcattcaagtcagaaac

SEQ ID NO: 630346 - DNA, 25 bp, Rattus norvegicus
tggagccatcattggaactctggcc

SEQ ID NO: 630347 - DNA, 25 bp, Rattus norvegicus
tggagccatcttatatcccagaagc

SEQ ID NO: 630348 - DNA, 25 bp, Rattus norvegicus
tggagccatcttttatcccagaagc

SEQ ID NO: 630349 - DNA, 25 bp, Rattus norvegicus
tggagccatggactgctgatgcccc

SEQ ID NO: 630350 - DNA, 25 bp, Rattus norvegicus
tggagccatggagtgctgatgcccc

SEQ ID NO: 630351 - DNA, 25 bp, Rattus norvegicus
tggagccattaaaccccatcctgga

SEQ ID NO: 630352 - DNA, 25 bp, Rattus norvegicus
tggagccattaatccccatcctgga

SEQ ID NO: 630353 - DNA, 25 bp, Rattus norvegicus
tggagcccaagcaggacctgctgct

SEQ ID NO: 630354 - DNA, 25 bp, Rattus norvegicus
tggagcccaagctggacctgctgct

SEQ ID NO: 630355 - DNA, 25 bp, Rattus norvegicus
tggagcccacagaacatttcaaatc

SEQ ID NO: 630356 - DNA, 25 bp, Rattus norvegicus
tggagcccacagtacatttcaaatc

SEQ ID NO: 630357 - DNA, 25 bp, Rattus norvegicus
tggagcccacttcctggatgtacac

SEQ ID NO: 630358 - DNA, 25 bp, Rattus norvegicus
tggagcccacttgctggatgtacac

SEQ ID NO: 630359 - DNA, 25 bp, Rattus norvegicus
tggagcccagcaaaccaacaatctg

SEQ ID NO: 630360 - DNA, 25 bp, Rattus norvegicus
tggagcccagcataccaacaatctg

SEQ ID NO: 630361 - DNA, 25 bp, Rattus norvegicus
tggagcccagccactacaccaagag

SEQ ID NO: 630362 - DNA, 25 bp, Rattus norvegicus
tggagcccagccatgcgcaacagag

SEQ ID NO: 630363 - DNA, 25 bp, Rattus norvegicus
tggagcccagcctctacaccaagag

SEQ ID NO: 630364 - DNA, 25 bp, Rattus norvegicus
tggagcccagccttgcgcaacagag

SEQ ID NO: 630365 - DNA, 25 bp, Rattus norvegicus
tggagcccagctagtccgggccctg

SEQ ID NO: 630366 - DNA, 25 bp, Rattus norvegicus
tggagcccagcttgtccgggccctg

SEQ ID NO: 630367 - DNA, 25 bp, Rattus norvegicus
tggagccccagaccaccagtcagag

SEQ ID NO: 630368 - DNA, 25 bp, Rattus norvegicus
tggagccccagagcaccagtcagag

SEQ ID NO: 630369 - DNA, 25 bp, Rattus norvegicus
tggagcccccggaaactgtgagcta

SEQ ID NO: 630370 - DNA, 25 bp, Rattus norvegicus
tggagcccccggtaactgtgagcta

SEQ ID NO: 630371 - DNA, 25 bp, Rattus norvegicus
tggagccccggactgagcctaagct

SEQ ID NO: 630372 - DNA, 25 bp, Rattus norvegicus
tggagccccggagtgagcctaagct

SEQ ID NO: 630373 - DNA, 25 bp, Rattus norvegicus
tggagcccctgtcttcagacagtgt

SEQ ID NO: 630374 - DNA, 25 bp, Rattus norvegicus
tggagcccctgtgttcagacagtgt

SEQ ID NO: 630375 - DNA, 25 bp, Rattus norvegicus
tggagcccgcacatacatgtacgag

SEQ ID NO: 630376 - DNA, 25 bp, Rattus norvegicus
tggagcccgcacttacatgtacgag

SEQ ID NO: 630377 - DNA, 25 bp, Rattus norvegicus
tggagcccgcggagaacgtgcatgg

SEQ ID NO: 630378 - DNA, 25 bp, Rattus norvegicus
tggagcccgcggtgaacgtgcatgg

SEQ ID NO: 630379 - DNA, 25 bp, Rattus norvegicus
tggagcccgggtaacgtacgcttca

SEQ ID NO: 630380 - DNA, 25 bp, Rattus norvegicus
tggagcccgggttacgtacgcttca

SEQ ID NO: 630381 - DNA, 25 bp, Rattus norvegicus
tggagccctatgaccaagtgtcgga

SEQ ID NO: 630382 - DNA, 25 bp, Rattus norvegicus
tggagccctatgtccaagtgtcgga

SEQ ID NO: 630383 - DNA, 25 bp, Rattus norvegicus
tggagccgagatcttggtccacaac

SEQ ID NO: 630384 - DNA, 25 bp, Rattus norvegicus
tggagccgagatgttggtccacaac

SEQ ID NO: 630385 - DNA, 25 bp, Rattus norvegicus
tggagccgcagccagtgaatctctc

SEQ ID NO: 630386 - DNA, 25 bp, Rattus norvegicus
tggagccgcagcgagtgaatctctc

SEQ ID NO: 630387 - DNA, 25 bp, Rattus norvegicus
tggagccgctgaatactcatgtttt

SEQ ID NO: 630388 - DNA, 25 bp, Rattus norvegicus
tggagccgctgattactcatgtttt

SEQ ID NO: 630389 - DNA, 25 bp, Rattus norvegicus
tggagccgctgtactcttctgatgg

SEQ ID NO: 630390 - DNA, 25 bp, Rattus norvegicus
tggagccgctgttctcttctgatgg

SEQ ID NO: 630391 - DNA, 25 bp, Rattus norvegicus
tggagccggcagaaccaggcaacgt

SEQ ID NO: 630392 - DNA, 25 bp, Rattus norvegicus
tggagccggcagtaccaggcaacgt

SEQ ID NO: 630393 - DNA, 25 bp, Rattus norvegicus
tggagccggctcacttgaccgcggc

SEQ ID NO: 630394 - DNA, 25 bp, Rattus norvegicus
tggagccggctctcttgaccgcggc

SEQ ID NO: 630395 - DNA, 25 bp, Rattus norvegicus
tggagccgggcaaccaaagctgtct

SEQ ID NO: 630396 - DNA, 25 bp, Rattus norvegicus
tggagccgggcatccaaagctgtct

SEQ ID NO: 630397 - DNA, 25 bp, Rattus norvegicus
tggagccgtctgatgttgactgtgt

SEQ ID NO: 630398 - DNA, 25 bp, Rattus norvegicus
tggagccgtctgttgttgactgtgt

SEQ ID NO: 630399 - DNA, 25 bp, Rattus norvegicus
tggagccgtgaactaccgtgttaga

SEQ ID NO: 630400 - DNA, 25 bp, Rattus norvegicus
tggagccgtgaagtaccgtgttaga

SEQ ID NO: 630401 - DNA, 25 bp, Rattus norvegicus
tggagcctagatacgtggttctgta

SEQ ID NO: 630402 - DNA, 25 bp, Rattus norvegicus
tggagcctagattcgtggttctgta

SEQ ID NO: 630403 - DNA, 25 bp, Rattus norvegicus
tggagcctcaatcgcaaccacattt

SEQ ID NO: 630404 - DNA, 25 bp, Rattus norvegicus
tggagcctcaatggcaaccacattt

SEQ ID NO: 630405 - DNA, 25 bp, Rattus norvegicus
tggagcctcacaaactttgcactag

SEQ ID NO: 630406 - DNA, 25 bp, Rattus norvegicus
tggagcctcacatactttgcactag

SEQ ID NO: 630407 - DNA, 25 bp, Rattus norvegicus
tggagcctccataattgtatttcag

SEQ ID NO: 630408 - DNA, 25 bp, Rattus norvegicus
tggagcctccattattgtatttcag

SEQ ID NO: 630409 - DNA, 25 bp, Rattus norvegicus
tggagcctccctcggcaagtagaga

SEQ ID NO: 630410 - DNA, 25 bp, Rattus norvegicus
tggagcctccctgggcaagtagaga

SEQ ID NO: 630411 - DNA, 25 bp, Rattus norvegicus
tggagcctctaactacacagactgg

SEQ ID NO: 630412 - DNA, 25 bp, Rattus norvegicus
tggagcctctaagtacacagactgg

SEQ ID NO: 630413 - DNA, 25 bp, Rattus norvegicus
tggagcctctggcagcgcgggcggc

SEQ ID NO: 630414 - DNA, 25 bp, Rattus norvegicus
tggagcctctgggagcgcgggcggc

SEQ ID NO: 630415 - DNA, 25 bp, Rattus norvegicus
tggagcctcttgctgtgaatgaaca

SEQ ID NO: 630416 - DNA, 25 bp, Rattus norvegicus
tggagcctcttggtgtgaatgaaca

SEQ ID NO: 630417 - DNA, 25 bp, Rattus norvegicus
tggagcctctttacatccacaaagg

SEQ ID NO: 630418 - DNA, 25 bp, Rattus norvegicus
tggagcctcttttcatccacaaagg

SEQ ID NO: 630419 - DNA, 25 bp, Rattus norvegicus
tggagcctgaggacatcgacctgac

SEQ ID NO: 630420 - DNA, 25 bp, Rattus norvegicus
tggagcctgaggtcatcgacctgac

SEQ ID NO: 630421 - DNA, 25 bp, Rattus norvegicus
tggagcctggtgatctaacccaagc

SEQ ID NO: 630422 - DNA, 25 bp, Rattus norvegicus
tggagcctggtgttctaacccaagc

SEQ ID NO: 630423 - DNA, 25 bp, Rattus norvegicus
tggagcctgtgtcggtttcctctct

SEQ ID NO: 630424 - DNA, 25 bp, Rattus norvegicus
tggagcctgtgtgggtttcctctct

SEQ ID NO: 630425 - DNA, 25 bp, Rattus norvegicus
tggagccttcagcttccaccaggaa

SEQ ID NO: 630426 - DNA, 25 bp, Rattus norvegicus
tggagccttcaggttccaccaggaa

SEQ ID NO: 630427 - DNA, 25 bp, Rattus norvegicus
tggagccttcctccggaacagttaa

SEQ ID NO: 630428 - DNA, 25 bp, Rattus norvegicus
tggagccttcctgcggaacagttaa

SEQ ID NO: 630429 - DNA, 25 bp, Rattus norvegicus
tggagccttctgattttacctcagc

SEQ ID NO: 630430 - DNA, 25 bp, Rattus norvegicus
tggagccttctgtttttacctcagc

SEQ ID NO: 630431 - DNA, 25 bp, Rattus norvegicus
tggagccttgtcactgtggctctat

SEQ ID NO: 630432 - DNA, 25 bp, Rattus norvegicus
tggagccttgtctctgtggctctat

SEQ ID NO: 630433 - DNA, 25 bp, Rattus norvegicus
tggagcctttcaacgcgagccggtg

SEQ ID NO: 630434 - DNA, 25 bp, Rattus norvegicus
tggagcctttcatcgcgagccggtg

SEQ ID NO: 630435 - DNA, 25 bp, Rattus norvegicus
tggagcgacgtccagccgtgcattt

SEQ ID NO: 630436 - DNA, 25 bp, Rattus norvegicus
tggagcgacgtcgagccgtgcattt

SEQ ID NO: 630437 - DNA, 25 bp, Rattus norvegicus
tggagcgaggagatgcctttccagc

SEQ ID NO: 630438 - DNA, 25 bp, Rattus norvegicus
tggagcgaggagttgcctttccagc

SEQ ID NO: 630439 - DNA, 25 bp, Rattus norvegicus
tggagcgcagaccaccactgggcca

SEQ ID NO: 630440 - DNA, 25 bp, Rattus norvegicus
tggagcgcagacgaccactgggcca

SEQ ID NO: 630441 - DNA, 25 bp, Rattus norvegicus
tggagcgcccatcctgacagacgat

SEQ ID NO: 630442 - DNA, 25 bp, Rattus norvegicus
tggagcgcccatgctgacagacgat

SEQ ID NO: 630443 - DNA, 25 bp, Rattus norvegicus
tggagcgcctgtcgcttgatgccaa

SEQ ID NO: 630444 - DNA, 25 bp, Rattus norvegicus
tggagcgcctgtggcttgatgccaa

SEQ ID NO: 630445 - DNA, 25 bp, Rattus norvegicus
tggagcgctgccagcgctcgccggt

SEQ ID NO: 630446 - DNA, 25 bp, Rattus norvegicus
tggagcgctgcctgcgctcgccggt

SEQ ID NO: 630447 - DNA, 25 bp, Rattus norvegicus
tggagcgggccaagacacagctgat

SEQ ID NO: 630448 - DNA, 25 bp, Rattus norvegicus
tggagcgggccatgacacagctgat

SEQ ID NO: 630449 - DNA, 25 bp, Rattus norvegicus
tggagcggtaccagcccttggagta

SEQ ID NO: 630450 - DNA, 25 bp, Rattus norvegicus
tggagcggtacctgcccttggagta

SEQ ID NO: 630451 - DNA, 25 bp, Rattus norvegicus
tggagcgtcagaacaacgaacacaa

SEQ ID NO: 630452 - DNA, 25 bp, Rattus norvegicus
tggagcgtcagatcaacgaacacaa

SEQ ID NO: 630453 - DNA, 25 bp, Rattus norvegicus
tggagcgtcgctacccggacacggt

SEQ ID NO: 630454 - DNA, 25 bp, Rattus norvegicus
tggagcgtcgcttcccggacacggt

SEQ ID NO: 630455 - DNA, 25 bp, Rattus norvegicus
tggagcgtgggtcgcctaccaatac

SEQ ID NO: 630456 - DNA, 25 bp, Rattus norvegicus
tggagcgtgggtggcctaccaatac

SEQ ID NO: 630457 - DNA, 25 bp, Rattus norvegicus
tggagcgtgtcactgcctgcagtac

SEQ ID NO: 630458 - DNA, 25 bp, Rattus norvegicus
tggagcgtgtcagtgcctgcagtac

SEQ ID NO: 630459 - DNA, 25 bp, Rattus norvegicus
tggagcgttcttactgtgaccttac

SEQ ID NO: 630460 - DNA, 25 bp, Rattus norvegicus
tggagcgttctttctgtgaccttac

SEQ ID NO: 630461 - DNA, 25 bp, Rattus norvegicus
tggagctaaggtatttacttctgtt

SEQ ID NO: 630462 - DNA, 25 bp, Rattus norvegicus
tggagctaaggtttttacttctgtt

SEQ ID NO: 630463 - DNA, 25 bp, Rattus norvegicus
tggagctacagaccccacgttatac

SEQ ID NO: 630464 - DNA, 25 bp, Rattus norvegicus
tggagctacagagcccacgttatac

SEQ ID NO: 630465 - DNA, 25 bp, Rattus norvegicus
tggagctacagcaagaccgtggact

SEQ ID NO: 630466 - DNA, 25 bp, Rattus norvegicus
tggagctacagctagaccgtggact

SEQ ID NO: 630467 - DNA, 25 bp, Rattus norvegicus
tggagctacctcagtgcacaggtgg

SEQ ID NO: 630468 - DNA, 25 bp, Rattus norvegicus
tggagctacctctgtgcacaggtgg

SEQ ID NO: 630469 - DNA, 25 bp, Rattus norvegicus
tggagctatcagagtggacccctgc

SEQ ID NO: 630470 - DNA, 25 bp, Rattus norvegicus
tggagctatcagtgtggacccctgc

SEQ ID NO: 630471 - DNA, 25 bp, Rattus norvegicus
tggagctcaagcacgcccgggccag

SEQ ID NO: 630472 - DNA, 25 bp, Rattus norvegicus
tggagctcaagctcgcccgggccag

SEQ ID NO: 630473 - DNA, 25 bp, Rattus norvegicus
tggagctcaattcggttttgctcct

SEQ ID NO: 630474 - DNA, 25 bp, Rattus norvegicus
tggagctcaattgggttttgctcct

SEQ ID NO: 630475 - DNA, 25 bp, Rattus norvegicus
tggagctcacacaagctgcagggca

SEQ ID NO: 630476 - DNA, 25 bp, Rattus norvegicus
tggagctcacactagctgcagggca

SEQ ID NO: 630477 - DNA, 25 bp, Rattus norvegicus
tggagctcactgactcaacttgact

SEQ ID NO: 630478 - DNA, 25 bp, Rattus norvegicus
tggagctcactgtctcaacttgact

SEQ ID NO: 630479 - DNA, 25 bp, Rattus norvegicus
tggagctcagcgagggagccttcat

SEQ ID NO: 630480 - DNA, 25 bp, Rattus norvegicus
tggagctcagcgtgggagccttcat

SEQ ID NO: 630481 - DNA, 25 bp, Rattus norvegicus
tggagctcagctattatcctctgca

SEQ ID NO: 630482 - DNA, 25 bp, Rattus norvegicus
tggagctcagcttttatcctctgca

SEQ ID NO: 630483 - DNA, 25 bp, Rattus norvegicus
tggagctcagtgcttgttcccagcc

SEQ ID NO: 630484 - DNA, 25 bp, Rattus norvegicus
tggagctcagtggttgttcccagcc

SEQ ID NO: 630485 - DNA, 25 bp, Rattus norvegicus
tggagctcatccaaggtgaaaccaa

SEQ ID NO: 630486 - DNA, 25 bp, Rattus norvegicus
tggagctcatcctaggtgaaaccaa

SEQ ID NO: 630487 - DNA, 25 bp, Rattus norvegicus
tggagctccacgagacccttattca

SEQ ID NO: 630488 - DNA, 25 bp, Rattus norvegicus
tggagctccacgtgacccttattca

SEQ ID NO: 630489 - DNA, 25 bp, Rattus norvegicus
tggagctccactatgatgccatctg

SEQ ID NO: 630490 - DNA, 25 bp, Rattus norvegicus
tggagctccactttgatgccatctg

SEQ ID NO: 630491 - DNA, 25 bp, Rattus norvegicus
tggagctccagcagtgagaacctgc

SEQ ID NO: 630492 - DNA, 25 bp, Rattus norvegicus
tggagctccagccttgacaagcatc

SEQ ID NO: 630493 - DNA, 25 bp, Rattus norvegicus
tggagctccagcgttgacaagcatc

SEQ ID NO: 630494 - DNA, 25 bp, Rattus norvegicus
tggagctccagctgtgagaacctgc

SEQ ID NO: 630495 - DNA, 25 bp, Rattus norvegicus
tggagctccatcactaaactatgag

SEQ ID NO: 630496 - DNA, 25 bp, Rattus norvegicus
tggagctccatctctaaactatgag

SEQ ID NO: 630497 - DNA, 25 bp, Rattus norvegicus
tggagctcccaacgcaaaaaatctt

SEQ ID NO: 630498 - DNA, 25 bp, Rattus norvegicus
tggagctcccaaggcaaaaaatctt

SEQ ID NO: 630499 - DNA, 25 bp, Rattus norvegicus
tggagctcccagaacctaggctggc

SEQ ID NO: 630500 - DNA, 25 bp, Rattus norvegicus
tggagctcccagtacctaggctggc

SEQ ID NO: 630501 - DNA, 25 bp, Rattus norvegicus
tggagctccccgaccctggaaatct

SEQ ID NO: 630502 - DNA, 25 bp, Rattus norvegicus
tggagctccccgtccctggaaatct

SEQ ID NO: 630503 - DNA, 25 bp, Rattus norvegicus
tggagctcccttagcaaaccacaaa

SEQ ID NO: 630504 - DNA, 25 bp, Rattus norvegicus
tggagctccctttgcaaaccacaaa

SEQ ID NO: 630505 - DNA, 25 bp, Rattus norvegicus
tggagctcctagattgcacctacag

SEQ ID NO: 630506 - DNA, 25 bp, Rattus norvegicus
tggagctcctagtttgcacctacag

SEQ ID NO: 630507 - DNA, 25 bp, Rattus norvegicus
tggagctcctgaccccaattttcca

SEQ ID NO: 630508 - DNA, 25 bp, Rattus norvegicus
tggagctcctgagcccaattttcca

SEQ ID NO: 630509 - DNA, 25 bp, Rattus norvegicus
tggagctcctgccttgtttgtgaag

SEQ ID NO: 630510 - DNA, 25 bp, Rattus norvegicus
tggagctcctgcgttgtttgtgaag

SEQ ID NO: 630511 - DNA, 25 bp, Rattus norvegicus
tggagctcgcatagctctgcctgcg

SEQ ID NO: 630512 - DNA, 25 bp, Rattus norvegicus
tggagctcgcattgctctgcctgcg

SEQ ID NO: 630513 - DNA, 25 bp, Rattus norvegicus
tggagctctcctacacaggaagtgt

SEQ ID NO: 630514 - DNA, 25 bp, Rattus norvegicus
tggagctctccttcacaggaagtgt

SEQ ID NO: 630515 - DNA, 25 bp, Rattus norvegicus
tggagctctctcaccatgggagggt

SEQ ID NO: 630516 - DNA, 25 bp, Rattus norvegicus
tggagctctctccaataggacgaga

SEQ ID NO: 630517 - DNA, 25 bp, Rattus norvegicus
tggagctctctcgaataggacgaga

SEQ ID NO: 630518 - DNA, 25 bp, Rattus norvegicus
tggagctctctctccatgggagggt

SEQ ID NO: 630519 - DNA, 25 bp, Rattus norvegicus
tggagctctgagagtcgatgacctg

SEQ ID NO: 630520 - DNA, 25 bp, Rattus norvegicus
tggagctctgagtgtcgatgacctg

SEQ ID NO: 630521 - DNA, 25 bp, Rattus norvegicus
tggagctctggtccactgatgtgaa

SEQ ID NO: 630522 - DNA, 25 bp, Rattus norvegicus
tggagctctggtgcactgatgtgaa

SEQ ID NO: 630523 - DNA, 25 bp, Rattus norvegicus
tggagctgaaacctgtggctgcctt

SEQ ID NO: 630524 - DNA, 25 bp, Rattus norvegicus
tggagctgaaacgtgtggctgcctt

SEQ ID NO: 630525 - DNA, 25 bp, Rattus norvegicus
tggagctgacacactggccaaggct

SEQ ID NO: 630526 - DNA, 25 bp, Rattus norvegicus
tggagctgacactctggccaaggct

SEQ ID NO: 630527 - DNA, 25 bp, Rattus norvegicus
tggagctgaggcacaagtcgcctgt

SEQ ID NO: 630528 - DNA, 25 bp, Rattus norvegicus
tggagctgaggctcaagtcgcctgt

SEQ ID NO: 630529 - DNA, 25 bp, Rattus norvegicus
tggagctgagggagccgcttacacc

SEQ ID NO: 630530 - DNA, 25 bp, Rattus norvegicus
tggagctgagggtgccgcttacacc

SEQ ID NO: 630531 - DNA, 25 bp, Rattus norvegicus
tggagctgatctccacttaaggtga

SEQ ID NO: 630532 - DNA, 25 bp, Rattus norvegicus
tggagctgatctgcacttaaggtga

SEQ ID NO: 630533 - DNA, 25 bp, Rattus norvegicus
tggagctgatgcatcctcaaggagg

SEQ ID NO: 630534 - DNA, 25 bp, Rattus norvegicus
tggagctgatgcttcctcaaggagg

SEQ ID NO: 630535 - DNA, 25 bp, Rattus norvegicus
tggagctgcagtaacgttcctttgc

SEQ ID NO: 630536 - DNA, 25 bp, Rattus norvegicus
tggagctgcagttacgttcctttgc

SEQ ID NO: 630537 - DNA, 25 bp, Rattus norvegicus
tggagctgccccatcatggaaacat

SEQ ID NO: 630538 - DNA, 25 bp, Rattus norvegicus
tggagctgccccttcatggaaacat

SEQ ID NO: 630539 - DNA, 25 bp, Rattus norvegicus
tggagctgcctcagtgttgttactg

SEQ ID NO: 630540 - DNA, 25 bp, Rattus norvegicus
tggagctgcctctgtgttgttactg

SEQ ID NO: 630541 - DNA, 25 bp, Rattus norvegicus
tggagctgcgcacctttgaggaact

SEQ ID NO: 630542 - DNA, 25 bp, Rattus norvegicus
tggagctgcgcagctttgaggaact

SEQ ID NO: 630543 - DNA, 25 bp, Rattus norvegicus
tggagctgcggcatccccaacagat

SEQ ID NO: 630544 - DNA, 25 bp, Rattus norvegicus
tggagctgcggcttccccaacagat

SEQ ID NO: 630545 - DNA, 25 bp, Rattus norvegicus
tggagctgctctacttggtgatcaa

SEQ ID NO: 630546 - DNA, 25 bp, Rattus norvegicus
tggagctgctcttcttggtgatcaa

SEQ ID NO: 630547 - DNA, 25 bp, Rattus norvegicus
tggagctgctgaagtttggagccta

SEQ ID NO: 630548 - DNA, 25 bp, Rattus norvegicus
tggagctgctgatgtttggagccta

SEQ ID NO: 630549 - DNA, 25 bp, Rattus norvegicus
tggagctggccgatctgctggaccc

SEQ ID NO: 630550 - DNA, 25 bp, Rattus norvegicus
tggagctggccgttctgctggaccc

SEQ ID NO: 630551 - DNA, 25 bp, Rattus norvegicus
tggagctgggctctttgtctacttc

SEQ ID NO: 630552 - DNA, 25 bp, Rattus norvegicus
tggagctgggctgtttgtctacttc

SEQ ID NO: 630553 - DNA, 25 bp, Rattus norvegicus
tggagctggtagattatcaatttca

SEQ ID NO: 630554 - DNA, 25 bp, Rattus norvegicus
tggagctggtagtttatcaatttca

SEQ ID NO: 630555 - DNA, 25 bp, Rattus norvegicus
tggagctgtaagagtctctgaccag

SEQ ID NO: 630556 - DNA, 25 bp, Rattus norvegicus
tggagctgtaagtgtctctgaccag

SEQ ID NO: 630557 - DNA, 25 bp, Rattus norvegicus
tggagctgtagcaaggaagcccaag

SEQ ID NO: 630558 - DNA, 25 bp, Rattus norvegicus
tggagctgtagctaggaagcccaag

SEQ ID NO: 630559 - DNA, 25 bp, Rattus norvegicus
tggagctgtcagaatggcttcacct

SEQ ID NO: 630560 - DNA, 25 bp, Rattus norvegicus
tggagctgtcagtatggcttcacct

SEQ ID NO: 630561 - DNA, 25 bp, Rattus norvegicus
tggagctgtctgacagagctgactt

SEQ ID NO: 630562 - DNA, 25 bp, Rattus norvegicus
tggagctgtctgtcagagctgactt

SEQ ID NO: 630563 - DNA, 25 bp, Rattus norvegicus
tggagctgtgaacaccagggcttcc

SEQ ID NO: 630564 - DNA, 25 bp, Rattus norvegicus
tggagctgtgaagaccagggcttcc

SEQ ID NO: 630565 - DNA, 25 bp, Rattus norvegicus
tggagctgtgttaacccaaggcgct

SEQ ID NO: 630566 - DNA, 25 bp, Rattus norvegicus
tggagctgtgtttacccaaggcgct

SEQ ID NO: 630567 - DNA, 25 bp, Rattus norvegicus
tggagctgttggaggccaagcccaa

SEQ ID NO: 630568 - DNA, 25 bp, Rattus norvegicus
tggagctgttggtggccaagcccaa

SEQ ID NO: 630569 - DNA, 25 bp, Rattus norvegicus
tggagctgtttcaattcctgacaac

SEQ ID NO: 630570 - DNA, 25 bp, Rattus norvegicus
tggagctgtttctattcctgacaac

SEQ ID NO: 630571 - DNA, 25 bp, Rattus norvegicus
tggagcttaactcaatgcctaacag

SEQ ID NO: 630572 - DNA, 25 bp, Rattus norvegicus
tggagcttaactgaatgcctaacag

SEQ ID NO: 630573 - DNA, 25 bp, Rattus norvegicus
tggagcttacacaaaatctacttat

SEQ ID NO: 630574 - DNA, 25 bp, Rattus norvegicus
tggagcttacactaaatctacttat

SEQ ID NO: 630575 - DNA, 25 bp, Rattus norvegicus
tggagcttcagcaatggcacattct

SEQ ID NO: 630576 - DNA, 25 bp, Rattus norvegicus
tggagcttcagctatggcacattct

SEQ ID NO: 630577 - DNA, 25 bp, Rattus norvegicus
tggagcttcccaaccagcaaggaag

SEQ ID NO: 630578 - DNA, 25 bp, Rattus norvegicus
tggagcttcccatccagcaaggaag

SEQ ID NO: 630579 - DNA, 25 bp, Rattus norvegicus
tggagcttctgcactctatcctagt

SEQ ID NO: 630580 - DNA, 25 bp, Rattus norvegicus
tggagcttctgctctctatcctagt

SEQ ID NO: 630581 - DNA, 25 bp, Rattus norvegicus
tggagcttgcacacaggtaacaatt

SEQ ID NO: 630582 - DNA, 25 bp, Rattus norvegicus
tggagcttgcactcaggtaacaatt

SEQ ID NO: 630583 - DNA, 25 bp, Rattus norvegicus
tggagcttgggacaagacgatcacc

SEQ ID NO: 630584 - DNA, 25 bp, Rattus norvegicus
tggagcttgggagaagacgatcacc

SEQ ID NO: 630585 - DNA, 25 bp, Rattus norvegicus
tggagctttccaactcagaagatta

SEQ ID NO: 630586 - DNA, 25 bp, Rattus norvegicus
tggagctttccatctcagaagatta

SEQ ID NO: 630587 - DNA, 25 bp, Rattus norvegicus
tggagctttggcacagcccatgttg

SEQ ID NO: 630588 - DNA, 25 bp, Rattus norvegicus
tggagctttggctcagcccatgttg

SEQ ID NO: 630589 - DNA, 25 bp, Rattus norvegicus
tggaggaaccaaaccatctctgttg

SEQ ID NO: 630590 - DNA, 25 bp, Rattus norvegicus
tggaggaaccaatccatctctgttg

SEQ ID NO: 630591 - DNA, 25 bp, Rattus norvegicus
tggaggaaccacacgttgacacaaa

SEQ ID NO: 630592 - DNA, 25 bp, Rattus norvegicus
tggaggaaccactcgttgacacaaa

SEQ ID NO: 630593 - DNA, 25 bp, Rattus norvegicus
tggaggaacgctcaggcccactcta

SEQ ID NO: 630594 - DNA, 25 bp, Rattus norvegicus
tggaggaacgctgaggcccactcta

SEQ ID NO: 630595 - DNA, 25 bp, Rattus norvegicus
tggaggaactgaaagccttgcttct

SEQ ID NO: 630596 - DNA, 25 bp, Rattus norvegicus
tggaggaactgatagccttgcttct

SEQ ID NO: 630597 - DNA, 25 bp, Rattus norvegicus
tggaggaagccaccatcactgttcg

SEQ ID NO: 630598 - DNA, 25 bp, Rattus norvegicus
tggaggaagccagcatcactgttcg

SEQ ID NO: 630599 - DNA, 25 bp, Rattus norvegicus
tggaggaagtgactcagcctcttct

SEQ ID NO: 630600 - DNA, 25 bp, Rattus norvegicus
tggaggaagtgagtcagcctcttct

SEQ ID NO: 630601 - DNA, 25 bp, Rattus norvegicus
tggaggaagtgcctacacacaccac

SEQ ID NO: 630602 - DNA, 25 bp, Rattus norvegicus
tggaggaagtgcgtacacacaccac

SEQ ID NO: 630603 - DNA, 25 bp, Rattus norvegicus
tggaggaataccagggcagtgattt

SEQ ID NO: 630604 - DNA, 25 bp, Rattus norvegicus
tggaggaatacctgggcagtgattt

SEQ ID NO: 630605 - DNA, 25 bp, Rattus norvegicus
tggaggacaagtctgcctctccggc

SEQ ID NO: 630606 - DNA, 25 bp, Rattus norvegicus
tggaggacaagtgtgcctctccggc

SEQ ID NO: 630607 - DNA, 25 bp, Rattus norvegicus
tggaggacactcagcgcatgtggat

SEQ ID NO: 630608 - DNA, 25 bp, Rattus norvegicus
tggaggacactcagggagccccatc

SEQ ID NO: 630609 - DNA, 25 bp, Rattus norvegicus
tggaggacactctgcgcatgtggat

SEQ ID NO: 630610 - DNA, 25 bp, Rattus norvegicus
tggaggacactctgggagccccatc

SEQ ID NO: 630611 - DNA, 25 bp, Rattus norvegicus
tggaggacagcaaacacgggacttt

SEQ ID NO: 630612 - DNA, 25 bp, Rattus norvegicus
tggaggacagcatacacgggacttt

SEQ ID NO: 630613 - DNA, 25 bp, Rattus norvegicus
tggaggacagccataccctaagcat

SEQ ID NO: 630614 - DNA, 25 bp, Rattus norvegicus
tggaggacagccttaccctaagcat

SEQ ID NO: 630615 - DNA, 25 bp, Rattus norvegicus
tggaggacaggtaacttcagaaagt

SEQ ID NO: 630616 - DNA, 25 bp, Rattus norvegicus
tggaggacaggttacttcagaaagt

SEQ ID NO: 630617 - DNA, 25 bp, Rattus norvegicus
tggaggacatgcagaacctgtggct

SEQ ID NO: 630618 - DNA, 25 bp, Rattus norvegicus
tggaggacatgctgaacctgtggct

SEQ ID NO: 630619 - DNA, 25 bp, Rattus norvegicus
tggaggaccaatcactctcactgtc

SEQ ID NO: 630620 - DNA, 25 bp, Rattus norvegicus
tggaggaccaatgactctcactgtc

SEQ ID NO: 630621 - DNA, 25 bp, Rattus norvegicus
tggaggacccctacaatatcatctg

SEQ ID NO: 630622 - DNA, 25 bp, Rattus norvegicus
tggaggaccccttcaatatcatctg

SEQ ID NO: 630623 - DNA, 25 bp, Rattus norvegicus
tggaggacccggcaatccccaactg

SEQ ID NO: 630624 - DNA, 25 bp, Rattus norvegicus
tggaggacccgggaatccccaactg

SEQ ID NO: 630625 - DNA, 25 bp, Rattus norvegicus
tggaggaccctcaggcctggtaaga

SEQ ID NO: 630626 - DNA, 25 bp, Rattus norvegicus
tggaggaccctctggcctggtaaga

SEQ ID NO: 630627 - DNA, 25 bp, Rattus norvegicus
tggaggaccctgactctgacactat

SEQ ID NO: 630628 - DNA, 25 bp, Rattus norvegicus
tggaggaccctgtctctgacactat

SEQ ID NO: 630629 - DNA, 25 bp, Rattus norvegicus
tggaggacctcacggacgcctgtac

SEQ ID NO: 630630 - DNA, 25 bp, Rattus norvegicus
tggaggacctcagggacgcctgtac

SEQ ID NO: 630631 - DNA, 25 bp, Rattus norvegicus
tggaggacgaccaggaacagctgct

SEQ ID NO: 630632 - DNA, 25 bp, Rattus norvegicus
tggaggacgacctggaacagctgct

SEQ ID NO: 630633 - DNA, 25 bp, Rattus norvegicus
tggaggactctgaagtgcttctgac

SEQ ID NO: 630634 - DNA, 25 bp, Rattus norvegicus
tggaggactctgtagtgcttctgac

SEQ ID NO: 630635 - DNA, 25 bp, Rattus norvegicus
tggaggactgcaccggcatccagtt

SEQ ID NO: 630636 - DNA, 25 bp, Rattus norvegicus
tggaggactgcagcggcatccagtt

SEQ ID NO: 630637 - DNA, 25 bp, Rattus norvegicus
tggaggactgctacaccttcctggg

SEQ ID NO: 630638 - DNA, 25 bp, Rattus norvegicus
tggaggactgcttcaccttcctggg

SEQ ID NO: 630639 - DNA, 25 bp, Rattus norvegicus
tggaggagaaccagaaccggcgcct

SEQ ID NO: 630640 - DNA, 25 bp, Rattus norvegicus
tggaggagaacctgaaccggcgcct

SEQ ID NO: 630641 - DNA, 25 bp, Rattus norvegicus
tggaggagcacaagagcctgcctac

SEQ ID NO: 630642 - DNA, 25 bp, Rattus norvegicus
tggaggagcacatgagcctgcctac

SEQ ID NO: 630643 - DNA, 25 bp, Rattus norvegicus
tggaggagccaaatggccctggcct

SEQ ID NO: 630644 - DNA, 25 bp, Rattus norvegicus
tggaggagccaattggccctggcct

SEQ ID NO: 630645 - DNA, 25 bp, Rattus norvegicus
tggaggagccccaagatcatgcctt

SEQ ID NO: 630646 - DNA, 25 bp, Rattus norvegicus
tggaggagcccctagatcatgcctt

SEQ ID NO: 630647 - DNA, 25 bp, Rattus norvegicus
tggaggagcgctcggtcacacacct

SEQ ID NO: 630648 - DNA, 25 bp, Rattus norvegicus
tggaggagcgctgggtcacacacct

SEQ ID NO: 630649 - DNA, 25 bp, Rattus norvegicus
tggaggagctgcatctcccaaggaa

SEQ ID NO: 630650 - DNA, 25 bp, Rattus norvegicus
tggaggagctgcttctcccaaggaa

SEQ ID NO: 630651 - DNA, 25 bp, Rattus norvegicus
tggaggaggagaagccggccggccg

SEQ ID NO: 630652 - DNA, 25 bp, Rattus norvegicus
tggaggaggagatgccggccggccg

SEQ ID NO: 630653 - DNA, 25 bp, Rattus norvegicus
tggaggaggtctaccatggtcccca

SEQ ID NO: 630654 - DNA, 25 bp, Rattus norvegicus
tggaggaggtcttccatggtcccca

SEQ ID NO: 630655 - DNA, 25 bp, Rattus norvegicus
tggaggagtgccactgacatcgtcc

SEQ ID NO: 630656 - DNA, 25 bp, Rattus norvegicus
tggaggagtgcctctgacatcgtcc

SEQ ID NO: 630657 - DNA, 25 bp, Rattus norvegicus
tggaggatacttcggcattcagcgc

SEQ ID NO: 630658 - DNA, 25 bp, Rattus norvegicus
tggaggatacttgggcattcagcgc

SEQ ID NO: 630659 - DNA, 25 bp, Rattus norvegicus
tggaggatagctcagcctgtgcttc

SEQ ID NO: 630660 - DNA, 25 bp, Rattus norvegicus
tggaggatagctgagcctgtgcttc

SEQ ID NO: 630661 - DNA, 25 bp, Rattus norvegicus
tggaggatccatagggactcagccc

SEQ ID NO: 630662 - DNA, 25 bp, Rattus norvegicus
tggaggatccattgggactcagccc

SEQ ID NO: 630663 - DNA, 25 bp, Rattus norvegicus
tggaggatgataccctgctcctgaa

SEQ ID NO: 630664 - DNA, 25 bp, Rattus norvegicus
tggaggatgatagcctgctcctgaa

SEQ ID NO: 630665 - DNA, 25 bp, Rattus norvegicus
tggaggatgcccctatgaacgccct

SEQ ID NO: 630666 - DNA, 25 bp, Rattus norvegicus
tggaggatgcccgtatgaacgccct

SEQ ID NO: 630667 - DNA, 25 bp, Rattus norvegicus
tggaggatgcgtcagtcgctctaca

SEQ ID NO: 630668 - DNA, 25 bp, Rattus norvegicus
tggaggatgcgtgagtcgctctaca

SEQ ID NO: 630669 - DNA, 25 bp, Rattus norvegicus
tggaggatggtcaattccggtctgc

SEQ ID NO: 630670 - DNA, 25 bp, Rattus norvegicus
tggaggatggtcactgcctaccaaa

SEQ ID NO: 630671 - DNA, 25 bp, Rattus norvegicus
tggaggatggtctattccggtctgc

SEQ ID NO: 630672 - DNA, 25 bp, Rattus norvegicus
tggaggatggtctctgcctaccaaa

SEQ ID NO: 630673 - DNA, 25 bp, Rattus norvegicus
tggaggattggcactgttgccagta

SEQ ID NO: 630674 - DNA, 25 bp, Rattus norvegicus
tggaggattggctctgttgccagta

SEQ ID NO: 630675 - DNA, 25 bp, Rattus norvegicus
tggaggcaactacgacttcttcccg

SEQ ID NO: 630676 - DNA, 25 bp, Rattus norvegicus
tggaggcaactaggacttcttcccg

SEQ ID NO: 630677 - DNA, 25 bp, Rattus norvegicus
tggaggcaagtcagtcattgttctt

SEQ ID NO: 630678 - DNA, 25 bp, Rattus norvegicus
tggaggcaagtctgtcattgttctt

SEQ ID NO: 630679 - DNA, 25 bp, Rattus norvegicus
tggaggcaatgcaggtcttttctac

SEQ ID NO: 630680 - DNA, 25 bp, Rattus norvegicus
tggaggcaatgctggtcttttctac

SEQ ID NO: 630681 - DNA, 25 bp, Rattus norvegicus
tggaggcacaacagtgacccggccg

SEQ ID NO: 630682 - DNA, 25 bp, Rattus norvegicus
tggaggcacaactgtgacccggccg

SEQ ID NO: 630683 - DNA, 25 bp, Rattus norvegicus
tggaggcacagcactaaggcactgc

SEQ ID NO: 630684 - DNA, 25 bp, Rattus norvegicus
tggaggcacagctctaaggcactgc

SEQ ID NO: 630685 - DNA, 25 bp, Rattus norvegicus
tggaggcacctgatcccgccaggag

SEQ ID NO: 630686 - DNA, 25 bp, Rattus norvegicus
tggaggcacctgttcccgccaggag

SEQ ID NO: 630687 - DNA, 25 bp, Rattus norvegicus
tggaggcacttgaatcccctgggtg

SEQ ID NO: 630688 - DNA, 25 bp, Rattus norvegicus
tggaggcacttgtatcccctgggtg

SEQ ID NO: 630689 - DNA, 25 bp, Rattus norvegicus
tggaggcagccaaacctttatccca

SEQ ID NO: 630690 - DNA, 25 bp, Rattus norvegicus
tggaggcagccatacctttatccca

SEQ ID NO: 630691 - DNA, 25 bp, Rattus norvegicus
tggaggccaactacccggagacgct

SEQ ID NO: 630692 - DNA, 25 bp, Rattus norvegicus
tggaggccaacttcccggagacgct

SEQ ID NO: 630693 - DNA, 25 bp, Rattus norvegicus
tggaggccaagaagctcgccccagc

SEQ ID NO: 630694 - DNA, 25 bp, Rattus norvegicus
tggaggccaagatgctcgccccagc

SEQ ID NO: 630695 - DNA, 25 bp, Rattus norvegicus
tggaggccagaaccgatctttttct

SEQ ID NO: 630696 - DNA, 25 bp, Rattus norvegicus
tggaggccagaagcgatctttttct

SEQ ID NO: 630697 - DNA, 25 bp, Rattus norvegicus
tggaggccagcaagggaccaccgat

SEQ ID NO: 630698 - DNA, 25 bp, Rattus norvegicus
tggaggccagcatgggaccaccgat

SEQ ID NO: 630699 - DNA, 25 bp, Rattus norvegicus
tggaggccagcgcagacctgaaaat

SEQ ID NO: 630700 - DNA, 25 bp, Rattus norvegicus
tggaggccagcggagacctgaaaat

SEQ ID NO: 630701 - DNA, 25 bp, Rattus norvegicus
tggaggccaggcatgtcagagacta

SEQ ID NO: 630702 - DNA, 25 bp, Rattus norvegicus
tggaggccaggcttgtcagagacta

SEQ ID NO: 630703 - DNA, 25 bp, Rattus norvegicus
tggaggccatcgacagcgtgattgc

SEQ ID NO: 630704 - DNA, 25 bp, Rattus norvegicus
tggaggccatcgtcagcgtgattgc

SEQ ID NO: 630705 - DNA, 25 bp, Rattus norvegicus
tggaggccatttagtcttgaagtca

SEQ ID NO: 630706 - DNA, 25 bp, Rattus norvegicus
tggaggccattttgtcttgaagtca

SEQ ID NO: 630707 - DNA, 25 bp, Rattus norvegicus
tggaggcccaagacttcagagtcac

SEQ ID NO: 630708 - DNA, 25 bp, Rattus norvegicus
tggaggcccaagtcttcagagtcac

SEQ ID NO: 630709 - DNA, 25 bp, Rattus norvegicus
tggaggcccacacaagccattgtga

SEQ ID NO: 630710 - DNA, 25 bp, Rattus norvegicus
tggaggcccacagaagccattgtga

SEQ ID NO: 630711 - DNA, 25 bp, Rattus norvegicus
tggaggcccagactcggaacagtct

SEQ ID NO: 630712 - DNA, 25 bp, Rattus norvegicus
tggaggcccagagtcggaacagtct

SEQ ID NO: 630713 - DNA, 25 bp, Rattus norvegicus
tggaggccccatcgtgaccaaagat

SEQ ID NO: 630714 - DNA, 25 bp, Rattus norvegicus
tggaggccccatggtgaccaaagat

SEQ ID NO: 630715 - DNA, 25 bp, Rattus norvegicus
tggaggccccgacacatgcaggcaa

SEQ ID NO: 630716 - DNA, 25 bp, Rattus norvegicus
tggaggccccgagacatgcaggcaa

SEQ ID NO: 630717 - DNA, 25 bp, Rattus norvegicus
tggaggccctaaccttggcaaagct

SEQ ID NO: 630718 - DNA, 25 bp, Rattus norvegicus
tggaggccctaagcttggcaaagct

SEQ ID NO: 630719 - DNA, 25 bp, Rattus norvegicus
tggaggccctccaacaaagtgcttg

SEQ ID NO: 630720 - DNA, 25 bp, Rattus norvegicus
tggaggccctcctacaaagtgcttg

SEQ ID NO: 630721 - DNA, 25 bp, Rattus norvegicus
tggaggccgttcaaacatcacatcc

SEQ ID NO: 630722 - DNA, 25 bp, Rattus norvegicus
tggaggccgttctaacatcacatcc

SEQ ID NO: 630723 - DNA, 25 bp, Rattus norvegicus
tggaggcctacaacccgagcaatgg

SEQ ID NO: 630724 - DNA, 25 bp, Rattus norvegicus
tggaggcctacatcccgagcaatgg

SEQ ID NO: 630725 - DNA, 25 bp, Rattus norvegicus
tggaggccttcaatgactgactgtc

SEQ ID NO: 630726 - DNA, 25 bp, Rattus norvegicus
tggaggccttcattgactgactgtc

SEQ ID NO: 630727 - DNA, 25 bp, Rattus norvegicus
tggaggcgaactactccgacctggt

SEQ ID NO: 630728 - DNA, 25 bp, Rattus norvegicus
tggaggcgaacttctccgacctggt

SEQ ID NO: 630729 - DNA, 25 bp, Rattus norvegicus
tggaggcgagggactcagccactct

SEQ ID NO: 630730 - DNA, 25 bp, Rattus norvegicus
tggaggcgagggtctcagccactct

SEQ ID NO: 630731 - DNA, 25 bp, Rattus norvegicus
tggaggcgccgtacacagagacatc

SEQ ID NO: 630732 - DNA, 25 bp, Rattus norvegicus
tggaggcgccgttcacagagacatc

SEQ ID NO: 630733 - DNA, 25 bp, Rattus norvegicus
tggaggcgctgtacagaggccttct

SEQ ID NO: 630734 - DNA, 25 bp, Rattus norvegicus
tggaggcgctgttcagaggccttct

SEQ ID NO: 630735 - DNA, 25 bp, Rattus norvegicus
tggaggcggaaaatgctttcctaaa

SEQ ID NO: 630736 - DNA, 25 bp, Rattus norvegicus
tggaggcggaaattgctttcctaaa

SEQ ID NO: 630737 - DNA, 25 bp, Rattus norvegicus
tggaggcggctcagcaggcacaccc

SEQ ID NO: 630738 - DNA, 25 bp, Rattus norvegicus
tggaggcggctctgcaggcacaccc

SEQ ID NO: 630739 - DNA, 25 bp, Rattus norvegicus
tggaggctatacagcgagaccctac

SEQ ID NO: 630740 - DNA, 25 bp, Rattus norvegicus
tggaggctatactgcgagaccctac

SEQ ID NO: 630741 - DNA, 25 bp, Rattus norvegicus
tggaggctcagaacccactcaaggg

SEQ ID NO: 630742 - DNA, 25 bp, Rattus norvegicus
tggaggctcagatcccactcaaggg

SEQ ID NO: 630743 - DNA, 25 bp, Rattus norvegicus
tggaggctcaggcaaaaagttctct

SEQ ID NO: 630744 - DNA, 25 bp, Rattus norvegicus
tggaggctcagggaaaaagttctct

SEQ ID NO: 630745 - DNA, 25 bp, Rattus norvegicus
tggaggctcatacggacagaattca

SEQ ID NO: 630746 - DNA, 25 bp, Rattus norvegicus
tggaggctcatagggacagaattca

SEQ ID NO: 630747 - DNA, 25 bp, Rattus norvegicus
tggaggctccaaatgggtgcttact

SEQ ID NO: 630748 - DNA, 25 bp, Rattus norvegicus
tggaggctccaattgggtgcttact

SEQ ID NO: 630749 - DNA, 25 bp, Rattus norvegicus
tggaggctccagagatgttgtcctt

SEQ ID NO: 630750 - DNA, 25 bp, Rattus norvegicus
tggaggctccagtgatgttgtcctt

SEQ ID NO: 630751 - DNA, 25 bp, Rattus norvegicus
tggaggctcccaaagtttacataaa

SEQ ID NO: 630752 - DNA, 25 bp, Rattus norvegicus
tggaggctcccatagtttacataaa

SEQ ID NO: 630753 - DNA, 25 bp, Rattus norvegicus
tggaggctctggagcatgtcactgc

SEQ ID NO: 630754 - DNA, 25 bp, Rattus norvegicus
tggaggctctggtgcatgtcactgc

SEQ ID NO: 630755 - DNA, 25 bp, Rattus norvegicus
tggaggctgagacgactgaagttgt

SEQ ID NO: 630756 - DNA, 25 bp, Rattus norvegicus
tggaggctgagaggactgaagttgt

SEQ ID NO: 630757 - DNA, 25 bp, Rattus norvegicus
tggaggcttccaacatgacaggcac

SEQ ID NO: 630758 - DNA, 25 bp, Rattus norvegicus
tggaggcttccatcatgacaggcac

SEQ ID NO: 630759 - DNA, 25 bp, Rattus norvegicus
tggaggcttctaaatcaacactggc

SEQ ID NO: 630760 - DNA, 25 bp, Rattus norvegicus
tggaggcttctatatcaacactggc

SEQ ID NO: 630761 - DNA, 25 bp, Rattus norvegicus
tggaggcttcttcaatagactggaa

SEQ ID NO: 630762 - DNA, 25 bp, Rattus norvegicus
tggaggcttcttgaatagactggaa

SEQ ID NO: 630763 - DNA, 25 bp, Rattus norvegicus
tggaggcttgtcacagtatctgcta

SEQ ID NO: 630764 - DNA, 25 bp, Rattus norvegicus
tggaggcttgtctcagtatctgcta

SEQ ID NO: 630765 - DNA, 25 bp, Rattus norvegicus
tggagggaaccccacacagtgcaga

SEQ ID NO: 630766 - DNA, 25 bp, Rattus norvegicus
tggagggaacccgacacagtgcaga

SEQ ID NO: 630767 - DNA, 25 bp, Rattus norvegicus
tggagggacaccctcatgtctctat

SEQ ID NO: 630768 - DNA, 25 bp, Rattus norvegicus
tggagggacaccgtcatgtctctat

SEQ ID NO: 630769 - DNA, 25 bp, Rattus norvegicus
tggagggacgttagggcatctccca

SEQ ID NO: 630770 - DNA, 25 bp, Rattus norvegicus
tggagggacgtttgggcatctccca

SEQ ID NO: 630771 - DNA, 25 bp, Rattus norvegicus
tggagggagagtccataaccttttt

SEQ ID NO: 630772 - DNA, 25 bp, Rattus norvegicus
tggagggagagtgcataaccttttt

SEQ ID NO: 630773 - DNA, 25 bp, Rattus norvegicus
tggagggaggctacctgcacgctct

SEQ ID NO: 630774 - DNA, 25 bp, Rattus norvegicus
tggagggaggcttcctgcacgctct

SEQ ID NO: 630775 - DNA, 25 bp, Rattus norvegicus
tggagggagggcactcacacacact

SEQ ID NO: 630776 - DNA, 25 bp, Rattus norvegicus
tggagggagggctctcacacacact

SEQ ID NO: 630777 - DNA, 25 bp, Rattus norvegicus
tggagggattaccttccttctaaag

SEQ ID NO: 630778 - DNA, 25 bp, Rattus norvegicus
tggagggattacgttccttctaaag

SEQ ID NO: 630779 - DNA, 25 bp, Rattus norvegicus
tggagggcaaacctttttaatatag

SEQ ID NO: 630780 - DNA, 25 bp, Rattus norvegicus
tggagggcaaacgtttttaatatag

SEQ ID NO: 630781 - DNA, 25 bp, Rattus norvegicus
tggagggcacagcacttctccccat

SEQ ID NO: 630782 - DNA, 25 bp, Rattus norvegicus
tggagggcacaggacttctccccat

SEQ ID NO: 630783 - DNA, 25 bp, Rattus norvegicus
tggagggcagagaacttctggtctc

SEQ ID NO: 630784 - DNA, 25 bp, Rattus norvegicus
tggagggcagagtacttctggtctc

SEQ ID NO: 630785 - DNA, 25 bp, Rattus norvegicus
tggagggcccaaagtcgctgtaaac

SEQ ID NO: 630786 - DNA, 25 bp, Rattus norvegicus
tggagggcccaatgtcgctgtaaac

SEQ ID NO: 630787 - DNA, 25 bp, Rattus norvegicus
tggagggcccagagttctcgacaga

SEQ ID NO: 630788 - DNA, 25 bp, Rattus norvegicus
tggagggcccagtgttctcgacaga

SEQ ID NO: 630789 - DNA, 25 bp, Rattus norvegicus
tggagggcccatatgacattcacag

SEQ ID NO: 630790 - DNA, 25 bp, Rattus norvegicus
tggagggcccatttgacattcacag

SEQ ID NO: 630791 - DNA, 25 bp, Rattus norvegicus
tggagggccctaacctgctgctgaa

SEQ ID NO: 630792 - DNA, 25 bp, Rattus norvegicus
tggagggccctatcctgctgctgaa

SEQ ID NO: 630793 - DNA, 25 bp, Rattus norvegicus
tggagggcctggactaacacacttc

SEQ ID NO: 630794 - DNA, 25 bp, Rattus norvegicus
tggagggcctggtctaacacacttc

SEQ ID NO: 630795 - DNA, 25 bp, Rattus norvegicus
tggagggcgcccaacagaaatggac

SEQ ID NO: 630796 - DNA, 25 bp, Rattus norvegicus
tggagggcgccctacagaaatggac

SEQ ID NO: 630797 - DNA, 25 bp, Rattus norvegicus
tggagggctcctctaaggtgacaat

SEQ ID NO: 630798 - DNA, 25 bp, Rattus norvegicus
tggagggctcctgtaaggtgacaat

SEQ ID NO: 630799 - DNA, 25 bp, Rattus norvegicus
tggagggctctgaacaaccttctaa

SEQ ID NO: 630800 - DNA, 25 bp, Rattus norvegicus
tggagggctctgtacaaccttctaa

SEQ ID NO: 630801 - DNA, 25 bp, Rattus norvegicus
tggagggtaggcacagttcccatgt

SEQ ID NO: 630802 - DNA, 25 bp, Rattus norvegicus
tggagggtaggctcagttcccatgt

SEQ ID NO: 630803 - DNA, 25 bp, Rattus norvegicus
tggagggtatccagtccccagagga

SEQ ID NO: 630804 - DNA, 25 bp, Rattus norvegicus
tggagggtatcctgtccccagagga

SEQ ID NO: 630805 - DNA, 25 bp, Rattus norvegicus
tggagggtccaacatttcagtgctt

SEQ ID NO: 630806 - DNA, 25 bp, Rattus norvegicus
tggagggtccaagatttcagtgctt

SEQ ID NO: 630807 - DNA, 25 bp, Rattus norvegicus
tggagggtcctcacaaaaatccgcg

SEQ ID NO: 630808 - DNA, 25 bp, Rattus norvegicus
tggagggtcctctcaaaaatccgcg

SEQ ID NO: 630809 - DNA, 25 bp, Rattus norvegicus
tggagggtgtctactgccagcccag

SEQ ID NO: 630810 - DNA, 25 bp, Rattus norvegicus
tggagggtgtcttctgccagcccag

SEQ ID NO: 630811 - DNA, 25 bp, Rattus norvegicus
tggaggtaacagatcctgcccaagt

SEQ ID NO: 630812 - DNA, 25 bp, Rattus norvegicus
tggaggtaacagttcctgcccaagt

SEQ ID NO: 630813 - DNA, 25 bp, Rattus norvegicus
tggaggtacggacagaccctaccca

SEQ ID NO: 630814 - DNA, 25 bp, Rattus norvegicus
tggaggtacggagagaccctaccca

SEQ ID NO: 630815 - DNA, 25 bp, Rattus norvegicus
tggaggtcaccaaggcactctggac

SEQ ID NO: 630816 - DNA, 25 bp, Rattus norvegicus
tggaggtcaccatggcactctggac

SEQ ID NO: 630817 - DNA, 25 bp, Rattus norvegicus
tggaggtcacgcagggcttcattgt

SEQ ID NO: 630818 - DNA, 25 bp, Rattus norvegicus
tggaggtcacgctgggcttcattgt

SEQ ID NO: 630819 - DNA, 25 bp, Rattus norvegicus
tggaggtcacgtatggcaatccgtc

SEQ ID NO: 630820 - DNA, 25 bp, Rattus norvegicus
tggaggtcacgtttggcaatccgtc

SEQ ID NO: 630821 - DNA, 25 bp, Rattus norvegicus
tggaggtcactgactgggactatga

SEQ ID NO: 630822 - DNA, 25 bp, Rattus norvegicus
tggaggtcactgtctgggactatga

SEQ ID NO: 630823 - DNA, 25 bp, Rattus norvegicus
tggaggtcacttaccgggaacgact

SEQ ID NO: 630824 - DNA, 25 bp, Rattus norvegicus
tggaggtcactttccgggaacgact

SEQ ID NO: 630825 - DNA, 25 bp, Rattus norvegicus
tggaggtcatctacaacagccggta

SEQ ID NO: 630826 - DNA, 25 bp, Rattus norvegicus
tggaggtcatcttcaacagccggta

SEQ ID NO: 630827 - DNA, 25 bp, Rattus norvegicus
tggaggtccacgctgtttgccagac

SEQ ID NO: 630828 - DNA, 25 bp, Rattus norvegicus
tggaggtccacggtgtttgccagac

SEQ ID NO: 630829 - DNA, 25 bp, Rattus norvegicus
tggaggtccctgaggctcttggtga

SEQ ID NO: 630830 - DNA, 25 bp, Rattus norvegicus
tggaggtccctgtggctcttggtga

SEQ ID NO: 630831 - DNA, 25 bp, Rattus norvegicus
tggaggtcgctgaactgccttctgc

SEQ ID NO: 630832 - DNA, 25 bp, Rattus norvegicus
tggaggtcgctgtactgccttctgc

SEQ ID NO: 630833 - DNA, 25 bp, Rattus norvegicus
tggaggtcgggcaactcatttgcct

SEQ ID NO: 630834 - DNA, 25 bp, Rattus norvegicus
tggaggtcgggctactcatttgcct

SEQ ID NO: 630835 - DNA, 25 bp, Rattus norvegicus
tggaggtctgtcagtcgggcactct

SEQ ID NO: 630836 - DNA, 25 bp, Rattus norvegicus
tggaggtctgtctgtcgggcactct

SEQ ID NO: 630837 - DNA, 25 bp, Rattus norvegicus
tggaggtcttctatcccaagttcaa

SEQ ID NO: 630838 - DNA, 25 bp, Rattus norvegicus
tggaggtcttctttcccaagttcaa

SEQ ID NO: 630839 - DNA, 25 bp, Rattus norvegicus
tggaggtgcaacagctgggccacac

SEQ ID NO: 630840 - DNA, 25 bp, Rattus norvegicus
tggaggtgcaactgctgggccacac

SEQ ID NO: 630841 - DNA, 25 bp, Rattus norvegicus
tggaggtgcaccacgtccatcctgg

SEQ ID NO: 630842 - DNA, 25 bp, Rattus norvegicus
tggaggtgcacctcgtccatcctgg

SEQ ID NO: 630843 - DNA, 25 bp, Rattus norvegicus
tggaggtgccatagccctgggtcac

SEQ ID NO: 630844 - DNA, 25 bp, Rattus norvegicus
tggaggtgccattgccctgggtcac

SEQ ID NO: 630845 - DNA, 25 bp, Rattus norvegicus
tggaggtgccctatgtggaccgcaa

SEQ ID NO: 630846 - DNA, 25 bp, Rattus norvegicus
tggaggtgccctttgtggaccgcaa

SEQ ID NO: 630847 - DNA, 25 bp, Rattus norvegicus
tggaggtggtcaaccaagcccagtt

SEQ ID NO: 630848 - DNA, 25 bp, Rattus norvegicus
tggaggtggtcatccaagcccagtt

SEQ ID NO: 630849 - DNA, 25 bp, Rattus norvegicus
tggaggtgtaagatctcagccccac

SEQ ID NO: 630850 - DNA, 25 bp, Rattus norvegicus
tggaggtgtaagttctcagccccac

SEQ ID NO: 630851 - DNA, 25 bp, Rattus norvegicus
tggaggtgttttctgtcccacccct

SEQ ID NO: 630852 - DNA, 25 bp, Rattus norvegicus
tggaggtgttttgtgtcccacccct

SEQ ID NO: 630853 - DNA, 25 bp, Rattus norvegicus
tggaggttagacacacagcaggaac

SEQ ID NO: 630854 - DNA, 25 bp, Rattus norvegicus
tggaggttagactcacagcaggaac

SEQ ID NO: 630855 - DNA, 25 bp, Rattus norvegicus
tggaggttctgaccacagtacctgc

SEQ ID NO: 630856 - DNA, 25 bp, Rattus norvegicus
tggaggttctgagcacagtacctgc

SEQ ID NO: 630857 - DNA, 25 bp, Rattus norvegicus
tggaggttgtttctcttttctgctc

SEQ ID NO: 630858 - DNA, 25 bp, Rattus norvegicus
tggaggttgtttgtcttttctgctc

SEQ ID NO: 630859 - DNA, 25 bp, Rattus norvegicus
tggaggttttgtctgtcgacttgac

SEQ ID NO: 630860 - DNA, 25 bp, Rattus norvegicus
tggaggttttgtgtgtcgacttgac

SEQ ID NO: 630861 - DNA, 25 bp, Rattus norvegicus
tggagtaaagtcaggccttcaccta

SEQ ID NO: 630862 - DNA, 25 bp, Rattus norvegicus
tggagtaaagtctggccttcaccta

SEQ ID NO: 630863 - DNA, 25 bp, Rattus norvegicus
tggagtaaatccagccctttctcat

SEQ ID NO: 630864 - DNA, 25 bp, Rattus norvegicus
tggagtaaatcctgccctttctcat

SEQ ID NO: 630865 - DNA, 25 bp, Rattus norvegicus
tggagtaacctcagggacttcctgt

SEQ ID NO: 630866 - DNA, 25 bp, Rattus norvegicus
tggagtaacctctgggacttcctgt

SEQ ID NO: 630867 - DNA, 25 bp, Rattus norvegicus
tggagtaactcaacttcaagtggtt

SEQ ID NO: 630868 - DNA, 25 bp, Rattus norvegicus
tggagtaactcatcttcaagtggtt

SEQ ID NO: 630869 - DNA, 25 bp, Rattus norvegicus
tggagtaactgcatctccacagcac

SEQ ID NO: 630870 - DNA, 25 bp, Rattus norvegicus
tggagtaactgcttctccacagcac

SEQ ID NO: 630871 - DNA, 25 bp, Rattus norvegicus
tggagtaagtccaggtccagcacac

SEQ ID NO: 630872 - DNA, 25 bp, Rattus norvegicus
tggagtaagtcctggtccagcacac

SEQ ID NO: 630873 - DNA, 25 bp, Rattus norvegicus
tggagtacacccatcggaaacgact

SEQ ID NO: 630874 - DNA, 25 bp, Rattus norvegicus
tggagtacacccttcggaaacgact

SEQ ID NO: 630875 - DNA, 25 bp, Rattus norvegicus
tggagtacactgaattctacccctg

SEQ ID NO: 630876 - DNA, 25 bp, Rattus norvegicus
tggagtacactgtattctacccctg

SEQ ID NO: 630877 - DNA, 25 bp, Rattus norvegicus
tggagtacatttattctgttttctt

SEQ ID NO: 630878 - DNA, 25 bp, Rattus norvegicus
tggagtacattttttctgttttctt

SEQ ID NO: 630879 - DNA, 25 bp, Rattus norvegicus
tggagtaccttcagtcccttcaaac

SEQ ID NO: 630880 - DNA, 25 bp, Rattus norvegicus
tggagtaccttctgtcccttcaaac

SEQ ID NO: 630881 - DNA, 25 bp, Rattus norvegicus
tggagtactgttcagtctctgcgtc

SEQ ID NO: 630882 - DNA, 25 bp, Rattus norvegicus
tggagtactgttgagtctctgcgtc

SEQ ID NO: 630883 - DNA, 25 bp, Rattus norvegicus
tggagtagagttcagcacacaagtg

SEQ ID NO: 630884 - DNA, 25 bp, Rattus norvegicus
tggagtagagttgagcacacaagtg

SEQ ID NO: 630885 - DNA, 25 bp, Rattus norvegicus
tggagtagcaggacaccattctctc

SEQ ID NO: 630886 - DNA, 25 bp, Rattus norvegicus
tggagtagcaggtcaccattctctc

SEQ ID NO: 630887 - DNA, 25 bp, Rattus norvegicus
tggagtagcctcaccagagagaaat

SEQ ID NO: 630888 - DNA, 25 bp, Rattus norvegicus
tggagtagcctctccagagagaaat

SEQ ID NO: 630889 - DNA, 25 bp, Rattus norvegicus
tggagtagctgccattctccgcttc

SEQ ID NO: 630890 - DNA, 25 bp, Rattus norvegicus
tggagtagctgcgattctccgcttc

SEQ ID NO: 630891 - DNA, 25 bp, Rattus norvegicus
tggagtatcagcaaaataattttat

SEQ ID NO: 630892 - DNA, 25 bp, Rattus norvegicus
tggagtatcagctaaataattttat

SEQ ID NO: 630893 - DNA, 25 bp, Rattus norvegicus
tggagtatccggagtgttagcgcct

SEQ ID NO: 630894 - DNA, 25 bp, Rattus norvegicus
tggagtatccggtgtgttagcgcct

SEQ ID NO: 630895 - DNA, 25 bp, Rattus norvegicus
tggagtatctgtcgtttttgtcaac

SEQ ID NO: 630896 - DNA, 25 bp, Rattus norvegicus
tggagtatctgtggtttttgtcaac

SEQ ID NO: 630897 - DNA, 25 bp, Rattus norvegicus
tggagtatgcatatgcccacttcaa

SEQ ID NO: 630898 - DNA, 25 bp, Rattus norvegicus
tggagtatgcatttgcccacttcaa

SEQ ID NO: 630899 - DNA, 25 bp, Rattus norvegicus
tggagtattcctccggtccatctca

SEQ ID NO: 630900 - DNA, 25 bp, Rattus norvegicus
tggagtattcctgcggtccatctca

SEQ ID NO: 630901 - DNA, 25 bp, Rattus norvegicus
tggagtcaaacacaccagttggtcc

SEQ ID NO: 630902 - DNA, 25 bp, Rattus norvegicus
tggagtcaaacagaccagttggtcc

SEQ ID NO: 630903 - DNA, 25 bp, Rattus norvegicus
tggagtcaagacagctgtcgccatg

SEQ ID NO: 630904 - DNA, 25 bp, Rattus norvegicus
tggagtcaagactgctgtcgccatg

SEQ ID NO: 630905 - DNA, 25 bp, Rattus norvegicus
tggagtcaatctacatgtgcctggc

SEQ ID NO: 630906 - DNA, 25 bp, Rattus norvegicus
tggagtcaatcttcatgtgcctggc

SEQ ID NO: 630907 - DNA, 25 bp, Rattus norvegicus
tggagtcaccccaagaaacccttgc

SEQ ID NO: 630908 - DNA, 25 bp, Rattus norvegicus
tggagtcacccctagaaacccttgc

SEQ ID NO: 630909 - DNA, 25 bp, Rattus norvegicus
tggagtcaccgaacacgatgaggcg

SEQ ID NO: 630910 - DNA, 25 bp, Rattus norvegicus
tggagtcaccgatcacgatgaggcg

SEQ ID NO: 630911 - DNA, 25 bp, Rattus norvegicus
tggagtcagacacgagttcaaggcc

SEQ ID NO: 630912 - DNA, 25 bp, Rattus norvegicus
tggagtcagacaggagttcaaggcc

SEQ ID NO: 630913 - DNA, 25 bp, Rattus norvegicus
tggagtcagactccctaagcccaaa

SEQ ID NO: 630914 - DNA, 25 bp, Rattus norvegicus
tggagtcagactccgctctgaggac

SEQ ID NO: 630915 - DNA, 25 bp, Rattus norvegicus
tggagtcagactgcctaagcccaaa

SEQ ID NO: 630916 - DNA, 25 bp, Rattus norvegicus
tggagtcagactgcgctctgaggac

SEQ ID NO: 630917 - DNA, 25 bp, Rattus norvegicus
tggagtcaggatccacaaagaaatt

SEQ ID NO: 630918 - DNA, 25 bp, Rattus norvegicus
tggagtcaggatgcacaaagaaatt

SEQ ID NO: 630919 - DNA, 25 bp, Rattus norvegicus
tggagtccaatcagagtccctcaca

SEQ ID NO: 630920 - DNA, 25 bp, Rattus norvegicus
tggagtccaatctgagtccctcaca

SEQ ID NO: 630921 - DNA, 25 bp, Rattus norvegicus
tggagtccaccaccattgagtatgt

SEQ ID NO: 630922 - DNA, 25 bp, Rattus norvegicus
tggagtccaccagcattgagtatgt

SEQ ID NO: 630923 - DNA, 25 bp, Rattus norvegicus
tggagtccacctatctgctgtatat

SEQ ID NO: 630924 - DNA, 25 bp, Rattus norvegicus
tggagtccacctcgaacccaaggga

SEQ ID NO: 630925 - DNA, 25 bp, Rattus norvegicus
tggagtccacctggaacccaaggga

SEQ ID NO: 630926 - DNA, 25 bp, Rattus norvegicus
tggagtccacctttctgctgtatat

SEQ ID NO: 630927 - DNA, 25 bp, Rattus norvegicus
tggagtccacttcatcttcaacaag

SEQ ID NO: 630928 - DNA, 25 bp, Rattus norvegicus
tggagtccacttgatcttcaacaag

SEQ ID NO: 630929 - DNA, 25 bp, Rattus norvegicus
tggagtccagatcgctcaagcaggc

SEQ ID NO: 630930 - DNA, 25 bp, Rattus norvegicus
tggagtccagatggctcaagcaggc

SEQ ID NO: 630931 - DNA, 25 bp, Rattus norvegicus
tggagtccagcaactctaacctggt

SEQ ID NO: 630932 - DNA, 25 bp, Rattus norvegicus
tggagtccagcatctctaacctggt

SEQ ID NO: 630933 - DNA, 25 bp, Rattus norvegicus
tggagtccaggaagtcctccgtgaa

SEQ ID NO: 630934 - DNA, 25 bp, Rattus norvegicus
tggagtccaggatgtcctccgtgaa

SEQ ID NO: 630935 - DNA, 25 bp, Rattus norvegicus
tggagtccaggcagttcctcagttt

SEQ ID NO: 630936 - DNA, 25 bp, Rattus norvegicus
tggagtccaggctgttcctcagttt

SEQ ID NO: 630937 - DNA, 25 bp, Rattus norvegicus
tggagtccagtccaagcacgatgtc

SEQ ID NO: 630938 - DNA, 25 bp, Rattus norvegicus
tggagtccagtcgaagcacgatgtc

SEQ ID NO: 630939 - DNA, 25 bp, Rattus norvegicus
tggagtccatatatcaggctgttga

SEQ ID NO: 630940 - DNA, 25 bp, Rattus norvegicus
tggagtccatatttcaggctgttga

SEQ ID NO: 630941 - DNA, 25 bp, Rattus norvegicus
tggagtccatggagcgctttgacgt

SEQ ID NO: 630942 - DNA, 25 bp, Rattus norvegicus
tggagtccatggtgcgctttgacgt

SEQ ID NO: 630943 - DNA, 25 bp, Rattus norvegicus
tggagtcccactattggccacggga

SEQ ID NO: 630944 - DNA, 25 bp, Rattus norvegicus
tggagtcccacttttggccacggga

SEQ ID NO: 630945 - DNA, 25 bp, Rattus norvegicus
tggagtcccatcctgtgtgcagtga

SEQ ID NO: 630946 - DNA, 25 bp, Rattus norvegicus
tggagtcccatcgtgtgtgcagtga

SEQ ID NO: 630947 - DNA, 25 bp, Rattus norvegicus
tggagtcccatgagtgctcttgagg

SEQ ID NO: 630948 - DNA, 25 bp, Rattus norvegicus
tggagtcccatgcagcctcatttgc

SEQ ID NO: 630949 - DNA, 25 bp, Rattus norvegicus
tggagtcccatggagcctcatttgc

SEQ ID NO: 630950 - DNA, 25 bp, Rattus norvegicus
tggagtcccatgtgtgctcttgagg

SEQ ID NO: 630951 - DNA, 25 bp, Rattus norvegicus
tggagtcccattccctatccctgat

SEQ ID NO: 630952 - DNA, 25 bp, Rattus norvegicus
tggagtcccattgcctatccctgat

SEQ ID NO: 630953 - DNA, 25 bp, Rattus norvegicus
tggagtcccggacatctgcaacgca

SEQ ID NO: 630954 - DNA, 25 bp, Rattus norvegicus
tggagtcccggagatctgcaacgca

SEQ ID NO: 630955 - DNA, 25 bp, Rattus norvegicus
tggagtccctcaagcagatgctgat

SEQ ID NO: 630956 - DNA, 25 bp, Rattus norvegicus
tggagtccctcatgcagatgctgat

SEQ ID NO: 630957 - DNA, 25 bp, Rattus norvegicus
tggagtcccttcagtatctctgagt

SEQ ID NO: 630958 - DNA, 25 bp, Rattus norvegicus
tggagtcccttctgtatctctgagt

SEQ ID NO: 630959 - DNA, 25 bp, Rattus norvegicus
tggagtcctcaaaccgcataacaaa

SEQ ID NO: 630960 - DNA, 25 bp, Rattus norvegicus
tggagtcctcaatccgcataacaaa

SEQ ID NO: 630961 - DNA, 25 bp, Rattus norvegicus
tggagtcctcagctgtttgtcctga

SEQ ID NO: 630962 - DNA, 25 bp, Rattus norvegicus
tggagtcctcaggtgtttgtcctga

SEQ ID NO: 630963 - DNA, 25 bp, Rattus norvegicus
tggagtcctctgaaaatgtaattac

SEQ ID NO: 630964 - DNA, 25 bp, Rattus norvegicus
tggagtcctctgtaaatgtaattac

SEQ ID NO: 630965 - DNA, 25 bp, Rattus norvegicus
tggagtcctgctaccaatcatgcta

SEQ ID NO: 630966 - DNA, 25 bp, Rattus norvegicus
tggagtcctgcttccaatcatgcta

SEQ ID NO: 630967 - DNA, 25 bp, Rattus norvegicus
tggagtcctggcaagtcactacatc

SEQ ID NO: 630968 - DNA, 25 bp, Rattus norvegicus
tggagtcctggctagtcactacatc

SEQ ID NO: 630969 - DNA, 25 bp, Rattus norvegicus
tggagtcctttcaacataacaaaat

SEQ ID NO: 630970 - DNA, 25 bp, Rattus norvegicus
tggagtcctttctacataacaaaat

SEQ ID NO: 630971 - DNA, 25 bp, Rattus norvegicus
tggagtcgccgaacgcagagcaaat

SEQ ID NO: 630972 - DNA, 25 bp, Rattus norvegicus
tggagtcgccgatcgcagagcaaat

SEQ ID NO: 630973 - DNA, 25 bp, Rattus norvegicus
tggagtcgccgcagctgctcgacag

SEQ ID NO: 630974 - DNA, 25 bp, Rattus norvegicus
tggagtcgccgctgctgctcgacag

SEQ ID NO: 630975 - DNA, 25 bp, Rattus norvegicus
tggagtcggcgaactttccgcgcga

SEQ ID NO: 630976 - DNA, 25 bp, Rattus norvegicus
tggagtcggcgatctttccgcgcga

SEQ ID NO: 630977 - DNA, 25 bp, Rattus norvegicus
tggagtcggctcaggaagctgcatc

SEQ ID NO: 630978 - DNA, 25 bp, Rattus norvegicus
tggagtcggctctggaagctgcatc

SEQ ID NO: 630979 - DNA, 25 bp, Rattus norvegicus
tggagtcgttgacgctcttctggaa

SEQ ID NO: 630980 - DNA, 25 bp, Rattus norvegicus
tggagtcgttgaggctcttctggaa

SEQ ID NO: 630981 - DNA, 25 bp, Rattus norvegicus
tggagtctacagctcacctcttgag

SEQ ID NO: 630982 - DNA, 25 bp, Rattus norvegicus
tggagtctacaggtcacctcttgag

SEQ ID NO: 630983 - DNA, 25 bp, Rattus norvegicus
tggagtctatcccttttaaagttgt

SEQ ID NO: 630984 - DNA, 25 bp, Rattus norvegicus
tggagtctatccgttttaaagttgt

SEQ ID NO: 630985 - DNA, 25 bp, Rattus norvegicus
tggagtctccagatgtgcagctgaa

SEQ ID NO: 630986 - DNA, 25 bp, Rattus norvegicus
tggagtctccagttgtgcagctgaa

SEQ ID NO: 630987 - DNA, 25 bp, Rattus norvegicus
tggagtctcccaactccactttttc

SEQ ID NO: 630988 - DNA, 25 bp, Rattus norvegicus
tggagtctcccatctccactttttc

SEQ ID NO: 630989 - DNA, 25 bp, Rattus norvegicus
tggagtctcctgcaagttcttctga

SEQ ID NO: 630990 - DNA, 25 bp, Rattus norvegicus
tggagtctcctggaagttcttctga

SEQ ID NO: 630991 - DNA, 25 bp, Rattus norvegicus
tggagtctccttattgcttcggctg

SEQ ID NO: 630992 - DNA, 25 bp, Rattus norvegicus
tggagtctcctttttgcttcggctg

SEQ ID NO: 630993 - DNA, 25 bp, Rattus norvegicus
tggagtctctgaccgcagtcatggc

SEQ ID NO: 630994 - DNA, 25 bp, Rattus norvegicus
tggagtctctgagcgcagtcatggc

SEQ ID NO: 630995 - DNA, 25 bp, Rattus norvegicus
tggagtctcttaagtcagacccaca

SEQ ID NO: 630996 - DNA, 25 bp, Rattus norvegicus
tggagtctcttatgtcagacccaca

SEQ ID NO: 630997 - DNA, 25 bp, Rattus norvegicus
tggagtctgacccaggtgagtcctt

SEQ ID NO: 630998 - DNA, 25 bp, Rattus norvegicus
tggagtctgaccgaggtgagtcctt

SEQ ID NO: 630999 - DNA, 25 bp, Rattus norvegicus
tggagtctgagcagccactgagttg

SEQ ID NO: 631000 - DNA, 25 bp, Rattus norvegicus
tggagtctgagctgccactgagttg

SEQ ID NO: 631001 - DNA, 25 bp, Rattus norvegicus
tggagtcttacgcacctcagaaccc

SEQ ID NO: 631002 - DNA, 25 bp, Rattus norvegicus
tggagtcttacggacctcagaaccc

SEQ ID NO: 631003 - DNA, 25 bp, Rattus norvegicus
tggagtcttagtagacacttgtcat

SEQ ID NO: 631004 - DNA, 25 bp, Rattus norvegicus
tggagtcttagttgacacttgtcat

SEQ ID NO: 631005 - DNA, 25 bp, Rattus norvegicus
tggagtcttccgctcactcgacgct

SEQ ID NO: 631006 - DNA, 25 bp, Rattus norvegicus
tggagtcttccggtcactcgacgct

SEQ ID NO: 631007 - DNA, 25 bp, Rattus norvegicus
tggagtcttcctcgccctggttgta

SEQ ID NO: 631008 - DNA, 25 bp, Rattus norvegicus
tggagtcttcctggccctggttgta

SEQ ID NO: 631009 - DNA, 25 bp, Rattus norvegicus
tggagtcttgtaatcatcccagcca

SEQ ID NO: 631010 - DNA, 25 bp, Rattus norvegicus
tggagtcttgtattcatcccagcca

SEQ ID NO: 631011 - DNA, 25 bp, Rattus norvegicus
tggagtctttttcgtaaacatcaaa

SEQ ID NO: 631012 - DNA, 25 bp, Rattus norvegicus
tggagtctttttggtaaacatcaaa

SEQ ID NO: 631013 - DNA, 25 bp, Rattus norvegicus
tggagtgaacccatgggcgggccga

SEQ ID NO: 631014 - DNA, 25 bp, Rattus norvegicus
tggagtgaacccttgggcgggccga

SEQ ID NO: 631015 - DNA, 25 bp, Rattus norvegicus
tggagtgaatttcgcctcagtgacc

SEQ ID NO: 631016 - DNA, 25 bp, Rattus norvegicus
tggagtgaatttggcctcagtgacc

SEQ ID NO: 631017 - DNA, 25 bp, Rattus norvegicus
tggagtgacaaaaccaacctcaaat

SEQ ID NO: 631018 - DNA, 25 bp, Rattus norvegicus
tggagtgacaaatccaacctcaaat

SEQ ID NO: 631019 - DNA, 25 bp, Rattus norvegicus
tggagtgacagaaccgacctcagat

SEQ ID NO: 631020 - DNA, 25 bp, Rattus norvegicus
tggagtgacagatccgacctcagat

SEQ ID NO: 631021 - DNA, 25 bp, Rattus norvegicus
tggagtgactgcatggtacccaccc

SEQ ID NO: 631022 - DNA, 25 bp, Rattus norvegicus
tggagtgactgcttggtacccaccc

SEQ ID NO: 631023 - DNA, 25 bp, Rattus norvegicus
tggagtgactggaggaccccttttc

SEQ ID NO: 631024 - DNA, 25 bp, Rattus norvegicus
tggagtgactggtggaccccttttc

SEQ ID NO: 631025 - DNA, 25 bp, Rattus norvegicus
tggagtgagactccctgactggaca

SEQ ID NO: 631026 - DNA, 25 bp, Rattus norvegicus
tggagtgagactgcctgactggaca

SEQ ID NO: 631027 - DNA, 25 bp, Rattus norvegicus
tggagtgagatcatgacacccctgt

SEQ ID NO: 631028 - DNA, 25 bp, Rattus norvegicus
tggagtgagatcttgacacccctgt

SEQ ID NO: 631029 - DNA, 25 bp, Rattus norvegicus
tggagtgagcccagagcttcagatt

SEQ ID NO: 631030 - DNA, 25 bp, Rattus norvegicus
tggagtgagccctgagcttcagatt

SEQ ID NO: 631031 - DNA, 25 bp, Rattus norvegicus
tggagtgagcttcctgtttcagttc

SEQ ID NO: 631032 - DNA, 25 bp, Rattus norvegicus
tggagtgagcttgctgtttcagttc

SEQ ID NO: 631033 - DNA, 25 bp, Rattus norvegicus
tggagtgagtgacaccctagcaagc

SEQ ID NO: 631034 - DNA, 25 bp, Rattus norvegicus
tggagtgagtgagaccctagcaagc

SEQ ID NO: 631035 - DNA, 25 bp, Rattus norvegicus
tggagtgatatcagttctcgcccag

SEQ ID NO: 631036 - DNA, 25 bp, Rattus norvegicus
tggagtgatatctgttctcgcccag

SEQ ID NO: 631037 - DNA, 25 bp, Rattus norvegicus
tggagtgcagccacagctagcaact

SEQ ID NO: 631038 - DNA, 25 bp, Rattus norvegicus
tggagtgcagcctcagctagcaact

SEQ ID NO: 631039 - DNA, 25 bp, Rattus norvegicus
tggagtgccaccaaagagcctttta

SEQ ID NO: 631040 - DNA, 25 bp, Rattus norvegicus
tggagtgccacctaagagcctttta

SEQ ID NO: 631041 - DNA, 25 bp, Rattus norvegicus
tggagtgccacgaatgtgcctacaa

SEQ ID NO: 631042 - DNA, 25 bp, Rattus norvegicus
tggagtgccacgtatgtgcctacaa

SEQ ID NO: 631043 - DNA, 25 bp, Rattus norvegicus
tggagtgccgcgactgctgcagcct

SEQ ID NO: 631044 - DNA, 25 bp, Rattus norvegicus
tggagtgccgcgtctgctgcagcct

SEQ ID NO: 631045 - DNA, 25 bp, Rattus norvegicus
tggagtgcctcacctgatcctgttt

SEQ ID NO: 631046 - DNA, 25 bp, Rattus norvegicus
tggagtgcctcagctgatcctgttt

SEQ ID NO: 631047 - DNA, 25 bp, Rattus norvegicus
tggagtgcctgcatatcattctgac

SEQ ID NO: 631048 - DNA, 25 bp, Rattus norvegicus
tggagtgcctgcttatcattctgac

SEQ ID NO: 631049 - DNA, 25 bp, Rattus norvegicus
tggagtgccttgacgatgcccggat

SEQ ID NO: 631050 - DNA, 25 bp, Rattus norvegicus
tggagtgccttgtcgatgcccggat

SEQ ID NO: 631051 - DNA, 25 bp, Rattus norvegicus
tggagtgcgcttaccatctggagaa

SEQ ID NO: 631052 - DNA, 25 bp, Rattus norvegicus
tggagtgcgctttccatctggagaa

SEQ ID NO: 631053 - DNA, 25 bp, Rattus norvegicus
tggagtgcgggtacgccacgatcaa

SEQ ID NO: 631054 - DNA, 25 bp, Rattus norvegicus
tggagtgcgggttcgccacgatcaa

SEQ ID NO: 631055 - DNA, 25 bp, Rattus norvegicus
tggagtgctccaccctcagccaaga

SEQ ID NO: 631056 - DNA, 25 bp, Rattus norvegicus
tggagtgctccagcctcagccaaga

SEQ ID NO: 631057 - DNA, 25 bp, Rattus norvegicus
tggagtgctcttatcttctgctcaa

SEQ ID NO: 631058 - DNA, 25 bp, Rattus norvegicus
tggagtgctcttttcttctgctcaa

SEQ ID NO: 631059 - DNA, 25 bp, Rattus norvegicus
tggagtgctgccagttaaccacctg

SEQ ID NO: 631060 - DNA, 25 bp, Rattus norvegicus
tggagtgctgcctgttaaccacctg

SEQ ID NO: 631061 - DNA, 25 bp, Rattus norvegicus
tggagtgctgtcaactttctgccag

SEQ ID NO: 631062 - DNA, 25 bp, Rattus norvegicus
tggagtgctgtctactttctgccag

SEQ ID NO: 631063 - DNA, 25 bp, Rattus norvegicus
tggagtgcttttaatcctgatgata

SEQ ID NO: 631064 - DNA, 25 bp, Rattus norvegicus
tggagtgctttttatcctgatgata

SEQ ID NO: 631065 - DNA, 25 bp, Rattus norvegicus
tggagtggatctccctttgctgctc

SEQ ID NO: 631066 - DNA, 25 bp, Rattus norvegicus
tggagtggatctgcctttgctgctc

SEQ ID NO: 631067 - DNA, 25 bp, Rattus norvegicus
tggagtggcatgacccaggctcgca

SEQ ID NO: 631068 - DNA, 25 bp, Rattus norvegicus
tggagtggcatgtcccaggctcgca

SEQ ID NO: 631069 - DNA, 25 bp, Rattus norvegicus
tggagtggcattctctgcttggcca

SEQ ID NO: 631070 - DNA, 25 bp, Rattus norvegicus
tggagtggcattgtctgcttggcca

SEQ ID NO: 631071 - DNA, 25 bp, Rattus norvegicus
tggagtggccggatgaaagctcatc

SEQ ID NO: 631072 - DNA, 25 bp, Rattus norvegicus
tggagtggccggttgaaagctcatc

SEQ ID NO: 631073 - DNA, 25 bp, Rattus norvegicus
tggagtggtaacctttcaacctgtt

SEQ ID NO: 631074 - DNA, 25 bp, Rattus norvegicus
tggagtggtaacgtttcaacctgtt

SEQ ID NO: 631075 - DNA, 25 bp, Rattus norvegicus
tggagtgtacaccatctttgccatc

SEQ ID NO: 631076 - DNA, 25 bp, Rattus norvegicus
tggagtgtacacgatctttgccatc

SEQ ID NO: 631077 - DNA, 25 bp, Rattus norvegicus
tggagtgtcccgagaggccttgtca

SEQ ID NO: 631078 - DNA, 25 bp, Rattus norvegicus
tggagtgtcccgtgaggccttgtca

SEQ ID NO: 631079 - DNA, 25 bp, Rattus norvegicus
tggagtgtctctcatctgagcttta

SEQ ID NO: 631080 - DNA, 25 bp, Rattus norvegicus
tggagtgtctctgatctgagcttta

SEQ ID NO: 631081 - DNA, 25 bp, Rattus norvegicus
tggagtgtgacacctgttctaccgc

SEQ ID NO: 631082 - DNA, 25 bp, Rattus norvegicus
tggagtgtgacagctgttctaccgc

SEQ ID NO: 631083 - DNA, 25 bp, Rattus norvegicus
tggagtgtgttgatcagccactgaa

SEQ ID NO: 631084 - DNA, 25 bp, Rattus norvegicus
tggagtgtgttgttcagccactgaa

SEQ ID NO: 631085 - DNA, 25 bp, Rattus norvegicus
tggagtgtttctacagcttcgtgcc

SEQ ID NO: 631086 - DNA, 25 bp, Rattus norvegicus
tggagtgtttcttcagcttcgtgcc

SEQ ID NO: 631087 - DNA, 25 bp, Rattus norvegicus
tggagttaaagaacgacgccgcttc

SEQ ID NO: 631088 - DNA, 25 bp, Rattus norvegicus
tggagttaaagatcgacgccgcttc

SEQ ID NO: 631089 - DNA, 25 bp, Rattus norvegicus
tggagttaaaggcacaccaccacac

SEQ ID NO: 631090 - DNA, 25 bp, Rattus norvegicus
tggagttaaagggacaccaccacac

SEQ ID NO: 631091 - DNA, 25 bp, Rattus norvegicus
tggagttaaattatctttcacctat

SEQ ID NO: 631092 - DNA, 25 bp, Rattus norvegicus
tggagttaaattttctttcacctat

SEQ ID NO: 631093 - DNA, 25 bp, Rattus norvegicus
tggagttacattatccttattggta

SEQ ID NO: 631094 - DNA, 25 bp, Rattus norvegicus
tggagttacattttccttattggta

SEQ ID NO: 631095 - DNA, 25 bp, Rattus norvegicus
tggagttactcactcgtttacttcc

SEQ ID NO: 631096 - DNA, 25 bp, Rattus norvegicus
tggagttactcagtcgtttacttcc

SEQ ID NO: 631097 - DNA, 25 bp, Rattus norvegicus
tggagttactcccagctgccgaggc

SEQ ID NO: 631098 - DNA, 25 bp, Rattus norvegicus
tggagttactccgagctgccgaggc

SEQ ID NO: 631099 - DNA, 25 bp, Rattus norvegicus
tggagttaggatcaccctgcaccct

SEQ ID NO: 631100 - DNA, 25 bp, Rattus norvegicus
tggagttaggatgaccctgcaccct

SEQ ID NO: 631101 - DNA, 25 bp, Rattus norvegicus
tggagttattaaaggccagcctgtg

SEQ ID NO: 631102 - DNA, 25 bp, Rattus norvegicus
tggagttattaatggccagcctgtg

SEQ ID NO: 631103 - DNA, 25 bp, Rattus norvegicus
tggagttattctccaatttcttctt

SEQ ID NO: 631104 - DNA, 25 bp, Rattus norvegicus
tggagttattctgcaatttcttctt

SEQ ID NO: 631105 - DNA, 25 bp, Rattus norvegicus
tggagttcaaataacctctgctaat

SEQ ID NO: 631106 - DNA, 25 bp, Rattus norvegicus
tggagttcaaatcctgctcctgcag

SEQ ID NO: 631107 - DNA, 25 bp, Rattus norvegicus
tggagttcaaatgctgctcctgcag

SEQ ID NO: 631108 - DNA, 25 bp, Rattus norvegicus
tggagttcaaattacctctgctaat

SEQ ID NO: 631109 - DNA, 25 bp, Rattus norvegicus
tggagttcaactcgctgtctacatg

SEQ ID NO: 631110 - DNA, 25 bp, Rattus norvegicus
tggagttcaactggctgtctacatg

SEQ ID NO: 631111 - DNA, 25 bp, Rattus norvegicus
tggagttcacaaccctacaactcct

SEQ ID NO: 631112 - DNA, 25 bp, Rattus norvegicus
tggagttcacaagcctacaactcct

SEQ ID NO: 631113 - DNA, 25 bp, Rattus norvegicus
tggagttcagtacgttgcgctgtaa

SEQ ID NO: 631114 - DNA, 25 bp, Rattus norvegicus
tggagttcagtaggttgcgctgtaa

SEQ ID NO: 631115 - DNA, 25 bp, Rattus norvegicus
tggagttcatccacaggctccaggg

SEQ ID NO: 631116 - DNA, 25 bp, Rattus norvegicus
tggagttcatcctcaggctccaggg

SEQ ID NO: 631117 - DNA, 25 bp, Rattus norvegicus
tggagttcatgtagttcaggtggtt

SEQ ID NO: 631118 - DNA, 25 bp, Rattus norvegicus
tggagttcatgttgttcaggtggtt

SEQ ID NO: 631119 - DNA, 25 bp, Rattus norvegicus
tggagttccagaaagcccgcactac

SEQ ID NO: 631120 - DNA, 25 bp, Rattus norvegicus
tggagttccagacccacatacctca

SEQ ID NO: 631121 - DNA, 25 bp, Rattus norvegicus
tggagttccagagccacatacctca

SEQ ID NO: 631122 - DNA, 25 bp, Rattus norvegicus
tggagttccagatagcccgcactac

SEQ ID NO: 631123 - DNA, 25 bp, Rattus norvegicus
tggagttcctggagtgtagtgccaa

SEQ ID NO: 631124 - DNA, 25 bp, Rattus norvegicus
tggagttcctggtgtgtagtgccaa

SEQ ID NO: 631125 - DNA, 25 bp, Rattus norvegicus
tggagttccttcataccaagcctga

SEQ ID NO: 631126 - DNA, 25 bp, Rattus norvegicus
tggagttccttcttaccaagcctga

SEQ ID NO: 631127 - DNA, 25 bp, Rattus norvegicus
tggagttctacaaaggtgcccctga

SEQ ID NO: 631128 - DNA, 25 bp, Rattus norvegicus
tggagttctacataggtgcccctga

SEQ ID NO: 631129 - DNA, 25 bp, Rattus norvegicus
tggagttctagccttggtacccttt

SEQ ID NO: 631130 - DNA, 25 bp, Rattus norvegicus
tggagttctagcgttggtacccttt

SEQ ID NO: 631131 - DNA, 25 bp, Rattus norvegicus
tggagttctcagactgaaccaccaa

SEQ ID NO: 631132 - DNA, 25 bp, Rattus norvegicus
tggagttctcagtctgaaccaccaa

SEQ ID NO: 631133 - DNA, 25 bp, Rattus norvegicus
tggagttctccactgttcaactctg

SEQ ID NO: 631134 - DNA, 25 bp, Rattus norvegicus
tggagttctccagtgttcaactctg

SEQ ID NO: 631135 - DNA, 25 bp, Rattus norvegicus
tggagttctcccagccttataaaac

SEQ ID NO: 631136 - DNA, 25 bp, Rattus norvegicus
tggagttctccctgccttataaaac

SEQ ID NO: 631137 - DNA, 25 bp, Rattus norvegicus
tggagttctcttaaagccttcaact

SEQ ID NO: 631138 - DNA, 25 bp, Rattus norvegicus
tggagttctcttctagactgcccag

SEQ ID NO: 631139 - DNA, 25 bp, Rattus norvegicus
tggagttctcttgtagactgcccag

SEQ ID NO: 631140 - DNA, 25 bp, Rattus norvegicus
tggagttctctttaagccttcaact

SEQ ID NO: 631141 - DNA, 25 bp, Rattus norvegicus
tggagttctgccctctgctcagcca

SEQ ID NO: 631142 - DNA, 25 bp, Rattus norvegicus
tggagttctgccgtctgctcagcca

SEQ ID NO: 631143 - DNA, 25 bp, Rattus norvegicus
tggagttgagcactcccggccccat

SEQ ID NO: 631144 - DNA, 25 bp, Rattus norvegicus
tggagttgagcagtcccggccccat

SEQ ID NO: 631145 - DNA, 25 bp, Rattus norvegicus
tggagttgagccaccaatgccacag

SEQ ID NO: 631146 - DNA, 25 bp, Rattus norvegicus
tggagttgagcctccaatgccacag

SEQ ID NO: 631147 - DNA, 25 bp, Rattus norvegicus
tggagttgatgccacagcccttagt

SEQ ID NO: 631148 - DNA, 25 bp, Rattus norvegicus
tggagttgatgcgacagcccttagt

SEQ ID NO: 631149 - DNA, 25 bp, Rattus norvegicus
tggagttgccccagttcctgtgcat

SEQ ID NO: 631150 - DNA, 25 bp, Rattus norvegicus
tggagttgcccctgttcctgtgcat

SEQ ID NO: 631151 - DNA, 25 bp, Rattus norvegicus
tggagttgctcccatcattgacgtt

SEQ ID NO: 631152 - DNA, 25 bp, Rattus norvegicus
tggagttgctccgatcattgacgtt

SEQ ID NO: 631153 - DNA, 25 bp, Rattus norvegicus
tggagttggagccatccatgcgcaa

SEQ ID NO: 631154 - DNA, 25 bp, Rattus norvegicus
tggagttggagcgatccatgcgcaa

SEQ ID NO: 631155 - DNA, 25 bp, Rattus norvegicus
tggagttggcacagtccgcggactt

SEQ ID NO: 631156 - DNA, 25 bp, Rattus norvegicus
tggagttggcactgtccgcggactt

SEQ ID NO: 631157 - DNA, 25 bp, Rattus norvegicus
tggagttggcataacagcaataccc

SEQ ID NO: 631158 - DNA, 25 bp, Rattus norvegicus
tggagttggcattacagcaataccc

SEQ ID NO: 631159 - DNA, 25 bp, Rattus norvegicus
tggagttggccaaatctgttttgat

SEQ ID NO: 631160 - DNA, 25 bp, Rattus norvegicus
tggagttggccatatctgttttgat

SEQ ID NO: 631161 - DNA, 25 bp, Rattus norvegicus
tggagtttaagaattgcttcccaac

SEQ ID NO: 631162 - DNA, 25 bp, Rattus norvegicus
tggagtttaagatttgcttcccaac

SEQ ID NO: 631163 - DNA, 25 bp, Rattus norvegicus
tggagtttacaaaatcagagagcag

SEQ ID NO: 631164 - DNA, 25 bp, Rattus norvegicus
tggagtttacaactaactgaccgta

SEQ ID NO: 631165 - DNA, 25 bp, Rattus norvegicus
tggagtttacaagtaactgaccgta

SEQ ID NO: 631166 - DNA, 25 bp, Rattus norvegicus
tggagtttacaatatcagagagcag

SEQ ID NO: 631167 - DNA, 25 bp, Rattus norvegicus
tggagtttacatccctggtttacat

SEQ ID NO: 631168 - DNA, 25 bp, Rattus norvegicus
tggagtttacatgcctggtttacat

SEQ ID NO: 631169 - DNA, 25 bp, Rattus norvegicus
tggagtttaccaaccgactggaact

SEQ ID NO: 631170 - DNA, 25 bp, Rattus norvegicus
tggagtttaccatccgactggaact

SEQ ID NO: 631171 - DNA, 25 bp, Rattus norvegicus
tggagtttacggcagtcgcatgaca

SEQ ID NO: 631172 - DNA, 25 bp, Rattus norvegicus
tggagtttacgggagtcgcatgaca

SEQ ID NO: 631173 - DNA, 25 bp, Rattus norvegicus
tggagtttaggcaggtgatcgcctc

SEQ ID NO: 631174 - DNA, 25 bp, Rattus norvegicus
tggagtttaggctggtgatcgcctc

SEQ ID NO: 631175 - DNA, 25 bp, Rattus norvegicus
tggagtttcagtaacatctgtgtgt

SEQ ID NO: 631176 - DNA, 25 bp, Rattus norvegicus
tggagtttcagttacatctgtgtgt

SEQ ID NO: 631177 - DNA, 25 bp, Rattus norvegicus
tggagtttctgccagtgtcaacaaa

SEQ ID NO: 631178 - DNA, 25 bp, Rattus norvegicus
tggagtttctgcgagtgtcaacaaa

SEQ ID NO: 631179 - DNA, 25 bp, Rattus norvegicus
tggagtttgaaaaggcctgcgcttc

SEQ ID NO: 631180 - DNA, 25 bp, Rattus norvegicus
tggagtttgaaatggcctgcgcttc

SEQ ID NO: 631181 - DNA, 25 bp, Rattus norvegicus
tggagtttgaataccgacctgacgg

SEQ ID NO: 631182 - DNA, 25 bp, Rattus norvegicus
tggagtttgaattccgacctgacgg

SEQ ID NO: 631183 - DNA, 25 bp, Rattus norvegicus
tggagtttgattagggtcctctgcc

SEQ ID NO: 631184 - DNA, 25 bp, Rattus norvegicus
tggagtttgatttgggtcctctgcc

SEQ ID NO: 631185 - DNA, 25 bp, Rattus norvegicus
tggagtttgcgcaccgagaagtcgt

SEQ ID NO: 631186 - DNA, 25 bp, Rattus norvegicus
tggagtttgcgctccgagaagtcgt

SEQ ID NO: 631187 - DNA, 25 bp, Rattus norvegicus
tggagtttggacactgctgcagact

SEQ ID NO: 631188 - DNA, 25 bp, Rattus norvegicus
tggagtttggactctgctgcagact

SEQ ID NO: 631189 - DNA, 25 bp, Rattus norvegicus
tggagtttggccaactaattgaacc

SEQ ID NO: 631190 - DNA, 25 bp, Rattus norvegicus
tggagtttggcctactaattgaacc

SEQ ID NO: 631191 - DNA, 25 bp, Rattus norvegicus
tggagtttgtccaggccaaagccac

SEQ ID NO: 631192 - DNA, 25 bp, Rattus norvegicus
tggagtttgtcctggccaaagccac

SEQ ID NO: 631193 - DNA, 25 bp, Rattus norvegicus
tggagtttgtgacgtcatccttcaa

SEQ ID NO: 631194 - DNA, 25 bp, Rattus norvegicus
tggagtttgtgaggtcatccttcaa

SEQ ID NO: 631195 - DNA, 25 bp, Rattus norvegicus
tggagttttctcacgcggacagcat

SEQ ID NO: 631196 - DNA, 25 bp, Rattus norvegicus
tggagttttctctcgcggacagcat

SEQ ID NO: 631197 - DNA, 25 bp, Rattus norvegicus
tggagttttgtaacccagctggctt

SEQ ID NO: 631198 - DNA, 25 bp, Rattus norvegicus
tggagttttgtatcccagctggctt

SEQ ID NO: 631199 - DNA, 25 bp, Rattus norvegicus
tggagttttttccacacgctgggcc

SEQ ID NO: 631200 - DNA, 25 bp, Rattus norvegicus
tggagttttttcgacacgctgggcc

SEQ ID NO: 631201 - DNA, 25 bp, Rattus norvegicus
tggataaaagatcgcacacccctgc

SEQ ID NO: 631202 - DNA, 25 bp, Rattus norvegicus
tggataaaagatggcacacccctgc

SEQ ID NO: 631203 - DNA, 25 bp, Rattus norvegicus
tggataaaagccagttccttgtgaa

SEQ ID NO: 631204 - DNA, 25 bp, Rattus norvegicus
tggataaaagcctgttccttgtgaa

SEQ ID NO: 631205 - DNA, 25 bp, Rattus norvegicus
tggataaaccttcttccttgtgggt

SEQ ID NO: 631206 - DNA, 25 bp, Rattus norvegicus
tggataaaccttgttccttgtgggt

SEQ ID NO: 631207 - DNA, 25 bp, Rattus norvegicus
tggataaagccccaaagcctcgaac

SEQ ID NO: 631208 - DNA, 25 bp, Rattus norvegicus
tggataaagcccgaaagcctcgaac

SEQ ID NO: 631209 - DNA, 25 bp, Rattus norvegicus
tggataaaggtacttgcccaccaag

SEQ ID NO: 631210 - DNA, 25 bp, Rattus norvegicus
tggataaaggtagttgcccaccaag

SEQ ID NO: 631211 - DNA, 25 bp, Rattus norvegicus
tggataaatacccactctttcctaa

SEQ ID NO: 631212 - DNA, 25 bp, Rattus norvegicus
tggataaataccgactctttcctaa

SEQ ID NO: 631213 - DNA, 25 bp, Rattus norvegicus
tggataaatcctcctgtggcttgac

SEQ ID NO: 631214 - DNA, 25 bp, Rattus norvegicus
tggataaatcctgctgtggcttgac

SEQ ID NO: 631215 - DNA, 25 bp, Rattus norvegicus
tggataacccggcaggtcactctcc

SEQ ID NO: 631216 - DNA, 25 bp, Rattus norvegicus
tggataacccgggaggtcactctcc

SEQ ID NO: 631217 - DNA, 25 bp, Rattus norvegicus
tggataaccctcatcacaaacttgg

SEQ ID NO: 631218 - DNA, 25 bp, Rattus norvegicus
tggataaccctcttcacaaacttgg

SEQ ID NO: 631219 - DNA, 25 bp, Rattus norvegicus
tggataacgccaccgacctcaaggt

SEQ ID NO: 631220 - DNA, 25 bp, Rattus norvegicus
tggataacgccagcgacctcaaggt

SEQ ID NO: 631221 - DNA, 25 bp, Rattus norvegicus
tggataactcacagcaacaccactt

SEQ ID NO: 631222 - DNA, 25 bp, Rattus norvegicus
tggataactcactgcaacaccactt

SEQ ID NO: 631223 - DNA, 25 bp, Rattus norvegicus
tggataactggccttttccttccta

SEQ ID NO: 631224 - DNA, 25 bp, Rattus norvegicus
tggataactggcgttttccttccta

SEQ ID NO: 631225 - DNA, 25 bp, Rattus norvegicus
tggataagacccacaaactcctgca

SEQ ID NO: 631226 - DNA, 25 bp, Rattus norvegicus
tggataagaccctcaaactcctgca

SEQ ID NO: 631227 - DNA, 25 bp, Rattus norvegicus
tggataagtacaagcccacctcact

SEQ ID NO: 631228 - DNA, 25 bp, Rattus norvegicus
tggataagtacatgcccacctcact

SEQ ID NO: 631229 - DNA, 25 bp, Rattus norvegicus
tggataagttgtatgaagctgtgga

SEQ ID NO: 631230 - DNA, 25 bp, Rattus norvegicus
tggataagttgtttgaagctgtgga

SEQ ID NO: 631231 - DNA, 25 bp, Rattus norvegicus
tggataatacttatcccagtctccc

SEQ ID NO: 631232 - DNA, 25 bp, Rattus norvegicus
tggataatacttttcccagtctccc

SEQ ID NO: 631233 - DNA, 25 bp, Rattus norvegicus
tggataatctccacaatcactccag

SEQ ID NO: 631234 - DNA, 25 bp, Rattus norvegicus
tggataatctcctcaatcactccag

SEQ ID NO: 631235 - DNA, 25 bp, Rattus norvegicus
tggataatgagcacacctaccttgg

SEQ ID NO: 631236 - DNA, 25 bp, Rattus norvegicus
tggataatgagctcacctaccttgg

SEQ ID NO: 631237 - DNA, 25 bp, Rattus norvegicus
tggatacagctgaacccatcgacgg

SEQ ID NO: 631238 - DNA, 25 bp, Rattus norvegicus
tggatacagctgtacccatcgacgg

SEQ ID NO: 631239 - DNA, 25 bp, Rattus norvegicus
tggatacaggacagcctcagggctt

SEQ ID NO: 631240 - DNA, 25 bp, Rattus norvegicus
tggatacaggactgcctcagggctt

SEQ ID NO: 631241 - DNA, 25 bp, Rattus norvegicus
tggatacatagtcggttcgaggcca

SEQ ID NO: 631242 - DNA, 25 bp, Rattus norvegicus
tggatacatagtgggttcgaggcca

SEQ ID NO: 631243 - DNA, 25 bp, Rattus norvegicus
tggatacatgtcaggttcctctgca

SEQ ID NO: 631244 - DNA, 25 bp, Rattus norvegicus
tggatacatgtctggttcctctgca

SEQ ID NO: 631245 - DNA, 25 bp, Rattus norvegicus
tggataccagtacccacgtgtgcga

SEQ ID NO: 631246 - DNA, 25 bp, Rattus norvegicus
tggataccagtagccacgtgtgcga

SEQ ID NO: 631247 - DNA, 25 bp, Rattus norvegicus
tggatacccactacagcagaaacag

SEQ ID NO: 631248 - DNA, 25 bp, Rattus norvegicus
tggatacccacttcagcagaaacag

SEQ ID NO: 631249 - DNA, 25 bp, Rattus norvegicus
tggatacccatgactcactcggaac

SEQ ID NO: 631250 - DNA, 25 bp, Rattus norvegicus
tggatacccatgtctcactcggaac

SEQ ID NO: 631251 - DNA, 25 bp, Rattus norvegicus
tggataccccttcaggaccagagaa

SEQ ID NO: 631252 - DNA, 25 bp, Rattus norvegicus
tggataccccttgaggaccagagaa

SEQ ID NO: 631253 - DNA, 25 bp, Rattus norvegicus
tggatacccggcattgacaccaaca

SEQ ID NO: 631254 - DNA, 25 bp, Rattus norvegicus
tggatacccggctttgacaccaaca

SEQ ID NO: 631255 - DNA, 25 bp, Rattus norvegicus
tggataccctttctagatgcccttc

SEQ ID NO: 631256 - DNA, 25 bp, Rattus norvegicus
tggataccctttgtagatgcccttc

SEQ ID NO: 631257 - DNA, 25 bp, Rattus norvegicus
tggataccgagtcgctgtgcagacc

SEQ ID NO: 631258 - DNA, 25 bp, Rattus norvegicus
tggataccgagtggctgtgcagacc

SEQ ID NO: 631259 - DNA, 25 bp, Rattus norvegicus
tggatacctgcaaagcccataggaa

SEQ ID NO: 631260 - DNA, 25 bp, Rattus norvegicus
tggatacctgcatagcccataggaa

SEQ ID NO: 631261 - DNA, 25 bp, Rattus norvegicus
tggatacgacccagaaaacccttag

SEQ ID NO: 631262 - DNA, 25 bp, Rattus norvegicus
tggatacgaccctgaaaacccttag

SEQ ID NO: 631263 - DNA, 25 bp, Rattus norvegicus
tggatacggagaaaggcagatacag

SEQ ID NO: 631264 - DNA, 25 bp, Rattus norvegicus
tggatacggagataggcagatacag

SEQ ID NO: 631265 - DNA, 25 bp, Rattus norvegicus
tggatacggcctcccacgctaaaag

SEQ ID NO: 631266 - DNA, 25 bp, Rattus norvegicus
tggatacggcctgccacgctaaaag

SEQ ID NO: 631267 - DNA, 25 bp, Rattus norvegicus
tggatactgacacggatcctgccga

SEQ ID NO: 631268 - DNA, 25 bp, Rattus norvegicus
tggatactgacagggatcctgccga

SEQ ID NO: 631269 - DNA, 25 bp, Rattus norvegicus
tggatactgctaactcctgctcttc

SEQ ID NO: 631270 - DNA, 25 bp, Rattus norvegicus
tggatactgctatctcctgctcttc

SEQ ID NO: 631271 - DNA, 25 bp, Rattus norvegicus
tggatactgttacgctccaggacga

SEQ ID NO: 631272 - DNA, 25 bp, Rattus norvegicus
tggatactgttaggctccaggacga

SEQ ID NO: 631273 - DNA, 25 bp, Rattus norvegicus
tggatactgtttcgtggcctggcaa

SEQ ID NO: 631274 - DNA, 25 bp, Rattus norvegicus
tggatactgtttggtggcctggcaa

SEQ ID NO: 631275 - DNA, 25 bp, Rattus norvegicus
tggatacttctccacacatacgggt

SEQ ID NO: 631276 - DNA, 25 bp, Rattus norvegicus
tggatacttctcgacacatacgggt

SEQ ID NO: 631277 - DNA, 25 bp, Rattus norvegicus
tggatacttttcagacccaattttt

SEQ ID NO: 631278 - DNA, 25 bp, Rattus norvegicus
tggatacttttctgacccaattttt

SEQ ID NO: 631279 - DNA, 25 bp, Rattus norvegicus
tggatagaatccaccaggccatagg

SEQ ID NO: 631280 - DNA, 25 bp, Rattus norvegicus
tggatagaatcctccaggccatagg

SEQ ID NO: 631281 - DNA, 25 bp, Rattus norvegicus
tggatagagcctattcatcccagct

SEQ ID NO: 631282 - DNA, 25 bp, Rattus norvegicus
tggatagagccttttcatcccagct

SEQ ID NO: 631283 - DNA, 25 bp, Rattus norvegicus
tggatagatacacctcccatacacc

SEQ ID NO: 631284 - DNA, 25 bp, Rattus norvegicus
tggatagatacagctcccatacacc

SEQ ID NO: 631285 - DNA, 25 bp, Rattus norvegicus
tggatagattgcacacttgtgtgta

SEQ ID NO: 631286 - DNA, 25 bp, Rattus norvegicus
tggatagattgctcacttgtgtgta

SEQ ID NO: 631287 - DNA, 25 bp, Rattus norvegicus
tggatagccatgatctcatacctca

SEQ ID NO: 631288 - DNA, 25 bp, Rattus norvegicus
tggatagccatgttctcatacctca

SEQ ID NO: 631289 - DNA, 25 bp, Rattus norvegicus
tggatagcctaacttcaccatcttc

SEQ ID NO: 631290 - DNA, 25 bp, Rattus norvegicus
tggatagcctaagttcaccatcttc

SEQ ID NO: 631291 - DNA, 25 bp, Rattus norvegicus
tggatagctatgaaaactttgccct

SEQ ID NO: 631292 - DNA, 25 bp, Rattus norvegicus
tggatagctatgtaaactttgccct

SEQ ID NO: 631293 - DNA, 25 bp, Rattus norvegicus
tggatagctgcacaacctggtagtt

SEQ ID NO: 631294 - DNA, 25 bp, Rattus norvegicus
tggatagctgcagaacctggtagtt

SEQ ID NO: 631295 - DNA, 25 bp, Rattus norvegicus
tggataggaccccagagtctctcta

SEQ ID NO: 631296 - DNA, 25 bp, Rattus norvegicus
tggataggacccgagagtctctcta

SEQ ID NO: 631297 - DNA, 25 bp, Rattus norvegicus
tggatagggtcccaggaacccctat

SEQ ID NO: 631298 - DNA, 25 bp, Rattus norvegicus
tggatagggtccgaggaacccctat

SEQ ID NO: 631299 - DNA, 25 bp, Rattus norvegicus
tggatagttagccttcaaaattttt

SEQ ID NO: 631300 - DNA, 25 bp, Rattus norvegicus
tggatagttagcgttcaaaattttt

SEQ ID NO: 631301 - DNA, 25 bp, Rattus norvegicus
tggatagttttgcaccatgccctat

SEQ ID NO: 631302 - DNA, 25 bp, Rattus norvegicus
tggatagttttggaccatgccctat

SEQ ID NO: 631303 - DNA, 25 bp, Rattus norvegicus
tggatataacccacgctcttacaaa

SEQ ID NO: 631304 - DNA, 25 bp, Rattus norvegicus
tggatataaccctcgctcttacaaa

SEQ ID NO: 631305 - DNA, 25 bp, Rattus norvegicus
tggatatatctaagcccttctgcac

SEQ ID NO: 631306 - DNA, 25 bp, Rattus norvegicus
tggatatatctatgcccttctgcac

SEQ ID NO: 631307 - DNA, 25 bp, Rattus norvegicus
tggatatcaccaactcggactgctt

SEQ ID NO: 631308 - DNA, 25 bp, Rattus norvegicus
tggatatcaccaatgggctcacttc

SEQ ID NO: 631309 - DNA, 25 bp, Rattus norvegicus
tggatatcaccatctcggactgctt

SEQ ID NO: 631310 - DNA, 25 bp, Rattus norvegicus
tggatatcaccattgggctcacttc

SEQ ID NO: 631311 - DNA, 25 bp, Rattus norvegicus
tggatatcccatcatttgagtttga

SEQ ID NO: 631312 - DNA, 25 bp, Rattus norvegicus
tggatatcccatgatttgagtttga

SEQ ID NO: 631313 - DNA, 25 bp, Rattus norvegicus
tggatatccggacaagccttcgacg

SEQ ID NO: 631314 - DNA, 25 bp, Rattus norvegicus
tggatatccggagaagccttcgacg

SEQ ID NO: 631315 - DNA, 25 bp, Rattus norvegicus
tggatatcctttctgactaacctgt

SEQ ID NO: 631316 - DNA, 25 bp, Rattus norvegicus
tggatatcctttgtgactaacctgt

SEQ ID NO: 631317 - DNA, 25 bp, Rattus norvegicus
tggatatcgtccctggcagccctgc

SEQ ID NO: 631318 - DNA, 25 bp, Rattus norvegicus
tggatatcgtccgtggcagccctgc

SEQ ID NO: 631319 - DNA, 25 bp, Rattus norvegicus
tggatatgccgcaggttctggacca

SEQ ID NO: 631320 - DNA, 25 bp, Rattus norvegicus
tggatatgccgctggttctggacca

SEQ ID NO: 631321 - DNA, 25 bp, Rattus norvegicus
tggatatgcgcaagtgtcttccctg

SEQ ID NO: 631322 - DNA, 25 bp, Rattus norvegicus
tggatatgcgcatgtgtcttccctg

SEQ ID NO: 631323 - DNA, 25 bp, Rattus norvegicus
tggatattcacaatgcagccctcct

SEQ ID NO: 631324 - DNA, 25 bp, Rattus norvegicus
tggatattcacattgcagccctcct

SEQ ID NO: 631325 - DNA, 25 bp, Rattus norvegicus
tggatatttagtacccactgcaaga

SEQ ID NO: 631326 - DNA, 25 bp, Rattus norvegicus
tggatatttagttcccactgcaaga

SEQ ID NO: 631327 - DNA, 25 bp, Rattus norvegicus
tggatatttcttccagagccacagt

SEQ ID NO: 631328 - DNA, 25 bp, Rattus norvegicus
tggatatttcttgcagagccacagt

SEQ ID NO: 631329 - DNA, 25 bp, Rattus norvegicus
tggatatttggacgaggcttgcctc

SEQ ID NO: 631330 - DNA, 25 bp, Rattus norvegicus
tggatatttggaggaggcttgcctc

SEQ ID NO: 631331 - DNA, 25 bp, Rattus norvegicus
tggatatttgtgagaggcctgctct

SEQ ID NO: 631332 - DNA, 25 bp, Rattus norvegicus
tggatatttgtgtgaggcctgctct

SEQ ID NO: 631333 - DNA, 25 bp, Rattus norvegicus
tggatcaaaaccaacggaggtctcc

SEQ ID NO: 631334 - DNA, 25 bp, Rattus norvegicus
tggatcaaaacctacggaggtctcc

SEQ ID NO: 631335 - DNA, 25 bp, Rattus norvegicus
tggatcaacctcacgctgtgggaaa

SEQ ID NO: 631336 - DNA, 25 bp, Rattus norvegicus
tggatcaacctctcgctgtgggaaa

SEQ ID NO: 631337 - DNA, 25 bp, Rattus norvegicus
tggatcaactcacgcctgggcttaa

SEQ ID NO: 631338 - DNA, 25 bp, Rattus norvegicus
tggatcaactcaggcctgggcttaa

SEQ ID NO: 631339 - DNA, 25 bp, Rattus norvegicus
tggatcacaagtccagcattctcta

SEQ ID NO: 631340 - DNA, 25 bp, Rattus norvegicus
tggatcacaagtgcagcattctcta

SEQ ID NO: 631341 - DNA, 25 bp, Rattus norvegicus
tggatcaccatcatccagatctacc

SEQ ID NO: 631342 - DNA, 25 bp, Rattus norvegicus
tggatcaccatcttccagatctacc

SEQ ID NO: 631343 - DNA, 25 bp, Rattus norvegicus
tggatcacctctcatagggctgcca

SEQ ID NO: 631344 - DNA, 25 bp, Rattus norvegicus
tggatcacctctgatagggctgcca

SEQ ID NO: 631345 - DNA, 25 bp, Rattus norvegicus
tggatcacgaatccctggacttttt

SEQ ID NO: 631346 - DNA, 25 bp, Rattus norvegicus
tggatcacgaatgcctggacttttt

SEQ ID NO: 631347 - DNA, 25 bp, Rattus norvegicus
tggatcacttaaagcctcaggcctg

SEQ ID NO: 631348 - DNA, 25 bp, Rattus norvegicus
tggatcacttaatgcctcaggcctg

SEQ ID NO: 631349 - DNA, 25 bp, Rattus norvegicus
tggatcagagccacacacaagtgtc

SEQ ID NO: 631350 - DNA, 25 bp, Rattus norvegicus
tggatcagagcctcacacaagtgtc

SEQ ID NO: 631351 - DNA, 25 bp, Rattus norvegicus
tggatcagatcccagacgattcccc

SEQ ID NO: 631352 - DNA, 25 bp, Rattus norvegicus
tggatcagatccgagacgattcccc

SEQ ID NO: 631353 - DNA, 25 bp, Rattus norvegicus
tggatcagatgcattcttccagcct

SEQ ID NO: 631354 - DNA, 25 bp, Rattus norvegicus
tggatcagatgctttcttccagcct

SEQ ID NO: 631355 - DNA, 25 bp, Rattus norvegicus
tggatcagccgtaggtgtgttagta

SEQ ID NO: 631356 - DNA, 25 bp, Rattus norvegicus
tggatcagccgttggtgtgttagta

SEQ ID NO: 631357 - DNA, 25 bp, Rattus norvegicus
tggatcagctatattcccagcacta

SEQ ID NO: 631358 - DNA, 25 bp, Rattus norvegicus
tggatcagctattttcccagcacta

SEQ ID NO: 631359 - DNA, 25 bp, Rattus norvegicus
tggatcaggtgtccacttcggcgtc

SEQ ID NO: 631360 - DNA, 25 bp, Rattus norvegicus
tggatcaggtgtgcacttcggcgtc

SEQ ID NO: 631361 - DNA, 25 bp, Rattus norvegicus
tggatcagtacacatgccgccttat

SEQ ID NO: 631362 - DNA, 25 bp, Rattus norvegicus
tggatcagtacagatgccgccttat

SEQ ID NO: 631363 - DNA, 25 bp, Rattus norvegicus
tggatcagtacgcgaaccccaaatc

SEQ ID NO: 631364 - DNA, 25 bp, Rattus norvegicus
tggatcagtacgggaaccccaaatc

SEQ ID NO: 631365 - DNA, 25 bp, Rattus norvegicus
tggatcagtcagaggttctggcctc

SEQ ID NO: 631366 - DNA, 25 bp, Rattus norvegicus
tggatcagtcagtggttctggcctc

SEQ ID NO: 631367 - DNA, 25 bp, Rattus norvegicus
tggatcatcatcaccaacaggctct

SEQ ID NO: 631368 - DNA, 25 bp, Rattus norvegicus
tggatcatcatctccaacaggctct

SEQ ID NO: 631369 - DNA, 25 bp, Rattus norvegicus
tggatcatcctgagacttccttgga

SEQ ID NO: 631370 - DNA, 25 bp, Rattus norvegicus
tggatcatcctgtgacttccttgga

SEQ ID NO: 631371 - DNA, 25 bp, Rattus norvegicus
tggatcatcttcatcttgggctaca

SEQ ID NO: 631372 - DNA, 25 bp, Rattus norvegicus
tggatcatcttcttcttgggctaca

SEQ ID NO: 631373 - DNA, 25 bp, Rattus norvegicus
tggatcatgagtctcctactaccct

SEQ ID NO: 631374 - DNA, 25 bp, Rattus norvegicus
tggatcatgagtgtcctactaccct

SEQ ID NO: 631375 - DNA, 25 bp, Rattus norvegicus
tggatcatgctgaatctgttgcaag

SEQ ID NO: 631376 - DNA, 25 bp, Rattus norvegicus
tggatcatgctgtatctgttgcaag

SEQ ID NO: 631377 - DNA, 25 bp, Rattus norvegicus
tggatccaacctactttttcatttt

SEQ ID NO: 631378 - DNA, 25 bp, Rattus norvegicus
tggatccaaccttctttttcatttt

SEQ ID NO: 631379 - DNA, 25 bp, Rattus norvegicus
tggatccaactcacccgtggtcgtt

SEQ ID NO: 631380 - DNA, 25 bp, Rattus norvegicus
tggatccaactctcccgtggtcgtt

SEQ ID NO: 631381 - DNA, 25 bp, Rattus norvegicus
tggatccacacacctaagtctttgc

SEQ ID NO: 631382 - DNA, 25 bp, Rattus norvegicus
tggatccacacagctaagtctttgc

SEQ ID NO: 631383 - DNA, 25 bp, Rattus norvegicus
tggatccacagcactcaaagtctat

SEQ ID NO: 631384 - DNA, 25 bp, Rattus norvegicus
tggatccacagctctcaaagtctat

SEQ ID NO: 631385 - DNA, 25 bp, Rattus norvegicus
tggatccacataccgctgttgcaaa

SEQ ID NO: 631386 - DNA, 25 bp, Rattus norvegicus
tggatccacatagcgctgttgcaaa

SEQ ID NO: 631387 - DNA, 25 bp, Rattus norvegicus
tggatccacccacactacagacaga

SEQ ID NO: 631388 - DNA, 25 bp, Rattus norvegicus
tggatccacccagactacagacaga

SEQ ID NO: 631389 - DNA, 25 bp, Rattus norvegicus
tggatccaccctcatttctatactt

SEQ ID NO: 631390 - DNA, 25 bp, Rattus norvegicus
tggatccaccctgatttctatactt

SEQ ID NO: 631391 - DNA, 25 bp, Rattus norvegicus
tggatccacctacccggaaggacgg

SEQ ID NO: 631392 - DNA, 25 bp, Rattus norvegicus
tggatccacctagccggaaggacgg

SEQ ID NO: 631393 - DNA, 25 bp, Rattus norvegicus
tggatccagactcgcaatatacatt

SEQ ID NO: 631394 - DNA, 25 bp, Rattus norvegicus
tggatccagactggcaatatacatt

SEQ ID NO: 631395 - DNA, 25 bp, Rattus norvegicus
tggatccagcagcacaagtcagccc

SEQ ID NO: 631396 - DNA, 25 bp, Rattus norvegicus
tggatccagcaggacaagtcagccc

SEQ ID NO: 631397 - DNA, 25 bp, Rattus norvegicus
tggatccatagcagcgtgtcttcca

SEQ ID NO: 631398 - DNA, 25 bp, Rattus norvegicus
tggatccatagctgcgtgtcttcca

SEQ ID NO: 631399 - DNA, 25 bp, Rattus norvegicus
tggatcccaaatctgctcatcgaaa

SEQ ID NO: 631400 - DNA, 25 bp, Rattus norvegicus
tggatcccaaatgtgctcatcgaaa

SEQ ID NO: 631401 - DNA, 25 bp, Rattus norvegicus
tggatcccaagacctacctgtatta

SEQ ID NO: 631402 - DNA, 25 bp, Rattus norvegicus
tggatcccaagagctacctgtatta

SEQ ID NO: 631403 - DNA, 25 bp, Rattus norvegicus
tggatcccaatccttggagctggat

SEQ ID NO: 631404 - DNA, 25 bp, Rattus norvegicus
tggatcccaatcgttggagctggat

SEQ ID NO: 631405 - DNA, 25 bp, Rattus norvegicus
tggatcccaatgagaacagcccctt

SEQ ID NO: 631406 - DNA, 25 bp, Rattus norvegicus
tggatcccaatgtgaacagcccctt

SEQ ID NO: 631407 - DNA, 25 bp, Rattus norvegicus
tggatccccactccatttttaatta

SEQ ID NO: 631408 - DNA, 25 bp, Rattus norvegicus
tggatccccactgcatttttaatta

SEQ ID NO: 631409 - DNA, 25 bp, Rattus norvegicus
tggatccccagactctgaacttatg

SEQ ID NO: 631410 - DNA, 25 bp, Rattus norvegicus
tggatccccagagtctgaacttatg

SEQ ID NO: 631411 - DNA, 25 bp, Rattus norvegicus
tggatccccggcagatttcgtggaa

SEQ ID NO: 631412 - DNA, 25 bp, Rattus norvegicus
tggatccccggctgatttcgtggaa

SEQ ID NO: 631413 - DNA, 25 bp, Rattus norvegicus
tggatccccgtgagttcaactctga

SEQ ID NO: 631414 - DNA, 25 bp, Rattus norvegicus
tggatccccgtgtgttcaactctga

SEQ ID NO: 631415 - DNA, 25 bp, Rattus norvegicus
tggatcccctgtacgcgagcgcgcg

SEQ ID NO: 631416 - DNA, 25 bp, Rattus norvegicus
tggatcccctgttcgcgagcgcgcg

SEQ ID NO: 631417 - DNA, 25 bp, Rattus norvegicus
tggatccccttgctctgtacggagg

SEQ ID NO: 631418 - DNA, 25 bp, Rattus norvegicus
tggatccccttggtctgtacggagg

SEQ ID NO: 631419 - DNA, 25 bp, Rattus norvegicus
tggatccctcagacaacgtcaactc

SEQ ID NO: 631420 - DNA, 25 bp, Rattus norvegicus
tggatccctcagtcaacgtcaactc

SEQ ID NO: 631421 - DNA, 25 bp, Rattus norvegicus
tggatccctccaaagcatactagtc

SEQ ID NO: 631422 - DNA, 25 bp, Rattus norvegicus
tggatccctccatagcatactagtc

SEQ ID NO: 631423 - DNA, 25 bp, Rattus norvegicus
tggatccctgacatatcctgaggcc

SEQ ID NO: 631424 - DNA, 25 bp, Rattus norvegicus
tggatccctgacttatcctgaggcc

SEQ ID NO: 631425 - DNA, 25 bp, Rattus norvegicus
tggatccctgctcccctctgggtgt

SEQ ID NO: 631426 - DNA, 25 bp, Rattus norvegicus
tggatccctgctgccctctgggtgt

SEQ ID NO: 631427 - DNA, 25 bp, Rattus norvegicus
tggatcccttggaccgggccttggc

SEQ ID NO: 631428 - DNA, 25 bp, Rattus norvegicus
tggatcccttggtccgggccttggc

SEQ ID NO: 631429 - DNA, 25 bp, Rattus norvegicus
tggatccgaggacagcactaccgat

SEQ ID NO: 631430 - DNA, 25 bp, Rattus norvegicus
tggatccgaggagagcactaccgat

SEQ ID NO: 631431 - DNA, 25 bp, Rattus norvegicus
tggatccgagggacagtctgcacca

SEQ ID NO: 631432 - DNA, 25 bp, Rattus norvegicus
tggatccgagggtcagtctgcacca

SEQ ID NO: 631433 - DNA, 25 bp, Rattus norvegicus
tggatcctagagacttctctgtgtt

SEQ ID NO: 631434 - DNA, 25 bp, Rattus norvegicus
tggatcctagagtcttctctgtgtt

SEQ ID NO: 631435 - DNA, 25 bp, Rattus norvegicus
tggatcctcttgctgaagctggcgt

SEQ ID NO: 631436 - DNA, 25 bp, Rattus norvegicus
tggatcctcttggtgaagctggcgt

SEQ ID NO: 631437 - DNA, 25 bp, Rattus norvegicus
tggatcctgagcagccgaagccgct

SEQ ID NO: 631438 - DNA, 25 bp, Rattus norvegicus
tggatcctgagctgccgaagccgct

SEQ ID NO: 631439 - DNA, 25 bp, Rattus norvegicus
tggatcctgatgactgcttaagctg

SEQ ID NO: 631440 - DNA, 25 bp, Rattus norvegicus
tggatcctgatgtctgcttaagctg

SEQ ID NO: 631441 - DNA, 25 bp, Rattus norvegicus
tggatcctgggcactttctactact

SEQ ID NO: 631442 - DNA, 25 bp, Rattus norvegicus
tggatcctgggctctttctactact

SEQ ID NO: 631443 - DNA, 25 bp, Rattus norvegicus
tggatccttcaaaccccgggatgga

SEQ ID NO: 631444 - DNA, 25 bp, Rattus norvegicus
tggatccttcaatccccgggatgga

SEQ ID NO: 631445 - DNA, 25 bp, Rattus norvegicus
tggatccttcctaatgtacacatga

SEQ ID NO: 631446 - DNA, 25 bp, Rattus norvegicus
tggatccttccttatgtacacatga

SEQ ID NO: 631447 - DNA, 25 bp, Rattus norvegicus
tggatccttgtcatctggcagagaa

SEQ ID NO: 631448 - DNA, 25 bp, Rattus norvegicus
tggatccttgtcttctggcagagaa

SEQ ID NO: 631449 - DNA, 25 bp, Rattus norvegicus
tggatcgatactattcttccggcac

SEQ ID NO: 631450 - DNA, 25 bp, Rattus norvegicus
tggatcgatacttttcttccggcac

SEQ ID NO: 631451 - DNA, 25 bp, Rattus norvegicus
tggatcgcacttaatttaaacacgt

SEQ ID NO: 631452 - DNA, 25 bp, Rattus norvegicus
tggatcgcactttatttaaacacgt

SEQ ID NO: 631453 - DNA, 25 bp, Rattus norvegicus
tggatcgccacgctcagactgcagt

SEQ ID NO: 631454 - DNA, 25 bp, Rattus norvegicus
tggatcgccacggtcagactgcagt

SEQ ID NO: 631455 - DNA, 25 bp, Rattus norvegicus
tggatcgccagcatcgagtcagatc

SEQ ID NO: 631456 - DNA, 25 bp, Rattus norvegicus
tggatcgccagcttcgagtcagatc

SEQ ID NO: 631457 - DNA, 25 bp, Rattus norvegicus
tggatcgcctggcactctaagcaag

SEQ ID NO: 631458 - DNA, 25 bp, Rattus norvegicus
tggatcgcctgggactctaagcaag

SEQ ID NO: 631459 - DNA, 25 bp, Rattus norvegicus
tggatcgctgacaggatggtccatc

SEQ ID NO: 631460 - DNA, 25 bp, Rattus norvegicus
tggatcgctgactggatggtccatc

SEQ ID NO: 631461 - DNA, 25 bp, Rattus norvegicus
tggatcgctgctccagctctaacgt

SEQ ID NO: 631462 - DNA, 25 bp, Rattus norvegicus
tggatcgctgctgcagctctaacgt

SEQ ID NO: 631463 - DNA, 25 bp, Rattus norvegicus
tggatcggaggcactggctctcaga

SEQ ID NO: 631464 - DNA, 25 bp, Rattus norvegicus
tggatcggaggctctggctctcaga

SEQ ID NO: 631465 - DNA, 25 bp, Rattus norvegicus
tggatcggagtaccgcgcagcactt

SEQ ID NO: 631466 - DNA, 25 bp, Rattus norvegicus
tggatcggagtagcgcgcagcactt

SEQ ID NO: 631467 - DNA, 25 bp, Rattus norvegicus
tggatcgggtcaaggactaccactt

SEQ ID NO: 631468 - DNA, 25 bp, Rattus norvegicus
tggatcgggtcatggactaccactt

SEQ ID NO: 631469 - DNA, 25 bp, Rattus norvegicus
tggatcgttcttctacaaattgtaa

SEQ ID NO: 631470 - DNA, 25 bp, Rattus norvegicus
tggatcgttcttgtacaaattgtaa

SEQ ID NO: 631471 - DNA, 25 bp, Rattus norvegicus
tggatctaaccacaaacccacaggg

SEQ ID NO: 631472 - DNA, 25 bp, Rattus norvegicus
tggatctaaccagaaacccacaggg

SEQ ID NO: 631473 - DNA, 25 bp, Rattus norvegicus
tggatctaaggcatacaccacaagt

SEQ ID NO: 631474 - DNA, 25 bp, Rattus norvegicus
tggatctaaggcttacaccacaagt

SEQ ID NO: 631475 - DNA, 25 bp, Rattus norvegicus
tggatctacatccttcttcggaaga

SEQ ID NO: 631476 - DNA, 25 bp, Rattus norvegicus
tggatctacatcgttcttcggaaga

SEQ ID NO: 631477 - DNA, 25 bp, Rattus norvegicus
tggatctatgctctcagaccgaatc

SEQ ID NO: 631478 - DNA, 25 bp, Rattus norvegicus
tggatctatgctgtcagaccgaatc

SEQ ID NO: 631479 - DNA, 25 bp, Rattus norvegicus
tggatctattccagcttattcattt

SEQ ID NO: 631480 - DNA, 25 bp, Rattus norvegicus
tggatctattcctgcttattcattt

SEQ ID NO: 631481 - DNA, 25 bp, Rattus norvegicus
tggatctcaaaccagcttcaggtgt

SEQ ID NO: 631482 - DNA, 25 bp, Rattus norvegicus
tggatctcaaacgagcttcaggtgt

SEQ ID NO: 631483 - DNA, 25 bp, Rattus norvegicus
tggatctcaaatcacgccttgggcc

SEQ ID NO: 631484 - DNA, 25 bp, Rattus norvegicus
tggatctcaaatcttgcaggcagtg

SEQ ID NO: 631485 - DNA, 25 bp, Rattus norvegicus
tggatctcaaatgacgccttgggcc

SEQ ID NO: 631486 - DNA, 25 bp, Rattus norvegicus
tggatctcaaatgttgcaggcagtg

SEQ ID NO: 631487 - DNA, 25 bp, Rattus norvegicus
tggatctcacagagctggaccacat

SEQ ID NO: 631488 - DNA, 25 bp, Rattus norvegicus
tggatctcacagtgctggaccacat

SEQ ID NO: 631489 - DNA, 25 bp, Rattus norvegicus
tggatctcagctcactgtgaagcgt

SEQ ID NO: 631490 - DNA, 25 bp, Rattus norvegicus
tggatctcagctgactgtgaagcgt

SEQ ID NO: 631491 - DNA, 25 bp, Rattus norvegicus
tggatctcatcgaaggtcaccggct

SEQ ID NO: 631492 - DNA, 25 bp, Rattus norvegicus
tggatctcatcgtaggtcaccggct

SEQ ID NO: 631493 - DNA, 25 bp, Rattus norvegicus
tggatctcccagctactgtgttaac

SEQ ID NO: 631494 - DNA, 25 bp, Rattus norvegicus
tggatctcccaggtactgtgttaac

SEQ ID NO: 631495 - DNA, 25 bp, Rattus norvegicus
tggatctccctgattgatctgtgaa

SEQ ID NO: 631496 - DNA, 25 bp, Rattus norvegicus
tggatctccctgtttgatctgtgaa

SEQ ID NO: 631497 - DNA, 25 bp, Rattus norvegicus
tggatctcccttcctcgaggaaaag

SEQ ID NO: 631498 - DNA, 25 bp, Rattus norvegicus
tggatctcccttgctcgaggaaaag

SEQ ID NO: 631499 - DNA, 25 bp, Rattus norvegicus
tggatctccgagatcaaggccagca

SEQ ID NO: 631500 - DNA, 25 bp, Rattus norvegicus
tggatctccgagttcaaggccagca

SEQ ID NO: 631501 - DNA, 25 bp, Rattus norvegicus
tggatctcctgacccaacagctaaa

SEQ ID NO: 631502 - DNA, 25 bp, Rattus norvegicus
tggatctcctgagccaacagctaaa

SEQ ID NO: 631503 - DNA, 25 bp, Rattus norvegicus
tggatctcgtccacaagtacagctc

SEQ ID NO: 631504 - DNA, 25 bp, Rattus norvegicus
tggatctcgtcctcaagtacagctc

SEQ ID NO: 631505 - DNA, 25 bp, Rattus norvegicus
tggatctctcctctaaagctcgaat

SEQ ID NO: 631506 - DNA, 25 bp, Rattus norvegicus
tggatctctcctgtaaagctcgaat

SEQ ID NO: 631507 - DNA, 25 bp, Rattus norvegicus
tggatctctgagcaagcggcccgcg

SEQ ID NO: 631508 - DNA, 25 bp, Rattus norvegicus
tggatctctgaggaagcggcccgcg

SEQ ID NO: 631509 - DNA, 25 bp, Rattus norvegicus
tggatctctgctcgagcactgaagg

SEQ ID NO: 631510 - DNA, 25 bp, Rattus norvegicus
tggatctctgctggagcactgaagg

SEQ ID NO: 631511 - DNA, 25 bp, Rattus norvegicus
tggatctctgtaaacctgaggccag

SEQ ID NO: 631512 - DNA, 25 bp, Rattus norvegicus
tggatctctgtatacctgaggccag

SEQ ID NO: 631513 - DNA, 25 bp, Rattus norvegicus
tggatctctttaaaggtcctggaac

SEQ ID NO: 631514 - DNA, 25 bp, Rattus norvegicus
tggatctctttataggtcctggaac

SEQ ID NO: 631515 - DNA, 25 bp, Rattus norvegicus
tggatctcttttatgctagcagcac

SEQ ID NO: 631516 - DNA, 25 bp, Rattus norvegicus
tggatctcttttttgctagcagcac

SEQ ID NO: 631517 - DNA, 25 bp, Rattus norvegicus
tggatctgacatcccgcctggagaa

SEQ ID NO: 631518 - DNA, 25 bp, Rattus norvegicus
tggatctgacatgccgcctggagaa

SEQ ID NO: 631519 - DNA, 25 bp, Rattus norvegicus
tggatctgagcccactcggcctcat

SEQ ID NO: 631520 - DNA, 25 bp, Rattus norvegicus
tggatctgagccgactcggcctcat

SEQ ID NO: 631521 - DNA, 25 bp, Rattus norvegicus
tggatctgaggcctgctgtacaaag

SEQ ID NO: 631522 - DNA, 25 bp, Rattus norvegicus
tggatctgaggcgtgctgtacaaag

SEQ ID NO: 631523 - DNA, 25 bp, Rattus norvegicus
tggatctgtccaataactctctgtc

SEQ ID NO: 631524 - DNA, 25 bp, Rattus norvegicus
tggatctgtccattaactctctgtc

SEQ ID NO: 631525 - DNA, 25 bp, Rattus norvegicus
tggatctgttctatggagctagcct

SEQ ID NO: 631526 - DNA, 25 bp, Rattus norvegicus
tggatctgttctttggagctagcct

SEQ ID NO: 631527 - DNA, 25 bp, Rattus norvegicus
tggatctgttgtctaaggcccttca

SEQ ID NO: 631528 - DNA, 25 bp, Rattus norvegicus
tggatctgttgtgtaaggcccttca

SEQ ID NO: 631529 - DNA, 25 bp, Rattus norvegicus
tggatcttaacactccttcaagtga

SEQ ID NO: 631530 - DNA, 25 bp, Rattus norvegicus
tggatcttaacagtccttcaagtga

SEQ ID NO: 631531 - DNA, 25 bp, Rattus norvegicus
tggatcttcatacccctggagttag

SEQ ID NO: 631532 - DNA, 25 bp, Rattus norvegicus
tggatcttcatagccctggagttag

SEQ ID NO: 631533 - DNA, 25 bp, Rattus norvegicus
tggatcttcgtaccaagagcaccgg

SEQ ID NO: 631534 - DNA, 25 bp, Rattus norvegicus
tggatcttcgtagcaagagcaccgg

SEQ ID NO: 631535 - DNA, 25 bp, Rattus norvegicus
tggatcttctatcgaggcttcgcca

SEQ ID NO: 631536 - DNA, 25 bp, Rattus norvegicus
tggatcttctatggaggcttcgcca

SEQ ID NO: 631537 - DNA, 25 bp, Rattus norvegicus
tggatcttgcttatggcctggtgga

SEQ ID NO: 631538 - DNA, 25 bp, Rattus norvegicus
tggatcttgcttttggcctggtgga

SEQ ID NO: 631539 - DNA, 25 bp, Rattus norvegicus
tggatcttgggaactcaagccccac

SEQ ID NO: 631540 - DNA, 25 bp, Rattus norvegicus
tggatcttgggatctcaagccccac

SEQ ID NO: 631541 - DNA, 25 bp, Rattus norvegicus
tggatctttacacgtgacgtgcaca

SEQ ID NO: 631542 - DNA, 25 bp, Rattus norvegicus
tggatctttacaggtgacgtgcaca

SEQ ID NO: 631543 - DNA, 25 bp, Rattus norvegicus
tggatctttcttccattctgtccct

SEQ ID NO: 631544 - DNA, 25 bp, Rattus norvegicus
tggatctttcttgcattctgtccct

SEQ ID NO: 631545 - DNA, 25 bp, Rattus norvegicus
tggatctttttcctttcccataatc

SEQ ID NO: 631546 - DNA, 25 bp, Rattus norvegicus
tggatctttttcgtttcccataatc

SEQ ID NO: 631547 - DNA, 25 bp, Rattus norvegicus
tggatgaaacagaagcctctcccgt

SEQ ID NO: 631548 - DNA, 25 bp, Rattus norvegicus
tggatgaaacagtagcctctcccgt

SEQ ID NO: 631549 - DNA, 25 bp, Rattus norvegicus
tggatgaagagaaggcccgcgtcct

SEQ ID NO: 631550 - DNA, 25 bp, Rattus norvegicus
tggatgaagagatggcccgcgtcct

SEQ ID NO: 631551 - DNA, 25 bp, Rattus norvegicus
tggatgaagcaactgcctccatcga

SEQ ID NO: 631552 - DNA, 25 bp, Rattus norvegicus
tggatgaagcaagtgcctccatcga

SEQ ID NO: 631553 - DNA, 25 bp, Rattus norvegicus
tggatgaagccaccctcagtgacac

SEQ ID NO: 631554 - DNA, 25 bp, Rattus norvegicus
tggatgaagccagcctcagtgacac

SEQ ID NO: 631555 - DNA, 25 bp, Rattus norvegicus
tggatgaaggctacttcacgcgcgc

SEQ ID NO: 631556 - DNA, 25 bp, Rattus norvegicus
tggatgaaggcttcttcacgcgcgc

SEQ ID NO: 631557 - DNA, 25 bp, Rattus norvegicus
tggatgacaccacagacctgcttgt

SEQ ID NO: 631558 - DNA, 25 bp, Rattus norvegicus
tggatgacaccagagacctgcttgt

SEQ ID NO: 631559 - DNA, 25 bp, Rattus norvegicus
tggatgacctacaactccctaggta

SEQ ID NO: 631560 - DNA, 25 bp, Rattus norvegicus
tggatgacctactactccctaggta

SEQ ID NO: 631561 - DNA, 25 bp, Rattus norvegicus
tggatgacctctcatgagcccgggc

SEQ ID NO: 631562 - DNA, 25 bp, Rattus norvegicus
tggatgacctctgatgagcccgggc

SEQ ID NO: 631563 - DNA, 25 bp, Rattus norvegicus
tggatgactctaatgctcatcagct

SEQ ID NO: 631564 - DNA, 25 bp, Rattus norvegicus
tggatgactctattgctcatcagct

SEQ ID NO: 631565 - DNA, 25 bp, Rattus norvegicus
tggatgacttcgaaggctgccccag

SEQ ID NO: 631566 - DNA, 25 bp, Rattus norvegicus
tggatgacttcgtaggctgccccag

SEQ ID NO: 631567 - DNA, 25 bp, Rattus norvegicus
tggatgagagcgacctgcaggccac

SEQ ID NO: 631568 - DNA, 25 bp, Rattus norvegicus
tggatgagagcgtcctgcaggccac

SEQ ID NO: 631569 - DNA, 25 bp, Rattus norvegicus
tggatgagcactaggctcctgacag

SEQ ID NO: 631570 - DNA, 25 bp, Rattus norvegicus
tggatgagcacttggctcctgacag

SEQ ID NO: 631571 - DNA, 25 bp, Rattus norvegicus
tggatgagccacagatttctttgtc

SEQ ID NO: 631572 - DNA, 25 bp, Rattus norvegicus
tggatgagccactgatttctttgtc

SEQ ID NO: 631573 - DNA, 25 bp, Rattus norvegicus
tggatgaggcaaccaagcgtccacc

SEQ ID NO: 631574 - DNA, 25 bp, Rattus norvegicus
tggatgaggcaagcaagcgtccacc

SEQ ID NO: 631575 - DNA, 25 bp, Rattus norvegicus
tggatgaggcttacagttccctggc

SEQ ID NO: 631576 - DNA, 25 bp, Rattus norvegicus
tggatgaggctttcagttccctggc

SEQ ID NO: 631577 - DNA, 25 bp, Rattus norvegicus
tggatgagggaaaccgaaattcctt

SEQ ID NO: 631578 - DNA, 25 bp, Rattus norvegicus
tggatgagggaatccgaaattcctt

SEQ ID NO: 631579 - DNA, 25 bp, Rattus norvegicus
tggatgagggttatcgcctgccact

SEQ ID NO: 631580 - DNA, 25 bp, Rattus norvegicus
tggatgagggttttcgcctgccact

SEQ ID NO: 631581 - DNA, 25 bp, Rattus norvegicus
tggatgaggtccagagaccctgtct

SEQ ID NO: 631582 - DNA, 25 bp, Rattus norvegicus
tggatgaggtcctgagaccctgtct

SEQ ID NO: 631583 - DNA, 25 bp, Rattus norvegicus
tggatgagtaccagaattctcccct

SEQ ID NO: 631584 - DNA, 25 bp, Rattus norvegicus
tggatgagtacctgaattctcccct

SEQ ID NO: 631585 - DNA, 25 bp, Rattus norvegicus
tggatgagtagccaggcacttcctg

SEQ ID NO: 631586 - DNA, 25 bp, Rattus norvegicus
tggatgagtagcgaggcacttcctg

SEQ ID NO: 631587 - DNA, 25 bp, Rattus norvegicus
tggatgagtttgagatccctgtccc

SEQ ID NO: 631588 - DNA, 25 bp, Rattus norvegicus
tggatgagtttgtgatccctgtccc

SEQ ID NO: 631589 - DNA, 25 bp, Rattus norvegicus
tggatgataaagaagaacctgccaa

SEQ ID NO: 631590 - DNA, 25 bp, Rattus norvegicus
tggatgataaagtagaacctgccaa

SEQ ID NO: 631591 - DNA, 25 bp, Rattus norvegicus
tggatgatcccgacaggtgcgaaat

SEQ ID NO: 631592 - DNA, 25 bp, Rattus norvegicus
tggatgatcccgtcaggtgcgaaat

SEQ ID NO: 631593 - DNA, 25 bp, Rattus norvegicus
tggatgatgttacccctctacaagc

SEQ ID NO: 631594 - DNA, 25 bp, Rattus norvegicus
tggatgatgttagccctctacaagc

SEQ ID NO: 631595 - DNA, 25 bp, Rattus norvegicus
tggatgattaacaccggattgagaa

SEQ ID NO: 631596 - DNA, 25 bp, Rattus norvegicus
tggatgattaactccggattgagaa

SEQ ID NO: 631597 - DNA, 25 bp, Rattus norvegicus
tggatgattagcaccgagctgcctt

SEQ ID NO: 631598 - DNA, 25 bp, Rattus norvegicus
tggatgattagctccgagctgcctt

SEQ ID NO: 631599 - DNA, 25 bp, Rattus norvegicus
tggatgcaagcaccctgtacaatca

SEQ ID NO: 631600 - DNA, 25 bp, Rattus norvegicus
tggatgcaagcagcctgtacaatca

SEQ ID NO: 631601 - DNA, 25 bp, Rattus norvegicus
tggatgcacattctcttagcttctt

SEQ ID NO: 631602 - DNA, 25 bp, Rattus norvegicus
tggatgcacattgtcttagcttctt

SEQ ID NO: 631603 - DNA, 25 bp, Rattus norvegicus
tggatgcacgctcgccaccatgagc

SEQ ID NO: 631604 - DNA, 25 bp, Rattus norvegicus
tggatgcacgctggccaccatgagc

SEQ ID NO: 631605 - DNA, 25 bp, Rattus norvegicus
tggatgcatctgcatctgtattggt

SEQ ID NO: 631606 - DNA, 25 bp, Rattus norvegicus
tggatgcatctggatctgtattggt

SEQ ID NO: 631607 - DNA, 25 bp, Rattus norvegicus
tggatgccacgcacaggcagcagaa

SEQ ID NO: 631608 - DNA, 25 bp, Rattus norvegicus
tggatgccacgctcaggcagcagaa

SEQ ID NO: 631609 - DNA, 25 bp, Rattus norvegicus
tggatgcccaatcttgtgtgtctac

SEQ ID NO: 631610 - DNA, 25 bp, Rattus norvegicus
tggatgcccaatgttgtgtgtctac

SEQ ID NO: 631611 - DNA, 25 bp, Rattus norvegicus
tggatgcccactagcacatcagtgc

SEQ ID NO: 631612 - DNA, 25 bp, Rattus norvegicus
tggatgcccacttgcacatcagtgc

SEQ ID NO: 631613 - DNA, 25 bp, Rattus norvegicus
tggatgcccttgaggaaagggctat

SEQ ID NO: 631614 - DNA, 25 bp, Rattus norvegicus
tggatgcccttgtggaaagggctat

SEQ ID NO: 631615 - DNA, 25 bp, Rattus norvegicus
tggatgcctaacacacagggacatt

SEQ ID NO: 631616 - DNA, 25 bp, Rattus norvegicus
tggatgcctaactcacagggacatt

SEQ ID NO: 631617 - DNA, 25 bp, Rattus norvegicus
tggatgcctaccaccacaaatgaag

SEQ ID NO: 631618 - DNA, 25 bp, Rattus norvegicus
tggatgcctacctccacaaatgaag

SEQ ID NO: 631619 - DNA, 25 bp, Rattus norvegicus
tggatgcctactaggtacccacttg

SEQ ID NO: 631620 - DNA, 25 bp, Rattus norvegicus
tggatgcctacttggtacccacttg

SEQ ID NO: 631621 - DNA, 25 bp, Rattus norvegicus
tggatgccttaccacctggtgaaga

SEQ ID NO: 631622 - DNA, 25 bp, Rattus norvegicus
tggatgccttacgacctggtgaaga

SEQ ID NO: 631623 - DNA, 25 bp, Rattus norvegicus
tggatgcgattgactggccagcttc

SEQ ID NO: 631624 - DNA, 25 bp, Rattus norvegicus
tggatgcgattgtctggccagcttc

SEQ ID NO: 631625 - DNA, 25 bp, Rattus norvegicus
tggatgcgcctcaacttctatggga

SEQ ID NO: 631626 - DNA, 25 bp, Rattus norvegicus
tggatgcgcctctacttctatggga

SEQ ID NO: 631627 - DNA, 25 bp, Rattus norvegicus
tggatgcgcctgaggctgagcaaca

SEQ ID NO: 631628 - DNA, 25 bp, Rattus norvegicus
tggatgcgcctgtggctgagcaaca

SEQ ID NO: 631629 - DNA, 25 bp, Rattus norvegicus
tggatgcgcgggaggtaatccccat

SEQ ID NO: 631630 - DNA, 25 bp, Rattus norvegicus
tggatgcgcgggtggtaatccccat

SEQ ID NO: 631631 - DNA, 25 bp, Rattus norvegicus
tggatgcgtcgaagttctgccaggc

SEQ ID NO: 631632 - DNA, 25 bp, Rattus norvegicus
tggatgcgtcgatgttctgccaggc

SEQ ID NO: 631633 - DNA, 25 bp, Rattus norvegicus
tggatgctcaatcgcccagcatggg

SEQ ID NO: 631634 - DNA, 25 bp, Rattus norvegicus
tggatgctcaatggcccagcatggg

SEQ ID NO: 631635 - DNA, 25 bp, Rattus norvegicus
tggatgctccaacacgccgtaattg

SEQ ID NO: 631636 - DNA, 25 bp, Rattus norvegicus
tggatgctccaagacgccgtaattg

SEQ ID NO: 631637 - DNA, 25 bp, Rattus norvegicus
tggatgctccggctcagagaccccg

SEQ ID NO: 631638 - DNA, 25 bp, Rattus norvegicus
tggatgctccgggtcagagaccccg

SEQ ID NO: 631639 - DNA, 25 bp, Rattus norvegicus
tggatgctcgccatgacactagcac

SEQ ID NO: 631640 - DNA, 25 bp, Rattus norvegicus
tggatgctcgccttgacactagcac

SEQ ID NO: 631641 - DNA, 25 bp, Rattus norvegicus
tggatgctctctatttagcggagaa

SEQ ID NO: 631642 - DNA, 25 bp, Rattus norvegicus
tggatgctctctttttagcggagaa

SEQ ID NO: 631643 - DNA, 25 bp, Rattus norvegicus
tggatgctcttgagtcactgctgtc

SEQ ID NO: 631644 - DNA, 25 bp, Rattus norvegicus
tggatgctcttgtgtcactgctgtc

SEQ ID NO: 631645 - DNA, 25 bp, Rattus norvegicus
tggatgctgattctcttgttgcaca

SEQ ID NO: 631646 - DNA, 25 bp, Rattus norvegicus
tggatgctgattgtcttgttgcaca

SEQ ID NO: 631647 - DNA, 25 bp, Rattus norvegicus
tggatgctgcagcaaagaccaccat

SEQ ID NO: 631648 - DNA, 25 bp, Rattus norvegicus
tggatgctgcaggaaagaccaccat

SEQ ID NO: 631649 - DNA, 25 bp, Rattus norvegicus
tggatgctgcttagactctagtgtc

SEQ ID NO: 631650 - DNA, 25 bp, Rattus norvegicus
tggatgctgcttctgtttgaataaa

SEQ ID NO: 631651 - DNA, 25 bp, Rattus norvegicus
tggatgctgcttgtgtttgaataaa

SEQ ID NO: 631652 - DNA, 25 bp, Rattus norvegicus
tggatgctgctttgactctagtgtc

SEQ ID NO: 631653 - DNA, 25 bp, Rattus norvegicus
tggatgctggccagggaagtactcc

SEQ ID NO: 631654 - DNA, 25 bp, Rattus norvegicus
tggatgctggcctgggaagtactcc

SEQ ID NO: 631655 - DNA, 25 bp, Rattus norvegicus
tggatgctgtgaagctgccatgctc

SEQ ID NO: 631656 - DNA, 25 bp, Rattus norvegicus
tggatgctgtgatgctgccatgctc

SEQ ID NO: 631657 - DNA, 25 bp, Rattus norvegicus
tggatggaaacaagcacgtcaggat

SEQ ID NO: 631658 - DNA, 25 bp, Rattus norvegicus
tggatggaaacatgcacgtcaggat

SEQ ID NO: 631659 - DNA, 25 bp, Rattus norvegicus
tggatggaaccacccgcagtcagga

SEQ ID NO: 631660 - DNA, 25 bp, Rattus norvegicus
tggatggaaccacctcaacactgtt

SEQ ID NO: 631661 - DNA, 25 bp, Rattus norvegicus
tggatggaaccagccgcagtcagga

SEQ ID NO: 631662 - DNA, 25 bp, Rattus norvegicus
tggatggaaccagctcaacactgtt

SEQ ID NO: 631663 - DNA, 25 bp, Rattus norvegicus
tggatggaaggcacctgactgttga

SEQ ID NO: 631664 - DNA, 25 bp, Rattus norvegicus
tggatggaaggctcctgactgttga

SEQ ID NO: 631665 - DNA, 25 bp, Rattus norvegicus
tggatggaattcagtccttccttca

SEQ ID NO: 631666 - DNA, 25 bp, Rattus norvegicus
tggatggaattctgtccttccttca

SEQ ID NO: 631667 - DNA, 25 bp, Rattus norvegicus
tggatggacagacttcagcattgct

SEQ ID NO: 631668 - DNA, 25 bp, Rattus norvegicus
tggatggacagagttcagcattgct

SEQ ID NO: 631669 - DNA, 25 bp, Rattus norvegicus
tggatggacagcaagggtaccttct

SEQ ID NO: 631670 - DNA, 25 bp, Rattus norvegicus
tggatggacagctagggtaccttct

SEQ ID NO: 631671 - DNA, 25 bp, Rattus norvegicus
tggatggactccacacctgaggaga

SEQ ID NO: 631672 - DNA, 25 bp, Rattus norvegicus
tggatggactcctcacctgaggaga

SEQ ID NO: 631673 - DNA, 25 bp, Rattus norvegicus
tggatggactgaaaggtaaacacgt

SEQ ID NO: 631674 - DNA, 25 bp, Rattus norvegicus
tggatggactgataggtaaacacgt

SEQ ID NO: 631675 - DNA, 25 bp, Rattus norvegicus
tggatggagttgacctcctcagtac

SEQ ID NO: 631676 - DNA, 25 bp, Rattus norvegicus
tggatggagttgtcctcctcagtac

SEQ ID NO: 631677 - DNA, 25 bp, Rattus norvegicus
tggatggagtttagccttaccctaa

SEQ ID NO: 631678 - DNA, 25 bp, Rattus norvegicus
tggatggagttttgccttaccctaa

SEQ ID NO: 631679 - DNA, 25 bp, Rattus norvegicus
tggatggatcgcaacgaagaagcaa

SEQ ID NO: 631680 - DNA, 25 bp, Rattus norvegicus
tggatggatcgctacgaagaagcaa

SEQ ID NO: 631681 - DNA, 25 bp, Rattus norvegicus
tggatggcaccacccctgtgtgtga

SEQ ID NO: 631682 - DNA, 25 bp, Rattus norvegicus
tggatggcaccagccctgtgtgtga

SEQ ID NO: 631683 - DNA, 25 bp, Rattus norvegicus
tggatggcatctactgacaactctc

SEQ ID NO: 631684 - DNA, 25 bp, Rattus norvegicus
tggatggcatcttctgacaactctc

SEQ ID NO: 631685 - DNA, 25 bp, Rattus norvegicus
tggatggccaccagcttgccgggtt

SEQ ID NO: 631686 - DNA, 25 bp, Rattus norvegicus
tggatggccacctgcttgccgggtt

SEQ ID NO: 631687 - DNA, 25 bp, Rattus norvegicus
tggatggccattccagactggacca

SEQ ID NO: 631688 - DNA, 25 bp, Rattus norvegicus
tggatggccattgcagactggacca

SEQ ID NO: 631689 - DNA, 25 bp, Rattus norvegicus
tggatggccgagcagatccccttta

SEQ ID NO: 631690 - DNA, 25 bp, Rattus norvegicus
tggatggccgaggagatccccttta

SEQ ID NO: 631691 - DNA, 25 bp, Rattus norvegicus
tggatggcctctctccagggaacat

SEQ ID NO: 631692 - DNA, 25 bp, Rattus norvegicus
tggatggcctctgtccagggaacat

SEQ ID NO: 631693 - DNA, 25 bp, Rattus norvegicus
tggatggctcatacagttcggaaag

SEQ ID NO: 631694 - DNA, 25 bp, Rattus norvegicus
tggatggctcattcagttcggaaag

SEQ ID NO: 631695 - DNA, 25 bp, Rattus norvegicus
tggatggctgtgacttctaggaccc

SEQ ID NO: 631696 - DNA, 25 bp, Rattus norvegicus
tggatggctgtgtcttctaggaccc

SEQ ID NO: 631697 - DNA, 25 bp, Rattus norvegicus
tggatggcttttcctcatgatgttt

SEQ ID NO: 631698 - DNA, 25 bp, Rattus norvegicus
tggatggcttttgctcatgatgttt

SEQ ID NO: 631699 - DNA, 25 bp, Rattus norvegicus
tggatgggctgtccctcccgctgct

SEQ ID NO: 631700 - DNA, 25 bp, Rattus norvegicus
tggatgggctgtgcctcccgctgct

SEQ ID NO: 631701 - DNA, 25 bp, Rattus norvegicus
tggatgggtatcacagagcctaatt

SEQ ID NO: 631702 - DNA, 25 bp, Rattus norvegicus
tggatgggtatctcagagcctaatt

SEQ ID NO: 631703 - DNA, 25 bp, Rattus norvegicus
tggatggtacctctggccagagcac

SEQ ID NO: 631704 - DNA, 25 bp, Rattus norvegicus
tggatggtacctgtggccagagcac

SEQ ID NO: 631705 - DNA, 25 bp, Rattus norvegicus
tggatggtcccacagccctgcatgt

SEQ ID NO: 631706 - DNA, 25 bp, Rattus norvegicus
tggatggtcccagagccctgcatgt

SEQ ID NO: 631707 - DNA, 25 bp, Rattus norvegicus
tggatggtgagcagaacttcggaaa

SEQ ID NO: 631708 - DNA, 25 bp, Rattus norvegicus
tggatggtgagctgaacttcggaaa

SEQ ID NO: 631709 - DNA, 25 bp, Rattus norvegicus
tggatggtgaggactgccccagaac

SEQ ID NO: 631710 - DNA, 25 bp, Rattus norvegicus
tggatggtgaggtctgccccagaac

SEQ ID NO: 631711 - DNA, 25 bp, Rattus norvegicus
tggatggtgcagcatgtctccatgt

SEQ ID NO: 631712 - DNA, 25 bp, Rattus norvegicus
tggatggtgcaggatgtctccatgt

SEQ ID NO: 631713 - DNA, 25 bp, Rattus norvegicus
tggatggtggataattcccaagcca

SEQ ID NO: 631714 - DNA, 25 bp, Rattus norvegicus
tggatggtggattattcccaagcca

SEQ ID NO: 631715 - DNA, 25 bp, Rattus norvegicus
tggatggtggccagaccaacagcct

SEQ ID NO: 631716 - DNA, 25 bp, Rattus norvegicus
tggatggtggcctgaccaacagcct

SEQ ID NO: 631717 - DNA, 25 bp, Rattus norvegicus
tggatggtgtccacgactttttgcc

SEQ ID NO: 631718 - DNA, 25 bp, Rattus norvegicus
tggatggtgtcctcgactttttgcc

SEQ ID NO: 631719 - DNA, 25 bp, Rattus norvegicus
tggatggttagcacctgggccacag

SEQ ID NO: 631720 - DNA, 25 bp, Rattus norvegicus
tggatggttagctcctgggccacag

SEQ ID NO: 631721 - DNA, 25 bp, Rattus norvegicus
tggatggttcttcgtcttctctgac

SEQ ID NO: 631722 - DNA, 25 bp, Rattus norvegicus
tggatggttcttggtcttctctgac

SEQ ID NO: 631723 - DNA, 25 bp, Rattus norvegicus
tggatgtaactactccctgataggg

SEQ ID NO: 631724 - DNA, 25 bp, Rattus norvegicus
tggatgtaactagtccctgataggg

SEQ ID NO: 631725 - DNA, 25 bp, Rattus norvegicus
tggatgtaagctctggcccattgtt

SEQ ID NO: 631726 - DNA, 25 bp, Rattus norvegicus
tggatgtaagctgtggcccattgtt

SEQ ID NO: 631727 - DNA, 25 bp, Rattus norvegicus
tggatgtactttattgccttatgaa

SEQ ID NO: 631728 - DNA, 25 bp, Rattus norvegicus
tggatgtacttttttgccttatgaa

SEQ ID NO: 631729 - DNA, 25 bp, Rattus norvegicus
tggatgtagcccatcactttagccc

SEQ ID NO: 631730 - DNA, 25 bp, Rattus norvegicus
tggatgtagcccttcactttagccc

SEQ ID NO: 631731 - DNA, 25 bp, Rattus norvegicus
tggatgtcagcaactcctcagagac

SEQ ID NO: 631732 - DNA, 25 bp, Rattus norvegicus
tggatgtcagcatctcctcagagac

SEQ ID NO: 631733 - DNA, 25 bp, Rattus norvegicus
tggatgtcagtcctgtgtttccatt

SEQ ID NO: 631734 - DNA, 25 bp, Rattus norvegicus
tggatgtcagtcgtgtgtttccatt

SEQ ID NO: 631735 - DNA, 25 bp, Rattus norvegicus
tggatgtcctccagagagctttcaa

SEQ ID NO: 631736 - DNA, 25 bp, Rattus norvegicus
tggatgtcctcctgagagctttcaa

SEQ ID NO: 631737 - DNA, 25 bp, Rattus norvegicus
tggatgtctggtctggagccccaat

SEQ ID NO: 631738 - DNA, 25 bp, Rattus norvegicus
tggatgtctggtgtggagccccaat

SEQ ID NO: 631739 - DNA, 25 bp, Rattus norvegicus
tggatgtcttttcgaaaacggttat

SEQ ID NO: 631740 - DNA, 25 bp, Rattus norvegicus
tggatgtcttttggaaaacggttat

SEQ ID NO: 631741 - DNA, 25 bp, Rattus norvegicus
tggatgtgagccactttaccccaga

SEQ ID NO: 631742 - DNA, 25 bp, Rattus norvegicus
tggatgtgagcctctttaccccaga

SEQ ID NO: 631743 - DNA, 25 bp, Rattus norvegicus
tggatgtgatgtcatccgggcccct

SEQ ID NO: 631744 - DNA, 25 bp, Rattus norvegicus
tggatgtgatgtctcctgcttccaa

SEQ ID NO: 631745 - DNA, 25 bp, Rattus norvegicus
tggatgtgatgtgatccgggcccct

SEQ ID NO: 631746 - DNA, 25 bp, Rattus norvegicus
tggatgtgatgtgtcctgcttccaa

SEQ ID NO: 631747 - DNA, 25 bp, Rattus norvegicus
tggatgtggcagctcacactgccta

SEQ ID NO: 631748 - DNA, 25 bp, Rattus norvegicus
tggatgtggcaggtcacactgccta

SEQ ID NO: 631749 - DNA, 25 bp, Rattus norvegicus
tggatgtggtgcctcatgcctgaca

SEQ ID NO: 631750 - DNA, 25 bp, Rattus norvegicus
tggatgtggtgcgtcatgcctgaca

SEQ ID NO: 631751 - DNA, 25 bp, Rattus norvegicus
tggatgtgtactacccagtgggtcc

SEQ ID NO: 631752 - DNA, 25 bp, Rattus norvegicus
tggatgtgtacttcccagtgggtcc

SEQ ID NO: 631753 - DNA, 25 bp, Rattus norvegicus
tggatgtgttttccctgactcaaac

SEQ ID NO: 631754 - DNA, 25 bp, Rattus norvegicus
tggatgtgttttgcctgactcaaac

SEQ ID NO: 631755 - DNA, 25 bp, Rattus norvegicus
tggatgttcatcattgtctgccttc

SEQ ID NO: 631756 - DNA, 25 bp, Rattus norvegicus
tggatgttcatctttgtctgccttc

SEQ ID NO: 631757 - DNA, 25 bp, Rattus norvegicus
tggatgttcggtcagcaagcccagc

SEQ ID NO: 631758 - DNA, 25 bp, Rattus norvegicus
tggatgttcggtgagcaagcccagc

SEQ ID NO: 631759 - DNA, 25 bp, Rattus norvegicus
tggatgttcttcctgttcaagccac

SEQ ID NO: 631760 - DNA, 25 bp, Rattus norvegicus
tggatgttcttcgtgttcaagccac

SEQ ID NO: 631761 - DNA, 25 bp, Rattus norvegicus
tggatgttggctcccatgaccctca

SEQ ID NO: 631762 - DNA, 25 bp, Rattus norvegicus
tggatgttggctgccatgaccctca

SEQ ID NO: 631763 - DNA, 25 bp, Rattus norvegicus
tggatgttttccaacttggtcagta

SEQ ID NO: 631764 - DNA, 25 bp, Rattus norvegicus
tggatgttttccagactgtatgtct

SEQ ID NO: 631765 - DNA, 25 bp, Rattus norvegicus
tggatgttttcctacttggtcagta

SEQ ID NO: 631766 - DNA, 25 bp, Rattus norvegicus
tggatgttttcctgactgtatgtct

SEQ ID NO: 631767 - DNA, 25 bp, Rattus norvegicus
tggattaaaccactttgtacctata

SEQ ID NO: 631768 - DNA, 25 bp, Rattus norvegicus
tggattaaaccagtttgtacctata

SEQ ID NO: 631769 - DNA, 25 bp, Rattus norvegicus
tggattaatggcctttttgcactta

SEQ ID NO: 631770 - DNA, 25 bp, Rattus norvegicus
tggattaatggcgtttttgcactta

SEQ ID NO: 631771 - DNA, 25 bp, Rattus norvegicus
tggattacaagcatggcagctcagg

SEQ ID NO: 631772 - DNA, 25 bp, Rattus norvegicus
tggattacaagcttggcagctcagg

SEQ ID NO: 631773 - DNA, 25 bp, Rattus norvegicus
tggattactgtaacccattcaacaa

SEQ ID NO: 631774 - DNA, 25 bp, Rattus norvegicus
tggattactgtatcccattcaacaa

SEQ ID NO: 631775 - DNA, 25 bp, Rattus norvegicus
tggattactgtgatttctctgtgca

SEQ ID NO: 631776 - DNA, 25 bp, Rattus norvegicus
tggattactgtgttttctctgtgca

SEQ ID NO: 631777 - DNA, 25 bp, Rattus norvegicus
tggattagacaaatcacggcccttc

SEQ ID NO: 631778 - DNA, 25 bp, Rattus norvegicus
tggattagacaattcacggcccttc

SEQ ID NO: 631779 - DNA, 25 bp, Rattus norvegicus
tggattagggcccaacctcatgaca

SEQ ID NO: 631780 - DNA, 25 bp, Rattus norvegicus
tggattagggccgaacctcatgaca

SEQ ID NO: 631781 - DNA, 25 bp, Rattus norvegicus
tggattatgaccctttcagccgcaa

SEQ ID NO: 631782 - DNA, 25 bp, Rattus norvegicus
tggattatgaccgtttcagccgcaa

SEQ ID NO: 631783 - DNA, 25 bp, Rattus norvegicus
tggattatgggactctctggccttc

SEQ ID NO: 631784 - DNA, 25 bp, Rattus norvegicus
tggattatgggagtctctggccttc

SEQ ID NO: 631785 - DNA, 25 bp, Rattus norvegicus
tggattatttgtccgagtccaccac

SEQ ID NO: 631786 - DNA, 25 bp, Rattus norvegicus
tggattatttgtgcgagtccaccac

SEQ ID NO: 631787 - DNA, 25 bp, Rattus norvegicus
tggattcacatcacaggtagctttg

SEQ ID NO: 631788 - DNA, 25 bp, Rattus norvegicus
tggattcacatctcaggtagctttg

SEQ ID NO: 631789 - DNA, 25 bp, Rattus norvegicus
tggattcagcccaggcacggtgccc

SEQ ID NO: 631790 - DNA, 25 bp, Rattus norvegicus
tggattcagccctggcacggtgccc

SEQ ID NO: 631791 - DNA, 25 bp, Rattus norvegicus
tggattcagtgaacaagcacctgga

SEQ ID NO: 631792 - DNA, 25 bp, Rattus norvegicus
tggattcagtgatcaagcacctgga

SEQ ID NO: 631793 - DNA, 25 bp, Rattus norvegicus
tggattccagacagtgcccggatca

SEQ ID NO: 631794 - DNA, 25 bp, Rattus norvegicus
tggattccagactgtgcccggatca

SEQ ID NO: 631795 - DNA, 25 bp, Rattus norvegicus
tggattccatcccaatgggccggta

SEQ ID NO: 631796 - DNA, 25 bp, Rattus norvegicus
tggattccatccgaatgggccggta

SEQ ID NO: 631797 - DNA, 25 bp, Rattus norvegicus
tggattccattcagtacccagtact

SEQ ID NO: 631798 - DNA, 25 bp, Rattus norvegicus
tggattccattctgtacccagtact

SEQ ID NO: 631799 - DNA, 25 bp, Rattus norvegicus
tggattccatttcggtcagcctggc

SEQ ID NO: 631800 - DNA, 25 bp, Rattus norvegicus
tggattccatttgggtcagcctggc

SEQ ID NO: 631801 - DNA, 25 bp, Rattus norvegicus
tggattcccaatcagtgtacactac

SEQ ID NO: 631802 - DNA, 25 bp, Rattus norvegicus
tggattcccaatgagtgtacactac

SEQ ID NO: 631803 - DNA, 25 bp, Rattus norvegicus
tggattcccagaaagcttgtgacac

SEQ ID NO: 631804 - DNA, 25 bp, Rattus norvegicus
tggattcccagacgcaaatctgcca

SEQ ID NO: 631805 - DNA, 25 bp, Rattus norvegicus
tggattcccagaggcaaatctgcca

SEQ ID NO: 631806 - DNA, 25 bp, Rattus norvegicus
tggattcccagatagcttgtgacac

SEQ ID NO: 631807 - DNA, 25 bp, Rattus norvegicus
tggattcccatcaagtactgtcgat

SEQ ID NO: 631808 - DNA, 25 bp, Rattus norvegicus
tggattcccatctagtactgtcgat

SEQ ID NO: 631809 - DNA, 25 bp, Rattus norvegicus
tggattccccagacttgaagcttga

SEQ ID NO: 631810 - DNA, 25 bp, Rattus norvegicus
tggattccccagtcttgaagcttga

SEQ ID NO: 631811 - DNA, 25 bp, Rattus norvegicus
tggattcccttaagtggtcacagca

SEQ ID NO: 631812 - DNA, 25 bp, Rattus norvegicus
tggattcccttatgtggtcacagca

SEQ ID NO: 631813 - DNA, 25 bp, Rattus norvegicus
tggattccgtgtctttaggcttctc

SEQ ID NO: 631814 - DNA, 25 bp, Rattus norvegicus
tggattccgtgtgtttaggcttctc

SEQ ID NO: 631815 - DNA, 25 bp, Rattus norvegicus
tggattcctatgacaaatttgtttt

SEQ ID NO: 631816 - DNA, 25 bp, Rattus norvegicus
tggattcctatgtcaaatttgtttt

SEQ ID NO: 631817 - DNA, 25 bp, Rattus norvegicus
tggattcctgatccagggcctagaa

SEQ ID NO: 631818 - DNA, 25 bp, Rattus norvegicus
tggattcctgatgcagggcctagaa

SEQ ID NO: 631819 - DNA, 25 bp, Rattus norvegicus
tggattcctgcacttgccaaagacg

SEQ ID NO: 631820 - DNA, 25 bp, Rattus norvegicus
tggattcctgcagttgccaaagacg

SEQ ID NO: 631821 - DNA, 25 bp, Rattus norvegicus
tggattcctttcaatgttcatgtac

SEQ ID NO: 631822 - DNA, 25 bp, Rattus norvegicus
tggattcctttctatgttcatgtac

SEQ ID NO: 631823 - DNA, 25 bp, Rattus norvegicus
tggattcgggctcctgcttttcatc

SEQ ID NO: 631824 - DNA, 25 bp, Rattus norvegicus
tggattcgggctgctgcttttcatc

SEQ ID NO: 631825 - DNA, 25 bp, Rattus norvegicus
tggattcggttcaactcctgtttaa

SEQ ID NO: 631826 - DNA, 25 bp, Rattus norvegicus
tggattcggttctactcctgtttaa

SEQ ID NO: 631827 - DNA, 25 bp, Rattus norvegicus
tggattctcagaccagtgtggcctt

SEQ ID NO: 631828 - DNA, 25 bp, Rattus norvegicus
tggattctcagagcagtgtggcctt

SEQ ID NO: 631829 - DNA, 25 bp, Rattus norvegicus
tggattctcatcaggcatatctaat

SEQ ID NO: 631830 - DNA, 25 bp, Rattus norvegicus
tggattctcatctggcatatctaat

SEQ ID NO: 631831 - DNA, 25 bp, Rattus norvegicus
tggattctccccaggaaactttcag

SEQ ID NO: 631832 - DNA, 25 bp, Rattus norvegicus
tggattctcccctggaaactttcag

SEQ ID NO: 631833 - DNA, 25 bp, Rattus norvegicus
tggattctcctgcacatactgtaaa

SEQ ID NO: 631834 - DNA, 25 bp, Rattus norvegicus
tggattctcctggacatactgtaaa

SEQ ID NO: 631835 - DNA, 25 bp, Rattus norvegicus
tggattctcggtccctaccagcgct

SEQ ID NO: 631836 - DNA, 25 bp, Rattus norvegicus
tggattctcggtgcctaccagcgct

SEQ ID NO: 631837 - DNA, 25 bp, Rattus norvegicus
tggattctgatgacccaacttgctg

SEQ ID NO: 631838 - DNA, 25 bp, Rattus norvegicus
tggattctgatgtcccaacttgctg

SEQ ID NO: 631839 - DNA, 25 bp, Rattus norvegicus
tggattctgcaccattcagggctaa

SEQ ID NO: 631840 - DNA, 25 bp, Rattus norvegicus
tggattctgcacgattcagggctaa

SEQ ID NO: 631841 - DNA, 25 bp, Rattus norvegicus
tggattctggatcgcttacctgtca

SEQ ID NO: 631842 - DNA, 25 bp, Rattus norvegicus
tggattctggatggcttacctgtca

SEQ ID NO: 631843 - DNA, 25 bp, Rattus norvegicus
tggattctgggaaaggctctgagca

SEQ ID NO: 631844 - DNA, 25 bp, Rattus norvegicus
tggattctgggataggctctgagca

SEQ ID NO: 631845 - DNA, 25 bp, Rattus norvegicus
tggattctgtttcacctgtggccct

SEQ ID NO: 631846 - DNA, 25 bp, Rattus norvegicus
tggattctgtttgacctgtggccct

SEQ ID NO: 631847 - DNA, 25 bp, Rattus norvegicus
tggattcttagcagccaccacagct

SEQ ID NO: 631848 - DNA, 25 bp, Rattus norvegicus
tggattcttagctgccaccacagct

SEQ ID NO: 631849 - DNA, 25 bp, Rattus norvegicus
tggattcttgtgatgctctagcagc

SEQ ID NO: 631850 - DNA, 25 bp, Rattus norvegicus
tggattcttgtgttgctctagcagc

SEQ ID NO: 631851 - DNA, 25 bp, Rattus norvegicus
tggattgaaaacaaactctatggta

SEQ ID NO: 631852 - DNA, 25 bp, Rattus norvegicus
tggattgaaaactaactctatggta

SEQ ID NO: 631853 - DNA, 25 bp, Rattus norvegicus
tggattgagctaccactgctgattc

SEQ ID NO: 631854 - DNA, 25 bp, Rattus norvegicus
tggattgagctagcactgctgattc

SEQ ID NO: 631855 - DNA, 25 bp, Rattus norvegicus
tggattgatgctactctagctcctt

SEQ ID NO: 631856 - DNA, 25 bp, Rattus norvegicus
tggattgatgcttctctagctcctt

SEQ ID NO: 631857 - DNA, 25 bp, Rattus norvegicus
tggattgattttactgccaagcctg

SEQ ID NO: 631858 - DNA, 25 bp, Rattus norvegicus
tggattgatttttctgccaagcctg

SEQ ID NO: 631859 - DNA, 25 bp, Rattus norvegicus
tggattgcaagacgtcatccacgcg

SEQ ID NO: 631860 - DNA, 25 bp, Rattus norvegicus
tggattgcaagaggtcatccacgcg

SEQ ID NO: 631861 - DNA, 25 bp, Rattus norvegicus
tggattgcagtaagctcccagatct

SEQ ID NO: 631862 - DNA, 25 bp, Rattus norvegicus
tggattgcagtatgctcccagatct

SEQ ID NO: 631863 - DNA, 25 bp, Rattus norvegicus
tggattgccatccttctggtaaagt

SEQ ID NO: 631864 - DNA, 25 bp, Rattus norvegicus
tggattgccatcgttctggtaaagt

SEQ ID NO: 631865 - DNA, 25 bp, Rattus norvegicus
tggattgcgtgaccctgaggacatt

SEQ ID NO: 631866 - DNA, 25 bp, Rattus norvegicus
tggattgcgtgagcctgaggacatt

SEQ ID NO: 631867 - DNA, 25 bp, Rattus norvegicus
tggattgcgttgcttgccagtttgt

SEQ ID NO: 631868 - DNA, 25 bp, Rattus norvegicus
tggattgcgttggttgccagtttgt

SEQ ID NO: 631869 - DNA, 25 bp, Rattus norvegicus
tggattgctagaatgactcaccgtc

SEQ ID NO: 631870 - DNA, 25 bp, Rattus norvegicus
tggattgctagattgactcaccgtc

SEQ ID NO: 631871 - DNA, 25 bp, Rattus norvegicus
tggattgcttccaagatcggcccta

SEQ ID NO: 631872 - DNA, 25 bp, Rattus norvegicus
tggattgcttcctagatcggcccta

SEQ ID NO: 631873 - DNA, 25 bp, Rattus norvegicus
tggattggaaagctgaaggccaact

SEQ ID NO: 631874 - DNA, 25 bp, Rattus norvegicus
tggattggaaaggtgaaggccaact

SEQ ID NO: 631875 - DNA, 25 bp, Rattus norvegicus
tggattggaactactcagctttctc

SEQ ID NO: 631876 - DNA, 25 bp, Rattus norvegicus
tggattggaacttctcagctttctc

SEQ ID NO: 631877 - DNA, 25 bp, Rattus norvegicus
tggattggaatacctttctttcctt

SEQ ID NO: 631878 - DNA, 25 bp, Rattus norvegicus
tggattggaatagctttctttcctt

SEQ ID NO: 631879 - DNA, 25 bp, Rattus norvegicus
tggattggacccatctcacattacc

SEQ ID NO: 631880 - DNA, 25 bp, Rattus norvegicus
tggattggacccttctcacattacc

SEQ ID NO: 631881 - DNA, 25 bp, Rattus norvegicus
tggattgtacatctctccggctttt

SEQ ID NO: 631882 - DNA, 25 bp, Rattus norvegicus
tggattgtacatgtctccggctttt

SEQ ID NO: 631883 - DNA, 25 bp, Rattus norvegicus
tggattgtagaaccctcacaccaga

SEQ ID NO: 631884 - DNA, 25 bp, Rattus norvegicus
tggattgtagaagcctcacaccaga

SEQ ID NO: 631885 - DNA, 25 bp, Rattus norvegicus
tggattgtagctccagtcacccatc

SEQ ID NO: 631886 - DNA, 25 bp, Rattus norvegicus
tggattgtagctgcagtcacccatc

SEQ ID NO: 631887 - DNA, 25 bp, Rattus norvegicus
tggattgtcacccaaacgatcactg

SEQ ID NO: 631888 - DNA, 25 bp, Rattus norvegicus
tggattgtcaccgaaacgatcactg

SEQ ID NO: 631889 - DNA, 25 bp, Rattus norvegicus
tggattgtccacaccctataagtat

SEQ ID NO: 631890 - DNA, 25 bp, Rattus norvegicus
tggattgtccactccctataagtat

SEQ ID NO: 631891 - DNA, 25 bp, Rattus norvegicus
tggattgtctgccatgggtcgcact

SEQ ID NO: 631892 - DNA, 25 bp, Rattus norvegicus
tggattgtctgcgatgggtcgcact

SEQ ID NO: 631893 - DNA, 25 bp, Rattus norvegicus
tggattgtgttccttcacagccatg

SEQ ID NO: 631894 - DNA, 25 bp, Rattus norvegicus
tggattgtgttcgttcacagccatg

SEQ ID NO: 631895 - DNA, 25 bp, Rattus norvegicus
tggattgttcttcctggtaaccctt

SEQ ID NO: 631896 - DNA, 25 bp, Rattus norvegicus
tggattgttcttgctggtaaccctt

SEQ ID NO: 631897 - DNA, 25 bp, Rattus norvegicus
tggattgttttaaggtggcacccaa

SEQ ID NO: 631898 - DNA, 25 bp, Rattus norvegicus
tggattgttttatggtggcacccaa

SEQ ID NO: 631899 - DNA, 25 bp, Rattus norvegicus
tggatttaacatccgcccagatctc

SEQ ID NO: 631900 - DNA, 25 bp, Rattus norvegicus
tggatttaacatgcgcccagatctc

SEQ ID NO: 631901 - DNA, 25 bp, Rattus norvegicus
tggatttacacaaagctggccctgc

SEQ ID NO: 631902 - DNA, 25 bp, Rattus norvegicus
tggatttacacatagctggccctgc

SEQ ID NO: 631903 - DNA, 25 bp, Rattus norvegicus
tggatttatcccctatagtcagaga

SEQ ID NO: 631904 - DNA, 25 bp, Rattus norvegicus
tggatttatcccgtatagtcagaga

SEQ ID NO: 631905 - DNA, 25 bp, Rattus norvegicus
tggatttatcttccttgccatgcat

SEQ ID NO: 631906 - DNA, 25 bp, Rattus norvegicus
tggatttatcttgcttgccatgcat

SEQ ID NO: 631907 - DNA, 25 bp, Rattus norvegicus
tggatttatgctctggatctccttt

SEQ ID NO: 631908 - DNA, 25 bp, Rattus norvegicus
tggatttatgctgtggatctccttt

SEQ ID NO: 631909 - DNA, 25 bp, Rattus norvegicus
tggatttcaagtcctgcagccagaa

SEQ ID NO: 631910 - DNA, 25 bp, Rattus norvegicus
tggatttcaagtgctgcagccagaa

SEQ ID NO: 631911 - DNA, 25 bp, Rattus norvegicus
tggatttccaaacccacgattcgac

SEQ ID NO: 631912 - DNA, 25 bp, Rattus norvegicus
tggatttccaaagccacgattcgac

SEQ ID NO: 631913 - DNA, 25 bp, Rattus norvegicus
tggatttccactcaggcgagggcca

SEQ ID NO: 631914 - DNA, 25 bp, Rattus norvegicus
tggatttccactgaggcgagggcca

SEQ ID NO: 631915 - DNA, 25 bp, Rattus norvegicus
tggatttcccaaactgtgtctctaa

SEQ ID NO: 631916 - DNA, 25 bp, Rattus norvegicus
tggatttcccaatctgtgtctctaa

SEQ ID NO: 631917 - DNA, 25 bp, Rattus norvegicus
tggatttccctaaaactctaccatc

SEQ ID NO: 631918 - DNA, 25 bp, Rattus norvegicus
tggatttccctataactctaccatc

SEQ ID NO: 631919 - DNA, 25 bp, Rattus norvegicus
tggatttcctggactccctggagta

SEQ ID NO: 631920 - DNA, 25 bp, Rattus norvegicus
tggatttcctggtctccctggagta

SEQ ID NO: 631921 - DNA, 25 bp, Rattus norvegicus
tggatttcgctgctcacacttggac

SEQ ID NO: 631922 - DNA, 25 bp, Rattus norvegicus
tggatttcgctggtcacacttggac

SEQ ID NO: 631923 - DNA, 25 bp, Rattus norvegicus
tggatttcgtgaaggtcccagcaag

SEQ ID NO: 631924 - DNA, 25 bp, Rattus norvegicus
tggatttcgtgatggtcccagcaag

SEQ ID NO: 631925 - DNA, 25 bp, Rattus norvegicus
tggatttctatcatgctctaccttg

SEQ ID NO: 631926 - DNA, 25 bp, Rattus norvegicus
tggatttctatcttgctctaccttg

SEQ ID NO: 631927 - DNA, 25 bp, Rattus norvegicus
tggatttctgaacgtcatgttcaat

SEQ ID NO: 631928 - DNA, 25 bp, Rattus norvegicus
tggatttctgaaggtcatgttcaat

SEQ ID NO: 631929 - DNA, 25 bp, Rattus norvegicus
tggatttctgcgagacagcccaaat

SEQ ID NO: 631930 - DNA, 25 bp, Rattus norvegicus
tggatttctgcgtgacagcccaaat

SEQ ID NO: 631931 - DNA, 25 bp, Rattus norvegicus
tggatttgacagagtggattcttgt

SEQ ID NO: 631932 - DNA, 25 bp, Rattus norvegicus
tggatttgacagtgtggattcttgt

SEQ ID NO: 631933 - DNA, 25 bp, Rattus norvegicus
tggatttgctccaagctatggctac

SEQ ID NO: 631934 - DNA, 25 bp, Rattus norvegicus
tggatttgctcctagctatggctac

SEQ ID NO: 631935 - DNA, 25 bp, Rattus norvegicus
tggatttggctgacttcatggcttt

SEQ ID NO: 631936 - DNA, 25 bp, Rattus norvegicus
tggatttggctgtcttcatggcttt

SEQ ID NO: 631937 - DNA, 25 bp, Rattus norvegicus
tggatttgtggaccttaaagttact

SEQ ID NO: 631938 - DNA, 25 bp, Rattus norvegicus
tggatttgtggagcttaaagttact

SEQ ID NO: 631939 - DNA, 25 bp, Rattus norvegicus
tggatttgttcacccatttacatta

SEQ ID NO: 631940 - DNA, 25 bp, Rattus norvegicus
tggatttgttcagccatttacatta

SEQ ID NO: 631941 - DNA, 25 bp, Rattus norvegicus
tggattttaacaactccctctgaga

SEQ ID NO: 631942 - DNA, 25 bp, Rattus norvegicus
tggattttaacatctccctctgaga

SEQ ID NO: 631943 - DNA, 25 bp, Rattus norvegicus
tggattttcccgcaccttctccaat

SEQ ID NO: 631944 - DNA, 25 bp, Rattus norvegicus
tggattttcccggaccttctccaat

SEQ ID NO: 631945 - DNA, 25 bp, Rattus norvegicus
tggattttccggaaccttggtgcca

SEQ ID NO: 631946 - DNA, 25 bp, Rattus norvegicus
tggattttccggtaccttggtgcca

SEQ ID NO: 631947 - DNA, 25 bp, Rattus norvegicus
tggattttgagtctccttgcagcaa

SEQ ID NO: 631948 - DNA, 25 bp, Rattus norvegicus
tggattttgagtgtccttgcagcaa

SEQ ID NO: 631949 - DNA, 25 bp, Rattus norvegicus
tggatttttaccagccatcaccttg

SEQ ID NO: 631950 - DNA, 25 bp, Rattus norvegicus
tggatttttacctgccatcaccttg

SEQ ID NO: 631951 - DNA, 25 bp, Rattus norvegicus
tggatttttcccatactggtctctg

SEQ ID NO: 631952 - DNA, 25 bp, Rattus norvegicus
tggatttttcccttactggtctctg

SEQ ID NO: 631953 - DNA, 25 bp, Rattus norvegicus
tggatttttcgcattgcacgtttga

SEQ ID NO: 631954 - DNA, 25 bp, Rattus norvegicus
tggatttttcgctttgcacgtttga

SEQ ID NO: 631955 - DNA, 25 bp, Rattus norvegicus
tggcaaaaacatacaacatacactg

SEQ ID NO: 631956 - DNA, 25 bp, Rattus norvegicus
tggcaaaaacattcaacatacactg

SEQ ID NO: 631957 - DNA, 25 bp, Rattus norvegicus
tggcaaaaacggagaaatttggacg

SEQ ID NO: 631958 - DNA, 25 bp, Rattus norvegicus
tggcaaaaacggtgaaatttggacg

SEQ ID NO: 631959 - DNA, 25 bp, Rattus norvegicus
tggcaaaaatccaccaggctgaaat

SEQ ID NO: 631960 - DNA, 25 bp, Rattus norvegicus
tggcaaaaatcctccaggctgaaat

SEQ ID NO: 631961 - DNA, 25 bp, Rattus norvegicus
tggcaaacaactatttgaccaggtt

SEQ ID NO: 631962 - DNA, 25 bp, Rattus norvegicus
tggcaaacaactttttgaccaggtt

SEQ ID NO: 631963 - DNA, 25 bp, Rattus norvegicus
tggcaaactcctcagtgactacgga

SEQ ID NO: 631964 - DNA, 25 bp, Rattus norvegicus
tggcaaactcctgagtgactacgga

SEQ ID NO: 631965 - DNA, 25 bp, Rattus norvegicus
tggcaaactgttacttcccaagtac

SEQ ID NO: 631966 - DNA, 25 bp, Rattus norvegicus
tggcaaactgtttcttcccaagtac

SEQ ID NO: 631967 - DNA, 25 bp, Rattus norvegicus
tggcaaacttctaggttcgctccag

SEQ ID NO: 631968 - DNA, 25 bp, Rattus norvegicus
tggcaaacttcttggttcgctccag

SEQ ID NO: 631969 - DNA, 25 bp, Rattus norvegicus
tggcaaagaatgacccttcagtcct

SEQ ID NO: 631970 - DNA, 25 bp, Rattus norvegicus
tggcaaagaatgtcccttcagtcct

SEQ ID NO: 631971 - DNA, 25 bp, Rattus norvegicus
tggcaaagcaccatctccactgagt

SEQ ID NO: 631972 - DNA, 25 bp, Rattus norvegicus
tggcaaagcaccttctccactgagt

SEQ ID NO: 631973 - DNA, 25 bp, Rattus norvegicus
tggcaaagccagataaccttgtgtt

SEQ ID NO: 631974 - DNA, 25 bp, Rattus norvegicus
tggcaaagccagttaaccttgtgtt

SEQ ID NO: 631975 - DNA, 25 bp, Rattus norvegicus
tggcaaagcgccagggcctgcaagc

SEQ ID NO: 631976 - DNA, 25 bp, Rattus norvegicus
tggcaaagcgcctgggcctgcaagc

SEQ ID NO: 631977 - DNA, 25 bp, Rattus norvegicus
tggcaaagctgtatccaggccgtgc

SEQ ID NO: 631978 - DNA, 25 bp, Rattus norvegicus
tggcaaagctgtttccaggccgtgc

SEQ ID NO: 631979 - DNA, 25 bp, Rattus norvegicus
tggcaaagcttcagctccagagcat

SEQ ID NO: 631980 - DNA, 25 bp, Rattus norvegicus
tggcaaagcttctgctccagagcat

SEQ ID NO: 631981 - DNA, 25 bp, Rattus norvegicus
tggcaaagcttgcatgtcctcacat

SEQ ID NO: 631982 - DNA, 25 bp, Rattus norvegicus
tggcaaagcttggatgtcctcacat

SEQ ID NO: 631983 - DNA, 25 bp, Rattus norvegicus
tggcaaaggccaagctatgagcaac

SEQ ID NO: 631984 - DNA, 25 bp, Rattus norvegicus
tggcaaaggccatgctatgagcaac

SEQ ID NO: 631985 - DNA, 25 bp, Rattus norvegicus
tggcaaagtaagatggaaagtgttt

SEQ ID NO: 631986 - DNA, 25 bp, Rattus norvegicus
tggcaaagtaagttggaaagtgttt

SEQ ID NO: 631987 - DNA, 25 bp, Rattus norvegicus
tggcaaatctcgctcttcgttgtaa

SEQ ID NO: 631988 - DNA, 25 bp, Rattus norvegicus
tggcaaatctcggtcttcgttgtaa

SEQ ID NO: 631989 - DNA, 25 bp, Rattus norvegicus
tggcaaatgcgcactgggtttgatc

SEQ ID NO: 631990 - DNA, 25 bp, Rattus norvegicus
tggcaaatgcgctctgggtttgatc

SEQ ID NO: 631991 - DNA, 25 bp, Rattus norvegicus
tggcaaattcatcagaggactcttc

SEQ ID NO: 631992 - DNA, 25 bp, Rattus norvegicus
tggcaaattcatgagaggactcttc

SEQ ID NO: 631993 - DNA, 25 bp, Rattus norvegicus
tggcaacaagccacgtgacctgagt

SEQ ID NO: 631994 - DNA, 25 bp, Rattus norvegicus
tggcaacaagcctcgtgacctgagt

SEQ ID NO: 631995 - DNA, 25 bp, Rattus norvegicus
tggcaacactctcctccaggaagag

SEQ ID NO: 631996 - DNA, 25 bp, Rattus norvegicus
tggcaacactctgctccaggaagag

SEQ ID NO: 631997 - DNA, 25 bp, Rattus norvegicus
tggcaacagcccagcccgtgagggt

SEQ ID NO: 631998 - DNA, 25 bp, Rattus norvegicus
tggcaacagccctgcccgtgagggt

SEQ ID NO: 631999 - DNA, 25 bp, Rattus norvegicus
tggcaacagtgcactctaaccgagt

SEQ ID NO: 632000 - DNA, 25 bp, Rattus norvegicus
tggcaacagtgctctctaaccgagt

SEQ ID NO: 632001 - DNA, 25 bp, Rattus norvegicus
tggcaacagttgcatcaatcccttc

SEQ ID NO: 632002 - DNA, 25 bp, Rattus norvegicus
tggcaacagttggatcaatcccttc

SEQ ID NO: 632003 - DNA, 25 bp, Rattus norvegicus
tggcaaccactgatacacattttgt

SEQ ID NO: 632004 - DNA, 25 bp, Rattus norvegicus
tggcaaccactgttacacattttgt

SEQ ID NO: 632005 - DNA, 25 bp, Rattus norvegicus
tggcaaccagagaccaattcctgaa

SEQ ID NO: 632006 - DNA, 25 bp, Rattus norvegicus
tggcaaccagagtccaattcctgaa

SEQ ID NO: 632007 - DNA, 25 bp, Rattus norvegicus
tggcaacccagtcttggctgtgcag

SEQ ID NO: 632008 - DNA, 25 bp, Rattus norvegicus
tggcaacccagtgttggctgtgcag

SEQ ID NO: 632009 - DNA, 25 bp, Rattus norvegicus
tggcaacccctgcaagctaccgatg

SEQ ID NO: 632010 - DNA, 25 bp, Rattus norvegicus
tggcaacccctggaagctaccgatg

SEQ ID NO: 632011 - DNA, 25 bp, Rattus norvegicus
tggcaaccctcgagttgtttctatt

SEQ ID NO: 632012 - DNA, 25 bp, Rattus norvegicus
tggcaaccctcgtgttgtttctatt

SEQ ID NO: 632013 - DNA, 25 bp, Rattus norvegicus
tggcaaccctgaccttctagaagtg

SEQ ID NO: 632014 - DNA, 25 bp, Rattus norvegicus
tggcaaccctgagcttctagaagtg

SEQ ID NO: 632015 - DNA, 25 bp, Rattus norvegicus
tggcaacctcaacctattctgaagc

SEQ ID NO: 632016 - DNA, 25 bp, Rattus norvegicus
tggcaacctcaagctattctgaagc

SEQ ID NO: 632017 - DNA, 25 bp, Rattus norvegicus
tggcaacctccgatgggaacagcag

SEQ ID NO: 632018 - DNA, 25 bp, Rattus norvegicus
tggcaacctccgttgggaacagcag

SEQ ID NO: 632019 - DNA, 25 bp, Rattus norvegicus
tggcaacctcctagttgtccacagg

SEQ ID NO: 632020 - DNA, 25 bp, Rattus norvegicus
tggcaacctcctatatgtactgagc

SEQ ID NO: 632021 - DNA, 25 bp, Rattus norvegicus
tggcaacctccttgttgtccacagg

SEQ ID NO: 632022 - DNA, 25 bp, Rattus norvegicus
tggcaacctcctttatgtactgagc

SEQ ID NO: 632023 - DNA, 25 bp, Rattus norvegicus
tggcaacgatgtcatctcccaggat

SEQ ID NO: 632024 - DNA, 25 bp, Rattus norvegicus
tggcaacgatgtgatctcccaggat

SEQ ID NO: 632025 - DNA, 25 bp, Rattus norvegicus
tggcaacggcacacgatgtcggcgt

SEQ ID NO: 632026 - DNA, 25 bp, Rattus norvegicus
tggcaacggcactcgatgtcggcgt

SEQ ID NO: 632027 - DNA, 25 bp, Rattus norvegicus
tggcaactacccatcatgtttggat

SEQ ID NO: 632028 - DNA, 25 bp, Rattus norvegicus
tggcaactacccttcatgtttggat

SEQ ID NO: 632029 - DNA, 25 bp, Rattus norvegicus
tggcaactcagcaaatcatcatgct

SEQ ID NO: 632030 - DNA, 25 bp, Rattus norvegicus
tggcaactcagctaatcatcatgct

SEQ ID NO: 632031 - DNA, 25 bp, Rattus norvegicus
tggcaactgaatccaggtccactac

SEQ ID NO: 632032 - DNA, 25 bp, Rattus norvegicus
tggcaactgaatgcaggtccactac

SEQ ID NO: 632033 - DNA, 25 bp, Rattus norvegicus
tggcaactgtcaagcctggctctta

SEQ ID NO: 632034 - DNA, 25 bp, Rattus norvegicus
tggcaactgtcatgcctggctctta

SEQ ID NO: 632035 - DNA, 25 bp, Rattus norvegicus
tggcaagaaagcctccggagcatct

SEQ ID NO: 632036 - DNA, 25 bp, Rattus norvegicus
tggcaagaaagcgtccggagcatct

SEQ ID NO: 632037 - DNA, 25 bp, Rattus norvegicus
tggcaagacccaaggcaacaagtgt

SEQ ID NO: 632038 - DNA, 25 bp, Rattus norvegicus
tggcaagacccatggcaacaagtgt

SEQ ID NO: 632039 - DNA, 25 bp, Rattus norvegicus
tggcaagagggactggacccacctt

SEQ ID NO: 632040 - DNA, 25 bp, Rattus norvegicus
tggcaagagggagtggacccacctt

SEQ ID NO: 632041 - DNA, 25 bp, Rattus norvegicus
tggcaagagtgaacacacacctcat

SEQ ID NO: 632042 - DNA, 25 bp, Rattus norvegicus
tggcaagagtgatcacacacctcat

SEQ ID NO: 632043 - DNA, 25 bp, Rattus norvegicus
tggcaagatagtatctgtccccacc

SEQ ID NO: 632044 - DNA, 25 bp, Rattus norvegicus
tggcaagatagtttctgtccccacc

SEQ ID NO: 632045 - DNA, 25 bp, Rattus norvegicus
tggcaagatgccactgttccagtaa

SEQ ID NO: 632046 - DNA, 25 bp, Rattus norvegicus
tggcaagatgcctctgttccagtaa

SEQ ID NO: 632047 - DNA, 25 bp, Rattus norvegicus
tggcaagcaaggaggcaaggcccgc

SEQ ID NO: 632048 - DNA, 25 bp, Rattus norvegicus
tggcaagcaaggtggcaaggcccgc

SEQ ID NO: 632049 - DNA, 25 bp, Rattus norvegicus
tggcaagcacttcgaccttggtgcc

SEQ ID NO: 632050 - DNA, 25 bp, Rattus norvegicus
tggcaagcacttggaccttggtgcc

SEQ ID NO: 632051 - DNA, 25 bp, Rattus norvegicus
tggcaagcagatcggccagctgcaa

SEQ ID NO: 632052 - DNA, 25 bp, Rattus norvegicus
tggcaagcagatgggccagctgcaa

SEQ ID NO: 632053 - DNA, 25 bp, Rattus norvegicus
tggcaagccatcatctgggagactt

SEQ ID NO: 632054 - DNA, 25 bp, Rattus norvegicus
tggcaagccatcttctgggagactt

SEQ ID NO: 632055 - DNA, 25 bp, Rattus norvegicus
tggcaagcccctagaatgtttgggt

SEQ ID NO: 632056 - DNA, 25 bp, Rattus norvegicus
tggcaagccccttgaatgtttgggt

SEQ ID NO: 632057 - DNA, 25 bp, Rattus norvegicus
tggcaagctcctagccatctttgcc

SEQ ID NO: 632058 - DNA, 25 bp, Rattus norvegicus
tggcaagctccttgccatctttgcc

SEQ ID NO: 632059 - DNA, 25 bp, Rattus norvegicus
tggcaagctgtgacccctggagatg

SEQ ID NO: 632060 - DNA, 25 bp, Rattus norvegicus
tggcaagctgtgtcccctggagatg

SEQ ID NO: 632061 - DNA, 25 bp, Rattus norvegicus
tggcaaggacagcaacctacctctt

SEQ ID NO: 632062 - DNA, 25 bp, Rattus norvegicus
tggcaaggacaggaacctacctctt

SEQ ID NO: 632063 - DNA, 25 bp, Rattus norvegicus
tggcaaggccacacatggactacct

SEQ ID NO: 632064 - DNA, 25 bp, Rattus norvegicus
tggcaaggccactcatggactacct

SEQ ID NO: 632065 - DNA, 25 bp, Rattus norvegicus
tggcaaggcctaccagagcagcagc

SEQ ID NO: 632066 - DNA, 25 bp, Rattus norvegicus
tggcaaggcctagcagagcagcagc

SEQ ID NO: 632067 - DNA, 25 bp, Rattus norvegicus
tggcaaggctaaccagccccaggga

SEQ ID NO: 632068 - DNA, 25 bp, Rattus norvegicus
tggcaaggctaagcagccccaggga

SEQ ID NO: 632069 - DNA, 25 bp, Rattus norvegicus
tggcaaggtccccaaggtcctgtaa

SEQ ID NO: 632070 - DNA, 25 bp, Rattus norvegicus
tggcaaggtcccgaaggtcctgtaa

SEQ ID NO: 632071 - DNA, 25 bp, Rattus norvegicus
tggcaaggtgacaatgacctcctgg

SEQ ID NO: 632072 - DNA, 25 bp, Rattus norvegicus
tggcaaggtgactatgacctcctgg

SEQ ID NO: 632073 - DNA, 25 bp, Rattus norvegicus
tggcaaggtggtcgcagacttcccc

SEQ ID NO: 632074 - DNA, 25 bp, Rattus norvegicus
tggcaaggtggtggcagacttcccc

SEQ ID NO: 632075 - DNA, 25 bp, Rattus norvegicus
tggcaagtaaccacccaaaatttag

SEQ ID NO: 632076 - DNA, 25 bp, Rattus norvegicus
tggcaagtaacctcccaaaatttag

SEQ ID NO: 632077 - DNA, 25 bp, Rattus norvegicus
tggcaagtacgtcatcaggcatttg

SEQ ID NO: 632078 - DNA, 25 bp, Rattus norvegicus
tggcaagtacgtgatcaggcatttg

SEQ ID NO: 632079 - DNA, 25 bp, Rattus norvegicus
tggcaagtcccaatatctcgacggt

SEQ ID NO: 632080 - DNA, 25 bp, Rattus norvegicus
tggcaagtcccattatctcgacggt

SEQ ID NO: 632081 - DNA, 25 bp, Rattus norvegicus
tggcaagtcttcagataaccggtcc

SEQ ID NO: 632082 - DNA, 25 bp, Rattus norvegicus
tggcaagtcttctgataaccggtcc

SEQ ID NO: 632083 - DNA, 25 bp, Rattus norvegicus
tggcaagtgaccacccatgagtaag

SEQ ID NO: 632084 - DNA, 25 bp, Rattus norvegicus
tggcaagtgacctcccatgagtaag

SEQ ID NO: 632085 - DNA, 25 bp, Rattus norvegicus
tggcaagttgtcataacccgatctg

SEQ ID NO: 632086 - DNA, 25 bp, Rattus norvegicus
tggcaagttgtcttaacccgatctg

SEQ ID NO: 632087 - DNA, 25 bp, Rattus norvegicus
tggcaagtttaaccggcccactctc

SEQ ID NO: 632088 - DNA, 25 bp, Rattus norvegicus
tggcaagtttaagcggcccactctc

SEQ ID NO: 632089 - DNA, 25 bp, Rattus norvegicus
tggcaataccttctccctttgaggc

SEQ ID NO: 632090 - DNA, 25 bp, Rattus norvegicus
tggcaataccttgtccctttgaggc

SEQ ID NO: 632091 - DNA, 25 bp, Rattus norvegicus
tggcaatatctgagaccgtcgtagt

SEQ ID NO: 632092 - DNA, 25 bp, Rattus norvegicus
tggcaatatctgtgaccgtcgtagt

SEQ ID NO: 632093 - DNA, 25 bp, Rattus norvegicus
tggcaatattcacacaccttagcac

SEQ ID NO: 632094 - DNA, 25 bp, Rattus norvegicus
tggcaatattcagacaccttagcac

SEQ ID NO: 632095 - DNA, 25 bp, Rattus norvegicus
tggcaatcacccactggctggcttt

SEQ ID NO: 632096 - DNA, 25 bp, Rattus norvegicus
tggcaatcaccctctggctggcttt

SEQ ID NO: 632097 - DNA, 25 bp, Rattus norvegicus
tggcaatcacggagactgtacaggt

SEQ ID NO: 632098 - DNA, 25 bp, Rattus norvegicus
tggcaatcacggtgactgtacaggt

SEQ ID NO: 632099 - DNA, 25 bp, Rattus norvegicus
tggcaatccgttaagagtcgtcact

SEQ ID NO: 632100 - DNA, 25 bp, Rattus norvegicus
tggcaatccgtttagagtcgtcact

SEQ ID NO: 632101 - DNA, 25 bp, Rattus norvegicus
tggcaatccttgagagcaagttctg

SEQ ID NO: 632102 - DNA, 25 bp, Rattus norvegicus
tggcaatccttgtgagcaagttctg

SEQ ID NO: 632103 - DNA, 25 bp, Rattus norvegicus
tggcaatctcatctggaaccagcac

SEQ ID NO: 632104 - DNA, 25 bp, Rattus norvegicus
tggcaatctcatgtggaaccagcac

SEQ ID NO: 632105 - DNA, 25 bp, Rattus norvegicus
tggcaatctttgctgatcttctaaa

SEQ ID NO: 632106 - DNA, 25 bp, Rattus norvegicus
tggcaatctttggtgatcttctaaa

SEQ ID NO: 632107 - DNA, 25 bp, Rattus norvegicus
tggcaatgatgactcaccccaagct

SEQ ID NO: 632108 - DNA, 25 bp, Rattus norvegicus
tggcaatgatgagtcaccccaagct

SEQ ID NO: 632109 - DNA, 25 bp, Rattus norvegicus
tggcaatgcactctgcggtccagat

SEQ ID NO: 632110 - DNA, 25 bp, Rattus norvegicus
tggcaatgcactgtgcggtccagat

SEQ ID NO: 632111 - DNA, 25 bp, Rattus norvegicus
tggcaatgccccagggtctagaata

SEQ ID NO: 632112 - DNA, 25 bp, Rattus norvegicus
tggcaatgcccctgggtctagaata

SEQ ID NO: 632113 - DNA, 25 bp, Rattus norvegicus
tggcaatgcttcatacttccttcct

SEQ ID NO: 632114 - DNA, 25 bp, Rattus norvegicus
tggcaatgcttcttacttccttcct

SEQ ID NO: 632115 - DNA, 25 bp, Rattus norvegicus
tggcaatgggaaaccccagtgagtt

SEQ ID NO: 632116 - DNA, 25 bp, Rattus norvegicus
tggcaatgggaatccccagtgagtt

SEQ ID NO: 632117 - DNA, 25 bp, Rattus norvegicus
tggcaattgccacccatattggtag

SEQ ID NO: 632118 - DNA, 25 bp, Rattus norvegicus
tggcaattgccagccatattggtag

SEQ ID NO: 632119 - DNA, 25 bp, Rattus norvegicus
tggcaatttgtgatactaggactac

SEQ ID NO: 632120 - DNA, 25 bp, Rattus norvegicus
tggcaatttgtgttactaggactac

SEQ ID NO: 632121 - DNA, 25 bp, Rattus norvegicus
tggcaatttttaacatttctcactg

SEQ ID NO: 632122 - DNA, 25 bp, Rattus norvegicus
tggcaatttttatcatttctcactg

SEQ ID NO: 632123 - DNA, 25 bp, Rattus norvegicus
tggcaatttttcctcctactctcaa

SEQ ID NO: 632124 - DNA, 25 bp, Rattus norvegicus
tggcaatttttcgtcctactctcaa

SEQ ID NO: 632125 - DNA, 25 bp, Rattus norvegicus
tggcacaaagtgaggcttgcctcca

SEQ ID NO: 632126 - DNA, 25 bp, Rattus norvegicus
tggcacaaagtgtggcttgcctcca

SEQ ID NO: 632127 - DNA, 25 bp, Rattus norvegicus
tggcacaagtatataccaccgtcct

SEQ ID NO: 632128 - DNA, 25 bp, Rattus norvegicus
tggcacaagtatttaccaccgtcct

SEQ ID NO: 632129 - DNA, 25 bp, Rattus norvegicus
tggcacacacagcagtgggacctga

SEQ ID NO: 632130 - DNA, 25 bp, Rattus norvegicus
tggcacacacaggagtgggacctga

SEQ ID NO: 632131 - DNA, 25 bp, Rattus norvegicus
tggcacacactaaaatcgcagcact

SEQ ID NO: 632132 - DNA, 25 bp, Rattus norvegicus
tggcacacactataatcgcagcact

SEQ ID NO: 632133 - DNA, 25 bp, Rattus norvegicus
tggcacacacttcggagacacagca

SEQ ID NO: 632134 - DNA, 25 bp, Rattus norvegicus
tggcacacacttgggagacacagca

SEQ ID NO: 632135 - DNA, 25 bp, Rattus norvegicus
tggcacacagccatcattgatcctc

SEQ ID NO: 632136 - DNA, 25 bp, Rattus norvegicus
tggcacacagccttcattgatcctc

SEQ ID NO: 632137 - DNA, 25 bp, Rattus norvegicus
tggcacacagcgccgggacccgtat

SEQ ID NO: 632138 - DNA, 25 bp, Rattus norvegicus
tggcacacagcggcgggacccgtat

SEQ ID NO: 632139 - DNA, 25 bp, Rattus norvegicus
tggcacacagctatgtcactgctct

SEQ ID NO: 632140 - DNA, 25 bp, Rattus norvegicus
tggcacacagctttgtcactgctct

SEQ ID NO: 632141 - DNA, 25 bp, Rattus norvegicus
tggcacacgggacttggaaagcatc

SEQ ID NO: 632142 - DNA, 25 bp, Rattus norvegicus
tggcacacgggagttggaaagcatc

SEQ ID NO: 632143 - DNA, 25 bp, Rattus norvegicus
tggcacactctgctagactgtagac

SEQ ID NO: 632144 - DNA, 25 bp, Rattus norvegicus
tggcacactctggtagactgtagac

SEQ ID NO: 632145 - DNA, 25 bp, Rattus norvegicus
tggcacagaacaagggctcaggaat

SEQ ID NO: 632146 - DNA, 25 bp, Rattus norvegicus
tggcacagaacatgggctcaggaat

SEQ ID NO: 632147 - DNA, 25 bp, Rattus norvegicus
tggcacagaccacatgacaactttt

SEQ ID NO: 632148 - DNA, 25 bp, Rattus norvegicus
tggcacagaccagatgacaactttt

SEQ ID NO: 632149 - DNA, 25 bp, Rattus norvegicus
tggcacagatacacaccttgtagac

SEQ ID NO: 632150 - DNA, 25 bp, Rattus norvegicus
tggcacagatactcaccttgtagac

SEQ ID NO: 632151 - DNA, 25 bp, Rattus norvegicus
tggcacagcgtcagttctcagggca

SEQ ID NO: 632152 - DNA, 25 bp, Rattus norvegicus
tggcacagcgtctgttctcagggca

SEQ ID NO: 632153 - DNA, 25 bp, Rattus norvegicus
tggcacagctctagcagcgctcgga

SEQ ID NO: 632154 - DNA, 25 bp, Rattus norvegicus
tggcacagctcttgcagcgctcgga

SEQ ID NO: 632155 - DNA, 25 bp, Rattus norvegicus
tggcacaggcaccaatgcttgctac

SEQ ID NO: 632156 - DNA, 25 bp, Rattus norvegicus
tggcacaggcacgaatgcttgctac

SEQ ID NO: 632157 - DNA, 25 bp, Rattus norvegicus
tggcacaggcttagcaggctccgga

SEQ ID NO: 632158 - DNA, 25 bp, Rattus norvegicus
tggcacaggctttgcaggctccgga

SEQ ID NO: 632159 - DNA, 25 bp, Rattus norvegicus
tggcacagtcacatggtccatatgt

SEQ ID NO: 632160 - DNA, 25 bp, Rattus norvegicus
tggcacagtcacttggtccatatgt

SEQ ID NO: 632161 - DNA, 25 bp, Rattus norvegicus
tggcacagtgccctcactaagacat

SEQ ID NO: 632162 - DNA, 25 bp, Rattus norvegicus
tggcacagtgccgtcactaagacat

SEQ ID NO: 632163 - DNA, 25 bp, Rattus norvegicus
tggcacagtgttccctgaggacagt

SEQ ID NO: 632164 - DNA, 25 bp, Rattus norvegicus
tggcacagtgttgcctgaggacagt

SEQ ID NO: 632165 - DNA, 25 bp, Rattus norvegicus
tggcacagttttaatccaggacaca

SEQ ID NO: 632166 - DNA, 25 bp, Rattus norvegicus
tggcacagtttttatccaggacaca

SEQ ID NO: 632167 - DNA, 25 bp, Rattus norvegicus
tggcacatacatcctactagcttgt

SEQ ID NO: 632168 - DNA, 25 bp, Rattus norvegicus
tggcacatacatgctactagcttgt

SEQ ID NO: 632169 - DNA, 25 bp, Rattus norvegicus
tggcacatacgcagagtcccatgat

SEQ ID NO: 632170 - DNA, 25 bp, Rattus norvegicus
tggcacatacgctgagtcccatgat

SEQ ID NO: 632171 - DNA, 25 bp, Rattus norvegicus
tggcacatcagcacgatttctgttt

SEQ ID NO: 632172 - DNA, 25 bp, Rattus norvegicus
tggcacatcagctcgatttctgttt

SEQ ID NO: 632173 - DNA, 25 bp, Rattus norvegicus
tggcacatcattcagtatttcatat

SEQ ID NO: 632174 - DNA, 25 bp, Rattus norvegicus
tggcacatcattgagtatttcatat

SEQ ID NO: 632175 - DNA, 25 bp, Rattus norvegicus
tggcacatcctcactttgaattgtt

SEQ ID NO: 632176 - DNA, 25 bp, Rattus norvegicus
tggcacatcctctctttgaattgtt

SEQ ID NO: 632177 - DNA, 25 bp, Rattus norvegicus
tggcacatcgcacatgctgatctga

SEQ ID NO: 632178 - DNA, 25 bp, Rattus norvegicus
tggcacatcgcagatgctgatctga

SEQ ID NO: 632179 - DNA, 25 bp, Rattus norvegicus
tggcacatgactaccaacattggtg

SEQ ID NO: 632180 - DNA, 25 bp, Rattus norvegicus
tggcacatgacttccaacattggtg

SEQ ID NO: 632181 - DNA, 25 bp, Rattus norvegicus
tggcacatgcgcctgtcagatggat

SEQ ID NO: 632182 - DNA, 25 bp, Rattus norvegicus
tggcacatgcgcgtgtcagatggat

SEQ ID NO: 632183 - DNA, 25 bp, Rattus norvegicus
tggcacatgggtcggctatcagtac

SEQ ID NO: 632184 - DNA, 25 bp, Rattus norvegicus
tggcacatgggtgggctatcagtac

SEQ ID NO: 632185 - DNA, 25 bp, Rattus norvegicus
tggcacatgtcaccaggtcagggat

SEQ ID NO: 632186 - DNA, 25 bp, Rattus norvegicus
tggcacatgtcagcaggtcagggat

SEQ ID NO: 632187 - DNA, 25 bp, Rattus norvegicus
tggcaccaacatcaagctttacaac

SEQ ID NO: 632188 - DNA, 25 bp, Rattus norvegicus
tggcaccaacatgaagctttacaac

SEQ ID NO: 632189 - DNA, 25 bp, Rattus norvegicus
tggcaccaatctcatcactcatgct

SEQ ID NO: 632190 - DNA, 25 bp, Rattus norvegicus
tggcaccaatctgatcactcatgct

SEQ ID NO: 632191 - DNA, 25 bp, Rattus norvegicus
tggcaccacactaggaatcatcagg

SEQ ID NO: 632192 - DNA, 25 bp, Rattus norvegicus
tggcaccacacttggaatcatcagg

SEQ ID NO: 632193 - DNA, 25 bp, Rattus norvegicus
tggcaccacctcaactgtgacaatc

SEQ ID NO: 632194 - DNA, 25 bp, Rattus norvegicus
tggcaccacctctactgtgacaatc

SEQ ID NO: 632195 - DNA, 25 bp, Rattus norvegicus
tggcaccactccagtcctggacgtt

SEQ ID NO: 632196 - DNA, 25 bp, Rattus norvegicus
tggcaccactcctgtcctggacgtt

SEQ ID NO: 632197 - DNA, 25 bp, Rattus norvegicus
tggcaccagccacaggaaggatgtt

SEQ ID NO: 632198 - DNA, 25 bp, Rattus norvegicus
tggcaccagccagaggaaggatgtt

SEQ ID NO: 632199 - DNA, 25 bp, Rattus norvegicus
tggcaccatcaccattcaagttggg

SEQ ID NO: 632200 - DNA, 25 bp, Rattus norvegicus
tggcaccatcacgattcaagttggg

SEQ ID NO: 632201 - DNA, 25 bp, Rattus norvegicus
tggcacccagcgcagaacatcattg

SEQ ID NO: 632202 - DNA, 25 bp, Rattus norvegicus
tggcacccagcggagaacatcattg

SEQ ID NO: 632203 - DNA, 25 bp, Rattus norvegicus
tggcacccaggtcacacctttttta

SEQ ID NO: 632204 - DNA, 25 bp, Rattus norvegicus
tggcacccaggtgacacctttttta

SEQ ID NO: 632205 - DNA, 25 bp, Rattus norvegicus
tggcacccattcattgtaactgttt

SEQ ID NO: 632206 - DNA, 25 bp, Rattus norvegicus
tggcacccattcctgaaaactgaac

SEQ ID NO: 632207 - DNA, 25 bp, Rattus norvegicus
tggcacccattcgtgaaaactgaac

SEQ ID NO: 632208 - DNA, 25 bp, Rattus norvegicus
tggcacccattctttgtaactgttt

SEQ ID NO: 632209 - DNA, 25 bp, Rattus norvegicus
tggcaccccgggaacgcaaagctgg

SEQ ID NO: 632210 - DNA, 25 bp, Rattus norvegicus
tggcaccccgggtacgcaaagctgg

SEQ ID NO: 632211 - DNA, 25 bp, Rattus norvegicus
tggcacccctctccagaattgtaca

SEQ ID NO: 632212 - DNA, 25 bp, Rattus norvegicus
tggcacccctctgcagaattgtaca

SEQ ID NO: 632213 - DNA, 25 bp, Rattus norvegicus
tggcacccctgtatatgatactagc

SEQ ID NO: 632214 - DNA, 25 bp, Rattus norvegicus
tggcacccctgtttatgatactagc

SEQ ID NO: 632215 - DNA, 25 bp, Rattus norvegicus
tggcacccgcaaagcttaaggctgt

SEQ ID NO: 632216 - DNA, 25 bp, Rattus norvegicus
tggcacccgcaatgcttaaggctgt

SEQ ID NO: 632217 - DNA, 25 bp, Rattus norvegicus
tggcacccgttcagcacaggaggag

SEQ ID NO: 632218 - DNA, 25 bp, Rattus norvegicus
tggcacccgttctgcacaggaggag

SEQ ID NO: 632219 - DNA, 25 bp, Rattus norvegicus
tggcaccctggaacccgggaggaaa

SEQ ID NO: 632220 - DNA, 25 bp, Rattus norvegicus
tggcaccctggatcccgggaggaaa

SEQ ID NO: 632221 - DNA, 25 bp, Rattus norvegicus
tggcaccgcacacaggattaacgtt

SEQ ID NO: 632222 - DNA, 25 bp, Rattus norvegicus
tggcaccgcacagaggattaacgtt

SEQ ID NO: 632223 - DNA, 25 bp, Rattus norvegicus
tggcaccgcactaggataccaggcg

SEQ ID NO: 632224 - DNA, 25 bp, Rattus norvegicus
tggcaccgcacttggataccaggcg

SEQ ID NO: 632225 - DNA, 25 bp, Rattus norvegicus
tggcacctaggtacagggagtccaa

SEQ ID NO: 632226 - DNA, 25 bp, Rattus norvegicus
tggcacctaggttcagggagtccaa

SEQ ID NO: 632227 - DNA, 25 bp, Rattus norvegicus
tggcacctagtaaatctcaccagag

SEQ ID NO: 632228 - DNA, 25 bp, Rattus norvegicus
tggcacctagtatatctcaccagag

SEQ ID NO: 632229 - DNA, 25 bp, Rattus norvegicus
tggcacctatggctgagtttgtttt

SEQ ID NO: 632230 - DNA, 25 bp, Rattus norvegicus
tggcacctatgggtgagtttgtttt

SEQ ID NO: 632231 - DNA, 25 bp, Rattus norvegicus
tggcacctctgtagagcagcctcaa

SEQ ID NO: 632232 - DNA, 25 bp, Rattus norvegicus
tggcacctctgttgagcagcctcaa

SEQ ID NO: 632233 - DNA, 25 bp, Rattus norvegicus
tggcacctgcctatagggttacagt

SEQ ID NO: 632234 - DNA, 25 bp, Rattus norvegicus
tggcacctgcctttagggttacagt

SEQ ID NO: 632235 - DNA, 25 bp, Rattus norvegicus
tggcacctgctcagtttcattaaat

SEQ ID NO: 632236 - DNA, 25 bp, Rattus norvegicus
tggcacctgctctgtttcattaaat

SEQ ID NO: 632237 - DNA, 25 bp, Rattus norvegicus
tggcacctgggtataactctagcac

SEQ ID NO: 632238 - DNA, 25 bp, Rattus norvegicus
tggcacctgggtatctaagcatgta

SEQ ID NO: 632239 - DNA, 25 bp, Rattus norvegicus
tggcacctgggtttaactctagcac

SEQ ID NO: 632240 - DNA, 25 bp, Rattus norvegicus
tggcacctgggtttctaagcatgta

SEQ ID NO: 632241 - DNA, 25 bp, Rattus norvegicus
tggcacctggttagagccctgcgga

SEQ ID NO: 632242 - DNA, 25 bp, Rattus norvegicus
tggcacctggtttgagccctgcgga

SEQ ID NO: 632243 - DNA, 25 bp, Rattus norvegicus
tggcaccttcaaccctgagtggaac

SEQ ID NO: 632244 - DNA, 25 bp, Rattus norvegicus
tggcaccttcaagcctgagtggaac

SEQ ID NO: 632245 - DNA, 25 bp, Rattus norvegicus
tggcaccttcgactcctggcaggag

SEQ ID NO: 632246 - DNA, 25 bp, Rattus norvegicus
tggcaccttcgagtcctggcaggag

SEQ ID NO: 632247 - DNA, 25 bp, Rattus norvegicus
tggcaccttgccaaaaaacaacaat

SEQ ID NO: 632248 - DNA, 25 bp, Rattus norvegicus
tggcaccttgcctaaaaacaacaat

SEQ ID NO: 632249 - DNA, 25 bp, Rattus norvegicus
tggcacctttagaggaaagaccatt

SEQ ID NO: 632250 - DNA, 25 bp, Rattus norvegicus
tggcacctttagtggaaagaccatt

SEQ ID NO: 632251 - DNA, 25 bp, Rattus norvegicus
tggcacgaatcgcagcatttgctga

SEQ ID NO: 632252 - DNA, 25 bp, Rattus norvegicus
tggcacgaatcggagcatttgctga

SEQ ID NO: 632253 - DNA, 25 bp, Rattus norvegicus
tggcacgacagaccctgtccactgt

SEQ ID NO: 632254 - DNA, 25 bp, Rattus norvegicus
tggcacgacagagcctgtccactgt

SEQ ID NO: 632255 - DNA, 25 bp, Rattus norvegicus
tggcacgagctgacttccaaaaggt

SEQ ID NO: 632256 - DNA, 25 bp, Rattus norvegicus
tggcacgagctgtcttccaaaaggt

SEQ ID NO: 632257 - DNA, 25 bp, Rattus norvegicus
tggcacgccatcagtgctggaaaga

SEQ ID NO: 632258 - DNA, 25 bp, Rattus norvegicus
tggcacgccatctgtgctggaaaga

SEQ ID NO: 632259 - DNA, 25 bp, Rattus norvegicus
tggcacgctcacaaacaagatggct

SEQ ID NO: 632260 - DNA, 25 bp, Rattus norvegicus
tggcacgctcactaacaagatggct

SEQ ID NO: 632261 - DNA, 25 bp, Rattus norvegicus
tggcacgctccaattcaacgaggag

SEQ ID NO: 632262 - DNA, 25 bp, Rattus norvegicus
tggcacgctccatttcaacgaggag

SEQ ID NO: 632263 - DNA, 25 bp, Rattus norvegicus
tggcacggcccaaggttctgtgatt

SEQ ID NO: 632264 - DNA, 25 bp, Rattus norvegicus
tggcacggcccatggttctgtgatt

SEQ ID NO: 632265 - DNA, 25 bp, Rattus norvegicus
tggcacggtgctctgaccaactgta

SEQ ID NO: 632266 - DNA, 25 bp, Rattus norvegicus
tggcacggtgctgtgaccaactgta

SEQ ID NO: 632267 - DNA, 25 bp, Rattus norvegicus
tggcacgtcagcatgtcacagtaaa

SEQ ID NO: 632268 - DNA, 25 bp, Rattus norvegicus
tggcacgtcagcttgtcacagtaaa

SEQ ID NO: 632269 - DNA, 25 bp, Rattus norvegicus
tggcacgtgtgtactgtatccggca

SEQ ID NO: 632270 - DNA, 25 bp, Rattus norvegicus
tggcacgtgtgttctgtatccggca

SEQ ID NO: 632271 - DNA, 25 bp, Rattus norvegicus
tggcactacagaatcctttcttaag

SEQ ID NO: 632272 - DNA, 25 bp, Rattus norvegicus
tggcactacagattcctttcttaag

SEQ ID NO: 632273 - DNA, 25 bp, Rattus norvegicus
tggcactaccttacaagggcctgtg

SEQ ID NO: 632274 - DNA, 25 bp, Rattus norvegicus
tggcactacctttcaagggcctgtg

SEQ ID NO: 632275 - DNA, 25 bp, Rattus norvegicus
tggcactagagcactgcagacgtag

SEQ ID NO: 632276 - DNA, 25 bp, Rattus norvegicus
tggcactagagctctgcagacgtag

SEQ ID NO: 632277 - DNA, 25 bp, Rattus norvegicus
tggcactagctgacacaacctgaaa

SEQ ID NO: 632278 - DNA, 25 bp, Rattus norvegicus
tggcactagctgtcacaacctgaaa

SEQ ID NO: 632279 - DNA, 25 bp, Rattus norvegicus
tggcactagggcactgcttgaagca

SEQ ID NO: 632280 - DNA, 25 bp, Rattus norvegicus
tggcactagggctctgcttgaagca

SEQ ID NO: 632281 - DNA, 25 bp, Rattus norvegicus
tggcactattgacttccctgaattt

SEQ ID NO: 632282 - DNA, 25 bp, Rattus norvegicus
tggcactattgagttccctgaattt

SEQ ID NO: 632283 - DNA, 25 bp, Rattus norvegicus
tggcactcccaaccggctgacatga

SEQ ID NO: 632284 - DNA, 25 bp, Rattus norvegicus
tggcactcccaagcggctgacatga

SEQ ID NO: 632285 - DNA, 25 bp, Rattus norvegicus
tggcactcccatcactgattgacag

SEQ ID NO: 632286 - DNA, 25 bp, Rattus norvegicus
tggcactcccatgactgattgacag

SEQ ID NO: 632287 - DNA, 25 bp, Rattus norvegicus
tggcactcctctactggaggttcca

SEQ ID NO: 632288 - DNA, 25 bp, Rattus norvegicus
tggcactcctcttctggaggttcca

SEQ ID NO: 632289 - DNA, 25 bp, Rattus norvegicus
tggcactcgggtactggttttctag

SEQ ID NO: 632290 - DNA, 25 bp, Rattus norvegicus
tggcactcgggttctggttttctag

SEQ ID NO: 632291 - DNA, 25 bp, Rattus norvegicus
tggcactctactcaacctgcagaag

SEQ ID NO: 632292 - DNA, 25 bp, Rattus norvegicus
tggcactctactgaacctgcagaag

SEQ ID NO: 632293 - DNA, 25 bp, Rattus norvegicus
tggcactctatgagttctccaacaa

SEQ ID NO: 632294 - DNA, 25 bp, Rattus norvegicus
tggcactctatgtgttctccaacaa

SEQ ID NO: 632295 - DNA, 25 bp, Rattus norvegicus
tggcactctcctattatccttaaaa

SEQ ID NO: 632296 - DNA, 25 bp, Rattus norvegicus
tggcactctccttttatccttaaaa

SEQ ID NO: 632297 - DNA, 25 bp, Rattus norvegicus
tggcactctggacctgggctatgac

SEQ ID NO: 632298 - DNA, 25 bp, Rattus norvegicus
tggcactctggagctgggctatgac

SEQ ID NO: 632299 - DNA, 25 bp, Rattus norvegicus
tggcactgactgaactgacctggag

SEQ ID NO: 632300 - DNA, 25 bp, Rattus norvegicus
tggcactgactgtactgacctggag

SEQ ID NO: 632301 - DNA, 25 bp, Rattus norvegicus
tggcactgaggactctctgcacaga

SEQ ID NO: 632302 - DNA, 25 bp, Rattus norvegicus
tggcactgaggagtctctgcacaga

SEQ ID NO: 632303 - DNA, 25 bp, Rattus norvegicus
tggcactgagtgctacctccgagat

SEQ ID NO: 632304 - DNA, 25 bp, Rattus norvegicus
tggcactgagtggtacctccgagat

SEQ ID NO: 632305 - DNA, 25 bp, Rattus norvegicus
tggcactgatggcttctcagctgct

SEQ ID NO: 632306 - DNA, 25 bp, Rattus norvegicus
tggcactgatgggttctcagctgct

SEQ ID NO: 632307 - DNA, 25 bp, Rattus norvegicus
tggcactgctgcatggttgtggaac

SEQ ID NO: 632308 - DNA, 25 bp, Rattus norvegicus
tggcactgctgcttggttgtggaac

SEQ ID NO: 632309 - DNA, 25 bp, Rattus norvegicus
tggcactggacgacgagactctcaa

SEQ ID NO: 632310 - DNA, 25 bp, Rattus norvegicus
tggcactggacgtcgagactctcaa

SEQ ID NO: 632311 - DNA, 25 bp, Rattus norvegicus
tggcactggtatacaaacacgggat

SEQ ID NO: 632312 - DNA, 25 bp, Rattus norvegicus
tggcactggtattcaaacacgggat

SEQ ID NO: 632313 - DNA, 25 bp, Rattus norvegicus
tggcactggtggcaagtccatctac

SEQ ID NO: 632314 - DNA, 25 bp, Rattus norvegicus
tggcactggtgggaagtccatctac

SEQ ID NO: 632315 - DNA, 25 bp, Rattus norvegicus
tggcactgtacacccagaaaaactt

SEQ ID NO: 632316 - DNA, 25 bp, Rattus norvegicus
tggcactgtacagccagaaaaactt

SEQ ID NO: 632317 - DNA, 25 bp, Rattus norvegicus
tggcactgtattctggacccaccaa

SEQ ID NO: 632318 - DNA, 25 bp, Rattus norvegicus
tggcactgtattgtggacccaccaa

SEQ ID NO: 632319 - DNA, 25 bp, Rattus norvegicus
tggcactgtccccttgttaactgca

SEQ ID NO: 632320 - DNA, 25 bp, Rattus norvegicus
tggcactgtcccgttgttaactgca

SEQ ID NO: 632321 - DNA, 25 bp, Rattus norvegicus
tggcactgtggtaccttcatgacaa

SEQ ID NO: 632322 - DNA, 25 bp, Rattus norvegicus
tggcactgtggttccttcatgacaa

SEQ ID NO: 632323 - DNA, 25 bp, Rattus norvegicus
tggcactgttccagctacacggcag

SEQ ID NO: 632324 - DNA, 25 bp, Rattus norvegicus
tggcactgttcctgctacacggcag

SEQ ID NO: 632325 - DNA, 25 bp, Rattus norvegicus
tggcacttactcagttcaaagccct

SEQ ID NO: 632326 - DNA, 25 bp, Rattus norvegicus
tggcacttactctgttcaaagccct

SEQ ID NO: 632327 - DNA, 25 bp, Rattus norvegicus
tggcacttccaaacgtttataactt

SEQ ID NO: 632328 - DNA, 25 bp, Rattus norvegicus
tggcacttccaatcgtttataactt

SEQ ID NO: 632329 - DNA, 25 bp, Rattus norvegicus
tggcacttccttcagagatgctttg

SEQ ID NO: 632330 - DNA, 25 bp, Rattus norvegicus
tggcacttccttgagagatgctttg

SEQ ID NO: 632331 - DNA, 25 bp, Rattus norvegicus
tggcacttcttacgttttcaaccca

SEQ ID NO: 632332 - DNA, 25 bp, Rattus norvegicus
tggcacttcttaggttttcaaccca

SEQ ID NO: 632333 - DNA, 25 bp, Rattus norvegicus
tggcacttgagtcctaacattatgt

SEQ ID NO: 632334 - DNA, 25 bp, Rattus norvegicus
tggcacttgagtgctaacattatgt

SEQ ID NO: 632335 - DNA, 25 bp, Rattus norvegicus
tggcactttatcacatttgtacgga

SEQ ID NO: 632336 - DNA, 25 bp, Rattus norvegicus
tggcactttatctcatttgtacgga

SEQ ID NO: 632337 - DNA, 25 bp, Rattus norvegicus
tggcactttgtgcaaattttcattt

SEQ ID NO: 632338 - DNA, 25 bp, Rattus norvegicus
tggcactttgtgctacacttgcacc

SEQ ID NO: 632339 - DNA, 25 bp, Rattus norvegicus
tggcactttgtggaaattttcattt

SEQ ID NO: 632340 - DNA, 25 bp, Rattus norvegicus
tggcactttgtggtacacttgcacc

SEQ ID NO: 632341 - DNA, 25 bp, Rattus norvegicus
tggcagaaagttatccatctcctcc

SEQ ID NO: 632342 - DNA, 25 bp, Rattus norvegicus
tggcagaaagttttccatctcctcc

SEQ ID NO: 632343 - DNA, 25 bp, Rattus norvegicus
tggcagaacaccagggctcgggact

SEQ ID NO: 632344 - DNA, 25 bp, Rattus norvegicus
tggcagaacacctgggctcgggact

SEQ ID NO: 632345 - DNA, 25 bp, Rattus norvegicus
tggcagaacgaacaccacattttga

SEQ ID NO: 632346 - DNA, 25 bp, Rattus norvegicus
tggcagaacgaagaccacattttga

SEQ ID NO: 632347 - DNA, 25 bp, Rattus norvegicus
tggcagaactcaccagctttcttgt

SEQ ID NO: 632348 - DNA, 25 bp, Rattus norvegicus
tggcagaactcagcagctttcttgt

SEQ ID NO: 632349 - DNA, 25 bp, Rattus norvegicus
tggcagaaggccacgctgtcgcgca

SEQ ID NO: 632350 - DNA, 25 bp, Rattus norvegicus
tggcagaaggcctcgctgtcgcgca

SEQ ID NO: 632351 - DNA, 25 bp, Rattus norvegicus
tggcagaataccacccggacaatgg

SEQ ID NO: 632352 - DNA, 25 bp, Rattus norvegicus
tggcagaatacctcccggacaatgg

SEQ ID NO: 632353 - DNA, 25 bp, Rattus norvegicus
tggcagacagtgaccatctttgtgg

SEQ ID NO: 632354 - DNA, 25 bp, Rattus norvegicus
tggcagacagtgtccatctttgtgg

SEQ ID NO: 632355 - DNA, 25 bp, Rattus norvegicus
tggcagacgtctctaatcggaggct

SEQ ID NO: 632356 - DNA, 25 bp, Rattus norvegicus
tggcagacgtctgtaatcggaggct

SEQ ID NO: 632357 - DNA, 25 bp, Rattus norvegicus
tggcagacttagacctcacagtagg

SEQ ID NO: 632358 - DNA, 25 bp, Rattus norvegicus
tggcagacttagtcctcacagtagg

SEQ ID NO: 632359 - DNA, 25 bp, Rattus norvegicus
tggcagagaactcggctcgtgactc

SEQ ID NO: 632360 - DNA, 25 bp, Rattus norvegicus
tggcagagaactgggctcgtgactc

SEQ ID NO: 632361 - DNA, 25 bp, Rattus norvegicus
tggcagagaccccagcatgagcctg

SEQ ID NO: 632362 - DNA, 25 bp, Rattus norvegicus
tggcagagacccgagcatgagcctg

SEQ ID NO: 632363 - DNA, 25 bp, Rattus norvegicus
tggcagagacgaaccgattgaagtg

SEQ ID NO: 632364 - DNA, 25 bp, Rattus norvegicus
tggcagagacgatccgattgaagtg

SEQ ID NO: 632365 - DNA, 25 bp, Rattus norvegicus
tggcagagcactattactccacatt

SEQ ID NO: 632366 - DNA, 25 bp, Rattus norvegicus
tggcagagcacttttactccacatt

SEQ ID NO: 632367 - DNA, 25 bp, Rattus norvegicus
tggcagagcctacggcttccctgga

SEQ ID NO: 632368 - DNA, 25 bp, Rattus norvegicus
tggcagagcctagggcttccctgga

SEQ ID NO: 632369 - DNA, 25 bp, Rattus norvegicus
tggcagagcgcaaggttcaggatct

SEQ ID NO: 632370 - DNA, 25 bp, Rattus norvegicus
tggcagagcgcatggttcaggatct

SEQ ID NO: 632371 - DNA, 25 bp, Rattus norvegicus
tggcagagcggcaaccagcagaagc

SEQ ID NO: 632372 - DNA, 25 bp, Rattus norvegicus
tggcagagcggctaccagcagaagc

SEQ ID NO: 632373 - DNA, 25 bp, Rattus norvegicus
tggcagagtcaaaatatatacactg

SEQ ID NO: 632374 - DNA, 25 bp, Rattus norvegicus
tggcagagtcaatatatatacactg

SEQ ID NO: 632375 - DNA, 25 bp, Rattus norvegicus
tggcagagtccccttgccgagagat

SEQ ID NO: 632376 - DNA, 25 bp, Rattus norvegicus
tggcagagtcccgttgccgagagat

SEQ ID NO: 632377 - DNA, 25 bp, Rattus norvegicus
tggcagatttggcaccatgacctac

SEQ ID NO: 632378 - DNA, 25 bp, Rattus norvegicus
tggcagatttgggaccatgacctac

SEQ ID NO: 632379 - DNA, 25 bp, Rattus norvegicus
tggcagattttgctgtgagcttaac

SEQ ID NO: 632380 - DNA, 25 bp, Rattus norvegicus
tggcagattttggtgtgagcttaac

SEQ ID NO: 632381 - DNA, 25 bp, Rattus norvegicus
tggcagcaaagtaacggcagcattt

SEQ ID NO: 632382 - DNA, 25 bp, Rattus norvegicus
tggcagcaaagttacggcagcattt

SEQ ID NO: 632383 - DNA, 25 bp, Rattus norvegicus
tggcagcaactgaacaaagtgggtt

SEQ ID NO: 632384 - DNA, 25 bp, Rattus norvegicus
tggcagcaactgtacaaagtgggtt

SEQ ID NO: 632385 - DNA, 25 bp, Rattus norvegicus
tggcagcaagctccctcagtcacta

SEQ ID NO: 632386 - DNA, 25 bp, Rattus norvegicus
tggcagcaagctgcctcagtcacta

SEQ ID NO: 632387 - DNA, 25 bp, Rattus norvegicus
tggcagcaatttccacatcagcgtg

SEQ ID NO: 632388 - DNA, 25 bp, Rattus norvegicus
tggcagcaatttgcacatcagcgtg

SEQ ID NO: 632389 - DNA, 25 bp, Rattus norvegicus
tggcagcacatcacccttggagagc

SEQ ID NO: 632390 - DNA, 25 bp, Rattus norvegicus
tggcagcacatctcccttggagagc

SEQ ID NO: 632391 - DNA, 25 bp, Rattus norvegicus
tggcagcagccaatgtccgaaggaa

SEQ ID NO: 632392 - DNA, 25 bp, Rattus norvegicus
tggcagcagccattgtccgaaggaa

SEQ ID NO: 632393 - DNA, 25 bp, Rattus norvegicus
tggcagcaggctcgacactaaaccc

SEQ ID NO: 632394 - DNA, 25 bp, Rattus norvegicus
tggcagcaggctggacactaaaccc

SEQ ID NO: 632395 - DNA, 25 bp, Rattus norvegicus
tggcagcagtccaagcagatctgtg

SEQ ID NO: 632396 - DNA, 25 bp, Rattus norvegicus
tggcagcagtcctagcagatctgtg

SEQ ID NO: 632397 - DNA, 25 bp, Rattus norvegicus
tggcagcataaaatcacttcaggta

SEQ ID NO: 632398 - DNA, 25 bp, Rattus norvegicus
tggcagcataaattcacttcaggta

SEQ ID NO: 632399 - DNA, 25 bp, Rattus norvegicus
tggcagcatctgaaggtggtaccta

SEQ ID NO: 632400 - DNA, 25 bp, Rattus norvegicus
tggcagcatctgtaggtggtaccta

SEQ ID NO: 632401 - DNA, 25 bp, Rattus norvegicus
tggcagcatgtcctagtgttgcact

SEQ ID NO: 632402 - DNA, 25 bp, Rattus norvegicus
tggcagcatgtcgtagtgttgcact

SEQ ID NO: 632403 - DNA, 25 bp, Rattus norvegicus
tggcagccacatctctacctagaag

SEQ ID NO: 632404 - DNA, 25 bp, Rattus norvegicus
tggcagccacatgtctacctagaag

SEQ ID NO: 632405 - DNA, 25 bp, Rattus norvegicus
tggcagccaccaacgagaggactac

SEQ ID NO: 632406 - DNA, 25 bp, Rattus norvegicus
tggcagccaccatcgagaggactac

SEQ ID NO: 632407 - DNA, 25 bp, Rattus norvegicus
tggcagccatctacagaacgttgtg

SEQ ID NO: 632408 - DNA, 25 bp, Rattus norvegicus
tggcagccatctacatagcccagat

SEQ ID NO: 632409 - DNA, 25 bp, Rattus norvegicus
tggcagccatcttcagaacgttgtg

SEQ ID NO: 632410 - DNA, 25 bp, Rattus norvegicus
tggcagccatcttcatagcccagat

SEQ ID NO: 632411 - DNA, 25 bp, Rattus norvegicus
tggcagccatttcaagttctactta

SEQ ID NO: 632412 - DNA, 25 bp, Rattus norvegicus
tggcagccatttgaagttctactta

SEQ ID NO: 632413 - DNA, 25 bp, Rattus norvegicus
tggcagcccagaaagcctgtatttt

SEQ ID NO: 632414 - DNA, 25 bp, Rattus norvegicus
tggcagcccagatagcctgtatttt

SEQ ID NO: 632415 - DNA, 25 bp, Rattus norvegicus
tggcagcccagtactgctggcagga

SEQ ID NO: 632416 - DNA, 25 bp, Rattus norvegicus
tggcagcccagttctgctggcagga

SEQ ID NO: 632417 - DNA, 25 bp, Rattus norvegicus
tggcagccccgtccatgaaggaaag

SEQ ID NO: 632418 - DNA, 25 bp, Rattus norvegicus
tggcagccccgtgcatgaaggaaag

SEQ ID NO: 632419 - DNA, 25 bp, Rattus norvegicus
tggcagccggtcagaccttgtctaa

SEQ ID NO: 632420 - DNA, 25 bp, Rattus norvegicus
tggcagccggtctgaccttgtctaa

SEQ ID NO: 632421 - DNA, 25 bp, Rattus norvegicus
tggcagcctcatctggtttattcca

SEQ ID NO: 632422 - DNA, 25 bp, Rattus norvegicus
tggcagcctcatgtggtttattcca

SEQ ID NO: 632423 - DNA, 25 bp, Rattus norvegicus
tggcagcctgctagtgtagtctctt

SEQ ID NO: 632424 - DNA, 25 bp, Rattus norvegicus
tggcagcctgcttgtgtagtctctt

SEQ ID NO: 632425 - DNA, 25 bp, Rattus norvegicus
tggcagcctgtaagcccactgaagt

SEQ ID NO: 632426 - DNA, 25 bp, Rattus norvegicus
tggcagcctgtaccagcacctgcag

SEQ ID NO: 632427 - DNA, 25 bp, Rattus norvegicus
tggcagcctgtagcagcacctgcag

SEQ ID NO: 632428 - DNA, 25 bp, Rattus norvegicus
tggcagcctgtatgcccactgaagt

SEQ ID NO: 632429 - DNA, 25 bp, Rattus norvegicus
tggcagcctttgacatcatggtcat

SEQ ID NO: 632430 - DNA, 25 bp, Rattus norvegicus
tggcagcctttgtcatcatggtcat

SEQ ID NO: 632431 - DNA, 25 bp, Rattus norvegicus
tggcagccttttccctaacttctgt

SEQ ID NO: 632432 - DNA, 25 bp, Rattus norvegicus
tggcagccttttgcctaacttctgt

SEQ ID NO: 632433 - DNA, 25 bp, Rattus norvegicus
tggcagcgctgcacccgagaaagga

SEQ ID NO: 632434 - DNA, 25 bp, Rattus norvegicus
tggcagcgctgctcccgagaaagga

SEQ ID NO: 632435 - DNA, 25 bp, Rattus norvegicus
tggcagcggtacagccgccctaatt

SEQ ID NO: 632436 - DNA, 25 bp, Rattus norvegicus
tggcagcggtactgccgccctaatt

SEQ ID NO: 632437 - DNA, 25 bp, Rattus norvegicus
tggcagcgtttgctgttattttagg

SEQ ID NO: 632438 - DNA, 25 bp, Rattus norvegicus
tggcagcgtttggtgttattttagg

SEQ ID NO: 632439 - DNA, 25 bp, Rattus norvegicus
tggcagctagctaccttttaatata

SEQ ID NO: 632440 - DNA, 25 bp, Rattus norvegicus
tggcagctagcttccttttaatata

SEQ ID NO: 632441 - DNA, 25 bp, Rattus norvegicus
tggcagctatggctggacccagtaa

SEQ ID NO: 632442 - DNA, 25 bp, Rattus norvegicus
tggcagctatgggtggacccagtaa

SEQ ID NO: 632443 - DNA, 25 bp, Rattus norvegicus
tggcagctcaatccggactctatga

SEQ ID NO: 632444 - DNA, 25 bp, Rattus norvegicus
tggcagctcaatgcggactctatga

SEQ ID NO: 632445 - DNA, 25 bp, Rattus norvegicus
tggcagctcacaccactgagggaga

SEQ ID NO: 632446 - DNA, 25 bp, Rattus norvegicus
tggcagctcacagcactgagggaga

SEQ ID NO: 632447 - DNA, 25 bp, Rattus norvegicus
tggcagctcaggacgcggcgctcac

SEQ ID NO: 632448 - DNA, 25 bp, Rattus norvegicus
tggcagctcaggtcgcggcgctcac

SEQ ID NO: 632449 - DNA, 25 bp, Rattus norvegicus
tggcagctcagtcgagcaggactct

SEQ ID NO: 632450 - DNA, 25 bp, Rattus norvegicus
tggcagctcagtggagcaggactct

SEQ ID NO: 632451 - DNA, 25 bp, Rattus norvegicus
tggcagctcataacctttggaagct

SEQ ID NO: 632452 - DNA, 25 bp, Rattus norvegicus
tggcagctcatatcctttggaagct

SEQ ID NO: 632453 - DNA, 25 bp, Rattus norvegicus
tggcagctcatgagtttgcaccata

SEQ ID NO: 632454 - DNA, 25 bp, Rattus norvegicus
tggcagctcatgtgtttgcaccata

SEQ ID NO: 632455 - DNA, 25 bp, Rattus norvegicus
tggcagctccagatggacttgtcct

SEQ ID NO: 632456 - DNA, 25 bp, Rattus norvegicus
tggcagctccagttggacttgtcct

SEQ ID NO: 632457 - DNA, 25 bp, Rattus norvegicus
tggcagctccatcaagatcgtcagg

SEQ ID NO: 632458 - DNA, 25 bp, Rattus norvegicus
tggcagctccatgaagatcgtcagg

SEQ ID NO: 632459 - DNA, 25 bp, Rattus norvegicus
tggcagctccttcggtcacggcttc

SEQ ID NO: 632460 - DNA, 25 bp, Rattus norvegicus
tggcagctccttgggtcacggcttc

SEQ ID NO: 632461 - DNA, 25 bp, Rattus norvegicus
tggcagctcggcaacctcacaggag

SEQ ID NO: 632462 - DNA, 25 bp, Rattus norvegicus
tggcagctcggcactgcattccgcg

SEQ ID NO: 632463 - DNA, 25 bp, Rattus norvegicus
tggcagctcggctacctcacaggag

SEQ ID NO: 632464 - DNA, 25 bp, Rattus norvegicus
tggcagctcggctctgcattccgcg

SEQ ID NO: 632465 - DNA, 25 bp, Rattus norvegicus
tggcagctctccagtcaggaggcat

SEQ ID NO: 632466 - DNA, 25 bp, Rattus norvegicus
tggcagctctcctgtcaggaggcat

SEQ ID NO: 632467 - DNA, 25 bp, Rattus norvegicus
tggcagctctgtcgaattagggttc

SEQ ID NO: 632468 - DNA, 25 bp, Rattus norvegicus
tggcagctctgtggaattagggttc

SEQ ID NO: 632469 - DNA, 25 bp, Rattus norvegicus
tggcagctgacaccagaggctccgt

SEQ ID NO: 632470 - DNA, 25 bp, Rattus norvegicus
tggcagctgacagcagaggctccgt

SEQ ID NO: 632471 - DNA, 25 bp, Rattus norvegicus
tggcagctgaccacaataatttgtt

SEQ ID NO: 632472 - DNA, 25 bp, Rattus norvegicus
tggcagctgacctcaataatttgtt

SEQ ID NO: 632473 - DNA, 25 bp, Rattus norvegicus
tggcagctgatcaccaaagtcctgg

SEQ ID NO: 632474 - DNA, 25 bp, Rattus norvegicus
tggcagctgatctccaaagtcctgg

SEQ ID NO: 632475 - DNA, 25 bp, Rattus norvegicus
tggcagctgcaaaggagaaccccaa

SEQ ID NO: 632476 - DNA, 25 bp, Rattus norvegicus
tggcagctgcaatggagaaccccaa

SEQ ID NO: 632477 - DNA, 25 bp, Rattus norvegicus
tggcagctgctaaatggacctccta

SEQ ID NO: 632478 - DNA, 25 bp, Rattus norvegicus
tggcagctgctatatggacctccta

SEQ ID NO: 632479 - DNA, 25 bp, Rattus norvegicus
tggcagctgctcaggagtcagtcct

SEQ ID NO: 632480 - DNA, 25 bp, Rattus norvegicus
tggcagctgctctggagtcagtcct

SEQ ID NO: 632481 - DNA, 25 bp, Rattus norvegicus
tggcagctggttaaatcaggccccg

SEQ ID NO: 632482 - DNA, 25 bp, Rattus norvegicus
tggcagctggtttaatcaggccccg

SEQ ID NO: 632483 - DNA, 25 bp, Rattus norvegicus
tggcagctgttaaagtccgaggcat

SEQ ID NO: 632484 - DNA, 25 bp, Rattus norvegicus
tggcagctgttatagtccgaggcat

SEQ ID NO: 632485 - DNA, 25 bp, Rattus norvegicus
tggcagcttaccaatctcagcatat

SEQ ID NO: 632486 - DNA, 25 bp, Rattus norvegicus
tggcagcttacctatctcagcatat

SEQ ID NO: 632487 - DNA, 25 bp, Rattus norvegicus
tggcagcttcctatgtaccttgttt

SEQ ID NO: 632488 - DNA, 25 bp, Rattus norvegicus
tggcagcttcctttgtaccttgttt

SEQ ID NO: 632489 - DNA, 25 bp, Rattus norvegicus
tggcagcttgccatttaatatgata

SEQ ID NO: 632490 - DNA, 25 bp, Rattus norvegicus
tggcagcttgccttttaatatgata

SEQ ID NO: 632491 - DNA, 25 bp, Rattus norvegicus
tggcaggaaaccacaagactagttc

SEQ ID NO: 632492 - DNA, 25 bp, Rattus norvegicus
tggcaggaaacctcaagactagttc

SEQ ID NO: 632493 - DNA, 25 bp, Rattus norvegicus
tggcaggaatagctccccgaggtct

SEQ ID NO: 632494 - DNA, 25 bp, Rattus norvegicus
tggcaggaataggtccccgaggtct

SEQ ID NO: 632495 - DNA, 25 bp, Rattus norvegicus
tggcaggaccatcggctaacatatg

SEQ ID NO: 632496 - DNA, 25 bp, Rattus norvegicus
tggcaggaccatgggctaacatatg

SEQ ID NO: 632497 - DNA, 25 bp, Rattus norvegicus
tggcaggacgtgaccatgcacagga

SEQ ID NO: 632498 - DNA, 25 bp, Rattus norvegicus
tggcaggacgtgtccatgcacagga

SEQ ID NO: 632499 - DNA, 25 bp, Rattus norvegicus
tggcaggagccacttcatgactaaa

SEQ ID NO: 632500 - DNA, 25 bp, Rattus norvegicus
tggcaggagccagttcatgactaaa

SEQ ID NO: 632501 - DNA, 25 bp, Rattus norvegicus
tggcaggaggtcaccaaccttcggg

SEQ ID NO: 632502 - DNA, 25 bp, Rattus norvegicus
tggcaggaggtctccaaccttcggg

SEQ ID NO: 632503 - DNA, 25 bp, Rattus norvegicus
tggcaggagtacatctaggagcacg

SEQ ID NO: 632504 - DNA, 25 bp, Rattus norvegicus
tggcaggagtacttctaggagcacg

SEQ ID NO: 632505 - DNA, 25 bp, Rattus norvegicus
tggcaggcacaaaggtcagaattct

SEQ ID NO: 632506 - DNA, 25 bp, Rattus norvegicus
tggcaggcacaatggtcagaattct

SEQ ID NO: 632507 - DNA, 25 bp, Rattus norvegicus
tggcaggcatgactggacccattta

SEQ ID NO: 632508 - DNA, 25 bp, Rattus norvegicus
tggcaggcatgagtggacccattta

SEQ ID NO: 632509 - DNA, 25 bp, Rattus norvegicus
tggcaggccaggaaacagcatgaat

SEQ ID NO: 632510 - DNA, 25 bp, Rattus norvegicus
tggcaggccaggtaacagcatgaat

SEQ ID NO: 632511 - DNA, 25 bp, Rattus norvegicus
tggcaggcccagaggcttccatcag

SEQ ID NO: 632512 - DNA, 25 bp, Rattus norvegicus
tggcaggcccagtggcttccatcag

SEQ ID NO: 632513 - DNA, 25 bp, Rattus norvegicus
tggcaggcctatcatctcagcacta

SEQ ID NO: 632514 - DNA, 25 bp, Rattus norvegicus
tggcaggcctatgatctcagcacta

SEQ ID NO: 632515 - DNA, 25 bp, Rattus norvegicus
tggcaggctgccaacatgctgggaa

SEQ ID NO: 632516 - DNA, 25 bp, Rattus norvegicus
tggcaggctgcctacatgctgggaa

SEQ ID NO: 632517 - DNA, 25 bp, Rattus norvegicus
tggcaggctgtgatttcctcaccat

SEQ ID NO: 632518 - DNA, 25 bp, Rattus norvegicus
tggcaggctgtgttttcctcaccat

SEQ ID NO: 632519 - DNA, 25 bp, Rattus norvegicus
tggcagggaccgcactgtgattaca

SEQ ID NO: 632520 - DNA, 25 bp, Rattus norvegicus
tggcagggaccggactgtgattaca

SEQ ID NO: 632521 - DNA, 25 bp, Rattus norvegicus
tggcagggactccaagtctaaacaa

SEQ ID NO: 632522 - DNA, 25 bp, Rattus norvegicus
tggcagggactcgaagtctaaacaa

SEQ ID NO: 632523 - DNA, 25 bp, Rattus norvegicus
tggcagggactgagcataatgcgca

SEQ ID NO: 632524 - DNA, 25 bp, Rattus norvegicus
tggcagggactgtgcataatgcgca

SEQ ID NO: 632525 - DNA, 25 bp, Rattus norvegicus
tggcagggcacacagttttagaact

SEQ ID NO: 632526 - DNA, 25 bp, Rattus norvegicus
tggcagggcacacatggcagaacaa

SEQ ID NO: 632527 - DNA, 25 bp, Rattus norvegicus
tggcagggcacagagttttagaact

SEQ ID NO: 632528 - DNA, 25 bp, Rattus norvegicus
tggcagggcacagatggcagaacaa

SEQ ID NO: 632529 - DNA, 25 bp, Rattus norvegicus
tggcagggcagaaacctctgtctct

SEQ ID NO: 632530 - DNA, 25 bp, Rattus norvegicus
tggcagggcagatacctctgtctct

SEQ ID NO: 632531 - DNA, 25 bp, Rattus norvegicus
tggcagggccatcggccagtcaact

SEQ ID NO: 632532 - DNA, 25 bp, Rattus norvegicus
tggcagggccatgggccagtcaact

SEQ ID NO: 632533 - DNA, 25 bp, Rattus norvegicus
tggcagggctaacttcccgctcggc

SEQ ID NO: 632534 - DNA, 25 bp, Rattus norvegicus
tggcagggctaagttcccgctcggc

SEQ ID NO: 632535 - DNA, 25 bp, Rattus norvegicus
tggcagggctccacatggatgtttt

SEQ ID NO: 632536 - DNA, 25 bp, Rattus norvegicus
tggcagggctcctcatggatgtttt

SEQ ID NO: 632537 - DNA, 25 bp, Rattus norvegicus
tggcagggcttacccaggctctcat

SEQ ID NO: 632538 - DNA, 25 bp, Rattus norvegicus
tggcagggcttagccaggctctcat

SEQ ID NO: 632539 - DNA, 25 bp, Rattus norvegicus
tggcagggtatgagctcacgcctac

SEQ ID NO: 632540 - DNA, 25 bp, Rattus norvegicus
tggcagggtatgtgctcacgcctac

SEQ ID NO: 632541 - DNA, 25 bp, Rattus norvegicus
tggcagggtctcagactccaggaaa

SEQ ID NO: 632542 - DNA, 25 bp, Rattus norvegicus
tggcagggtctctgactccaggaaa

SEQ ID NO: 632543 - DNA, 25 bp, Rattus norvegicus
tggcaggtatatctcatctctcccc

SEQ ID NO: 632544 - DNA, 25 bp, Rattus norvegicus
tggcaggtatatgtcatctctcccc

SEQ ID NO: 632545 - DNA, 25 bp, Rattus norvegicus
tggcaggtctctcagttgaaggcca

SEQ ID NO: 632546 - DNA, 25 bp, Rattus norvegicus
tggcaggtctctgagttgaaggcca

SEQ ID NO: 632547 - DNA, 25 bp, Rattus norvegicus
tggcaggtctgcctcagtgtctcag

SEQ ID NO: 632548 - DNA, 25 bp, Rattus norvegicus
tggcaggtctgcgtcagtgtctcag

SEQ ID NO: 632549 - DNA, 25 bp, Rattus norvegicus
tggcaggtctttacttcttgactta

SEQ ID NO: 632550 - DNA, 25 bp, Rattus norvegicus
tggcaggtcttttcttcttgactta

SEQ ID NO: 632551 - DNA, 25 bp, Rattus norvegicus
tggcaggtgcttctgtgtacccctc

SEQ ID NO: 632552 - DNA, 25 bp, Rattus norvegicus
tggcaggtgcttgtgtgtacccctc

SEQ ID NO: 632553 - DNA, 25 bp, Rattus norvegicus
tggcaggtgggcagttctcacccat

SEQ ID NO: 632554 - DNA, 25 bp, Rattus norvegicus
tggcaggtgggctgttctcacccat

SEQ ID NO: 632555 - DNA, 25 bp, Rattus norvegicus
tggcaggtgttgagggtctcaccat

SEQ ID NO: 632556 - DNA, 25 bp, Rattus norvegicus
tggcaggtgttgtgggtctcaccat

SEQ ID NO: 632557 - DNA, 25 bp, Rattus norvegicus
tggcaggttcttagtgaggtcccac

SEQ ID NO: 632558 - DNA, 25 bp, Rattus norvegicus
tggcaggttctttgtgaggtcccac

SEQ ID NO: 632559 - DNA, 25 bp, Rattus norvegicus
tggcagtaaatcaaagcagagactt

SEQ ID NO: 632560 - DNA, 25 bp, Rattus norvegicus
tggcagtaaatctaagcagagactt

SEQ ID NO: 632561 - DNA, 25 bp, Rattus norvegicus
tggcagtacacacatgagggactct

SEQ ID NO: 632562 - DNA, 25 bp, Rattus norvegicus
tggcagtacacagatgagggactct

SEQ ID NO: 632563 - DNA, 25 bp, Rattus norvegicus
tggcagtacaggcaataaccactag

SEQ ID NO: 632564 - DNA, 25 bp, Rattus norvegicus
tggcagtacagggaataaccactag

SEQ ID NO: 632565 - DNA, 25 bp, Rattus norvegicus
tggcagtacccactcctgagagatg

SEQ ID NO: 632566 - DNA, 25 bp, Rattus norvegicus
tggcagtacccagtcctgagagatg

SEQ ID NO: 632567 - DNA, 25 bp, Rattus norvegicus
tggcagtacgtcacttggactctct

SEQ ID NO: 632568 - DNA, 25 bp, Rattus norvegicus
tggcagtacgtctcttggactctct

SEQ ID NO: 632569 - DNA, 25 bp, Rattus norvegicus
tggcagtagcctctcttcagatagt

SEQ ID NO: 632570 - DNA, 25 bp, Rattus norvegicus
tggcagtagcctgtcttcagatagt

SEQ ID NO: 632571 - DNA, 25 bp, Rattus norvegicus
tggcagtaggctagcccagactctt

SEQ ID NO: 632572 - DNA, 25 bp, Rattus norvegicus
tggcagtaggcttgcccagactctt

SEQ ID NO: 632573 - DNA, 25 bp, Rattus norvegicus
tggcagtagttcagtgcaccgccta

SEQ ID NO: 632574 - DNA, 25 bp, Rattus norvegicus
tggcagtagttctgtgcaccgccta

SEQ ID NO: 632575 - DNA, 25 bp, Rattus norvegicus
tggcagtatcatacccactcttata

SEQ ID NO: 632576 - DNA, 25 bp, Rattus norvegicus
tggcagtatcattcccactcttata

SEQ ID NO: 632577 - DNA, 25 bp, Rattus norvegicus
tggcagtcaccaagacatgattttt

SEQ ID NO: 632578 - DNA, 25 bp, Rattus norvegicus
tggcagtcaccatgacatgattttt

SEQ ID NO: 632579 - DNA, 25 bp, Rattus norvegicus
tggcagtcatcgagggtgcctcagt

SEQ ID NO: 632580 - DNA, 25 bp, Rattus norvegicus
tggcagtcatcgtgggtgcctcagt

SEQ ID NO: 632581 - DNA, 25 bp, Rattus norvegicus
tggcagtccagtcagcccttttctg

SEQ ID NO: 632582 - DNA, 25 bp, Rattus norvegicus
tggcagtccagtgagcccttttctg

SEQ ID NO: 632583 - DNA, 25 bp, Rattus norvegicus
tggcagtcgactaacccttgaggta

SEQ ID NO: 632584 - DNA, 25 bp, Rattus norvegicus
tggcagtcgacttacccttgaggta

SEQ ID NO: 632585 - DNA, 25 bp, Rattus norvegicus
tggcagtcggaacggatttttgttt

SEQ ID NO: 632586 - DNA, 25 bp, Rattus norvegicus
tggcagtcggaagggatttttgttt

SEQ ID NO: 632587 - DNA, 25 bp, Rattus norvegicus
tggcagtcgtttagcgacgctagta

SEQ ID NO: 632588 - DNA, 25 bp, Rattus norvegicus
tggcagtcgttttgcgacgctagta

SEQ ID NO: 632589 - DNA, 25 bp, Rattus norvegicus
tggcagtctactaaattacctattt

SEQ ID NO: 632590 - DNA, 25 bp, Rattus norvegicus
tggcagtctacttaattacctattt

SEQ ID NO: 632591 - DNA, 25 bp, Rattus norvegicus
tggcagtctatcaacagatcctcac

SEQ ID NO: 632592 - DNA, 25 bp, Rattus norvegicus
tggcagtctatcacagcgtgtcaaa

SEQ ID NO: 632593 - DNA, 25 bp, Rattus norvegicus
tggcagtctatctacagatcctcac

SEQ ID NO: 632594 - DNA, 25 bp, Rattus norvegicus
tggcagtctatctcagcgtgtcaaa

SEQ ID NO: 632595 - DNA, 25 bp, Rattus norvegicus
tggcagtctcgaaccacagtgtgga

SEQ ID NO: 632596 - DNA, 25 bp, Rattus norvegicus
tggcagtctcgatccacagtgtgga

SEQ ID NO: 632597 - DNA, 25 bp, Rattus norvegicus
tggcagtctgccatgtttactctac

SEQ ID NO: 632598 - DNA, 25 bp, Rattus norvegicus
tggcagtctgccttgtttactctac

SEQ ID NO: 632599 - DNA, 25 bp, Rattus norvegicus
tggcagtgagagagctttccgtcct

SEQ ID NO: 632600 - DNA, 25 bp, Rattus norvegicus
tggcagtgagagtgctttccgtcct

SEQ ID NO: 632601 - DNA, 25 bp, Rattus norvegicus
tggcagtgagtcatgacttcccttt

SEQ ID NO: 632602 - DNA, 25 bp, Rattus norvegicus
tggcagtgagtcttgacttcccttt

SEQ ID NO: 632603 - DNA, 25 bp, Rattus norvegicus
tggcagtgcaggcttgtcttcctag

SEQ ID NO: 632604 - DNA, 25 bp, Rattus norvegicus
tggcagtgcagggttgtcttcctag

SEQ ID NO: 632605 - DNA, 25 bp, Rattus norvegicus
tggcagtgcccacggaagtgtccac

SEQ ID NO: 632606 - DNA, 25 bp, Rattus norvegicus
tggcagtgcccagggaagtgtccac

SEQ ID NO: 632607 - DNA, 25 bp, Rattus norvegicus
tggcagtgctgtctcacttcgcgga

SEQ ID NO: 632608 - DNA, 25 bp, Rattus norvegicus
tggcagtgctgtgtcacttcgcgga

SEQ ID NO: 632609 - DNA, 25 bp, Rattus norvegicus
tggcagtgcttgcactgatgccctc

SEQ ID NO: 632610 - DNA, 25 bp, Rattus norvegicus
tggcagtgcttggactgatgccctc

SEQ ID NO: 632611 - DNA, 25 bp, Rattus norvegicus
tggcagtggccaagacagccgtaaa

SEQ ID NO: 632612 - DNA, 25 bp, Rattus norvegicus
tggcagtggccatgacagccgtaaa

SEQ ID NO: 632613 - DNA, 25 bp, Rattus norvegicus
tggcagtggtcacccaaccttgaga

SEQ ID NO: 632614 - DNA, 25 bp, Rattus norvegicus
tggcagtggtcagccaaccttgaga

SEQ ID NO: 632615 - DNA, 25 bp, Rattus norvegicus
tggcagtgtgccaatcatgtagata

SEQ ID NO: 632616 - DNA, 25 bp, Rattus norvegicus
tggcagtgtgcctatcatgtagata

SEQ ID NO: 632617 - DNA, 25 bp, Rattus norvegicus
tggcagtgttacctgtggcctgttc

SEQ ID NO: 632618 - DNA, 25 bp, Rattus norvegicus
tggcagtgttacgtgtggcctgttc

SEQ ID NO: 632619 - DNA, 25 bp, Rattus norvegicus
tggcagttaaacatacccgtcattt

SEQ ID NO: 632620 - DNA, 25 bp, Rattus norvegicus
tggcagttaaacttacccgtcattt

SEQ ID NO: 632621 - DNA, 25 bp, Rattus norvegicus
tggcagttacaaacatactttccgt

SEQ ID NO: 632622 - DNA, 25 bp, Rattus norvegicus
tggcagttacaatcatactttccgt

SEQ ID NO: 632623 - DNA, 25 bp, Rattus norvegicus
tggcagttcataatgccaggagcag

SEQ ID NO: 632624 - DNA, 25 bp, Rattus norvegicus
tggcagttcatattgccaggagcag

SEQ ID NO: 632625 - DNA, 25 bp, Rattus norvegicus
tggcagttcctcaaggacttccaga

SEQ ID NO: 632626 - DNA, 25 bp, Rattus norvegicus
tggcagttcctctaggacttccaga

SEQ ID NO: 632627 - DNA, 25 bp, Rattus norvegicus
tggcagttgcctaggctctgagcac

SEQ ID NO: 632628 - DNA, 25 bp, Rattus norvegicus
tggcagttgccttggctctgagcac

SEQ ID NO: 632629 - DNA, 25 bp, Rattus norvegicus
tggcagttgggtaacagtgctgact

SEQ ID NO: 632630 - DNA, 25 bp, Rattus norvegicus
tggcagttgggttacagtgctgact

SEQ ID NO: 632631 - DNA, 25 bp, Rattus norvegicus
tggcagtttccaagcttgcatcgaa

SEQ ID NO: 632632 - DNA, 25 bp, Rattus norvegicus
tggcagtttccatgcttgcatcgaa

SEQ ID NO: 632633 - DNA, 25 bp, Rattus norvegicus
tggcagttttcgcatggaagctcaa

SEQ ID NO: 632634 - DNA, 25 bp, Rattus norvegicus
tggcagttttcggatggaagctcaa

SEQ ID NO: 632635 - DNA, 25 bp, Rattus norvegicus
tggcataaacaacagcgctcaccta

SEQ ID NO: 632636 - DNA, 25 bp, Rattus norvegicus
tggcataaacaagagcgctcaccta

SEQ ID NO: 632637 - DNA, 25 bp, Rattus norvegicus
tggcataagaccagctttcgctgcg

SEQ ID NO: 632638 - DNA, 25 bp, Rattus norvegicus
tggcataagacctgctttcgctgcg

SEQ ID NO: 632639 - DNA, 25 bp, Rattus norvegicus
tggcataaggcaaggttttcctcct

SEQ ID NO: 632640 - DNA, 25 bp, Rattus norvegicus
tggcataaggcatggttttcctcct

SEQ ID NO: 632641 - DNA, 25 bp, Rattus norvegicus
tggcataattctaacacttctctgg

SEQ ID NO: 632642 - DNA, 25 bp, Rattus norvegicus
tggcataattcttacacttctctgg

SEQ ID NO: 632643 - DNA, 25 bp, Rattus norvegicus
tggcatacccctccttttggaacac

SEQ ID NO: 632644 - DNA, 25 bp, Rattus norvegicus
tggcatacccctgcttttggaacac

SEQ ID NO: 632645 - DNA, 25 bp, Rattus norvegicus
tggcatactgtactggaacgctgaa

SEQ ID NO: 632646 - DNA, 25 bp, Rattus norvegicus
tggcatactgtagtggaacgctgaa

SEQ ID NO: 632647 - DNA, 25 bp, Rattus norvegicus
tggcatacttaaacacgcagggcta

SEQ ID NO: 632648 - DNA, 25 bp, Rattus norvegicus
tggcatacttaatcacgcagggcta

SEQ ID NO: 632649 - DNA, 25 bp, Rattus norvegicus
tggcatagacagcagcacacacagt

SEQ ID NO: 632650 - DNA, 25 bp, Rattus norvegicus
tggcatagacaggagcacacacagt

SEQ ID NO: 632651 - DNA, 25 bp, Rattus norvegicus
tggcatagcgcgactcaagcgagtc

SEQ ID NO: 632652 - DNA, 25 bp, Rattus norvegicus
tggcatagcgcgtctcaagcgagtc

SEQ ID NO: 632653 - DNA, 25 bp, Rattus norvegicus
tggcatagctctccaggtgaggact

SEQ ID NO: 632654 - DNA, 25 bp, Rattus norvegicus
tggcatagctctgcaggtgaggact

SEQ ID NO: 632655 - DNA, 25 bp, Rattus norvegicus
tggcataggcctaaaacccaggacc

SEQ ID NO: 632656 - DNA, 25 bp, Rattus norvegicus
tggcataggccttaaacccaggacc

SEQ ID NO: 632657 - DNA, 25 bp, Rattus norvegicus
tggcataggcgaagacctccctggg

SEQ ID NO: 632658 - DNA, 25 bp, Rattus norvegicus
tggcataggcgacgcagtatctgct

SEQ ID NO: 632659 - DNA, 25 bp, Rattus norvegicus
tggcataggcgaggcagtatctgct

SEQ ID NO: 632660 - DNA, 25 bp, Rattus norvegicus
tggcataggcgatgacctccctggg

SEQ ID NO: 632661 - DNA, 25 bp, Rattus norvegicus
tggcatagtcagattctgtacccct

SEQ ID NO: 632662 - DNA, 25 bp, Rattus norvegicus
tggcatagtcagtttctgtacccct

SEQ ID NO: 632663 - DNA, 25 bp, Rattus norvegicus
tggcatatctctacacagacacact

SEQ ID NO: 632664 - DNA, 25 bp, Rattus norvegicus
tggcatatctcttcacagacacact

SEQ ID NO: 632665 - DNA, 25 bp, Rattus norvegicus
tggcatcaaaatcaaggcccttccc

SEQ ID NO: 632666 - DNA, 25 bp, Rattus norvegicus
tggcatcaaaatgaaggcccttccc

SEQ ID NO: 632667 - DNA, 25 bp, Rattus norvegicus
tggcatcacagaagagaccctcaca

SEQ ID NO: 632668 - DNA, 25 bp, Rattus norvegicus
tggcatcacagatgagaccctcaca

SEQ ID NO: 632669 - DNA, 25 bp, Rattus norvegicus
tggcatcacagtctagtttcatgtc

SEQ ID NO: 632670 - DNA, 25 bp, Rattus norvegicus
tggcatcacagtgtagtttcatgtc

SEQ ID NO: 632671 - DNA, 25 bp, Rattus norvegicus
tggcatcaccgcatggtagctagaa

SEQ ID NO: 632672 - DNA, 25 bp, Rattus norvegicus
tggcatcaccgcttggtagctagaa

SEQ ID NO: 632673 - DNA, 25 bp, Rattus norvegicus
tggcatcactcccaatgatacagta

SEQ ID NO: 632674 - DNA, 25 bp, Rattus norvegicus
tggcatcactccgaatgatacagta

SEQ ID NO: 632675 - DNA, 25 bp, Rattus norvegicus
tggcatcagccaaccgaagaggact

SEQ ID NO: 632676 - DNA, 25 bp, Rattus norvegicus
tggcatcagccatccgaagaggact

SEQ ID NO: 632677 - DNA, 25 bp, Rattus norvegicus
tggcatcagcttaggttaccagaga

SEQ ID NO: 632678 - DNA, 25 bp, Rattus norvegicus
tggcatcagctttggttaccagaga

SEQ ID NO: 632679 - DNA, 25 bp, Rattus norvegicus
tggcatcaggcaccacctgagaact

SEQ ID NO: 632680 - DNA, 25 bp, Rattus norvegicus
tggcatcaggcagcacctgagaact

SEQ ID NO: 632681 - DNA, 25 bp, Rattus norvegicus
tggcatcaggcccagtgacagtgca

SEQ ID NO: 632682 - DNA, 25 bp, Rattus norvegicus
tggcatcaggccgagtgacagtgca

SEQ ID NO: 632683 - DNA, 25 bp, Rattus norvegicus
tggcatcatcttatttactggcaaa

SEQ ID NO: 632684 - DNA, 25 bp, Rattus norvegicus
tggcatcatcttctcatctatccat

SEQ ID NO: 632685 - DNA, 25 bp, Rattus norvegicus
tggcatcatcttgtcatctatccat

SEQ ID NO: 632686 - DNA, 25 bp, Rattus norvegicus
tggcatcatcttttttactggcaaa

SEQ ID NO: 632687 - DNA, 25 bp, Rattus norvegicus
tggcatcatgcgaaggaactctctg

SEQ ID NO: 632688 - DNA, 25 bp, Rattus norvegicus
tggcatcatgcgtaggaactctctg

SEQ ID NO: 632689 - DNA, 25 bp, Rattus norvegicus
tggcatcatgtcaagtcacgcactt

SEQ ID NO: 632690 - DNA, 25 bp, Rattus norvegicus
tggcatcatgtctagtcacgcactt

SEQ ID NO: 632691 - DNA, 25 bp, Rattus norvegicus
tggcatcattgcacactgttcatta

SEQ ID NO: 632692 - DNA, 25 bp, Rattus norvegicus
tggcatcattgctcactgttcatta

SEQ ID NO: 632693 - DNA, 25 bp, Rattus norvegicus
tggcatccagtgagggctacgtgct

SEQ ID NO: 632694 - DNA, 25 bp, Rattus norvegicus
tggcatccagtgtgggctacgtgct

SEQ ID NO: 632695 - DNA, 25 bp, Rattus norvegicus
tggcatccatagattgtatccccgg

SEQ ID NO: 632696 - DNA, 25 bp, Rattus norvegicus
tggcatccatagtttgtatccccgg

SEQ ID NO: 632697 - DNA, 25 bp, Rattus norvegicus
tggcatccatgcagtggcggtccac

SEQ ID NO: 632698 - DNA, 25 bp, Rattus norvegicus
tggcatccatgctgtggcggtccac

SEQ ID NO: 632699 - DNA, 25 bp, Rattus norvegicus
tggcatccgcagaagtcagctgttt

SEQ ID NO: 632700 - DNA, 25 bp, Rattus norvegicus
tggcatccgcagtagtcagctgttt

SEQ ID NO: 632701 - DNA, 25 bp, Rattus norvegicus
tggcatcctctacttcttggtggaa

SEQ ID NO: 632702 - DNA, 25 bp, Rattus norvegicus
tggcatcctctagttcttggtggaa

SEQ ID NO: 632703 - DNA, 25 bp, Rattus norvegicus
tggcatcctgatctcaccatacctg

SEQ ID NO: 632704 - DNA, 25 bp, Rattus norvegicus
tggcatcctgatgtcaccatacctg

SEQ ID NO: 632705 - DNA, 25 bp, Rattus norvegicus
tggcatcctgccaaattttctaagg

SEQ ID NO: 632706 - DNA, 25 bp, Rattus norvegicus
tggcatcctgcctaattttctaagg

SEQ ID NO: 632707 - DNA, 25 bp, Rattus norvegicus
tggcatcgatgaaccctactgggac

SEQ ID NO: 632708 - DNA, 25 bp, Rattus norvegicus
tggcatcgatgatccctactgggac

SEQ ID NO: 632709 - DNA, 25 bp, Rattus norvegicus
tggcatctaagactcatccctggac

SEQ ID NO: 632710 - DNA, 25 bp, Rattus norvegicus
tggcatctaagagtcatccctggac

SEQ ID NO: 632711 - DNA, 25 bp, Rattus norvegicus
tggcatctaaggatggcaggcttga

SEQ ID NO: 632712 - DNA, 25 bp, Rattus norvegicus
tggcatctaaggttggcaggcttga

SEQ ID NO: 632713 - DNA, 25 bp, Rattus norvegicus
tggcatctacagaactgggctccat

SEQ ID NO: 632714 - DNA, 25 bp, Rattus norvegicus
tggcatctacagtactgggctccat

SEQ ID NO: 632715 - DNA, 25 bp, Rattus norvegicus
tggcatctagtgattctttgaagca

SEQ ID NO: 632716 - DNA, 25 bp, Rattus norvegicus
tggcatctagtgtttctttgaagca

SEQ ID NO: 632717 - DNA, 25 bp, Rattus norvegicus
tggcatctatcacacagggcggcta

SEQ ID NO: 632718 - DNA, 25 bp, Rattus norvegicus
tggcatctatcagacagggcggcta

SEQ ID NO: 632719 - DNA, 25 bp, Rattus norvegicus
tggcatctccgaattttcccaatga

SEQ ID NO: 632720 - DNA, 25 bp, Rattus norvegicus
tggcatctccgatttttcccaatga

SEQ ID NO: 632721 - DNA, 25 bp, Rattus norvegicus
tggcatctgacgatctctgagactg

SEQ ID NO: 632722 - DNA, 25 bp, Rattus norvegicus
tggcatctgacgttctctgagactg

SEQ ID NO: 632723 - DNA, 25 bp, Rattus norvegicus
tggcatctgcctccatgcagccata

SEQ ID NO: 632724 - DNA, 25 bp, Rattus norvegicus
tggcatctgcctgcatgcagccata

SEQ ID NO: 632725 - DNA, 25 bp, Rattus norvegicus
tggcatctgcggcaagtgcttcact

SEQ ID NO: 632726 - DNA, 25 bp, Rattus norvegicus
tggcatctgcgggaagtgcttcact

SEQ ID NO: 632727 - DNA, 25 bp, Rattus norvegicus
tggcatctggcgacactggtgactt

SEQ ID NO: 632728 - DNA, 25 bp, Rattus norvegicus
tggcatctggcgtcactggtgactt

SEQ ID NO: 632729 - DNA, 25 bp, Rattus norvegicus
tggcatctggctcgcaacctccttg

SEQ ID NO: 632730 - DNA, 25 bp, Rattus norvegicus
tggcatctggctggcaacctccttg

SEQ ID NO: 632731 - DNA, 25 bp, Rattus norvegicus
tggcatctgtacacttctgtatgac

SEQ ID NO: 632732 - DNA, 25 bp, Rattus norvegicus
tggcatctgtactcttctgtatgac

SEQ ID NO: 632733 - DNA, 25 bp, Rattus norvegicus
tggcatctgtgtagccagaaacaaa

SEQ ID NO: 632734 - DNA, 25 bp, Rattus norvegicus
tggcatctgtgttgccagaaacaaa

SEQ ID NO: 632735 - DNA, 25 bp, Rattus norvegicus
tggcatctttgcctgtgagggaaca

SEQ ID NO: 632736 - DNA, 25 bp, Rattus norvegicus
tggcatctttgcgtgtgagggaaca

SEQ ID NO: 632737 - DNA, 25 bp, Rattus norvegicus
tggcatgacccacgcttattatgta

SEQ ID NO: 632738 - DNA, 25 bp, Rattus norvegicus
tggcatgacccaggcttattatgta

SEQ ID NO: 632739 - DNA, 25 bp, Rattus norvegicus
tggcatgactaaatggtatctcttc

SEQ ID NO: 632740 - DNA, 25 bp, Rattus norvegicus
tggcatgactaattggtatctcttc

SEQ ID NO: 632741 - DNA, 25 bp, Rattus norvegicus
tggcatgactgtagctttctgcatt

SEQ ID NO: 632742 - DNA, 25 bp, Rattus norvegicus
tggcatgactgtcacctaattggtg

SEQ ID NO: 632743 - DNA, 25 bp, Rattus norvegicus
tggcatgactgtgacctaattggtg

SEQ ID NO: 632744 - DNA, 25 bp, Rattus norvegicus
tggcatgactgttgctttctgcatt

SEQ ID NO: 632745 - DNA, 25 bp, Rattus norvegicus
tggcatgatacacagctcccttttg

SEQ ID NO: 632746 - DNA, 25 bp, Rattus norvegicus
tggcatgatacagagctcccttttg

SEQ ID NO: 632747 - DNA, 25 bp, Rattus norvegicus
tggcatgattaaaacactggcacaa

SEQ ID NO: 632748 - DNA, 25 bp, Rattus norvegicus
tggcatgattaatacactggcacaa

SEQ ID NO: 632749 - DNA, 25 bp, Rattus norvegicus
tggcatgatttgagtagcccaaagc

SEQ ID NO: 632750 - DNA, 25 bp, Rattus norvegicus
tggcatgatttgtgtagcccaaagc

SEQ ID NO: 632751 - DNA, 25 bp, Rattus norvegicus
tggcatgcaagtcgtttctgtcggt

SEQ ID NO: 632752 - DNA, 25 bp, Rattus norvegicus
tggcatgcaagtggtttctgtcggt

SEQ ID NO: 632753 - DNA, 25 bp, Rattus norvegicus
tggcatgcacgtcctcaggcaaaat

SEQ ID NO: 632754 - DNA, 25 bp, Rattus norvegicus
tggcatgcacgtgctcaggcaaaat

SEQ ID NO: 632755 - DNA, 25 bp, Rattus norvegicus
tggcatgcatacatttttcttcaca

SEQ ID NO: 632756 - DNA, 25 bp, Rattus norvegicus
tggcatgcatacttttttcttcaca

SEQ ID NO: 632757 - DNA, 25 bp, Rattus norvegicus
tggcatgcatgtccagactcacact

SEQ ID NO: 632758 - DNA, 25 bp, Rattus norvegicus
tggcatgcatgtgcagactcacact

SEQ ID NO: 632759 - DNA, 25 bp, Rattus norvegicus
tggcatgccagtcatgaactcgttt

SEQ ID NO: 632760 - DNA, 25 bp, Rattus norvegicus
tggcatgccagtgatgaactcgttt

SEQ ID NO: 632761 - DNA, 25 bp, Rattus norvegicus
tggcatgccatactagaggtcccct

SEQ ID NO: 632762 - DNA, 25 bp, Rattus norvegicus
tggcatgccatagtagaggtcccct

SEQ ID NO: 632763 - DNA, 25 bp, Rattus norvegicus
tggcatgccccaagggaccggagcc

SEQ ID NO: 632764 - DNA, 25 bp, Rattus norvegicus
tggcatgccccatgggaccggagcc

SEQ ID NO: 632765 - DNA, 25 bp, Rattus norvegicus
tggcatgcctcacttgttcagaagc

SEQ ID NO: 632766 - DNA, 25 bp, Rattus norvegicus
tggcatgcctcagttgttcagaagc

SEQ ID NO: 632767 - DNA, 25 bp, Rattus norvegicus
tggcatgcctttcctatgatggact

SEQ ID NO: 632768 - DNA, 25 bp, Rattus norvegicus
tggcatgcctttgctatgatggact

SEQ ID NO: 632769 - DNA, 25 bp, Rattus norvegicus
tggcatgcgctaccgtgtgacacat

SEQ ID NO: 632770 - DNA, 25 bp, Rattus norvegicus
tggcatgcgctagcgtgtgacacat

SEQ ID NO: 632771 - DNA, 25 bp, Rattus norvegicus
tggcatgctcttctgtttaattctc

SEQ ID NO: 632772 - DNA, 25 bp, Rattus norvegicus
tggcatgctcttgtgtttaattctc

SEQ ID NO: 632773 - DNA, 25 bp, Rattus norvegicus
tggcatgctgatccatggttccctc

SEQ ID NO: 632774 - DNA, 25 bp, Rattus norvegicus
tggcatgctgatgcatggttccctc

SEQ ID NO: 632775 - DNA, 25 bp, Rattus norvegicus
tggcatgcttggctgttaggacaac

SEQ ID NO: 632776 - DNA, 25 bp, Rattus norvegicus
tggcatgcttgggtgttaggacaac

SEQ ID NO: 632777 - DNA, 25 bp, Rattus norvegicus
tggcatggacatagagcgcgtgaac

SEQ ID NO: 632778 - DNA, 25 bp, Rattus norvegicus
tggcatggacattgagcgcgtgaac

SEQ ID NO: 632779 - DNA, 25 bp, Rattus norvegicus
tggcatggattaccggaccagcatc

SEQ ID NO: 632780 - DNA, 25 bp, Rattus norvegicus
tggcatggattagcggaccagcatc

SEQ ID NO: 632781 - DNA, 25 bp, Rattus norvegicus
tggcatggccacattccagatacaa

SEQ ID NO: 632782 - DNA, 25 bp, Rattus norvegicus
tggcatggccactttccagatacaa

SEQ ID NO: 632783 - DNA, 25 bp, Rattus norvegicus
tggcatggccgtcctcttgcacatg

SEQ ID NO: 632784 - DNA, 25 bp, Rattus norvegicus
tggcatggccgtgctcttgcacatg

SEQ ID NO: 632785 - DNA, 25 bp, Rattus norvegicus
tggcatgggtctcgcgatctaacac

SEQ ID NO: 632786 - DNA, 25 bp, Rattus norvegicus
tggcatgggtctggcgatctaacac

SEQ ID NO: 632787 - DNA, 25 bp, Rattus norvegicus
tggcatgggtttatctgtgcctgca

SEQ ID NO: 632788 - DNA, 25 bp, Rattus norvegicus
tggcatgggtttttctgtgcctgca

SEQ ID NO: 632789 - DNA, 25 bp, Rattus norvegicus
tggcatgtaccgcaactagcttagc

SEQ ID NO: 632790 - DNA, 25 bp, Rattus norvegicus
tggcatgtaccggaactagcttagc

SEQ ID NO: 632791 - DNA, 25 bp, Rattus norvegicus
tggcatgtccacctttccaaagaaa

SEQ ID NO: 632792 - DNA, 25 bp, Rattus norvegicus
tggcatgtccacgtttccaaagaaa

SEQ ID NO: 632793 - DNA, 25 bp, Rattus norvegicus
tggcatgtcctcacgtgtatacctc

SEQ ID NO: 632794 - DNA, 25 bp, Rattus norvegicus
tggcatgtcctctcgtgtatacctc

SEQ ID NO: 632795 - DNA, 25 bp, Rattus norvegicus
tggcatgtctacaatgactcccgtg

SEQ ID NO: 632796 - DNA, 25 bp, Rattus norvegicus
tggcatgtctactatgactcccgtg

SEQ ID NO: 632797 - DNA, 25 bp, Rattus norvegicus
tggcatgtgccaacctcacaatggg

SEQ ID NO: 632798 - DNA, 25 bp, Rattus norvegicus
tggcatgtgccatcctcacaatggg

SEQ ID NO: 632799 - DNA, 25 bp, Rattus norvegicus
tggcattacctaacactttcatcta

SEQ ID NO: 632800 - DNA, 25 bp, Rattus norvegicus
tggcattacctatcactttcatcta

SEQ ID NO: 632801 - DNA, 25 bp, Rattus norvegicus
tggcattcacaaaactggcactata

SEQ ID NO: 632802 - DNA, 25 bp, Rattus norvegicus
tggcattcacaatactggcactata

SEQ ID NO: 632803 - DNA, 25 bp, Rattus norvegicus
tggcattcactcaccttagatgcat

SEQ ID NO: 632804 - DNA, 25 bp, Rattus norvegicus
tggcattcactctccttagatgcat

SEQ ID NO: 632805 - DNA, 25 bp, Rattus norvegicus
tggcattccaggcttggtctgcctt

SEQ ID NO: 632806 - DNA, 25 bp, Rattus norvegicus
tggcattccagggttggtctgcctt

SEQ ID NO: 632807 - DNA, 25 bp, Rattus norvegicus
tggcattcccagactacactaggga

SEQ ID NO: 632808 - DNA, 25 bp, Rattus norvegicus
tggcattcccagtctacactaggga

SEQ ID NO: 632809 - DNA, 25 bp, Rattus norvegicus
tggcattccgtgaactcttacgtta

SEQ ID NO: 632810 - DNA, 25 bp, Rattus norvegicus
tggcattccgtgtactcttacgtta

SEQ ID NO: 632811 - DNA, 25 bp, Rattus norvegicus
tggcattccgttagaattccttctt

SEQ ID NO: 632812 - DNA, 25 bp, Rattus norvegicus
tggcattccgtttgaattccttctt

SEQ ID NO: 632813 - DNA, 25 bp, Rattus norvegicus
tggcattccttgatgaaccactggg

SEQ ID NO: 632814 - DNA, 25 bp, Rattus norvegicus
tggcattccttgttgaaccactggg

SEQ ID NO: 632815 - DNA, 25 bp, Rattus norvegicus
tggcattcgtggatggtctttacat

SEQ ID NO: 632816 - DNA, 25 bp, Rattus norvegicus
tggcattcgtggttggtctttacat

SEQ ID NO: 632817 - DNA, 25 bp, Rattus norvegicus
tggcattctgctctttgaagctcag

SEQ ID NO: 632818 - DNA, 25 bp, Rattus norvegicus
tggcattctgctgtttgaagctcag

SEQ ID NO: 632819 - DNA, 25 bp, Rattus norvegicus
tggcattcttagagggcaccagtac

SEQ ID NO: 632820 - DNA, 25 bp, Rattus norvegicus
tggcattcttagtgggcaccagtac

SEQ ID NO: 632821 - DNA, 25 bp, Rattus norvegicus
tggcattcttgcagctctgatgaca

SEQ ID NO: 632822 - DNA, 25 bp, Rattus norvegicus
tggcattcttgctgctctgatgaca

SEQ ID NO: 632823 - DNA, 25 bp, Rattus norvegicus
tggcattgacgaccgaaaatattta

SEQ ID NO: 632824 - DNA, 25 bp, Rattus norvegicus
tggcattgacgagcgaaaatattta

SEQ ID NO: 632825 - DNA, 25 bp, Rattus norvegicus
tggcattgcaccactgatttgctaa

SEQ ID NO: 632826 - DNA, 25 bp, Rattus norvegicus
tggcattgcacctctgatttgctaa

SEQ ID NO: 632827 - DNA, 25 bp, Rattus norvegicus
tggcattgccaccttggcctggatg

SEQ ID NO: 632828 - DNA, 25 bp, Rattus norvegicus
tggcattgccacgttggcctggatg

SEQ ID NO: 632829 - DNA, 25 bp, Rattus norvegicus
tggcattgccttctgtgttattctg

SEQ ID NO: 632830 - DNA, 25 bp, Rattus norvegicus
tggcattgccttgtgtgttattctg

SEQ ID NO: 632831 - DNA, 25 bp, Rattus norvegicus
tggcattgcgagctgacaccacaaa

SEQ ID NO: 632832 - DNA, 25 bp, Rattus norvegicus
tggcattgcgaggtgacaccacaaa

SEQ ID NO: 632833 - DNA, 25 bp, Rattus norvegicus
tggcattggccacagatagcattct

SEQ ID NO: 632834 - DNA, 25 bp, Rattus norvegicus
tggcattggccagagatagcattct

SEQ ID NO: 632835 - DNA, 25 bp, Rattus norvegicus
tggcattggctaaggcctagagggt

SEQ ID NO: 632836 - DNA, 25 bp, Rattus norvegicus
tggcattggctatggcctagagggt

SEQ ID NO: 632837 - DNA, 25 bp, Rattus norvegicus
tggcattgggcaaagcacctcatat

SEQ ID NO: 632838 - DNA, 25 bp, Rattus norvegicus
tggcattgggcatagcacctcatat

SEQ ID NO: 632839 - DNA, 25 bp, Rattus norvegicus
tggcattggtggagcagtgacatca

SEQ ID NO: 632840 - DNA, 25 bp, Rattus norvegicus
tggcattggtggtgcagtgacatca

SEQ ID NO: 632841 - DNA, 25 bp, Rattus norvegicus
tggcattgtccaagactccggcggc

SEQ ID NO: 632842 - DNA, 25 bp, Rattus norvegicus
tggcattgtccatgactccggcggc

SEQ ID NO: 632843 - DNA, 25 bp, Rattus norvegicus
tggcattgttatcaggtatggccct

SEQ ID NO: 632844 - DNA, 25 bp, Rattus norvegicus
tggcattgttatgaggtatggccct

SEQ ID NO: 632845 - DNA, 25 bp, Rattus norvegicus
tggcatttcacgcttgcatttcctc

SEQ ID NO: 632846 - DNA, 25 bp, Rattus norvegicus
tggcatttcacggttgcatttcctc

SEQ ID NO: 632847 - DNA, 25 bp, Rattus norvegicus
tggcatttctgcagctgttcacact

SEQ ID NO: 632848 - DNA, 25 bp, Rattus norvegicus
tggcatttctgctgctgttcacact

SEQ ID NO: 632849 - DNA, 25 bp, Rattus norvegicus
tggcatttctttatacgacccgaag

SEQ ID NO: 632850 - DNA, 25 bp, Rattus norvegicus
tggcatttctttttacgacccgaag

SEQ ID NO: 632851 - DNA, 25 bp, Rattus norvegicus
tggcatttgagacgctgttcttctt

SEQ ID NO: 632852 - DNA, 25 bp, Rattus norvegicus
tggcatttgagaggctgttcttctt

SEQ ID NO: 632853 - DNA, 25 bp, Rattus norvegicus
tggcatttgatacccagctgctgat

SEQ ID NO: 632854 - DNA, 25 bp, Rattus norvegicus
tggcatttgatagccagctgctgat

SEQ ID NO: 632855 - DNA, 25 bp, Rattus norvegicus
tggcatttgcatcgtgttttcacaa

SEQ ID NO: 632856 - DNA, 25 bp, Rattus norvegicus
tggcatttgcatggtgttttcacaa

SEQ ID NO: 632857 - DNA, 25 bp, Rattus norvegicus
tggcatttggaactctgcatcccca

SEQ ID NO: 632858 - DNA, 25 bp, Rattus norvegicus
tggcatttggaagtctgcatcccca

SEQ ID NO: 632859 - DNA, 25 bp, Rattus norvegicus
tggcatttgggacgctttgctgaaa

SEQ ID NO: 632860 - DNA, 25 bp, Rattus norvegicus
tggcatttgggaggctttgctgaaa

SEQ ID NO: 632861 - DNA, 25 bp, Rattus norvegicus
tggcattttccactctcagtgtgaa

SEQ ID NO: 632862 - DNA, 25 bp, Rattus norvegicus
tggcattttccagtctcagtgtgaa

SEQ ID NO: 632863 - DNA, 25 bp, Rattus norvegicus
tggcattttctgatttcctgactat

SEQ ID NO: 632864 - DNA, 25 bp, Rattus norvegicus
tggcattttctgttttcctgactat

SEQ ID NO: 632865 - DNA, 25 bp, Rattus norvegicus
tggccaaacatccacctgctgtgta

SEQ ID NO: 632866 - DNA, 25 bp, Rattus norvegicus
tggccaaacatcgacctgctgtgta

SEQ ID NO: 632867 - DNA, 25 bp, Rattus norvegicus
tggccaaaccacatacagcggtgtg

SEQ ID NO: 632868 - DNA, 25 bp, Rattus norvegicus
tggccaaaccacttacagcggtgtg

SEQ ID NO: 632869 - DNA, 25 bp, Rattus norvegicus
tggccaaaccataatccagcttgac

SEQ ID NO: 632870 - DNA, 25 bp, Rattus norvegicus
tggccaaaccatcaacagcagactg

SEQ ID NO: 632871 - DNA, 25 bp, Rattus norvegicus
tggccaaaccatgaacagcagactg

SEQ ID NO: 632872 - DNA, 25 bp, Rattus norvegicus
tggccaaaccattatccagcttgac

SEQ ID NO: 632873 - DNA, 25 bp, Rattus norvegicus
tggccaaactggcttcgacttggac

SEQ ID NO: 632874 - DNA, 25 bp, Rattus norvegicus
tggccaaactgggttcgacttggac

SEQ ID NO: 632875 - DNA, 25 bp, Rattus norvegicus
tggccaaagaagatcctagcctttc

SEQ ID NO: 632876 - DNA, 25 bp, Rattus norvegicus
tggccaaagaagttcctagcctttc

SEQ ID NO: 632877 - DNA, 25 bp, Rattus norvegicus
tggccaaagccaagacctatctggg

SEQ ID NO: 632878 - DNA, 25 bp, Rattus norvegicus
tggccaaagccatgacctatctggg

SEQ ID NO: 632879 - DNA, 25 bp, Rattus norvegicus
tggccaaagcctaggaccacgaagt

SEQ ID NO: 632880 - DNA, 25 bp, Rattus norvegicus
tggccaaagccttggaccacgaagt

SEQ ID NO: 632881 - DNA, 25 bp, Rattus norvegicus
tggccaaaggaaactgtcactgttt

SEQ ID NO: 632882 - DNA, 25 bp, Rattus norvegicus
tggccaaaggaatctgtcactgttt

SEQ ID NO: 632883 - DNA, 25 bp, Rattus norvegicus
tggccaaaggatcgacaccatgttt

SEQ ID NO: 632884 - DNA, 25 bp, Rattus norvegicus
tggccaaaggatggacaccatgttt

SEQ ID NO: 632885 - DNA, 25 bp, Rattus norvegicus
tggccaaaggttaaggcttgtacct

SEQ ID NO: 632886 - DNA, 25 bp, Rattus norvegicus
tggccaaaggtttaggcttgtacct

SEQ ID NO: 632887 - DNA, 25 bp, Rattus norvegicus
tggccaaagtcaataaccccgtggg

SEQ ID NO: 632888 - DNA, 25 bp, Rattus norvegicus
tggccaaagtcattaaccccgtggg

SEQ ID NO: 632889 - DNA, 25 bp, Rattus norvegicus
tggccaaataccacatggagctctc

SEQ ID NO: 632890 - DNA, 25 bp, Rattus norvegicus
tggccaaatacctcatggagctctc

SEQ ID NO: 632891 - DNA, 25 bp, Rattus norvegicus
tggccaacaactacgctcgctcttt

SEQ ID NO: 632892 - DNA, 25 bp, Rattus norvegicus
tggccaacaacttcgctcgctcttt

SEQ ID NO: 632893 - DNA, 25 bp, Rattus norvegicus
tggccaacagtcaccttgacagtga

SEQ ID NO: 632894 - DNA, 25 bp, Rattus norvegicus
tggccaacagtctccttgacagtga

SEQ ID NO: 632895 - DNA, 25 bp, Rattus norvegicus
tggccaaccagtcctgctgaatcag

SEQ ID NO: 632896 - DNA, 25 bp, Rattus norvegicus
tggccaaccagtgctgctgaatcag

SEQ ID NO: 632897 - DNA, 25 bp, Rattus norvegicus
tggccaaccttcagctatgtatgta

SEQ ID NO: 632898 - DNA, 25 bp, Rattus norvegicus
tggccaaccttctgctatgtatgta

SEQ ID NO: 632899 - DNA, 25 bp, Rattus norvegicus
tggccaacggctcctggacggatat

SEQ ID NO: 632900 - DNA, 25 bp, Rattus norvegicus
tggccaacggctgctggacggatat

SEQ ID NO: 632901 - DNA, 25 bp, Rattus norvegicus
tggccaacgggcatttctttgatct

SEQ ID NO: 632902 - DNA, 25 bp, Rattus norvegicus
tggccaacgggcttttctttgatct

SEQ ID NO: 632903 - DNA, 25 bp, Rattus norvegicus
tggccaactagacccgctgtgtgaa

SEQ ID NO: 632904 - DNA, 25 bp, Rattus norvegicus
tggccaactagagccgctgtgtgaa

SEQ ID NO: 632905 - DNA, 25 bp, Rattus norvegicus
tggccaactcccatttcatcgagga

SEQ ID NO: 632906 - DNA, 25 bp, Rattus norvegicus
tggccaactcccttttcatcgagga

SEQ ID NO: 632907 - DNA, 25 bp, Rattus norvegicus
tggccaactgttaccagaatacgtt

SEQ ID NO: 632908 - DNA, 25 bp, Rattus norvegicus
tggccaactgtttccagaatacgtt

SEQ ID NO: 632909 - DNA, 25 bp, Rattus norvegicus
tggccaagaaggctctgtgcattca

SEQ ID NO: 632910 - DNA, 25 bp, Rattus norvegicus
tggccaagaagggtctgtgcattca

SEQ ID NO: 632911 - DNA, 25 bp, Rattus norvegicus
tggccaagaagtcctcctctggaaa

SEQ ID NO: 632912 - DNA, 25 bp, Rattus norvegicus
tggccaagaagtgctcctctggaaa

SEQ ID NO: 632913 - DNA, 25 bp, Rattus norvegicus
tggccaagaccacattactcctgtg

SEQ ID NO: 632914 - DNA, 25 bp, Rattus norvegicus
tggccaagaccagattactcctgtg

SEQ ID NO: 632915 - DNA, 25 bp, Rattus norvegicus
tggccaagagcacatcccagctagg

SEQ ID NO: 632916 - DNA, 25 bp, Rattus norvegicus
tggccaagagcagatcccagctagg

SEQ ID NO: 632917 - DNA, 25 bp, Rattus norvegicus
tggccaagccacacattttgacaag

SEQ ID NO: 632918 - DNA, 25 bp, Rattus norvegicus
tggccaagccactcattttgacaag

SEQ ID NO: 632919 - DNA, 25 bp, Rattus norvegicus
tggccaagcctccagggactgtcca

SEQ ID NO: 632920 - DNA, 25 bp, Rattus norvegicus
tggccaagcctcgagggactgtcca

SEQ ID NO: 632921 - DNA, 25 bp, Rattus norvegicus
tggccaagcctgaggtagaacccgt

SEQ ID NO: 632922 - DNA, 25 bp, Rattus norvegicus
tggccaagcctgtggtagaacccgt

SEQ ID NO: 632923 - DNA, 25 bp, Rattus norvegicus
tggccaagctcaagctaggcacatg

SEQ ID NO: 632924 - DNA, 25 bp, Rattus norvegicus
tggccaagctcatgctaggcacatg

SEQ ID NO: 632925 - DNA, 25 bp, Rattus norvegicus
tggccaaggattactccgtgctcaa

SEQ ID NO: 632926 - DNA, 25 bp, Rattus norvegicus
tggccaaggatttctccgtgctcaa

SEQ ID NO: 632927 - DNA, 25 bp, Rattus norvegicus
tggccaaggcataccagcactgtgt

SEQ ID NO: 632928 - DNA, 25 bp, Rattus norvegicus
tggccaaggcattccagcactgtgt

SEQ ID NO: 632929 - DNA, 25 bp, Rattus norvegicus
tggccaaggctcatctgcagtgttg

SEQ ID NO: 632930 - DNA, 25 bp, Rattus norvegicus
tggccaaggctcttctgcagtgttg

SEQ ID NO: 632931 - DNA, 25 bp, Rattus norvegicus
tggccaaggctgctttgtagtttgc

SEQ ID NO: 632932 - DNA, 25 bp, Rattus norvegicus
tggccaaggctggtttgtagtttgc

SEQ ID NO: 632933 - DNA, 25 bp, Rattus norvegicus
tggccaagggccaactgggaactgt

SEQ ID NO: 632934 - DNA, 25 bp, Rattus norvegicus
tggccaagggcctactgggaactgt

SEQ ID NO: 632935 - DNA, 25 bp, Rattus norvegicus
tggccaagtgcacgttccctaaatg

SEQ ID NO: 632936 - DNA, 25 bp, Rattus norvegicus
tggccaagtgcaggttccctaaatg

SEQ ID NO: 632937 - DNA, 25 bp, Rattus norvegicus
tggccaatatccaggttatcaagcc

SEQ ID NO: 632938 - DNA, 25 bp, Rattus norvegicus
tggccaatatcctggttatcaagcc

SEQ ID NO: 632939 - DNA, 25 bp, Rattus norvegicus
tggccaatatgtacagtgtcttcac

SEQ ID NO: 632940 - DNA, 25 bp, Rattus norvegicus
tggccaatatgttcagtgtcttcac

SEQ ID NO: 632941 - DNA, 25 bp, Rattus norvegicus
tggccaatcagccatcgctcagcat

SEQ ID NO: 632942 - DNA, 25 bp, Rattus norvegicus
tggccaatcagcgatcgctcagcat

SEQ ID NO: 632943 - DNA, 25 bp, Rattus norvegicus
tggccaatcttacgcaaaccagttt

SEQ ID NO: 632944 - DNA, 25 bp, Rattus norvegicus
tggccaatcttaggcaaaccagttt

SEQ ID NO: 632945 - DNA, 25 bp, Rattus norvegicus
tggccaatgagtaccgctgttatac

SEQ ID NO: 632946 - DNA, 25 bp, Rattus norvegicus
tggccaatgagttccgctgttatac

SEQ ID NO: 632947 - DNA, 25 bp, Rattus norvegicus
tggccaatgcagactccagaatctt

SEQ ID NO: 632948 - DNA, 25 bp, Rattus norvegicus
tggccaatgcagtctccagaatctt

SEQ ID NO: 632949 - DNA, 25 bp, Rattus norvegicus
tggccaatgcctcttgtccagcagg

SEQ ID NO: 632950 - DNA, 25 bp, Rattus norvegicus
tggccaatgcctgttgtccagcagg

SEQ ID NO: 632951 - DNA, 25 bp, Rattus norvegicus
tggccaatggagactactctctgcc

SEQ ID NO: 632952 - DNA, 25 bp, Rattus norvegicus
tggccaatggagtctactctctgcc

SEQ ID NO: 632953 - DNA, 25 bp, Rattus norvegicus
tggccaatggcaaaaacggtgaaat

SEQ ID NO: 632954 - DNA, 25 bp, Rattus norvegicus
tggccaatggcataaacggtgaaat

SEQ ID NO: 632955 - DNA, 25 bp, Rattus norvegicus
tggccaatgtttatcaactttcccg

SEQ ID NO: 632956 - DNA, 25 bp, Rattus norvegicus
tggccaatgtttttcaactttcccg

SEQ ID NO: 632957 - DNA, 25 bp, Rattus norvegicus
tggccaattccaaccgcatgattat

SEQ ID NO: 632958 - DNA, 25 bp, Rattus norvegicus
tggccaattccatccgcatgattat

SEQ ID NO: 632959 - DNA, 25 bp, Rattus norvegicus
tggccacaaacactagcacagacgt

SEQ ID NO: 632960 - DNA, 25 bp, Rattus norvegicus
tggccacaaacagtagcacagacgt

SEQ ID NO: 632961 - DNA, 25 bp, Rattus norvegicus
tggccacaagttccggcaggcagac

SEQ ID NO: 632962 - DNA, 25 bp, Rattus norvegicus
tggccacaagttgcggcaggcagac

SEQ ID NO: 632963 - DNA, 25 bp, Rattus norvegicus
tggccacaatgacctttctcgaaga

SEQ ID NO: 632964 - DNA, 25 bp, Rattus norvegicus
tggccacaatgagctttctcgaaga

SEQ ID NO: 632965 - DNA, 25 bp, Rattus norvegicus
tggccacaccctcatccagaggagg

SEQ ID NO: 632966 - DNA, 25 bp, Rattus norvegicus
tggccacaccctcttgtgaatagat

SEQ ID NO: 632967 - DNA, 25 bp, Rattus norvegicus
tggccacaccctgatccagaggagg

SEQ ID NO: 632968 - DNA, 25 bp, Rattus norvegicus
tggccacaccctgttgtgaatagat

SEQ ID NO: 632969 - DNA, 25 bp, Rattus norvegicus
tggccacacctcatgaagcaattat

SEQ ID NO: 632970 - DNA, 25 bp, Rattus norvegicus
tggccacacctcttgaagcaattat

SEQ ID NO: 632971 - DNA, 25 bp, Rattus norvegicus
tggccacaccttcccaagcagagaa

SEQ ID NO: 632972 - DNA, 25 bp, Rattus norvegicus
tggccacaccttgccaagcagagaa

SEQ ID NO: 632973 - DNA, 25 bp, Rattus norvegicus
tggccacacggacggagctttctta

SEQ ID NO: 632974 - DNA, 25 bp, Rattus norvegicus
tggccacacggagggagctttctta

SEQ ID NO: 632975 - DNA, 25 bp, Rattus norvegicus
tggccacagcatctgcaaaggtctg

SEQ ID NO: 632976 - DNA, 25 bp, Rattus norvegicus
tggccacagcatgtgcaaaggtctg

SEQ ID NO: 632977 - DNA, 25 bp, Rattus norvegicus
tggccacagcttctctaggttgagg

SEQ ID NO: 632978 - DNA, 25 bp, Rattus norvegicus
tggccacagcttgtctaggttgagg

SEQ ID NO: 632979 - DNA, 25 bp, Rattus norvegicus
tggccacagggcatctggcaataag

SEQ ID NO: 632980 - DNA, 25 bp, Rattus norvegicus
tggccacagggcttctggcaataag

SEQ ID NO: 632981 - DNA, 25 bp, Rattus norvegicus
tggccacagtatccggggcatccac

SEQ ID NO: 632982 - DNA, 25 bp, Rattus norvegicus
tggccacagtatgcggggcatccac

SEQ ID NO: 632983 - DNA, 25 bp, Rattus norvegicus
tggccacagtgtagccttgcatgta

SEQ ID NO: 632984 - DNA, 25 bp, Rattus norvegicus
tggccacagtgttgccttgcatgta

SEQ ID NO: 632985 - DNA, 25 bp, Rattus norvegicus
tggccacatcaacatcactgacttt

SEQ ID NO: 632986 - DNA, 25 bp, Rattus norvegicus
tggccacatcaagatcactgacttt

SEQ ID NO: 632987 - DNA, 25 bp, Rattus norvegicus
tggccacattctcggtttgagctat

SEQ ID NO: 632988 - DNA, 25 bp, Rattus norvegicus
tggccacattctgggtttgagctat

SEQ ID NO: 632989 - DNA, 25 bp, Rattus norvegicus
tggccacattgcaccatgtgctgaa

SEQ ID NO: 632990 - DNA, 25 bp, Rattus norvegicus
tggccacattgctccatgtgctgaa

SEQ ID NO: 632991 - DNA, 25 bp, Rattus norvegicus
tggccacatttgacctatttgagct

SEQ ID NO: 632992 - DNA, 25 bp, Rattus norvegicus
tggccacatttgtcctatttgagct

SEQ ID NO: 632993 - DNA, 25 bp, Rattus norvegicus
tggccaccaacacttccaagcaggg

SEQ ID NO: 632994 - DNA, 25 bp, Rattus norvegicus
tggccaccaacagttccaagcaggg

SEQ ID NO: 632995 - DNA, 25 bp, Rattus norvegicus
tggccaccacctctgagctatgatt

SEQ ID NO: 632996 - DNA, 25 bp, Rattus norvegicus
tggccaccacctgtgagctatgatt

SEQ ID NO: 632997 - DNA, 25 bp, Rattus norvegicus
tggccaccactgacatacaaatcta

SEQ ID NO: 632998 - DNA, 25 bp, Rattus norvegicus
tggccaccactgtcatacaaatcta

SEQ ID NO: 632999 - DNA, 25 bp, Rattus norvegicus
tggccaccaggcaaagcagatccgt

SEQ ID NO: 633000 - DNA, 25 bp, Rattus norvegicus
tggccaccaggctaagcagatccgt

SEQ ID NO: 633001 - DNA, 25 bp, Rattus norvegicus
tggccaccagtaccgataaccgagt

SEQ ID NO: 633002 - DNA, 25 bp, Rattus norvegicus
tggccaccagtagcgataaccgagt

SEQ ID NO: 633003 - DNA, 25 bp, Rattus norvegicus
tggccaccagttactggttcctgta

SEQ ID NO: 633004 - DNA, 25 bp, Rattus norvegicus
tggccaccagtttctggttcctgta

SEQ ID NO: 633005 - DNA, 25 bp, Rattus norvegicus
tggccaccatcgctgtgacttggga

SEQ ID NO: 633006 - DNA, 25 bp, Rattus norvegicus
tggccaccatcggtgtgacttggga

SEQ ID NO: 633007 - DNA, 25 bp, Rattus norvegicus
tggccaccatctcagagtgaccaat

SEQ ID NO: 633008 - DNA, 25 bp, Rattus norvegicus
tggccaccatctgagagtgaccaat

SEQ ID NO: 633009 - DNA, 25 bp, Rattus norvegicus
tggccacccacacttgcatggaaaa

SEQ ID NO: 633010 - DNA, 25 bp, Rattus norvegicus
tggccacccacagttgcatggaaaa

SEQ ID NO: 633011 - DNA, 25 bp, Rattus norvegicus
tggccacccgacactacatggaagt

SEQ ID NO: 633012 - DNA, 25 bp, Rattus norvegicus
tggccacccgactctacatggaagt

SEQ ID NO: 633013 - DNA, 25 bp, Rattus norvegicus
tggccaccctccacttctggtgagg

SEQ ID NO: 633014 - DNA, 25 bp, Rattus norvegicus
tggccaccctcctcttctggtgagg

SEQ ID NO: 633015 - DNA, 25 bp, Rattus norvegicus
tggccaccgtggatcttaaagaaat

SEQ ID NO: 633016 - DNA, 25 bp, Rattus norvegicus
tggccaccgtggttcttaaagaaat

SEQ ID NO: 633017 - DNA, 25 bp, Rattus norvegicus
tggccacctaagaagtctacacctg

SEQ ID NO: 633018 - DNA, 25 bp, Rattus norvegicus
tggccacctaagtagtctacacctg

SEQ ID NO: 633019 - DNA, 25 bp, Rattus norvegicus
tggccacctacaacagactgtttat

SEQ ID NO: 633020 - DNA, 25 bp, Rattus norvegicus
tggccacctacatcagactgtttat

SEQ ID NO: 633021 - DNA, 25 bp, Rattus norvegicus
tggccacctcgaaacactagtgagg

SEQ ID NO: 633022 - DNA, 25 bp, Rattus norvegicus
tggccacctcgatacactagtgagg

SEQ ID NO: 633023 - DNA, 25 bp, Rattus norvegicus
tggccacctgcgaggcgagcactac

SEQ ID NO: 633024 - DNA, 25 bp, Rattus norvegicus
tggccacctgcgtggcgagcactac

SEQ ID NO: 633025 - DNA, 25 bp, Rattus norvegicus
tggccacctggaactcagaacttaa

SEQ ID NO: 633026 - DNA, 25 bp, Rattus norvegicus
tggccacctggatctcagaacttaa

SEQ ID NO: 633027 - DNA, 25 bp, Rattus norvegicus
tggccacctgtgatcgaggcatgac

SEQ ID NO: 633028 - DNA, 25 bp, Rattus norvegicus
tggccacctgtgttcgaggcatgac

SEQ ID NO: 633029 - DNA, 25 bp, Rattus norvegicus
tggccaccttacaacgggaactacg

SEQ ID NO: 633030 - DNA, 25 bp, Rattus norvegicus
tggccaccttactacgggaactacg

SEQ ID NO: 633031 - DNA, 25 bp, Rattus norvegicus
tggccaccttctagtcagggaagga

SEQ ID NO: 633032 - DNA, 25 bp, Rattus norvegicus
tggccaccttcttgtcagggaagga

SEQ ID NO: 633033 - DNA, 25 bp, Rattus norvegicus
tggccaccttgtcatactgctaaat

SEQ ID NO: 633034 - DNA, 25 bp, Rattus norvegicus
tggccaccttgtgatactgctaaat

SEQ ID NO: 633035 - DNA, 25 bp, Rattus norvegicus
tggccacgcccacagcttgtaaagg

SEQ ID NO: 633036 - DNA, 25 bp, Rattus norvegicus
tggccacgcccagagcttgtaaagg

SEQ ID NO: 633037 - DNA, 25 bp, Rattus norvegicus
tggccacgctagaactgctgggcaa

SEQ ID NO: 633038 - DNA, 25 bp, Rattus norvegicus
tggccacgctagtactgctgggcaa

SEQ ID NO: 633039 - DNA, 25 bp, Rattus norvegicus
tggccacgcttcaccaagtgaagat

SEQ ID NO: 633040 - DNA, 25 bp, Rattus norvegicus
tggccacgcttctccaagtgaagat

SEQ ID NO: 633041 - DNA, 25 bp, Rattus norvegicus
tggccacggactacgacgatgagtt

SEQ ID NO: 633042 - DNA, 25 bp, Rattus norvegicus
tggccacggacttcgacgatgagtt

SEQ ID NO: 633043 - DNA, 25 bp, Rattus norvegicus
tggccacggccaagagcgacatgaa

SEQ ID NO: 633044 - DNA, 25 bp, Rattus norvegicus
tggccacggccatgagcgacatgaa

SEQ ID NO: 633045 - DNA, 25 bp, Rattus norvegicus
tggccacgggctccttttgaaagaa

SEQ ID NO: 633046 - DNA, 25 bp, Rattus norvegicus
tggccacgggctgcttttgaaagaa

SEQ ID NO: 633047 - DNA, 25 bp, Rattus norvegicus
tggccacgtggaattcgatgacttt

SEQ ID NO: 633048 - DNA, 25 bp, Rattus norvegicus
tggccacgtggatttcgatgacttt

SEQ ID NO: 633049 - DNA, 25 bp, Rattus norvegicus
tggccactatggaattctaacctga

SEQ ID NO: 633050 - DNA, 25 bp, Rattus norvegicus
tggccactatggtattctaacctga

SEQ ID NO: 633051 - DNA, 25 bp, Rattus norvegicus
tggccactcagcaacagatgctttt

SEQ ID NO: 633052 - DNA, 25 bp, Rattus norvegicus
tggccactcagcacagttcacaaag

SEQ ID NO: 633053 - DNA, 25 bp, Rattus norvegicus
tggccactcagctacagatgctttt

SEQ ID NO: 633054 - DNA, 25 bp, Rattus norvegicus
tggccactcagctcagttcacaaag

SEQ ID NO: 633055 - DNA, 25 bp, Rattus norvegicus
tggccactcattcactgttatctca

SEQ ID NO: 633056 - DNA, 25 bp, Rattus norvegicus
tggccactcattgactgttatctca

SEQ ID NO: 633057 - DNA, 25 bp, Rattus norvegicus
tggccactccacaaatttcgtgatt

SEQ ID NO: 633058 - DNA, 25 bp, Rattus norvegicus
tggccactccactaatttcgtgatt

SEQ ID NO: 633059 - DNA, 25 bp, Rattus norvegicus
tggccactcgcgcaggagttattaa

SEQ ID NO: 633060 - DNA, 25 bp, Rattus norvegicus
tggccactcgcggaggagttattaa

SEQ ID NO: 633061 - DNA, 25 bp, Rattus norvegicus
tggccactcggcacactggaggctg

SEQ ID NO: 633062 - DNA, 25 bp, Rattus norvegicus
tggccactcggctcactggaggctg

SEQ ID NO: 633063 - DNA, 25 bp, Rattus norvegicus
tggccactctgcactgtggaacaag

SEQ ID NO: 633064 - DNA, 25 bp, Rattus norvegicus
tggccactctgctctgtggaacaag

SEQ ID NO: 633065 - DNA, 25 bp, Rattus norvegicus
tggccactctgtcatttggacgagc

SEQ ID NO: 633066 - DNA, 25 bp, Rattus norvegicus
tggccactctgtgatttggacgagc

SEQ ID NO: 633067 - DNA, 25 bp, Rattus norvegicus
tggccactgacccaaggcaagtttg

SEQ ID NO: 633068 - DNA, 25 bp, Rattus norvegicus
tggccactgaccgaaggcaagtttg

SEQ ID NO: 633069 - DNA, 25 bp, Rattus norvegicus
tggccactgaggaagctgaacgtat

SEQ ID NO: 633070 - DNA, 25 bp, Rattus norvegicus
tggccactgaggtagctgaacgtat

SEQ ID NO: 633071 - DNA, 25 bp, Rattus norvegicus
tggccactgatcacctttaagagct

SEQ ID NO: 633072 - DNA, 25 bp, Rattus norvegicus
tggccactgatctcctttaagagct

SEQ ID NO: 633073 - DNA, 25 bp, Rattus norvegicus
tggccactgcaaccttagaatcatg

SEQ ID NO: 633074 - DNA, 25 bp, Rattus norvegicus
tggccactgcaagcttagaatcatg

SEQ ID NO: 633075 - DNA, 25 bp, Rattus norvegicus
tggccactgccaagtgtgttgcaca

SEQ ID NO: 633076 - DNA, 25 bp, Rattus norvegicus
tggccactgccatgtgtgttgcaca

SEQ ID NO: 633077 - DNA, 25 bp, Rattus norvegicus
tggccactggctactttgatcatag

SEQ ID NO: 633078 - DNA, 25 bp, Rattus norvegicus
tggccactggcttctttgatcatag

SEQ ID NO: 633079 - DNA, 25 bp, Rattus norvegicus
tggccactgggaactatggtcctag

SEQ ID NO: 633080 - DNA, 25 bp, Rattus norvegicus
tggccactgggatctatggtcctag

SEQ ID NO: 633081 - DNA, 25 bp, Rattus norvegicus
tggccactgggcactgttttaaagc

SEQ ID NO: 633082 - DNA, 25 bp, Rattus norvegicus
tggccactgggctctgttttaaagc

SEQ ID NO: 633083 - DNA, 25 bp, Rattus norvegicus
tggccactgggtcacttattgaggt

SEQ ID NO: 633084 - DNA, 25 bp, Rattus norvegicus
tggccactgggtccacagcgacaaa

SEQ ID NO: 633085 - DNA, 25 bp, Rattus norvegicus
tggccactgggtgacttattgaggt

SEQ ID NO: 633086 - DNA, 25 bp, Rattus norvegicus
tggccactgggtgcacagcgacaaa

SEQ ID NO: 633087 - DNA, 25 bp, Rattus norvegicus
tggccactggtcactctatgaagat

SEQ ID NO: 633088 - DNA, 25 bp, Rattus norvegicus
tggccactggtctctctatgaagat

SEQ ID NO: 633089 - DNA, 25 bp, Rattus norvegicus
tggccactggttctggtccatttga

SEQ ID NO: 633090 - DNA, 25 bp, Rattus norvegicus
tggccactggttgtggtccatttga

SEQ ID NO: 633091 - DNA, 25 bp, Rattus norvegicus
tggccactgtgacaagcatatccct

SEQ ID NO: 633092 - DNA, 25 bp, Rattus norvegicus
tggccactgtgagaagcatatccct

SEQ ID NO: 633093 - DNA, 25 bp, Rattus norvegicus
tggccactgtgtatctgtgaacaga

SEQ ID NO: 633094 - DNA, 25 bp, Rattus norvegicus
tggccactgtgtttctgtgaacaga

SEQ ID NO: 633095 - DNA, 25 bp, Rattus norvegicus
tggccacttactcagtttctggaag

SEQ ID NO: 633096 - DNA, 25 bp, Rattus norvegicus
tggccacttactgagtttctggaag

SEQ ID NO: 633097 - DNA, 25 bp, Rattus norvegicus
tggccacttcagaacactcagactt

SEQ ID NO: 633098 - DNA, 25 bp, Rattus norvegicus
tggccacttcagcactgtaatggag

SEQ ID NO: 633099 - DNA, 25 bp, Rattus norvegicus
tggccacttcaggactgtaatggag

SEQ ID NO: 633100 - DNA, 25 bp, Rattus norvegicus
tggccacttcagtacactcagactt

SEQ ID NO: 633101 - DNA, 25 bp, Rattus norvegicus
tggccacttcggctactattatagc

SEQ ID NO: 633102 - DNA, 25 bp, Rattus norvegicus
tggccacttcgggtactattatagc

SEQ ID NO: 633103 - DNA, 25 bp, Rattus norvegicus
tggccacttcttctcttgattgtac

SEQ ID NO: 633104 - DNA, 25 bp, Rattus norvegicus
tggccacttcttgtcttgattgtac

SEQ ID NO: 633105 - DNA, 25 bp, Rattus norvegicus
tggccacttggaacatgagcatgct

SEQ ID NO: 633106 - DNA, 25 bp, Rattus norvegicus
tggccacttggatcatgagcatgct

SEQ ID NO: 633107 - DNA, 25 bp, Rattus norvegicus
tggccacttggcaagatttatcttc

SEQ ID NO: 633108 - DNA, 25 bp, Rattus norvegicus
tggccacttggctagatttatcttc

SEQ ID NO: 633109 - DNA, 25 bp, Rattus norvegicus
tggccacttgtgatctgttttaaat

SEQ ID NO: 633110 - DNA, 25 bp, Rattus norvegicus
tggccacttgtgttctgttttaaat

SEQ ID NO: 633111 - DNA, 25 bp, Rattus norvegicus
tggccactttcactgtaaccttgat

SEQ ID NO: 633112 - DNA, 25 bp, Rattus norvegicus
tggccactttcagtgtaaccttgat

SEQ ID NO: 633113 - DNA, 25 bp, Rattus norvegicus
tggccactttccaatgcagtgatta

SEQ ID NO: 633114 - DNA, 25 bp, Rattus norvegicus
tggccactttcctatgcagtgatta

SEQ ID NO: 633115 - DNA, 25 bp, Rattus norvegicus
tggccactttggaagggacagcttc

SEQ ID NO: 633116 - DNA, 25 bp, Rattus norvegicus
tggccactttggtagggacagcttc

SEQ ID NO: 633117 - DNA, 25 bp, Rattus norvegicus
tggccagaaccaccgatgagctaga

SEQ ID NO: 633118 - DNA, 25 bp, Rattus norvegicus
tggccagaaccactgtgaccattct

SEQ ID NO: 633119 - DNA, 25 bp, Rattus norvegicus
tggccagaaccagcgatgagctaga

SEQ ID NO: 633120 - DNA, 25 bp, Rattus norvegicus
tggccagaaccagtgtgaccattct

SEQ ID NO: 633121 - DNA, 25 bp, Rattus norvegicus
tggccagaagccctacaagaagatg

SEQ ID NO: 633122 - DNA, 25 bp, Rattus norvegicus
tggccagaagccgtacaagaagatg

SEQ ID NO: 633123 - DNA, 25 bp, Rattus norvegicus
tggccagacatccacagtggagcat

SEQ ID NO: 633124 - DNA, 25 bp, Rattus norvegicus
tggccagacatcgacagtggagcat

SEQ ID NO: 633125 - DNA, 25 bp, Rattus norvegicus
tggccagactcacctgctaaccaaa

SEQ ID NO: 633126 - DNA, 25 bp, Rattus norvegicus
tggccagactcagctgctaaccaaa

SEQ ID NO: 633127 - DNA, 25 bp, Rattus norvegicus
tggccagactggagcacgcctacaa

SEQ ID NO: 633128 - DNA, 25 bp, Rattus norvegicus
tggccagactggtgcacgcctacaa

SEQ ID NO: 633129 - DNA, 25 bp, Rattus norvegicus
tggccagagcttcctttgacgtagc

SEQ ID NO: 633130 - DNA, 25 bp, Rattus norvegicus
tggccagagcttgctttgacgtagc

SEQ ID NO: 633131 - DNA, 25 bp, Rattus norvegicus
tggccagaggtccaccatgtgaaat

SEQ ID NO: 633132 - DNA, 25 bp, Rattus norvegicus
tggccagaggtcgaccatgtgaaat

SEQ ID NO: 633133 - DNA, 25 bp, Rattus norvegicus
tggccagagttcatttcagtcagct

SEQ ID NO: 633134 - DNA, 25 bp, Rattus norvegicus
tggccagagttcttttcagtcagct

SEQ ID NO: 633135 - DNA, 25 bp, Rattus norvegicus
tggccagatagtcacgctgtttcct

SEQ ID NO: 633136 - DNA, 25 bp, Rattus norvegicus
tggccagatagtgacgctgtttcct

SEQ ID NO: 633137 - DNA, 25 bp, Rattus norvegicus
tggccagatctgcagttaccgttca

SEQ ID NO: 633138 - DNA, 25 bp, Rattus norvegicus
tggccagatctggagttaccgttca

SEQ ID NO: 633139 - DNA, 25 bp, Rattus norvegicus
tggccagcaccgctcatgagacaat

SEQ ID NO: 633140 - DNA, 25 bp, Rattus norvegicus
tggccagcaccggtcatgagacaat

SEQ ID NO: 633141 - DNA, 25 bp, Rattus norvegicus
tggccagcagtgcaccacttgagaa

SEQ ID NO: 633142 - DNA, 25 bp, Rattus norvegicus
tggccagcagtggaccacttgagaa

SEQ ID NO: 633143 - DNA, 25 bp, Rattus norvegicus
tggccagcatacactatgcgtactt

SEQ ID NO: 633144 - DNA, 25 bp, Rattus norvegicus
tggccagcatactctatgcgtactt

SEQ ID NO: 633145 - DNA, 25 bp, Rattus norvegicus
tggccagcatagactctagcaacct

SEQ ID NO: 633146 - DNA, 25 bp, Rattus norvegicus
tggccagcatagtctctagcaacct

SEQ ID NO: 633147 - DNA, 25 bp, Rattus norvegicus
tggccagcatgcacagttcaaagat

SEQ ID NO: 633148 - DNA, 25 bp, Rattus norvegicus
tggccagcatgctcagttcaaagat

SEQ ID NO: 633149 - DNA, 25 bp, Rattus norvegicus
tggccagccaccacattgaggctaa

SEQ ID NO: 633150 - DNA, 25 bp, Rattus norvegicus
tggccagccacctcattgaggctaa

SEQ ID NO: 633151 - DNA, 25 bp, Rattus norvegicus
tggccagccaggaccagaaagaacc

SEQ ID NO: 633152 - DNA, 25 bp, Rattus norvegicus
tggccagccaggtccagaaagaacc

SEQ ID NO: 633153 - DNA, 25 bp, Rattus norvegicus
tggccagcccttaacggagctctta

SEQ ID NO: 633154 - DNA, 25 bp, Rattus norvegicus
tggccagcccttacaagacagactg

SEQ ID NO: 633155 - DNA, 25 bp, Rattus norvegicus
tggccagccctttacggagctctta

SEQ ID NO: 633156 - DNA, 25 bp, Rattus norvegicus
tggccagccctttcaagacagactg

SEQ ID NO: 633157 - DNA, 25 bp, Rattus norvegicus
tggccagccgtactgaccaagaaaa

SEQ ID NO: 633158 - DNA, 25 bp, Rattus norvegicus
tggccagccgtagtgaccaagaaaa

SEQ ID NO: 633159 - DNA, 25 bp, Rattus norvegicus
tggccagccttgagctatgttgata

SEQ ID NO: 633160 - DNA, 25 bp, Rattus norvegicus
tggccagccttgtgctatgttgata

SEQ ID NO: 633161 - DNA, 25 bp, Rattus norvegicus
tggccagcgacaaccagaagctttg

SEQ ID NO: 633162 - DNA, 25 bp, Rattus norvegicus
tggccagcgacatccagaagctttg

SEQ ID NO: 633163 - DNA, 25 bp, Rattus norvegicus
tggccagctagcagggttcccagga

SEQ ID NO: 633164 - DNA, 25 bp, Rattus norvegicus
tggccagctagctgggttcccagga

SEQ ID NO: 633165 - DNA, 25 bp, Rattus norvegicus
tggccagctatcatcacacgtgtgt

SEQ ID NO: 633166 - DNA, 25 bp, Rattus norvegicus
tggccagctatcttcacacgtgtgt

SEQ ID NO: 633167 - DNA, 25 bp, Rattus norvegicus
tggccagctgtccagaacaatccgc

SEQ ID NO: 633168 - DNA, 25 bp, Rattus norvegicus
tggccagctgtcgagaacaatccgc

SEQ ID NO: 633169 - DNA, 25 bp, Rattus norvegicus
tggccagcttcgctgggcacagtcc

SEQ ID NO: 633170 - DNA, 25 bp, Rattus norvegicus
tggccagcttcggtgggcacagtcc

SEQ ID NO: 633171 - DNA, 25 bp, Rattus norvegicus
tggccaggactcaggtgctcgctct

SEQ ID NO: 633172 - DNA, 25 bp, Rattus norvegicus
tggccaggactccaatgttctgaca

SEQ ID NO: 633173 - DNA, 25 bp, Rattus norvegicus
tggccaggactcgaatgttctgaca

SEQ ID NO: 633174 - DNA, 25 bp, Rattus norvegicus
tggccaggactctggtgctcgctct

SEQ ID NO: 633175 - DNA, 25 bp, Rattus norvegicus
tggccaggcaagcagacccgacttt

SEQ ID NO: 633176 - DNA, 25 bp, Rattus norvegicus
tggccaggcaaggagacccgacttt

SEQ ID NO: 633177 - DNA, 25 bp, Rattus norvegicus
tggccaggctaactggtcagctaaa

SEQ ID NO: 633178 - DNA, 25 bp, Rattus norvegicus
tggccaggctaagtggtcagctaaa

SEQ ID NO: 633179 - DNA, 25 bp, Rattus norvegicus
tggccaggcttgattggtacccatt

SEQ ID NO: 633180 - DNA, 25 bp, Rattus norvegicus
tggccaggcttgtttggtacccatt

SEQ ID NO: 633181 - DNA, 25 bp, Rattus norvegicus
tggccagggcacatcttttatttat

SEQ ID NO: 633182 - DNA, 25 bp, Rattus norvegicus
tggccagggcacttcttttatttat

SEQ ID NO: 633183 - DNA, 25 bp, Rattus norvegicus
tggccagggcctattgaacagtagt

SEQ ID NO: 633184 - DNA, 25 bp, Rattus norvegicus
tggccagggccttttgaacagtagt

SEQ ID NO: 633185 - DNA, 25 bp, Rattus norvegicus
tggccagggctcacacaagtcatat

SEQ ID NO: 633186 - DNA, 25 bp, Rattus norvegicus
tggccagggctcatggtttagcaat

SEQ ID NO: 633187 - DNA, 25 bp, Rattus norvegicus
tggccagggctctcacaagtcatat

SEQ ID NO: 633188 - DNA, 25 bp, Rattus norvegicus
tggccagggctcttggtttagcaat

SEQ ID NO: 633189 - DNA, 25 bp, Rattus norvegicus
tggccagggctgatgtgtcaatcac

SEQ ID NO: 633190 - DNA, 25 bp, Rattus norvegicus
tggccagggctgttgtgtcaatcac

SEQ ID NO: 633191 - DNA, 25 bp, Rattus norvegicus
tggccaggtagacgtcgatgggcac

SEQ ID NO: 633192 - DNA, 25 bp, Rattus norvegicus
tggccaggtagaggtcgatgggcac

SEQ ID NO: 633193 - DNA, 25 bp, Rattus norvegicus
tggccaggtcataccggttgtccaa

SEQ ID NO: 633194 - DNA, 25 bp, Rattus norvegicus
tggccaggtcattccggttgtccaa

SEQ ID NO: 633195 - DNA, 25 bp, Rattus norvegicus
tggccaggtcctctactgtgaagga

SEQ ID NO: 633196 - DNA, 25 bp, Rattus norvegicus
tggccaggtcctgtactgtgaagga

SEQ ID NO: 633197 - DNA, 25 bp, Rattus norvegicus
tggccaggtgccaggaccgactccg

SEQ ID NO: 633198 - DNA, 25 bp, Rattus norvegicus
tggccaggtgcctggaccgactccg

SEQ ID NO: 633199 - DNA, 25 bp, Rattus norvegicus
tggccaggtgctattctgtcaaatt

SEQ ID NO: 633200 - DNA, 25 bp, Rattus norvegicus
tggccaggtgcttttctgtcaaatt

SEQ ID NO: 633201 - DNA, 25 bp, Rattus norvegicus
tggccagtagtccagatccagcagc

SEQ ID NO: 633202 - DNA, 25 bp, Rattus norvegicus
tggccagtagtcgagatccagcagc

SEQ ID NO: 633203 - DNA, 25 bp, Rattus norvegicus
tggccagtatgcagcttcagaagct

SEQ ID NO: 633204 - DNA, 25 bp, Rattus norvegicus
tggccagtatgctgcttcagaagct

SEQ ID NO: 633205 - DNA, 25 bp, Rattus norvegicus
tggccagtatggctgagacactcat

SEQ ID NO: 633206 - DNA, 25 bp, Rattus norvegicus
tggccagtatgggtgagacactcat

SEQ ID NO: 633207 - DNA, 25 bp, Rattus norvegicus
tggccagtattaacatttctatcct

SEQ ID NO: 633208 - DNA, 25 bp, Rattus norvegicus
tggccagtattatcatttctatcct

SEQ ID NO: 633209 - DNA, 25 bp, Rattus norvegicus
tggccagtccatcagagatctcacg

SEQ ID NO: 633210 - DNA, 25 bp, Rattus norvegicus
tggccagtccatgagagatctcacg

SEQ ID NO: 633211 - DNA, 25 bp, Rattus norvegicus
tggccagtctgcactttggtttatt

SEQ ID NO: 633212 - DNA, 25 bp, Rattus norvegicus
tggccagtctgctctttggtttatt

SEQ ID NO: 633213 - DNA, 25 bp, Rattus norvegicus
tggccagtgagcatgagggatctac

SEQ ID NO: 633214 - DNA, 25 bp, Rattus norvegicus
tggccagtgagcttgagggatctac

SEQ ID NO: 633215 - DNA, 25 bp, Rattus norvegicus
tggccagtgatgaccggattgactt

SEQ ID NO: 633216 - DNA, 25 bp, Rattus norvegicus
tggccagtgatgtccggattgactt

SEQ ID NO: 633217 - DNA, 25 bp, Rattus norvegicus
tggccagtgggacttccagaagcaa

SEQ ID NO: 633218 - DNA, 25 bp, Rattus norvegicus
tggccagtgggagttccagaagcaa

SEQ ID NO: 633219 - DNA, 25 bp, Rattus norvegicus
tggccagtgtccagggcccctgaca

SEQ ID NO: 633220 - DNA, 25 bp, Rattus norvegicus
tggccagtgtcctgggcccctgaca

SEQ ID NO: 633221 - DNA, 25 bp, Rattus norvegicus
tggccagtgtgcagtggactagtta

SEQ ID NO: 633222 - DNA, 25 bp, Rattus norvegicus
tggccagtgtgctgtggactagtta

SEQ ID NO: 633223 - DNA, 25 bp, Rattus norvegicus
tggccagttagactcgaccttagat

SEQ ID NO: 633224 - DNA, 25 bp, Rattus norvegicus
tggccagttagagtcgaccttagat

SEQ ID NO: 633225 - DNA, 25 bp, Rattus norvegicus
tggccagtttccattccctgggatt

SEQ ID NO: 633226 - DNA, 25 bp, Rattus norvegicus
tggccagtttcctttccctgggatt

SEQ ID NO: 633227 - DNA, 25 bp, Rattus norvegicus
tggccagtttctaagtcactgaact

SEQ ID NO: 633228 - DNA, 25 bp, Rattus norvegicus
tggccagtttcttagtcactgaact

SEQ ID NO: 633229 - DNA, 25 bp, Rattus norvegicus
tggccagttttcagtgctttacata

SEQ ID NO: 633230 - DNA, 25 bp, Rattus norvegicus
tggccagttttctgtgctttacata

SEQ ID NO: 633231 - DNA, 25 bp, Rattus norvegicus
tggccataatgtctgtctcctgcgt

SEQ ID NO: 633232 - DNA, 25 bp, Rattus norvegicus
tggccataatgtgtgtctcctgcgt

SEQ ID NO: 633233 - DNA, 25 bp, Rattus norvegicus
tggccataggtgactgtcgctgtgc

SEQ ID NO: 633234 - DNA, 25 bp, Rattus norvegicus
tggccataggtgtctgtcgctgtgc

SEQ ID NO: 633235 - DNA, 25 bp, Rattus norvegicus
tggccatagtgcctaaagcttccct

SEQ ID NO: 633236 - DNA, 25 bp, Rattus norvegicus
tggccatagtgcgtaaagcttccct

SEQ ID NO: 633237 - DNA, 25 bp, Rattus norvegicus
tggccatcaagccagatttcctcag

SEQ ID NO: 633238 - DNA, 25 bp, Rattus norvegicus
tggccatcaagcgagatttcctcag

SEQ ID NO: 633239 - DNA, 25 bp, Rattus norvegicus
tggccatcaatgacctgtctgtggt

SEQ ID NO: 633240 - DNA, 25 bp, Rattus norvegicus
tggccatcaatgtcctgtctgtggt

SEQ ID NO: 633241 - DNA, 25 bp, Rattus norvegicus
tggccatcagatactaacataaagt

SEQ ID NO: 633242 - DNA, 25 bp, Rattus norvegicus
tggccatcagattctaacataaagt

SEQ ID NO: 633243 - DNA, 25 bp, Rattus norvegicus
tggccatcagttcacacgtcatagt

SEQ ID NO: 633244 - DNA, 25 bp, Rattus norvegicus
tggccatcagttgacacgtcatagt

SEQ ID NO: 633245 - DNA, 25 bp, Rattus norvegicus
tggccatcatccaagcagacaactt

SEQ ID NO: 633246 - DNA, 25 bp, Rattus norvegicus
tggccatcatcctagcagacaactt

SEQ ID NO: 633247 - DNA, 25 bp, Rattus norvegicus
tggccatcattgcaattgtggtggc

SEQ ID NO: 633248 - DNA, 25 bp, Rattus norvegicus
tggccatcattggaattgtggtggc

SEQ ID NO: 633249 - DNA, 25 bp, Rattus norvegicus
tggccatccaggaagtgttccgacg

SEQ ID NO: 633250 - DNA, 25 bp, Rattus norvegicus
tggccatccaggtagtgttccgacg

SEQ ID NO: 633251 - DNA, 25 bp, Rattus norvegicus
tggccatcctctaggacagcaaggg

SEQ ID NO: 633252 - DNA, 25 bp, Rattus norvegicus
tggccatcctcttggacagcaaggg

SEQ ID NO: 633253 - DNA, 25 bp, Rattus norvegicus
tggccatcctggcacaacctggaag

SEQ ID NO: 633254 - DNA, 25 bp, Rattus norvegicus
tggccatcctgggacaacctggaag

SEQ ID NO: 633255 - DNA, 25 bp, Rattus norvegicus
tggccatcgaccacctgaatgaaga

SEQ ID NO: 633256 - DNA, 25 bp, Rattus norvegicus
tggccatcgacctcctgaatgaaga

SEQ ID NO: 633257 - DNA, 25 bp, Rattus norvegicus
tggccatcggccaagtgcacaatgg

SEQ ID NO: 633258 - DNA, 25 bp, Rattus norvegicus
tggccatcggcctagtgcacaatgg

SEQ ID NO: 633259 - DNA, 25 bp, Rattus norvegicus
tggccatctccgagaacacttgaaa

SEQ ID NO: 633260 - DNA, 25 bp, Rattus norvegicus
tggccatctccgtgaacacttgaaa

SEQ ID NO: 633261 - DNA, 25 bp, Rattus norvegicus
tggccatctggacgtcttgcatcag

SEQ ID NO: 633262 - DNA, 25 bp, Rattus norvegicus
tggccatctggaggtcttgcatcag

SEQ ID NO: 633263 - DNA, 25 bp, Rattus norvegicus
tggccatcttaaactcacttttcct

SEQ ID NO: 633264 - DNA, 25 bp, Rattus norvegicus
tggccatcttaatctcacttttcct

SEQ ID NO: 633265 - DNA, 25 bp, Rattus norvegicus
tggccatcttagcatcaaccaagac

SEQ ID NO: 633266 - DNA, 25 bp, Rattus norvegicus
tggccatcttaggatcaaccaagac

SEQ ID NO: 633267 - DNA, 25 bp, Rattus norvegicus
tggccatcttccaagtgcccgatga

SEQ ID NO: 633268 - DNA, 25 bp, Rattus norvegicus
tggccatcttcctagtgcccgatga

SEQ ID NO: 633269 - DNA, 25 bp, Rattus norvegicus
tggccatctttgagtgtgtctgcat

SEQ ID NO: 633270 - DNA, 25 bp, Rattus norvegicus
tggccatctttgtgtgtgtctgcat

SEQ ID NO: 633271 - DNA, 25 bp, Rattus norvegicus
tggccatgagggactgttgcttgaa

SEQ ID NO: 633272 - DNA, 25 bp, Rattus norvegicus
tggccatgagggtctgttgcttgaa

SEQ ID NO: 633273 - DNA, 25 bp, Rattus norvegicus
tggccatgcagcctgacattcaaat

SEQ ID NO: 633274 - DNA, 25 bp, Rattus norvegicus
tggccatgcagcgtgacattcaaat

SEQ ID NO: 633275 - DNA, 25 bp, Rattus norvegicus
tggccatgctgcaggagcacgtaga

SEQ ID NO: 633276 - DNA, 25 bp, Rattus norvegicus
tggccatgctgctggagcacgtaga

SEQ ID NO: 633277 - DNA, 25 bp, Rattus norvegicus
tggccatgctgtagggaccacagat

SEQ ID NO: 633278 - DNA, 25 bp, Rattus norvegicus
tggccatgctgttgggaccacagat

SEQ ID NO: 633279 - DNA, 25 bp, Rattus norvegicus
tggccatggctcaaaggaggtgaaa

SEQ ID NO: 633280 - DNA, 25 bp, Rattus norvegicus
tggccatggctctaaggaggtgaaa

SEQ ID NO: 633281 - DNA, 25 bp, Rattus norvegicus
tggccatggtttccagaggacgtct

SEQ ID NO: 633282 - DNA, 25 bp, Rattus norvegicus
tggccatggtttgcagaggacgtct

SEQ ID NO: 633283 - DNA, 25 bp, Rattus norvegicus
tggccatgtcgccttttgggagcct

SEQ ID NO: 633284 - DNA, 25 bp, Rattus norvegicus
tggccatgtcgcgttttgggagcct

SEQ ID NO: 633285 - DNA, 25 bp, Rattus norvegicus
tggccatgtgacctatcagcccagc

SEQ ID NO: 633286 - DNA, 25 bp, Rattus norvegicus
tggccatgtgacgtatcagcccagc

SEQ ID NO: 633287 - DNA, 25 bp, Rattus norvegicus
tggccatgtgccctcttacttgtgt

SEQ ID NO: 633288 - DNA, 25 bp, Rattus norvegicus
tggccatgtgccgtcttacttgtgt

SEQ ID NO: 633289 - DNA, 25 bp, Rattus norvegicus
tggccatgtgctccacctgtacaat

SEQ ID NO: 633290 - DNA, 25 bp, Rattus norvegicus
tggccatgtgctgcacctgtacaat

SEQ ID NO: 633291 - DNA, 25 bp, Rattus norvegicus
tggccattactacactttttacttt

SEQ ID NO: 633292 - DNA, 25 bp, Rattus norvegicus
tggccattactagactttttacttt

SEQ ID NO: 633293 - DNA, 25 bp, Rattus norvegicus
tggccattagcacacaacattcttg

SEQ ID NO: 633294 - DNA, 25 bp, Rattus norvegicus
tggccattagcagacaacattcttg

SEQ ID NO: 633295 - DNA, 25 bp, Rattus norvegicus
tggccattagttactttcccttgtg

SEQ ID NO: 633296 - DNA, 25 bp, Rattus norvegicus
tggccattagtttctttcccttgtg

SEQ ID NO: 633297 - DNA, 25 bp, Rattus norvegicus
tggccattattccagctgtgatcat

SEQ ID NO: 633298 - DNA, 25 bp, Rattus norvegicus
tggccattattcgagctgtgatcat

SEQ ID NO: 633299 - DNA, 25 bp, Rattus norvegicus
tggccattcacacctgtctgtgact

SEQ ID NO: 633300 - DNA, 25 bp, Rattus norvegicus
tggccattcacagctgtctgtgact

SEQ ID NO: 633301 - DNA, 25 bp, Rattus norvegicus
tggccattcatcactgggtgtgcca

SEQ ID NO: 633302 - DNA, 25 bp, Rattus norvegicus
tggccattcatctctgggtgtgcca

SEQ ID NO: 633303 - DNA, 25 bp, Rattus norvegicus
tggccattccataacaagcttcaag

SEQ ID NO: 633304 - DNA, 25 bp, Rattus norvegicus
tggccattccattacaagcttcaag

SEQ ID NO: 633305 - DNA, 25 bp, Rattus norvegicus
tggccattcctaccccatcaaaaaa

SEQ ID NO: 633306 - DNA, 25 bp, Rattus norvegicus
tggccattcctagcccatcaaaaaa

SEQ ID NO: 633307 - DNA, 25 bp, Rattus norvegicus
tggccattcctgatgaagcgttcta

SEQ ID NO: 633308 - DNA, 25 bp, Rattus norvegicus
tggccattcctgttgaagcgttcta

SEQ ID NO: 633309 - DNA, 25 bp, Rattus norvegicus
tggccattctaaacacttcgaggga

SEQ ID NO: 633310 - DNA, 25 bp, Rattus norvegicus
tggccattctaatcacttcgaggga

SEQ ID NO: 633311 - DNA, 25 bp, Rattus norvegicus
tggccattgctgagtattccagaaa

SEQ ID NO: 633312 - DNA, 25 bp, Rattus norvegicus
tggccattgctgtgtattccagaaa

SEQ ID NO: 633313 - DNA, 25 bp, Rattus norvegicus
tggccattggaacacgcaggttgct

SEQ ID NO: 633314 - DNA, 25 bp, Rattus norvegicus
tggccattggaagacgcaggttgct

SEQ ID NO: 633315 - DNA, 25 bp, Rattus norvegicus
tggccattggtgagtgctcctacat

SEQ ID NO: 633316 - DNA, 25 bp, Rattus norvegicus
tggccattggtgtgtgctcctacat

SEQ ID NO: 633317 - DNA, 25 bp, Rattus norvegicus
tggccattgttaattccagtcaaaa

SEQ ID NO: 633318 - DNA, 25 bp, Rattus norvegicus
tggccattgttatttccagtcaaaa

SEQ ID NO: 633319 - DNA, 25 bp, Rattus norvegicus
tggccatttacacagcacatcattc

SEQ ID NO: 633320 - DNA, 25 bp, Rattus norvegicus
tggccatttacagagcacatcattc

SEQ ID NO: 633321 - DNA, 25 bp, Rattus norvegicus
tggccatttgacagacctgggtctt

SEQ ID NO: 633322 - DNA, 25 bp, Rattus norvegicus
tggccatttgactgacctgggtctt

SEQ ID NO: 633323 - DNA, 25 bp, Rattus norvegicus
tggccatttgatcacggagctccgc

SEQ ID NO: 633324 - DNA, 25 bp, Rattus norvegicus
tggccatttgatgacggagctccgc

SEQ ID NO: 633325 - DNA, 25 bp, Rattus norvegicus
tggccatttggcatttaagtaccac

SEQ ID NO: 633326 - DNA, 25 bp, Rattus norvegicus
tggccatttggcttttaagtaccac

SEQ ID NO: 633327 - DNA, 25 bp, Rattus norvegicus
tggccatttgttattccaagcaaac

SEQ ID NO: 633328 - DNA, 25 bp, Rattus norvegicus
tggccatttgtttttccaagcaaac

SEQ ID NO: 633329 - DNA, 25 bp, Rattus norvegicus
tggccattttatctcactccatgtg

SEQ ID NO: 633330 - DNA, 25 bp, Rattus norvegicus
tggccattttatgtcactccatgtg

SEQ ID NO: 633331 - DNA, 25 bp, Rattus norvegicus
tggcccaaaactcctctctttgtgt

SEQ ID NO: 633332 - DNA, 25 bp, Rattus norvegicus
tggcccaaaactgctctctttgtgt

SEQ ID NO: 633333 - DNA, 25 bp, Rattus norvegicus
tggcccaaacatcctgtctttgtat

SEQ ID NO: 633334 - DNA, 25 bp, Rattus norvegicus
tggcccaaacatgctgtctttgtat

SEQ ID NO: 633335 - DNA, 25 bp, Rattus norvegicus
tggcccaaacttatatacctgctag

SEQ ID NO: 633336 - DNA, 25 bp, Rattus norvegicus
tggcccaaacttttatacctgctag

SEQ ID NO: 633337 - DNA, 25 bp, Rattus norvegicus
tggcccaaaggcagtgccgactgaa

SEQ ID NO: 633338 - DNA, 25 bp, Rattus norvegicus
tggcccaaaggctgtgccgactgaa

SEQ ID NO: 633339 - DNA, 25 bp, Rattus norvegicus
tggcccaacagaatcacccactgtg

SEQ ID NO: 633340 - DNA, 25 bp, Rattus norvegicus
tggcccaacagattcacccactgtg

SEQ ID NO: 633341 - DNA, 25 bp, Rattus norvegicus
tggcccaacccaatatccatgagta

SEQ ID NO: 633342 - DNA, 25 bp, Rattus norvegicus
tggcccaacccattatccatgagta

SEQ ID NO: 633343 - DNA, 25 bp, Rattus norvegicus
tggcccaacctcagttgttgctgct

SEQ ID NO: 633344 - DNA, 25 bp, Rattus norvegicus
tggcccaacctctgttgttgctgct

SEQ ID NO: 633345 - DNA, 25 bp, Rattus norvegicus
tggcccaacgtacatgctcacagtg

SEQ ID NO: 633346 - DNA, 25 bp, Rattus norvegicus
tggcccaacgtagatgctcacagtg

SEQ ID NO: 633347 - DNA, 25 bp, Rattus norvegicus
tggcccaagatgctctggttacatt

SEQ ID NO: 633348 - DNA, 25 bp, Rattus norvegicus
tggcccaagatggtctggttacatt

SEQ ID NO: 633349 - DNA, 25 bp, Rattus norvegicus
tggcccaagcatcttaaggtctaaa

SEQ ID NO: 633350 - DNA, 25 bp, Rattus norvegicus
tggcccaagcatgttaaggtctaaa

SEQ ID NO: 633351 - DNA, 25 bp, Rattus norvegicus
tggcccaaggctctggaagagaact

SEQ ID NO: 633352 - DNA, 25 bp, Rattus norvegicus
tggcccaaggctgtggaagagaact

SEQ ID NO: 633353 - DNA, 25 bp, Rattus norvegicus
tggcccaatggcagaccgcagtaaa

SEQ ID NO: 633354 - DNA, 25 bp, Rattus norvegicus
tggcccaatggctgaccgcagtaaa

SEQ ID NO: 633355 - DNA, 25 bp, Rattus norvegicus
tggcccacaaccaatgtcacaatgt

SEQ ID NO: 633356 - DNA, 25 bp, Rattus norvegicus
tggcccacaacctatgtcacaatgt

SEQ ID NO: 633357 - DNA, 25 bp, Rattus norvegicus
tggcccaccacgagtcacagaagcg

SEQ ID NO: 633358 - DNA, 25 bp, Rattus norvegicus
tggcccaccacgtgtcacagaagcg

SEQ ID NO: 633359 - DNA, 25 bp, Rattus norvegicus
tggcccacccgcaggcagggaggaa

SEQ ID NO: 633360 - DNA, 25 bp, Rattus norvegicus
tggcccacccgctggcagggaggaa

SEQ ID NO: 633361 - DNA, 25 bp, Rattus norvegicus
tggcccacgatgctgatgcccagga

SEQ ID NO: 633362 - DNA, 25 bp, Rattus norvegicus
tggcccacgatggtgatgcccagga

SEQ ID NO: 633363 - DNA, 25 bp, Rattus norvegicus
tggcccacgtagctgaactgacaat

SEQ ID NO: 633364 - DNA, 25 bp, Rattus norvegicus
tggcccacgtaggtgaactgacaat

SEQ ID NO: 633365 - DNA, 25 bp, Rattus norvegicus
tggcccacgtttcgttctgtgagga

SEQ ID NO: 633366 - DNA, 25 bp, Rattus norvegicus
tggcccacgtttggttctgtgagga

SEQ ID NO: 633367 - DNA, 25 bp, Rattus norvegicus
tggcccactgggaaaacacacttgc

SEQ ID NO: 633368 - DNA, 25 bp, Rattus norvegicus
tggcccactgggtaaacacacttgc

SEQ ID NO: 633369 - DNA, 25 bp, Rattus norvegicus
tggcccacttggacacaggtaactg

SEQ ID NO: 633370 - DNA, 25 bp, Rattus norvegicus
tggcccacttggtcacaggtaactg

SEQ ID NO: 633371 - DNA, 25 bp, Rattus norvegicus
tggcccagaaagctcggccaccgag

SEQ ID NO: 633372 - DNA, 25 bp, Rattus norvegicus
tggcccagaaaggtcggccaccgag

SEQ ID NO: 633373 - DNA, 25 bp, Rattus norvegicus
tggcccagaaccctgctctgtggtg

SEQ ID NO: 633374 - DNA, 25 bp, Rattus norvegicus
tggcccagaaccgtgctctgtggtg

SEQ ID NO: 633375 - DNA, 25 bp, Rattus norvegicus
tggcccagacacagaaaggttacct

SEQ ID NO: 633376 - DNA, 25 bp, Rattus norvegicus
tggcccagacactgaaaggttacct

SEQ ID NO: 633377 - DNA, 25 bp, Rattus norvegicus
tggcccagagctatatcacgggtat

SEQ ID NO: 633378 - DNA, 25 bp, Rattus norvegicus
tggcccagagctttatcacgggtat

SEQ ID NO: 633379 - DNA, 25 bp, Rattus norvegicus
tggcccagagtcacacagttaggag

SEQ ID NO: 633380 - DNA, 25 bp, Rattus norvegicus
tggcccagagtctcacagttaggag

SEQ ID NO: 633381 - DNA, 25 bp, Rattus norvegicus
tggcccagatagacattcaggtttt

SEQ ID NO: 633382 - DNA, 25 bp, Rattus norvegicus
tggcccagatagtcattcaggtttt

SEQ ID NO: 633383 - DNA, 25 bp, Rattus norvegicus
tggcccagcattccagatgtcaggg

SEQ ID NO: 633384 - DNA, 25 bp, Rattus norvegicus
tggcccagcattgcagatgtcaggg

SEQ ID NO: 633385 - DNA, 25 bp, Rattus norvegicus
tggcccagccagcagtctttaagag

SEQ ID NO: 633386 - DNA, 25 bp, Rattus norvegicus
tggcccagccaggagtctttaagag

SEQ ID NO: 633387 - DNA, 25 bp, Rattus norvegicus
tggcccagcccaaaattcgaaagga

SEQ ID NO: 633388 - DNA, 25 bp, Rattus norvegicus
tggcccagcccataattcgaaagga

SEQ ID NO: 633389 - DNA, 25 bp, Rattus norvegicus
tggcccagctgacctgccaggagaa

SEQ ID NO: 633390 - DNA, 25 bp, Rattus norvegicus
tggcccagctgagctgccaggagaa

SEQ ID NO: 633391 - DNA, 25 bp, Rattus norvegicus
tggcccagctgtccttagctcagaa

SEQ ID NO: 633392 - DNA, 25 bp, Rattus norvegicus
tggcccagctgtgcttagctcagaa

SEQ ID NO: 633393 - DNA, 25 bp, Rattus norvegicus
tggcccaggacgaccatgagtatta

SEQ ID NO: 633394 - DNA, 25 bp, Rattus norvegicus
tggcccaggacgtccatgagtatta

SEQ ID NO: 633395 - DNA, 25 bp, Rattus norvegicus
tggcccaggcaaccattgacaggaa

SEQ ID NO: 633396 - DNA, 25 bp, Rattus norvegicus
tggcccaggcaagcattgacaggaa

SEQ ID NO: 633397 - DNA, 25 bp, Rattus norvegicus
tggcccaggcacaggacgagccacg

SEQ ID NO: 633398 - DNA, 25 bp, Rattus norvegicus
tggcccaggcactggacgagccacg

SEQ ID NO: 633399 - DNA, 25 bp, Rattus norvegicus
tggcccagggcgataaatttacaga

SEQ ID NO: 633400 - DNA, 25 bp, Rattus norvegicus
tggcccagggcgttaaatttacaga

SEQ ID NO: 633401 - DNA, 25 bp, Rattus norvegicus
tggcccagggctcttctcactgctt

SEQ ID NO: 633402 - DNA, 25 bp, Rattus norvegicus
tggcccagggctgttctcactgctt

SEQ ID NO: 633403 - DNA, 25 bp, Rattus norvegicus
tggcccaggtgacaagctacagtgc

SEQ ID NO: 633404 - DNA, 25 bp, Rattus norvegicus
tggcccaggtgagaagctacagtgc

SEQ ID NO: 633405 - DNA, 25 bp, Rattus norvegicus
tggcccagtcccagataggtttcat

SEQ ID NO: 633406 - DNA, 25 bp, Rattus norvegicus
tggcccagtccctgataggtttcat

SEQ ID NO: 633407 - DNA, 25 bp, Rattus norvegicus
tggcccagtgatcatgtctcttgag

SEQ ID NO: 633408 - DNA, 25 bp, Rattus norvegicus
tggcccagtgatgatgtctcttgag

SEQ ID NO: 633409 - DNA, 25 bp, Rattus norvegicus
tggcccagtggcaaacagcgtgttg

SEQ ID NO: 633410 - DNA, 25 bp, Rattus norvegicus
tggcccagtggctaacagcgtgttg

SEQ ID NO: 633411 - DNA, 25 bp, Rattus norvegicus
tggcccagtggtaagaattgaatac

SEQ ID NO: 633412 - DNA, 25 bp, Rattus norvegicus
tggcccagtggttagaattgaatac

SEQ ID NO: 633413 - DNA, 25 bp, Rattus norvegicus
tggcccagttggatgcatggcagca

SEQ ID NO: 633414 - DNA, 25 bp, Rattus norvegicus
tggcccagttggttgcatggcagca

SEQ ID NO: 633415 - DNA, 25 bp, Rattus norvegicus
tggcccatattacccactgtgctga

SEQ ID NO: 633416 - DNA, 25 bp, Rattus norvegicus
tggcccatattagccactgtgctga

SEQ ID NO: 633417 - DNA, 25 bp, Rattus norvegicus
tggcccatcatgactcgagaggaag

SEQ ID NO: 633418 - DNA, 25 bp, Rattus norvegicus
tggcccatcatgtctcgagaggaag

SEQ ID NO: 633419 - DNA, 25 bp, Rattus norvegicus
tggcccatccatcgctttgtgacac

SEQ ID NO: 633420 - DNA, 25 bp, Rattus norvegicus
tggcccatccatctactattgaaat

SEQ ID NO: 633421 - DNA, 25 bp, Rattus norvegicus
tggcccatccatggctttgtgacac

SEQ ID NO: 633422 - DNA, 25 bp, Rattus norvegicus
tggcccatccatgtactattgaaat

SEQ ID NO: 633423 - DNA, 25 bp, Rattus norvegicus
tggcccatcgctcgatagagcaact

SEQ ID NO: 633424 - DNA, 25 bp, Rattus norvegicus
tggcccatcgctggatagagcaact

SEQ ID NO: 633425 - DNA, 25 bp, Rattus norvegicus
tggcccatctccaacagcaatggag

SEQ ID NO: 633426 - DNA, 25 bp, Rattus norvegicus
tggcccatctcctacagcaatggag

SEQ ID NO: 633427 - DNA, 25 bp, Rattus norvegicus
tggcccatctgccttctgctctgag

SEQ ID NO: 633428 - DNA, 25 bp, Rattus norvegicus
tggcccatctgcgttctgctctgag

SEQ ID NO: 633429 - DNA, 25 bp, Rattus norvegicus
tggcccatgagcatctaaggattct

SEQ ID NO: 633430 - DNA, 25 bp, Rattus norvegicus
tggcccatgagcttctaaggattct

SEQ ID NO: 633431 - DNA, 25 bp, Rattus norvegicus
tggcccatgatcaacggacatctgg

SEQ ID NO: 633432 - DNA, 25 bp, Rattus norvegicus
tggcccatgatctacggacatctgg

SEQ ID NO: 633433 - DNA, 25 bp, Rattus norvegicus
tggcccatgcctagacagaaaaatc

SEQ ID NO: 633434 - DNA, 25 bp, Rattus norvegicus
tggcccatgccttgacagaaaaatc

SEQ ID NO: 633435 - DNA, 25 bp, Rattus norvegicus
tggcccatgctacaggattctttat

SEQ ID NO: 633436 - DNA, 25 bp, Rattus norvegicus
tggcccatgctagaggattctttat

SEQ ID NO: 633437 - DNA, 25 bp, Rattus norvegicus
tggcccatggaaccctgctgatgat

SEQ ID NO: 633438 - DNA, 25 bp, Rattus norvegicus
tggcccatggaagcctgctgatgat

SEQ ID NO: 633439 - DNA, 25 bp, Rattus norvegicus
tggcccatgtcacatctcagatgag

SEQ ID NO: 633440 - DNA, 25 bp, Rattus norvegicus
tggcccatgtcagatctcagatgag

SEQ ID NO: 633441 - DNA, 25 bp, Rattus norvegicus
tggcccattggtaactcctgctaaa

SEQ ID NO: 633442 - DNA, 25 bp, Rattus norvegicus
tggcccattggtacccaagcttttt

SEQ ID NO: 633443 - DNA, 25 bp, Rattus norvegicus
tggcccattggttactcctgctaaa

SEQ ID NO: 633444 - DNA, 25 bp, Rattus norvegicus
tggcccattggttcccaagcttttt

SEQ ID NO: 633445 - DNA, 25 bp, Rattus norvegicus
tggcccattgtaccctctgattatg

SEQ ID NO: 633446 - DNA, 25 bp, Rattus norvegicus
tggcccattgtagcctctgattatg

SEQ ID NO: 633447 - DNA, 25 bp, Rattus norvegicus
tggcccattttcctgacacatacat

SEQ ID NO: 633448 - DNA, 25 bp, Rattus norvegicus
tggcccattttcgtgacacatacat

SEQ ID NO: 633449 - DNA, 25 bp, Rattus norvegicus
tggccccaaacacgtagcatttgtt

SEQ ID NO: 633450 - DNA, 25 bp, Rattus norvegicus
tggccccaaacaggtagcatttgtt

SEQ ID NO: 633451 - DNA, 25 bp, Rattus norvegicus
tggccccaatccctggaaccagtta

SEQ ID NO: 633452 - DNA, 25 bp, Rattus norvegicus
tggccccaatccgtggaaccagtta

SEQ ID NO: 633453 - DNA, 25 bp, Rattus norvegicus
tggccccacacaaagttcagaggta

SEQ ID NO: 633454 - DNA, 25 bp, Rattus norvegicus
tggccccacacatagttcagaggta

SEQ ID NO: 633455 - DNA, 25 bp, Rattus norvegicus
tggccccacatccagaatacctgtt

SEQ ID NO: 633456 - DNA, 25 bp, Rattus norvegicus
tggccccacatcgagaatacctgtt

SEQ ID NO: 633457 - DNA, 25 bp, Rattus norvegicus
tggccccagcacagggaaccagaga

SEQ ID NO: 633458 - DNA, 25 bp, Rattus norvegicus
tggccccagcactgggaaccagaga

SEQ ID NO: 633459 - DNA, 25 bp, Rattus norvegicus
tggccccagcatcgactctatggaa

SEQ ID NO: 633460 - DNA, 25 bp, Rattus norvegicus
tggccccagcatggactctatggaa

SEQ ID NO: 633461 - DNA, 25 bp, Rattus norvegicus
tggccccaggatctctttggaatta

SEQ ID NO: 633462 - DNA, 25 bp, Rattus norvegicus
tggccccaggatgtctttggaatta

SEQ ID NO: 633463 - DNA, 25 bp, Rattus norvegicus
tggccccaggcgattttatacagca

SEQ ID NO: 633464 - DNA, 25 bp, Rattus norvegicus
tggccccaggcgtttttatacagca

SEQ ID NO: 633465 - DNA, 25 bp, Rattus norvegicus
tggccccagtgcagtcattatggct

SEQ ID NO: 633466 - DNA, 25 bp, Rattus norvegicus
tggccccagtgctgtcattatggct

SEQ ID NO: 633467 - DNA, 25 bp, Rattus norvegicus
tggcccccagaaagactcttgagga

SEQ ID NO: 633468 - DNA, 25 bp, Rattus norvegicus
tggcccccagaatgactcttgagga

SEQ ID NO: 633469 - DNA, 25 bp, Rattus norvegicus
tggcccccctatcaggaagttaact

SEQ ID NO: 633470 - DNA, 25 bp, Rattus norvegicus
tggcccccctatgaggaagttaact

SEQ ID NO: 633471 - DNA, 25 bp, Rattus norvegicus
tggccccgaaacactcaggagctaa

SEQ ID NO: 633472 - DNA, 25 bp, Rattus norvegicus
tggccccgaaactctcaggagctaa

SEQ ID NO: 633473 - DNA, 25 bp, Rattus norvegicus
tggccccgcaacattttcgggtctt

SEQ ID NO: 633474 - DNA, 25 bp, Rattus norvegicus
tggccccgcaactttttcgggtctt

SEQ ID NO: 633475 - DNA, 25 bp, Rattus norvegicus
tggccccggcgccagggatgaatga

SEQ ID NO: 633476 - DNA, 25 bp, Rattus norvegicus
tggccccggcgcgagggatgaatga

SEQ ID NO: 633477 - DNA, 25 bp, Rattus norvegicus
tggccccgtctgatgtgtactaata

SEQ ID NO: 633478 - DNA, 25 bp, Rattus norvegicus
tggccccgtctgttgtgtactaata

SEQ ID NO: 633479 - DNA, 25 bp, Rattus norvegicus
tggccccgtttcataagtgactagg

SEQ ID NO: 633480 - DNA, 25 bp, Rattus norvegicus
tggccccgtttcttaagtgactagg

SEQ ID NO: 633481 - DNA, 25 bp, Rattus norvegicus
tggcccctcagccttgtttaaggtg

SEQ ID NO: 633482 - DNA, 25 bp, Rattus norvegicus
tggcccctcagcgttgtttaaggtg

SEQ ID NO: 633483 - DNA, 25 bp, Rattus norvegicus
tggcccctcattagattgttgctgt

SEQ ID NO: 633484 - DNA, 25 bp, Rattus norvegicus
tggcccctcatttgattgttgctgt

SEQ ID NO: 633485 - DNA, 25 bp, Rattus norvegicus
tggcccctcccactgaggtcacgct

SEQ ID NO: 633486 - DNA, 25 bp, Rattus norvegicus
tggcccctcccagtgaggtcacgct

SEQ ID NO: 633487 - DNA, 25 bp, Rattus norvegicus
tggcccctccccagtggaaacaata

SEQ ID NO: 633488 - DNA, 25 bp, Rattus norvegicus
tggcccctcccctgtggaaacaata

SEQ ID NO: 633489 - DNA, 25 bp, Rattus norvegicus
tggcccctcgatatgttctgttcct

SEQ ID NO: 633490 - DNA, 25 bp, Rattus norvegicus
tggcccctcgatttgttctgttcct

SEQ ID NO: 633491 - DNA, 25 bp, Rattus norvegicus
tggcccctctaaccagaattgacta

SEQ ID NO: 633492 - DNA, 25 bp, Rattus norvegicus
tggcccctctaagcagaattgacta

SEQ ID NO: 633493 - DNA, 25 bp, Rattus norvegicus
tggcccctctcgcaagaaagcgtaa

SEQ ID NO: 633494 - DNA, 25 bp, Rattus norvegicus
tggcccctctcggaagaaagcgtaa

SEQ ID NO: 633495 - DNA, 25 bp, Rattus norvegicus
tggcccctctttagtgaagctgcag

SEQ ID NO: 633496 - DNA, 25 bp, Rattus norvegicus
tggcccctcttttgtgaagctgcag

SEQ ID NO: 633497 - DNA, 25 bp, Rattus norvegicus
tggcccctgacgacatgctgaagac

SEQ ID NO: 633498 - DNA, 25 bp, Rattus norvegicus
tggcccctgacgtcatgctgaagac

SEQ ID NO: 633499 - DNA, 25 bp, Rattus norvegicus
tggcccctgatacacctcataatga

SEQ ID NO: 633500 - DNA, 25 bp, Rattus norvegicus
tggcccctgatagacctcataatga

SEQ ID NO: 633501 - DNA, 25 bp, Rattus norvegicus
tggcccctgcgtatttggtggagcc

SEQ ID NO: 633502 - DNA, 25 bp, Rattus norvegicus
tggcccctgcgtttttggtggagcc

SEQ ID NO: 633503 - DNA, 25 bp, Rattus norvegicus
tggcccctgctacgtatgtgcttgc

SEQ ID NO: 633504 - DNA, 25 bp, Rattus norvegicus
tggcccctgctaggtatgtgcttgc

SEQ ID NO: 633505 - DNA, 25 bp, Rattus norvegicus
tggcccctggcaactatgggtagat

SEQ ID NO: 633506 - DNA, 25 bp, Rattus norvegicus
tggcccctggcatctatgggtagat

SEQ ID NO: 633507 - DNA, 25 bp, Rattus norvegicus
tggcccctggctctgactatctgta

SEQ ID NO: 633508 - DNA, 25 bp, Rattus norvegicus
tggcccctggctgtgactatctgta

SEQ ID NO: 633509 - DNA, 25 bp, Rattus norvegicus
tggcccctggtgactgttctcataa

SEQ ID NO: 633510 - DNA, 25 bp, Rattus norvegicus
tggcccctggtgtctgttctcataa

SEQ ID NO: 633511 - DNA, 25 bp, Rattus norvegicus
tggcccctgtttcatctggattaag

SEQ ID NO: 633512 - DNA, 25 bp, Rattus norvegicus
tggcccctgtttgatctggattaag

SEQ ID NO: 633513 - DNA, 25 bp, Rattus norvegicus
tggccccttgcacgaagagctctgg

SEQ ID NO: 633514 - DNA, 25 bp, Rattus norvegicus
tggccccttgcaggaagagctctgg

SEQ ID NO: 633515 - DNA, 25 bp, Rattus norvegicus
tggcccctttctacagacttggaaa

SEQ ID NO: 633516 - DNA, 25 bp, Rattus norvegicus
tggcccctttcttcagacttggaaa

SEQ ID NO: 633517 - DNA, 25 bp, Rattus norvegicus
tggcccctttggacataaaccctag

SEQ ID NO: 633518 - DNA, 25 bp, Rattus norvegicus
tggcccctttggtcataaaccctag

SEQ ID NO: 633519 - DNA, 25 bp, Rattus norvegicus
tggcccgaagctcttcccaggagag

SEQ ID NO: 633520 - DNA, 25 bp, Rattus norvegicus
tggcccgaagctgttcccaggagag

SEQ ID NO: 633521 - DNA, 25 bp, Rattus norvegicus
tggcccgaatgacgcgattcagtgt

SEQ ID NO: 633522 - DNA, 25 bp, Rattus norvegicus
tggcccgaatgaggcgattcagtgt

SEQ ID NO: 633523 - DNA, 25 bp, Rattus norvegicus
tggcccgagtgcagaagctttactg

SEQ ID NO: 633524 - DNA, 25 bp, Rattus norvegicus
tggcccgagtgctgaagctttactg

SEQ ID NO: 633525 - DNA, 25 bp, Rattus norvegicus
tggcccgcatggaattgtttctgct

SEQ ID NO: 633526 - DNA, 25 bp, Rattus norvegicus
tggcccgcatggtattgtttctgct

SEQ ID NO: 633527 - DNA, 25 bp, Rattus norvegicus
tggcccgcattaattctaaaccgtt

SEQ ID NO: 633528 - DNA, 25 bp, Rattus norvegicus
tggcccgcattatttctaaaccgtt

SEQ ID NO: 633529 - DNA, 25 bp, Rattus norvegicus
tggcccgccagcctagtcattggga

SEQ ID NO: 633530 - DNA, 25 bp, Rattus norvegicus
tggcccgccagcgtagtcattggga

SEQ ID NO: 633531 - DNA, 25 bp, Rattus norvegicus
tggcccggatcactaagctcattga

SEQ ID NO: 633532 - DNA, 25 bp, Rattus norvegicus
tggcccggatcagtaagctcattga

SEQ ID NO: 633533 - DNA, 25 bp, Rattus norvegicus
tggcccgggtacaaggacaggtatc

SEQ ID NO: 633534 - DNA, 25 bp, Rattus norvegicus
tggcccgggtactaggacaggtatc

SEQ ID NO: 633535 - DNA, 25 bp, Rattus norvegicus
tggcccggtaggaagctttgatcta

SEQ ID NO: 633536 - DNA, 25 bp, Rattus norvegicus
tggcccggtaggtagctttgatcta

SEQ ID NO: 633537 - DNA, 25 bp, Rattus norvegicus
tggcccggtttgctgatcacataat

SEQ ID NO: 633538 - DNA, 25 bp, Rattus norvegicus
tggcccggtttggtgatcacataat

SEQ ID NO: 633539 - DNA, 25 bp, Rattus norvegicus
tggcccgtaagcaggtcatcatcga

SEQ ID NO: 633540 - DNA, 25 bp, Rattus norvegicus
tggcccgtaagctggtcatcatcga

SEQ ID NO: 633541 - DNA, 25 bp, Rattus norvegicus
tggcccgtgacaacttgctcaagac

SEQ ID NO: 633542 - DNA, 25 bp, Rattus norvegicus
tggcccgtgacatcttgctcaagac

SEQ ID NO: 633543 - DNA, 25 bp, Rattus norvegicus
tggcccgtgggtccattttacagat

SEQ ID NO: 633544 - DNA, 25 bp, Rattus norvegicus
tggcccgtgggtgcattttacagat

SEQ ID NO: 633545 - DNA, 25 bp, Rattus norvegicus
tggccctaaaggagtcttgtaccca

SEQ ID NO: 633546 - DNA, 25 bp, Rattus norvegicus
tggccctaaaggtgtcttgtaccca

SEQ ID NO: 633547 - DNA, 25 bp, Rattus norvegicus
tggccctacagcaagagacatgtct

SEQ ID NO: 633548 - DNA, 25 bp, Rattus norvegicus
tggccctacagctagagacatgtct

SEQ ID NO: 633549 - DNA, 25 bp, Rattus norvegicus
tggccctagcctagtgtatttcaca

SEQ ID NO: 633550 - DNA, 25 bp, Rattus norvegicus
tggccctagccttgtgtatttcaca

SEQ ID NO: 633551 - DNA, 25 bp, Rattus norvegicus
tggccctagcttaacctcaggatat

SEQ ID NO: 633552 - DNA, 25 bp, Rattus norvegicus
tggccctagctttacctcaggatat

SEQ ID NO: 633553 - DNA, 25 bp, Rattus norvegicus
tggccctataggatcagtccaggct

SEQ ID NO: 633554 - DNA, 25 bp, Rattus norvegicus
tggccctataggttcagtccaggct

SEQ ID NO: 633555 - DNA, 25 bp, Rattus norvegicus
tggccctatattatttgaagctgta

SEQ ID NO: 633556 - DNA, 25 bp, Rattus norvegicus
tggccctatattttttgaagctgta

SEQ ID NO: 633557 - DNA, 25 bp, Rattus norvegicus
tggccctatcttacttcatattcga

SEQ ID NO: 633558 - DNA, 25 bp, Rattus norvegicus
tggccctatctttcttcatattcga

SEQ ID NO: 633559 - DNA, 25 bp, Rattus norvegicus
tggccctcaactcggttaggaccat

SEQ ID NO: 633560 - DNA, 25 bp, Rattus norvegicus
tggccctcaactgggttaggaccat

SEQ ID NO: 633561 - DNA, 25 bp, Rattus norvegicus
tggccctcaagaacgacacagctgc

SEQ ID NO: 633562 - DNA, 25 bp, Rattus norvegicus
tggccctcaagatcgacacagctgc

SEQ ID NO: 633563 - DNA, 25 bp, Rattus norvegicus
tggccctcaagtacagagcgcatgc

SEQ ID NO: 633564 - DNA, 25 bp, Rattus norvegicus
tggccctcaagttcagagcgcatgc

SEQ ID NO: 633565 - DNA, 25 bp, Rattus norvegicus
tggccctcaatcatgaacagctgct

SEQ ID NO: 633566 - DNA, 25 bp, Rattus norvegicus
tggccctcaatcttgaacagctgct

SEQ ID NO: 633567 - DNA, 25 bp, Rattus norvegicus
tggccctcagctccatgaagagtct

SEQ ID NO: 633568 - DNA, 25 bp, Rattus norvegicus
tggccctcagctgcatgaagagtct

SEQ ID NO: 633569 - DNA, 25 bp, Rattus norvegicus
tggccctcagggagcttatcgagga

SEQ ID NO: 633570 - DNA, 25 bp, Rattus norvegicus
tggccctcagggtgcttatcgagga

SEQ ID NO: 633571 - DNA, 25 bp, Rattus norvegicus
tggccctcagtgctttttaactgtg

SEQ ID NO: 633572 - DNA, 25 bp, Rattus norvegicus
tggccctcagtggtttttaactgtg

SEQ ID NO: 633573 - DNA, 25 bp, Rattus norvegicus
tggccctcatacatacacagcaagt

SEQ ID NO: 633574 - DNA, 25 bp, Rattus norvegicus
tggccctcatacttacacagcaagt

SEQ ID NO: 633575 - DNA, 25 bp, Rattus norvegicus
tggccctcggtgaagaagatctgtc

SEQ ID NO: 633576 - DNA, 25 bp, Rattus norvegicus
tggccctcggtgtagaagatctgtc

SEQ ID NO: 633577 - DNA, 25 bp, Rattus norvegicus
tggccctcggttagatttttctgtt

SEQ ID NO: 633578 - DNA, 25 bp, Rattus norvegicus
tggccctcggtttgatttttctgtt

SEQ ID NO: 633579 - DNA, 25 bp, Rattus norvegicus
tggccctctactattatgtcactaa

SEQ ID NO: 633580 - DNA, 25 bp, Rattus norvegicus
tggccctctacttttatgtcactaa

SEQ ID NO: 633581 - DNA, 25 bp, Rattus norvegicus
tggccctctgacatagacactaaga

SEQ ID NO: 633582 - DNA, 25 bp, Rattus norvegicus
tggccctctgacttagacactaaga

SEQ ID NO: 633583 - DNA, 25 bp, Rattus norvegicus
tggccctctgcaaagactgcctata

SEQ ID NO: 633584 - DNA, 25 bp, Rattus norvegicus
tggccctctgcatagactgcctata

SEQ ID NO: 633585 - DNA, 25 bp, Rattus norvegicus
tggccctctggcaaggttctccaaa

SEQ ID NO: 633586 - DNA, 25 bp, Rattus norvegicus
tggccctctggctaggttctccaaa

SEQ ID NO: 633587 - DNA, 25 bp, Rattus norvegicus
tggccctctggtcgtaacttgtgtt

SEQ ID NO: 633588 - DNA, 25 bp, Rattus norvegicus
tggccctctggtggtaacttgtgtt

SEQ ID NO: 633589 - DNA, 25 bp, Rattus norvegicus
tggccctctgtaaagcctgcttgaa

SEQ ID NO: 633590 - DNA, 25 bp, Rattus norvegicus
tggccctctgtatagcctgcttgaa

SEQ ID NO: 633591 - DNA, 25 bp, Rattus norvegicus
tggccctgaagccagactctgagta

SEQ ID NO: 633592 - DNA, 25 bp, Rattus norvegicus
tggccctgaagcgagactctgagta

SEQ ID NO: 633593 - DNA, 25 bp, Rattus norvegicus
tggccctgaaggagccactccagtg

SEQ ID NO: 633594 - DNA, 25 bp, Rattus norvegicus
tggccctgaaggtgccactccagtg

SEQ ID NO: 633595 - DNA, 25 bp, Rattus norvegicus
tggccctgagacagcacatcacact

SEQ ID NO: 633596 - DNA, 25 bp, Rattus norvegicus
tggccctgagactgcacatcacact

SEQ ID NO: 633597 - DNA, 25 bp, Rattus norvegicus
tggccctgaggcacatacacagtgt

SEQ ID NO: 633598 - DNA, 25 bp, Rattus norvegicus
tggccctgaggctcatacacagtgt

SEQ ID NO: 633599 - DNA, 25 bp, Rattus norvegicus
tggccctgatccattggtaacaaat

SEQ ID NO: 633600 - DNA, 25 bp, Rattus norvegicus
tggccctgatcctttggtaacaaat

SEQ ID NO: 633601 - DNA, 25 bp, Rattus norvegicus
tggccctgcacacctgatatttgca

SEQ ID NO: 633602 - DNA, 25 bp, Rattus norvegicus
tggccctgcacagctgatatttgca

SEQ ID NO: 633603 - DNA, 25 bp, Rattus norvegicus
tggccctgcaggaggaagctgaacc

SEQ ID NO: 633604 - DNA, 25 bp, Rattus norvegicus
tggccctgcaggtggaagctgaacc

SEQ ID NO: 633605 - DNA, 25 bp, Rattus norvegicus
tggccctgccttatgctaaacgaaa

SEQ ID NO: 633606 - DNA, 25 bp, Rattus norvegicus
tggccctgccttttgctaaacgaaa

SEQ ID NO: 633607 - DNA, 25 bp, Rattus norvegicus
tggccctggactagcggttctcatg

SEQ ID NO: 633608 - DNA, 25 bp, Rattus norvegicus
tggccctggacttgcggttctcatg

SEQ ID NO: 633609 - DNA, 25 bp, Rattus norvegicus
tggccctggcagataacctgggtgt

SEQ ID NO: 633610 - DNA, 25 bp, Rattus norvegicus
tggccctggcagttaacctgggtgt

SEQ ID NO: 633611 - DNA, 25 bp, Rattus norvegicus
tggccctggccaagcaagagattgc

SEQ ID NO: 633612 - DNA, 25 bp, Rattus norvegicus
tggccctggccatgcaagagattgc

SEQ ID NO: 633613 - DNA, 25 bp, Rattus norvegicus
tggccctggttcatagcccagcttt

SEQ ID NO: 633614 - DNA, 25 bp, Rattus norvegicus
tggccctggttcttagcccagcttt

SEQ ID NO: 633615 - DNA, 25 bp, Rattus norvegicus
tggccctgtctgagtgcatgagtat

SEQ ID NO: 633616 - DNA, 25 bp, Rattus norvegicus
tggccctgtctgtgtgcatgagtat

SEQ ID NO: 633617 - DNA, 25 bp, Rattus norvegicus
tggccctgtgaacagaccaaggcag

SEQ ID NO: 633618 - DNA, 25 bp, Rattus norvegicus
tggccctgtgaagagaccaaggcag

SEQ ID NO: 633619 - DNA, 25 bp, Rattus norvegicus
tggccctgtgcacatggtatttcag

SEQ ID NO: 633620 - DNA, 25 bp, Rattus norvegicus
tggccctgtgcagatggtatttcag

SEQ ID NO: 633621 - DNA, 25 bp, Rattus norvegicus
tggccctgttccactactatatagt

SEQ ID NO: 633622 - DNA, 25 bp, Rattus norvegicus
tggccctgttcctctactatatagt

SEQ ID NO: 633623 - DNA, 25 bp, Rattus norvegicus
tggcccttaacacttgacactctta

SEQ ID NO: 633624 - DNA, 25 bp, Rattus norvegicus
tggcccttaacagttgacactctta

SEQ ID NO: 633625 - DNA, 25 bp, Rattus norvegicus
tggcccttaggtcgatttcagatta

SEQ ID NO: 633626 - DNA, 25 bp, Rattus norvegicus
tggcccttaggtggatttcagatta

SEQ ID NO: 633627 - DNA, 25 bp, Rattus norvegicus
tggcccttccttcggaagctgtaaa

SEQ ID NO: 633628 - DNA, 25 bp, Rattus norvegicus
tggcccttccttgggaagctgtaaa

SEQ ID NO: 633629 - DNA, 25 bp, Rattus norvegicus
tggcccttcgtgatgagtcagatac

SEQ ID NO: 633630 - DNA, 25 bp, Rattus norvegicus
tggcccttcgtgttgagtcagatac

SEQ ID NO: 633631 - DNA, 25 bp, Rattus norvegicus
tggcccttcttccaatgactcattg

SEQ ID NO: 633632 - DNA, 25 bp, Rattus norvegicus
tggcccttcttcgaatgactcattg

SEQ ID NO: 633633 - DNA, 25 bp, Rattus norvegicus
tggcccttgagaatatatcccaaaa

SEQ ID NO: 633634 - DNA, 25 bp, Rattus norvegicus
tggcccttgagattatatcccaaaa

SEQ ID NO: 633635 - DNA, 25 bp, Rattus norvegicus
tggcccttggaccactgtgactgcc

SEQ ID NO: 633636 - DNA, 25 bp, Rattus norvegicus
tggcccttggacgactgtgactgcc

SEQ ID NO: 633637 - DNA, 25 bp, Rattus norvegicus
tggcccttggagctaggtgcatttt

SEQ ID NO: 633638 - DNA, 25 bp, Rattus norvegicus
tggcccttggaggtaggtgcatttt

SEQ ID NO: 633639 - DNA, 25 bp, Rattus norvegicus
tggcccttgggcattaatgttataa

SEQ ID NO: 633640 - DNA, 25 bp, Rattus norvegicus
tggcccttgggctttaatgttataa

SEQ ID NO: 633641 - DNA, 25 bp, Rattus norvegicus
tggcccttgggtcatctgaccagta

SEQ ID NO: 633642 - DNA, 25 bp, Rattus norvegicus
tggcccttgggtgatctgaccagta

SEQ ID NO: 633643 - DNA, 25 bp, Rattus norvegicus
tggcccttggttatctttccagatt

SEQ ID NO: 633644 - DNA, 25 bp, Rattus norvegicus
tggcccttggttttctttccagatt

SEQ ID NO: 633645 - DNA, 25 bp, Rattus norvegicus
tggcccttgtcacactcaatgggag

SEQ ID NO: 633646 - DNA, 25 bp, Rattus norvegicus
tggcccttgtcagactcaatgggag

SEQ ID NO: 633647 - DNA, 25 bp, Rattus norvegicus
tggccctttgggattccacaggaga

SEQ ID NO: 633648 - DNA, 25 bp, Rattus norvegicus
tggccctttgggtttccacaggaga

SEQ ID NO: 633649 - DNA, 25 bp, Rattus norvegicus
tggccgaaaacaacactgaggcttt

SEQ ID NO: 633650 - DNA, 25 bp, Rattus norvegicus
tggccgaaaacatcactgaggcttt

SEQ ID NO: 633651 - DNA, 25 bp, Rattus norvegicus
tggccgaaatcaccacccagatgga

SEQ ID NO: 633652 - DNA, 25 bp, Rattus norvegicus
tggccgaaatcagcacccagatgga

SEQ ID NO: 633653 - DNA, 25 bp, Rattus norvegicus
tggccgaagctcacaagttcattga

SEQ ID NO: 633654 - DNA, 25 bp, Rattus norvegicus
tggccgaagctctcaagttcattga

SEQ ID NO: 633655 - DNA, 25 bp, Rattus norvegicus
tggccgaagtcgagctgctctgctg

SEQ ID NO: 633656 - DNA, 25 bp, Rattus norvegicus
tggccgaagtcgtgctgctctgctg

SEQ ID NO: 633657 - DNA, 25 bp, Rattus norvegicus
tggccgaatgaaatgcaagactaac

SEQ ID NO: 633658 - DNA, 25 bp, Rattus norvegicus
tggccgaatgaattgcaagactaac

SEQ ID NO: 633659 - DNA, 25 bp, Rattus norvegicus
tggccgacaggcatatgctggagct

SEQ ID NO: 633660 - DNA, 25 bp, Rattus norvegicus
tggccgacaggcttatgctggagct

SEQ ID NO: 633661 - DNA, 25 bp, Rattus norvegicus
tggccgacatgcatcatgaacagcg

SEQ ID NO: 633662 - DNA, 25 bp, Rattus norvegicus
tggccgacatgcttcatgaacagcg

SEQ ID NO: 633663 - DNA, 25 bp, Rattus norvegicus
tggccgacgtgtacgacatttccaa

SEQ ID NO: 633664 - DNA, 25 bp, Rattus norvegicus
tggccgacgtgttcgacatttccaa

SEQ ID NO: 633665 - DNA, 25 bp, Rattus norvegicus
tggccgactggtctgagggtgtgca

SEQ ID NO: 633666 - DNA, 25 bp, Rattus norvegicus
tggccgactggtgtgagggtgtgca

SEQ ID NO: 633667 - DNA, 25 bp, Rattus norvegicus
tggccgactttgcatcctgtgttct

SEQ ID NO: 633668 - DNA, 25 bp, Rattus norvegicus
tggccgactttggatcctgtgttct

SEQ ID NO: 633669 - DNA, 25 bp, Rattus norvegicus
tggccgagccggactacatagaaga

SEQ ID NO: 633670 - DNA, 25 bp, Rattus norvegicus
tggccgagccggtctacatagaaga

SEQ ID NO: 633671 - DNA, 25 bp, Rattus norvegicus
tggccgaggacaccacatccaggat

SEQ ID NO: 633672 - DNA, 25 bp, Rattus norvegicus
tggccgaggacagcacatccaggat

SEQ ID NO: 633673 - DNA, 25 bp, Rattus norvegicus
tggccgaggcttaacccaaaacaca

SEQ ID NO: 633674 - DNA, 25 bp, Rattus norvegicus
tggccgaggctttacccaaaacaca

SEQ ID NO: 633675 - DNA, 25 bp, Rattus norvegicus
tggccgaggttaagaccgggaccat

SEQ ID NO: 633676 - DNA, 25 bp, Rattus norvegicus
tggccgaggttatgaccgggaccat

SEQ ID NO: 633677 - DNA, 25 bp, Rattus norvegicus
tggccgagtactccgtgaagaccaa

SEQ ID NO: 633678 - DNA, 25 bp, Rattus norvegicus
tggccgagtactgcgtgaagaccaa

SEQ ID NO: 633679 - DNA, 25 bp, Rattus norvegicus
tggccgagtagcatccaaggtgtgt

SEQ ID NO: 633680 - DNA, 25 bp, Rattus norvegicus
tggccgagtagcttccaaggtgtgt

SEQ ID NO: 633681 - DNA, 25 bp, Rattus norvegicus
tggccgatccatccacaactcgtga

SEQ ID NO: 633682 - DNA, 25 bp, Rattus norvegicus
tggccgatccatgcacaactcgtga

SEQ ID NO: 633683 - DNA, 25 bp, Rattus norvegicus
tggccgatctggacaacatagcaag

SEQ ID NO: 633684 - DNA, 25 bp, Rattus norvegicus
tggccgatctggtcaacatagcaag

SEQ ID NO: 633685 - DNA, 25 bp, Rattus norvegicus
tggccgatgcggatcccgcgctaga

SEQ ID NO: 633686 - DNA, 25 bp, Rattus norvegicus
tggccgatgcggttcccgcgctaga

SEQ ID NO: 633687 - DNA, 25 bp, Rattus norvegicus
tggccgatgtgtactcagtgaaaac

SEQ ID NO: 633688 - DNA, 25 bp, Rattus norvegicus
tggccgatgtgttctcagtgaaaac

SEQ ID NO: 633689 - DNA, 25 bp, Rattus norvegicus
tggccgcaaataaacttcagcacat

SEQ ID NO: 633690 - DNA, 25 bp, Rattus norvegicus
tggccgcaaatatacttcagcacat

SEQ ID NO: 633691 - DNA, 25 bp, Rattus norvegicus
tggccgcaccttatggaggattcaa

SEQ ID NO: 633692 - DNA, 25 bp, Rattus norvegicus
tggccgcaccttttggaggattcaa

SEQ ID NO: 633693 - DNA, 25 bp, Rattus norvegicus
tggccgcacttgctcaccagtggtg

SEQ ID NO: 633694 - DNA, 25 bp, Rattus norvegicus
tggccgcacttggtcaccagtggtg

SEQ ID NO: 633695 - DNA, 25 bp, Rattus norvegicus
tggccgcagcgactccaggaataaa

SEQ ID NO: 633696 - DNA, 25 bp, Rattus norvegicus
tggccgcagcgagtccaggaataaa

SEQ ID NO: 633697 - DNA, 25 bp, Rattus norvegicus
tggccgcagggaagctcaacttgtc

SEQ ID NO: 633698 - DNA, 25 bp, Rattus norvegicus
tggccgcagggatgctcaacttgtc

SEQ ID NO: 633699 - DNA, 25 bp, Rattus norvegicus
tggccgccaacccacataagatgtt

SEQ ID NO: 633700 - DNA, 25 bp, Rattus norvegicus
tggccgccaaccgacataagatgtt

SEQ ID NO: 633701 - DNA, 25 bp, Rattus norvegicus
tggccgccaagaatactctactaaa

SEQ ID NO: 633702 - DNA, 25 bp, Rattus norvegicus
tggccgccaagattactctactaaa

SEQ ID NO: 633703 - DNA, 25 bp, Rattus norvegicus
tggccgccagataggactcatgatt

SEQ ID NO: 633704 - DNA, 25 bp, Rattus norvegicus
tggccgccagattggactcatgatt

SEQ ID NO: 633705 - DNA, 25 bp, Rattus norvegicus
tggccgccagccagaagagttgaag

SEQ ID NO: 633706 - DNA, 25 bp, Rattus norvegicus
tggccgccagcctgaagagttgaag

SEQ ID NO: 633707 - DNA, 25 bp, Rattus norvegicus
tggccgccagtgagcagccacagag

SEQ ID NO: 633708 - DNA, 25 bp, Rattus norvegicus
tggccgccagtgtgcagccacagag

SEQ ID NO: 633709 - DNA, 25 bp, Rattus norvegicus
tggccgccattaaacaggtcctgat

SEQ ID NO: 633710 - DNA, 25 bp, Rattus norvegicus
tggccgccattatacaggtcctgat

SEQ ID NO: 633711 - DNA, 25 bp, Rattus norvegicus
tggccgcccatcaaggcacagagga

SEQ ID NO: 633712 - DNA, 25 bp, Rattus norvegicus
tggccgcccatctaggcacagagga

SEQ ID NO: 633713 - DNA, 25 bp, Rattus norvegicus
tggccgccttcacgaagaaccagaa

SEQ ID NO: 633714 - DNA, 25 bp, Rattus norvegicus
tggccgccttcaggaagaaccagaa

SEQ ID NO: 633715 - DNA, 25 bp, Rattus norvegicus
tggccgcgctctacgcgctttgctg

SEQ ID NO: 633716 - DNA, 25 bp, Rattus norvegicus
tggccgcgctcttcgcgctttgctg

SEQ ID NO: 633717 - DNA, 25 bp, Rattus norvegicus
tggccgcggtaactgacttttacat

SEQ ID NO: 633718 - DNA, 25 bp, Rattus norvegicus
tggccgcggtaagtgacttttacat

SEQ ID NO: 633719 - DNA, 25 bp, Rattus norvegicus
tggccgctacctccagcaagatagg

SEQ ID NO: 633720 - DNA, 25 bp, Rattus norvegicus
tggccgctacctgcagcaagatagg

SEQ ID NO: 633721 - DNA, 25 bp, Rattus norvegicus
tggccgctgttcacttgtaagataa

SEQ ID NO: 633722 - DNA, 25 bp, Rattus norvegicus
tggccgctgttctcttgtaagataa

SEQ ID NO: 633723 - DNA, 25 bp, Rattus norvegicus
tggccgcttctgacctggtaatgca

SEQ ID NO: 633724 - DNA, 25 bp, Rattus norvegicus
tggccgcttctgtcctggtaatgca

SEQ ID NO: 633725 - DNA, 25 bp, Rattus norvegicus
tggccggaaacgcaggccatgcacc

SEQ ID NO: 633726 - DNA, 25 bp, Rattus norvegicus
tggccggaaacggaggccatgcacc

SEQ ID NO: 633727 - DNA, 25 bp, Rattus norvegicus
tggccggaaggtcataccactgtcc

SEQ ID NO: 633728 - DNA, 25 bp, Rattus norvegicus
tggccggaaggtgataccactgtcc

SEQ ID NO: 633729 - DNA, 25 bp, Rattus norvegicus
tggccggaagtgactaggtttttcg

SEQ ID NO: 633730 - DNA, 25 bp, Rattus norvegicus
tggccggaagtgtctaggtttttcg

SEQ ID NO: 633731 - DNA, 25 bp, Rattus norvegicus
tggccggaccccagaatcggaccaa

SEQ ID NO: 633732 - DNA, 25 bp, Rattus norvegicus
tggccggacccctgaatcggaccaa

SEQ ID NO: 633733 - DNA, 25 bp, Rattus norvegicus
tggccggactttacagtgctgctat

SEQ ID NO: 633734 - DNA, 25 bp, Rattus norvegicus
tggccggacttttcagtgctgctat

SEQ ID NO: 633735 - DNA, 25 bp, Rattus norvegicus
tggccggagcagaaccagctgagca

SEQ ID NO: 633736 - DNA, 25 bp, Rattus norvegicus
tggccggagcagtaccagctgagca

SEQ ID NO: 633737 - DNA, 25 bp, Rattus norvegicus
tggccggaggccatatatttcttac

SEQ ID NO: 633738 - DNA, 25 bp, Rattus norvegicus
tggccggaggccttatatttcttac

SEQ ID NO: 633739 - DNA, 25 bp, Rattus norvegicus
tggccggcatctcgacacggaagtc

SEQ ID NO: 633740 - DNA, 25 bp, Rattus norvegicus
tggccggcatctggacacggaagtc

SEQ ID NO: 633741 - DNA, 25 bp, Rattus norvegicus
tggccggccagtacagcctgaggaa

SEQ ID NO: 633742 - DNA, 25 bp, Rattus norvegicus
tggccggccagttcagcctgaggaa

SEQ ID NO: 633743 - DNA, 25 bp, Rattus norvegicus
tggccggccatgagctcagcagaga

SEQ ID NO: 633744 - DNA, 25 bp, Rattus norvegicus
tggccggccatgtgctcagcagaga

SEQ ID NO: 633745 - DNA, 25 bp, Rattus norvegicus
tggccgggccataaagcagcgtctg

SEQ ID NO: 633746 - DNA, 25 bp, Rattus norvegicus
tggccgggccattaagcagcgtctg

SEQ ID NO: 633747 - DNA, 25 bp, Rattus norvegicus
tggccgggtctcacttgcaacaggt

SEQ ID NO: 633748 - DNA, 25 bp, Rattus norvegicus
tggccgggtctctcttgcaacaggt

SEQ ID NO: 633749 - DNA, 25 bp, Rattus norvegicus
tggccgggtttactagatccaccac

SEQ ID NO: 633750 - DNA, 25 bp, Rattus norvegicus
tggccgggtttagtagatccaccac

SEQ ID NO: 633751 - DNA, 25 bp, Rattus norvegicus
tggccggtgccacaggaagatcctt

SEQ ID NO: 633752 - DNA, 25 bp, Rattus norvegicus
tggccggtgccagaggaagatcctt

SEQ ID NO: 633753 - DNA, 25 bp, Rattus norvegicus
tggccgtaagttagcccggagtgac

SEQ ID NO: 633754 - DNA, 25 bp, Rattus norvegicus
tggccgtaagtttgcccggagtgac

SEQ ID NO: 633755 - DNA, 25 bp, Rattus norvegicus
tggccgtcataaacacagctcgtaa

SEQ ID NO: 633756 - DNA, 25 bp, Rattus norvegicus
tggccgtcataatcacagctcgtaa

SEQ ID NO: 633757 - DNA, 25 bp, Rattus norvegicus
tggccgtccatcacaacaacttgga

SEQ ID NO: 633758 - DNA, 25 bp, Rattus norvegicus
tggccgtccatctcaacaacttgga

SEQ ID NO: 633759 - DNA, 25 bp, Rattus norvegicus
tggccgtcctcacggctcagatgga

SEQ ID NO: 633760 - DNA, 25 bp, Rattus norvegicus
tggccgtcctcagggctcagatgga

SEQ ID NO: 633761 - DNA, 25 bp, Rattus norvegicus
tggccgtcctccatacagaaagcat

SEQ ID NO: 633762 - DNA, 25 bp, Rattus norvegicus
tggccgtcctccttacagaaagcat

SEQ ID NO: 633763 - DNA, 25 bp, Rattus norvegicus
tggccgtcctgaaactgtaccagtt

SEQ ID NO: 633764 - DNA, 25 bp, Rattus norvegicus
tggccgtcctgatactgtaccagtt

SEQ ID NO: 633765 - DNA, 25 bp, Rattus norvegicus
tggccgtcgctgataaccgtacagt

SEQ ID NO: 633766 - DNA, 25 bp, Rattus norvegicus
tggccgtcgctgttaaccgtacagt

SEQ ID NO: 633767 - DNA, 25 bp, Rattus norvegicus
tggccgtcgtgtcctgaacatgcag

SEQ ID NO: 633768 - DNA, 25 bp, Rattus norvegicus
tggccgtcgtgtgctgaacatgcag

SEQ ID NO: 633769 - DNA, 25 bp, Rattus norvegicus
tggccgtgaaaccagcagctctgtt

SEQ ID NO: 633770 - DNA, 25 bp, Rattus norvegicus
tggccgtgaaacgagcagctctgtt

SEQ ID NO: 633771 - DNA, 25 bp, Rattus norvegicus
tggccgtgagaaacttcccttcaag

SEQ ID NO: 633772 - DNA, 25 bp, Rattus norvegicus
tggccgtgagaatcttcccttcaag

SEQ ID NO: 633773 - DNA, 25 bp, Rattus norvegicus
tggccgtgcggtatcagctctttat

SEQ ID NO: 633774 - DNA, 25 bp, Rattus norvegicus
tggccgtgcggtttcagctctttat

SEQ ID NO: 633775 - DNA, 25 bp, Rattus norvegicus
tggccgtggccaaagaaactttctg

SEQ ID NO: 633776 - DNA, 25 bp, Rattus norvegicus
tggccgtggccatagaaactttctg

SEQ ID NO: 633777 - DNA, 25 bp, Rattus norvegicus
tggccgtgggcgacatcaagaacgt

SEQ ID NO: 633778 - DNA, 25 bp, Rattus norvegicus
tggccgtgggcgtcatcaagaacgt

SEQ ID NO: 633779 - DNA, 25 bp, Rattus norvegicus
tggccgtgtggcagaacagacctgt

SEQ ID NO: 633780 - DNA, 25 bp, Rattus norvegicus
tggccgtgtggctgaacagacctgt

SEQ ID NO: 633781 - DNA, 25 bp, Rattus norvegicus
tggccgttatgcatcctgagggaga

SEQ ID NO: 633782 - DNA, 25 bp, Rattus norvegicus
tggccgttatgcttcctgagggaga

SEQ ID NO: 633783 - DNA, 25 bp, Rattus norvegicus
tggccgttcttaaagctcagtctga

SEQ ID NO: 633784 - DNA, 25 bp, Rattus norvegicus
tggccgttcttatagctcagtctga

SEQ ID NO: 633785 - DNA, 25 bp, Rattus norvegicus
tggccgtttccgacaagcctggaga

SEQ ID NO: 633786 - DNA, 25 bp, Rattus norvegicus
tggccgtttccgtcaagcctggaga

SEQ ID NO: 633787 - DNA, 25 bp, Rattus norvegicus
tggccgtttctgcacataccagaca

SEQ ID NO: 633788 - DNA, 25 bp, Rattus norvegicus
tggccgtttctggacataccagaca

SEQ ID NO: 633789 - DNA, 25 bp, Rattus norvegicus
tggccgtttttcatggcggtcacaa

SEQ ID NO: 633790 - DNA, 25 bp, Rattus norvegicus
tggccgtttttcttggcggtcacaa

SEQ ID NO: 633791 - DNA, 25 bp, Rattus norvegicus
tggcctaaagccaccgtttgtaacg

SEQ ID NO: 633792 - DNA, 25 bp, Rattus norvegicus
tggcctaaagccatttcaagaacaa

SEQ ID NO: 633793 - DNA, 25 bp, Rattus norvegicus
tggcctaaagcctccgtttgtaacg

SEQ ID NO: 633794 - DNA, 25 bp, Rattus norvegicus
tggcctaaagccttttcaagaacaa

SEQ ID NO: 633795 - DNA, 25 bp, Rattus norvegicus
tggcctaacttcatatccttttgac

SEQ ID NO: 633796 - DNA, 25 bp, Rattus norvegicus
tggcctaacttcttatccttttgac

SEQ ID NO: 633797 - DNA, 25 bp, Rattus norvegicus
tggcctaagattcagagatctgcat

SEQ ID NO: 633798 - DNA, 25 bp, Rattus norvegicus
tggcctaagattgagagatctgcat

SEQ ID NO: 633799 - DNA, 25 bp, Rattus norvegicus
tggcctaatgccctatcggaaattg

SEQ ID NO: 633800 - DNA, 25 bp, Rattus norvegicus
tggcctaatgccgtatcggaaattg

SEQ ID NO: 633801 - DNA, 25 bp, Rattus norvegicus
tggcctacaactctggtgcacgaat

SEQ ID NO: 633802 - DNA, 25 bp, Rattus norvegicus
tggcctacaactgtggtgcacgaat

SEQ ID NO: 633803 - DNA, 25 bp, Rattus norvegicus
tggcctacacggactctttttgtaa

SEQ ID NO: 633804 - DNA, 25 bp, Rattus norvegicus
tggcctacacggtctctttttgtaa

SEQ ID NO: 633805 - DNA, 25 bp, Rattus norvegicus
tggcctacagaaaggactcaagcaa

SEQ ID NO: 633806 - DNA, 25 bp, Rattus norvegicus
tggcctacagaatggactcaagcaa

SEQ ID NO: 633807 - DNA, 25 bp, Rattus norvegicus
tggcctacagcgcagagaacacttt

SEQ ID NO: 633808 - DNA, 25 bp, Rattus norvegicus
tggcctacagcggagagaacacttt

SEQ ID NO: 633809 - DNA, 25 bp, Rattus norvegicus
tggcctacatgacaacctgtcccaa

SEQ ID NO: 633810 - DNA, 25 bp, Rattus norvegicus
tggcctacatgagaacctgtcccaa

SEQ ID NO: 633811 - DNA, 25 bp, Rattus norvegicus
tggcctacgccgcaatgtgttgtgt

SEQ ID NO: 633812 - DNA, 25 bp, Rattus norvegicus
tggcctacgccggaatgtgttgtgt

SEQ ID NO: 633813 - DNA, 25 bp, Rattus norvegicus
tggcctactccaaagctgcatttga

SEQ ID NO: 633814 - DNA, 25 bp, Rattus norvegicus
tggcctactccatagctgcatttga

SEQ ID NO: 633815 - DNA, 25 bp, Rattus norvegicus
tggcctagacctataacttaaatga

SEQ ID NO: 633816 - DNA, 25 bp, Rattus norvegicus
tggcctagacctttaacttaaatga

SEQ ID NO: 633817 - DNA, 25 bp, Rattus norvegicus
tggcctagcgctccctctgtcaagt

SEQ ID NO: 633818 - DNA, 25 bp, Rattus norvegicus
tggcctagcgctgcctctgtcaagt

SEQ ID NO: 633819 - DNA, 25 bp, Rattus norvegicus
tggcctaggcctcagggacccataa

SEQ ID NO: 633820 - DNA, 25 bp, Rattus norvegicus
tggcctaggcctgagggacccataa

SEQ ID NO: 633821 - DNA, 25 bp, Rattus norvegicus
tggcctatagatagtaggtctcttt

SEQ ID NO: 633822 - DNA, 25 bp, Rattus norvegicus
tggcctatagattgtaggtctcttt

SEQ ID NO: 633823 - DNA, 25 bp, Rattus norvegicus
tggcctatcctcagatggttccaca

SEQ ID NO: 633824 - DNA, 25 bp, Rattus norvegicus
tggcctatcctctgatggttccaca

SEQ ID NO: 633825 - DNA, 25 bp, Rattus norvegicus
tggcctatcgtactgcaggtacttt

SEQ ID NO: 633826 - DNA, 25 bp, Rattus norvegicus
tggcctatcgtagtgcaggtacttt

SEQ ID NO: 633827 - DNA, 25 bp, Rattus norvegicus
tggcctatctctctcagtggtggag

SEQ ID NO: 633828 - DNA, 25 bp, Rattus norvegicus
tggcctatctctgtcagtggtggag

SEQ ID NO: 633829 - DNA, 25 bp, Rattus norvegicus
tggcctatggccacatcatttcaaa

SEQ ID NO: 633830 - DNA, 25 bp, Rattus norvegicus
tggcctatggcctcatcatttcaaa

SEQ ID NO: 633831 - DNA, 25 bp, Rattus norvegicus
tggcctatgtctacacggaccggga

SEQ ID NO: 633832 - DNA, 25 bp, Rattus norvegicus
tggcctatgtcttcacggaccggga

SEQ ID NO: 633833 - DNA, 25 bp, Rattus norvegicus
tggcctcaaccacgaatgcttgcaa

SEQ ID NO: 633834 - DNA, 25 bp, Rattus norvegicus
tggcctcaaccaggaatgcttgcaa

SEQ ID NO: 633835 - DNA, 25 bp, Rattus norvegicus
tggcctcaacttcgccattcagaat

SEQ ID NO: 633836 - DNA, 25 bp, Rattus norvegicus
tggcctcaacttggccattcagaat

SEQ ID NO: 633837 - DNA, 25 bp, Rattus norvegicus
tggcctcaaggccacttttgatgac

SEQ ID NO: 633838 - DNA, 25 bp, Rattus norvegicus
tggcctcaaggcgacttttgatgac

SEQ ID NO: 633839 - DNA, 25 bp, Rattus norvegicus
tggcctcaatatacacaccgtagtg

SEQ ID NO: 633840 - DNA, 25 bp, Rattus norvegicus
tggcctcaatattcacaccgtagtg

SEQ ID NO: 633841 - DNA, 25 bp, Rattus norvegicus
tggcctcaatgtctccacagggaaa

SEQ ID NO: 633842 - DNA, 25 bp, Rattus norvegicus
tggcctcaatgtgtccacagggaaa

SEQ ID NO: 633843 - DNA, 25 bp, Rattus norvegicus
tggcctcacaagcttgcaacacaga

SEQ ID NO: 633844 - DNA, 25 bp, Rattus norvegicus
tggcctcacaaggttgcaacacaga

SEQ ID NO: 633845 - DNA, 25 bp, Rattus norvegicus
tggcctcacacgctaactggcaaac

SEQ ID NO: 633846 - DNA, 25 bp, Rattus norvegicus
tggcctcacacggtaactggcaaac

SEQ ID NO: 633847 - DNA, 25 bp, Rattus norvegicus
tggcctcacattcaagggacctgct

SEQ ID NO: 633848 - DNA, 25 bp, Rattus norvegicus
tggcctcacattgaagggacctgct

SEQ ID NO: 633849 - DNA, 25 bp, Rattus norvegicus
tggcctcaccagattctgattcagc

SEQ ID NO: 633850 - DNA, 25 bp, Rattus norvegicus
tggcctcaccagtttctgattcagc

SEQ ID NO: 633851 - DNA, 25 bp, Rattus norvegicus
tggcctcacgaacactggctggaac

SEQ ID NO: 633852 - DNA, 25 bp, Rattus norvegicus
tggcctcacgaagactggctggaac

SEQ ID NO: 633853 - DNA, 25 bp, Rattus norvegicus
tggcctcactgcatgctgggaaatg

SEQ ID NO: 633854 - DNA, 25 bp, Rattus norvegicus
tggcctcactgcttgctgggaaatg

SEQ ID NO: 633855 - DNA, 25 bp, Rattus norvegicus
tggcctcacttacaaaaggcccaaa

SEQ ID NO: 633856 - DNA, 25 bp, Rattus norvegicus
tggcctcacttagaaaaggcccaaa

SEQ ID NO: 633857 - DNA, 25 bp, Rattus norvegicus
tggcctcagaggattccctggaatg

SEQ ID NO: 633858 - DNA, 25 bp, Rattus norvegicus
tggcctcagaggtttccctggaatg

SEQ ID NO: 633859 - DNA, 25 bp, Rattus norvegicus
tggcctcagccacaacgatacaagg

SEQ ID NO: 633860 - DNA, 25 bp, Rattus norvegicus
tggcctcagccagaacgatacaagg

SEQ ID NO: 633861 - DNA, 25 bp, Rattus norvegicus
tggcctcagcgtcgcaaatgcatgt

SEQ ID NO: 633862 - DNA, 25 bp, Rattus norvegicus
tggcctcagcgtggcaaatgcatgt

SEQ ID NO: 633863 - DNA, 25 bp, Rattus norvegicus
tggcctcagctgagatccctcaatg

SEQ ID NO: 633864 - DNA, 25 bp, Rattus norvegicus
tggcctcagctgtgatccctcaatg

SEQ ID NO: 633865 - DNA, 25 bp, Rattus norvegicus
tggcctcaggacagtcaccacagtg

SEQ ID NO: 633866 - DNA, 25 bp, Rattus norvegicus
tggcctcaggactgtcaccacagtg

SEQ ID NO: 633867 - DNA, 25 bp, Rattus norvegicus
tggcctcaggtgaagatgtctgttt

SEQ ID NO: 633868 - DNA, 25 bp, Rattus norvegicus
tggcctcaggtgtagatgtctgttt

SEQ ID NO: 633869 - DNA, 25 bp, Rattus norvegicus
tggcctcataggctggtagccatat

SEQ ID NO: 633870 - DNA, 25 bp, Rattus norvegicus
tggcctcatagggtggtagccatat

SEQ ID NO: 633871 - DNA, 25 bp, Rattus norvegicus
tggcctcatccaaaacagattctgg

SEQ ID NO: 633872 - DNA, 25 bp, Rattus norvegicus
tggcctcatccataacagattctgg

SEQ ID NO: 633873 - DNA, 25 bp, Rattus norvegicus
tggcctcatgcactggctttatgta

SEQ ID NO: 633874 - DNA, 25 bp, Rattus norvegicus
tggcctcatgcagtggctttatgta

SEQ ID NO: 633875 - DNA, 25 bp, Rattus norvegicus
tggcctccagacaaaagggacaggt

SEQ ID NO: 633876 - DNA, 25 bp, Rattus norvegicus
tggcctccagactaaagggacaggt

SEQ ID NO: 633877 - DNA, 25 bp, Rattus norvegicus
tggcctccagcaccattatcaagga

SEQ ID NO: 633878 - DNA, 25 bp, Rattus norvegicus
tggcctccagcagcattatcaagga

SEQ ID NO: 633879 - DNA, 25 bp, Rattus norvegicus
tggcctccaggcaaaagcatctaaa

SEQ ID NO: 633880 - DNA, 25 bp, Rattus norvegicus
tggcctccaggctaaagcatctaaa

SEQ ID NO: 633881 - DNA, 25 bp, Rattus norvegicus
tggcctccagtgaagcaagctctgt

SEQ ID NO: 633882 - DNA, 25 bp, Rattus norvegicus
tggcctccagtgaattgctctatgc

SEQ ID NO: 633883 - DNA, 25 bp, Rattus norvegicus
tggcctccagtgatgccttgaagag

SEQ ID NO: 633884 - DNA, 25 bp, Rattus norvegicus
tggcctccagtgtagcaagctctgt

SEQ ID NO: 633885 - DNA, 25 bp, Rattus norvegicus
tggcctccagtgtattgctctatgc

SEQ ID NO: 633886 - DNA, 25 bp, Rattus norvegicus
tggcctccagtgttgccttgaagag

SEQ ID NO: 633887 - DNA, 25 bp, Rattus norvegicus
tggcctccatacactgtgcatttat

SEQ ID NO: 633888 - DNA, 25 bp, Rattus norvegicus
tggcctccatactctgtgcatttat

SEQ ID NO: 633889 - DNA, 25 bp, Rattus norvegicus
tggcctccatcgacagcttggtgaa

SEQ ID NO: 633890 - DNA, 25 bp, Rattus norvegicus
tggcctccatcgtcagcttggtgaa

SEQ ID NO: 633891 - DNA, 25 bp, Rattus norvegicus
tggcctccatggactcgacaacaga

SEQ ID NO: 633892 - DNA, 25 bp, Rattus norvegicus
tggcctccatggtctcgacaacaga

SEQ ID NO: 633893 - DNA, 25 bp, Rattus norvegicus
tggcctcccagaaaaatcacttact

SEQ ID NO: 633894 - DNA, 25 bp, Rattus norvegicus
tggcctcccagataaatcacttact

SEQ ID NO: 633895 - DNA, 25 bp, Rattus norvegicus
tggcctcccaggagaatctcgaatc

SEQ ID NO: 633896 - DNA, 25 bp, Rattus norvegicus
tggcctcccaggtgaatctcgaatc

SEQ ID NO: 633897 - DNA, 25 bp, Rattus norvegicus
tggcctcccagtacagtggctttta

SEQ ID NO: 633898 - DNA, 25 bp, Rattus norvegicus
tggcctcccagttcagtggctttta

SEQ ID NO: 633899 - DNA, 25 bp, Rattus norvegicus
tggcctccccttcactttattaggg

SEQ ID NO: 633900 - DNA, 25 bp, Rattus norvegicus
tggcctccccttcagtagagagacc

SEQ ID NO: 633901 - DNA, 25 bp, Rattus norvegicus
tggcctccccttgactttattaggg

SEQ ID NO: 633902 - DNA, 25 bp, Rattus norvegicus
tggcctccccttgagtagagagacc

SEQ ID NO: 633903 - DNA, 25 bp, Rattus norvegicus
tggcctccctaaataaacacaccgg

SEQ ID NO: 633904 - DNA, 25 bp, Rattus norvegicus
tggcctccctaattaaacacaccgg

SEQ ID NO: 633905 - DNA, 25 bp, Rattus norvegicus
tggcctccctagatatctacaagca

SEQ ID NO: 633906 - DNA, 25 bp, Rattus norvegicus
tggcctccctagttatctacaagca

SEQ ID NO: 633907 - DNA, 25 bp, Rattus norvegicus
tggcctccctcccttagagaggagg

SEQ ID NO: 633908 - DNA, 25 bp, Rattus norvegicus
tggcctccctccgttagagaggagg

SEQ ID NO: 633909 - DNA, 25 bp, Rattus norvegicus
tggcctccggagagtggtacttgat

SEQ ID NO: 633910 - DNA, 25 bp, Rattus norvegicus
tggcctccggagtgtggtacttgat

SEQ ID NO: 633911 - DNA, 25 bp, Rattus norvegicus
tggcctccgggacgctttattagat

SEQ ID NO: 633912 - DNA, 25 bp, Rattus norvegicus
tggcctccgggaggctttattagat

SEQ ID NO: 633913 - DNA, 25 bp, Rattus norvegicus
tggcctcctcggactggcagaccgg

SEQ ID NO: 633914 - DNA, 25 bp, Rattus norvegicus
tggcctcctcggtctggcagaccgg

SEQ ID NO: 633915 - DNA, 25 bp, Rattus norvegicus
tggcctcctcttactcaaataataa

SEQ ID NO: 633916 - DNA, 25 bp, Rattus norvegicus
tggcctcctctttctcaaataataa

SEQ ID NO: 633917 - DNA, 25 bp, Rattus norvegicus
tggcctcctgcgcatcttactggaa

SEQ ID NO: 633918 - DNA, 25 bp, Rattus norvegicus
tggcctcctgcggatcttactggaa

SEQ ID NO: 633919 - DNA, 25 bp, Rattus norvegicus
tggcctcctggaagatgtctctgaa

SEQ ID NO: 633920 - DNA, 25 bp, Rattus norvegicus
tggcctcctggatgatgtctctgaa

SEQ ID NO: 633921 - DNA, 25 bp, Rattus norvegicus
tggcctcgcaccagtcgaagtggaa

SEQ ID NO: 633922 - DNA, 25 bp, Rattus norvegicus
tggcctcgcacctgtcgaagtggaa

SEQ ID NO: 633923 - DNA, 25 bp, Rattus norvegicus
tggcctcggactacttgtacatgaa

SEQ ID NO: 633924 - DNA, 25 bp, Rattus norvegicus
tggcctcggacttcttgtacatgaa

SEQ ID NO: 633925 - DNA, 25 bp, Rattus norvegicus
tggcctcggcctacctgaagcagaa

SEQ ID NO: 633926 - DNA, 25 bp, Rattus norvegicus
tggcctcggccttcctgaagcagaa

SEQ ID NO: 633927 - DNA, 25 bp, Rattus norvegicus
tggcctcggttcaatggcagagact

SEQ ID NO: 633928 - DNA, 25 bp, Rattus norvegicus
tggcctcggttctatggcagagact

SEQ ID NO: 633929 - DNA, 25 bp, Rattus norvegicus
tggcctcgttcacgacacttgcaga

SEQ ID NO: 633930 - DNA, 25 bp, Rattus norvegicus
tggcctcgttcaggacacttgcaga

SEQ ID NO: 633931 - DNA, 25 bp, Rattus norvegicus
tggcctctaaggacacctgcagtca

SEQ ID NO: 633932 - DNA, 25 bp, Rattus norvegicus
tggcctctaaggatgtgttgggtat

SEQ ID NO: 633933 - DNA, 25 bp, Rattus norvegicus
tggcctctaaggtcacctgcagtca

SEQ ID NO: 633934 - DNA, 25 bp, Rattus norvegicus
tggcctctaaggttgtgttgggtat

SEQ ID NO: 633935 - DNA, 25 bp, Rattus norvegicus
tggcctctacacataacctgaacac

SEQ ID NO: 633936 - DNA, 25 bp, Rattus norvegicus
tggcctctacacttaacctgaacac

SEQ ID NO: 633937 - DNA, 25 bp, Rattus norvegicus
tggcctctacagataccaggaattc

SEQ ID NO: 633938 - DNA, 25 bp, Rattus norvegicus
tggcctctacagttaccaggaattc

SEQ ID NO: 633939 - DNA, 25 bp, Rattus norvegicus
tggcctctactgcaagtgctattga

SEQ ID NO: 633940 - DNA, 25 bp, Rattus norvegicus
tggcctctactggaagtgctattga

SEQ ID NO: 633941 - DNA, 25 bp, Rattus norvegicus
tggcctctaggaccctttgaatgga

SEQ ID NO: 633942 - DNA, 25 bp, Rattus norvegicus
tggcctctaggagcctttgaatgga

SEQ ID NO: 633943 - DNA, 25 bp, Rattus norvegicus
tggcctctattgatgagaagaactg

SEQ ID NO: 633944 - DNA, 25 bp, Rattus norvegicus
tggcctctattgttgagaagaactg

SEQ ID NO: 633945 - DNA, 25 bp, Rattus norvegicus
tggcctctcaaaaccatcgtacaaa

SEQ ID NO: 633946 - DNA, 25 bp, Rattus norvegicus
tggcctctcaaatccatcgtacaaa

SEQ ID NO: 633947 - DNA, 25 bp, Rattus norvegicus
tggcctctcaagctctggaaagcaa

SEQ ID NO: 633948 - DNA, 25 bp, Rattus norvegicus
tggcctctcaaggtctggaaagcaa

SEQ ID NO: 633949 - DNA, 25 bp, Rattus norvegicus
tggcctctccaacttagtgctttag

SEQ ID NO: 633950 - DNA, 25 bp, Rattus norvegicus
tggcctctccaagttagtgctttag

SEQ ID NO: 633951 - DNA, 25 bp, Rattus norvegicus
tggcctctccctagtggtcactgag

SEQ ID NO: 633952 - DNA, 25 bp, Rattus norvegicus
tggcctctcccttgtggtcactgag

SEQ ID NO: 633953 - DNA, 25 bp, Rattus norvegicus
tggcctctcgcgaaagtggttaaca

SEQ ID NO: 633954 - DNA, 25 bp, Rattus norvegicus
tggcctctcgcgtaagtggttaaca

SEQ ID NO: 633955 - DNA, 25 bp, Rattus norvegicus
tggcctctctttaaagggtaaccat

SEQ ID NO: 633956 - DNA, 25 bp, Rattus norvegicus
tggcctctcttttaagggtaaccat

SEQ ID NO: 633957 - DNA, 25 bp, Rattus norvegicus
tggcctctgacaatgctgcagcctg

SEQ ID NO: 633958 - DNA, 25 bp, Rattus norvegicus
tggcctctgacattgctgcagcctg

SEQ ID NO: 633959 - DNA, 25 bp, Rattus norvegicus
tggcctctgagtactgcagacaggt

SEQ ID NO: 633960 - DNA, 25 bp, Rattus norvegicus
tggcctctgagttctgcagacaggt

SEQ ID NO: 633961 - DNA, 25 bp, Rattus norvegicus
tggcctctgattcccaaaatggtca

SEQ ID NO: 633962 - DNA, 25 bp, Rattus norvegicus
tggcctctgattgccaaaatggtca

SEQ ID NO: 633963 - DNA, 25 bp, Rattus norvegicus
tggcctctgccaactgtaagctacc

SEQ ID NO: 633964 - DNA, 25 bp, Rattus norvegicus
tggcctctgccatctgtaagctacc

SEQ ID NO: 633965 - DNA, 25 bp, Rattus norvegicus
tggcctctgctcagactactagaat

SEQ ID NO: 633966 - DNA, 25 bp, Rattus norvegicus
tggcctctgctctgactactagaat

SEQ ID NO: 633967 - DNA, 25 bp, Rattus norvegicus
tggcctctggaccaatccagtataa

SEQ ID NO: 633968 - DNA, 25 bp, Rattus norvegicus
tggcctctggacgaatccagtataa

SEQ ID NO: 633969 - DNA, 25 bp, Rattus norvegicus
tggcctctggccaatgtagatctgg

SEQ ID NO: 633970 - DNA, 25 bp, Rattus norvegicus
tggcctctggcctatgtagatctgg

SEQ ID NO: 633971 - DNA, 25 bp, Rattus norvegicus
tggcctctgggcatcagggacagca

SEQ ID NO: 633972 - DNA, 25 bp, Rattus norvegicus
tggcctctgggcttcagggacagca

SEQ ID NO: 633973 - DNA, 25 bp, Rattus norvegicus
tggcctctgggtcttgtaattccaa

SEQ ID NO: 633974 - DNA, 25 bp, Rattus norvegicus
tggcctctgggtgttgtaattccaa

SEQ ID NO: 633975 - DNA, 25 bp, Rattus norvegicus
tggcctctgtccagcgatggtttgg

SEQ ID NO: 633976 - DNA, 25 bp, Rattus norvegicus
tggcctctgtcctgcgatggtttgg

SEQ ID NO: 633977 - DNA, 25 bp, Rattus norvegicus
tggcctctgtctctgatagggcagc

SEQ ID NO: 633978 - DNA, 25 bp, Rattus norvegicus
tggcctctgtctgtgatagggcagc

SEQ ID NO: 633979 - DNA, 25 bp, Rattus norvegicus
tggcctctgtgcacatctgcatgca

SEQ ID NO: 633980 - DNA, 25 bp, Rattus norvegicus
tggcctctgtgctcatctgcatgca

SEQ ID NO: 633981 - DNA, 25 bp, Rattus norvegicus
tggcctctgtttcttgtttcctttt

SEQ ID NO: 633982 - DNA, 25 bp, Rattus norvegicus
tggcctctgtttgttgtttcctttt

SEQ ID NO: 633983 - DNA, 25 bp, Rattus norvegicus
tggcctcttacacttcacagtgact

SEQ ID NO: 633984 - DNA, 25 bp, Rattus norvegicus
tggcctcttacagttcacagtgact

SEQ ID NO: 633985 - DNA, 25 bp, Rattus norvegicus
tggcctcttattctcactgttactg

SEQ ID NO: 633986 - DNA, 25 bp, Rattus norvegicus
tggcctcttattgtcactgttactg

SEQ ID NO: 633987 - DNA, 25 bp, Rattus norvegicus
tggcctcttgccaggttgaagggac

SEQ ID NO: 633988 - DNA, 25 bp, Rattus norvegicus
tggcctcttgcctggttgaagggac

SEQ ID NO: 633989 - DNA, 25 bp, Rattus norvegicus
tggcctcttggacctggtggcactc

SEQ ID NO: 633990 - DNA, 25 bp, Rattus norvegicus
tggcctcttggagctggtggcactc

SEQ ID NO: 633991 - DNA, 25 bp, Rattus norvegicus
tggcctctttgaaggtcacgtatgg

SEQ ID NO: 633992 - DNA, 25 bp, Rattus norvegicus
tggcctctttgatggtcacgtatgg

SEQ ID NO: 633993 - DNA, 25 bp, Rattus norvegicus
tggcctctttggaacttcttaacac

SEQ ID NO: 633994 - DNA, 25 bp, Rattus norvegicus
tggcctctttggtacttcttaacac

SEQ ID NO: 633995 - DNA, 25 bp, Rattus norvegicus
tggcctcttttgctccacaaagcag

SEQ ID NO: 633996 - DNA, 25 bp, Rattus norvegicus
tggcctcttttggtccacaaagcag

SEQ ID NO: 633997 - DNA, 25 bp, Rattus norvegicus
tggcctgaaatcagctggtctgaag

SEQ ID NO: 633998 - DNA, 25 bp, Rattus norvegicus
tggcctgaaatctgctggtctgaag

SEQ ID NO: 633999 - DNA, 25 bp, Rattus norvegicus
tggcctgaaatgcttgactgtgtta

SEQ ID NO: 634000 - DNA, 25 bp, Rattus norvegicus
tggcctgaaatggttgactgtgtta

SEQ ID NO: 634001 - DNA, 25 bp, Rattus norvegicus
tggcctgaacccattctatgctgat

SEQ ID NO: 634002 - DNA, 25 bp, Rattus norvegicus
tggcctgaaccctttctatgctgat

SEQ ID NO: 634003 - DNA, 25 bp, Rattus norvegicus
tggcctgaactcaacctgctaggac

SEQ ID NO: 634004 - DNA, 25 bp, Rattus norvegicus
tggcctgaactctacctgctaggac

SEQ ID NO: 634005 - DNA, 25 bp, Rattus norvegicus
tggcctgaagaccacgtgttcattt

SEQ ID NO: 634006 - DNA, 25 bp, Rattus norvegicus
tggcctgaagacgacgtgttcattt

SEQ ID NO: 634007 - DNA, 25 bp, Rattus norvegicus
tggcctgactggaccaaccaagcaa

SEQ ID NO: 634008 - DNA, 25 bp, Rattus norvegicus
tggcctgactggtccaaccaagcaa

SEQ ID NO: 634009 - DNA, 25 bp, Rattus norvegicus
tggcctgagcagagcgtgccccatc

SEQ ID NO: 634010 - DNA, 25 bp, Rattus norvegicus
tggcctgagcagctactgagcacag

SEQ ID NO: 634011 - DNA, 25 bp, Rattus norvegicus
tggcctgagcaggtactgagcacag

SEQ ID NO: 634012 - DNA, 25 bp, Rattus norvegicus
tggcctgagcagtgcgtgccccatc

SEQ ID NO: 634013 - DNA, 25 bp, Rattus norvegicus
tggcctgaggctcgacagcctacac

SEQ ID NO: 634014 - DNA, 25 bp, Rattus norvegicus
tggcctgaggctggacagcctacac

SEQ ID NO: 634015 - DNA, 25 bp, Rattus norvegicus
tggcctgagggtattattgctgcaa

SEQ ID NO: 634016 - DNA, 25 bp, Rattus norvegicus
tggcctgagggttttattgctgcaa

SEQ ID NO: 634017 - DNA, 25 bp, Rattus norvegicus
tggcctgaggtcagcaatgtcacct

SEQ ID NO: 634018 - DNA, 25 bp, Rattus norvegicus
tggcctgaggtctgcaatgtcacct

SEQ ID NO: 634019 - DNA, 25 bp, Rattus norvegicus
tggcctgagtttccttgtctctaaa

SEQ ID NO: 634020 - DNA, 25 bp, Rattus norvegicus
tggcctgagtttgcttgtctctaaa

SEQ ID NO: 634021 - DNA, 25 bp, Rattus norvegicus
tggcctgcaccaactggaagcgagt

SEQ ID NO: 634022 - DNA, 25 bp, Rattus norvegicus
tggcctgcaccatctggaagcgagt

SEQ ID NO: 634023 - DNA, 25 bp, Rattus norvegicus
tggcctgcagcactgattcagacgt

SEQ ID NO: 634024 - DNA, 25 bp, Rattus norvegicus
tggcctgcagcagtgattcagacgt

SEQ ID NO: 634025 - DNA, 25 bp, Rattus norvegicus
tggcctgccaatccacagccgagtg

SEQ ID NO: 634026 - DNA, 25 bp, Rattus norvegicus
tggcctgccaatgcacagccgagtg

SEQ ID NO: 634027 - DNA, 25 bp, Rattus norvegicus
tggcctgccacaacctttagaagtt

SEQ ID NO: 634028 - DNA, 25 bp, Rattus norvegicus
tggcctgccacatcctttagaagtt

SEQ ID NO: 634029 - DNA, 25 bp, Rattus norvegicus
tggcctgccagccattcagggtata

SEQ ID NO: 634030 - DNA, 25 bp, Rattus norvegicus
tggcctgccagcgattcagggtata

SEQ ID NO: 634031 - DNA, 25 bp, Rattus norvegicus
tggcctgccagtctgcaactatttt

SEQ ID NO: 634032 - DNA, 25 bp, Rattus norvegicus
tggcctgccagtgtgcaactatttt

SEQ ID NO: 634033 - DNA, 25 bp, Rattus norvegicus
tggcctgccataccaaagactggtc

SEQ ID NO: 634034 - DNA, 25 bp, Rattus norvegicus
tggcctgccatagcaaagactggtc

SEQ ID NO: 634035 - DNA, 25 bp, Rattus norvegicus
tggcctgccatccaggttggaacga

SEQ ID NO: 634036 - DNA, 25 bp, Rattus norvegicus
tggcctgccatcgaggttggaacga

SEQ ID NO: 634037 - DNA, 25 bp, Rattus norvegicus
tggcctgccattagtacccgaaata

SEQ ID NO: 634038 - DNA, 25 bp, Rattus norvegicus
tggcctgccatttgtacccgaaata

SEQ ID NO: 634039 - DNA, 25 bp, Rattus norvegicus
tggcctgccccactgacagtgggat

SEQ ID NO: 634040 - DNA, 25 bp, Rattus norvegicus
tggcctgccccagtgacagtgggat

SEQ ID NO: 634041 - DNA, 25 bp, Rattus norvegicus
tggcctgcccgtcgttattgtcaat

SEQ ID NO: 634042 - DNA, 25 bp, Rattus norvegicus
tggcctgcccgtggttattgtcaat

SEQ ID NO: 634043 - DNA, 25 bp, Rattus norvegicus
tggcctgcctggatggctacatgaa

SEQ ID NO: 634044 - DNA, 25 bp, Rattus norvegicus
tggcctgcctggttggctacatgaa

SEQ ID NO: 634045 - DNA, 25 bp, Rattus norvegicus
tggcctgcgaggaagtcaacagcct

SEQ ID NO: 634046 - DNA, 25 bp, Rattus norvegicus
tggcctgcgaggtagtcaacagcct

SEQ ID NO: 634047 - DNA, 25 bp, Rattus norvegicus
tggcctgctagaaacataatggata

SEQ ID NO: 634048 - DNA, 25 bp, Rattus norvegicus
tggcctgctagatacataatggata

SEQ ID NO: 634049 - DNA, 25 bp, Rattus norvegicus
tggcctgctatcactgttcattatt

SEQ ID NO: 634050 - DNA, 25 bp, Rattus norvegicus
tggcctgctatctctgttcattatt

SEQ ID NO: 634051 - DNA, 25 bp, Rattus norvegicus
tggcctgctcacagatggctgggaa

SEQ ID NO: 634052 - DNA, 25 bp, Rattus norvegicus
tggcctgctcactgatggctgggaa

SEQ ID NO: 634053 - DNA, 25 bp, Rattus norvegicus
tggcctgctgacatccctaagtgag

SEQ ID NO: 634054 - DNA, 25 bp, Rattus norvegicus
tggcctgctgacttccctaagtgag

SEQ ID NO: 634055 - DNA, 25 bp, Rattus norvegicus
tggcctggaaccctaaggtctggca

SEQ ID NO: 634056 - DNA, 25 bp, Rattus norvegicus
tggcctggaaccgtaaggtctggca

SEQ ID NO: 634057 - DNA, 25 bp, Rattus norvegicus
tggcctggacaccacagatctgtga

SEQ ID NO: 634058 - DNA, 25 bp, Rattus norvegicus
tggcctggacacgacagatctgtga

SEQ ID NO: 634059 - DNA, 25 bp, Rattus norvegicus
tggcctggaggcaacagctctataa

SEQ ID NO: 634060 - DNA, 25 bp, Rattus norvegicus
tggcctggaggcctgcacatagccc

SEQ ID NO: 634061 - DNA, 25 bp, Rattus norvegicus
tggcctggaggcgtgcacatagccc

SEQ ID NO: 634062 - DNA, 25 bp, Rattus norvegicus
tggcctggaggctacagctctataa

SEQ ID NO: 634063 - DNA, 25 bp, Rattus norvegicus
tggcctggcagaactcatctgtttt

SEQ ID NO: 634064 - DNA, 25 bp, Rattus norvegicus
tggcctggcagatctcatctgtttt

SEQ ID NO: 634065 - DNA, 25 bp, Rattus norvegicus
tggcctggccccaatgagaaagagt

SEQ ID NO: 634066 - DNA, 25 bp, Rattus norvegicus
tggcctggcccctatgagaaagagt

SEQ ID NO: 634067 - DNA, 25 bp, Rattus norvegicus
tggcctggcccgatgctagaatata

SEQ ID NO: 634068 - DNA, 25 bp, Rattus norvegicus
tggcctggcccgttgctagaatata

SEQ ID NO: 634069 - DNA, 25 bp, Rattus norvegicus
tggcctggcctaaatagttccgata

SEQ ID NO: 634070 - DNA, 25 bp, Rattus norvegicus
tggcctggcctatatagttccgata

SEQ ID NO: 634071 - DNA, 25 bp, Rattus norvegicus
tggcctggcctgcacaaagctcaga

SEQ ID NO: 634072 - DNA, 25 bp, Rattus norvegicus
tggcctggcctggacaaagctcaga

SEQ ID NO: 634073 - DNA, 25 bp, Rattus norvegicus
tggcctggctccagaaaccatgaag

SEQ ID NO: 634074 - DNA, 25 bp, Rattus norvegicus
tggcctggctccatgatacatctag

SEQ ID NO: 634075 - DNA, 25 bp, Rattus norvegicus
tggcctggctcctgaaaccatgaag

SEQ ID NO: 634076 - DNA, 25 bp, Rattus norvegicus
tggcctggctccttgatacatctag

SEQ ID NO: 634077 - DNA, 25 bp, Rattus norvegicus
tggcctgggacacagggacacccca

SEQ ID NO: 634078 - DNA, 25 bp, Rattus norvegicus
tggcctgggacagagggacacccca

SEQ ID NO: 634079 - DNA, 25 bp, Rattus norvegicus
tggcctgggactcaactgtgtagct

SEQ ID NO: 634080 - DNA, 25 bp, Rattus norvegicus
tggcctgggactcgagctaacacct

SEQ ID NO: 634081 - DNA, 25 bp, Rattus norvegicus
tggcctgggactgaactgtgtagct

SEQ ID NO: 634082 - DNA, 25 bp, Rattus norvegicus
tggcctgggactggagctaacacct

SEQ ID NO: 634083 - DNA, 25 bp, Rattus norvegicus
tggcctgggagtcactgtcttgtcc

SEQ ID NO: 634084 - DNA, 25 bp, Rattus norvegicus
tggcctgggagtgactgtcttgtcc

SEQ ID NO: 634085 - DNA, 25 bp, Rattus norvegicus
tggcctgggcagactgaaccctgaa

SEQ ID NO: 634086 - DNA, 25 bp, Rattus norvegicus
tggcctgggcagtctgaaccctgaa

SEQ ID NO: 634087 - DNA, 25 bp, Rattus norvegicus
tggcctgggtaccattcacctacag

SEQ ID NO: 634088 - DNA, 25 bp, Rattus norvegicus
tggcctgggtacgattcacctacag

SEQ ID NO: 634089 - DNA, 25 bp, Rattus norvegicus
tggcctggtcacatccgcatagtga

SEQ ID NO: 634090 - DNA, 25 bp, Rattus norvegicus
tggcctggtcacttccgcatagtga

SEQ ID NO: 634091 - DNA, 25 bp, Rattus norvegicus
tggcctggtcgcaaccagttttagt

SEQ ID NO: 634092 - DNA, 25 bp, Rattus norvegicus
tggcctggtcgctaccagttttagt

SEQ ID NO: 634093 - DNA, 25 bp, Rattus norvegicus
tggcctggtctcagtgcagacaaag

SEQ ID NO: 634094 - DNA, 25 bp, Rattus norvegicus
tggcctggtctctgtgcagacaaag

SEQ ID NO: 634095 - DNA, 25 bp, Rattus norvegicus
tggcctggtgtgaaatgggtttaaa

SEQ ID NO: 634096 - DNA, 25 bp, Rattus norvegicus
tggcctggtgtgtaatgggtttaaa

SEQ ID NO: 634097 - DNA, 25 bp, Rattus norvegicus
tggcctggttccctgtgtgtttcat

SEQ ID NO: 634098 - DNA, 25 bp, Rattus norvegicus
tggcctggttccgtgtgtgtttcat

SEQ ID NO: 634099 - DNA, 25 bp, Rattus norvegicus
tggcctgtaccaagtcgctaaagga

SEQ ID NO: 634100 - DNA, 25 bp, Rattus norvegicus
tggcctgtaccaataatcattccgg

SEQ ID NO: 634101 - DNA, 25 bp, Rattus norvegicus
tggcctgtaccatgtcgctaaagga

SEQ ID NO: 634102 - DNA, 25 bp, Rattus norvegicus
tggcctgtaccattaatcattccgg

SEQ ID NO: 634103 - DNA, 25 bp, Rattus norvegicus
tggcctgtactaaatagcgcagact

SEQ ID NO: 634104 - DNA, 25 bp, Rattus norvegicus
tggcctgtactatatagcgcagact

SEQ ID NO: 634105 - DNA, 25 bp, Rattus norvegicus
tggcctgtactcactctggactgaa

SEQ ID NO: 634106 - DNA, 25 bp, Rattus norvegicus
tggcctgtactcattactccattga

SEQ ID NO: 634107 - DNA, 25 bp, Rattus norvegicus
tggcctgtactctctctggactgaa

SEQ ID NO: 634108 - DNA, 25 bp, Rattus norvegicus
tggcctgtactctttactccattga

SEQ ID NO: 634109 - DNA, 25 bp, Rattus norvegicus
tggcctgtataacaagcactgcact

SEQ ID NO: 634110 - DNA, 25 bp, Rattus norvegicus
tggcctgtataagaagcactgcact

SEQ ID NO: 634111 - DNA, 25 bp, Rattus norvegicus
tggcctgtatttcttgcacactgtt

SEQ ID NO: 634112 - DNA, 25 bp, Rattus norvegicus
tggcctgtatttgttgcacactgtt

SEQ ID NO: 634113 - DNA, 25 bp, Rattus norvegicus
tggcctgtccctcttgaggaacgag

SEQ ID NO: 634114 - DNA, 25 bp, Rattus norvegicus
tggcctgtccctgttgaggaacgag

SEQ ID NO: 634115 - DNA, 25 bp, Rattus norvegicus
tggcctgtctgtagttcctgctgaa

SEQ ID NO: 634116 - DNA, 25 bp, Rattus norvegicus
tggcctgtctgttgttcctgctgaa

SEQ ID NO: 634117 - DNA, 25 bp, Rattus norvegicus
tggcctgtctttaatcgcctctcca

SEQ ID NO: 634118 - DNA, 25 bp, Rattus norvegicus
tggcctgtcttttatcgcctctcca

SEQ ID NO: 634119 - DNA, 25 bp, Rattus norvegicus
tggcctgtgcagaacattatgtttt

SEQ ID NO: 634120 - DNA, 25 bp, Rattus norvegicus
tggcctgtgcagtacattatgtttt

SEQ ID NO: 634121 - DNA, 25 bp, Rattus norvegicus
tggcctgtggacagcggctcccatc

SEQ ID NO: 634122 - DNA, 25 bp, Rattus norvegicus
tggcctgtggactgcggctcccatc

SEQ ID NO: 634123 - DNA, 25 bp, Rattus norvegicus
tggcctgtggctctaagactctgtt

SEQ ID NO: 634124 - DNA, 25 bp, Rattus norvegicus
tggcctgtggctgtaagactctgtt

SEQ ID NO: 634125 - DNA, 25 bp, Rattus norvegicus
tggcctgtgggactctgacagcacc

SEQ ID NO: 634126 - DNA, 25 bp, Rattus norvegicus
tggcctgtgggagtctgacagcacc

SEQ ID NO: 634127 - DNA, 25 bp, Rattus norvegicus
tggcctgtgtgcacactttgaatta

SEQ ID NO: 634128 - DNA, 25 bp, Rattus norvegicus
tggcctgtgtgctcactttgaatta

SEQ ID NO: 634129 - DNA, 25 bp, Rattus norvegicus
tggcctgttatgctgagtgacctca

SEQ ID NO: 634130 - DNA, 25 bp, Rattus norvegicus
tggcctgttatggtgagtgacctca

SEQ ID NO: 634131 - DNA, 25 bp, Rattus norvegicus
tggcctgttgccagaatgcagcctg

SEQ ID NO: 634132 - DNA, 25 bp, Rattus norvegicus
tggcctgttgcctgaatgcagcctg

SEQ ID NO: 634133 - DNA, 25 bp, Rattus norvegicus
tggcctgttggccaggtgcacacaa

SEQ ID NO: 634134 - DNA, 25 bp, Rattus norvegicus
tggcctgttggcgaggtgcacacaa

SEQ ID NO: 634135 - DNA, 25 bp, Rattus norvegicus
tggcctgtttgaataagttcccctg

SEQ ID NO: 634136 - DNA, 25 bp, Rattus norvegicus
tggcctgtttgattaagttcccctg

SEQ ID NO: 634137 - DNA, 25 bp, Rattus norvegicus
tggccttaaatgacttcttcctcag

SEQ ID NO: 634138 - DNA, 25 bp, Rattus norvegicus
tggccttaaatgtcttcttcctcag

SEQ ID NO: 634139 - DNA, 25 bp, Rattus norvegicus
tggccttaagagacaaatgcctaat

SEQ ID NO: 634140 - DNA, 25 bp, Rattus norvegicus
tggccttaagagtcaaatgcctaat

SEQ ID NO: 634141 - DNA, 25 bp, Rattus norvegicus
tggccttacctgattttcctccaag

SEQ ID NO: 634142 - DNA, 25 bp, Rattus norvegicus
tggccttacctgtttttcctccaag

SEQ ID NO: 634143 - DNA, 25 bp, Rattus norvegicus
tggccttactctactgcatattgca

SEQ ID NO: 634144 - DNA, 25 bp, Rattus norvegicus
tggccttactcttctgcatattgca

SEQ ID NO: 634145 - DNA, 25 bp, Rattus norvegicus
tggccttagaccacacggagggcag

SEQ ID NO: 634146 - DNA, 25 bp, Rattus norvegicus
tggccttagacctcacggagggcag

SEQ ID NO: 634147 - DNA, 25 bp, Rattus norvegicus
tggccttagggcagagtgactcaag

SEQ ID NO: 634148 - DNA, 25 bp, Rattus norvegicus
tggccttagggctgagtgactcaag

SEQ ID NO: 634149 - DNA, 25 bp, Rattus norvegicus
tggccttatggcctgaagacatcgt

SEQ ID NO: 634150 - DNA, 25 bp, Rattus norvegicus
tggccttatggcgtgaagacatcgt

SEQ ID NO: 634151 - DNA, 25 bp, Rattus norvegicus
tggccttatggtcctctggaacaca

SEQ ID NO: 634152 - DNA, 25 bp, Rattus norvegicus
tggccttatggtgctctggaacaca

SEQ ID NO: 634153 - DNA, 25 bp, Rattus norvegicus
tggccttatgtacacagcccggctg

SEQ ID NO: 634154 - DNA, 25 bp, Rattus norvegicus
tggccttatgtagacagcccggctg

SEQ ID NO: 634155 - DNA, 25 bp, Rattus norvegicus
tggccttatgtcagctgccggcaca

SEQ ID NO: 634156 - DNA, 25 bp, Rattus norvegicus
tggccttatgtctgctgccggcaca

SEQ ID NO: 634157 - DNA, 25 bp, Rattus norvegicus
tggccttatgtgaccctattgtaat

SEQ ID NO: 634158 - DNA, 25 bp, Rattus norvegicus
tggccttatgtgtccctattgtaat

SEQ ID NO: 634159 - DNA, 25 bp, Rattus norvegicus
tggccttattaaaggacagctttcc

SEQ ID NO: 634160 - DNA, 25 bp, Rattus norvegicus
tggccttattaatggacagctttcc

SEQ ID NO: 634161 - DNA, 25 bp, Rattus norvegicus
tggccttattgtacggtgtccatag

SEQ ID NO: 634162 - DNA, 25 bp, Rattus norvegicus
tggccttattgttcggtgtccatag

SEQ ID NO: 634163 - DNA, 25 bp, Rattus norvegicus
tggccttcaataactccttcagcaa

SEQ ID NO: 634164 - DNA, 25 bp, Rattus norvegicus
tggccttcaatatctccttcagcaa

SEQ ID NO: 634165 - DNA, 25 bp, Rattus norvegicus
tggccttcagagatttttgcttttt

SEQ ID NO: 634166 - DNA, 25 bp, Rattus norvegicus
tggccttcagagttttttgcttttt

SEQ ID NO: 634167 - DNA, 25 bp, Rattus norvegicus
tggccttcagtacaccttttattga

SEQ ID NO: 634168 - DNA, 25 bp, Rattus norvegicus
tggccttcagtagaccttttattga

SEQ ID NO: 634169 - DNA, 25 bp, Rattus norvegicus
tggccttcatagactccggcgaaaa

SEQ ID NO: 634170 - DNA, 25 bp, Rattus norvegicus
tggccttcatagtctccggcgaaaa

SEQ ID NO: 634171 - DNA, 25 bp, Rattus norvegicus
tggccttcattgacctcagacagct

SEQ ID NO: 634172 - DNA, 25 bp, Rattus norvegicus
tggccttcattgtcctcagacagct

SEQ ID NO: 634173 - DNA, 25 bp, Rattus norvegicus
tggccttccacacgtttggcagaga

SEQ ID NO: 634174 - DNA, 25 bp, Rattus norvegicus
tggccttccacaggtttggcagaga

SEQ ID NO: 634175 - DNA, 25 bp, Rattus norvegicus
tggccttccagaagtacgggcgttc

SEQ ID NO: 634176 - DNA, 25 bp, Rattus norvegicus
tggccttccagatgtacgggcgttc

SEQ ID NO: 634177 - DNA, 25 bp, Rattus norvegicus
tggccttcccaaaagctaatgcagc

SEQ ID NO: 634178 - DNA, 25 bp, Rattus norvegicus
tggccttcccaatagctaatgcagc

SEQ ID NO: 634179 - DNA, 25 bp, Rattus norvegicus
tggccttcccacaaatgcaggtatg

SEQ ID NO: 634180 - DNA, 25 bp, Rattus norvegicus
tggccttcccactaatgcaggtatg

SEQ ID NO: 634181 - DNA, 25 bp, Rattus norvegicus
tggccttcccggactccaagagtct

SEQ ID NO: 634182 - DNA, 25 bp, Rattus norvegicus
tggccttcccggtctccaagagtct

SEQ ID NO: 634183 - DNA, 25 bp, Rattus norvegicus
tggccttccctgcaaagcaggcaaa

SEQ ID NO: 634184 - DNA, 25 bp, Rattus norvegicus
tggccttccctgcagtcagaatctg

SEQ ID NO: 634185 - DNA, 25 bp, Rattus norvegicus
tggccttccctggaaagcaggcaaa

SEQ ID NO: 634186 - DNA, 25 bp, Rattus norvegicus
tggccttccctggagtcagaatctg

SEQ ID NO: 634187 - DNA, 25 bp, Rattus norvegicus
tggccttcctgcaagtctatgatga

SEQ ID NO: 634188 - DNA, 25 bp, Rattus norvegicus
tggccttcctgctagtctatgatga

SEQ ID NO: 634189 - DNA, 25 bp, Rattus norvegicus
tggccttcggctcctgtcaagtgaa

SEQ ID NO: 634190 - DNA, 25 bp, Rattus norvegicus
tggccttcggctgctgtcaagtgaa

SEQ ID NO: 634191 - DNA, 25 bp, Rattus norvegicus
tggccttcgggaaaccctgtaagga

SEQ ID NO: 634192 - DNA, 25 bp, Rattus norvegicus
tggccttcgggataccctgtaagga

SEQ ID NO: 634193 - DNA, 25 bp, Rattus norvegicus
tggccttcgggcacatgtttgctct

SEQ ID NO: 634194 - DNA, 25 bp, Rattus norvegicus
tggccttcgggctcatgtttgctct

SEQ ID NO: 634195 - DNA, 25 bp, Rattus norvegicus
tggccttcggtcatcccagaaagaa

SEQ ID NO: 634196 - DNA, 25 bp, Rattus norvegicus
tggccttcggtcttcccagaaagaa

SEQ ID NO: 634197 - DNA, 25 bp, Rattus norvegicus
tggccttctcatctttgtctatgat

SEQ ID NO: 634198 - DNA, 25 bp, Rattus norvegicus
tggccttctcatgtttgtctatgat

SEQ ID NO: 634199 - DNA, 25 bp, Rattus norvegicus
tggccttctcggagccagaaaccat

SEQ ID NO: 634200 - DNA, 25 bp, Rattus norvegicus
tggccttctcggtgccagaaaccat

SEQ ID NO: 634201 - DNA, 25 bp, Rattus norvegicus
tggccttctgccagagttacacacc

SEQ ID NO: 634202 - DNA, 25 bp, Rattus norvegicus
tggccttctgcctgagttacacacc

SEQ ID NO: 634203 - DNA, 25 bp, Rattus norvegicus
tggccttctgggattctagtttcac

SEQ ID NO: 634204 - DNA, 25 bp, Rattus norvegicus
tggccttctgggtttctagtttcac

SEQ ID NO: 634205 - DNA, 25 bp, Rattus norvegicus
tggccttgagaacttgaaagtttta

SEQ ID NO: 634206 - DNA, 25 bp, Rattus norvegicus
tggccttgagaagttgaaagtttta

SEQ ID NO: 634207 - DNA, 25 bp, Rattus norvegicus
tggccttgagccactgagaacttct

SEQ ID NO: 634208 - DNA, 25 bp, Rattus norvegicus
tggccttgagcctctgagaacttct

SEQ ID NO: 634209 - DNA, 25 bp, Rattus norvegicus
tggccttgagctcatagcaatcctc

SEQ ID NO: 634210 - DNA, 25 bp, Rattus norvegicus
tggccttgagctgatagcaatcctc

SEQ ID NO: 634211 - DNA, 25 bp, Rattus norvegicus
tggccttgccaaacactcacttaaa

SEQ ID NO: 634212 - DNA, 25 bp, Rattus norvegicus
tggccttgccaatcactcacttaaa

SEQ ID NO: 634213 - DNA, 25 bp, Rattus norvegicus
tggccttgcctgagatggtccgtgc

SEQ ID NO: 634214 - DNA, 25 bp, Rattus norvegicus
tggccttgcctgtgatggtccgtgc

SEQ ID NO: 634215 - DNA, 25 bp, Rattus norvegicus
tggccttgctcaaccatgagcgaat

SEQ ID NO: 634216 - DNA, 25 bp, Rattus norvegicus
tggccttgctcatccatgagcgaat

SEQ ID NO: 634217 - DNA, 25 bp, Rattus norvegicus
tggccttgcttcaagacggtcttca

SEQ ID NO: 634218 - DNA, 25 bp, Rattus norvegicus
tggccttgcttctagacggtcttca

SEQ ID NO: 634219 - DNA, 25 bp, Rattus norvegicus
tggccttggaaccagtttcccatga

SEQ ID NO: 634220 - DNA, 25 bp, Rattus norvegicus
tggccttggaacgagtttcccatga

SEQ ID NO: 634221 - DNA, 25 bp, Rattus norvegicus
tggccttggagacacagcatcataa

SEQ ID NO: 634222 - DNA, 25 bp, Rattus norvegicus
tggccttggagacgccccactgtct

SEQ ID NO: 634223 - DNA, 25 bp, Rattus norvegicus
tggccttggagagacagcatcataa

SEQ ID NO: 634224 - DNA, 25 bp, Rattus norvegicus
tggccttggagaggccccactgtct

SEQ ID NO: 634225 - DNA, 25 bp, Rattus norvegicus
tggccttggagcattatctttagtt

SEQ ID NO: 634226 - DNA, 25 bp, Rattus norvegicus
tggccttggagctttatctttagtt

SEQ ID NO: 634227 - DNA, 25 bp, Rattus norvegicus
tggccttggcatagctttgctgcat

SEQ ID NO: 634228 - DNA, 25 bp, Rattus norvegicus
tggccttggcatccacacaaagtgt

SEQ ID NO: 634229 - DNA, 25 bp, Rattus norvegicus
tggccttggcatgcacacaaagtgt

SEQ ID NO: 634230 - DNA, 25 bp, Rattus norvegicus
tggccttggcattgctttgctgcat

SEQ ID NO: 634231 - DNA, 25 bp, Rattus norvegicus
tggccttggccaattacaccggagt

SEQ ID NO: 634232 - DNA, 25 bp, Rattus norvegicus
tggccttggccatttacaccggagt

SEQ ID NO: 634233 - DNA, 25 bp, Rattus norvegicus
tggccttgggacagcaaagtgtctc

SEQ ID NO: 634234 - DNA, 25 bp, Rattus norvegicus
tggccttgggactgcaaagtgtctc

SEQ ID NO: 634235 - DNA, 25 bp, Rattus norvegicus
tggccttgggagaacctgtttgtca

SEQ ID NO: 634236 - DNA, 25 bp, Rattus norvegicus
tggccttgggagtacctgtttgtca

SEQ ID NO: 634237 - DNA, 25 bp, Rattus norvegicus
tggccttgggtgacaaattcctctt

SEQ ID NO: 634238 - DNA, 25 bp, Rattus norvegicus
tggccttgggtgtcaaattcctctt

SEQ ID NO: 634239 - DNA, 25 bp, Rattus norvegicus
tggccttgtgctagggatcaattct

SEQ ID NO: 634240 - DNA, 25 bp, Rattus norvegicus
tggccttgtgcttgggatcaattct

SEQ ID NO: 634241 - DNA, 25 bp, Rattus norvegicus
tggccttgttcaaacttgtttgcac

SEQ ID NO: 634242 - DNA, 25 bp, Rattus norvegicus
tggccttgttcatacttgtttgcac

SEQ ID NO: 634243 - DNA, 25 bp, Rattus norvegicus
tggcctttaacaactgctgctcttc

SEQ ID NO: 634244 - DNA, 25 bp, Rattus norvegicus
tggcctttaacatctgctgctcttc

SEQ ID NO: 634245 - DNA, 25 bp, Rattus norvegicus
tggcctttaccgagaagctgagctg

SEQ ID NO: 634246 - DNA, 25 bp, Rattus norvegicus
tggcctttaccgtgaagctgagctg

SEQ ID NO: 634247 - DNA, 25 bp, Rattus norvegicus
tggcctttagatagtacgtctcttg

SEQ ID NO: 634248 - DNA, 25 bp, Rattus norvegicus
tggcctttagattgtacgtctcttg

SEQ ID NO: 634249 - DNA, 25 bp, Rattus norvegicus
tggcctttatctccagacacatctg

SEQ ID NO: 634250 - DNA, 25 bp, Rattus norvegicus
tggcctttatctgcagacacatctg

SEQ ID NO: 634251 - DNA, 25 bp, Rattus norvegicus
tggcctttattaacactgcggagtg

SEQ ID NO: 634252 - DNA, 25 bp, Rattus norvegicus
tggcctttattatcactgcggagtg

SEQ ID NO: 634253 - DNA, 25 bp, Rattus norvegicus
tggcctttattcatttcctcttgta

SEQ ID NO: 634254 - DNA, 25 bp, Rattus norvegicus
tggcctttattcttttcctcttgta

SEQ ID NO: 634255 - DNA, 25 bp, Rattus norvegicus
tggcctttatttccgcagagggcat

SEQ ID NO: 634256 - DNA, 25 bp, Rattus norvegicus
tggcctttatttgcgcagagggcat

SEQ ID NO: 634257 - DNA, 25 bp, Rattus norvegicus
tggcctttcaaaccagttgaccctg

SEQ ID NO: 634258 - DNA, 25 bp, Rattus norvegicus
tggcctttcaaagcagttgaccctg

SEQ ID NO: 634259 - DNA, 25 bp, Rattus norvegicus
tggcctttccgcagggctatcatta

SEQ ID NO: 634260 - DNA, 25 bp, Rattus norvegicus
tggcctttccgctgggctatcatta

SEQ ID NO: 634261 - DNA, 25 bp, Rattus norvegicus
tggcctttccggaacaaggtcacct

SEQ ID NO: 634262 - DNA, 25 bp, Rattus norvegicus
tggcctttccggtacaaggtcacct

SEQ ID NO: 634263 - DNA, 25 bp, Rattus norvegicus
tggcctttcgagcagatgacacctt

SEQ ID NO: 634264 - DNA, 25 bp, Rattus norvegicus
tggcctttcgaggagatgacacctt

SEQ ID NO: 634265 - DNA, 25 bp, Rattus norvegicus
tggcctttcggaattgaccccaaca

SEQ ID NO: 634266 - DNA, 25 bp, Rattus norvegicus
tggcctttcggatttgaccccaaca

SEQ ID NO: 634267 - DNA, 25 bp, Rattus norvegicus
tggcctttctccacacactgaagag

SEQ ID NO: 634268 - DNA, 25 bp, Rattus norvegicus
tggcctttctcccacatcgtttttt

SEQ ID NO: 634269 - DNA, 25 bp, Rattus norvegicus
tggcctttctccgacatcgtttttt

SEQ ID NO: 634270 - DNA, 25 bp, Rattus norvegicus
tggcctttctcctcacactgaagag

SEQ ID NO: 634271 - DNA, 25 bp, Rattus norvegicus
tggcctttctggcttgatacacacg

SEQ ID NO: 634272 - DNA, 25 bp, Rattus norvegicus
tggcctttctgggttgatacacacg

SEQ ID NO: 634273 - DNA, 25 bp, Rattus norvegicus
tggcctttcttcaaccttgtgtttg

SEQ ID NO: 634274 - DNA, 25 bp, Rattus norvegicus
tggcctttcttctaccttgtgtttg

SEQ ID NO: 634275 - DNA, 25 bp, Rattus norvegicus
tggcctttgcagacagcagccttta

SEQ ID NO: 634276 - DNA, 25 bp, Rattus norvegicus
tggcctttgcagtcagcagccttta

SEQ ID NO: 634277 - DNA, 25 bp, Rattus norvegicus
tggcctttgccgctgatggtttgct

SEQ ID NO: 634278 - DNA, 25 bp, Rattus norvegicus
tggcctttgccggtgatggtttgct

SEQ ID NO: 634279 - DNA, 25 bp, Rattus norvegicus
tggccttttcaaccctgagatggat

SEQ ID NO: 634280 - DNA, 25 bp, Rattus norvegicus
tggccttttcaagcctgagatggat

SEQ ID NO: 634281 - DNA, 25 bp, Rattus norvegicus
tggccttttgccagtttttctgaac

SEQ ID NO: 634282 - DNA, 25 bp, Rattus norvegicus
tggccttttgcctgtttttctgaac

SEQ ID NO: 634283 - DNA, 25 bp, Rattus norvegicus
tggccttttgggaagcagtgtctgc

SEQ ID NO: 634284 - DNA, 25 bp, Rattus norvegicus
tggccttttgggtagcagtgtctgc

SEQ ID NO: 634285 - DNA, 25 bp, Rattus norvegicus
tggcctttttacacattatgtagat

SEQ ID NO: 634286 - DNA, 25 bp, Rattus norvegicus
tggcctttttactcattatgtagat

SEQ ID NO: 634287 - DNA, 25 bp, Rattus norvegicus
tggccttttttgcaacgtcggtgtc

SEQ ID NO: 634288 - DNA, 25 bp, Rattus norvegicus
tggccttttttggaacgtcggtgtc

SEQ ID NO: 634289 - DNA, 25 bp, Rattus norvegicus
tggcgaaaacccacgggcactgcag

SEQ ID NO: 634290 - DNA, 25 bp, Rattus norvegicus
tggcgaaaaccctcgggcactgcag

SEQ ID NO: 634291 - DNA, 25 bp, Rattus norvegicus
tggcgaaaagcgaccgcggcccgac

SEQ ID NO: 634292 - DNA, 25 bp, Rattus norvegicus
tggcgaaaagcgtccgcggcccgac

SEQ ID NO: 634293 - DNA, 25 bp, Rattus norvegicus
tggcgaacagaaagtacggcatcaa

SEQ ID NO: 634294 - DNA, 25 bp, Rattus norvegicus
tggcgaacagaatgtacggcatcaa

SEQ ID NO: 634295 - DNA, 25 bp, Rattus norvegicus
tggcgaacagcaaggctctcctgtg

SEQ ID NO: 634296 - DNA, 25 bp, Rattus norvegicus
tggcgaacagcatggctctcctgtg

SEQ ID NO: 634297 - DNA, 25 bp, Rattus norvegicus
tggcgaacgtcgactgctataggca

SEQ ID NO: 634298 - DNA, 25 bp, Rattus norvegicus
tggcgaacgtcgtctgctataggca

SEQ ID NO: 634299 - DNA, 25 bp, Rattus norvegicus
tggcgaactcgtatttactatttag

SEQ ID NO: 634300 - DNA, 25 bp, Rattus norvegicus
tggcgaactcgtttttactatttag

SEQ ID NO: 634301 - DNA, 25 bp, Rattus norvegicus
tggcgaagacggctatgtccgcatc

SEQ ID NO: 634302 - DNA, 25 bp, Rattus norvegicus
tggcgaagacgggtatgtccgcatc

SEQ ID NO: 634303 - DNA, 25 bp, Rattus norvegicus
tggcgaagagccactgtgtacccag

SEQ ID NO: 634304 - DNA, 25 bp, Rattus norvegicus
tggcgaagagcctctgtgtacccag

SEQ ID NO: 634305 - DNA, 25 bp, Rattus norvegicus
tggcgacaagtaccgtttccattgc

SEQ ID NO: 634306 - DNA, 25 bp, Rattus norvegicus
tggcgacaagtagcgtttccattgc

SEQ ID NO: 634307 - DNA, 25 bp, Rattus norvegicus
tggcgacacaccacttccaataagg

SEQ ID NO: 634308 - DNA, 25 bp, Rattus norvegicus
tggcgacacacctcttccaataagg

SEQ ID NO: 634309 - DNA, 25 bp, Rattus norvegicus
tggcgacagccacatttcagagcat

SEQ ID NO: 634310 - DNA, 25 bp, Rattus norvegicus
tggcgacagccagatttcagagcat

SEQ ID NO: 634311 - DNA, 25 bp, Rattus norvegicus
tggcgacagcccatctgcaggagaa

SEQ ID NO: 634312 - DNA, 25 bp, Rattus norvegicus
tggcgacagcccttctgcaggagaa

SEQ ID NO: 634313 - DNA, 25 bp, Rattus norvegicus
tggcgacagttccatcgtctaagaa

SEQ ID NO: 634314 - DNA, 25 bp, Rattus norvegicus
tggcgacagttcgatcgtctaagaa

SEQ ID NO: 634315 - DNA, 25 bp, Rattus norvegicus
tggcgaccagtaatttcagacatat

SEQ ID NO: 634316 - DNA, 25 bp, Rattus norvegicus
tggcgaccagtattttcagacatat

SEQ ID NO: 634317 - DNA, 25 bp, Rattus norvegicus
tggcgaccatgcaccaaggaaggct

SEQ ID NO: 634318 - DNA, 25 bp, Rattus norvegicus
tggcgaccatgctccaaggaaggct

SEQ ID NO: 634319 - DNA, 25 bp, Rattus norvegicus
tggcgacccttgagactaatcattg

SEQ ID NO: 634320 - DNA, 25 bp, Rattus norvegicus
tggcgacccttgtgactaatcattg

SEQ ID NO: 634321 - DNA, 25 bp, Rattus norvegicus
tggcgacctctgcttagctctgtgt

SEQ ID NO: 634322 - DNA, 25 bp, Rattus norvegicus
tggcgacctctggttagctctgtgt

SEQ ID NO: 634323 - DNA, 25 bp, Rattus norvegicus
tggcgacctgctatagacttgcaga

SEQ ID NO: 634324 - DNA, 25 bp, Rattus norvegicus
tggcgacctgctttagacttgcaga

SEQ ID NO: 634325 - DNA, 25 bp, Rattus norvegicus
tggcgacgaacacctggcactgagt

SEQ ID NO: 634326 - DNA, 25 bp, Rattus norvegicus
tggcgacgaacagctggcactgagt

SEQ ID NO: 634327 - DNA, 25 bp, Rattus norvegicus
tggcgactacatcttctgctttgac

SEQ ID NO: 634328 - DNA, 25 bp, Rattus norvegicus
tggcgactacatgttctgctttgac

SEQ ID NO: 634329 - DNA, 25 bp, Rattus norvegicus
tggcgactccatccatgtgaataaa

SEQ ID NO: 634330 - DNA, 25 bp, Rattus norvegicus
tggcgactccatgcatgtgaataaa

SEQ ID NO: 634331 - DNA, 25 bp, Rattus norvegicus
tggcgactgctcattctaatttcac

SEQ ID NO: 634332 - DNA, 25 bp, Rattus norvegicus
tggcgactgctctttctaatttcac

SEQ ID NO: 634333 - DNA, 25 bp, Rattus norvegicus
tggcgactggatatggcttgatcac

SEQ ID NO: 634334 - DNA, 25 bp, Rattus norvegicus
tggcgactggatttggcttgatcac

SEQ ID NO: 634335 - DNA, 25 bp, Rattus norvegicus
tggcgacttgttaccttgtcacatc

SEQ ID NO: 634336 - DNA, 25 bp, Rattus norvegicus
tggcgacttgtttccttgtcacatc

SEQ ID NO: 634337 - DNA, 25 bp, Rattus norvegicus
tggcgagaagccatatcagtgcagt

SEQ ID NO: 634338 - DNA, 25 bp, Rattus norvegicus
tggcgagaagccttatcagtgcagt

SEQ ID NO: 634339 - DNA, 25 bp, Rattus norvegicus
tggcgagacattccaagtttggcat

SEQ ID NO: 634340 - DNA, 25 bp, Rattus norvegicus
tggcgagacattgcaagtttggcat

SEQ ID NO: 634341 - DNA, 25 bp, Rattus norvegicus
tggcgagactatcaagccttgacta

SEQ ID NO: 634342 - DNA, 25 bp, Rattus norvegicus
tggcgagactatgaagccttgacta

SEQ ID NO: 634343 - DNA, 25 bp, Rattus norvegicus
tggcgagagtccaagcgggactaca

SEQ ID NO: 634344 - DNA, 25 bp, Rattus norvegicus
tggcgagagtcctagcgggactaca

SEQ ID NO: 634345 - DNA, 25 bp, Rattus norvegicus
tggcgagatcccaggaatgtcacgt

SEQ ID NO: 634346 - DNA, 25 bp, Rattus norvegicus
tggcgagatccctggaatgtcacgt

SEQ ID NO: 634347 - DNA, 25 bp, Rattus norvegicus
tggcgagctgttcctgagctcccga

SEQ ID NO: 634348 - DNA, 25 bp, Rattus norvegicus
tggcgagctgttgctgagctcccga

SEQ ID NO: 634349 - DNA, 25 bp, Rattus norvegicus
tggcgagcttagcatcatccgcaca

SEQ ID NO: 634350 - DNA, 25 bp, Rattus norvegicus
tggcgagcttaggatcatccgcaca

SEQ ID NO: 634351 - DNA, 25 bp, Rattus norvegicus
tggcgaggaggacacactcaccttt

SEQ ID NO: 634352 - DNA, 25 bp, Rattus norvegicus
tggcgaggaggagacactcaccttt

SEQ ID NO: 634353 - DNA, 25 bp, Rattus norvegicus
tggcgaggatcaaccgcaatgcctg

SEQ ID NO: 634354 - DNA, 25 bp, Rattus norvegicus
tggcgaggatcatccgcaatgcctg

SEQ ID NO: 634355 - DNA, 25 bp, Rattus norvegicus
tggcgagggccacttcaacgaagat

SEQ ID NO: 634356 - DNA, 25 bp, Rattus norvegicus
tggcgagggccagttcaacgaagat

SEQ ID NO: 634357 - DNA, 25 bp, Rattus norvegicus
tggcgagtacctctgtgaaatccat

SEQ ID NO: 634358 - DNA, 25 bp, Rattus norvegicus
tggcgagtacctgtgtgaaatccat

SEQ ID NO: 634359 - DNA, 25 bp, Rattus norvegicus
tggcgagttctcataaggacaatac

SEQ ID NO: 634360 - DNA, 25 bp, Rattus norvegicus
tggcgagttctcttaaggacaatac

SEQ ID NO: 634361 - DNA, 25 bp, Rattus norvegicus
tggcgatcagagaacatgtgtgcaa

SEQ ID NO: 634362 - DNA, 25 bp, Rattus norvegicus
tggcgatcagagtacatgtgtgcaa

SEQ ID NO: 634363 - DNA, 25 bp, Rattus norvegicus
tggcgatctcaaagtgcttccgagg

SEQ ID NO: 634364 - DNA, 25 bp, Rattus norvegicus
tggcgatctcaatgtgcttccgagg

SEQ ID NO: 634365 - DNA, 25 bp, Rattus norvegicus
tggcgatggcatcaggtcctaaaat

SEQ ID NO: 634366 - DNA, 25 bp, Rattus norvegicus
tggcgatggcatgaggtcctaaaat

SEQ ID NO: 634367 - DNA, 25 bp, Rattus norvegicus
tggcgatggcgcactttggcatagc

SEQ ID NO: 634368 - DNA, 25 bp, Rattus norvegicus
tggcgatggcgctctttggcatagc

SEQ ID NO: 634369 - DNA, 25 bp, Rattus norvegicus
tggcgatgtggaattctctcacgaa

SEQ ID NO: 634370 - DNA, 25 bp, Rattus norvegicus
tggcgatgtggatttctctcacgaa

SEQ ID NO: 634371 - DNA, 25 bp, Rattus norvegicus
tggcgatttaagacctgctgactaa

SEQ ID NO: 634372 - DNA, 25 bp, Rattus norvegicus
tggcgatttaagtcctgctgactaa

SEQ ID NO: 634373 - DNA, 25 bp, Rattus norvegicus
tggcgcaaaaagaccagtttcagga

SEQ ID NO: 634374 - DNA, 25 bp, Rattus norvegicus
tggcgcaaaaagtccagtttcagga

SEQ ID NO: 634375 - DNA, 25 bp, Rattus norvegicus
tggcgcaaatgcacgaccaggtcgc

SEQ ID NO: 634376 - DNA, 25 bp, Rattus norvegicus
tggcgcaaatgctcgaccaggtcgc

SEQ ID NO: 634377 - DNA, 25 bp, Rattus norvegicus
tggcgcaccagacagggtctttgtc

SEQ ID NO: 634378 - DNA, 25 bp, Rattus norvegicus
tggcgcaccagagagggtctttgtc

SEQ ID NO: 634379 - DNA, 25 bp, Rattus norvegicus
tggcgcagattcacaagcgcctcaa

SEQ ID NO: 634380 - DNA, 25 bp, Rattus norvegicus
tggcgcagattctcaagcgcctcaa

SEQ ID NO: 634381 - DNA, 25 bp, Rattus norvegicus
tggcgcagcagtcactcttgaaaag

SEQ ID NO: 634382 - DNA, 25 bp, Rattus norvegicus
tggcgcagcagtgactcttgaaaag

SEQ ID NO: 634383 - DNA, 25 bp, Rattus norvegicus
tggcgcagctcaagcagaaggtcat

SEQ ID NO: 634384 - DNA, 25 bp, Rattus norvegicus
tggcgcagctcatgcagaaggtcat

SEQ ID NO: 634385 - DNA, 25 bp, Rattus norvegicus
tggcgcatgtctcgcagactacaaa

SEQ ID NO: 634386 - DNA, 25 bp, Rattus norvegicus
tggcgcatgtctggcagactacaaa

SEQ ID NO: 634387 - DNA, 25 bp, Rattus norvegicus
tggcgcatgttgagagtgtgtctct

SEQ ID NO: 634388 - DNA, 25 bp, Rattus norvegicus
tggcgcatgttgtgagtgtgtctct

SEQ ID NO: 634389 - DNA, 25 bp, Rattus norvegicus
tggcgccacctgagagcctagagtt

SEQ ID NO: 634390 - DNA, 25 bp, Rattus norvegicus
tggcgccacctgtgagcctagagtt

SEQ ID NO: 634391 - DNA, 25 bp, Rattus norvegicus
tggcgccagcctactttagatgtgg

SEQ ID NO: 634392 - DNA, 25 bp, Rattus norvegicus
tggcgccagccttctttagatgtgg

SEQ ID NO: 634393 - DNA, 25 bp, Rattus norvegicus
tggcgccagtcaacaagttcgataa

SEQ ID NO: 634394 - DNA, 25 bp, Rattus norvegicus
tggcgccagtcatcaagttcgataa

SEQ ID NO: 634395 - DNA, 25 bp, Rattus norvegicus
tggcgcccacggctcttatgtaggt

SEQ ID NO: 634396 - DNA, 25 bp, Rattus norvegicus
tggcgcccacgggtcttatgtaggt

SEQ ID NO: 634397 - DNA, 25 bp, Rattus norvegicus
tggcgcccatatccaaaggcctttc

SEQ ID NO: 634398 - DNA, 25 bp, Rattus norvegicus
tggcgcccatatgcaaaggcctttc

SEQ ID NO: 634399 - DNA, 25 bp, Rattus norvegicus
tggcgccctaacagaacttggatat

SEQ ID NO: 634400 - DNA, 25 bp, Rattus norvegicus
tggcgccctaactgaacttggatat

SEQ ID NO: 634401 - DNA, 25 bp, Rattus norvegicus
tggcgccgagaaagcgatccacgat

SEQ ID NO: 634402 - DNA, 25 bp, Rattus norvegicus
tggcgccgagaatgcgatccacgat

SEQ ID NO: 634403 - DNA, 25 bp, Rattus norvegicus
tggcgccgccatatgtactgttcta

SEQ ID NO: 634404 - DNA, 25 bp, Rattus norvegicus
tggcgccgccatttgtactgttcta

SEQ ID NO: 634405 - DNA, 25 bp, Rattus norvegicus
tggcgccgcgacatagagggcggca

SEQ ID NO: 634406 - DNA, 25 bp, Rattus norvegicus
tggcgccgcgacttagagggcggca

SEQ ID NO: 634407 - DNA, 25 bp, Rattus norvegicus
tggcgcctactgaaccctggtgaat

SEQ ID NO: 634408 - DNA, 25 bp, Rattus norvegicus
tggcgcctactgtaccctggtgaat

SEQ ID NO: 634409 - DNA, 25 bp, Rattus norvegicus
tggcgcctcactaggctttgtgtga

SEQ ID NO: 634410 - DNA, 25 bp, Rattus norvegicus
tggcgcctcacttggctttgtgtga

SEQ ID NO: 634411 - DNA, 25 bp, Rattus norvegicus
tggcgcctccacaaaatacctcaag

SEQ ID NO: 634412 - DNA, 25 bp, Rattus norvegicus
tggcgcctccactaaatacctcaag

SEQ ID NO: 634413 - DNA, 25 bp, Rattus norvegicus
tggcgcctgccaacgaaaaggactt

SEQ ID NO: 634414 - DNA, 25 bp, Rattus norvegicus
tggcgcctgccacaagtaacagaaa

SEQ ID NO: 634415 - DNA, 25 bp, Rattus norvegicus
tggcgcctgccagaagtaacagaaa

SEQ ID NO: 634416 - DNA, 25 bp, Rattus norvegicus
tggcgcctgccatcgaaaaggactt

SEQ ID NO: 634417 - DNA, 25 bp, Rattus norvegicus
tggcgcctttctatcagttgacaaa

SEQ ID NO: 634418 - DNA, 25 bp, Rattus norvegicus
tggcgcctttctttcagttgacaaa

SEQ ID NO: 634419 - DNA, 25 bp, Rattus norvegicus
tggcgcgaaactacatcctgatgct

SEQ ID NO: 634420 - DNA, 25 bp, Rattus norvegicus
tggcgcgaaacttcatcctgatgct

SEQ ID NO: 634421 - DNA, 25 bp, Rattus norvegicus
tggcgcgagcccacattggataacc

SEQ ID NO: 634422 - DNA, 25 bp, Rattus norvegicus
tggcgcgagccctcattggataacc

SEQ ID NO: 634423 - DNA, 25 bp, Rattus norvegicus
tggcgcgctcccagacgacgaggat

SEQ ID NO: 634424 - DNA, 25 bp, Rattus norvegicus
tggcgcgctccctgacgacgaggat

SEQ ID NO: 634425 - DNA, 25 bp, Rattus norvegicus
tggcgcgctgcgctcgggcaggaga

SEQ ID NO: 634426 - DNA, 25 bp, Rattus norvegicus
tggcgcgctgcggtcgggcaggaga

SEQ ID NO: 634427 - DNA, 25 bp, Rattus norvegicus
tggcgcggatgaaccccaaagtgga

SEQ ID NO: 634428 - DNA, 25 bp, Rattus norvegicus
tggcgcggatgatccccaaagtgga

SEQ ID NO: 634429 - DNA, 25 bp, Rattus norvegicus
tggcgcggggcactttgtacaaatc

SEQ ID NO: 634430 - DNA, 25 bp, Rattus norvegicus
tggcgcggggcagtttgtacaaatc

SEQ ID NO: 634431 - DNA, 25 bp, Rattus norvegicus
tggcgcgtacctagtctgagtctca

SEQ ID NO: 634432 - DNA, 25 bp, Rattus norvegicus
tggcgcgtaccttgtctgagtctca

SEQ ID NO: 634433 - DNA, 25 bp, Rattus norvegicus
tggcgcgtctgcagtacatgaagga

SEQ ID NO: 634434 - DNA, 25 bp, Rattus norvegicus
tggcgcgtctgctgtacatgaagga

SEQ ID NO: 634435 - DNA, 25 bp, Rattus norvegicus
tggcgctacgttcagaccggaaact

SEQ ID NO: 634436 - DNA, 25 bp, Rattus norvegicus
tggcgctacgttgagaccggaaact

SEQ ID NO: 634437 - DNA, 25 bp, Rattus norvegicus
tggcgctcaacaccaggacctggaa

SEQ ID NO: 634438 - DNA, 25 bp, Rattus norvegicus
tggcgctcaacagcaggacctggaa

SEQ ID NO: 634439 - DNA, 25 bp, Rattus norvegicus
tggcgctcacagattcacagagtta

SEQ ID NO: 634440 - DNA, 25 bp, Rattus norvegicus
tggcgctcacagtttcacagagtta

SEQ ID NO: 634441 - DNA, 25 bp, Rattus norvegicus
tggcgctcagcactaatgaccccat

SEQ ID NO: 634442 - DNA, 25 bp, Rattus norvegicus
tggcgctcagcagtaatgaccccat

SEQ ID NO: 634443 - DNA, 25 bp, Rattus norvegicus
tggcgctcagcgaagacacagagcc

SEQ ID NO: 634444 - DNA, 25 bp, Rattus norvegicus
tggcgctcagcgtagacacagagcc

SEQ ID NO: 634445 - DNA, 25 bp, Rattus norvegicus
tggcgctcagtgagcttctctttta

SEQ ID NO: 634446 - DNA, 25 bp, Rattus norvegicus
tggcgctcagtgcttcatcttgaat

SEQ ID NO: 634447 - DNA, 25 bp, Rattus norvegicus
tggcgctcagtggttcatcttgaat

SEQ ID NO: 634448 - DNA, 25 bp, Rattus norvegicus
tggcgctcagtgtgcttctctttta

SEQ ID NO: 634449 - DNA, 25 bp, Rattus norvegicus
tggcgctcctctatgggtgactaca

SEQ ID NO: 634450 - DNA, 25 bp, Rattus norvegicus
tggcgctcctctttgggtgactaca

SEQ ID NO: 634451 - DNA, 25 bp, Rattus norvegicus
tggcgctcgtttcctttgtcagaga

SEQ ID NO: 634452 - DNA, 25 bp, Rattus norvegicus
tggcgctcgtttgctttgtcagaga

SEQ ID NO: 634453 - DNA, 25 bp, Rattus norvegicus
tggcgctctgtccagtcagaagttt

SEQ ID NO: 634454 - DNA, 25 bp, Rattus norvegicus
tggcgctctgtcgagtcagaagttt

SEQ ID NO: 634455 - DNA, 25 bp, Rattus norvegicus
tggcgctgcgctactacaaaataaa

SEQ ID NO: 634456 - DNA, 25 bp, Rattus norvegicus
tggcgctgcgctatgataagcccat

SEQ ID NO: 634457 - DNA, 25 bp, Rattus norvegicus
tggcgctgcgcttctacaaaataaa

SEQ ID NO: 634458 - DNA, 25 bp, Rattus norvegicus
tggcgctgcgctttgataagcccat

SEQ ID NO: 634459 - DNA, 25 bp, Rattus norvegicus
tggcgctggatacgaatagacactt

SEQ ID NO: 634460 - DNA, 25 bp, Rattus norvegicus
tggcgctggataggaatagacactt

SEQ ID NO: 634461 - DNA, 25 bp, Rattus norvegicus
tggcgctggtgcaccttgcagcagt

SEQ ID NO: 634462 - DNA, 25 bp, Rattus norvegicus
tggcgctggtgctccttgcagcagt

SEQ ID NO: 634463 - DNA, 25 bp, Rattus norvegicus
tggcgctggtgtacaacgtgttgaa

SEQ ID NO: 634464 - DNA, 25 bp, Rattus norvegicus
tggcgctggtgttcaacgtgttgaa

SEQ ID NO: 634465 - DNA, 25 bp, Rattus norvegicus
tggcgctgtccgacttgttagccgc

SEQ ID NO: 634466 - DNA, 25 bp, Rattus norvegicus
tggcgctgtccgtcttgttagccgc

SEQ ID NO: 634467 - DNA, 25 bp, Rattus norvegicus
tggcgcttccttcaagccgtagagt

SEQ ID NO: 634468 - DNA, 25 bp, Rattus norvegicus
tggcgcttccttgaagccgtagagt

SEQ ID NO: 634469 - DNA, 25 bp, Rattus norvegicus
tggcgcttgctgacatagggaactc

SEQ ID NO: 634470 - DNA, 25 bp, Rattus norvegicus
tggcgcttgctgcagattgaatgac

SEQ ID NO: 634471 - DNA, 25 bp, Rattus norvegicus
tggcgcttgctggagattgaatgac

SEQ ID NO: 634472 - DNA, 25 bp, Rattus norvegicus
tggcgcttgctgtcatagggaactc

SEQ ID NO: 634473 - DNA, 25 bp, Rattus norvegicus
tggcgcttggttagagcctcataaa

SEQ ID NO: 634474 - DNA, 25 bp, Rattus norvegicus
tggcgcttggtttgagcctcataaa

SEQ ID NO: 634475 - DNA, 25 bp, Rattus norvegicus
tggcgctttgctagccacatggcag

SEQ ID NO: 634476 - DNA, 25 bp, Rattus norvegicus
tggcgctttgcttgccacatggcag

SEQ ID NO: 634477 - DNA, 25 bp, Rattus norvegicus
tggcgcttttccacacaggtgtgaa

SEQ ID NO: 634478 - DNA, 25 bp, Rattus norvegicus
tggcgcttttcctcacaggtgtgaa

SEQ ID NO: 634479 - DNA, 25 bp, Rattus norvegicus
tggcggaaacttcactctgacctgc

SEQ ID NO: 634480 - DNA, 25 bp, Rattus norvegicus
tggcggaaacttgactctgacctgc

SEQ ID NO: 634481 - DNA, 25 bp, Rattus norvegicus
tggcggaagatcacgttggtgactt

SEQ ID NO: 634482 - DNA, 25 bp, Rattus norvegicus
tggcggaagatctcgttggtgactt

SEQ ID NO: 634483 - DNA, 25 bp, Rattus norvegicus
tggcggaagttgacacagtcactaa

SEQ ID NO: 634484 - DNA, 25 bp, Rattus norvegicus
tggcggaagttgtcacagtcactaa

SEQ ID NO: 634485 - DNA, 25 bp, Rattus norvegicus
tggcggaattgcaccacggtaacag

SEQ ID NO: 634486 - DNA, 25 bp, Rattus norvegicus
tggcggaattgctccacggtaacag

SEQ ID NO: 634487 - DNA, 25 bp, Rattus norvegicus
tggcggacatggatgagctcttctc

SEQ ID NO: 634488 - DNA, 25 bp, Rattus norvegicus
tggcggacatggttgagctcttctc

SEQ ID NO: 634489 - DNA, 25 bp, Rattus norvegicus
tggcggaccaagcttcccaggtgaa

SEQ ID NO: 634490 - DNA, 25 bp, Rattus norvegicus
tggcggaccaaggttcccaggtgaa

SEQ ID NO: 634491 - DNA, 25 bp, Rattus norvegicus
tggcggacttttcggcatccctttt

SEQ ID NO: 634492 - DNA, 25 bp, Rattus norvegicus
tggcggacttttgggcatccctttt

SEQ ID NO: 634493 - DNA, 25 bp, Rattus norvegicus
tggcggagctccagaggactcactg

SEQ ID NO: 634494 - DNA, 25 bp, Rattus norvegicus
tggcggagctcctgaggactcactg

SEQ ID NO: 634495 - DNA, 25 bp, Rattus norvegicus
tggcggatgacgaggaccttcagca

SEQ ID NO: 634496 - DNA, 25 bp, Rattus norvegicus
tggcggatgacgtggaccttcagca

SEQ ID NO: 634497 - DNA, 25 bp, Rattus norvegicus
tggcggcacactactggcagttgaa

SEQ ID NO: 634498 - DNA, 25 bp, Rattus norvegicus
tggcggcacacttctggcagttgaa

SEQ ID NO: 634499 - DNA, 25 bp, Rattus norvegicus
tggcggcagcatagacctttgggtc

SEQ ID NO: 634500 - DNA, 25 bp, Rattus norvegicus
tggcggcagcattgacctttgggtc

SEQ ID NO: 634501 - DNA, 25 bp, Rattus norvegicus
tggcggcagcctatgagcaggacct

SEQ ID NO: 634502 - DNA, 25 bp, Rattus norvegicus
tggcggcagcctttgagcaggacct

SEQ ID NO: 634503 - DNA, 25 bp, Rattus norvegicus
tggcggcccggcagttaagcttgta

SEQ ID NO: 634504 - DNA, 25 bp, Rattus norvegicus
tggcggcccggctgttaagcttgta

SEQ ID NO: 634505 - DNA, 25 bp, Rattus norvegicus
tggcggccctacagagcgccttcgg

SEQ ID NO: 634506 - DNA, 25 bp, Rattus norvegicus
tggcggccctactgagcgccttcgg

SEQ ID NO: 634507 - DNA, 25 bp, Rattus norvegicus
tggcggccgtccatataaaaagaca

SEQ ID NO: 634508 - DNA, 25 bp, Rattus norvegicus
tggcggccgtccttataaaaagaca

SEQ ID NO: 634509 - DNA, 25 bp, Rattus norvegicus
tggcggcgcacaactacctgagagg

SEQ ID NO: 634510 - DNA, 25 bp, Rattus norvegicus
tggcggcgcacatctacctgagagg

SEQ ID NO: 634511 - DNA, 25 bp, Rattus norvegicus
tggcggcgctggctaaggaggagct

SEQ ID NO: 634512 - DNA, 25 bp, Rattus norvegicus
tggcggcgctgggtaaggaggagct

SEQ ID NO: 634513 - DNA, 25 bp, Rattus norvegicus
tggcggcgggcgcacggcgagcttc

SEQ ID NO: 634514 - DNA, 25 bp, Rattus norvegicus
tggcggcgggcggacggcgagcttc

SEQ ID NO: 634515 - DNA, 25 bp, Rattus norvegicus
tggcggctatggcaactatggttat

SEQ ID NO: 634516 - DNA, 25 bp, Rattus norvegicus
tggcggctatgggaactatggttat

SEQ ID NO: 634517 - DNA, 25 bp, Rattus norvegicus
tggcggctctgtccaacaactttga

SEQ ID NO: 634518 - DNA, 25 bp, Rattus norvegicus
tggcggctctgtgcaacaactttga

SEQ ID NO: 634519 - DNA, 25 bp, Rattus norvegicus
tggcggctgcagaccagctccgaaa

SEQ ID NO: 634520 - DNA, 25 bp, Rattus norvegicus
tggcggctgcagtccagctccgaaa

SEQ ID NO: 634521 - DNA, 25 bp, Rattus norvegicus
tggcggcttcttagcggtgacacag

SEQ ID NO: 634522 - DNA, 25 bp, Rattus norvegicus
tggcggcttctttgcggtgacacag

SEQ ID NO: 634523 - DNA, 25 bp, Rattus norvegicus
tggcggctttcgagggatcttcaat

SEQ ID NO: 634524 - DNA, 25 bp, Rattus norvegicus
tggcggctttcgtgggatcttcaat

SEQ ID NO: 634525 - DNA, 25 bp, Rattus norvegicus
tggcgggaaccaccctcaggagtta

SEQ ID NO: 634526 - DNA, 25 bp, Rattus norvegicus
tggcgggaaccagcctcaggagtta

SEQ ID NO: 634527 - DNA, 25 bp, Rattus norvegicus
tggcgggaggccacctttgtaccaa

SEQ ID NO: 634528 - DNA, 25 bp, Rattus norvegicus
tggcgggaggcctcctttgtaccaa

SEQ ID NO: 634529 - DNA, 25 bp, Rattus norvegicus
tggcgggcacttaccgtgttagaaa

SEQ ID NO: 634530 - DNA, 25 bp, Rattus norvegicus
tggcgggcactttccgtgttagaaa

SEQ ID NO: 634531 - DNA, 25 bp, Rattus norvegicus
tggcgggccctgaattatgaaataa

SEQ ID NO: 634532 - DNA, 25 bp, Rattus norvegicus
tggcgggccctgtattatgaaataa

SEQ ID NO: 634533 - DNA, 25 bp, Rattus norvegicus
tggcgggcggttcagattcccactt

SEQ ID NO: 634534 - DNA, 25 bp, Rattus norvegicus
tggcgggcggttgagattcccactt

SEQ ID NO: 634535 - DNA, 25 bp, Rattus norvegicus
tggcgggtaattctatcgggatatc

SEQ ID NO: 634536 - DNA, 25 bp, Rattus norvegicus
tggcgggtaattgtatcgggatatc

SEQ ID NO: 634537 - DNA, 25 bp, Rattus norvegicus
tggcgggtacttatctatcttttat

SEQ ID NO: 634538 - DNA, 25 bp, Rattus norvegicus
tggcgggtacttttctatcttttat

SEQ ID NO: 634539 - DNA, 25 bp, Rattus norvegicus
tggcggtacatcagcagcagcagca

SEQ ID NO: 634540 - DNA, 25 bp, Rattus norvegicus
tggcggtacatctgcagcagcagca

SEQ ID NO: 634541 - DNA, 25 bp, Rattus norvegicus
tggcggtaccacacgcgacaagcag

SEQ ID NO: 634542 - DNA, 25 bp, Rattus norvegicus
tggcggtaccactcgcgacaagcag

SEQ ID NO: 634543 - DNA, 25 bp, Rattus norvegicus
tggcggtacccacttttaatcctag

SEQ ID NO: 634544 - DNA, 25 bp, Rattus norvegicus
tggcggtacccagttttaatcctag

SEQ ID NO: 634545 - DNA, 25 bp, Rattus norvegicus
tggcggtaccttaggcactttcatg

SEQ ID NO: 634546 - DNA, 25 bp, Rattus norvegicus
tggcggtacctttggcactttcatg

SEQ ID NO: 634547 - DNA, 25 bp, Rattus norvegicus
tggcggtactaacgcctcagaccta

SEQ ID NO: 634548 - DNA, 25 bp, Rattus norvegicus
tggcggtactaaggcctcagaccta

SEQ ID NO: 634549 - DNA, 25 bp, Rattus norvegicus
tggcggtattgcagctggccctgtc

SEQ ID NO: 634550 - DNA, 25 bp, Rattus norvegicus
tggcggtattgctgctggccctgtc

SEQ ID NO: 634551 - DNA, 25 bp, Rattus norvegicus
tggcggtcaataagtcggcagtgtt

SEQ ID NO: 634552 - DNA, 25 bp, Rattus norvegicus
tggcggtcaatatgtcggcagtgtt

SEQ ID NO: 634553 - DNA, 25 bp, Rattus norvegicus
tggcggtcagccaagtaccacgaag

SEQ ID NO: 634554 - DNA, 25 bp, Rattus norvegicus
tggcggtcagcctagtaccacgaag

SEQ ID NO: 634555 - DNA, 25 bp, Rattus norvegicus
tggcggtcttgtatgtcacctactg

SEQ ID NO: 634556 - DNA, 25 bp, Rattus norvegicus
tggcggtcttgtttgtcacctactg

SEQ ID NO: 634557 - DNA, 25 bp, Rattus norvegicus
tggcggtgacacagactgtgcccat

SEQ ID NO: 634558 - DNA, 25 bp, Rattus norvegicus
tggcggtgacactgactgtgcccat

SEQ ID NO: 634559 - DNA, 25 bp, Rattus norvegicus
tggcggtgccacagtaattcagtac

SEQ ID NO: 634560 - DNA, 25 bp, Rattus norvegicus
tggcggtgccactgtaattcagtac

SEQ ID NO: 634561 - DNA, 25 bp, Rattus norvegicus
tggcggtggcggacttttttctcgt

SEQ ID NO: 634562 - DNA, 25 bp, Rattus norvegicus
tggcggtggcggaggctcagagttc

SEQ ID NO: 634563 - DNA, 25 bp, Rattus norvegicus
tggcggtggcggtcttttttctcgt

SEQ ID NO: 634564 - DNA, 25 bp, Rattus norvegicus
tggcggtggcggtggctcagagttc

SEQ ID NO: 634565 - DNA, 25 bp, Rattus norvegicus
tggcggttggatattccaagccgaa

SEQ ID NO: 634566 - DNA, 25 bp, Rattus norvegicus
tggcggttggattttccaagccgaa

SEQ ID NO: 634567 - DNA, 25 bp, Rattus norvegicus
tggcgtaaaatgaaagcttcctcgt

SEQ ID NO: 634568 - DNA, 25 bp, Rattus norvegicus
tggcgtaaaatgtaagcttcctcgt

SEQ ID NO: 634569 - DNA, 25 bp, Rattus norvegicus
tggcgtagccttctggagtttcact

SEQ ID NO: 634570 - DNA, 25 bp, Rattus norvegicus
tggcgtagccttgtggagtttcact

SEQ ID NO: 634571 - DNA, 25 bp, Rattus norvegicus
tggcgtattattaaaccttcacagt

SEQ ID NO: 634572 - DNA, 25 bp, Rattus norvegicus
tggcgtattatttaaccttcacagt

SEQ ID NO: 634573 - DNA, 25 bp, Rattus norvegicus
tggcgtcaccagcagataccacaag

SEQ ID NO: 634574 - DNA, 25 bp, Rattus norvegicus
tggcgtcaccaggagataccacaag

SEQ ID NO: 634575 - DNA, 25 bp, Rattus norvegicus
tggcgtcatatcaaagcatcaggtg

SEQ ID NO: 634576 - DNA, 25 bp, Rattus norvegicus
tggcgtcatatctaagcatcaggtg

SEQ ID NO: 634577 - DNA, 25 bp, Rattus norvegicus
tggcgtccaagcagctccagatgga

SEQ ID NO: 634578 - DNA, 25 bp, Rattus norvegicus
tggcgtccaagctgctccagatgga

SEQ ID NO: 634579 - DNA, 25 bp, Rattus norvegicus
tggcgtcccaaaccctcgtggctgg

SEQ ID NO: 634580 - DNA, 25 bp, Rattus norvegicus
tggcgtcccaaagcctcgtggctgg

SEQ ID NO: 634581 - DNA, 25 bp, Rattus norvegicus
tggcgtctaattcttcacctgagga

SEQ ID NO: 634582 - DNA, 25 bp, Rattus norvegicus
tggcgtctaattgttcacctgagga

SEQ ID NO: 634583 - DNA, 25 bp, Rattus norvegicus
tggcgtctcccaaacaacaagctgg

SEQ ID NO: 634584 - DNA, 25 bp, Rattus norvegicus
tggcgtctcccatacaacaagctgg

SEQ ID NO: 634585 - DNA, 25 bp, Rattus norvegicus
tggcgtctcgctatgtcaactgtta

SEQ ID NO: 634586 - DNA, 25 bp, Rattus norvegicus
tggcgtctcgctttgtcaactgtta

SEQ ID NO: 634587 - DNA, 25 bp, Rattus norvegicus
tggcgtctgtctcgagcagtcttga

SEQ ID NO: 634588 - DNA, 25 bp, Rattus norvegicus
tggcgtctgtctggagcagtcttga

SEQ ID NO: 634589 - DNA, 25 bp, Rattus norvegicus
tggcgtcttcaccaccatggagaag

SEQ ID NO: 634590 - DNA, 25 bp, Rattus norvegicus
tggcgtcttcacgaccatggagaag

SEQ ID NO: 634591 - DNA, 25 bp, Rattus norvegicus
tggcgtgaacccagcaatcatcatg

SEQ ID NO: 634592 - DNA, 25 bp, Rattus norvegicus
tggcgtgaaccctgcaatcatcatg

SEQ ID NO: 634593 - DNA, 25 bp, Rattus norvegicus
tggcgtgaacgaaggactgatctct

SEQ ID NO: 634594 - DNA, 25 bp, Rattus norvegicus
tggcgtgaacgatggactgatctct

SEQ ID NO: 634595 - DNA, 25 bp, Rattus norvegicus
tggcgtgacataacatggctaactc

SEQ ID NO: 634596 - DNA, 25 bp, Rattus norvegicus
tggcgtgacatatcatggctaactc

SEQ ID NO: 634597 - DNA, 25 bp, Rattus norvegicus
tggcgtgagattccactcgtgtaga

SEQ ID NO: 634598 - DNA, 25 bp, Rattus norvegicus
tggcgtgagattgcactcgtgtaga

SEQ ID NO: 634599 - DNA, 25 bp, Rattus norvegicus
tggcgtgcctagcatgtcatcggac

SEQ ID NO: 634600 - DNA, 25 bp, Rattus norvegicus
tggcgtgcctaggatgtcatcggac

SEQ ID NO: 634601 - DNA, 25 bp, Rattus norvegicus
tggcgtgcctgccatgacgtcatag

SEQ ID NO: 634602 - DNA, 25 bp, Rattus norvegicus
tggcgtgcctgcgatgacgtcatag

SEQ ID NO: 634603 - DNA, 25 bp, Rattus norvegicus
tggcgtgctatgagctttggcatat

SEQ ID NO: 634604 - DNA, 25 bp, Rattus norvegicus
tggcgtgctatgtgctttggcatat

SEQ ID NO: 634605 - DNA, 25 bp, Rattus norvegicus
tggcgtggagtaaactgtccgacaa

SEQ ID NO: 634606 - DNA, 25 bp, Rattus norvegicus
tggcgtggagtatactgtccgacaa

SEQ ID NO: 634607 - DNA, 25 bp, Rattus norvegicus
tggcgtggccacctatttcatgagt

SEQ ID NO: 634608 - DNA, 25 bp, Rattus norvegicus
tggcgtggccacgtatttcatgagt

SEQ ID NO: 634609 - DNA, 25 bp, Rattus norvegicus
tggcgtggctctccaggtcagaaca

SEQ ID NO: 634610 - DNA, 25 bp, Rattus norvegicus
tggcgtggctctgcaggtcagaaca

SEQ ID NO: 634611 - DNA, 25 bp, Rattus norvegicus
tggcgtggcttgctgctattgacaa

SEQ ID NO: 634612 - DNA, 25 bp, Rattus norvegicus
tggcgtggcttggtgctattgacaa

SEQ ID NO: 634613 - DNA, 25 bp, Rattus norvegicus
tggcgtgggccaagctgcaggtgga

SEQ ID NO: 634614 - DNA, 25 bp, Rattus norvegicus
tggcgtgggccatgctgcaggtgga

SEQ ID NO: 634615 - DNA, 25 bp, Rattus norvegicus
tggcgtgtgcaaacaggctgcccta

SEQ ID NO: 634616 - DNA, 25 bp, Rattus norvegicus
tggcgtgtgcaatcaggctgcccta

SEQ ID NO: 634617 - DNA, 25 bp, Rattus norvegicus
tggcgtgtgcctctaagtttagaac

SEQ ID NO: 634618 - DNA, 25 bp, Rattus norvegicus
tggcgtgtgcctgtaagtttagaac

SEQ ID NO: 634619 - DNA, 25 bp, Rattus norvegicus
tggcgtgtgctaagccgggacatac

SEQ ID NO: 634620 - DNA, 25 bp, Rattus norvegicus
tggcgtgtgctatgccgggacatac

SEQ ID NO: 634621 - DNA, 25 bp, Rattus norvegicus
tggcgtgtttggacaccactcagga

SEQ ID NO: 634622 - DNA, 25 bp, Rattus norvegicus
tggcgtgtttggtcaccactcagga

SEQ ID NO: 634623 - DNA, 25 bp, Rattus norvegicus
tggcgttcccgacgagaatttacct

SEQ ID NO: 634624 - DNA, 25 bp, Rattus norvegicus
tggcgttcccgaggagaatttacct

SEQ ID NO: 634625 - DNA, 25 bp, Rattus norvegicus
tggcgttctccccaaatcatcagga

SEQ ID NO: 634626 - DNA, 25 bp, Rattus norvegicus
tggcgttctcccgaaatcatcagga

SEQ ID NO: 634627 - DNA, 25 bp, Rattus norvegicus
tggcgttgaaatcacgaatcacttt

SEQ ID NO: 634628 - DNA, 25 bp, Rattus norvegicus
tggcgttgaaatgacgaatcacttt

SEQ ID NO: 634629 - DNA, 25 bp, Rattus norvegicus
tggcgttgccctaacatgattgatg

SEQ ID NO: 634630 - DNA, 25 bp, Rattus norvegicus
tggcgttgcccttacatgattgatg

SEQ ID NO: 634631 - DNA, 25 bp, Rattus norvegicus
tggcgttgctatatcagtgctaatg

SEQ ID NO: 634632 - DNA, 25 bp, Rattus norvegicus
tggcgttgctatttcagtgctaatg

SEQ ID NO: 634633 - DNA, 25 bp, Rattus norvegicus
tggcgttgggctaccaaaggccaaa

SEQ ID NO: 634634 - DNA, 25 bp, Rattus norvegicus
tggcgttgggcttccaaaggccaaa

SEQ ID NO: 634635 - DNA, 25 bp, Rattus norvegicus
tggcgtttgttccagaacgccgcct

SEQ ID NO: 634636 - DNA, 25 bp, Rattus norvegicus
tggcgtttgttcgagaacgccgcct

SEQ ID NO: 634637 - DNA, 25 bp, Rattus norvegicus
tggcgttttttgagacttcccaaca

SEQ ID NO: 634638 - DNA, 25 bp, Rattus norvegicus
tggcgttttttgtgacttcccaaca

SEQ ID NO: 634639 - DNA, 25 bp, Rattus norvegicus
tggctaaacaatccaaactccctaa

SEQ ID NO: 634640 - DNA, 25 bp, Rattus norvegicus
tggctaaacaatgcaaactccctaa

SEQ ID NO: 634641 - DNA, 25 bp, Rattus norvegicus
tggctaaacactcccttttaagctt

SEQ ID NO: 634642 - DNA, 25 bp, Rattus norvegicus
tggctaaacactgccttttaagctt

SEQ ID NO: 634643 - DNA, 25 bp, Rattus norvegicus
tggctaaatggcatccaatcctcca

SEQ ID NO: 634644 - DNA, 25 bp, Rattus norvegicus
tggctaaatggcttccaatcctcca

SEQ ID NO: 634645 - DNA, 25 bp, Rattus norvegicus
tggctaacctcacacagggcgatga

SEQ ID NO: 634646 - DNA, 25 bp, Rattus norvegicus
tggctaacctcagacagggcgatga

SEQ ID NO: 634647 - DNA, 25 bp, Rattus norvegicus
tggctaacctggagcgtgtgcagca

SEQ ID NO: 634648 - DNA, 25 bp, Rattus norvegicus
tggctaacctggtgcgtgtgcagca

SEQ ID NO: 634649 - DNA, 25 bp, Rattus norvegicus
tggctaagacataggtccgaggact

SEQ ID NO: 634650 - DNA, 25 bp, Rattus norvegicus
tggctaagacattggtccgaggact

SEQ ID NO: 634651 - DNA, 25 bp, Rattus norvegicus
tggctaagccccacgagatgcagat

SEQ ID NO: 634652 - DNA, 25 bp, Rattus norvegicus
tggctaagcccctcgagatgcagat

SEQ ID NO: 634653 - DNA, 25 bp, Rattus norvegicus
tggctaaggaatacttacacccagt

SEQ ID NO: 634654 - DNA, 25 bp, Rattus norvegicus
tggctaaggaattcttacacccagt

SEQ ID NO: 634655 - DNA, 25 bp, Rattus norvegicus
tggctaaggcccacctcaagactca

SEQ ID NO: 634656 - DNA, 25 bp, Rattus norvegicus
tggctaaggccctcctcaagactca

SEQ ID NO: 634657 - DNA, 25 bp, Rattus norvegicus
tggctaagggtgagctgctccttaa

SEQ ID NO: 634658 - DNA, 25 bp, Rattus norvegicus
tggctaagggtgtgctgctccttaa

SEQ ID NO: 634659 - DNA, 25 bp, Rattus norvegicus
tggctaatacttcgcgcacaatccc

SEQ ID NO: 634660 - DNA, 25 bp, Rattus norvegicus
tggctaatacttggcgcacaatccc

SEQ ID NO: 634661 - DNA, 25 bp, Rattus norvegicus
tggctaatctccataagtctgcgtt

SEQ ID NO: 634662 - DNA, 25 bp, Rattus norvegicus
tggctaatctccttaagtctgcgtt

SEQ ID NO: 634663 - DNA, 25 bp, Rattus norvegicus
tggctaatgccaactccggttctaa

SEQ ID NO: 634664 - DNA, 25 bp, Rattus norvegicus
tggctaatgccatctccggttctaa

SEQ ID NO: 634665 - DNA, 25 bp, Rattus norvegicus
tggctaattcctccatgctgggaga

SEQ ID NO: 634666 - DNA, 25 bp, Rattus norvegicus
tggctaattcctgcatgctgggaga

SEQ ID NO: 634667 - DNA, 25 bp, Rattus norvegicus
tggctacaacctaaggctttttata

SEQ ID NO: 634668 - DNA, 25 bp, Rattus norvegicus
tggctacaaccttaggctttttata

SEQ ID NO: 634669 - DNA, 25 bp, Rattus norvegicus
tggctacaaggcaccagggtaattg

SEQ ID NO: 634670 - DNA, 25 bp, Rattus norvegicus
tggctacaaggctccagggtaattg

SEQ ID NO: 634671 - DNA, 25 bp, Rattus norvegicus
tggctacactgaccttgaactattc

SEQ ID NO: 634672 - DNA, 25 bp, Rattus norvegicus
tggctacactgagcttgaactattc

SEQ ID NO: 634673 - DNA, 25 bp, Rattus norvegicus
tggctacagcttcaccaccacagct

SEQ ID NO: 634674 - DNA, 25 bp, Rattus norvegicus
tggctacagcttgaccaccacagct

SEQ ID NO: 634675 - DNA, 25 bp, Rattus norvegicus
tggctacagtggctttttgggctca

SEQ ID NO: 634676 - DNA, 25 bp, Rattus norvegicus
tggctacagtgggtttttgggctca

SEQ ID NO: 634677 - DNA, 25 bp, Rattus norvegicus
tggctaccacagatgcttcgacatg

SEQ ID NO: 634678 - DNA, 25 bp, Rattus norvegicus
tggctaccacagttgcttcgacatg

SEQ ID NO: 634679 - DNA, 25 bp, Rattus norvegicus
tggctaccacctcggatgcagaagg

SEQ ID NO: 634680 - DNA, 25 bp, Rattus norvegicus
tggctaccacctgggatgcagaagg

SEQ ID NO: 634681 - DNA, 25 bp, Rattus norvegicus
tggctaccagtcacatttctttatg

SEQ ID NO: 634682 - DNA, 25 bp, Rattus norvegicus
tggctaccagtctcatttctttatg

SEQ ID NO: 634683 - DNA, 25 bp, Rattus norvegicus
tggctacccagaagccaattacctg

SEQ ID NO: 634684 - DNA, 25 bp, Rattus norvegicus
tggctacccagatgccaattacctg

SEQ ID NO: 634685 - DNA, 25 bp, Rattus norvegicus
tggctaccccatcactctatgtgtg

SEQ ID NO: 634686 - DNA, 25 bp, Rattus norvegicus
tggctaccccatgactctatgtgtg

SEQ ID NO: 634687 - DNA, 25 bp, Rattus norvegicus
tggctaccgtggctctctgagactg

SEQ ID NO: 634688 - DNA, 25 bp, Rattus norvegicus
tggctaccgtgggtctctgagactg

SEQ ID NO: 634689 - DNA, 25 bp, Rattus norvegicus
tggctacctcaactgtattctcagg

SEQ ID NO: 634690 - DNA, 25 bp, Rattus norvegicus
tggctacctcaagtgtattctcagg

SEQ ID NO: 634691 - DNA, 25 bp, Rattus norvegicus
tggctacctgatcctagacttcaat

SEQ ID NO: 634692 - DNA, 25 bp, Rattus norvegicus
tggctacctgatgctagacttcaat

SEQ ID NO: 634693 - DNA, 25 bp, Rattus norvegicus
tggctacctgtgctttgctttgtac

SEQ ID NO: 634694 - DNA, 25 bp, Rattus norvegicus
tggctacctgtggtttgctttgtac

SEQ ID NO: 634695 - DNA, 25 bp, Rattus norvegicus
tggctacgcggtaggctgcggcaga

SEQ ID NO: 634696 - DNA, 25 bp, Rattus norvegicus
tggctacgcggttggctgcggcaga

SEQ ID NO: 634697 - DNA, 25 bp, Rattus norvegicus
tggctactcaacctgtgtctatctg

SEQ ID NO: 634698 - DNA, 25 bp, Rattus norvegicus
tggctactcaacgtgtgtctatctg

SEQ ID NO: 634699 - DNA, 25 bp, Rattus norvegicus
tggctactctgtacccatcccaggg

SEQ ID NO: 634700 - DNA, 25 bp, Rattus norvegicus
tggctactctgttcccatcccaggg

SEQ ID NO: 634701 - DNA, 25 bp, Rattus norvegicus
tggctactctttctgcttcgagaag

SEQ ID NO: 634702 - DNA, 25 bp, Rattus norvegicus
tggctactctttgtgcttcgagaag

SEQ ID NO: 634703 - DNA, 25 bp, Rattus norvegicus
tggctactggagactttgctgcaag

SEQ ID NO: 634704 - DNA, 25 bp, Rattus norvegicus
tggctactggagtctttgctgcaag

SEQ ID NO: 634705 - DNA, 25 bp, Rattus norvegicus
tggctacttttgatcttccgtggtg

SEQ ID NO: 634706 - DNA, 25 bp, Rattus norvegicus
tggctacttttgttcttccgtggtg

SEQ ID NO: 634707 - DNA, 25 bp, Rattus norvegicus
tggctagaaacccaggtccaagcat

SEQ ID NO: 634708 - DNA, 25 bp, Rattus norvegicus
tggctagaaaccctgcttaaacttt

SEQ ID NO: 634709 - DNA, 25 bp, Rattus norvegicus
tggctagaaaccgaggtccaagcat

SEQ ID NO: 634710 - DNA, 25 bp, Rattus norvegicus
tggctagaaaccgtgcttaaacttt

SEQ ID NO: 634711 - DNA, 25 bp, Rattus norvegicus
tggctagaaatgacactgtggaacc

SEQ ID NO: 634712 - DNA, 25 bp, Rattus norvegicus
tggctagaaatgtcactgtggaacc

SEQ ID NO: 634713 - DNA, 25 bp, Rattus norvegicus
tggctagaagtgagccctggctgct

SEQ ID NO: 634714 - DNA, 25 bp, Rattus norvegicus
tggctagaagtgtgccctggctgct

SEQ ID NO: 634715 - DNA, 25 bp, Rattus norvegicus
tggctagaatttctgtgaaccactc

SEQ ID NO: 634716 - DNA, 25 bp, Rattus norvegicus
tggctagaatttgtgtgaaccactc

SEQ ID NO: 634717 - DNA, 25 bp, Rattus norvegicus
tggctagactctctataggaaggca

SEQ ID NO: 634718 - DNA, 25 bp, Rattus norvegicus
tggctagactctgtataggaaggca

SEQ ID NO: 634719 - DNA, 25 bp, Rattus norvegicus
tggctagagcgtctccatctcggtg

SEQ ID NO: 634720 - DNA, 25 bp, Rattus norvegicus
tggctagagcgtgtccatctcggtg

SEQ ID NO: 634721 - DNA, 25 bp, Rattus norvegicus
tggctagaggtgattgtcccttgca

SEQ ID NO: 634722 - DNA, 25 bp, Rattus norvegicus
tggctagaggtgtttgtcccttgca

SEQ ID NO: 634723 - DNA, 25 bp, Rattus norvegicus
tggctagcccgtaactaactcggca

SEQ ID NO: 634724 - DNA, 25 bp, Rattus norvegicus
tggctagcccgttactaactcggca

SEQ ID NO: 634725 - DNA, 25 bp, Rattus norvegicus
tggctagccctcagtgtgacacaaa

SEQ ID NO: 634726 - DNA, 25 bp, Rattus norvegicus
tggctagccctctgtgtgacacaaa

SEQ ID NO: 634727 - DNA, 25 bp, Rattus norvegicus
tggctaggaatgcatcccgctgtgt

SEQ ID NO: 634728 - DNA, 25 bp, Rattus norvegicus
tggctaggaatggatcccgctgtgt

SEQ ID NO: 634729 - DNA, 25 bp, Rattus norvegicus
tggctaggatggaaagcactttcat

SEQ ID NO: 634730 - DNA, 25 bp, Rattus norvegicus
tggctaggatggtaagcactttcat

SEQ ID NO: 634731 - DNA, 25 bp, Rattus norvegicus
tggctagggatgcagctcagtttcc

SEQ ID NO: 634732 - DNA, 25 bp, Rattus norvegicus
tggctagggatggagctcagtttcc

SEQ ID NO: 634733 - DNA, 25 bp, Rattus norvegicus
tggctagtcacaaatctgctgctgt

SEQ ID NO: 634734 - DNA, 25 bp, Rattus norvegicus
tggctagtcacatatctgctgctgt

SEQ ID NO: 634735 - DNA, 25 bp, Rattus norvegicus
tggctagtcgccctaccagtaaacg

SEQ ID NO: 634736 - DNA, 25 bp, Rattus norvegicus
tggctagtcgccgtaccagtaaacg

SEQ ID NO: 634737 - DNA, 25 bp, Rattus norvegicus
tggctagtctgtcaagttgcttttg

SEQ ID NO: 634738 - DNA, 25 bp, Rattus norvegicus
tggctagtctgtgaagttgcttttg

SEQ ID NO: 634739 - DNA, 25 bp, Rattus norvegicus
tggctagtggttaactgtacctcct

SEQ ID NO: 634740 - DNA, 25 bp, Rattus norvegicus
tggctagtggtttactgtacctcct

SEQ ID NO: 634741 - DNA, 25 bp, Rattus norvegicus
tggctagttctgagtcagcttgcta

SEQ ID NO: 634742 - DNA, 25 bp, Rattus norvegicus
tggctagttctgtgtcagcttgcta

SEQ ID NO: 634743 - DNA, 25 bp, Rattus norvegicus
tggctataagttacccagtttcctt

SEQ ID NO: 634744 - DNA, 25 bp, Rattus norvegicus
tggctataagtttcccagtttcctt

SEQ ID NO: 634745 - DNA, 25 bp, Rattus norvegicus
tggctataattcatgcaactgcttc

SEQ ID NO: 634746 - DNA, 25 bp, Rattus norvegicus
tggctataattcttgcaactgcttc

SEQ ID NO: 634747 - DNA, 25 bp, Rattus norvegicus
tggctatacagccattcaagccctg

SEQ ID NO: 634748 - DNA, 25 bp, Rattus norvegicus
tggctatacagcgattcaagccctg

SEQ ID NO: 634749 - DNA, 25 bp, Rattus norvegicus
tggctataggaacgtctcactcccc

SEQ ID NO: 634750 - DNA, 25 bp, Rattus norvegicus
tggctataggaaggtctcactcccc

SEQ ID NO: 634751 - DNA, 25 bp, Rattus norvegicus
tggctatcaaatcctcgtgtggcac

SEQ ID NO: 634752 - DNA, 25 bp, Rattus norvegicus
tggctatcaaatgctcgtgtggcac

SEQ ID NO: 634753 - DNA, 25 bp, Rattus norvegicus
tggctatcattgacccaggtgattc

SEQ ID NO: 634754 - DNA, 25 bp, Rattus norvegicus
tggctatcattgtcccaggtgattc

SEQ ID NO: 634755 - DNA, 25 bp, Rattus norvegicus
tggctatccataatcagtaaacaaa

SEQ ID NO: 634756 - DNA, 25 bp, Rattus norvegicus
tggctatccatattcagtaaacaaa

SEQ ID NO: 634757 - DNA, 25 bp, Rattus norvegicus
tggctatcctgaaacccatcagaag

SEQ ID NO: 634758 - DNA, 25 bp, Rattus norvegicus
tggctatcctgatacccatcagaag

SEQ ID NO: 634759 - DNA, 25 bp, Rattus norvegicus
tggctatcctgtcaaccagcctggc

SEQ ID NO: 634760 - DNA, 25 bp, Rattus norvegicus
tggctatcctgtgaaccagcctggc

SEQ ID NO: 634761 - DNA, 25 bp, Rattus norvegicus
tggctatcgagcagctcctcaagaa

SEQ ID NO: 634762 - DNA, 25 bp, Rattus norvegicus
tggctatcgagctgctcctcaagaa

SEQ ID NO: 634763 - DNA, 25 bp, Rattus norvegicus
tggctatctagacggattcctcgtt

SEQ ID NO: 634764 - DNA, 25 bp, Rattus norvegicus
tggctatctagagggattcctcgtt

SEQ ID NO: 634765 - DNA, 25 bp, Rattus norvegicus
tggctatctggccaccatggcagga

SEQ ID NO: 634766 - DNA, 25 bp, Rattus norvegicus
tggctatctggcgaccatggcagga

SEQ ID NO: 634767 - DNA, 25 bp, Rattus norvegicus
tggctatcttatactaatgttgttt

SEQ ID NO: 634768 - DNA, 25 bp, Rattus norvegicus
tggctatcttattctaatgttgttt

SEQ ID NO: 634769 - DNA, 25 bp, Rattus norvegicus
tggctatcttccacaagtactctgg

SEQ ID NO: 634770 - DNA, 25 bp, Rattus norvegicus
tggctatcttcctcaagtactctgg

SEQ ID NO: 634771 - DNA, 25 bp, Rattus norvegicus
tggctatgacaaagacttcttctgt

SEQ ID NO: 634772 - DNA, 25 bp, Rattus norvegicus
tggctatgacaatgacttcttctgt

SEQ ID NO: 634773 - DNA, 25 bp, Rattus norvegicus
tggctatgactgacccgctcagagc

SEQ ID NO: 634774 - DNA, 25 bp, Rattus norvegicus
tggctatgactgtcccgctcagagc

SEQ ID NO: 634775 - DNA, 25 bp, Rattus norvegicus
tggctatggaagctctgcactgaga

SEQ ID NO: 634776 - DNA, 25 bp, Rattus norvegicus
tggctatggaaggtctgcactgaga

SEQ ID NO: 634777 - DNA, 25 bp, Rattus norvegicus
tggctatggccaattgtatttcccc

SEQ ID NO: 634778 - DNA, 25 bp, Rattus norvegicus
tggctatggccatttgtatttcccc

SEQ ID NO: 634779 - DNA, 25 bp, Rattus norvegicus
tggctatggcggctatgactatacg

SEQ ID NO: 634780 - DNA, 25 bp, Rattus norvegicus
tggctatggcgggtatgactatacg

SEQ ID NO: 634781 - DNA, 25 bp, Rattus norvegicus
tggctatggctcagaccaagggctt

SEQ ID NO: 634782 - DNA, 25 bp, Rattus norvegicus
tggctatggctctgaccaagggctt

SEQ ID NO: 634783 - DNA, 25 bp, Rattus norvegicus
tggctattcagaatgcctgcggaat

SEQ ID NO: 634784 - DNA, 25 bp, Rattus norvegicus
tggctattcagattgcctgcggaat

SEQ ID NO: 634785 - DNA, 25 bp, Rattus norvegicus
tggctattgagcacttcctcatggt

SEQ ID NO: 634786 - DNA, 25 bp, Rattus norvegicus
tggctattgagctcttcctcatggt

SEQ ID NO: 634787 - DNA, 25 bp, Rattus norvegicus
tggctattgttcatgtgtaccctga

SEQ ID NO: 634788 - DNA, 25 bp, Rattus norvegicus
tggctattgttcttgtgtaccctga

SEQ ID NO: 634789 - DNA, 25 bp, Rattus norvegicus
tggctatttccaactccacataaat

SEQ ID NO: 634790 - DNA, 25 bp, Rattus norvegicus
tggctatttccatctccacataaat

SEQ ID NO: 634791 - DNA, 25 bp, Rattus norvegicus
tggctattttccatactttcctcac

SEQ ID NO: 634792 - DNA, 25 bp, Rattus norvegicus
tggctattttccttactttcctcac

SEQ ID NO: 634793 - DNA, 25 bp, Rattus norvegicus
tggctcaaagaaaggtctagaatga

SEQ ID NO: 634794 - DNA, 25 bp, Rattus norvegicus
tggctcaaagaatggtctagaatga

SEQ ID NO: 634795 - DNA, 25 bp, Rattus norvegicus
tggctcaactagcttgctgctgcat

SEQ ID NO: 634796 - DNA, 25 bp, Rattus norvegicus
tggctcaactaggttgctgctgcat

SEQ ID NO: 634797 - DNA, 25 bp, Rattus norvegicus
tggctcaagagcacactgcctgtga

SEQ ID NO: 634798 - DNA, 25 bp, Rattus norvegicus
tggctcaagagctcactgcctgtga

SEQ ID NO: 634799 - DNA, 25 bp, Rattus norvegicus
tggctcaaggataccattcgttttt

SEQ ID NO: 634800 - DNA, 25 bp, Rattus norvegicus
tggctcaaggattccattcgttttt

SEQ ID NO: 634801 - DNA, 25 bp, Rattus norvegicus
tggctcaagtgtcgcagctgctgaa

SEQ ID NO: 634802 - DNA, 25 bp, Rattus norvegicus
tggctcaagtgtggcagctgctgaa

SEQ ID NO: 634803 - DNA, 25 bp, Rattus norvegicus
tggctcaatctcatctctcaggata

SEQ ID NO: 634804 - DNA, 25 bp, Rattus norvegicus
tggctcaatctcttctctcaggata

SEQ ID NO: 634805 - DNA, 25 bp, Rattus norvegicus
tggctcaatgtcatcatcaggtaca

SEQ ID NO: 634806 - DNA, 25 bp, Rattus norvegicus
tggctcaatgtcttcatcaggtaca

SEQ ID NO: 634807 - DNA, 25 bp, Rattus norvegicus
tggctcacaacaacctgttactatc

SEQ ID NO: 634808 - DNA, 25 bp, Rattus norvegicus
tggctcacaacatcctgttactatc

SEQ ID NO: 634809 - DNA, 25 bp, Rattus norvegicus
tggctcacaactatccgtatgggat

SEQ ID NO: 634810 - DNA, 25 bp, Rattus norvegicus
tggctcacaactcttcttacctgtc

SEQ ID NO: 634811 - DNA, 25 bp, Rattus norvegicus
tggctcacaactgttcttacctgtc

SEQ ID NO: 634812 - DNA, 25 bp, Rattus norvegicus
tggctcacaactttccgtatgggat

SEQ ID NO: 634813 - DNA, 25 bp, Rattus norvegicus
tggctcacacagaggtgccctgaga

SEQ ID NO: 634814 - DNA, 25 bp, Rattus norvegicus
tggctcacacagtggtgccctgaga

SEQ ID NO: 634815 - DNA, 25 bp, Rattus norvegicus
tggctcacacgcaacaccttgggtc

SEQ ID NO: 634816 - DNA, 25 bp, Rattus norvegicus
tggctcacacgctacaccttgggtc

SEQ ID NO: 634817 - DNA, 25 bp, Rattus norvegicus
tggctcacacgtacatgcaactagg

SEQ ID NO: 634818 - DNA, 25 bp, Rattus norvegicus
tggctcacacgttcatgcaactagg

SEQ ID NO: 634819 - DNA, 25 bp, Rattus norvegicus
tggctcacagagctgcttgtccagt

SEQ ID NO: 634820 - DNA, 25 bp, Rattus norvegicus
tggctcacagaggtgcttgtccagt

SEQ ID NO: 634821 - DNA, 25 bp, Rattus norvegicus
tggctcacagcacttctggatccag

SEQ ID NO: 634822 - DNA, 25 bp, Rattus norvegicus
tggctcacagcagttctggatccag

SEQ ID NO: 634823 - DNA, 25 bp, Rattus norvegicus
tggctcacagccacgtgtcgaagtg

SEQ ID NO: 634824 - DNA, 25 bp, Rattus norvegicus
tggctcacagccattacctgggtgg

SEQ ID NO: 634825 - DNA, 25 bp, Rattus norvegicus
tggctcacagcctcgtgtcgaagtg

SEQ ID NO: 634826 - DNA, 25 bp, Rattus norvegicus
tggctcacagcctttacctgggtgg

SEQ ID NO: 634827 - DNA, 25 bp, Rattus norvegicus
tggctcacagctcgccttagtgatg

SEQ ID NO: 634828 - DNA, 25 bp, Rattus norvegicus
tggctcacagctggccttagtgatg

SEQ ID NO: 634829 - DNA, 25 bp, Rattus norvegicus
tggctcacaggaaaagggcacttaa

SEQ ID NO: 634830 - DNA, 25 bp, Rattus norvegicus
tggctcacaggataagggcacttaa

SEQ ID NO: 634831 - DNA, 25 bp, Rattus norvegicus
tggctcacagtgaaggatgatgtag

SEQ ID NO: 634832 - DNA, 25 bp, Rattus norvegicus
tggctcacagtgtaggatgatgtag

SEQ ID NO: 634833 - DNA, 25 bp, Rattus norvegicus
tggctcacatggacacagtagttct

SEQ ID NO: 634834 - DNA, 25 bp, Rattus norvegicus
tggctcacatggcaggattcagctt

SEQ ID NO: 634835 - DNA, 25 bp, Rattus norvegicus
tggctcacatgggaggattcagctt

SEQ ID NO: 634836 - DNA, 25 bp, Rattus norvegicus
tggctcacatggtcacagtagttct

SEQ ID NO: 634837 - DNA, 25 bp, Rattus norvegicus
tggctcaccactcgcagaggacggc

SEQ ID NO: 634838 - DNA, 25 bp, Rattus norvegicus
tggctcaccactggcagaggacggc

SEQ ID NO: 634839 - DNA, 25 bp, Rattus norvegicus
tggctcaccagacattcagaagaag

SEQ ID NO: 634840 - DNA, 25 bp, Rattus norvegicus
tggctcaccagagattcagaagaag

SEQ ID NO: 634841 - DNA, 25 bp, Rattus norvegicus
tggctcaccctcaaaacaagaaagt

SEQ ID NO: 634842 - DNA, 25 bp, Rattus norvegicus
tggctcaccctctaaacaagaaagt

SEQ ID NO: 634843 - DNA, 25 bp, Rattus norvegicus
tggctcacccttacctggaacagta

SEQ ID NO: 634844 - DNA, 25 bp, Rattus norvegicus
tggctcaccctttcctggaacagta

SEQ ID NO: 634845 - DNA, 25 bp, Rattus norvegicus
tggctcacctggagctcagtacact

SEQ ID NO: 634846 - DNA, 25 bp, Rattus norvegicus
tggctcacctggtgctcagtacact

SEQ ID NO: 634847 - DNA, 25 bp, Rattus norvegicus
tggctcacgggcacggtggtgggtt

SEQ ID NO: 634848 - DNA, 25 bp, Rattus norvegicus
tggctcacgggctcggtggtgggtt

SEQ ID NO: 634849 - DNA, 25 bp, Rattus norvegicus
tggctcacgggtaaagagcaccgta

SEQ ID NO: 634850 - DNA, 25 bp, Rattus norvegicus
tggctcacgggttaagagcaccgta

SEQ ID NO: 634851 - DNA, 25 bp, Rattus norvegicus
tggctcagagagaaatgggtgtaat

SEQ ID NO: 634852 - DNA, 25 bp, Rattus norvegicus
tggctcagagagtaatgggtgtaat

SEQ ID NO: 634853 - DNA, 25 bp, Rattus norvegicus
tggctcagagcgcatgtgtcacaga

SEQ ID NO: 634854 - DNA, 25 bp, Rattus norvegicus
tggctcagagcggatgtgtcacaga

SEQ ID NO: 634855 - DNA, 25 bp, Rattus norvegicus
tggctcagagctactcatcaccaag

SEQ ID NO: 634856 - DNA, 25 bp, Rattus norvegicus
tggctcagagcttctcatcaccaag

SEQ ID NO: 634857 - DNA, 25 bp, Rattus norvegicus
tggctcagatgacgcacttctttca

SEQ ID NO: 634858 - DNA, 25 bp, Rattus norvegicus
tggctcagatgaggcacttctttca

SEQ ID NO: 634859 - DNA, 25 bp, Rattus norvegicus
tggctcagatttcacagctctaggc

SEQ ID NO: 634860 - DNA, 25 bp, Rattus norvegicus
tggctcagatttgacagctctaggc

SEQ ID NO: 634861 - DNA, 25 bp, Rattus norvegicus
tggctcagcatcaagctctcagaag

SEQ ID NO: 634862 - DNA, 25 bp, Rattus norvegicus
tggctcagcatctagctctcagaag

SEQ ID NO: 634863 - DNA, 25 bp, Rattus norvegicus
tggctcagctcactgaggccaggtc

SEQ ID NO: 634864 - DNA, 25 bp, Rattus norvegicus
tggctcagctcagtgaggccaggtc

SEQ ID NO: 634865 - DNA, 25 bp, Rattus norvegicus
tggctcagctcgagcgcctccagag

SEQ ID NO: 634866 - DNA, 25 bp, Rattus norvegicus
tggctcagctcgtgcgcctccagag

SEQ ID NO: 634867 - DNA, 25 bp, Rattus norvegicus
tggctcagctctcttgtgttagcaa

SEQ ID NO: 634868 - DNA, 25 bp, Rattus norvegicus
tggctcagctctgttgtgttagcaa

SEQ ID NO: 634869 - DNA, 25 bp, Rattus norvegicus
tggctcagctgcctgctgcccgatt

SEQ ID NO: 634870 - DNA, 25 bp, Rattus norvegicus
tggctcagctgcgtgctgcccgatt

SEQ ID NO: 634871 - DNA, 25 bp, Rattus norvegicus
tggctcagctgtagcctgatcaatc

SEQ ID NO: 634872 - DNA, 25 bp, Rattus norvegicus
tggctcagctgttgcctgatcaatc

SEQ ID NO: 634873 - DNA, 25 bp, Rattus norvegicus
tggctcaggcagatgtcaggagact

SEQ ID NO: 634874 - DNA, 25 bp, Rattus norvegicus
tggctcaggcagttgtcaggagact

SEQ ID NO: 634875 - DNA, 25 bp, Rattus norvegicus
tggctcaggccaatttagtcgactc

SEQ ID NO: 634876 - DNA, 25 bp, Rattus norvegicus
tggctcaggccattttagtcgactc

SEQ ID NO: 634877 - DNA, 25 bp, Rattus norvegicus
tggctcagtcaaacactatggatgc

SEQ ID NO: 634878 - DNA, 25 bp, Rattus norvegicus
tggctcagtcaatcactatggatgc

SEQ ID NO: 634879 - DNA, 25 bp, Rattus norvegicus
tggctcagtgacagatgctccctga

SEQ ID NO: 634880 - DNA, 25 bp, Rattus norvegicus
tggctcagtgactgatgctccctga

SEQ ID NO: 634881 - DNA, 25 bp, Rattus norvegicus
tggctcagtgggaactgtacttcta

SEQ ID NO: 634882 - DNA, 25 bp, Rattus norvegicus
tggctcagtgggtactgtacttcta

SEQ ID NO: 634883 - DNA, 25 bp, Rattus norvegicus
tggctcagtggtaaggagcactggc

SEQ ID NO: 634884 - DNA, 25 bp, Rattus norvegicus
tggctcagtggttaggagcactggc

SEQ ID NO: 634885 - DNA, 25 bp, Rattus norvegicus
tggctcagttgtaaagacctccgac

SEQ ID NO: 634886 - DNA, 25 bp, Rattus norvegicus
tggctcagttgttaagacctccgac

SEQ ID NO: 634887 - DNA, 25 bp, Rattus norvegicus
tggctcatcagcaacactcgatctc

SEQ ID NO: 634888 - DNA, 25 bp, Rattus norvegicus
tggctcatcagcacctaagataatt

SEQ ID NO: 634889 - DNA, 25 bp, Rattus norvegicus
tggctcatcagctacactcgatctc

SEQ ID NO: 634890 - DNA, 25 bp, Rattus norvegicus
tggctcatcagctcctaagataatt

SEQ ID NO: 634891 - DNA, 25 bp, Rattus norvegicus
tggctcatccagagagtgtcaccta

SEQ ID NO: 634892 - DNA, 25 bp, Rattus norvegicus
tggctcatccagtgagtgtcaccta

SEQ ID NO: 634893 - DNA, 25 bp, Rattus norvegicus
tggctcatcctgagtcatcagagac

SEQ ID NO: 634894 - DNA, 25 bp, Rattus norvegicus
tggctcatcctgtgtcatcagagac

SEQ ID NO: 634895 - DNA, 25 bp, Rattus norvegicus
tggctcatgagcatcgttacccagg

SEQ ID NO: 634896 - DNA, 25 bp, Rattus norvegicus
tggctcatgagcttcgttacccagg

SEQ ID NO: 634897 - DNA, 25 bp, Rattus norvegicus
tggctcatggtcaactttcttcttt

SEQ ID NO: 634898 - DNA, 25 bp, Rattus norvegicus
tggctcatggtctactttcttcttt

SEQ ID NO: 634899 - DNA, 25 bp, Rattus norvegicus
tggctcattcccataatctaagcgc

SEQ ID NO: 634900 - DNA, 25 bp, Rattus norvegicus
tggctcattcccttaatctaagcgc

SEQ ID NO: 634901 - DNA, 25 bp, Rattus norvegicus
tggctcattgagctcaacggtgccc

SEQ ID NO: 634902 - DNA, 25 bp, Rattus norvegicus
tggctcattgaggtcaacggtgccc

SEQ ID NO: 634903 - DNA, 25 bp, Rattus norvegicus
tggctcattgttagtttccttccca

SEQ ID NO: 634904 - DNA, 25 bp, Rattus norvegicus
tggctcattgtttgtttccttccca

SEQ ID NO: 634905 - DNA, 25 bp, Rattus norvegicus
tggctcatttttaaccacccataaa

SEQ ID NO: 634906 - DNA, 25 bp, Rattus norvegicus
tggctcattttttaccacccataaa

SEQ ID NO: 634907 - DNA, 25 bp, Rattus norvegicus
tggctccaaagcatcctatagatta

SEQ ID NO: 634908 - DNA, 25 bp, Rattus norvegicus
tggctccaaagcttcctatagatta

SEQ ID NO: 634909 - DNA, 25 bp, Rattus norvegicus
tggctccacacaagaccagtactat

SEQ ID NO: 634910 - DNA, 25 bp, Rattus norvegicus
tggctccacacatgaccagtactat

SEQ ID NO: 634911 - DNA, 25 bp, Rattus norvegicus
tggctccacagtatcgaggtgcctg

SEQ ID NO: 634912 - DNA, 25 bp, Rattus norvegicus
tggctccacagtttcgaggtgcctg

SEQ ID NO: 634913 - DNA, 25 bp, Rattus norvegicus
tggctccacctcaaaggtcaaactg

SEQ ID NO: 634914 - DNA, 25 bp, Rattus norvegicus
tggctccacctctaaggtcaaactg

SEQ ID NO: 634915 - DNA, 25 bp, Rattus norvegicus
tggctccactgtcacctggtgtctc

SEQ ID NO: 634916 - DNA, 25 bp, Rattus norvegicus
tggctccactgtgacctggtgtctc

SEQ ID NO: 634917 - DNA, 25 bp, Rattus norvegicus
tggctccagagacctgagttgtcat

SEQ ID NO: 634918 - DNA, 25 bp, Rattus norvegicus
tggctccagagagctgagttgtcat

SEQ ID NO: 634919 - DNA, 25 bp, Rattus norvegicus
tggctccagcataccagaaggtcac

SEQ ID NO: 634920 - DNA, 25 bp, Rattus norvegicus
tggctccagcattccagaaggtcac

SEQ ID NO: 634921 - DNA, 25 bp, Rattus norvegicus
tggctccagcccaacatacaaacat

SEQ ID NO: 634922 - DNA, 25 bp, Rattus norvegicus
tggctccagccctacatacaaacat

SEQ ID NO: 634923 - DNA, 25 bp, Rattus norvegicus
tggctccaggcgatactcagtgatc

SEQ ID NO: 634924 - DNA, 25 bp, Rattus norvegicus
tggctccaggcgttactcagtgatc

SEQ ID NO: 634925 - DNA, 25 bp, Rattus norvegicus
tggctccatagcctatgtgcagtaa

SEQ ID NO: 634926 - DNA, 25 bp, Rattus norvegicus
tggctccatagcgtatgtgcagtaa

SEQ ID NO: 634927 - DNA, 25 bp, Rattus norvegicus
tggctccatccacaaagatttacgg

SEQ ID NO: 634928 - DNA, 25 bp, Rattus norvegicus
tggctccatccagaaagatttacgg

SEQ ID NO: 634929 - DNA, 25 bp, Rattus norvegicus
tggctccatctccactggtctggat

SEQ ID NO: 634930 - DNA, 25 bp, Rattus norvegicus
tggctccatctcgactggtctggat

SEQ ID NO: 634931 - DNA, 25 bp, Rattus norvegicus
tggctcccacagcactttgtatata

SEQ ID NO: 634932 - DNA, 25 bp, Rattus norvegicus
tggctcccacaggactttgtatata

SEQ ID NO: 634933 - DNA, 25 bp, Rattus norvegicus
tggctcccagacctaatgttgctat

SEQ ID NO: 634934 - DNA, 25 bp, Rattus norvegicus
tggctcccagacgtaatgttgctat

SEQ ID NO: 634935 - DNA, 25 bp, Rattus norvegicus
tggctcccagcacatctgcaagaag

SEQ ID NO: 634936 - DNA, 25 bp, Rattus norvegicus
tggctcccagcagatctgcaagaag

SEQ ID NO: 634937 - DNA, 25 bp, Rattus norvegicus
tggctcccagggaagtcttgtcatg

SEQ ID NO: 634938 - DNA, 25 bp, Rattus norvegicus
tggctcccagggatgctaaaaacca

SEQ ID NO: 634939 - DNA, 25 bp, Rattus norvegicus
tggctcccagggtagtcttgtcatg

SEQ ID NO: 634940 - DNA, 25 bp, Rattus norvegicus
tggctcccagggttgctaaaaacca

SEQ ID NO: 634941 - DNA, 25 bp, Rattus norvegicus
tggctcccagtactgctccagtgtg

SEQ ID NO: 634942 - DNA, 25 bp, Rattus norvegicus
tggctcccagtagtgctccagtgtg

SEQ ID NO: 634943 - DNA, 25 bp, Rattus norvegicus
tggctcccagttatttcatcgagaa

SEQ ID NO: 634944 - DNA, 25 bp, Rattus norvegicus
tggctcccagttttttcatcgagaa

SEQ ID NO: 634945 - DNA, 25 bp, Rattus norvegicus
tggctcccatggacactaggaagct

SEQ ID NO: 634946 - DNA, 25 bp, Rattus norvegicus
tggctcccatggtcactaggaagct

SEQ ID NO: 634947 - DNA, 25 bp, Rattus norvegicus
tggctcccatgtattaccgaggctc

SEQ ID NO: 634948 - DNA, 25 bp, Rattus norvegicus
tggctcccatgttttaccgaggctc

SEQ ID NO: 634949 - DNA, 25 bp, Rattus norvegicus
tggctccccgcaaaggatacaacat

SEQ ID NO: 634950 - DNA, 25 bp, Rattus norvegicus
tggctccccgcataggatacaacat

SEQ ID NO: 634951 - DNA, 25 bp, Rattus norvegicus
tggctcccctgcattgtgagttagg

SEQ ID NO: 634952 - DNA, 25 bp, Rattus norvegicus
tggctcccctgctttgtgagttagg

SEQ ID NO: 634953 - DNA, 25 bp, Rattus norvegicus
tggctcccctttcacttatgagtga

SEQ ID NO: 634954 - DNA, 25 bp, Rattus norvegicus
tggctcccctttgacttatgagtga

SEQ ID NO: 634955 - DNA, 25 bp, Rattus norvegicus
tggctccctatgcaggatcctgata

SEQ ID NO: 634956 - DNA, 25 bp, Rattus norvegicus
tggctccctatggaggatcctgata

SEQ ID NO: 634957 - DNA, 25 bp, Rattus norvegicus
tggctccctttcagtatcatcaaat

SEQ ID NO: 634958 - DNA, 25 bp, Rattus norvegicus
tggctccctttctgtatcatcaaat

SEQ ID NO: 634959 - DNA, 25 bp, Rattus norvegicus
tggctccgaacaccagatcaaccat

SEQ ID NO: 634960 - DNA, 25 bp, Rattus norvegicus
tggctccgaacagcagatcaaccat

SEQ ID NO: 634961 - DNA, 25 bp, Rattus norvegicus
tggctccgttcaacagactgaggtg

SEQ ID NO: 634962 - DNA, 25 bp, Rattus norvegicus
tggctccgttcatcagactgaggtg

SEQ ID NO: 634963 - DNA, 25 bp, Rattus norvegicus
tggctccgttggcttgtgtttctag

SEQ ID NO: 634964 - DNA, 25 bp, Rattus norvegicus
tggctccgttgggttgtgtttctag

SEQ ID NO: 634965 - DNA, 25 bp, Rattus norvegicus
tggctcctaaaaattgtgcacctgc

SEQ ID NO: 634966 - DNA, 25 bp, Rattus norvegicus
tggctcctaaaatttgtgcacctgc

SEQ ID NO: 634967 - DNA, 25 bp, Rattus norvegicus
tggctcctacccaaacagtcaaatg

SEQ ID NO: 634968 - DNA, 25 bp, Rattus norvegicus
tggctcctaccctaacagtcaaatg

SEQ ID NO: 634969 - DNA, 25 bp, Rattus norvegicus
tggctcctactaacccaaagctaag

SEQ ID NO: 634970 - DNA, 25 bp, Rattus norvegicus
tggctcctactatcccaaagctaag

SEQ ID NO: 634971 - DNA, 25 bp, Rattus norvegicus
tggctcctactcattgtttcaggtc

SEQ ID NO: 634972 - DNA, 25 bp, Rattus norvegicus
tggctcctactctttgtttcaggtc

SEQ ID NO: 634973 - DNA, 25 bp, Rattus norvegicus
tggctcctagacatttcttcagaat

SEQ ID NO: 634974 - DNA, 25 bp, Rattus norvegicus
tggctcctagacttttcttcagaat

SEQ ID NO: 634975 - DNA, 25 bp, Rattus norvegicus
tggctcctccatctgcttggtcatg

SEQ ID NO: 634976 - DNA, 25 bp, Rattus norvegicus
tggctcctccatgtgcttggtcatg

SEQ ID NO: 634977 - DNA, 25 bp, Rattus norvegicus
tggctcctccgcaaggcacatgaga

SEQ ID NO: 634978 - DNA, 25 bp, Rattus norvegicus
tggctcctccgctaggcacatgaga

SEQ ID NO: 634979 - DNA, 25 bp, Rattus norvegicus
tggctcctcgatcattacagaactt

SEQ ID NO: 634980 - DNA, 25 bp, Rattus norvegicus
tggctcctcgatgattacagaactt

SEQ ID NO: 634981 - DNA, 25 bp, Rattus norvegicus
tggctcctctagctgtcagagtggt

SEQ ID NO: 634982 - DNA, 25 bp, Rattus norvegicus
tggctcctctagcttttcatgggtc

SEQ ID NO: 634983 - DNA, 25 bp, Rattus norvegicus
tggctcctctaggtgtcagagtggt

SEQ ID NO: 634984 - DNA, 25 bp, Rattus norvegicus
tggctcctctaggttttcatgggtc

SEQ ID NO: 634985 - DNA, 25 bp, Rattus norvegicus
tggctcctgaccaaaactgacagct

SEQ ID NO: 634986 - DNA, 25 bp, Rattus norvegicus
tggctcctgacctaaactgacagct

SEQ ID NO: 634987 - DNA, 25 bp, Rattus norvegicus
tggctcctgaggactccagtgacag

SEQ ID NO: 634988 - DNA, 25 bp, Rattus norvegicus
tggctcctgaggtctccagtgacag

SEQ ID NO: 634989 - DNA, 25 bp, Rattus norvegicus
tggctcctgagtactcgtgtctgag

SEQ ID NO: 634990 - DNA, 25 bp, Rattus norvegicus
tggctcctgagttctcgtgtctgag

SEQ ID NO: 634991 - DNA, 25 bp, Rattus norvegicus
tggctcctgcctagaagtcaccaag

SEQ ID NO: 634992 - DNA, 25 bp, Rattus norvegicus
tggctcctgccttgaagtcaccaag

SEQ ID NO: 634993 - DNA, 25 bp, Rattus norvegicus
tggctcctggaaatcccttagggtt

SEQ ID NO: 634994 - DNA, 25 bp, Rattus norvegicus
tggctcctggaattcccttagggtt

SEQ ID NO: 634995 - DNA, 25 bp, Rattus norvegicus
tggctcctggacattatgatagatt

SEQ ID NO: 634996 - DNA, 25 bp, Rattus norvegicus
tggctcctggactttatgatagatt

SEQ ID NO: 634997 - DNA, 25 bp, Rattus norvegicus
tggctcctggcacttcctgctgtgg

SEQ ID NO: 634998 - DNA, 25 bp, Rattus norvegicus
tggctcctggcagttcctgctgtgg

SEQ ID NO: 634999 - DNA, 25 bp, Rattus norvegicus
tggctcctggccacagtgtacagtt

SEQ ID NO: 635000 - DNA, 25 bp, Rattus norvegicus
tggctcctggcctcagtgtacagtt

SEQ ID NO: 635001 - DNA, 25 bp, Rattus norvegicus
tggctcctggcgacagtatgatcgg

SEQ ID NO: 635002 - DNA, 25 bp, Rattus norvegicus
tggctcctggcgtcagtatgatcgg

SEQ ID NO: 635003 - DNA, 25 bp, Rattus norvegicus
tggctcctggctctgaaggaacctc

SEQ ID NO: 635004 - DNA, 25 bp, Rattus norvegicus
tggctcctggctgtgaaggaacctc

SEQ ID NO: 635005 - DNA, 25 bp, Rattus norvegicus
tggctcctgggacaactaacggaca

SEQ ID NO: 635006 - DNA, 25 bp, Rattus norvegicus
tggctcctgggactaattatgcatt

SEQ ID NO: 635007 - DNA, 25 bp, Rattus norvegicus
tggctcctgggagaactaacggaca

SEQ ID NO: 635008 - DNA, 25 bp, Rattus norvegicus
tggctcctgggagtaattatgcatt

SEQ ID NO: 635009 - DNA, 25 bp, Rattus norvegicus
tggctcctgtagacaccaggccagg

SEQ ID NO: 635010 - DNA, 25 bp, Rattus norvegicus
tggctcctgtagtcaccaggccagg

SEQ ID NO: 635011 - DNA, 25 bp, Rattus norvegicus
tggctcctgtcacttaatgttctga

SEQ ID NO: 635012 - DNA, 25 bp, Rattus norvegicus
tggctcctgtcagttaatgttctga

SEQ ID NO: 635013 - DNA, 25 bp, Rattus norvegicus
tggctcctgtcgctcagtctgtgac

SEQ ID NO: 635014 - DNA, 25 bp, Rattus norvegicus
tggctcctgtcggtcagtctgtgac

SEQ ID NO: 635015 - DNA, 25 bp, Rattus norvegicus
tggctcctgttcacaattattccag

SEQ ID NO: 635016 - DNA, 25 bp, Rattus norvegicus
tggctcctgttctcaattattccag

SEQ ID NO: 635017 - DNA, 25 bp, Rattus norvegicus
tggctccttgctagaagctttcctg

SEQ ID NO: 635018 - DNA, 25 bp, Rattus norvegicus
tggctccttgcttgaagctttcctg

SEQ ID NO: 635019 - DNA, 25 bp, Rattus norvegicus
tggctccttggtacctgagaatgga

SEQ ID NO: 635020 - DNA, 25 bp, Rattus norvegicus
tggctccttggttcctgagaatgga

SEQ ID NO: 635021 - DNA, 25 bp, Rattus norvegicus
tggctccttttactagtcatgacag

SEQ ID NO: 635022 - DNA, 25 bp, Rattus norvegicus
tggctccttttagtagtcatgacag

SEQ ID NO: 635023 - DNA, 25 bp, Rattus norvegicus
tggctcgaaaccagggtgcgcttcg

SEQ ID NO: 635024 - DNA, 25 bp, Rattus norvegicus
tggctcgaaacctgggtgcgcttcg

SEQ ID NO: 635025 - DNA, 25 bp, Rattus norvegicus
tggctcgagcttacaacctgaggga

SEQ ID NO: 635026 - DNA, 25 bp, Rattus norvegicus
tggctcgagctttcaacctgaggga

SEQ ID NO: 635027 - DNA, 25 bp, Rattus norvegicus
tggctcgattcgatgctggagaatt

SEQ ID NO: 635028 - DNA, 25 bp, Rattus norvegicus
tggctcgattcgttgctggagaatt

SEQ ID NO: 635029 - DNA, 25 bp, Rattus norvegicus
tggctcgcactacccggagatcgtt

SEQ ID NO: 635030 - DNA, 25 bp, Rattus norvegicus
tggctcgcactagccggagatcgtt

SEQ ID NO: 635031 - DNA, 25 bp, Rattus norvegicus
tggctcgcagggacaccaaggacac

SEQ ID NO: 635032 - DNA, 25 bp, Rattus norvegicus
tggctcgcagggtcaccaaggacac

SEQ ID NO: 635033 - DNA, 25 bp, Rattus norvegicus
tggctcgctgcactgatgacttcaa

SEQ ID NO: 635034 - DNA, 25 bp, Rattus norvegicus
tggctcgctgcagtgatgacttcaa

SEQ ID NO: 635035 - DNA, 25 bp, Rattus norvegicus
tggctcggaaacactgtcggaggaa

SEQ ID NO: 635036 - DNA, 25 bp, Rattus norvegicus
tggctcggaaactctgtcggaggaa

SEQ ID NO: 635037 - DNA, 25 bp, Rattus norvegicus
tggctcggtggtacagaggactctt

SEQ ID NO: 635038 - DNA, 25 bp, Rattus norvegicus
tggctcggtggttcagaggactctt

SEQ ID NO: 635039 - DNA, 25 bp, Rattus norvegicus
tggctcgtccttccgttcactttgt

SEQ ID NO: 635040 - DNA, 25 bp, Rattus norvegicus
tggctcgtccttgcgttcactttgt

SEQ ID NO: 635041 - DNA, 25 bp, Rattus norvegicus
tggctctaaagcacttagtcctcct

SEQ ID NO: 635042 - DNA, 25 bp, Rattus norvegicus
tggctctaaagctcttagtcctcct

SEQ ID NO: 635043 - DNA, 25 bp, Rattus norvegicus
tggctctacaatcaggccgtggtgc

SEQ ID NO: 635044 - DNA, 25 bp, Rattus norvegicus
tggctctacaatgaggccgtggtgc

SEQ ID NO: 635045 - DNA, 25 bp, Rattus norvegicus
tggctctacctcatcaactttatag

SEQ ID NO: 635046 - DNA, 25 bp, Rattus norvegicus
tggctctacctcttcaactttatag

SEQ ID NO: 635047 - DNA, 25 bp, Rattus norvegicus
tggctctagctaccttctcggaagc

SEQ ID NO: 635048 - DNA, 25 bp, Rattus norvegicus
tggctctagctagcttctcggaagc

SEQ ID NO: 635049 - DNA, 25 bp, Rattus norvegicus
tggctctatggcaatcgcttcgaag

SEQ ID NO: 635050 - DNA, 25 bp, Rattus norvegicus
tggctctatggctatcgcttcgaag

SEQ ID NO: 635051 - DNA, 25 bp, Rattus norvegicus
tggctctatgtcctgtttcctatca

SEQ ID NO: 635052 - DNA, 25 bp, Rattus norvegicus
tggctctatgtcgtgtttcctatca

SEQ ID NO: 635053 - DNA, 25 bp, Rattus norvegicus
tggctctcaaacatcccttttgaag

SEQ ID NO: 635054 - DNA, 25 bp, Rattus norvegicus
tggctctcaaacttcccttttgaag

SEQ ID NO: 635055 - DNA, 25 bp, Rattus norvegicus
tggctctcacttccagtaatcgaat

SEQ ID NO: 635056 - DNA, 25 bp, Rattus norvegicus
tggctctcacttgcagtaatcgaat

SEQ ID NO: 635057 - DNA, 25 bp, Rattus norvegicus
tggctctcagccaacctgagctgca

SEQ ID NO: 635058 - DNA, 25 bp, Rattus norvegicus
tggctctcagcctacctgagctgca

SEQ ID NO: 635059 - DNA, 25 bp, Rattus norvegicus
tggctctcagctacaggacaacaca

SEQ ID NO: 635060 - DNA, 25 bp, Rattus norvegicus
tggctctcagctcatttaatggcat

SEQ ID NO: 635061 - DNA, 25 bp, Rattus norvegicus
tggctctcagctgatttaatggcat

SEQ ID NO: 635062 - DNA, 25 bp, Rattus norvegicus
tggctctcagcttcaggacaacaca

SEQ ID NO: 635063 - DNA, 25 bp, Rattus norvegicus
tggctctcaggcctgggacagatct

SEQ ID NO: 635064 - DNA, 25 bp, Rattus norvegicus
tggctctcaggcgtgggacagatct

SEQ ID NO: 635065 - DNA, 25 bp, Rattus norvegicus
tggctctcatgcatcatcagtgctg

SEQ ID NO: 635066 - DNA, 25 bp, Rattus norvegicus
tggctctcatgcttcatcagtgctg

SEQ ID NO: 635067 - DNA, 25 bp, Rattus norvegicus
tggctctccagcacctgtgtaagtg

SEQ ID NO: 635068 - DNA, 25 bp, Rattus norvegicus
tggctctccagctcctgtgtaagtg

SEQ ID NO: 635069 - DNA, 25 bp, Rattus norvegicus
tggctctccaggcaagcctgaggaa

SEQ ID NO: 635070 - DNA, 25 bp, Rattus norvegicus
tggctctccagggaagcctgaggaa

SEQ ID NO: 635071 - DNA, 25 bp, Rattus norvegicus
tggctctccagtatggctgcaaaca

SEQ ID NO: 635072 - DNA, 25 bp, Rattus norvegicus
tggctctccagtttggctgcaaaca

SEQ ID NO: 635073 - DNA, 25 bp, Rattus norvegicus
tggctctcccaaaaaactgtctgtg

SEQ ID NO: 635074 - DNA, 25 bp, Rattus norvegicus
tggctctcccaataaactgtctgtg

SEQ ID NO: 635075 - DNA, 25 bp, Rattus norvegicus
tggctctcccacagtgatggactat

SEQ ID NO: 635076 - DNA, 25 bp, Rattus norvegicus
tggctctcccactgtgatggactat

SEQ ID NO: 635077 - DNA, 25 bp, Rattus norvegicus
tggctctccccaatgaggttcctat

SEQ ID NO: 635078 - DNA, 25 bp, Rattus norvegicus
tggctctccccattgaggttcctat

SEQ ID NO: 635079 - DNA, 25 bp, Rattus norvegicus
tggctctcgctcagcagctacagtg

SEQ ID NO: 635080 - DNA, 25 bp, Rattus norvegicus
tggctctcgctctgcagctacagtg

SEQ ID NO: 635081 - DNA, 25 bp, Rattus norvegicus
tggctctcggacacttccaagggtg

SEQ ID NO: 635082 - DNA, 25 bp, Rattus norvegicus
tggctctcggactcttccaagggtg

SEQ ID NO: 635083 - DNA, 25 bp, Rattus norvegicus
tggctctcgggccagtattagactg

SEQ ID NO: 635084 - DNA, 25 bp, Rattus norvegicus
tggctctcgggcgagtattagactg

SEQ ID NO: 635085 - DNA, 25 bp, Rattus norvegicus
tggctctctagtacttttctcagaa

SEQ ID NO: 635086 - DNA, 25 bp, Rattus norvegicus
tggctctctagttcttttctcagaa

SEQ ID NO: 635087 - DNA, 25 bp, Rattus norvegicus
tggctctctatcactctggttatta

SEQ ID NO: 635088 - DNA, 25 bp, Rattus norvegicus
tggctctctatctctctggttatta

SEQ ID NO: 635089 - DNA, 25 bp, Rattus norvegicus
tggctctctccacagtatctgcaaa

SEQ ID NO: 635090 - DNA, 25 bp, Rattus norvegicus
tggctctctccacgatccagaaggg

SEQ ID NO: 635091 - DNA, 25 bp, Rattus norvegicus
tggctctctccagagtatctgcaaa

SEQ ID NO: 635092 - DNA, 25 bp, Rattus norvegicus
tggctctctccaggatccagaaggg

SEQ ID NO: 635093 - DNA, 25 bp, Rattus norvegicus
tggctctctccgctaaaattctaag

SEQ ID NO: 635094 - DNA, 25 bp, Rattus norvegicus
tggctctctccggtaaaattctaag

SEQ ID NO: 635095 - DNA, 25 bp, Rattus norvegicus
tggctctctctaactgccgagtaca

SEQ ID NO: 635096 - DNA, 25 bp, Rattus norvegicus
tggctctctctatctgccgagtaca

SEQ ID NO: 635097 - DNA, 25 bp, Rattus norvegicus
tggctctctctcacatgctctgtta

SEQ ID NO: 635098 - DNA, 25 bp, Rattus norvegicus
tggctctctctctcatgctctgtta

SEQ ID NO: 635099 - DNA, 25 bp, Rattus norvegicus
tggctctgaactcctgtttactgga

SEQ ID NO: 635100 - DNA, 25 bp, Rattus norvegicus
tggctctgaactgctgtttactgga

SEQ ID NO: 635101 - DNA, 25 bp, Rattus norvegicus
tggctctgaagaccttccttcctaa

SEQ ID NO: 635102 - DNA, 25 bp, Rattus norvegicus
tggctctgaagagcttccttcctaa

SEQ ID NO: 635103 - DNA, 25 bp, Rattus norvegicus
tggctctgcacaagaagcgacacat

SEQ ID NO: 635104 - DNA, 25 bp, Rattus norvegicus
tggctctgcacaccctggaaaagtc

SEQ ID NO: 635105 - DNA, 25 bp, Rattus norvegicus
tggctctgcacagcctggaaaagtc

SEQ ID NO: 635106 - DNA, 25 bp, Rattus norvegicus
tggctctgcacatgaagcgacacat

SEQ ID NO: 635107 - DNA, 25 bp, Rattus norvegicus
tggctctgcccaagctaagcctcaa

SEQ ID NO: 635108 - DNA, 25 bp, Rattus norvegicus
tggctctgcccatgctaagcctcaa

SEQ ID NO: 635109 - DNA, 25 bp, Rattus norvegicus
tggctctgccttatcatgtcttttc

SEQ ID NO: 635110 - DNA, 25 bp, Rattus norvegicus
tggctctgccttttcatgtcttttc

SEQ ID NO: 635111 - DNA, 25 bp, Rattus norvegicus
tggctctgctgcagtgactcacttc

SEQ ID NO: 635112 - DNA, 25 bp, Rattus norvegicus
tggctctgctgctgtgactcacttc

SEQ ID NO: 635113 - DNA, 25 bp, Rattus norvegicus
tggctctgctttcttcactttcata

SEQ ID NO: 635114 - DNA, 25 bp, Rattus norvegicus
tggctctgctttgttcactttcata

SEQ ID NO: 635115 - DNA, 25 bp, Rattus norvegicus
tggctctggcatcgcctggttcatc

SEQ ID NO: 635116 - DNA, 25 bp, Rattus norvegicus
tggctctggcatggcctggttcatc

SEQ ID NO: 635117 - DNA, 25 bp, Rattus norvegicus
tggctctggccaaagcttcattgct

SEQ ID NO: 635118 - DNA, 25 bp, Rattus norvegicus
tggctctggccatagcttcattgct

SEQ ID NO: 635119 - DNA, 25 bp, Rattus norvegicus
tggctctggctaaaccaacatcatg

SEQ ID NO: 635120 - DNA, 25 bp, Rattus norvegicus
tggctctggctataccaacatcatg

SEQ ID NO: 635121 - DNA, 25 bp, Rattus norvegicus
tggctctggctgacaaggtgctaaa

SEQ ID NO: 635122 - DNA, 25 bp, Rattus norvegicus
tggctctggctgtcaaggtgctaaa

SEQ ID NO: 635123 - DNA, 25 bp, Rattus norvegicus
tggctctgggatcccctgggccttt

SEQ ID NO: 635124 - DNA, 25 bp, Rattus norvegicus
tggctctgggatgccctgggccttt

SEQ ID NO: 635125 - DNA, 25 bp, Rattus norvegicus
tggctctggtcgaagtgcagcacaa

SEQ ID NO: 635126 - DNA, 25 bp, Rattus norvegicus
tggctctggtcgtagtgcagcacaa

SEQ ID NO: 635127 - DNA, 25 bp, Rattus norvegicus
tggctctgtatactttcatctcacg

SEQ ID NO: 635128 - DNA, 25 bp, Rattus norvegicus
tggctctgtatagtttcatctcacg

SEQ ID NO: 635129 - DNA, 25 bp, Rattus norvegicus
tggctctgtatgaaaacctattgca

SEQ ID NO: 635130 - DNA, 25 bp, Rattus norvegicus
tggctctgtatgtaaacctattgca

SEQ ID NO: 635131 - DNA, 25 bp, Rattus norvegicus
tggctctgtctgatggtactgataa

SEQ ID NO: 635132 - DNA, 25 bp, Rattus norvegicus
tggctctgtctgttggtactgataa

SEQ ID NO: 635133 - DNA, 25 bp, Rattus norvegicus
tggctctgtgttactgttccctcat

SEQ ID NO: 635134 - DNA, 25 bp, Rattus norvegicus
tggctctgtgtttctgttccctcat

SEQ ID NO: 635135 - DNA, 25 bp, Rattus norvegicus
tggctctgttgtctctggccctctt

SEQ ID NO: 635136 - DNA, 25 bp, Rattus norvegicus
tggctctgttgtgtctggccctctt

SEQ ID NO: 635137 - DNA, 25 bp, Rattus norvegicus
tggctcttacagactttcttgcagg

SEQ ID NO: 635138 - DNA, 25 bp, Rattus norvegicus
tggctcttacagtctttcttgcagg

SEQ ID NO: 635139 - DNA, 25 bp, Rattus norvegicus
tggctcttcattactttcaatctgg

SEQ ID NO: 635140 - DNA, 25 bp, Rattus norvegicus
tggctcttcatttctttcaatctgg

SEQ ID NO: 635141 - DNA, 25 bp, Rattus norvegicus
tggctcttccctcttcactgctttg

SEQ ID NO: 635142 - DNA, 25 bp, Rattus norvegicus
tggctcttccctgttcactgctttg

SEQ ID NO: 635143 - DNA, 25 bp, Rattus norvegicus
tggctcttccgacagcagcagaaag

SEQ ID NO: 635144 - DNA, 25 bp, Rattus norvegicus
tggctcttccgagagcagcagaaag

SEQ ID NO: 635145 - DNA, 25 bp, Rattus norvegicus
tggctcttcctaagtaacacgtcac

SEQ ID NO: 635146 - DNA, 25 bp, Rattus norvegicus
tggctcttcctatgtaacacgtcac

SEQ ID NO: 635147 - DNA, 25 bp, Rattus norvegicus
tggctcttcctgacttgtatagttt

SEQ ID NO: 635148 - DNA, 25 bp, Rattus norvegicus
tggctcttcctgtcttgtatagttt

SEQ ID NO: 635149 - DNA, 25 bp, Rattus norvegicus
tggctcttgagcacacattgaatgg

SEQ ID NO: 635150 - DNA, 25 bp, Rattus norvegicus
tggctcttgagctcacattgaatgg

SEQ ID NO: 635151 - DNA, 25 bp, Rattus norvegicus
tggctcttgggcctcagatcttgcc

SEQ ID NO: 635152 - DNA, 25 bp, Rattus norvegicus
tggctcttgggcgtcagatcttgcc

SEQ ID NO: 635153 - DNA, 25 bp, Rattus norvegicus
tggctcttggggcatcctggctaac

SEQ ID NO: 635154 - DNA, 25 bp, Rattus norvegicus
tggctcttgggggatcctggctaac

SEQ ID NO: 635155 - DNA, 25 bp, Rattus norvegicus
tggctctttattctttactcagaag

SEQ ID NO: 635156 - DNA, 25 bp, Rattus norvegicus
tggctctttattgtttactcagaag

SEQ ID NO: 635157 - DNA, 25 bp, Rattus norvegicus
tggctctttctacctgcagtcaaag

SEQ ID NO: 635158 - DNA, 25 bp, Rattus norvegicus
tggctctttctagctgcagtcaaag

SEQ ID NO: 635159 - DNA, 25 bp, Rattus norvegicus
tggctctttgcactacacacttcaa

SEQ ID NO: 635160 - DNA, 25 bp, Rattus norvegicus
tggctctttgcagtacacacttcaa

SEQ ID NO: 635161 - DNA, 25 bp, Rattus norvegicus
tggctctttgccactgaaagcttta

SEQ ID NO: 635162 - DNA, 25 bp, Rattus norvegicus
tggctctttgcctctgaaagcttta

SEQ ID NO: 635163 - DNA, 25 bp, Rattus norvegicus
tggctgaaaaccagcttcgggtctt

SEQ ID NO: 635164 - DNA, 25 bp, Rattus norvegicus
tggctgaaaacctgcttcgggtctt

SEQ ID NO: 635165 - DNA, 25 bp, Rattus norvegicus
tggctgaaagacacggaggcctcaa

SEQ ID NO: 635166 - DNA, 25 bp, Rattus norvegicus
tggctgaaagactcggaggcctcaa

SEQ ID NO: 635167 - DNA, 25 bp, Rattus norvegicus
tggctgaacttcaacgccaccagca

SEQ ID NO: 635168 - DNA, 25 bp, Rattus norvegicus
tggctgaacttctacgccaccagca

SEQ ID NO: 635169 - DNA, 25 bp, Rattus norvegicus
tggctgaagaaacccaacatggctg

SEQ ID NO: 635170 - DNA, 25 bp, Rattus norvegicus
tggctgaagaaagccaacatggctg

SEQ ID NO: 635171 - DNA, 25 bp, Rattus norvegicus
tggctgaagcacatactctagggaa

SEQ ID NO: 635172 - DNA, 25 bp, Rattus norvegicus
tggctgaagcacttactctagggaa

SEQ ID NO: 635173 - DNA, 25 bp, Rattus norvegicus
tggctgaaggctcctgggccatctt

SEQ ID NO: 635174 - DNA, 25 bp, Rattus norvegicus
tggctgaaggctgctgggccatctt

SEQ ID NO: 635175 - DNA, 25 bp, Rattus norvegicus
tggctgaagtgtctcgctgttgaaa

SEQ ID NO: 635176 - DNA, 25 bp, Rattus norvegicus
tggctgaagtgtgtcgctgttgaaa

SEQ ID NO: 635177 - DNA, 25 bp, Rattus norvegicus
tggctgacactgacgcctcttagaa

SEQ ID NO: 635178 - DNA, 25 bp, Rattus norvegicus
tggctgacactgtcgcctcttagaa

SEQ ID NO: 635179 - DNA, 25 bp, Rattus norvegicus
tggctgacagagctccggagactcc

SEQ ID NO: 635180 - DNA, 25 bp, Rattus norvegicus
tggctgacagaggtccggagactcc

SEQ ID NO: 635181 - DNA, 25 bp, Rattus norvegicus
tggctgacatcaacgggcctgctaa

SEQ ID NO: 635182 - DNA, 25 bp, Rattus norvegicus
tggctgacatcatcgggcctgctaa

SEQ ID NO: 635183 - DNA, 25 bp, Rattus norvegicus
tggctgacatctagcatggccccag

SEQ ID NO: 635184 - DNA, 25 bp, Rattus norvegicus
tggctgacatcttgcatggccccag

SEQ ID NO: 635185 - DNA, 25 bp, Rattus norvegicus
tggctgaccagcaggcccggcgaca

SEQ ID NO: 635186 - DNA, 25 bp, Rattus norvegicus
tggctgaccagctggcccggcgaca

SEQ ID NO: 635187 - DNA, 25 bp, Rattus norvegicus
tggctgaccctgaggagtctttggt

SEQ ID NO: 635188 - DNA, 25 bp, Rattus norvegicus
tggctgaccctgtggagtctttggt

SEQ ID NO: 635189 - DNA, 25 bp, Rattus norvegicus
tggctgaccgcaacaggaagtacca

SEQ ID NO: 635190 - DNA, 25 bp, Rattus norvegicus
tggctgaccgcatcaggaagtacca

SEQ ID NO: 635191 - DNA, 25 bp, Rattus norvegicus
tggctgacctccatgattggacatt

SEQ ID NO: 635192 - DNA, 25 bp, Rattus norvegicus
tggctgacctccttgattggacatt

SEQ ID NO: 635193 - DNA, 25 bp, Rattus norvegicus
tggctgaccttcctagacagttggg

SEQ ID NO: 635194 - DNA, 25 bp, Rattus norvegicus
tggctgaccttcgtagacagttggg

SEQ ID NO: 635195 - DNA, 25 bp, Rattus norvegicus
tggctgactgagagcccacagaatg

SEQ ID NO: 635196 - DNA, 25 bp, Rattus norvegicus
tggctgactgagtgcccacagaatg

SEQ ID NO: 635197 - DNA, 25 bp, Rattus norvegicus
tggctgactgttctctccagaaata

SEQ ID NO: 635198 - DNA, 25 bp, Rattus norvegicus
tggctgactgttgtctccagaaata

SEQ ID NO: 635199 - DNA, 25 bp, Rattus norvegicus
tggctgagactcctgccctgcagtg

SEQ ID NO: 635200 - DNA, 25 bp, Rattus norvegicus
tggctgagactcgtgccctgcagtg

SEQ ID NO: 635201 - DNA, 25 bp, Rattus norvegicus
tggctgagatgtcccgctcacttcg

SEQ ID NO: 635202 - DNA, 25 bp, Rattus norvegicus
tggctgagatgtgccgctcacttcg

SEQ ID NO: 635203 - DNA, 25 bp, Rattus norvegicus
tggctgagcagcacattcggcagat

SEQ ID NO: 635204 - DNA, 25 bp, Rattus norvegicus
tggctgagcagctcattcggcagat

SEQ ID NO: 635205 - DNA, 25 bp, Rattus norvegicus
tggctgaggagtacaccgaccgctt

SEQ ID NO: 635206 - DNA, 25 bp, Rattus norvegicus
tggctgaggagttcaccgaccgctt

SEQ ID NO: 635207 - DNA, 25 bp, Rattus norvegicus
tggctgaggctcctttgtcagcagt

SEQ ID NO: 635208 - DNA, 25 bp, Rattus norvegicus
tggctgaggctcgtttgtcagcagt

SEQ ID NO: 635209 - DNA, 25 bp, Rattus norvegicus
tggctgaggcttcctgtggcatcca

SEQ ID NO: 635210 - DNA, 25 bp, Rattus norvegicus
tggctgaggcttgctgtggcatcca

SEQ ID NO: 635211 - DNA, 25 bp, Rattus norvegicus
tggctgaggtggaggtatttttaca

SEQ ID NO: 635212 - DNA, 25 bp, Rattus norvegicus
tggctgaggtggtggtatttttaca

SEQ ID NO: 635213 - DNA, 25 bp, Rattus norvegicus
tggctgagtcaaacccgtgccttgg

SEQ ID NO: 635214 - DNA, 25 bp, Rattus norvegicus
tggctgagtcaatcccgtgccttgg

SEQ ID NO: 635215 - DNA, 25 bp, Rattus norvegicus
tggctgagttgcagcactctggtca

SEQ ID NO: 635216 - DNA, 25 bp, Rattus norvegicus
tggctgagttgctgcactctggtca

SEQ ID NO: 635217 - DNA, 25 bp, Rattus norvegicus
tggctgatccctcacagtgcggaca

SEQ ID NO: 635218 - DNA, 25 bp, Rattus norvegicus
tggctgatccctgacagtgcggaca

SEQ ID NO: 635219 - DNA, 25 bp, Rattus norvegicus
tggctgatccgtccactgtgatgga

SEQ ID NO: 635220 - DNA, 25 bp, Rattus norvegicus
tggctgatccgtgcactgtgatgga

SEQ ID NO: 635221 - DNA, 25 bp, Rattus norvegicus
tggctgatctccagcaagagcatca

SEQ ID NO: 635222 - DNA, 25 bp, Rattus norvegicus
tggctgatctcctgcaagagcatca

SEQ ID NO: 635223 - DNA, 25 bp, Rattus norvegicus
tggctgatgatgattccacgcaaac

SEQ ID NO: 635224 - DNA, 25 bp, Rattus norvegicus
tggctgatgatgtttccacgcaaac

SEQ ID NO: 635225 - DNA, 25 bp, Rattus norvegicus
tggctgatgcccacaacaggcaaat

SEQ ID NO: 635226 - DNA, 25 bp, Rattus norvegicus
tggctgatgccctcaacaggcaaat

SEQ ID NO: 635227 - DNA, 25 bp, Rattus norvegicus
tggctgatgctgatgttactgcctt

SEQ ID NO: 635228 - DNA, 25 bp, Rattus norvegicus
tggctgatgctgttgttactgcctt

SEQ ID NO: 635229 - DNA, 25 bp, Rattus norvegicus
tggctgatggagagcctttgtaccc

SEQ ID NO: 635230 - DNA, 25 bp, Rattus norvegicus
tggctgatggagtgcctttgtaccc

SEQ ID NO: 635231 - DNA, 25 bp, Rattus norvegicus
tggctgatttcactcccacgagaat

SEQ ID NO: 635232 - DNA, 25 bp, Rattus norvegicus
tggctgatttcagtcccacgagaat

SEQ ID NO: 635233 - DNA, 25 bp, Rattus norvegicus
tggctgatttccagggtgctatcgg

SEQ ID NO: 635234 - DNA, 25 bp, Rattus norvegicus
tggctgatttcctgggtgctatcgg

SEQ ID NO: 635235 - DNA, 25 bp, Rattus norvegicus
tggctgcaatttcgcttttactgtt

SEQ ID NO: 635236 - DNA, 25 bp, Rattus norvegicus
tggctgcaatttggcttttactgtt

SEQ ID NO: 635237 - DNA, 25 bp, Rattus norvegicus
tggctgcacctcatggtcctgagag

SEQ ID NO: 635238 - DNA, 25 bp, Rattus norvegicus
tggctgcacctcttggtcctgagag

SEQ ID NO: 635239 - DNA, 25 bp, Rattus norvegicus
tggctgcagaacacgtggcaacttg

SEQ ID NO: 635240 - DNA, 25 bp, Rattus norvegicus
tggctgcagaactcgtggcaacttg

SEQ ID NO: 635241 - DNA, 25 bp, Rattus norvegicus
tggctgcagaccaagggctttagct

SEQ ID NO: 635242 - DNA, 25 bp, Rattus norvegicus
tggctgcagacctagggctttagct

SEQ ID NO: 635243 - DNA, 25 bp, Rattus norvegicus
tggctgcagcatatgtggcccacaa

SEQ ID NO: 635244 - DNA, 25 bp, Rattus norvegicus
tggctgcagcatttgtggcccacaa

SEQ ID NO: 635245 - DNA, 25 bp, Rattus norvegicus
tggctgcaggcacttcatttatagg

SEQ ID NO: 635246 - DNA, 25 bp, Rattus norvegicus
tggctgcaggcagttcatttatagg

SEQ ID NO: 635247 - DNA, 25 bp, Rattus norvegicus
tggctgcagtggacacagcttctca

SEQ ID NO: 635248 - DNA, 25 bp, Rattus norvegicus
tggctgcagtggtcacagcttctca

SEQ ID NO: 635249 - DNA, 25 bp, Rattus norvegicus
tggctgcatgctaccatgggtatga

SEQ ID NO: 635250 - DNA, 25 bp, Rattus norvegicus
tggctgcatgcttccatgggtatga

SEQ ID NO: 635251 - DNA, 25 bp, Rattus norvegicus
tggctgccaaaccagtgacctgatt

SEQ ID NO: 635252 - DNA, 25 bp, Rattus norvegicus
tggctgccaaacgagtgacctgatt

SEQ ID NO: 635253 - DNA, 25 bp, Rattus norvegicus
tggctgccaagtacattctcacaca

SEQ ID NO: 635254 - DNA, 25 bp, Rattus norvegicus
tggctgccaagttcattctcacaca

SEQ ID NO: 635255 - DNA, 25 bp, Rattus norvegicus
tggctgccacatcgctgtgaaatgt

SEQ ID NO: 635256 - DNA, 25 bp, Rattus norvegicus
tggctgccacatggctgtgaaatgt

SEQ ID NO: 635257 - DNA, 25 bp, Rattus norvegicus
tggctgccaccaatctctaacaggt

SEQ ID NO: 635258 - DNA, 25 bp, Rattus norvegicus
tggctgccaccattctctaacaggt

SEQ ID NO: 635259 - DNA, 25 bp, Rattus norvegicus
tggctgccagggagggctttatact

SEQ ID NO: 635260 - DNA, 25 bp, Rattus norvegicus
tggctgccagggtgggctttatact

SEQ ID NO: 635261 - DNA, 25 bp, Rattus norvegicus
tggctgccagttaggagactctgaa

SEQ ID NO: 635262 - DNA, 25 bp, Rattus norvegicus
tggctgccagtttggagactctgaa

SEQ ID NO: 635263 - DNA, 25 bp, Rattus norvegicus
tggctgccatcgcaaactttctaca

SEQ ID NO: 635264 - DNA, 25 bp, Rattus norvegicus
tggctgccatcggaaactttctaca

SEQ ID NO: 635265 - DNA, 25 bp, Rattus norvegicus
tggctgcccatgcagttttgctggc

SEQ ID NO: 635266 - DNA, 25 bp, Rattus norvegicus
tggctgcccatggagttttgctggc

SEQ ID NO: 635267 - DNA, 25 bp, Rattus norvegicus
tggctgccccgtacatcgagaaata

SEQ ID NO: 635268 - DNA, 25 bp, Rattus norvegicus
tggctgccccgttcatcgagaaata

SEQ ID NO: 635269 - DNA, 25 bp, Rattus norvegicus
tggctgccctatagcatgtctgaaa

SEQ ID NO: 635270 - DNA, 25 bp, Rattus norvegicus
tggctgccctattgcatgtctgaaa

SEQ ID NO: 635271 - DNA, 25 bp, Rattus norvegicus
tggctgccctgtcagaaacggcgac

SEQ ID NO: 635272 - DNA, 25 bp, Rattus norvegicus
tggctgccctgtgagaaacggcgac

SEQ ID NO: 635273 - DNA, 25 bp, Rattus norvegicus
tggctgccgaccaagaagtggcaaa

SEQ ID NO: 635274 - DNA, 25 bp, Rattus norvegicus
tggctgccgacctagaagtggcaaa

SEQ ID NO: 635275 - DNA, 25 bp, Rattus norvegicus
tggctgccgcccaggagagagcggg

SEQ ID NO: 635276 - DNA, 25 bp, Rattus norvegicus
tggctgccgccctggagagagcggg

SEQ ID NO: 635277 - DNA, 25 bp, Rattus norvegicus
tggctgccggagaacgtcttcatca

SEQ ID NO: 635278 - DNA, 25 bp, Rattus norvegicus
tggctgccggagtacgtcttcatca

SEQ ID NO: 635279 - DNA, 25 bp, Rattus norvegicus
tggctgcctatccatactgtggaaa

SEQ ID NO: 635280 - DNA, 25 bp, Rattus norvegicus
tggctgcctatcgatactgtggaaa

SEQ ID NO: 635281 - DNA, 25 bp, Rattus norvegicus
tggctgccttaaagtccttctattt

SEQ ID NO: 635282 - DNA, 25 bp, Rattus norvegicus
tggctgccttaatgtccttctattt

SEQ ID NO: 635283 - DNA, 25 bp, Rattus norvegicus
tggctgccttgcaactgactctgat

SEQ ID NO: 635284 - DNA, 25 bp, Rattus norvegicus
tggctgccttgctactgactctgat

SEQ ID NO: 635285 - DNA, 25 bp, Rattus norvegicus
tggctgcctttcattgtggtatcct

SEQ ID NO: 635286 - DNA, 25 bp, Rattus norvegicus
tggctgcctttctttgtggtatcct

SEQ ID NO: 635287 - DNA, 25 bp, Rattus norvegicus
tggctgcggaacacttgaccctgaa

SEQ ID NO: 635288 - DNA, 25 bp, Rattus norvegicus
tggctgcggaactcttgaccctgaa

SEQ ID NO: 635289 - DNA, 25 bp, Rattus norvegicus
tggctgcggtcgaggcccaccggag

SEQ ID NO: 635290 - DNA, 25 bp, Rattus norvegicus
tggctgcggtcgtggcccaccggag

SEQ ID NO: 635291 - DNA, 25 bp, Rattus norvegicus
tggctgcgtcttatggcaaaccaat

SEQ ID NO: 635292 - DNA, 25 bp, Rattus norvegicus
tggctgcgtcttttggcaaaccaat

SEQ ID NO: 635293 - DNA, 25 bp, Rattus norvegicus
tggctgctacacagttacccagtaa

SEQ ID NO: 635294 - DNA, 25 bp, Rattus norvegicus
tggctgctacactgttacccagtaa

SEQ ID NO: 635295 - DNA, 25 bp, Rattus norvegicus
tggctgctactgacctgctgaaaag

SEQ ID NO: 635296 - DNA, 25 bp, Rattus norvegicus
tggctgctactgtcctgctgaaaag

SEQ ID NO: 635297 - DNA, 25 bp, Rattus norvegicus
tggctgctattgaccttggtgtcac

SEQ ID NO: 635298 - DNA, 25 bp, Rattus norvegicus
tggctgctattgtccttggtgtcac

SEQ ID NO: 635299 - DNA, 25 bp, Rattus norvegicus
tggctgctcattctgtcatctacaa

SEQ ID NO: 635300 - DNA, 25 bp, Rattus norvegicus
tggctgctcattgtgtcatctacaa

SEQ ID NO: 635301 - DNA, 25 bp, Rattus norvegicus
tggctgctccaaacacaagtgtcca

SEQ ID NO: 635302 - DNA, 25 bp, Rattus norvegicus
tggctgctccaatcacaagtgtcca

SEQ ID NO: 635303 - DNA, 25 bp, Rattus norvegicus
tggctgctcccaaggaatctaccag

SEQ ID NO: 635304 - DNA, 25 bp, Rattus norvegicus
tggctgctcccatggaatctaccag

SEQ ID NO: 635305 - DNA, 25 bp, Rattus norvegicus
tggctgctcctaaactggtttccag

SEQ ID NO: 635306 - DNA, 25 bp, Rattus norvegicus
tggctgctcctatactggtttccag

SEQ ID NO: 635307 - DNA, 25 bp, Rattus norvegicus
tggctgctcctcagttttagtctct

SEQ ID NO: 635308 - DNA, 25 bp, Rattus norvegicus
tggctgctcctctgttttagtctct

SEQ ID NO: 635309 - DNA, 25 bp, Rattus norvegicus
tggctgctcctgaattctgacataa

SEQ ID NO: 635310 - DNA, 25 bp, Rattus norvegicus
tggctgctcctgtattctgacataa

SEQ ID NO: 635311 - DNA, 25 bp, Rattus norvegicus
tggctgctcggcaacatttgatcac

SEQ ID NO: 635312 - DNA, 25 bp, Rattus norvegicus
tggctgctcggctacatttgatcac

SEQ ID NO: 635313 - DNA, 25 bp, Rattus norvegicus
tggctgctctgtccctggcagtgcc

SEQ ID NO: 635314 - DNA, 25 bp, Rattus norvegicus
tggctgctctgtgcctggcagtgcc

SEQ ID NO: 635315 - DNA, 25 bp, Rattus norvegicus
tggctgctcttaacaccagtttgtc

SEQ ID NO: 635316 - DNA, 25 bp, Rattus norvegicus
tggctgctcttatcaccagtttgtc

SEQ ID NO: 635317 - DNA, 25 bp, Rattus norvegicus
tggctgctcttccaagaagtcatga

SEQ ID NO: 635318 - DNA, 25 bp, Rattus norvegicus
tggctgctcttcgaagaagtcatga

SEQ ID NO: 635319 - DNA, 25 bp, Rattus norvegicus
tggctgctcttgcaggctcaattcc

SEQ ID NO: 635320 - DNA, 25 bp, Rattus norvegicus
tggctgctcttggaggctcaattcc

SEQ ID NO: 635321 - DNA, 25 bp, Rattus norvegicus
tggctgctgaggaacatgaccttgg

SEQ ID NO: 635322 - DNA, 25 bp, Rattus norvegicus
tggctgctgaggtacatgaccttgg

SEQ ID NO: 635323 - DNA, 25 bp, Rattus norvegicus
tggctgctggccatgctggcagtaa

SEQ ID NO: 635324 - DNA, 25 bp, Rattus norvegicus
tggctgctggccttgctggcagtaa

SEQ ID NO: 635325 - DNA, 25 bp, Rattus norvegicus
tggctgctggttctaatatggctgc

SEQ ID NO: 635326 - DNA, 25 bp, Rattus norvegicus
tggctgctggttgtaatatggctgc

SEQ ID NO: 635327 - DNA, 25 bp, Rattus norvegicus
tggctgctgtataccagatcatctc

SEQ ID NO: 635328 - DNA, 25 bp, Rattus norvegicus
tggctgctgtattccagatcatctc

SEQ ID NO: 635329 - DNA, 25 bp, Rattus norvegicus
tggctgctgtcactgccaggtccac

SEQ ID NO: 635330 - DNA, 25 bp, Rattus norvegicus
tggctgctgtcagtgccaggtccac

SEQ ID NO: 635331 - DNA, 25 bp, Rattus norvegicus
tggctgctgtctacggcggcctgaa

SEQ ID NO: 635332 - DNA, 25 bp, Rattus norvegicus
tggctgctgtctctcaccttggtgc

SEQ ID NO: 635333 - DNA, 25 bp, Rattus norvegicus
tggctgctgtctgtcaccttggtgc

SEQ ID NO: 635334 - DNA, 25 bp, Rattus norvegicus
tggctgctgtcttcggcggcctgaa

SEQ ID NO: 635335 - DNA, 25 bp, Rattus norvegicus
tggctgctgtgactctttgccatca

SEQ ID NO: 635336 - DNA, 25 bp, Rattus norvegicus
tggctgctgtgagtctttgccatca

SEQ ID NO: 635337 - DNA, 25 bp, Rattus norvegicus
tggctgctgttacttgctgtcactc

SEQ ID NO: 635338 - DNA, 25 bp, Rattus norvegicus
tggctgctgttagttgctgtcactc

SEQ ID NO: 635339 - DNA, 25 bp, Rattus norvegicus
tggctgctgtttcgccttcaagtca

SEQ ID NO: 635340 - DNA, 25 bp, Rattus norvegicus
tggctgctgtttggccttcaagtca

SEQ ID NO: 635341 - DNA, 25 bp, Rattus norvegicus
tggctgcttaacacacacgtgctat

SEQ ID NO: 635342 - DNA, 25 bp, Rattus norvegicus
tggctgcttaactcacacgtgctat

SEQ ID NO: 635343 - DNA, 25 bp, Rattus norvegicus
tggctgcttacaacctctggaaatt

SEQ ID NO: 635344 - DNA, 25 bp, Rattus norvegicus
tggctgcttacatcctctggaaatt

SEQ ID NO: 635345 - DNA, 25 bp, Rattus norvegicus
tggctgcttgcaatttccttttaaa

SEQ ID NO: 635346 - DNA, 25 bp, Rattus norvegicus
tggctgcttgcattttccttttaaa

SEQ ID NO: 635347 - DNA, 25 bp, Rattus norvegicus
tggctgctttcactgttctgtggat

SEQ ID NO: 635348 - DNA, 25 bp, Rattus norvegicus
tggctgctttcagtgttctgtggat

SEQ ID NO: 635349 - DNA, 25 bp, Rattus norvegicus
tggctggaaccgaccctggaaggaa

SEQ ID NO: 635350 - DNA, 25 bp, Rattus norvegicus
tggctggaaccgtccctggaaggaa

SEQ ID NO: 635351 - DNA, 25 bp, Rattus norvegicus
tggctggaagctcaacctgacactc

SEQ ID NO: 635352 - DNA, 25 bp, Rattus norvegicus
tggctggaagctgaacctgacactc

SEQ ID NO: 635353 - DNA, 25 bp, Rattus norvegicus
tggctggaagttactgtccgtctca

SEQ ID NO: 635354 - DNA, 25 bp, Rattus norvegicus
tggctggaagtttctgtccgtctca

SEQ ID NO: 635355 - DNA, 25 bp, Rattus norvegicus
tggctggaatgacacacctttaatc

SEQ ID NO: 635356 - DNA, 25 bp, Rattus norvegicus
tggctggaatgagacacctttaatc

SEQ ID NO: 635357 - DNA, 25 bp, Rattus norvegicus
tggctggaatgcctataccctagca

SEQ ID NO: 635358 - DNA, 25 bp, Rattus norvegicus
tggctggaatgcgtataccctagca

SEQ ID NO: 635359 - DNA, 25 bp, Rattus norvegicus
tggctggacaaccacttcagatttt

SEQ ID NO: 635360 - DNA, 25 bp, Rattus norvegicus
tggctggacaacgacttcagatttt

SEQ ID NO: 635361 - DNA, 25 bp, Rattus norvegicus
tggctggacagaacatccccactca

SEQ ID NO: 635362 - DNA, 25 bp, Rattus norvegicus
tggctggacagatcatccccactca

SEQ ID NO: 635363 - DNA, 25 bp, Rattus norvegicus
tggctggaccaaaccaggaccaggg

SEQ ID NO: 635364 - DNA, 25 bp, Rattus norvegicus
tggctggaccaatccaggaccaggg

SEQ ID NO: 635365 - DNA, 25 bp, Rattus norvegicus
tggctggaccagattattatttaac

SEQ ID NO: 635366 - DNA, 25 bp, Rattus norvegicus
tggctggaccagctttaaggctctg

SEQ ID NO: 635367 - DNA, 25 bp, Rattus norvegicus
tggctggaccaggtttaaggctctg

SEQ ID NO: 635368 - DNA, 25 bp, Rattus norvegicus
tggctggaccagtttattatttaac

SEQ ID NO: 635369 - DNA, 25 bp, Rattus norvegicus
tggctggaccttcttaagctggctc

SEQ ID NO: 635370 - DNA, 25 bp, Rattus norvegicus
tggctggaccttgttaagctggctc

SEQ ID NO: 635371 - DNA, 25 bp, Rattus norvegicus
tggctggactcaatggactggctgt

SEQ ID NO: 635372 - DNA, 25 bp, Rattus norvegicus
tggctggactcattggactggctgt

SEQ ID NO: 635373 - DNA, 25 bp, Rattus norvegicus
tggctggagaaaccactcggcagtt

SEQ ID NO: 635374 - DNA, 25 bp, Rattus norvegicus
tggctggagaaagcactcggcagtt

SEQ ID NO: 635375 - DNA, 25 bp, Rattus norvegicus
tggctggagagcatgttttgaaaac

SEQ ID NO: 635376 - DNA, 25 bp, Rattus norvegicus
tggctggagagcttgttttgaaaac

SEQ ID NO: 635377 - DNA, 25 bp, Rattus norvegicus
tggctggattctcctattggcgtga

SEQ ID NO: 635378 - DNA, 25 bp, Rattus norvegicus
tggctggattctgctattggcgtga

SEQ ID NO: 635379 - DNA, 25 bp, Rattus norvegicus
tggctggatttgctgccttcagtta

SEQ ID NO: 635380 - DNA, 25 bp, Rattus norvegicus
tggctggatttggtgccttcagtta

SEQ ID NO: 635381 - DNA, 25 bp, Rattus norvegicus
tggctggcaacccagaaccctctga

SEQ ID NO: 635382 - DNA, 25 bp, Rattus norvegicus
tggctggcaaccgagaaccctctga

SEQ ID NO: 635383 - DNA, 25 bp, Rattus norvegicus
tggctggcacagactcggaagatac

SEQ ID NO: 635384 - DNA, 25 bp, Rattus norvegicus
tggctggcacagtctcggaagatac

SEQ ID NO: 635385 - DNA, 25 bp, Rattus norvegicus
tggctggcactgagcattctattgg

SEQ ID NO: 635386 - DNA, 25 bp, Rattus norvegicus
tggctggcactgtgcattctattgg

SEQ ID NO: 635387 - DNA, 25 bp, Rattus norvegicus
tggctggcagaacacatgctgattt

SEQ ID NO: 635388 - DNA, 25 bp, Rattus norvegicus
tggctggcagaagacatgctgattt

SEQ ID NO: 635389 - DNA, 25 bp, Rattus norvegicus
tggctggcatacagctgtggtacct

SEQ ID NO: 635390 - DNA, 25 bp, Rattus norvegicus
tggctggcatactgctgtggtacct

SEQ ID NO: 635391 - DNA, 25 bp, Rattus norvegicus
tggctggcattaccctatactgagg

SEQ ID NO: 635392 - DNA, 25 bp, Rattus norvegicus
tggctggcattagcctatactgagg

SEQ ID NO: 635393 - DNA, 25 bp, Rattus norvegicus
tggctggccactagggaccttgtgc

SEQ ID NO: 635394 - DNA, 25 bp, Rattus norvegicus
tggctggccactcctcaggtctctg

SEQ ID NO: 635395 - DNA, 25 bp, Rattus norvegicus
tggctggccactgctcaggtctctg

SEQ ID NO: 635396 - DNA, 25 bp, Rattus norvegicus
tggctggccacttgggaccttgtgc

SEQ ID NO: 635397 - DNA, 25 bp, Rattus norvegicus
tggctggccagaaaagccctttttc

SEQ ID NO: 635398 - DNA, 25 bp, Rattus norvegicus
tggctggccagataagccctttttc

SEQ ID NO: 635399 - DNA, 25 bp, Rattus norvegicus
tggctggccatgactgccgcataca

SEQ ID NO: 635400 - DNA, 25 bp, Rattus norvegicus
tggctggccatgctggactgaatac

SEQ ID NO: 635401 - DNA, 25 bp, Rattus norvegicus
tggctggccatggtggactgaatac

SEQ ID NO: 635402 - DNA, 25 bp, Rattus norvegicus
tggctggccatgtctgccgcataca

SEQ ID NO: 635403 - DNA, 25 bp, Rattus norvegicus
tggctggccattcccttgctgaagt

SEQ ID NO: 635404 - DNA, 25 bp, Rattus norvegicus
tggctggccattgccttgctgaagt

SEQ ID NO: 635405 - DNA, 25 bp, Rattus norvegicus
tggctggcccggaattttctatttt

SEQ ID NO: 635406 - DNA, 25 bp, Rattus norvegicus
tggctggcccggtattttctatttt

SEQ ID NO: 635407 - DNA, 25 bp, Rattus norvegicus
tggctggcctacacatccatgaatc

SEQ ID NO: 635408 - DNA, 25 bp, Rattus norvegicus
tggctggcctactcatccatgaatc

SEQ ID NO: 635409 - DNA, 25 bp, Rattus norvegicus
tggctggcctttagactctttaaca

SEQ ID NO: 635410 - DNA, 25 bp, Rattus norvegicus
tggctggccttttgactctttaaca

SEQ ID NO: 635411 - DNA, 25 bp, Rattus norvegicus
tggctggctactctgctggttaaat

SEQ ID NO: 635412 - DNA, 25 bp, Rattus norvegicus
tggctggctactgtgctggttaaat

SEQ ID NO: 635413 - DNA, 25 bp, Rattus norvegicus
tggctggctatcatggtcaaggcgc

SEQ ID NO: 635414 - DNA, 25 bp, Rattus norvegicus
tggctggctatcttggtcaaggcgc

SEQ ID NO: 635415 - DNA, 25 bp, Rattus norvegicus
tggctggctcttacagtgcagatta

SEQ ID NO: 635416 - DNA, 25 bp, Rattus norvegicus
tggctggctctttcagtgcagatta

SEQ ID NO: 635417 - DNA, 25 bp, Rattus norvegicus
tggctgggaagcatctgataactca

SEQ ID NO: 635418 - DNA, 25 bp, Rattus norvegicus
tggctgggaagcttctgataactca

SEQ ID NO: 635419 - DNA, 25 bp, Rattus norvegicus
tggctgggactaccgcgataactca

SEQ ID NO: 635420 - DNA, 25 bp, Rattus norvegicus
tggctgggactagcgcgataactca

SEQ ID NO: 635421 - DNA, 25 bp, Rattus norvegicus
tggctgggatacatggatactggtt

SEQ ID NO: 635422 - DNA, 25 bp, Rattus norvegicus
tggctgggatacttggatactggtt

SEQ ID NO: 635423 - DNA, 25 bp, Rattus norvegicus
tggctgggatggatggtcctttcca

SEQ ID NO: 635424 - DNA, 25 bp, Rattus norvegicus
tggctgggatggttggtcctttcca

SEQ ID NO: 635425 - DNA, 25 bp, Rattus norvegicus
tggctgggcccgcaggatatccacc

SEQ ID NO: 635426 - DNA, 25 bp, Rattus norvegicus
tggctgggcccggaggatatccacc

SEQ ID NO: 635427 - DNA, 25 bp, Rattus norvegicus
tggctgggcgcaaacttgctctaaa

SEQ ID NO: 635428 - DNA, 25 bp, Rattus norvegicus
tggctgggcgcatacttgctctaaa

SEQ ID NO: 635429 - DNA, 25 bp, Rattus norvegicus
tggctgggcttgacctgaactactc

SEQ ID NO: 635430 - DNA, 25 bp, Rattus norvegicus
tggctgggcttgtcctgaactactc

SEQ ID NO: 635431 - DNA, 25 bp, Rattus norvegicus
tggctgggtcctagcatgctggaca

SEQ ID NO: 635432 - DNA, 25 bp, Rattus norvegicus
tggctgggtccttgcatgctggaca

SEQ ID NO: 635433 - DNA, 25 bp, Rattus norvegicus
tggctggtagccagatataaagatc

SEQ ID NO: 635434 - DNA, 25 bp, Rattus norvegicus
tggctggtagcctgatataaagatc

SEQ ID NO: 635435 - DNA, 25 bp, Rattus norvegicus
tggctggtatctattgcatgcttct

SEQ ID NO: 635436 - DNA, 25 bp, Rattus norvegicus
tggctggtatcttttgcatgcttct

SEQ ID NO: 635437 - DNA, 25 bp, Rattus norvegicus
tggctggtcaccacataggaccaca

SEQ ID NO: 635438 - DNA, 25 bp, Rattus norvegicus
tggctggtcacctcataggaccaca

SEQ ID NO: 635439 - DNA, 25 bp, Rattus norvegicus
tggctggtccagaacaggttctacc

SEQ ID NO: 635440 - DNA, 25 bp, Rattus norvegicus
tggctggtccagtacaggttctacc

SEQ ID NO: 635441 - DNA, 25 bp, Rattus norvegicus
tggctggtcttacgcactgtagttc

SEQ ID NO: 635442 - DNA, 25 bp, Rattus norvegicus
tggctggtcttaggcactgtagttc

SEQ ID NO: 635443 - DNA, 25 bp, Rattus norvegicus
tggctggtgactcgtgagtttccca

SEQ ID NO: 635444 - DNA, 25 bp, Rattus norvegicus
tggctggtgactggtgagtttccca

SEQ ID NO: 635445 - DNA, 25 bp, Rattus norvegicus
tggctggtgttgaccttgggttccc

SEQ ID NO: 635446 - DNA, 25 bp, Rattus norvegicus
tggctggtgttgtccttgggttccc

SEQ ID NO: 635447 - DNA, 25 bp, Rattus norvegicus
tggctggttcaacgcttagtcactg

SEQ ID NO: 635448 - DNA, 25 bp, Rattus norvegicus
tggctggttcaaggcttagtcactg

SEQ ID NO: 635449 - DNA, 25 bp, Rattus norvegicus
tggctggttcttattgcggttcttc

SEQ ID NO: 635450 - DNA, 25 bp, Rattus norvegicus
tggctggttctttttgcggttcttc

SEQ ID NO: 635451 - DNA, 25 bp, Rattus norvegicus
tggctggttgacatctggattcgat

SEQ ID NO: 635452 - DNA, 25 bp, Rattus norvegicus
tggctggttgacttctggattcgat

SEQ ID NO: 635453 - DNA, 25 bp, Rattus norvegicus
tggctggttgcccacgttttcaaac

SEQ ID NO: 635454 - DNA, 25 bp, Rattus norvegicus
tggctggttgccgacgttttcaaac

SEQ ID NO: 635455 - DNA, 25 bp, Rattus norvegicus
tggctggtttgcctcttctctgtta

SEQ ID NO: 635456 - DNA, 25 bp, Rattus norvegicus
tggctggtttgcgtcttctctgtta

SEQ ID NO: 635457 - DNA, 25 bp, Rattus norvegicus
tggctgtacatacacatcgtccggt

SEQ ID NO: 635458 - DNA, 25 bp, Rattus norvegicus
tggctgtacatagacatcgtccggt

SEQ ID NO: 635459 - DNA, 25 bp, Rattus norvegicus
tggctgtagggcaccccacagcaag

SEQ ID NO: 635460 - DNA, 25 bp, Rattus norvegicus
tggctgtagggctccccacagcaag

SEQ ID NO: 635461 - DNA, 25 bp, Rattus norvegicus
tggctgtatacacacttaccctctt

SEQ ID NO: 635462 - DNA, 25 bp, Rattus norvegicus
tggctgtatacagacttaccctctt

SEQ ID NO: 635463 - DNA, 25 bp, Rattus norvegicus
tggctgtatttaacgtctgctggac

SEQ ID NO: 635464 - DNA, 25 bp, Rattus norvegicus
tggctgtatttaatttctgcaacta

SEQ ID NO: 635465 - DNA, 25 bp, Rattus norvegicus
tggctgtatttatcgtctgctggac

SEQ ID NO: 635466 - DNA, 25 bp, Rattus norvegicus
tggctgtatttattttctgcaacta

SEQ ID NO: 635467 - DNA, 25 bp, Rattus norvegicus
tggctgtcaagcaatcgtttccgtc

SEQ ID NO: 635468 - DNA, 25 bp, Rattus norvegicus
tggctgtcaagctatcgtttccgtc

SEQ ID NO: 635469 - DNA, 25 bp, Rattus norvegicus
tggctgtcaggacccaaataccaat

SEQ ID NO: 635470 - DNA, 25 bp, Rattus norvegicus
tggctgtcaggagccaaataccaat

SEQ ID NO: 635471 - DNA, 25 bp, Rattus norvegicus
tggctgtcattgaacttgtggccct

SEQ ID NO: 635472 - DNA, 25 bp, Rattus norvegicus
tggctgtcattgtacttgtggccct

SEQ ID NO: 635473 - DNA, 25 bp, Rattus norvegicus
tggctgtcccaaagctgtgtgctgg

SEQ ID NO: 635474 - DNA, 25 bp, Rattus norvegicus
tggctgtcccaatgctgtgtgctgg

SEQ ID NO: 635475 - DNA, 25 bp, Rattus norvegicus
tggctgtccggcaccattgtactgt

SEQ ID NO: 635476 - DNA, 25 bp, Rattus norvegicus
tggctgtccggctccattgtactgt

SEQ ID NO: 635477 - DNA, 25 bp, Rattus norvegicus
tggctgtcgctgaccacccaggaca

SEQ ID NO: 635478 - DNA, 25 bp, Rattus norvegicus
tggctgtcgctgtccacccaggaca

SEQ ID NO: 635479 - DNA, 25 bp, Rattus norvegicus
tggctgtctacaacagaactctggc

SEQ ID NO: 635480 - DNA, 25 bp, Rattus norvegicus
tggctgtctacatcagaactctggc

SEQ ID NO: 635481 - DNA, 25 bp, Rattus norvegicus
tggctgtctacgcagagcaagcttt

SEQ ID NO: 635482 - DNA, 25 bp, Rattus norvegicus
tggctgtctacggagagcaagcttt

SEQ ID NO: 635483 - DNA, 25 bp, Rattus norvegicus
tggctgtctctgattgcacatgtaa

SEQ ID NO: 635484 - DNA, 25 bp, Rattus norvegicus
tggctgtctctgtttgcacatgtaa

SEQ ID NO: 635485 - DNA, 25 bp, Rattus norvegicus
tggctgtctgctatcaccgcctgct

SEQ ID NO: 635486 - DNA, 25 bp, Rattus norvegicus
tggctgtctgctttcaccgcctgct

SEQ ID NO: 635487 - DNA, 25 bp, Rattus norvegicus
tggctgtcttccagagtgttgggca

SEQ ID NO: 635488 - DNA, 25 bp, Rattus norvegicus
tggctgtcttcccttggacaataat

SEQ ID NO: 635489 - DNA, 25 bp, Rattus norvegicus
tggctgtcttccgttggacaataat

SEQ ID NO: 635490 - DNA, 25 bp, Rattus norvegicus
tggctgtcttcctgagtgttgggca

SEQ ID NO: 635491 - DNA, 25 bp, Rattus norvegicus
tggctgtgaaacactacttcggacc

SEQ ID NO: 635492 - DNA, 25 bp, Rattus norvegicus
tggctgtgaaactctacttcggacc

SEQ ID NO: 635493 - DNA, 25 bp, Rattus norvegicus
tggctgtgcactccagtcttccgtg

SEQ ID NO: 635494 - DNA, 25 bp, Rattus norvegicus
tggctgtgcactgcagtcttccgtg

SEQ ID NO: 635495 - DNA, 25 bp, Rattus norvegicus
tggctgtgcattacttttgtcaaaa

SEQ ID NO: 635496 - DNA, 25 bp, Rattus norvegicus
tggctgtgcatttcttttgtcaaaa

SEQ ID NO: 635497 - DNA, 25 bp, Rattus norvegicus
tggctgtgctagagaccctgtgagt

SEQ ID NO: 635498 - DNA, 25 bp, Rattus norvegicus
tggctgtgctagtgaccctgtgagt

SEQ ID NO: 635499 - DNA, 25 bp, Rattus norvegicus
tggctgtgctctcaggccagcgtct

SEQ ID NO: 635500 - DNA, 25 bp, Rattus norvegicus
tggctgtgctctgaggccagcgtct

SEQ ID NO: 635501 - DNA, 25 bp, Rattus norvegicus
tggctgtggaccagctggacagaaa

SEQ ID NO: 635502 - DNA, 25 bp, Rattus norvegicus
tggctgtggacctgctggacagaaa

SEQ ID NO: 635503 - DNA, 25 bp, Rattus norvegicus
tggctgtggcccacagtagtatctg

SEQ ID NO: 635504 - DNA, 25 bp, Rattus norvegicus
tggctgtggccctcagtagtatctg

SEQ ID NO: 635505 - DNA, 25 bp, Rattus norvegicus
tggctgtggcctcagattctagcta

SEQ ID NO: 635506 - DNA, 25 bp, Rattus norvegicus
tggctgtggcctgagattctagcta

SEQ ID NO: 635507 - DNA, 25 bp, Rattus norvegicus
tggctgtgggcaaaccacttattgc

SEQ ID NO: 635508 - DNA, 25 bp, Rattus norvegicus
tggctgtgggcataccacttattgc

SEQ ID NO: 635509 - DNA, 25 bp, Rattus norvegicus
tggctgtgttccagacccagaagag

SEQ ID NO: 635510 - DNA, 25 bp, Rattus norvegicus
tggctgtgttcctgacccagaagag

SEQ ID NO: 635511 - DNA, 25 bp, Rattus norvegicus
tggctgtgttttcaccttaggtttt

SEQ ID NO: 635512 - DNA, 25 bp, Rattus norvegicus
tggctgtgttttgaccttaggtttt

SEQ ID NO: 635513 - DNA, 25 bp, Rattus norvegicus
tggctgttacaaatgtcccttttcc

SEQ ID NO: 635514 - DNA, 25 bp, Rattus norvegicus
tggctgttacaattgtcccttttcc

SEQ ID NO: 635515 - DNA, 25 bp, Rattus norvegicus
tggctgttacttctcactacgtcac

SEQ ID NO: 635516 - DNA, 25 bp, Rattus norvegicus
tggctgttacttgtcactacgtcac

SEQ ID NO: 635517 - DNA, 25 bp, Rattus norvegicus
tggctgttaggtcgacctgtctccc

SEQ ID NO: 635518 - DNA, 25 bp, Rattus norvegicus
tggctgttaggtggacctgtctccc

SEQ ID NO: 635519 - DNA, 25 bp, Rattus norvegicus
tggctgttatcaacaattcccctaa

SEQ ID NO: 635520 - DNA, 25 bp, Rattus norvegicus
tggctgttatcatcaattcccctaa

SEQ ID NO: 635521 - DNA, 25 bp, Rattus norvegicus
tggctgttcctgaaaaactctttgg

SEQ ID NO: 635522 - DNA, 25 bp, Rattus norvegicus
tggctgttcctgtaaaactctttgg

SEQ ID NO: 635523 - DNA, 25 bp, Rattus norvegicus
tggctgttccttcccagaaaaagaa

SEQ ID NO: 635524 - DNA, 25 bp, Rattus norvegicus
tggctgttccttgccagaaaaagaa

SEQ ID NO: 635525 - DNA, 25 bp, Rattus norvegicus
tggctgttcgctcctggctgataac

SEQ ID NO: 635526 - DNA, 25 bp, Rattus norvegicus
tggctgttcgctgctggctgataac

SEQ ID NO: 635527 - DNA, 25 bp, Rattus norvegicus
tggctgttgcagaatcacaccgctt

SEQ ID NO: 635528 - DNA, 25 bp, Rattus norvegicus
tggctgttgcagtatcacaccgctt

SEQ ID NO: 635529 - DNA, 25 bp, Rattus norvegicus
tggctgttgccaagtttgcttatta

SEQ ID NO: 635530 - DNA, 25 bp, Rattus norvegicus
tggctgttgccatgtttgcttatta

SEQ ID NO: 635531 - DNA, 25 bp, Rattus norvegicus
tggctgttgttgcacgagctcgact

SEQ ID NO: 635532 - DNA, 25 bp, Rattus norvegicus
tggctgttgttggacgagctcgact

SEQ ID NO: 635533 - DNA, 25 bp, Rattus norvegicus
tggctgtttaggattacacggccct

SEQ ID NO: 635534 - DNA, 25 bp, Rattus norvegicus
tggctgtttaggtttacacggccct

SEQ ID NO: 635535 - DNA, 25 bp, Rattus norvegicus
tggctgtttccaccttagaatttca

SEQ ID NO: 635536 - DNA, 25 bp, Rattus norvegicus
tggctgtttccagcttagaatttca

SEQ ID NO: 635537 - DNA, 25 bp, Rattus norvegicus
tggctgtttctgacaggcccaggaa

SEQ ID NO: 635538 - DNA, 25 bp, Rattus norvegicus
tggctgtttctgtcaggcccaggaa

SEQ ID NO: 635539 - DNA, 25 bp, Rattus norvegicus
tggctgttttctcaggcaccactga

SEQ ID NO: 635540 - DNA, 25 bp, Rattus norvegicus
tggctgttttctgaggcaccactga

SEQ ID NO: 635541 - DNA, 25 bp, Rattus norvegicus
tggcttaaacgcaacccacaggttt

SEQ ID NO: 635542 - DNA, 25 bp, Rattus norvegicus
tggcttaaacgctacccacaggttt

SEQ ID NO: 635543 - DNA, 25 bp, Rattus norvegicus
tggcttaaagatcctatcaaaaatt

SEQ ID NO: 635544 - DNA, 25 bp, Rattus norvegicus
tggcttaaagatgctatcaaaaatt

SEQ ID NO: 635545 - DNA, 25 bp, Rattus norvegicus
tggcttaaagtgctgtgcttctctc

SEQ ID NO: 635546 - DNA, 25 bp, Rattus norvegicus
tggcttaaagtggtgtgcttctctc

SEQ ID NO: 635547 - DNA, 25 bp, Rattus norvegicus
tggcttaagaatcgcctggcctcta

SEQ ID NO: 635548 - DNA, 25 bp, Rattus norvegicus
tggcttaagaatggcctggcctcta

SEQ ID NO: 635549 - DNA, 25 bp, Rattus norvegicus
tggcttaaggatacccgtcttgcct

SEQ ID NO: 635550 - DNA, 25 bp, Rattus norvegicus
tggcttaaggattcccgtcttgcct

SEQ ID NO: 635551 - DNA, 25 bp, Rattus norvegicus
tggcttaattttcctactcctccat

SEQ ID NO: 635552 - DNA, 25 bp, Rattus norvegicus
tggcttaattttgctactcctccat

SEQ ID NO: 635553 - DNA, 25 bp, Rattus norvegicus
tggcttacacagacacccaaaggtt

SEQ ID NO: 635554 - DNA, 25 bp, Rattus norvegicus
tggcttacacagtcacccaaaggtt

SEQ ID NO: 635555 - DNA, 25 bp, Rattus norvegicus
tggcttacagctctaggtggacgca

SEQ ID NO: 635556 - DNA, 25 bp, Rattus norvegicus
tggcttacagctgtaggtggacgca

SEQ ID NO: 635557 - DNA, 25 bp, Rattus norvegicus
tggcttacgtttctctttggatttt

SEQ ID NO: 635558 - DNA, 25 bp, Rattus norvegicus
tggcttacgtttgtctttggatttt

SEQ ID NO: 635559 - DNA, 25 bp, Rattus norvegicus
tggcttacttttcccagcctggaat

SEQ ID NO: 635560 - DNA, 25 bp, Rattus norvegicus
tggcttacttttgccagcctggaat

SEQ ID NO: 635561 - DNA, 25 bp, Rattus norvegicus
tggcttagaccaaaatcctctgctg

SEQ ID NO: 635562 - DNA, 25 bp, Rattus norvegicus
tggcttagaccataatcctctgctg

SEQ ID NO: 635563 - DNA, 25 bp, Rattus norvegicus
tggcttagagatcgtttgtgtgata

SEQ ID NO: 635564 - DNA, 25 bp, Rattus norvegicus
tggcttagagatggtttgtgtgata

SEQ ID NO: 635565 - DNA, 25 bp, Rattus norvegicus
tggcttagcagaaccggacagggcc

SEQ ID NO: 635566 - DNA, 25 bp, Rattus norvegicus
tggcttagcagatccggacagggcc

SEQ ID NO: 635567 - DNA, 25 bp, Rattus norvegicus
tggcttagcagcctttaacgggctt

SEQ ID NO: 635568 - DNA, 25 bp, Rattus norvegicus
tggcttagcagcgtttaacgggctt

SEQ ID NO: 635569 - DNA, 25 bp, Rattus norvegicus
tggcttagccttacttatccaaaag

SEQ ID NO: 635570 - DNA, 25 bp, Rattus norvegicus
tggcttagcctttcttatccaaaag

SEQ ID NO: 635571 - DNA, 25 bp, Rattus norvegicus
tggcttaggcatcactcaggcaaac

SEQ ID NO: 635572 - DNA, 25 bp, Rattus norvegicus
tggcttaggcatgactcaggcaaac

SEQ ID NO: 635573 - DNA, 25 bp, Rattus norvegicus
tggcttaggtctcagtcccaggaaa

SEQ ID NO: 635574 - DNA, 25 bp, Rattus norvegicus
tggcttaggtctgagtcccaggaaa

SEQ ID NO: 635575 - DNA, 25 bp, Rattus norvegicus
tggcttagttatctgtgactccagt

SEQ ID NO: 635576 - DNA, 25 bp, Rattus norvegicus
tggcttagttatgtgtgactccagt

SEQ ID NO: 635577 - DNA, 25 bp, Rattus norvegicus
tggcttatcacaccctttgaggagg

SEQ ID NO: 635578 - DNA, 25 bp, Rattus norvegicus
tggcttatcacagcctttgaggagg

SEQ ID NO: 635579 - DNA, 25 bp, Rattus norvegicus
tggcttatgaacaccaagtcactcc

SEQ ID NO: 635580 - DNA, 25 bp, Rattus norvegicus
tggcttatgaactccaagtcactcc

SEQ ID NO: 635581 - DNA, 25 bp, Rattus norvegicus
tggcttatgcccacagaacctggag

SEQ ID NO: 635582 - DNA, 25 bp, Rattus norvegicus
tggcttatgccctcagaacctggag

SEQ ID NO: 635583 - DNA, 25 bp, Rattus norvegicus
tggcttatgggcaaacctatagtat

SEQ ID NO: 635584 - DNA, 25 bp, Rattus norvegicus
tggcttatgggctaacctatagtat

SEQ ID NO: 635585 - DNA, 25 bp, Rattus norvegicus
tggcttattactaccagctgtgttt

SEQ ID NO: 635586 - DNA, 25 bp, Rattus norvegicus
tggcttattacttccagctgtgttt

SEQ ID NO: 635587 - DNA, 25 bp, Rattus norvegicus
tggcttatttctcacagagctgccg

SEQ ID NO: 635588 - DNA, 25 bp, Rattus norvegicus
tggcttatttctgacagagctgccg

SEQ ID NO: 635589 - DNA, 25 bp, Rattus norvegicus
tggcttattttgacctgtctatgtt

SEQ ID NO: 635590 - DNA, 25 bp, Rattus norvegicus
tggcttattttgtcctgtctatgtt

SEQ ID NO: 635591 - DNA, 25 bp, Rattus norvegicus
tggcttcaaaccagagtcctctgca

SEQ ID NO: 635592 - DNA, 25 bp, Rattus norvegicus
tggcttcaaacctgagtcctctgca

SEQ ID NO: 635593 - DNA, 25 bp, Rattus norvegicus
tggcttcaaactctagcttctttgc

SEQ ID NO: 635594 - DNA, 25 bp, Rattus norvegicus
tggcttcaaactgtagcttctttgc

SEQ ID NO: 635595 - DNA, 25 bp, Rattus norvegicus
tggcttcaaagcacgtgttgtgtaa

SEQ ID NO: 635596 - DNA, 25 bp, Rattus norvegicus
tggcttcaaagctcgtgttgtgtaa

SEQ ID NO: 635597 - DNA, 25 bp, Rattus norvegicus
tggcttcaacctagcttgtgtttaa

SEQ ID NO: 635598 - DNA, 25 bp, Rattus norvegicus
tggcttcaaccttgcttgtgtttaa

SEQ ID NO: 635599 - DNA, 25 bp, Rattus norvegicus
tggcttcaatctactctccaatgca

SEQ ID NO: 635600 - DNA, 25 bp, Rattus norvegicus
tggcttcaatcttctctccaatgca

SEQ ID NO: 635601 - DNA, 25 bp, Rattus norvegicus
tggcttcaatttaactcaactgcta

SEQ ID NO: 635602 - DNA, 25 bp, Rattus norvegicus
tggcttcaattttactcaactgcta

SEQ ID NO: 635603 - DNA, 25 bp, Rattus norvegicus
tggcttcacagacgacagaggtcaa

SEQ ID NO: 635604 - DNA, 25 bp, Rattus norvegicus
tggcttcacagaggacagaggtcaa

SEQ ID NO: 635605 - DNA, 25 bp, Rattus norvegicus
tggcttcaccccaaaaatgcagcag

SEQ ID NO: 635606 - DNA, 25 bp, Rattus norvegicus
tggcttcacccctaaaatgcagcag

SEQ ID NO: 635607 - DNA, 25 bp, Rattus norvegicus
tggcttcaccctcgagttaatacgg

SEQ ID NO: 635608 - DNA, 25 bp, Rattus norvegicus
tggcttcaccctggagttaatacgg

SEQ ID NO: 635609 - DNA, 25 bp, Rattus norvegicus
tggcttcacctgataaacatgggcg

SEQ ID NO: 635610 - DNA, 25 bp, Rattus norvegicus
tggcttcacctgttaaacatgggcg

SEQ ID NO: 635611 - DNA, 25 bp, Rattus norvegicus
tggcttcacggtcttcagacggatt

SEQ ID NO: 635612 - DNA, 25 bp, Rattus norvegicus
tggcttcacggtgttcagacggatt

SEQ ID NO: 635613 - DNA, 25 bp, Rattus norvegicus
tggcttcactagatggttaccttgg

SEQ ID NO: 635614 - DNA, 25 bp, Rattus norvegicus
tggcttcactagttggttaccttgg

SEQ ID NO: 635615 - DNA, 25 bp, Rattus norvegicus
tggcttcactgcatgactgacgacc

SEQ ID NO: 635616 - DNA, 25 bp, Rattus norvegicus
tggcttcactgcttgactgacgacc

SEQ ID NO: 635617 - DNA, 25 bp, Rattus norvegicus
tggcttcacttcaggcaacgcgaga

SEQ ID NO: 635618 - DNA, 25 bp, Rattus norvegicus
tggcttcacttctggcaacgcgaga

SEQ ID NO: 635619 - DNA, 25 bp, Rattus norvegicus
tggcttcagattcagagatcctcct

SEQ ID NO: 635620 - DNA, 25 bp, Rattus norvegicus
tggcttcagattgagagatcctcct

SEQ ID NO: 635621 - DNA, 25 bp, Rattus norvegicus
tggcttcagccaaagtacacatctc

SEQ ID NO: 635622 - DNA, 25 bp, Rattus norvegicus
tggcttcagccatagtacacatctc

SEQ ID NO: 635623 - DNA, 25 bp, Rattus norvegicus
tggcttcagcctcaagttctgaggt

SEQ ID NO: 635624 - DNA, 25 bp, Rattus norvegicus
tggcttcagcctgaagttctgaggt

SEQ ID NO: 635625 - DNA, 25 bp, Rattus norvegicus
tggcttcagcgtatccaaggacatg

SEQ ID NO: 635626 - DNA, 25 bp, Rattus norvegicus
tggcttcagcgtttccaaggacatg

SEQ ID NO: 635627 - DNA, 25 bp, Rattus norvegicus
tggcttcagtgtctttgggcagtac

SEQ ID NO: 635628 - DNA, 25 bp, Rattus norvegicus
tggcttcagtgtgtttgggcagtac

SEQ ID NO: 635629 - DNA, 25 bp, Rattus norvegicus
tggcttcatcatctactcggattga

SEQ ID NO: 635630 - DNA, 25 bp, Rattus norvegicus
tggcttcatcatgtactcggattga

SEQ ID NO: 635631 - DNA, 25 bp, Rattus norvegicus
tggcttcatgtcagcttttcttcca

SEQ ID NO: 635632 - DNA, 25 bp, Rattus norvegicus
tggcttcatgtctgcttttcttcca

SEQ ID NO: 635633 - DNA, 25 bp, Rattus norvegicus
tggcttccaaccaattggtcccaag

SEQ ID NO: 635634 - DNA, 25 bp, Rattus norvegicus
tggcttccaacctattggtcccaag

SEQ ID NO: 635635 - DNA, 25 bp, Rattus norvegicus
tggcttccaagtaggcatgtatgct

SEQ ID NO: 635636 - DNA, 25 bp, Rattus norvegicus
tggcttccaagttggcatgtatgct

SEQ ID NO: 635637 - DNA, 25 bp, Rattus norvegicus
tggcttccacacatagcagaatgaa

SEQ ID NO: 635638 - DNA, 25 bp, Rattus norvegicus
tggcttccacaccaatatgcaattg

SEQ ID NO: 635639 - DNA, 25 bp, Rattus norvegicus
tggcttccacacgaatatgcaattg

SEQ ID NO: 635640 - DNA, 25 bp, Rattus norvegicus
tggcttccacacttagcagaatgaa

SEQ ID NO: 635641 - DNA, 25 bp, Rattus norvegicus
tggcttccacatctgctgtaagact

SEQ ID NO: 635642 - DNA, 25 bp, Rattus norvegicus
tggcttccacatgtgctgtaagact

SEQ ID NO: 635643 - DNA, 25 bp, Rattus norvegicus
tggcttccagctacgttgttaccat

SEQ ID NO: 635644 - DNA, 25 bp, Rattus norvegicus
tggcttccagcttcgttgttaccat

SEQ ID NO: 635645 - DNA, 25 bp, Rattus norvegicus
tggcttccaggtaaaggttctccga

SEQ ID NO: 635646 - DNA, 25 bp, Rattus norvegicus
tggcttccaggtagctgcacaggca

SEQ ID NO: 635647 - DNA, 25 bp, Rattus norvegicus
tggcttccaggtatttaaatgttct

SEQ ID NO: 635648 - DNA, 25 bp, Rattus norvegicus
tggcttccaggttaaggttctccga

SEQ ID NO: 635649 - DNA, 25 bp, Rattus norvegicus
tggcttccaggttgctgcacaggca

SEQ ID NO: 635650 - DNA, 25 bp, Rattus norvegicus
tggcttccaggtttttaaatgttct

SEQ ID NO: 635651 - DNA, 25 bp, Rattus norvegicus
tggcttccatacagtgtgttctgga

SEQ ID NO: 635652 - DNA, 25 bp, Rattus norvegicus
tggcttccatactgtgtgttctgga

SEQ ID NO: 635653 - DNA, 25 bp, Rattus norvegicus
tggcttccatgtccattggccatga

SEQ ID NO: 635654 - DNA, 25 bp, Rattus norvegicus
tggcttccatgtgcattggccatga

SEQ ID NO: 635655 - DNA, 25 bp, Rattus norvegicus
tggcttccattgcttctggtgataa

SEQ ID NO: 635656 - DNA, 25 bp, Rattus norvegicus
tggcttccattggttctggtgataa

SEQ ID NO: 635657 - DNA, 25 bp, Rattus norvegicus
tggcttcccacgacgatggcaatga

SEQ ID NO: 635658 - DNA, 25 bp, Rattus norvegicus
tggcttcccacgtcgatggcaatga

SEQ ID NO: 635659 - DNA, 25 bp, Rattus norvegicus
tggcttcccatcagtttcatcagaa

SEQ ID NO: 635660 - DNA, 25 bp, Rattus norvegicus
tggcttcccatctgtttcatcagaa

SEQ ID NO: 635661 - DNA, 25 bp, Rattus norvegicus
tggcttccccttaagtggtttgtct

SEQ ID NO: 635662 - DNA, 25 bp, Rattus norvegicus
tggcttccccttctaaaggctctaa

SEQ ID NO: 635663 - DNA, 25 bp, Rattus norvegicus
tggcttccccttgtaaaggctctaa

SEQ ID NO: 635664 - DNA, 25 bp, Rattus norvegicus
tggcttcccctttagtggtttgtct

SEQ ID NO: 635665 - DNA, 25 bp, Rattus norvegicus
tggcttccctcaccctgtagggaaa

SEQ ID NO: 635666 - DNA, 25 bp, Rattus norvegicus
tggcttccctcagcctgtagggaaa

SEQ ID NO: 635667 - DNA, 25 bp, Rattus norvegicus
tggcttccctggctgtctcacatct

SEQ ID NO: 635668 - DNA, 25 bp, Rattus norvegicus
tggcttccctgggtgtctcacatct

SEQ ID NO: 635669 - DNA, 25 bp, Rattus norvegicus
tggcttcccttcaaaacaaaaacat

SEQ ID NO: 635670 - DNA, 25 bp, Rattus norvegicus
tggcttcccttctaaacaaaaacat

SEQ ID NO: 635671 - DNA, 25 bp, Rattus norvegicus
tggcttccgagtcttgtaaagtccc

SEQ ID NO: 635672 - DNA, 25 bp, Rattus norvegicus
tggcttccgagtgttgtaaagtccc

SEQ ID NO: 635673 - DNA, 25 bp, Rattus norvegicus
tggcttcctcccatggaaaacagga

SEQ ID NO: 635674 - DNA, 25 bp, Rattus norvegicus
tggcttcctcccttggaaaacagga

SEQ ID NO: 635675 - DNA, 25 bp, Rattus norvegicus
tggcttcctcttactgttctaatac

SEQ ID NO: 635676 - DNA, 25 bp, Rattus norvegicus
tggcttcctctttctgttctaatac

SEQ ID NO: 635677 - DNA, 25 bp, Rattus norvegicus
tggcttcctgatactacttggagtt

SEQ ID NO: 635678 - DNA, 25 bp, Rattus norvegicus
tggcttcctgattctacttggagtt

SEQ ID NO: 635679 - DNA, 25 bp, Rattus norvegicus
tggcttccttcccttgttttaacag

SEQ ID NO: 635680 - DNA, 25 bp, Rattus norvegicus
tggcttccttccgttgttttaacag

SEQ ID NO: 635681 - DNA, 25 bp, Rattus norvegicus
tggcttcgctgaaccagatcttgga

SEQ ID NO: 635682 - DNA, 25 bp, Rattus norvegicus
tggcttcgctgaactacaactttat

SEQ ID NO: 635683 - DNA, 25 bp, Rattus norvegicus
tggcttcgctgatccagatcttgga

SEQ ID NO: 635684 - DNA, 25 bp, Rattus norvegicus
tggcttcgctgatctacaactttat

SEQ ID NO: 635685 - DNA, 25 bp, Rattus norvegicus
tggcttcgcttcatgtgatcccaga

SEQ ID NO: 635686 - DNA, 25 bp, Rattus norvegicus
tggcttcgcttcttgtgatcccaga

SEQ ID NO: 635687 - DNA, 25 bp, Rattus norvegicus
tggcttcgctttatcgtaaggcatc

SEQ ID NO: 635688 - DNA, 25 bp, Rattus norvegicus
tggcttcgctttttcgtaaggcatc

SEQ ID NO: 635689 - DNA, 25 bp, Rattus norvegicus
tggcttcggcggctaagaaacaaag

SEQ ID NO: 635690 - DNA, 25 bp, Rattus norvegicus
tggcttcggcgggtaagaaacaaag

SEQ ID NO: 635691 - DNA, 25 bp, Rattus norvegicus
tggcttctaactccttgttttccta

SEQ ID NO: 635692 - DNA, 25 bp, Rattus norvegicus
tggcttctaactgcttgttttccta

SEQ ID NO: 635693 - DNA, 25 bp, Rattus norvegicus
tggcttctaccaagggtactacttt

SEQ ID NO: 635694 - DNA, 25 bp, Rattus norvegicus
tggcttctaccatgggtactacttt

SEQ ID NO: 635695 - DNA, 25 bp, Rattus norvegicus
tggcttctaccgaagccgacgagag

SEQ ID NO: 635696 - DNA, 25 bp, Rattus norvegicus
tggcttctaccgtagccgacgagag

SEQ ID NO: 635697 - DNA, 25 bp, Rattus norvegicus
tggcttctactcctacttcaagtga

SEQ ID NO: 635698 - DNA, 25 bp, Rattus norvegicus
tggcttctactcgtacttcaagtga

SEQ ID NO: 635699 - DNA, 25 bp, Rattus norvegicus
tggcttctactgaccctgtggctag

SEQ ID NO: 635700 - DNA, 25 bp, Rattus norvegicus
tggcttctactgtccctgtggctag

SEQ ID NO: 635701 - DNA, 25 bp, Rattus norvegicus
tggcttctagcccatgcaagttaga

SEQ ID NO: 635702 - DNA, 25 bp, Rattus norvegicus
tggcttctagccgatgcaagttaga

SEQ ID NO: 635703 - DNA, 25 bp, Rattus norvegicus
tggcttctcaacaccattctgcttg

SEQ ID NO: 635704 - DNA, 25 bp, Rattus norvegicus
tggcttctcaactccattctgcttg

SEQ ID NO: 635705 - DNA, 25 bp, Rattus norvegicus
tggcttctcagacggccttagttta

SEQ ID NO: 635706 - DNA, 25 bp, Rattus norvegicus
tggcttctcagagggccttagttta

SEQ ID NO: 635707 - DNA, 25 bp, Rattus norvegicus
tggcttctccaaaaccagtctggaa

SEQ ID NO: 635708 - DNA, 25 bp, Rattus norvegicus
tggcttctccaataccagtctggaa

SEQ ID NO: 635709 - DNA, 25 bp, Rattus norvegicus
tggcttctccacacaaacaatgcta

SEQ ID NO: 635710 - DNA, 25 bp, Rattus norvegicus
tggcttctccacacttagcagatgt

SEQ ID NO: 635711 - DNA, 25 bp, Rattus norvegicus
tggcttctccactcaaacaatgcta

SEQ ID NO: 635712 - DNA, 25 bp, Rattus norvegicus
tggcttctccactcttagcagatgt

SEQ ID NO: 635713 - DNA, 25 bp, Rattus norvegicus
tggcttctcctgaagctcttacaat

SEQ ID NO: 635714 - DNA, 25 bp, Rattus norvegicus
tggcttctcctgtagctcttacaat

SEQ ID NO: 635715 - DNA, 25 bp, Rattus norvegicus
tggcttctcgcgataaccaaggaaa

SEQ ID NO: 635716 - DNA, 25 bp, Rattus norvegicus
tggcttctcgcgttaaccaaggaaa

SEQ ID NO: 635717 - DNA, 25 bp, Rattus norvegicus
tggcttctctcaaccctgtatgtgt

SEQ ID NO: 635718 - DNA, 25 bp, Rattus norvegicus
tggcttctctcaatttatttgtggg

SEQ ID NO: 635719 - DNA, 25 bp, Rattus norvegicus
tggcttctctcacggcagaccagga

SEQ ID NO: 635720 - DNA, 25 bp, Rattus norvegicus
tggcttctctcagggcagaccagga

SEQ ID NO: 635721 - DNA, 25 bp, Rattus norvegicus
tggcttctctcatccctgtatgtgt

SEQ ID NO: 635722 - DNA, 25 bp, Rattus norvegicus
tggcttctctcattttatttgtggg

SEQ ID NO: 635723 - DNA, 25 bp, Rattus norvegicus
tggcttctcttcagcagtggtttaa

SEQ ID NO: 635724 - DNA, 25 bp, Rattus norvegicus
tggcttctcttctgcagtggtttaa

SEQ ID NO: 635725 - DNA, 25 bp, Rattus norvegicus
tggcttctgcataaattcacttcaa

SEQ ID NO: 635726 - DNA, 25 bp, Rattus norvegicus
tggcttctgcattaattcacttcaa

SEQ ID NO: 635727 - DNA, 25 bp, Rattus norvegicus
tggcttctgtccaagatctttgctc

SEQ ID NO: 635728 - DNA, 25 bp, Rattus norvegicus
tggcttctgtcctagatctttgctc

SEQ ID NO: 635729 - DNA, 25 bp, Rattus norvegicus
tggcttctgtgccaaatcctaagaa

SEQ ID NO: 635730 - DNA, 25 bp, Rattus norvegicus
tggcttctgtgcgaaatcctaagaa

SEQ ID NO: 635731 - DNA, 25 bp, Rattus norvegicus
tggcttctgtttccccttatcagaa

SEQ ID NO: 635732 - DNA, 25 bp, Rattus norvegicus
tggcttctgtttgcccttatcagaa

SEQ ID NO: 635733 - DNA, 25 bp, Rattus norvegicus
tggcttcttcaaacgtcagtacaaa

SEQ ID NO: 635734 - DNA, 25 bp, Rattus norvegicus
tggcttcttcaatcgtcagtacaaa

SEQ ID NO: 635735 - DNA, 25 bp, Rattus norvegicus
tggcttcttctgctcttggagagat

SEQ ID NO: 635736 - DNA, 25 bp, Rattus norvegicus
tggcttcttctggtcttggagagat

SEQ ID NO: 635737 - DNA, 25 bp, Rattus norvegicus
tggcttcttgaacgcactctgtaaa

SEQ ID NO: 635738 - DNA, 25 bp, Rattus norvegicus
tggcttcttgaaggcactctgtaaa

SEQ ID NO: 635739 - DNA, 25 bp, Rattus norvegicus
tggcttcttgagaaaggctgccctg

SEQ ID NO: 635740 - DNA, 25 bp, Rattus norvegicus
tggcttcttgagtaaggctgccctg

SEQ ID NO: 635741 - DNA, 25 bp, Rattus norvegicus
tggcttctttgcctatgtcagagga

SEQ ID NO: 635742 - DNA, 25 bp, Rattus norvegicus
tggcttctttgcgtatgtcagagga

SEQ ID NO: 635743 - DNA, 25 bp, Rattus norvegicus
tggcttctttttcctcattcctcat

SEQ ID NO: 635744 - DNA, 25 bp, Rattus norvegicus
tggcttctttttgctcattcctcat

SEQ ID NO: 635745 - DNA, 25 bp, Rattus norvegicus
tggcttgacagcatctcttagttag

SEQ ID NO: 635746 - DNA, 25 bp, Rattus norvegicus
tggcttgacagcttctcttagttag

SEQ ID NO: 635747 - DNA, 25 bp, Rattus norvegicus
tggcttgaccctcacctatggagct

SEQ ID NO: 635748 - DNA, 25 bp, Rattus norvegicus
tggcttgaccctgacctatggagct

SEQ ID NO: 635749 - DNA, 25 bp, Rattus norvegicus
tggcttgactgcctatactctacaa

SEQ ID NO: 635750 - DNA, 25 bp, Rattus norvegicus
tggcttgactgcgtatactctacaa

SEQ ID NO: 635751 - DNA, 25 bp, Rattus norvegicus
tggcttgagactatccgtgtccata

SEQ ID NO: 635752 - DNA, 25 bp, Rattus norvegicus
tggcttgagactttccgtgtccata

SEQ ID NO: 635753 - DNA, 25 bp, Rattus norvegicus
tggcttgcacctaggaatggttgcc

SEQ ID NO: 635754 - DNA, 25 bp, Rattus norvegicus
tggcttgcaccttggaatggttgcc

SEQ ID NO: 635755 - DNA, 25 bp, Rattus norvegicus
tggcttgcagccagtcacccagtga

SEQ ID NO: 635756 - DNA, 25 bp, Rattus norvegicus
tggcttgcagcctgtcacccagtga

SEQ ID NO: 635757 - DNA, 25 bp, Rattus norvegicus
tggcttgcatagatgtttcccactt

SEQ ID NO: 635758 - DNA, 25 bp, Rattus norvegicus
tggcttgcatagttgtttcccactt

SEQ ID NO: 635759 - DNA, 25 bp, Rattus norvegicus
tggcttgcatctcgcctccaaagaa

SEQ ID NO: 635760 - DNA, 25 bp, Rattus norvegicus
tggcttgcatctggcctccaaagaa

SEQ ID NO: 635761 - DNA, 25 bp, Rattus norvegicus
tggcttgcattcacatcagttcagg

SEQ ID NO: 635762 - DNA, 25 bp, Rattus norvegicus
tggcttgcattctcatcagttcagg

SEQ ID NO: 635763 - DNA, 25 bp, Rattus norvegicus
tggcttgcccttaatttcacctgag

SEQ ID NO: 635764 - DNA, 25 bp, Rattus norvegicus
tggcttgccctttatttcacctgag

SEQ ID NO: 635765 - DNA, 25 bp, Rattus norvegicus
tggcttgcgtagaaacccaactgta

SEQ ID NO: 635766 - DNA, 25 bp, Rattus norvegicus
tggcttgcgtagtaacccaactgta

SEQ ID NO: 635767 - DNA, 25 bp, Rattus norvegicus
tggcttgcgtctaagctcacagaga

SEQ ID NO: 635768 - DNA, 25 bp, Rattus norvegicus
tggcttgcgtcttagctcacagaga

SEQ ID NO: 635769 - DNA, 25 bp, Rattus norvegicus
tggcttgctaatccactggcctggg

SEQ ID NO: 635770 - DNA, 25 bp, Rattus norvegicus
tggcttgctaatgcactggcctggg

SEQ ID NO: 635771 - DNA, 25 bp, Rattus norvegicus
tggcttgctcaaatcgagtccattc

SEQ ID NO: 635772 - DNA, 25 bp, Rattus norvegicus
tggcttgctcaattcgagtccattc

SEQ ID NO: 635773 - DNA, 25 bp, Rattus norvegicus
tggcttgctctgaagctccctcaag

SEQ ID NO: 635774 - DNA, 25 bp, Rattus norvegicus
tggcttgctctgtagctccctcaag

SEQ ID NO: 635775 - DNA, 25 bp, Rattus norvegicus
tggcttgctgcacggctgtatgaca

SEQ ID NO: 635776 - DNA, 25 bp, Rattus norvegicus
tggcttgctgcagggctgtatgaca

SEQ ID NO: 635777 - DNA, 25 bp, Rattus norvegicus
tggcttggaacaagtgtccacactc

SEQ ID NO: 635778 - DNA, 25 bp, Rattus norvegicus
tggcttggaacatgtgtccacactc

SEQ ID NO: 635779 - DNA, 25 bp, Rattus norvegicus
tggcttggaggtctctaaccttttc

SEQ ID NO: 635780 - DNA, 25 bp, Rattus norvegicus
tggcttggaggtgtctaaccttttc

SEQ ID NO: 635781 - DNA, 25 bp, Rattus norvegicus
tggcttggcctcatttcataatgga

SEQ ID NO: 635782 - DNA, 25 bp, Rattus norvegicus
tggcttggcctcttttcataatgga

SEQ ID NO: 635783 - DNA, 25 bp, Rattus norvegicus
tggcttggcctgaagaccatcatgg

SEQ ID NO: 635784 - DNA, 25 bp, Rattus norvegicus
tggcttggcctgtagaccatcatgg

SEQ ID NO: 635785 - DNA, 25 bp, Rattus norvegicus
tggcttggctttcctgctgttggta

SEQ ID NO: 635786 - DNA, 25 bp, Rattus norvegicus
tggcttggctttgctgctgttggta

SEQ ID NO: 635787 - DNA, 25 bp, Rattus norvegicus
tggcttgggccaaggacactcagca

SEQ ID NO: 635788 - DNA, 25 bp, Rattus norvegicus
tggcttgggccatggacactcagca

SEQ ID NO: 635789 - DNA, 25 bp, Rattus norvegicus
tggcttgtcaataccaatttctttt

SEQ ID NO: 635790 - DNA, 25 bp, Rattus norvegicus
tggcttgtcaattccaatttctttt

SEQ ID NO: 635791 - DNA, 25 bp, Rattus norvegicus
tggcttgtccgcaatgtattcctca

SEQ ID NO: 635792 - DNA, 25 bp, Rattus norvegicus
tggcttgtccgctatgtattcctca

SEQ ID NO: 635793 - DNA, 25 bp, Rattus norvegicus
tggcttgtcttccatgggttctcac

SEQ ID NO: 635794 - DNA, 25 bp, Rattus norvegicus
tggcttgtcttcgatgggttctcac

SEQ ID NO: 635795 - DNA, 25 bp, Rattus norvegicus
tggcttgtgcagagctgctttgatt

SEQ ID NO: 635796 - DNA, 25 bp, Rattus norvegicus
tggcttgtgcagtgctgctttgatt

SEQ ID NO: 635797 - DNA, 25 bp, Rattus norvegicus
tggcttgtgcctatagtggaactct

SEQ ID NO: 635798 - DNA, 25 bp, Rattus norvegicus
tggcttgtgcctttagtggaactct

SEQ ID NO: 635799 - DNA, 25 bp, Rattus norvegicus
tggcttgtgctcactcagacatcct

SEQ ID NO: 635800 - DNA, 25 bp, Rattus norvegicus
tggcttgtgctctctcagacatcct

SEQ ID NO: 635801 - DNA, 25 bp, Rattus norvegicus
tggcttgtgctgctaaccgaggtat

SEQ ID NO: 635802 - DNA, 25 bp, Rattus norvegicus
tggcttgtgctggtaaccgaggtat

SEQ ID NO: 635803 - DNA, 25 bp, Rattus norvegicus
tggcttgtggctctccctctaactg

SEQ ID NO: 635804 - DNA, 25 bp, Rattus norvegicus
tggcttgtggctgtccctctaactg

SEQ ID NO: 635805 - DNA, 25 bp, Rattus norvegicus
tggcttgttatacctgaccaccaaa

SEQ ID NO: 635806 - DNA, 25 bp, Rattus norvegicus
tggcttgttatagctgaccaccaaa

SEQ ID NO: 635807 - DNA, 25 bp, Rattus norvegicus
tggcttgttgatatggagtctcctg

SEQ ID NO: 635808 - DNA, 25 bp, Rattus norvegicus
tggcttgttgatttggagtctcctg

SEQ ID NO: 635809 - DNA, 25 bp, Rattus norvegicus
tggcttgttttgactgctttctcat

SEQ ID NO: 635810 - DNA, 25 bp, Rattus norvegicus
tggcttgttttgtctgctttctcat

SEQ ID NO: 635811 - DNA, 25 bp, Rattus norvegicus
tggctttaaataaaccccacttgat

SEQ ID NO: 635812 - DNA, 25 bp, Rattus norvegicus
tggctttaaatataccccacttgat

SEQ ID NO: 635813 - DNA, 25 bp, Rattus norvegicus
tggctttaaattctctcttgctcct

SEQ ID NO: 635814 - DNA, 25 bp, Rattus norvegicus
tggctttaaattgtctcttgctcct

SEQ ID NO: 635815 - DNA, 25 bp, Rattus norvegicus
tggctttaatgcagcaaggcttgct

SEQ ID NO: 635816 - DNA, 25 bp, Rattus norvegicus
tggctttaatgctgcaaggcttgct

SEQ ID NO: 635817 - DNA, 25 bp, Rattus norvegicus
tggctttagctgagttaccaagaca

SEQ ID NO: 635818 - DNA, 25 bp, Rattus norvegicus
tggctttagctgtgttaccaagaca

SEQ ID NO: 635819 - DNA, 25 bp, Rattus norvegicus
tggctttatgtgagtctcggttgac

SEQ ID NO: 635820 - DNA, 25 bp, Rattus norvegicus
tggctttatgtgtgtctcggttgac

SEQ ID NO: 635821 - DNA, 25 bp, Rattus norvegicus
tggctttattggcactgcagctcta

SEQ ID NO: 635822 - DNA, 25 bp, Rattus norvegicus
tggctttattgggactgcagctcta

SEQ ID NO: 635823 - DNA, 25 bp, Rattus norvegicus
tggctttcaccaccaagcagagcct

SEQ ID NO: 635824 - DNA, 25 bp, Rattus norvegicus
tggctttcaccagcaagcagagcct

SEQ ID NO: 635825 - DNA, 25 bp, Rattus norvegicus
tggctttcactaaaaatgtccctcc

SEQ ID NO: 635826 - DNA, 25 bp, Rattus norvegicus
tggctttcactataaatgtccctcc

SEQ ID NO: 635827 - DNA, 25 bp, Rattus norvegicus
tggctttcacttagtttacttctgc

SEQ ID NO: 635828 - DNA, 25 bp, Rattus norvegicus
tggctttcactttgtttacttctgc

SEQ ID NO: 635829 - DNA, 25 bp, Rattus norvegicus
tggctttcattactcaggtccctga

SEQ ID NO: 635830 - DNA, 25 bp, Rattus norvegicus
tggctttcattagtcaggtccctga

SEQ ID NO: 635831 - DNA, 25 bp, Rattus norvegicus
tggctttccccaagtgtgctaaccg

SEQ ID NO: 635832 - DNA, 25 bp, Rattus norvegicus
tggctttccccactttggacataga

SEQ ID NO: 635833 - DNA, 25 bp, Rattus norvegicus
tggctttccccagtttggacataga

SEQ ID NO: 635834 - DNA, 25 bp, Rattus norvegicus
tggctttccccatgtgtgctaaccg

SEQ ID NO: 635835 - DNA, 25 bp, Rattus norvegicus
tggctttccctaataatccagcact

SEQ ID NO: 635836 - DNA, 25 bp, Rattus norvegicus
tggctttccctattaatccagcact

SEQ ID NO: 635837 - DNA, 25 bp, Rattus norvegicus
tggctttcctacattccactgagta

SEQ ID NO: 635838 - DNA, 25 bp, Rattus norvegicus
tggctttcctactttccactgagta

SEQ ID NO: 635839 - DNA, 25 bp, Rattus norvegicus
tggctttcctatagtcactgtatta

SEQ ID NO: 635840 - DNA, 25 bp, Rattus norvegicus
tggctttcctattgtcactgtatta

SEQ ID NO: 635841 - DNA, 25 bp, Rattus norvegicus
tggctttcctgcactgctgtctcaa

SEQ ID NO: 635842 - DNA, 25 bp, Rattus norvegicus
tggctttcctgcctggaatgagttt

SEQ ID NO: 635843 - DNA, 25 bp, Rattus norvegicus
tggctttcctgcgtggaatgagttt

SEQ ID NO: 635844 - DNA, 25 bp, Rattus norvegicus
tggctttcctgctctgctgtctcaa

SEQ ID NO: 635845 - DNA, 25 bp, Rattus norvegicus
tggctttcctttcgcctgtgaatgc

SEQ ID NO: 635846 - DNA, 25 bp, Rattus norvegicus
tggctttcctttggcctgtgaatgc

SEQ ID NO: 635847 - DNA, 25 bp, Rattus norvegicus
tggctttcgtggcatacacagctag

SEQ ID NO: 635848 - DNA, 25 bp, Rattus norvegicus
tggctttcgtgggatacacagctag

SEQ ID NO: 635849 - DNA, 25 bp, Rattus norvegicus
tggctttctaccagcatcgtatgca

SEQ ID NO: 635850 - DNA, 25 bp, Rattus norvegicus
tggctttctacctgcatcgtatgca

SEQ ID NO: 635851 - DNA, 25 bp, Rattus norvegicus
tggctttctcagagtcagggaatca

SEQ ID NO: 635852 - DNA, 25 bp, Rattus norvegicus
tggctttctcagtgtcagggaatca

SEQ ID NO: 635853 - DNA, 25 bp, Rattus norvegicus
tggctttctctgaggcctctgaaat

SEQ ID NO: 635854 - DNA, 25 bp, Rattus norvegicus
tggctttctctgtggcctctgaaat

SEQ ID NO: 635855 - DNA, 25 bp, Rattus norvegicus
tggctttctgtacctgaatgcaagt

SEQ ID NO: 635856 - DNA, 25 bp, Rattus norvegicus
tggctttctgtagctgaatgcaagt

SEQ ID NO: 635857 - DNA, 25 bp, Rattus norvegicus
tggctttcttctacatcccagaaga

SEQ ID NO: 635858 - DNA, 25 bp, Rattus norvegicus
tggctttcttcttcatcccagaaga

SEQ ID NO: 635859 - DNA, 25 bp, Rattus norvegicus
tggctttcttggctcgggttcagtc

SEQ ID NO: 635860 - DNA, 25 bp, Rattus norvegicus
tggctttcttgggtcgggttcagtc

SEQ ID NO: 635861 - DNA, 25 bp, Rattus norvegicus
tggctttcttgtcttctattcggaa

SEQ ID NO: 635862 - DNA, 25 bp, Rattus norvegicus
tggctttcttgtgttctattcggaa

SEQ ID NO: 635863 - DNA, 25 bp, Rattus norvegicus
tggctttctttacttccagcgtcaa

SEQ ID NO: 635864 - DNA, 25 bp, Rattus norvegicus
tggctttctttagttccagcgtcaa

SEQ ID NO: 635865 - DNA, 25 bp, Rattus norvegicus
tggctttctttgatcctagtttaag

SEQ ID NO: 635866 - DNA, 25 bp, Rattus norvegicus
tggctttctttgttcctagtttaag

SEQ ID NO: 635867 - DNA, 25 bp, Rattus norvegicus
tggctttgaccaataactccttgtc

SEQ ID NO: 635868 - DNA, 25 bp, Rattus norvegicus
tggctttgaccattaactccttgtc

SEQ ID NO: 635869 - DNA, 25 bp, Rattus norvegicus
tggctttgagcacatcaccccaatg

SEQ ID NO: 635870 - DNA, 25 bp, Rattus norvegicus
tggctttgagcagatcaccccaatg

SEQ ID NO: 635871 - DNA, 25 bp, Rattus norvegicus
tggctttgatagcatggccttccct

SEQ ID NO: 635872 - DNA, 25 bp, Rattus norvegicus
tggctttgataggatggccttccct

SEQ ID NO: 635873 - DNA, 25 bp, Rattus norvegicus
tggctttgatccatagcttgtctca

SEQ ID NO: 635874 - DNA, 25 bp, Rattus norvegicus
tggctttgatccttagcttgtctca

SEQ ID NO: 635875 - DNA, 25 bp, Rattus norvegicus
tggctttgcccaatttcttattaaa

SEQ ID NO: 635876 - DNA, 25 bp, Rattus norvegicus
tggctttgcccattttcttattaaa

SEQ ID NO: 635877 - DNA, 25 bp, Rattus norvegicus
tggctttgctgacacgcctctacct

SEQ ID NO: 635878 - DNA, 25 bp, Rattus norvegicus
tggctttgctgagacgcctctacct

SEQ ID NO: 635879 - DNA, 25 bp, Rattus norvegicus
tggctttgctgtaactaccttgctt

SEQ ID NO: 635880 - DNA, 25 bp, Rattus norvegicus
tggctttgctgttactaccttgctt

SEQ ID NO: 635881 - DNA, 25 bp, Rattus norvegicus
tggctttgctttcgtggacacaata

SEQ ID NO: 635882 - DNA, 25 bp, Rattus norvegicus
tggctttgctttctctccttgagat

SEQ ID NO: 635883 - DNA, 25 bp, Rattus norvegicus
tggctttgctttggtggacacaata

SEQ ID NO: 635884 - DNA, 25 bp, Rattus norvegicus
tggctttgctttgtctccttgagat

SEQ ID NO: 635885 - DNA, 25 bp, Rattus norvegicus
tggctttggaagccgtaggccactt

SEQ ID NO: 635886 - DNA, 25 bp, Rattus norvegicus
tggctttggaaggcgtaggccactt

SEQ ID NO: 635887 - DNA, 25 bp, Rattus norvegicus
tggctttggacaacgacagggacac

SEQ ID NO: 635888 - DNA, 25 bp, Rattus norvegicus
tggctttggacaatcattcatctat

SEQ ID NO: 635889 - DNA, 25 bp, Rattus norvegicus
tggctttggacatcgacagggacac

SEQ ID NO: 635890 - DNA, 25 bp, Rattus norvegicus
tggctttggacattcattcatctat

SEQ ID NO: 635891 - DNA, 25 bp, Rattus norvegicus
tggctttggacccttaaagagactt

SEQ ID NO: 635892 - DNA, 25 bp, Rattus norvegicus
tggctttggaccgttaaagagactt

SEQ ID NO: 635893 - DNA, 25 bp, Rattus norvegicus
tggctttggccacaggaccatattt

SEQ ID NO: 635894 - DNA, 25 bp, Rattus norvegicus
tggctttggccagaggaccatattt

SEQ ID NO: 635895 - DNA, 25 bp, Rattus norvegicus
tggctttgggtgctctacattctga

SEQ ID NO: 635896 - DNA, 25 bp, Rattus norvegicus
tggctttgggtggtctacattctga

SEQ ID NO: 635897 - DNA, 25 bp, Rattus norvegicus
tggctttggtaactaccctgttcta

SEQ ID NO: 635898 - DNA, 25 bp, Rattus norvegicus
tggctttggtaagtaccctgttcta

SEQ ID NO: 635899 - DNA, 25 bp, Rattus norvegicus
tggctttggtccaccctgttctcca

SEQ ID NO: 635900 - DNA, 25 bp, Rattus norvegicus
tggctttggtcctccctgttctcca

SEQ ID NO: 635901 - DNA, 25 bp, Rattus norvegicus
tggctttggttcatggttctttggc

SEQ ID NO: 635902 - DNA, 25 bp, Rattus norvegicus
tggctttggttcttggttctttggc

SEQ ID NO: 635903 - DNA, 25 bp, Rattus norvegicus
tggctttgtattccccatttaggag

SEQ ID NO: 635904 - DNA, 25 bp, Rattus norvegicus
tggctttgtattgcccatttaggag

SEQ ID NO: 635905 - DNA, 25 bp, Rattus norvegicus
tggctttgtccaaccacagagcagg

SEQ ID NO: 635906 - DNA, 25 bp, Rattus norvegicus
tggctttgtccatccacagagcagg

SEQ ID NO: 635907 - DNA, 25 bp, Rattus norvegicus
tggctttgtctcatgccgaagtagc

SEQ ID NO: 635908 - DNA, 25 bp, Rattus norvegicus
tggctttgtctcttgccgaagtagc

SEQ ID NO: 635909 - DNA, 25 bp, Rattus norvegicus
tggctttgttcccaaatcctttata

SEQ ID NO: 635910 - DNA, 25 bp, Rattus norvegicus
tggctttgttccgaaatcctttata

SEQ ID NO: 635911 - DNA, 25 bp, Rattus norvegicus
tggcttttaaacaggtcacccgtga

SEQ ID NO: 635912 - DNA, 25 bp, Rattus norvegicus
tggcttttaaactggtcacccgtga

SEQ ID NO: 635913 - DNA, 25 bp, Rattus norvegicus
tggcttttaggcactttgtgggttc

SEQ ID NO: 635914 - DNA, 25 bp, Rattus norvegicus
tggcttttaggctctttgtgggttc

SEQ ID NO: 635915 - DNA, 25 bp, Rattus norvegicus
tggcttttccaaatccagcacaaat

SEQ ID NO: 635916 - DNA, 25 bp, Rattus norvegicus
tggcttttccaattccagcacaaat

SEQ ID NO: 635917 - DNA, 25 bp, Rattus norvegicus
tggcttttcctaaccagcagtatgt

SEQ ID NO: 635918 - DNA, 25 bp, Rattus norvegicus
tggcttttcctatccagcagtatgt

SEQ ID NO: 635919 - DNA, 25 bp, Rattus norvegicus
tggcttttcctgattctcacgtgct

SEQ ID NO: 635920 - DNA, 25 bp, Rattus norvegicus
tggcttttcctgtttctcacgtgct

SEQ ID NO: 635921 - DNA, 25 bp, Rattus norvegicus
tggcttttcgggacacaggctgtga

SEQ ID NO: 635922 - DNA, 25 bp, Rattus norvegicus
tggcttttcgggtcacaggctgtga

SEQ ID NO: 635923 - DNA, 25 bp, Rattus norvegicus
tggcttttctctcaacagatctgaa

SEQ ID NO: 635924 - DNA, 25 bp, Rattus norvegicus
tggcttttctctgaacagatctgaa

SEQ ID NO: 635925 - DNA, 25 bp, Rattus norvegicus
tggcttttctggctttggacattcc

SEQ ID NO: 635926 - DNA, 25 bp, Rattus norvegicus
tggcttttctgggtttggacattcc

SEQ ID NO: 635927 - DNA, 25 bp, Rattus norvegicus
tggcttttcttacctcagatgactg

SEQ ID NO: 635928 - DNA, 25 bp, Rattus norvegicus
tggcttttcttagctcagatgactg

SEQ ID NO: 635929 - DNA, 25 bp, Rattus norvegicus
tggcttttgcagatcaggaaattga

SEQ ID NO: 635930 - DNA, 25 bp, Rattus norvegicus
tggcttttgcagttcaggaaattga

SEQ ID NO: 635931 - DNA, 25 bp, Rattus norvegicus
tggcttttgccaatgcgtttgtcat

SEQ ID NO: 635932 - DNA, 25 bp, Rattus norvegicus
tggcttttgccattgcgtttgtcat

SEQ ID NO: 635933 - DNA, 25 bp, Rattus norvegicus
tggcttttggaaaaatgccgtcccg

SEQ ID NO: 635934 - DNA, 25 bp, Rattus norvegicus
tggcttttggaataatgccgtcccg

SEQ ID NO: 635935 - DNA, 25 bp, Rattus norvegicus
tggcttttggtcatcctgagtagga

SEQ ID NO: 635936 - DNA, 25 bp, Rattus norvegicus
tggcttttggtcttcctgagtagga

SEQ ID NO: 635937 - DNA, 25 bp, Rattus norvegicus
tggcttttgttaccatttcttgttt

SEQ ID NO: 635938 - DNA, 25 bp, Rattus norvegicus
tggcttttgttagcatttcttgttt

SEQ ID NO: 635939 - DNA, 25 bp, Rattus norvegicus
tggctttttatactttccccaatct

SEQ ID NO: 635940 - DNA, 25 bp, Rattus norvegicus
tggctttttatagtttccccaatct

SEQ ID NO: 635941 - DNA, 25 bp, Rattus norvegicus
tggctttttatgaagaatcccgaac

SEQ ID NO: 635942 - DNA, 25 bp, Rattus norvegicus
tggctttttatgtagaatcccgaac

SEQ ID NO: 635943 - DNA, 25 bp, Rattus norvegicus
tggctttttcttctggcccatggct

SEQ ID NO: 635944 - DNA, 25 bp, Rattus norvegicus
tggctttttcttgtggcccatggct

SEQ ID NO: 635945 - DNA, 25 bp, Rattus norvegicus
tggctttttgctctgactctgtaac

SEQ ID NO: 635946 - DNA, 25 bp, Rattus norvegicus
tggctttttgctgtgactctgtaac

SEQ ID NO: 635947 - DNA, 25 bp, Rattus norvegicus
tggctttttggaaaacctgggtgct

SEQ ID NO: 635948 - DNA, 25 bp, Rattus norvegicus
tggctttttggataacctgggtgct

SEQ ID NO: 635949 - DNA, 25 bp, Rattus norvegicus
tggctttttggcctctcatgggaga

SEQ ID NO: 635950 - DNA, 25 bp, Rattus norvegicus
tggctttttggcgtctcatgggaga

SEQ ID NO: 635951 - DNA, 25 bp, Rattus norvegicus
tgggaaaacaccactgcctgggact

SEQ ID NO: 635952 - DNA, 25 bp, Rattus norvegicus
tgggaaaacacctctgcctgggact

SEQ ID NO: 635953 - DNA, 25 bp, Rattus norvegicus
tgggaaaactatcgctccttcccca

SEQ ID NO: 635954 - DNA, 25 bp, Rattus norvegicus
tgggaaaactatggctccttcccca

SEQ ID NO: 635955 - DNA, 25 bp, Rattus norvegicus
tgggaaaagctcaactgccatcctg

SEQ ID NO: 635956 - DNA, 25 bp, Rattus norvegicus
tgggaaaagctctactgccatcctg

SEQ ID NO: 635957 - DNA, 25 bp, Rattus norvegicus
tgggaaaatcccactgtcaactatg

SEQ ID NO: 635958 - DNA, 25 bp, Rattus norvegicus
tgggaaaatccctctgtcaactatg

SEQ ID NO: 635959 - DNA, 25 bp, Rattus norvegicus
tgggaaacacttcacctttatgggt

SEQ ID NO: 635960 - DNA, 25 bp, Rattus norvegicus
tgggaaacacttcggtgactccgcc

SEQ ID NO: 635961 - DNA, 25 bp, Rattus norvegicus
tgggaaacacttgacctttatgggt

SEQ ID NO: 635962 - DNA, 25 bp, Rattus norvegicus
tgggaaacacttgggtgactccgcc

SEQ ID NO: 635963 - DNA, 25 bp, Rattus norvegicus
tgggaaacagttccctgcctgggaa

SEQ ID NO: 635964 - DNA, 25 bp, Rattus norvegicus
tgggaaacagttgcctgcctgggaa

SEQ ID NO: 635965 - DNA, 25 bp, Rattus norvegicus
tgggaaaccaggcttccacctagaa

SEQ ID NO: 635966 - DNA, 25 bp, Rattus norvegicus
tgggaaaccagggttccacctagaa

SEQ ID NO: 635967 - DNA, 25 bp, Rattus norvegicus
tgggaaaccccactagaactctata

SEQ ID NO: 635968 - DNA, 25 bp, Rattus norvegicus
tgggaaaccccagtagaactctata

SEQ ID NO: 635969 - DNA, 25 bp, Rattus norvegicus
tgggaaacccgtcattttcctccat

SEQ ID NO: 635970 - DNA, 25 bp, Rattus norvegicus
tgggaaacccgtgattttcctccat

SEQ ID NO: 635971 - DNA, 25 bp, Rattus norvegicus
tgggaaacccttaccttgcaaagtg

SEQ ID NO: 635972 - DNA, 25 bp, Rattus norvegicus
tgggaaaccctttccttgcaaagtg

SEQ ID NO: 635973 - DNA, 25 bp, Rattus norvegicus
tgggaaaccgtgaggacacgcaccg

SEQ ID NO: 635974 - DNA, 25 bp, Rattus norvegicus
tgggaaaccgtgtggacacgcaccg

SEQ ID NO: 635975 - DNA, 25 bp, Rattus norvegicus
tgggaaacctgcactgaggtcaaga

SEQ ID NO: 635976 - DNA, 25 bp, Rattus norvegicus
tgggaaacctgctctgaggtcaaga

SEQ ID NO: 635977 - DNA, 25 bp, Rattus norvegicus
tgggaaacggtgcatcctactcaac

SEQ ID NO: 635978 - DNA, 25 bp, Rattus norvegicus
tgggaaacggtggatcctactcaac

SEQ ID NO: 635979 - DNA, 25 bp, Rattus norvegicus
tgggaaactatactcagaatgtaat

SEQ ID NO: 635980 - DNA, 25 bp, Rattus norvegicus
tgggaaactatagtcagaatgtaat

SEQ ID NO: 635981 - DNA, 25 bp, Rattus norvegicus
tgggaaactattactccagctccaa

SEQ ID NO: 635982 - DNA, 25 bp, Rattus norvegicus
tgggaaactatttctccagctccaa

SEQ ID NO: 635983 - DNA, 25 bp, Rattus norvegicus
tgggaaacttgtactccttttgaag

SEQ ID NO: 635984 - DNA, 25 bp, Rattus norvegicus
tgggaaacttgttctccttttgaag

SEQ ID NO: 635985 - DNA, 25 bp, Rattus norvegicus
tgggaaagccccagtgaattgagaa

SEQ ID NO: 635986 - DNA, 25 bp, Rattus norvegicus
tgggaaagcccctgtgaattgagaa

SEQ ID NO: 635987 - DNA, 25 bp, Rattus norvegicus
tgggaaagctgtcttagctgccacc

SEQ ID NO: 635988 - DNA, 25 bp, Rattus norvegicus
tgggaaagctgtgttagctgccacc

SEQ ID NO: 635989 - DNA, 25 bp, Rattus norvegicus
tgggaaaggagactacacccctgct

SEQ ID NO: 635990 - DNA, 25 bp, Rattus norvegicus
tgggaaaggagagtacacccctgct

SEQ ID NO: 635991 - DNA, 25 bp, Rattus norvegicus
tgggaaaggatccagccactcccca

SEQ ID NO: 635992 - DNA, 25 bp, Rattus norvegicus
tgggaaaggatcgagccactcccca

SEQ ID NO: 635993 - DNA, 25 bp, Rattus norvegicus
tgggaaaggcatctaccactgagct

SEQ ID NO: 635994 - DNA, 25 bp, Rattus norvegicus
tgggaaaggcatgtaccactgagct

SEQ ID NO: 635995 - DNA, 25 bp, Rattus norvegicus
tgggaaagggccactggtcaaccag

SEQ ID NO: 635996 - DNA, 25 bp, Rattus norvegicus
tgggaaagggcctctggtcaaccag

SEQ ID NO: 635997 - DNA, 25 bp, Rattus norvegicus
tgggaaaggtcaactctgctctcgc

SEQ ID NO: 635998 - DNA, 25 bp, Rattus norvegicus
tgggaaaggtcatctctgctctcgc

SEQ ID NO: 635999 - DNA, 25 bp, Rattus norvegicus
tgggaaagtcccagtatggcctgtt

SEQ ID NO: 636000 - DNA, 25 bp, Rattus norvegicus
tgggaaagtccctgtatggcctgtt

SEQ ID NO: 636001 - DNA, 25 bp, Rattus norvegicus
tgggaaagtctcacaatacagtctg

SEQ ID NO: 636002 - DNA, 25 bp, Rattus norvegicus
tgggaaagtctctcaatacagtctg

SEQ ID NO: 636003 - DNA, 25 bp, Rattus norvegicus
tgggaaatatcgctcttatctaccc

SEQ ID NO: 636004 - DNA, 25 bp, Rattus norvegicus
tgggaaatatcggtcttatctaccc

SEQ ID NO: 636005 - DNA, 25 bp, Rattus norvegicus
tgggaaatatttcctgtcttttatt

SEQ ID NO: 636006 - DNA, 25 bp, Rattus norvegicus
tgggaaatatttgctgtcttttatt

SEQ ID NO: 636007 - DNA, 25 bp, Rattus norvegicus
tgggaaatctacatcctgtcagttt

SEQ ID NO: 636008 - DNA, 25 bp, Rattus norvegicus
tgggaaatctacttcctgtcagttt

SEQ ID NO: 636009 - DNA, 25 bp, Rattus norvegicus
tgggaaatgtccccagggccctggg

SEQ ID NO: 636010 - DNA, 25 bp, Rattus norvegicus
tgggaaatgtccgcagggccctggg

SEQ ID NO: 636011 - DNA, 25 bp, Rattus norvegicus
tgggaaattataacacacggtagca

SEQ ID NO: 636012 - DNA, 25 bp, Rattus norvegicus
tgggaaattatatcacacggtagca

SEQ ID NO: 636013 - DNA, 25 bp, Rattus norvegicus
tgggaaattcccaagatgcaccacc

SEQ ID NO: 636014 - DNA, 25 bp, Rattus norvegicus
tgggaaattccctagatgcaccacc

SEQ ID NO: 636015 - DNA, 25 bp, Rattus norvegicus
tgggaaattcctcggcaccccagaa

SEQ ID NO: 636016 - DNA, 25 bp, Rattus norvegicus
tgggaaattcctgggcaccccagaa

SEQ ID NO: 636017 - DNA, 25 bp, Rattus norvegicus
tgggaaattctacccactaccgctg

SEQ ID NO: 636018 - DNA, 25 bp, Rattus norvegicus
tgggaaattctagccactaccgctg

SEQ ID NO: 636019 - DNA, 25 bp, Rattus norvegicus
tgggaacaaactagcagtcagctgc

SEQ ID NO: 636020 - DNA, 25 bp, Rattus norvegicus
tgggaacaaacttgcagtcagctgc

SEQ ID NO: 636021 - DNA, 25 bp, Rattus norvegicus
tgggaacaagagagtcgtgctgaca

SEQ ID NO: 636022 - DNA, 25 bp, Rattus norvegicus
tgggaacaagagtgtcgtgctgaca

SEQ ID NO: 636023 - DNA, 25 bp, Rattus norvegicus
tgggaacacacacgtcggttttctt

SEQ ID NO: 636024 - DNA, 25 bp, Rattus norvegicus
tgggaacacacaggtcggttttctt

SEQ ID NO: 636025 - DNA, 25 bp, Rattus norvegicus
tgggaacacagaaacctcgttgcac

SEQ ID NO: 636026 - DNA, 25 bp, Rattus norvegicus
tgggaacacagatacctcgttgcac

SEQ ID NO: 636027 - DNA, 25 bp, Rattus norvegicus
tgggaacagcttagcactgcacttc

SEQ ID NO: 636028 - DNA, 25 bp, Rattus norvegicus
tgggaacagctttgcactgcacttc

SEQ ID NO: 636029 - DNA, 25 bp, Rattus norvegicus
tgggaacagttacagccttcaccac

SEQ ID NO: 636030 - DNA, 25 bp, Rattus norvegicus
tgggaacagttagagccttcaccac

SEQ ID NO: 636031 - DNA, 25 bp, Rattus norvegicus
tgggaacatatccaggctgacaact

SEQ ID NO: 636032 - DNA, 25 bp, Rattus norvegicus
tgggaacatatcgaggctgacaact

SEQ ID NO: 636033 - DNA, 25 bp, Rattus norvegicus
tgggaacattgcagcagccaccggc

SEQ ID NO: 636034 - DNA, 25 bp, Rattus norvegicus
tgggaacattgctgcagccaccggc

SEQ ID NO: 636035 - DNA, 25 bp, Rattus norvegicus
tgggaaccagcacaccactgttgcc

SEQ ID NO: 636036 - DNA, 25 bp, Rattus norvegicus
tgggaaccagcagaccactgttgcc

SEQ ID NO: 636037 - DNA, 25 bp, Rattus norvegicus
tgggaaccagggattgcccttcgct

SEQ ID NO: 636038 - DNA, 25 bp, Rattus norvegicus
tgggaaccagggtttgcccttcgct

SEQ ID NO: 636039 - DNA, 25 bp, Rattus norvegicus
tgggaacccagaacgtctacaggcg

SEQ ID NO: 636040 - DNA, 25 bp, Rattus norvegicus
tgggaacccagatcgtctacaggcg

SEQ ID NO: 636041 - DNA, 25 bp, Rattus norvegicus
tgggaacccagtcctaactgctgag

SEQ ID NO: 636042 - DNA, 25 bp, Rattus norvegicus
tgggaacccagtgctaactgctgag

SEQ ID NO: 636043 - DNA, 25 bp, Rattus norvegicus
tgggaacccatgacacccagtatta

SEQ ID NO: 636044 - DNA, 25 bp, Rattus norvegicus
tgggaacccatgtcacccagtatta

SEQ ID NO: 636045 - DNA, 25 bp, Rattus norvegicus
tgggaaccccacacatgctagatgt

SEQ ID NO: 636046 - DNA, 25 bp, Rattus norvegicus
tgggaaccccactcatgctagatgt

SEQ ID NO: 636047 - DNA, 25 bp, Rattus norvegicus
tgggaaccctctcgcaagtggaagc

SEQ ID NO: 636048 - DNA, 25 bp, Rattus norvegicus
tgggaaccctctggcaagtggaagc

SEQ ID NO: 636049 - DNA, 25 bp, Rattus norvegicus
tgggaaccctgcatggacttgagag

SEQ ID NO: 636050 - DNA, 25 bp, Rattus norvegicus
tgggaaccctgcttggacttgagag

SEQ ID NO: 636051 - DNA, 25 bp, Rattus norvegicus
tgggaaccggcacagccgctgctgg

SEQ ID NO: 636052 - DNA, 25 bp, Rattus norvegicus
tgggaaccggcagagccgctgctgg

SEQ ID NO: 636053 - DNA, 25 bp, Rattus norvegicus
tgggaacctcagagccacagaagta

SEQ ID NO: 636054 - DNA, 25 bp, Rattus norvegicus
tgggaacctcagtgccacagaagta

SEQ ID NO: 636055 - DNA, 25 bp, Rattus norvegicus
tgggaacctgcaaaacatctccttg

SEQ ID NO: 636056 - DNA, 25 bp, Rattus norvegicus
tgggaacctgcataacatctccttg

SEQ ID NO: 636057 - DNA, 25 bp, Rattus norvegicus
tgggaacctgtgacagtgacccaca

SEQ ID NO: 636058 - DNA, 25 bp, Rattus norvegicus
tgggaacctgtgtcagtgacccaca

SEQ ID NO: 636059 - DNA, 25 bp, Rattus norvegicus
tgggaaccttcgcaaaacctctgag

SEQ ID NO: 636060 - DNA, 25 bp, Rattus norvegicus
tgggaaccttcggaaaacctctgag

SEQ ID NO: 636061 - DNA, 25 bp, Rattus norvegicus
tgggaacgcgctcagcatttagaga

SEQ ID NO: 636062 - DNA, 25 bp, Rattus norvegicus
tgggaacgcgctgagcatttagaga

SEQ ID NO: 636063 - DNA, 25 bp, Rattus norvegicus
tgggaacgtaccacagctggtagag

SEQ ID NO: 636064 - DNA, 25 bp, Rattus norvegicus
tgggaacgtacctcagctggtagag

SEQ ID NO: 636065 - DNA, 25 bp, Rattus norvegicus
tgggaacgtccgaacttcaacatta

SEQ ID NO: 636066 - DNA, 25 bp, Rattus norvegicus
tgggaacgtccgtacttcaacatta

SEQ ID NO: 636067 - DNA, 25 bp, Rattus norvegicus
tgggaacgttgcatctgcacttcat

SEQ ID NO: 636068 - DNA, 25 bp, Rattus norvegicus
tgggaacgttgcttctgcacttcat

SEQ ID NO: 636069 - DNA, 25 bp, Rattus norvegicus
tgggaactcaaaaacccacgtcagg

SEQ ID NO: 636070 - DNA, 25 bp, Rattus norvegicus
tgggaactcaaatacccacgtcagg

SEQ ID NO: 636071 - DNA, 25 bp, Rattus norvegicus
tgggaactcacaccctccttgagaa

SEQ ID NO: 636072 - DNA, 25 bp, Rattus norvegicus
tgggaactcacagcctccttgagaa

SEQ ID NO: 636073 - DNA, 25 bp, Rattus norvegicus
tgggaactccctcaatgccttttat

SEQ ID NO: 636074 - DNA, 25 bp, Rattus norvegicus
tgggaactccctctgcaggatctgg

SEQ ID NO: 636075 - DNA, 25 bp, Rattus norvegicus
tgggaactccctgaatgccttttat

SEQ ID NO: 636076 - DNA, 25 bp, Rattus norvegicus
tgggaactccctgtgcaggatctgg

SEQ ID NO: 636077 - DNA, 25 bp, Rattus norvegicus
tgggaactgaacacctgtatgagag

SEQ ID NO: 636078 - DNA, 25 bp, Rattus norvegicus
tgggaactgaactcctgtatgagag

SEQ ID NO: 636079 - DNA, 25 bp, Rattus norvegicus
tgggaactgaatccaccctctctgt

SEQ ID NO: 636080 - DNA, 25 bp, Rattus norvegicus
tgggaactgaatgcaccctctctgt

SEQ ID NO: 636081 - DNA, 25 bp, Rattus norvegicus
tgggaactgtcacaccagcatgtgc

SEQ ID NO: 636082 - DNA, 25 bp, Rattus norvegicus
tgggaactgtcagaccagcatgtgc

SEQ ID NO: 636083 - DNA, 25 bp, Rattus norvegicus
tgggaactgttcatgctataaatgc

SEQ ID NO: 636084 - DNA, 25 bp, Rattus norvegicus
tgggaactgttcttgctataaatgc

SEQ ID NO: 636085 - DNA, 25 bp, Rattus norvegicus
tgggaacttctcaatccacatggct

SEQ ID NO: 636086 - DNA, 25 bp, Rattus norvegicus
tgggaacttctctatccacatggct

SEQ ID NO: 636087 - DNA, 25 bp, Rattus norvegicus
tgggaagaagtacgcaacactcagt

SEQ ID NO: 636088 - DNA, 25 bp, Rattus norvegicus
tgggaagaagtaggcaacactcagt

SEQ ID NO: 636089 - DNA, 25 bp, Rattus norvegicus
tgggaagacagacaagtccagcttg

SEQ ID NO: 636090 - DNA, 25 bp, Rattus norvegicus
tgggaagacagagaagtccagcttg

SEQ ID NO: 636091 - DNA, 25 bp, Rattus norvegicus
tgggaagacagcacactagacagtg

SEQ ID NO: 636092 - DNA, 25 bp, Rattus norvegicus
tgggaagacagctcactagacagtg

SEQ ID NO: 636093 - DNA, 25 bp, Rattus norvegicus
tgggaagaccatcatactgaagaac

SEQ ID NO: 636094 - DNA, 25 bp, Rattus norvegicus
tgggaagaccatgatactgaagaac

SEQ ID NO: 636095 - DNA, 25 bp, Rattus norvegicus
tgggaagaccctccctaactgtggg

SEQ ID NO: 636096 - DNA, 25 bp, Rattus norvegicus
tgggaagaccctgcctaactgtggg

SEQ ID NO: 636097 - DNA, 25 bp, Rattus norvegicus
tgggaagaccgtacagaaggcatct

SEQ ID NO: 636098 - DNA, 25 bp, Rattus norvegicus
tgggaagaccgttcagaaggcatct

SEQ ID NO: 636099 - DNA, 25 bp, Rattus norvegicus
tgggaagactctctagcctctctgt

SEQ ID NO: 636100 - DNA, 25 bp, Rattus norvegicus
tgggaagactctgtagcctctctgt

SEQ ID NO: 636101 - DNA, 25 bp, Rattus norvegicus
tgggaagactttctcctgcatgtac

SEQ ID NO: 636102 - DNA, 25 bp, Rattus norvegicus
tgggaagactttgtcctgcatgtac

SEQ ID NO: 636103 - DNA, 25 bp, Rattus norvegicus
tgggaagagacgacccttcacctgt

SEQ ID NO: 636104 - DNA, 25 bp, Rattus norvegicus
tgggaagagacgtcccttcacctgt

SEQ ID NO: 636105 - DNA, 25 bp, Rattus norvegicus
tgggaagagccaagagccacctcag

SEQ ID NO: 636106 - DNA, 25 bp, Rattus norvegicus
tgggaagagccatgagccacctcag

SEQ ID NO: 636107 - DNA, 25 bp, Rattus norvegicus
tgggaagatcccagcagctgttccc

SEQ ID NO: 636108 - DNA, 25 bp, Rattus norvegicus
tgggaagatccctgcagctgttccc

SEQ ID NO: 636109 - DNA, 25 bp, Rattus norvegicus
tgggaagcagccacacttgcttagg

SEQ ID NO: 636110 - DNA, 25 bp, Rattus norvegicus
tgggaagcagcctcacttgcttagg

SEQ ID NO: 636111 - DNA, 25 bp, Rattus norvegicus
tgggaagcagctcttcgagaagatg

SEQ ID NO: 636112 - DNA, 25 bp, Rattus norvegicus
tgggaagcagctgttcgagaagatg

SEQ ID NO: 636113 - DNA, 25 bp, Rattus norvegicus
tgggaagcaggtaatctccctgacc

SEQ ID NO: 636114 - DNA, 25 bp, Rattus norvegicus
tgggaagcaggttatctccctgacc

SEQ ID NO: 636115 - DNA, 25 bp, Rattus norvegicus
tgggaagcatcgaaggtttcctgct

SEQ ID NO: 636116 - DNA, 25 bp, Rattus norvegicus
tgggaagcatcgtaggtttcctgct

SEQ ID NO: 636117 - DNA, 25 bp, Rattus norvegicus
tgggaagcattcagccacctggaac

SEQ ID NO: 636118 - DNA, 25 bp, Rattus norvegicus
tgggaagcattctgccacctggaac

SEQ ID NO: 636119 - DNA, 25 bp, Rattus norvegicus
tgggaagccactccgcatgtcggac

SEQ ID NO: 636120 - DNA, 25 bp, Rattus norvegicus
tgggaagccactgcgcatgtcggac

SEQ ID NO: 636121 - DNA, 25 bp, Rattus norvegicus
tgggaagccaggattcttgctctga

SEQ ID NO: 636122 - DNA, 25 bp, Rattus norvegicus
tgggaagccaggtttcttgctctga

SEQ ID NO: 636123 - DNA, 25 bp, Rattus norvegicus
tgggaagccccaatcatgcttttgc

SEQ ID NO: 636124 - DNA, 25 bp, Rattus norvegicus
tgggaagccccattcatgcttttgc

SEQ ID NO: 636125 - DNA, 25 bp, Rattus norvegicus
tgggaagccctcacagatgcagtgc

SEQ ID NO: 636126 - DNA, 25 bp, Rattus norvegicus
tgggaagccctctcagatgcagtgc

SEQ ID NO: 636127 - DNA, 25 bp, Rattus norvegicus
tgggaagccgcaagttcagtcagtg

SEQ ID NO: 636128 - DNA, 25 bp, Rattus norvegicus
tgggaagccgcatgttcagtcagtg

SEQ ID NO: 636129 - DNA, 25 bp, Rattus norvegicus
tgggaagccttcctaggttgatctg

SEQ ID NO: 636130 - DNA, 25 bp, Rattus norvegicus
tgggaagccttcgtaggttgatctg

SEQ ID NO: 636131 - DNA, 25 bp, Rattus norvegicus
tgggaagcctttaagttaactgtct

SEQ ID NO: 636132 - DNA, 25 bp, Rattus norvegicus
tgggaagccttttagttaactgtct

SEQ ID NO: 636133 - DNA, 25 bp, Rattus norvegicus
tgggaagcgttaaggagaagactct

SEQ ID NO: 636134 - DNA, 25 bp, Rattus norvegicus
tgggaagcgttatggagaagactct

SEQ ID NO: 636135 - DNA, 25 bp, Rattus norvegicus
tgggaagctgacatttggcttttcc

SEQ ID NO: 636136 - DNA, 25 bp, Rattus norvegicus
tgggaagctgacttttggcttttcc

SEQ ID NO: 636137 - DNA, 25 bp, Rattus norvegicus
tgggaagctggcacccacctttagt

SEQ ID NO: 636138 - DNA, 25 bp, Rattus norvegicus
tgggaagctggctcccacctttagt

SEQ ID NO: 636139 - DNA, 25 bp, Rattus norvegicus
tgggaagctgtacctcacttactaa

SEQ ID NO: 636140 - DNA, 25 bp, Rattus norvegicus
tgggaagctgtagctcacttactaa

SEQ ID NO: 636141 - DNA, 25 bp, Rattus norvegicus
tgggaagcttgaaccccactcaggg

SEQ ID NO: 636142 - DNA, 25 bp, Rattus norvegicus
tgggaagcttgatccccactcaggg

SEQ ID NO: 636143 - DNA, 25 bp, Rattus norvegicus
tgggaaggaaccacacgcagcttct

SEQ ID NO: 636144 - DNA, 25 bp, Rattus norvegicus
tgggaaggaacctcacgcagcttct

SEQ ID NO: 636145 - DNA, 25 bp, Rattus norvegicus
tgggaaggcagccatccttttgcct

SEQ ID NO: 636146 - DNA, 25 bp, Rattus norvegicus
tgggaaggcagcgatccttttgcct

SEQ ID NO: 636147 - DNA, 25 bp, Rattus norvegicus
tgggaaggccttcagtcaaaagtct

SEQ ID NO: 636148 - DNA, 25 bp, Rattus norvegicus
tgggaaggccttgagtcaaaagtct

SEQ ID NO: 636149 - DNA, 25 bp, Rattus norvegicus
tgggaaggctttaccttacttctag

SEQ ID NO: 636150 - DNA, 25 bp, Rattus norvegicus
tgggaaggcttttccttacttctag

SEQ ID NO: 636151 - DNA, 25 bp, Rattus norvegicus
tgggaagggaccacgctgtacctga

SEQ ID NO: 636152 - DNA, 25 bp, Rattus norvegicus
tgggaagggacctcgctgtacctga

SEQ ID NO: 636153 - DNA, 25 bp, Rattus norvegicus
tgggaagggctacctcagactctga

SEQ ID NO: 636154 - DNA, 25 bp, Rattus norvegicus
tgggaagggctagctcagactctga

SEQ ID NO: 636155 - DNA, 25 bp, Rattus norvegicus
tgggaagggtcccaacaccaaatgc

SEQ ID NO: 636156 - DNA, 25 bp, Rattus norvegicus
tgggaagggtccgaacaccaaatgc

SEQ ID NO: 636157 - DNA, 25 bp, Rattus norvegicus
tgggaaggtaggaccccaggcatca

SEQ ID NO: 636158 - DNA, 25 bp, Rattus norvegicus
tgggaaggtaggtccccaggcatca

SEQ ID NO: 636159 - DNA, 25 bp, Rattus norvegicus
tgggaaggtgcacagccctccagtt

SEQ ID NO: 636160 - DNA, 25 bp, Rattus norvegicus
tgggaaggtgcagagccctccagtt

SEQ ID NO: 636161 - DNA, 25 bp, Rattus norvegicus
tgggaagtagctacccagttccatt

SEQ ID NO: 636162 - DNA, 25 bp, Rattus norvegicus
tgggaagtagctaggaagcccctgc

SEQ ID NO: 636163 - DNA, 25 bp, Rattus norvegicus
tgggaagtagcttcccagttccatt

SEQ ID NO: 636164 - DNA, 25 bp, Rattus norvegicus
tgggaagtagcttggaagcccctgc

SEQ ID NO: 636165 - DNA, 25 bp, Rattus norvegicus
tgggaagtcacacccgaattccatg

SEQ ID NO: 636166 - DNA, 25 bp, Rattus norvegicus
tgggaagtcacagccgaattccatg

SEQ ID NO: 636167 - DNA, 25 bp, Rattus norvegicus
tgggaagtcctacccagtctccaga

SEQ ID NO: 636168 - DNA, 25 bp, Rattus norvegicus
tgggaagtcctagccagtctccaga

SEQ ID NO: 636169 - DNA, 25 bp, Rattus norvegicus
tgggaagtgggaccctgacccaacc

SEQ ID NO: 636170 - DNA, 25 bp, Rattus norvegicus
tgggaagtgggagcctgacccaacc

SEQ ID NO: 636171 - DNA, 25 bp, Rattus norvegicus
tgggaagtgttccagttgctcctga

SEQ ID NO: 636172 - DNA, 25 bp, Rattus norvegicus
tgggaagtgttcgagttgctcctga

SEQ ID NO: 636173 - DNA, 25 bp, Rattus norvegicus
tgggaatacactcttgtcttggcct

SEQ ID NO: 636174 - DNA, 25 bp, Rattus norvegicus
tgggaatacactgttgtcttggcct

SEQ ID NO: 636175 - DNA, 25 bp, Rattus norvegicus
tgggaatatccgaccaccaggcagc

SEQ ID NO: 636176 - DNA, 25 bp, Rattus norvegicus
tgggaatatccgtccaccaggcagc

SEQ ID NO: 636177 - DNA, 25 bp, Rattus norvegicus
tgggaatcacatctcacacagcgcc

SEQ ID NO: 636178 - DNA, 25 bp, Rattus norvegicus
tgggaatcacatgtcacacagcgcc

SEQ ID NO: 636179 - DNA, 25 bp, Rattus norvegicus
tgggaatcagacatttcctgccctg

SEQ ID NO: 636180 - DNA, 25 bp, Rattus norvegicus
tgggaatcagacttttcctgccctg

SEQ ID NO: 636181 - DNA, 25 bp, Rattus norvegicus
tgggaatcattcctcacatcacaga

SEQ ID NO: 636182 - DNA, 25 bp, Rattus norvegicus
tgggaatcattcgtcacatcacaga

SEQ ID NO: 636183 - DNA, 25 bp, Rattus norvegicus
tgggaatcccggctcttatgtttac

SEQ ID NO: 636184 - DNA, 25 bp, Rattus norvegicus
tgggaatcccgggtcttatgtttac

SEQ ID NO: 636185 - DNA, 25 bp, Rattus norvegicus
tgggaatccctaccggtccaagttc

SEQ ID NO: 636186 - DNA, 25 bp, Rattus norvegicus
tgggaatccctagcggtccaagttc

SEQ ID NO: 636187 - DNA, 25 bp, Rattus norvegicus
tgggaatccctgagcaccgggtatg

SEQ ID NO: 636188 - DNA, 25 bp, Rattus norvegicus
tgggaatccctgtgcaccgggtatg

SEQ ID NO: 636189 - DNA, 25 bp, Rattus norvegicus
tgggaatcctaaagcccctcatgaa

SEQ ID NO: 636190 - DNA, 25 bp, Rattus norvegicus
tgggaatcctaatgcccctcatgaa

SEQ ID NO: 636191 - DNA, 25 bp, Rattus norvegicus
tgggaatcctgcagtttagcacagg

SEQ ID NO: 636192 - DNA, 25 bp, Rattus norvegicus
tgggaatcctgctgtttagcacagg

SEQ ID NO: 636193 - DNA, 25 bp, Rattus norvegicus
tgggaatcgaccatgctatagatgc

SEQ ID NO: 636194 - DNA, 25 bp, Rattus norvegicus
tgggaatcgaccttgctatagatgc

SEQ ID NO: 636195 - DNA, 25 bp, Rattus norvegicus
tgggaatctaacctggatcctccat

SEQ ID NO: 636196 - DNA, 25 bp, Rattus norvegicus
tgggaatctaacgtggatcctccat

SEQ ID NO: 636197 - DNA, 25 bp, Rattus norvegicus
tgggaatctgagaacctgcatgctg

SEQ ID NO: 636198 - DNA, 25 bp, Rattus norvegicus
tgggaatctgagtacctgcatgctg

SEQ ID NO: 636199 - DNA, 25 bp, Rattus norvegicus
tgggaatggcccagcagcactcctc

SEQ ID NO: 636200 - DNA, 25 bp, Rattus norvegicus
tgggaatggccctgcagcactcctc

SEQ ID NO: 636201 - DNA, 25 bp, Rattus norvegicus
tgggaatgggatcccagtctcctgc

SEQ ID NO: 636202 - DNA, 25 bp, Rattus norvegicus
tgggaatgggatgccagtctcctgc

SEQ ID NO: 636203 - DNA, 25 bp, Rattus norvegicus
tgggaatgtctgcttcaattagaag

SEQ ID NO: 636204 - DNA, 25 bp, Rattus norvegicus
tgggaatgtctggttcaattagaag

SEQ ID NO: 636205 - DNA, 25 bp, Rattus norvegicus
tgggaatgtggcacagttctcaaaa

SEQ ID NO: 636206 - DNA, 25 bp, Rattus norvegicus
tgggaatgtggctcagttctcaaaa

SEQ ID NO: 636207 - DNA, 25 bp, Rattus norvegicus
tgggaatgtgtgccggaatatcagc

SEQ ID NO: 636208 - DNA, 25 bp, Rattus norvegicus
tgggaatgtgtggcggaatatcagc

SEQ ID NO: 636209 - DNA, 25 bp, Rattus norvegicus
tgggaatgtttcactgctacctgca

SEQ ID NO: 636210 - DNA, 25 bp, Rattus norvegicus
tgggaatgtttctctgctacctgca

SEQ ID NO: 636211 - DNA, 25 bp, Rattus norvegicus
tgggaattacaaatgaccatccatt

SEQ ID NO: 636212 - DNA, 25 bp, Rattus norvegicus
tgggaattacaattgaccatccatt

SEQ ID NO: 636213 - DNA, 25 bp, Rattus norvegicus
tgggaattatcacccactctaagat

SEQ ID NO: 636214 - DNA, 25 bp, Rattus norvegicus
tgggaattatcagccactctaagat

SEQ ID NO: 636215 - DNA, 25 bp, Rattus norvegicus
tgggaattcagcacttggatggact

SEQ ID NO: 636216 - DNA, 25 bp, Rattus norvegicus
tgggaattcagctcttggatggact

SEQ ID NO: 636217 - DNA, 25 bp, Rattus norvegicus
tgggaattccccatctccccagttt

SEQ ID NO: 636218 - DNA, 25 bp, Rattus norvegicus
tgggaattccccttctccccagttt

SEQ ID NO: 636219 - DNA, 25 bp, Rattus norvegicus
tgggaattctaaacctcccagttag

SEQ ID NO: 636220 - DNA, 25 bp, Rattus norvegicus
tgggaattctaatcctcccagttag

SEQ ID NO: 636221 - DNA, 25 bp, Rattus norvegicus
tgggaattctgcctgggtaccattg

SEQ ID NO: 636222 - DNA, 25 bp, Rattus norvegicus
tgggaattctgcgtgggtaccattg

SEQ ID NO: 636223 - DNA, 25 bp, Rattus norvegicus
tgggaattctgtaacataaagcgga

SEQ ID NO: 636224 - DNA, 25 bp, Rattus norvegicus
tgggaattctgttacataaagcgga

SEQ ID NO: 636225 - DNA, 25 bp, Rattus norvegicus
tgggaattgaacctgagttgacaat

SEQ ID NO: 636226 - DNA, 25 bp, Rattus norvegicus
tgggaattgaacgtgagttgacaat

SEQ ID NO: 636227 - DNA, 25 bp, Rattus norvegicus
tgggaattgggcatatgttgactct

SEQ ID NO: 636228 - DNA, 25 bp, Rattus norvegicus
tgggaattgggcttatgttgactct

SEQ ID NO: 636229 - DNA, 25 bp, Rattus norvegicus
tgggaatttaggagactcctccact

SEQ ID NO: 636230 - DNA, 25 bp, Rattus norvegicus
tgggaatttaggtgactcctccact

SEQ ID NO: 636231 - DNA, 25 bp, Rattus norvegicus
tgggacaaacctagcctaaagcccg

SEQ ID NO: 636232 - DNA, 25 bp, Rattus norvegicus
tgggacaaaccttgcctaaagcccg

SEQ ID NO: 636233 - DNA, 25 bp, Rattus norvegicus
tgggacaaacttaggccaccagttt

SEQ ID NO: 636234 - DNA, 25 bp, Rattus norvegicus
tgggacaaactttggccaccagttt

SEQ ID NO: 636235 - DNA, 25 bp, Rattus norvegicus
tgggacaaatacagtggccacccct

SEQ ID NO: 636236 - DNA, 25 bp, Rattus norvegicus
tgggacaaatactgtggccacccct

SEQ ID NO: 636237 - DNA, 25 bp, Rattus norvegicus
tgggacaaattgatactgccactgt

SEQ ID NO: 636238 - DNA, 25 bp, Rattus norvegicus
tgggacaaattgttactgccactgt

SEQ ID NO: 636239 - DNA, 25 bp, Rattus norvegicus
tgggacaacaacagctctgttccgc

SEQ ID NO: 636240 - DNA, 25 bp, Rattus norvegicus
tgggacaacaactgctctgttccgc

SEQ ID NO: 636241 - DNA, 25 bp, Rattus norvegicus
tgggacaactgacctgttcatctgt

SEQ ID NO: 636242 - DNA, 25 bp, Rattus norvegicus
tgggacaactgagctgttcatctgt

SEQ ID NO: 636243 - DNA, 25 bp, Rattus norvegicus
tgggacaagcatactacagttacct

SEQ ID NO: 636244 - DNA, 25 bp, Rattus norvegicus
tgggacaagcattctacagttacct

SEQ ID NO: 636245 - DNA, 25 bp, Rattus norvegicus
tgggacaataagcaccgcgggaaat

SEQ ID NO: 636246 - DNA, 25 bp, Rattus norvegicus
tgggacaataaggaccgcgggaaat

SEQ ID NO: 636247 - DNA, 25 bp, Rattus norvegicus
tgggacacacagaggctgacatgcc

SEQ ID NO: 636248 - DNA, 25 bp, Rattus norvegicus
tgggacacacagtggctgacatgcc

SEQ ID NO: 636249 - DNA, 25 bp, Rattus norvegicus
tgggacacagccacgtagatttgac

SEQ ID NO: 636250 - DNA, 25 bp, Rattus norvegicus
tgggacacagcctcgtagatttgac

SEQ ID NO: 636251 - DNA, 25 bp, Rattus norvegicus
tgggacacatctccaagacacctct

SEQ ID NO: 636252 - DNA, 25 bp, Rattus norvegicus
tgggacacatctgcaagacacctct

SEQ ID NO: 636253 - DNA, 25 bp, Rattus norvegicus
tgggacaccagcctacattgtttag

SEQ ID NO: 636254 - DNA, 25 bp, Rattus norvegicus
tgggacaccagcgtacattgtttag

SEQ ID NO: 636255 - DNA, 25 bp, Rattus norvegicus
tgggacaccatcaagttttttccct

SEQ ID NO: 636256 - DNA, 25 bp, Rattus norvegicus
tgggacaccatctagttttttccct

SEQ ID NO: 636257 - DNA, 25 bp, Rattus norvegicus
tgggacactagcaacttggaacact

SEQ ID NO: 636258 - DNA, 25 bp, Rattus norvegicus
tgggacactagctacttggaacact

SEQ ID NO: 636259 - DNA, 25 bp, Rattus norvegicus
tgggacactcaaaggacactctgat

SEQ ID NO: 636260 - DNA, 25 bp, Rattus norvegicus
tgggacactcaatggacactctgat

SEQ ID NO: 636261 - DNA, 25 bp, Rattus norvegicus
tgggacactcgtcagcaaagtcggc

SEQ ID NO: 636262 - DNA, 25 bp, Rattus norvegicus
tgggacactcgtgagcaaagtcggc

SEQ ID NO: 636263 - DNA, 25 bp, Rattus norvegicus
tgggacactgttctccacgaactca

SEQ ID NO: 636264 - DNA, 25 bp, Rattus norvegicus
tgggacactgttgtccacgaactca

SEQ ID NO: 636265 - DNA, 25 bp, Rattus norvegicus
tgggacagaagaccactcttacctc

SEQ ID NO: 636266 - DNA, 25 bp, Rattus norvegicus
tgggacagaagagcactcttacctc

SEQ ID NO: 636267 - DNA, 25 bp, Rattus norvegicus
tgggacagacacctcaacttggtct

SEQ ID NO: 636268 - DNA, 25 bp, Rattus norvegicus
tgggacagacacgtcaacttggtct

SEQ ID NO: 636269 - DNA, 25 bp, Rattus norvegicus
tgggacagactaagagacaggcttc

SEQ ID NO: 636270 - DNA, 25 bp, Rattus norvegicus
tgggacagactatgagacaggcttc

SEQ ID NO: 636271 - DNA, 25 bp, Rattus norvegicus
tgggacagatggagcctccccttcc

SEQ ID NO: 636272 - DNA, 25 bp, Rattus norvegicus
tgggacagatggtgcctccccttcc

SEQ ID NO: 636273 - DNA, 25 bp, Rattus norvegicus
tgggacagcaaaccctttccttggt

SEQ ID NO: 636274 - DNA, 25 bp, Rattus norvegicus
tgggacagcaaagcctttccttggt

SEQ ID NO: 636275 - DNA, 25 bp, Rattus norvegicus
tgggacagcctcagcacctgatcaa

SEQ ID NO: 636276 - DNA, 25 bp, Rattus norvegicus
tgggacagcctcagccaggaggcat

SEQ ID NO: 636277 - DNA, 25 bp, Rattus norvegicus
tgggacagcctctgcacctgatcaa

SEQ ID NO: 636278 - DNA, 25 bp, Rattus norvegicus
tgggacagcctctgccaggaggcat

SEQ ID NO: 636279 - DNA, 25 bp, Rattus norvegicus
tgggacaggcctcctgacagaagct

SEQ ID NO: 636280 - DNA, 25 bp, Rattus norvegicus
tgggacaggcctgctgacagaagct

SEQ ID NO: 636281 - DNA, 25 bp, Rattus norvegicus
tgggacagtggcatcagctcccggc

SEQ ID NO: 636282 - DNA, 25 bp, Rattus norvegicus
tgggacagtggcttcagctcccggc

SEQ ID NO: 636283 - DNA, 25 bp, Rattus norvegicus
tgggacagttcaacacagcctcagg

SEQ ID NO: 636284 - DNA, 25 bp, Rattus norvegicus
tgggacagttcacagtgcttgccgt

SEQ ID NO: 636285 - DNA, 25 bp, Rattus norvegicus
tgggacagttcagagtgcttgccgt

SEQ ID NO: 636286 - DNA, 25 bp, Rattus norvegicus
tgggacagttcatcacagcctcagg

SEQ ID NO: 636287 - DNA, 25 bp, Rattus norvegicus
tgggacagttggcttctctgactcc

SEQ ID NO: 636288 - DNA, 25 bp, Rattus norvegicus
tgggacagttgggttctctgactcc

SEQ ID NO: 636289 - DNA, 25 bp, Rattus norvegicus
tgggacagttgtcggttcagtcctt

SEQ ID NO: 636290 - DNA, 25 bp, Rattus norvegicus
tgggacagttgtgggttcagtcctt

SEQ ID NO: 636291 - DNA, 25 bp, Rattus norvegicus
tgggacatccttctgatttgtactt

SEQ ID NO: 636292 - DNA, 25 bp, Rattus norvegicus
tgggacatccttgtgatttgtactt

SEQ ID NO: 636293 - DNA, 25 bp, Rattus norvegicus
tgggacatcttcagcccctcacgag

SEQ ID NO: 636294 - DNA, 25 bp, Rattus norvegicus
tgggacatcttctgcccctcacgag

SEQ ID NO: 636295 - DNA, 25 bp, Rattus norvegicus
tgggacatgcccagttggctgccat

SEQ ID NO: 636296 - DNA, 25 bp, Rattus norvegicus
tgggacatgccctgttggctgccat

SEQ ID NO: 636297 - DNA, 25 bp, Rattus norvegicus
tgggacattcttcagctagcttgca

SEQ ID NO: 636298 - DNA, 25 bp, Rattus norvegicus
tgggacattcttgagctagcttgca

SEQ ID NO: 636299 - DNA, 25 bp, Rattus norvegicus
tgggacattgtcaccatctttcggt

SEQ ID NO: 636300 - DNA, 25 bp, Rattus norvegicus
tgggacattgtctccatctttcggt

SEQ ID NO: 636301 - DNA, 25 bp, Rattus norvegicus
tgggacatttggctgacatcaggta

SEQ ID NO: 636302 - DNA, 25 bp, Rattus norvegicus
tgggacatttgggtgacatcaggta

SEQ ID NO: 636303 - DNA, 25 bp, Rattus norvegicus
tgggacatttgtcttcagtcttctg

SEQ ID NO: 636304 - DNA, 25 bp, Rattus norvegicus
tgggacatttgtgttcagtcttctg

SEQ ID NO: 636305 - DNA, 25 bp, Rattus norvegicus
tgggaccaacagagatggcctctaa

SEQ ID NO: 636306 - DNA, 25 bp, Rattus norvegicus
tgggaccaacagtgatggcctctaa

SEQ ID NO: 636307 - DNA, 25 bp, Rattus norvegicus
tgggaccaaccacatgaacgcaatg

SEQ ID NO: 636308 - DNA, 25 bp, Rattus norvegicus
tgggaccaaccagatgaacgcaatg

SEQ ID NO: 636309 - DNA, 25 bp, Rattus norvegicus
tgggaccaaggcacacaactcttaa

SEQ ID NO: 636310 - DNA, 25 bp, Rattus norvegicus
tgggaccaaggctcacaactcttaa

SEQ ID NO: 636311 - DNA, 25 bp, Rattus norvegicus
tgggaccacaaaataggacctttct

SEQ ID NO: 636312 - DNA, 25 bp, Rattus norvegicus
tgggaccacaaattaggacctttct

SEQ ID NO: 636313 - DNA, 25 bp, Rattus norvegicus
tgggaccacacactgcatgcagggt

SEQ ID NO: 636314 - DNA, 25 bp, Rattus norvegicus
tgggaccacacagtgcatgcagggt

SEQ ID NO: 636315 - DNA, 25 bp, Rattus norvegicus
tgggaccacaggctgcatgtcgaat

SEQ ID NO: 636316 - DNA, 25 bp, Rattus norvegicus
tgggaccacagggtgcatgtcgaat

SEQ ID NO: 636317 - DNA, 25 bp, Rattus norvegicus
tgggaccagccacatcagttcatgc

SEQ ID NO: 636318 - DNA, 25 bp, Rattus norvegicus
tgggaccagccagatcagttcatgc

SEQ ID NO: 636319 - DNA, 25 bp, Rattus norvegicus
tgggaccagcctaccgtggactgaa

SEQ ID NO: 636320 - DNA, 25 bp, Rattus norvegicus
tgggaccagccttccgtggactgaa

SEQ ID NO: 636321 - DNA, 25 bp, Rattus norvegicus
tgggaccattgcctgcttcatgaca

SEQ ID NO: 636322 - DNA, 25 bp, Rattus norvegicus
tgggaccattgcgtgcttcatgaca

SEQ ID NO: 636323 - DNA, 25 bp, Rattus norvegicus
tgggacccaaataacaggacacaga

SEQ ID NO: 636324 - DNA, 25 bp, Rattus norvegicus
tgggacccaaattacaggacacaga

SEQ ID NO: 636325 - DNA, 25 bp, Rattus norvegicus
tgggacccactccaggagaatcaga

SEQ ID NO: 636326 - DNA, 25 bp, Rattus norvegicus
tgggacccactcgaggagaatcaga

SEQ ID NO: 636327 - DNA, 25 bp, Rattus norvegicus
tgggacccactgaattacctgcagc

SEQ ID NO: 636328 - DNA, 25 bp, Rattus norvegicus
tgggacccactgtattacctgcagc

SEQ ID NO: 636329 - DNA, 25 bp, Rattus norvegicus
tgggacccagaaacctatttctttc

SEQ ID NO: 636330 - DNA, 25 bp, Rattus norvegicus
tgggacccagaatcctatttctttc

SEQ ID NO: 636331 - DNA, 25 bp, Rattus norvegicus
tgggacccagagacacagtgagcct

SEQ ID NO: 636332 - DNA, 25 bp, Rattus norvegicus
tgggacccagagtcacagtgagcct

SEQ ID NO: 636333 - DNA, 25 bp, Rattus norvegicus
tgggacccaggtcttctcagctcta

SEQ ID NO: 636334 - DNA, 25 bp, Rattus norvegicus
tgggacccaggtgttctcagctcta

SEQ ID NO: 636335 - DNA, 25 bp, Rattus norvegicus
tgggacccctacattagaattctct

SEQ ID NO: 636336 - DNA, 25 bp, Rattus norvegicus
tgggacccctactttagaattctct

SEQ ID NO: 636337 - DNA, 25 bp, Rattus norvegicus
tgggacccgatgaatgtgttctgtt

SEQ ID NO: 636338 - DNA, 25 bp, Rattus norvegicus
tgggacccgatgtatgtgttctgtt

SEQ ID NO: 636339 - DNA, 25 bp, Rattus norvegicus
tgggacccgtgcatgtcaaacagga

SEQ ID NO: 636340 - DNA, 25 bp, Rattus norvegicus
tgggacccgtgcttgtcaaacagga

SEQ ID NO: 636341 - DNA, 25 bp, Rattus norvegicus
tgggacccgttccatttccagctgg

SEQ ID NO: 636342 - DNA, 25 bp, Rattus norvegicus
tgggacccgttcgatttccagctgg

SEQ ID NO: 636343 - DNA, 25 bp, Rattus norvegicus
tgggaccctccaagtagcttaagct

SEQ ID NO: 636344 - DNA, 25 bp, Rattus norvegicus
tgggaccctccatgtagcttaagct

SEQ ID NO: 636345 - DNA, 25 bp, Rattus norvegicus
tgggaccctgaaacatgatgcaact

SEQ ID NO: 636346 - DNA, 25 bp, Rattus norvegicus
tgggaccctgaatcatgatgcaact

SEQ ID NO: 636347 - DNA, 25 bp, Rattus norvegicus
tgggaccctgagctgtactgagaac

SEQ ID NO: 636348 - DNA, 25 bp, Rattus norvegicus
tgggaccctgaggtgtactgagaac

SEQ ID NO: 636349 - DNA, 25 bp, Rattus norvegicus
tgggacccttgccttagatgtgact

SEQ ID NO: 636350 - DNA, 25 bp, Rattus norvegicus
tgggacccttgcgttagatgtgact

SEQ ID NO: 636351 - DNA, 25 bp, Rattus norvegicus
tgggaccgacaaccgtgcatgttaa

SEQ ID NO: 636352 - DNA, 25 bp, Rattus norvegicus
tgggaccgacaagcgtgcatgttaa

SEQ ID NO: 636353 - DNA, 25 bp, Rattus norvegicus
tgggaccgacttagttctttgttat

SEQ ID NO: 636354 - DNA, 25 bp, Rattus norvegicus
tgggaccgactttgttctttgttat

SEQ ID NO: 636355 - DNA, 25 bp, Rattus norvegicus
tgggaccgattaacagggccgcccg

SEQ ID NO: 636356 - DNA, 25 bp, Rattus norvegicus
tgggaccgattatcagggccgcccg

SEQ ID NO: 636357 - DNA, 25 bp, Rattus norvegicus
tgggaccggatgcagcccctgtcat

SEQ ID NO: 636358 - DNA, 25 bp, Rattus norvegicus
tgggaccggatggagcccctgtcat

SEQ ID NO: 636359 - DNA, 25 bp, Rattus norvegicus
tgggaccgtgaacctcttcgggctt

SEQ ID NO: 636360 - DNA, 25 bp, Rattus norvegicus
tgggaccgtgaagctcttcgggctt

SEQ ID NO: 636361 - DNA, 25 bp, Rattus norvegicus
tgggaccgtggtctagctttcctag

SEQ ID NO: 636362 - DNA, 25 bp, Rattus norvegicus
tgggaccgtggtgtagctttcctag

SEQ ID NO: 636363 - DNA, 25 bp, Rattus norvegicus
tgggacctagccagcatcccggagc

SEQ ID NO: 636364 - DNA, 25 bp, Rattus norvegicus
tgggacctagcctgcatcccggagc

SEQ ID NO: 636365 - DNA, 25 bp, Rattus norvegicus
tgggacctagttctgcctattgtga

SEQ ID NO: 636366 - DNA, 25 bp, Rattus norvegicus
tgggacctagttgtgcctattgtga

SEQ ID NO: 636367 - DNA, 25 bp, Rattus norvegicus
tgggacctattacttcccctgggag

SEQ ID NO: 636368 - DNA, 25 bp, Rattus norvegicus
tgggacctattagttcccctgggag

SEQ ID NO: 636369 - DNA, 25 bp, Rattus norvegicus
tgggacctccagatgtcagacctgc

SEQ ID NO: 636370 - DNA, 25 bp, Rattus norvegicus
tgggacctccagttgtcagacctgc

SEQ ID NO: 636371 - DNA, 25 bp, Rattus norvegicus
tgggacctccggaagaacagtgcat

SEQ ID NO: 636372 - DNA, 25 bp, Rattus norvegicus
tgggacctccggtagaacagtgcat

SEQ ID NO: 636373 - DNA, 25 bp, Rattus norvegicus
tgggacctcctgctcatggacagag

SEQ ID NO: 636374 - DNA, 25 bp, Rattus norvegicus
tgggacctcctggtcatggacagag

SEQ ID NO: 636375 - DNA, 25 bp, Rattus norvegicus
tgggacctcttgactccccgagtgg

SEQ ID NO: 636376 - DNA, 25 bp, Rattus norvegicus
tgggacctcttgtctccccgagtgg

SEQ ID NO: 636377 - DNA, 25 bp, Rattus norvegicus
tgggacctgcctctcacaatggctg

SEQ ID NO: 636378 - DNA, 25 bp, Rattus norvegicus
tgggacctgcctgtcacaatggctg

SEQ ID NO: 636379 - DNA, 25 bp, Rattus norvegicus
tgggacctggcgacagtcactcgtg

SEQ ID NO: 636380 - DNA, 25 bp, Rattus norvegicus
tgggacctggcgtcagtcactcgtg

SEQ ID NO: 636381 - DNA, 25 bp, Rattus norvegicus
tgggacctggtcatcatcagggctg

SEQ ID NO: 636382 - DNA, 25 bp, Rattus norvegicus
tgggacctggtcttcatcagggctg

SEQ ID NO: 636383 - DNA, 25 bp, Rattus norvegicus
tgggaccttggaattacctaatcct

SEQ ID NO: 636384 - DNA, 25 bp, Rattus norvegicus
tgggaccttggatttacctaatcct

SEQ ID NO: 636385 - DNA, 25 bp, Rattus norvegicus
tgggacctttacctccaggctggga

SEQ ID NO: 636386 - DNA, 25 bp, Rattus norvegicus
tgggacctttacgtccaggctggga

SEQ ID NO: 636387 - DNA, 25 bp, Rattus norvegicus
tgggacctttgaaaccaagtacatt

SEQ ID NO: 636388 - DNA, 25 bp, Rattus norvegicus
tgggacctttgataccaagtacatt

SEQ ID NO: 636389 - DNA, 25 bp, Rattus norvegicus
tgggacgataccattgactcatctt

SEQ ID NO: 636390 - DNA, 25 bp, Rattus norvegicus
tgggacgatacctttgactcatctt

SEQ ID NO: 636391 - DNA, 25 bp, Rattus norvegicus
tgggacgcctaccaagaaactggac

SEQ ID NO: 636392 - DNA, 25 bp, Rattus norvegicus
tgggacgcctacgaagaaactggac

SEQ ID NO: 636393 - DNA, 25 bp, Rattus norvegicus
tgggacggaccgcaacaaggccaca

SEQ ID NO: 636394 - DNA, 25 bp, Rattus norvegicus
tgggacggaccggaacaaggccaca

SEQ ID NO: 636395 - DNA, 25 bp, Rattus norvegicus
tgggactacattcctgcgatgtcag

SEQ ID NO: 636396 - DNA, 25 bp, Rattus norvegicus
tgggactacattgctgcgatgtcag

SEQ ID NO: 636397 - DNA, 25 bp, Rattus norvegicus
tgggactacctccagacagtgcgtc

SEQ ID NO: 636398 - DNA, 25 bp, Rattus norvegicus
tgggactacctcgagacagtgcgtc

SEQ ID NO: 636399 - DNA, 25 bp, Rattus norvegicus
tgggactatcacctgtcctgtgata

SEQ ID NO: 636400 - DNA, 25 bp, Rattus norvegicus
tgggactatcacgtgtcctgtgata

SEQ ID NO: 636401 - DNA, 25 bp, Rattus norvegicus
tgggactatccacacatttttaaaa

SEQ ID NO: 636402 - DNA, 25 bp, Rattus norvegicus
tgggactatccagacatttttaaaa

SEQ ID NO: 636403 - DNA, 25 bp, Rattus norvegicus
tgggactatgaaacacatgtggtgg

SEQ ID NO: 636404 - DNA, 25 bp, Rattus norvegicus
tgggactatgaatcacatgtggtgg

SEQ ID NO: 636405 - DNA, 25 bp, Rattus norvegicus
tgggactcaaggactgtgctgtcac

SEQ ID NO: 636406 - DNA, 25 bp, Rattus norvegicus
tgggactcaaggtctgtgctgtcac

SEQ ID NO: 636407 - DNA, 25 bp, Rattus norvegicus
tgggactcacagatacaggcacatt

SEQ ID NO: 636408 - DNA, 25 bp, Rattus norvegicus
tgggactcacagttacaggcacatt

SEQ ID NO: 636409 - DNA, 25 bp, Rattus norvegicus
tgggactcagatcacttctcaccaa

SEQ ID NO: 636410 - DNA, 25 bp, Rattus norvegicus
tgggactcagatccgggaagccctc

SEQ ID NO: 636411 - DNA, 25 bp, Rattus norvegicus
tgggactcagatgacttctcaccaa

SEQ ID NO: 636412 - DNA, 25 bp, Rattus norvegicus
tgggactcagatgcgggaagccctc

SEQ ID NO: 636413 - DNA, 25 bp, Rattus norvegicus
tgggactcatggcaagggttcaatc

SEQ ID NO: 636414 - DNA, 25 bp, Rattus norvegicus
tgggactcatgggaagggttcaatc

SEQ ID NO: 636415 - DNA, 25 bp, Rattus norvegicus
tgggactccgctctaacgttttcta

SEQ ID NO: 636416 - DNA, 25 bp, Rattus norvegicus
tgggactccgctgtaacgttttcta

SEQ ID NO: 636417 - DNA, 25 bp, Rattus norvegicus
tgggactccgtaagtagaccaagct

SEQ ID NO: 636418 - DNA, 25 bp, Rattus norvegicus
tgggactccgtatgtagaccaagct

SEQ ID NO: 636419 - DNA, 25 bp, Rattus norvegicus
tgggactcggctacctctgaaacct

SEQ ID NO: 636420 - DNA, 25 bp, Rattus norvegicus
tgggactcggcttcctctgaaacct

SEQ ID NO: 636421 - DNA, 25 bp, Rattus norvegicus
tgggactctggaactttctggaagc

SEQ ID NO: 636422 - DNA, 25 bp, Rattus norvegicus
tgggactctggatctttctggaagc

SEQ ID NO: 636423 - DNA, 25 bp, Rattus norvegicus
tgggactgaaagactcctcgtcggc

SEQ ID NO: 636424 - DNA, 25 bp, Rattus norvegicus
tgggactgaaagtctcctcgtcggc

SEQ ID NO: 636425 - DNA, 25 bp, Rattus norvegicus
tgggactgatgtcggtacctgctca

SEQ ID NO: 636426 - DNA, 25 bp, Rattus norvegicus
tgggactgatgtgggtacctgctca

SEQ ID NO: 636427 - DNA, 25 bp, Rattus norvegicus
tgggactgatttacatttcagcctg

SEQ ID NO: 636428 - DNA, 25 bp, Rattus norvegicus
tgggactgattttcatttcagcctg

SEQ ID NO: 636429 - DNA, 25 bp, Rattus norvegicus
tgggactgctcccaagacgtagatg

SEQ ID NO: 636430 - DNA, 25 bp, Rattus norvegicus
tgggactgctccgaagacgtagatg

SEQ ID NO: 636431 - DNA, 25 bp, Rattus norvegicus
tgggactggacaatcctcctaggaa

SEQ ID NO: 636432 - DNA, 25 bp, Rattus norvegicus
tgggactggacattcctcctaggaa

SEQ ID NO: 636433 - DNA, 25 bp, Rattus norvegicus
tgggactggagtactgtcacctgtg

SEQ ID NO: 636434 - DNA, 25 bp, Rattus norvegicus
tgggactggagtcacttcactgagt

SEQ ID NO: 636435 - DNA, 25 bp, Rattus norvegicus
tgggactggagtcttggttctttca

SEQ ID NO: 636436 - DNA, 25 bp, Rattus norvegicus
tgggactggagtgacttcactgagt

SEQ ID NO: 636437 - DNA, 25 bp, Rattus norvegicus
tgggactggagtgttggttctttca

SEQ ID NO: 636438 - DNA, 25 bp, Rattus norvegicus
tgggactggagttctgtcacctgtg

SEQ ID NO: 636439 - DNA, 25 bp, Rattus norvegicus
tgggactggatcatcgcacctaagc

SEQ ID NO: 636440 - DNA, 25 bp, Rattus norvegicus
tgggactggatcttcgcacctaagc

SEQ ID NO: 636441 - DNA, 25 bp, Rattus norvegicus
tgggactgggtactacttttgagtt

SEQ ID NO: 636442 - DNA, 25 bp, Rattus norvegicus
tgggactgggtagtacttttgagtt

SEQ ID NO: 636443 - DNA, 25 bp, Rattus norvegicus
tgggactggtgaactcgtgacaatc

SEQ ID NO: 636444 - DNA, 25 bp, Rattus norvegicus
tgggactggtgatctcgtgacaatc

SEQ ID NO: 636445 - DNA, 25 bp, Rattus norvegicus
tgggactgtaccctgaaaccttgtt

SEQ ID NO: 636446 - DNA, 25 bp, Rattus norvegicus
tgggactgtaccgtgaaaccttgtt

SEQ ID NO: 636447 - DNA, 25 bp, Rattus norvegicus
tgggactgtgtcctggattccagtt

SEQ ID NO: 636448 - DNA, 25 bp, Rattus norvegicus
tgggactgtgtcgtggattccagtt

SEQ ID NO: 636449 - DNA, 25 bp, Rattus norvegicus
tgggactgttaaatttcacaaccaa

SEQ ID NO: 636450 - DNA, 25 bp, Rattus norvegicus
tgggactgttaattttcacaaccaa

SEQ ID NO: 636451 - DNA, 25 bp, Rattus norvegicus
tgggacttaagcaacagcagtgtaa

SEQ ID NO: 636452 - DNA, 25 bp, Rattus norvegicus
tgggacttaagctacagcagtgtaa

SEQ ID NO: 636453 - DNA, 25 bp, Rattus norvegicus
tgggacttagacactgcctcaggcg

SEQ ID NO: 636454 - DNA, 25 bp, Rattus norvegicus
tgggacttagactctgcctcaggcg

SEQ ID NO: 636455 - DNA, 25 bp, Rattus norvegicus
tgggacttcacaccattaagaaata

SEQ ID NO: 636456 - DNA, 25 bp, Rattus norvegicus
tgggacttcacagcattaagaaata

SEQ ID NO: 636457 - DNA, 25 bp, Rattus norvegicus
tgggacttcccaatagcttagcagc

SEQ ID NO: 636458 - DNA, 25 bp, Rattus norvegicus
tgggacttcccacgcatgtgagctc

SEQ ID NO: 636459 - DNA, 25 bp, Rattus norvegicus
tgggacttcccaggcatgtgagctc

SEQ ID NO: 636460 - DNA, 25 bp, Rattus norvegicus
tgggacttcccattagcttagcagc

SEQ ID NO: 636461 - DNA, 25 bp, Rattus norvegicus
tgggacttccgaattccaaatcctt

SEQ ID NO: 636462 - DNA, 25 bp, Rattus norvegicus
tgggacttccgatttccaaatcctt

SEQ ID NO: 636463 - DNA, 25 bp, Rattus norvegicus
tgggacttcgtgattgaggactctc

SEQ ID NO: 636464 - DNA, 25 bp, Rattus norvegicus
tgggacttcgtgtttgaggactctc

SEQ ID NO: 636465 - DNA, 25 bp, Rattus norvegicus
tgggacttctacaaggccgactggt

SEQ ID NO: 636466 - DNA, 25 bp, Rattus norvegicus
tgggacttctactaggccgactggt

SEQ ID NO: 636467 - DNA, 25 bp, Rattus norvegicus
tgggacttctgacctactagtgtgt

SEQ ID NO: 636468 - DNA, 25 bp, Rattus norvegicus
tgggacttctgagctactagtgtgt

SEQ ID NO: 636469 - DNA, 25 bp, Rattus norvegicus
tgggacttctttcctctaacttgaa

SEQ ID NO: 636470 - DNA, 25 bp, Rattus norvegicus
tgggacttctttgctctaacttgaa

SEQ ID NO: 636471 - DNA, 25 bp, Rattus norvegicus
tgggacttgcaccacgattctgaac

SEQ ID NO: 636472 - DNA, 25 bp, Rattus norvegicus
tgggacttgcacgacgattctgaac

SEQ ID NO: 636473 - DNA, 25 bp, Rattus norvegicus
tgggacttggatactcaggaggaat

SEQ ID NO: 636474 - DNA, 25 bp, Rattus norvegicus
tgggacttggattctcaggaggaat

SEQ ID NO: 636475 - DNA, 25 bp, Rattus norvegicus
tgggacttggctcatcatggaaatg

SEQ ID NO: 636476 - DNA, 25 bp, Rattus norvegicus
tgggacttggctgatcatggaaatg

SEQ ID NO: 636477 - DNA, 25 bp, Rattus norvegicus
tgggactttcaccattcagcacctg

SEQ ID NO: 636478 - DNA, 25 bp, Rattus norvegicus
tgggactttcacgattcagcacctg

SEQ ID NO: 636479 - DNA, 25 bp, Rattus norvegicus
tgggactttcctacacatgattctg

SEQ ID NO: 636480 - DNA, 25 bp, Rattus norvegicus
tgggactttccttcacatgattctg

SEQ ID NO: 636481 - DNA, 25 bp, Rattus norvegicus
tgggagaagagtcccctcctcgcca

SEQ ID NO: 636482 - DNA, 25 bp, Rattus norvegicus
tgggagaagagtgccctcctcgcca

SEQ ID NO: 636483 - DNA, 25 bp, Rattus norvegicus
tgggagaagccaagtcgtcctacac

SEQ ID NO: 636484 - DNA, 25 bp, Rattus norvegicus
tgggagaagccatgtcgtcctacac

SEQ ID NO: 636485 - DNA, 25 bp, Rattus norvegicus
tgggagaagcctagctggcctgcct

SEQ ID NO: 636486 - DNA, 25 bp, Rattus norvegicus
tgggagaagccttgctggcctgcct

SEQ ID NO: 636487 - DNA, 25 bp, Rattus norvegicus
tgggagaagcttctagccaaccgcg

SEQ ID NO: 636488 - DNA, 25 bp, Rattus norvegicus
tgggagaagcttgtagccaaccgcg

SEQ ID NO: 636489 - DNA, 25 bp, Rattus norvegicus
tgggagaatctcatcctggccatgc

SEQ ID NO: 636490 - DNA, 25 bp, Rattus norvegicus
tgggagaatctcttcctggccatgc

SEQ ID NO: 636491 - DNA, 25 bp, Rattus norvegicus
tgggagacaacaagccatgtggcct

SEQ ID NO: 636492 - DNA, 25 bp, Rattus norvegicus
tgggagacaacatgccatgtggcct

SEQ ID NO: 636493 - DNA, 25 bp, Rattus norvegicus
tgggagacacccactctatcagctg

SEQ ID NO: 636494 - DNA, 25 bp, Rattus norvegicus
tgggagacacccatacctgtatata

SEQ ID NO: 636495 - DNA, 25 bp, Rattus norvegicus
tgggagacacccatagcttctctct

SEQ ID NO: 636496 - DNA, 25 bp, Rattus norvegicus
tgggagacaccctctctatcagctg

SEQ ID NO: 636497 - DNA, 25 bp, Rattus norvegicus
tgggagacacccttacctgtatata

SEQ ID NO: 636498 - DNA, 25 bp, Rattus norvegicus
tgggagacacccttagcttctctct

SEQ ID NO: 636499 - DNA, 25 bp, Rattus norvegicus
tgggagacagttactgggtctgcct

SEQ ID NO: 636500 - DNA, 25 bp, Rattus norvegicus
tgggagacagtttctgggtctgcct

SEQ ID NO: 636501 - DNA, 25 bp, Rattus norvegicus
tgggagacatccctttctatttttc

SEQ ID NO: 636502 - DNA, 25 bp, Rattus norvegicus
tgggagacatccgtttctatttttc

SEQ ID NO: 636503 - DNA, 25 bp, Rattus norvegicus
tgggagaccgtaattacaaactgag

SEQ ID NO: 636504 - DNA, 25 bp, Rattus norvegicus
tgggagaccgtatttacaaactgag

SEQ ID NO: 636505 - DNA, 25 bp, Rattus norvegicus
tgggagacgcagccacaactcttta

SEQ ID NO: 636506 - DNA, 25 bp, Rattus norvegicus
tgggagacgcaggcacaactcttta

SEQ ID NO: 636507 - DNA, 25 bp, Rattus norvegicus
tgggagactcatatcagcttgcttc

SEQ ID NO: 636508 - DNA, 25 bp, Rattus norvegicus
tgggagactcatctacaaccacgat

SEQ ID NO: 636509 - DNA, 25 bp, Rattus norvegicus
tgggagactcatgtacaaccacgat

SEQ ID NO: 636510 - DNA, 25 bp, Rattus norvegicus
tgggagactcatttcagcttgcttc

SEQ ID NO: 636511 - DNA, 25 bp, Rattus norvegicus
tgggagaggactatctacgctctgt

SEQ ID NO: 636512 - DNA, 25 bp, Rattus norvegicus
tgggagaggactttctacgctctgt

SEQ ID NO: 636513 - DNA, 25 bp, Rattus norvegicus
tgggagaggctgacagctgcacctt

SEQ ID NO: 636514 - DNA, 25 bp, Rattus norvegicus
tgggagaggctgtcagctgcacctt

SEQ ID NO: 636515 - DNA, 25 bp, Rattus norvegicus
tgggagaggttcacaacagcatcct

SEQ ID NO: 636516 - DNA, 25 bp, Rattus norvegicus
tgggagaggttctcaacagcatcct

SEQ ID NO: 636517 - DNA, 25 bp, Rattus norvegicus
tgggagcagcccaagtaacacacgg

SEQ ID NO: 636518 - DNA, 25 bp, Rattus norvegicus
tgggagcagccctagtaacacacgg

SEQ ID NO: 636519 - DNA, 25 bp, Rattus norvegicus
tgggagcataagcactttcctctca

SEQ ID NO: 636520 - DNA, 25 bp, Rattus norvegicus
tgggagcataaggactttcctctca

SEQ ID NO: 636521 - DNA, 25 bp, Rattus norvegicus
tgggagccacccaggtacttatagg

SEQ ID NO: 636522 - DNA, 25 bp, Rattus norvegicus
tgggagccaccctggtacttatagg

SEQ ID NO: 636523 - DNA, 25 bp, Rattus norvegicus
tgggagccacggcaatctctactgg

SEQ ID NO: 636524 - DNA, 25 bp, Rattus norvegicus
tgggagccacgggaatctctactgg

SEQ ID NO: 636525 - DNA, 25 bp, Rattus norvegicus
tgggagccagcgaagccacactgct

SEQ ID NO: 636526 - DNA, 25 bp, Rattus norvegicus
tgggagccagcgtagccacactgct

SEQ ID NO: 636527 - DNA, 25 bp, Rattus norvegicus
tgggagccatatctgcttgtgcgat

SEQ ID NO: 636528 - DNA, 25 bp, Rattus norvegicus
tgggagccatatgtgcttgtgcgat

SEQ ID NO: 636529 - DNA, 25 bp, Rattus norvegicus
tgggagcccacacgacccatggaaa

SEQ ID NO: 636530 - DNA, 25 bp, Rattus norvegicus
tgggagcccacaggacccatggaaa

SEQ ID NO: 636531 - DNA, 25 bp, Rattus norvegicus
tgggagcccagcatgccaatttgga

SEQ ID NO: 636532 - DNA, 25 bp, Rattus norvegicus
tgggagcccagcatggagtcagaac

SEQ ID NO: 636533 - DNA, 25 bp, Rattus norvegicus
tgggagcccagcttgccaatttgga

SEQ ID NO: 636534 - DNA, 25 bp, Rattus norvegicus
tgggagcccagcttggagtcagaac

SEQ ID NO: 636535 - DNA, 25 bp, Rattus norvegicus
tgggagcccatcactttaatcttag

SEQ ID NO: 636536 - DNA, 25 bp, Rattus norvegicus
tgggagcccatctctttaatcttag

SEQ ID NO: 636537 - DNA, 25 bp, Rattus norvegicus
tgggagccccatcaaacacgaaaga

SEQ ID NO: 636538 - DNA, 25 bp, Rattus norvegicus
tgggagccccatgaaacacgaaaga

SEQ ID NO: 636539 - DNA, 25 bp, Rattus norvegicus
tgggagcccgggagactcctgaaat

SEQ ID NO: 636540 - DNA, 25 bp, Rattus norvegicus
tgggagcccgggtgactcctgaaat

SEQ ID NO: 636541 - DNA, 25 bp, Rattus norvegicus
tgggagccgccgatgcagctcatgt

SEQ ID NO: 636542 - DNA, 25 bp, Rattus norvegicus
tgggagccgccgttgcagctcatgt

SEQ ID NO: 636543 - DNA, 25 bp, Rattus norvegicus
tgggagcctcttctggctagacaga

SEQ ID NO: 636544 - DNA, 25 bp, Rattus norvegicus
tgggagcctcttgtggctagacaga

SEQ ID NO: 636545 - DNA, 25 bp, Rattus norvegicus
tgggagcctgacaacaggacctacc

SEQ ID NO: 636546 - DNA, 25 bp, Rattus norvegicus
tgggagcctgactacaggacctacc

SEQ ID NO: 636547 - DNA, 25 bp, Rattus norvegicus
tgggagcctgggatttcatctcatt

SEQ ID NO: 636548 - DNA, 25 bp, Rattus norvegicus
tgggagcctgggttttcatctcatt

SEQ ID NO: 636549 - DNA, 25 bp, Rattus norvegicus
tgggagcctggtatatcttgttcaa

SEQ ID NO: 636550 - DNA, 25 bp, Rattus norvegicus
tgggagcctggtttatcttgttcaa

SEQ ID NO: 636551 - DNA, 25 bp, Rattus norvegicus
tgggagccttgaattacagttctgc

SEQ ID NO: 636552 - DNA, 25 bp, Rattus norvegicus
tgggagccttgatttacagttctgc

SEQ ID NO: 636553 - DNA, 25 bp, Rattus norvegicus
tgggagccttgtcagtttgatcctt

SEQ ID NO: 636554 - DNA, 25 bp, Rattus norvegicus
tgggagccttgtgagtttgatcctt

SEQ ID NO: 636555 - DNA, 25 bp, Rattus norvegicus
tgggagcgacaccatagctgccaag

SEQ ID NO: 636556 - DNA, 25 bp, Rattus norvegicus
tgggagcgacacgatagctgccaag

SEQ ID NO: 636557 - DNA, 25 bp, Rattus norvegicus
tgggagcgacagctgcatgcatgcg

SEQ ID NO: 636558 - DNA, 25 bp, Rattus norvegicus
tgggagcgacaggtgcatgcatgcg

SEQ ID NO: 636559 - DNA, 25 bp, Rattus norvegicus
tgggagcgagttccagtcctttcct

SEQ ID NO: 636560 - DNA, 25 bp, Rattus norvegicus
tgggagcgagttgcagtcctttcct

SEQ ID NO: 636561 - DNA, 25 bp, Rattus norvegicus
tgggagcgctgcagacatcttccaa

SEQ ID NO: 636562 - DNA, 25 bp, Rattus norvegicus
tgggagcgctgctgacatcttccaa

SEQ ID NO: 636563 - DNA, 25 bp, Rattus norvegicus
tgggagcgctgtacggagtttccct

SEQ ID NO: 636564 - DNA, 25 bp, Rattus norvegicus
tgggagcgctgttcggagtttccct

SEQ ID NO: 636565 - DNA, 25 bp, Rattus norvegicus
tgggagctaatgaccctcagggagc

SEQ ID NO: 636566 - DNA, 25 bp, Rattus norvegicus
tgggagctaatgtccctcagggagc

SEQ ID NO: 636567 - DNA, 25 bp, Rattus norvegicus
tgggagctacccacgcgcgaccgag

SEQ ID NO: 636568 - DNA, 25 bp, Rattus norvegicus
tgggagctaccctcgcgcgaccgag

SEQ ID NO: 636569 - DNA, 25 bp, Rattus norvegicus
tgggagctcacgcaaggctctccag

SEQ ID NO: 636570 - DNA, 25 bp, Rattus norvegicus
tgggagctcacggaaggctctccag

SEQ ID NO: 636571 - DNA, 25 bp, Rattus norvegicus
tgggagctcagccaaactttggtgt

SEQ ID NO: 636572 - DNA, 25 bp, Rattus norvegicus
tgggagctcagcgaaactttggtgt

SEQ ID NO: 636573 - DNA, 25 bp, Rattus norvegicus
tgggagctcaggacaggcccatttg

SEQ ID NO: 636574 - DNA, 25 bp, Rattus norvegicus
tgggagctcaggtcaggcccatttg

SEQ ID NO: 636575 - DNA, 25 bp, Rattus norvegicus
tgggagctcgttactcgttgcaagg

SEQ ID NO: 636576 - DNA, 25 bp, Rattus norvegicus
tgggagctcgtttctcgttgcaagg

SEQ ID NO: 636577 - DNA, 25 bp, Rattus norvegicus
tgggagctcttcatgtatgtgtttc

SEQ ID NO: 636578 - DNA, 25 bp, Rattus norvegicus
tgggagctcttcttgtatgtgtttc

SEQ ID NO: 636579 - DNA, 25 bp, Rattus norvegicus
tgggagcttcttcttatgttaaact

SEQ ID NO: 636580 - DNA, 25 bp, Rattus norvegicus
tgggagcttcttgttatgttaaact

SEQ ID NO: 636581 - DNA, 25 bp, Rattus norvegicus
tgggagcttggaaccttgcctggac

SEQ ID NO: 636582 - DNA, 25 bp, Rattus norvegicus
tgggagcttggatccttgcctggac

SEQ ID NO: 636583 - DNA, 25 bp, Rattus norvegicus
tgggagcttgttctctctgaggatc

SEQ ID NO: 636584 - DNA, 25 bp, Rattus norvegicus
tgggagcttgttgtctctgaggatc

SEQ ID NO: 636585 - DNA, 25 bp, Rattus norvegicus
tgggaggacagccagctcctgcacc

SEQ ID NO: 636586 - DNA, 25 bp, Rattus norvegicus
tgggaggacagcgagctcctgcacc

SEQ ID NO: 636587 - DNA, 25 bp, Rattus norvegicus
tgggaggacctcaggctgacacaga

SEQ ID NO: 636588 - DNA, 25 bp, Rattus norvegicus
tgggaggacctctggctgacacaga

SEQ ID NO: 636589 - DNA, 25 bp, Rattus norvegicus
tgggaggactggactccgtccactg

SEQ ID NO: 636590 - DNA, 25 bp, Rattus norvegicus
tgggaggactggtctccgtccactg

SEQ ID NO: 636591 - DNA, 25 bp, Rattus norvegicus
tgggaggagccgcttggcgtctctg

SEQ ID NO: 636592 - DNA, 25 bp, Rattus norvegicus
tgggaggagccggttggcgtctctg

SEQ ID NO: 636593 - DNA, 25 bp, Rattus norvegicus
tgggaggagcctctcttggtcctac

SEQ ID NO: 636594 - DNA, 25 bp, Rattus norvegicus
tgggaggagcctgtcttggtcctac

SEQ ID NO: 636595 - DNA, 25 bp, Rattus norvegicus
tgggaggagtgtccgcgacagggca

SEQ ID NO: 636596 - DNA, 25 bp, Rattus norvegicus
tgggaggagtgtgcgcgacagggca

SEQ ID NO: 636597 - DNA, 25 bp, Rattus norvegicus
tgggaggatgctcccacctctgaat

SEQ ID NO: 636598 - DNA, 25 bp, Rattus norvegicus
tgggaggatgctgccacctctgaat

SEQ ID NO: 636599 - DNA, 25 bp, Rattus norvegicus
tgggaggattggatcagcattctga

SEQ ID NO: 636600 - DNA, 25 bp, Rattus norvegicus
tgggaggattggttcagcattctga

SEQ ID NO: 636601 - DNA, 25 bp, Rattus norvegicus
tgggaggcaacactgtcaccacagg

SEQ ID NO: 636602 - DNA, 25 bp, Rattus norvegicus
tgggaggcaacagtgtcaccacagg

SEQ ID NO: 636603 - DNA, 25 bp, Rattus norvegicus
tgggaggcagaacttcaagaccaac

SEQ ID NO: 636604 - DNA, 25 bp, Rattus norvegicus
tgggaggcagaagttcaagaccaac

SEQ ID NO: 636605 - DNA, 25 bp, Rattus norvegicus
tgggaggccacccaggctcgttcac

SEQ ID NO: 636606 - DNA, 25 bp, Rattus norvegicus
tgggaggccaccgaggctcgttcac

SEQ ID NO: 636607 - DNA, 25 bp, Rattus norvegicus
tgggaggcccacaggactgatgtct

SEQ ID NO: 636608 - DNA, 25 bp, Rattus norvegicus
tgggaggcccactggactgatgtct

SEQ ID NO: 636609 - DNA, 25 bp, Rattus norvegicus
tgggaggccctgaacacaaagactg

SEQ ID NO: 636610 - DNA, 25 bp, Rattus norvegicus
tgggaggccctgtacacaaagactg

SEQ ID NO: 636611 - DNA, 25 bp, Rattus norvegicus
tgggaggcccttatgaaatgtatgc

SEQ ID NO: 636612 - DNA, 25 bp, Rattus norvegicus
tgggaggcccttttgaaatgtatgc

SEQ ID NO: 636613 - DNA, 25 bp, Rattus norvegicus
tgggaggcctctacacgtcagtggt

SEQ ID NO: 636614 - DNA, 25 bp, Rattus norvegicus
tgggaggcctcttcacgtcagtggt

SEQ ID NO: 636615 - DNA, 25 bp, Rattus norvegicus
tgggaggcgacactctccagacttt

SEQ ID NO: 636616 - DNA, 25 bp, Rattus norvegicus
tgggaggcgacagtctccagacttt

SEQ ID NO: 636617 - DNA, 25 bp, Rattus norvegicus
tgggaggctactcggaactttaaca

SEQ ID NO: 636618 - DNA, 25 bp, Rattus norvegicus
tgggaggctactgggaactttaaca

SEQ ID NO: 636619 - DNA, 25 bp, Rattus norvegicus
tgggaggctaggactcaagacacgc

SEQ ID NO: 636620 - DNA, 25 bp, Rattus norvegicus
tgggaggctaggtctcaagacacgc

SEQ ID NO: 636621 - DNA, 25 bp, Rattus norvegicus
tgggagggagcgagccaaccccttt

SEQ ID NO: 636622 - DNA, 25 bp, Rattus norvegicus
tgggagggagcgtgccaaccccttt

SEQ ID NO: 636623 - DNA, 25 bp, Rattus norvegicus
tgggagggcggtactgacccacttt

SEQ ID NO: 636624 - DNA, 25 bp, Rattus norvegicus
tgggagggcggttctgacccacttt

SEQ ID NO: 636625 - DNA, 25 bp, Rattus norvegicus
tgggagggctttccacctgacgtcc

SEQ ID NO: 636626 - DNA, 25 bp, Rattus norvegicus
tgggagggctttgcacctgacgtcc

SEQ ID NO: 636627 - DNA, 25 bp, Rattus norvegicus
tgggagggtaggaagttctctttat

SEQ ID NO: 636628 - DNA, 25 bp, Rattus norvegicus
tgggagggtaggtagttctctttat

SEQ ID NO: 636629 - DNA, 25 bp, Rattus norvegicus
tgggagggtttgacccactgccatc

SEQ ID NO: 636630 - DNA, 25 bp, Rattus norvegicus
tgggagggtttgtcccactgccatc

SEQ ID NO: 636631 - DNA, 25 bp, Rattus norvegicus
tgggaggtcattcccagtgacccat

SEQ ID NO: 636632 - DNA, 25 bp, Rattus norvegicus
tgggaggtcattgccagtgacccat

SEQ ID NO: 636633 - DNA, 25 bp, Rattus norvegicus
tgggagtcaaagaccctaggagcca

SEQ ID NO: 636634 - DNA, 25 bp, Rattus norvegicus
tgggagtcaaagtccctaggagcca

SEQ ID NO: 636635 - DNA, 25 bp, Rattus norvegicus
tgggagtcattgagctctggttact

SEQ ID NO: 636636 - DNA, 25 bp, Rattus norvegicus
tgggagtcattgtgctctggttact

SEQ ID NO: 636637 - DNA, 25 bp, Rattus norvegicus
tgggagtcctcacaggtcactactg

SEQ ID NO: 636638 - DNA, 25 bp, Rattus norvegicus
tgggagtcctcagaggtcactactg

SEQ ID NO: 636639 - DNA, 25 bp, Rattus norvegicus
tgggagtcctctacatggccatcag

SEQ ID NO: 636640 - DNA, 25 bp, Rattus norvegicus
tgggagtcctcttcatggccatcag

SEQ ID NO: 636641 - DNA, 25 bp, Rattus norvegicus
tgggagtcggccaggtcccctgaaa

SEQ ID NO: 636642 - DNA, 25 bp, Rattus norvegicus
tgggagtcggcctggtcccctgaaa

SEQ ID NO: 636643 - DNA, 25 bp, Rattus norvegicus
tgggagtcggctatgccgtcctcta

SEQ ID NO: 636644 - DNA, 25 bp, Rattus norvegicus
tgggagtcggctttgccgtcctcta

SEQ ID NO: 636645 - DNA, 25 bp, Rattus norvegicus
tgggagtcgggacatcagggttaca

SEQ ID NO: 636646 - DNA, 25 bp, Rattus norvegicus
tgggagtcgggagatcagggttaca

SEQ ID NO: 636647 - DNA, 25 bp, Rattus norvegicus
tgggagtctgcaatttccaggctaa

SEQ ID NO: 636648 - DNA, 25 bp, Rattus norvegicus
tgggagtctgcattttccaggctaa

SEQ ID NO: 636649 - DNA, 25 bp, Rattus norvegicus
tgggagtgagccctacactaggttc

SEQ ID NO: 636650 - DNA, 25 bp, Rattus norvegicus
tgggagtgagccgtacactaggttc

SEQ ID NO: 636651 - DNA, 25 bp, Rattus norvegicus
tgggagtgaggtatcttccacctgt

SEQ ID NO: 636652 - DNA, 25 bp, Rattus norvegicus
tgggagtgaggtttcttccacctgt

SEQ ID NO: 636653 - DNA, 25 bp, Rattus norvegicus
tgggagtgctccagcttgacaccat

SEQ ID NO: 636654 - DNA, 25 bp, Rattus norvegicus
tgggagtgctcctgcttgacaccat

SEQ ID NO: 636655 - DNA, 25 bp, Rattus norvegicus
tgggagtgcttaacttttccccttg

SEQ ID NO: 636656 - DNA, 25 bp, Rattus norvegicus
tgggagtgcttatcttttccccttg

SEQ ID NO: 636657 - DNA, 25 bp, Rattus norvegicus
tgggagtggccacggcggcgcacgt

SEQ ID NO: 636658 - DNA, 25 bp, Rattus norvegicus
tgggagtggccagggcggcgcacgt

SEQ ID NO: 636659 - DNA, 25 bp, Rattus norvegicus
tgggagtggcccatgtgtacgcacc

SEQ ID NO: 636660 - DNA, 25 bp, Rattus norvegicus
tgggagtggcccttgtgtacgcacc

SEQ ID NO: 636661 - DNA, 25 bp, Rattus norvegicus
tgggagtggctgcacatacctctaa

SEQ ID NO: 636662 - DNA, 25 bp, Rattus norvegicus
tgggagtggctggacatacctctaa

SEQ ID NO: 636663 - DNA, 25 bp, Rattus norvegicus
tgggagtggttcacaggcctatcac

SEQ ID NO: 636664 - DNA, 25 bp, Rattus norvegicus
tgggagtggttctcaggcctatcac

SEQ ID NO: 636665 - DNA, 25 bp, Rattus norvegicus
tgggagttacacactctacgagccc

SEQ ID NO: 636666 - DNA, 25 bp, Rattus norvegicus
tgggagttacactctctacgagccc

SEQ ID NO: 636667 - DNA, 25 bp, Rattus norvegicus
tgggagttcagaactgtagcgtgaa

SEQ ID NO: 636668 - DNA, 25 bp, Rattus norvegicus
tgggagttcagatctgtagcgtgaa

SEQ ID NO: 636669 - DNA, 25 bp, Rattus norvegicus
tgggagttcccaagttcgctgatca

SEQ ID NO: 636670 - DNA, 25 bp, Rattus norvegicus
tgggagttcccatgttcgctgatca

SEQ ID NO: 636671 - DNA, 25 bp, Rattus norvegicus
tgggagttctgcagcaagcctactt

SEQ ID NO: 636672 - DNA, 25 bp, Rattus norvegicus
tgggagttctgctgcaagcctactt

SEQ ID NO: 636673 - DNA, 25 bp, Rattus norvegicus
tgggagttctttactcacatgtgaa

SEQ ID NO: 636674 - DNA, 25 bp, Rattus norvegicus
tgggagttctttagtggcctgtgct

SEQ ID NO: 636675 - DNA, 25 bp, Rattus norvegicus
tgggagttcttttctcacatgtgaa

SEQ ID NO: 636676 - DNA, 25 bp, Rattus norvegicus
tgggagttcttttgtggcctgtgct

SEQ ID NO: 636677 - DNA, 25 bp, Rattus norvegicus
tgggagttgccaactgagagccgat

SEQ ID NO: 636678 - DNA, 25 bp, Rattus norvegicus
tgggagttgccatctgagagccgat

SEQ ID NO: 636679 - DNA, 25 bp, Rattus norvegicus
tgggagtttccaacggccggtgcta

SEQ ID NO: 636680 - DNA, 25 bp, Rattus norvegicus
tgggagtttccatcggccggtgcta

SEQ ID NO: 636681 - DNA, 25 bp, Rattus norvegicus
tgggagtttctcattttcagaaaga

SEQ ID NO: 636682 - DNA, 25 bp, Rattus norvegicus
tgggagtttctctttttcagaaaga

SEQ ID NO: 636683 - DNA, 25 bp, Rattus norvegicus
tgggagttttatatcatgcgagtga

SEQ ID NO: 636684 - DNA, 25 bp, Rattus norvegicus
tgggagttttatttcatgcgagtga

SEQ ID NO: 636685 - DNA, 25 bp, Rattus norvegicus
tgggataacctacgcatactgcact

SEQ ID NO: 636686 - DNA, 25 bp, Rattus norvegicus
tgggataacctaggcatactgcact

SEQ ID NO: 636687 - DNA, 25 bp, Rattus norvegicus
tgggataagcgcaactgcctggaca

SEQ ID NO: 636688 - DNA, 25 bp, Rattus norvegicus
tgggataagcgctactgcctggaca

SEQ ID NO: 636689 - DNA, 25 bp, Rattus norvegicus
tgggatacacctcccttgttctgta

SEQ ID NO: 636690 - DNA, 25 bp, Rattus norvegicus
tgggatacacctgccttgttctgta

SEQ ID NO: 636691 - DNA, 25 bp, Rattus norvegicus
tgggatacactactctcaagctgac

SEQ ID NO: 636692 - DNA, 25 bp, Rattus norvegicus
tgggatacactagtctcaagctgac

SEQ ID NO: 636693 - DNA, 25 bp, Rattus norvegicus
tgggatacatgccttctgccagcat

SEQ ID NO: 636694 - DNA, 25 bp, Rattus norvegicus
tgggatacatgcgttctgccagcat

SEQ ID NO: 636695 - DNA, 25 bp, Rattus norvegicus
tgggataccattcttgttgctcttc

SEQ ID NO: 636696 - DNA, 25 bp, Rattus norvegicus
tgggataccattgttgttgctcttc

SEQ ID NO: 636697 - DNA, 25 bp, Rattus norvegicus
tgggatacctacacgggctcattaa

SEQ ID NO: 636698 - DNA, 25 bp, Rattus norvegicus
tgggatacctactcgggctcattaa

SEQ ID NO: 636699 - DNA, 25 bp, Rattus norvegicus
tgggatactcagactttctcatcat

SEQ ID NO: 636700 - DNA, 25 bp, Rattus norvegicus
tgggatactcagtctttctcatcat

SEQ ID NO: 636701 - DNA, 25 bp, Rattus norvegicus
tgggatactggccagcttacaaatg

SEQ ID NO: 636702 - DNA, 25 bp, Rattus norvegicus
tgggatactggcgagcttacaaatg

SEQ ID NO: 636703 - DNA, 25 bp, Rattus norvegicus
tgggataggtggctttccctctcgt

SEQ ID NO: 636704 - DNA, 25 bp, Rattus norvegicus
tgggataggtgggtttccctctcgt

SEQ ID NO: 636705 - DNA, 25 bp, Rattus norvegicus
tgggatatactgagccatctacctc

SEQ ID NO: 636706 - DNA, 25 bp, Rattus norvegicus
tgggatatactgtgccatctacctc

SEQ ID NO: 636707 - DNA, 25 bp, Rattus norvegicus
tgggatatttatatggctttaacac

SEQ ID NO: 636708 - DNA, 25 bp, Rattus norvegicus
tgggatatttatttggctttaacac

SEQ ID NO: 636709 - DNA, 25 bp, Rattus norvegicus
tgggatcacacaccccagaatctca

SEQ ID NO: 636710 - DNA, 25 bp, Rattus norvegicus
tgggatcacacagcccagaatctca

SEQ ID NO: 636711 - DNA, 25 bp, Rattus norvegicus
tgggatcacacccttttcatcttct

SEQ ID NO: 636712 - DNA, 25 bp, Rattus norvegicus
tgggatcacaccgttttcatcttct

SEQ ID NO: 636713 - DNA, 25 bp, Rattus norvegicus
tgggatcaccccaggagaattctcg

SEQ ID NO: 636714 - DNA, 25 bp, Rattus norvegicus
tgggatcacccctggagaattctcg

SEQ ID NO: 636715 - DNA, 25 bp, Rattus norvegicus
tgggatcagtccattgtgctaccat

SEQ ID NO: 636716 - DNA, 25 bp, Rattus norvegicus
tgggatcagtcctttgtgctaccat

SEQ ID NO: 636717 - DNA, 25 bp, Rattus norvegicus
tgggatcatgtccaagagccctatg

SEQ ID NO: 636718 - DNA, 25 bp, Rattus norvegicus
tgggatcatgtcgaagagccctatg

SEQ ID NO: 636719 - DNA, 25 bp, Rattus norvegicus
tgggatccaactatcagcagtgctt

SEQ ID NO: 636720 - DNA, 25 bp, Rattus norvegicus
tgggatccaactttcagcagtgctt

SEQ ID NO: 636721 - DNA, 25 bp, Rattus norvegicus
tgggatccaataccgtctgacagga

SEQ ID NO: 636722 - DNA, 25 bp, Rattus norvegicus
tgggatccaatagcgtctgacagga

SEQ ID NO: 636723 - DNA, 25 bp, Rattus norvegicus
tgggatccaccactgggcgacctag

SEQ ID NO: 636724 - DNA, 25 bp, Rattus norvegicus
tgggatccaccagtgggcgacctag

SEQ ID NO: 636725 - DNA, 25 bp, Rattus norvegicus
tgggatccacccacaggcaccaggg

SEQ ID NO: 636726 - DNA, 25 bp, Rattus norvegicus
tgggatccaccctcaggcaccaggg

SEQ ID NO: 636727 - DNA, 25 bp, Rattus norvegicus
tgggatccactcagctccctccagg

SEQ ID NO: 636728 - DNA, 25 bp, Rattus norvegicus
tgggatccactctgctccctccagg

SEQ ID NO: 636729 - DNA, 25 bp, Rattus norvegicus
tgggatccagtacttccagagcctc

SEQ ID NO: 636730 - DNA, 25 bp, Rattus norvegicus
tgggatccagtagttccagagcctc

SEQ ID NO: 636731 - DNA, 25 bp, Rattus norvegicus
tgggatcccataacggactctgcga

SEQ ID NO: 636732 - DNA, 25 bp, Rattus norvegicus
tgggatcccatatcggactctgcga

SEQ ID NO: 636733 - DNA, 25 bp, Rattus norvegicus
tgggatcccattaacttttgtcctt

SEQ ID NO: 636734 - DNA, 25 bp, Rattus norvegicus
tgggatcccatttacttttgtcctt

SEQ ID NO: 636735 - DNA, 25 bp, Rattus norvegicus
tgggatccctccaggagtgcccagc

SEQ ID NO: 636736 - DNA, 25 bp, Rattus norvegicus
tgggatccctcctggagtgcccagc

SEQ ID NO: 636737 - DNA, 25 bp, Rattus norvegicus
tgggatccgcgcctccagtgcatac

SEQ ID NO: 636738 - DNA, 25 bp, Rattus norvegicus
tgggatccgcgcgtccagtgcatac

SEQ ID NO: 636739 - DNA, 25 bp, Rattus norvegicus
tgggatccgttcatgaaacttaagt

SEQ ID NO: 636740 - DNA, 25 bp, Rattus norvegicus
tgggatccgttcttgaaacttaagt

SEQ ID NO: 636741 - DNA, 25 bp, Rattus norvegicus
tgggatcctccaaggtgttcctgat

SEQ ID NO: 636742 - DNA, 25 bp, Rattus norvegicus
tgggatcctccatggtgttcctgat

SEQ ID NO: 636743 - DNA, 25 bp, Rattus norvegicus
tgggatcctgtcctgagattaccat

SEQ ID NO: 636744 - DNA, 25 bp, Rattus norvegicus
tgggatcctgtcgtgagattaccat

SEQ ID NO: 636745 - DNA, 25 bp, Rattus norvegicus
tgggatcgctccaagcaacacaggg

SEQ ID NO: 636746 - DNA, 25 bp, Rattus norvegicus
tgggatcgctcctagcaacacaggg

SEQ ID NO: 636747 - DNA, 25 bp, Rattus norvegicus
tgggatcggtgcaacccgggctaaa

SEQ ID NO: 636748 - DNA, 25 bp, Rattus norvegicus
tgggatcggtgctacccgggctaaa

SEQ ID NO: 636749 - DNA, 25 bp, Rattus norvegicus
tgggatcgtttcacggccgaaggca

SEQ ID NO: 636750 - DNA, 25 bp, Rattus norvegicus
tgggatcgtttctcggccgaaggca

SEQ ID NO: 636751 - DNA, 25 bp, Rattus norvegicus
tgggatctcactcgtcatgggtcta

SEQ ID NO: 636752 - DNA, 25 bp, Rattus norvegicus
tgggatctcactggtcatgggtcta

SEQ ID NO: 636753 - DNA, 25 bp, Rattus norvegicus
tgggatctcagaaatgcacacgctt

SEQ ID NO: 636754 - DNA, 25 bp, Rattus norvegicus
tgggatctcagatatgcacacgctt

SEQ ID NO: 636755 - DNA, 25 bp, Rattus norvegicus
tgggatctgaaaagggtctgtgtct

SEQ ID NO: 636756 - DNA, 25 bp, Rattus norvegicus
tgggatctgaaatgggtctgtgtct

SEQ ID NO: 636757 - DNA, 25 bp, Rattus norvegicus
tgggatctgcccatggtcggtccag

SEQ ID NO: 636758 - DNA, 25 bp, Rattus norvegicus
tgggatctgcccttggtcggtccag

SEQ ID NO: 636759 - DNA, 25 bp, Rattus norvegicus
tgggatctgcctccggtcaagaatc

SEQ ID NO: 636760 - DNA, 25 bp, Rattus norvegicus
tgggatctgcctgcggtcaagaatc

SEQ ID NO: 636761 - DNA, 25 bp, Rattus norvegicus
tgggatctggtaagctcttctgaca

SEQ ID NO: 636762 - DNA, 25 bp, Rattus norvegicus
tgggatctggtatgctcttctgaca

SEQ ID NO: 636763 - DNA, 25 bp, Rattus norvegicus
tgggatctgtgcaagcagtttgagc

SEQ ID NO: 636764 - DNA, 25 bp, Rattus norvegicus
tgggatctgtgctagcagtttgagc

SEQ ID NO: 636765 - DNA, 25 bp, Rattus norvegicus
tgggatcttgagacttttccttcag

SEQ ID NO: 636766 - DNA, 25 bp, Rattus norvegicus
tgggatcttgagtcttttccttcag

SEQ ID NO: 636767 - DNA, 25 bp, Rattus norvegicus
tgggatgaagctcccacaacttgag

SEQ ID NO: 636768 - DNA, 25 bp, Rattus norvegicus
tgggatgaagctgccacaacttgag

SEQ ID NO: 636769 - DNA, 25 bp, Rattus norvegicus
tgggatgaaggtcgtcctgccctac

SEQ ID NO: 636770 - DNA, 25 bp, Rattus norvegicus
tgggatgaaggtggtcctgccctac

SEQ ID NO: 636771 - DNA, 25 bp, Rattus norvegicus
tgggatgacagacccgtgtcaccat

SEQ ID NO: 636772 - DNA, 25 bp, Rattus norvegicus
tgggatgacagagccgtgtcaccat

SEQ ID NO: 636773 - DNA, 25 bp, Rattus norvegicus
tgggatgacatcactggcctcaggg

SEQ ID NO: 636774 - DNA, 25 bp, Rattus norvegicus
tgggatgacatctctggcctcaggg

SEQ ID NO: 636775 - DNA, 25 bp, Rattus norvegicus
tgggatgacccacgaaggcccacac

SEQ ID NO: 636776 - DNA, 25 bp, Rattus norvegicus
tgggatgacccaggaaggcccacac

SEQ ID NO: 636777 - DNA, 25 bp, Rattus norvegicus
tgggatgaccctaactacgacattg

SEQ ID NO: 636778 - DNA, 25 bp, Rattus norvegicus
tgggatgacccttactacgacattg

SEQ ID NO: 636779 - DNA, 25 bp, Rattus norvegicus
tgggatgacttgcagcctccataac

SEQ ID NO: 636780 - DNA, 25 bp, Rattus norvegicus
tgggatgacttggagcctccataac

SEQ ID NO: 636781 - DNA, 25 bp, Rattus norvegicus
tgggatgagcacagttctgctggca

SEQ ID NO: 636782 - DNA, 25 bp, Rattus norvegicus
tgggatgagcactgttctgctggca

SEQ ID NO: 636783 - DNA, 25 bp, Rattus norvegicus
tgggatgagccaaggtgccagacat

SEQ ID NO: 636784 - DNA, 25 bp, Rattus norvegicus
tgggatgagccatggtgccagacat

SEQ ID NO: 636785 - DNA, 25 bp, Rattus norvegicus
tgggatgatgcccaaactgccctgg

SEQ ID NO: 636786 - DNA, 25 bp, Rattus norvegicus
tgggatgatgccgaaactgccctgg

SEQ ID NO: 636787 - DNA, 25 bp, Rattus norvegicus
tgggatgcccgcaccaagctcagag

SEQ ID NO: 636788 - DNA, 25 bp, Rattus norvegicus
tgggatgcccgctccaagctcagag

SEQ ID NO: 636789 - DNA, 25 bp, Rattus norvegicus
tgggatgccctgaacacacgcacaa

SEQ ID NO: 636790 - DNA, 25 bp, Rattus norvegicus
tgggatgccctgagaagatcacata

SEQ ID NO: 636791 - DNA, 25 bp, Rattus norvegicus
tgggatgccctgtacacacgcacaa

SEQ ID NO: 636792 - DNA, 25 bp, Rattus norvegicus
tgggatgccctgtgaagatcacata

SEQ ID NO: 636793 - DNA, 25 bp, Rattus norvegicus
tgggatgctcctctcacaaagcttg

SEQ ID NO: 636794 - DNA, 25 bp, Rattus norvegicus
tgggatgctcctgtcacaaagcttg

SEQ ID NO: 636795 - DNA, 25 bp, Rattus norvegicus
tgggatgctgcccaagatcatcaga

SEQ ID NO: 636796 - DNA, 25 bp, Rattus norvegicus
tgggatgctgccgaagatcatcaga

SEQ ID NO: 636797 - DNA, 25 bp, Rattus norvegicus
tgggatgctggcacagagcctttta

SEQ ID NO: 636798 - DNA, 25 bp, Rattus norvegicus
tgggatgctggctcagagcctttta

SEQ ID NO: 636799 - DNA, 25 bp, Rattus norvegicus
tgggatgcttcaactacagccatca

SEQ ID NO: 636800 - DNA, 25 bp, Rattus norvegicus
tgggatgcttcatctacagccatca

SEQ ID NO: 636801 - DNA, 25 bp, Rattus norvegicus
tgggatggcaggaacgcaccacttg

SEQ ID NO: 636802 - DNA, 25 bp, Rattus norvegicus
tgggatggcaggtacgcaccacttg

SEQ ID NO: 636803 - DNA, 25 bp, Rattus norvegicus
tgggatggctgaacttctacgccac

SEQ ID NO: 636804 - DNA, 25 bp, Rattus norvegicus
tgggatggctgatcttctacgccac

SEQ ID NO: 636805 - DNA, 25 bp, Rattus norvegicus
tgggatggctgcagttcaagacccc

SEQ ID NO: 636806 - DNA, 25 bp, Rattus norvegicus
tgggatggctgctgttcaagacccc

SEQ ID NO: 636807 - DNA, 25 bp, Rattus norvegicus
tgggatgggcatagtcttttgactg

SEQ ID NO: 636808 - DNA, 25 bp, Rattus norvegicus
tgggatgggcattgtcttttgactg

SEQ ID NO: 636809 - DNA, 25 bp, Rattus norvegicus
tgggatgggcctctccacttcggat

SEQ ID NO: 636810 - DNA, 25 bp, Rattus norvegicus
tgggatgggcctgtccacttcggat

SEQ ID NO: 636811 - DNA, 25 bp, Rattus norvegicus
tgggatgggtttatctctttgtaat

SEQ ID NO: 636812 - DNA, 25 bp, Rattus norvegicus
tgggatgggtttttctctttgtaat

SEQ ID NO: 636813 - DNA, 25 bp, Rattus norvegicus
tgggatggtcatactgtggaagcct

SEQ ID NO: 636814 - DNA, 25 bp, Rattus norvegicus
tgggatggtcattctgtggaagcct

SEQ ID NO: 636815 - DNA, 25 bp, Rattus norvegicus
tgggatgtaccacgcataaactgtg

SEQ ID NO: 636816 - DNA, 25 bp, Rattus norvegicus
tgggatgtaccaggcataaactgtg

SEQ ID NO: 636817 - DNA, 25 bp, Rattus norvegicus
tgggatgtccctcaatgtagtttaa

SEQ ID NO: 636818 - DNA, 25 bp, Rattus norvegicus
tgggatgtccctgaatgtagtttaa

SEQ ID NO: 636819 - DNA, 25 bp, Rattus norvegicus
tgggatgtctcacacactgagcaac

SEQ ID NO: 636820 - DNA, 25 bp, Rattus norvegicus
tgggatgtctcagacactgagcaac

SEQ ID NO: 636821 - DNA, 25 bp, Rattus norvegicus
tgggatgtctctctgtgagcacgaa

SEQ ID NO: 636822 - DNA, 25 bp, Rattus norvegicus
tgggatgtctctgtgtgagcacgaa

SEQ ID NO: 636823 - DNA, 25 bp, Rattus norvegicus
tgggatgtctgccagtctctcacat

SEQ ID NO: 636824 - DNA, 25 bp, Rattus norvegicus
tgggatgtctgcgagtctctcacat

SEQ ID NO: 636825 - DNA, 25 bp, Rattus norvegicus
tgggatgttcatcatcaccactctc

SEQ ID NO: 636826 - DNA, 25 bp, Rattus norvegicus
tgggatgttcatgatcaccactctc

SEQ ID NO: 636827 - DNA, 25 bp, Rattus norvegicus
tgggatgttcttaaccctgggtaag

SEQ ID NO: 636828 - DNA, 25 bp, Rattus norvegicus
tgggatgttctttaccctgggtaag

SEQ ID NO: 636829 - DNA, 25 bp, Rattus norvegicus
tgggatgttgataacccctaagaac

SEQ ID NO: 636830 - DNA, 25 bp, Rattus norvegicus
tgggatgttgattacccctaagaac

SEQ ID NO: 636831 - DNA, 25 bp, Rattus norvegicus
tgggattaacctcttactctcactg

SEQ ID NO: 636832 - DNA, 25 bp, Rattus norvegicus
tgggattaacctgttactctcactg

SEQ ID NO: 636833 - DNA, 25 bp, Rattus norvegicus
tgggattaacgtcgtgtgccaccgt

SEQ ID NO: 636834 - DNA, 25 bp, Rattus norvegicus
tgggattaacgtggtgtgccaccgt

SEQ ID NO: 636835 - DNA, 25 bp, Rattus norvegicus
tgggattacaagatcttcttaaggt

SEQ ID NO: 636836 - DNA, 25 bp, Rattus norvegicus
tgggattacaagttcttcttaaggt

SEQ ID NO: 636837 - DNA, 25 bp, Rattus norvegicus
tgggattacaccagaagcttgcagt

SEQ ID NO: 636838 - DNA, 25 bp, Rattus norvegicus
tgggattacacctgaagcttgcagt

SEQ ID NO: 636839 - DNA, 25 bp, Rattus norvegicus
tgggattatggcctgtgtcaccacg

SEQ ID NO: 636840 - DNA, 25 bp, Rattus norvegicus
tgggattatggcgtgtgtcaccacg

SEQ ID NO: 636841 - DNA, 25 bp, Rattus norvegicus
tgggattcaccacttggctttggcc

SEQ ID NO: 636842 - DNA, 25 bp, Rattus norvegicus
tgggattcaccagttggctttggcc

SEQ ID NO: 636843 - DNA, 25 bp, Rattus norvegicus
tgggattcagtgagcatgcccatcc

SEQ ID NO: 636844 - DNA, 25 bp, Rattus norvegicus
tgggattcagtgtgcatgcccatcc

SEQ ID NO: 636845 - DNA, 25 bp, Rattus norvegicus
tgggattccaataactccctccaag

SEQ ID NO: 636846 - DNA, 25 bp, Rattus norvegicus
tgggattccaattactccctccaag

SEQ ID NO: 636847 - DNA, 25 bp, Rattus norvegicus
tgggattccagacttggaccactca

SEQ ID NO: 636848 - DNA, 25 bp, Rattus norvegicus
tgggattccagagttggaccactca

SEQ ID NO: 636849 - DNA, 25 bp, Rattus norvegicus
tgggattccagtcctctatttccat

SEQ ID NO: 636850 - DNA, 25 bp, Rattus norvegicus
tgggattccagtgctctatttccat

SEQ ID NO: 636851 - DNA, 25 bp, Rattus norvegicus
tgggattcccagagttcgtaagcat

SEQ ID NO: 636852 - DNA, 25 bp, Rattus norvegicus
tgggattcccagtgttcgtaagcat

SEQ ID NO: 636853 - DNA, 25 bp, Rattus norvegicus
tgggattccccaacagtcacagtca

SEQ ID NO: 636854 - DNA, 25 bp, Rattus norvegicus
tgggattccccatcagtcacagtca

SEQ ID NO: 636855 - DNA, 25 bp, Rattus norvegicus
tgggattcctggattgtgtaagcag

SEQ ID NO: 636856 - DNA, 25 bp, Rattus norvegicus
tgggattcctggtttgtgtaagcag

SEQ ID NO: 636857 - DNA, 25 bp, Rattus norvegicus
tgggattctctaccgtgccgcgatg

SEQ ID NO: 636858 - DNA, 25 bp, Rattus norvegicus
tgggattctctagcgtgccgcgatg

SEQ ID NO: 636859 - DNA, 25 bp, Rattus norvegicus
tgggattcttccacacatacataaa

SEQ ID NO: 636860 - DNA, 25 bp, Rattus norvegicus
tgggattcttcctcacatacataaa

SEQ ID NO: 636861 - DNA, 25 bp, Rattus norvegicus
tgggattctttcctaccttctttag

SEQ ID NO: 636862 - DNA, 25 bp, Rattus norvegicus
tgggattctttcgtaccttctttag

SEQ ID NO: 636863 - DNA, 25 bp, Rattus norvegicus
tgggattgatgtagtgcaccacagt

SEQ ID NO: 636864 - DNA, 25 bp, Rattus norvegicus
tgggattgatgttgtgcaccacagt

SEQ ID NO: 636865 - DNA, 25 bp, Rattus norvegicus
tgggattgcatgagccagggcataa

SEQ ID NO: 636866 - DNA, 25 bp, Rattus norvegicus
tgggattgcatgtgccagggcataa

SEQ ID NO: 636867 - DNA, 25 bp, Rattus norvegicus
tgggattgcattcccattgctgcta

SEQ ID NO: 636868 - DNA, 25 bp, Rattus norvegicus
tgggattgcattgccattgctgcta

SEQ ID NO: 636869 - DNA, 25 bp, Rattus norvegicus
tgggattggccaccgctagctattt

SEQ ID NO: 636870 - DNA, 25 bp, Rattus norvegicus
tgggattggccagcgctagctattt

SEQ ID NO: 636871 - DNA, 25 bp, Rattus norvegicus
tgggattggtttctccctcaggaca

SEQ ID NO: 636872 - DNA, 25 bp, Rattus norvegicus
tgggattggtttgtccctcaggaca

SEQ ID NO: 636873 - DNA, 25 bp, Rattus norvegicus
tgggattgtaccacctgttgagctt

SEQ ID NO: 636874 - DNA, 25 bp, Rattus norvegicus
tgggattgtacctcctgttgagctt

SEQ ID NO: 636875 - DNA, 25 bp, Rattus norvegicus
tgggattgttggacagaggcctctc

SEQ ID NO: 636876 - DNA, 25 bp, Rattus norvegicus
tgggattgttggtcagaggcctctc

SEQ ID NO: 636877 - DNA, 25 bp, Rattus norvegicus
tgggatttagacatcacatggtgaa

SEQ ID NO: 636878 - DNA, 25 bp, Rattus norvegicus
tgggatttagacttcacatggtgaa

SEQ ID NO: 636879 - DNA, 25 bp, Rattus norvegicus
tgggatttcatcaggtttttataca

SEQ ID NO: 636880 - DNA, 25 bp, Rattus norvegicus
tgggatttcatctggtttttataca

SEQ ID NO: 636881 - DNA, 25 bp, Rattus norvegicus
tgggatttcttgctcgcgctccggt

SEQ ID NO: 636882 - DNA, 25 bp, Rattus norvegicus
tgggatttcttggtcgcgctccggt

SEQ ID NO: 636883 - DNA, 25 bp, Rattus norvegicus
tgggatttgcccatcatttgcatat

SEQ ID NO: 636884 - DNA, 25 bp, Rattus norvegicus
tgggatttgcccttcatttgcatat

SEQ ID NO: 636885 - DNA, 25 bp, Rattus norvegicus
tgggattttaatcctaacgctgtag

SEQ ID NO: 636886 - DNA, 25 bp, Rattus norvegicus
tgggattttaatgctaacgctgtag

SEQ ID NO: 636887 - DNA, 25 bp, Rattus norvegicus
tgggattttcagatgctttgcactt

SEQ ID NO: 636888 - DNA, 25 bp, Rattus norvegicus
tgggattttcagttgctttgcactt

SEQ ID NO: 636889 - DNA, 25 bp, Rattus norvegicus
tgggattttcctcttgccttctaaa

SEQ ID NO: 636890 - DNA, 25 bp, Rattus norvegicus
tgggattttcctgttgccttctaaa

SEQ ID NO: 636891 - DNA, 25 bp, Rattus norvegicus
tgggattttcttacacagatactga

SEQ ID NO: 636892 - DNA, 25 bp, Rattus norvegicus
tgggattttctttcacagatactga

SEQ ID NO: 636893 - DNA, 25 bp, Rattus norvegicus
tgggattttgtacgctctccagtcc

SEQ ID NO: 636894 - DNA, 25 bp, Rattus norvegicus
tgggattttgtaggctctccagtcc

SEQ ID NO: 636895 - DNA, 25 bp, Rattus norvegicus
tgggcaaaaaatataacagggcctg

SEQ ID NO: 636896 - DNA, 25 bp, Rattus norvegicus
tgggcaaaaaatttaacagggcctg

SEQ ID NO: 636897 - DNA, 25 bp, Rattus norvegicus
tgggcaaaaaggagctggtcactat

SEQ ID NO: 636898 - DNA, 25 bp, Rattus norvegicus
tgggcaaaaaggtgctggtcactat

SEQ ID NO: 636899 - DNA, 25 bp, Rattus norvegicus
tgggcaaacagcatcgcacatgcac

SEQ ID NO: 636900 - DNA, 25 bp, Rattus norvegicus
tgggcaaacagcttcgcacatgcac

SEQ ID NO: 636901 - DNA, 25 bp, Rattus norvegicus
tgggcaaactggacaatacccaggg

SEQ ID NO: 636902 - DNA, 25 bp, Rattus norvegicus
tgggcaaactggacagctcatccga

SEQ ID NO: 636903 - DNA, 25 bp, Rattus norvegicus
tgggcaaactggtcaatacccaggg

SEQ ID NO: 636904 - DNA, 25 bp, Rattus norvegicus
tgggcaaactggtcagctcatccga

SEQ ID NO: 636905 - DNA, 25 bp, Rattus norvegicus
tgggcaaagcccctttagttgtaga

SEQ ID NO: 636906 - DNA, 25 bp, Rattus norvegicus
tgggcaaagcccgtttagttgtaga

SEQ ID NO: 636907 - DNA, 25 bp, Rattus norvegicus
tgggcaaaggccagactgacattca

SEQ ID NO: 636908 - DNA, 25 bp, Rattus norvegicus
tgggcaaaggccctggcaatacccc

SEQ ID NO: 636909 - DNA, 25 bp, Rattus norvegicus
tgggcaaaggccgtggcaatacccc

SEQ ID NO: 636910 - DNA, 25 bp, Rattus norvegicus
tgggcaaaggcctgactgacattca

SEQ ID NO: 636911 - DNA, 25 bp, Rattus norvegicus
tgggcaaagtgtacagtactgtctt

SEQ ID NO: 636912 - DNA, 25 bp, Rattus norvegicus
tgggcaaagtgttcagtactgtctt

SEQ ID NO: 636913 - DNA, 25 bp, Rattus norvegicus
tgggcaaataccagcgagctctgtt

SEQ ID NO: 636914 - DNA, 25 bp, Rattus norvegicus
tgggcaaatacctgcgagctctgtt

SEQ ID NO: 636915 - DNA, 25 bp, Rattus norvegicus
tgggcaacacctagagctacagctg

SEQ ID NO: 636916 - DNA, 25 bp, Rattus norvegicus
tgggcaacaccttgagctacagctg

SEQ ID NO: 636917 - DNA, 25 bp, Rattus norvegicus
tgggcaacagccagactgacgatta

SEQ ID NO: 636918 - DNA, 25 bp, Rattus norvegicus
tgggcaacagcctgactgacgatta

SEQ ID NO: 636919 - DNA, 25 bp, Rattus norvegicus
tgggcaacatcgcttctcgggtctc

SEQ ID NO: 636920 - DNA, 25 bp, Rattus norvegicus
tgggcaacatcggttctcgggtctc

SEQ ID NO: 636921 - DNA, 25 bp, Rattus norvegicus
tgggcaaccagccttcctcagatag

SEQ ID NO: 636922 - DNA, 25 bp, Rattus norvegicus
tgggcaaccagcgttcctcagatag

SEQ ID NO: 636923 - DNA, 25 bp, Rattus norvegicus
tgggcaacccggaggtaaccaatag

SEQ ID NO: 636924 - DNA, 25 bp, Rattus norvegicus
tgggcaacccggtggtaaccaatag

SEQ ID NO: 636925 - DNA, 25 bp, Rattus norvegicus
tgggcaaccgtgatcctttagatca

SEQ ID NO: 636926 - DNA, 25 bp, Rattus norvegicus
tgggcaaccgtgttcctttagatca

SEQ ID NO: 636927 - DNA, 25 bp, Rattus norvegicus
tgggcaacctggacctgagtgacat

SEQ ID NO: 636928 - DNA, 25 bp, Rattus norvegicus
tgggcaacctggtcctgagtgacat

SEQ ID NO: 636929 - DNA, 25 bp, Rattus norvegicus
tgggcaacgattctcacatgattct

SEQ ID NO: 636930 - DNA, 25 bp, Rattus norvegicus
tgggcaacgattgtcacatgattct

SEQ ID NO: 636931 - DNA, 25 bp, Rattus norvegicus
tgggcaactactcctctgtgagcag

SEQ ID NO: 636932 - DNA, 25 bp, Rattus norvegicus
tgggcaactactgctctgtgagcag

SEQ ID NO: 636933 - DNA, 25 bp, Rattus norvegicus
tgggcaactcgcagatggcaccagt

SEQ ID NO: 636934 - DNA, 25 bp, Rattus norvegicus
tgggcaactcgctgatggcaccagt

SEQ ID NO: 636935 - DNA, 25 bp, Rattus norvegicus
tgggcaactggcagatcaggcgtca

SEQ ID NO: 636936 - DNA, 25 bp, Rattus norvegicus
tgggcaactggctgatcaggcgtca

SEQ ID NO: 636937 - DNA, 25 bp, Rattus norvegicus
tgggcaagacctagtctactttctg

SEQ ID NO: 636938 - DNA, 25 bp, Rattus norvegicus
tgggcaagaccttgtctactttctg

SEQ ID NO: 636939 - DNA, 25 bp, Rattus norvegicus
tgggcaagagtcagccactgtacca

SEQ ID NO: 636940 - DNA, 25 bp, Rattus norvegicus
tgggcaagagtctgccactgtacca

SEQ ID NO: 636941 - DNA, 25 bp, Rattus norvegicus
tgggcaagatcaaccgcacacaggc

SEQ ID NO: 636942 - DNA, 25 bp, Rattus norvegicus
tgggcaagatcatccgcacacaggc

SEQ ID NO: 636943 - DNA, 25 bp, Rattus norvegicus
tgggcaagccagagtgtcctttcct

SEQ ID NO: 636944 - DNA, 25 bp, Rattus norvegicus
tgggcaagccagtgtgtcctttcct

SEQ ID NO: 636945 - DNA, 25 bp, Rattus norvegicus
tgggcaagccctcggaaggactttc

SEQ ID NO: 636946 - DNA, 25 bp, Rattus norvegicus
tgggcaagccctgggaaggactttc

SEQ ID NO: 636947 - DNA, 25 bp, Rattus norvegicus
tgggcaagccgtactgctttgcgag

SEQ ID NO: 636948 - DNA, 25 bp, Rattus norvegicus
tgggcaagccgttctgctttgcgag

SEQ ID NO: 636949 - DNA, 25 bp, Rattus norvegicus
tgggcaagcctcagtatagatcacg

SEQ ID NO: 636950 - DNA, 25 bp, Rattus norvegicus
tgggcaagcctctgtatagatcacg

SEQ ID NO: 636951 - DNA, 25 bp, Rattus norvegicus
tgggcaagcctgcagggcattttct

SEQ ID NO: 636952 - DNA, 25 bp, Rattus norvegicus
tgggcaagcctggagggcattttct

SEQ ID NO: 636953 - DNA, 25 bp, Rattus norvegicus
tgggcaaggcctcctctgtactgaa

SEQ ID NO: 636954 - DNA, 25 bp, Rattus norvegicus
tgggcaaggcctgctctgtactgaa

SEQ ID NO: 636955 - DNA, 25 bp, Rattus norvegicus
tgggcaagtggcagacgctcagaac

SEQ ID NO: 636956 - DNA, 25 bp, Rattus norvegicus
tgggcaagtggctgacgctcagaac

SEQ ID NO: 636957 - DNA, 25 bp, Rattus norvegicus
tgggcaatcatacctaattcttggt

SEQ ID NO: 636958 - DNA, 25 bp, Rattus norvegicus
tgggcaatcatagctaattcttggt

SEQ ID NO: 636959 - DNA, 25 bp, Rattus norvegicus
tgggcaatctccagtgagagcaagt

SEQ ID NO: 636960 - DNA, 25 bp, Rattus norvegicus
tgggcaatctcctgtgagagcaagt

SEQ ID NO: 636961 - DNA, 25 bp, Rattus norvegicus
tgggcaatgaaaactcctacccgct

SEQ ID NO: 636962 - DNA, 25 bp, Rattus norvegicus
tgggcaatgaaatctcctacccgct

SEQ ID NO: 636963 - DNA, 25 bp, Rattus norvegicus
tgggcaatgcatataacatcccctt

SEQ ID NO: 636964 - DNA, 25 bp, Rattus norvegicus
tgggcaatgcatttaacatcccctt

SEQ ID NO: 636965 - DNA, 25 bp, Rattus norvegicus
tgggcaatgttgagctcctggccat

SEQ ID NO: 636966 - DNA, 25 bp, Rattus norvegicus
tgggcaatgttgtgctcctggccat

SEQ ID NO: 636967 - DNA, 25 bp, Rattus norvegicus
tgggcaattccacgcaagtccaggc

SEQ ID NO: 636968 - DNA, 25 bp, Rattus norvegicus
tgggcaattccaggcaagtccaggc

SEQ ID NO: 636969 - DNA, 25 bp, Rattus norvegicus
tgggcaatttgcctcttgtatggaa

SEQ ID NO: 636970 - DNA, 25 bp, Rattus norvegicus
tgggcaatttgcgtcttgtatggaa

SEQ ID NO: 636971 - DNA, 25 bp, Rattus norvegicus
tgggcaattttgcaccatttcccac

SEQ ID NO: 636972 - DNA, 25 bp, Rattus norvegicus
tgggcaattttggaccatttcccac

SEQ ID NO: 636973 - DNA, 25 bp, Rattus norvegicus
tgggcacaaacccacaagggtccag

SEQ ID NO: 636974 - DNA, 25 bp, Rattus norvegicus
tgggcacaaaccgacaagggtccag

SEQ ID NO: 636975 - DNA, 25 bp, Rattus norvegicus
tgggcacaaggacttaatttccaaa

SEQ ID NO: 636976 - DNA, 25 bp, Rattus norvegicus
tgggcacaaggagttaatttccaaa

SEQ ID NO: 636977 - DNA, 25 bp, Rattus norvegicus
tgggcacaaggcaggattactagtc

SEQ ID NO: 636978 - DNA, 25 bp, Rattus norvegicus
tgggcacaaggctggattactagtc

SEQ ID NO: 636979 - DNA, 25 bp, Rattus norvegicus
tgggcacacagtcgtggagccaact

SEQ ID NO: 636980 - DNA, 25 bp, Rattus norvegicus
tgggcacacagtggtggagccaact

SEQ ID NO: 636981 - DNA, 25 bp, Rattus norvegicus
tgggcacaccatactgagctgtaag

SEQ ID NO: 636982 - DNA, 25 bp, Rattus norvegicus
tgggcacaccattctgagctgtaag

SEQ ID NO: 636983 - DNA, 25 bp, Rattus norvegicus
tgggcacacgtgcatttgcttctat

SEQ ID NO: 636984 - DNA, 25 bp, Rattus norvegicus
tgggcacacgtggatttgcttctat

SEQ ID NO: 636985 - DNA, 25 bp, Rattus norvegicus
tgggcacagaggcaacctgcacacc

SEQ ID NO: 636986 - DNA, 25 bp, Rattus norvegicus
tgggcacagagggaacctgcacacc

SEQ ID NO: 636987 - DNA, 25 bp, Rattus norvegicus
tgggcacagcagatcctggctaaaa

SEQ ID NO: 636988 - DNA, 25 bp, Rattus norvegicus
tgggcacagcagttcctggctaaaa

SEQ ID NO: 636989 - DNA, 25 bp, Rattus norvegicus
tgggcacagcgcacagatatctaca

SEQ ID NO: 636990 - DNA, 25 bp, Rattus norvegicus
tgggcacagcgctcagatatctaca

SEQ ID NO: 636991 - DNA, 25 bp, Rattus norvegicus
tgggcacagcttcaccttagttagg

SEQ ID NO: 636992 - DNA, 25 bp, Rattus norvegicus
tgggcacagcttctctaaccaaggc

SEQ ID NO: 636993 - DNA, 25 bp, Rattus norvegicus
tgggcacagcttgaccttagttagg

SEQ ID NO: 636994 - DNA, 25 bp, Rattus norvegicus
tgggcacagcttgtctaaccaaggc

SEQ ID NO: 636995 - DNA, 25 bp, Rattus norvegicus
tgggcacagtaccagtcccctggat

SEQ ID NO: 636996 - DNA, 25 bp, Rattus norvegicus
tgggcacagtacgagtcccctggat

SEQ ID NO: 636997 - DNA, 25 bp, Rattus norvegicus
tgggcacataagcacagcacctact

SEQ ID NO: 636998 - DNA, 25 bp, Rattus norvegicus
tgggcacataaggacagcacctact

SEQ ID NO: 636999 - DNA, 25 bp, Rattus norvegicus
tgggcacatcagcaggacacgtcat

SEQ ID NO: 637000 - DNA, 25 bp, Rattus norvegicus
tgggcacatcaggaggacacgtcat

SEQ ID NO: 637001 - DNA, 25 bp, Rattus norvegicus
tgggcacatcgtagtttcctgagac

SEQ ID NO: 637002 - DNA, 25 bp, Rattus norvegicus
tgggcacatcgttgtttcctgagac

SEQ ID NO: 637003 - DNA, 25 bp, Rattus norvegicus
tgggcaccagctctaggcttatagt

SEQ ID NO: 637004 - DNA, 25 bp, Rattus norvegicus
tgggcaccagctgtaggcttatagt

SEQ ID NO: 637005 - DNA, 25 bp, Rattus norvegicus
tgggcaccatctccttttttagttc

SEQ ID NO: 637006 - DNA, 25 bp, Rattus norvegicus
tgggcaccatctctgtcattatttt

SEQ ID NO: 637007 - DNA, 25 bp, Rattus norvegicus
tgggcaccatctgcttttttagttc

SEQ ID NO: 637008 - DNA, 25 bp, Rattus norvegicus
tgggcaccatctgtgtcattatttt

SEQ ID NO: 637009 - DNA, 25 bp, Rattus norvegicus
tgggcacccacactgacaccttggt

SEQ ID NO: 637010 - DNA, 25 bp, Rattus norvegicus
tgggcacccacagtgacaccttggt

SEQ ID NO: 637011 - DNA, 25 bp, Rattus norvegicus
tgggcacccagcctttaatatggga

SEQ ID NO: 637012 - DNA, 25 bp, Rattus norvegicus
tgggcacccagcgtttaatatggga

SEQ ID NO: 637013 - DNA, 25 bp, Rattus norvegicus
tgggcacccctaacaacgaagtgtg

SEQ ID NO: 637014 - DNA, 25 bp, Rattus norvegicus
tgggcacccctatcaacgaagtgtg

SEQ ID NO: 637015 - DNA, 25 bp, Rattus norvegicus
tgggcacccctccagcgtctattgg

SEQ ID NO: 637016 - DNA, 25 bp, Rattus norvegicus
tgggcacccctcgagcgtctattgg

SEQ ID NO: 637017 - DNA, 25 bp, Rattus norvegicus
tgggcacccgttcgctcagaatgaa

SEQ ID NO: 637018 - DNA, 25 bp, Rattus norvegicus
tgggcacccgttggctcagaatgaa

SEQ ID NO: 637019 - DNA, 25 bp, Rattus norvegicus
tgggcaccgagcatcacaaaaacgc

SEQ ID NO: 637020 - DNA, 25 bp, Rattus norvegicus
tgggcaccgagcttcacaaaaacgc

SEQ ID NO: 637021 - DNA, 25 bp, Rattus norvegicus
tgggcaccgatgctcctcacgttgt

SEQ ID NO: 637022 - DNA, 25 bp, Rattus norvegicus
tgggcaccgatggtcctcacgttgt

SEQ ID NO: 637023 - DNA, 25 bp, Rattus norvegicus
tgggcaccggcaactatgatgtcaa

SEQ ID NO: 637024 - DNA, 25 bp, Rattus norvegicus
tgggcaccggcatctatgatgtcaa

SEQ ID NO: 637025 - DNA, 25 bp, Rattus norvegicus
tgggcacctcacatggacattggat

SEQ ID NO: 637026 - DNA, 25 bp, Rattus norvegicus
tgggcacctcacttggacattggat

SEQ ID NO: 637027 - DNA, 25 bp, Rattus norvegicus
tgggcacctctcaaccactgactga

SEQ ID NO: 637028 - DNA, 25 bp, Rattus norvegicus
tgggcacctctctaccactgactga

SEQ ID NO: 637029 - DNA, 25 bp, Rattus norvegicus
tgggcacctgccaacttttggaata

SEQ ID NO: 637030 - DNA, 25 bp, Rattus norvegicus
tgggcacctgcctacttttggaata

SEQ ID NO: 637031 - DNA, 25 bp, Rattus norvegicus
tgggcacctgctatgcacagaagac

SEQ ID NO: 637032 - DNA, 25 bp, Rattus norvegicus
tgggcacctgctttgcacagaagac

SEQ ID NO: 637033 - DNA, 25 bp, Rattus norvegicus
tgggcacctggccttaaagttcttc

SEQ ID NO: 637034 - DNA, 25 bp, Rattus norvegicus
tgggcacctggcgttaaagttcttc

SEQ ID NO: 637035 - DNA, 25 bp, Rattus norvegicus
tgggcaccttagacttggtcacaga

SEQ ID NO: 637036 - DNA, 25 bp, Rattus norvegicus
tgggcaccttagtcttggtcacaga

SEQ ID NO: 637037 - DNA, 25 bp, Rattus norvegicus
tgggcacgagacaggcatcgccata

SEQ ID NO: 637038 - DNA, 25 bp, Rattus norvegicus
tgggcacgagactggcatcgccata

SEQ ID NO: 637039 - DNA, 25 bp, Rattus norvegicus
tgggcacgccctacgcaagcgggac

SEQ ID NO: 637040 - DNA, 25 bp, Rattus norvegicus
tgggcacgcccttcgcaagcgggac

SEQ ID NO: 637041 - DNA, 25 bp, Rattus norvegicus
tgggcacgccgcagtctgagctaga

SEQ ID NO: 637042 - DNA, 25 bp, Rattus norvegicus
tgggcacgccgctgtctgagctaga

SEQ ID NO: 637043 - DNA, 25 bp, Rattus norvegicus
tgggcacgctggaacaccaccaaag

SEQ ID NO: 637044 - DNA, 25 bp, Rattus norvegicus
tgggcacgctggtacaccaccaaag

SEQ ID NO: 637045 - DNA, 25 bp, Rattus norvegicus
tgggcacggtggcacatttgctacc

SEQ ID NO: 637046 - DNA, 25 bp, Rattus norvegicus
tgggcacggtgggacatttgctacc

SEQ ID NO: 637047 - DNA, 25 bp, Rattus norvegicus
tgggcactaaaacagaaacaatatg

SEQ ID NO: 637048 - DNA, 25 bp, Rattus norvegicus
tgggcactaaaagagaaacaatatg

SEQ ID NO: 637049 - DNA, 25 bp, Rattus norvegicus
tgggcactaataacttcttccacac

SEQ ID NO: 637050 - DNA, 25 bp, Rattus norvegicus
tgggcactaatatcttcttccacac

SEQ ID NO: 637051 - DNA, 25 bp, Rattus norvegicus
tgggcactagttaaggtcacagcat

SEQ ID NO: 637052 - DNA, 25 bp, Rattus norvegicus
tgggcactagtttaggtcacagcat

SEQ ID NO: 637053 - DNA, 25 bp, Rattus norvegicus
tgggcactcaggagcctcagcttgt

SEQ ID NO: 637054 - DNA, 25 bp, Rattus norvegicus
tgggcactcaggtgcctcagcttgt

SEQ ID NO: 637055 - DNA, 25 bp, Rattus norvegicus
tgggcactcagtatagactctcaac

SEQ ID NO: 637056 - DNA, 25 bp, Rattus norvegicus
tgggcactcagtttagactctcaac

SEQ ID NO: 637057 - DNA, 25 bp, Rattus norvegicus
tgggcactctccacacaagtgacat

SEQ ID NO: 637058 - DNA, 25 bp, Rattus norvegicus
tgggcactctcctcacaagtgacat

SEQ ID NO: 637059 - DNA, 25 bp, Rattus norvegicus
tgggcactgcacatgttgctaccaa

SEQ ID NO: 637060 - DNA, 25 bp, Rattus norvegicus
tgggcactgcacttgttgctaccaa

SEQ ID NO: 637061 - DNA, 25 bp, Rattus norvegicus
tgggcactgccacgcaacatgaaga

SEQ ID NO: 637062 - DNA, 25 bp, Rattus norvegicus
tgggcactgccaggcaacatgaaga

SEQ ID NO: 637063 - DNA, 25 bp, Rattus norvegicus
tgggcactgctcagggacacctgtt

SEQ ID NO: 637064 - DNA, 25 bp, Rattus norvegicus
tgggcactgctctgggacacctgtt

SEQ ID NO: 637065 - DNA, 25 bp, Rattus norvegicus
tgggcactgtgcctactctccagaa

SEQ ID NO: 637066 - DNA, 25 bp, Rattus norvegicus
tgggcactgtgcgtactctccagaa

SEQ ID NO: 637067 - DNA, 25 bp, Rattus norvegicus
tgggcactgtgtccgataactgtaa

SEQ ID NO: 637068 - DNA, 25 bp, Rattus norvegicus
tgggcactgtgtgcgataactgtaa

SEQ ID NO: 637069 - DNA, 25 bp, Rattus norvegicus
tgggcacttcctagcacgcaaaagg

SEQ ID NO: 637070 - DNA, 25 bp, Rattus norvegicus
tgggcacttccttgcacgcaaaagg

SEQ ID NO: 637071 - DNA, 25 bp, Rattus norvegicus
tgggcacttctcacaaactttctag

SEQ ID NO: 637072 - DNA, 25 bp, Rattus norvegicus
tgggcacttctctcaaactttctag

SEQ ID NO: 637073 - DNA, 25 bp, Rattus norvegicus
tgggcacttcttctcactttgaaaa

SEQ ID NO: 637074 - DNA, 25 bp, Rattus norvegicus
tgggcacttcttgtcactttgaaaa

SEQ ID NO: 637075 - DNA, 25 bp, Rattus norvegicus
tgggcacttgtaagggtgcgtaaac

SEQ ID NO: 637076 - DNA, 25 bp, Rattus norvegicus
tgggcacttgtatgggtgcgtaaac

SEQ ID NO: 637077 - DNA, 25 bp, Rattus norvegicus
tgggcacttgtgaccacagaggctg

SEQ ID NO: 637078 - DNA, 25 bp, Rattus norvegicus
tgggcacttgtgtccacagaggctg

SEQ ID NO: 637079 - DNA, 25 bp, Rattus norvegicus
tgggcactttctattcatccccagt

SEQ ID NO: 637080 - DNA, 25 bp, Rattus norvegicus
tgggcactttcttttcatccccagt

SEQ ID NO: 637081 - DNA, 25 bp, Rattus norvegicus
tgggcagaagggataccaccaccgt

SEQ ID NO: 637082 - DNA, 25 bp, Rattus norvegicus
tgggcagaagggttaccaccaccgt

SEQ ID NO: 637083 - DNA, 25 bp, Rattus norvegicus
tgggcagaatcaccatcctgtcttt

SEQ ID NO: 637084 - DNA, 25 bp, Rattus norvegicus
tgggcagaatcagcatcctgtcttt

SEQ ID NO: 637085 - DNA, 25 bp, Rattus norvegicus
tgggcagaccgacacaaccctgaga

SEQ ID NO: 637086 - DNA, 25 bp, Rattus norvegicus
tgggcagaccgagacaaccctgaga

SEQ ID NO: 637087 - DNA, 25 bp, Rattus norvegicus
tgggcagacctcagggacctcagta

SEQ ID NO: 637088 - DNA, 25 bp, Rattus norvegicus
tgggcagacctctgggacctcagta

SEQ ID NO: 637089 - DNA, 25 bp, Rattus norvegicus
tgggcagactcaactaccccgtggg

SEQ ID NO: 637090 - DNA, 25 bp, Rattus norvegicus
tgggcagactcatctaccccgtggg

SEQ ID NO: 637091 - DNA, 25 bp, Rattus norvegicus
tgggcagagaacaaccttaggtgtc

SEQ ID NO: 637092 - DNA, 25 bp, Rattus norvegicus
tgggcagagaactaccttaggtgtc

SEQ ID NO: 637093 - DNA, 25 bp, Rattus norvegicus
tgggcagagaccacagagtcgacac

SEQ ID NO: 637094 - DNA, 25 bp, Rattus norvegicus
tgggcagagacctcagagtcgacac

SEQ ID NO: 637095 - DNA, 25 bp, Rattus norvegicus
tgggcagagatgctggctaaccctc

SEQ ID NO: 637096 - DNA, 25 bp, Rattus norvegicus
tgggcagagatggtggctaaccctc

SEQ ID NO: 637097 - DNA, 25 bp, Rattus norvegicus
tgggcagagcagacactcatttcct

SEQ ID NO: 637098 - DNA, 25 bp, Rattus norvegicus
tgggcagagcagtcactcatttcct

SEQ ID NO: 637099 - DNA, 25 bp, Rattus norvegicus
tgggcagagccaaaccctggaactg

SEQ ID NO: 637100 - DNA, 25 bp, Rattus norvegicus
tgggcagagccataccctggaactg

SEQ ID NO: 637101 - DNA, 25 bp, Rattus norvegicus
tgggcagaggccagagatccttttc

SEQ ID NO: 637102 - DNA, 25 bp, Rattus norvegicus
tgggcagaggcctgagatccttttc

SEQ ID NO: 637103 - DNA, 25 bp, Rattus norvegicus
tgggcagagtccacactacgctggc

SEQ ID NO: 637104 - DNA, 25 bp, Rattus norvegicus
tgggcagagtcctcactacgctggc

SEQ ID NO: 637105 - DNA, 25 bp, Rattus norvegicus
tgggcagatctacccagacctcctg

SEQ ID NO: 637106 - DNA, 25 bp, Rattus norvegicus
tgggcagatctagccagacctcctg

SEQ ID NO: 637107 - DNA, 25 bp, Rattus norvegicus
tgggcagcaaccatggatgccagaa

SEQ ID NO: 637108 - DNA, 25 bp, Rattus norvegicus
tgggcagcaaccttggatgccagaa

SEQ ID NO: 637109 - DNA, 25 bp, Rattus norvegicus
tgggcagcaagtccttggctccata

SEQ ID NO: 637110 - DNA, 25 bp, Rattus norvegicus
tgggcagcaagtgcttggctccata

SEQ ID NO: 637111 - DNA, 25 bp, Rattus norvegicus
tgggcagcacagcaccacattaact

SEQ ID NO: 637112 - DNA, 25 bp, Rattus norvegicus
tgggcagcacaggaccacattaact

SEQ ID NO: 637113 - DNA, 25 bp, Rattus norvegicus
tgggcagcagtgcacacatccatat

SEQ ID NO: 637114 - DNA, 25 bp, Rattus norvegicus
tgggcagcagtggacacatccatat

SEQ ID NO: 637115 - DNA, 25 bp, Rattus norvegicus
tgggcagccaacacatgtagacctt

SEQ ID NO: 637116 - DNA, 25 bp, Rattus norvegicus
tgggcagccaactcatgtagacctt

SEQ ID NO: 637117 - DNA, 25 bp, Rattus norvegicus
tgggcagccaagcacatcgaaaact

SEQ ID NO: 637118 - DNA, 25 bp, Rattus norvegicus
tgggcagccaaggacatcgaaaact

SEQ ID NO: 637119 - DNA, 25 bp, Rattus norvegicus
tgggcagccactaataaccctgttg

SEQ ID NO: 637120 - DNA, 25 bp, Rattus norvegicus
tgggcagccacttataaccctgttg

SEQ ID NO: 637121 - DNA, 25 bp, Rattus norvegicus
tgggcagccatgcagcagcatcttt

SEQ ID NO: 637122 - DNA, 25 bp, Rattus norvegicus
tgggcagccatggagcagcatcttt

SEQ ID NO: 637123 - DNA, 25 bp, Rattus norvegicus
tgggcagccattctgggcttttcca

SEQ ID NO: 637124 - DNA, 25 bp, Rattus norvegicus
tgggcagccattgtgggcttttcca

SEQ ID NO: 637125 - DNA, 25 bp, Rattus norvegicus
tgggcagcccatccatatgtcatta

SEQ ID NO: 637126 - DNA, 25 bp, Rattus norvegicus
tgggcagcccatgcatatgtcatta

SEQ ID NO: 637127 - DNA, 25 bp, Rattus norvegicus
tgggcagccctgcaacttttgcctt

SEQ ID NO: 637128 - DNA, 25 bp, Rattus norvegicus
tgggcagccctgctacttaaagcac

SEQ ID NO: 637129 - DNA, 25 bp, Rattus norvegicus
tgggcagccctggaacttttgcctt

SEQ ID NO: 637130 - DNA, 25 bp, Rattus norvegicus
tgggcagccctggtacttaaagcac

SEQ ID NO: 637131 - DNA, 25 bp, Rattus norvegicus
tgggcagcccttcgacaccatgaag

SEQ ID NO: 637132 - DNA, 25 bp, Rattus norvegicus
tgggcagcccttggacaccatgaag

SEQ ID NO: 637133 - DNA, 25 bp, Rattus norvegicus
tgggcagcctcgcaccatgactggc

SEQ ID NO: 637134 - DNA, 25 bp, Rattus norvegicus
tgggcagcctcggaccatgactggc

SEQ ID NO: 637135 - DNA, 25 bp, Rattus norvegicus
tgggcagcctgcactacgactttct

SEQ ID NO: 637136 - DNA, 25 bp, Rattus norvegicus
tgggcagcctgctctacgactttct

SEQ ID NO: 637137 - DNA, 25 bp, Rattus norvegicus
tgggcagcctttccatcatatttgc

SEQ ID NO: 637138 - DNA, 25 bp, Rattus norvegicus
tgggcagcctttgcatcatatttgc

SEQ ID NO: 637139 - DNA, 25 bp, Rattus norvegicus
tgggcagcgtgtacccctatacctg

SEQ ID NO: 637140 - DNA, 25 bp, Rattus norvegicus
tgggcagcgtgttcccctatacctg

SEQ ID NO: 637141 - DNA, 25 bp, Rattus norvegicus
tgggcagctattaaagtttcttcac

SEQ ID NO: 637142 - DNA, 25 bp, Rattus norvegicus
tgggcagctatttaagtttcttcac

SEQ ID NO: 637143 - DNA, 25 bp, Rattus norvegicus
tgggcagctccacactaagatagaa

SEQ ID NO: 637144 - DNA, 25 bp, Rattus norvegicus
tgggcagctccagactaagatagaa

SEQ ID NO: 637145 - DNA, 25 bp, Rattus norvegicus
tgggcagctctgagttgaattccta

SEQ ID NO: 637146 - DNA, 25 bp, Rattus norvegicus
tgggcagctctgtgttgaattccta

SEQ ID NO: 637147 - DNA, 25 bp, Rattus norvegicus
tgggcagctcttagatgttccacac

SEQ ID NO: 637148 - DNA, 25 bp, Rattus norvegicus
tgggcagctctttgatgttccacac

SEQ ID NO: 637149 - DNA, 25 bp, Rattus norvegicus
tgggcagctgcactcatgtgtacgt

SEQ ID NO: 637150 - DNA, 25 bp, Rattus norvegicus
tgggcagctgcagtcatgtgtacgt

SEQ ID NO: 637151 - DNA, 25 bp, Rattus norvegicus
tgggcagctttcaccagacctttga

SEQ ID NO: 637152 - DNA, 25 bp, Rattus norvegicus
tgggcagctttctccagacctttga

SEQ ID NO: 637153 - DNA, 25 bp, Rattus norvegicus
tgggcaggacacacaacaggacgct

SEQ ID NO: 637154 - DNA, 25 bp, Rattus norvegicus
tgggcaggacactcaacaggacgct

SEQ ID NO: 637155 - DNA, 25 bp, Rattus norvegicus
tgggcaggaccgatctgtctggatc

SEQ ID NO: 637156 - DNA, 25 bp, Rattus norvegicus
tgggcaggaccgcagtattcatcac

SEQ ID NO: 637157 - DNA, 25 bp, Rattus norvegicus
tgggcaggaccggagtattcatcac

SEQ ID NO: 637158 - DNA, 25 bp, Rattus norvegicus
tgggcaggaccgttctgtctggatc

SEQ ID NO: 637159 - DNA, 25 bp, Rattus norvegicus
tgggcaggctctcccttgaaaggat

SEQ ID NO: 637160 - DNA, 25 bp, Rattus norvegicus
tgggcaggctctgccttgaaaggat

SEQ ID NO: 637161 - DNA, 25 bp, Rattus norvegicus
tgggcaggctgcaggttgtctaccc

SEQ ID NO: 637162 - DNA, 25 bp, Rattus norvegicus
tgggcaggctgctggttgtctaccc

SEQ ID NO: 637163 - DNA, 25 bp, Rattus norvegicus
tgggcagggacgagtttcctcagca

SEQ ID NO: 637164 - DNA, 25 bp, Rattus norvegicus
tgggcagggacgtgtttcctcagca

SEQ ID NO: 637165 - DNA, 25 bp, Rattus norvegicus
tgggcagggccacctagcattcgct

SEQ ID NO: 637166 - DNA, 25 bp, Rattus norvegicus
tgggcagggccagctagcattcgct

SEQ ID NO: 637167 - DNA, 25 bp, Rattus norvegicus
tgggcagggtaaattccccgcctag

SEQ ID NO: 637168 - DNA, 25 bp, Rattus norvegicus
tgggcagggtaatttccccgcctag

SEQ ID NO: 637169 - DNA, 25 bp, Rattus norvegicus
tgggcaggtctgactagctgtccag

SEQ ID NO: 637170 - DNA, 25 bp, Rattus norvegicus
tgggcaggtctgtctagctgtccag

SEQ ID NO: 637171 - DNA, 25 bp, Rattus norvegicus
tgggcaggtgacagcacctccttga

SEQ ID NO: 637172 - DNA, 25 bp, Rattus norvegicus
tgggcaggtgactgcacctccttga

SEQ ID NO: 637173 - DNA, 25 bp, Rattus norvegicus
tgggcaggtggtatgtccttttcct

SEQ ID NO: 637174 - DNA, 25 bp, Rattus norvegicus
tgggcaggtggtttgtccttttcct

SEQ ID NO: 637175 - DNA, 25 bp, Rattus norvegicus
tgggcagtatgcaaatctcttggta

SEQ ID NO: 637176 - DNA, 25 bp, Rattus norvegicus
tgggcagtatgctaatctcttggta

SEQ ID NO: 637177 - DNA, 25 bp, Rattus norvegicus
tgggcagtatttaaacttgttccaa

SEQ ID NO: 637178 - DNA, 25 bp, Rattus norvegicus
tgggcagtattttaacttgttccaa

SEQ ID NO: 637179 - DNA, 25 bp, Rattus norvegicus
tgggcagtcccacaactttaagagc

SEQ ID NO: 637180 - DNA, 25 bp, Rattus norvegicus
tgggcagtcccagaactttaagagc

SEQ ID NO: 637181 - DNA, 25 bp, Rattus norvegicus
tgggcagtgacaatagcatcctctc

SEQ ID NO: 637182 - DNA, 25 bp, Rattus norvegicus
tgggcagtgacattagcatcctctc

SEQ ID NO: 637183 - DNA, 25 bp, Rattus norvegicus
tgggcagtgcacctaactcacagat

SEQ ID NO: 637184 - DNA, 25 bp, Rattus norvegicus
tgggcagtgcacgtaactcacagat

SEQ ID NO: 637185 - DNA, 25 bp, Rattus norvegicus
tgggcagtgcataatcagactcaat

SEQ ID NO: 637186 - DNA, 25 bp, Rattus norvegicus
tgggcagtgcattatcagactcaat

SEQ ID NO: 637187 - DNA, 25 bp, Rattus norvegicus
tgggcagtgcccacaaggccaaaga

SEQ ID NO: 637188 - DNA, 25 bp, Rattus norvegicus
tgggcagtgccctcaaggccaaaga

SEQ ID NO: 637189 - DNA, 25 bp, Rattus norvegicus
tgggcagtggtcaatttgctcctac

SEQ ID NO: 637190 - DNA, 25 bp, Rattus norvegicus
tgggcagtggtcagttcaccctgag

SEQ ID NO: 637191 - DNA, 25 bp, Rattus norvegicus
tgggcagtggtctatttgctcctac

SEQ ID NO: 637192 - DNA, 25 bp, Rattus norvegicus
tgggcagtggtctgttcaccctgag

SEQ ID NO: 637193 - DNA, 25 bp, Rattus norvegicus
tgggcagtgtggctgacttctttac

SEQ ID NO: 637194 - DNA, 25 bp, Rattus norvegicus
tgggcagtgtgggtgacttctttac

SEQ ID NO: 637195 - DNA, 25 bp, Rattus norvegicus
tgggcagttcctagccccaaacagt

SEQ ID NO: 637196 - DNA, 25 bp, Rattus norvegicus
tgggcagttccttgccccaaacagt

SEQ ID NO: 637197 - DNA, 25 bp, Rattus norvegicus
tgggcagttctccaggtatctcggt

SEQ ID NO: 637198 - DNA, 25 bp, Rattus norvegicus
tgggcagttctcgaggtatctcggt

SEQ ID NO: 637199 - DNA, 25 bp, Rattus norvegicus
tgggcagttgctactcgtgggactt

SEQ ID NO: 637200 - DNA, 25 bp, Rattus norvegicus
tgggcagttgcttctcgtgggactt

SEQ ID NO: 637201 - DNA, 25 bp, Rattus norvegicus
tgggcagtttatcgttttggaattc

SEQ ID NO: 637202 - DNA, 25 bp, Rattus norvegicus
tgggcagtttatggttttggaattc

SEQ ID NO: 637203 - DNA, 25 bp, Rattus norvegicus
tgggcagtttctaggcctggtactc

SEQ ID NO: 637204 - DNA, 25 bp, Rattus norvegicus
tgggcagtttcttggcctggtactc

SEQ ID NO: 637205 - DNA, 25 bp, Rattus norvegicus
tgggcagtttggagtcggcttctac

SEQ ID NO: 637206 - DNA, 25 bp, Rattus norvegicus
tgggcagtttggtgtcggcttctac

SEQ ID NO: 637207 - DNA, 25 bp, Rattus norvegicus
tgggcatacttactctgtctcagga

SEQ ID NO: 637208 - DNA, 25 bp, Rattus norvegicus
tgggcatacttagtctgtctcagga

SEQ ID NO: 637209 - DNA, 25 bp, Rattus norvegicus
tgggcatagatgagtaaacccttat

SEQ ID NO: 637210 - DNA, 25 bp, Rattus norvegicus
tgggcatagatgtgtaaacccttat

SEQ ID NO: 637211 - DNA, 25 bp, Rattus norvegicus
tgggcatattttcagcagtcagtaa

SEQ ID NO: 637212 - DNA, 25 bp, Rattus norvegicus
tgggcatattttgagcagtcagtaa

SEQ ID NO: 637213 - DNA, 25 bp, Rattus norvegicus
tgggcatcacatctgtaaagcaatc

SEQ ID NO: 637214 - DNA, 25 bp, Rattus norvegicus
tgggcatcacatgtgtaaagcaatc

SEQ ID NO: 637215 - DNA, 25 bp, Rattus norvegicus
tgggcatcatatctttctcctacac

SEQ ID NO: 637216 - DNA, 25 bp, Rattus norvegicus
tgggcatcatatgtttctcctacac

SEQ ID NO: 637217 - DNA, 25 bp, Rattus norvegicus
tgggcatcatcgactgtgctgtggt

SEQ ID NO: 637218 - DNA, 25 bp, Rattus norvegicus
tgggcatcatcgtctgtgctgtggt

SEQ ID NO: 637219 - DNA, 25 bp, Rattus norvegicus
tgggcatcatgaacaaccggctggc

SEQ ID NO: 637220 - DNA, 25 bp, Rattus norvegicus
tgggcatcatgatcaaccggctggc

SEQ ID NO: 637221 - DNA, 25 bp, Rattus norvegicus
tgggcatccagccatggacagtaga

SEQ ID NO: 637222 - DNA, 25 bp, Rattus norvegicus
tgggcatccagcgatggacagtaga

SEQ ID NO: 637223 - DNA, 25 bp, Rattus norvegicus
tgggcatccaggatctatcacacag

SEQ ID NO: 637224 - DNA, 25 bp, Rattus norvegicus
tgggcatccaggttctatcacacag

SEQ ID NO: 637225 - DNA, 25 bp, Rattus norvegicus
tgggcatccttaccttgactgactc

SEQ ID NO: 637226 - DNA, 25 bp, Rattus norvegicus
tgggcatccttagcttgactgactc

SEQ ID NO: 637227 - DNA, 25 bp, Rattus norvegicus
tgggcatcgccaacaataattatta

SEQ ID NO: 637228 - DNA, 25 bp, Rattus norvegicus
tgggcatcgccatcaataattatta

SEQ ID NO: 637229 - DNA, 25 bp, Rattus norvegicus
tgggcatcggataccacctgcaggt

SEQ ID NO: 637230 - DNA, 25 bp, Rattus norvegicus
tgggcatcggattccacctgcaggt

SEQ ID NO: 637231 - DNA, 25 bp, Rattus norvegicus
tgggcatcggttaccatctgcagat

SEQ ID NO: 637232 - DNA, 25 bp, Rattus norvegicus
tgggcatcggtttccatctgcagat

SEQ ID NO: 637233 - DNA, 25 bp, Rattus norvegicus
tgggcatctacaccttagcagtaag

SEQ ID NO: 637234 - DNA, 25 bp, Rattus norvegicus
tgggcatctacagcttagcagtaag

SEQ ID NO: 637235 - DNA, 25 bp, Rattus norvegicus
tgggcatctgtcatttccagcagtg

SEQ ID NO: 637236 - DNA, 25 bp, Rattus norvegicus
tgggcatctgtcttttccagcagtg

SEQ ID NO: 637237 - DNA, 25 bp, Rattus norvegicus
tgggcatgaccacaacctgcagtat

SEQ ID NO: 637238 - DNA, 25 bp, Rattus norvegicus
tgggcatgaccagaacctgcagtat

SEQ ID NO: 637239 - DNA, 25 bp, Rattus norvegicus
tgggcatgacttcatttctgtctgt

SEQ ID NO: 637240 - DNA, 25 bp, Rattus norvegicus
tgggcatgacttgatttctgtctgt

SEQ ID NO: 637241 - DNA, 25 bp, Rattus norvegicus
tgggcatgagcaccaaacgaatcaa

SEQ ID NO: 637242 - DNA, 25 bp, Rattus norvegicus
tgggcatgagcagcaaacgaatcaa

SEQ ID NO: 637243 - DNA, 25 bp, Rattus norvegicus
tgggcatgagttagtgagacaaaca

SEQ ID NO: 637244 - DNA, 25 bp, Rattus norvegicus
tgggcatgagtttgtgagacaaaca

SEQ ID NO: 637245 - DNA, 25 bp, Rattus norvegicus
tgggcatgatctccagtgcttgcaa

SEQ ID NO: 637246 - DNA, 25 bp, Rattus norvegicus
tgggcatgatctgcagtgcttgcaa

SEQ ID NO: 637247 - DNA, 25 bp, Rattus norvegicus
tgggcatggcaccacacacctttgg

SEQ ID NO: 637248 - DNA, 25 bp, Rattus norvegicus
tgggcatggcacgacacacctttgg

SEQ ID NO: 637249 - DNA, 25 bp, Rattus norvegicus
tgggcatggcagcacacactcttct

SEQ ID NO: 637250 - DNA, 25 bp, Rattus norvegicus
tgggcatggcaggacacactcttct

SEQ ID NO: 637251 - DNA, 25 bp, Rattus norvegicus
tgggcatgggcacttccagagcacc

SEQ ID NO: 637252 - DNA, 25 bp, Rattus norvegicus
tgggcatgggcagttccagagcacc

SEQ ID NO: 637253 - DNA, 25 bp, Rattus norvegicus
tgggcatgggtcatctggtcaccag

SEQ ID NO: 637254 - DNA, 25 bp, Rattus norvegicus
tgggcatgggtcttctggtcaccag

SEQ ID NO: 637255 - DNA, 25 bp, Rattus norvegicus
tgggcatggtaacccagcctgttat

SEQ ID NO: 637256 - DNA, 25 bp, Rattus norvegicus
tgggcatggtaagccagcctgttat

SEQ ID NO: 637257 - DNA, 25 bp, Rattus norvegicus
tgggcatggtgccagatatctgtaa

SEQ ID NO: 637258 - DNA, 25 bp, Rattus norvegicus
tgggcatggtgcgagatatctgtaa

SEQ ID NO: 637259 - DNA, 25 bp, Rattus norvegicus
tgggcatgtagcagccagccactgg

SEQ ID NO: 637260 - DNA, 25 bp, Rattus norvegicus
tgggcatgtagctgccagccactgg

SEQ ID NO: 637261 - DNA, 25 bp, Rattus norvegicus
tgggcatgtcccaggatcacgggcc

SEQ ID NO: 637262 - DNA, 25 bp, Rattus norvegicus
tgggcatgtccctggatcacgggcc

SEQ ID NO: 637263 - DNA, 25 bp, Rattus norvegicus
tgggcatgtcgcctaacaatataat

SEQ ID NO: 637264 - DNA, 25 bp, Rattus norvegicus
tgggcatgtcgcgtaacaatataat

SEQ ID NO: 637265 - DNA, 25 bp, Rattus norvegicus
tgggcatgtgttcactctggttcac

SEQ ID NO: 637266 - DNA, 25 bp, Rattus norvegicus
tgggcatgtgttgactctggttcac

SEQ ID NO: 637267 - DNA, 25 bp, Rattus norvegicus
tgggcattcactccacagtgatcga

SEQ ID NO: 637268 - DNA, 25 bp, Rattus norvegicus
tgggcattcactgcacagtgatcga

SEQ ID NO: 637269 - DNA, 25 bp, Rattus norvegicus
tgggcattcccaaaaagatcagata

SEQ ID NO: 637270 - DNA, 25 bp, Rattus norvegicus
tgggcattcccataaagatcagata

SEQ ID NO: 637271 - DNA, 25 bp, Rattus norvegicus
tgggcattccgaacttgtcatgaaa

SEQ ID NO: 637272 - DNA, 25 bp, Rattus norvegicus
tgggcattccgacctctgaggaaga

SEQ ID NO: 637273 - DNA, 25 bp, Rattus norvegicus
tgggcattccgagctctgaggaaga

SEQ ID NO: 637274 - DNA, 25 bp, Rattus norvegicus
tgggcattccgatcttgtcatgaaa

SEQ ID NO: 637275 - DNA, 25 bp, Rattus norvegicus
tgggcattctgccatcttggccata

SEQ ID NO: 637276 - DNA, 25 bp, Rattus norvegicus
tgggcattctgcgatcttggccata

SEQ ID NO: 637277 - DNA, 25 bp, Rattus norvegicus
tgggcattctttccgtcacgggaag

SEQ ID NO: 637278 - DNA, 25 bp, Rattus norvegicus
tgggcattctttgcgtcacgggaag

SEQ ID NO: 637279 - DNA, 25 bp, Rattus norvegicus
tgggcattggcaccgaagtcaagtt

SEQ ID NO: 637280 - DNA, 25 bp, Rattus norvegicus
tgggcattggcagcgaagtcaagtt

SEQ ID NO: 637281 - DNA, 25 bp, Rattus norvegicus
tgggcattggttagcaggacttctt

SEQ ID NO: 637282 - DNA, 25 bp, Rattus norvegicus
tgggcattggtttgcaggacttctt

SEQ ID NO: 637283 - DNA, 25 bp, Rattus norvegicus
tgggcattgtggaactttgtagcaa

SEQ ID NO: 637284 - DNA, 25 bp, Rattus norvegicus
tgggcattgtggtactttgtagcaa

SEQ ID NO: 637285 - DNA, 25 bp, Rattus norvegicus
tgggccaaacctctggttcctgtac

SEQ ID NO: 637286 - DNA, 25 bp, Rattus norvegicus
tgggccaaacctgtggttcctgtac

SEQ ID NO: 637287 - DNA, 25 bp, Rattus norvegicus
tgggccaaagctactgttgcggaaa

SEQ ID NO: 637288 - DNA, 25 bp, Rattus norvegicus
tgggccaaagcttctgttgcggaaa

SEQ ID NO: 637289 - DNA, 25 bp, Rattus norvegicus
tgggccaaaggtcgtcccaaggaag

SEQ ID NO: 637290 - DNA, 25 bp, Rattus norvegicus
tgggccaaaggtggtcccaaggaag

SEQ ID NO: 637291 - DNA, 25 bp, Rattus norvegicus
tgggccaaccttcagtggagatact

SEQ ID NO: 637292 - DNA, 25 bp, Rattus norvegicus
tgggccaaccttgagtggagatact

SEQ ID NO: 637293 - DNA, 25 bp, Rattus norvegicus
tgggccaacgacctcgtataaattg

SEQ ID NO: 637294 - DNA, 25 bp, Rattus norvegicus
tgggccaacgacgtcgtataaattg

SEQ ID NO: 637295 - DNA, 25 bp, Rattus norvegicus
tgggccaacgctacgggagattcct

SEQ ID NO: 637296 - DNA, 25 bp, Rattus norvegicus
tgggccaacgcttcgggagattcct

SEQ ID NO: 637297 - DNA, 25 bp, Rattus norvegicus
tgggccaacggccaaattgcttcat

SEQ ID NO: 637298 - DNA, 25 bp, Rattus norvegicus
tgggccaacggcgaaattgcttcat

SEQ ID NO: 637299 - DNA, 25 bp, Rattus norvegicus
tgggccaactcaacccgctgggctg

SEQ ID NO: 637300 - DNA, 25 bp, Rattus norvegicus
tgggccaactcatcccgctgggctg

SEQ ID NO: 637301 - DNA, 25 bp, Rattus norvegicus
tgggccaaggcaaatttcatgttcc

SEQ ID NO: 637302 - DNA, 25 bp, Rattus norvegicus
tgggccaaggcatatttcatgttcc

SEQ ID NO: 637303 - DNA, 25 bp, Rattus norvegicus
tgggccaaggccaggattacttcta

SEQ ID NO: 637304 - DNA, 25 bp, Rattus norvegicus
tgggccaaggcctggattacttcta

SEQ ID NO: 637305 - DNA, 25 bp, Rattus norvegicus
tgggccaaggctcagatcctggtta

SEQ ID NO: 637306 - DNA, 25 bp, Rattus norvegicus
tgggccaaggctgagatcctggtta

SEQ ID NO: 637307 - DNA, 25 bp, Rattus norvegicus
tgggccaataaaaactgccctttcg

SEQ ID NO: 637308 - DNA, 25 bp, Rattus norvegicus
tgggccaataaatactgccctttcg

SEQ ID NO: 637309 - DNA, 25 bp, Rattus norvegicus
tgggccaatcccagaaccgggattt

SEQ ID NO: 637310 - DNA, 25 bp, Rattus norvegicus
tgggccaatccctgaaccgggattt

SEQ ID NO: 637311 - DNA, 25 bp, Rattus norvegicus
tgggccaattccaagagtttctcag

SEQ ID NO: 637312 - DNA, 25 bp, Rattus norvegicus
tgggccaattcctagagtttctcag

SEQ ID NO: 637313 - DNA, 25 bp, Rattus norvegicus
tgggccacagctccaatgcagaaag

SEQ ID NO: 637314 - DNA, 25 bp, Rattus norvegicus
tgggccacagctgcaatgcagaaag

SEQ ID NO: 637315 - DNA, 25 bp, Rattus norvegicus
tgggccacagtacaggacttcagat

SEQ ID NO: 637316 - DNA, 25 bp, Rattus norvegicus
tgggccacagtagaggacttcagat

SEQ ID NO: 637317 - DNA, 25 bp, Rattus norvegicus
tgggccacagttatagcatacatat

SEQ ID NO: 637318 - DNA, 25 bp, Rattus norvegicus
tgggccacagttttagcatacatat

SEQ ID NO: 637319 - DNA, 25 bp, Rattus norvegicus
tgggccacctttcttctgagcaacc

SEQ ID NO: 637320 - DNA, 25 bp, Rattus norvegicus
tgggccacctttgttctgagcaacc

SEQ ID NO: 637321 - DNA, 25 bp, Rattus norvegicus
tgggccacggctcacaggcatgatt

SEQ ID NO: 637322 - DNA, 25 bp, Rattus norvegicus
tgggccacggctgacaggcatgatt

SEQ ID NO: 637323 - DNA, 25 bp, Rattus norvegicus
tgggccacgtagacatttgcatact

SEQ ID NO: 637324 - DNA, 25 bp, Rattus norvegicus
tgggccacgtagtcatttgcatact

SEQ ID NO: 637325 - DNA, 25 bp, Rattus norvegicus
tgggccacgtggatttctagccgtc

SEQ ID NO: 637326 - DNA, 25 bp, Rattus norvegicus
tgggccacgtggttttctagccgtc

SEQ ID NO: 637327 - DNA, 25 bp, Rattus norvegicus
tgggccactcacattagctgtgcag

SEQ ID NO: 637328 - DNA, 25 bp, Rattus norvegicus
tgggccactcactttagctgtgcag

SEQ ID NO: 637329 - DNA, 25 bp, Rattus norvegicus
tgggccactcctcttggagcagctc

SEQ ID NO: 637330 - DNA, 25 bp, Rattus norvegicus
tgggccactcctgttggagcagctc

SEQ ID NO: 637331 - DNA, 25 bp, Rattus norvegicus
tgggccactgccaggaaacagatta

SEQ ID NO: 637332 - DNA, 25 bp, Rattus norvegicus
tgggccactgcctggaaacagatta

SEQ ID NO: 637333 - DNA, 25 bp, Rattus norvegicus
tgggccactgggaccttccagctgc

SEQ ID NO: 637334 - DNA, 25 bp, Rattus norvegicus
tgggccactgggatgcagtcatacc

SEQ ID NO: 637335 - DNA, 25 bp, Rattus norvegicus
tgggccactgggtccttccagctgc

SEQ ID NO: 637336 - DNA, 25 bp, Rattus norvegicus
tgggccactgggttgcagtcatacc

SEQ ID NO: 637337 - DNA, 25 bp, Rattus norvegicus
tgggccacttaaacgaggtctccta

SEQ ID NO: 637338 - DNA, 25 bp, Rattus norvegicus
tgggccacttaatcgaggtctccta

SEQ ID NO: 637339 - DNA, 25 bp, Rattus norvegicus
tgggccacttatctgtcagttcaca

SEQ ID NO: 637340 - DNA, 25 bp, Rattus norvegicus
tgggccacttatgtgtcagttcaca

SEQ ID NO: 637341 - DNA, 25 bp, Rattus norvegicus
tgggccacttttagtttctgcttct

SEQ ID NO: 637342 - DNA, 25 bp, Rattus norvegicus
tgggccactttttgtttctgcttct

SEQ ID NO: 637343 - DNA, 25 bp, Rattus norvegicus
tgggccagagtcatcaaacaaaaag

SEQ ID NO: 637344 - DNA, 25 bp, Rattus norvegicus
tgggccagagtccagccaacactgt

SEQ ID NO: 637345 - DNA, 25 bp, Rattus norvegicus
tgggccagagtcgagccaacactgt

SEQ ID NO: 637346 - DNA, 25 bp, Rattus norvegicus
tgggccagagtcttcaaacaaaaag

SEQ ID NO: 637347 - DNA, 25 bp, Rattus norvegicus
tgggccagatcaacgagggcaagat

SEQ ID NO: 637348 - DNA, 25 bp, Rattus norvegicus
tgggccagatcatcgagggcaagat

SEQ ID NO: 637349 - DNA, 25 bp, Rattus norvegicus
tgggccagcactccgtttttgtaaa

SEQ ID NO: 637350 - DNA, 25 bp, Rattus norvegicus
tgggccagcactgcgtttttgtaaa

SEQ ID NO: 637351 - DNA, 25 bp, Rattus norvegicus
tgggccagctagataccaggagcta

SEQ ID NO: 637352 - DNA, 25 bp, Rattus norvegicus
tgggccagctagttaccaggagcta

SEQ ID NO: 637353 - DNA, 25 bp, Rattus norvegicus
tgggccagctctcaggacatttgct

SEQ ID NO: 637354 - DNA, 25 bp, Rattus norvegicus
tgggccagctctgaggacatttgct

SEQ ID NO: 637355 - DNA, 25 bp, Rattus norvegicus
tgggccagcttacggattacagtga

SEQ ID NO: 637356 - DNA, 25 bp, Rattus norvegicus
tgggccagcttagggattacagtga

SEQ ID NO: 637357 - DNA, 25 bp, Rattus norvegicus
tgggccagcttcattttcgggaaat

SEQ ID NO: 637358 - DNA, 25 bp, Rattus norvegicus
tgggccagcttctttttcgggaaat

SEQ ID NO: 637359 - DNA, 25 bp, Rattus norvegicus
tgggccaggctgagatttcttcttt

SEQ ID NO: 637360 - DNA, 25 bp, Rattus norvegicus
tgggccaggctgtgatttcttcttt

SEQ ID NO: 637361 - DNA, 25 bp, Rattus norvegicus
tgggccaggtctccagcaacattaa

SEQ ID NO: 637362 - DNA, 25 bp, Rattus norvegicus
tgggccaggtctgcagcaacattaa

SEQ ID NO: 637363 - DNA, 25 bp, Rattus norvegicus
tgggccagtcagctgcctttgaatt

SEQ ID NO: 637364 - DNA, 25 bp, Rattus norvegicus
tgggccagtcaggtgcctttgaatt

SEQ ID NO: 637365 - DNA, 25 bp, Rattus norvegicus
tgggccagtccgaggccctgacatt

SEQ ID NO: 637366 - DNA, 25 bp, Rattus norvegicus
tgggccagtccgtggccctgacatt

SEQ ID NO: 637367 - DNA, 25 bp, Rattus norvegicus
tgggccagtgtcacagcaccgataa

SEQ ID NO: 637368 - DNA, 25 bp, Rattus norvegicus
tgggccagtgtctcagcaccgataa

SEQ ID NO: 637369 - DNA, 25 bp, Rattus norvegicus
tgggccagtgttagggaatgaattc

SEQ ID NO: 637370 - DNA, 25 bp, Rattus norvegicus
tgggccagtgtttgggaatgaattc

SEQ ID NO: 637371 - DNA, 25 bp, Rattus norvegicus
tgggccagttctccatgcactgtag

SEQ ID NO: 637372 - DNA, 25 bp, Rattus norvegicus
tgggccagttctgcatgcactgtag

SEQ ID NO: 637373 - DNA, 25 bp, Rattus norvegicus
tgggccatagacagaccttcctaaa

SEQ ID NO: 637374 - DNA, 25 bp, Rattus norvegicus
tgggccatagactgaccttcctaaa

SEQ ID NO: 637375 - DNA, 25 bp, Rattus norvegicus
tgggccatagttcattatcagcttc

SEQ ID NO: 637376 - DNA, 25 bp, Rattus norvegicus
tgggccatagttgattatcagcttc

SEQ ID NO: 637377 - DNA, 25 bp, Rattus norvegicus
tgggccatataaagagacctcggtc

SEQ ID NO: 637378 - DNA, 25 bp, Rattus norvegicus
tgggccatataatgagacctcggtc

SEQ ID NO: 637379 - DNA, 25 bp, Rattus norvegicus
tgggccatcagcaactatgcacgtt

SEQ ID NO: 637380 - DNA, 25 bp, Rattus norvegicus
tgggccatcagctactatgcacgtt

SEQ ID NO: 637381 - DNA, 25 bp, Rattus norvegicus
tgggccatccctatttgaagtgtag

SEQ ID NO: 637382 - DNA, 25 bp, Rattus norvegicus
tgggccatccctttttgaagtgtag

SEQ ID NO: 637383 - DNA, 25 bp, Rattus norvegicus
tgggccatcgtgactggaatgttga

SEQ ID NO: 637384 - DNA, 25 bp, Rattus norvegicus
tgggccatcgtgtctggaatgttga

SEQ ID NO: 637385 - DNA, 25 bp, Rattus norvegicus
tgggccatgaacacattctccacag

SEQ ID NO: 637386 - DNA, 25 bp, Rattus norvegicus
tgggccatgaactcattctccacag

SEQ ID NO: 637387 - DNA, 25 bp, Rattus norvegicus
tgggccatgcaaaagctttgtacgc

SEQ ID NO: 637388 - DNA, 25 bp, Rattus norvegicus
tgggccatgcaatagctttgtacgc

SEQ ID NO: 637389 - DNA, 25 bp, Rattus norvegicus
tgggccatgcatccagtcaaagttt

SEQ ID NO: 637390 - DNA, 25 bp, Rattus norvegicus
tgggccatgcatgcagtcaaagttt

SEQ ID NO: 637391 - DNA, 25 bp, Rattus norvegicus
tgggccatgcctactacagaatctg

SEQ ID NO: 637392 - DNA, 25 bp, Rattus norvegicus
tgggccatgccttctacagaatctg

SEQ ID NO: 637393 - DNA, 25 bp, Rattus norvegicus
tgggccatggacatcctgacctcta

SEQ ID NO: 637394 - DNA, 25 bp, Rattus norvegicus
tgggccatggacttcctgacctcta

SEQ ID NO: 637395 - DNA, 25 bp, Rattus norvegicus
tgggccatggagacagcactgctga

SEQ ID NO: 637396 - DNA, 25 bp, Rattus norvegicus
tgggccatggagtcagcactgctga

SEQ ID NO: 637397 - DNA, 25 bp, Rattus norvegicus
tgggccatggccacttctaataaag

SEQ ID NO: 637398 - DNA, 25 bp, Rattus norvegicus
tgggccatggcctcttctaataaag

SEQ ID NO: 637399 - DNA, 25 bp, Rattus norvegicus
tgggccatggtacacactcacacag

SEQ ID NO: 637400 - DNA, 25 bp, Rattus norvegicus
tgggccatggtagacactcacacag

SEQ ID NO: 637401 - DNA, 25 bp, Rattus norvegicus
tgggccatgtcacaacactgttgca

SEQ ID NO: 637402 - DNA, 25 bp, Rattus norvegicus
tgggccatgtcagaacactgttgca

SEQ ID NO: 637403 - DNA, 25 bp, Rattus norvegicus
tgggccattcccaacaggcagatga

SEQ ID NO: 637404 - DNA, 25 bp, Rattus norvegicus
tgggccattccctacaggcagatga

SEQ ID NO: 637405 - DNA, 25 bp, Rattus norvegicus
tgggccattgcgacagtcactagac

SEQ ID NO: 637406 - DNA, 25 bp, Rattus norvegicus
tgggccattgcgtcagtcactagac

SEQ ID NO: 637407 - DNA, 25 bp, Rattus norvegicus
tgggccatttagaactccgccggaa

SEQ ID NO: 637408 - DNA, 25 bp, Rattus norvegicus
tgggccatttagtactccgccggaa

SEQ ID NO: 637409 - DNA, 25 bp, Rattus norvegicus
tgggccatttggcaaaaccctgcag

SEQ ID NO: 637410 - DNA, 25 bp, Rattus norvegicus
tgggccatttgggaaaaccctgcag

SEQ ID NO: 637411 - DNA, 25 bp, Rattus norvegicus
tgggcccaaataacattaggtagct

SEQ ID NO: 637412 - DNA, 25 bp, Rattus norvegicus
tgggcccaaatatcattaggtagct

SEQ ID NO: 637413 - DNA, 25 bp, Rattus norvegicus
tgggcccaatggagaacaaccgcta

SEQ ID NO: 637414 - DNA, 25 bp, Rattus norvegicus
tgggcccaatggtgaacaaccgcta

SEQ ID NO: 637415 - DNA, 25 bp, Rattus norvegicus
tgggcccacaacatcaaggcaggca

SEQ ID NO: 637416 - DNA, 25 bp, Rattus norvegicus
tgggcccacaacttcaaggcaggca

SEQ ID NO: 637417 - DNA, 25 bp, Rattus norvegicus
tgggcccacataagccagtatgaag

SEQ ID NO: 637418 - DNA, 25 bp, Rattus norvegicus
tgggcccacatatgccagtatgaag

SEQ ID NO: 637419 - DNA, 25 bp, Rattus norvegicus
tgggcccaccaaaataacagcactt

SEQ ID NO: 637420 - DNA, 25 bp, Rattus norvegicus
tgggcccaccaatataacagcactt

SEQ ID NO: 637421 - DNA, 25 bp, Rattus norvegicus
tgggcccactgtcctgtctgtgaga

SEQ ID NO: 637422 - DNA, 25 bp, Rattus norvegicus
tgggcccactgtgctgtctgtgaga

SEQ ID NO: 637423 - DNA, 25 bp, Rattus norvegicus
tgggcccacttcctggtatttacta

SEQ ID NO: 637424 - DNA, 25 bp, Rattus norvegicus
tgggcccacttcgtggtatttacta

SEQ ID NO: 637425 - DNA, 25 bp, Rattus norvegicus
tgggcccagcaacttgagacactga

SEQ ID NO: 637426 - DNA, 25 bp, Rattus norvegicus
tgggcccagcaagttgagacactga

SEQ ID NO: 637427 - DNA, 25 bp, Rattus norvegicus
tgggcccagctccttctcttcaagg

SEQ ID NO: 637428 - DNA, 25 bp, Rattus norvegicus
tgggcccagctcgttctcttcaagg

SEQ ID NO: 637429 - DNA, 25 bp, Rattus norvegicus
tgggcccaggagcacttgtccataa

SEQ ID NO: 637430 - DNA, 25 bp, Rattus norvegicus
tgggcccaggaggacttgtccataa

SEQ ID NO: 637431 - DNA, 25 bp, Rattus norvegicus
tgggcccagggcagagccaaatttt

SEQ ID NO: 637432 - DNA, 25 bp, Rattus norvegicus
tgggcccagggcatatattgccact

SEQ ID NO: 637433 - DNA, 25 bp, Rattus norvegicus
tgggcccagggctgagccaaatttt

SEQ ID NO: 637434 - DNA, 25 bp, Rattus norvegicus
tgggcccagggcttatattgccact

SEQ ID NO: 637435 - DNA, 25 bp, Rattus norvegicus
tgggcccagtccacagtgactcagt

SEQ ID NO: 637436 - DNA, 25 bp, Rattus norvegicus
tgggcccagtcctcagtgactcagt

SEQ ID NO: 637437 - DNA, 25 bp, Rattus norvegicus
tgggcccatgggaggtctcattcca

SEQ ID NO: 637438 - DNA, 25 bp, Rattus norvegicus
tgggcccatgggtggtctcattcca

SEQ ID NO: 637439 - DNA, 25 bp, Rattus norvegicus
tgggcccattacaggacacatgctg

SEQ ID NO: 637440 - DNA, 25 bp, Rattus norvegicus
tgggcccattactggacacatgctg

SEQ ID NO: 637441 - DNA, 25 bp, Rattus norvegicus
tgggccccaatgcagcactggtgaa

SEQ ID NO: 637442 - DNA, 25 bp, Rattus norvegicus
tgggccccaatggagcactggtgaa

SEQ ID NO: 637443 - DNA, 25 bp, Rattus norvegicus
tgggccccacagagtgacgcgtatg

SEQ ID NO: 637444 - DNA, 25 bp, Rattus norvegicus
tgggccccacagtgtgacgcgtatg

SEQ ID NO: 637445 - DNA, 25 bp, Rattus norvegicus
tgggccccaccaaggcagtggacaa

SEQ ID NO: 637446 - DNA, 25 bp, Rattus norvegicus
tgggccccaccatggcagtggacaa

SEQ ID NO: 637447 - DNA, 25 bp, Rattus norvegicus
tgggccccatgtcggctgaccataa

SEQ ID NO: 637448 - DNA, 25 bp, Rattus norvegicus
tgggccccatgtgggctgaccataa

SEQ ID NO: 637449 - DNA, 25 bp, Rattus norvegicus
tgggccccatttactgttcagtgca

SEQ ID NO: 637450 - DNA, 25 bp, Rattus norvegicus
tgggccccattttctgttcagtgca

SEQ ID NO: 637451 - DNA, 25 bp, Rattus norvegicus
tgggccccttacctgggaactcaat

SEQ ID NO: 637452 - DNA, 25 bp, Rattus norvegicus
tgggccccttacgtgggaactcaat

SEQ ID NO: 637453 - DNA, 25 bp, Rattus norvegicus
tgggcccgagtactcaacctcaatg

SEQ ID NO: 637454 - DNA, 25 bp, Rattus norvegicus
tgggcccgagtagtcaacctcaatg

SEQ ID NO: 637455 - DNA, 25 bp, Rattus norvegicus
tgggcccggctcaccagagtctgga

SEQ ID NO: 637456 - DNA, 25 bp, Rattus norvegicus
tgggcccggctctccagagtctgga

SEQ ID NO: 637457 - DNA, 25 bp, Rattus norvegicus
tgggcccggttcactgggaacagca

SEQ ID NO: 637458 - DNA, 25 bp, Rattus norvegicus
tgggcccggttctctgggaacagca

SEQ ID NO: 637459 - DNA, 25 bp, Rattus norvegicus
tgggccctaacaactactacagctt

SEQ ID NO: 637460 - DNA, 25 bp, Rattus norvegicus
tgggccctaacatctactacagctt

SEQ ID NO: 637461 - DNA, 25 bp, Rattus norvegicus
tgggccctacagcacccgggaaaag

SEQ ID NO: 637462 - DNA, 25 bp, Rattus norvegicus
tgggccctacaggacccgggaaaag

SEQ ID NO: 637463 - DNA, 25 bp, Rattus norvegicus
tgggccctagacatcagactcagag

SEQ ID NO: 637464 - DNA, 25 bp, Rattus norvegicus
tgggccctagacttcagactcagag

SEQ ID NO: 637465 - DNA, 25 bp, Rattus norvegicus
tgggccctagttcaagacacctgca

SEQ ID NO: 637466 - DNA, 25 bp, Rattus norvegicus
tgggccctagttgaagacacctgca

SEQ ID NO: 637467 - DNA, 25 bp, Rattus norvegicus
tgggccctatcccagatgttctaca

SEQ ID NO: 637468 - DNA, 25 bp, Rattus norvegicus
tgggccctatccgagatgttctaca

SEQ ID NO: 637469 - DNA, 25 bp, Rattus norvegicus
tgggccctcatacaaatcattctgt

SEQ ID NO: 637470 - DNA, 25 bp, Rattus norvegicus
tgggccctcatagaaatcattctgt

SEQ ID NO: 637471 - DNA, 25 bp, Rattus norvegicus
tgggccctccaacctggagttttct

SEQ ID NO: 637472 - DNA, 25 bp, Rattus norvegicus
tgggccctccaagctggagttttct

SEQ ID NO: 637473 - DNA, 25 bp, Rattus norvegicus
tgggccctccagataatttgacaat

SEQ ID NO: 637474 - DNA, 25 bp, Rattus norvegicus
tgggccctccagttaatttgacaat

SEQ ID NO: 637475 - DNA, 25 bp, Rattus norvegicus
tgggccctccatattataagcctct

SEQ ID NO: 637476 - DNA, 25 bp, Rattus norvegicus
tgggccctccattttataagcctct

SEQ ID NO: 637477 - DNA, 25 bp, Rattus norvegicus
tgggccctgaacatcatcaatgaag

SEQ ID NO: 637478 - DNA, 25 bp, Rattus norvegicus
tgggccctgaacttcatcaatgaag

SEQ ID NO: 637479 - DNA, 25 bp, Rattus norvegicus
tgggccctggagacaccattctgag

SEQ ID NO: 637480 - DNA, 25 bp, Rattus norvegicus
tgggccctggagtcaccattctgag

SEQ ID NO: 637481 - DNA, 25 bp, Rattus norvegicus
tgggccctggatcttactttctata

SEQ ID NO: 637482 - DNA, 25 bp, Rattus norvegicus
tgggccctggatgttactttctata

SEQ ID NO: 637483 - DNA, 25 bp, Rattus norvegicus
tgggccctgtgaaatcagaggctct

SEQ ID NO: 637484 - DNA, 25 bp, Rattus norvegicus
tgggccctgtgaatgctggaaagca

SEQ ID NO: 637485 - DNA, 25 bp, Rattus norvegicus
tgggccctgtgatatcagaggctct

SEQ ID NO: 637486 - DNA, 25 bp, Rattus norvegicus
tgggccctgtgattgctggaaagca

SEQ ID NO: 637487 - DNA, 25 bp, Rattus norvegicus
tgggcccttctgactcacacactca

SEQ ID NO: 637488 - DNA, 25 bp, Rattus norvegicus
tgggcccttctgtctcacacactca

SEQ ID NO: 637489 - DNA, 25 bp, Rattus norvegicus
tgggcccttgcacttggagccttgt

SEQ ID NO: 637490 - DNA, 25 bp, Rattus norvegicus
tgggcccttgcagttggagccttgt

SEQ ID NO: 637491 - DNA, 25 bp, Rattus norvegicus
tgggccctttgcaacctaatgagaa

SEQ ID NO: 637492 - DNA, 25 bp, Rattus norvegicus
tgggccctttgctacctaatgagaa

SEQ ID NO: 637493 - DNA, 25 bp, Rattus norvegicus
tgggcccttttcacgattgcaagat

SEQ ID NO: 637494 - DNA, 25 bp, Rattus norvegicus
tgggcccttttctcgattgcaagat

SEQ ID NO: 637495 - DNA, 25 bp, Rattus norvegicus
tgggccgaagtcaacctggttttag

SEQ ID NO: 637496 - DNA, 25 bp, Rattus norvegicus
tgggccgaagtctacctggttttag

SEQ ID NO: 637497 - DNA, 25 bp, Rattus norvegicus
tgggccgaatgtactacgcgattac

SEQ ID NO: 637498 - DNA, 25 bp, Rattus norvegicus
tgggccgaatgttctacgcgattac

SEQ ID NO: 637499 - DNA, 25 bp, Rattus norvegicus
tgggccgagcaaattctttaaagga

SEQ ID NO: 637500 - DNA, 25 bp, Rattus norvegicus
tgggccgagcaatttctttaaagga

SEQ ID NO: 637501 - DNA, 25 bp, Rattus norvegicus
tgggccgcatccaggtctcgtcgct

SEQ ID NO: 637502 - DNA, 25 bp, Rattus norvegicus
tgggccgcatcctggtctcgtcgct

SEQ ID NO: 637503 - DNA, 25 bp, Rattus norvegicus
tgggccgctattatgccagacataa

SEQ ID NO: 637504 - DNA, 25 bp, Rattus norvegicus
tgggccgctattttgccagacataa

SEQ ID NO: 637505 - DNA, 25 bp, Rattus norvegicus
tgggccgctcctcactagatgtgct

SEQ ID NO: 637506 - DNA, 25 bp, Rattus norvegicus
tgggccgctcctgactagatgtgct

SEQ ID NO: 637507 - DNA, 25 bp, Rattus norvegicus
tgggccggagaaccccgtgcaaaat

SEQ ID NO: 637508 - DNA, 25 bp, Rattus norvegicus
tgggccggagaagcccgtgcaaaat

SEQ ID NO: 637509 - DNA, 25 bp, Rattus norvegicus
tgggccggatgtccagtcgtgtgag

SEQ ID NO: 637510 - DNA, 25 bp, Rattus norvegicus
tgggccggatgtgcagtcgtgtgag

SEQ ID NO: 637511 - DNA, 25 bp, Rattus norvegicus
tgggccggccacagacaacaacggt

SEQ ID NO: 637512 - DNA, 25 bp, Rattus norvegicus
tgggccggccactgacaacaacggt

SEQ ID NO: 637513 - DNA, 25 bp, Rattus norvegicus
tgggccgggtaacactttgcttagt

SEQ ID NO: 637514 - DNA, 25 bp, Rattus norvegicus
tgggccgggtaagactttgcttagt

SEQ ID NO: 637515 - DNA, 25 bp, Rattus norvegicus
tgggccgggtatcccacttgttcct

SEQ ID NO: 637516 - DNA, 25 bp, Rattus norvegicus
tgggccgggtatgccacttgttcct

SEQ ID NO: 637517 - DNA, 25 bp, Rattus norvegicus
tgggccgtcatccttatgggaaatc

SEQ ID NO: 637518 - DNA, 25 bp, Rattus norvegicus
tgggccgtcatcgttatgggaaatc

SEQ ID NO: 637519 - DNA, 25 bp, Rattus norvegicus
tgggccgtctgtctcagtggtttcc

SEQ ID NO: 637520 - DNA, 25 bp, Rattus norvegicus
tgggccgtctgtgtcagtggtttcc

SEQ ID NO: 637521 - DNA, 25 bp, Rattus norvegicus
tgggccgttagcactggacagatgt

SEQ ID NO: 637522 - DNA, 25 bp, Rattus norvegicus
tgggccgttagctctggacagatgt

SEQ ID NO: 637523 - DNA, 25 bp, Rattus norvegicus
tgggccgttcaaccagacaggacct

SEQ ID NO: 637524 - DNA, 25 bp, Rattus norvegicus
tgggccgttcaagcagacaggacct

SEQ ID NO: 637525 - DNA, 25 bp, Rattus norvegicus
tgggcctaaaaaatgttaatttcat

SEQ ID NO: 637526 - DNA, 25 bp, Rattus norvegicus
tgggcctaaaaattgttaatttcat

SEQ ID NO: 637527 - DNA, 25 bp, Rattus norvegicus
tgggcctaaggccatgggttctcat

SEQ ID NO: 637528 - DNA, 25 bp, Rattus norvegicus
tgggcctaaggcgatgggttctcat

SEQ ID NO: 637529 - DNA, 25 bp, Rattus norvegicus
tgggcctagaccacggagccttggc

SEQ ID NO: 637530 - DNA, 25 bp, Rattus norvegicus
tgggcctagacctcggagccttggc

SEQ ID NO: 637531 - DNA, 25 bp, Rattus norvegicus
tgggcctagagccagcacaggtcat

SEQ ID NO: 637532 - DNA, 25 bp, Rattus norvegicus
tgggcctagagcgagcacaggtcat

SEQ ID NO: 637533 - DNA, 25 bp, Rattus norvegicus
tgggcctcaggtcattcagttcagg

SEQ ID NO: 637534 - DNA, 25 bp, Rattus norvegicus
tgggcctcaggtgattcagttcagg

SEQ ID NO: 637535 - DNA, 25 bp, Rattus norvegicus
tgggcctcagtccatgcagaccagt

SEQ ID NO: 637536 - DNA, 25 bp, Rattus norvegicus
tgggcctcagtcgatgcagaccagt

SEQ ID NO: 637537 - DNA, 25 bp, Rattus norvegicus
tgggcctcagttctcagaagcagcc

SEQ ID NO: 637538 - DNA, 25 bp, Rattus norvegicus
tgggcctcagttgtcagaagcagcc

SEQ ID NO: 637539 - DNA, 25 bp, Rattus norvegicus
tgggcctcatgcctagaattctcag

SEQ ID NO: 637540 - DNA, 25 bp, Rattus norvegicus
tgggcctcatgcgtagaattctcag

SEQ ID NO: 637541 - DNA, 25 bp, Rattus norvegicus
tgggcctcattcagccaaagctgga

SEQ ID NO: 637542 - DNA, 25 bp, Rattus norvegicus
tgggcctcattctgccaaagctgga

SEQ ID NO: 637543 - DNA, 25 bp, Rattus norvegicus
tgggcctcccatagaggactgcaga

SEQ ID NO: 637544 - DNA, 25 bp, Rattus norvegicus
tgggcctcccattgaggactgcaga

SEQ ID NO: 637545 - DNA, 25 bp, Rattus norvegicus
tgggcctccgttaacatgtgcacac

SEQ ID NO: 637546 - DNA, 25 bp, Rattus norvegicus
tgggcctccgtttacatgtgcacac

SEQ ID NO: 637547 - DNA, 25 bp, Rattus norvegicus
tgggcctcctccaagtgaatgagaa

SEQ ID NO: 637548 - DNA, 25 bp, Rattus norvegicus
tgggcctcctcctagtgaatgagaa

SEQ ID NO: 637549 - DNA, 25 bp, Rattus norvegicus
tgggcctcgggaaccagacagatgc

SEQ ID NO: 637550 - DNA, 25 bp, Rattus norvegicus
tgggcctcgggatccagacagatgc

SEQ ID NO: 637551 - DNA, 25 bp, Rattus norvegicus
tgggcctcgggcatagaagccaaaa

SEQ ID NO: 637552 - DNA, 25 bp, Rattus norvegicus
tgggcctcgggcttagaagccaaaa

SEQ ID NO: 637553 - DNA, 25 bp, Rattus norvegicus
tgggcctctaccatttttcagaaag

SEQ ID NO: 637554 - DNA, 25 bp, Rattus norvegicus
tgggcctctaccttttttcagaaag

SEQ ID NO: 637555 - DNA, 25 bp, Rattus norvegicus
tgggcctctaggcagagtgctctac

SEQ ID NO: 637556 - DNA, 25 bp, Rattus norvegicus
tgggcctctagggagagtgctctac

SEQ ID NO: 637557 - DNA, 25 bp, Rattus norvegicus
tgggcctctcttacttcaatagcat

SEQ ID NO: 637558 - DNA, 25 bp, Rattus norvegicus
tgggcctctctttcttcaatagcat

SEQ ID NO: 637559 - DNA, 25 bp, Rattus norvegicus
tgggcctctgcaaaccttaatgaca

SEQ ID NO: 637560 - DNA, 25 bp, Rattus norvegicus
tgggcctctgcataccttaatgaca

SEQ ID NO: 637561 - DNA, 25 bp, Rattus norvegicus
tgggcctctggtacctctacattct

SEQ ID NO: 637562 - DNA, 25 bp, Rattus norvegicus
tgggcctctggttcctctacattct

SEQ ID NO: 637563 - DNA, 25 bp, Rattus norvegicus
tgggcctcttcacattcctaaaaat

SEQ ID NO: 637564 - DNA, 25 bp, Rattus norvegicus
tgggcctcttcagattcctaaaaat

SEQ ID NO: 637565 - DNA, 25 bp, Rattus norvegicus
tgggcctctttacaaaaaccacaga

SEQ ID NO: 637566 - DNA, 25 bp, Rattus norvegicus
tgggcctctttagaaaaaccacaga

SEQ ID NO: 637567 - DNA, 25 bp, Rattus norvegicus
tgggcctgaccaaagatcctaccta

SEQ ID NO: 637568 - DNA, 25 bp, Rattus norvegicus
tgggcctgaccatagatcctaccta

SEQ ID NO: 637569 - DNA, 25 bp, Rattus norvegicus
tgggcctgattaatgccacacagag

SEQ ID NO: 637570 - DNA, 25 bp, Rattus norvegicus
tgggcctgattattgccacacagag

SEQ ID NO: 637571 - DNA, 25 bp, Rattus norvegicus
tgggcctgcactagcctttataagt

SEQ ID NO: 637572 - DNA, 25 bp, Rattus norvegicus
tgggcctgcacttgcctttataagt

SEQ ID NO: 637573 - DNA, 25 bp, Rattus norvegicus
tgggcctgcagtatgccttgataga

SEQ ID NO: 637574 - DNA, 25 bp, Rattus norvegicus
tgggcctgcagtttgccttgataga

SEQ ID NO: 637575 - DNA, 25 bp, Rattus norvegicus
tgggcctgcatcacagagcacgcta

SEQ ID NO: 637576 - DNA, 25 bp, Rattus norvegicus
tgggcctgcatctcagagcacgcta

SEQ ID NO: 637577 - DNA, 25 bp, Rattus norvegicus
tgggcctgctccacctatgtgagag

SEQ ID NO: 637578 - DNA, 25 bp, Rattus norvegicus
tgggcctgctcctcctatgtgagag

SEQ ID NO: 637579 - DNA, 25 bp, Rattus norvegicus
tgggcctggccaagaaactgcaaag

SEQ ID NO: 637580 - DNA, 25 bp, Rattus norvegicus
tgggcctggccatgaaactgcaaag

SEQ ID NO: 637581 - DNA, 25 bp, Rattus norvegicus
tgggcctggccgaacaccaactgcg

SEQ ID NO: 637582 - DNA, 25 bp, Rattus norvegicus
tgggcctggccgtacaccaactgcg

SEQ ID NO: 637583 - DNA, 25 bp, Rattus norvegicus
tgggcctggctgacaaccctctgaa

SEQ ID NO: 637584 - DNA, 25 bp, Rattus norvegicus
tgggcctggctgtcaaccctctgaa

SEQ ID NO: 637585 - DNA, 25 bp, Rattus norvegicus
tgggcctgggcaactccttctgaaa

SEQ ID NO: 637586 - DNA, 25 bp, Rattus norvegicus
tgggcctgggcatctccttctgaaa

SEQ ID NO: 637587 - DNA, 25 bp, Rattus norvegicus
tgggcctgggtaaagagtcacattg

SEQ ID NO: 637588 - DNA, 25 bp, Rattus norvegicus
tgggcctgggtatagagtcacattg

SEQ ID NO: 637589 - DNA, 25 bp, Rattus norvegicus
tgggcctggtaaactcagcatgcgg

SEQ ID NO: 637590 - DNA, 25 bp, Rattus norvegicus
tgggcctggtaatctcagcatgcgg

SEQ ID NO: 637591 - DNA, 25 bp, Rattus norvegicus
tgggcctggtagcaaccatcttctg

SEQ ID NO: 637592 - DNA, 25 bp, Rattus norvegicus
tgggcctggtaggaaccatcttctg

SEQ ID NO: 637593 - DNA, 25 bp, Rattus norvegicus
tgggcctgtcctacacgggcccgga

SEQ ID NO: 637594 - DNA, 25 bp, Rattus norvegicus
tgggcctgtccttcacgggcccgga

SEQ ID NO: 637595 - DNA, 25 bp, Rattus norvegicus
tgggcctgtggaatctgctgtccaa

SEQ ID NO: 637596 - DNA, 25 bp, Rattus norvegicus
tgggcctgtggattctgctgtccaa

SEQ ID NO: 637597 - DNA, 25 bp, Rattus norvegicus
tgggccttaatcacagcgcttgctg

SEQ ID NO: 637598 - DNA, 25 bp, Rattus norvegicus
tgggccttaatctcagcgcttgctg

SEQ ID NO: 637599 - DNA, 25 bp, Rattus norvegicus
tgggccttcgtgcatcagccattat

SEQ ID NO: 637600 - DNA, 25 bp, Rattus norvegicus
tgggccttcgtggatcagccattat

SEQ ID NO: 637601 - DNA, 25 bp, Rattus norvegicus
tgggccttcttgaagcctcaggaaa

SEQ ID NO: 637602 - DNA, 25 bp, Rattus norvegicus
tgggccttcttgtagcctcaggaaa

SEQ ID NO: 637603 - DNA, 25 bp, Rattus norvegicus
tgggccttgccgatgtaggatttaa

SEQ ID NO: 637604 - DNA, 25 bp, Rattus norvegicus
tgggccttgccgttgtaggatttaa

SEQ ID NO: 637605 - DNA, 25 bp, Rattus norvegicus
tgggccttggcaatgtagagaagaa

SEQ ID NO: 637606 - DNA, 25 bp, Rattus norvegicus
tgggccttggcattgtagagaagaa

SEQ ID NO: 637607 - DNA, 25 bp, Rattus norvegicus
tgggccttggtgactagtccttcca

SEQ ID NO: 637608 - DNA, 25 bp, Rattus norvegicus
tgggccttggtgtctagtccttcca

SEQ ID NO: 637609 - DNA, 25 bp, Rattus norvegicus
tgggcctttaagagggagctttttg

SEQ ID NO: 637610 - DNA, 25 bp, Rattus norvegicus
tgggcctttaagtgggagctttttg

SEQ ID NO: 637611 - DNA, 25 bp, Rattus norvegicus
tgggcctttcgaccactagaacaaa

SEQ ID NO: 637612 - DNA, 25 bp, Rattus norvegicus
tgggcctttcgagcactagaacaaa

SEQ ID NO: 637613 - DNA, 25 bp, Rattus norvegicus
tgggcctttctcagaagactgtaat

SEQ ID NO: 637614 - DNA, 25 bp, Rattus norvegicus
tgggcctttctctgaagactgtaat

SEQ ID NO: 637615 - DNA, 25 bp, Rattus norvegicus
tgggcctttgccatcgaaaaaatag

SEQ ID NO: 637616 - DNA, 25 bp, Rattus norvegicus
tgggcctttgccttcgaaaaaatag

SEQ ID NO: 637617 - DNA, 25 bp, Rattus norvegicus
tgggccttttagcactccatcttga

SEQ ID NO: 637618 - DNA, 25 bp, Rattus norvegicus
tgggccttttaggactccatcttga

SEQ ID NO: 637619 - DNA, 25 bp, Rattus norvegicus
tgggcctttttcaagtgctttggct

SEQ ID NO: 637620 - DNA, 25 bp, Rattus norvegicus
tgggcctttttctagtgctttggct

SEQ ID NO: 637621 - DNA, 25 bp, Rattus norvegicus
tgggccttttttcggcacagaggaa

SEQ ID NO: 637622 - DNA, 25 bp, Rattus norvegicus
tgggccttttttgggcacagaggaa

SEQ ID NO: 637623 - DNA, 25 bp, Rattus norvegicus
tgggcgaaagcccagaactcctgac

SEQ ID NO: 637624 - DNA, 25 bp, Rattus norvegicus
tgggcgaaagccgagaactcctgac

SEQ ID NO: 637625 - DNA, 25 bp, Rattus norvegicus
tgggcgaacacgatgggccgcttct

SEQ ID NO: 637626 - DNA, 25 bp, Rattus norvegicus
tgggcgaacacgttgggccgcttct

SEQ ID NO: 637627 - DNA, 25 bp, Rattus norvegicus
tgggcgaaggtgctctcattgcctt

SEQ ID NO: 637628 - DNA, 25 bp, Rattus norvegicus
tgggcgaaggtggtctcattgcctt

SEQ ID NO: 637629 - DNA, 25 bp, Rattus norvegicus
tgggcgaatcttctgacctcacctt

SEQ ID NO: 637630 - DNA, 25 bp, Rattus norvegicus
tgggcgaatcttgtgacctcacctt

SEQ ID NO: 637631 - DNA, 25 bp, Rattus norvegicus
tgggcgacacaacgagaccctggat

SEQ ID NO: 637632 - DNA, 25 bp, Rattus norvegicus
tgggcgacacaaggagaccctggat

SEQ ID NO: 637633 - DNA, 25 bp, Rattus norvegicus
tgggcgacactaacttgctatcatc

SEQ ID NO: 637634 - DNA, 25 bp, Rattus norvegicus
tgggcgacactatcttgctatcatc

SEQ ID NO: 637635 - DNA, 25 bp, Rattus norvegicus
tgggcgacagccactaaagcctctt

SEQ ID NO: 637636 - DNA, 25 bp, Rattus norvegicus
tgggcgacagcctctaaagcctctt

SEQ ID NO: 637637 - DNA, 25 bp, Rattus norvegicus
tgggcgacagctccaatcctgacca

SEQ ID NO: 637638 - DNA, 25 bp, Rattus norvegicus
tgggcgacagctgcaatcctgacca

SEQ ID NO: 637639 - DNA, 25 bp, Rattus norvegicus
tgggcgactaccagctccgtggtta

SEQ ID NO: 637640 - DNA, 25 bp, Rattus norvegicus
tgggcgactacctgctccgtggtta

SEQ ID NO: 637641 - DNA, 25 bp, Rattus norvegicus
tgggcgagacccacaggactgagtt

SEQ ID NO: 637642 - DNA, 25 bp, Rattus norvegicus
tgggcgagaccctcaggactgagtt

SEQ ID NO: 637643 - DNA, 25 bp, Rattus norvegicus
tgggcgatcagactccctaagacgt

SEQ ID NO: 637644 - DNA, 25 bp, Rattus norvegicus
tgggcgatcagagtccctaagacgt

SEQ ID NO: 637645 - DNA, 25 bp, Rattus norvegicus
tgggcgattctgagccgagccgttt

SEQ ID NO: 637646 - DNA, 25 bp, Rattus norvegicus
tgggcgattctgtgccgagccgttt

SEQ ID NO: 637647 - DNA, 25 bp, Rattus norvegicus
tgggcgcagtcaccgggtgcgggcg

SEQ ID NO: 637648 - DNA, 25 bp, Rattus norvegicus
tgggcgcagtcagcgggtgcgggcg

SEQ ID NO: 637649 - DNA, 25 bp, Rattus norvegicus
tgggcgcatgttatcatcactgaat

SEQ ID NO: 637650 - DNA, 25 bp, Rattus norvegicus
tgggcgcatgttttcatcactgaat

SEQ ID NO: 637651 - DNA, 25 bp, Rattus norvegicus
tgggcgccagggaatgctcaccaac

SEQ ID NO: 637652 - DNA, 25 bp, Rattus norvegicus
tgggcgccagggtatgctcaccaac

SEQ ID NO: 637653 - DNA, 25 bp, Rattus norvegicus
tgggcgcccgacctgttacgcgggt

SEQ ID NO: 637654 - DNA, 25 bp, Rattus norvegicus
tgggcgcccgacgtgttacgcgggt

SEQ ID NO: 637655 - DNA, 25 bp, Rattus norvegicus
tgggcgccctcactagtattttatg

SEQ ID NO: 637656 - DNA, 25 bp, Rattus norvegicus
tgggcgccctcagtagtattttatg

SEQ ID NO: 637657 - DNA, 25 bp, Rattus norvegicus
tgggcgccgactccactttgagaag

SEQ ID NO: 637658 - DNA, 25 bp, Rattus norvegicus
tgggcgccgactgcactttgagaag

SEQ ID NO: 637659 - DNA, 25 bp, Rattus norvegicus
tgggcgcgctgccagaatcctgtct

SEQ ID NO: 637660 - DNA, 25 bp, Rattus norvegicus
tgggcgcgctgcgagaatcctgtct

SEQ ID NO: 637661 - DNA, 25 bp, Rattus norvegicus
tgggcgctacatcctcacgagggat

SEQ ID NO: 637662 - DNA, 25 bp, Rattus norvegicus
tgggcgctacatgctcacgagggat

SEQ ID NO: 637663 - DNA, 25 bp, Rattus norvegicus
tgggcgctcactactagcttagctg

SEQ ID NO: 637664 - DNA, 25 bp, Rattus norvegicus
tgggcgctcacttctagcttagctg

SEQ ID NO: 637665 - DNA, 25 bp, Rattus norvegicus
tgggcgctcaggaaacacaggcatt

SEQ ID NO: 637666 - DNA, 25 bp, Rattus norvegicus
tgggcgctcaggtaacacaggcatt

SEQ ID NO: 637667 - DNA, 25 bp, Rattus norvegicus
tgggcggaccaacccacagtggcat

SEQ ID NO: 637668 - DNA, 25 bp, Rattus norvegicus
tgggcggaccaagccacagtggcat

SEQ ID NO: 637669 - DNA, 25 bp, Rattus norvegicus
tgggcggagccacattttaaacaaa

SEQ ID NO: 637670 - DNA, 25 bp, Rattus norvegicus
tgggcggagccagattttaaacaaa

SEQ ID NO: 637671 - DNA, 25 bp, Rattus norvegicus
tgggcggagttcacagctctatacg

SEQ ID NO: 637672 - DNA, 25 bp, Rattus norvegicus
tgggcggagttctcagctctatacg

SEQ ID NO: 637673 - DNA, 25 bp, Rattus norvegicus
tgggcggcacacacaggtacatctg

SEQ ID NO: 637674 - DNA, 25 bp, Rattus norvegicus
tgggcggcacactcaggtacatctg

SEQ ID NO: 637675 - DNA, 25 bp, Rattus norvegicus
tgggcggcagaacgcgtttctccta

SEQ ID NO: 637676 - DNA, 25 bp, Rattus norvegicus
tgggcggcagaaggcgtttctccta

SEQ ID NO: 637677 - DNA, 25 bp, Rattus norvegicus
tgggcggcattgcttctgcagcatc

SEQ ID NO: 637678 - DNA, 25 bp, Rattus norvegicus
tgggcggcattggttctgcagcatc

SEQ ID NO: 637679 - DNA, 25 bp, Rattus norvegicus
tgggcggcctcaatttcccctggat

SEQ ID NO: 637680 - DNA, 25 bp, Rattus norvegicus
tgggcggcctcattttcccctggat

SEQ ID NO: 637681 - DNA, 25 bp, Rattus norvegicus
tgggcggcgcctactacctgaagca

SEQ ID NO: 637682 - DNA, 25 bp, Rattus norvegicus
tgggcggcgccttctacctgaagca

SEQ ID NO: 637683 - DNA, 25 bp, Rattus norvegicus
tgggcgggaactacctgccaaagac

SEQ ID NO: 637684 - DNA, 25 bp, Rattus norvegicus
tgggcgggaacttcctgccaaagac

SEQ ID NO: 637685 - DNA, 25 bp, Rattus norvegicus
tgggcgggccttcgtctttgttctc

SEQ ID NO: 637686 - DNA, 25 bp, Rattus norvegicus
tgggcgggccttggtctttgttctc

SEQ ID NO: 637687 - DNA, 25 bp, Rattus norvegicus
tgggcgggcggtctttaatccacct

SEQ ID NO: 637688 - DNA, 25 bp, Rattus norvegicus
tgggcgggcggtgtttaatccacct

SEQ ID NO: 637689 - DNA, 25 bp, Rattus norvegicus
tgggcgggctggattttccaatatt

SEQ ID NO: 637690 - DNA, 25 bp, Rattus norvegicus
tgggcgggctggtttttccaatatt

SEQ ID NO: 637691 - DNA, 25 bp, Rattus norvegicus
tgggcgggcttgaaatttctcatct

SEQ ID NO: 637692 - DNA, 25 bp, Rattus norvegicus
tgggcgggcttgtaatttctcatct

SEQ ID NO: 637693 - DNA, 25 bp, Rattus norvegicus
tgggcggtatgactggttttcacat

SEQ ID NO: 637694 - DNA, 25 bp, Rattus norvegicus
tgggcggtatgagtggttttcacat

SEQ ID NO: 637695 - DNA, 25 bp, Rattus norvegicus
tgggcgtcctttctcatttaaaaat

SEQ ID NO: 637696 - DNA, 25 bp, Rattus norvegicus
tgggcgtcctttgtcatttaaaaat

SEQ ID NO: 637697 - DNA, 25 bp, Rattus norvegicus
tgggcgtctcttccattggaaacag

SEQ ID NO: 637698 - DNA, 25 bp, Rattus norvegicus
tgggcgtctcttgcattggaaacag

SEQ ID NO: 637699 - DNA, 25 bp, Rattus norvegicus
tgggcgtctgaaatgggcaacctcc

SEQ ID NO: 637700 - DNA, 25 bp, Rattus norvegicus
tgggcgtctgaattgggcaacctcc

SEQ ID NO: 637701 - DNA, 25 bp, Rattus norvegicus
tgggcgtctgagacagctgccatga

SEQ ID NO: 637702 - DNA, 25 bp, Rattus norvegicus
tgggcgtctgagtcagctgccatga

SEQ ID NO: 637703 - DNA, 25 bp, Rattus norvegicus
tgggcgtgatgcagttcaacgacat

SEQ ID NO: 637704 - DNA, 25 bp, Rattus norvegicus
tgggcgtgatgctgttcaacgacat

SEQ ID NO: 637705 - DNA, 25 bp, Rattus norvegicus
tgggcgtgctttcttacatactcgt

SEQ ID NO: 637706 - DNA, 25 bp, Rattus norvegicus
tgggcgtgctttgttacatactcgt

SEQ ID NO: 637707 - DNA, 25 bp, Rattus norvegicus
tgggcgtggtgtactacgtcaacaa

SEQ ID NO: 637708 - DNA, 25 bp, Rattus norvegicus
tgggcgtggtgttctacgtcaacaa

SEQ ID NO: 637709 - DNA, 25 bp, Rattus norvegicus
tgggcgttcctcagccaaagcacat

SEQ ID NO: 637710 - DNA, 25 bp, Rattus norvegicus
tgggcgttcctctgccaaagcacat

SEQ ID NO: 637711 - DNA, 25 bp, Rattus norvegicus
tgggcgttgtgtccatagcagtcta

SEQ ID NO: 637712 - DNA, 25 bp, Rattus norvegicus
tgggcgttgtgtgcatagcagtcta

SEQ ID NO: 637713 - DNA, 25 bp, Rattus norvegicus
tgggctaaaaatcctcgcttgtgca

SEQ ID NO: 637714 - DNA, 25 bp, Rattus norvegicus
tgggctaaaaatgctcgcttgtgca

SEQ ID NO: 637715 - DNA, 25 bp, Rattus norvegicus
tgggctaaaatcaatccaccttttt

SEQ ID NO: 637716 - DNA, 25 bp, Rattus norvegicus
tgggctaaaatctatccaccttttt

SEQ ID NO: 637717 - DNA, 25 bp, Rattus norvegicus
tgggctaaacataatttgttcgttt

SEQ ID NO: 637718 - DNA, 25 bp, Rattus norvegicus
tgggctaaacattatttgttcgttt

SEQ ID NO: 637719 - DNA, 25 bp, Rattus norvegicus
tgggctaaagagaactgagctaagt

SEQ ID NO: 637720 - DNA, 25 bp, Rattus norvegicus
tgggctaaagagtactgagctaagt

SEQ ID NO: 637721 - DNA, 25 bp, Rattus norvegicus
tgggctaaatgcaggtatacttctc

SEQ ID NO: 637722 - DNA, 25 bp, Rattus norvegicus
tgggctaaatgctggtatacttctc

SEQ ID NO: 637723 - DNA, 25 bp, Rattus norvegicus
tgggctaaggagaaacctccctcat

SEQ ID NO: 637724 - DNA, 25 bp, Rattus norvegicus
tgggctaaggagtaacctccctcat

SEQ ID NO: 637725 - DNA, 25 bp, Rattus norvegicus
tgggctacaaaaagagctccaggcc

SEQ ID NO: 637726 - DNA, 25 bp, Rattus norvegicus
tgggctacaaaatgagctccaggcc

SEQ ID NO: 637727 - DNA, 25 bp, Rattus norvegicus
tgggctacaaagacctggccgccat

SEQ ID NO: 637728 - DNA, 25 bp, Rattus norvegicus
tgggctacaaagtcctggccgccat

SEQ ID NO: 637729 - DNA, 25 bp, Rattus norvegicus
tgggctacaagcagcatggacgcac

SEQ ID NO: 637730 - DNA, 25 bp, Rattus norvegicus
tgggctacaagctgcatggacgcac

SEQ ID NO: 637731 - DNA, 25 bp, Rattus norvegicus
tgggctacacaaaggcaaactggca

SEQ ID NO: 637732 - DNA, 25 bp, Rattus norvegicus
tgggctacacaatggcaaactggca

SEQ ID NO: 637733 - DNA, 25 bp, Rattus norvegicus
tgggctacaggacctggcagccaca

SEQ ID NO: 637734 - DNA, 25 bp, Rattus norvegicus
tgggctacaggagctggcagccaca

SEQ ID NO: 637735 - DNA, 25 bp, Rattus norvegicus
tgggctacatacagcgtgtgactat

SEQ ID NO: 637736 - DNA, 25 bp, Rattus norvegicus
tgggctacatactgcgtgtgactat

SEQ ID NO: 637737 - DNA, 25 bp, Rattus norvegicus
tgggctacatcactggctactacgt

SEQ ID NO: 637738 - DNA, 25 bp, Rattus norvegicus
tgggctacatcagtggctactacgt

SEQ ID NO: 637739 - DNA, 25 bp, Rattus norvegicus
tgggctacatgacagaaccagtctg

SEQ ID NO: 637740 - DNA, 25 bp, Rattus norvegicus
tgggctacatgagagaaccagtctg

SEQ ID NO: 637741 - DNA, 25 bp, Rattus norvegicus
tgggctaccagcatcagcaatgact

SEQ ID NO: 637742 - DNA, 25 bp, Rattus norvegicus
tgggctaccagcttcagcaatgact

SEQ ID NO: 637743 - DNA, 25 bp, Rattus norvegicus
tgggctaccgagactgagcttcgat

SEQ ID NO: 637744 - DNA, 25 bp, Rattus norvegicus
tgggctaccgagtctgagcttcgat

SEQ ID NO: 637745 - DNA, 25 bp, Rattus norvegicus
tgggctacgcagatctggccggcat

SEQ ID NO: 637746 - DNA, 25 bp, Rattus norvegicus
tgggctacgcagttctggccggcat

SEQ ID NO: 637747 - DNA, 25 bp, Rattus norvegicus
tgggctactacaatctctacttcct

SEQ ID NO: 637748 - DNA, 25 bp, Rattus norvegicus
tgggctactacattctctacttcct

SEQ ID NO: 637749 - DNA, 25 bp, Rattus norvegicus
tgggctactcacattgcataactgt

SEQ ID NO: 637750 - DNA, 25 bp, Rattus norvegicus
tgggctactcactttgcataactgt

SEQ ID NO: 637751 - DNA, 25 bp, Rattus norvegicus
tgggctactctgaaagttgtgcaaa

SEQ ID NO: 637752 - DNA, 25 bp, Rattus norvegicus
tgggctactctgtaagttgtgcaaa

SEQ ID NO: 637753 - DNA, 25 bp, Rattus norvegicus
tgggctacttagcaacaaaccgtta

SEQ ID NO: 637754 - DNA, 25 bp, Rattus norvegicus
tgggctacttaggaacaaaccgtta

SEQ ID NO: 637755 - DNA, 25 bp, Rattus norvegicus
tgggctagacacctaatcttggctg

SEQ ID NO: 637756 - DNA, 25 bp, Rattus norvegicus
tgggctagacacgtaatcttggctg

SEQ ID NO: 637757 - DNA, 25 bp, Rattus norvegicus
tgggctagagcaatactatctaaat

SEQ ID NO: 637758 - DNA, 25 bp, Rattus norvegicus
tgggctagagcattactatctaaat

SEQ ID NO: 637759 - DNA, 25 bp, Rattus norvegicus
tgggctagaggacacgacagtattc

SEQ ID NO: 637760 - DNA, 25 bp, Rattus norvegicus
tgggctagaggagacgacagtattc

SEQ ID NO: 637761 - DNA, 25 bp, Rattus norvegicus
tgggctagcattactggaccttctc

SEQ ID NO: 637762 - DNA, 25 bp, Rattus norvegicus
tgggctagcatttctggaccttctc

SEQ ID NO: 637763 - DNA, 25 bp, Rattus norvegicus
tgggctagtagtcaaatccccgctg

SEQ ID NO: 637764 - DNA, 25 bp, Rattus norvegicus
tgggctagtagtgaaatccccgctg

SEQ ID NO: 637765 - DNA, 25 bp, Rattus norvegicus
tgggctatcagtagactgtccacac

SEQ ID NO: 637766 - DNA, 25 bp, Rattus norvegicus
tgggctatcagttgactgtccacac

SEQ ID NO: 637767 - DNA, 25 bp, Rattus norvegicus
tgggctatccagactttcggacagg

SEQ ID NO: 637768 - DNA, 25 bp, Rattus norvegicus
tgggctatccagtctttcggacagg

SEQ ID NO: 637769 - DNA, 25 bp, Rattus norvegicus
tgggctatgcttaaagctccattga

SEQ ID NO: 637770 - DNA, 25 bp, Rattus norvegicus
tgggctatgctttaagctccattga

SEQ ID NO: 637771 - DNA, 25 bp, Rattus norvegicus
tgggctattcccagtcttgtttcca

SEQ ID NO: 637772 - DNA, 25 bp, Rattus norvegicus
tgggctattccctgtcttgtttcca

SEQ ID NO: 637773 - DNA, 25 bp, Rattus norvegicus
tgggctattctgaaatcacctctcc

SEQ ID NO: 637774 - DNA, 25 bp, Rattus norvegicus
tgggctattctgtaatcacctctcc

SEQ ID NO: 637775 - DNA, 25 bp, Rattus norvegicus
tgggctcaaatactcaagggcagtt

SEQ ID NO: 637776 - DNA, 25 bp, Rattus norvegicus
tgggctcaaatagtcaagggcagtt

SEQ ID NO: 637777 - DNA, 25 bp, Rattus norvegicus
tgggctcaacatctgatttctgtac

SEQ ID NO: 637778 - DNA, 25 bp, Rattus norvegicus
tgggctcaacatgtgatttctgtac

SEQ ID NO: 637779 - DNA, 25 bp, Rattus norvegicus
tgggctcactacagaacctaccagg

SEQ ID NO: 637780 - DNA, 25 bp, Rattus norvegicus
tgggctcactactgaacctaccagg

SEQ ID NO: 637781 - DNA, 25 bp, Rattus norvegicus
tgggctcactatcccctgaagacaa

SEQ ID NO: 637782 - DNA, 25 bp, Rattus norvegicus
tgggctcactatgccctgaagacaa

SEQ ID NO: 637783 - DNA, 25 bp, Rattus norvegicus
tgggctcactccctgatgttcagaa

SEQ ID NO: 637784 - DNA, 25 bp, Rattus norvegicus
tgggctcactccgtgatgttcagaa

SEQ ID NO: 637785 - DNA, 25 bp, Rattus norvegicus
tgggctcactgcaccataatcaggg

SEQ ID NO: 637786 - DNA, 25 bp, Rattus norvegicus
tgggctcactgctccataatcaggg

SEQ ID NO: 637787 - DNA, 25 bp, Rattus norvegicus
tgggctcagagaatacactgtgtct

SEQ ID NO: 637788 - DNA, 25 bp, Rattus norvegicus
tgggctcagagattacactgtgtct

SEQ ID NO: 637789 - DNA, 25 bp, Rattus norvegicus
tgggctcagagcatctttctagcta

SEQ ID NO: 637790 - DNA, 25 bp, Rattus norvegicus
tgggctcagagcttctttctagcta

SEQ ID NO: 637791 - DNA, 25 bp, Rattus norvegicus
tgggctcagcaaaggcagctgagat

SEQ ID NO: 637792 - DNA, 25 bp, Rattus norvegicus
tgggctcagcaatggcagctgagat

SEQ ID NO: 637793 - DNA, 25 bp, Rattus norvegicus
tgggctcagctgaagggcatgtcat

SEQ ID NO: 637794 - DNA, 25 bp, Rattus norvegicus
tgggctcagctgtagggcatgtcat

SEQ ID NO: 637795 - DNA, 25 bp, Rattus norvegicus
tgggctcaggcacttctacaaccga

SEQ ID NO: 637796 - DNA, 25 bp, Rattus norvegicus
tgggctcaggcagttctacaaccga

SEQ ID NO: 637797 - DNA, 25 bp, Rattus norvegicus
tgggctcagtccctggaactagaaa

SEQ ID NO: 637798 - DNA, 25 bp, Rattus norvegicus
tgggctcagtccgtggaactagaaa

SEQ ID NO: 637799 - DNA, 25 bp, Rattus norvegicus
tgggctccaaaactcaaggcctgag

SEQ ID NO: 637800 - DNA, 25 bp, Rattus norvegicus
tgggctccaaaagtcaaggcctgag

SEQ ID NO: 637801 - DNA, 25 bp, Rattus norvegicus
tgggctccaacactgctccagatgg

SEQ ID NO: 637802 - DNA, 25 bp, Rattus norvegicus
tgggctccaacagtgctccagatgg

SEQ ID NO: 637803 - DNA, 25 bp, Rattus norvegicus
tgggctccaatcattgtggcatcta

SEQ ID NO: 637804 - DNA, 25 bp, Rattus norvegicus
tgggctccaatctttgtggcatcta

SEQ ID NO: 637805 - DNA, 25 bp, Rattus norvegicus
tgggctccacagaacatccatttgt

SEQ ID NO: 637806 - DNA, 25 bp, Rattus norvegicus
tgggctccacagtacatccatttgt

SEQ ID NO: 637807 - DNA, 25 bp, Rattus norvegicus
tgggctccagccagagaacaatctt

SEQ ID NO: 637808 - DNA, 25 bp, Rattus norvegicus
tgggctccagcctgagaacaatctt

SEQ ID NO: 637809 - DNA, 25 bp, Rattus norvegicus
tgggctccatacaaaaacctcagaa

SEQ ID NO: 637810 - DNA, 25 bp, Rattus norvegicus
tgggctccatacagcaggcatcaat

SEQ ID NO: 637811 - DNA, 25 bp, Rattus norvegicus
tgggctccatactaaaacctcagaa

SEQ ID NO: 637812 - DNA, 25 bp, Rattus norvegicus
tgggctccatactgcaggcatcaat

SEQ ID NO: 637813 - DNA, 25 bp, Rattus norvegicus
tgggctccatgtcctacttaggagt

SEQ ID NO: 637814 - DNA, 25 bp, Rattus norvegicus
tgggctccatgtgctacttaggagt

SEQ ID NO: 637815 - DNA, 25 bp, Rattus norvegicus
tgggctcccacgacaacttggtgta

SEQ ID NO: 637816 - DNA, 25 bp, Rattus norvegicus
tgggctcccacgtcaacttggtgta

SEQ ID NO: 637817 - DNA, 25 bp, Rattus norvegicus
tgggctcccatcagcctaatttggg

SEQ ID NO: 637818 - DNA, 25 bp, Rattus norvegicus
tgggctcccatctgcctaatttggg

SEQ ID NO: 637819 - DNA, 25 bp, Rattus norvegicus
tgggctccctgaaaaatcactcttg

SEQ ID NO: 637820 - DNA, 25 bp, Rattus norvegicus
tgggctccctgataaatcactcttg

SEQ ID NO: 637821 - DNA, 25 bp, Rattus norvegicus
tgggctccctggcagatgagtttaa

SEQ ID NO: 637822 - DNA, 25 bp, Rattus norvegicus
tgggctccctgggagatgagtttaa

SEQ ID NO: 637823 - DNA, 25 bp, Rattus norvegicus
tgggctccgaggcagttgccatttc

SEQ ID NO: 637824 - DNA, 25 bp, Rattus norvegicus
tgggctccgagggagttgccatttc

SEQ ID NO: 637825 - DNA, 25 bp, Rattus norvegicus
tgggctccgtctaaaatacatcctt

SEQ ID NO: 637826 - DNA, 25 bp, Rattus norvegicus
tgggctccgtcttaaatacatcctt

SEQ ID NO: 637827 - DNA, 25 bp, Rattus norvegicus
tgggctccgtttactttgttttcag

SEQ ID NO: 637828 - DNA, 25 bp, Rattus norvegicus
tgggctccgttttctttgttttcag

SEQ ID NO: 637829 - DNA, 25 bp, Rattus norvegicus
tgggctcctatgctactgaggtgaa

SEQ ID NO: 637830 - DNA, 25 bp, Rattus norvegicus
tgggctcctatggtactgaggtgaa

SEQ ID NO: 637831 - DNA, 25 bp, Rattus norvegicus
tgggctcctcagatacagttccagg

SEQ ID NO: 637832 - DNA, 25 bp, Rattus norvegicus
tgggctcctcagttacagttccagg

SEQ ID NO: 637833 - DNA, 25 bp, Rattus norvegicus
tgggctcctgacacaaagccagatg

SEQ ID NO: 637834 - DNA, 25 bp, Rattus norvegicus
tgggctcctgactcaaagccagatg

SEQ ID NO: 637835 - DNA, 25 bp, Rattus norvegicus
tgggctcctggaatctcacagagga

SEQ ID NO: 637836 - DNA, 25 bp, Rattus norvegicus
tgggctcctggattctcacagagga

SEQ ID NO: 637837 - DNA, 25 bp, Rattus norvegicus
tgggctcctgggaaacaccaactgg

SEQ ID NO: 637838 - DNA, 25 bp, Rattus norvegicus
tgggctcctgggaggaactcaacca

SEQ ID NO: 637839 - DNA, 25 bp, Rattus norvegicus
tgggctcctgggtaacaccaactgg

SEQ ID NO: 637840 - DNA, 25 bp, Rattus norvegicus
tgggctcctgggtggaactcaacca

SEQ ID NO: 637841 - DNA, 25 bp, Rattus norvegicus
tgggctcctgttattgagagacgtt

SEQ ID NO: 637842 - DNA, 25 bp, Rattus norvegicus
tgggctcctgtttttgagagacgtt

SEQ ID NO: 637843 - DNA, 25 bp, Rattus norvegicus
tgggctccttgtcgcacaggacaga

SEQ ID NO: 637844 - DNA, 25 bp, Rattus norvegicus
tgggctccttgtggcacaggacaga

SEQ ID NO: 637845 - DNA, 25 bp, Rattus norvegicus
tgggctcctttactcagcaaggtgg

SEQ ID NO: 637846 - DNA, 25 bp, Rattus norvegicus
tgggctcctttagtcagcaaggtgg

SEQ ID NO: 637847 - DNA, 25 bp, Rattus norvegicus
tgggctcgaggtcgcaagcttatct

SEQ ID NO: 637848 - DNA, 25 bp, Rattus norvegicus
tgggctcgaggtggcaagcttatct

SEQ ID NO: 637849 - DNA, 25 bp, Rattus norvegicus
tgggctcgccgaagaggatctcgtt

SEQ ID NO: 637850 - DNA, 25 bp, Rattus norvegicus
tgggctcgccgatgaggatctcgtt

SEQ ID NO: 637851 - DNA, 25 bp, Rattus norvegicus
tgggctcgctgaaacgcagttagga

SEQ ID NO: 637852 - DNA, 25 bp, Rattus norvegicus
tgggctcgctgatacgcagttagga

SEQ ID NO: 637853 - DNA, 25 bp, Rattus norvegicus
tgggctctaacaaagctagcaccta

SEQ ID NO: 637854 - DNA, 25 bp, Rattus norvegicus
tgggctctaacatagctagcaccta

SEQ ID NO: 637855 - DNA, 25 bp, Rattus norvegicus
tgggctctaggacaggtcttcctga

SEQ ID NO: 637856 - DNA, 25 bp, Rattus norvegicus
tgggctctaggagaggtcttcctga

SEQ ID NO: 637857 - DNA, 25 bp, Rattus norvegicus
tgggctctatgtctcagggtttgtc

SEQ ID NO: 637858 - DNA, 25 bp, Rattus norvegicus
tgggctctatgtgtcagggtttgtc

SEQ ID NO: 637859 - DNA, 25 bp, Rattus norvegicus
tgggctctcaaaagttcaacgtatt

SEQ ID NO: 637860 - DNA, 25 bp, Rattus norvegicus
tgggctctcaaatgttcaacgtatt

SEQ ID NO: 637861 - DNA, 25 bp, Rattus norvegicus
tgggctctcaacaaatactttggat

SEQ ID NO: 637862 - DNA, 25 bp, Rattus norvegicus
tgggctctcaactaatactttggat

SEQ ID NO: 637863 - DNA, 25 bp, Rattus norvegicus
tgggctctcaatcggagtcccttta

SEQ ID NO: 637864 - DNA, 25 bp, Rattus norvegicus
tgggctctcaatgggagtcccttta

SEQ ID NO: 637865 - DNA, 25 bp, Rattus norvegicus
tgggctctcaggctccttgtctaag

SEQ ID NO: 637866 - DNA, 25 bp, Rattus norvegicus
tgggctctcagggtccttgtctaag

SEQ ID NO: 637867 - DNA, 25 bp, Rattus norvegicus
tgggctctccctagccatggagaac

SEQ ID NO: 637868 - DNA, 25 bp, Rattus norvegicus
tgggctctcccttgccatggagaac

SEQ ID NO: 637869 - DNA, 25 bp, Rattus norvegicus
tgggctctctccatataaacatggt

SEQ ID NO: 637870 - DNA, 25 bp, Rattus norvegicus
tgggctctctccttataaacatggt

SEQ ID NO: 637871 - DNA, 25 bp, Rattus norvegicus
tgggctctctgcattttctcttctt

SEQ ID NO: 637872 - DNA, 25 bp, Rattus norvegicus
tgggctctctgctttttctcttctt

SEQ ID NO: 637873 - DNA, 25 bp, Rattus norvegicus
tgggctctgaccattaacactgctg

SEQ ID NO: 637874 - DNA, 25 bp, Rattus norvegicus
tgggctctgacctttaacactgctg

SEQ ID NO: 637875 - DNA, 25 bp, Rattus norvegicus
tgggctctgagcaggagaccgccat

SEQ ID NO: 637876 - DNA, 25 bp, Rattus norvegicus
tgggctctgagcctcttgatgctca

SEQ ID NO: 637877 - DNA, 25 bp, Rattus norvegicus
tgggctctgagcgtcttgatgctca

SEQ ID NO: 637878 - DNA, 25 bp, Rattus norvegicus
tgggctctgagctggagaccgccat

SEQ ID NO: 637879 - DNA, 25 bp, Rattus norvegicus
tgggctctgattccgtggcagcttt

SEQ ID NO: 637880 - DNA, 25 bp, Rattus norvegicus
tgggctctgattgcgtggcagcttt

SEQ ID NO: 637881 - DNA, 25 bp, Rattus norvegicus
tgggctctgcacacatgttatacat

SEQ ID NO: 637882 - DNA, 25 bp, Rattus norvegicus
tgggctctgcaccactcattatggt

SEQ ID NO: 637883 - DNA, 25 bp, Rattus norvegicus
tgggctctgcacgactcattatggt

SEQ ID NO: 637884 - DNA, 25 bp, Rattus norvegicus
tgggctctgcactcatgttatacat

SEQ ID NO: 637885 - DNA, 25 bp, Rattus norvegicus
tgggctctgcatcggctgccctgac

SEQ ID NO: 637886 - DNA, 25 bp, Rattus norvegicus
tgggctctgcatgggctgccctgac

SEQ ID NO: 637887 - DNA, 25 bp, Rattus norvegicus
tgggctctgcctagacattcctcat

SEQ ID NO: 637888 - DNA, 25 bp, Rattus norvegicus
tgggctctgccttgacattcctcat

SEQ ID NO: 637889 - DNA, 25 bp, Rattus norvegicus
tgggctctgcgcaagaattcctcaa

SEQ ID NO: 637890 - DNA, 25 bp, Rattus norvegicus
tgggctctgcgctagaattcctcaa

SEQ ID NO: 637891 - DNA, 25 bp, Rattus norvegicus
tgggctctgctaaaactgttggttg

SEQ ID NO: 637892 - DNA, 25 bp, Rattus norvegicus
tgggctctgctataactgttggttg

SEQ ID NO: 637893 - DNA, 25 bp, Rattus norvegicus
tgggctctgctgcaactcacaaatt

SEQ ID NO: 637894 - DNA, 25 bp, Rattus norvegicus
tgggctctgctggaactcacaaatt

SEQ ID NO: 637895 - DNA, 25 bp, Rattus norvegicus
tgggctctgtacagaaagaccctaa

SEQ ID NO: 637896 - DNA, 25 bp, Rattus norvegicus
tgggctctgtactgaaagaccctaa

SEQ ID NO: 637897 - DNA, 25 bp, Rattus norvegicus
tgggctctgttcaaatgacacctcc

SEQ ID NO: 637898 - DNA, 25 bp, Rattus norvegicus
tgggctctgttctaatgacacctcc

SEQ ID NO: 637899 - DNA, 25 bp, Rattus norvegicus
tgggctcttcagagtctgccacagc

SEQ ID NO: 637900 - DNA, 25 bp, Rattus norvegicus
tgggctcttcagtgtctgccacagc

SEQ ID NO: 637901 - DNA, 25 bp, Rattus norvegicus
tgggctcttccgaggtcgaacaggt

SEQ ID NO: 637902 - DNA, 25 bp, Rattus norvegicus
tgggctcttccgtggtcgaacaggt

SEQ ID NO: 637903 - DNA, 25 bp, Rattus norvegicus
tgggctcttctgaatcaggcacctg

SEQ ID NO: 637904 - DNA, 25 bp, Rattus norvegicus
tgggctcttctgtatcaggcacctg

SEQ ID NO: 637905 - DNA, 25 bp, Rattus norvegicus
tgggctcttgatctcctggctatcc

SEQ ID NO: 637906 - DNA, 25 bp, Rattus norvegicus
tgggctcttgatgtcctggctatcc

SEQ ID NO: 637907 - DNA, 25 bp, Rattus norvegicus
tgggctcttgtccatttagctggct

SEQ ID NO: 637908 - DNA, 25 bp, Rattus norvegicus
tgggctcttgtcgatttagctggct

SEQ ID NO: 637909 - DNA, 25 bp, Rattus norvegicus
tgggctgaaaacacggcctcaacca

SEQ ID NO: 637910 - DNA, 25 bp, Rattus norvegicus
tgggctgaaaactcggcctcaacca

SEQ ID NO: 637911 - DNA, 25 bp, Rattus norvegicus
tgggctgaacttcatctggccatcc

SEQ ID NO: 637912 - DNA, 25 bp, Rattus norvegicus
tgggctgaacttgatctggccatcc

SEQ ID NO: 637913 - DNA, 25 bp, Rattus norvegicus
tgggctgaattcctctttctttgcg

SEQ ID NO: 637914 - DNA, 25 bp, Rattus norvegicus
tgggctgaattcgtctttctttgcg

SEQ ID NO: 637915 - DNA, 25 bp, Rattus norvegicus
tgggctgacaacacggctttgaaaa

SEQ ID NO: 637916 - DNA, 25 bp, Rattus norvegicus
tgggctgacaactcggctttgaaaa

SEQ ID NO: 637917 - DNA, 25 bp, Rattus norvegicus
tgggctgacagcaaatcctcctgag

SEQ ID NO: 637918 - DNA, 25 bp, Rattus norvegicus
tgggctgacagctaatcctcctgag

SEQ ID NO: 637919 - DNA, 25 bp, Rattus norvegicus
tgggctgacggcatttcctgtggat

SEQ ID NO: 637920 - DNA, 25 bp, Rattus norvegicus
tgggctgacggcttttcctgtggat

SEQ ID NO: 637921 - DNA, 25 bp, Rattus norvegicus
tgggctgaggtacgctttctagttc

SEQ ID NO: 637922 - DNA, 25 bp, Rattus norvegicus
tgggctgaggtaggctttctagttc

SEQ ID NO: 637923 - DNA, 25 bp, Rattus norvegicus
tgggctgatacacattgaggtttta

SEQ ID NO: 637924 - DNA, 25 bp, Rattus norvegicus
tgggctgatacagattgaggtttta

SEQ ID NO: 637925 - DNA, 25 bp, Rattus norvegicus
tgggctgcacatagaccccatgtca

SEQ ID NO: 637926 - DNA, 25 bp, Rattus norvegicus
tgggctgcacattgaccccatgtca

SEQ ID NO: 637927 - DNA, 25 bp, Rattus norvegicus
tgggctgcaccacattgagatctga

SEQ ID NO: 637928 - DNA, 25 bp, Rattus norvegicus
tgggctgcaccagattgagatctga

SEQ ID NO: 637929 - DNA, 25 bp, Rattus norvegicus
tgggctgcactcattggctatgtga

SEQ ID NO: 637930 - DNA, 25 bp, Rattus norvegicus
tgggctgcactctttggctatgtga

SEQ ID NO: 637931 - DNA, 25 bp, Rattus norvegicus
tgggctgcaggcataaaggacactt

SEQ ID NO: 637932 - DNA, 25 bp, Rattus norvegicus
tgggctgcaggcttaaaggacactt

SEQ ID NO: 637933 - DNA, 25 bp, Rattus norvegicus
tgggctgcataacactctgtcttta

SEQ ID NO: 637934 - DNA, 25 bp, Rattus norvegicus
tgggctgcataagactctgtcttta

SEQ ID NO: 637935 - DNA, 25 bp, Rattus norvegicus
tgggctgcatacacgttggctcaaa

SEQ ID NO: 637936 - DNA, 25 bp, Rattus norvegicus
tgggctgcatactcgttggctcaaa

SEQ ID NO: 637937 - DNA, 25 bp, Rattus norvegicus
tgggctgccaaccagaagtactaac

SEQ ID NO: 637938 - DNA, 25 bp, Rattus norvegicus
tgggctgccaacgagaagtactaac

SEQ ID NO: 637939 - DNA, 25 bp, Rattus norvegicus
tgggctgccactcgacttgcagtac

SEQ ID NO: 637940 - DNA, 25 bp, Rattus norvegicus
tgggctgccactggacttgcagtac

SEQ ID NO: 637941 - DNA, 25 bp, Rattus norvegicus
tgggctgccatccttaagtttgctt

SEQ ID NO: 637942 - DNA, 25 bp, Rattus norvegicus
tgggctgccatcgttaagtttgctt

SEQ ID NO: 637943 - DNA, 25 bp, Rattus norvegicus
tgggctgcccaacctctgagaagta

SEQ ID NO: 637944 - DNA, 25 bp, Rattus norvegicus
tgggctgcccaagctctgagaagta

SEQ ID NO: 637945 - DNA, 25 bp, Rattus norvegicus
tgggctgccgacacctgggccagag

SEQ ID NO: 637946 - DNA, 25 bp, Rattus norvegicus
tgggctgccgactcctgggccagag

SEQ ID NO: 637947 - DNA, 25 bp, Rattus norvegicus
tgggctgcgtagagcctcttcctga

SEQ ID NO: 637948 - DNA, 25 bp, Rattus norvegicus
tgggctgcgtagtgcctcttcctga

SEQ ID NO: 637949 - DNA, 25 bp, Rattus norvegicus
tgggctgctccactcctatctttct

SEQ ID NO: 637950 - DNA, 25 bp, Rattus norvegicus
tgggctgctccagtcctatctttct

SEQ ID NO: 637951 - DNA, 25 bp, Rattus norvegicus
tgggctgctcgaaaccaaacccaga

SEQ ID NO: 637952 - DNA, 25 bp, Rattus norvegicus
tgggctgctcgataccaaacccaga

SEQ ID NO: 637953 - DNA, 25 bp, Rattus norvegicus
tgggctgctctgagttcatccttta

SEQ ID NO: 637954 - DNA, 25 bp, Rattus norvegicus
tgggctgctctgatcatggaccatc

SEQ ID NO: 637955 - DNA, 25 bp, Rattus norvegicus
tgggctgctctgtgttcatccttta

SEQ ID NO: 637956 - DNA, 25 bp, Rattus norvegicus
tgggctgctctgttcatggaccatc

SEQ ID NO: 637957 - DNA, 25 bp, Rattus norvegicus
tgggctgctggtccctgtacatctc

SEQ ID NO: 637958 - DNA, 25 bp, Rattus norvegicus
tgggctgctggtgcctgtacatctc

SEQ ID NO: 637959 - DNA, 25 bp, Rattus norvegicus
tgggctgcttggcagaagactcttc

SEQ ID NO: 637960 - DNA, 25 bp, Rattus norvegicus
tgggctgcttgggagaagactcttc

SEQ ID NO: 637961 - DNA, 25 bp, Rattus norvegicus
tgggctgctttaagaggtgctgaat

SEQ ID NO: 637962 - DNA, 25 bp, Rattus norvegicus
tgggctgctttatgaggtgctgaat

SEQ ID NO: 637963 - DNA, 25 bp, Rattus norvegicus
tgggctggattcactggtacaccgg

SEQ ID NO: 637964 - DNA, 25 bp, Rattus norvegicus
tgggctggattctctggtacaccgg

SEQ ID NO: 637965 - DNA, 25 bp, Rattus norvegicus
tgggctggccaacacgagacctgcc

SEQ ID NO: 637966 - DNA, 25 bp, Rattus norvegicus
tgggctggccaagacgagacctgcc

SEQ ID NO: 637967 - DNA, 25 bp, Rattus norvegicus
tgggctggccctacgagggtcacaa

SEQ ID NO: 637968 - DNA, 25 bp, Rattus norvegicus
tgggctggcccttcgagggtcacaa

SEQ ID NO: 637969 - DNA, 25 bp, Rattus norvegicus
tgggctggccgtactgtaaactcct

SEQ ID NO: 637970 - DNA, 25 bp, Rattus norvegicus
tgggctggccgttctgtaaactcct

SEQ ID NO: 637971 - DNA, 25 bp, Rattus norvegicus
tgggctgggatcatgttcatcacat

SEQ ID NO: 637972 - DNA, 25 bp, Rattus norvegicus
tgggctgggatcttgttcatcacat

SEQ ID NO: 637973 - DNA, 25 bp, Rattus norvegicus
tgggctgggctccagcctcagataa

SEQ ID NO: 637974 - DNA, 25 bp, Rattus norvegicus
tgggctgggctcgagcctcagataa

SEQ ID NO: 637975 - DNA, 25 bp, Rattus norvegicus
tgggctgggtccagtgttccaaagt

SEQ ID NO: 637976 - DNA, 25 bp, Rattus norvegicus
tgggctgggtcctgtgttccaaagt

SEQ ID NO: 637977 - DNA, 25 bp, Rattus norvegicus
tgggctgggttcagccctagtatcc

SEQ ID NO: 637978 - DNA, 25 bp, Rattus norvegicus
tgggctgggttctgccctagtatcc

SEQ ID NO: 637979 - DNA, 25 bp, Rattus norvegicus
tgggctgggtttacagtgctgaata

SEQ ID NO: 637980 - DNA, 25 bp, Rattus norvegicus
tgggctgggttttcagtgctgaata

SEQ ID NO: 637981 - DNA, 25 bp, Rattus norvegicus
tgggctggtaccactatgcagtgag

SEQ ID NO: 637982 - DNA, 25 bp, Rattus norvegicus
tgggctggtacctctatgcagtgag

SEQ ID NO: 637983 - DNA, 25 bp, Rattus norvegicus
tgggctgtaccactgactgcatttg

SEQ ID NO: 637984 - DNA, 25 bp, Rattus norvegicus
tgggctgtaccagtgactgcatttg

SEQ ID NO: 637985 - DNA, 25 bp, Rattus norvegicus
tgggctgtaccgattgaattcttca

SEQ ID NO: 637986 - DNA, 25 bp, Rattus norvegicus
tgggctgtaccgtttgaattcttca

SEQ ID NO: 637987 - DNA, 25 bp, Rattus norvegicus
tgggctgtatatcaagaccctctct

SEQ ID NO: 637988 - DNA, 25 bp, Rattus norvegicus
tgggctgtatatgaagaccctctct

SEQ ID NO: 637989 - DNA, 25 bp, Rattus norvegicus
tgggctgtatgtcgtattgctgatc

SEQ ID NO: 637990 - DNA, 25 bp, Rattus norvegicus
tgggctgtatgtggtattgctgatc

SEQ ID NO: 637991 - DNA, 25 bp, Rattus norvegicus
tgggctgtatttatctccgaggcat

SEQ ID NO: 637992 - DNA, 25 bp, Rattus norvegicus
tgggctgtatttttctccgaggcat

SEQ ID NO: 637993 - DNA, 25 bp, Rattus norvegicus
tgggctgtcattcagacgttccaga

SEQ ID NO: 637994 - DNA, 25 bp, Rattus norvegicus
tgggctgtcattgagacgttccaga

SEQ ID NO: 637995 - DNA, 25 bp, Rattus norvegicus
tgggctgtccggaaaactgaacacc

SEQ ID NO: 637996 - DNA, 25 bp, Rattus norvegicus
tgggctgtccggtaaactgaacacc

SEQ ID NO: 637997 - DNA, 25 bp, Rattus norvegicus
tgggctgtcctgacccgggagatac

SEQ ID NO: 637998 - DNA, 25 bp, Rattus norvegicus
tgggctgtcctgtcccgggagatac

SEQ ID NO: 637999 - DNA, 25 bp, Rattus norvegicus
tgggctgtctccattgtggtccgtc

SEQ ID NO: 638000 - DNA, 25 bp, Rattus norvegicus
tgggctgtctcctttgtggtccgtc

SEQ ID NO: 638001 - DNA, 25 bp, Rattus norvegicus
tgggctgtctgtcagtccagttcat

SEQ ID NO: 638002 - DNA, 25 bp, Rattus norvegicus
tgggctgtctgtgagtccagttcat

SEQ ID NO: 638003 - DNA, 25 bp, Rattus norvegicus
tgggctgtcttcagtgccacagata

SEQ ID NO: 638004 - DNA, 25 bp, Rattus norvegicus
tgggctgtcttctgtgccacagata

SEQ ID NO: 638005 - DNA, 25 bp, Rattus norvegicus
tgggctgtgaccaactctcagaatt

SEQ ID NO: 638006 - DNA, 25 bp, Rattus norvegicus
tgggctgtgacctactctcagaatt

SEQ ID NO: 638007 - DNA, 25 bp, Rattus norvegicus
tgggctgtgcggcttccctgcgccg

SEQ ID NO: 638008 - DNA, 25 bp, Rattus norvegicus
tgggctgtgcgggttccctgcgccg

SEQ ID NO: 638009 - DNA, 25 bp, Rattus norvegicus
tgggctgtggcaataccgaggtccc

SEQ ID NO: 638010 - DNA, 25 bp, Rattus norvegicus
tgggctgtggcattaccgaggtccc

SEQ ID NO: 638011 - DNA, 25 bp, Rattus norvegicus
tgggctgtgtggacaacaactcctt

SEQ ID NO: 638012 - DNA, 25 bp, Rattus norvegicus
tgggctgtgtggtcaacaactcctt

SEQ ID NO: 638013 - DNA, 25 bp, Rattus norvegicus
tgggctgttaccacctggactaaat

SEQ ID NO: 638014 - DNA, 25 bp, Rattus norvegicus
tgggctgttacctcctggactaaat

SEQ ID NO: 638015 - DNA, 25 bp, Rattus norvegicus
tgggctgttcctatgttgatattct

SEQ ID NO: 638016 - DNA, 25 bp, Rattus norvegicus
tgggctgttcctttgttgatattct

SEQ ID NO: 638017 - DNA, 25 bp, Rattus norvegicus
tgggctgttctgacttcgcctcata

SEQ ID NO: 638018 - DNA, 25 bp, Rattus norvegicus
tgggctgttctgtcttcgcctcata

SEQ ID NO: 638019 - DNA, 25 bp, Rattus norvegicus
tgggctgttggacctcttgctcacc

SEQ ID NO: 638020 - DNA, 25 bp, Rattus norvegicus
tgggctgttggagctcttgctcacc

SEQ ID NO: 638021 - DNA, 25 bp, Rattus norvegicus
tgggcttaaagcatgggtttccata

SEQ ID NO: 638022 - DNA, 25 bp, Rattus norvegicus
tgggcttaaagcttgggtttccata

SEQ ID NO: 638023 - DNA, 25 bp, Rattus norvegicus
tgggcttaaccccaaggctaagtgt

SEQ ID NO: 638024 - DNA, 25 bp, Rattus norvegicus
tgggcttaacccgaaggctaagtgt

SEQ ID NO: 638025 - DNA, 25 bp, Rattus norvegicus
tgggcttaacctcgtagagacttaa

SEQ ID NO: 638026 - DNA, 25 bp, Rattus norvegicus
tgggcttaacctggtagagacttaa

SEQ ID NO: 638027 - DNA, 25 bp, Rattus norvegicus
tgggcttaagagatcctgacggctg

SEQ ID NO: 638028 - DNA, 25 bp, Rattus norvegicus
tgggcttaagagttcctgacggctg

SEQ ID NO: 638029 - DNA, 25 bp, Rattus norvegicus
tgggcttaccatatcagacgttgtc

SEQ ID NO: 638030 - DNA, 25 bp, Rattus norvegicus
tgggcttaccatttcagacgttgtc

SEQ ID NO: 638031 - DNA, 25 bp, Rattus norvegicus
tgggcttacggtaccagagtgttag

SEQ ID NO: 638032 - DNA, 25 bp, Rattus norvegicus
tgggcttacggttccagagtgttag

SEQ ID NO: 638033 - DNA, 25 bp, Rattus norvegicus
tgggcttactgtagcttcagcgtct

SEQ ID NO: 638034 - DNA, 25 bp, Rattus norvegicus
tgggcttactgttgcttcagcgtct

SEQ ID NO: 638035 - DNA, 25 bp, Rattus norvegicus
tgggcttagagcacctcctcctcat

SEQ ID NO: 638036 - DNA, 25 bp, Rattus norvegicus
tgggcttagagcagcctcatccctg

SEQ ID NO: 638037 - DNA, 25 bp, Rattus norvegicus
tgggcttagagctcctcctcctcat

SEQ ID NO: 638038 - DNA, 25 bp, Rattus norvegicus
tgggcttagagctgcctcatccctg

SEQ ID NO: 638039 - DNA, 25 bp, Rattus norvegicus
tgggcttagctaattttgcacatct

SEQ ID NO: 638040 - DNA, 25 bp, Rattus norvegicus
tgggcttagctatttttgcacatct

SEQ ID NO: 638041 - DNA, 25 bp, Rattus norvegicus
tgggcttaggagagatccacactaa

SEQ ID NO: 638042 - DNA, 25 bp, Rattus norvegicus
tgggcttaggagtgatccacactaa

SEQ ID NO: 638043 - DNA, 25 bp, Rattus norvegicus
tgggcttatctgagcagcaggcctt

SEQ ID NO: 638044 - DNA, 25 bp, Rattus norvegicus
tgggcttatctgtgcagcaggcctt

SEQ ID NO: 638045 - DNA, 25 bp, Rattus norvegicus
tgggcttatgcactgctaactttca

SEQ ID NO: 638046 - DNA, 25 bp, Rattus norvegicus
tgggcttatgcagtgctaactttca

SEQ ID NO: 638047 - DNA, 25 bp, Rattus norvegicus
tgggcttcaccaacagagggtacca

SEQ ID NO: 638048 - DNA, 25 bp, Rattus norvegicus
tgggcttcaccatcagagggtacca

SEQ ID NO: 638049 - DNA, 25 bp, Rattus norvegicus
tgggcttcacccagaaattttactt

SEQ ID NO: 638050 - DNA, 25 bp, Rattus norvegicus
tgggcttcacccagatgactatctg

SEQ ID NO: 638051 - DNA, 25 bp, Rattus norvegicus
tgggcttcaccctgaaattttactt

SEQ ID NO: 638052 - DNA, 25 bp, Rattus norvegicus
tgggcttcaccctgatgactatctg

SEQ ID NO: 638053 - DNA, 25 bp, Rattus norvegicus
tgggcttcacgaaaaccgcggagac

SEQ ID NO: 638054 - DNA, 25 bp, Rattus norvegicus
tgggcttcacgataaccgcggagac

SEQ ID NO: 638055 - DNA, 25 bp, Rattus norvegicus
tgggcttcactgcaactcaagggca

SEQ ID NO: 638056 - DNA, 25 bp, Rattus norvegicus
tgggcttcactggaactcaagggca

SEQ ID NO: 638057 - DNA, 25 bp, Rattus norvegicus
tgggcttcagcaaggtccatgacgc

SEQ ID NO: 638058 - DNA, 25 bp, Rattus norvegicus
tgggcttcagcatggtccatgacgc

SEQ ID NO: 638059 - DNA, 25 bp, Rattus norvegicus
tgggcttcagttcatgcacgcatac

SEQ ID NO: 638060 - DNA, 25 bp, Rattus norvegicus
tgggcttcagttgatgcacgcatac

SEQ ID NO: 638061 - DNA, 25 bp, Rattus norvegicus
tgggcttccacgatccctatcagga

SEQ ID NO: 638062 - DNA, 25 bp, Rattus norvegicus
tgggcttccacgttccctatcagga

SEQ ID NO: 638063 - DNA, 25 bp, Rattus norvegicus
tgggcttccactatgtcttatcgat

SEQ ID NO: 638064 - DNA, 25 bp, Rattus norvegicus
tgggcttccactttgtcttatcgat

SEQ ID NO: 638065 - DNA, 25 bp, Rattus norvegicus
tgggcttccagcacggtttcttacg

SEQ ID NO: 638066 - DNA, 25 bp, Rattus norvegicus
tgggcttccagctcggtttcttacg

SEQ ID NO: 638067 - DNA, 25 bp, Rattus norvegicus
tgggcttccagtagccttaatagaa

SEQ ID NO: 638068 - DNA, 25 bp, Rattus norvegicus
tgggcttccagttgccttaatagaa

SEQ ID NO: 638069 - DNA, 25 bp, Rattus norvegicus
tgggcttcccaaaacctggcagagg

SEQ ID NO: 638070 - DNA, 25 bp, Rattus norvegicus
tgggcttcccaacagcaaggtccag

SEQ ID NO: 638071 - DNA, 25 bp, Rattus norvegicus
tgggcttcccaagagcaaggtccag

SEQ ID NO: 638072 - DNA, 25 bp, Rattus norvegicus
tgggcttcccaatacctggcagagg

SEQ ID NO: 638073 - DNA, 25 bp, Rattus norvegicus
tgggcttcccagcaaatcacaggga

SEQ ID NO: 638074 - DNA, 25 bp, Rattus norvegicus
tgggcttcccaggaaatcacaggga

SEQ ID NO: 638075 - DNA, 25 bp, Rattus norvegicus
tgggcttccgacacacctggaggag

SEQ ID NO: 638076 - DNA, 25 bp, Rattus norvegicus
tgggcttccgactcacctggaggag

SEQ ID NO: 638077 - DNA, 25 bp, Rattus norvegicus
tgggcttcctcacatacaggtaggt

SEQ ID NO: 638078 - DNA, 25 bp, Rattus norvegicus
tgggcttcctcagatacaggtaggt

SEQ ID NO: 638079 - DNA, 25 bp, Rattus norvegicus
tgggcttcctgaaaccctatcacag

SEQ ID NO: 638080 - DNA, 25 bp, Rattus norvegicus
tgggcttcctgaaccattaccagat

SEQ ID NO: 638081 - DNA, 25 bp, Rattus norvegicus
tgggcttcctgataccctatcacag

SEQ ID NO: 638082 - DNA, 25 bp, Rattus norvegicus
tgggcttcctgatccattaccagat

SEQ ID NO: 638083 - DNA, 25 bp, Rattus norvegicus
tgggcttcctggcttcgatttcaac

SEQ ID NO: 638084 - DNA, 25 bp, Rattus norvegicus
tgggcttcctgggttcgatttcaac

SEQ ID NO: 638085 - DNA, 25 bp, Rattus norvegicus
tgggcttcgcctccgatatttacat

SEQ ID NO: 638086 - DNA, 25 bp, Rattus norvegicus
tgggcttcgcctgcgatatttacat

SEQ ID NO: 638087 - DNA, 25 bp, Rattus norvegicus
tgggcttctagtcctctgaaagtgg

SEQ ID NO: 638088 - DNA, 25 bp, Rattus norvegicus
tgggcttctagtgctctgaaagtgg

SEQ ID NO: 638089 - DNA, 25 bp, Rattus norvegicus
tgggcttctcacactgttctaaaga

SEQ ID NO: 638090 - DNA, 25 bp, Rattus norvegicus
tgggcttctcactctgttctaaaga

SEQ ID NO: 638091 - DNA, 25 bp, Rattus norvegicus
tgggcttctcagagctaagacgaga

SEQ ID NO: 638092 - DNA, 25 bp, Rattus norvegicus
tgggcttctcagtgctaagacgaga

SEQ ID NO: 638093 - DNA, 25 bp, Rattus norvegicus
tgggcttctcatatgcattctgtcc

SEQ ID NO: 638094 - DNA, 25 bp, Rattus norvegicus
tgggcttctcatttgcattctgtcc

SEQ ID NO: 638095 - DNA, 25 bp, Rattus norvegicus
tgggcttctccacagatcacaagca

SEQ ID NO: 638096 - DNA, 25 bp, Rattus norvegicus
tgggcttctccagagatcacaagca

SEQ ID NO: 638097 - DNA, 25 bp, Rattus norvegicus
tgggcttctctccttaacctgaaac

SEQ ID NO: 638098 - DNA, 25 bp, Rattus norvegicus
tgggcttctctcgttaacctgaaac

SEQ ID NO: 638099 - DNA, 25 bp, Rattus norvegicus
tgggcttctgacactttaccatgaa

SEQ ID NO: 638100 - DNA, 25 bp, Rattus norvegicus
tgggcttctgactctttaccatgaa

SEQ ID NO: 638101 - DNA, 25 bp, Rattus norvegicus
tgggcttctgctatggtgctggaca

SEQ ID NO: 638102 - DNA, 25 bp, Rattus norvegicus
tgggcttctgctttggtgctggaca

SEQ ID NO: 638103 - DNA, 25 bp, Rattus norvegicus
tgggcttctggaatcctgactgaga

SEQ ID NO: 638104 - DNA, 25 bp, Rattus norvegicus
tgggcttctggattcctgactgaga

SEQ ID NO: 638105 - DNA, 25 bp, Rattus norvegicus
tgggcttctttgatctctgtctcct

SEQ ID NO: 638106 - DNA, 25 bp, Rattus norvegicus
tgggcttctttgttctctgtctcct

SEQ ID NO: 638107 - DNA, 25 bp, Rattus norvegicus
tgggcttgaccacggacactgtgtc

SEQ ID NO: 638108 - DNA, 25 bp, Rattus norvegicus
tgggcttgaccagggacactgtgtc

SEQ ID NO: 638109 - DNA, 25 bp, Rattus norvegicus
tgggcttgatttcgccctgacatta

SEQ ID NO: 638110 - DNA, 25 bp, Rattus norvegicus
tgggcttgatttggccctgacatta

SEQ ID NO: 638111 - DNA, 25 bp, Rattus norvegicus
tgggcttgcagcaacgaccccggac

SEQ ID NO: 638112 - DNA, 25 bp, Rattus norvegicus
tgggcttgcagctacgaccccggac

SEQ ID NO: 638113 - DNA, 25 bp, Rattus norvegicus
tgggcttgccccaagggtaaggata

SEQ ID NO: 638114 - DNA, 25 bp, Rattus norvegicus
tgggcttgcccctagggtaaggata

SEQ ID NO: 638115 - DNA, 25 bp, Rattus norvegicus
tgggcttgcctcattagtaacagtg

SEQ ID NO: 638116 - DNA, 25 bp, Rattus norvegicus
tgggcttgcctctttagtaacagtg

SEQ ID NO: 638117 - DNA, 25 bp, Rattus norvegicus
tgggcttgccttctgtggtaataca

SEQ ID NO: 638118 - DNA, 25 bp, Rattus norvegicus
tgggcttgccttgtgtggtaataca

SEQ ID NO: 638119 - DNA, 25 bp, Rattus norvegicus
tgggcttgcgagatcatgctggtca

SEQ ID NO: 638120 - DNA, 25 bp, Rattus norvegicus
tgggcttgcgagttcatgctggtca

SEQ ID NO: 638121 - DNA, 25 bp, Rattus norvegicus
tgggcttgcgcactaggtctctaca

SEQ ID NO: 638122 - DNA, 25 bp, Rattus norvegicus
tgggcttgcgcagtaggtctctaca

SEQ ID NO: 638123 - DNA, 25 bp, Rattus norvegicus
tgggcttggagaaccacctcatagc

SEQ ID NO: 638124 - DNA, 25 bp, Rattus norvegicus
tgggcttggagatccacctcatagc

SEQ ID NO: 638125 - DNA, 25 bp, Rattus norvegicus
tgggcttggcccataagtgcctcta

SEQ ID NO: 638126 - DNA, 25 bp, Rattus norvegicus
tgggcttggcccttaagtgcctcta

SEQ ID NO: 638127 - DNA, 25 bp, Rattus norvegicus
tgggcttgtatcctagtgtcctctt

SEQ ID NO: 638128 - DNA, 25 bp, Rattus norvegicus
tgggcttgtatcgtagtgtcctctt

SEQ ID NO: 638129 - DNA, 25 bp, Rattus norvegicus
tgggcttgtcccagtaggactagaa

SEQ ID NO: 638130 - DNA, 25 bp, Rattus norvegicus
tgggcttgtccctgtaggactagaa

SEQ ID NO: 638131 - DNA, 25 bp, Rattus norvegicus
tgggcttgtgtgatagagctgtact

SEQ ID NO: 638132 - DNA, 25 bp, Rattus norvegicus
tgggcttgtgtgttagagctgtact

SEQ ID NO: 638133 - DNA, 25 bp, Rattus norvegicus
tgggctttaaacacagctccttaca

SEQ ID NO: 638134 - DNA, 25 bp, Rattus norvegicus
tgggctttaaactcagctccttaca

SEQ ID NO: 638135 - DNA, 25 bp, Rattus norvegicus
tgggctttatctcttcccaccaaag

SEQ ID NO: 638136 - DNA, 25 bp, Rattus norvegicus
tgggctttatctgttcccaccaaag

SEQ ID NO: 638137 - DNA, 25 bp, Rattus norvegicus
tgggctttcaatctgcactcggttc

SEQ ID NO: 638138 - DNA, 25 bp, Rattus norvegicus
tgggctttcaatgtgcactcggttc

SEQ ID NO: 638139 - DNA, 25 bp, Rattus norvegicus
tgggctttcaccacagcaccaaaaa

SEQ ID NO: 638140 - DNA, 25 bp, Rattus norvegicus
tgggctttcacctcagcaccaaaaa

SEQ ID NO: 638141 - DNA, 25 bp, Rattus norvegicus
tgggctttcccaagaagggcatttt

SEQ ID NO: 638142 - DNA, 25 bp, Rattus norvegicus
tgggctttcccatgaagggcatttt

SEQ ID NO: 638143 - DNA, 25 bp, Rattus norvegicus
tgggctttcctaatccatgggagta

SEQ ID NO: 638144 - DNA, 25 bp, Rattus norvegicus
tgggctttcctattccatgggagta

SEQ ID NO: 638145 - DNA, 25 bp, Rattus norvegicus
tgggctttccttccatgagccagga

SEQ ID NO: 638146 - DNA, 25 bp, Rattus norvegicus
tgggctttccttgcatgagccagga

SEQ ID NO: 638147 - DNA, 25 bp, Rattus norvegicus
tgggctttctctaattcaggtttaa

SEQ ID NO: 638148 - DNA, 25 bp, Rattus norvegicus
tgggctttctcttattcaggtttaa

SEQ ID NO: 638149 - DNA, 25 bp, Rattus norvegicus
tgggctttgacaagtggcctttcat

SEQ ID NO: 638150 - DNA, 25 bp, Rattus norvegicus
tgggctttgacatgtggcctttcat

SEQ ID NO: 638151 - DNA, 25 bp, Rattus norvegicus
tgggctttgagaactgacctccata

SEQ ID NO: 638152 - DNA, 25 bp, Rattus norvegicus
tgggctttgagatctgacctccata

SEQ ID NO: 638153 - DNA, 25 bp, Rattus norvegicus
tgggctttgcacacatgaagcactt

SEQ ID NO: 638154 - DNA, 25 bp, Rattus norvegicus
tgggctttgcactcatgaagcactt

SEQ ID NO: 638155 - DNA, 25 bp, Rattus norvegicus
tgggctttgccaaccgaggacatga

SEQ ID NO: 638156 - DNA, 25 bp, Rattus norvegicus
tgggctttgccatccgaggacatga

SEQ ID NO: 638157 - DNA, 25 bp, Rattus norvegicus
tgggctttgcctagttcctgtgtag

SEQ ID NO: 638158 - DNA, 25 bp, Rattus norvegicus
tgggctttgccttgttcctgtgtag

SEQ ID NO: 638159 - DNA, 25 bp, Rattus norvegicus
tgggctttgctgacttttgtgtcat

SEQ ID NO: 638160 - DNA, 25 bp, Rattus norvegicus
tgggctttgctgtcttttgtgtcat

SEQ ID NO: 638161 - DNA, 25 bp, Rattus norvegicus
tgggctttgcttaccaacatcacac

SEQ ID NO: 638162 - DNA, 25 bp, Rattus norvegicus
tgggctttgctttccaacatcacac

SEQ ID NO: 638163 - DNA, 25 bp, Rattus norvegicus
tgggctttggagatcgcagttaaat

SEQ ID NO: 638164 - DNA, 25 bp, Rattus norvegicus
tgggctttggagcaaccttcaagag

SEQ ID NO: 638165 - DNA, 25 bp, Rattus norvegicus
tgggctttggaggaaccttcaagag

SEQ ID NO: 638166 - DNA, 25 bp, Rattus norvegicus
tgggctttggagttcgcagttaaat

SEQ ID NO: 638167 - DNA, 25 bp, Rattus norvegicus
tgggctttgggcaccctaaatgttt

SEQ ID NO: 638168 - DNA, 25 bp, Rattus norvegicus
tgggctttgggctccctaaatgttt

SEQ ID NO: 638169 - DNA, 25 bp, Rattus norvegicus
tgggctttgtgtccgagttctgctc

SEQ ID NO: 638170 - DNA, 25 bp, Rattus norvegicus
tgggctttgtgtgcgagttctgctc

SEQ ID NO: 638171 - DNA, 25 bp, Rattus norvegicus
tgggctttgttcaggccataaattc

SEQ ID NO: 638172 - DNA, 25 bp, Rattus norvegicus
tgggctttgttctggccataaattc

SEQ ID NO: 638173 - DNA, 25 bp, Rattus norvegicus
tgggcttttatacccagtgctggga

SEQ ID NO: 638174 - DNA, 25 bp, Rattus norvegicus
tgggcttttatagccagtgctggga

SEQ ID NO: 638175 - DNA, 25 bp, Rattus norvegicus
tgggcttttcctatgaaggccattg

SEQ ID NO: 638176 - DNA, 25 bp, Rattus norvegicus
tgggcttttcctttgaaggccattg

SEQ ID NO: 638177 - DNA, 25 bp, Rattus norvegicus
tgggcttttggcacaagggacacag

SEQ ID NO: 638178 - DNA, 25 bp, Rattus norvegicus
tgggcttttggctcaagggacacag

SEQ ID NO: 638179 - DNA, 25 bp, Rattus norvegicus
tgggctttttctctggccactgagg

SEQ ID NO: 638180 - DNA, 25 bp, Rattus norvegicus
tgggctttttctgtggccactgagg

SEQ ID NO: 638181 - DNA, 25 bp, Rattus norvegicus
tggggagcccctatcctacttgttg

SEQ ID NO: 638182 - DNA, 25 bp, Rattus norvegicus
tggggagcccctttcctacttgttg

SEQ ID NO: 638183 - DNA, 25 bp, Rattus norvegicus
tggggaggaaacacgatgtagcttt

SEQ ID NO: 638184 - DNA, 25 bp, Rattus norvegicus
tggggaggaaactcgatgtagcttt

SEQ ID NO: 638185 - DNA, 25 bp, Rattus norvegicus
tggggatgcacgctcataacccaac

SEQ ID NO: 638186 - DNA, 25 bp, Rattus norvegicus
tggggatgcacggtcataacccaac

SEQ ID NO: 638187 - DNA, 25 bp, Rattus norvegicus
tggggcgggtaccttacactcaggg

SEQ ID NO: 638188 - DNA, 25 bp, Rattus norvegicus
tggggcgggtacgttacactcaggg

SEQ ID NO: 638189 - DNA, 25 bp, Rattus norvegicus
tgggggaaccttctgctattaccat

SEQ ID NO: 638190 - DNA, 25 bp, Rattus norvegicus
tgggggaaccttgtgctattaccat

SEQ ID NO: 638191 - DNA, 25 bp, Rattus norvegicus
tgggggaggctcaaaacctatcttc

SEQ ID NO: 638192 - DNA, 25 bp, Rattus norvegicus
tgggggaggctctaaacctatcttc

SEQ ID NO: 638193 - DNA, 25 bp, Rattus norvegicus
tgggggcttttcagtttcacattaa

SEQ ID NO: 638194 - DNA, 25 bp, Rattus norvegicus
tgggggcttttctgtttcacattaa

SEQ ID NO: 638195 - DNA, 25 bp, Rattus norvegicus
tggggtcccaggattagaatttcag

SEQ ID NO: 638196 - DNA, 25 bp, Rattus norvegicus
tggggtcccaggtttagaatttcag

SEQ ID NO: 638197 - DNA, 25 bp, Rattus norvegicus
tggggttcaccacaatccttcagtg

SEQ ID NO: 638198 - DNA, 25 bp, Rattus norvegicus
tggggttcaccagaatccttcagtg

SEQ ID NO: 638199 - DNA, 25 bp, Rattus norvegicus
tggggtttttgcacaaatccacttg

SEQ ID NO: 638200 - DNA, 25 bp, Rattus norvegicus
tggggtttttgctcaaatccacttg

SEQ ID NO: 638201 - DNA, 25 bp, Rattus norvegicus
tgggtaaaatgcacaactgccggcc

SEQ ID NO: 638202 - DNA, 25 bp, Rattus norvegicus
tgggtaaaatgctcaactgccggcc

SEQ ID NO: 638203 - DNA, 25 bp, Rattus norvegicus
tgggtaaacaccctccctgccatgt

SEQ ID NO: 638204 - DNA, 25 bp, Rattus norvegicus
tgggtaaacaccgtccctgccatgt

SEQ ID NO: 638205 - DNA, 25 bp, Rattus norvegicus
tgggtaaatgtaccgcccgggcact

SEQ ID NO: 638206 - DNA, 25 bp, Rattus norvegicus
tgggtaaatgtagcgcccgggcact

SEQ ID NO: 638207 - DNA, 25 bp, Rattus norvegicus
tgggtaaatgtcacgtattgcactt

SEQ ID NO: 638208 - DNA, 25 bp, Rattus norvegicus
tgggtaaatgtctcgtattgcactt

SEQ ID NO: 638209 - DNA, 25 bp, Rattus norvegicus
tgggtaacctcacccagtttaataa

SEQ ID NO: 638210 - DNA, 25 bp, Rattus norvegicus
tgggtaacctcagccagtttaataa

SEQ ID NO: 638211 - DNA, 25 bp, Rattus norvegicus
tgggtaacgaccacctgaccgaagg

SEQ ID NO: 638212 - DNA, 25 bp, Rattus norvegicus
tgggtaacgacctcctgaccgaagg

SEQ ID NO: 638213 - DNA, 25 bp, Rattus norvegicus
tgggtaactgcgaccaggtacaaat

SEQ ID NO: 638214 - DNA, 25 bp, Rattus norvegicus
tgggtaactgcgtccaggtacaaat

SEQ ID NO: 638215 - DNA, 25 bp, Rattus norvegicus
tgggtaactggcatttccactacct

SEQ ID NO: 638216 - DNA, 25 bp, Rattus norvegicus
tgggtaactggcttttccactacct

SEQ ID NO: 638217 - DNA, 25 bp, Rattus norvegicus
tgggtaacttcacaacactctcatt

SEQ ID NO: 638218 - DNA, 25 bp, Rattus norvegicus
tgggtaacttcagaacactctcatt

SEQ ID NO: 638219 - DNA, 25 bp, Rattus norvegicus
tgggtaagaattcgccatttcaaga

SEQ ID NO: 638220 - DNA, 25 bp, Rattus norvegicus
tgggtaagaattggccatttcaaga

SEQ ID NO: 638221 - DNA, 25 bp, Rattus norvegicus
tgggtaagcactcttctcctggatc

SEQ ID NO: 638222 - DNA, 25 bp, Rattus norvegicus
tgggtaagcactgttctcctggatc

SEQ ID NO: 638223 - DNA, 25 bp, Rattus norvegicus
tgggtaagccacaagagtcttctct

SEQ ID NO: 638224 - DNA, 25 bp, Rattus norvegicus
tgggtaagccactagagtcttctct

SEQ ID NO: 638225 - DNA, 25 bp, Rattus norvegicus
tgggtaagccgaaggcccagactgc

SEQ ID NO: 638226 - DNA, 25 bp, Rattus norvegicus
tgggtaagccgatggcccagactgc

SEQ ID NO: 638227 - DNA, 25 bp, Rattus norvegicus
tgggtaataaacagcaactttgtca

SEQ ID NO: 638228 - DNA, 25 bp, Rattus norvegicus
tgggtaataaactgcaactttgtca

SEQ ID NO: 638229 - DNA, 25 bp, Rattus norvegicus
tgggtaatccctacaacctgacatt

SEQ ID NO: 638230 - DNA, 25 bp, Rattus norvegicus
tgggtaatcccttcaacctgacatt

SEQ ID NO: 638231 - DNA, 25 bp, Rattus norvegicus
tgggtaatgactaccttcacctgct

SEQ ID NO: 638232 - DNA, 25 bp, Rattus norvegicus
tgggtaatgacttccttcacctgct

SEQ ID NO: 638233 - DNA, 25 bp, Rattus norvegicus
tgggtaatgcggcactcaacagcaa

SEQ ID NO: 638234 - DNA, 25 bp, Rattus norvegicus
tgggtaatgcgggactcaacagcaa

SEQ ID NO: 638235 - DNA, 25 bp, Rattus norvegicus
tgggtaattcccctgtccccaattg

SEQ ID NO: 638236 - DNA, 25 bp, Rattus norvegicus
tgggtaattcccgtgtccccaattg

SEQ ID NO: 638237 - DNA, 25 bp, Rattus norvegicus
tgggtacacaacaaccctttcggct

SEQ ID NO: 638238 - DNA, 25 bp, Rattus norvegicus
tgggtacacaactaccctttcggct

SEQ ID NO: 638239 - DNA, 25 bp, Rattus norvegicus
tgggtacaccacaggaccatgaact

SEQ ID NO: 638240 - DNA, 25 bp, Rattus norvegicus
tgggtacaccactggaccatgaact

SEQ ID NO: 638241 - DNA, 25 bp, Rattus norvegicus
tgggtaccaaggaccagaccatctt

SEQ ID NO: 638242 - DNA, 25 bp, Rattus norvegicus
tgggtaccaaggtccagaccatctt

SEQ ID NO: 638243 - DNA, 25 bp, Rattus norvegicus
tgggtaccacttcttgagcctttta

SEQ ID NO: 638244 - DNA, 25 bp, Rattus norvegicus
tgggtaccacttgttgagcctttta

SEQ ID NO: 638245 - DNA, 25 bp, Rattus norvegicus
tgggtaccagcacgttcacagcgct

SEQ ID NO: 638246 - DNA, 25 bp, Rattus norvegicus
tgggtaccagcaggttcacagcgct

SEQ ID NO: 638247 - DNA, 25 bp, Rattus norvegicus
tgggtaccaggcatgatgtttgatc

SEQ ID NO: 638248 - DNA, 25 bp, Rattus norvegicus
tgggtaccaggcttgatgtttgatc

SEQ ID NO: 638249 - DNA, 25 bp, Rattus norvegicus
tgggtaccccacaccaaggatgatt

SEQ ID NO: 638250 - DNA, 25 bp, Rattus norvegicus
tgggtaccccactccaaggatgatt

SEQ ID NO: 638251 - DNA, 25 bp, Rattus norvegicus
tgggtaccccatcttcctgatttat

SEQ ID NO: 638252 - DNA, 25 bp, Rattus norvegicus
tgggtaccccatgttcctgatttat

SEQ ID NO: 638253 - DNA, 25 bp, Rattus norvegicus
tgggtaccctctctttaggtccgcg

SEQ ID NO: 638254 - DNA, 25 bp, Rattus norvegicus
tgggtaccctctgtttaggtccgcg

SEQ ID NO: 638255 - DNA, 25 bp, Rattus norvegicus
tgggtaccggtaatcctcacggcat

SEQ ID NO: 638256 - DNA, 25 bp, Rattus norvegicus
tgggtaccggtattcctcacggcat

SEQ ID NO: 638257 - DNA, 25 bp, Rattus norvegicus
tgggtaccgttgactacacgaaggt

SEQ ID NO: 638258 - DNA, 25 bp, Rattus norvegicus
tgggtaccgttgtctacacgaaggt

SEQ ID NO: 638259 - DNA, 25 bp, Rattus norvegicus
tgggtacctcttatgggctggcagt

SEQ ID NO: 638260 - DNA, 25 bp, Rattus norvegicus
tgggtacctcttttgggctggcagt

SEQ ID NO: 638261 - DNA, 25 bp, Rattus norvegicus
tgggtacctgacctctagtttactt

SEQ ID NO: 638262 - DNA, 25 bp, Rattus norvegicus
tgggtacctgacgtctagtttactt

SEQ ID NO: 638263 - DNA, 25 bp, Rattus norvegicus
tgggtacgaaacaacctctcactgg

SEQ ID NO: 638264 - DNA, 25 bp, Rattus norvegicus
tgggtacgaaactacctctcactgg

SEQ ID NO: 638265 - DNA, 25 bp, Rattus norvegicus
tgggtacgatcaaagcacccgcctg

SEQ ID NO: 638266 - DNA, 25 bp, Rattus norvegicus
tgggtacgatcatagcacccgcctg

SEQ ID NO: 638267 - DNA, 25 bp, Rattus norvegicus
tgggtacgtattcctcttacagaga

SEQ ID NO: 638268 - DNA, 25 bp, Rattus norvegicus
tgggtacgtattgctcttacagaga

SEQ ID NO: 638269 - DNA, 25 bp, Rattus norvegicus
tgggtactagatcccctgcaaacac

SEQ ID NO: 638270 - DNA, 25 bp, Rattus norvegicus
tgggtactagatgccctgcaaacac

SEQ ID NO: 638271 - DNA, 25 bp, Rattus norvegicus
tgggtactcagactcgccccgagtt

SEQ ID NO: 638272 - DNA, 25 bp, Rattus norvegicus
tgggtactcagagtcgccccgagtt

SEQ ID NO: 638273 - DNA, 25 bp, Rattus norvegicus
tgggtactcctgctgtggcctgcaa

SEQ ID NO: 638274 - DNA, 25 bp, Rattus norvegicus
tgggtactcctggtgtggcctgcaa

SEQ ID NO: 638275 - DNA, 25 bp, Rattus norvegicus
tgggtactcttgacagaggcacact

SEQ ID NO: 638276 - DNA, 25 bp, Rattus norvegicus
tgggtactcttgcatcagctaaaac

SEQ ID NO: 638277 - DNA, 25 bp, Rattus norvegicus
tgggtactcttggatcagctaaaac

SEQ ID NO: 638278 - DNA, 25 bp, Rattus norvegicus
tgggtactcttgtcagaggcacact

SEQ ID NO: 638279 - DNA, 25 bp, Rattus norvegicus
tgggtactgttgacgacatgaagat

SEQ ID NO: 638280 - DNA, 25 bp, Rattus norvegicus
tgggtactgttgtcgacatgaagat

SEQ ID NO: 638281 - DNA, 25 bp, Rattus norvegicus
tgggtacttcacactcagagggtct

SEQ ID NO: 638282 - DNA, 25 bp, Rattus norvegicus
tgggtacttcactctcagagggtct

SEQ ID NO: 638283 - DNA, 25 bp, Rattus norvegicus
tgggtacttcttcctagacgaacgg

SEQ ID NO: 638284 - DNA, 25 bp, Rattus norvegicus
tgggtacttcttgctagacgaacgg

SEQ ID NO: 638285 - DNA, 25 bp, Rattus norvegicus
tgggtagcacttcccgttaacaaca

SEQ ID NO: 638286 - DNA, 25 bp, Rattus norvegicus
tgggtagcacttgccgttaacaaca

SEQ ID NO: 638287 - DNA, 25 bp, Rattus norvegicus
tgggtagcagccacctgcacaatgt

SEQ ID NO: 638288 - DNA, 25 bp, Rattus norvegicus
tgggtagcagcctcctgcacaatgt

SEQ ID NO: 638289 - DNA, 25 bp, Rattus norvegicus
tgggtagccacgatctgtcttgtcc

SEQ ID NO: 638290 - DNA, 25 bp, Rattus norvegicus
tgggtagccacgttctgtcttgtcc

SEQ ID NO: 638291 - DNA, 25 bp, Rattus norvegicus
tgggtagccatcacaaagctgctgt

SEQ ID NO: 638292 - DNA, 25 bp, Rattus norvegicus
tgggtagccatctcaaagctgctgt

SEQ ID NO: 638293 - DNA, 25 bp, Rattus norvegicus
tgggtagcgactcctcggtcaccag

SEQ ID NO: 638294 - DNA, 25 bp, Rattus norvegicus
tgggtagcgactgctcggtcaccag

SEQ ID NO: 638295 - DNA, 25 bp, Rattus norvegicus
tgggtagctgatccactctttacac

SEQ ID NO: 638296 - DNA, 25 bp, Rattus norvegicus
tgggtagctgatgcactctttacac

SEQ ID NO: 638297 - DNA, 25 bp, Rattus norvegicus
tgggtagctttcagtcaggcagtgc

SEQ ID NO: 638298 - DNA, 25 bp, Rattus norvegicus
tgggtagctttctgtcaggcagtgc

SEQ ID NO: 638299 - DNA, 25 bp, Rattus norvegicus
tgggtaggttttagtcggccctgct

SEQ ID NO: 638300 - DNA, 25 bp, Rattus norvegicus
tgggtaggtttttgtcggccctgct

SEQ ID NO: 638301 - DNA, 25 bp, Rattus norvegicus
tgggtagtccaaactgtgggcctcc

SEQ ID NO: 638302 - DNA, 25 bp, Rattus norvegicus
tgggtagtccaatctgtgggcctcc

SEQ ID NO: 638303 - DNA, 25 bp, Rattus norvegicus
tgggtagtgctcaagattctcctca

SEQ ID NO: 638304 - DNA, 25 bp, Rattus norvegicus
tgggtagtgctctagattctcctca

SEQ ID NO: 638305 - DNA, 25 bp, Rattus norvegicus
tgggtagttcgtcctttgagccact

SEQ ID NO: 638306 - DNA, 25 bp, Rattus norvegicus
tgggtagttcgtgctttgagccact

SEQ ID NO: 638307 - DNA, 25 bp, Rattus norvegicus
tgggtataagcccagctccagccaa

SEQ ID NO: 638308 - DNA, 25 bp, Rattus norvegicus
tgggtataagccgagctccagccaa

SEQ ID NO: 638309 - DNA, 25 bp, Rattus norvegicus
tgggtatagccccacccatgtaggg

SEQ ID NO: 638310 - DNA, 25 bp, Rattus norvegicus
tgggtatagcccgacccatgtaggg

SEQ ID NO: 638311 - DNA, 25 bp, Rattus norvegicus
tgggtatcacttcccactgctaaac

SEQ ID NO: 638312 - DNA, 25 bp, Rattus norvegicus
tgggtatcacttgccactgctaaac

SEQ ID NO: 638313 - DNA, 25 bp, Rattus norvegicus
tgggtatccaccatgatgctgtcat

SEQ ID NO: 638314 - DNA, 25 bp, Rattus norvegicus
tgggtatccaccttgatgctgtcat

SEQ ID NO: 638315 - DNA, 25 bp, Rattus norvegicus
tgggtatccttgaccaactggtgat

SEQ ID NO: 638316 - DNA, 25 bp, Rattus norvegicus
tgggtatccttgtccaactggtgat

SEQ ID NO: 638317 - DNA, 25 bp, Rattus norvegicus
tgggtatcgaggaccaggttcttac

SEQ ID NO: 638318 - DNA, 25 bp, Rattus norvegicus
tgggtatcgaggtccaggttcttac

SEQ ID NO: 638319 - DNA, 25 bp, Rattus norvegicus
tgggtatgagtcatccctccttgtc

SEQ ID NO: 638320 - DNA, 25 bp, Rattus norvegicus
tgggtatgagtcttccctccttgtc

SEQ ID NO: 638321 - DNA, 25 bp, Rattus norvegicus
tgggtatggaggacctgccagccaa

SEQ ID NO: 638322 - DNA, 25 bp, Rattus norvegicus
tgggtatggaggtcctgccagccaa

SEQ ID NO: 638323 - DNA, 25 bp, Rattus norvegicus
tgggtatgtaccaggaaccacagca

SEQ ID NO: 638324 - DNA, 25 bp, Rattus norvegicus
tgggtatgtacctggaaccacagca

SEQ ID NO: 638325 - DNA, 25 bp, Rattus norvegicus
tgggtattaagaactgaacctgggt

SEQ ID NO: 638326 - DNA, 25 bp, Rattus norvegicus
tgggtattaagatctgaacctgggt

SEQ ID NO: 638327 - DNA, 25 bp, Rattus norvegicus
tgggtattatccatctcaggcacct

SEQ ID NO: 638328 - DNA, 25 bp, Rattus norvegicus
tgggtattatccttctcaggcacct

SEQ ID NO: 638329 - DNA, 25 bp, Rattus norvegicus
tgggtattatctccctgtcagacat

SEQ ID NO: 638330 - DNA, 25 bp, Rattus norvegicus
tgggtattatctgcctgtcagacat

SEQ ID NO: 638331 - DNA, 25 bp, Rattus norvegicus
tgggtattggccaacactccgtctt

SEQ ID NO: 638332 - DNA, 25 bp, Rattus norvegicus
tgggtattggcctacactccgtctt

SEQ ID NO: 638333 - DNA, 25 bp, Rattus norvegicus
tgggtatttcatctgcatgtatgtc

SEQ ID NO: 638334 - DNA, 25 bp, Rattus norvegicus
tgggtatttcatgtgcatgtatgtc

SEQ ID NO: 638335 - DNA, 25 bp, Rattus norvegicus
tgggtcaaacctctaagtcttcata

SEQ ID NO: 638336 - DNA, 25 bp, Rattus norvegicus
tgggtcaaacctgtaagtcttcata

SEQ ID NO: 638337 - DNA, 25 bp, Rattus norvegicus
tgggtcaaggcaaaaaccatccagc

SEQ ID NO: 638338 - DNA, 25 bp, Rattus norvegicus
tgggtcaaggcataaaccatccagc

SEQ ID NO: 638339 - DNA, 25 bp, Rattus norvegicus
tgggtcaattagaaaaacctcatga

SEQ ID NO: 638340 - DNA, 25 bp, Rattus norvegicus
tgggtcaattagtaaaacctcatga

SEQ ID NO: 638341 - DNA, 25 bp, Rattus norvegicus
tgggtcacacaaactaaacaatatt

SEQ ID NO: 638342 - DNA, 25 bp, Rattus norvegicus
tgggtcacacaatctaaacaatatt

SEQ ID NO: 638343 - DNA, 25 bp, Rattus norvegicus
tgggtcacagccatccgtaattgga

SEQ ID NO: 638344 - DNA, 25 bp, Rattus norvegicus
tgggtcacagccttccgtaattgga

SEQ ID NO: 638345 - DNA, 25 bp, Rattus norvegicus
tgggtcacatagacagtctgtccat

SEQ ID NO: 638346 - DNA, 25 bp, Rattus norvegicus
tgggtcacatagtcagtctgtccat

SEQ ID NO: 638347 - DNA, 25 bp, Rattus norvegicus
tgggtcaccaacaagaaggaacctt

SEQ ID NO: 638348 - DNA, 25 bp, Rattus norvegicus
tgggtcaccaactagaaggaacctt

SEQ ID NO: 638349 - DNA, 25 bp, Rattus norvegicus
tgggtcacccacaaactagttctgg

SEQ ID NO: 638350 - DNA, 25 bp, Rattus norvegicus
tgggtcacccactaactagttctgg

SEQ ID NO: 638351 - DNA, 25 bp, Rattus norvegicus
tgggtcaccgccactctgcaagtgg

SEQ ID NO: 638352 - DNA, 25 bp, Rattus norvegicus
tgggtcaccgcctctctgcaagtgg

SEQ ID NO: 638353 - DNA, 25 bp, Rattus norvegicus
tgggtcaccgcgatgcgccttaaga

SEQ ID NO: 638354 - DNA, 25 bp, Rattus norvegicus
tgggtcaccgcgttgcgccttaaga

SEQ ID NO: 638355 - DNA, 25 bp, Rattus norvegicus
tgggtcacctaaagagtttacacca

SEQ ID NO: 638356 - DNA, 25 bp, Rattus norvegicus
tgggtcacctaatgagtttacacca

SEQ ID NO: 638357 - DNA, 25 bp, Rattus norvegicus
tgggtcactgagatcaccatcttga

SEQ ID NO: 638358 - DNA, 25 bp, Rattus norvegicus
tgggtcactgagttcaccatcttga

SEQ ID NO: 638359 - DNA, 25 bp, Rattus norvegicus
tgggtcactgtgcaagcttctttat

SEQ ID NO: 638360 - DNA, 25 bp, Rattus norvegicus
tgggtcactgtggaagcttctttat

SEQ ID NO: 638361 - DNA, 25 bp, Rattus norvegicus
tgggtcagagacaattcctactaag

SEQ ID NO: 638362 - DNA, 25 bp, Rattus norvegicus
tgggtcagagactattcctactaag

SEQ ID NO: 638363 - DNA, 25 bp, Rattus norvegicus
tgggtcaggcagctgatcctcgctt

SEQ ID NO: 638364 - DNA, 25 bp, Rattus norvegicus
tgggtcaggcaggtgatcctcgctt

SEQ ID NO: 638365 - DNA, 25 bp, Rattus norvegicus
tgggtcagtccacatatccatggtc

SEQ ID NO: 638366 - DNA, 25 bp, Rattus norvegicus
tgggtcagtccagatatccatggtc

SEQ ID NO: 638367 - DNA, 25 bp, Rattus norvegicus
tgggtcagttggacttcttgctaaa

SEQ ID NO: 638368 - DNA, 25 bp, Rattus norvegicus
tgggtcagttggtcttcttgctaaa

SEQ ID NO: 638369 - DNA, 25 bp, Rattus norvegicus
tgggtcatcaccaagtatgtgtatt

SEQ ID NO: 638370 - DNA, 25 bp, Rattus norvegicus
tgggtcatcacctagtatgtgtatt

SEQ ID NO: 638371 - DNA, 25 bp, Rattus norvegicus
tgggtcatcccaatgtgagttccag

SEQ ID NO: 638372 - DNA, 25 bp, Rattus norvegicus
tgggtcatcccattgtgagttccag

SEQ ID NO: 638373 - DNA, 25 bp, Rattus norvegicus
tgggtcatcgctccttgatgagata

SEQ ID NO: 638374 - DNA, 25 bp, Rattus norvegicus
tgggtcatcgctgcttgatgagata

SEQ ID NO: 638375 - DNA, 25 bp, Rattus norvegicus
tgggtcatctcgcatcaccaggagc

SEQ ID NO: 638376 - DNA, 25 bp, Rattus norvegicus
tgggtcatctcggatcaccaggagc

SEQ ID NO: 638377 - DNA, 25 bp, Rattus norvegicus
tgggtcatgaccctgcttagcagtt

SEQ ID NO: 638378 - DNA, 25 bp, Rattus norvegicus
tgggtcatgaccgtgcttagcagtt

SEQ ID NO: 638379 - DNA, 25 bp, Rattus norvegicus
tgggtcatgggcacttttaaaggga

SEQ ID NO: 638380 - DNA, 25 bp, Rattus norvegicus
tgggtcatgggctcttttaaaggga

SEQ ID NO: 638381 - DNA, 25 bp, Rattus norvegicus
tgggtcatgtgaccaaggtcattgc

SEQ ID NO: 638382 - DNA, 25 bp, Rattus norvegicus
tgggtcatgtgagcaaggtcattgc

SEQ ID NO: 638383 - DNA, 25 bp, Rattus norvegicus
tgggtcattagacccagaccttcct

SEQ ID NO: 638384 - DNA, 25 bp, Rattus norvegicus
tgggtcattagagccagaccttcct

SEQ ID NO: 638385 - DNA, 25 bp, Rattus norvegicus
tgggtccaaatcatgccctttgtga

SEQ ID NO: 638386 - DNA, 25 bp, Rattus norvegicus
tgggtccaaatccagcagaagctgc

SEQ ID NO: 638387 - DNA, 25 bp, Rattus norvegicus
tgggtccaaatcgagcagaagctgc

SEQ ID NO: 638388 - DNA, 25 bp, Rattus norvegicus
tgggtccaaatcttgccctttgtga

SEQ ID NO: 638389 - DNA, 25 bp, Rattus norvegicus
tgggtccaacggcagcggcacacgc

SEQ ID NO: 638390 - DNA, 25 bp, Rattus norvegicus
tgggtccaacgggagcggcacacgc

SEQ ID NO: 638391 - DNA, 25 bp, Rattus norvegicus
tgggtccacattaagaacacatgca

SEQ ID NO: 638392 - DNA, 25 bp, Rattus norvegicus
tgggtccacatttagaacacatgca

SEQ ID NO: 638393 - DNA, 25 bp, Rattus norvegicus
tgggtccagaagctgcagttccctg

SEQ ID NO: 638394 - DNA, 25 bp, Rattus norvegicus
tgggtccagaaggtgcagttccctg

SEQ ID NO: 638395 - DNA, 25 bp, Rattus norvegicus
tgggtccagccacaactgcggacaa

SEQ ID NO: 638396 - DNA, 25 bp, Rattus norvegicus
tgggtccagccagaactgcggacaa

SEQ ID NO: 638397 - DNA, 25 bp, Rattus norvegicus
tgggtccagggacttcaataattac

SEQ ID NO: 638398 - DNA, 25 bp, Rattus norvegicus
tgggtccagggagttcaataattac

SEQ ID NO: 638399 - DNA, 25 bp, Rattus norvegicus
tgggtccaggttctggtccacgaac

SEQ ID NO: 638400 - DNA, 25 bp, Rattus norvegicus
tgggtccaggttgtggtccacgaac

SEQ ID NO: 638401 - DNA, 25 bp, Rattus norvegicus
tgggtccatctacactccattgtca

SEQ ID NO: 638402 - DNA, 25 bp, Rattus norvegicus
tgggtccatctagactccattgtca

SEQ ID NO: 638403 - DNA, 25 bp, Rattus norvegicus
tgggtccattgaaacagctgtggct

SEQ ID NO: 638404 - DNA, 25 bp, Rattus norvegicus
tgggtccattgatacagctgtggct

SEQ ID NO: 638405 - DNA, 25 bp, Rattus norvegicus
tgggtcccaaacaactgcgagctgg

SEQ ID NO: 638406 - DNA, 25 bp, Rattus norvegicus
tgggtcccaaactactgcgagctgg

SEQ ID NO: 638407 - DNA, 25 bp, Rattus norvegicus
tgggtcccaccactgttgccgaggt

SEQ ID NO: 638408 - DNA, 25 bp, Rattus norvegicus
tgggtcccaccagtgttgccgaggt

SEQ ID NO: 638409 - DNA, 25 bp, Rattus norvegicus
tgggtcccagaaccaccattcactg

SEQ ID NO: 638410 - DNA, 25 bp, Rattus norvegicus
tgggtcccagaagcaccattcactg

SEQ ID NO: 638411 - DNA, 25 bp, Rattus norvegicus
tgggtcccagacattagtgattttc

SEQ ID NO: 638412 - DNA, 25 bp, Rattus norvegicus
tgggtcccagactttagtgattttc

SEQ ID NO: 638413 - DNA, 25 bp, Rattus norvegicus
tgggtcccagcaccccggagcagct

SEQ ID NO: 638414 - DNA, 25 bp, Rattus norvegicus
tgggtcccagcagcccggagcagct

SEQ ID NO: 638415 - DNA, 25 bp, Rattus norvegicus
tgggtcccaggcagcatcctggcac

SEQ ID NO: 638416 - DNA, 25 bp, Rattus norvegicus
tgggtcccaggctgcatcctggcac

SEQ ID NO: 638417 - DNA, 25 bp, Rattus norvegicus
tgggtcccatgaagtagatctgcct

SEQ ID NO: 638418 - DNA, 25 bp, Rattus norvegicus
tgggtcccatgatgtagatctgcct

SEQ ID NO: 638419 - DNA, 25 bp, Rattus norvegicus
tgggtccccaaacaaaccgatgtga

SEQ ID NO: 638420 - DNA, 25 bp, Rattus norvegicus
tgggtccccaaagaaaccgatgtga

SEQ ID NO: 638421 - DNA, 25 bp, Rattus norvegicus
tgggtccccatcaaagagtacagct

SEQ ID NO: 638422 - DNA, 25 bp, Rattus norvegicus
tgggtccccatctaagagtacagct

SEQ ID NO: 638423 - DNA, 25 bp, Rattus norvegicus
tgggtccccgaaacctttggaggag

SEQ ID NO: 638424 - DNA, 25 bp, Rattus norvegicus
tgggtccccgaatcctttggaggag

SEQ ID NO: 638425 - DNA, 25 bp, Rattus norvegicus
tgggtccccgctctcattaaggtat

SEQ ID NO: 638426 - DNA, 25 bp, Rattus norvegicus
tgggtccccgctgtcattaaggtat

SEQ ID NO: 638427 - DNA, 25 bp, Rattus norvegicus
tgggtcccctaacaagtgttcatgt

SEQ ID NO: 638428 - DNA, 25 bp, Rattus norvegicus
tgggtcccctaagaagtgttcatgt

SEQ ID NO: 638429 - DNA, 25 bp, Rattus norvegicus
tgggtcccctgtaggtggtactgtt

SEQ ID NO: 638430 - DNA, 25 bp, Rattus norvegicus
tgggtcccctgttggtggtactgtt

SEQ ID NO: 638431 - DNA, 25 bp, Rattus norvegicus
tgggtcccgacccagtgcacaaaag

SEQ ID NO: 638432 - DNA, 25 bp, Rattus norvegicus
tgggtcccgaccgagtgcacaaaag

SEQ ID NO: 638433 - DNA, 25 bp, Rattus norvegicus
tgggtccctagaccatttggtaaac

SEQ ID NO: 638434 - DNA, 25 bp, Rattus norvegicus
tgggtccctagagcatttggtaaac

SEQ ID NO: 638435 - DNA, 25 bp, Rattus norvegicus
tgggtccctagcacctgatgtcgaa

SEQ ID NO: 638436 - DNA, 25 bp, Rattus norvegicus
tgggtccctagccacagataccaca

SEQ ID NO: 638437 - DNA, 25 bp, Rattus norvegicus
tgggtccctagcgacagataccaca

SEQ ID NO: 638438 - DNA, 25 bp, Rattus norvegicus
tgggtccctagctcctgatgtcgaa

SEQ ID NO: 638439 - DNA, 25 bp, Rattus norvegicus
tgggtccctcttcttaggtctggat

SEQ ID NO: 638440 - DNA, 25 bp, Rattus norvegicus
tgggtccctcttgttaggtctggat

SEQ ID NO: 638441 - DNA, 25 bp, Rattus norvegicus
tgggtccctgcaagctaagtacata

SEQ ID NO: 638442 - DNA, 25 bp, Rattus norvegicus
tgggtccctgcatgctaagtacata

SEQ ID NO: 638443 - DNA, 25 bp, Rattus norvegicus
tgggtcccttcaacttcatcaagat

SEQ ID NO: 638444 - DNA, 25 bp, Rattus norvegicus
tgggtcccttcatcttcatcaagat

SEQ ID NO: 638445 - DNA, 25 bp, Rattus norvegicus
tgggtcccttggatcttactcataa

SEQ ID NO: 638446 - DNA, 25 bp, Rattus norvegicus
tgggtcccttggttcttactcataa

SEQ ID NO: 638447 - DNA, 25 bp, Rattus norvegicus
tgggtccctttccttaccagagaag

SEQ ID NO: 638448 - DNA, 25 bp, Rattus norvegicus
tgggtccctttcgttaccagagaag

SEQ ID NO: 638449 - DNA, 25 bp, Rattus norvegicus
tgggtccgacatacagttttctcac

SEQ ID NO: 638450 - DNA, 25 bp, Rattus norvegicus
tgggtccgacattcagttttctcac

SEQ ID NO: 638451 - DNA, 25 bp, Rattus norvegicus
tgggtccgagggacacagccaagac

SEQ ID NO: 638452 - DNA, 25 bp, Rattus norvegicus
tgggtccgagggtcacagccaagac

SEQ ID NO: 638453 - DNA, 25 bp, Rattus norvegicus
tgggtcctagccagcatggacgaga

SEQ ID NO: 638454 - DNA, 25 bp, Rattus norvegicus
tgggtcctagcctgcatggacgaga

SEQ ID NO: 638455 - DNA, 25 bp, Rattus norvegicus
tgggtcctagttcacgcttttgaga

SEQ ID NO: 638456 - DNA, 25 bp, Rattus norvegicus
tgggtcctagttgacgcttttgaga

SEQ ID NO: 638457 - DNA, 25 bp, Rattus norvegicus
tgggtcctcagtagagccctgtgca

SEQ ID NO: 638458 - DNA, 25 bp, Rattus norvegicus
tgggtcctcagttgagccctgtgca

SEQ ID NO: 638459 - DNA, 25 bp, Rattus norvegicus
tgggtcctcctgcaaagcccaggaa

SEQ ID NO: 638460 - DNA, 25 bp, Rattus norvegicus
tgggtcctcctggaaagcccaggaa

SEQ ID NO: 638461 - DNA, 25 bp, Rattus norvegicus
tgggtcctctcaacctgaggaagaa

SEQ ID NO: 638462 - DNA, 25 bp, Rattus norvegicus
tgggtcctctcaataaactgtctat

SEQ ID NO: 638463 - DNA, 25 bp, Rattus norvegicus
tgggtcctctcatcctgaggaagaa

SEQ ID NO: 638464 - DNA, 25 bp, Rattus norvegicus
tgggtcctctcattaaactgtctat

SEQ ID NO: 638465 - DNA, 25 bp, Rattus norvegicus
tgggtcctgctgatcacctcagaag

SEQ ID NO: 638466 - DNA, 25 bp, Rattus norvegicus
tgggtcctgctgttcacctcagaag

SEQ ID NO: 638467 - DNA, 25 bp, Rattus norvegicus
tgggtcctgggaacaatgcactgcc

SEQ ID NO: 638468 - DNA, 25 bp, Rattus norvegicus
tgggtcctgggatcaatgcactgcc

SEQ ID NO: 638469 - DNA, 25 bp, Rattus norvegicus
tgggtcctgggcaggaaaccacatg

SEQ ID NO: 638470 - DNA, 25 bp, Rattus norvegicus
tgggtcctgggctggaaaccacatg

SEQ ID NO: 638471 - DNA, 25 bp, Rattus norvegicus
tgggtcctgggtatactacaccact

SEQ ID NO: 638472 - DNA, 25 bp, Rattus norvegicus
tgggtcctgggtttactacaccact

SEQ ID NO: 638473 - DNA, 25 bp, Rattus norvegicus
tgggtcctgtggctgaaatgctcaa

SEQ ID NO: 638474 - DNA, 25 bp, Rattus norvegicus
tgggtcctgtgggtgaaatgctcaa

SEQ ID NO: 638475 - DNA, 25 bp, Rattus norvegicus
tgggtccttaggactgcatgcaaag

SEQ ID NO: 638476 - DNA, 25 bp, Rattus norvegicus
tgggtccttaggtctgcatgcaaag

SEQ ID NO: 638477 - DNA, 25 bp, Rattus norvegicus
tgggtccttcccatttggagagata

SEQ ID NO: 638478 - DNA, 25 bp, Rattus norvegicus
tgggtccttcccttttggagagata

SEQ ID NO: 638479 - DNA, 25 bp, Rattus norvegicus
tgggtccttgtgatgttggcgaatc

SEQ ID NO: 638480 - DNA, 25 bp, Rattus norvegicus
tgggtccttgtgttgttggcgaatc

SEQ ID NO: 638481 - DNA, 25 bp, Rattus norvegicus
tgggtcctttcacatgtttgcaata

SEQ ID NO: 638482 - DNA, 25 bp, Rattus norvegicus
tgggtcctttcagatgtttgcaata

SEQ ID NO: 638483 - DNA, 25 bp, Rattus norvegicus
tgggtccttttaatggttaacatag

SEQ ID NO: 638484 - DNA, 25 bp, Rattus norvegicus
tgggtccttttattggttaacatag

SEQ ID NO: 638485 - DNA, 25 bp, Rattus norvegicus
tgggtcgcaggcagcccctactgtg

SEQ ID NO: 638486 - DNA, 25 bp, Rattus norvegicus
tgggtcgcaggctgcccctactgtg

SEQ ID NO: 638487 - DNA, 25 bp, Rattus norvegicus
tgggtcggcaccagttcagattacc

SEQ ID NO: 638488 - DNA, 25 bp, Rattus norvegicus
tgggtcggcacctgttcagattacc

SEQ ID NO: 638489 - DNA, 25 bp, Rattus norvegicus
tgggtcgggttgataacgcctttct

SEQ ID NO: 638490 - DNA, 25 bp, Rattus norvegicus
tgggtcgggttgttaacgcctttct

SEQ ID NO: 638491 - DNA, 25 bp, Rattus norvegicus
tgggtcggtggcagtccaccacatc

SEQ ID NO: 638492 - DNA, 25 bp, Rattus norvegicus
tgggtcggtggctgtccaccacatc

SEQ ID NO: 638493 - DNA, 25 bp, Rattus norvegicus
tgggtcgtcaagatggagtcctgca

SEQ ID NO: 638494 - DNA, 25 bp, Rattus norvegicus
tgggtcgtcaagttggagtcctgca

SEQ ID NO: 638495 - DNA, 25 bp, Rattus norvegicus
tgggtcgtcttgctcctcttgtgcc

SEQ ID NO: 638496 - DNA, 25 bp, Rattus norvegicus
tgggtcgtcttggtcctcttgtgcc

SEQ ID NO: 638497 - DNA, 25 bp, Rattus norvegicus
tgggtctacacaccagggtctacac

SEQ ID NO: 638498 - DNA, 25 bp, Rattus norvegicus
tgggtctacacagcagggtctacac

SEQ ID NO: 638499 - DNA, 25 bp, Rattus norvegicus
tgggtctacttgctacctcacagga

SEQ ID NO: 638500 - DNA, 25 bp, Rattus norvegicus
tgggtctacttggtacctcacagga

SEQ ID NO: 638501 - DNA, 25 bp, Rattus norvegicus
tgggtctatgcgactgcctagctct

SEQ ID NO: 638502 - DNA, 25 bp, Rattus norvegicus
tgggtctatgcgtctgcctagctct

SEQ ID NO: 638503 - DNA, 25 bp, Rattus norvegicus
tgggtctcaacgacatggcttcgga

SEQ ID NO: 638504 - DNA, 25 bp, Rattus norvegicus
tgggtctcaacgtcatggcttcgga

SEQ ID NO: 638505 - DNA, 25 bp, Rattus norvegicus
tgggtctcaagacttcacgtaggaa

SEQ ID NO: 638506 - DNA, 25 bp, Rattus norvegicus
tgggtctcaagagttcacgtaggaa

SEQ ID NO: 638507 - DNA, 25 bp, Rattus norvegicus
tgggtctcaatcctagtcttttgca

SEQ ID NO: 638508 - DNA, 25 bp, Rattus norvegicus
tgggtctcaatcgtagtcttttgca

SEQ ID NO: 638509 - DNA, 25 bp, Rattus norvegicus
tgggtctcactacatagtcctggct

SEQ ID NO: 638510 - DNA, 25 bp, Rattus norvegicus
tgggtctcactagatagtcctggct

SEQ ID NO: 638511 - DNA, 25 bp, Rattus norvegicus
tgggtctcacttaacagaagccagt

SEQ ID NO: 638512 - DNA, 25 bp, Rattus norvegicus
tgggtctcactttacagaagccagt

SEQ ID NO: 638513 - DNA, 25 bp, Rattus norvegicus
tgggtctcagcgaggactcaggtaa

SEQ ID NO: 638514 - DNA, 25 bp, Rattus norvegicus
tgggtctcagcgtggactcaggtaa

SEQ ID NO: 638515 - DNA, 25 bp, Rattus norvegicus
tgggtctcatgaccgtgaactacta

SEQ ID NO: 638516 - DNA, 25 bp, Rattus norvegicus
tgggtctcatgagcgtgaactacta

SEQ ID NO: 638517 - DNA, 25 bp, Rattus norvegicus
tgggtctccatacgcatgtttctga

SEQ ID NO: 638518 - DNA, 25 bp, Rattus norvegicus
tgggtctccataggcatgtttctga

SEQ ID NO: 638519 - DNA, 25 bp, Rattus norvegicus
tgggtctccatgcaaggccgccgca

SEQ ID NO: 638520 - DNA, 25 bp, Rattus norvegicus
tgggtctccatggaaggccgccgca

SEQ ID NO: 638521 - DNA, 25 bp, Rattus norvegicus
tgggtctccctgagtgctcagccac

SEQ ID NO: 638522 - DNA, 25 bp, Rattus norvegicus
tgggtctccctgtgtgctcagccac

SEQ ID NO: 638523 - DNA, 25 bp, Rattus norvegicus
tgggtctccggcatttgaatacttg

SEQ ID NO: 638524 - DNA, 25 bp, Rattus norvegicus
tgggtctccggcttttgaatacttg

SEQ ID NO: 638525 - DNA, 25 bp, Rattus norvegicus
tgggtctcgagtctttgctgatctt

SEQ ID NO: 638526 - DNA, 25 bp, Rattus norvegicus
tgggtctcgagtgtttgctgatctt

SEQ ID NO: 638527 - DNA, 25 bp, Rattus norvegicus
tgggtctcgccaaggtaccaggaca

SEQ ID NO: 638528 - DNA, 25 bp, Rattus norvegicus
tgggtctcgccatggtaccaggaca

SEQ ID NO: 638529 - DNA, 25 bp, Rattus norvegicus
tgggtctctgccctcaccagtgctg

SEQ ID NO: 638530 - DNA, 25 bp, Rattus norvegicus
tgggtctctgccgtcaccagtgctg

SEQ ID NO: 638531 - DNA, 25 bp, Rattus norvegicus
tgggtctcttaaatcctatcagctc

SEQ ID NO: 638532 - DNA, 25 bp, Rattus norvegicus
tgggtctcttaattcctatcagctc

SEQ ID NO: 638533 - DNA, 25 bp, Rattus norvegicus
tgggtctcttctccaccaatgtggc

SEQ ID NO: 638534 - DNA, 25 bp, Rattus norvegicus
tgggtctcttctgcaccaatgtggc

SEQ ID NO: 638535 - DNA, 25 bp, Rattus norvegicus
tgggtctgacctaacagtgttccag

SEQ ID NO: 638536 - DNA, 25 bp, Rattus norvegicus
tgggtctgaccttacagtgttccag

SEQ ID NO: 638537 - DNA, 25 bp, Rattus norvegicus
tgggtctgcacgactactgtgacat

SEQ ID NO: 638538 - DNA, 25 bp, Rattus norvegicus
tgggtctgcacgtctactgtgacat

SEQ ID NO: 638539 - DNA, 25 bp, Rattus norvegicus
tgggtctgccatagccccaggaagg

SEQ ID NO: 638540 - DNA, 25 bp, Rattus norvegicus
tgggtctgccattgccccaggaagg

SEQ ID NO: 638541 - DNA, 25 bp, Rattus norvegicus
tgggtctgcctacgatccaagcgac

SEQ ID NO: 638542 - DNA, 25 bp, Rattus norvegicus
tgggtctgcctaggatccaagcgac

SEQ ID NO: 638543 - DNA, 25 bp, Rattus norvegicus
tgggtctgctttaccactgtggaga

SEQ ID NO: 638544 - DNA, 25 bp, Rattus norvegicus
tgggtctgcttttccactgtggaga

SEQ ID NO: 638545 - DNA, 25 bp, Rattus norvegicus
tgggtctggcttaaatctctactcc

SEQ ID NO: 638546 - DNA, 25 bp, Rattus norvegicus
tgggtctggctttaatctctactcc

SEQ ID NO: 638547 - DNA, 25 bp, Rattus norvegicus
tgggtctggtctcagcagcggctgc

SEQ ID NO: 638548 - DNA, 25 bp, Rattus norvegicus
tgggtctggtctgagcagcggctgc

SEQ ID NO: 638549 - DNA, 25 bp, Rattus norvegicus
tgggtctgtctaacgtcatgggagc

SEQ ID NO: 638550 - DNA, 25 bp, Rattus norvegicus
tgggtctgtctatcgtcatgggagc

SEQ ID NO: 638551 - DNA, 25 bp, Rattus norvegicus
tgggtctgtcttcctgtcagtaaga

SEQ ID NO: 638552 - DNA, 25 bp, Rattus norvegicus
tgggtctgtcttgctgtcagtaaga

SEQ ID NO: 638553 - DNA, 25 bp, Rattus norvegicus
tgggtctgtttgaccggcctcagga

SEQ ID NO: 638554 - DNA, 25 bp, Rattus norvegicus
tgggtctgtttgtccggcctcagga

SEQ ID NO: 638555 - DNA, 25 bp, Rattus norvegicus
tgggtcttagttaccttccagtttg

SEQ ID NO: 638556 - DNA, 25 bp, Rattus norvegicus
tgggtcttagtttccttccagtttg

SEQ ID NO: 638557 - DNA, 25 bp, Rattus norvegicus
tgggtcttcaaacgcacggctgtgt

SEQ ID NO: 638558 - DNA, 25 bp, Rattus norvegicus
tgggtcttcaaaggcacggctgtgt

SEQ ID NO: 638559 - DNA, 25 bp, Rattus norvegicus
tgggtcttcacacaacgtttgcaga

SEQ ID NO: 638560 - DNA, 25 bp, Rattus norvegicus
tgggtcttcacagaacgtttgcaga

SEQ ID NO: 638561 - DNA, 25 bp, Rattus norvegicus
tgggtcttcatccttctacttcaac

SEQ ID NO: 638562 - DNA, 25 bp, Rattus norvegicus
tgggtcttcatcgttctacttcaac

SEQ ID NO: 638563 - DNA, 25 bp, Rattus norvegicus
tgggtcttccatccccaataaagta

SEQ ID NO: 638564 - DNA, 25 bp, Rattus norvegicus
tgggtcttccatgcccaataaagta

SEQ ID NO: 638565 - DNA, 25 bp, Rattus norvegicus
tgggtcttccgcaccatggtcctgt

SEQ ID NO: 638566 - DNA, 25 bp, Rattus norvegicus
tgggtcttccgctccatggtcctgt

SEQ ID NO: 638567 - DNA, 25 bp, Rattus norvegicus
tgggtcttgactatggaactcctac

SEQ ID NO: 638568 - DNA, 25 bp, Rattus norvegicus
tgggtcttgactttggaactcctac

SEQ ID NO: 638569 - DNA, 25 bp, Rattus norvegicus
tgggtcttggacacactgatgtttt

SEQ ID NO: 638570 - DNA, 25 bp, Rattus norvegicus
tgggtcttggactcactgatgtttt

SEQ ID NO: 638571 - DNA, 25 bp, Rattus norvegicus
tgggtcttgtctatgcatcttcact

SEQ ID NO: 638572 - DNA, 25 bp, Rattus norvegicus
tgggtcttgtctttgcatcttcact

SEQ ID NO: 638573 - DNA, 25 bp, Rattus norvegicus
tgggtctttaaacttcttgaataat

SEQ ID NO: 638574 - DNA, 25 bp, Rattus norvegicus
tgggtctttaaagttcttgaataat

SEQ ID NO: 638575 - DNA, 25 bp, Rattus norvegicus
tgggtctttcttcccggatttcaag

SEQ ID NO: 638576 - DNA, 25 bp, Rattus norvegicus
tgggtctttcttgccggatttcaag

SEQ ID NO: 638577 - DNA, 25 bp, Rattus norvegicus
tgggtctttgagcaggtgggttgga

SEQ ID NO: 638578 - DNA, 25 bp, Rattus norvegicus
tgggtctttgaggaggtgggttgga

SEQ ID NO: 638579 - DNA, 25 bp, Rattus norvegicus
tgggtgaacatcaggcttctcggtt

SEQ ID NO: 638580 - DNA, 25 bp, Rattus norvegicus
tgggtgaacatctggcttctcggtt

SEQ ID NO: 638581 - DNA, 25 bp, Rattus norvegicus
tgggtgaaccaaactgccacctgta

SEQ ID NO: 638582 - DNA, 25 bp, Rattus norvegicus
tgggtgaaccaatctgccacctgta

SEQ ID NO: 638583 - DNA, 25 bp, Rattus norvegicus
tgggtgaaccctagcagagcccgta

SEQ ID NO: 638584 - DNA, 25 bp, Rattus norvegicus
tgggtgaacccttgcagagcccgta

SEQ ID NO: 638585 - DNA, 25 bp, Rattus norvegicus
tgggtgaagatcactggttcccagt

SEQ ID NO: 638586 - DNA, 25 bp, Rattus norvegicus
tgggtgaagatctctggttcccagt

SEQ ID NO: 638587 - DNA, 25 bp, Rattus norvegicus
tgggtgaagcccattgcatgcaagc

SEQ ID NO: 638588 - DNA, 25 bp, Rattus norvegicus
tgggtgaagccctttgcatgcaagc

SEQ ID NO: 638589 - DNA, 25 bp, Rattus norvegicus
tgggtgacaccgaaccatcctagtg

SEQ ID NO: 638590 - DNA, 25 bp, Rattus norvegicus
tgggtgacaccgtaccatcctagtg

SEQ ID NO: 638591 - DNA, 25 bp, Rattus norvegicus
tgggtgacactcatacggtgacttt

SEQ ID NO: 638592 - DNA, 25 bp, Rattus norvegicus
tgggtgacactcttacggtgacttt

SEQ ID NO: 638593 - DNA, 25 bp, Rattus norvegicus
tgggtgacatggcttcccactcaaa

SEQ ID NO: 638594 - DNA, 25 bp, Rattus norvegicus
tgggtgacatgggttcccactcaaa

SEQ ID NO: 638595 - DNA, 25 bp, Rattus norvegicus
tgggtgaccaggattccacgccaca

SEQ ID NO: 638596 - DNA, 25 bp, Rattus norvegicus
tgggtgaccaggtttccacgccaca

SEQ ID NO: 638597 - DNA, 25 bp, Rattus norvegicus
tgggtgactggtcattcctgctgct

SEQ ID NO: 638598 - DNA, 25 bp, Rattus norvegicus
tgggtgactggtgattcctgctgct

SEQ ID NO: 638599 - DNA, 25 bp, Rattus norvegicus
tgggtgacttcaagccttacaggcc

SEQ ID NO: 638600 - DNA, 25 bp, Rattus norvegicus
tgggtgacttcatgccttacaggcc

SEQ ID NO: 638601 - DNA, 25 bp, Rattus norvegicus
tgggtgagctctccctccattctta

SEQ ID NO: 638602 - DNA, 25 bp, Rattus norvegicus
tgggtgagctctgcctccattctta

SEQ ID NO: 638603 - DNA, 25 bp, Rattus norvegicus
tgggtgagctgtccatgtacacgct

SEQ ID NO: 638604 - DNA, 25 bp, Rattus norvegicus
tgggtgagctgtgcatgtacacgct

SEQ ID NO: 638605 - DNA, 25 bp, Rattus norvegicus
tgggtgaggcacactttcctacata

SEQ ID NO: 638606 - DNA, 25 bp, Rattus norvegicus
tgggtgaggcactctttcctacata

SEQ ID NO: 638607 - DNA, 25 bp, Rattus norvegicus
tgggtgaggcagaaccttctcttct

SEQ ID NO: 638608 - DNA, 25 bp, Rattus norvegicus
tgggtgaggcagtaccttctcttct

SEQ ID NO: 638609 - DNA, 25 bp, Rattus norvegicus
tgggtgaggcccacaatccagctgg

SEQ ID NO: 638610 - DNA, 25 bp, Rattus norvegicus
tgggtgaggccctcaatccagctgg

SEQ ID NO: 638611 - DNA, 25 bp, Rattus norvegicus
tgggtgaggctcatctgcccaggac

SEQ ID NO: 638612 - DNA, 25 bp, Rattus norvegicus
tgggtgaggctcttctgcccaggac

SEQ ID NO: 638613 - DNA, 25 bp, Rattus norvegicus
tgggtgagtctcaagtgtgtgatct

SEQ ID NO: 638614 - DNA, 25 bp, Rattus norvegicus
tgggtgagtctctagtgtgtgatct

SEQ ID NO: 638615 - DNA, 25 bp, Rattus norvegicus
tgggtgagtcttcctttagcgttaa

SEQ ID NO: 638616 - DNA, 25 bp, Rattus norvegicus
tgggtgagtcttgctttagcgttaa

SEQ ID NO: 638617 - DNA, 25 bp, Rattus norvegicus
tgggtgatcacccaatcttttgaat

SEQ ID NO: 638618 - DNA, 25 bp, Rattus norvegicus
tgggtgatcaccgaatcttttgaat

SEQ ID NO: 638619 - DNA, 25 bp, Rattus norvegicus
tgggtgatgctcatgtgaccggcta

SEQ ID NO: 638620 - DNA, 25 bp, Rattus norvegicus
tgggtgatgctcttgtgaccggcta

SEQ ID NO: 638621 - DNA, 25 bp, Rattus norvegicus
tgggtgattgacaaggcctgcctgc

SEQ ID NO: 638622 - DNA, 25 bp, Rattus norvegicus
tgggtgattgactaggcctgcctgc

SEQ ID NO: 638623 - DNA, 25 bp, Rattus norvegicus
tgggtgcaaaagcagcatcccgacc

SEQ ID NO: 638624 - DNA, 25 bp, Rattus norvegicus
tgggtgcaaaaggagcatcccgacc

SEQ ID NO: 638625 - DNA, 25 bp, Rattus norvegicus
tgggtgcaaacgctgctttgttcct

SEQ ID NO: 638626 - DNA, 25 bp, Rattus norvegicus
tgggtgcaaacggtgctttgttcct

SEQ ID NO: 638627 - DNA, 25 bp, Rattus norvegicus
tgggtgcagcacctcagacaaggct

SEQ ID NO: 638628 - DNA, 25 bp, Rattus norvegicus
tgggtgcagcacgtcagacaaggct

SEQ ID NO: 638629 - DNA, 25 bp, Rattus norvegicus
tgggtgcagcgtaccaaggcattta

SEQ ID NO: 638630 - DNA, 25 bp, Rattus norvegicus
tgggtgcagcgttccaaggcattta

SEQ ID NO: 638631 - DNA, 25 bp, Rattus norvegicus
tgggtgcaggccacattcatgccat

SEQ ID NO: 638632 - DNA, 25 bp, Rattus norvegicus
tgggtgcaggcctcattcatgccat

SEQ ID NO: 638633 - DNA, 25 bp, Rattus norvegicus
tgggtgcataaaactagcgaacatt

SEQ ID NO: 638634 - DNA, 25 bp, Rattus norvegicus
tgggtgcataaatctagcgaacatt

SEQ ID NO: 638635 - DNA, 25 bp, Rattus norvegicus
tgggtgcataccagcttacaaatgt

SEQ ID NO: 638636 - DNA, 25 bp, Rattus norvegicus
tgggtgcatacctgcttacaaatgt

SEQ ID NO: 638637 - DNA, 25 bp, Rattus norvegicus
tgggtgccacataggattccgggac

SEQ ID NO: 638638 - DNA, 25 bp, Rattus norvegicus
tgggtgccacattggattccgggac

SEQ ID NO: 638639 - DNA, 25 bp, Rattus norvegicus
tgggtgccaccccacagtgaggaca

SEQ ID NO: 638640 - DNA, 25 bp, Rattus norvegicus
tgggtgccacccgacagtgaggaca

SEQ ID NO: 638641 - DNA, 25 bp, Rattus norvegicus
tgggtgccccttcctcctgactggg

SEQ ID NO: 638642 - DNA, 25 bp, Rattus norvegicus
tgggtgccccttgctcctgactggg

SEQ ID NO: 638643 - DNA, 25 bp, Rattus norvegicus
tgggtgccgccaagacaacctaata

SEQ ID NO: 638644 - DNA, 25 bp, Rattus norvegicus
tgggtgccgccatgacaacctaata

SEQ ID NO: 638645 - DNA, 25 bp, Rattus norvegicus
tgggtgcctctcagacgggcccaag

SEQ ID NO: 638646 - DNA, 25 bp, Rattus norvegicus
tgggtgcctctctgacgggcccaag

SEQ ID NO: 638647 - DNA, 25 bp, Rattus norvegicus
tgggtgcctttcactggcctaaaaa

SEQ ID NO: 638648 - DNA, 25 bp, Rattus norvegicus
tgggtgcctttcatgtctccaagca

SEQ ID NO: 638649 - DNA, 25 bp, Rattus norvegicus
tgggtgcctttctctggcctaaaaa

SEQ ID NO: 638650 - DNA, 25 bp, Rattus norvegicus
tgggtgcctttcttgtctccaagca

SEQ ID NO: 638651 - DNA, 25 bp, Rattus norvegicus
tgggtgccttttcatcgtggccatg

SEQ ID NO: 638652 - DNA, 25 bp, Rattus norvegicus
tgggtgccttttgatcgtggccatg

SEQ ID NO: 638653 - DNA, 25 bp, Rattus norvegicus
tgggtgcgcgtcctgaccaaatgaa

SEQ ID NO: 638654 - DNA, 25 bp, Rattus norvegicus
tgggtgcgcgtcgtgaccaaatgaa

SEQ ID NO: 638655 - DNA, 25 bp, Rattus norvegicus
tgggtgctaacaacacctttggagg

SEQ ID NO: 638656 - DNA, 25 bp, Rattus norvegicus
tgggtgctaacatcacctttggagg

SEQ ID NO: 638657 - DNA, 25 bp, Rattus norvegicus
tgggtgctaagtctgtttccgttca

SEQ ID NO: 638658 - DNA, 25 bp, Rattus norvegicus
tgggtgctaagtgtgtttccgttca

SEQ ID NO: 638659 - DNA, 25 bp, Rattus norvegicus
tgggtgctacaacccctggtgtcag

SEQ ID NO: 638660 - DNA, 25 bp, Rattus norvegicus
tgggtgctacaagccctggtgtcag

SEQ ID NO: 638661 - DNA, 25 bp, Rattus norvegicus
tgggtgctaggaccttaactctctc

SEQ ID NO: 638662 - DNA, 25 bp, Rattus norvegicus
tgggtgctaggagcttaactctctc

SEQ ID NO: 638663 - DNA, 25 bp, Rattus norvegicus
tgggtgctccgcctagtgagttacc

SEQ ID NO: 638664 - DNA, 25 bp, Rattus norvegicus
tgggtgctccgcgtagtgagttacc

SEQ ID NO: 638665 - DNA, 25 bp, Rattus norvegicus
tgggtgctctctaaacaccaaccat

SEQ ID NO: 638666 - DNA, 25 bp, Rattus norvegicus
tgggtgctctcttaacaccaaccat

SEQ ID NO: 638667 - DNA, 25 bp, Rattus norvegicus
tgggtgctcttgctagggctgtaaa

SEQ ID NO: 638668 - DNA, 25 bp, Rattus norvegicus
tgggtgctcttggtagggctgtaaa

SEQ ID NO: 638669 - DNA, 25 bp, Rattus norvegicus
tgggtgctgctaatctactctgccg

SEQ ID NO: 638670 - DNA, 25 bp, Rattus norvegicus
tgggtgctgctacgtgctaccattc

SEQ ID NO: 638671 - DNA, 25 bp, Rattus norvegicus
tgggtgctgctaggtgctaccattc

SEQ ID NO: 638672 - DNA, 25 bp, Rattus norvegicus
tgggtgctgctattctactctgccg

SEQ ID NO: 638673 - DNA, 25 bp, Rattus norvegicus
tgggtgctgcttccctgggtttcaa

SEQ ID NO: 638674 - DNA, 25 bp, Rattus norvegicus
tgggtgctgcttgcctgggtttcaa

SEQ ID NO: 638675 - DNA, 25 bp, Rattus norvegicus
tgggtgcttcagatgcatggacact

SEQ ID NO: 638676 - DNA, 25 bp, Rattus norvegicus
tgggtgcttcagttgcatggacact

SEQ ID NO: 638677 - DNA, 25 bp, Rattus norvegicus
tgggtgcttcctatcaggtctggca

SEQ ID NO: 638678 - DNA, 25 bp, Rattus norvegicus
tgggtgcttcctttcaggtctggca

SEQ ID NO: 638679 - DNA, 25 bp, Rattus norvegicus
tgggtgctttttaacttgagaaact

SEQ ID NO: 638680 - DNA, 25 bp, Rattus norvegicus
tgggtgcttttttacttgagaaact

SEQ ID NO: 638681 - DNA, 25 bp, Rattus norvegicus
tgggtggacctgcaatctcatctac

SEQ ID NO: 638682 - DNA, 25 bp, Rattus norvegicus
tgggtggacctggaatctcatctac

SEQ ID NO: 638683 - DNA, 25 bp, Rattus norvegicus
tgggtggagcacaggaccacactca

SEQ ID NO: 638684 - DNA, 25 bp, Rattus norvegicus
tgggtggagcactggaccacactca

SEQ ID NO: 638685 - DNA, 25 bp, Rattus norvegicus
tgggtggcaacaatccatgggctgc

SEQ ID NO: 638686 - DNA, 25 bp, Rattus norvegicus
tgggtggcaacattccatgggctgc

SEQ ID NO: 638687 - DNA, 25 bp, Rattus norvegicus
tgggtggcataaaaggcccacgtgt

SEQ ID NO: 638688 - DNA, 25 bp, Rattus norvegicus
tgggtggcataataggcccacgtgt

SEQ ID NO: 638689 - DNA, 25 bp, Rattus norvegicus
tgggtggccaccagtcagggcctaa

SEQ ID NO: 638690 - DNA, 25 bp, Rattus norvegicus
tgggtggccacctgtcagggcctaa

SEQ ID NO: 638691 - DNA, 25 bp, Rattus norvegicus
tgggtggcccctcaaagaactgata

SEQ ID NO: 638692 - DNA, 25 bp, Rattus norvegicus
tgggtggcccctgaaagaactgata

SEQ ID NO: 638693 - DNA, 25 bp, Rattus norvegicus
tgggtggccgagaccgccgccatca

SEQ ID NO: 638694 - DNA, 25 bp, Rattus norvegicus
tgggtggccgagtccgccgccatca

SEQ ID NO: 638695 - DNA, 25 bp, Rattus norvegicus
tgggtggccttcataaacccttcat

SEQ ID NO: 638696 - DNA, 25 bp, Rattus norvegicus
tgggtggccttcttaaacccttcat

SEQ ID NO: 638697 - DNA, 25 bp, Rattus norvegicus
tgggtggcgtttaaactccttatgt

SEQ ID NO: 638698 - DNA, 25 bp, Rattus norvegicus
tgggtggcgttttaactccttatgt

SEQ ID NO: 638699 - DNA, 25 bp, Rattus norvegicus
tgggtggctacacgcatcgtatcct

SEQ ID NO: 638700 - DNA, 25 bp, Rattus norvegicus
tgggtggctacaggcatcgtatcct

SEQ ID NO: 638701 - DNA, 25 bp, Rattus norvegicus
tgggtggctgctcgaatcccttact

SEQ ID NO: 638702 - DNA, 25 bp, Rattus norvegicus
tgggtggctgctggaatcccttact

SEQ ID NO: 638703 - DNA, 25 bp, Rattus norvegicus
tgggtggctgtcactgaccttgata

SEQ ID NO: 638704 - DNA, 25 bp, Rattus norvegicus
tgggtggctgtctctgaccttgata

SEQ ID NO: 638705 - DNA, 25 bp, Rattus norvegicus
tgggtggctttcactacatcctggc

SEQ ID NO: 638706 - DNA, 25 bp, Rattus norvegicus
tgggtggctttctctacatcctggc

SEQ ID NO: 638707 - DNA, 25 bp, Rattus norvegicus
tgggtgggaaacacattgctcagcc

SEQ ID NO: 638708 - DNA, 25 bp, Rattus norvegicus
tgggtgggaaactcattgctcagcc

SEQ ID NO: 638709 - DNA, 25 bp, Rattus norvegicus
tgggtgggatcaactgccctttcta

SEQ ID NO: 638710 - DNA, 25 bp, Rattus norvegicus
tgggtgggatcatctgccctttcta

SEQ ID NO: 638711 - DNA, 25 bp, Rattus norvegicus
tgggtgggccaacaaatccaggtcc

SEQ ID NO: 638712 - DNA, 25 bp, Rattus norvegicus
tgggtgggccaagaaatccaggtcc

SEQ ID NO: 638713 - DNA, 25 bp, Rattus norvegicus
tgggtgggccacctacagagaattc

SEQ ID NO: 638714 - DNA, 25 bp, Rattus norvegicus
tgggtgggccacgtacagagaattc

SEQ ID NO: 638715 - DNA, 25 bp, Rattus norvegicus
tgggtgggcgcaccctcccctattg

SEQ ID NO: 638716 - DNA, 25 bp, Rattus norvegicus
tgggtgggcgcagcctcccctattg

SEQ ID NO: 638717 - DNA, 25 bp, Rattus norvegicus
tgggtgggtcacatgcctcagcagc

SEQ ID NO: 638718 - DNA, 25 bp, Rattus norvegicus
tgggtgggtcacttgcctcagcagc

SEQ ID NO: 638719 - DNA, 25 bp, Rattus norvegicus
tgggtggtcaaaaatgcggctgtca

SEQ ID NO: 638720 - DNA, 25 bp, Rattus norvegicus
tgggtggtcaaatatgcggctgtca

SEQ ID NO: 638721 - DNA, 25 bp, Rattus norvegicus
tgggtggtccttagagccaatgaaa

SEQ ID NO: 638722 - DNA, 25 bp, Rattus norvegicus
tgggtggtccttagtgtctgcttca

SEQ ID NO: 638723 - DNA, 25 bp, Rattus norvegicus
tgggtggtcctttgagccaatgaaa

SEQ ID NO: 638724 - DNA, 25 bp, Rattus norvegicus
tgggtggtcctttgtgtctgcttca

SEQ ID NO: 638725 - DNA, 25 bp, Rattus norvegicus
tgggtggtgacaaccctgcacagag

SEQ ID NO: 638726 - DNA, 25 bp, Rattus norvegicus
tgggtggtgacatccctgcacagag

SEQ ID NO: 638727 - DNA, 25 bp, Rattus norvegicus
tgggtggtgctaaactatctccgtg

SEQ ID NO: 638728 - DNA, 25 bp, Rattus norvegicus
tgggtggtgctatactatctccgtg

SEQ ID NO: 638729 - DNA, 25 bp, Rattus norvegicus
tgggtggttcacacacactcattca

SEQ ID NO: 638730 - DNA, 25 bp, Rattus norvegicus
tgggtggttcactcacactcattca

SEQ ID NO: 638731 - DNA, 25 bp, Rattus norvegicus
tgggtggttttcactgggtaccaag

SEQ ID NO: 638732 - DNA, 25 bp, Rattus norvegicus
tgggtggttttctctgggtaccaag

SEQ ID NO: 638733 - DNA, 25 bp, Rattus norvegicus
tgggtgtaacagagacctcgtccac

SEQ ID NO: 638734 - DNA, 25 bp, Rattus norvegicus
tgggtgtaacagtgacctcgtccac

SEQ ID NO: 638735 - DNA, 25 bp, Rattus norvegicus
tgggtgtacacacatctggtccaca

SEQ ID NO: 638736 - DNA, 25 bp, Rattus norvegicus
tgggtgtacacagatctggtccaca

SEQ ID NO: 638737 - DNA, 25 bp, Rattus norvegicus
tgggtgtatcccaggtctgctttct

SEQ ID NO: 638738 - DNA, 25 bp, Rattus norvegicus
tgggtgtatccctggtctgctttct

SEQ ID NO: 638739 - DNA, 25 bp, Rattus norvegicus
tgggtgtcagcaagccttcctaagg

SEQ ID NO: 638740 - DNA, 25 bp, Rattus norvegicus
tgggtgtcagcatgccttcctaagg

SEQ ID NO: 638741 - DNA, 25 bp, Rattus norvegicus
tgggtgtcaggaagctgctcactgt

SEQ ID NO: 638742 - DNA, 25 bp, Rattus norvegicus
tgggtgtcaggatgctgctcactgt

SEQ ID NO: 638743 - DNA, 25 bp, Rattus norvegicus
tgggtgtccaggagcctaccagcaa

SEQ ID NO: 638744 - DNA, 25 bp, Rattus norvegicus
tgggtgtccaggtgcctaccagcaa

SEQ ID NO: 638745 - DNA, 25 bp, Rattus norvegicus
tgggtgtcctacatctctcccatgg

SEQ ID NO: 638746 - DNA, 25 bp, Rattus norvegicus
tgggtgtcctaccttcaaattttgg

SEQ ID NO: 638747 - DNA, 25 bp, Rattus norvegicus
tgggtgtcctacgttcaaattttgg

SEQ ID NO: 638748 - DNA, 25 bp, Rattus norvegicus
tgggtgtcctacttctctcccatgg

SEQ ID NO: 638749 - DNA, 25 bp, Rattus norvegicus
tgggtgtcgctgctttttcttgcat

SEQ ID NO: 638750 - DNA, 25 bp, Rattus norvegicus
tgggtgtcgctggtttttcttgcat

SEQ ID NO: 638751 - DNA, 25 bp, Rattus norvegicus
tgggtgtctgcaaatgacctttctc

SEQ ID NO: 638752 - DNA, 25 bp, Rattus norvegicus
tgggtgtctgcatatgacctttctc

SEQ ID NO: 638753 - DNA, 25 bp, Rattus norvegicus
tgggtgtctgtgactttaccagaag

SEQ ID NO: 638754 - DNA, 25 bp, Rattus norvegicus
tgggtgtctgtgtctttaccagaag

SEQ ID NO: 638755 - DNA, 25 bp, Rattus norvegicus
tgggtgtcttccaggactatgacca

SEQ ID NO: 638756 - DNA, 25 bp, Rattus norvegicus
tgggtgtcttcctggactatgacca

SEQ ID NO: 638757 - DNA, 25 bp, Rattus norvegicus
tgggtgtgaagtccagctccttccg

SEQ ID NO: 638758 - DNA, 25 bp, Rattus norvegicus
tgggtgtgaagtgcagctccttccg

SEQ ID NO: 638759 - DNA, 25 bp, Rattus norvegicus
tgggtgtgacccatgaaattctagg

SEQ ID NO: 638760 - DNA, 25 bp, Rattus norvegicus
tgggtgtgacccttgaaattctagg

SEQ ID NO: 638761 - DNA, 25 bp, Rattus norvegicus
tgggtgtgagtcactaatcttaaaa

SEQ ID NO: 638762 - DNA, 25 bp, Rattus norvegicus
tgggtgtgagtctctaatcttaaaa

SEQ ID NO: 638763 - DNA, 25 bp, Rattus norvegicus
tgggtgtgatttagatccctcgcca

SEQ ID NO: 638764 - DNA, 25 bp, Rattus norvegicus
tgggtgtgattttgatccctcgcca

SEQ ID NO: 638765 - DNA, 25 bp, Rattus norvegicus
tgggtgtgcactctaaaccttcaga

SEQ ID NO: 638766 - DNA, 25 bp, Rattus norvegicus
tgggtgtgcactgtaaaccttcaga

SEQ ID NO: 638767 - DNA, 25 bp, Rattus norvegicus
tgggtgtgcggcagacccccgccaa

SEQ ID NO: 638768 - DNA, 25 bp, Rattus norvegicus
tgggtgtgcggctgacccccgccaa

SEQ ID NO: 638769 - DNA, 25 bp, Rattus norvegicus
tgggtgtggttaactttttccttat

SEQ ID NO: 638770 - DNA, 25 bp, Rattus norvegicus
tgggtgtggttatctttttccttat

SEQ ID NO: 638771 - DNA, 25 bp, Rattus norvegicus
tgggtgttaccacgcactcttttaa

SEQ ID NO: 638772 - DNA, 25 bp, Rattus norvegicus
tgggtgttaccaggcactcttttaa

SEQ ID NO: 638773 - DNA, 25 bp, Rattus norvegicus
tgggtgttcctgattaactttctgg

SEQ ID NO: 638774 - DNA, 25 bp, Rattus norvegicus
tgggtgttcctgtttaactttctgg

SEQ ID NO: 638775 - DNA, 25 bp, Rattus norvegicus
tgggtgttcttgactctctgggttc

SEQ ID NO: 638776 - DNA, 25 bp, Rattus norvegicus
tgggtgttcttgatgacccatcagc

SEQ ID NO: 638777 - DNA, 25 bp, Rattus norvegicus
tgggtgttcttgtctctctgggttc

SEQ ID NO: 638778 - DNA, 25 bp, Rattus norvegicus
tgggtgttcttgttgacccatcagc

SEQ ID NO: 638779 - DNA, 25 bp, Rattus norvegicus
tgggtgttggcaactgtgttcacaa

SEQ ID NO: 638780 - DNA, 25 bp, Rattus norvegicus
tgggtgttggcatctgtgttcacaa

SEQ ID NO: 638781 - DNA, 25 bp, Rattus norvegicus
tgggtgtttcctattgcttttatct

SEQ ID NO: 638782 - DNA, 25 bp, Rattus norvegicus
tgggtgtttccttttgcttttatct

SEQ ID NO: 638783 - DNA, 25 bp, Rattus norvegicus
tgggtgtttgccctgagacatagcc

SEQ ID NO: 638784 - DNA, 25 bp, Rattus norvegicus
tgggtgtttgccgtgagacatagcc

SEQ ID NO: 638785 - DNA, 25 bp, Rattus norvegicus
tgggtgtttttacaaagcttcctgg

SEQ ID NO: 638786 - DNA, 25 bp, Rattus norvegicus
tgggtgtttttagaaagcttcctgg

SEQ ID NO: 638787 - DNA, 25 bp, Rattus norvegicus
tgggtgtttttcaatagcctgtggt

SEQ ID NO: 638788 - DNA, 25 bp, Rattus norvegicus
tgggtgtttttctatagcctgtggt

SEQ ID NO: 638789 - DNA, 25 bp, Rattus norvegicus
tgggttaactctacttatccaaaga

SEQ ID NO: 638790 - DNA, 25 bp, Rattus norvegicus
tgggttaactcttcttatccaaaga

SEQ ID NO: 638791 - DNA, 25 bp, Rattus norvegicus
tgggttaagctcatcctgccccgtt

SEQ ID NO: 638792 - DNA, 25 bp, Rattus norvegicus
tgggttaagctcttcctgccccgtt

SEQ ID NO: 638793 - DNA, 25 bp, Rattus norvegicus
tgggttaagtcaccacattacctaa

SEQ ID NO: 638794 - DNA, 25 bp, Rattus norvegicus
tgggttaagtcagcacattacctaa

SEQ ID NO: 638795 - DNA, 25 bp, Rattus norvegicus
tgggttaatggacttagttgcctca

SEQ ID NO: 638796 - DNA, 25 bp, Rattus norvegicus
tgggttaatggagttagttgcctca

SEQ ID NO: 638797 - DNA, 25 bp, Rattus norvegicus
tgggttacagcacactcagagtcaa

SEQ ID NO: 638798 - DNA, 25 bp, Rattus norvegicus
tgggttacagcagactcagagtcaa

SEQ ID NO: 638799 - DNA, 25 bp, Rattus norvegicus
tgggttactgatcctcacactcgaa

SEQ ID NO: 638800 - DNA, 25 bp, Rattus norvegicus
tgggttactgatgctcacactcgaa

SEQ ID NO: 638801 - DNA, 25 bp, Rattus norvegicus
tgggttagagctccccagcatctta

SEQ ID NO: 638802 - DNA, 25 bp, Rattus norvegicus
tgggttagagctgcccagcatctta

SEQ ID NO: 638803 - DNA, 25 bp, Rattus norvegicus
tgggttagggaccttcagcctgact

SEQ ID NO: 638804 - DNA, 25 bp, Rattus norvegicus
tgggttagggacgttcagcctgact

SEQ ID NO: 638805 - DNA, 25 bp, Rattus norvegicus
tgggttatacccacaggtctacgcg

SEQ ID NO: 638806 - DNA, 25 bp, Rattus norvegicus
tgggttataccctcaggtctacgcg

SEQ ID NO: 638807 - DNA, 25 bp, Rattus norvegicus
tgggttatacgcagagtctccgacc

SEQ ID NO: 638808 - DNA, 25 bp, Rattus norvegicus
tgggttatacgctgagtctccgacc

SEQ ID NO: 638809 - DNA, 25 bp, Rattus norvegicus
tgggttatccacaaagttattacct

SEQ ID NO: 638810 - DNA, 25 bp, Rattus norvegicus
tgggttatccactaagttattacct

SEQ ID NO: 638811 - DNA, 25 bp, Rattus norvegicus
tgggttatctttaaggcccctctgt

SEQ ID NO: 638812 - DNA, 25 bp, Rattus norvegicus
tgggttatcttttaggcccctctgt

SEQ ID NO: 638813 - DNA, 25 bp, Rattus norvegicus
tgggttattttgaccagccctactt

SEQ ID NO: 638814 - DNA, 25 bp, Rattus norvegicus
tgggttattttgtccagccctactt

SEQ ID NO: 638815 - DNA, 25 bp, Rattus norvegicus
tgggttcaagctcttatgctgacct

SEQ ID NO: 638816 - DNA, 25 bp, Rattus norvegicus
tgggttcaagctgttatgctgacct

SEQ ID NO: 638817 - DNA, 25 bp, Rattus norvegicus
tgggttcacccaacctgtttattat

SEQ ID NO: 638818 - DNA, 25 bp, Rattus norvegicus
tgggttcacccatcctgtttattat

SEQ ID NO: 638819 - DNA, 25 bp, Rattus norvegicus
tgggttcacgatcatctgtaactat

SEQ ID NO: 638820 - DNA, 25 bp, Rattus norvegicus
tgggttcacgatgatctgtaactat

SEQ ID NO: 638821 - DNA, 25 bp, Rattus norvegicus
tgggttcagaacacgtttgggcata

SEQ ID NO: 638822 - DNA, 25 bp, Rattus norvegicus
tgggttcagaactcgtttgggcata

SEQ ID NO: 638823 - DNA, 25 bp, Rattus norvegicus
tgggttcagatactacaggcatgtc

SEQ ID NO: 638824 - DNA, 25 bp, Rattus norvegicus
tgggttcagatagtacaggcatgtc

SEQ ID NO: 638825 - DNA, 25 bp, Rattus norvegicus
tgggttcagctgaagcgccagcctg

SEQ ID NO: 638826 - DNA, 25 bp, Rattus norvegicus
tgggttcagctgtagcgccagcctg

SEQ ID NO: 638827 - DNA, 25 bp, Rattus norvegicus
tgggttcaggacacgattaccactg

SEQ ID NO: 638828 - DNA, 25 bp, Rattus norvegicus
tgggttcaggactcgattaccactg

SEQ ID NO: 638829 - DNA, 25 bp, Rattus norvegicus
tgggttcaggcgattgtttcatgta

SEQ ID NO: 638830 - DNA, 25 bp, Rattus norvegicus
tgggttcaggcgtttgtttcatgta

SEQ ID NO: 638831 - DNA, 25 bp, Rattus norvegicus
tgggttcagttccctgcgcccacaa

SEQ ID NO: 638832 - DNA, 25 bp, Rattus norvegicus
tgggttcagttcgctgcgcccacaa

SEQ ID NO: 638833 - DNA, 25 bp, Rattus norvegicus
tgggttcagtttccggcacctatat

SEQ ID NO: 638834 - DNA, 25 bp, Rattus norvegicus
tgggttcagtttgcggcacctatat

SEQ ID NO: 638835 - DNA, 25 bp, Rattus norvegicus
tgggttcatcagactttgtgttctt

SEQ ID NO: 638836 - DNA, 25 bp, Rattus norvegicus
tgggttcatcagtctttgtgttctt

SEQ ID NO: 638837 - DNA, 25 bp, Rattus norvegicus
tgggttcatgccacagacacaaaca

SEQ ID NO: 638838 - DNA, 25 bp, Rattus norvegicus
tgggttcatgcctcagacacaaaca

SEQ ID NO: 638839 - DNA, 25 bp, Rattus norvegicus
tgggttccacttcagactaactcac

SEQ ID NO: 638840 - DNA, 25 bp, Rattus norvegicus
tgggttccacttgagactaactcac

SEQ ID NO: 638841 - DNA, 25 bp, Rattus norvegicus
tgggttccagttatctcgagctgct

SEQ ID NO: 638842 - DNA, 25 bp, Rattus norvegicus
tgggttccagttttctcgagctgct

SEQ ID NO: 638843 - DNA, 25 bp, Rattus norvegicus
tgggttccatcaccagacacatact

SEQ ID NO: 638844 - DNA, 25 bp, Rattus norvegicus
tgggttccatcagcagacacatact

SEQ ID NO: 638845 - DNA, 25 bp, Rattus norvegicus
tgggttccatttcccaatgtcgtca

SEQ ID NO: 638846 - DNA, 25 bp, Rattus norvegicus
tgggttccatttgccaatgtcgtca

SEQ ID NO: 638847 - DNA, 25 bp, Rattus norvegicus
tgggttcccaacaggctgtcttcac

SEQ ID NO: 638848 - DNA, 25 bp, Rattus norvegicus
tgggttcccaactggctgtcttcac

SEQ ID NO: 638849 - DNA, 25 bp, Rattus norvegicus
tgggttcccaccatgcatcatgagt

SEQ ID NO: 638850 - DNA, 25 bp, Rattus norvegicus
tgggttcccaccttgcatcatgagt

SEQ ID NO: 638851 - DNA, 25 bp, Rattus norvegicus
tgggttcccagcactcctatgtcag

SEQ ID NO: 638852 - DNA, 25 bp, Rattus norvegicus
tgggttcccagctctcctatgtcag

SEQ ID NO: 638853 - DNA, 25 bp, Rattus norvegicus
tgggttcccatcatttcctgtgtca

SEQ ID NO: 638854 - DNA, 25 bp, Rattus norvegicus
tgggttcccatcttttcctgtgtca

SEQ ID NO: 638855 - DNA, 25 bp, Rattus norvegicus
tgggttcccctcagacctaattaag

SEQ ID NO: 638856 - DNA, 25 bp, Rattus norvegicus
tgggttcccctctgacctaattaag

SEQ ID NO: 638857 - DNA, 25 bp, Rattus norvegicus
tgggttccccttagctttacttcat

SEQ ID NO: 638858 - DNA, 25 bp, Rattus norvegicus
tgggttcccctttgctttacttcat

SEQ ID NO: 638859 - DNA, 25 bp, Rattus norvegicus
tgggttcccttcagaggagcggatt

SEQ ID NO: 638860 - DNA, 25 bp, Rattus norvegicus
tgggttcccttctgaggagcggatt

SEQ ID NO: 638861 - DNA, 25 bp, Rattus norvegicus
tgggttcccttgaagtcctagcact

SEQ ID NO: 638862 - DNA, 25 bp, Rattus norvegicus
tgggttcccttgaccactgaacaaa

SEQ ID NO: 638863 - DNA, 25 bp, Rattus norvegicus
tgggttcccttgtagtcctagcact

SEQ ID NO: 638864 - DNA, 25 bp, Rattus norvegicus
tgggttcccttgtccactgaacaaa

SEQ ID NO: 638865 - DNA, 25 bp, Rattus norvegicus
tgggttcctttgaaaggtccaggct

SEQ ID NO: 638866 - DNA, 25 bp, Rattus norvegicus
tgggttcctttgtaaggtccaggct

SEQ ID NO: 638867 - DNA, 25 bp, Rattus norvegicus
tgggttccttttctcaggccaataa

SEQ ID NO: 638868 - DNA, 25 bp, Rattus norvegicus
tgggttccttttgtcaggccaataa

SEQ ID NO: 638869 - DNA, 25 bp, Rattus norvegicus
tgggttcgtgatatttaccatgcga

SEQ ID NO: 638870 - DNA, 25 bp, Rattus norvegicus
tgggttcgtgatttttaccatgcga

SEQ ID NO: 638871 - DNA, 25 bp, Rattus norvegicus
tgggttctaccgaccaaattaagct

SEQ ID NO: 638872 - DNA, 25 bp, Rattus norvegicus
tgggttctaccgtccaaattaagct

SEQ ID NO: 638873 - DNA, 25 bp, Rattus norvegicus
tgggttctagtacaagtaagcacac

SEQ ID NO: 638874 - DNA, 25 bp, Rattus norvegicus
tgggttctagtagaagtaagcacac

SEQ ID NO: 638875 - DNA, 25 bp, Rattus norvegicus
tgggttctcatcagagtcctttcca

SEQ ID NO: 638876 - DNA, 25 bp, Rattus norvegicus
tgggttctcatccttcgtttgacat

SEQ ID NO: 638877 - DNA, 25 bp, Rattus norvegicus
tgggttctcatcgttcgtttgacat

SEQ ID NO: 638878 - DNA, 25 bp, Rattus norvegicus
tgggttctcatctgagtcctttcca

SEQ ID NO: 638879 - DNA, 25 bp, Rattus norvegicus
tgggttctcccaatccaagatggag

SEQ ID NO: 638880 - DNA, 25 bp, Rattus norvegicus
tgggttctcccattccaagatggag

SEQ ID NO: 638881 - DNA, 25 bp, Rattus norvegicus
tgggttctcccgagtagatgaccag

SEQ ID NO: 638882 - DNA, 25 bp, Rattus norvegicus
tgggttctcccgtgtagatgaccag

SEQ ID NO: 638883 - DNA, 25 bp, Rattus norvegicus
tgggttctccggatcattctatatc

SEQ ID NO: 638884 - DNA, 25 bp, Rattus norvegicus
tgggttctccggttcattctatatc

SEQ ID NO: 638885 - DNA, 25 bp, Rattus norvegicus
tgggttctccttcttccatgggaag

SEQ ID NO: 638886 - DNA, 25 bp, Rattus norvegicus
tgggttctccttgttccatgggaag

SEQ ID NO: 638887 - DNA, 25 bp, Rattus norvegicus
tgggttctggacacaggttgtcttc

SEQ ID NO: 638888 - DNA, 25 bp, Rattus norvegicus
tgggttctggactcaggttgtcttc

SEQ ID NO: 638889 - DNA, 25 bp, Rattus norvegicus
tgggttcttaagaggctggctctct

SEQ ID NO: 638890 - DNA, 25 bp, Rattus norvegicus
tgggttcttaagtggctggctctct

SEQ ID NO: 638891 - DNA, 25 bp, Rattus norvegicus
tgggttcttagcaccagctacagta

SEQ ID NO: 638892 - DNA, 25 bp, Rattus norvegicus
tgggttcttagctccagctacagta

SEQ ID NO: 638893 - DNA, 25 bp, Rattus norvegicus
tgggttcttcacaatggtcactgca

SEQ ID NO: 638894 - DNA, 25 bp, Rattus norvegicus
tgggttcttcactatggtcactgca

SEQ ID NO: 638895 - DNA, 25 bp, Rattus norvegicus
tgggttcttcccagtccagagacaa

SEQ ID NO: 638896 - DNA, 25 bp, Rattus norvegicus
tgggttcttccccagaatccatgat

SEQ ID NO: 638897 - DNA, 25 bp, Rattus norvegicus
tgggttcttcccgagaatccatgat

SEQ ID NO: 638898 - DNA, 25 bp, Rattus norvegicus
tgggttcttccctgtccagagacaa

SEQ ID NO: 638899 - DNA, 25 bp, Rattus norvegicus
tgggttcttcctcagcggtccagaa

SEQ ID NO: 638900 - DNA, 25 bp, Rattus norvegicus
tgggttcttcctgagcggtccagaa

SEQ ID NO: 638901 - DNA, 25 bp, Rattus norvegicus
tgggttcttctgacttctgatgtta

SEQ ID NO: 638902 - DNA, 25 bp, Rattus norvegicus
tgggttcttctgtcttctgatgtta

SEQ ID NO: 638903 - DNA, 25 bp, Rattus norvegicus
tgggttcttgccatgacttcgctaa

SEQ ID NO: 638904 - DNA, 25 bp, Rattus norvegicus
tgggttcttgccttgacttcgctaa

SEQ ID NO: 638905 - DNA, 25 bp, Rattus norvegicus
tgggttgaactcaggtgcttccctc

SEQ ID NO: 638906 - DNA, 25 bp, Rattus norvegicus
tgggttgaactctggtgcttccctc

SEQ ID NO: 638907 - DNA, 25 bp, Rattus norvegicus
tgggttgactttcaggtactacttt

SEQ ID NO: 638908 - DNA, 25 bp, Rattus norvegicus
tgggttgactttgaggtactacttt

SEQ ID NO: 638909 - DNA, 25 bp, Rattus norvegicus
tgggttgcaaacaatctctagaact

SEQ ID NO: 638910 - DNA, 25 bp, Rattus norvegicus
tgggttgcaaactatctctagaact

SEQ ID NO: 638911 - DNA, 25 bp, Rattus norvegicus
tgggttgcagagacagacctcatct

SEQ ID NO: 638912 - DNA, 25 bp, Rattus norvegicus
tgggttgcagagtcagacctcatct

SEQ ID NO: 638913 - DNA, 25 bp, Rattus norvegicus
tgggttgcaggtctgagccacacac

SEQ ID NO: 638914 - DNA, 25 bp, Rattus norvegicus
tgggttgcaggtgtgagccacacac

SEQ ID NO: 638915 - DNA, 25 bp, Rattus norvegicus
tgggttgcatacagggcttctcaaa

SEQ ID NO: 638916 - DNA, 25 bp, Rattus norvegicus
tgggttgcatactgggcttctcaaa

SEQ ID NO: 638917 - DNA, 25 bp, Rattus norvegicus
tgggttgccaggatatcatcggagc

SEQ ID NO: 638918 - DNA, 25 bp, Rattus norvegicus
tgggttgccaggttatcatcggagc

SEQ ID NO: 638919 - DNA, 25 bp, Rattus norvegicus
tgggttgcgacacagagactcactc

SEQ ID NO: 638920 - DNA, 25 bp, Rattus norvegicus
tgggttgcgacagagagactcactc

SEQ ID NO: 638921 - DNA, 25 bp, Rattus norvegicus
tgggttgcgcttatctgaacaacaa

SEQ ID NO: 638922 - DNA, 25 bp, Rattus norvegicus
tgggttgcgcttttctgaacaacaa

SEQ ID NO: 638923 - DNA, 25 bp, Rattus norvegicus
tgggttgctaacacagtacgcagtt

SEQ ID NO: 638924 - DNA, 25 bp, Rattus norvegicus
tgggttgctaactcagtacgcagtt

SEQ ID NO: 638925 - DNA, 25 bp, Rattus norvegicus
tgggttgctgcaattccgaaacggc

SEQ ID NO: 638926 - DNA, 25 bp, Rattus norvegicus
tgggttgctgcatttccgaaacggc

SEQ ID NO: 638927 - DNA, 25 bp, Rattus norvegicus
tgggttgctggcactccaagtgcca

SEQ ID NO: 638928 - DNA, 25 bp, Rattus norvegicus
tgggttgctggctctccaagtgcca

SEQ ID NO: 638929 - DNA, 25 bp, Rattus norvegicus
tgggttggacccagagtctcctcag

SEQ ID NO: 638930 - DNA, 25 bp, Rattus norvegicus
tgggttggaccctgagtctcctcag

SEQ ID NO: 638931 - DNA, 25 bp, Rattus norvegicus
tgggttggactgcacgaccccttga

SEQ ID NO: 638932 - DNA, 25 bp, Rattus norvegicus
tgggttggactggacgaccccttga

SEQ ID NO: 638933 - DNA, 25 bp, Rattus norvegicus
tgggttggtattcgttgaatcctcc

SEQ ID NO: 638934 - DNA, 25 bp, Rattus norvegicus
tgggttggtattggttgaatcctcc

SEQ ID NO: 638935 - DNA, 25 bp, Rattus norvegicus
tgggttggtctgctgctgatattac

SEQ ID NO: 638936 - DNA, 25 bp, Rattus norvegicus
tgggttggtctggtgctgatattac

SEQ ID NO: 638937 - DNA, 25 bp, Rattus norvegicus
tgggttggtggaaaccctttcacca

SEQ ID NO: 638938 - DNA, 25 bp, Rattus norvegicus
tgggttggtggataccctttcacca

SEQ ID NO: 638939 - DNA, 25 bp, Rattus norvegicus
tgggttgtaaagacaggcagtctca

SEQ ID NO: 638940 - DNA, 25 bp, Rattus norvegicus
tgggttgtaaagtcaggcagtctca

SEQ ID NO: 638941 - DNA, 25 bp, Rattus norvegicus
tgggttgtcattctcatctcctgag

SEQ ID NO: 638942 - DNA, 25 bp, Rattus norvegicus
tgggttgtcattgtcatctcctgag

SEQ ID NO: 638943 - DNA, 25 bp, Rattus norvegicus
tgggttgtccacagtcttaggaaga

SEQ ID NO: 638944 - DNA, 25 bp, Rattus norvegicus
tgggttgtccactgtcttaggaaga

SEQ ID NO: 638945 - DNA, 25 bp, Rattus norvegicus
tgggttgtgcttctataactccctt

SEQ ID NO: 638946 - DNA, 25 bp, Rattus norvegicus
tgggttgtgcttgtataactccctt

SEQ ID NO: 638947 - DNA, 25 bp, Rattus norvegicus
tgggttgttgatacctcacagcttt

SEQ ID NO: 638948 - DNA, 25 bp, Rattus norvegicus
tgggttgttgattcctcacagcttt

SEQ ID NO: 638949 - DNA, 25 bp, Rattus norvegicus
tgggtttaagttattgctcattcct

SEQ ID NO: 638950 - DNA, 25 bp, Rattus norvegicus
tgggtttaagtttttgctcattcct

SEQ ID NO: 638951 - DNA, 25 bp, Rattus norvegicus
tgggtttacaagcatgtacaccata

SEQ ID NO: 638952 - DNA, 25 bp, Rattus norvegicus
tgggtttacaaggatgtacaccata

SEQ ID NO: 638953 - DNA, 25 bp, Rattus norvegicus
tgggtttacccacactccttataag

SEQ ID NO: 638954 - DNA, 25 bp, Rattus norvegicus
tgggtttacccagactccttataag

SEQ ID NO: 638955 - DNA, 25 bp, Rattus norvegicus
tgggtttactgaccagccatactgc

SEQ ID NO: 638956 - DNA, 25 bp, Rattus norvegicus
tgggtttactgagcagccatactgc

SEQ ID NO: 638957 - DNA, 25 bp, Rattus norvegicus
tgggtttacttcctaacactcacat

SEQ ID NO: 638958 - DNA, 25 bp, Rattus norvegicus
tgggtttacttcgtaacactcacat

SEQ ID NO: 638959 - DNA, 25 bp, Rattus norvegicus
tgggtttagttgagagtccttgcct

SEQ ID NO: 638960 - DNA, 25 bp, Rattus norvegicus
tgggtttagttgtgagtccttgcct

SEQ ID NO: 638961 - DNA, 25 bp, Rattus norvegicus
tgggtttcactgaccggcggtgccc

SEQ ID NO: 638962 - DNA, 25 bp, Rattus norvegicus
tgggtttcactgtccggcggtgccc

SEQ ID NO: 638963 - DNA, 25 bp, Rattus norvegicus
tgggtttcagccagcaatctgcagg

SEQ ID NO: 638964 - DNA, 25 bp, Rattus norvegicus
tgggtttcagcctgcaatctgcagg

SEQ ID NO: 638965 - DNA, 25 bp, Rattus norvegicus
tgggtttcatccctgtaccaagaaa

SEQ ID NO: 638966 - DNA, 25 bp, Rattus norvegicus
tgggtttcatccgtgtaccaagaaa

SEQ ID NO: 638967 - DNA, 25 bp, Rattus norvegicus
tgggtttccaagagcttaacccgag

SEQ ID NO: 638968 - DNA, 25 bp, Rattus norvegicus
tgggtttccaagtgcttaacccgag

SEQ ID NO: 638969 - DNA, 25 bp, Rattus norvegicus
tgggtttccaccaatagtctctttg

SEQ ID NO: 638970 - DNA, 25 bp, Rattus norvegicus
tgggtttccacctatagtctctttg

SEQ ID NO: 638971 - DNA, 25 bp, Rattus norvegicus
tgggtttccagacctcgctgtgtct

SEQ ID NO: 638972 - DNA, 25 bp, Rattus norvegicus
tgggtttccagagctcgctgtgtct

SEQ ID NO: 638973 - DNA, 25 bp, Rattus norvegicus
tgggtttcccgacggccagacaaat

SEQ ID NO: 638974 - DNA, 25 bp, Rattus norvegicus
tgggtttcccgagggccagacaaat

SEQ ID NO: 638975 - DNA, 25 bp, Rattus norvegicus
tgggtttccggaagacctgggtttg

SEQ ID NO: 638976 - DNA, 25 bp, Rattus norvegicus
tgggtttccggatgacctgggtttg

SEQ ID NO: 638977 - DNA, 25 bp, Rattus norvegicus
tgggtttcctgacttgcagcctcaa

SEQ ID NO: 638978 - DNA, 25 bp, Rattus norvegicus
tgggtttcctgagttgcagcctcaa

SEQ ID NO: 638979 - DNA, 25 bp, Rattus norvegicus
tgggtttcgccaccgtattccaaaa

SEQ ID NO: 638980 - DNA, 25 bp, Rattus norvegicus
tgggtttcgccagcgtattccaaaa

SEQ ID NO: 638981 - DNA, 25 bp, Rattus norvegicus
tgggtttctcccatggttccatgca

SEQ ID NO: 638982 - DNA, 25 bp, Rattus norvegicus
tgggtttctcccttggttccatgca

SEQ ID NO: 638983 - DNA, 25 bp, Rattus norvegicus
tgggtttctgcccaggactttagaa

SEQ ID NO: 638984 - DNA, 25 bp, Rattus norvegicus
tgggtttctgccgaggactttagaa

SEQ ID NO: 638985 - DNA, 25 bp, Rattus norvegicus
tgggtttctttacttcttcagcgga

SEQ ID NO: 638986 - DNA, 25 bp, Rattus norvegicus
tgggtttctttagttcttcagcgga

SEQ ID NO: 638987 - DNA, 25 bp, Rattus norvegicus
tgggtttgacccacattaatcacaa

SEQ ID NO: 638988 - DNA, 25 bp, Rattus norvegicus
tgggtttgaccctcattaatcacaa

SEQ ID NO: 638989 - DNA, 25 bp, Rattus norvegicus
tgggtttgagagcacctgctgccac

SEQ ID NO: 638990 - DNA, 25 bp, Rattus norvegicus
tgggtttgagaggacctgctgccac

SEQ ID NO: 638991 - DNA, 25 bp, Rattus norvegicus
tgggtttgagatactacttttccta

SEQ ID NO: 638992 - DNA, 25 bp, Rattus norvegicus
tgggtttgagattctacttttccta

SEQ ID NO: 638993 - DNA, 25 bp, Rattus norvegicus
tgggtttgaggtacagccactgcac

SEQ ID NO: 638994 - DNA, 25 bp, Rattus norvegicus
tgggtttgaggttcagccactgcac

SEQ ID NO: 638995 - DNA, 25 bp, Rattus norvegicus
tgggtttgcagaaaactgccaccga

SEQ ID NO: 638996 - DNA, 25 bp, Rattus norvegicus
tgggtttgcagataactgccaccga

SEQ ID NO: 638997 - DNA, 25 bp, Rattus norvegicus
tgggtttgctttccgtgttctgtac

SEQ ID NO: 638998 - DNA, 25 bp, Rattus norvegicus
tgggtttgctttgcgtgttctgtac

SEQ ID NO: 638999 - DNA, 25 bp, Rattus norvegicus
tgggtttggtagctatgactctcac

SEQ ID NO: 639000 - DNA, 25 bp, Rattus norvegicus
tgggtttggtaggtatgactctcac

SEQ ID NO: 639001 - DNA, 25 bp, Rattus norvegicus
tgggtttgtctcattttgttctgtt

SEQ ID NO: 639002 - DNA, 25 bp, Rattus norvegicus
tgggtttgtctctttttgttctgtt

SEQ ID NO: 639003 - DNA, 25 bp, Rattus norvegicus
tgggttttaccaagggcagctctat

SEQ ID NO: 639004 - DNA, 25 bp, Rattus norvegicus
tgggttttaccatgggcagctctat

SEQ ID NO: 639005 - DNA, 25 bp, Rattus norvegicus
tgggttttatacatctccaagaact

SEQ ID NO: 639006 - DNA, 25 bp, Rattus norvegicus
tgggttttatacttctccaagaact

SEQ ID NO: 639007 - DNA, 25 bp, Rattus norvegicus
tgggttttatcaaggcggccttcat

SEQ ID NO: 639008 - DNA, 25 bp, Rattus norvegicus
tgggttttatcatggcggccttcat

SEQ ID NO: 639009 - DNA, 25 bp, Rattus norvegicus
tgggttttcagaccccatgttgttg

SEQ ID NO: 639010 - DNA, 25 bp, Rattus norvegicus
tgggttttcagagcccatgttgttg

SEQ ID NO: 639011 - DNA, 25 bp, Rattus norvegicus
tgggttttcagcctcttaagcccag

SEQ ID NO: 639012 - DNA, 25 bp, Rattus norvegicus
tgggttttcagcgtcttaagcccag

SEQ ID NO: 639013 - DNA, 25 bp, Rattus norvegicus
tgggttttcaggatttggagtacat

SEQ ID NO: 639014 - DNA, 25 bp, Rattus norvegicus
tgggttttcaggttttggagtacat

SEQ ID NO: 639015 - DNA, 25 bp, Rattus norvegicus
tgggttttcatacgaccggaagtat

SEQ ID NO: 639016 - DNA, 25 bp, Rattus norvegicus
tgggttttcataggaccggaagtat

SEQ ID NO: 639017 - DNA, 25 bp, Rattus norvegicus
tgggttttccccaaacacagataat

SEQ ID NO: 639018 - DNA, 25 bp, Rattus norvegicus
tgggttttcccctaacacagataat

SEQ ID NO: 639019 - DNA, 25 bp, Rattus norvegicus
tgggttttctctaggctcgagcctg

SEQ ID NO: 639020 - DNA, 25 bp, Rattus norvegicus
tgggttttctcttggctcgagcctg

SEQ ID NO: 639021 - DNA, 25 bp, Rattus norvegicus
tgggttttctgcagtgtatgctcct

SEQ ID NO: 639022 - DNA, 25 bp, Rattus norvegicus
tgggttttctgctgtgtatgctcct

SEQ ID NO: 639023 - DNA, 25 bp, Rattus norvegicus
tgggtttttactctcccagtactgg

SEQ ID NO: 639024 - DNA, 25 bp, Rattus norvegicus
tgggtttttactgtcccagtactgg

SEQ ID NO: 639025 - DNA, 25 bp, Rattus norvegicus
tgggtttttatccacctcacgggag

SEQ ID NO: 639026 - DNA, 25 bp, Rattus norvegicus
tgggtttttatcgacctcacgggag

SEQ ID NO: 639027 - DNA, 25 bp, Rattus norvegicus
tgggtttttattacgtctctaagat

SEQ ID NO: 639028 - DNA, 25 bp, Rattus norvegicus
tgggtttttatttcgtctctaagat

SEQ ID NO: 639029 - DNA, 25 bp, Rattus norvegicus
tgggtttttccaatgagcaagaatg

SEQ ID NO: 639030 - DNA, 25 bp, Rattus norvegicus
tgggtttttccattgagcaagaatg

SEQ ID NO: 639031 - DNA, 25 bp, Rattus norvegicus
tgggtttttctcacattcttcggag

SEQ ID NO: 639032 - DNA, 25 bp, Rattus norvegicus
tgggtttttctctcattcttcggag

SEQ ID NO: 639033 - DNA, 25 bp, Rattus norvegicus
tgggtttttgcgaccgtccatacag

SEQ ID NO: 639034 - DNA, 25 bp, Rattus norvegicus
tgggtttttgcgtccgtccatacag

SEQ ID NO: 639035 - DNA, 25 bp, Rattus norvegicus
tgggttttttgccacagtaacagat

SEQ ID NO: 639036 - DNA, 25 bp, Rattus norvegicus
tgggttttttgcgacagtaacagat

SEQ ID NO: 639037 - DNA, 25 bp, Rattus norvegicus
tggtaaaccttgcgattttggctca

SEQ ID NO: 639038 - DNA, 25 bp, Rattus norvegicus
tggtaaaccttgggattttggctca

SEQ ID NO: 639039 - DNA, 25 bp, Rattus norvegicus
tggtaaacttccacacaagccacca

SEQ ID NO: 639040 - DNA, 25 bp, Rattus norvegicus
tggtaaacttcctcacaagccacca

SEQ ID NO: 639041 - DNA, 25 bp, Rattus norvegicus
tggtaaagtcagagccccaggatcc

SEQ ID NO: 639042 - DNA, 25 bp, Rattus norvegicus
tggtaaagtcagtgccccaggatcc

SEQ ID NO: 639043 - DNA, 25 bp, Rattus norvegicus
tggtaaatccataccatttccccga

SEQ ID NO: 639044 - DNA, 25 bp, Rattus norvegicus
tggtaaatccattccatttccccga

SEQ ID NO: 639045 - DNA, 25 bp, Rattus norvegicus
tggtaaatccttaatcccagcatgt

SEQ ID NO: 639046 - DNA, 25 bp, Rattus norvegicus
tggtaaatcctttatcccagcatgt

SEQ ID NO: 639047 - DNA, 25 bp, Rattus norvegicus
tggtaaatgtgacacccctttgcgg

SEQ ID NO: 639048 - DNA, 25 bp, Rattus norvegicus
tggtaaatgtgagacccctttgcgg

SEQ ID NO: 639049 - DNA, 25 bp, Rattus norvegicus
tggtaacaaaaacctcaccttagat

SEQ ID NO: 639050 - DNA, 25 bp, Rattus norvegicus
tggtaacaaaaagctcaccttagat

SEQ ID NO: 639051 - DNA, 25 bp, Rattus norvegicus
tggtaacaaccacagagacattcga

SEQ ID NO: 639052 - DNA, 25 bp, Rattus norvegicus
tggtaacaaccagagagacattcga

SEQ ID NO: 639053 - DNA, 25 bp, Rattus norvegicus
tggtaacaccttccatttctttgta

SEQ ID NO: 639054 - DNA, 25 bp, Rattus norvegicus
tggtaacaccttcgaagtcactggg

SEQ ID NO: 639055 - DNA, 25 bp, Rattus norvegicus
tggtaacaccttgcatttctttgta

SEQ ID NO: 639056 - DNA, 25 bp, Rattus norvegicus
tggtaacaccttggaagtcactggg

SEQ ID NO: 639057 - DNA, 25 bp, Rattus norvegicus
tggtaacagagtcttcggttccctg

SEQ ID NO: 639058 - DNA, 25 bp, Rattus norvegicus
tggtaacagagtgttcggttccctg

SEQ ID NO: 639059 - DNA, 25 bp, Rattus norvegicus
tggtaacaggaacgcacgcacatgt

SEQ ID NO: 639060 - DNA, 25 bp, Rattus norvegicus
tggtaacaggaaggcacgcacatgt

SEQ ID NO: 639061 - DNA, 25 bp, Rattus norvegicus
tggtaacaggctattccctcattgc

SEQ ID NO: 639062 - DNA, 25 bp, Rattus norvegicus
tggtaacaggcttttccctcattgc

SEQ ID NO: 639063 - DNA, 25 bp, Rattus norvegicus
tggtaacatgaaccccacttgtttc

SEQ ID NO: 639064 - DNA, 25 bp, Rattus norvegicus
tggtaacatgaagcccacttgtttc

SEQ ID NO: 639065 - DNA, 25 bp, Rattus norvegicus
tggtaaccacagagcctgcttcttc

SEQ ID NO: 639066 - DNA, 25 bp, Rattus norvegicus
tggtaaccacagtgcctgcttcttc

SEQ ID NO: 639067 - DNA, 25 bp, Rattus norvegicus
tggtaaccatgaactccatctctgg

SEQ ID NO: 639068 - DNA, 25 bp, Rattus norvegicus
tggtaaccatgatctccatctctgg

SEQ ID NO: 639069 - DNA, 25 bp, Rattus norvegicus
tggtaaccccatcactgcacaaaat

SEQ ID NO: 639070 - DNA, 25 bp, Rattus norvegicus
tggtaaccccatgactgcacaaaat

SEQ ID NO: 639071 - DNA, 25 bp, Rattus norvegicus
tggtaaccgcttactcaaacctgag

SEQ ID NO: 639072 - DNA, 25 bp, Rattus norvegicus
tggtaaccgctttctcaaacctgag

SEQ ID NO: 639073 - DNA, 25 bp, Rattus norvegicus
tggtaacctgttaggcagtgcctat

SEQ ID NO: 639074 - DNA, 25 bp, Rattus norvegicus
tggtaacctgtttggcagtgcctat

SEQ ID NO: 639075 - DNA, 25 bp, Rattus norvegicus
tggtaactccaaagctgaacccgtt

SEQ ID NO: 639076 - DNA, 25 bp, Rattus norvegicus
tggtaactccaatgctgaacccgtt

SEQ ID NO: 639077 - DNA, 25 bp, Rattus norvegicus
tggtaactcccacgtgcctacatag

SEQ ID NO: 639078 - DNA, 25 bp, Rattus norvegicus
tggtaactcccaggtgcctacatag

SEQ ID NO: 639079 - DNA, 25 bp, Rattus norvegicus
tggtaactctagctcccagagagct

SEQ ID NO: 639080 - DNA, 25 bp, Rattus norvegicus
tggtaactctaggtcccagagagct

SEQ ID NO: 639081 - DNA, 25 bp, Rattus norvegicus
tggtaactctgactttttcctttgt

SEQ ID NO: 639082 - DNA, 25 bp, Rattus norvegicus
tggtaactctgagtttttcctttgt

SEQ ID NO: 639083 - DNA, 25 bp, Rattus norvegicus
tggtaactggatctttggcgcccat

SEQ ID NO: 639084 - DNA, 25 bp, Rattus norvegicus
tggtaactggatgtttggcgcccat

SEQ ID NO: 639085 - DNA, 25 bp, Rattus norvegicus
tggtaacttaccagcagacctgctg

SEQ ID NO: 639086 - DNA, 25 bp, Rattus norvegicus
tggtaacttacctgcagacctgctg

SEQ ID NO: 639087 - DNA, 25 bp, Rattus norvegicus
tggtaacttgtaaccatcccagtgt

SEQ ID NO: 639088 - DNA, 25 bp, Rattus norvegicus
tggtaacttgtatccatcccagtgt

SEQ ID NO: 639089 - DNA, 25 bp, Rattus norvegicus
tggtaacttttgagagccccatcct

SEQ ID NO: 639090 - DNA, 25 bp, Rattus norvegicus
tggtaacttttgtgagccccatcct

SEQ ID NO: 639091 - DNA, 25 bp, Rattus norvegicus
tggtaagaaaccacttcgcctgttt

SEQ ID NO: 639092 - DNA, 25 bp, Rattus norvegicus
tggtaagaaacctcttcgcctgttt

SEQ ID NO: 639093 - DNA, 25 bp, Rattus norvegicus
tggtaagagcttatatctgcccgac

SEQ ID NO: 639094 - DNA, 25 bp, Rattus norvegicus
tggtaagagcttttatctgcccgac

SEQ ID NO: 639095 - DNA, 25 bp, Rattus norvegicus
tggtaagagttacgaggtgccccct

SEQ ID NO: 639096 - DNA, 25 bp, Rattus norvegicus
tggtaagagttaggaggtgccccct

SEQ ID NO: 639097 - DNA, 25 bp, Rattus norvegicus
tggtaagcacttaatgctcctcgac

SEQ ID NO: 639098 - DNA, 25 bp, Rattus norvegicus
tggtaagcactttatgctcctcgac

SEQ ID NO: 639099 - DNA, 25 bp, Rattus norvegicus
tggtaagcagtgcacctgcccaagc

SEQ ID NO: 639100 - DNA, 25 bp, Rattus norvegicus
tggtaagcagtggacctgcccaagc

SEQ ID NO: 639101 - DNA, 25 bp, Rattus norvegicus
tggtaagcagttatctaaccctagg

SEQ ID NO: 639102 - DNA, 25 bp, Rattus norvegicus
tggtaagcagttttctaaccctagg

SEQ ID NO: 639103 - DNA, 25 bp, Rattus norvegicus
tggtaagccagcctgttatcccagt

SEQ ID NO: 639104 - DNA, 25 bp, Rattus norvegicus
tggtaagccagcgtgttatcccagt

SEQ ID NO: 639105 - DNA, 25 bp, Rattus norvegicus
tggtaagcctcgatgcactgtctac

SEQ ID NO: 639106 - DNA, 25 bp, Rattus norvegicus
tggtaagcctcgttgcactgtctac

SEQ ID NO: 639107 - DNA, 25 bp, Rattus norvegicus
tggtaaggcgatcttatctgaactt

SEQ ID NO: 639108 - DNA, 25 bp, Rattus norvegicus
tggtaaggcgatgttatctgaactt

SEQ ID NO: 639109 - DNA, 25 bp, Rattus norvegicus
tggtaaggcttgaagtatcgactga

SEQ ID NO: 639110 - DNA, 25 bp, Rattus norvegicus
tggtaaggcttgtagtatcgactga

SEQ ID NO: 639111 - DNA, 25 bp, Rattus norvegicus
tggtaagggcctacgtccagcgcta

SEQ ID NO: 639112 - DNA, 25 bp, Rattus norvegicus
tggtaagggccttcgtccagcgcta

SEQ ID NO: 639113 - DNA, 25 bp, Rattus norvegicus
tggtaagtgattaaccctgtcctgg

SEQ ID NO: 639114 - DNA, 25 bp, Rattus norvegicus
tggtaagtgatttaccctgtcctgg

SEQ ID NO: 639115 - DNA, 25 bp, Rattus norvegicus
tggtaagttactactgggcattttc

SEQ ID NO: 639116 - DNA, 25 bp, Rattus norvegicus
tggtaagttacttctgggcattttc

SEQ ID NO: 639117 - DNA, 25 bp, Rattus norvegicus
tggtaatacctccacttggtcttcc

SEQ ID NO: 639118 - DNA, 25 bp, Rattus norvegicus
tggtaatacctcgacttggtcttcc

SEQ ID NO: 639119 - DNA, 25 bp, Rattus norvegicus
tggtaatatgagaggtctccccata

SEQ ID NO: 639120 - DNA, 25 bp, Rattus norvegicus
tggtaatatgagtggtctccccata

SEQ ID NO: 639121 - DNA, 25 bp, Rattus norvegicus
tggtaatatgatcactagtcgttgt

SEQ ID NO: 639122 - DNA, 25 bp, Rattus norvegicus
tggtaatatgatgactagtcgttgt

SEQ ID NO: 639123 - DNA, 25 bp, Rattus norvegicus
tggtaatcacatcgatccagcacct

SEQ ID NO: 639124 - DNA, 25 bp, Rattus norvegicus
tggtaatcacatggatccagcacct

SEQ ID NO: 639125 - DNA, 25 bp, Rattus norvegicus
tggtaatcagtgcacaccctctaca

SEQ ID NO: 639126 - DNA, 25 bp, Rattus norvegicus
tggtaatcagtggacaccctctaca

SEQ ID NO: 639127 - DNA, 25 bp, Rattus norvegicus
tggtaatccctcacctagaaacctg

SEQ ID NO: 639128 - DNA, 25 bp, Rattus norvegicus
tggtaatccctctcctagaaacctg

SEQ ID NO: 639129 - DNA, 25 bp, Rattus norvegicus
tggtaatccctgagtattcctaaga

SEQ ID NO: 639130 - DNA, 25 bp, Rattus norvegicus
tggtaatccctgtgtattcctaaga

SEQ ID NO: 639131 - DNA, 25 bp, Rattus norvegicus
tggtaatgccgcatccaatacatca

SEQ ID NO: 639132 - DNA, 25 bp, Rattus norvegicus
tggtaatgccgcttccaatacatca

SEQ ID NO: 639133 - DNA, 25 bp, Rattus norvegicus
tggtaatgccttacatctggatgga

SEQ ID NO: 639134 - DNA, 25 bp, Rattus norvegicus
tggtaatgcctttcatctggatgga

SEQ ID NO: 639135 - DNA, 25 bp, Rattus norvegicus
tggtaatggcacaattgacttccct

SEQ ID NO: 639136 - DNA, 25 bp, Rattus norvegicus
tggtaatggcactattgacttccct

SEQ ID NO: 639137 - DNA, 25 bp, Rattus norvegicus
tggtaatgggagaccccagcacgct

SEQ ID NO: 639138 - DNA, 25 bp, Rattus norvegicus
tggtaatgggagtccccagcacgct

SEQ ID NO: 639139 - DNA, 25 bp, Rattus norvegicus
tggtaatgtgctcccgaggcagcat

SEQ ID NO: 639140 - DNA, 25 bp, Rattus norvegicus
tggtaatgtgctgccgaggcagcat

SEQ ID NO: 639141 - DNA, 25 bp, Rattus norvegicus
tggtaatgttgcctgcagcccacac

SEQ ID NO: 639142 - DNA, 25 bp, Rattus norvegicus
tggtaatgttgcgtgcagcccacac

SEQ ID NO: 639143 - DNA, 25 bp, Rattus norvegicus
tggtaattatctatgggttcttaat

SEQ ID NO: 639144 - DNA, 25 bp, Rattus norvegicus
tggtaattatctttgggttcttaat

SEQ ID NO: 639145 - DNA, 25 bp, Rattus norvegicus
tggtaattccaactggctcacagct

SEQ ID NO: 639146 - DNA, 25 bp, Rattus norvegicus
tggtaattccaagtggctcacagct

SEQ ID NO: 639147 - DNA, 25 bp, Rattus norvegicus
tggtaattccacatcttaggagcat

SEQ ID NO: 639148 - DNA, 25 bp, Rattus norvegicus
tggtaattccacttcttaggagcat

SEQ ID NO: 639149 - DNA, 25 bp, Rattus norvegicus
tggtaattctacacaggctgccgta

SEQ ID NO: 639150 - DNA, 25 bp, Rattus norvegicus
tggtaattctactcaggctgccgta

SEQ ID NO: 639151 - DNA, 25 bp, Rattus norvegicus
tggtaatttagcacgtggcacacgg

SEQ ID NO: 639152 - DNA, 25 bp, Rattus norvegicus
tggtaatttagctcgtggcacacgg

SEQ ID NO: 639153 - DNA, 25 bp, Rattus norvegicus
tggtacaaactacacttcagcccct

SEQ ID NO: 639154 - DNA, 25 bp, Rattus norvegicus
tggtacaaactagacttcagcccct

SEQ ID NO: 639155 - DNA, 25 bp, Rattus norvegicus
tggtacaaccttaatccttttccag

SEQ ID NO: 639156 - DNA, 25 bp, Rattus norvegicus
tggtacaacctttatccttttccag

SEQ ID NO: 639157 - DNA, 25 bp, Rattus norvegicus
tggtacaacttcctgattattctga

SEQ ID NO: 639158 - DNA, 25 bp, Rattus norvegicus
tggtacaacttcgtgattattctga

SEQ ID NO: 639159 - DNA, 25 bp, Rattus norvegicus
tggtacaaggcacctggcagcatgc

SEQ ID NO: 639160 - DNA, 25 bp, Rattus norvegicus
tggtacaaggcagctggcagcatgc

SEQ ID NO: 639161 - DNA, 25 bp, Rattus norvegicus
tggtacaagtcacggccaggcaaga

SEQ ID NO: 639162 - DNA, 25 bp, Rattus norvegicus
tggtacaagtcagggccaggcaaga

SEQ ID NO: 639163 - DNA, 25 bp, Rattus norvegicus
tggtacaatccacccttaaaagtta

SEQ ID NO: 639164 - DNA, 25 bp, Rattus norvegicus
tggtacaatccagccttaaaagtta

SEQ ID NO: 639165 - DNA, 25 bp, Rattus norvegicus
tggtacacagtacatccacacacgt

SEQ ID NO: 639166 - DNA, 25 bp, Rattus norvegicus
tggtacacagtagatccacacacgt

SEQ ID NO: 639167 - DNA, 25 bp, Rattus norvegicus
tggtacacatccaacatcgatctgc

SEQ ID NO: 639168 - DNA, 25 bp, Rattus norvegicus
tggtacacatcctacatcgatctgc

SEQ ID NO: 639169 - DNA, 25 bp, Rattus norvegicus
tggtacaccggcaacatcgagatct

SEQ ID NO: 639170 - DNA, 25 bp, Rattus norvegicus
tggtacaccggctacatcgagatct

SEQ ID NO: 639171 - DNA, 25 bp, Rattus norvegicus
tggtacacctctatacgtatatgat

SEQ ID NO: 639172 - DNA, 25 bp, Rattus norvegicus
tggtacacctctttacgtatatgat

SEQ ID NO: 639173 - DNA, 25 bp, Rattus norvegicus
tggtacactgtcacctagggctcaa

SEQ ID NO: 639174 - DNA, 25 bp, Rattus norvegicus
tggtacactgtctcctagggctcaa

SEQ ID NO: 639175 - DNA, 25 bp, Rattus norvegicus
tggtacagaagaagctcctgccacc

SEQ ID NO: 639176 - DNA, 25 bp, Rattus norvegicus
tggtacagaagatgctcctgccacc

SEQ ID NO: 639177 - DNA, 25 bp, Rattus norvegicus
tggtacagatcgctgtagtgccttg

SEQ ID NO: 639178 - DNA, 25 bp, Rattus norvegicus
tggtacagatcggtgtagtgccttg

SEQ ID NO: 639179 - DNA, 25 bp, Rattus norvegicus
tggtacagatctaccacgttcctat

SEQ ID NO: 639180 - DNA, 25 bp, Rattus norvegicus
tggtacagatcttccacgttcctat

SEQ ID NO: 639181 - DNA, 25 bp, Rattus norvegicus
tggtacagccagctccatgagcaac

SEQ ID NO: 639182 - DNA, 25 bp, Rattus norvegicus
tggtacagccaggtccatgagcaac

SEQ ID NO: 639183 - DNA, 25 bp, Rattus norvegicus
tggtacagctgcaagagactccgct

SEQ ID NO: 639184 - DNA, 25 bp, Rattus norvegicus
tggtacagctgctagagactccgct

SEQ ID NO: 639185 - DNA, 25 bp, Rattus norvegicus
tggtacaggtaactggacccagagc

SEQ ID NO: 639186 - DNA, 25 bp, Rattus norvegicus
tggtacaggtaagtggacccagagc

SEQ ID NO: 639187 - DNA, 25 bp, Rattus norvegicus
tggtacatatccaggagccaactga

SEQ ID NO: 639188 - DNA, 25 bp, Rattus norvegicus
tggtacatatcctggagccaactga

SEQ ID NO: 639189 - DNA, 25 bp, Rattus norvegicus
tggtacatccatacggaggcgacac

SEQ ID NO: 639190 - DNA, 25 bp, Rattus norvegicus
tggtacatccattcggaggcgacac

SEQ ID NO: 639191 - DNA, 25 bp, Rattus norvegicus
tggtacatctgtattatgccgccta

SEQ ID NO: 639192 - DNA, 25 bp, Rattus norvegicus
tggtacatctgttttatgccgccta

SEQ ID NO: 639193 - DNA, 25 bp, Rattus norvegicus
tggtacatggccattacccgcaagg

SEQ ID NO: 639194 - DNA, 25 bp, Rattus norvegicus
tggtacatggcctttacccgcaagg

SEQ ID NO: 639195 - DNA, 25 bp, Rattus norvegicus
tggtacattcccaagtaaaacaact

SEQ ID NO: 639196 - DNA, 25 bp, Rattus norvegicus
tggtacattccctagtaaaacaact

SEQ ID NO: 639197 - DNA, 25 bp, Rattus norvegicus
tggtacatttctctgatctccaggt

SEQ ID NO: 639198 - DNA, 25 bp, Rattus norvegicus
tggtacatttctgtgatctccaggt

SEQ ID NO: 639199 - DNA, 25 bp, Rattus norvegicus
tggtaccaagtcactgtccttagat

SEQ ID NO: 639200 - DNA, 25 bp, Rattus norvegicus
tggtaccaagtctctgtccttagat

SEQ ID NO: 639201 - DNA, 25 bp, Rattus norvegicus
tggtaccagggcacggcaaggcatc

SEQ ID NO: 639202 - DNA, 25 bp, Rattus norvegicus
tggtaccagggctcggcaaggcatc

SEQ ID NO: 639203 - DNA, 25 bp, Rattus norvegicus
tggtaccattctcccaaacaactac

SEQ ID NO: 639204 - DNA, 25 bp, Rattus norvegicus
tggtaccattctgccaaacaactac

SEQ ID NO: 639205 - DNA, 25 bp, Rattus norvegicus
tggtaccattggacggcctagcaga

SEQ ID NO: 639206 - DNA, 25 bp, Rattus norvegicus
tggtaccattggtcggcctagcaga

SEQ ID NO: 639207 - DNA, 25 bp, Rattus norvegicus
tggtaccattttctctttcttcata

SEQ ID NO: 639208 - DNA, 25 bp, Rattus norvegicus
tggtaccattttgtctttcttcata

SEQ ID NO: 639209 - DNA, 25 bp, Rattus norvegicus
tggtacccaaaaactccagcagcag

SEQ ID NO: 639210 - DNA, 25 bp, Rattus norvegicus
tggtacccaaaatctccagcagcag

SEQ ID NO: 639211 - DNA, 25 bp, Rattus norvegicus
tggtacccaaggagagccctgctgc

SEQ ID NO: 639212 - DNA, 25 bp, Rattus norvegicus
tggtacccaaggtgagccctgctgc

SEQ ID NO: 639213 - DNA, 25 bp, Rattus norvegicus
tggtacccaagtccacatgtacata

SEQ ID NO: 639214 - DNA, 25 bp, Rattus norvegicus
tggtacccaagtgcacatgtacata

SEQ ID NO: 639215 - DNA, 25 bp, Rattus norvegicus
tggtacccacaaaggtcccctgaag

SEQ ID NO: 639216 - DNA, 25 bp, Rattus norvegicus
tggtacccacaatggtcccctgaag

SEQ ID NO: 639217 - DNA, 25 bp, Rattus norvegicus
tggtacccagtacgcaacaccttat

SEQ ID NO: 639218 - DNA, 25 bp, Rattus norvegicus
tggtacccagtaggcaacaccttat

SEQ ID NO: 639219 - DNA, 25 bp, Rattus norvegicus
tggtaccccaaaccgttcgacagga

SEQ ID NO: 639220 - DNA, 25 bp, Rattus norvegicus
tggtaccccaaagcgttcgacagga

SEQ ID NO: 639221 - DNA, 25 bp, Rattus norvegicus
tggtaccccattctcaggtcaaagg

SEQ ID NO: 639222 - DNA, 25 bp, Rattus norvegicus
tggtaccccattgtcaggtcaaagg

SEQ ID NO: 639223 - DNA, 25 bp, Rattus norvegicus
tggtacccctaaccatcatctgtct

SEQ ID NO: 639224 - DNA, 25 bp, Rattus norvegicus
tggtacccctaagcatcatctgtct

SEQ ID NO: 639225 - DNA, 25 bp, Rattus norvegicus
tggtaccctcctatacatttgtgtt

SEQ ID NO: 639226 - DNA, 25 bp, Rattus norvegicus
tggtaccctcctttacatttgtgtt

SEQ ID NO: 639227 - DNA, 25 bp, Rattus norvegicus
tggtacctacccactatttattagc

SEQ ID NO: 639228 - DNA, 25 bp, Rattus norvegicus
tggtacctaccctctatttattagc

SEQ ID NO: 639229 - DNA, 25 bp, Rattus norvegicus
tggtacctcaccaattgctgtattt

SEQ ID NO: 639230 - DNA, 25 bp, Rattus norvegicus
tggtacctcacctattgctgtattt

SEQ ID NO: 639231 - DNA, 25 bp, Rattus norvegicus
tggtacctcctcataggcactttag

SEQ ID NO: 639232 - DNA, 25 bp, Rattus norvegicus
tggtacctcctcttaggcactttag

SEQ ID NO: 639233 - DNA, 25 bp, Rattus norvegicus
tggtacctggacattcactggtgcc

SEQ ID NO: 639234 - DNA, 25 bp, Rattus norvegicus
tggtacctggactttcactggtgcc

SEQ ID NO: 639235 - DNA, 25 bp, Rattus norvegicus
tggtacctggctatagttttctgtc

SEQ ID NO: 639236 - DNA, 25 bp, Rattus norvegicus
tggtacctggctttagttttctgtc

SEQ ID NO: 639237 - DNA, 25 bp, Rattus norvegicus
tggtaccttgacacttttctgctta

SEQ ID NO: 639238 - DNA, 25 bp, Rattus norvegicus
tggtaccttgactcttttctgctta

SEQ ID NO: 639239 - DNA, 25 bp, Rattus norvegicus
tggtacctttcaaactcagccaaac

SEQ ID NO: 639240 - DNA, 25 bp, Rattus norvegicus
tggtacctttcatactcagccaaac

SEQ ID NO: 639241 - DNA, 25 bp, Rattus norvegicus
tggtacctttgccatgttgccaaac

SEQ ID NO: 639242 - DNA, 25 bp, Rattus norvegicus
tggtacctttgcgatgttgccaaac

SEQ ID NO: 639243 - DNA, 25 bp, Rattus norvegicus
tggtacgagacgaccttctggcttc

SEQ ID NO: 639244 - DNA, 25 bp, Rattus norvegicus
tggtacgagacgtccttctggcttc

SEQ ID NO: 639245 - DNA, 25 bp, Rattus norvegicus
tggtacgagtcccactatgcactgc

SEQ ID NO: 639246 - DNA, 25 bp, Rattus norvegicus
tggtacgagtccgactatgcactgc

SEQ ID NO: 639247 - DNA, 25 bp, Rattus norvegicus
tggtacgccaggctgtaagtcttct

SEQ ID NO: 639248 - DNA, 25 bp, Rattus norvegicus
tggtacgccagggtgtaagtcttct

SEQ ID NO: 639249 - DNA, 25 bp, Rattus norvegicus
tggtacggcttgaggccctcagagc

SEQ ID NO: 639250 - DNA, 25 bp, Rattus norvegicus
tggtacggcttgtggccctcagagc

SEQ ID NO: 639251 - DNA, 25 bp, Rattus norvegicus
tggtacgggcacagggccaccagct

SEQ ID NO: 639252 - DNA, 25 bp, Rattus norvegicus
tggtacgggcactgggccaccagct

SEQ ID NO: 639253 - DNA, 25 bp, Rattus norvegicus
tggtacgtgtgtcaaggcttccagt

SEQ ID NO: 639254 - DNA, 25 bp, Rattus norvegicus
tggtacgtgtgtgaaggcttccagt

SEQ ID NO: 639255 - DNA, 25 bp, Rattus norvegicus
tggtactaaccaagcatccggcaga

SEQ ID NO: 639256 - DNA, 25 bp, Rattus norvegicus
tggtactaaccatgcatccggcaga

SEQ ID NO: 639257 - DNA, 25 bp, Rattus norvegicus
tggtactataacagcttcctccatc

SEQ ID NO: 639258 - DNA, 25 bp, Rattus norvegicus
tggtactataactgcttcctccatc

SEQ ID NO: 639259 - DNA, 25 bp, Rattus norvegicus
tggtactccatgactgctgggctgc

SEQ ID NO: 639260 - DNA, 25 bp, Rattus norvegicus
tggtactccatgtctgctgggctgc

SEQ ID NO: 639261 - DNA, 25 bp, Rattus norvegicus
tggtactccattctttgccatgagg

SEQ ID NO: 639262 - DNA, 25 bp, Rattus norvegicus
tggtactccattgtttgccatgagg

SEQ ID NO: 639263 - DNA, 25 bp, Rattus norvegicus
tggtactccctgagccgaaatctgg

SEQ ID NO: 639264 - DNA, 25 bp, Rattus norvegicus
tggtactccctgtgccgaaatctgg

SEQ ID NO: 639265 - DNA, 25 bp, Rattus norvegicus
tggtactccttaacatcctggttaa

SEQ ID NO: 639266 - DNA, 25 bp, Rattus norvegicus
tggtactccttatcatcctggttaa

SEQ ID NO: 639267 - DNA, 25 bp, Rattus norvegicus
tggtactccttgagggtctggcaat

SEQ ID NO: 639268 - DNA, 25 bp, Rattus norvegicus
tggtactccttgtgggtctggcaat

SEQ ID NO: 639269 - DNA, 25 bp, Rattus norvegicus
tggtactctggcctcaaatcctaaa

SEQ ID NO: 639270 - DNA, 25 bp, Rattus norvegicus
tggtactctggcgtcaaatcctaaa

SEQ ID NO: 639271 - DNA, 25 bp, Rattus norvegicus
tggtactggagtatggaaaccccat

SEQ ID NO: 639272 - DNA, 25 bp, Rattus norvegicus
tggtactggagtttggaaaccccat

SEQ ID NO: 639273 - DNA, 25 bp, Rattus norvegicus
tggtactggccacttagttgacagt

SEQ ID NO: 639274 - DNA, 25 bp, Rattus norvegicus
tggtactggccagttagttgacagt

SEQ ID NO: 639275 - DNA, 25 bp, Rattus norvegicus
tggtactggccgctattccaaacta

SEQ ID NO: 639276 - DNA, 25 bp, Rattus norvegicus
tggtactggccggtattccaaacta

SEQ ID NO: 639277 - DNA, 25 bp, Rattus norvegicus
tggtactggctacgagatcaactct

SEQ ID NO: 639278 - DNA, 25 bp, Rattus norvegicus
tggtactggctaggagatcaactct

SEQ ID NO: 639279 - DNA, 25 bp, Rattus norvegicus
tggtactgggaccacatgctggaaa

SEQ ID NO: 639280 - DNA, 25 bp, Rattus norvegicus
tggtactgggacgacatgctggaaa

SEQ ID NO: 639281 - DNA, 25 bp, Rattus norvegicus
tggtactggtgtaatctccatcctc

SEQ ID NO: 639282 - DNA, 25 bp, Rattus norvegicus
tggtactggtgttatctccatcctc

SEQ ID NO: 639283 - DNA, 25 bp, Rattus norvegicus
tggtactgtgatatcacgcccaaat

SEQ ID NO: 639284 - DNA, 25 bp, Rattus norvegicus
tggtactgtgatttcacgcccaaat

SEQ ID NO: 639285 - DNA, 25 bp, Rattus norvegicus
tggtactgtggcatcaaaactgatc

SEQ ID NO: 639286 - DNA, 25 bp, Rattus norvegicus
tggtactgtggcttcaaaactgatc

SEQ ID NO: 639287 - DNA, 25 bp, Rattus norvegicus
tggtacttagcgctgttcgtcataa

SEQ ID NO: 639288 - DNA, 25 bp, Rattus norvegicus
tggtacttagcggtgttcgtcataa

SEQ ID NO: 639289 - DNA, 25 bp, Rattus norvegicus
tggtacttagtaagtccactaggat

SEQ ID NO: 639290 - DNA, 25 bp, Rattus norvegicus
tggtacttagtatgtccactaggat

SEQ ID NO: 639291 - DNA, 25 bp, Rattus norvegicus
tggtacttcattcttcttctgtggt

SEQ ID NO: 639292 - DNA, 25 bp, Rattus norvegicus
tggtacttcattgttcttctgtggt

SEQ ID NO: 639293 - DNA, 25 bp, Rattus norvegicus
tggtacttgatcagtctagctcttc

SEQ ID NO: 639294 - DNA, 25 bp, Rattus norvegicus
tggtacttgatctgtctagctcttc

SEQ ID NO: 639295 - DNA, 25 bp, Rattus norvegicus
tggtacttggccctcagcctgggat

SEQ ID NO: 639296 - DNA, 25 bp, Rattus norvegicus
tggtacttggccgtcagcctgggat

SEQ ID NO: 639297 - DNA, 25 bp, Rattus norvegicus
tggtacttggttaattcccttccat

SEQ ID NO: 639298 - DNA, 25 bp, Rattus norvegicus
tggtacttggtttattcccttccat

SEQ ID NO: 639299 - DNA, 25 bp, Rattus norvegicus
tggtactttcctacggcaggtgagc

SEQ ID NO: 639300 - DNA, 25 bp, Rattus norvegicus
tggtactttcctcccttaaggagtg

SEQ ID NO: 639301 - DNA, 25 bp, Rattus norvegicus
tggtactttcctgccttaaggagtg

SEQ ID NO: 639302 - DNA, 25 bp, Rattus norvegicus
tggtactttccttcggcaggtgagc

SEQ ID NO: 639303 - DNA, 25 bp, Rattus norvegicus
tggtagaaagcccaggacagctcag

SEQ ID NO: 639304 - DNA, 25 bp, Rattus norvegicus
tggtagaaagccgaggacagctcag

SEQ ID NO: 639305 - DNA, 25 bp, Rattus norvegicus
tggtagaaatacacccacgcggtat

SEQ ID NO: 639306 - DNA, 25 bp, Rattus norvegicus
tggtagaaatactcccacgcggtat

SEQ ID NO: 639307 - DNA, 25 bp, Rattus norvegicus
tggtagaaccaaagtgggtgccctg

SEQ ID NO: 639308 - DNA, 25 bp, Rattus norvegicus
tggtagaaccaatgtgggtgccctg

SEQ ID NO: 639309 - DNA, 25 bp, Rattus norvegicus
tggtagaaccacacagccacagatg

SEQ ID NO: 639310 - DNA, 25 bp, Rattus norvegicus
tggtagaaccactcagccacagatg

SEQ ID NO: 639311 - DNA, 25 bp, Rattus norvegicus
tggtagaagaccctgttgccctcct

SEQ ID NO: 639312 - DNA, 25 bp, Rattus norvegicus
tggtagaagaccgtgttgccctcct

SEQ ID NO: 639313 - DNA, 25 bp, Rattus norvegicus
tggtagaatgcaattcctgggctcc

SEQ ID NO: 639314 - DNA, 25 bp, Rattus norvegicus
tggtagaatgcatttcctgggctcc

SEQ ID NO: 639315 - DNA, 25 bp, Rattus norvegicus
tggtagaccccacaccaggaaagac

SEQ ID NO: 639316 - DNA, 25 bp, Rattus norvegicus
tggtagaccccagaccaggaaagac

SEQ ID NO: 639317 - DNA, 25 bp, Rattus norvegicus
tggtagacctcaacacactgtaact

SEQ ID NO: 639318 - DNA, 25 bp, Rattus norvegicus
tggtagacctcatcacactgtaact

SEQ ID NO: 639319 - DNA, 25 bp, Rattus norvegicus
tggtagactcctattacttggccat

SEQ ID NO: 639320 - DNA, 25 bp, Rattus norvegicus
tggtagactccttttacttggccat

SEQ ID NO: 639321 - DNA, 25 bp, Rattus norvegicus
tggtagagaagaccgtggatcacct

SEQ ID NO: 639322 - DNA, 25 bp, Rattus norvegicus
tggtagagaagagcgtggatcacct

SEQ ID NO: 639323 - DNA, 25 bp, Rattus norvegicus
tggtagagccggatattcacagaga

SEQ ID NO: 639324 - DNA, 25 bp, Rattus norvegicus
tggtagagccggttattcacagaga

SEQ ID NO: 639325 - DNA, 25 bp, Rattus norvegicus
tggtagagccgtagctttccagaca

SEQ ID NO: 639326 - DNA, 25 bp, Rattus norvegicus
tggtagagccgttgctttccagaca

SEQ ID NO: 639327 - DNA, 25 bp, Rattus norvegicus
tggtagagctgcactgcttccacaa

SEQ ID NO: 639328 - DNA, 25 bp, Rattus norvegicus
tggtagagctgctctgcttccacaa

SEQ ID NO: 639329 - DNA, 25 bp, Rattus norvegicus
tggtagaggactatcctagaaagcg

SEQ ID NO: 639330 - DNA, 25 bp, Rattus norvegicus
tggtagaggactttcctagaaagcg

SEQ ID NO: 639331 - DNA, 25 bp, Rattus norvegicus
tggtagcaaaagacccctcagccta

SEQ ID NO: 639332 - DNA, 25 bp, Rattus norvegicus
tggtagcaaaagtcccctcagccta

SEQ ID NO: 639333 - DNA, 25 bp, Rattus norvegicus
tggtagcaatggaacacactgtgat

SEQ ID NO: 639334 - DNA, 25 bp, Rattus norvegicus
tggtagcaatggtacacactgtgat

SEQ ID NO: 639335 - DNA, 25 bp, Rattus norvegicus
tggtagcaccatcttcttggtgttc

SEQ ID NO: 639336 - DNA, 25 bp, Rattus norvegicus
tggtagcaccatgttcttggtgttc

SEQ ID NO: 639337 - DNA, 25 bp, Rattus norvegicus
tggtagcacgtgcacgccattgtaa

SEQ ID NO: 639338 - DNA, 25 bp, Rattus norvegicus
tggtagcacgtggacgccattgtaa

SEQ ID NO: 639339 - DNA, 25 bp, Rattus norvegicus
tggtagcagccaatgatctcaagtg

SEQ ID NO: 639340 - DNA, 25 bp, Rattus norvegicus
tggtagcagccattgatctcaagtg

SEQ ID NO: 639341 - DNA, 25 bp, Rattus norvegicus
tggtagcagggcacttcacacagac

SEQ ID NO: 639342 - DNA, 25 bp, Rattus norvegicus
tggtagcagggctcttcacacagac

SEQ ID NO: 639343 - DNA, 25 bp, Rattus norvegicus
tggtagcatcatccccgatgcgccg

SEQ ID NO: 639344 - DNA, 25 bp, Rattus norvegicus
tggtagcatcatgcccgatgcgccg

SEQ ID NO: 639345 - DNA, 25 bp, Rattus norvegicus
tggtagcatgctctgttgattctca

SEQ ID NO: 639346 - DNA, 25 bp, Rattus norvegicus
tggtagcatgctgtgttgattctca

SEQ ID NO: 639347 - DNA, 25 bp, Rattus norvegicus
tggtagcccagtaccagagcaacag

SEQ ID NO: 639348 - DNA, 25 bp, Rattus norvegicus
tggtagcccagttccagagcaacag

SEQ ID NO: 639349 - DNA, 25 bp, Rattus norvegicus
tggtagccccagaggcgaactcgca

SEQ ID NO: 639350 - DNA, 25 bp, Rattus norvegicus
tggtagccccagtggcgaactcgca

SEQ ID NO: 639351 - DNA, 25 bp, Rattus norvegicus
tggtagccctgtcgtgcaatgcgac

SEQ ID NO: 639352 - DNA, 25 bp, Rattus norvegicus
tggtagccctgtggtgcaatgcgac

SEQ ID NO: 639353 - DNA, 25 bp, Rattus norvegicus
tggtagcctaacatcattttcgtat

SEQ ID NO: 639354 - DNA, 25 bp, Rattus norvegicus
tggtagcctaacttcattttcgtat

SEQ ID NO: 639355 - DNA, 25 bp, Rattus norvegicus
tggtagcctaataccctgccgggtt

SEQ ID NO: 639356 - DNA, 25 bp, Rattus norvegicus
tggtagcctaattccctgccgggtt

SEQ ID NO: 639357 - DNA, 25 bp, Rattus norvegicus
tggtagcctacacagtggaaagatc

SEQ ID NO: 639358 - DNA, 25 bp, Rattus norvegicus
tggtagcctacagagtggaaagatc

SEQ ID NO: 639359 - DNA, 25 bp, Rattus norvegicus
tggtagcctcctctactatgtgcat

SEQ ID NO: 639360 - DNA, 25 bp, Rattus norvegicus
tggtagcctcctgtactatgtgcat

SEQ ID NO: 639361 - DNA, 25 bp, Rattus norvegicus
tggtagcctctcaacactgtaacaa

SEQ ID NO: 639362 - DNA, 25 bp, Rattus norvegicus
tggtagcctctctacactgtaacaa

SEQ ID NO: 639363 - DNA, 25 bp, Rattus norvegicus
tggtagctagctaacagacaccgcc

SEQ ID NO: 639364 - DNA, 25 bp, Rattus norvegicus
tggtagctagcttacagacaccgcc

SEQ ID NO: 639365 - DNA, 25 bp, Rattus norvegicus
tggtagctcctaaaaggcctgggtt

SEQ ID NO: 639366 - DNA, 25 bp, Rattus norvegicus
tggtagctcctataaggcctgggtt

SEQ ID NO: 639367 - DNA, 25 bp, Rattus norvegicus
tggtagcttcaaacctacgtggtcc

SEQ ID NO: 639368 - DNA, 25 bp, Rattus norvegicus
tggtagcttcaatcctacgtggtcc

SEQ ID NO: 639369 - DNA, 25 bp, Rattus norvegicus
tggtaggagactctgctcggccagc

SEQ ID NO: 639370 - DNA, 25 bp, Rattus norvegicus
tggtaggagactgtgctcggccagc

SEQ ID NO: 639371 - DNA, 25 bp, Rattus norvegicus
tggtaggcatgcatttgtgaagact

SEQ ID NO: 639372 - DNA, 25 bp, Rattus norvegicus
tggtaggcatgcttttgtgaagact

SEQ ID NO: 639373 - DNA, 25 bp, Rattus norvegicus
tggtaggccaacacatgatcaaagt

SEQ ID NO: 639374 - DNA, 25 bp, Rattus norvegicus
tggtaggccaactcatgatcaaagt

SEQ ID NO: 639375 - DNA, 25 bp, Rattus norvegicus
tggtaggccaagcacctgtaacagt

SEQ ID NO: 639376 - DNA, 25 bp, Rattus norvegicus
tggtaggccaaggacctgtaacagt

SEQ ID NO: 639377 - DNA, 25 bp, Rattus norvegicus
tggtaggctagcacagcacagctga

SEQ ID NO: 639378 - DNA, 25 bp, Rattus norvegicus
tggtaggctagctcagcacagctga

SEQ ID NO: 639379 - DNA, 25 bp, Rattus norvegicus
tggtagggcagtacagtgccgtcct

SEQ ID NO: 639380 - DNA, 25 bp, Rattus norvegicus
tggtagggcagttcagtgccgtcct

SEQ ID NO: 639381 - DNA, 25 bp, Rattus norvegicus
tggtaggttagcatcccgtgacatc

SEQ ID NO: 639382 - DNA, 25 bp, Rattus norvegicus
tggtaggttagcttcccgtgacatc

SEQ ID NO: 639383 - DNA, 25 bp, Rattus norvegicus
tggtagtataggacgggctcccatc

SEQ ID NO: 639384 - DNA, 25 bp, Rattus norvegicus
tggtagtataggtcgggctcccatc

SEQ ID NO: 639385 - DNA, 25 bp, Rattus norvegicus
tggtagtcaggcacttcccgggatg

SEQ ID NO: 639386 - DNA, 25 bp, Rattus norvegicus
tggtagtcaggctcttcccgggatg

SEQ ID NO: 639387 - DNA, 25 bp, Rattus norvegicus
tggtagtccctgcaggcaaccactg

SEQ ID NO: 639388 - DNA, 25 bp, Rattus norvegicus
tggtagtccctggaggcaaccactg

SEQ ID NO: 639389 - DNA, 25 bp, Rattus norvegicus
tggtagtggtgcacatcccagcact

SEQ ID NO: 639390 - DNA, 25 bp, Rattus norvegicus
tggtagtggtgctcatcccagcact

SEQ ID NO: 639391 - DNA, 25 bp, Rattus norvegicus
tggtagttacctcctaaggcctgtt

SEQ ID NO: 639392 - DNA, 25 bp, Rattus norvegicus
tggtagttacctgctaaggcctgtt

SEQ ID NO: 639393 - DNA, 25 bp, Rattus norvegicus
tggtagttccaaaatccgtaagttt

SEQ ID NO: 639394 - DNA, 25 bp, Rattus norvegicus
tggtagttccaatatccgtaagttt

SEQ ID NO: 639395 - DNA, 25 bp, Rattus norvegicus
tggtagttccttatatattttcata

SEQ ID NO: 639396 - DNA, 25 bp, Rattus norvegicus
tggtagttccttttatattttcata

SEQ ID NO: 639397 - DNA, 25 bp, Rattus norvegicus
tggtagttgactattacctgtccct

SEQ ID NO: 639398 - DNA, 25 bp, Rattus norvegicus
tggtagttgacttttacctgtccct

SEQ ID NO: 639399 - DNA, 25 bp, Rattus norvegicus
tggtagttggatactatttttattg

SEQ ID NO: 639400 - DNA, 25 bp, Rattus norvegicus
tggtagttggattctatttttattg

SEQ ID NO: 639401 - DNA, 25 bp, Rattus norvegicus
tggtagttgtcaagcatgcctgttt

SEQ ID NO: 639402 - DNA, 25 bp, Rattus norvegicus
tggtagttgtcatgcatgcctgttt

SEQ ID NO: 639403 - DNA, 25 bp, Rattus norvegicus
tggtataagccaacctgcctgctgc

SEQ ID NO: 639404 - DNA, 25 bp, Rattus norvegicus
tggtataagccatcctgcctgctgc

SEQ ID NO: 639405 - DNA, 25 bp, Rattus norvegicus
tggtatacattacaccggcatctcc

SEQ ID NO: 639406 - DNA, 25 bp, Rattus norvegicus
tggtatacattagaccggcatctcc

SEQ ID NO: 639407 - DNA, 25 bp, Rattus norvegicus
tggtatacatttatgcagtcctttg

SEQ ID NO: 639408 - DNA, 25 bp, Rattus norvegicus
tggtatacatttttgcagtcctttg

SEQ ID NO: 639409 - DNA, 25 bp, Rattus norvegicus
tggtataccctgcaagtcgcttttt

SEQ ID NO: 639410 - DNA, 25 bp, Rattus norvegicus
tggtataccctggaagtcgcttttt

SEQ ID NO: 639411 - DNA, 25 bp, Rattus norvegicus
tggtataccttgattccacacaggg

SEQ ID NO: 639412 - DNA, 25 bp, Rattus norvegicus
tggtataccttgtttccacacaggg

SEQ ID NO: 639413 - DNA, 25 bp, Rattus norvegicus
tggtatacgcacaacatggaaactt

SEQ ID NO: 639414 - DNA, 25 bp, Rattus norvegicus
tggtatacgcactacatggaaactt

SEQ ID NO: 639415 - DNA, 25 bp, Rattus norvegicus
tggtatactcagcactcggaacact

SEQ ID NO: 639416 - DNA, 25 bp, Rattus norvegicus
tggtatactcaggactcggaacact

SEQ ID NO: 639417 - DNA, 25 bp, Rattus norvegicus
tggtatagctttcctagttccagaa

SEQ ID NO: 639418 - DNA, 25 bp, Rattus norvegicus
tggtatagctttgctagttccagaa

SEQ ID NO: 639419 - DNA, 25 bp, Rattus norvegicus
tggtatatacttacttccatcctct

SEQ ID NO: 639420 - DNA, 25 bp, Rattus norvegicus
tggtatatactttcttccatcctct

SEQ ID NO: 639421 - DNA, 25 bp, Rattus norvegicus
tggtatatgtccacaaccccaacag

SEQ ID NO: 639422 - DNA, 25 bp, Rattus norvegicus
tggtatatgtcctcaaccccaacag

SEQ ID NO: 639423 - DNA, 25 bp, Rattus norvegicus
tggtatcaacatcgtgtgtgcccag

SEQ ID NO: 639424 - DNA, 25 bp, Rattus norvegicus
tggtatcaacatggtgtgtgcccag

SEQ ID NO: 639425 - DNA, 25 bp, Rattus norvegicus
tggtatcaactgacataatgccctt

SEQ ID NO: 639426 - DNA, 25 bp, Rattus norvegicus
tggtatcaactgtcataatgccctt

SEQ ID NO: 639427 - DNA, 25 bp, Rattus norvegicus
tggtatcaggataccagctccctcg

SEQ ID NO: 639428 - DNA, 25 bp, Rattus norvegicus
tggtatcaggattccagctccctcg

SEQ ID NO: 639429 - DNA, 25 bp, Rattus norvegicus
tggtatcatcagacacaacttccct

SEQ ID NO: 639430 - DNA, 25 bp, Rattus norvegicus
tggtatcatcagtcacaacttccct

SEQ ID NO: 639431 - DNA, 25 bp, Rattus norvegicus
tggtatcatcatcatcccatcatag

SEQ ID NO: 639432 - DNA, 25 bp, Rattus norvegicus
tggtatcatcatgatcccatcatag

SEQ ID NO: 639433 - DNA, 25 bp, Rattus norvegicus
tggtatccccttagccatgctgggc

SEQ ID NO: 639434 - DNA, 25 bp, Rattus norvegicus
tggtatcccctttgccatgctgggc

SEQ ID NO: 639435 - DNA, 25 bp, Rattus norvegicus
tggtatccgtatactcttctgagca

SEQ ID NO: 639436 - DNA, 25 bp, Rattus norvegicus
tggtatccgtattctcttctgagca

SEQ ID NO: 639437 - DNA, 25 bp, Rattus norvegicus
tggtatcctgcactagctcttgggc

SEQ ID NO: 639438 - DNA, 25 bp, Rattus norvegicus
tggtatcctgcagtagctcttgggc

SEQ ID NO: 639439 - DNA, 25 bp, Rattus norvegicus
tggtatctcaccactctggaaaggt

SEQ ID NO: 639440 - DNA, 25 bp, Rattus norvegicus
tggtatctcacctctctggaaaggt

SEQ ID NO: 639441 - DNA, 25 bp, Rattus norvegicus
tggtatctcctacaagctcaacggg

SEQ ID NO: 639442 - DNA, 25 bp, Rattus norvegicus
tggtatctcctagaagctcaacggg

SEQ ID NO: 639443 - DNA, 25 bp, Rattus norvegicus
tggtatctcttcatactcattctgc

SEQ ID NO: 639444 - DNA, 25 bp, Rattus norvegicus
tggtatctcttcttactcattctgc

SEQ ID NO: 639445 - DNA, 25 bp, Rattus norvegicus
tggtatcttccaacgtgcaactttt

SEQ ID NO: 639446 - DNA, 25 bp, Rattus norvegicus
tggtatcttccacctccagaaattt

SEQ ID NO: 639447 - DNA, 25 bp, Rattus norvegicus
tggtatcttccagctccagaaattt

SEQ ID NO: 639448 - DNA, 25 bp, Rattus norvegicus
tggtatcttccatcgtgcaactttt

SEQ ID NO: 639449 - DNA, 25 bp, Rattus norvegicus
tggtatcttgatcaacttgcagaaa

SEQ ID NO: 639450 - DNA, 25 bp, Rattus norvegicus
tggtatcttgatgaacttgcagaaa

SEQ ID NO: 639451 - DNA, 25 bp, Rattus norvegicus
tggtatcttgctcaggaattagtcg

SEQ ID NO: 639452 - DNA, 25 bp, Rattus norvegicus
tggtatcttgctgaggaattagtcg

SEQ ID NO: 639453 - DNA, 25 bp, Rattus norvegicus
tggtatcttgtcactaaactcatag

SEQ ID NO: 639454 - DNA, 25 bp, Rattus norvegicus
tggtatcttgtctctaaactcatag

SEQ ID NO: 639455 - DNA, 25 bp, Rattus norvegicus
tggtatcttttgacgcttttgcagc

SEQ ID NO: 639456 - DNA, 25 bp, Rattus norvegicus
tggtatcttttgctagcctcaggaa

SEQ ID NO: 639457 - DNA, 25 bp, Rattus norvegicus
tggtatcttttggtagcctcaggaa

SEQ ID NO: 639458 - DNA, 25 bp, Rattus norvegicus
tggtatcttttgtcgcttttgcagc

SEQ ID NO: 639459 - DNA, 25 bp, Rattus norvegicus
tggtatgactccatcagcagacaca

SEQ ID NO: 639460 - DNA, 25 bp, Rattus norvegicus
tggtatgactccttcagcagacaca

SEQ ID NO: 639461 - DNA, 25 bp, Rattus norvegicus
tggtatgcagtgacatgcccactct

SEQ ID NO: 639462 - DNA, 25 bp, Rattus norvegicus
tggtatgcagtgtcatgcccactct

SEQ ID NO: 639463 - DNA, 25 bp, Rattus norvegicus
tggtatgcttgccatcacacatgca

SEQ ID NO: 639464 - DNA, 25 bp, Rattus norvegicus
tggtatgcttgcgatcacacatgca

SEQ ID NO: 639465 - DNA, 25 bp, Rattus norvegicus
tggtatggacgcacatcaagcatgt

SEQ ID NO: 639466 - DNA, 25 bp, Rattus norvegicus
tggtatggacgctcatcaagcatgt

SEQ ID NO: 639467 - DNA, 25 bp, Rattus norvegicus
tggtatgtaccaccactgtgctcag

SEQ ID NO: 639468 - DNA, 25 bp, Rattus norvegicus
tggtatgtaccagcactgtgctcag

SEQ ID NO: 639469 - DNA, 25 bp, Rattus norvegicus
tggtattagggtcttttaatttctg

SEQ ID NO: 639470 - DNA, 25 bp, Rattus norvegicus
tggtattagggtgttttaatttctg

SEQ ID NO: 639471 - DNA, 25 bp, Rattus norvegicus
tggtattcaaagaacctcctctctc

SEQ ID NO: 639472 - DNA, 25 bp, Rattus norvegicus
tggtattcaaagtacctcctctctc

SEQ ID NO: 639473 - DNA, 25 bp, Rattus norvegicus
tggtattcaggaagcttcccctctg

SEQ ID NO: 639474 - DNA, 25 bp, Rattus norvegicus
tggtattcaggatgcttcccctctg

SEQ ID NO: 639475 - DNA, 25 bp, Rattus norvegicus
tggtattcttcaattgcggtccaga

SEQ ID NO: 639476 - DNA, 25 bp, Rattus norvegicus
tggtattcttcatttgcggtccaga

SEQ ID NO: 639477 - DNA, 25 bp, Rattus norvegicus
tggtattgatacactgtcacccact

SEQ ID NO: 639478 - DNA, 25 bp, Rattus norvegicus
tggtattgatactctgtcacccact

SEQ ID NO: 639479 - DNA, 25 bp, Rattus norvegicus
tggtattgctatatgcccatcccat

SEQ ID NO: 639480 - DNA, 25 bp, Rattus norvegicus
tggtattgctatttgcccatcccat

SEQ ID NO: 639481 - DNA, 25 bp, Rattus norvegicus
tggtattgtattccccagtgcacac

SEQ ID NO: 639482 - DNA, 25 bp, Rattus norvegicus
tggtattgtattgcccagtgcacac

SEQ ID NO: 639483 - DNA, 25 bp, Rattus norvegicus
tggtattgtgccagactaagcctgc

SEQ ID NO: 639484 - DNA, 25 bp, Rattus norvegicus
tggtattgtgcctgactaagcctgc

SEQ ID NO: 639485 - DNA, 25 bp, Rattus norvegicus
tggtatttatacacacccacagata

SEQ ID NO: 639486 - DNA, 25 bp, Rattus norvegicus
tggtatttatactcacccacagata

SEQ ID NO: 639487 - DNA, 25 bp, Rattus norvegicus
tggtatttcccaaataacaaggtca

SEQ ID NO: 639488 - DNA, 25 bp, Rattus norvegicus
tggtatttcccatataacaaggtca

SEQ ID NO: 639489 - DNA, 25 bp, Rattus norvegicus
tggtattttgatccctacccccatt

SEQ ID NO: 639490 - DNA, 25 bp, Rattus norvegicus
tggtattttgatgcctacccccatt

SEQ ID NO: 639491 - DNA, 25 bp, Rattus norvegicus
tggtattttgtactccacatcccaa

SEQ ID NO: 639492 - DNA, 25 bp, Rattus norvegicus
tggtattttgtagtccacatcccaa

SEQ ID NO: 639493 - DNA, 25 bp, Rattus norvegicus
tggtatttttgtatctatcttaacg

SEQ ID NO: 639494 - DNA, 25 bp, Rattus norvegicus
tggtatttttgtttctatcttaacg

SEQ ID NO: 639495 - DNA, 25 bp, Rattus norvegicus
tggtcaaacaagatgcaatcctctg

SEQ ID NO: 639496 - DNA, 25 bp, Rattus norvegicus
tggtcaaacaagttgcaatcctctg

SEQ ID NO: 639497 - DNA, 25 bp, Rattus norvegicus
tggtcaaacgtcatgctggtgtgct

SEQ ID NO: 639498 - DNA, 25 bp, Rattus norvegicus
tggtcaaacgtcttgctggtgtgct

SEQ ID NO: 639499 - DNA, 25 bp, Rattus norvegicus
tggtcaaatctcagccaggaggcct

SEQ ID NO: 639500 - DNA, 25 bp, Rattus norvegicus
tggtcaaatctctgccaggaggcct

SEQ ID NO: 639501 - DNA, 25 bp, Rattus norvegicus
tggtcaacatataggactctgctgt

SEQ ID NO: 639502 - DNA, 25 bp, Rattus norvegicus
tggtcaacatattggactctgctgt

SEQ ID NO: 639503 - DNA, 25 bp, Rattus norvegicus
tggtcaacatcaccctcaacagctt

SEQ ID NO: 639504 - DNA, 25 bp, Rattus norvegicus
tggtcaacatcagcctcaacagctt

SEQ ID NO: 639505 - DNA, 25 bp, Rattus norvegicus
tggtcaacccagataggctatgcta

SEQ ID NO: 639506 - DNA, 25 bp, Rattus norvegicus
tggtcaacccagttaggctatgcta

SEQ ID NO: 639507 - DNA, 25 bp, Rattus norvegicus
tggtcaacgactacatctgtggagg

SEQ ID NO: 639508 - DNA, 25 bp, Rattus norvegicus
tggtcaacgacttcatctgtggagg

SEQ ID NO: 639509 - DNA, 25 bp, Rattus norvegicus
tggtcaacgagaccacagtgtgcct

SEQ ID NO: 639510 - DNA, 25 bp, Rattus norvegicus
tggtcaacgagagcacagtgtgcct

SEQ ID NO: 639511 - DNA, 25 bp, Rattus norvegicus
tggtcaacgtatcaactatgggttt

SEQ ID NO: 639512 - DNA, 25 bp, Rattus norvegicus
tggtcaacgtatgaactatgggttt

SEQ ID NO: 639513 - DNA, 25 bp, Rattus norvegicus
tggtcaactccaacaccatcaagat

SEQ ID NO: 639514 - DNA, 25 bp, Rattus norvegicus
tggtcaactccatcaccatcaagat

SEQ ID NO: 639515 - DNA, 25 bp, Rattus norvegicus
tggtcaacttctatgtcacagactc

SEQ ID NO: 639516 - DNA, 25 bp, Rattus norvegicus
tggtcaacttctttgtcacagactc

SEQ ID NO: 639517 - DNA, 25 bp, Rattus norvegicus
tggtcaacttggaagtttccctttg

SEQ ID NO: 639518 - DNA, 25 bp, Rattus norvegicus
tggtcaacttggtagtttccctttg

SEQ ID NO: 639519 - DNA, 25 bp, Rattus norvegicus
tggtcaagagcgaggcggcgtcacc

SEQ ID NO: 639520 - DNA, 25 bp, Rattus norvegicus
tggtcaagagcgtggcggcgtcacc

SEQ ID NO: 639521 - DNA, 25 bp, Rattus norvegicus
tggtcaagcagcagagaactgggcc

SEQ ID NO: 639522 - DNA, 25 bp, Rattus norvegicus
tggtcaagcagctgagaactgggcc

SEQ ID NO: 639523 - DNA, 25 bp, Rattus norvegicus
tggtcaagcaggacggctccactat

SEQ ID NO: 639524 - DNA, 25 bp, Rattus norvegicus
tggtcaagcaggtcggctccactat

SEQ ID NO: 639525 - DNA, 25 bp, Rattus norvegicus
tggtcaagcccaaatcaactcggtc

SEQ ID NO: 639526 - DNA, 25 bp, Rattus norvegicus
tggtcaagcccatatcaactcggtc

SEQ ID NO: 639527 - DNA, 25 bp, Rattus norvegicus
tggtcaagcgttattctaggttcct

SEQ ID NO: 639528 - DNA, 25 bp, Rattus norvegicus
tggtcaagcgtttttctaggttcct

SEQ ID NO: 639529 - DNA, 25 bp, Rattus norvegicus
tggtcaaggccaagggcaactgcgc

SEQ ID NO: 639530 - DNA, 25 bp, Rattus norvegicus
tggtcaaggccatgggcaactgcgc

SEQ ID NO: 639531 - DNA, 25 bp, Rattus norvegicus
tggtcaagggacacacatctcgtct

SEQ ID NO: 639532 - DNA, 25 bp, Rattus norvegicus
tggtcaagggactcacatctcgtct

SEQ ID NO: 639533 - DNA, 25 bp, Rattus norvegicus
tggtcaataggcacaaccaccaacc

SEQ ID NO: 639534 - DNA, 25 bp, Rattus norvegicus
tggtcaataggctcaaccaccaacc

SEQ ID NO: 639535 - DNA, 25 bp, Rattus norvegicus
tggtcaatagttagcctgcttttcc

SEQ ID NO: 639536 - DNA, 25 bp, Rattus norvegicus
tggtcaatagtttgcctgcttttcc

SEQ ID NO: 639537 - DNA, 25 bp, Rattus norvegicus
tggtcaatcaaacccactgtgcctg

SEQ ID NO: 639538 - DNA, 25 bp, Rattus norvegicus
tggtcaatcaaagccactgtgcctg

SEQ ID NO: 639539 - DNA, 25 bp, Rattus norvegicus
tggtcaatccttacttgcagttgta

SEQ ID NO: 639540 - DNA, 25 bp, Rattus norvegicus
tggtcaatcctttcttgcagttgta

SEQ ID NO: 639541 - DNA, 25 bp, Rattus norvegicus
tggtcaatttgcacctaccttttgt

SEQ ID NO: 639542 - DNA, 25 bp, Rattus norvegicus
tggtcaatttgctcctaccttttgt

SEQ ID NO: 639543 - DNA, 25 bp, Rattus norvegicus
tggtcacaacagctactcacaggat

SEQ ID NO: 639544 - DNA, 25 bp, Rattus norvegicus
tggtcacaacaggtactcacaggat

SEQ ID NO: 639545 - DNA, 25 bp, Rattus norvegicus
tggtcacacatcaggcagccaaggg

SEQ ID NO: 639546 - DNA, 25 bp, Rattus norvegicus
tggtcacacatctggcagccaaggg

SEQ ID NO: 639547 - DNA, 25 bp, Rattus norvegicus
tggtcacacctgctaaagattcaat

SEQ ID NO: 639548 - DNA, 25 bp, Rattus norvegicus
tggtcacacctggtaaagattcaat

SEQ ID NO: 639549 - DNA, 25 bp, Rattus norvegicus
tggtcacacggactctctcattaaa

SEQ ID NO: 639550 - DNA, 25 bp, Rattus norvegicus
tggtcacacggagtctctcattaaa

SEQ ID NO: 639551 - DNA, 25 bp, Rattus norvegicus
tggtcacactcccaacaggttttgg

SEQ ID NO: 639552 - DNA, 25 bp, Rattus norvegicus
tggtcacactccgaacaggttttgg

SEQ ID NO: 639553 - DNA, 25 bp, Rattus norvegicus
tggtcacagaggacatccgacgctg

SEQ ID NO: 639554 - DNA, 25 bp, Rattus norvegicus
tggtcacagaggtcatccgacgctg

SEQ ID NO: 639555 - DNA, 25 bp, Rattus norvegicus
tggtcacagcacattcataatcact

SEQ ID NO: 639556 - DNA, 25 bp, Rattus norvegicus
tggtcacagcactttcataatcact

SEQ ID NO: 639557 - DNA, 25 bp, Rattus norvegicus
tggtcacagccaacacagccttgaa

SEQ ID NO: 639558 - DNA, 25 bp, Rattus norvegicus
tggtcacagccatcacagccttgaa

SEQ ID NO: 639559 - DNA, 25 bp, Rattus norvegicus
tggtcacagcccctcggcacggcag

SEQ ID NO: 639560 - DNA, 25 bp, Rattus norvegicus
tggtcacagcccgtcggcacggcag

SEQ ID NO: 639561 - DNA, 25 bp, Rattus norvegicus
tggtcacagctgctaccatgcaaag

SEQ ID NO: 639562 - DNA, 25 bp, Rattus norvegicus
tggtcacagctggtaccatgcaaag

SEQ ID NO: 639563 - DNA, 25 bp, Rattus norvegicus
tggtcacagcttctcagggatcagg

SEQ ID NO: 639564 - DNA, 25 bp, Rattus norvegicus
tggtcacagcttgtcagggatcagg

SEQ ID NO: 639565 - DNA, 25 bp, Rattus norvegicus
tggtcacatccaaaccactgtagcc

SEQ ID NO: 639566 - DNA, 25 bp, Rattus norvegicus
tggtcacatccataccactgtagcc

SEQ ID NO: 639567 - DNA, 25 bp, Rattus norvegicus
tggtcacatttaattgcctcttcgt

SEQ ID NO: 639568 - DNA, 25 bp, Rattus norvegicus
tggtcacatttatttgcctcttcgt

SEQ ID NO: 639569 - DNA, 25 bp, Rattus norvegicus
tggtcaccaagcactgagcggctgg

SEQ ID NO: 639570 - DNA, 25 bp, Rattus norvegicus
tggtcaccaagctctgagcggctgg

SEQ ID NO: 639571 - DNA, 25 bp, Rattus norvegicus
tggtcaccacaaaagcactatccgg

SEQ ID NO: 639572 - DNA, 25 bp, Rattus norvegicus
tggtcaccacaatagcactatccgg

SEQ ID NO: 639573 - DNA, 25 bp, Rattus norvegicus
tggtcaccactcagaaccttctcgg

SEQ ID NO: 639574 - DNA, 25 bp, Rattus norvegicus
tggtcaccactctgaaccttctcgg

SEQ ID NO: 639575 - DNA, 25 bp, Rattus norvegicus
tggtcaccagagacggcctcgagga

SEQ ID NO: 639576 - DNA, 25 bp, Rattus norvegicus
tggtcaccagagtcggcctcgagga

SEQ ID NO: 639577 - DNA, 25 bp, Rattus norvegicus
tggtcaccagtgactgcccaatgtt

SEQ ID NO: 639578 - DNA, 25 bp, Rattus norvegicus
tggtcaccagtgtctgcccaatgtt

SEQ ID NO: 639579 - DNA, 25 bp, Rattus norvegicus
tggtcaccatctcctatgctggaaa

SEQ ID NO: 639580 - DNA, 25 bp, Rattus norvegicus
tggtcaccatctgctatgctggaaa

SEQ ID NO: 639581 - DNA, 25 bp, Rattus norvegicus
tggtcaccatgccaactcaggagag

SEQ ID NO: 639582 - DNA, 25 bp, Rattus norvegicus
tggtcaccatgcgaactcaggagag

SEQ ID NO: 639583 - DNA, 25 bp, Rattus norvegicus
tggtcaccccatagtgtcttgagga

SEQ ID NO: 639584 - DNA, 25 bp, Rattus norvegicus
tggtcaccccattgtgtcttgagga

SEQ ID NO: 639585 - DNA, 25 bp, Rattus norvegicus
tggtcaccccttcatgtggaacgag

SEQ ID NO: 639586 - DNA, 25 bp, Rattus norvegicus
tggtcaccccttgatgtggaacgag

SEQ ID NO: 639587 - DNA, 25 bp, Rattus norvegicus
tggtcacccgcgcaaccaaatggat

SEQ ID NO: 639588 - DNA, 25 bp, Rattus norvegicus
tggtcacccgcggaaccaaatggat

SEQ ID NO: 639589 - DNA, 25 bp, Rattus norvegicus
tggtcaccctctattaagacgccaa

SEQ ID NO: 639590 - DNA, 25 bp, Rattus norvegicus
tggtcaccctctcaggtcataaaag

SEQ ID NO: 639591 - DNA, 25 bp, Rattus norvegicus
tggtcaccctctgaggtcataaaag

SEQ ID NO: 639592 - DNA, 25 bp, Rattus norvegicus
tggtcaccctcttttaagacgccaa

SEQ ID NO: 639593 - DNA, 25 bp, Rattus norvegicus
tggtcaccctggaagcctttgacag

SEQ ID NO: 639594 - DNA, 25 bp, Rattus norvegicus
tggtcaccctggtagcctttgacag

SEQ ID NO: 639595 - DNA, 25 bp, Rattus norvegicus
tggtcaccgctcagcggtgtgactg

SEQ ID NO: 639596 - DNA, 25 bp, Rattus norvegicus
tggtcaccgctctgcggtgtgactg

SEQ ID NO: 639597 - DNA, 25 bp, Rattus norvegicus
tggtcacctcttaccagcctcagat

SEQ ID NO: 639598 - DNA, 25 bp, Rattus norvegicus
tggtcacctctttccagcctcagat

SEQ ID NO: 639599 - DNA, 25 bp, Rattus norvegicus
tggtcacctgctcaaacgggttcta

SEQ ID NO: 639600 - DNA, 25 bp, Rattus norvegicus
tggtcacctgctgaaacgggttcta

SEQ ID NO: 639601 - DNA, 25 bp, Rattus norvegicus
tggtcacgacacacaaatcctggtt

SEQ ID NO: 639602 - DNA, 25 bp, Rattus norvegicus
tggtcacgacactcaaatcctggtt

SEQ ID NO: 639603 - DNA, 25 bp, Rattus norvegicus
tggtcacggcatatccttcggacat

SEQ ID NO: 639604 - DNA, 25 bp, Rattus norvegicus
tggtcacggcatttccttcggacat

SEQ ID NO: 639605 - DNA, 25 bp, Rattus norvegicus
tggtcacgtgcgcaggaaaccctca

SEQ ID NO: 639606 - DNA, 25 bp, Rattus norvegicus
tggtcacgtgcggaggaaaccctca

SEQ ID NO: 639607 - DNA, 25 bp, Rattus norvegicus
tggtcactaaaaattcttccccact

SEQ ID NO: 639608 - DNA, 25 bp, Rattus norvegicus
tggtcactaaaatttcttccccact

SEQ ID NO: 639609 - DNA, 25 bp, Rattus norvegicus
tggtcactaagtctggccgcctgcg

SEQ ID NO: 639610 - DNA, 25 bp, Rattus norvegicus
tggtcactaagtgtggccgcctgcg

SEQ ID NO: 639611 - DNA, 25 bp, Rattus norvegicus
tggtcactaccgacgctttctattt

SEQ ID NO: 639612 - DNA, 25 bp, Rattus norvegicus
tggtcactaccgtcgctttctattt

SEQ ID NO: 639613 - DNA, 25 bp, Rattus norvegicus
tggtcactatatatctatttctgtc

SEQ ID NO: 639614 - DNA, 25 bp, Rattus norvegicus
tggtcactatatttctatttctgtc

SEQ ID NO: 639615 - DNA, 25 bp, Rattus norvegicus
tggtcactatttattccttgttccc

SEQ ID NO: 639616 - DNA, 25 bp, Rattus norvegicus
tggtcactattttttccttgttccc

SEQ ID NO: 639617 - DNA, 25 bp, Rattus norvegicus
tggtcactcactaccggcgagaagc

SEQ ID NO: 639618 - DNA, 25 bp, Rattus norvegicus
tggtcactcacttccggcgagaagc

SEQ ID NO: 639619 - DNA, 25 bp, Rattus norvegicus
tggtcactcttcatctggcccaaag

SEQ ID NO: 639620 - DNA, 25 bp, Rattus norvegicus
tggtcactcttcttctggcccaaag

SEQ ID NO: 639621 - DNA, 25 bp, Rattus norvegicus
tggtcactgcacagagaaatctctc

SEQ ID NO: 639622 - DNA, 25 bp, Rattus norvegicus
tggtcactgcactgagaaatctctc

SEQ ID NO: 639623 - DNA, 25 bp, Rattus norvegicus
tggtcactgccccaagatgttccaa

SEQ ID NO: 639624 - DNA, 25 bp, Rattus norvegicus
tggtcactgcccgaagatgttccaa

SEQ ID NO: 639625 - DNA, 25 bp, Rattus norvegicus
tggtcactggatcccccacagatgt

SEQ ID NO: 639626 - DNA, 25 bp, Rattus norvegicus
tggtcactggatgccccacagatgt

SEQ ID NO: 639627 - DNA, 25 bp, Rattus norvegicus
tggtcacttacccatgatctcatta

SEQ ID NO: 639628 - DNA, 25 bp, Rattus norvegicus
tggtcacttaccgatgatctcatta

SEQ ID NO: 639629 - DNA, 25 bp, Rattus norvegicus
tggtcacttcagagtttgggccgct

SEQ ID NO: 639630 - DNA, 25 bp, Rattus norvegicus
tggtcacttcagtgtttgggccgct

SEQ ID NO: 639631 - DNA, 25 bp, Rattus norvegicus
tggtcacttccaccaagttgtccag

SEQ ID NO: 639632 - DNA, 25 bp, Rattus norvegicus
tggtcacttccagcaagttgtccag

SEQ ID NO: 639633 - DNA, 25 bp, Rattus norvegicus
tggtcacttctacaacctggcagat

SEQ ID NO: 639634 - DNA, 25 bp, Rattus norvegicus
tggtcacttctagaacctggcagat

SEQ ID NO: 639635 - DNA, 25 bp, Rattus norvegicus
tggtcacttcttaggactgtatgag

SEQ ID NO: 639636 - DNA, 25 bp, Rattus norvegicus
tggtcacttctttggactgtatgag

SEQ ID NO: 639637 - DNA, 25 bp, Rattus norvegicus
tggtcacttgaaacaaccagtgtga

SEQ ID NO: 639638 - DNA, 25 bp, Rattus norvegicus
tggtcacttgaatcaaccagtgtga

SEQ ID NO: 639639 - DNA, 25 bp, Rattus norvegicus
tggtcacttgcaagtataatctagg

SEQ ID NO: 639640 - DNA, 25 bp, Rattus norvegicus
tggtcacttgcatgtataatctagg

SEQ ID NO: 639641 - DNA, 25 bp, Rattus norvegicus
tggtcagacatcagcggtgtagccg

SEQ ID NO: 639642 - DNA, 25 bp, Rattus norvegicus
tggtcagacatctgcggtgtagccg

SEQ ID NO: 639643 - DNA, 25 bp, Rattus norvegicus
tggtcagacctaactttctgtccat

SEQ ID NO: 639644 - DNA, 25 bp, Rattus norvegicus
tggtcagacctatctttctgtccat

SEQ ID NO: 639645 - DNA, 25 bp, Rattus norvegicus
tggtcagagaccacacaggcattgt

SEQ ID NO: 639646 - DNA, 25 bp, Rattus norvegicus
tggtcagagacctcacaggcattgt

SEQ ID NO: 639647 - DNA, 25 bp, Rattus norvegicus
tggtcagagatacctggcctggtct

SEQ ID NO: 639648 - DNA, 25 bp, Rattus norvegicus
tggtcagagatagctggcctggtct

SEQ ID NO: 639649 - DNA, 25 bp, Rattus norvegicus
tggtcagagtccatccagagtgtgg

SEQ ID NO: 639650 - DNA, 25 bp, Rattus norvegicus
tggtcagagtccctctcaaatgact

SEQ ID NO: 639651 - DNA, 25 bp, Rattus norvegicus
tggtcagagtccgtctcaaatgact

SEQ ID NO: 639652 - DNA, 25 bp, Rattus norvegicus
tggtcagagtccttccagagtgtgg

SEQ ID NO: 639653 - DNA, 25 bp, Rattus norvegicus
tggtcagcacagaacaacatctgga

SEQ ID NO: 639654 - DNA, 25 bp, Rattus norvegicus
tggtcagcacagtacaacatctgga

SEQ ID NO: 639655 - DNA, 25 bp, Rattus norvegicus
tggtcagcaccgagagcccaacttt

SEQ ID NO: 639656 - DNA, 25 bp, Rattus norvegicus
tggtcagcaccgtgagcccaacttt

SEQ ID NO: 639657 - DNA, 25 bp, Rattus norvegicus
tggtcagcagcgacaacacagtggc

SEQ ID NO: 639658 - DNA, 25 bp, Rattus norvegicus
tggtcagcagcgtcaacacagtggc

SEQ ID NO: 639659 - DNA, 25 bp, Rattus norvegicus
tggtcagccgccagcacagaagtga

SEQ ID NO: 639660 - DNA, 25 bp, Rattus norvegicus
tggtcagccgcctgcacagaagtga

SEQ ID NO: 639661 - DNA, 25 bp, Rattus norvegicus
tggtcagcctatacttcatgttcat

SEQ ID NO: 639662 - DNA, 25 bp, Rattus norvegicus
tggtcagcctattcttcatgttcat

SEQ ID NO: 639663 - DNA, 25 bp, Rattus norvegicus
tggtcagcgactaagagaacatcct

SEQ ID NO: 639664 - DNA, 25 bp, Rattus norvegicus
tggtcagcgacttagagaacatcct

SEQ ID NO: 639665 - DNA, 25 bp, Rattus norvegicus
tggtcagcgcatcagcttggttctg

SEQ ID NO: 639666 - DNA, 25 bp, Rattus norvegicus
tggtcagcgcatgagcttggttctg

SEQ ID NO: 639667 - DNA, 25 bp, Rattus norvegicus
tggtcagctcagcaattgcacgggt

SEQ ID NO: 639668 - DNA, 25 bp, Rattus norvegicus
tggtcagctcaggaattgcacgggt

SEQ ID NO: 639669 - DNA, 25 bp, Rattus norvegicus
tggtcagctggcaaggatctttctg

SEQ ID NO: 639670 - DNA, 25 bp, Rattus norvegicus
tggtcagctggctaggatctttctg

SEQ ID NO: 639671 - DNA, 25 bp, Rattus norvegicus
tggtcaggactactccatcctcaga

SEQ ID NO: 639672 - DNA, 25 bp, Rattus norvegicus
tggtcaggactagtccatcctcaga

SEQ ID NO: 639673 - DNA, 25 bp, Rattus norvegicus
tggtcaggactcagtttcaagtact

SEQ ID NO: 639674 - DNA, 25 bp, Rattus norvegicus
tggtcaggactctgtttcaagtact

SEQ ID NO: 639675 - DNA, 25 bp, Rattus norvegicus
tggtcaggagcaactttgccacctt

SEQ ID NO: 639676 - DNA, 25 bp, Rattus norvegicus
tggtcaggagcatctttgccacctt

SEQ ID NO: 639677 - DNA, 25 bp, Rattus norvegicus
tggtcaggagccagtcaagccacag

SEQ ID NO: 639678 - DNA, 25 bp, Rattus norvegicus
tggtcaggagcctgtcaagccacag

SEQ ID NO: 639679 - DNA, 25 bp, Rattus norvegicus
tggtcaggattgcagctgtcgccca

SEQ ID NO: 639680 - DNA, 25 bp, Rattus norvegicus
tggtcaggattggagctgtcgccca

SEQ ID NO: 639681 - DNA, 25 bp, Rattus norvegicus
tggtcaggcagaacccgcagagaag

SEQ ID NO: 639682 - DNA, 25 bp, Rattus norvegicus
tggtcaggcagatcccgcagagaag

SEQ ID NO: 639683 - DNA, 25 bp, Rattus norvegicus
tggtcaggcctccaactgagattca

SEQ ID NO: 639684 - DNA, 25 bp, Rattus norvegicus
tggtcaggcctcgaactgagattca

SEQ ID NO: 639685 - DNA, 25 bp, Rattus norvegicus
tggtcaggctgacttaccttctggg

SEQ ID NO: 639686 - DNA, 25 bp, Rattus norvegicus
tggtcaggctgagttaccttctggg

SEQ ID NO: 639687 - DNA, 25 bp, Rattus norvegicus
tggtcagggcttattacagtcacgt

SEQ ID NO: 639688 - DNA, 25 bp, Rattus norvegicus
tggtcagggctttttacagtcacgt

SEQ ID NO: 639689 - DNA, 25 bp, Rattus norvegicus
tggtcagggtatcccagcgctccac

SEQ ID NO: 639690 - DNA, 25 bp, Rattus norvegicus
tggtcagggtatgccagcgctccac

SEQ ID NO: 639691 - DNA, 25 bp, Rattus norvegicus
tggtcagggtcactcacttctgagt

SEQ ID NO: 639692 - DNA, 25 bp, Rattus norvegicus
tggtcagggtcagtcacttctgagt

SEQ ID NO: 639693 - DNA, 25 bp, Rattus norvegicus
tggtcagggtctatgctgctactac

SEQ ID NO: 639694 - DNA, 25 bp, Rattus norvegicus
tggtcagggtctttgctgctactac

SEQ ID NO: 639695 - DNA, 25 bp, Rattus norvegicus
tggtcaggtactcggtctcagcctt

SEQ ID NO: 639696 - DNA, 25 bp, Rattus norvegicus
tggtcaggtactgggtctcagcctt

SEQ ID NO: 639697 - DNA, 25 bp, Rattus norvegicus
tggtcaggtatcaagaactttaact

SEQ ID NO: 639698 - DNA, 25 bp, Rattus norvegicus
tggtcaggtatctagaactttaact

SEQ ID NO: 639699 - DNA, 25 bp, Rattus norvegicus
tggtcaggtgttcttcttctgttgg

SEQ ID NO: 639700 - DNA, 25 bp, Rattus norvegicus
tggtcaggtgttgttcttctgttgg

SEQ ID NO: 639701 - DNA, 25 bp, Rattus norvegicus
tggtcaggttggctttgtgtattct

SEQ ID NO: 639702 - DNA, 25 bp, Rattus norvegicus
tggtcaggttgggtttgtgtattct

SEQ ID NO: 639703 - DNA, 25 bp, Rattus norvegicus
tggtcagtgaaacatctcctttttt

SEQ ID NO: 639704 - DNA, 25 bp, Rattus norvegicus
tggtcagtgaaagatctcctttttt

SEQ ID NO: 639705 - DNA, 25 bp, Rattus norvegicus
tggtcagtgacccttggatctaatc

SEQ ID NO: 639706 - DNA, 25 bp, Rattus norvegicus
tggtcagtgaccgttggatctaatc

SEQ ID NO: 639707 - DNA, 25 bp, Rattus norvegicus
tggtcagtgccgacttctgcgagaa

SEQ ID NO: 639708 - DNA, 25 bp, Rattus norvegicus
tggtcagtgccgtcttctgcgagaa

SEQ ID NO: 639709 - DNA, 25 bp, Rattus norvegicus
tggtcagttcggcttacacagcgag

SEQ ID NO: 639710 - DNA, 25 bp, Rattus norvegicus
tggtcagttcgggttacacagcgag

SEQ ID NO: 639711 - DNA, 25 bp, Rattus norvegicus
tggtcagtttggagtcgcttggcac

SEQ ID NO: 639712 - DNA, 25 bp, Rattus norvegicus
tggtcagtttggtgtcgcttggcac

SEQ ID NO: 639713 - DNA, 25 bp, Rattus norvegicus
tggtcataacctactgctgctaata

SEQ ID NO: 639714 - DNA, 25 bp, Rattus norvegicus
tggtcataaccttctgctgctaata

SEQ ID NO: 639715 - DNA, 25 bp, Rattus norvegicus
tggtcatagcggaacagcccatgtc

SEQ ID NO: 639716 - DNA, 25 bp, Rattus norvegicus
tggtcatagcggtacagcccatgtc

SEQ ID NO: 639717 - DNA, 25 bp, Rattus norvegicus
tggtcatattgacagagccttctat

SEQ ID NO: 639718 - DNA, 25 bp, Rattus norvegicus
tggtcatattgagagagccttctat

SEQ ID NO: 639719 - DNA, 25 bp, Rattus norvegicus
tggtcatcaactcctgtttatcctt

SEQ ID NO: 639720 - DNA, 25 bp, Rattus norvegicus
tggtcatcaactgctgtttatcctt

SEQ ID NO: 639721 - DNA, 25 bp, Rattus norvegicus
tggtcatcaagtactcactggtaaa

SEQ ID NO: 639722 - DNA, 25 bp, Rattus norvegicus
tggtcatcaagttctcactggtaaa

SEQ ID NO: 639723 - DNA, 25 bp, Rattus norvegicus
tggtcatcactcacggtggtcactt

SEQ ID NO: 639724 - DNA, 25 bp, Rattus norvegicus
tggtcatcactctcggtggtcactt

SEQ ID NO: 639725 - DNA, 25 bp, Rattus norvegicus
tggtcatcgtacaccactttgttga

SEQ ID NO: 639726 - DNA, 25 bp, Rattus norvegicus
tggtcatcgtactccactttgttga

SEQ ID NO: 639727 - DNA, 25 bp, Rattus norvegicus
tggtcatctccaaatccatcaatat

SEQ ID NO: 639728 - DNA, 25 bp, Rattus norvegicus
tggtcatctccatatccatcaatat

SEQ ID NO: 639729 - DNA, 25 bp, Rattus norvegicus
tggtcatctgctccttgatcgtcac

SEQ ID NO: 639730 - DNA, 25 bp, Rattus norvegicus
tggtcatctgctgcttgatcgtcac

SEQ ID NO: 639731 - DNA, 25 bp, Rattus norvegicus
tggtcatctggtagtctgccgggaa

SEQ ID NO: 639732 - DNA, 25 bp, Rattus norvegicus
tggtcatctggttgtctgccgggaa

SEQ ID NO: 639733 - DNA, 25 bp, Rattus norvegicus
tggtcatctgtcatggtctgccgta

SEQ ID NO: 639734 - DNA, 25 bp, Rattus norvegicus
tggtcatctgtcttggtctgccgta

SEQ ID NO: 639735 - DNA, 25 bp, Rattus norvegicus
tggtcatcttccaggtctgtttcac

SEQ ID NO: 639736 - DNA, 25 bp, Rattus norvegicus
tggtcatcttcctggtctgtttcac

SEQ ID NO: 639737 - DNA, 25 bp, Rattus norvegicus
tggtcatctttcatccgagtggaga

SEQ ID NO: 639738 - DNA, 25 bp, Rattus norvegicus
tggtcatctttcttccgagtggaga

SEQ ID NO: 639739 - DNA, 25 bp, Rattus norvegicus
tggtcatgcctcagataaatgccca

SEQ ID NO: 639740 - DNA, 25 bp, Rattus norvegicus
tggtcatgcctctgataaatgccca

SEQ ID NO: 639741 - DNA, 25 bp, Rattus norvegicus
tggtcatgctggctccatcaatgag

SEQ ID NO: 639742 - DNA, 25 bp, Rattus norvegicus
tggtcatgctgggtccatcaatgag

SEQ ID NO: 639743 - DNA, 25 bp, Rattus norvegicus
tggtcatggaagcagcctctgccac

SEQ ID NO: 639744 - DNA, 25 bp, Rattus norvegicus
tggtcatggaaggagcctctgccac

SEQ ID NO: 639745 - DNA, 25 bp, Rattus norvegicus
tggtcatggctgagcgcctgcgata

SEQ ID NO: 639746 - DNA, 25 bp, Rattus norvegicus
tggtcatggctgtgcgcctgcgata

SEQ ID NO: 639747 - DNA, 25 bp, Rattus norvegicus
tggtcatgggtcaattggtggctaa

SEQ ID NO: 639748 - DNA, 25 bp, Rattus norvegicus
tggtcatgggtctattggtggctaa

SEQ ID NO: 639749 - DNA, 25 bp, Rattus norvegicus
tggtcatgtcccaacactcagagca

SEQ ID NO: 639750 - DNA, 25 bp, Rattus norvegicus
tggtcatgtccctacactcagagca

SEQ ID NO: 639751 - DNA, 25 bp, Rattus norvegicus
tggtcattacctactgctaacggag

SEQ ID NO: 639752 - DNA, 25 bp, Rattus norvegicus
tggtcattaccttctgctaacggag

SEQ ID NO: 639753 - DNA, 25 bp, Rattus norvegicus
tggtcattccctcagatatagcctc

SEQ ID NO: 639754 - DNA, 25 bp, Rattus norvegicus
tggtcattccctgagatatagcctc

SEQ ID NO: 639755 - DNA, 25 bp, Rattus norvegicus
tggtcattctccagtgtcttttcca

SEQ ID NO: 639756 - DNA, 25 bp, Rattus norvegicus
tggtcattctcctgtgtcttttcca

SEQ ID NO: 639757 - DNA, 25 bp, Rattus norvegicus
tggtcattctctacaagtcatctgt

SEQ ID NO: 639758 - DNA, 25 bp, Rattus norvegicus
tggtcattctcttcaagtcatctgt

SEQ ID NO: 639759 - DNA, 25 bp, Rattus norvegicus
tggtcattggaacctgtacctgcca

SEQ ID NO: 639760 - DNA, 25 bp, Rattus norvegicus
tggtcattggaagctgtacctgcca

SEQ ID NO: 639761 - DNA, 25 bp, Rattus norvegicus
tggtcatttcatacctgcagcggca

SEQ ID NO: 639762 - DNA, 25 bp, Rattus norvegicus
tggtcatttcattcctgcagcggca

SEQ ID NO: 639763 - DNA, 25 bp, Rattus norvegicus
tggtcatttgttcccttctgagtta

SEQ ID NO: 639764 - DNA, 25 bp, Rattus norvegicus
tggtcatttgttgccttctgagtta

SEQ ID NO: 639765 - DNA, 25 bp, Rattus norvegicus
tggtccaaatctagttcccttattt

SEQ ID NO: 639766 - DNA, 25 bp, Rattus norvegicus
tggtccaaatcttgttcccttattt

SEQ ID NO: 639767 - DNA, 25 bp, Rattus norvegicus
tggtccaaatgcaaacaggctcctg

SEQ ID NO: 639768 - DNA, 25 bp, Rattus norvegicus
tggtccaaatgctaacaggctcctg

SEQ ID NO: 639769 - DNA, 25 bp, Rattus norvegicus
tggtccaacaccatgaacagggcat

SEQ ID NO: 639770 - DNA, 25 bp, Rattus norvegicus
tggtccaacaccttgaacagggcat

SEQ ID NO: 639771 - DNA, 25 bp, Rattus norvegicus
tggtccaactggagaacctcggcca

SEQ ID NO: 639772 - DNA, 25 bp, Rattus norvegicus
tggtccaactggtgaacctcggcca

SEQ ID NO: 639773 - DNA, 25 bp, Rattus norvegicus
tggtccaactgtaaaggccacttga

SEQ ID NO: 639774 - DNA, 25 bp, Rattus norvegicus
tggtccaactgttaaggccacttga

SEQ ID NO: 639775 - DNA, 25 bp, Rattus norvegicus
tggtccaagaatcccacacactttt

SEQ ID NO: 639776 - DNA, 25 bp, Rattus norvegicus
tggtccaagaatgccacacactttt

SEQ ID NO: 639777 - DNA, 25 bp, Rattus norvegicus
tggtccaagcagcaggctccagcag

SEQ ID NO: 639778 - DNA, 25 bp, Rattus norvegicus
tggtccaagcaggaggctccagcag

SEQ ID NO: 639779 - DNA, 25 bp, Rattus norvegicus
tggtccaagctcattcagccagagt

SEQ ID NO: 639780 - DNA, 25 bp, Rattus norvegicus
tggtccaagctctttcagccagagt

SEQ ID NO: 639781 - DNA, 25 bp, Rattus norvegicus
tggtccaatgccaattcagcaggaa

SEQ ID NO: 639782 - DNA, 25 bp, Rattus norvegicus
tggtccaatgcctattcagcaggaa

SEQ ID NO: 639783 - DNA, 25 bp, Rattus norvegicus
tggtccacaacaacctttcagaaga

SEQ ID NO: 639784 - DNA, 25 bp, Rattus norvegicus
tggtccacaacatcctttcagaaga

SEQ ID NO: 639785 - DNA, 25 bp, Rattus norvegicus
tggtccacactacgtcgctctctgt

SEQ ID NO: 639786 - DNA, 25 bp, Rattus norvegicus
tggtccacactaggtcgctctctgt

SEQ ID NO: 639787 - DNA, 25 bp, Rattus norvegicus
tggtccacaggcacctttataaggg

SEQ ID NO: 639788 - DNA, 25 bp, Rattus norvegicus
tggtccacaggctcctttataaggg

SEQ ID NO: 639789 - DNA, 25 bp, Rattus norvegicus
tggtccacagtcacacggaagcaag

SEQ ID NO: 639790 - DNA, 25 bp, Rattus norvegicus
tggtccacagtctcacggaagcaag

SEQ ID NO: 639791 - DNA, 25 bp, Rattus norvegicus
tggtccacatcactgagaaatcaga

SEQ ID NO: 639792 - DNA, 25 bp, Rattus norvegicus
tggtccacatcagtgagaaatcaga

SEQ ID NO: 639793 - DNA, 25 bp, Rattus norvegicus
tggtccaccagacagggagccaaga

SEQ ID NO: 639794 - DNA, 25 bp, Rattus norvegicus
tggtccaccagagagggagccaaga

SEQ ID NO: 639795 - DNA, 25 bp, Rattus norvegicus
tggtccaccatactgaagtgtgtta

SEQ ID NO: 639796 - DNA, 25 bp, Rattus norvegicus
tggtccaccatagtgaagtgtgtta

SEQ ID NO: 639797 - DNA, 25 bp, Rattus norvegicus
tggtccacccagaatatagtaaacg

SEQ ID NO: 639798 - DNA, 25 bp, Rattus norvegicus
tggtccacccagcatgtagtcagca

SEQ ID NO: 639799 - DNA, 25 bp, Rattus norvegicus
tggtccacccaggatgtagtcagca

SEQ ID NO: 639800 - DNA, 25 bp, Rattus norvegicus
tggtccacccagtatatagtaaacg

SEQ ID NO: 639801 - DNA, 25 bp, Rattus norvegicus
tggtccacccgcaccggagagaaac

SEQ ID NO: 639802 - DNA, 25 bp, Rattus norvegicus
tggtccacccgctccggagagaaac

SEQ ID NO: 639803 - DNA, 25 bp, Rattus norvegicus
tggtccaccgtgcttctttaattct

SEQ ID NO: 639804 - DNA, 25 bp, Rattus norvegicus
tggtccaccgtggttctttaattct

SEQ ID NO: 639805 - DNA, 25 bp, Rattus norvegicus
tggtccacctcaatgtgtgtgccat

SEQ ID NO: 639806 - DNA, 25 bp, Rattus norvegicus
tggtccacctcattgtgtgtgccat

SEQ ID NO: 639807 - DNA, 25 bp, Rattus norvegicus
tggtccacgggtacccctttggcag

SEQ ID NO: 639808 - DNA, 25 bp, Rattus norvegicus
tggtccacgggttcccctttggcag

SEQ ID NO: 639809 - DNA, 25 bp, Rattus norvegicus
tggtccactcctcgaactcctattt

SEQ ID NO: 639810 - DNA, 25 bp, Rattus norvegicus
tggtccactcctggaactcctattt

SEQ ID NO: 639811 - DNA, 25 bp, Rattus norvegicus
tggtccacttgtaccttctatgaag

SEQ ID NO: 639812 - DNA, 25 bp, Rattus norvegicus
tggtccacttgttccttctatgaag

SEQ ID NO: 639813 - DNA, 25 bp, Rattus norvegicus
tggtccactttacccttctgcaaca

SEQ ID NO: 639814 - DNA, 25 bp, Rattus norvegicus
tggtccactttagccttctgcaaca

SEQ ID NO: 639815 - DNA, 25 bp, Rattus norvegicus
tggtccagaagcacctgtctaggat

SEQ ID NO: 639816 - DNA, 25 bp, Rattus norvegicus
tggtccagaagctcctgtctaggat

SEQ ID NO: 639817 - DNA, 25 bp, Rattus norvegicus
tggtccagacacatgggcctggcaa

SEQ ID NO: 639818 - DNA, 25 bp, Rattus norvegicus
tggtccagacacttgggcctggcaa

SEQ ID NO: 639819 - DNA, 25 bp, Rattus norvegicus
tggtccagaccccaagtgcggaact

SEQ ID NO: 639820 - DNA, 25 bp, Rattus norvegicus
tggtccagacccgaagtgcggaact

SEQ ID NO: 639821 - DNA, 25 bp, Rattus norvegicus
tggtccagaccgagtgtcagtacgt

SEQ ID NO: 639822 - DNA, 25 bp, Rattus norvegicus
tggtccagaccgtgtgtcagtacgt

SEQ ID NO: 639823 - DNA, 25 bp, Rattus norvegicus
tggtccagagagacggcaagtccgt

SEQ ID NO: 639824 - DNA, 25 bp, Rattus norvegicus
tggtccagagagtcggcaagtccgt

SEQ ID NO: 639825 - DNA, 25 bp, Rattus norvegicus
tggtccagcagtcttagcacgggct

SEQ ID NO: 639826 - DNA, 25 bp, Rattus norvegicus
tggtccagcagtgttagcacgggct

SEQ ID NO: 639827 - DNA, 25 bp, Rattus norvegicus
tggtccagccagattctacagaaga

SEQ ID NO: 639828 - DNA, 25 bp, Rattus norvegicus
tggtccagccagtttctacagaaga

SEQ ID NO: 639829 - DNA, 25 bp, Rattus norvegicus
tggtccagcttcatatctgtctaca

SEQ ID NO: 639830 - DNA, 25 bp, Rattus norvegicus
tggtccagcttcttatctgtctaca

SEQ ID NO: 639831 - DNA, 25 bp, Rattus norvegicus
tggtccaggaagcatctatcaaaca

SEQ ID NO: 639832 - DNA, 25 bp, Rattus norvegicus
tggtccaggaaggatctatcaaaca

SEQ ID NO: 639833 - DNA, 25 bp, Rattus norvegicus
tggtccaggaatcaatccatgcctt

SEQ ID NO: 639834 - DNA, 25 bp, Rattus norvegicus
tggtccaggaatgaatccatgcctt

SEQ ID NO: 639835 - DNA, 25 bp, Rattus norvegicus
tggtccaggacacatctcatcgaat

SEQ ID NO: 639836 - DNA, 25 bp, Rattus norvegicus
tggtccaggacagatctcatcgaat

SEQ ID NO: 639837 - DNA, 25 bp, Rattus norvegicus
tggtccaggccgatatagacttcct

SEQ ID NO: 639838 - DNA, 25 bp, Rattus norvegicus
tggtccaggccgttatagacttcct

SEQ ID NO: 639839 - DNA, 25 bp, Rattus norvegicus
tggtccaggcgcctctggctctcag

SEQ ID NO: 639840 - DNA, 25 bp, Rattus norvegicus
tggtccaggcgcgtctggctctcag

SEQ ID NO: 639841 - DNA, 25 bp, Rattus norvegicus
tggtccaggtccagccacgggatgt

SEQ ID NO: 639842 - DNA, 25 bp, Rattus norvegicus
tggtccaggtcctgccacgggatgt

SEQ ID NO: 639843 - DNA, 25 bp, Rattus norvegicus
tggtccagtctgacagcagcagcag

SEQ ID NO: 639844 - DNA, 25 bp, Rattus norvegicus
tggtccagtctgtcagcagcagcag

SEQ ID NO: 639845 - DNA, 25 bp, Rattus norvegicus
tggtccagtggcagagtactcgcct

SEQ ID NO: 639846 - DNA, 25 bp, Rattus norvegicus
tggtccagtggctgagtactcgcct

SEQ ID NO: 639847 - DNA, 25 bp, Rattus norvegicus
tggtccagtgtcagctcggatgtag

SEQ ID NO: 639848 - DNA, 25 bp, Rattus norvegicus
tggtccagtgtctgctcggatgtag

SEQ ID NO: 639849 - DNA, 25 bp, Rattus norvegicus
tggtccagttcgcagtggccccaaa

SEQ ID NO: 639850 - DNA, 25 bp, Rattus norvegicus
tggtccagttcggagtggccccaaa

SEQ ID NO: 639851 - DNA, 25 bp, Rattus norvegicus
tggtccatactgaggtcgttataac

SEQ ID NO: 639852 - DNA, 25 bp, Rattus norvegicus
tggtccatactgtggtcgttataac

SEQ ID NO: 639853 - DNA, 25 bp, Rattus norvegicus
tggtccatcagacgcttcaacagag

SEQ ID NO: 639854 - DNA, 25 bp, Rattus norvegicus
tggtccatcagaggcttcaacagag

SEQ ID NO: 639855 - DNA, 25 bp, Rattus norvegicus
tggtccatcaggctaacgtgcagta

SEQ ID NO: 639856 - DNA, 25 bp, Rattus norvegicus
tggtccatcagggtaacgtgcagta

SEQ ID NO: 639857 - DNA, 25 bp, Rattus norvegicus
tggtccatcatacagctgcacacag

SEQ ID NO: 639858 - DNA, 25 bp, Rattus norvegicus
tggtccatcatagagctgcacacag

SEQ ID NO: 639859 - DNA, 25 bp, Rattus norvegicus
tggtccatcccaccacaggtaaaga

SEQ ID NO: 639860 - DNA, 25 bp, Rattus norvegicus
tggtccatcccagcacaggtaaaga

SEQ ID NO: 639861 - DNA, 25 bp, Rattus norvegicus
tggtccatctctaacacaggctgac

SEQ ID NO: 639862 - DNA, 25 bp, Rattus norvegicus
tggtccatctcttacacaggctgac

SEQ ID NO: 639863 - DNA, 25 bp, Rattus norvegicus
tggtccatgaacctgcatctcaaaa

SEQ ID NO: 639864 - DNA, 25 bp, Rattus norvegicus
tggtccatgaacgtgcatctcaaaa

SEQ ID NO: 639865 - DNA, 25 bp, Rattus norvegicus
tggtccatggtgcagactgtcccaa

SEQ ID NO: 639866 - DNA, 25 bp, Rattus norvegicus
tggtccatggtggagactgtcccaa

SEQ ID NO: 639867 - DNA, 25 bp, Rattus norvegicus
tggtccatgtagacggcatagccgg

SEQ ID NO: 639868 - DNA, 25 bp, Rattus norvegicus
tggtccatgtagtcggcatagccgg

SEQ ID NO: 639869 - DNA, 25 bp, Rattus norvegicus
tggtcccaaagaacaaaccccagtg

SEQ ID NO: 639870 - DNA, 25 bp, Rattus norvegicus
tggtcccaaagatcaaaccccagtg

SEQ ID NO: 639871 - DNA, 25 bp, Rattus norvegicus
tggtcccaaattaagcctctcaagt

SEQ ID NO: 639872 - DNA, 25 bp, Rattus norvegicus
tggtcccaaatttagcctctcaagt

SEQ ID NO: 639873 - DNA, 25 bp, Rattus norvegicus
tggtcccaacccatgaggtcatcgt

SEQ ID NO: 639874 - DNA, 25 bp, Rattus norvegicus
tggtcccaacccttgaggtcatcgt

SEQ ID NO: 639875 - DNA, 25 bp, Rattus norvegicus
tggtcccaagttcacagcaagtaca

SEQ ID NO: 639876 - DNA, 25 bp, Rattus norvegicus
tggtcccaagttgacagcaagtaca

SEQ ID NO: 639877 - DNA, 25 bp, Rattus norvegicus
tggtcccaatggacaagcctttttg

SEQ ID NO: 639878 - DNA, 25 bp, Rattus norvegicus
tggtcccaatggtcaagcctttttg

SEQ ID NO: 639879 - DNA, 25 bp, Rattus norvegicus
tggtcccacaaaagcatctcctttt

SEQ ID NO: 639880 - DNA, 25 bp, Rattus norvegicus
tggtcccacaaatgcatctcctttt

SEQ ID NO: 639881 - DNA, 25 bp, Rattus norvegicus
tggtcccacatacgtctggtaacac

SEQ ID NO: 639882 - DNA, 25 bp, Rattus norvegicus
tggtcccacataggtctggtaacac

SEQ ID NO: 639883 - DNA, 25 bp, Rattus norvegicus
tggtcccaccttagcaggagctgaa

SEQ ID NO: 639884 - DNA, 25 bp, Rattus norvegicus
tggtcccacctttgcaggagctgaa

SEQ ID NO: 639885 - DNA, 25 bp, Rattus norvegicus
tggtcccagcttaatgcttgcaaca

SEQ ID NO: 639886 - DNA, 25 bp, Rattus norvegicus
tggtcccagctttatgcttgcaaca

SEQ ID NO: 639887 - DNA, 25 bp, Rattus norvegicus
tggtcccaggaaaacccatgtgtgt

SEQ ID NO: 639888 - DNA, 25 bp, Rattus norvegicus
tggtcccaggaatacccatgtgtgt

SEQ ID NO: 639889 - DNA, 25 bp, Rattus norvegicus
tggtcccaggacattcacaagagga

SEQ ID NO: 639890 - DNA, 25 bp, Rattus norvegicus
tggtcccaggactttcacaagagga

SEQ ID NO: 639891 - DNA, 25 bp, Rattus norvegicus
tggtcccagttgagaaattttattt

SEQ ID NO: 639892 - DNA, 25 bp, Rattus norvegicus
tggtcccagttgtgaaattttattt

SEQ ID NO: 639893 - DNA, 25 bp, Rattus norvegicus
tggtcccagtttcctaccagcaatc

SEQ ID NO: 639894 - DNA, 25 bp, Rattus norvegicus
tggtcccagtttgctaccagcaatc

SEQ ID NO: 639895 - DNA, 25 bp, Rattus norvegicus
tggtcccatcttactttactggtag

SEQ ID NO: 639896 - DNA, 25 bp, Rattus norvegicus
tggtcccatctttctttactggtag

SEQ ID NO: 639897 - DNA, 25 bp, Rattus norvegicus
tggtcccattacagtcctggttcct

SEQ ID NO: 639898 - DNA, 25 bp, Rattus norvegicus
tggtcccattactgtcctggttcct

SEQ ID NO: 639899 - DNA, 25 bp, Rattus norvegicus
tggtcccattgtagcattgtgtctg

SEQ ID NO: 639900 - DNA, 25 bp, Rattus norvegicus
tggtcccattgttgcattgtgtctg

SEQ ID NO: 639901 - DNA, 25 bp, Rattus norvegicus
tggtccccagaacctagatctttgg

SEQ ID NO: 639902 - DNA, 25 bp, Rattus norvegicus
tggtccccagaagctagatctttgg

SEQ ID NO: 639903 - DNA, 25 bp, Rattus norvegicus
tggtccccagtgcatccagaatgca

SEQ ID NO: 639904 - DNA, 25 bp, Rattus norvegicus
tggtccccagtggatccagaatgca

SEQ ID NO: 639905 - DNA, 25 bp, Rattus norvegicus
tggtccccatttcttagatcatgtc

SEQ ID NO: 639906 - DNA, 25 bp, Rattus norvegicus
tggtccccatttgttagatcatgtc

SEQ ID NO: 639907 - DNA, 25 bp, Rattus norvegicus
tggtcccccgatcctgatgatgacc

SEQ ID NO: 639908 - DNA, 25 bp, Rattus norvegicus
tggtcccccgatgctgatgatgacc

SEQ ID NO: 639909 - DNA, 25 bp, Rattus norvegicus
tggtccccgagacgttgcattgagc

SEQ ID NO: 639910 - DNA, 25 bp, Rattus norvegicus
tggtccccgagaggttgcattgagc

SEQ ID NO: 639911 - DNA, 25 bp, Rattus norvegicus
tggtccccgaggctatcggatgatc

SEQ ID NO: 639912 - DNA, 25 bp, Rattus norvegicus
tggtccccgagggtatcggatgatc

SEQ ID NO: 639913 - DNA, 25 bp, Rattus norvegicus
tggtccccgggcaggcagaagctct

SEQ ID NO: 639914 - DNA, 25 bp, Rattus norvegicus
tggtccccgggctggcagaagctct

SEQ ID NO: 639915 - DNA, 25 bp, Rattus norvegicus
tggtcccctataccctacaaaagtg

SEQ ID NO: 639916 - DNA, 25 bp, Rattus norvegicus
tggtcccctatagcctacaaaagtg

SEQ ID NO: 639917 - DNA, 25 bp, Rattus norvegicus
tggtccccttctatattgacacctt

SEQ ID NO: 639918 - DNA, 25 bp, Rattus norvegicus
tggtccccttctttattgacacctt

SEQ ID NO: 639919 - DNA, 25 bp, Rattus norvegicus
tggtccccttgaccttcattaacaa

SEQ ID NO: 639920 - DNA, 25 bp, Rattus norvegicus
tggtccccttgagcttcattaacaa

SEQ ID NO: 639921 - DNA, 25 bp, Rattus norvegicus
tggtcccgaggactgtggcttcttc

SEQ ID NO: 639922 - DNA, 25 bp, Rattus norvegicus
tggtcccgaggagtgtggcttcttc

SEQ ID NO: 639923 - DNA, 25 bp, Rattus norvegicus
tggtcccgagtaactgtggtggttc

SEQ ID NO: 639924 - DNA, 25 bp, Rattus norvegicus
tggtcccgagtatctgtggtggttc

SEQ ID NO: 639925 - DNA, 25 bp, Rattus norvegicus
tggtcccgatcgagccaactatgag

SEQ ID NO: 639926 - DNA, 25 bp, Rattus norvegicus
tggtcccgatcgtgccaactatgag

SEQ ID NO: 639927 - DNA, 25 bp, Rattus norvegicus
tggtccctatcactggtctgtttgg

SEQ ID NO: 639928 - DNA, 25 bp, Rattus norvegicus
tggtccctatcagtggtctgtttgg

SEQ ID NO: 639929 - DNA, 25 bp, Rattus norvegicus
tggtccctcccaagttgtaatttgt

SEQ ID NO: 639930 - DNA, 25 bp, Rattus norvegicus
tggtccctcccatgttgtaatttgt

SEQ ID NO: 639931 - DNA, 25 bp, Rattus norvegicus
tggtccctccttaggagacgcaggg

SEQ ID NO: 639932 - DNA, 25 bp, Rattus norvegicus
tggtccctcctttggagacgcaggg

SEQ ID NO: 639933 - DNA, 25 bp, Rattus norvegicus
tggtccctctaacatgcagcttgtg

SEQ ID NO: 639934 - DNA, 25 bp, Rattus norvegicus
tggtccctctaagatgcagcttgtg

SEQ ID NO: 639935 - DNA, 25 bp, Rattus norvegicus
tggtccctctatccaaagtggtgca

SEQ ID NO: 639936 - DNA, 25 bp, Rattus norvegicus
tggtccctctatgcaaagtggtgca

SEQ ID NO: 639937 - DNA, 25 bp, Rattus norvegicus
tggtccctctccacaaaagaacttc

SEQ ID NO: 639938 - DNA, 25 bp, Rattus norvegicus
tggtccctctcctcaaaagaacttc

SEQ ID NO: 639939 - DNA, 25 bp, Rattus norvegicus
tggtccctcttacttactggcagtc

SEQ ID NO: 639940 - DNA, 25 bp, Rattus norvegicus
tggtccctcttagttactggcagtc

SEQ ID NO: 639941 - DNA, 25 bp, Rattus norvegicus
tggtccctgactcccaataaaagaa

SEQ ID NO: 639942 - DNA, 25 bp, Rattus norvegicus
tggtccctgactgccaataaaagaa

SEQ ID NO: 639943 - DNA, 25 bp, Rattus norvegicus
tggtccctgcctatctgaagaattg

SEQ ID NO: 639944 - DNA, 25 bp, Rattus norvegicus
tggtccctgcctttctgaagaattg

SEQ ID NO: 639945 - DNA, 25 bp, Rattus norvegicus
tggtccctgctgatcttcaaattgg

SEQ ID NO: 639946 - DNA, 25 bp, Rattus norvegicus
tggtccctgctgttcttcaaattgg

SEQ ID NO: 639947 - DNA, 25 bp, Rattus norvegicus
tggtccctggatcctacacagctaa

SEQ ID NO: 639948 - DNA, 25 bp, Rattus norvegicus
tggtccctggatgctacacagctaa

SEQ ID NO: 639949 - DNA, 25 bp, Rattus norvegicus
tggtccctggcacaattgcagagca

SEQ ID NO: 639950 - DNA, 25 bp, Rattus norvegicus
tggtccctggcagaattgcagagca

SEQ ID NO: 639951 - DNA, 25 bp, Rattus norvegicus
tggtccctggccagtgaagaagttc

SEQ ID NO: 639952 - DNA, 25 bp, Rattus norvegicus
tggtccctggcctgtgaagaagttc

SEQ ID NO: 639953 - DNA, 25 bp, Rattus norvegicus
tggtccctggctccagaagacccgt

SEQ ID NO: 639954 - DNA, 25 bp, Rattus norvegicus
tggtccctggctgcagaagacccgt

SEQ ID NO: 639955 - DNA, 25 bp, Rattus norvegicus
tggtccctgggaagctcaaaagtca

SEQ ID NO: 639956 - DNA, 25 bp, Rattus norvegicus
tggtccctgggatgctcaaaagtca

SEQ ID NO: 639957 - DNA, 25 bp, Rattus norvegicus
tggtccctgggtcaatcccttgtga

SEQ ID NO: 639958 - DNA, 25 bp, Rattus norvegicus
tggtccctgggtgaatcccttgtga

SEQ ID NO: 639959 - DNA, 25 bp, Rattus norvegicus
tggtccctgtacatttccagtattg

SEQ ID NO: 639960 - DNA, 25 bp, Rattus norvegicus
tggtccctgtacttttccagtattg

SEQ ID NO: 639961 - DNA, 25 bp, Rattus norvegicus
tggtccctgtgcacgagcttagcgg

SEQ ID NO: 639962 - DNA, 25 bp, Rattus norvegicus
tggtccctgtgctcgagcttagcgg

SEQ ID NO: 639963 - DNA, 25 bp, Rattus norvegicus
tggtccctgtgtatgatgcccatgc

SEQ ID NO: 639964 - DNA, 25 bp, Rattus norvegicus
tggtccctgtgtttgatgcccatgc

SEQ ID NO: 639965 - DNA, 25 bp, Rattus norvegicus
tggtccctgttgctgacagtattaa

SEQ ID NO: 639966 - DNA, 25 bp, Rattus norvegicus
tggtccctgttggtgacagtattaa

SEQ ID NO: 639967 - DNA, 25 bp, Rattus norvegicus
tggtcccttctacctggtttgtaat

SEQ ID NO: 639968 - DNA, 25 bp, Rattus norvegicus
tggtcccttctagctggtttgtaat

SEQ ID NO: 639969 - DNA, 25 bp, Rattus norvegicus
tggtccgaagtgctaagaactccgt

SEQ ID NO: 639970 - DNA, 25 bp, Rattus norvegicus
tggtccgaagtggtaagaactccgt

SEQ ID NO: 639971 - DNA, 25 bp, Rattus norvegicus
tggtccgagggcaaacccagctaag

SEQ ID NO: 639972 - DNA, 25 bp, Rattus norvegicus
tggtccgagggctaacccagctaag

SEQ ID NO: 639973 - DNA, 25 bp, Rattus norvegicus
tggtccggagttccaaaatcccaat

SEQ ID NO: 639974 - DNA, 25 bp, Rattus norvegicus
tggtccggagttgcaaaatcccaat

SEQ ID NO: 639975 - DNA, 25 bp, Rattus norvegicus
tggtccgggtgcctcttaaaacagg

SEQ ID NO: 639976 - DNA, 25 bp, Rattus norvegicus
tggtccgggtgcgtcttaaaacagg

SEQ ID NO: 639977 - DNA, 25 bp, Rattus norvegicus
tggtccgtaggtaggtggctcacaa

SEQ ID NO: 639978 - DNA, 25 bp, Rattus norvegicus
tggtccgtaggttggtggctcacaa

SEQ ID NO: 639979 - DNA, 25 bp, Rattus norvegicus
tggtccgtcatgcttgttggtgatt

SEQ ID NO: 639980 - DNA, 25 bp, Rattus norvegicus
tggtccgtcatggttgttggtgatt

SEQ ID NO: 639981 - DNA, 25 bp, Rattus norvegicus
tggtccgtgatcaggccaatggcaa

SEQ ID NO: 639982 - DNA, 25 bp, Rattus norvegicus
tggtccgtgatctggccaatggcaa

SEQ ID NO: 639983 - DNA, 25 bp, Rattus norvegicus
tggtccgtggaaactgtgttcacct

SEQ ID NO: 639984 - DNA, 25 bp, Rattus norvegicus
tggtccgtggaatctgtgttcacct

SEQ ID NO: 639985 - DNA, 25 bp, Rattus norvegicus
tggtcctaaccaacatggcgttcca

SEQ ID NO: 639986 - DNA, 25 bp, Rattus norvegicus
tggtcctaaccatcatggcgttcca

SEQ ID NO: 639987 - DNA, 25 bp, Rattus norvegicus
tggtcctaactgctggccggtgcaa

SEQ ID NO: 639988 - DNA, 25 bp, Rattus norvegicus
tggtcctaactggtggccggtgcaa

SEQ ID NO: 639989 - DNA, 25 bp, Rattus norvegicus
tggtcctaagaaaagtataacagtg

SEQ ID NO: 639990 - DNA, 25 bp, Rattus norvegicus
tggtcctaagaatagtataacagtg

SEQ ID NO: 639991 - DNA, 25 bp, Rattus norvegicus
tggtcctaagtgcagccggttaaac

SEQ ID NO: 639992 - DNA, 25 bp, Rattus norvegicus
tggtcctaagtggagccggttaaac

SEQ ID NO: 639993 - DNA, 25 bp, Rattus norvegicus
tggtcctaatagagtgtgcacagct

SEQ ID NO: 639994 - DNA, 25 bp, Rattus norvegicus
tggtcctaatagtgtgtgcacagct

SEQ ID NO: 639995 - DNA, 25 bp, Rattus norvegicus
tggtcctaccacaggctttgacttg

SEQ ID NO: 639996 - DNA, 25 bp, Rattus norvegicus
tggtcctaccactggctttgacttg

SEQ ID NO: 639997 - DNA, 25 bp, Rattus norvegicus
tggtcctacgatcagaatgccgccc

SEQ ID NO: 639998 - DNA, 25 bp, Rattus norvegicus
tggtcctacgatgagaatgccgccc

SEQ ID NO: 639999 - DNA, 25 bp, Rattus norvegicus
tggtcctaggtgacttctgtttgta

SEQ ID NO: 640000 - DNA, 25 bp, Rattus norvegicus
tggtcctaggtgtcttctgtttgta

SEQ ID NO: 640001 - DNA, 25 bp, Rattus norvegicus
tggtcctagtttagcgcacattttc

SEQ ID NO: 640002 - DNA, 25 bp, Rattus norvegicus
tggtcctagttttgcgcacattttc

SEQ ID NO: 640003 - DNA, 25 bp, Rattus norvegicus
tggtcctatttcatgcctgcaggca

SEQ ID NO: 640004 - DNA, 25 bp, Rattus norvegicus
tggtcctatttcttgcctgcaggca

SEQ ID NO: 640005 - DNA, 25 bp, Rattus norvegicus
tggtcctcacagctgcatagtacag

SEQ ID NO: 640006 - DNA, 25 bp, Rattus norvegicus
tggtcctcacaggtgcatagtacag

SEQ ID NO: 640007 - DNA, 25 bp, Rattus norvegicus
tggtcctcaccaactgtgccaagag

SEQ ID NO: 640008 - DNA, 25 bp, Rattus norvegicus
tggtcctcaccatctgtgccaagag

SEQ ID NO: 640009 - DNA, 25 bp, Rattus norvegicus
tggtcctcagaaaggcacgcgcctc

SEQ ID NO: 640010 - DNA, 25 bp, Rattus norvegicus
tggtcctcagaatggcacgcgcctc

SEQ ID NO: 640011 - DNA, 25 bp, Rattus norvegicus
tggtcctcaggaacagtacattgat

SEQ ID NO: 640012 - DNA, 25 bp, Rattus norvegicus
tggtcctcaggatcagtacattgat

SEQ ID NO: 640013 - DNA, 25 bp, Rattus norvegicus
tggtcctcaggtcgtggaactgtct

SEQ ID NO: 640014 - DNA, 25 bp, Rattus norvegicus
tggtcctcaggtggtggaactgtct

SEQ ID NO: 640015 - DNA, 25 bp, Rattus norvegicus
tggtcctcagtgatggcagttactt

SEQ ID NO: 640016 - DNA, 25 bp, Rattus norvegicus
tggtcctcagtgttggcagttactt

SEQ ID NO: 640017 - DNA, 25 bp, Rattus norvegicus
tggtcctcataccagatcaccacgt

SEQ ID NO: 640018 - DNA, 25 bp, Rattus norvegicus
tggtcctcatacgagatcaccacgt

SEQ ID NO: 640019 - DNA, 25 bp, Rattus norvegicus
tggtcctcatcacgctcagagatgg

SEQ ID NO: 640020 - DNA, 25 bp, Rattus norvegicus
tggtcctcatcaggctcagagatgg

SEQ ID NO: 640021 - DNA, 25 bp, Rattus norvegicus
tggtcctcatccagtatctgggaga

SEQ ID NO: 640022 - DNA, 25 bp, Rattus norvegicus
tggtcctcatcctgtatctgggaga

SEQ ID NO: 640023 - DNA, 25 bp, Rattus norvegicus
tggtcctccagtcctgagcatggac

SEQ ID NO: 640024 - DNA, 25 bp, Rattus norvegicus
tggtcctccagtgctgagcatggac

SEQ ID NO: 640025 - DNA, 25 bp, Rattus norvegicus
tggtcctccatgacagcgatcggaa

SEQ ID NO: 640026 - DNA, 25 bp, Rattus norvegicus
tggtcctccatgtcagcgatcggaa

SEQ ID NO: 640027 - DNA, 25 bp, Rattus norvegicus
tggtcctcccgcatagcaaatgaca

SEQ ID NO: 640028 - DNA, 25 bp, Rattus norvegicus
tggtcctcccgcttagcaaatgaca

SEQ ID NO: 640029 - DNA, 25 bp, Rattus norvegicus
tggtcctcccttaggcaaattgtca

SEQ ID NO: 640030 - DNA, 25 bp, Rattus norvegicus
tggtcctccctttggcaaattgtca

SEQ ID NO: 640031 - DNA, 25 bp, Rattus norvegicus
tggtcctcgctgcttttcttccttt

SEQ ID NO: 640032 - DNA, 25 bp, Rattus norvegicus
tggtcctcgctggttttcttccttt

SEQ ID NO: 640033 - DNA, 25 bp, Rattus norvegicus
tggtcctcgtcaattagcagtttgg

SEQ ID NO: 640034 - DNA, 25 bp, Rattus norvegicus
tggtcctcgtcatttagcagtttgg

SEQ ID NO: 640035 - DNA, 25 bp, Rattus norvegicus
tggtcctcgtggcatcccgggtcca

SEQ ID NO: 640036 - DNA, 25 bp, Rattus norvegicus
tggtcctcgtgggatcccgggtcca

SEQ ID NO: 640037 - DNA, 25 bp, Rattus norvegicus
tggtcctctgacatgcttttacata

SEQ ID NO: 640038 - DNA, 25 bp, Rattus norvegicus
tggtcctctgacttgcttttacata

SEQ ID NO: 640039 - DNA, 25 bp, Rattus norvegicus
tggtcctctgccattattacccact

SEQ ID NO: 640040 - DNA, 25 bp, Rattus norvegicus
tggtcctctgcctttattacccact

SEQ ID NO: 640041 - DNA, 25 bp, Rattus norvegicus
tggtcctctggcactaacaatcatt

SEQ ID NO: 640042 - DNA, 25 bp, Rattus norvegicus
tggtcctctggctctaacaatcatt

SEQ ID NO: 640043 - DNA, 25 bp, Rattus norvegicus
tggtcctctggtcagctccaggcac

SEQ ID NO: 640044 - DNA, 25 bp, Rattus norvegicus
tggtcctctggtgagctccaggcac

SEQ ID NO: 640045 - DNA, 25 bp, Rattus norvegicus
tggtcctcttgaagcctgctattga

SEQ ID NO: 640046 - DNA, 25 bp, Rattus norvegicus
tggtcctcttgatgcctgctattga

SEQ ID NO: 640047 - DNA, 25 bp, Rattus norvegicus
tggtcctgagcgacacctgtggtca

SEQ ID NO: 640048 - DNA, 25 bp, Rattus norvegicus
tggtcctgagcgtcacctgtggtca

SEQ ID NO: 640049 - DNA, 25 bp, Rattus norvegicus
tggtcctgagctcaatctctagcaa

SEQ ID NO: 640050 - DNA, 25 bp, Rattus norvegicus
tggtcctgagctgaatctctagcaa

SEQ ID NO: 640051 - DNA, 25 bp, Rattus norvegicus
tggtcctgccaaagtgttggtgcta

SEQ ID NO: 640052 - DNA, 25 bp, Rattus norvegicus
tggtcctgccaatgtgttggtgcta

SEQ ID NO: 640053 - DNA, 25 bp, Rattus norvegicus
tggtcctgcccgagaaatggtttca

SEQ ID NO: 640054 - DNA, 25 bp, Rattus norvegicus
tggtcctgcccgtgaaatggtttca

SEQ ID NO: 640055 - DNA, 25 bp, Rattus norvegicus
tggtcctgcctgacagtgagactga

SEQ ID NO: 640056 - DNA, 25 bp, Rattus norvegicus
tggtcctgcctgtcagtgagactga

SEQ ID NO: 640057 - DNA, 25 bp, Rattus norvegicus
tggtcctgctgacagcctccaaaga

SEQ ID NO: 640058 - DNA, 25 bp, Rattus norvegicus
tggtcctgctgagagcctccaaaga

SEQ ID NO: 640059 - DNA, 25 bp, Rattus norvegicus
tggtcctggccactgtgttgctgac

SEQ ID NO: 640060 - DNA, 25 bp, Rattus norvegicus
tggtcctggccagtgtgttgctgac

SEQ ID NO: 640061 - DNA, 25 bp, Rattus norvegicus
tggtcctggctaagagtttcactga

SEQ ID NO: 640062 - DNA, 25 bp, Rattus norvegicus
tggtcctggctatgagtttcactga

SEQ ID NO: 640063 - DNA, 25 bp, Rattus norvegicus
tggtcctggctccaccttgaaagga

SEQ ID NO: 640064 - DNA, 25 bp, Rattus norvegicus
tggtcctggctcgaccttgaaagga

SEQ ID NO: 640065 - DNA, 25 bp, Rattus norvegicus
tggtcctggtctctggtggcatttc

SEQ ID NO: 640066 - DNA, 25 bp, Rattus norvegicus
tggtcctggtctgtggtggcatttc

SEQ ID NO: 640067 - DNA, 25 bp, Rattus norvegicus
tggtcctgtaagcactttaccgcta

SEQ ID NO: 640068 - DNA, 25 bp, Rattus norvegicus
tggtcctgtaaggactttaccgcta

SEQ ID NO: 640069 - DNA, 25 bp, Rattus norvegicus
tggtcctgtcaacatggtacatggt

SEQ ID NO: 640070 - DNA, 25 bp, Rattus norvegicus
tggtcctgtcaagatggtacatggt

SEQ ID NO: 640071 - DNA, 25 bp, Rattus norvegicus
tggtcctgttcccagcagataagag

SEQ ID NO: 640072 - DNA, 25 bp, Rattus norvegicus
tggtcctgttccgagcagataagag

SEQ ID NO: 640073 - DNA, 25 bp, Rattus norvegicus
tggtccttaaacagtccaggcgaca

SEQ ID NO: 640074 - DNA, 25 bp, Rattus norvegicus
tggtccttaaactgtccaggcgaca

SEQ ID NO: 640075 - DNA, 25 bp, Rattus norvegicus
tggtccttagaaccacctcaggtca

SEQ ID NO: 640076 - DNA, 25 bp, Rattus norvegicus
tggtccttagaagcacctcaggtca

SEQ ID NO: 640077 - DNA, 25 bp, Rattus norvegicus
tggtccttatacactggtctgcggg

SEQ ID NO: 640078 - DNA, 25 bp, Rattus norvegicus
tggtccttatactctggtctgcggg

SEQ ID NO: 640079 - DNA, 25 bp, Rattus norvegicus
tggtccttattcaattcccctagtt

SEQ ID NO: 640080 - DNA, 25 bp, Rattus norvegicus
tggtccttattctattcccctagtt

SEQ ID NO: 640081 - DNA, 25 bp, Rattus norvegicus
tggtccttctctagctgtcggcctg

SEQ ID NO: 640082 - DNA, 25 bp, Rattus norvegicus
tggtccttctctatggtcttctaca

SEQ ID NO: 640083 - DNA, 25 bp, Rattus norvegicus
tggtccttctcttgctgtcggcctg

SEQ ID NO: 640084 - DNA, 25 bp, Rattus norvegicus
tggtccttctctttggtcttctaca

SEQ ID NO: 640085 - DNA, 25 bp, Rattus norvegicus
tggtccttgctacatcggtggaagc

SEQ ID NO: 640086 - DNA, 25 bp, Rattus norvegicus
tggtccttgctagatcggtggaagc

SEQ ID NO: 640087 - DNA, 25 bp, Rattus norvegicus
tggtccttggccactgagtcatgag

SEQ ID NO: 640088 - DNA, 25 bp, Rattus norvegicus
tggtccttggcctctgagtcatgag

SEQ ID NO: 640089 - DNA, 25 bp, Rattus norvegicus
tggtccttggcgattacagagtcac

SEQ ID NO: 640090 - DNA, 25 bp, Rattus norvegicus
tggtccttggcgtttacagagtcac

SEQ ID NO: 640091 - DNA, 25 bp, Rattus norvegicus
tggtcctttatcagcccaggtctaa

SEQ ID NO: 640092 - DNA, 25 bp, Rattus norvegicus
tggtcctttatctgcccaggtctaa

SEQ ID NO: 640093 - DNA, 25 bp, Rattus norvegicus
tggtcctttcaacccaaagagatgg

SEQ ID NO: 640094 - DNA, 25 bp, Rattus norvegicus
tggtcctttcaagccaaagagatgg

SEQ ID NO: 640095 - DNA, 25 bp, Rattus norvegicus
tggtcctttggaatcttactcacag

SEQ ID NO: 640096 - DNA, 25 bp, Rattus norvegicus
tggtcctttggattcttactcacag

SEQ ID NO: 640097 - DNA, 25 bp, Rattus norvegicus
tggtcctttggtccttcttcgaagc

SEQ ID NO: 640098 - DNA, 25 bp, Rattus norvegicus
tggtcctttggtgcttcttcgaagc

SEQ ID NO: 640099 - DNA, 25 bp, Rattus norvegicus
tggtcctttttaacctatgcctaaa

SEQ ID NO: 640100 - DNA, 25 bp, Rattus norvegicus
tggtcctttttatcctatgcctaaa

SEQ ID NO: 640101 - DNA, 25 bp, Rattus norvegicus
tggtcctttttgacaagagccctct

SEQ ID NO: 640102 - DNA, 25 bp, Rattus norvegicus
tggtcctttttgtcaagagccctct

SEQ ID NO: 640103 - DNA, 25 bp, Rattus norvegicus
tggtcgaagataagcctggccctag

SEQ ID NO: 640104 - DNA, 25 bp, Rattus norvegicus
tggtcgaagatatgcctggccctag

SEQ ID NO: 640105 - DNA, 25 bp, Rattus norvegicus
tggtcgaagctgacgcggcaccaac

SEQ ID NO: 640106 - DNA, 25 bp, Rattus norvegicus
tggtcgaagctgtcgcggcaccaac

SEQ ID NO: 640107 - DNA, 25 bp, Rattus norvegicus
tggtcgagcgatcgatttccgtctc

SEQ ID NO: 640108 - DNA, 25 bp, Rattus norvegicus
tggtcgagcgatggatttccgtctc

SEQ ID NO: 640109 - DNA, 25 bp, Rattus norvegicus
tggtcgcacagcaggtcactcagca

SEQ ID NO: 640110 - DNA, 25 bp, Rattus norvegicus
tggtcgcacagctggtcactcagca

SEQ ID NO: 640111 - DNA, 25 bp, Rattus norvegicus
tggtcgccagctcatgtgactcatg

SEQ ID NO: 640112 - DNA, 25 bp, Rattus norvegicus
tggtcgccagctgatgtgactcatg

SEQ ID NO: 640113 - DNA, 25 bp, Rattus norvegicus
tggtcgcccaaaaatacttgcctcg

SEQ ID NO: 640114 - DNA, 25 bp, Rattus norvegicus
tggtcgcccaaatatacttgcctcg

SEQ ID NO: 640115 - DNA, 25 bp, Rattus norvegicus
tggtcgcccggaattccgaaagtat

SEQ ID NO: 640116 - DNA, 25 bp, Rattus norvegicus
tggtcgcccggatttccgaaagtat

SEQ ID NO: 640117 - DNA, 25 bp, Rattus norvegicus
tggtcgccctgacacgcccttgtat

SEQ ID NO: 640118 - DNA, 25 bp, Rattus norvegicus
tggtcgccctgagacgcccttgtat

SEQ ID NO: 640119 - DNA, 25 bp, Rattus norvegicus
tggtcgcctgtcatccttaggagac

SEQ ID NO: 640120 - DNA, 25 bp, Rattus norvegicus
tggtcgcctgtcttccttaggagac

SEQ ID NO: 640121 - DNA, 25 bp, Rattus norvegicus
tggtcgccttgcataacctcatcaa

SEQ ID NO: 640122 - DNA, 25 bp, Rattus norvegicus
tggtcgccttgcttaacctcatcaa

SEQ ID NO: 640123 - DNA, 25 bp, Rattus norvegicus
tggtcgcgctgtagatgttctcgat

SEQ ID NO: 640124 - DNA, 25 bp, Rattus norvegicus
tggtcgcgctgttgatgttctcgat

SEQ ID NO: 640125 - DNA, 25 bp, Rattus norvegicus
tggtcgctctgccttcattagtgac

SEQ ID NO: 640126 - DNA, 25 bp, Rattus norvegicus
tggtcgctctgcgttcattagtgac

SEQ ID NO: 640127 - DNA, 25 bp, Rattus norvegicus
tggtcgcttaccctcagtgagagaa

SEQ ID NO: 640128 - DNA, 25 bp, Rattus norvegicus
tggtcgcttaccgtcagtgagagaa

SEQ ID NO: 640129 - DNA, 25 bp, Rattus norvegicus
tggtcggcatggacaaagccctcaa

SEQ ID NO: 640130 - DNA, 25 bp, Rattus norvegicus
tggtcggcatggtcaaagccctcaa

SEQ ID NO: 640131 - DNA, 25 bp, Rattus norvegicus
tggtcgggtattattcacacctgtt

SEQ ID NO: 640132 - DNA, 25 bp, Rattus norvegicus
tggtcgggtatttttcacacctgtt

SEQ ID NO: 640133 - DNA, 25 bp, Rattus norvegicus
tggtcggtcatcacagtcagtgttc

SEQ ID NO: 640134 - DNA, 25 bp, Rattus norvegicus
tggtcggtcatctcagtcagtgttc

SEQ ID NO: 640135 - DNA, 25 bp, Rattus norvegicus
tggtcgtaacttcaggaccccagga

SEQ ID NO: 640136 - DNA, 25 bp, Rattus norvegicus
tggtcgtaacttgaggaccccagga

SEQ ID NO: 640137 - DNA, 25 bp, Rattus norvegicus
tggtcgtataatcgagcgcgtaatc

SEQ ID NO: 640138 - DNA, 25 bp, Rattus norvegicus
tggtcgtataatggagcgcgtaatc

SEQ ID NO: 640139 - DNA, 25 bp, Rattus norvegicus
tggtcgtccaggaaactcaggtatc

SEQ ID NO: 640140 - DNA, 25 bp, Rattus norvegicus
tggtcgtccaggtaactcaggtatc

SEQ ID NO: 640141 - DNA, 25 bp, Rattus norvegicus
tggtcgtcgtatacccgctggtcgt

SEQ ID NO: 640142 - DNA, 25 bp, Rattus norvegicus
tggtcgtcgtattcccgctggtcgt

SEQ ID NO: 640143 - DNA, 25 bp, Rattus norvegicus
tggtcgtctgttaggcacttttcac

SEQ ID NO: 640144 - DNA, 25 bp, Rattus norvegicus
tggtcgtctgtttggcacttttcac

SEQ ID NO: 640145 - DNA, 25 bp, Rattus norvegicus
tggtcgtggaccatctgaatattgt

SEQ ID NO: 640146 - DNA, 25 bp, Rattus norvegicus
tggtcgtggaccttctgaatattgt

SEQ ID NO: 640147 - DNA, 25 bp, Rattus norvegicus
tggtcgtggccgcaagtcttctcca

SEQ ID NO: 640148 - DNA, 25 bp, Rattus norvegicus
tggtcgtggccggaagtcttctcca

SEQ ID NO: 640149 - DNA, 25 bp, Rattus norvegicus
tggtcgtggtggatacaggtaactt

SEQ ID NO: 640150 - DNA, 25 bp, Rattus norvegicus
tggtcgtggtggttacaggtaactt

SEQ ID NO: 640151 - DNA, 25 bp, Rattus norvegicus
tggtcgtgtgtcctacatgcttgga

SEQ ID NO: 640152 - DNA, 25 bp, Rattus norvegicus
tggtcgtgtgtcgtacatgcttgga

SEQ ID NO: 640153 - DNA, 25 bp, Rattus norvegicus
tggtctaaaactacttctacttcgg

SEQ ID NO: 640154 - DNA, 25 bp, Rattus norvegicus
tggtctaaaacttcttctacttcgg

SEQ ID NO: 640155 - DNA, 25 bp, Rattus norvegicus
tggtctaaactcattcacattgtaa

SEQ ID NO: 640156 - DNA, 25 bp, Rattus norvegicus
tggtctaaactctttcacattgtaa

SEQ ID NO: 640157 - DNA, 25 bp, Rattus norvegicus
tggtctaacgtgagggcaacccaca

SEQ ID NO: 640158 - DNA, 25 bp, Rattus norvegicus
tggtctaacgtgtgggcaacccaca

SEQ ID NO: 640159 - DNA, 25 bp, Rattus norvegicus
tggtctacaaaactccatggagcca

SEQ ID NO: 640160 - DNA, 25 bp, Rattus norvegicus
tggtctacaaaagtccatggagcca

SEQ ID NO: 640161 - DNA, 25 bp, Rattus norvegicus
tggtctacagacagccacggctatg

SEQ ID NO: 640162 - DNA, 25 bp, Rattus norvegicus
tggtctacagactgccacggctatg

SEQ ID NO: 640163 - DNA, 25 bp, Rattus norvegicus
tggtctacattccagcttggcccct

SEQ ID NO: 640164 - DNA, 25 bp, Rattus norvegicus
tggtctacattcgagcttggcccct

SEQ ID NO: 640165 - DNA, 25 bp, Rattus norvegicus
tggtctacccagattctcagggatc

SEQ ID NO: 640166 - DNA, 25 bp, Rattus norvegicus
tggtctacccagtttctcagggatc

SEQ ID NO: 640167 - DNA, 25 bp, Rattus norvegicus
tggtctaccccacttttcattttgt

SEQ ID NO: 640168 - DNA, 25 bp, Rattus norvegicus
tggtctaccccagttttcattttgt

SEQ ID NO: 640169 - DNA, 25 bp, Rattus norvegicus
tggtctaccgcaagagggctgatga

SEQ ID NO: 640170 - DNA, 25 bp, Rattus norvegicus
tggtctaccgcatgagggctgatga

SEQ ID NO: 640171 - DNA, 25 bp, Rattus norvegicus
tggtctacctatcagttcgttgcac

SEQ ID NO: 640172 - DNA, 25 bp, Rattus norvegicus
tggtctacctatgagttcgttgcac

SEQ ID NO: 640173 - DNA, 25 bp, Rattus norvegicus
tggtctaccttaatttctctgggaa

SEQ ID NO: 640174 - DNA, 25 bp, Rattus norvegicus
tggtctaccttattttctctgggaa

SEQ ID NO: 640175 - DNA, 25 bp, Rattus norvegicus
tggtctacgacaccaagggccgctt

SEQ ID NO: 640176 - DNA, 25 bp, Rattus norvegicus
tggtctacgacagcaagggccgctt

SEQ ID NO: 640177 - DNA, 25 bp, Rattus norvegicus
tggtctactcagctctgtctgttaa

SEQ ID NO: 640178 - DNA, 25 bp, Rattus norvegicus
tggtctactcaggtctgtctgttaa

SEQ ID NO: 640179 - DNA, 25 bp, Rattus norvegicus
tggtctactgttacatgcaccgccg

SEQ ID NO: 640180 - DNA, 25 bp, Rattus norvegicus
tggtctactgtttcatgcaccgccg

SEQ ID NO: 640181 - DNA, 25 bp, Rattus norvegicus
tggtctagtcgcaggcttaagcctc

SEQ ID NO: 640182 - DNA, 25 bp, Rattus norvegicus
tggtctagtcgctggcttaagcctc

SEQ ID NO: 640183 - DNA, 25 bp, Rattus norvegicus
tggtctagtgagatcagttgctatg

SEQ ID NO: 640184 - DNA, 25 bp, Rattus norvegicus
tggtctagtgagttcagttgctatg

SEQ ID NO: 640185 - DNA, 25 bp, Rattus norvegicus
tggtctatacatattcctcccaaac

SEQ ID NO: 640186 - DNA, 25 bp, Rattus norvegicus
tggtctatacattttcctcccaaac

SEQ ID NO: 640187 - DNA, 25 bp, Rattus norvegicus
tggtctatggaaccaggatagccat

SEQ ID NO: 640188 - DNA, 25 bp, Rattus norvegicus
tggtctatggaagcaggatagccat

SEQ ID NO: 640189 - DNA, 25 bp, Rattus norvegicus
tggtctattccacggcgatattgtc

SEQ ID NO: 640190 - DNA, 25 bp, Rattus norvegicus
tggtctattccagggcgatattgtc

SEQ ID NO: 640191 - DNA, 25 bp, Rattus norvegicus
tggtctcaaaaacaagcctgtcgtg

SEQ ID NO: 640192 - DNA, 25 bp, Rattus norvegicus
tggtctcaaaaagaagcctgtcgtg

SEQ ID NO: 640193 - DNA, 25 bp, Rattus norvegicus
tggtctcaaactaatggcacctctc

SEQ ID NO: 640194 - DNA, 25 bp, Rattus norvegicus
tggtctcaaacttatggcacctctc

SEQ ID NO: 640195 - DNA, 25 bp, Rattus norvegicus
tggtctcaaagtcagcttgtttctt

SEQ ID NO: 640196 - DNA, 25 bp, Rattus norvegicus
tggtctcaaagtgagcttgtttctt

SEQ ID NO: 640197 - DNA, 25 bp, Rattus norvegicus
tggtctcaacatacaggacttgctg

SEQ ID NO: 640198 - DNA, 25 bp, Rattus norvegicus
tggtctcaacattcaggacttgctg

SEQ ID NO: 640199 - DNA, 25 bp, Rattus norvegicus
tggtctcaatgcagtctgatacgaa

SEQ ID NO: 640200 - DNA, 25 bp, Rattus norvegicus
tggtctcaatgctgtctgatacgaa

SEQ ID NO: 640201 - DNA, 25 bp, Rattus norvegicus
tggtctcacagtccttatctgccta

SEQ ID NO: 640202 - DNA, 25 bp, Rattus norvegicus
tggtctcacagtgcttatctgccta

SEQ ID NO: 640203 - DNA, 25 bp, Rattus norvegicus
tggtctcacatcaagttccagacca

SEQ ID NO: 640204 - DNA, 25 bp, Rattus norvegicus
tggtctcacatctagttccagacca

SEQ ID NO: 640205 - DNA, 25 bp, Rattus norvegicus
tggtctcacctgatgcatgggaaga

SEQ ID NO: 640206 - DNA, 25 bp, Rattus norvegicus
tggtctcacctgttgcatgggaaga

SEQ ID NO: 640207 - DNA, 25 bp, Rattus norvegicus
tggtctcagaagacagtgactggct

SEQ ID NO: 640208 - DNA, 25 bp, Rattus norvegicus
tggtctcagaagtcagtgactggct

SEQ ID NO: 640209 - DNA, 25 bp, Rattus norvegicus
tggtctcagaccatgatgacatgct

SEQ ID NO: 640210 - DNA, 25 bp, Rattus norvegicus
tggtctcagaccttgatgacatgct

SEQ ID NO: 640211 - DNA, 25 bp, Rattus norvegicus
tggtctcagagcctgcgagttgcct

SEQ ID NO: 640212 - DNA, 25 bp, Rattus norvegicus
tggtctcagagcgtgcgagttgcct

SEQ ID NO: 640213 - DNA, 25 bp, Rattus norvegicus
tggtctcagtgtatcagatcctgta

SEQ ID NO: 640214 - DNA, 25 bp, Rattus norvegicus
tggtctcagtgtcctggatcattag

SEQ ID NO: 640215 - DNA, 25 bp, Rattus norvegicus
tggtctcagtgtgctggatcattag

SEQ ID NO: 640216 - DNA, 25 bp, Rattus norvegicus
tggtctcagtgtttcagatcctgta

SEQ ID NO: 640217 - DNA, 25 bp, Rattus norvegicus
tggtctcatcaactaactcccttaa

SEQ ID NO: 640218 - DNA, 25 bp, Rattus norvegicus
tggtctcatcaagtaactcccttaa

SEQ ID NO: 640219 - DNA, 25 bp, Rattus norvegicus
tggtctccaacaccagtcatcgcgg

SEQ ID NO: 640220 - DNA, 25 bp, Rattus norvegicus
tggtctccaacagcagtcatcgcgg

SEQ ID NO: 640221 - DNA, 25 bp, Rattus norvegicus
tggtctccaaccatctactggttaa

SEQ ID NO: 640222 - DNA, 25 bp, Rattus norvegicus
tggtctccaaccttctactggttaa

SEQ ID NO: 640223 - DNA, 25 bp, Rattus norvegicus
tggtctccaaggagactctagatct

SEQ ID NO: 640224 - DNA, 25 bp, Rattus norvegicus
tggtctccaaggtgactctagatct

SEQ ID NO: 640225 - DNA, 25 bp, Rattus norvegicus
tggtctccacacagaacagtctcag

SEQ ID NO: 640226 - DNA, 25 bp, Rattus norvegicus
tggtctccacactgaacagtctcag

SEQ ID NO: 640227 - DNA, 25 bp, Rattus norvegicus
tggtctccacggactttaatggcga

SEQ ID NO: 640228 - DNA, 25 bp, Rattus norvegicus
tggtctccacggtctttaatggcga

SEQ ID NO: 640229 - DNA, 25 bp, Rattus norvegicus
tggtctccagtgctgctccaagaaa

SEQ ID NO: 640230 - DNA, 25 bp, Rattus norvegicus
tggtctccagtggtgctccaagaaa

SEQ ID NO: 640231 - DNA, 25 bp, Rattus norvegicus
tggtctcccggcatggcggctaccg

SEQ ID NO: 640232 - DNA, 25 bp, Rattus norvegicus
tggtctcccggcttggcggctaccg

SEQ ID NO: 640233 - DNA, 25 bp, Rattus norvegicus
tggtctcccgtgaagatgccgtcag

SEQ ID NO: 640234 - DNA, 25 bp, Rattus norvegicus
tggtctcccgtgctccatatgaagc

SEQ ID NO: 640235 - DNA, 25 bp, Rattus norvegicus
tggtctcccgtggtccatatgaagc

SEQ ID NO: 640236 - DNA, 25 bp, Rattus norvegicus
tggtctcccgtgtagatgccgtcag

SEQ ID NO: 640237 - DNA, 25 bp, Rattus norvegicus
tggtctcccgttcggaaattgacat

SEQ ID NO: 640238 - DNA, 25 bp, Rattus norvegicus
tggtctcccgttgggaaattgacat

SEQ ID NO: 640239 - DNA, 25 bp, Rattus norvegicus
tggtctccctacacagagattcaac

SEQ ID NO: 640240 - DNA, 25 bp, Rattus norvegicus
tggtctccctactcagagattcaac

SEQ ID NO: 640241 - DNA, 25 bp, Rattus norvegicus
tggtctccctctattattactctaa

SEQ ID NO: 640242 - DNA, 25 bp, Rattus norvegicus
tggtctccctcttttattactctaa

SEQ ID NO: 640243 - DNA, 25 bp, Rattus norvegicus
tggtctccctgcaacatgtccatgg

SEQ ID NO: 640244 - DNA, 25 bp, Rattus norvegicus
tggtctccctgctacatgtccatgg

SEQ ID NO: 640245 - DNA, 25 bp, Rattus norvegicus
tggtctccctggctgcacagatggc

SEQ ID NO: 640246 - DNA, 25 bp, Rattus norvegicus
tggtctccctgggtgcacagatggc

SEQ ID NO: 640247 - DNA, 25 bp, Rattus norvegicus
tggtctccctgtattcagtgaatta

SEQ ID NO: 640248 - DNA, 25 bp, Rattus norvegicus
tggtctccctgttttcagtgaatta

SEQ ID NO: 640249 - DNA, 25 bp, Rattus norvegicus
tggtctccgtcaagtttccagcaag

SEQ ID NO: 640250 - DNA, 25 bp, Rattus norvegicus
tggtctccgtcatgtttccagcaag

SEQ ID NO: 640251 - DNA, 25 bp, Rattus norvegicus
tggtctcgctccagcgccggaagag

SEQ ID NO: 640252 - DNA, 25 bp, Rattus norvegicus
tggtctcgctcctgcgccggaagag

SEQ ID NO: 640253 - DNA, 25 bp, Rattus norvegicus
tggtctcggcaaagcggccagagtt

SEQ ID NO: 640254 - DNA, 25 bp, Rattus norvegicus
tggtctcggcaatgcggccagagtt

SEQ ID NO: 640255 - DNA, 25 bp, Rattus norvegicus
tggtctctagagactgcctctgcca

SEQ ID NO: 640256 - DNA, 25 bp, Rattus norvegicus
tggtctctagagtctgcctctgcca

SEQ ID NO: 640257 - DNA, 25 bp, Rattus norvegicus
tggtctctagttcagtgtccctgaa

SEQ ID NO: 640258 - DNA, 25 bp, Rattus norvegicus
tggtctctagttgagtgtccctgaa

SEQ ID NO: 640259 - DNA, 25 bp, Rattus norvegicus
tggtctctcaccattgaatacttag

SEQ ID NO: 640260 - DNA, 25 bp, Rattus norvegicus
tggtctctcacctttgaatacttag

SEQ ID NO: 640261 - DNA, 25 bp, Rattus norvegicus
tggtctctccaacgatggctacggt

SEQ ID NO: 640262 - DNA, 25 bp, Rattus norvegicus
tggtctctccaaggatggctacggt

SEQ ID NO: 640263 - DNA, 25 bp, Rattus norvegicus
tggtctctcgctactctaaaatagt

SEQ ID NO: 640264 - DNA, 25 bp, Rattus norvegicus
tggtctctcgcttctctaaaatagt

SEQ ID NO: 640265 - DNA, 25 bp, Rattus norvegicus
tggtctctctgcagtctgaagagta

SEQ ID NO: 640266 - DNA, 25 bp, Rattus norvegicus
tggtctctctgctgtctgaagagta

SEQ ID NO: 640267 - DNA, 25 bp, Rattus norvegicus
tggtctctcttgctgcatgcagtag

SEQ ID NO: 640268 - DNA, 25 bp, Rattus norvegicus
tggtctctcttggtgcatgcagtag

SEQ ID NO: 640269 - DNA, 25 bp, Rattus norvegicus
tggtctctgaggcactaacacacat

SEQ ID NO: 640270 - DNA, 25 bp, Rattus norvegicus
tggtctctgagggactaacacacat

SEQ ID NO: 640271 - DNA, 25 bp, Rattus norvegicus
tggtctctgccccaaagatttggag

SEQ ID NO: 640272 - DNA, 25 bp, Rattus norvegicus
tggtctctgcccgaaagatttggag

SEQ ID NO: 640273 - DNA, 25 bp, Rattus norvegicus
tggtctctggccaacatatatgtct

SEQ ID NO: 640274 - DNA, 25 bp, Rattus norvegicus
tggtctctggcctacatatatgtct

SEQ ID NO: 640275 - DNA, 25 bp, Rattus norvegicus
tggtctctggtcaacaactcggcag

SEQ ID NO: 640276 - DNA, 25 bp, Rattus norvegicus
tggtctctggtctacaactcggcag

SEQ ID NO: 640277 - DNA, 25 bp, Rattus norvegicus
tggtctctgttcagtccagtgttca

SEQ ID NO: 640278 - DNA, 25 bp, Rattus norvegicus
tggtctctgttctgtccagtgttca

SEQ ID NO: 640279 - DNA, 25 bp, Rattus norvegicus
tggtctctgtttatgcctatgatgc

SEQ ID NO: 640280 - DNA, 25 bp, Rattus norvegicus
tggtctctgtttcaggcacgccctg

SEQ ID NO: 640281 - DNA, 25 bp, Rattus norvegicus
tggtctctgtttgaggcacgccctg

SEQ ID NO: 640282 - DNA, 25 bp, Rattus norvegicus
tggtctctgtttttgcctatgatgc

SEQ ID NO: 640283 - DNA, 25 bp, Rattus norvegicus
tggtctcttcaacgcccagaataca

SEQ ID NO: 640284 - DNA, 25 bp, Rattus norvegicus
tggtctcttcaaggcccagaataca

SEQ ID NO: 640285 - DNA, 25 bp, Rattus norvegicus
tggtctcttctgacctgctgggtaa

SEQ ID NO: 640286 - DNA, 25 bp, Rattus norvegicus
tggtctcttctgtcctgctgggtaa

SEQ ID NO: 640287 - DNA, 25 bp, Rattus norvegicus
tggtctcttgcccaaggcttgggaa

SEQ ID NO: 640288 - DNA, 25 bp, Rattus norvegicus
tggtctcttgccgaaggcttgggaa

SEQ ID NO: 640289 - DNA, 25 bp, Rattus norvegicus
tggtctcttggacaggctgaagcct

SEQ ID NO: 640290 - DNA, 25 bp, Rattus norvegicus
tggtctcttggagaggctgaagcct

SEQ ID NO: 640291 - DNA, 25 bp, Rattus norvegicus
tggtctcttgtcatctatcttatta

SEQ ID NO: 640292 - DNA, 25 bp, Rattus norvegicus
tggtctcttgtcttctatcttatta

SEQ ID NO: 640293 - DNA, 25 bp, Rattus norvegicus
tggtctctttccacctgtgtttaaa

SEQ ID NO: 640294 - DNA, 25 bp, Rattus norvegicus
tggtctctttcctcctgtgtttaaa

SEQ ID NO: 640295 - DNA, 25 bp, Rattus norvegicus
tggtctcttttcatggtagctttat

SEQ ID NO: 640296 - DNA, 25 bp, Rattus norvegicus
tggtctcttttcttggtagctttat

SEQ ID NO: 640297 - DNA, 25 bp, Rattus norvegicus
tggtctgaccagagtaggaacggac

SEQ ID NO: 640298 - DNA, 25 bp, Rattus norvegicus
tggtctgaccagtgtaggaacggac

SEQ ID NO: 640299 - DNA, 25 bp, Rattus norvegicus
tggtctgacctgaatctaatctcct

SEQ ID NO: 640300 - DNA, 25 bp, Rattus norvegicus
tggtctgacctgtatctaatctcct

SEQ ID NO: 640301 - DNA, 25 bp, Rattus norvegicus
tggtctgagagcatctattccacac

SEQ ID NO: 640302 - DNA, 25 bp, Rattus norvegicus
tggtctgagagcttctattccacac

SEQ ID NO: 640303 - DNA, 25 bp, Rattus norvegicus
tggtctgagccaagaatcctctaag

SEQ ID NO: 640304 - DNA, 25 bp, Rattus norvegicus
tggtctgagccatgaatcctctaag

SEQ ID NO: 640305 - DNA, 25 bp, Rattus norvegicus
tggtctgcaggtatggctggctctc

SEQ ID NO: 640306 - DNA, 25 bp, Rattus norvegicus
tggtctgcaggtttggctggctctc

SEQ ID NO: 640307 - DNA, 25 bp, Rattus norvegicus
tggtctgccaaaactcttcacacgt

SEQ ID NO: 640308 - DNA, 25 bp, Rattus norvegicus
tggtctgccaaatctcttcacacgt

SEQ ID NO: 640309 - DNA, 25 bp, Rattus norvegicus
tggtctgccttgctgactcatgtca

SEQ ID NO: 640310 - DNA, 25 bp, Rattus norvegicus
tggtctgccttggtgactcatgtca

SEQ ID NO: 640311 - DNA, 25 bp, Rattus norvegicus
tggtctgctgctactagttgtcggc

SEQ ID NO: 640312 - DNA, 25 bp, Rattus norvegicus
tggtctgctgcttctagttgtcggc

SEQ ID NO: 640313 - DNA, 25 bp, Rattus norvegicus
tggtctgctttccttcccaagagca

SEQ ID NO: 640314 - DNA, 25 bp, Rattus norvegicus
tggtctgctttcgttcccaagagca

SEQ ID NO: 640315 - DNA, 25 bp, Rattus norvegicus
tggtctggaaccaactataaagtgt

SEQ ID NO: 640316 - DNA, 25 bp, Rattus norvegicus
tggtctggaacctactataaagtgt

SEQ ID NO: 640317 - DNA, 25 bp, Rattus norvegicus
tggtctggacttaaacaactgctgt

SEQ ID NO: 640318 - DNA, 25 bp, Rattus norvegicus
tggtctggactttaacaactgctgt

SEQ ID NO: 640319 - DNA, 25 bp, Rattus norvegicus
tggtctggataactgctgcctgaaa

SEQ ID NO: 640320 - DNA, 25 bp, Rattus norvegicus
tggtctggataagtgctgcctgaaa

SEQ ID NO: 640321 - DNA, 25 bp, Rattus norvegicus
tggtctggattgatgtatggcttgt

SEQ ID NO: 640322 - DNA, 25 bp, Rattus norvegicus
tggtctggattgttgtatggcttgt

SEQ ID NO: 640323 - DNA, 25 bp, Rattus norvegicus
tggtctggcaggagtgaatctcccc

SEQ ID NO: 640324 - DNA, 25 bp, Rattus norvegicus
tggtctggcaggtgtgaatctcccc

SEQ ID NO: 640325 - DNA, 25 bp, Rattus norvegicus
tggtctgggtctactagtcccatgg

SEQ ID NO: 640326 - DNA, 25 bp, Rattus norvegicus
tggtctgggtcttctagtcccatgg

SEQ ID NO: 640327 - DNA, 25 bp, Rattus norvegicus
tggtctggtgctcatattacatatc

SEQ ID NO: 640328 - DNA, 25 bp, Rattus norvegicus
tggtctggtgctgatattacatatc

SEQ ID NO: 640329 - DNA, 25 bp, Rattus norvegicus
tggtctggttgtattctcctgggaa

SEQ ID NO: 640330 - DNA, 25 bp, Rattus norvegicus
tggtctggttgttttctcctgggaa

SEQ ID NO: 640331 - DNA, 25 bp, Rattus norvegicus
tggtctgtacccagcttttaaatct

SEQ ID NO: 640332 - DNA, 25 bp, Rattus norvegicus
tggtctgtaccctgcttttaaatct

SEQ ID NO: 640333 - DNA, 25 bp, Rattus norvegicus
tggtctgtacctccaggccatggca

SEQ ID NO: 640334 - DNA, 25 bp, Rattus norvegicus
tggtctgtacctgcaggccatggca

SEQ ID NO: 640335 - DNA, 25 bp, Rattus norvegicus
tggtctgtccacaggagcccaggat

SEQ ID NO: 640336 - DNA, 25 bp, Rattus norvegicus
tggtctgtccactggagcccaggat

SEQ ID NO: 640337 - DNA, 25 bp, Rattus norvegicus
tggtctgtctccacactgttgttgg

SEQ ID NO: 640338 - DNA, 25 bp, Rattus norvegicus
tggtctgtctcctcactgttgttgg

SEQ ID NO: 640339 - DNA, 25 bp, Rattus norvegicus
tggtctgtcttccatttctcagtat

SEQ ID NO: 640340 - DNA, 25 bp, Rattus norvegicus
tggtctgtcttcgatttctcagtat

SEQ ID NO: 640341 - DNA, 25 bp, Rattus norvegicus
tggtctgtgactagaggtgttgcat

SEQ ID NO: 640342 - DNA, 25 bp, Rattus norvegicus
tggtctgtgactctatttatatgta

SEQ ID NO: 640343 - DNA, 25 bp, Rattus norvegicus
tggtctgtgactgtatttatatgta

SEQ ID NO: 640344 - DNA, 25 bp, Rattus norvegicus
tggtctgtgacttgaggtgttgcat

SEQ ID NO: 640345 - DNA, 25 bp, Rattus norvegicus
tggtctgtgatgaaacccattatca

SEQ ID NO: 640346 - DNA, 25 bp, Rattus norvegicus
tggtctgtgatgtaacccattatca

SEQ ID NO: 640347 - DNA, 25 bp, Rattus norvegicus
tggtctgtgcacaggcaggaacctg

SEQ ID NO: 640348 - DNA, 25 bp, Rattus norvegicus
tggtctgtgcactggcaggaacctg

SEQ ID NO: 640349 - DNA, 25 bp, Rattus norvegicus
tggtctgtgggcaccgtctgtctct

SEQ ID NO: 640350 - DNA, 25 bp, Rattus norvegicus
tggtctgtgggctccgtctgtctct

SEQ ID NO: 640351 - DNA, 25 bp, Rattus norvegicus
tggtctgtggttactccagaaggct

SEQ ID NO: 640352 - DNA, 25 bp, Rattus norvegicus
tggtctgtggtttctccagaaggct

SEQ ID NO: 640353 - DNA, 25 bp, Rattus norvegicus
tggtctgttcataaaattccctttt

SEQ ID NO: 640354 - DNA, 25 bp, Rattus norvegicus
tggtctgttcattaaattccctttt

SEQ ID NO: 640355 - DNA, 25 bp, Rattus norvegicus
tggtctgttcttacaaatcctttgt

SEQ ID NO: 640356 - DNA, 25 bp, Rattus norvegicus
tggtctgttctttcaaatcctttgt

SEQ ID NO: 640357 - DNA, 25 bp, Rattus norvegicus
tggtctgtttcaacagcaacctctt

SEQ ID NO: 640358 - DNA, 25 bp, Rattus norvegicus
tggtctgtttcatcagcaacctctt

SEQ ID NO: 640359 - DNA, 25 bp, Rattus norvegicus
tggtcttaactaacgctttttggct

SEQ ID NO: 640360 - DNA, 25 bp, Rattus norvegicus
tggtcttaactatcgctttttggct

SEQ ID NO: 640361 - DNA, 25 bp, Rattus norvegicus
tggtcttaaggcaactcttcccgaa

SEQ ID NO: 640362 - DNA, 25 bp, Rattus norvegicus
tggtcttaaggctactcttcccgaa

SEQ ID NO: 640363 - DNA, 25 bp, Rattus norvegicus
tggtcttaagtcagttcacagttat

SEQ ID NO: 640364 - DNA, 25 bp, Rattus norvegicus
tggtcttaagtctgttcacagttat

SEQ ID NO: 640365 - DNA, 25 bp, Rattus norvegicus
tggtcttaattgaggccttcttcat

SEQ ID NO: 640366 - DNA, 25 bp, Rattus norvegicus
tggtcttaattgtggccttcttcat

SEQ ID NO: 640367 - DNA, 25 bp, Rattus norvegicus
tggtcttatccgaacagtgtgcatt

SEQ ID NO: 640368 - DNA, 25 bp, Rattus norvegicus
tggtcttatccgtacagtgtgcatt

SEQ ID NO: 640369 - DNA, 25 bp, Rattus norvegicus
tggtcttcaaagagcactgcatgca

SEQ ID NO: 640370 - DNA, 25 bp, Rattus norvegicus
tggtcttcaaagtgcactgcatgca

SEQ ID NO: 640371 - DNA, 25 bp, Rattus norvegicus
tggtcttcagctacatctcggagcc

SEQ ID NO: 640372 - DNA, 25 bp, Rattus norvegicus
tggtcttcagctattcctaactgcg

SEQ ID NO: 640373 - DNA, 25 bp, Rattus norvegicus
tggtcttcagcttcatctcggagcc

SEQ ID NO: 640374 - DNA, 25 bp, Rattus norvegicus
tggtcttcagcttttcctaactgcg

SEQ ID NO: 640375 - DNA, 25 bp, Rattus norvegicus
tggtcttcagggagcacctggaaga

SEQ ID NO: 640376 - DNA, 25 bp, Rattus norvegicus
tggtcttcagggtgcacctggaaga

SEQ ID NO: 640377 - DNA, 25 bp, Rattus norvegicus
tggtcttccacacttttcagtttct

SEQ ID NO: 640378 - DNA, 25 bp, Rattus norvegicus
tggtcttccacagttttcagtttct

SEQ ID NO: 640379 - DNA, 25 bp, Rattus norvegicus
tggtcttcccatcactacaacttga

SEQ ID NO: 640380 - DNA, 25 bp, Rattus norvegicus
tggtcttcccatgactacaacttga

SEQ ID NO: 640381 - DNA, 25 bp, Rattus norvegicus
tggtcttccctgagtagattctttt

SEQ ID NO: 640382 - DNA, 25 bp, Rattus norvegicus
tggtcttccctgtgtagattctttt

SEQ ID NO: 640383 - DNA, 25 bp, Rattus norvegicus
tggtcttcctttactgtggattcat

SEQ ID NO: 640384 - DNA, 25 bp, Rattus norvegicus
tggtcttccttttctgtggattcat

SEQ ID NO: 640385 - DNA, 25 bp, Rattus norvegicus
tggtcttcgcgccttaagagaaaca

SEQ ID NO: 640386 - DNA, 25 bp, Rattus norvegicus
tggtcttcgcgcgttaagagaaaca

SEQ ID NO: 640387 - DNA, 25 bp, Rattus norvegicus
tggtcttcgcttcctgtctgtaaga

SEQ ID NO: 640388 - DNA, 25 bp, Rattus norvegicus
tggtcttcgcttgctgtctgtaaga

SEQ ID NO: 640389 - DNA, 25 bp, Rattus norvegicus
tggtcttcgggtctcgacaatccaa

SEQ ID NO: 640390 - DNA, 25 bp, Rattus norvegicus
tggtcttcgggtgtcgacaatccaa

SEQ ID NO: 640391 - DNA, 25 bp, Rattus norvegicus
tggtcttctgcaactccttaaggaa

SEQ ID NO: 640392 - DNA, 25 bp, Rattus norvegicus
tggtcttctgcatctccttaaggaa

SEQ ID NO: 640393 - DNA, 25 bp, Rattus norvegicus
tggtcttctgtcaagtgccgaggga

SEQ ID NO: 640394 - DNA, 25 bp, Rattus norvegicus
tggtcttctgtctagtgccgaggga

SEQ ID NO: 640395 - DNA, 25 bp, Rattus norvegicus
tggtcttctttgagactgctagcac

SEQ ID NO: 640396 - DNA, 25 bp, Rattus norvegicus
tggtcttctttgtgactgctagcac

SEQ ID NO: 640397 - DNA, 25 bp, Rattus norvegicus
tggtcttgaaaaacaggagttcgtg

SEQ ID NO: 640398 - DNA, 25 bp, Rattus norvegicus
tggtcttgaaaatcaggagttcgtg

SEQ ID NO: 640399 - DNA, 25 bp, Rattus norvegicus
tggtcttgagacaacaggctgctgg

SEQ ID NO: 640400 - DNA, 25 bp, Rattus norvegicus
tggtcttgagactacaggctgctgg

SEQ ID NO: 640401 - DNA, 25 bp, Rattus norvegicus
tggtcttgatctcttcctctcagac

SEQ ID NO: 640402 - DNA, 25 bp, Rattus norvegicus
tggtcttgatctgttcctctcagac

SEQ ID NO: 640403 - DNA, 25 bp, Rattus norvegicus
tggtcttgcataaatcctgtcttaa

SEQ ID NO: 640404 - DNA, 25 bp, Rattus norvegicus
tggtcttgcatatatcctgtcttaa

SEQ ID NO: 640405 - DNA, 25 bp, Rattus norvegicus
tggtcttgcgcaagtccacggagtt

SEQ ID NO: 640406 - DNA, 25 bp, Rattus norvegicus
tggtcttgcgcatgtccacggagtt

SEQ ID NO: 640407 - DNA, 25 bp, Rattus norvegicus
tggtcttgcttcacagtgtaactga

SEQ ID NO: 640408 - DNA, 25 bp, Rattus norvegicus
tggtcttgcttctcagtgtaactga

SEQ ID NO: 640409 - DNA, 25 bp, Rattus norvegicus
tggtcttgtccaaaaggcctgtcac

SEQ ID NO: 640410 - DNA, 25 bp, Rattus norvegicus
tggtcttgtccataaggcctgtcac

SEQ ID NO: 640411 - DNA, 25 bp, Rattus norvegicus
tggtcttgttaccttgtctaccaag

SEQ ID NO: 640412 - DNA, 25 bp, Rattus norvegicus
tggtcttgttacgttgtctaccaag

SEQ ID NO: 640413 - DNA, 25 bp, Rattus norvegicus
tggtctttaaccatggttcctttcg

SEQ ID NO: 640414 - DNA, 25 bp, Rattus norvegicus
tggtctttaaccttggttcctttcg

SEQ ID NO: 640415 - DNA, 25 bp, Rattus norvegicus
tggtctttaacgaattctatttgga

SEQ ID NO: 640416 - DNA, 25 bp, Rattus norvegicus
tggtctttaacgtattctatttgga

SEQ ID NO: 640417 - DNA, 25 bp, Rattus norvegicus
tggtctttacccatttccttaaatg

SEQ ID NO: 640418 - DNA, 25 bp, Rattus norvegicus
tggtctttacccttttccttaaatg

SEQ ID NO: 640419 - DNA, 25 bp, Rattus norvegicus
tggtctttccaaaattatcatacac

SEQ ID NO: 640420 - DNA, 25 bp, Rattus norvegicus
tggtctttccaatattatcatacac

SEQ ID NO: 640421 - DNA, 25 bp, Rattus norvegicus
tggtctttccacagtctggtaacaa

SEQ ID NO: 640422 - DNA, 25 bp, Rattus norvegicus
tggtctttccaccttcagtgatgtg

SEQ ID NO: 640423 - DNA, 25 bp, Rattus norvegicus
tggtctttccacgttcagtgatgtg

SEQ ID NO: 640424 - DNA, 25 bp, Rattus norvegicus
tggtctttccactgtctggtaacaa

SEQ ID NO: 640425 - DNA, 25 bp, Rattus norvegicus
tggtctttcctgctagatgtctgta

SEQ ID NO: 640426 - DNA, 25 bp, Rattus norvegicus
tggtctttcctggtagatgtctgta

SEQ ID NO: 640427 - DNA, 25 bp, Rattus norvegicus
tggtctttctctccttattttgttt

SEQ ID NO: 640428 - DNA, 25 bp, Rattus norvegicus
tggtctttctctgcttattttgttt

SEQ ID NO: 640429 - DNA, 25 bp, Rattus norvegicus
tggtctttgctgaggcctagccaga

SEQ ID NO: 640430 - DNA, 25 bp, Rattus norvegicus
tggtctttgctgtggcctagccaga

SEQ ID NO: 640431 - DNA, 25 bp, Rattus norvegicus
tggtctttggacattcatgttttgt

SEQ ID NO: 640432 - DNA, 25 bp, Rattus norvegicus
tggtctttggactttcatgttttgt

SEQ ID NO: 640433 - DNA, 25 bp, Rattus norvegicus
tggtctttggcacttaactccataa

SEQ ID NO: 640434 - DNA, 25 bp, Rattus norvegicus
tggtctttggcagttaactccataa

SEQ ID NO: 640435 - DNA, 25 bp, Rattus norvegicus
tggtctttggtgaacacacgctgct

SEQ ID NO: 640436 - DNA, 25 bp, Rattus norvegicus
tggtctttggtgaagactttcccgc

SEQ ID NO: 640437 - DNA, 25 bp, Rattus norvegicus
tggtctttggtgtacacacgctgct

SEQ ID NO: 640438 - DNA, 25 bp, Rattus norvegicus
tggtctttggtgtagactttcccgc

SEQ ID NO: 640439 - DNA, 25 bp, Rattus norvegicus
tggtctttgtgaatggccacccaaa

SEQ ID NO: 640440 - DNA, 25 bp, Rattus norvegicus
tggtctttgtgattggccacccaaa

SEQ ID NO: 640441 - DNA, 25 bp, Rattus norvegicus
tggtctttgtgcacgcaagccaagt

SEQ ID NO: 640442 - DNA, 25 bp, Rattus norvegicus
tggtctttgtgctcgcaagccaagt

SEQ ID NO: 640443 - DNA, 25 bp, Rattus norvegicus
tggtcttttcagatagtgccctaaa

SEQ ID NO: 640444 - DNA, 25 bp, Rattus norvegicus
tggtcttttcagttagtgccctaaa

SEQ ID NO: 640445 - DNA, 25 bp, Rattus norvegicus
tggtcttttccaatctggaacccct

SEQ ID NO: 640446 - DNA, 25 bp, Rattus norvegicus
tggtcttttccattctggaacccct

SEQ ID NO: 640447 - DNA, 25 bp, Rattus norvegicus
tggtcttttctaacccctaagaggc

SEQ ID NO: 640448 - DNA, 25 bp, Rattus norvegicus
tggtcttttctatcccctaagaggc

SEQ ID NO: 640449 - DNA, 25 bp, Rattus norvegicus
tggtcttttggaatgagggtaccct

SEQ ID NO: 640450 - DNA, 25 bp, Rattus norvegicus
tggtcttttggattgagggtaccct

SEQ ID NO: 640451 - DNA, 25 bp, Rattus norvegicus
tggtctttttatacgtgcagcccct

SEQ ID NO: 640452 - DNA, 25 bp, Rattus norvegicus
tggtctttttattcgtgcagcccct

SEQ ID NO: 640453 - DNA, 25 bp, Rattus norvegicus
tggtgaaaactgctcctatggctct

SEQ ID NO: 640454 - DNA, 25 bp, Rattus norvegicus
tggtgaaaactggtcctatggctct

SEQ ID NO: 640455 - DNA, 25 bp, Rattus norvegicus
tggtgaaatattagcatgctttttt

SEQ ID NO: 640456 - DNA, 25 bp, Rattus norvegicus
tggtgaaatatttgcatgctttttt

SEQ ID NO: 640457 - DNA, 25 bp, Rattus norvegicus
tggtgaaatcaaaccggcatctaca

SEQ ID NO: 640458 - DNA, 25 bp, Rattus norvegicus
tggtgaaatcaatccggcatctaca

SEQ ID NO: 640459 - DNA, 25 bp, Rattus norvegicus
tggtgaaatggcacggcacttaaga

SEQ ID NO: 640460 - DNA, 25 bp, Rattus norvegicus
tggtgaaatggctcggcacttaaga

SEQ ID NO: 640461 - DNA, 25 bp, Rattus norvegicus
tggtgaacacagctgcctagcagtt

SEQ ID NO: 640462 - DNA, 25 bp, Rattus norvegicus
tggtgaacacaggtgcctagcagtt

SEQ ID NO: 640463 - DNA, 25 bp, Rattus norvegicus
tggtgaactcaaaacagccctcttc

SEQ ID NO: 640464 - DNA, 25 bp, Rattus norvegicus
tggtgaactcaatacagccctcttc

SEQ ID NO: 640465 - DNA, 25 bp, Rattus norvegicus
tggtgaactgtgagtgagcattgca

SEQ ID NO: 640466 - DNA, 25 bp, Rattus norvegicus
tggtgaactgtgtgtgagcattgca

SEQ ID NO: 640467 - DNA, 25 bp, Rattus norvegicus
tggtgaagaacaactgtctccagcc

SEQ ID NO: 640468 - DNA, 25 bp, Rattus norvegicus
tggtgaagaacatctgtctccagcc

SEQ ID NO: 640469 - DNA, 25 bp, Rattus norvegicus
tggtgaagcatcctactgcccacaa

SEQ ID NO: 640470 - DNA, 25 bp, Rattus norvegicus
tggtgaagcatcgtactgcccacaa

SEQ ID NO: 640471 - DNA, 25 bp, Rattus norvegicus
tggtgaagccccatgaagactatca

SEQ ID NO: 640472 - DNA, 25 bp, Rattus norvegicus
tggtgaagccccttgaagactatca

SEQ ID NO: 640473 - DNA, 25 bp, Rattus norvegicus
tggtgaagcgctatggtcccatgga

SEQ ID NO: 640474 - DNA, 25 bp, Rattus norvegicus
tggtgaagcgctttggtcccatgga

SEQ ID NO: 640475 - DNA, 25 bp, Rattus norvegicus
tggtgaagctgaccaaggaagccaa

SEQ ID NO: 640476 - DNA, 25 bp, Rattus norvegicus
tggtgaagctgagcaaggaagccaa

SEQ ID NO: 640477 - DNA, 25 bp, Rattus norvegicus
tggtgaaggacgcttagctctctcc

SEQ ID NO: 640478 - DNA, 25 bp, Rattus norvegicus
tggtgaaggacggttagctctctcc

SEQ ID NO: 640479 - DNA, 25 bp, Rattus norvegicus
tggtgaagggcacccccccaacttg

SEQ ID NO: 640480 - DNA, 25 bp, Rattus norvegicus
tggtgaagggcagccccccaacttg

SEQ ID NO: 640481 - DNA, 25 bp, Rattus norvegicus
tggtgaaggtgaaaggcacgccgct

SEQ ID NO: 640482 - DNA, 25 bp, Rattus norvegicus
tggtgaaggtgataggcacgccgct

SEQ ID NO: 640483 - DNA, 25 bp, Rattus norvegicus
tggtgaatcaatatgctgccttccc

SEQ ID NO: 640484 - DNA, 25 bp, Rattus norvegicus
tggtgaatcaatttgctgccttccc

SEQ ID NO: 640485 - DNA, 25 bp, Rattus norvegicus
tggtgaatcagacctgttctcctcc

SEQ ID NO: 640486 - DNA, 25 bp, Rattus norvegicus
tggtgaatcagagctgttctcctcc

SEQ ID NO: 640487 - DNA, 25 bp, Rattus norvegicus
tggtgaatccatcccagcatctacg

SEQ ID NO: 640488 - DNA, 25 bp, Rattus norvegicus
tggtgaatccatgccagcatctacg

SEQ ID NO: 640489 - DNA, 25 bp, Rattus norvegicus
tggtgaatccggatgccccagggat

SEQ ID NO: 640490 - DNA, 25 bp, Rattus norvegicus
tggtgaatccggttgccccagggat

SEQ ID NO: 640491 - DNA, 25 bp, Rattus norvegicus
tggtgaatgcttcagcaagaacaca

SEQ ID NO: 640492 - DNA, 25 bp, Rattus norvegicus
tggtgaatgcttgagcaagaacaca

SEQ ID NO: 640493 - DNA, 25 bp, Rattus norvegicus
tggtgaatgtcgagcccaaactcaa

SEQ ID NO: 640494 - DNA, 25 bp, Rattus norvegicus
tggtgaatgtcgtgcccaaactcaa

SEQ ID NO: 640495 - DNA, 25 bp, Rattus norvegicus
tggtgaatttctctacctcctccaa

SEQ ID NO: 640496 - DNA, 25 bp, Rattus norvegicus
tggtgaatttctgtacctcctccaa

SEQ ID NO: 640497 - DNA, 25 bp, Rattus norvegicus
tggtgacaagccatgctgaccacag

SEQ ID NO: 640498 - DNA, 25 bp, Rattus norvegicus
tggtgacaagccttgctgaccacag

SEQ ID NO: 640499 - DNA, 25 bp, Rattus norvegicus
tggtgacaccagcagttatgacttt

SEQ ID NO: 640500 - DNA, 25 bp, Rattus norvegicus
tggtgacaccaggagttatgacttt

SEQ ID NO: 640501 - DNA, 25 bp, Rattus norvegicus
tggtgacaggaacattgcccatcct

SEQ ID NO: 640502 - DNA, 25 bp, Rattus norvegicus
tggtgacaggaagattgcccatcct

SEQ ID NO: 640503 - DNA, 25 bp, Rattus norvegicus
tggtgacagtcaacttttgccgaat

SEQ ID NO: 640504 - DNA, 25 bp, Rattus norvegicus
tggtgacagtcatcttttgccgaat

SEQ ID NO: 640505 - DNA, 25 bp, Rattus norvegicus
tggtgacagtggctataaacagcct

SEQ ID NO: 640506 - DNA, 25 bp, Rattus norvegicus
tggtgacagtgggtataaacagcct

SEQ ID NO: 640507 - DNA, 25 bp, Rattus norvegicus
tggtgacagttccttaagttcagct

SEQ ID NO: 640508 - DNA, 25 bp, Rattus norvegicus
tggtgacagttcgttaagttcagct

SEQ ID NO: 640509 - DNA, 25 bp, Rattus norvegicus
tggtgacatattcctgttacagcct

SEQ ID NO: 640510 - DNA, 25 bp, Rattus norvegicus
tggtgacatattgctgttacagcct

SEQ ID NO: 640511 - DNA, 25 bp, Rattus norvegicus
tggtgacatcagactcccttttagg

SEQ ID NO: 640512 - DNA, 25 bp, Rattus norvegicus
tggtgacatcagtctcccttttagg

SEQ ID NO: 640513 - DNA, 25 bp, Rattus norvegicus
tggtgacatcgacttgctcctttaa

SEQ ID NO: 640514 - DNA, 25 bp, Rattus norvegicus
tggtgacatcgagttgctcctttaa

SEQ ID NO: 640515 - DNA, 25 bp, Rattus norvegicus
tggtgacatcttaggctaatctggc

SEQ ID NO: 640516 - DNA, 25 bp, Rattus norvegicus
tggtgacatctttggctaatctggc

SEQ ID NO: 640517 - DNA, 25 bp, Rattus norvegicus
tggtgacatgagacgcctgtgccac

SEQ ID NO: 640518 - DNA, 25 bp, Rattus norvegicus
tggtgacatgagtcgcctgtgccac

SEQ ID NO: 640519 - DNA, 25 bp, Rattus norvegicus
tggtgacatgatcgacccagacctg

SEQ ID NO: 640520 - DNA, 25 bp, Rattus norvegicus
tggtgacatgatggacccagacctg

SEQ ID NO: 640521 - DNA, 25 bp, Rattus norvegicus
tggtgacattcaactgcccttttaa

SEQ ID NO: 640522 - DNA, 25 bp, Rattus norvegicus
tggtgacattcatctgcccttttaa

SEQ ID NO: 640523 - DNA, 25 bp, Rattus norvegicus
tggtgacattgcctggctacagcat

SEQ ID NO: 640524 - DNA, 25 bp, Rattus norvegicus
tggtgacattgcgtggctacagcat

SEQ ID NO: 640525 - DNA, 25 bp, Rattus norvegicus
tggtgacattgtactattccctttt

SEQ ID NO: 640526 - DNA, 25 bp, Rattus norvegicus
tggtgacattgttctattccctttt

SEQ ID NO: 640527 - DNA, 25 bp, Rattus norvegicus
tggtgaccaaaaactacttctagtg

SEQ ID NO: 640528 - DNA, 25 bp, Rattus norvegicus
tggtgaccaaaatctacttctagtg

SEQ ID NO: 640529 - DNA, 25 bp, Rattus norvegicus
tggtgaccaactcctctaggacttc

SEQ ID NO: 640530 - DNA, 25 bp, Rattus norvegicus
tggtgaccaactgctctaggacttc

SEQ ID NO: 640531 - DNA, 25 bp, Rattus norvegicus
tggtgaccaaggattaccctccaca

SEQ ID NO: 640532 - DNA, 25 bp, Rattus norvegicus
tggtgaccaaggtttaccctccaca

SEQ ID NO: 640533 - DNA, 25 bp, Rattus norvegicus
tggtgaccaccaaactaatatccta

SEQ ID NO: 640534 - DNA, 25 bp, Rattus norvegicus
tggtgaccaccacattgtcccagtg

SEQ ID NO: 640535 - DNA, 25 bp, Rattus norvegicus
tggtgaccaccagattgtcccagtg

SEQ ID NO: 640536 - DNA, 25 bp, Rattus norvegicus
tggtgaccaccatactaatatccta

SEQ ID NO: 640537 - DNA, 25 bp, Rattus norvegicus
tggtgaccacggaagaaaacggcta

SEQ ID NO: 640538 - DNA, 25 bp, Rattus norvegicus
tggtgaccacggtagaaaacggcta

SEQ ID NO: 640539 - DNA, 25 bp, Rattus norvegicus
tggtgaccagatcgcagagtctcct

SEQ ID NO: 640540 - DNA, 25 bp, Rattus norvegicus
tggtgaccagatggcagagtctcct

SEQ ID NO: 640541 - DNA, 25 bp, Rattus norvegicus
tggtgaccagccagttgagccacat

SEQ ID NO: 640542 - DNA, 25 bp, Rattus norvegicus
tggtgaccagcctgttgagccacat

SEQ ID NO: 640543 - DNA, 25 bp, Rattus norvegicus
tggtgacccacgaactgtttatagc

SEQ ID NO: 640544 - DNA, 25 bp, Rattus norvegicus
tggtgacccacgtactgtttatagc

SEQ ID NO: 640545 - DNA, 25 bp, Rattus norvegicus
tggtgacccaggaattcttcaaccc

SEQ ID NO: 640546 - DNA, 25 bp, Rattus norvegicus
tggtgacccaggtattcttcaaccc

SEQ ID NO: 640547 - DNA, 25 bp, Rattus norvegicus
tggtgacccatgatgcccgtactat

SEQ ID NO: 640548 - DNA, 25 bp, Rattus norvegicus
tggtgacccatgttgcccgtactat

SEQ ID NO: 640549 - DNA, 25 bp, Rattus norvegicus
tggtgacccctgagggcaatttgcc

SEQ ID NO: 640550 - DNA, 25 bp, Rattus norvegicus
tggtgacccctgtgggcaatttgcc

SEQ ID NO: 640551 - DNA, 25 bp, Rattus norvegicus
tggtgaccccttagttacccaatgc

SEQ ID NO: 640552 - DNA, 25 bp, Rattus norvegicus
tggtgacccctttgttacccaatgc

SEQ ID NO: 640553 - DNA, 25 bp, Rattus norvegicus
tggtgacccgaaacagacattcaga

SEQ ID NO: 640554 - DNA, 25 bp, Rattus norvegicus
tggtgacccgaatcagacattcaga

SEQ ID NO: 640555 - DNA, 25 bp, Rattus norvegicus
tggtgacccgcactcagcagtgcaa

SEQ ID NO: 640556 - DNA, 25 bp, Rattus norvegicus
tggtgacccgcagtcagcagtgcaa

SEQ ID NO: 640557 - DNA, 25 bp, Rattus norvegicus
tggtgacctcttaaggaccaaggat

SEQ ID NO: 640558 - DNA, 25 bp, Rattus norvegicus
tggtgacctctttaggaccaaggat

SEQ ID NO: 640559 - DNA, 25 bp, Rattus norvegicus
tggtgacctgagattcgtccctaga

SEQ ID NO: 640560 - DNA, 25 bp, Rattus norvegicus
tggtgacctgagtttcgtccctaga

SEQ ID NO: 640561 - DNA, 25 bp, Rattus norvegicus
tggtgacggtcaccggcgagcccga

SEQ ID NO: 640562 - DNA, 25 bp, Rattus norvegicus
tggtgacggtcagcggcgagcccga

SEQ ID NO: 640563 - DNA, 25 bp, Rattus norvegicus
tggtgactaaacactgcttgtgcta

SEQ ID NO: 640564 - DNA, 25 bp, Rattus norvegicus
tggtgactaaactctgcttgtgcta

SEQ ID NO: 640565 - DNA, 25 bp, Rattus norvegicus
tggtgactaactatccccagctgat

SEQ ID NO: 640566 - DNA, 25 bp, Rattus norvegicus
tggtgactaactttccccagctgat

SEQ ID NO: 640567 - DNA, 25 bp, Rattus norvegicus
tggtgactaatcagagctgaggcat

SEQ ID NO: 640568 - DNA, 25 bp, Rattus norvegicus
tggtgactaatctgagctgaggcat

SEQ ID NO: 640569 - DNA, 25 bp, Rattus norvegicus
tggtgactacagactagaggagctc

SEQ ID NO: 640570 - DNA, 25 bp, Rattus norvegicus
tggtgactacagcatgttctgtcct

SEQ ID NO: 640571 - DNA, 25 bp, Rattus norvegicus
tggtgactacaggatgttctgtcct

SEQ ID NO: 640572 - DNA, 25 bp, Rattus norvegicus
tggtgactacagtctagaggagctc

SEQ ID NO: 640573 - DNA, 25 bp, Rattus norvegicus
tggtgactacatatactcatcctgt

SEQ ID NO: 640574 - DNA, 25 bp, Rattus norvegicus
tggtgactacatttactcatcctgt

SEQ ID NO: 640575 - DNA, 25 bp, Rattus norvegicus
tggtgactactaccggatccagggc

SEQ ID NO: 640576 - DNA, 25 bp, Rattus norvegicus
tggtgactactagcggatccagggc

SEQ ID NO: 640577 - DNA, 25 bp, Rattus norvegicus
tggtgactagacacacgcttagctt

SEQ ID NO: 640578 - DNA, 25 bp, Rattus norvegicus
tggtgactagactcacgcttagctt

SEQ ID NO: 640579 - DNA, 25 bp, Rattus norvegicus
tggtgactagtcagcacagggccct

SEQ ID NO: 640580 - DNA, 25 bp, Rattus norvegicus
tggtgactagtctgcacagggccct

SEQ ID NO: 640581 - DNA, 25 bp, Rattus norvegicus
tggtgactatagcaatcagcagagt

SEQ ID NO: 640582 - DNA, 25 bp, Rattus norvegicus
tggtgactataggaatcagcagagt

SEQ ID NO: 640583 - DNA, 25 bp, Rattus norvegicus
tggtgactatgaactccagacccct

SEQ ID NO: 640584 - DNA, 25 bp, Rattus norvegicus
tggtgactatgatctccagacccct

SEQ ID NO: 640585 - DNA, 25 bp, Rattus norvegicus
tggtgactccacacttccaacttgt

SEQ ID NO: 640586 - DNA, 25 bp, Rattus norvegicus
tggtgactccactcttccaacttgt

SEQ ID NO: 640587 - DNA, 25 bp, Rattus norvegicus
tggtgactgagtaccctgttcaaac

SEQ ID NO: 640588 - DNA, 25 bp, Rattus norvegicus
tggtgactgagttccctgttcaaac

SEQ ID NO: 640589 - DNA, 25 bp, Rattus norvegicus
tggtgactggccacgacgtctcggc

SEQ ID NO: 640590 - DNA, 25 bp, Rattus norvegicus
tggtgactggcctcgacgtctcggc

SEQ ID NO: 640591 - DNA, 25 bp, Rattus norvegicus
tggtgactggttcttgccccttcaa

SEQ ID NO: 640592 - DNA, 25 bp, Rattus norvegicus
tggtgactggttgttgccccttcaa

SEQ ID NO: 640593 - DNA, 25 bp, Rattus norvegicus
tggtgactgtaacaccttccagggc

SEQ ID NO: 640594 - DNA, 25 bp, Rattus norvegicus
tggtgactgtaagaccttccagggc

SEQ ID NO: 640595 - DNA, 25 bp, Rattus norvegicus
tggtgacttcctatgtaattctaaa

SEQ ID NO: 640596 - DNA, 25 bp, Rattus norvegicus
tggtgacttcctttgtaattctaaa

SEQ ID NO: 640597 - DNA, 25 bp, Rattus norvegicus
tggtgacttgaaactgcctgtgggt

SEQ ID NO: 640598 - DNA, 25 bp, Rattus norvegicus
tggtgacttgaatctgcctgtgggt

SEQ ID NO: 640599 - DNA, 25 bp, Rattus norvegicus
tggtgacttgtcatggttcaggaag

SEQ ID NO: 640600 - DNA, 25 bp, Rattus norvegicus
tggtgacttgtcttggttcaggaag

SEQ ID NO: 640601 - DNA, 25 bp, Rattus norvegicus
tggtgagaagcccattcagtgtaat

SEQ ID NO: 640602 - DNA, 25 bp, Rattus norvegicus
tggtgagaagccgattcagtgtaat

SEQ ID NO: 640603 - DNA, 25 bp, Rattus norvegicus
tggtgagacataagcccaggcccta

SEQ ID NO: 640604 - DNA, 25 bp, Rattus norvegicus
tggtgagacatatgcccaggcccta

SEQ ID NO: 640605 - DNA, 25 bp, Rattus norvegicus
tggtgagacccacgccgaagatgta

SEQ ID NO: 640606 - DNA, 25 bp, Rattus norvegicus
tggtgagacccaggccgaagatgta

SEQ ID NO: 640607 - DNA, 25 bp, Rattus norvegicus
tggtgagaccctctgtactggatgc

SEQ ID NO: 640608 - DNA, 25 bp, Rattus norvegicus
tggtgagaccctgtgtactggatgc

SEQ ID NO: 640609 - DNA, 25 bp, Rattus norvegicus
tggtgagagaccatctatccctcgg

SEQ ID NO: 640610 - DNA, 25 bp, Rattus norvegicus
tggtgagagaccttctatccctcgg

SEQ ID NO: 640611 - DNA, 25 bp, Rattus norvegicus
tggtgagcacacaggagactcctct

SEQ ID NO: 640612 - DNA, 25 bp, Rattus norvegicus
tggtgagcacacatcagccagcata

SEQ ID NO: 640613 - DNA, 25 bp, Rattus norvegicus
tggtgagcacactggagactcctct

SEQ ID NO: 640614 - DNA, 25 bp, Rattus norvegicus
tggtgagcacacttcagccagcata

SEQ ID NO: 640615 - DNA, 25 bp, Rattus norvegicus
tggtgagcagctctgagaacccaga

SEQ ID NO: 640616 - DNA, 25 bp, Rattus norvegicus
tggtgagcagctgtgagaacccaga

SEQ ID NO: 640617 - DNA, 25 bp, Rattus norvegicus
tggtgagcatgcaggcagagcccaa

SEQ ID NO: 640618 - DNA, 25 bp, Rattus norvegicus
tggtgagcatgctggcagagcccaa

SEQ ID NO: 640619 - DNA, 25 bp, Rattus norvegicus
tggtgagccaggacttccatttctc

SEQ ID NO: 640620 - DNA, 25 bp, Rattus norvegicus
tggtgagccaggtcttccatttctc

SEQ ID NO: 640621 - DNA, 25 bp, Rattus norvegicus
tggtgagctcaacgtttccagcttt

SEQ ID NO: 640622 - DNA, 25 bp, Rattus norvegicus
tggtgagctcaaggtttccagcttt

SEQ ID NO: 640623 - DNA, 25 bp, Rattus norvegicus
tggtgagctgccattccgatgcaca

SEQ ID NO: 640624 - DNA, 25 bp, Rattus norvegicus
tggtgagctgcctttccgatgcaca

SEQ ID NO: 640625 - DNA, 25 bp, Rattus norvegicus
tggtgaggaccaacctgccgaagaa

SEQ ID NO: 640626 - DNA, 25 bp, Rattus norvegicus
tggtgaggaccatcctgccgaagaa

SEQ ID NO: 640627 - DNA, 25 bp, Rattus norvegicus
tggtgaggacttagccttttactct

SEQ ID NO: 640628 - DNA, 25 bp, Rattus norvegicus
tggtgaggactttgccttttactct

SEQ ID NO: 640629 - DNA, 25 bp, Rattus norvegicus
tggtgaggagctcttcccattgttc

SEQ ID NO: 640630 - DNA, 25 bp, Rattus norvegicus
tggtgaggagctgttcccattgttc

SEQ ID NO: 640631 - DNA, 25 bp, Rattus norvegicus
tggtgaggcagccaagccatctcat

SEQ ID NO: 640632 - DNA, 25 bp, Rattus norvegicus
tggtgaggcagcgaagccatctcat

SEQ ID NO: 640633 - DNA, 25 bp, Rattus norvegicus
tggtgaggtcgccatgacccctgac

SEQ ID NO: 640634 - DNA, 25 bp, Rattus norvegicus
tggtgaggtcgcgatgacccctgac

SEQ ID NO: 640635 - DNA, 25 bp, Rattus norvegicus
tggtgaggtcttaccagctgtggcc

SEQ ID NO: 640636 - DNA, 25 bp, Rattus norvegicus
tggtgaggtctttccagctgtggcc

SEQ ID NO: 640637 - DNA, 25 bp, Rattus norvegicus
tggtgagtcccaaaccaaccgtgaa

SEQ ID NO: 640638 - DNA, 25 bp, Rattus norvegicus
tggtgagtcccataccaaccgtgaa

SEQ ID NO: 640639 - DNA, 25 bp, Rattus norvegicus
tggtgagtcgaaagcccacctcgaa

SEQ ID NO: 640640 - DNA, 25 bp, Rattus norvegicus
tggtgagtcgaatgcccacctcgaa

SEQ ID NO: 640641 - DNA, 25 bp, Rattus norvegicus
tggtgataactaacccatgccgcgg

SEQ ID NO: 640642 - DNA, 25 bp, Rattus norvegicus
tggtgataactatcccatgccgcgg

SEQ ID NO: 640643 - DNA, 25 bp, Rattus norvegicus
tggtgatacacaccacctctggaca

SEQ ID NO: 640644 - DNA, 25 bp, Rattus norvegicus
tggtgatacacagcacctctggaca

SEQ ID NO: 640645 - DNA, 25 bp, Rattus norvegicus
tggtgataggccacttctctgtctt

SEQ ID NO: 640646 - DNA, 25 bp, Rattus norvegicus
tggtgataggcctcttctctgtctt

SEQ ID NO: 640647 - DNA, 25 bp, Rattus norvegicus
tggtgatatccccatcacagactgt

SEQ ID NO: 640648 - DNA, 25 bp, Rattus norvegicus
tggtgatatcccgatcacagactgt

SEQ ID NO: 640649 - DNA, 25 bp, Rattus norvegicus
tggtgatcaccgaccgcatcgaaaa

SEQ ID NO: 640650 - DNA, 25 bp, Rattus norvegicus
tggtgatcaccgtccgcatcgaaaa

SEQ ID NO: 640651 - DNA, 25 bp, Rattus norvegicus
tggtgatcatggaaacgagcttcat

SEQ ID NO: 640652 - DNA, 25 bp, Rattus norvegicus
tggtgatcatggtaacgagcttcat

SEQ ID NO: 640653 - DNA, 25 bp, Rattus norvegicus
tggtgatccaccctgtgagttacct

SEQ ID NO: 640654 - DNA, 25 bp, Rattus norvegicus
tggtgatccaccgtgtgagttacct

SEQ ID NO: 640655 - DNA, 25 bp, Rattus norvegicus
tggtgatccagtcttccggcagtct

SEQ ID NO: 640656 - DNA, 25 bp, Rattus norvegicus
tggtgatccagtgttccggcagtct

SEQ ID NO: 640657 - DNA, 25 bp, Rattus norvegicus
tggtgatcccaactggagaagccca

SEQ ID NO: 640658 - DNA, 25 bp, Rattus norvegicus
tggtgatcccaagtggagaagccca

SEQ ID NO: 640659 - DNA, 25 bp, Rattus norvegicus
tggtgatcccataggctgcttgaag

SEQ ID NO: 640660 - DNA, 25 bp, Rattus norvegicus
tggtgatcccattggctgcttgaag

SEQ ID NO: 640661 - DNA, 25 bp, Rattus norvegicus
tggtgatctattaccccacagcaga

SEQ ID NO: 640662 - DNA, 25 bp, Rattus norvegicus
tggtgatctatttccccacagcaga

SEQ ID NO: 640663 - DNA, 25 bp, Rattus norvegicus
tggtgatctgcccatcggagtgtct

SEQ ID NO: 640664 - DNA, 25 bp, Rattus norvegicus
tggtgatctgccgatcggagtgtct

SEQ ID NO: 640665 - DNA, 25 bp, Rattus norvegicus
tggtgatcttagctctaggccgtaa

SEQ ID NO: 640666 - DNA, 25 bp, Rattus norvegicus
tggtgatcttaggtctaggccgtaa

SEQ ID NO: 640667 - DNA, 25 bp, Rattus norvegicus
tggtgatcttttccttaccgacggt

SEQ ID NO: 640668 - DNA, 25 bp, Rattus norvegicus
tggtgatcttttgcttaccgacggt

SEQ ID NO: 640669 - DNA, 25 bp, Rattus norvegicus
tggtgatgatgaatcggcccaaccc

SEQ ID NO: 640670 - DNA, 25 bp, Rattus norvegicus
tggtgatgatgattcggcccaaccc

SEQ ID NO: 640671 - DNA, 25 bp, Rattus norvegicus
tggtgatgcacactacgttggttct

SEQ ID NO: 640672 - DNA, 25 bp, Rattus norvegicus
tggtgatgcacagtacgttggttct

SEQ ID NO: 640673 - DNA, 25 bp, Rattus norvegicus
tggtgatgcgaacccactgccattc

SEQ ID NO: 640674 - DNA, 25 bp, Rattus norvegicus
tggtgatgcgaagccactgccattc

SEQ ID NO: 640675 - DNA, 25 bp, Rattus norvegicus
tggtgatgcgccagctgaccaggat

SEQ ID NO: 640676 - DNA, 25 bp, Rattus norvegicus
tggtgatgcgcctgctgaccaggat

SEQ ID NO: 640677 - DNA, 25 bp, Rattus norvegicus
tggtgatgcgctcctcgcagtcgat

SEQ ID NO: 640678 - DNA, 25 bp, Rattus norvegicus
tggtgatgcgctgctcgcagtcgat

SEQ ID NO: 640679 - DNA, 25 bp, Rattus norvegicus
tggtgatggcgcaacagactctcca

SEQ ID NO: 640680 - DNA, 25 bp, Rattus norvegicus
tggtgatggcgctacagactctcca

SEQ ID NO: 640681 - DNA, 25 bp, Rattus norvegicus
tggtgatggctcaaattcctctgac

SEQ ID NO: 640682 - DNA, 25 bp, Rattus norvegicus
tggtgatggctctaattcctctgac

SEQ ID NO: 640683 - DNA, 25 bp, Rattus norvegicus
tggtgatggcttaccctagccagac

SEQ ID NO: 640684 - DNA, 25 bp, Rattus norvegicus
tggtgatggctttccctagccagac

SEQ ID NO: 640685 - DNA, 25 bp, Rattus norvegicus
tggtgatgggtcatcattcaggccc

SEQ ID NO: 640686 - DNA, 25 bp, Rattus norvegicus
tggtgatgggtcttcattcaggccc

SEQ ID NO: 640687 - DNA, 25 bp, Rattus norvegicus
tggtgatgtagacctgtgatcccag

SEQ ID NO: 640688 - DNA, 25 bp, Rattus norvegicus
tggtgatgtagagctgtgatcccag

SEQ ID NO: 640689 - DNA, 25 bp, Rattus norvegicus
tggtgatgtcccacgagttgtgaaa

SEQ ID NO: 640690 - DNA, 25 bp, Rattus norvegicus
tggtgatgtccctcgagttgtgaaa

SEQ ID NO: 640691 - DNA, 25 bp, Rattus norvegicus
tggtgattcagcattggttctctct

SEQ ID NO: 640692 - DNA, 25 bp, Rattus norvegicus
tggtgattcagctttggttctctct

SEQ ID NO: 640693 - DNA, 25 bp, Rattus norvegicus
tggtgattctagagcctttcaagtt

SEQ ID NO: 640694 - DNA, 25 bp, Rattus norvegicus
tggtgattctagtgcctttcaagtt

SEQ ID NO: 640695 - DNA, 25 bp, Rattus norvegicus
tggtgatttccaatcctcgaaggca

SEQ ID NO: 640696 - DNA, 25 bp, Rattus norvegicus
tggtgatttccattcctcgaaggca

SEQ ID NO: 640697 - DNA, 25 bp, Rattus norvegicus
tggtgatttctcaatctccagggag

SEQ ID NO: 640698 - DNA, 25 bp, Rattus norvegicus
tggtgatttctctatctccagggag

SEQ ID NO: 640699 - DNA, 25 bp, Rattus norvegicus
tggtgcaaaaagctgaccctcggct

SEQ ID NO: 640700 - DNA, 25 bp, Rattus norvegicus
tggtgcaaaaaggtgaccctcggct

SEQ ID NO: 640701 - DNA, 25 bp, Rattus norvegicus
tggtgcaaaagtagtcccgtgtctc

SEQ ID NO: 640702 - DNA, 25 bp, Rattus norvegicus
tggtgcaaaagttgtcccgtgtctc

SEQ ID NO: 640703 - DNA, 25 bp, Rattus norvegicus
tggtgcaacccacagtagaatttat

SEQ ID NO: 640704 - DNA, 25 bp, Rattus norvegicus
tggtgcaacccagagtagaatttat

SEQ ID NO: 640705 - DNA, 25 bp, Rattus norvegicus
tggtgcacacagactcctgatatcc

SEQ ID NO: 640706 - DNA, 25 bp, Rattus norvegicus
tggtgcacacagtctcctgatatcc

SEQ ID NO: 640707 - DNA, 25 bp, Rattus norvegicus
tggtgcacagcacagcctttcagag

SEQ ID NO: 640708 - DNA, 25 bp, Rattus norvegicus
tggtgcacagcagagcctttcagag

SEQ ID NO: 640709 - DNA, 25 bp, Rattus norvegicus
tggtgcaccaaaatacgagcccctg

SEQ ID NO: 640710 - DNA, 25 bp, Rattus norvegicus
tggtgcaccaaattacgagcccctg

SEQ ID NO: 640711 - DNA, 25 bp, Rattus norvegicus
tggtgcaccaggatgtccccatgtc

SEQ ID NO: 640712 - DNA, 25 bp, Rattus norvegicus
tggtgcaccaggttgtccccatgtc

SEQ ID NO: 640713 - DNA, 25 bp, Rattus norvegicus
tggtgcactagacagcctggacttc

SEQ ID NO: 640714 - DNA, 25 bp, Rattus norvegicus
tggtgcactagagagcctggacttc

SEQ ID NO: 640715 - DNA, 25 bp, Rattus norvegicus
tggtgcactgtcacactggaatgga

SEQ ID NO: 640716 - DNA, 25 bp, Rattus norvegicus
tggtgcactgtctcactggaatgga

SEQ ID NO: 640717 - DNA, 25 bp, Rattus norvegicus
tggtgcacttcgatgcctggaacat

SEQ ID NO: 640718 - DNA, 25 bp, Rattus norvegicus
tggtgcacttcgttgcctggaacat

SEQ ID NO: 640719 - DNA, 25 bp, Rattus norvegicus
tggtgcagaactatatgcagatgaa

SEQ ID NO: 640720 - DNA, 25 bp, Rattus norvegicus
tggtgcagaactttatgcagatgaa

SEQ ID NO: 640721 - DNA, 25 bp, Rattus norvegicus
tggtgcagaccacctaagttttaga

SEQ ID NO: 640722 - DNA, 25 bp, Rattus norvegicus
tggtgcagaccagctaagttttaga

SEQ ID NO: 640723 - DNA, 25 bp, Rattus norvegicus
tggtgcagatgactcctacctagct

SEQ ID NO: 640724 - DNA, 25 bp, Rattus norvegicus
tggtgcagatgagtcctacctagct

SEQ ID NO: 640725 - DNA, 25 bp, Rattus norvegicus
tggtgcagccaacgacacagttacc

SEQ ID NO: 640726 - DNA, 25 bp, Rattus norvegicus
tggtgcagccaaggacacagttacc

SEQ ID NO: 640727 - DNA, 25 bp, Rattus norvegicus
tggtgcagcctgcattcctggtctc

SEQ ID NO: 640728 - DNA, 25 bp, Rattus norvegicus
tggtgcagcctggattcctggtctc

SEQ ID NO: 640729 - DNA, 25 bp, Rattus norvegicus
tggtgcaggtccacactctaatctg

SEQ ID NO: 640730 - DNA, 25 bp, Rattus norvegicus
tggtgcaggtcctcactctaatctg

SEQ ID NO: 640731 - DNA, 25 bp, Rattus norvegicus
tggtgcagtaccaggaggaacccct

SEQ ID NO: 640732 - DNA, 25 bp, Rattus norvegicus
tggtgcagtacctggaggaacccct

SEQ ID NO: 640733 - DNA, 25 bp, Rattus norvegicus
tggtgcagtctcaaaggcctcacaa

SEQ ID NO: 640734 - DNA, 25 bp, Rattus norvegicus
tggtgcagtctctaaggcctcacaa

SEQ ID NO: 640735 - DNA, 25 bp, Rattus norvegicus
tggtgcatgcctatagccctaacac

SEQ ID NO: 640736 - DNA, 25 bp, Rattus norvegicus
tggtgcatgcctttagccctaacac

SEQ ID NO: 640737 - DNA, 25 bp, Rattus norvegicus
tggtgcatggctattctgtctcact

SEQ ID NO: 640738 - DNA, 25 bp, Rattus norvegicus
tggtgcatggcttttctgtctcact

SEQ ID NO: 640739 - DNA, 25 bp, Rattus norvegicus
tggtgcatgtacacgactgccgctg

SEQ ID NO: 640740 - DNA, 25 bp, Rattus norvegicus
tggtgcatgtactcgactgccgctg

SEQ ID NO: 640741 - DNA, 25 bp, Rattus norvegicus
tggtgcatttaacgcaactggtaat

SEQ ID NO: 640742 - DNA, 25 bp, Rattus norvegicus
tggtgcatttaaggcaactggtaat

SEQ ID NO: 640743 - DNA, 25 bp, Rattus norvegicus
tggtgcatttctcatggcagccttg

SEQ ID NO: 640744 - DNA, 25 bp, Rattus norvegicus
tggtgcatttctgatggcagccttg

SEQ ID NO: 640745 - DNA, 25 bp, Rattus norvegicus
tggtgccaacatatttctattgctg

SEQ ID NO: 640746 - DNA, 25 bp, Rattus norvegicus
tggtgccaacatttttctattgctg

SEQ ID NO: 640747 - DNA, 25 bp, Rattus norvegicus
tggtgccacacccaaagctcctttg

SEQ ID NO: 640748 - DNA, 25 bp, Rattus norvegicus
tggtgccacaccgaaagctcctttg

SEQ ID NO: 640749 - DNA, 25 bp, Rattus norvegicus
tggtgccaccctacgaggaggtgta

SEQ ID NO: 640750 - DNA, 25 bp, Rattus norvegicus
tggtgccacccttcgaggaggtgta

SEQ ID NO: 640751 - DNA, 25 bp, Rattus norvegicus
tggtgccacctgctaaaggtcacgt

SEQ ID NO: 640752 - DNA, 25 bp, Rattus norvegicus
tggtgccacctggtaaaggtcacgt

SEQ ID NO: 640753 - DNA, 25 bp, Rattus norvegicus
tggtgccactccataggctagagct

SEQ ID NO: 640754 - DNA, 25 bp, Rattus norvegicus
tggtgccactccttaggctagagct

SEQ ID NO: 640755 - DNA, 25 bp, Rattus norvegicus
tggtgccagacacttgaatctatct

SEQ ID NO: 640756 - DNA, 25 bp, Rattus norvegicus
tggtgccagacagttgaatctatct

SEQ ID NO: 640757 - DNA, 25 bp, Rattus norvegicus
tggtgccaggcacaggacaaacttt

SEQ ID NO: 640758 - DNA, 25 bp, Rattus norvegicus
tggtgccaggcagaggacaaacttt

SEQ ID NO: 640759 - DNA, 25 bp, Rattus norvegicus
tggtgccagggcagctgaacaaaga

SEQ ID NO: 640760 - DNA, 25 bp, Rattus norvegicus
tggtgccagggctgctgaacaaaga

SEQ ID NO: 640761 - DNA, 25 bp, Rattus norvegicus
tggtgccatctccagaacgagtgca

SEQ ID NO: 640762 - DNA, 25 bp, Rattus norvegicus
tggtgccatctcgagaacgagtgca

SEQ ID NO: 640763 - DNA, 25 bp, Rattus norvegicus
tggtgccatgcaacccaggcaggaa

SEQ ID NO: 640764 - DNA, 25 bp, Rattus norvegicus
tggtgccatgcatcccaggcaggaa

SEQ ID NO: 640765 - DNA, 25 bp, Rattus norvegicus
tggtgccatggacagcctggtaaat

SEQ ID NO: 640766 - DNA, 25 bp, Rattus norvegicus
tggtgccatggagagcctggtaaat

SEQ ID NO: 640767 - DNA, 25 bp, Rattus norvegicus
tggtgccattggacatctcttatgc

SEQ ID NO: 640768 - DNA, 25 bp, Rattus norvegicus
tggtgccattggtcatctcttatgc

SEQ ID NO: 640769 - DNA, 25 bp, Rattus norvegicus
tggtgcccaagcactctaggaacta

SEQ ID NO: 640770 - DNA, 25 bp, Rattus norvegicus
tggtgcccaagctctctaggaacta

SEQ ID NO: 640771 - DNA, 25 bp, Rattus norvegicus
tggtgcccaaggatgtgaacgctgc

SEQ ID NO: 640772 - DNA, 25 bp, Rattus norvegicus
tggtgcccaaggttgtgaacgctgc

SEQ ID NO: 640773 - DNA, 25 bp, Rattus norvegicus
tggtgcccacacaggctagaggaca

SEQ ID NO: 640774 - DNA, 25 bp, Rattus norvegicus
tggtgcccacacagtaagaaggtca

SEQ ID NO: 640775 - DNA, 25 bp, Rattus norvegicus
tggtgcccacactggctagaggaca

SEQ ID NO: 640776 - DNA, 25 bp, Rattus norvegicus
tggtgcccacactgtaagaaggtca

SEQ ID NO: 640777 - DNA, 25 bp, Rattus norvegicus
tggtgcccactcatcgggtgaggcc

SEQ ID NO: 640778 - DNA, 25 bp, Rattus norvegicus
tggtgcccactcttcgggtgaggcc

SEQ ID NO: 640779 - DNA, 25 bp, Rattus norvegicus
tggtgcccagtgctgtaaactgagt

SEQ ID NO: 640780 - DNA, 25 bp, Rattus norvegicus
tggtgcccagtggtgtaaactgagt

SEQ ID NO: 640781 - DNA, 25 bp, Rattus norvegicus
tggtgcccatttatgcgacctacaa

SEQ ID NO: 640782 - DNA, 25 bp, Rattus norvegicus
tggtgcccatttttgcgacctacaa

SEQ ID NO: 640783 - DNA, 25 bp, Rattus norvegicus
tggtgccccaagcaacacggagcaa

SEQ ID NO: 640784 - DNA, 25 bp, Rattus norvegicus
tggtgccccaaggaacacggagcaa

SEQ ID NO: 640785 - DNA, 25 bp, Rattus norvegicus
tggtgccccttcaatagcagagtta

SEQ ID NO: 640786 - DNA, 25 bp, Rattus norvegicus
tggtgccccttctatagcagagtta

SEQ ID NO: 640787 - DNA, 25 bp, Rattus norvegicus
tggtgccctcaactgtccagggatt

SEQ ID NO: 640788 - DNA, 25 bp, Rattus norvegicus
tggtgccctcaagtgtccagggatt

SEQ ID NO: 640789 - DNA, 25 bp, Rattus norvegicus
tggtgccctgagagtcaatttctga

SEQ ID NO: 640790 - DNA, 25 bp, Rattus norvegicus
tggtgccctgagtgtcaatttctga

SEQ ID NO: 640791 - DNA, 25 bp, Rattus norvegicus
tggtgccctgatattttaacactgg

SEQ ID NO: 640792 - DNA, 25 bp, Rattus norvegicus
tggtgccctgattttttaacactgg

SEQ ID NO: 640793 - DNA, 25 bp, Rattus norvegicus
tggtgccctggacgatagcttcgca

SEQ ID NO: 640794 - DNA, 25 bp, Rattus norvegicus
tggtgccctggactatgtccccaag

SEQ ID NO: 640795 - DNA, 25 bp, Rattus norvegicus
tggtgccctggaggatagcttcgca

SEQ ID NO: 640796 - DNA, 25 bp, Rattus norvegicus
tggtgccctggagtatgtccccaag

SEQ ID NO: 640797 - DNA, 25 bp, Rattus norvegicus
tggtgcccttttctgctttaaataa

SEQ ID NO: 640798 - DNA, 25 bp, Rattus norvegicus
tggtgcccttttgtgctttaaataa

SEQ ID NO: 640799 - DNA, 25 bp, Rattus norvegicus
tggtgccgcacaagaacccggtggc

SEQ ID NO: 640800 - DNA, 25 bp, Rattus norvegicus
tggtgccgcacatgaacccggtggc

SEQ ID NO: 640801 - DNA, 25 bp, Rattus norvegicus
tggtgccggagccattctcagtgat

SEQ ID NO: 640802 - DNA, 25 bp, Rattus norvegicus
tggtgccggagcgattctcagtgat

SEQ ID NO: 640803 - DNA, 25 bp, Rattus norvegicus
tggtgcctacaccatttggttttgt

SEQ ID NO: 640804 - DNA, 25 bp, Rattus norvegicus
tggtgcctacacgatttggttttgt

SEQ ID NO: 640805 - DNA, 25 bp, Rattus norvegicus
tggtgcctaccaagcaagactgcag

SEQ ID NO: 640806 - DNA, 25 bp, Rattus norvegicus
tggtgcctaccatgcaagactgcag

SEQ ID NO: 640807 - DNA, 25 bp, Rattus norvegicus
tggtgcctacctctaccgggtaaga

SEQ ID NO: 640808 - DNA, 25 bp, Rattus norvegicus
tggtgcctacctgtaccgggtaaga

SEQ ID NO: 640809 - DNA, 25 bp, Rattus norvegicus
tggtgcctaggacccaggatgccca

SEQ ID NO: 640810 - DNA, 25 bp, Rattus norvegicus
tggtgcctaggagccaggatgccca

SEQ ID NO: 640811 - DNA, 25 bp, Rattus norvegicus
tggtgcctatccaaaatatttctct

SEQ ID NO: 640812 - DNA, 25 bp, Rattus norvegicus
tggtgcctatcctaaatatttctct

SEQ ID NO: 640813 - DNA, 25 bp, Rattus norvegicus
tggtgcctcaacattcccaggatat

SEQ ID NO: 640814 - DNA, 25 bp, Rattus norvegicus
tggtgcctcaactttcccaggatat

SEQ ID NO: 640815 - DNA, 25 bp, Rattus norvegicus
tggtgcctcagtcgtcaggctgtct

SEQ ID NO: 640816 - DNA, 25 bp, Rattus norvegicus
tggtgcctcagtggtcaggctgtct

SEQ ID NO: 640817 - DNA, 25 bp, Rattus norvegicus
tggtgcctcccacagaaacgaacac

SEQ ID NO: 640818 - DNA, 25 bp, Rattus norvegicus
tggtgcctcccagagaaacgaacac

SEQ ID NO: 640819 - DNA, 25 bp, Rattus norvegicus
tggtgcctccgacattgaggatcac

SEQ ID NO: 640820 - DNA, 25 bp, Rattus norvegicus
tggtgcctccgagattgaggatcac

SEQ ID NO: 640821 - DNA, 25 bp, Rattus norvegicus
tggtgcctcctcagaaaagtctcga

SEQ ID NO: 640822 - DNA, 25 bp, Rattus norvegicus
tggtgcctcctccaagggccataaa

SEQ ID NO: 640823 - DNA, 25 bp, Rattus norvegicus
tggtgcctcctcgaagggccataaa

SEQ ID NO: 640824 - DNA, 25 bp, Rattus norvegicus
tggtgcctcctctgaaaagtctcga

SEQ ID NO: 640825 - DNA, 25 bp, Rattus norvegicus
tggtgcctcctgctgatatcgacat

SEQ ID NO: 640826 - DNA, 25 bp, Rattus norvegicus
tggtgcctcctggtgatatcgacat

SEQ ID NO: 640827 - DNA, 25 bp, Rattus norvegicus
tggtgcctccttagctgataggaag

SEQ ID NO: 640828 - DNA, 25 bp, Rattus norvegicus
tggtgcctcctttgctgataggaag

SEQ ID NO: 640829 - DNA, 25 bp, Rattus norvegicus
tggtgcctcgcaacagacttcggtg

SEQ ID NO: 640830 - DNA, 25 bp, Rattus norvegicus
tggtgcctcgcatcagacttcggtg

SEQ ID NO: 640831 - DNA, 25 bp, Rattus norvegicus
tggtgcctcggtcttggccaaactc

SEQ ID NO: 640832 - DNA, 25 bp, Rattus norvegicus
tggtgcctcggtgttggccaaactc

SEQ ID NO: 640833 - DNA, 25 bp, Rattus norvegicus
tggtgcctgagccattcagtactga

SEQ ID NO: 640834 - DNA, 25 bp, Rattus norvegicus
tggtgcctgagcgattcagtactga

SEQ ID NO: 640835 - DNA, 25 bp, Rattus norvegicus
tggtgcctgcagaggccaaaagaag

SEQ ID NO: 640836 - DNA, 25 bp, Rattus norvegicus
tggtgcctgcagtggccaaaagaag

SEQ ID NO: 640837 - DNA, 25 bp, Rattus norvegicus
tggtgcctgccccacatattggagg

SEQ ID NO: 640838 - DNA, 25 bp, Rattus norvegicus
tggtgcctgcccgacatattggagg

SEQ ID NO: 640839 - DNA, 25 bp, Rattus norvegicus
tggtgcctgctaatcgttaactcga

SEQ ID NO: 640840 - DNA, 25 bp, Rattus norvegicus
tggtgcctgctattcgttaactcga

SEQ ID NO: 640841 - DNA, 25 bp, Rattus norvegicus
tggtgccttccaactgcgcggtgag

SEQ ID NO: 640842 - DNA, 25 bp, Rattus norvegicus
tggtgccttccatctgcgcggtgag

SEQ ID NO: 640843 - DNA, 25 bp, Rattus norvegicus
tggtgccttgttactgcactaacaa

SEQ ID NO: 640844 - DNA, 25 bp, Rattus norvegicus
tggtgccttgtttctgcactaacaa

SEQ ID NO: 640845 - DNA, 25 bp, Rattus norvegicus
tggtgcctttctaggaaccctttga

SEQ ID NO: 640846 - DNA, 25 bp, Rattus norvegicus
tggtgcctttcttggaaccctttga

SEQ ID NO: 640847 - DNA, 25 bp, Rattus norvegicus
tggtgcctttgaagttacggttact

SEQ ID NO: 640848 - DNA, 25 bp, Rattus norvegicus
tggtgcctttgatgttacggttact

SEQ ID NO: 640849 - DNA, 25 bp, Rattus norvegicus
tggtgcctttgtcgccaaacactta

SEQ ID NO: 640850 - DNA, 25 bp, Rattus norvegicus
tggtgcctttgtggccaaacactta

SEQ ID NO: 640851 - DNA, 25 bp, Rattus norvegicus
tggtgcgattttacgttagcctcta

SEQ ID NO: 640852 - DNA, 25 bp, Rattus norvegicus
tggtgcgatttttcgttagcctcta

SEQ ID NO: 640853 - DNA, 25 bp, Rattus norvegicus
tggtgcgcagatatcagggcctctc

SEQ ID NO: 640854 - DNA, 25 bp, Rattus norvegicus
tggtgcgcagatttcagggcctctc

SEQ ID NO: 640855 - DNA, 25 bp, Rattus norvegicus
tggtgcgcaggtatatctccacaag

SEQ ID NO: 640856 - DNA, 25 bp, Rattus norvegicus
tggtgcgcaggtttatctccacaag

SEQ ID NO: 640857 - DNA, 25 bp, Rattus norvegicus
tggtgcgcccgcatagaatgtctac

SEQ ID NO: 640858 - DNA, 25 bp, Rattus norvegicus
tggtgcgcccgcttagaatgtctac

SEQ ID NO: 640859 - DNA, 25 bp, Rattus norvegicus
tggtgcgctcacagaccatggttga

SEQ ID NO: 640860 - DNA, 25 bp, Rattus norvegicus
tggtgcgctcactgaccatggttga

SEQ ID NO: 640861 - DNA, 25 bp, Rattus norvegicus
tggtgcggcaccagaaagcgcacgt

SEQ ID NO: 640862 - DNA, 25 bp, Rattus norvegicus
tggtgcggcaccatgtgtctttacc

SEQ ID NO: 640863 - DNA, 25 bp, Rattus norvegicus
tggtgcggcacctgaaagcgcacgt

SEQ ID NO: 640864 - DNA, 25 bp, Rattus norvegicus
tggtgcggcaccttgtgtctttacc

SEQ ID NO: 640865 - DNA, 25 bp, Rattus norvegicus
tggtgcggcgccaacggcgggagga

SEQ ID NO: 640866 - DNA, 25 bp, Rattus norvegicus
tggtgcggcgcctacggcgggagga

SEQ ID NO: 640867 - DNA, 25 bp, Rattus norvegicus
tggtgcggcttcacgccgctgtgaa

SEQ ID NO: 640868 - DNA, 25 bp, Rattus norvegicus
tggtgcggcttctcgccgctgtgaa

SEQ ID NO: 640869 - DNA, 25 bp, Rattus norvegicus
tggtgcgtcatcatcgccacattgg

SEQ ID NO: 640870 - DNA, 25 bp, Rattus norvegicus
tggtgcgtcatcttcgccacattgg

SEQ ID NO: 640871 - DNA, 25 bp, Rattus norvegicus
tggtgcgtcgcacccactatgagga

SEQ ID NO: 640872 - DNA, 25 bp, Rattus norvegicus
tggtgcgtcgcagccactatgagga

SEQ ID NO: 640873 - DNA, 25 bp, Rattus norvegicus
tggtgcgtgcaaacagagggccttc

SEQ ID NO: 640874 - DNA, 25 bp, Rattus norvegicus
tggtgcgtgcaatcagagggccttc

SEQ ID NO: 640875 - DNA, 25 bp, Rattus norvegicus
tggtgcgtgtgccttgtctagacat

SEQ ID NO: 640876 - DNA, 25 bp, Rattus norvegicus
tggtgcgtgtgcgttgtctagacat

SEQ ID NO: 640877 - DNA, 25 bp, Rattus norvegicus
tggtgcgttctcagcagatgggaat

SEQ ID NO: 640878 - DNA, 25 bp, Rattus norvegicus
tggtgcgttctctgcagatgggaat

SEQ ID NO: 640879 - DNA, 25 bp, Rattus norvegicus
tggtgctaacaacccctgccctggg

SEQ ID NO: 640880 - DNA, 25 bp, Rattus norvegicus
tggtgctaacaagccctgccctggg

SEQ ID NO: 640881 - DNA, 25 bp, Rattus norvegicus
tggtgctaagccagatgcgacctga

SEQ ID NO: 640882 - DNA, 25 bp, Rattus norvegicus
tggtgctaagcctgatgcgacctga

SEQ ID NO: 640883 - DNA, 25 bp, Rattus norvegicus
tggtgctactccaggacatggctgg

SEQ ID NO: 640884 - DNA, 25 bp, Rattus norvegicus
tggtgctactcctggacatggctgg

SEQ ID NO: 640885 - DNA, 25 bp, Rattus norvegicus
tggtgctaggcacctcggacgccaa

SEQ ID NO: 640886 - DNA, 25 bp, Rattus norvegicus
tggtgctaggcagctcggacgccaa

SEQ ID NO: 640887 - DNA, 25 bp, Rattus norvegicus
tggtgctatgcaccctccactcaag

SEQ ID NO: 640888 - DNA, 25 bp, Rattus norvegicus
tggtgctatgcagcctccactcaag

SEQ ID NO: 640889 - DNA, 25 bp, Rattus norvegicus
tggtgctattgcaggtatgcctgcc

SEQ ID NO: 640890 - DNA, 25 bp, Rattus norvegicus
tggtgctattgctggtatgcctgcc

SEQ ID NO: 640891 - DNA, 25 bp, Rattus norvegicus
tggtgctatttgaggtgctggctca

SEQ ID NO: 640892 - DNA, 25 bp, Rattus norvegicus
tggtgctatttgtggtgctggctca

SEQ ID NO: 640893 - DNA, 25 bp, Rattus norvegicus
tggtgctcagtgagacttcgcacat

SEQ ID NO: 640894 - DNA, 25 bp, Rattus norvegicus
tggtgctcagtgtgacttcgcacat

SEQ ID NO: 640895 - DNA, 25 bp, Rattus norvegicus
tggtgctcatacaactctggctaag

SEQ ID NO: 640896 - DNA, 25 bp, Rattus norvegicus
tggtgctcatactactctggctaag

SEQ ID NO: 640897 - DNA, 25 bp, Rattus norvegicus
tggtgctcatctagttagtctccct

SEQ ID NO: 640898 - DNA, 25 bp, Rattus norvegicus
tggtgctcatcttgttagtctccct

SEQ ID NO: 640899 - DNA, 25 bp, Rattus norvegicus
tggtgctccacacgtactctatgcg

SEQ ID NO: 640900 - DNA, 25 bp, Rattus norvegicus
tggtgctccacaggtactctatgcg

SEQ ID NO: 640901 - DNA, 25 bp, Rattus norvegicus
tggtgctccataacacctgcgagga

SEQ ID NO: 640902 - DNA, 25 bp, Rattus norvegicus
tggtgctccatatcacctgcgagga

SEQ ID NO: 640903 - DNA, 25 bp, Rattus norvegicus
tggtgctcctccaaactgtgcagaa

SEQ ID NO: 640904 - DNA, 25 bp, Rattus norvegicus
tggtgctcctcctaactgtgcagaa

SEQ ID NO: 640905 - DNA, 25 bp, Rattus norvegicus
tggtgctccttgaatgtcctgtgac

SEQ ID NO: 640906 - DNA, 25 bp, Rattus norvegicus
tggtgctccttgtatgtcctgtgac

SEQ ID NO: 640907 - DNA, 25 bp, Rattus norvegicus
tggtgctcctttcgcacactgcatg

SEQ ID NO: 640908 - DNA, 25 bp, Rattus norvegicus
tggtgctcctttcggttttcctggc

SEQ ID NO: 640909 - DNA, 25 bp, Rattus norvegicus
tggtgctcctttggcacactgcatg

SEQ ID NO: 640910 - DNA, 25 bp, Rattus norvegicus
tggtgctcctttgggttttcctggc

SEQ ID NO: 640911 - DNA, 25 bp, Rattus norvegicus
tggtgctctcgaagtcgcagtagga

SEQ ID NO: 640912 - DNA, 25 bp, Rattus norvegicus
tggtgctctcgatgtcgcagtagga

SEQ ID NO: 640913 - DNA, 25 bp, Rattus norvegicus
tggtgctctgaaatgacctacccaa

SEQ ID NO: 640914 - DNA, 25 bp, Rattus norvegicus
tggtgctctgaattgacctacccaa

SEQ ID NO: 640915 - DNA, 25 bp, Rattus norvegicus
tggtgctctggcactagtggcacaa

SEQ ID NO: 640916 - DNA, 25 bp, Rattus norvegicus
tggtgctctggctctagtggcacaa

SEQ ID NO: 640917 - DNA, 25 bp, Rattus norvegicus
tggtgctctgttctacgacctgtac

SEQ ID NO: 640918 - DNA, 25 bp, Rattus norvegicus
tggtgctctgttgtacgacctgtac

SEQ ID NO: 640919 - DNA, 25 bp, Rattus norvegicus
tggtgctcttcactgttgcctgtca

SEQ ID NO: 640920 - DNA, 25 bp, Rattus norvegicus
tggtgctcttcagtgttgcctgtca

SEQ ID NO: 640921 - DNA, 25 bp, Rattus norvegicus
tggtgctctttgattccttatattc

SEQ ID NO: 640922 - DNA, 25 bp, Rattus norvegicus
tggtgctctttgtttccttatattc

SEQ ID NO: 640923 - DNA, 25 bp, Rattus norvegicus
tggtgctgaagcctccatgtttaga

SEQ ID NO: 640924 - DNA, 25 bp, Rattus norvegicus
tggtgctgaagcgtccatgtttaga

SEQ ID NO: 640925 - DNA, 25 bp, Rattus norvegicus
tggtgctgagtaagtcgtggagtct

SEQ ID NO: 640926 - DNA, 25 bp, Rattus norvegicus
tggtgctgagtatgtcgtggagtct

SEQ ID NO: 640927 - DNA, 25 bp, Rattus norvegicus
tggtgctgagttaccgcctgagtca

SEQ ID NO: 640928 - DNA, 25 bp, Rattus norvegicus
tggtgctgagtttccgcctgagtca

SEQ ID NO: 640929 - DNA, 25 bp, Rattus norvegicus
tggtgctgccaaagggtgctttcct

SEQ ID NO: 640930 - DNA, 25 bp, Rattus norvegicus
tggtgctgccaatgggtgctttcct

SEQ ID NO: 640931 - DNA, 25 bp, Rattus norvegicus
tggtgctgcgccactacgaggacat

SEQ ID NO: 640932 - DNA, 25 bp, Rattus norvegicus
tggtgctgcgcctctacgaggacat

SEQ ID NO: 640933 - DNA, 25 bp, Rattus norvegicus
tggtgctgctcgagcacacggagca

SEQ ID NO: 640934 - DNA, 25 bp, Rattus norvegicus
tggtgctgctcgtgcacacggagca

SEQ ID NO: 640935 - DNA, 25 bp, Rattus norvegicus
tggtgctggagaacagcgactccct

SEQ ID NO: 640936 - DNA, 25 bp, Rattus norvegicus
tggtgctggagatcagcgactccct

SEQ ID NO: 640937 - DNA, 25 bp, Rattus norvegicus
tggtgctggtggattaatcccagca

SEQ ID NO: 640938 - DNA, 25 bp, Rattus norvegicus
tggtgctggtggtttaatcccagca

SEQ ID NO: 640939 - DNA, 25 bp, Rattus norvegicus
tggtgctgtagtaacactgttctca

SEQ ID NO: 640940 - DNA, 25 bp, Rattus norvegicus
tggtgctgtagttacactgttctca

SEQ ID NO: 640941 - DNA, 25 bp, Rattus norvegicus
tggtgctgtgatctgaattcaggtc

SEQ ID NO: 640942 - DNA, 25 bp, Rattus norvegicus
tggtgctgtgatgtgaattcaggtc

SEQ ID NO: 640943 - DNA, 25 bp, Rattus norvegicus
tggtgctgtggcctaggcccttcct

SEQ ID NO: 640944 - DNA, 25 bp, Rattus norvegicus
tggtgctgtggcgtaggcccttcct

SEQ ID NO: 640945 - DNA, 25 bp, Rattus norvegicus
tggtgctgtggtctgactgactttc

SEQ ID NO: 640946 - DNA, 25 bp, Rattus norvegicus
tggtgctgtggtgtgactgactttc

SEQ ID NO: 640947 - DNA, 25 bp, Rattus norvegicus
tggtgctgttcacagccaaactgga

SEQ ID NO: 640948 - DNA, 25 bp, Rattus norvegicus
tggtgctgttcagagccaaactgga

SEQ ID NO: 640949 - DNA, 25 bp, Rattus norvegicus
tggtgcttcaaacctctgcaagaga

SEQ ID NO: 640950 - DNA, 25 bp, Rattus norvegicus
tggtgcttcaaagctctgcaagaga

SEQ ID NO: 640951 - DNA, 25 bp, Rattus norvegicus
tggtgcttcacaagaacgcccagga

SEQ ID NO: 640952 - DNA, 25 bp, Rattus norvegicus
tggtgcttcacatgaacgcccagga

SEQ ID NO: 640953 - DNA, 25 bp, Rattus norvegicus
tggtgcttccaacccaaaagacacg

SEQ ID NO: 640954 - DNA, 25 bp, Rattus norvegicus
tggtgcttccaagccaaaagacacg

SEQ ID NO: 640955 - DNA, 25 bp, Rattus norvegicus
tggtgcttcccacacatcatcacta

SEQ ID NO: 640956 - DNA, 25 bp, Rattus norvegicus
tggtgcttcccagacatcatcacta

SEQ ID NO: 640957 - DNA, 25 bp, Rattus norvegicus
tggtgcttccccaacaggtatagtc

SEQ ID NO: 640958 - DNA, 25 bp, Rattus norvegicus
tggtgcttcccctacaggtatagtc

SEQ ID NO: 640959 - DNA, 25 bp, Rattus norvegicus
tggtgcttcttaaaggccttcttgc

SEQ ID NO: 640960 - DNA, 25 bp, Rattus norvegicus
tggtgcttcttataggccttcttgc

SEQ ID NO: 640961 - DNA, 25 bp, Rattus norvegicus
tggtgcttgctcagatggaaggact

SEQ ID NO: 640962 - DNA, 25 bp, Rattus norvegicus
tggtgcttgctctgatggaaggact

SEQ ID NO: 640963 - DNA, 25 bp, Rattus norvegicus
tggtgcttggacacttcttagctgt

SEQ ID NO: 640964 - DNA, 25 bp, Rattus norvegicus
tggtgcttggactcttcttagctgt

SEQ ID NO: 640965 - DNA, 25 bp, Rattus norvegicus
tggtgcttggccacagaacatctca

SEQ ID NO: 640966 - DNA, 25 bp, Rattus norvegicus
tggtgcttggcctcagaacatctca

SEQ ID NO: 640967 - DNA, 25 bp, Rattus norvegicus
tggtgcttggctaagcaggtcactt

SEQ ID NO: 640968 - DNA, 25 bp, Rattus norvegicus
tggtgcttggcttagcaggtcactt

SEQ ID NO: 640969 - DNA, 25 bp, Rattus norvegicus
tggtgctttgaactgcagctcctca

SEQ ID NO: 640970 - DNA, 25 bp, Rattus norvegicus
tggtgctttgaagtgcagctcctca

SEQ ID NO: 640971 - DNA, 25 bp, Rattus norvegicus
tggtgctttgaccttgacccatgtc

SEQ ID NO: 640972 - DNA, 25 bp, Rattus norvegicus
tggtgctttgacgttgacccatgtc

SEQ ID NO: 640973 - DNA, 25 bp, Rattus norvegicus
tggtgctttgtactactggtccagc

SEQ ID NO: 640974 - DNA, 25 bp, Rattus norvegicus
tggtgctttgtagtactggtccagc

SEQ ID NO: 640975 - DNA, 25 bp, Rattus norvegicus
tggtgcttttgtccctaggttttat

SEQ ID NO: 640976 - DNA, 25 bp, Rattus norvegicus
tggtgcttttgtgcctaggttttat

SEQ ID NO: 640977 - DNA, 25 bp, Rattus norvegicus
tggtgcttttttcccacatcacaaa

SEQ ID NO: 640978 - DNA, 25 bp, Rattus norvegicus
tggtgcttttttgccacatcacaaa

SEQ ID NO: 640979 - DNA, 25 bp, Rattus norvegicus
tggtggaacactacggatgctgcgc

SEQ ID NO: 640980 - DNA, 25 bp, Rattus norvegicus
tggtggaacacttcggatgctgcgc

SEQ ID NO: 640981 - DNA, 25 bp, Rattus norvegicus
tggtggaagaccagcgcctgcgcct

SEQ ID NO: 640982 - DNA, 25 bp, Rattus norvegicus
tggtggaagacctgcgcctgcgcct

SEQ ID NO: 640983 - DNA, 25 bp, Rattus norvegicus
tggtggaagagtccccactgttgac

SEQ ID NO: 640984 - DNA, 25 bp, Rattus norvegicus
tggtggaagagtgcccactgttgac

SEQ ID NO: 640985 - DNA, 25 bp, Rattus norvegicus
tggtggaagatcatgcccctggctc

SEQ ID NO: 640986 - DNA, 25 bp, Rattus norvegicus
tggtggaagatcttgcccctggctc

SEQ ID NO: 640987 - DNA, 25 bp, Rattus norvegicus
tggtggaagcacaccgcgcacagcg

SEQ ID NO: 640988 - DNA, 25 bp, Rattus norvegicus
tggtggaagcactccgcgcacagcg

SEQ ID NO: 640989 - DNA, 25 bp, Rattus norvegicus
tggtggaataccagcgggctgtcat

SEQ ID NO: 640990 - DNA, 25 bp, Rattus norvegicus
tggtggaatacctgcgggctgtcat

SEQ ID NO: 640991 - DNA, 25 bp, Rattus norvegicus
tggtggacacacatggccagcatat

SEQ ID NO: 640992 - DNA, 25 bp, Rattus norvegicus
tggtggacacacttggccagcatat

SEQ ID NO: 640993 - DNA, 25 bp, Rattus norvegicus
tggtggaccaccagataattttgca

SEQ ID NO: 640994 - DNA, 25 bp, Rattus norvegicus
tggtggaccaccagtttttgcacaa

SEQ ID NO: 640995 - DNA, 25 bp, Rattus norvegicus
tggtggaccacctgataattttgca

SEQ ID NO: 640996 - DNA, 25 bp, Rattus norvegicus
tggtggaccacctgtttttgcacaa

SEQ ID NO: 640997 - DNA, 25 bp, Rattus norvegicus
tggtggaccaggacagcctagcaca

SEQ ID NO: 640998 - DNA, 25 bp, Rattus norvegicus
tggtggaccaggtcagcctagcaca

SEQ ID NO: 640999 - DNA, 25 bp, Rattus norvegicus
tggtggacgccaactgcgataagat

SEQ ID NO: 641000 - DNA, 25 bp, Rattus norvegicus
tggtggacgccatctgcgataagat

SEQ ID NO: 641001 - DNA, 25 bp, Rattus norvegicus
tggtggacgctcaggtgaagctccc

SEQ ID NO: 641002 - DNA, 25 bp, Rattus norvegicus
tggtggacgctctggtgaagctccc

SEQ ID NO: 641003 - DNA, 25 bp, Rattus norvegicus
tggtggacgtgcaacccagcgactc

SEQ ID NO: 641004 - DNA, 25 bp, Rattus norvegicus
tggtggacgtgctacccagcgactc

SEQ ID NO: 641005 - DNA, 25 bp, Rattus norvegicus
tggtggactcacatgggtggccatc

SEQ ID NO: 641006 - DNA, 25 bp, Rattus norvegicus
tggtggactcacttgggtggccatc

SEQ ID NO: 641007 - DNA, 25 bp, Rattus norvegicus
tggtggacttctcacttggagtgtc

SEQ ID NO: 641008 - DNA, 25 bp, Rattus norvegicus
tggtggacttctgacttggagtgtc

SEQ ID NO: 641009 - DNA, 25 bp, Rattus norvegicus
tggtggagaccgacccggacttcga

SEQ ID NO: 641010 - DNA, 25 bp, Rattus norvegicus
tggtggagaccgtcccggacttcga

SEQ ID NO: 641011 - DNA, 25 bp, Rattus norvegicus
tggtggagactgagcaccccagcat

SEQ ID NO: 641012 - DNA, 25 bp, Rattus norvegicus
tggtggagactgtgcaccccagcat

SEQ ID NO: 641013 - DNA, 25 bp, Rattus norvegicus
tggtggagagaaactgggccccttt

SEQ ID NO: 641014 - DNA, 25 bp, Rattus norvegicus
tggtggagagaatctgggccccttt

SEQ ID NO: 641015 - DNA, 25 bp, Rattus norvegicus
tggtggagcctgaagagacctcctt

SEQ ID NO: 641016 - DNA, 25 bp, Rattus norvegicus
tggtggagcctgtagagacctcctt

SEQ ID NO: 641017 - DNA, 25 bp, Rattus norvegicus
tggtggagccttcagtcgaatgtca

SEQ ID NO: 641018 - DNA, 25 bp, Rattus norvegicus
tggtggagccttgagtcgaatgtca

SEQ ID NO: 641019 - DNA, 25 bp, Rattus norvegicus
tggtggaggccaactacccggagac

SEQ ID NO: 641020 - DNA, 25 bp, Rattus norvegicus
tggtggaggccatctacccggagac

SEQ ID NO: 641021 - DNA, 25 bp, Rattus norvegicus
tggtggaggctaatttcattaaaac

SEQ ID NO: 641022 - DNA, 25 bp, Rattus norvegicus
tggtggaggctattttcattaaaac

SEQ ID NO: 641023 - DNA, 25 bp, Rattus norvegicus
tggtggaggctcatattgccctaac

SEQ ID NO: 641024 - DNA, 25 bp, Rattus norvegicus
tggtggaggctcttattgccctaac

SEQ ID NO: 641025 - DNA, 25 bp, Rattus norvegicus
tggtggagtttgaacccagggtctt

SEQ ID NO: 641026 - DNA, 25 bp, Rattus norvegicus
tggtggagtttgtacccagggtctt

SEQ ID NO: 641027 - DNA, 25 bp, Rattus norvegicus
tggtggatatcaacgggtccctgaa

SEQ ID NO: 641028 - DNA, 25 bp, Rattus norvegicus
tggtggatatcatcgggtccctgaa

SEQ ID NO: 641029 - DNA, 25 bp, Rattus norvegicus
tggtggatccctacagctttgtgaa

SEQ ID NO: 641030 - DNA, 25 bp, Rattus norvegicus
tggtggatcccttcagctttgtgaa

SEQ ID NO: 641031 - DNA, 25 bp, Rattus norvegicus
tggtggattctacgtgacagccttc

SEQ ID NO: 641032 - DNA, 25 bp, Rattus norvegicus
tggtggattctaggtgacagccttc

SEQ ID NO: 641033 - DNA, 25 bp, Rattus norvegicus
tggtggcaaccaaatctgtttaggt

SEQ ID NO: 641034 - DNA, 25 bp, Rattus norvegicus
tggtggcaaccatatctgtttaggt

SEQ ID NO: 641035 - DNA, 25 bp, Rattus norvegicus
tggtggcaaggacaagcctactttg

SEQ ID NO: 641036 - DNA, 25 bp, Rattus norvegicus
tggtggcaaggagaagcctactttg

SEQ ID NO: 641037 - DNA, 25 bp, Rattus norvegicus
tggtggcaattgaagtttctctctt

SEQ ID NO: 641038 - DNA, 25 bp, Rattus norvegicus
tggtggcaattgtagtttctctctt

SEQ ID NO: 641039 - DNA, 25 bp, Rattus norvegicus
tggtggcacactcccttaatctggg

SEQ ID NO: 641040 - DNA, 25 bp, Rattus norvegicus
tggtggcacactgccttaatctggg

SEQ ID NO: 641041 - DNA, 25 bp, Rattus norvegicus
tggtggcacagccttgatcccagca

SEQ ID NO: 641042 - DNA, 25 bp, Rattus norvegicus
tggtggcacagcgttgatcccagca

SEQ ID NO: 641043 - DNA, 25 bp, Rattus norvegicus
tggtggcacagtatttatccaggac

SEQ ID NO: 641044 - DNA, 25 bp, Rattus norvegicus
tggtggcacagtttttatccaggac

SEQ ID NO: 641045 - DNA, 25 bp, Rattus norvegicus
tggtggcactcaagcagacgtctgt

SEQ ID NO: 641046 - DNA, 25 bp, Rattus norvegicus
tggtggcactcatgcagacgtctgt

SEQ ID NO: 641047 - DNA, 25 bp, Rattus norvegicus
tggtggcactgcagtctgaacccaa

SEQ ID NO: 641048 - DNA, 25 bp, Rattus norvegicus
tggtggcactgctgtctgaacccaa

SEQ ID NO: 641049 - DNA, 25 bp, Rattus norvegicus
tggtggcagcaacatcagcctggca

SEQ ID NO: 641050 - DNA, 25 bp, Rattus norvegicus
tggtggcagcaagatcagcctggca

SEQ ID NO: 641051 - DNA, 25 bp, Rattus norvegicus
tggtggcagcggaactgccgcccta

SEQ ID NO: 641052 - DNA, 25 bp, Rattus norvegicus
tggtggcagcggtactgccgcccta

SEQ ID NO: 641053 - DNA, 25 bp, Rattus norvegicus
tggtggcaggccaaggtcaacagaa

SEQ ID NO: 641054 - DNA, 25 bp, Rattus norvegicus
tggtggcaggcctaggtcaacagaa

SEQ ID NO: 641055 - DNA, 25 bp, Rattus norvegicus
tggtggccaaataacaggtttaact

SEQ ID NO: 641056 - DNA, 25 bp, Rattus norvegicus
tggtggccaaattacaggtttaact

SEQ ID NO: 641057 - DNA, 25 bp, Rattus norvegicus
tggtggccacatagagcagttctca

SEQ ID NO: 641058 - DNA, 25 bp, Rattus norvegicus
tggtggccacattgagcagttctca

SEQ ID NO: 641059 - DNA, 25 bp, Rattus norvegicus
tggtggccaccaagatcaactctag

SEQ ID NO: 641060 - DNA, 25 bp, Rattus norvegicus
tggtggccaccatgatcaactctag

SEQ ID NO: 641061 - DNA, 25 bp, Rattus norvegicus
tggtggccacctatggacaggagct

SEQ ID NO: 641062 - DNA, 25 bp, Rattus norvegicus
tggtggccacctttggacaggagct

SEQ ID NO: 641063 - DNA, 25 bp, Rattus norvegicus
tggtggccactaactcagcgcaggg

SEQ ID NO: 641064 - DNA, 25 bp, Rattus norvegicus
tggtggccactatctcagcgcaggg

SEQ ID NO: 641065 - DNA, 25 bp, Rattus norvegicus
tggtggccactcacggaactgcagg

SEQ ID NO: 641066 - DNA, 25 bp, Rattus norvegicus
tggtggccactcagactgacctgta

SEQ ID NO: 641067 - DNA, 25 bp, Rattus norvegicus
tggtggccactctcggaactgcagg

SEQ ID NO: 641068 - DNA, 25 bp, Rattus norvegicus
tggtggccactctgactgacctgta

SEQ ID NO: 641069 - DNA, 25 bp, Rattus norvegicus
tggtggccagccatgtgtccgcaca

SEQ ID NO: 641070 - DNA, 25 bp, Rattus norvegicus
tggtggccagccttgtgtccgcaca

SEQ ID NO: 641071 - DNA, 25 bp, Rattus norvegicus
tggtggccagtgctcaatgtgttcc

SEQ ID NO: 641072 - DNA, 25 bp, Rattus norvegicus
tggtggccagtggtcaatgtgttcc

SEQ ID NO: 641073 - DNA, 25 bp, Rattus norvegicus
tggtggccatctctggtactacagt

SEQ ID NO: 641074 - DNA, 25 bp, Rattus norvegicus
tggtggccatctgtggtactacagt

SEQ ID NO: 641075 - DNA, 25 bp, Rattus norvegicus
tggtggcccattactatcatgctgc

SEQ ID NO: 641076 - DNA, 25 bp, Rattus norvegicus
tggtggcccatttctatcatgctgc

SEQ ID NO: 641077 - DNA, 25 bp, Rattus norvegicus
tggtggcccctgaagtttctgttta

SEQ ID NO: 641078 - DNA, 25 bp, Rattus norvegicus
tggtggcccctgtagtttctgttta

SEQ ID NO: 641079 - DNA, 25 bp, Rattus norvegicus
tggtggccccttagggattaggata

SEQ ID NO: 641080 - DNA, 25 bp, Rattus norvegicus
tggtggcccctttgggattaggata

SEQ ID NO: 641081 - DNA, 25 bp, Rattus norvegicus
tggtggcccgggacaagcctatgta

SEQ ID NO: 641082 - DNA, 25 bp, Rattus norvegicus
tggtggcccgggtcaagcctatgta

SEQ ID NO: 641083 - DNA, 25 bp, Rattus norvegicus
tggtggccctacagatggtcatagt

SEQ ID NO: 641084 - DNA, 25 bp, Rattus norvegicus
tggtggccctactgatggtcatagt

SEQ ID NO: 641085 - DNA, 25 bp, Rattus norvegicus
tggtggccctcacgagctgtagaca

SEQ ID NO: 641086 - DNA, 25 bp, Rattus norvegicus
tggtggccctcaggagctgtagaca

SEQ ID NO: 641087 - DNA, 25 bp, Rattus norvegicus
tggtggccctgtaaacagcctggca

SEQ ID NO: 641088 - DNA, 25 bp, Rattus norvegicus
tggtggccctgtcactgtgtctgtc

SEQ ID NO: 641089 - DNA, 25 bp, Rattus norvegicus
tggtggccctgtgactgtgtctgtc

SEQ ID NO: 641090 - DNA, 25 bp, Rattus norvegicus
tggtggccctgttaacagcctggca

SEQ ID NO: 641091 - DNA, 25 bp, Rattus norvegicus
tggtggcccttgcttaggatccttc

SEQ ID NO: 641092 - DNA, 25 bp, Rattus norvegicus
tggtggcccttggttaggatccttc

SEQ ID NO: 641093 - DNA, 25 bp, Rattus norvegicus
tggtggccgacaagcttcatgaaca

SEQ ID NO: 641094 - DNA, 25 bp, Rattus norvegicus
tggtggccgacatgcttcatgaaca

SEQ ID NO: 641095 - DNA, 25 bp, Rattus norvegicus
tggtggccgcccctatcaaaaacac

SEQ ID NO: 641096 - DNA, 25 bp, Rattus norvegicus
tggtggccgcccgtatcaaaaacac

SEQ ID NO: 641097 - DNA, 25 bp, Rattus norvegicus
tggtggccgcgcagcacttgtgcat

SEQ ID NO: 641098 - DNA, 25 bp, Rattus norvegicus
tggtggccgcgctgcacttgtgcat

SEQ ID NO: 641099 - DNA, 25 bp, Rattus norvegicus
tggtggcctacacccatccatgaca

SEQ ID NO: 641100 - DNA, 25 bp, Rattus norvegicus
tggtggcctacagccatccatgaca

SEQ ID NO: 641101 - DNA, 25 bp, Rattus norvegicus
tggtggcctatccattgctctaaag

SEQ ID NO: 641102 - DNA, 25 bp, Rattus norvegicus
tggtggcctatcgattgctctaaag

SEQ ID NO: 641103 - DNA, 25 bp, Rattus norvegicus
tggtggcctcccaccgcaggtcgaa

SEQ ID NO: 641104 - DNA, 25 bp, Rattus norvegicus
tggtggcctccctccgcaggtcgaa

SEQ ID NO: 641105 - DNA, 25 bp, Rattus norvegicus
tggtggccttcaactacttcctaaa

SEQ ID NO: 641106 - DNA, 25 bp, Rattus norvegicus
tggtggccttcatctacttcctaaa

SEQ ID NO: 641107 - DNA, 25 bp, Rattus norvegicus
tggtggccttctacaagctgcgcaa

SEQ ID NO: 641108 - DNA, 25 bp, Rattus norvegicus
tggtggccttcttcaagctgcgcaa

SEQ ID NO: 641109 - DNA, 25 bp, Rattus norvegicus
tggtggccttttaatcctgactgga

SEQ ID NO: 641110 - DNA, 25 bp, Rattus norvegicus
tggtggcctttttatcctgactgga

SEQ ID NO: 641111 - DNA, 25 bp, Rattus norvegicus
tggtggcgcccgaacggacccgact

SEQ ID NO: 641112 - DNA, 25 bp, Rattus norvegicus
tggtggcgcccgtacggacccgact

SEQ ID NO: 641113 - DNA, 25 bp, Rattus norvegicus
tggtggcggcaaagttcctcaacgt

SEQ ID NO: 641114 - DNA, 25 bp, Rattus norvegicus
tggtggcggcaatgttcctcaacgt

SEQ ID NO: 641115 - DNA, 25 bp, Rattus norvegicus
tggtggctaactagagggcccgaat

SEQ ID NO: 641116 - DNA, 25 bp, Rattus norvegicus
tggtggctaacttgagggcccgaat

SEQ ID NO: 641117 - DNA, 25 bp, Rattus norvegicus
tggtggctataccagagaatctgtt

SEQ ID NO: 641118 - DNA, 25 bp, Rattus norvegicus
tggtggctatacgagagaatctgtt

SEQ ID NO: 641119 - DNA, 25 bp, Rattus norvegicus
tggtggctatcaacatccctgaggg

SEQ ID NO: 641120 - DNA, 25 bp, Rattus norvegicus
tggtggctatcatcatccctgaggg

SEQ ID NO: 641121 - DNA, 25 bp, Rattus norvegicus
tggtggctcccaaactgaatagttc

SEQ ID NO: 641122 - DNA, 25 bp, Rattus norvegicus
tggtggctcccatactgaatagttc

SEQ ID NO: 641123 - DNA, 25 bp, Rattus norvegicus
tggtggctcgaaatgcccagctaaa

SEQ ID NO: 641124 - DNA, 25 bp, Rattus norvegicus
tggtggctcgaattgcccagctaaa

SEQ ID NO: 641125 - DNA, 25 bp, Rattus norvegicus
tggtggctcttgcttatagtcctag

SEQ ID NO: 641126 - DNA, 25 bp, Rattus norvegicus
tggtggctcttggttatagtcctag

SEQ ID NO: 641127 - DNA, 25 bp, Rattus norvegicus
tggtggctgagacattcgcccaaaa

SEQ ID NO: 641128 - DNA, 25 bp, Rattus norvegicus
tggtggctgagagattcgcccaaaa

SEQ ID NO: 641129 - DNA, 25 bp, Rattus norvegicus
tggtggctgaggacagtccatgttc

SEQ ID NO: 641130 - DNA, 25 bp, Rattus norvegicus
tggtggctgaggtcagtccatgttc

SEQ ID NO: 641131 - DNA, 25 bp, Rattus norvegicus
tggtggctgcccatctcatagactt

SEQ ID NO: 641132 - DNA, 25 bp, Rattus norvegicus
tggtggctgcccttctcatagactt

SEQ ID NO: 641133 - DNA, 25 bp, Rattus norvegicus
tggtggctggcaacaagtactacat

SEQ ID NO: 641134 - DNA, 25 bp, Rattus norvegicus
tggtggctggcatcaagtactacat

SEQ ID NO: 641135 - DNA, 25 bp, Rattus norvegicus
tggtggctgtctacatcttctgctg

SEQ ID NO: 641136 - DNA, 25 bp, Rattus norvegicus
tggtggctgtcttcatcttctgctg

SEQ ID NO: 641137 - DNA, 25 bp, Rattus norvegicus
tggtggctgtggacaacgacaccgt

SEQ ID NO: 641138 - DNA, 25 bp, Rattus norvegicus
tggtggctgtggtcaacgacaccgt

SEQ ID NO: 641139 - DNA, 25 bp, Rattus norvegicus
tggtggctgtttagcccctggccaa

SEQ ID NO: 641140 - DNA, 25 bp, Rattus norvegicus
tggtggctgtttcccaatgcacata

SEQ ID NO: 641141 - DNA, 25 bp, Rattus norvegicus
tggtggctgtttgccaatgcacata

SEQ ID NO: 641142 - DNA, 25 bp, Rattus norvegicus
tggtggctgttttgcccctggccaa

SEQ ID NO: 641143 - DNA, 25 bp, Rattus norvegicus
tggtggcttcagagtctgtgacagt

SEQ ID NO: 641144 - DNA, 25 bp, Rattus norvegicus
tggtggcttcagtgtctgtgacagt

SEQ ID NO: 641145 - DNA, 25 bp, Rattus norvegicus
tggtggcttgtgaggaagtttacca

SEQ ID NO: 641146 - DNA, 25 bp, Rattus norvegicus
tggtggcttgtgtggaagtttacca

SEQ ID NO: 641147 - DNA, 25 bp, Rattus norvegicus
tggtgggaaccacatgggacctttt

SEQ ID NO: 641148 - DNA, 25 bp, Rattus norvegicus
tggtgggaaccagatgggacctttt

SEQ ID NO: 641149 - DNA, 25 bp, Rattus norvegicus
tggtgggaaggacgactccctactt

SEQ ID NO: 641150 - DNA, 25 bp, Rattus norvegicus
tggtgggaaggaggactccctactt

SEQ ID NO: 641151 - DNA, 25 bp, Rattus norvegicus
tggtgggactaaccggcctggaagt

SEQ ID NO: 641152 - DNA, 25 bp, Rattus norvegicus
tggtgggactaagcggcctggaagt

SEQ ID NO: 641153 - DNA, 25 bp, Rattus norvegicus
tggtgggagctgacagcactcacat

SEQ ID NO: 641154 - DNA, 25 bp, Rattus norvegicus
tggtgggagctgtcagcactcacat

SEQ ID NO: 641155 - DNA, 25 bp, Rattus norvegicus
tggtgggagtctcccgctttcctca

SEQ ID NO: 641156 - DNA, 25 bp, Rattus norvegicus
tggtgggagtctgccgctttcctca

SEQ ID NO: 641157 - DNA, 25 bp, Rattus norvegicus
tggtgggatcaaactcagggccttt

SEQ ID NO: 641158 - DNA, 25 bp, Rattus norvegicus
tggtgggatcaatctcagggccttt

SEQ ID NO: 641159 - DNA, 25 bp, Rattus norvegicus
tggtgggattctaggcctgcgccac

SEQ ID NO: 641160 - DNA, 25 bp, Rattus norvegicus
tggtgggattcttggcctgcgccac

SEQ ID NO: 641161 - DNA, 25 bp, Rattus norvegicus
tggtgggcacacagacctcgctgaa

SEQ ID NO: 641162 - DNA, 25 bp, Rattus norvegicus
tggtgggcacactgacctcgctgaa

SEQ ID NO: 641163 - DNA, 25 bp, Rattus norvegicus
tggtgggcacttatcttcagtagat

SEQ ID NO: 641164 - DNA, 25 bp, Rattus norvegicus
tggtgggcacttttcttcagtagat

SEQ ID NO: 641165 - DNA, 25 bp, Rattus norvegicus
tggtgggcagttaccaggacctcca

SEQ ID NO: 641166 - DNA, 25 bp, Rattus norvegicus
tggtgggcagttactccacactggc

SEQ ID NO: 641167 - DNA, 25 bp, Rattus norvegicus
tggtgggcagtttccaggacctcca

SEQ ID NO: 641168 - DNA, 25 bp, Rattus norvegicus
tggtgggcagtttctccacactggc

SEQ ID NO: 641169 - DNA, 25 bp, Rattus norvegicus
tggtgggcataaactgagccttgtt

SEQ ID NO: 641170 - DNA, 25 bp, Rattus norvegicus
tggtgggcataatctgagccttgtt

SEQ ID NO: 641171 - DNA, 25 bp, Rattus norvegicus
tggtgggcatctccactaccttgga

SEQ ID NO: 641172 - DNA, 25 bp, Rattus norvegicus
tggtgggcatctgcactaccttgga

SEQ ID NO: 641173 - DNA, 25 bp, Rattus norvegicus
tggtgggccagtctccatttcagca

SEQ ID NO: 641174 - DNA, 25 bp, Rattus norvegicus
tggtgggccagtgtccatttcagca

SEQ ID NO: 641175 - DNA, 25 bp, Rattus norvegicus
tggtgggccataccatcgcatgctg

SEQ ID NO: 641176 - DNA, 25 bp, Rattus norvegicus
tggtgggccatagcatcgcatgctg

SEQ ID NO: 641177 - DNA, 25 bp, Rattus norvegicus
tggtgggccccactgccttcaagat

SEQ ID NO: 641178 - DNA, 25 bp, Rattus norvegicus
tggtgggccccagtgccttcaagat

SEQ ID NO: 641179 - DNA, 25 bp, Rattus norvegicus
tggtgggccgagagatcgacatctt

SEQ ID NO: 641180 - DNA, 25 bp, Rattus norvegicus
tggtgggccgagtgatcgacatctt

SEQ ID NO: 641181 - DNA, 25 bp, Rattus norvegicus
tggtgggcctcaagggtaccatctc

SEQ ID NO: 641182 - DNA, 25 bp, Rattus norvegicus
tggtgggcctcatgggtaccatctc

SEQ ID NO: 641183 - DNA, 25 bp, Rattus norvegicus
tggtgggcctctagagccccaagaa

SEQ ID NO: 641184 - DNA, 25 bp, Rattus norvegicus
tggtgggcctcttgagccccaagaa

SEQ ID NO: 641185 - DNA, 25 bp, Rattus norvegicus
tggtgggcctggaaccaacctgaat

SEQ ID NO: 641186 - DNA, 25 bp, Rattus norvegicus
tggtgggcctggtaccaacctgaat

SEQ ID NO: 641187 - DNA, 25 bp, Rattus norvegicus
tggtgggccttaccatgcctagata

SEQ ID NO: 641188 - DNA, 25 bp, Rattus norvegicus
tggtgggccttagcatgcctagata

SEQ ID NO: 641189 - DNA, 25 bp, Rattus norvegicus
tggtgggctcaaattttggtgttcc

SEQ ID NO: 641190 - DNA, 25 bp, Rattus norvegicus
tggtgggctcaatttttggtgttcc

SEQ ID NO: 641191 - DNA, 25 bp, Rattus norvegicus
tggtgggcttctccatgctgagaac

SEQ ID NO: 641192 - DNA, 25 bp, Rattus norvegicus
tggtgggcttctgcatgctgagaac

SEQ ID NO: 641193 - DNA, 25 bp, Rattus norvegicus
tggtgggtaagcactctacccctga

SEQ ID NO: 641194 - DNA, 25 bp, Rattus norvegicus
tggtgggtaagctctctacccctga

SEQ ID NO: 641195 - DNA, 25 bp, Rattus norvegicus
tggtgggtccttctatattctgctc

SEQ ID NO: 641196 - DNA, 25 bp, Rattus norvegicus
tggtgggtccttgtatattctgctc

SEQ ID NO: 641197 - DNA, 25 bp, Rattus norvegicus
tggtgggtctcgcttggtcccatat

SEQ ID NO: 641198 - DNA, 25 bp, Rattus norvegicus
tggtgggtctcggttggtcccatat

SEQ ID NO: 641199 - DNA, 25 bp, Rattus norvegicus
tggtgggtcttgagcgagccctcac

SEQ ID NO: 641200 - DNA, 25 bp, Rattus norvegicus
tggtgggtcttgtgcgagccctcac

SEQ ID NO: 641201 - DNA, 25 bp, Rattus norvegicus
tggtgggtgcacatttctagtctca

SEQ ID NO: 641202 - DNA, 25 bp, Rattus norvegicus
tggtgggtgcacttttctagtctca

SEQ ID NO: 641203 - DNA, 25 bp, Rattus norvegicus
tggtgggtgctaacatcacctttgg

SEQ ID NO: 641204 - DNA, 25 bp, Rattus norvegicus
tggtgggtgctatcatcacctttgg

SEQ ID NO: 641205 - DNA, 25 bp, Rattus norvegicus
tggtgggtggttaatgccagcactt

SEQ ID NO: 641206 - DNA, 25 bp, Rattus norvegicus
tggtgggtggtttatgccagcactt

SEQ ID NO: 641207 - DNA, 25 bp, Rattus norvegicus
tggtgggtgtccacatcgtggtcct

SEQ ID NO: 641208 - DNA, 25 bp, Rattus norvegicus
tggtgggtgtcctcatcgtggtcct

SEQ ID NO: 641209 - DNA, 25 bp, Rattus norvegicus
tggtgggttggtacgggctgctggc

SEQ ID NO: 641210 - DNA, 25 bp, Rattus norvegicus
tggtgggttggttcgggctgctggc

SEQ ID NO: 641211 - DNA, 25 bp, Rattus norvegicus
tggtggtaaatacccagcactcctt

SEQ ID NO: 641212 - DNA, 25 bp, Rattus norvegicus
tggtggtaaatagccagcactcctt

SEQ ID NO: 641213 - DNA, 25 bp, Rattus norvegicus
tggtggtacagcctgctctgcagtc

SEQ ID NO: 641214 - DNA, 25 bp, Rattus norvegicus
tggtggtacagcgtgctctgcagtc

SEQ ID NO: 641215 - DNA, 25 bp, Rattus norvegicus
tggtggtcaactcgcattgtgattc

SEQ ID NO: 641216 - DNA, 25 bp, Rattus norvegicus
tggtggtcaactggcattgtgattc

SEQ ID NO: 641217 - DNA, 25 bp, Rattus norvegicus
tggtggtcacacaccctcttgagac

SEQ ID NO: 641218 - DNA, 25 bp, Rattus norvegicus
tggtggtcacactccctcttgagac

SEQ ID NO: 641219 - DNA, 25 bp, Rattus norvegicus
tggtggtcaccaagctgtcaagtat

SEQ ID NO: 641220 - DNA, 25 bp, Rattus norvegicus
tggtggtcaccatgctgtcaagtat

SEQ ID NO: 641221 - DNA, 25 bp, Rattus norvegicus
tggtggtcactcatggaggcctaac

SEQ ID NO: 641222 - DNA, 25 bp, Rattus norvegicus
tggtggtcactcatttgctgtctac

SEQ ID NO: 641223 - DNA, 25 bp, Rattus norvegicus
tggtggtcactcttggaggcctaac

SEQ ID NO: 641224 - DNA, 25 bp, Rattus norvegicus
tggtggtcactcttttgctgtctac

SEQ ID NO: 641225 - DNA, 25 bp, Rattus norvegicus
tggtggtcagtaccccaacacagga

SEQ ID NO: 641226 - DNA, 25 bp, Rattus norvegicus
tggtggtcagtagcccaacacagga

SEQ ID NO: 641227 - DNA, 25 bp, Rattus norvegicus
tggtggtcatgtctctgggatccct

SEQ ID NO: 641228 - DNA, 25 bp, Rattus norvegicus
tggtggtcatgtgtctgggatccct

SEQ ID NO: 641229 - DNA, 25 bp, Rattus norvegicus
tggtggtccacacctcagagccttg

SEQ ID NO: 641230 - DNA, 25 bp, Rattus norvegicus
tggtggtccacagctcagagccttg

SEQ ID NO: 641231 - DNA, 25 bp, Rattus norvegicus
tggtggtccagaagagcccagaact

SEQ ID NO: 641232 - DNA, 25 bp, Rattus norvegicus
tggtggtccagaccttagccagaag

SEQ ID NO: 641233 - DNA, 25 bp, Rattus norvegicus
tggtggtccagagcttagccagaag

SEQ ID NO: 641234 - DNA, 25 bp, Rattus norvegicus
tggtggtccagatgagcccagaact

SEQ ID NO: 641235 - DNA, 25 bp, Rattus norvegicus
tggtggtccagtcatcacagcccct

SEQ ID NO: 641236 - DNA, 25 bp, Rattus norvegicus
tggtggtccagtgatcacagcccct

SEQ ID NO: 641237 - DNA, 25 bp, Rattus norvegicus
tggtggtccatgagtccaatctcag

SEQ ID NO: 641238 - DNA, 25 bp, Rattus norvegicus
tggtggtccatgtgtccaatctcag

SEQ ID NO: 641239 - DNA, 25 bp, Rattus norvegicus
tggtggtcctcgagtctccgtgaag

SEQ ID NO: 641240 - DNA, 25 bp, Rattus norvegicus
tggtggtcctcgtgtctccgtgaag

SEQ ID NO: 641241 - DNA, 25 bp, Rattus norvegicus
tggtggtcctgcacgcattgggcat

SEQ ID NO: 641242 - DNA, 25 bp, Rattus norvegicus
tggtggtcctgctcgcattgggcat

SEQ ID NO: 641243 - DNA, 25 bp, Rattus norvegicus
tggtggtcttccacgaggagacgct

SEQ ID NO: 641244 - DNA, 25 bp, Rattus norvegicus
tggtggtcttcctcgaggagacgct

SEQ ID NO: 641245 - DNA, 25 bp, Rattus norvegicus
tggtggtcttggatgctataagata

SEQ ID NO: 641246 - DNA, 25 bp, Rattus norvegicus
tggtggtcttggttgctataagata

SEQ ID NO: 641247 - DNA, 25 bp, Rattus norvegicus
tggtggtgattgctagctcagccca

SEQ ID NO: 641248 - DNA, 25 bp, Rattus norvegicus
tggtggtgattggtagctcagccca

SEQ ID NO: 641249 - DNA, 25 bp, Rattus norvegicus
tggtggtgcatcaagggaatttccc

SEQ ID NO: 641250 - DNA, 25 bp, Rattus norvegicus
tggtggtgcatctagggaatttccc

SEQ ID NO: 641251 - DNA, 25 bp, Rattus norvegicus
tggtggtgcccaccacacaaggcca

SEQ ID NO: 641252 - DNA, 25 bp, Rattus norvegicus
tggtggtgcccagcacacaaggcca

SEQ ID NO: 641253 - DNA, 25 bp, Rattus norvegicus
tggtggtgctaactgtgcgcaacta

SEQ ID NO: 641254 - DNA, 25 bp, Rattus norvegicus
tggtggtgctaagtgtgcgcaacta

SEQ ID NO: 641255 - DNA, 25 bp, Rattus norvegicus
tggtggtgctcacctaacctcggaa

SEQ ID NO: 641256 - DNA, 25 bp, Rattus norvegicus
tggtggtgctcagctaacctcggaa

SEQ ID NO: 641257 - DNA, 25 bp, Rattus norvegicus
tggtggtgctggagactccctgact

SEQ ID NO: 641258 - DNA, 25 bp, Rattus norvegicus
tggtggtgctggtgactccctgact

SEQ ID NO: 641259 - DNA, 25 bp, Rattus norvegicus
tggtggtgctgtcctgggtgctgac

SEQ ID NO: 641260 - DNA, 25 bp, Rattus norvegicus
tggtggtgctgtgctgggtgctgac

SEQ ID NO: 641261 - DNA, 25 bp, Rattus norvegicus
tggtggtgtatcagtgcctaatccc

SEQ ID NO: 641262 - DNA, 25 bp, Rattus norvegicus
tggtggtgtatctgtgcctaatccc

SEQ ID NO: 641263 - DNA, 25 bp, Rattus norvegicus
tggtggtgtccaacacagggttata

SEQ ID NO: 641264 - DNA, 25 bp, Rattus norvegicus
tggtggtgtccatcacagggttata

SEQ ID NO: 641265 - DNA, 25 bp, Rattus norvegicus
tggtggtgtctcctcaggctgtcca

SEQ ID NO: 641266 - DNA, 25 bp, Rattus norvegicus
tggtggtgtctcgtcaggctgtcca

SEQ ID NO: 641267 - DNA, 25 bp, Rattus norvegicus
tggtggtgtgcaactgcatagtccc

SEQ ID NO: 641268 - DNA, 25 bp, Rattus norvegicus
tggtggtgtgcatctgcatagtccc

SEQ ID NO: 641269 - DNA, 25 bp, Rattus norvegicus
tggtggtgttcgaaaggcatttctt

SEQ ID NO: 641270 - DNA, 25 bp, Rattus norvegicus
tggtggtgttcgtaaggcatttctt

SEQ ID NO: 641271 - DNA, 25 bp, Rattus norvegicus
tggtggtgtttcaccgcagacagac

SEQ ID NO: 641272 - DNA, 25 bp, Rattus norvegicus
tggtggtgtttctccgcagacagac

SEQ ID NO: 641273 - DNA, 25 bp, Rattus norvegicus
tggtggttagcccaagcttatgctt

SEQ ID NO: 641274 - DNA, 25 bp, Rattus norvegicus
tggtggttagccgaagcttatgctt

SEQ ID NO: 641275 - DNA, 25 bp, Rattus norvegicus
tggtggttagtacccgccagcatga

SEQ ID NO: 641276 - DNA, 25 bp, Rattus norvegicus
tggtggttagtagccgccagcatga

SEQ ID NO: 641277 - DNA, 25 bp, Rattus norvegicus
tggtggttatccagctttagcctaa

SEQ ID NO: 641278 - DNA, 25 bp, Rattus norvegicus
tggtggttatcctgctttagcctaa

SEQ ID NO: 641279 - DNA, 25 bp, Rattus norvegicus
tggtggttcaacatgctatgcattt

SEQ ID NO: 641280 - DNA, 25 bp, Rattus norvegicus
tggtggttcaacttgctatgcattt

SEQ ID NO: 641281 - DNA, 25 bp, Rattus norvegicus
tggtggttcacacccatcttgtaac

SEQ ID NO: 641282 - DNA, 25 bp, Rattus norvegicus
tggtggttcacagccatcttgtaac

SEQ ID NO: 641283 - DNA, 25 bp, Rattus norvegicus
tggtggttcggcactttaaatggga

SEQ ID NO: 641284 - DNA, 25 bp, Rattus norvegicus
tggtggttcggctctttaaatggga

SEQ ID NO: 641285 - DNA, 25 bp, Rattus norvegicus
tggtggttctttaggtcttcgcgaa

SEQ ID NO: 641286 - DNA, 25 bp, Rattus norvegicus
tggtggttctttcttggtccaaaat

SEQ ID NO: 641287 - DNA, 25 bp, Rattus norvegicus
tggtggttctttgttggtccaaaat

SEQ ID NO: 641288 - DNA, 25 bp, Rattus norvegicus
tggtggttcttttggtcttcgcgaa

SEQ ID NO: 641289 - DNA, 25 bp, Rattus norvegicus
tggtggtttaccagtcctttcccag

SEQ ID NO: 641290 - DNA, 25 bp, Rattus norvegicus
tggtggtttacctgtcctttcccag

SEQ ID NO: 641291 - DNA, 25 bp, Rattus norvegicus
tggtggtttgtaatctttttccttg

SEQ ID NO: 641292 - DNA, 25 bp, Rattus norvegicus
tggtggtttgtattctttttccttg

SEQ ID NO: 641293 - DNA, 25 bp, Rattus norvegicus
tggtgtaaccccacaaagagctcta

SEQ ID NO: 641294 - DNA, 25 bp, Rattus norvegicus
tggtgtaacccctcaaagagctcta

SEQ ID NO: 641295 - DNA, 25 bp, Rattus norvegicus
tggtgtaactggatcccactcagcc

SEQ ID NO: 641296 - DNA, 25 bp, Rattus norvegicus
tggtgtaactggttcccactcagcc

SEQ ID NO: 641297 - DNA, 25 bp, Rattus norvegicus
tggtgtaagcctctcggtgatcctt

SEQ ID NO: 641298 - DNA, 25 bp, Rattus norvegicus
tggtgtaagcctgtcggtgatcctt

SEQ ID NO: 641299 - DNA, 25 bp, Rattus norvegicus
tggtgtaagctcatggttcctttaa

SEQ ID NO: 641300 - DNA, 25 bp, Rattus norvegicus
tggtgtaagctcttggttcctttaa

SEQ ID NO: 641301 - DNA, 25 bp, Rattus norvegicus
tggtgtaatcccaaggcttcaaccc

SEQ ID NO: 641302 - DNA, 25 bp, Rattus norvegicus
tggtgtaatccctaggcttcaaccc

SEQ ID NO: 641303 - DNA, 25 bp, Rattus norvegicus
tggtgtacatagcttttcccagctg

SEQ ID NO: 641304 - DNA, 25 bp, Rattus norvegicus
tggtgtacataggttttcccagctg

SEQ ID NO: 641305 - DNA, 25 bp, Rattus norvegicus
tggtgtaccctgaggttcagtctcc

SEQ ID NO: 641306 - DNA, 25 bp, Rattus norvegicus
tggtgtaccctgtggttcagtctcc

SEQ ID NO: 641307 - DNA, 25 bp, Rattus norvegicus
tggtgtacctccctgtgccctgggt

SEQ ID NO: 641308 - DNA, 25 bp, Rattus norvegicus
tggtgtacctccgtgtgccctgggt

SEQ ID NO: 641309 - DNA, 25 bp, Rattus norvegicus
tggtgtacgtaaccttttctctcat

SEQ ID NO: 641310 - DNA, 25 bp, Rattus norvegicus
tggtgtacgtaagcttttctctcat

SEQ ID NO: 641311 - DNA, 25 bp, Rattus norvegicus
tggtgtagaccccatagtctccttt

SEQ ID NO: 641312 - DNA, 25 bp, Rattus norvegicus
tggtgtagacccgatagtctccttt

SEQ ID NO: 641313 - DNA, 25 bp, Rattus norvegicus
tggtgtagactcctggttctcaacc

SEQ ID NO: 641314 - DNA, 25 bp, Rattus norvegicus
tggtgtagactcgtggttctcaacc

SEQ ID NO: 641315 - DNA, 25 bp, Rattus norvegicus
tggtgtagagcgacttctcaaaagt

SEQ ID NO: 641316 - DNA, 25 bp, Rattus norvegicus
tggtgtagagcgtcttctcaaaagt

SEQ ID NO: 641317 - DNA, 25 bp, Rattus norvegicus
tggtgtaggcctcccctgcgctctt

SEQ ID NO: 641318 - DNA, 25 bp, Rattus norvegicus
tggtgtaggcctgccctgcgctctt

SEQ ID NO: 641319 - DNA, 25 bp, Rattus norvegicus
tggtgtatcctgctgtctgggtcct

SEQ ID NO: 641320 - DNA, 25 bp, Rattus norvegicus
tggtgtatcctggtgtctgggtcct

SEQ ID NO: 641321 - DNA, 25 bp, Rattus norvegicus
tggtgtcaacaaagctgtgtgcccc

SEQ ID NO: 641322 - DNA, 25 bp, Rattus norvegicus
tggtgtcaacaatgctgtgtgcccc

SEQ ID NO: 641323 - DNA, 25 bp, Rattus norvegicus
tggtgtcaatcacggtgtggcttac

SEQ ID NO: 641324 - DNA, 25 bp, Rattus norvegicus
tggtgtcaatcagggtgtggcttac

SEQ ID NO: 641325 - DNA, 25 bp, Rattus norvegicus
tggtgtcacagtcatgcatgtctct

SEQ ID NO: 641326 - DNA, 25 bp, Rattus norvegicus
tggtgtcacagtgatgcatgtctct

SEQ ID NO: 641327 - DNA, 25 bp, Rattus norvegicus
tggtgtcacatgaagctgcccattc

SEQ ID NO: 641328 - DNA, 25 bp, Rattus norvegicus
tggtgtcacatgtagctgcccattc

SEQ ID NO: 641329 - DNA, 25 bp, Rattus norvegicus
tggtgtcaccttccttacttacgaa

SEQ ID NO: 641330 - DNA, 25 bp, Rattus norvegicus
tggtgtcaccttgcttacttacgaa

SEQ ID NO: 641331 - DNA, 25 bp, Rattus norvegicus
tggtgtcacgagaccccagctatgg

SEQ ID NO: 641332 - DNA, 25 bp, Rattus norvegicus
tggtgtcacgagtccccagctatgg

SEQ ID NO: 641333 - DNA, 25 bp, Rattus norvegicus
tggtgtcagaccattttccagaagt

SEQ ID NO: 641334 - DNA, 25 bp, Rattus norvegicus
tggtgtcagacctttttccagaagt

SEQ ID NO: 641335 - DNA, 25 bp, Rattus norvegicus
tggtgtcagcccactgcctttgcct

SEQ ID NO: 641336 - DNA, 25 bp, Rattus norvegicus
tggtgtcagccctctgcctttgcct

SEQ ID NO: 641337 - DNA, 25 bp, Rattus norvegicus
tggtgtcaggcgagtttaagcatgc

SEQ ID NO: 641338 - DNA, 25 bp, Rattus norvegicus
tggtgtcaggcgtgtttaagcatgc

SEQ ID NO: 641339 - DNA, 25 bp, Rattus norvegicus
tggtgtcatagtcccttttggttat

SEQ ID NO: 641340 - DNA, 25 bp, Rattus norvegicus
tggtgtcatagtgccttttggttat

SEQ ID NO: 641341 - DNA, 25 bp, Rattus norvegicus
tggtgtccacacagcttctgggtga

SEQ ID NO: 641342 - DNA, 25 bp, Rattus norvegicus
tggtgtccacactgcttctgggtga

SEQ ID NO: 641343 - DNA, 25 bp, Rattus norvegicus
tggtgtccacatcttttggcctcat

SEQ ID NO: 641344 - DNA, 25 bp, Rattus norvegicus
tggtgtccacatgttttggcctcat

SEQ ID NO: 641345 - DNA, 25 bp, Rattus norvegicus
tggtgtccacctaaaagccctagaa

SEQ ID NO: 641346 - DNA, 25 bp, Rattus norvegicus
tggtgtccaccttaaagccctagaa

SEQ ID NO: 641347 - DNA, 25 bp, Rattus norvegicus
tggtgtccacttcggccacagggcc

SEQ ID NO: 641348 - DNA, 25 bp, Rattus norvegicus
tggtgtccacttgggccacagggcc

SEQ ID NO: 641349 - DNA, 25 bp, Rattus norvegicus
tggtgtccatgcaggacgaggcctt

SEQ ID NO: 641350 - DNA, 25 bp, Rattus norvegicus
tggtgtccatgcatgtctacagttt

SEQ ID NO: 641351 - DNA, 25 bp, Rattus norvegicus
tggtgtccatgctggacgaggcctt

SEQ ID NO: 641352 - DNA, 25 bp, Rattus norvegicus
tggtgtccatgcttgtctacagttt

SEQ ID NO: 641353 - DNA, 25 bp, Rattus norvegicus
tggtgtcccagtatccctagtaaat

SEQ ID NO: 641354 - DNA, 25 bp, Rattus norvegicus
tggtgtcccagtatcgaacccaggg

SEQ ID NO: 641355 - DNA, 25 bp, Rattus norvegicus
tggtgtcccagtttccctagtaaat

SEQ ID NO: 641356 - DNA, 25 bp, Rattus norvegicus
tggtgtcccagtttcgaacccaggg

SEQ ID NO: 641357 - DNA, 25 bp, Rattus norvegicus
tggtgtccccgcagaagatatttac

SEQ ID NO: 641358 - DNA, 25 bp, Rattus norvegicus
tggtgtccccgctgaagatatttac

SEQ ID NO: 641359 - DNA, 25 bp, Rattus norvegicus
tggtgtcccggaagatgcctgtcaa

SEQ ID NO: 641360 - DNA, 25 bp, Rattus norvegicus
tggtgtcccggatgatgcctgtcaa

SEQ ID NO: 641361 - DNA, 25 bp, Rattus norvegicus
tggtgtccctagatcccattcatgg

SEQ ID NO: 641362 - DNA, 25 bp, Rattus norvegicus
tggtgtccctagttcccattcatgg

SEQ ID NO: 641363 - DNA, 25 bp, Rattus norvegicus
tggtgtccctggcagtccaatatcc

SEQ ID NO: 641364 - DNA, 25 bp, Rattus norvegicus
tggtgtccctgggagtccaatatcc

SEQ ID NO: 641365 - DNA, 25 bp, Rattus norvegicus
tggtgtcccttgcaaggcagccagc

SEQ ID NO: 641366 - DNA, 25 bp, Rattus norvegicus
tggtgtcccttggaaggcagccagc

SEQ ID NO: 641367 - DNA, 25 bp, Rattus norvegicus
tggtgtcctcccactaaatgaagaa

SEQ ID NO: 641368 - DNA, 25 bp, Rattus norvegicus
tggtgtcctccctctaaatgaagaa

SEQ ID NO: 641369 - DNA, 25 bp, Rattus norvegicus
tggtgtcctggcaccaagttttcat

SEQ ID NO: 641370 - DNA, 25 bp, Rattus norvegicus
tggtgtcctggctccaagttttcat

SEQ ID NO: 641371 - DNA, 25 bp, Rattus norvegicus
tggtgtccttcaacgtaactctgat

SEQ ID NO: 641372 - DNA, 25 bp, Rattus norvegicus
tggtgtccttcatcgtaactctgat

SEQ ID NO: 641373 - DNA, 25 bp, Rattus norvegicus
tggtgtccttttagaatgcctcaca

SEQ ID NO: 641374 - DNA, 25 bp, Rattus norvegicus
tggtgtcctttttgaatgcctcaca

SEQ ID NO: 641375 - DNA, 25 bp, Rattus norvegicus
tggtgtctagtcacacgagcccggg

SEQ ID NO: 641376 - DNA, 25 bp, Rattus norvegicus
tggtgtctagtctcacgagcccggg

SEQ ID NO: 641377 - DNA, 25 bp, Rattus norvegicus
tggtgtctcctaatagctcctatta

SEQ ID NO: 641378 - DNA, 25 bp, Rattus norvegicus
tggtgtctcctattagctcctatta

SEQ ID NO: 641379 - DNA, 25 bp, Rattus norvegicus
tggtgtctcgtcactgtgaatctaa

SEQ ID NO: 641380 - DNA, 25 bp, Rattus norvegicus
tggtgtctcgtctctgtgaatctaa

SEQ ID NO: 641381 - DNA, 25 bp, Rattus norvegicus
tggtgtctctggcacttgcaggcaa

SEQ ID NO: 641382 - DNA, 25 bp, Rattus norvegicus
tggtgtctctgggacttgcaggcaa

SEQ ID NO: 641383 - DNA, 25 bp, Rattus norvegicus
tggtgtctctgtactacgggacaat

SEQ ID NO: 641384 - DNA, 25 bp, Rattus norvegicus
tggtgtctctgttctacgggacaat

SEQ ID NO: 641385 - DNA, 25 bp, Rattus norvegicus
tggtgtctcttgaacatcgactttg

SEQ ID NO: 641386 - DNA, 25 bp, Rattus norvegicus
tggtgtctcttgattcatcatgcgc

SEQ ID NO: 641387 - DNA, 25 bp, Rattus norvegicus
tggtgtctcttgtacatcgactttg

SEQ ID NO: 641388 - DNA, 25 bp, Rattus norvegicus
tggtgtctcttgtttcatcatgcgc

SEQ ID NO: 641389 - DNA, 25 bp, Rattus norvegicus
tggtgtctgctaagccaccttagac

SEQ ID NO: 641390 - DNA, 25 bp, Rattus norvegicus
tggtgtctgctatgccaccttagac

SEQ ID NO: 641391 - DNA, 25 bp, Rattus norvegicus
tggtgtctggtccaccagttgtaaa

SEQ ID NO: 641392 - DNA, 25 bp, Rattus norvegicus
tggtgtctggtcgaccagttgtaaa

SEQ ID NO: 641393 - DNA, 25 bp, Rattus norvegicus
tggtgtcttccaagtttatcagaaa

SEQ ID NO: 641394 - DNA, 25 bp, Rattus norvegicus
tggtgtcttccatgtttatcagaaa

SEQ ID NO: 641395 - DNA, 25 bp, Rattus norvegicus
tggtgtcttcgtctcccaggatcta

SEQ ID NO: 641396 - DNA, 25 bp, Rattus norvegicus
tggtgtcttcgtgtcccaggatcta

SEQ ID NO: 641397 - DNA, 25 bp, Rattus norvegicus
tggtgtgacagcaccttcctggctg

SEQ ID NO: 641398 - DNA, 25 bp, Rattus norvegicus
tggtgtgacagctccttcctggctg

SEQ ID NO: 641399 - DNA, 25 bp, Rattus norvegicus
tggtgtgactcaaaaatttccagtg

SEQ ID NO: 641400 - DNA, 25 bp, Rattus norvegicus
tggtgtgactcataaatttccagtg

SEQ ID NO: 641401 - DNA, 25 bp, Rattus norvegicus
tggtgtgatcacacgagcactgtcc

SEQ ID NO: 641402 - DNA, 25 bp, Rattus norvegicus
tggtgtgatcactcgagcactgtcc

SEQ ID NO: 641403 - DNA, 25 bp, Rattus norvegicus
tggtgtgatctgacccagtgtcaac

SEQ ID NO: 641404 - DNA, 25 bp, Rattus norvegicus
tggtgtgatctgtcccagtgtcaac

SEQ ID NO: 641405 - DNA, 25 bp, Rattus norvegicus
tggtgtgatgtacttcgccagcctc

SEQ ID NO: 641406 - DNA, 25 bp, Rattus norvegicus
tggtgtgatgtagttcgccagcctc

SEQ ID NO: 641407 - DNA, 25 bp, Rattus norvegicus
tggtgtgcaagtctacatgcaggca

SEQ ID NO: 641408 - DNA, 25 bp, Rattus norvegicus
tggtgtgcaagtgtacatgcaggca

SEQ ID NO: 641409 - DNA, 25 bp, Rattus norvegicus
tggtgtgcacccagtggagccatgc

SEQ ID NO: 641410 - DNA, 25 bp, Rattus norvegicus
tggtgtgcaccctgtggagccatgc

SEQ ID NO: 641411 - DNA, 25 bp, Rattus norvegicus
tggtgtgcagtcagcacccacataa

SEQ ID NO: 641412 - DNA, 25 bp, Rattus norvegicus
tggtgtgcagtctgcacccacataa

SEQ ID NO: 641413 - DNA, 25 bp, Rattus norvegicus
tggtgtgccactactgcaggtgtcg

SEQ ID NO: 641414 - DNA, 25 bp, Rattus norvegicus
tggtgtgccacttctgcaggtgtcg

SEQ ID NO: 641415 - DNA, 25 bp, Rattus norvegicus
tggtgtgccgtaagtctgaaggcct

SEQ ID NO: 641416 - DNA, 25 bp, Rattus norvegicus
tggtgtgccgtatgtctgaaggcct

SEQ ID NO: 641417 - DNA, 25 bp, Rattus norvegicus
tggtgtgcctcacaagacttctcgt

SEQ ID NO: 641418 - DNA, 25 bp, Rattus norvegicus
tggtgtgcctcagaagacttctcgt

SEQ ID NO: 641419 - DNA, 25 bp, Rattus norvegicus
tggtgtgccttcaagacagcgtgtt

SEQ ID NO: 641420 - DNA, 25 bp, Rattus norvegicus
tggtgtgccttctagacagcgtgtt

SEQ ID NO: 641421 - DNA, 25 bp, Rattus norvegicus
tggtgtgcggccactgggactcatc

SEQ ID NO: 641422 - DNA, 25 bp, Rattus norvegicus
tggtgtgcggcctctgggactcatc

SEQ ID NO: 641423 - DNA, 25 bp, Rattus norvegicus
tggtgtgctaccaactttctagtct

SEQ ID NO: 641424 - DNA, 25 bp, Rattus norvegicus
tggtgtgctacctactttctagtct

SEQ ID NO: 641425 - DNA, 25 bp, Rattus norvegicus
tggtgtgctgtaatccgctgtcaaa

SEQ ID NO: 641426 - DNA, 25 bp, Rattus norvegicus
tggtgtgctgtattccgctgtcaaa

SEQ ID NO: 641427 - DNA, 25 bp, Rattus norvegicus
tggtgtgctgttctgtttgtgtaaa

SEQ ID NO: 641428 - DNA, 25 bp, Rattus norvegicus
tggtgtgctgttgtgtttgtgtaaa

SEQ ID NO: 641429 - DNA, 25 bp, Rattus norvegicus
tggtgtggacaacagcatcgctgcc

SEQ ID NO: 641430 - DNA, 25 bp, Rattus norvegicus
tggtgtggacaacataggtctctaa

SEQ ID NO: 641431 - DNA, 25 bp, Rattus norvegicus
tggtgtggacaagagcatcgctgcc

SEQ ID NO: 641432 - DNA, 25 bp, Rattus norvegicus
tggtgtggacaagataggtctctaa

SEQ ID NO: 641433 - DNA, 25 bp, Rattus norvegicus
tggtgtggaggaattctcatcactc

SEQ ID NO: 641434 - DNA, 25 bp, Rattus norvegicus
tggtgtggaggatttctcatcactc

SEQ ID NO: 641435 - DNA, 25 bp, Rattus norvegicus
tggtgtggccaaaccagggcctcaa

SEQ ID NO: 641436 - DNA, 25 bp, Rattus norvegicus
tggtgtggccaatccagggcctcaa

SEQ ID NO: 641437 - DNA, 25 bp, Rattus norvegicus
tggtgtggccacagaattcactcca

SEQ ID NO: 641438 - DNA, 25 bp, Rattus norvegicus
tggtgtggccactgaattcactcca

SEQ ID NO: 641439 - DNA, 25 bp, Rattus norvegicus
tggtgtggcctaaggccgcaagcaa

SEQ ID NO: 641440 - DNA, 25 bp, Rattus norvegicus
tggtgtggcctatggccgcaagcaa

SEQ ID NO: 641441 - DNA, 25 bp, Rattus norvegicus
tggtgtggcgtaaccagaggctatt

SEQ ID NO: 641442 - DNA, 25 bp, Rattus norvegicus
tggtgtggcgtatccagaggctatt

SEQ ID NO: 641443 - DNA, 25 bp, Rattus norvegicus
tggtgtgggccaagcactccttcat

SEQ ID NO: 641444 - DNA, 25 bp, Rattus norvegicus
tggtgtgggccatgcactccttcat

SEQ ID NO: 641445 - DNA, 25 bp, Rattus norvegicus
tggtgtggtaacacattctccatga

SEQ ID NO: 641446 - DNA, 25 bp, Rattus norvegicus
tggtgtggtaactcattctccatga

SEQ ID NO: 641447 - DNA, 25 bp, Rattus norvegicus
tggtgtgtactaccacagccaactt

SEQ ID NO: 641448 - DNA, 25 bp, Rattus norvegicus
tggtgtgtactagcacagccaactt

SEQ ID NO: 641449 - DNA, 25 bp, Rattus norvegicus
tggtgtgtagccaacccatagccat

SEQ ID NO: 641450 - DNA, 25 bp, Rattus norvegicus
tggtgtgtagcctacccatagccat

SEQ ID NO: 641451 - DNA, 25 bp, Rattus norvegicus
tggtgtgtcacaccactatggccat

SEQ ID NO: 641452 - DNA, 25 bp, Rattus norvegicus
tggtgtgtcacagcactatggccat

SEQ ID NO: 641453 - DNA, 25 bp, Rattus norvegicus
tggtgtgtccaaacttgatttctca

SEQ ID NO: 641454 - DNA, 25 bp, Rattus norvegicus
tggtgtgtccaatcttgatttctca

SEQ ID NO: 641455 - DNA, 25 bp, Rattus norvegicus
tggtgtgtctctctggatcatttca

SEQ ID NO: 641456 - DNA, 25 bp, Rattus norvegicus
tggtgtgtctctgtggatcatttca

SEQ ID NO: 641457 - DNA, 25 bp, Rattus norvegicus
tggtgtgtgccaactctagtggaga

SEQ ID NO: 641458 - DNA, 25 bp, Rattus norvegicus
tggtgtgtgccatctctagtggaga

SEQ ID NO: 641459 - DNA, 25 bp, Rattus norvegicus
tggtgtgtgtccaaccctatttgaa

SEQ ID NO: 641460 - DNA, 25 bp, Rattus norvegicus
tggtgtgtgtcctaccctatttgaa

SEQ ID NO: 641461 - DNA, 25 bp, Rattus norvegicus
tggtgtgttccaagagttgctcact

SEQ ID NO: 641462 - DNA, 25 bp, Rattus norvegicus
tggtgtgttccatgagttgctcact

SEQ ID NO: 641463 - DNA, 25 bp, Rattus norvegicus
tggtgttacagaaaacccctcactg

SEQ ID NO: 641464 - DNA, 25 bp, Rattus norvegicus
tggtgttacagataacccctcactg

SEQ ID NO: 641465 - DNA, 25 bp, Rattus norvegicus
tggtgttacctcagtcaggcctatg

SEQ ID NO: 641466 - DNA, 25 bp, Rattus norvegicus
tggtgttacctctgtcaggcctatg

SEQ ID NO: 641467 - DNA, 25 bp, Rattus norvegicus
tggtgttatttacctcctggatata

SEQ ID NO: 641468 - DNA, 25 bp, Rattus norvegicus
tggtgttatttagctcctggatata

SEQ ID NO: 641469 - DNA, 25 bp, Rattus norvegicus
tggtgttcacaaagcctagcgagtc

SEQ ID NO: 641470 - DNA, 25 bp, Rattus norvegicus
tggtgttcacaatgcctagcgagtc

SEQ ID NO: 641471 - DNA, 25 bp, Rattus norvegicus
tggtgttcacagcatgcatgaccct

SEQ ID NO: 641472 - DNA, 25 bp, Rattus norvegicus
tggtgttcacaggatgcatgaccct

SEQ ID NO: 641473 - DNA, 25 bp, Rattus norvegicus
tggtgttcaccacggctcatctaat

SEQ ID NO: 641474 - DNA, 25 bp, Rattus norvegicus
tggtgttcaccagggctcatctaat

SEQ ID NO: 641475 - DNA, 25 bp, Rattus norvegicus
tggtgttcacgcactcagcaggaaa

SEQ ID NO: 641476 - DNA, 25 bp, Rattus norvegicus
tggtgttcacgctctcagcaggaaa

SEQ ID NO: 641477 - DNA, 25 bp, Rattus norvegicus
tggtgttcaggtctggcttgcatac

SEQ ID NO: 641478 - DNA, 25 bp, Rattus norvegicus
tggtgttcaggtgtggcttgcatac

SEQ ID NO: 641479 - DNA, 25 bp, Rattus norvegicus
tggtgttcatatccacccacaaaca

SEQ ID NO: 641480 - DNA, 25 bp, Rattus norvegicus
tggtgttcatatgcacccacaaaca

SEQ ID NO: 641481 - DNA, 25 bp, Rattus norvegicus
tggtgttcatgtcttgttgccttta

SEQ ID NO: 641482 - DNA, 25 bp, Rattus norvegicus
tggtgttcatgtgttgttgccttta

SEQ ID NO: 641483 - DNA, 25 bp, Rattus norvegicus
tggtgttccccgaatgatgttgaca

SEQ ID NO: 641484 - DNA, 25 bp, Rattus norvegicus
tggtgttccccgtatgatgttgaca

SEQ ID NO: 641485 - DNA, 25 bp, Rattus norvegicus
tggtgttccgacctaacttacaaga

SEQ ID NO: 641486 - DNA, 25 bp, Rattus norvegicus
tggtgttccgacgtaacttacaaga

SEQ ID NO: 641487 - DNA, 25 bp, Rattus norvegicus
tggtgttcctggatcttgggccctc

SEQ ID NO: 641488 - DNA, 25 bp, Rattus norvegicus
tggtgttcctggttcttgggccctc

SEQ ID NO: 641489 - DNA, 25 bp, Rattus norvegicus
tggtgttcgcatctagtcccagcac

SEQ ID NO: 641490 - DNA, 25 bp, Rattus norvegicus
tggtgttcgcatgtagtcccagcac

SEQ ID NO: 641491 - DNA, 25 bp, Rattus norvegicus
tggtgttcggtgacacccagctgcc

SEQ ID NO: 641492 - DNA, 25 bp, Rattus norvegicus
tggtgttcggtgtcacccagctgcc

SEQ ID NO: 641493 - DNA, 25 bp, Rattus norvegicus
tggtgttctctcacattctcaagac

SEQ ID NO: 641494 - DNA, 25 bp, Rattus norvegicus
tggtgttctctctcattctcaagac

SEQ ID NO: 641495 - DNA, 25 bp, Rattus norvegicus
tggtgttctgtcaaaactccactcc

SEQ ID NO: 641496 - DNA, 25 bp, Rattus norvegicus
tggtgttctgtctaaactccactcc

SEQ ID NO: 641497 - DNA, 25 bp, Rattus norvegicus
tggtgttctttgacacgcatggaat

SEQ ID NO: 641498 - DNA, 25 bp, Rattus norvegicus
tggtgttctttgtcacgcatggaat

SEQ ID NO: 641499 - DNA, 25 bp, Rattus norvegicus
tggtgttgacccattcataaggatg

SEQ ID NO: 641500 - DNA, 25 bp, Rattus norvegicus
tggtgttgaccctttcataaggatg

SEQ ID NO: 641501 - DNA, 25 bp, Rattus norvegicus
tggtgttgaggcaagtctggcttat

SEQ ID NO: 641502 - DNA, 25 bp, Rattus norvegicus
tggtgttgaggctagtctggcttat

SEQ ID NO: 641503 - DNA, 25 bp, Rattus norvegicus
tggtgttgcccaaccaaccagggat

SEQ ID NO: 641504 - DNA, 25 bp, Rattus norvegicus
tggtgttgcccatccaaccagggat

SEQ ID NO: 641505 - DNA, 25 bp, Rattus norvegicus
tggtgttgcccccaaaagaaatggc

SEQ ID NO: 641506 - DNA, 25 bp, Rattus norvegicus
tggtgttgccccgaaaagaaatggc

SEQ ID NO: 641507 - DNA, 25 bp, Rattus norvegicus
tggtgttggctcagggaatcatttt

SEQ ID NO: 641508 - DNA, 25 bp, Rattus norvegicus
tggtgttggctctgggaatcatttt

SEQ ID NO: 641509 - DNA, 25 bp, Rattus norvegicus
tggtgttgtgaaccctgtcctctga

SEQ ID NO: 641510 - DNA, 25 bp, Rattus norvegicus
tggtgttgtgaagcctgtcctctga

SEQ ID NO: 641511 - DNA, 25 bp, Rattus norvegicus
tggtgtttatcgactttgccgttca

SEQ ID NO: 641512 - DNA, 25 bp, Rattus norvegicus
tggtgtttatcgtctttgccgttca

SEQ ID NO: 641513 - DNA, 25 bp, Rattus norvegicus
tggtgtttcagtcctcagagagctg

SEQ ID NO: 641514 - DNA, 25 bp, Rattus norvegicus
tggtgtttcagtgctcagagagctg

SEQ ID NO: 641515 - DNA, 25 bp, Rattus norvegicus
tggtgtttccacactgcacaagcat

SEQ ID NO: 641516 - DNA, 25 bp, Rattus norvegicus
tggtgtttccacataacgatttcta

SEQ ID NO: 641517 - DNA, 25 bp, Rattus norvegicus
tggtgtttccactctgcacaagcat

SEQ ID NO: 641518 - DNA, 25 bp, Rattus norvegicus
tggtgtttccacttaacgatttcta

SEQ ID NO: 641519 - DNA, 25 bp, Rattus norvegicus
tggtgtttccttaagaactccgtct

SEQ ID NO: 641520 - DNA, 25 bp, Rattus norvegicus
tggtgtttcctttagaactccgtct

SEQ ID NO: 641521 - DNA, 25 bp, Rattus norvegicus
tggtgtttctgtcttaaccttctgt

SEQ ID NO: 641522 - DNA, 25 bp, Rattus norvegicus
tggtgtttctgtgttaaccttctgt

SEQ ID NO: 641523 - DNA, 25 bp, Rattus norvegicus
tggtgtttcttcaggatagtctcct

SEQ ID NO: 641524 - DNA, 25 bp, Rattus norvegicus
tggtgtttcttctggatagtctcct

SEQ ID NO: 641525 - DNA, 25 bp, Rattus norvegicus
tggtgtttgaggaggaactgctcaa

SEQ ID NO: 641526 - DNA, 25 bp, Rattus norvegicus
tggtgtttgaggtggaactgctcaa

SEQ ID NO: 641527 - DNA, 25 bp, Rattus norvegicus
tggtgtttgcctattttgctttgta

SEQ ID NO: 641528 - DNA, 25 bp, Rattus norvegicus
tggtgtttgccttttttgctttgta

SEQ ID NO: 641529 - DNA, 25 bp, Rattus norvegicus
tggtgtttggttacacagctgttga

SEQ ID NO: 641530 - DNA, 25 bp, Rattus norvegicus
tggtgtttggtttcacagctgttga

SEQ ID NO: 641531 - DNA, 25 bp, Rattus norvegicus
tggtgtttgtatctatgtccctata

SEQ ID NO: 641532 - DNA, 25 bp, Rattus norvegicus
tggtgtttgtatgtatgtccctata

SEQ ID NO: 641533 - DNA, 25 bp, Rattus norvegicus
tggtgtttgtttatattccccaagt

SEQ ID NO: 641534 - DNA, 25 bp, Rattus norvegicus
tggtgtttgtttttattccccaagt

SEQ ID NO: 641535 - DNA, 25 bp, Rattus norvegicus
tggtgttttatgatcgctgggatta

SEQ ID NO: 641536 - DNA, 25 bp, Rattus norvegicus
tggtgttttatgttcgctgggatta

SEQ ID NO: 641537 - DNA, 25 bp, Rattus norvegicus
tggtgttttcagcatgtccttgtcc

SEQ ID NO: 641538 - DNA, 25 bp, Rattus norvegicus
tggtgttttcaggatgtccttgtcc

SEQ ID NO: 641539 - DNA, 25 bp, Rattus norvegicus
tggtgttttgatctgctatggcctc

SEQ ID NO: 641540 - DNA, 25 bp, Rattus norvegicus
tggtgttttgatgtgctatggcctc

SEQ ID NO: 641541 - DNA, 25 bp, Rattus norvegicus
tggtgttttggactttgcccaagtt

SEQ ID NO: 641542 - DNA, 25 bp, Rattus norvegicus
tggtgttttggagtttgcccaagtt

SEQ ID NO: 641543 - DNA, 25 bp, Rattus norvegicus
tggtgtttttgactctgtgacctcc

SEQ ID NO: 641544 - DNA, 25 bp, Rattus norvegicus
tggtgtttttgagtctgtgacctcc

SEQ ID NO: 641545 - DNA, 25 bp, Rattus norvegicus
tggttaaaactcagtcccttctaag

SEQ ID NO: 641546 - DNA, 25 bp, Rattus norvegicus
tggttaaaactctgtcccttctaag

SEQ ID NO: 641547 - DNA, 25 bp, Rattus norvegicus
tggttaaacctgagtcctagagact

SEQ ID NO: 641548 - DNA, 25 bp, Rattus norvegicus
tggttaaacctgtgtcctagagact

SEQ ID NO: 641549 - DNA, 25 bp, Rattus norvegicus
tggttaaacttgatcccttccttga

SEQ ID NO: 641550 - DNA, 25 bp, Rattus norvegicus
tggttaaacttgttcccttccttga

SEQ ID NO: 641551 - DNA, 25 bp, Rattus norvegicus
tggttaaagtctcgccaccggactt

SEQ ID NO: 641552 - DNA, 25 bp, Rattus norvegicus
tggttaaagtctggccaccggactt

SEQ ID NO: 641553 - DNA, 25 bp, Rattus norvegicus
tggttaacaatgactccggagctgc

SEQ ID NO: 641554 - DNA, 25 bp, Rattus norvegicus
tggttaacaatgtctccggagctgc

SEQ ID NO: 641555 - DNA, 25 bp, Rattus norvegicus
tggttaacacctagattgcttccgt

SEQ ID NO: 641556 - DNA, 25 bp, Rattus norvegicus
tggttaacaccttgattgcttccgt

SEQ ID NO: 641557 - DNA, 25 bp, Rattus norvegicus
tggttaactcctcctgggctgacat

SEQ ID NO: 641558 - DNA, 25 bp, Rattus norvegicus
tggttaactcctgctgggctgacat

SEQ ID NO: 641559 - DNA, 25 bp, Rattus norvegicus
tggttaacttccactacttcttcta

SEQ ID NO: 641560 - DNA, 25 bp, Rattus norvegicus
tggttaacttcctctacttcttcta

SEQ ID NO: 641561 - DNA, 25 bp, Rattus norvegicus
tggttaagaaccaggcggagaagaa

SEQ ID NO: 641562 - DNA, 25 bp, Rattus norvegicus
tggttaagaacctggcggagaagaa

SEQ ID NO: 641563 - DNA, 25 bp, Rattus norvegicus
tggttaaggctgctgacaagctgct

SEQ ID NO: 641564 - DNA, 25 bp, Rattus norvegicus
tggttaaggctggtgacaagctgct

SEQ ID NO: 641565 - DNA, 25 bp, Rattus norvegicus
tggttacaacagctactatggatat

SEQ ID NO: 641566 - DNA, 25 bp, Rattus norvegicus
tggttacaacaggtactatggatat

SEQ ID NO: 641567 - DNA, 25 bp, Rattus norvegicus
tggttacaatatcctcctccatcag

SEQ ID NO: 641568 - DNA, 25 bp, Rattus norvegicus
tggttacaatatgctcctccatcag

SEQ ID NO: 641569 - DNA, 25 bp, Rattus norvegicus
tggttacacgcaagccgaggccaga

SEQ ID NO: 641570 - DNA, 25 bp, Rattus norvegicus
tggttacacgcatgccgaggccaga

SEQ ID NO: 641571 - DNA, 25 bp, Rattus norvegicus
tggttacactacagccaagggctct

SEQ ID NO: 641572 - DNA, 25 bp, Rattus norvegicus
tggttacactactgccaagggctct

SEQ ID NO: 641573 - DNA, 25 bp, Rattus norvegicus
tggttacactctccttatccagtta

SEQ ID NO: 641574 - DNA, 25 bp, Rattus norvegicus
tggttacactctgcttatccagtta

SEQ ID NO: 641575 - DNA, 25 bp, Rattus norvegicus
tggttacactgacagctggctttgc

SEQ ID NO: 641576 - DNA, 25 bp, Rattus norvegicus
tggttacactgagagctggctttgc

SEQ ID NO: 641577 - DNA, 25 bp, Rattus norvegicus
tggttacaggaaaggccggagccct

SEQ ID NO: 641578 - DNA, 25 bp, Rattus norvegicus
tggttacaggaatggccggagccct

SEQ ID NO: 641579 - DNA, 25 bp, Rattus norvegicus
tggttacagggactctaacctggcc

SEQ ID NO: 641580 - DNA, 25 bp, Rattus norvegicus
tggttacagggagtctaacctggcc

SEQ ID NO: 641581 - DNA, 25 bp, Rattus norvegicus
tggttacagtctaactttcctcgac

SEQ ID NO: 641582 - DNA, 25 bp, Rattus norvegicus
tggttacagtcttactttcctcgac

SEQ ID NO: 641583 - DNA, 25 bp, Rattus norvegicus
tggttaccaaggctgactccagtaa

SEQ ID NO: 641584 - DNA, 25 bp, Rattus norvegicus
tggttaccaagggtgactccagtaa

SEQ ID NO: 641585 - DNA, 25 bp, Rattus norvegicus
tggttacccaaaattcttagattct

SEQ ID NO: 641586 - DNA, 25 bp, Rattus norvegicus
tggttacccaaatttcttagattct

SEQ ID NO: 641587 - DNA, 25 bp, Rattus norvegicus
tggttacccagtcagcccacagtga

SEQ ID NO: 641588 - DNA, 25 bp, Rattus norvegicus
tggttacccagtgagcccacagtga

SEQ ID NO: 641589 - DNA, 25 bp, Rattus norvegicus
tggttacctaccacgtgtccaggga

SEQ ID NO: 641590 - DNA, 25 bp, Rattus norvegicus
tggttacctacctcgtgtccaggga

SEQ ID NO: 641591 - DNA, 25 bp, Rattus norvegicus
tggttacggagcagcacacacctgt

SEQ ID NO: 641592 - DNA, 25 bp, Rattus norvegicus
tggttacggagctgcacacacctgt

SEQ ID NO: 641593 - DNA, 25 bp, Rattus norvegicus
tggttacggattccccatatcacgc

SEQ ID NO: 641594 - DNA, 25 bp, Rattus norvegicus
tggttacggattgcccatatcacgc

SEQ ID NO: 641595 - DNA, 25 bp, Rattus norvegicus
tggttactaccaatcatcattgtgt

SEQ ID NO: 641596 - DNA, 25 bp, Rattus norvegicus
tggttactaccattcatcattgtgt

SEQ ID NO: 641597 - DNA, 25 bp, Rattus norvegicus
tggttactagtacaggttttgccct

SEQ ID NO: 641598 - DNA, 25 bp, Rattus norvegicus
tggttactagtagaggttttgccct

SEQ ID NO: 641599 - DNA, 25 bp, Rattus norvegicus
tggttactcttcacgttgctatgac

SEQ ID NO: 641600 - DNA, 25 bp, Rattus norvegicus
tggttactcttctcgttgctatgac

SEQ ID NO: 641601 - DNA, 25 bp, Rattus norvegicus
tggttactgtcccagcgactgagtc

SEQ ID NO: 641602 - DNA, 25 bp, Rattus norvegicus
tggttactgtccgagcgactgagtc

SEQ ID NO: 641603 - DNA, 25 bp, Rattus norvegicus
tggttacttacacattgggcatgca

SEQ ID NO: 641604 - DNA, 25 bp, Rattus norvegicus
tggttacttacagattgggcatgca

SEQ ID NO: 641605 - DNA, 25 bp, Rattus norvegicus
tggttacttgttataccgcacctaa

SEQ ID NO: 641606 - DNA, 25 bp, Rattus norvegicus
tggttacttgttttaccgcacctaa

SEQ ID NO: 641607 - DNA, 25 bp, Rattus norvegicus
tggttagaatagatcacagggagaa

SEQ ID NO: 641608 - DNA, 25 bp, Rattus norvegicus
tggttagaatagttcacagggagaa

SEQ ID NO: 641609 - DNA, 25 bp, Rattus norvegicus
tggttagacgaaccccatgccctca

SEQ ID NO: 641610 - DNA, 25 bp, Rattus norvegicus
tggttagacgaagcccatgccctca

SEQ ID NO: 641611 - DNA, 25 bp, Rattus norvegicus
tggttagacgctccggtcgccatga

SEQ ID NO: 641612 - DNA, 25 bp, Rattus norvegicus
tggttagacgctgcggtcgccatga

SEQ ID NO: 641613 - DNA, 25 bp, Rattus norvegicus
tggttagagtggcacactccttcct

SEQ ID NO: 641614 - DNA, 25 bp, Rattus norvegicus
tggttagagtgggacactccttcct

SEQ ID NO: 641615 - DNA, 25 bp, Rattus norvegicus
tggttagccggcattcatcaggatg

SEQ ID NO: 641616 - DNA, 25 bp, Rattus norvegicus
tggttagccggctttcatcaggatg

SEQ ID NO: 641617 - DNA, 25 bp, Rattus norvegicus
tggttagctctgagtctgccacggc

SEQ ID NO: 641618 - DNA, 25 bp, Rattus norvegicus
tggttagctctgtgtctgccacggc

SEQ ID NO: 641619 - DNA, 25 bp, Rattus norvegicus
tggttaggaacactggcttctcttg

SEQ ID NO: 641620 - DNA, 25 bp, Rattus norvegicus
tggttaggaacagtggcttctcttg

SEQ ID NO: 641621 - DNA, 25 bp, Rattus norvegicus
tggttaggatttcctggccaaaaag

SEQ ID NO: 641622 - DNA, 25 bp, Rattus norvegicus
tggttaggatttgctggccaaaaag

SEQ ID NO: 641623 - DNA, 25 bp, Rattus norvegicus
tggttaggcctgaagctccaagctg

SEQ ID NO: 641624 - DNA, 25 bp, Rattus norvegicus
tggttaggcctgtagctccaagctg

SEQ ID NO: 641625 - DNA, 25 bp, Rattus norvegicus
tggttagggtcacacagcctccgtg

SEQ ID NO: 641626 - DNA, 25 bp, Rattus norvegicus
tggttagggtcagacagcctccgtg

SEQ ID NO: 641627 - DNA, 25 bp, Rattus norvegicus
tggttagtcatcaccagggtcctcg

SEQ ID NO: 641628 - DNA, 25 bp, Rattus norvegicus
tggttagtcatctccagggtcctcg

SEQ ID NO: 641629 - DNA, 25 bp, Rattus norvegicus
tggttagtcttactgctagccttac

SEQ ID NO: 641630 - DNA, 25 bp, Rattus norvegicus
tggttagtcttagtgctagccttac

SEQ ID NO: 641631 - DNA, 25 bp, Rattus norvegicus
tggttagtgaatctgctttgcgaat

SEQ ID NO: 641632 - DNA, 25 bp, Rattus norvegicus
tggttagtgaatgtgctttgcgaat

SEQ ID NO: 641633 - DNA, 25 bp, Rattus norvegicus
tggttagtgccacatccatctttta

SEQ ID NO: 641634 - DNA, 25 bp, Rattus norvegicus
tggttagtgccagatccatctttta

SEQ ID NO: 641635 - DNA, 25 bp, Rattus norvegicus
tggttagtgtccatggaggtcagaa

SEQ ID NO: 641636 - DNA, 25 bp, Rattus norvegicus
tggttagtgtccttggaggtcagaa

SEQ ID NO: 641637 - DNA, 25 bp, Rattus norvegicus
tggttagtttgcaggtccatgctat

SEQ ID NO: 641638 - DNA, 25 bp, Rattus norvegicus
tggttagtttgctggtccatgctat

SEQ ID NO: 641639 - DNA, 25 bp, Rattus norvegicus
tggttataccacacagactctgcct

SEQ ID NO: 641640 - DNA, 25 bp, Rattus norvegicus
tggttataccactcagactctgcct

SEQ ID NO: 641641 - DNA, 25 bp, Rattus norvegicus
tggttatcatttacacgggtgccgg

SEQ ID NO: 641642 - DNA, 25 bp, Rattus norvegicus
tggttatcattttcacgggtgccgg

SEQ ID NO: 641643 - DNA, 25 bp, Rattus norvegicus
tggttatccagtctccccaggaaca

SEQ ID NO: 641644 - DNA, 25 bp, Rattus norvegicus
tggttatccagtgtccccaggaaca

SEQ ID NO: 641645 - DNA, 25 bp, Rattus norvegicus
tggttatcccttactccaagcagaa

SEQ ID NO: 641646 - DNA, 25 bp, Rattus norvegicus
tggttatccctttctccaagcagaa

SEQ ID NO: 641647 - DNA, 25 bp, Rattus norvegicus
tggttatctcgtaatcagtgctgcc

SEQ ID NO: 641648 - DNA, 25 bp, Rattus norvegicus
tggttatctcgttatcagtgctgcc

SEQ ID NO: 641649 - DNA, 25 bp, Rattus norvegicus
tggttatgtctgatttgggtggtat

SEQ ID NO: 641650 - DNA, 25 bp, Rattus norvegicus
tggttatgtctgttttgggtggtat

SEQ ID NO: 641651 - DNA, 25 bp, Rattus norvegicus
tggttatgtcttccgattgggcagc

SEQ ID NO: 641652 - DNA, 25 bp, Rattus norvegicus
tggttatgtcttgcgattgggcagc

SEQ ID NO: 641653 - DNA, 25 bp, Rattus norvegicus
tggttattactgatccaggtcctaa

SEQ ID NO: 641654 - DNA, 25 bp, Rattus norvegicus
tggttattactgttccaggtcctaa

SEQ ID NO: 641655 - DNA, 25 bp, Rattus norvegicus
tggttattccagctgatgagcatac

SEQ ID NO: 641656 - DNA, 25 bp, Rattus norvegicus
tggttattccaggtgatgagcatac

SEQ ID NO: 641657 - DNA, 25 bp, Rattus norvegicus
tggttattcctgcatgccaactggg

SEQ ID NO: 641658 - DNA, 25 bp, Rattus norvegicus
tggttattcctggatgccaactggg

SEQ ID NO: 641659 - DNA, 25 bp, Rattus norvegicus
tggttattgccgatctctgagtatc

SEQ ID NO: 641660 - DNA, 25 bp, Rattus norvegicus
tggttattgccgttctctgagtatc

SEQ ID NO: 641661 - DNA, 25 bp, Rattus norvegicus
tggttatttcttcatttgtttcctt

SEQ ID NO: 641662 - DNA, 25 bp, Rattus norvegicus
tggttatttcttgatttgtttcctt

SEQ ID NO: 641663 - DNA, 25 bp, Rattus norvegicus
tggttattttgaatgctgagcaggc

SEQ ID NO: 641664 - DNA, 25 bp, Rattus norvegicus
tggttattttgattgctgagcaggc

SEQ ID NO: 641665 - DNA, 25 bp, Rattus norvegicus
tggttcaaaacacttcctggctgct

SEQ ID NO: 641666 - DNA, 25 bp, Rattus norvegicus
tggttcaaaacagttcctggctgct

SEQ ID NO: 641667 - DNA, 25 bp, Rattus norvegicus
tggttcaaagcacccaccgagtcag

SEQ ID NO: 641668 - DNA, 25 bp, Rattus norvegicus
tggttcaaagcagccaccgagtcag

SEQ ID NO: 641669 - DNA, 25 bp, Rattus norvegicus
tggttcaaaggcagttctgaccggc

SEQ ID NO: 641670 - DNA, 25 bp, Rattus norvegicus
tggttcaaaggctgttctgaccggc

SEQ ID NO: 641671 - DNA, 25 bp, Rattus norvegicus
tggttcaagcctaccagtacactga

SEQ ID NO: 641672 - DNA, 25 bp, Rattus norvegicus
tggttcaagccttccagtacactga

SEQ ID NO: 641673 - DNA, 25 bp, Rattus norvegicus
tggttcaagtttaagggcacagctg

SEQ ID NO: 641674 - DNA, 25 bp, Rattus norvegicus
tggttcaagttttagggcacagctg

SEQ ID NO: 641675 - DNA, 25 bp, Rattus norvegicus
tggttcaatgaaactcatcaccctc

SEQ ID NO: 641676 - DNA, 25 bp, Rattus norvegicus
tggttcaatgaatctcatcaccctc

SEQ ID NO: 641677 - DNA, 25 bp, Rattus norvegicus
tggttcacactacgctgatcatgtt

SEQ ID NO: 641678 - DNA, 25 bp, Rattus norvegicus
tggttcacactaggctgatcatgtt

SEQ ID NO: 641679 - DNA, 25 bp, Rattus norvegicus
tggttcacatctagtcctgctaaca

SEQ ID NO: 641680 - DNA, 25 bp, Rattus norvegicus
tggttcacatcttgtcctgctaaca

SEQ ID NO: 641681 - DNA, 25 bp, Rattus norvegicus
tggttcacggagacacagaattcta

SEQ ID NO: 641682 - DNA, 25 bp, Rattus norvegicus
tggttcacggagtcacagaattcta

SEQ ID NO: 641683 - DNA, 25 bp, Rattus norvegicus
tggttcactctcagacccggagaca

SEQ ID NO: 641684 - DNA, 25 bp, Rattus norvegicus
tggttcactctctgacccggagaca

SEQ ID NO: 641685 - DNA, 25 bp, Rattus norvegicus
tggttcactgacacaaaagggtttg

SEQ ID NO: 641686 - DNA, 25 bp, Rattus norvegicus
tggttcactgactcaaaagggtttg

SEQ ID NO: 641687 - DNA, 25 bp, Rattus norvegicus
tggttcactgccagtagtcctagac

SEQ ID NO: 641688 - DNA, 25 bp, Rattus norvegicus
tggttcactgcctgtagtcctagac

SEQ ID NO: 641689 - DNA, 25 bp, Rattus norvegicus
tggttcagagtcaatcaggatcgaa

SEQ ID NO: 641690 - DNA, 25 bp, Rattus norvegicus
tggttcagagtctatcaggatcgaa

SEQ ID NO: 641691 - DNA, 25 bp, Rattus norvegicus
tggttcagcgcccttatcaagtgcc

SEQ ID NO: 641692 - DNA, 25 bp, Rattus norvegicus
tggttcagcgccgttatcaagtgcc

SEQ ID NO: 641693 - DNA, 25 bp, Rattus norvegicus
tggttcagcgtcctgcggcgaatta

SEQ ID NO: 641694 - DNA, 25 bp, Rattus norvegicus
tggttcagcgtcgtgcggcgaatta

SEQ ID NO: 641695 - DNA, 25 bp, Rattus norvegicus
tggttcagctggcttccccaatttc

SEQ ID NO: 641696 - DNA, 25 bp, Rattus norvegicus
tggttcagctgggttccccaatttc

SEQ ID NO: 641697 - DNA, 25 bp, Rattus norvegicus
tggttcaggacccagcatcagaagt

SEQ ID NO: 641698 - DNA, 25 bp, Rattus norvegicus
tggttcaggaccgagcatcagaagt

SEQ ID NO: 641699 - DNA, 25 bp, Rattus norvegicus
tggttcaggctcaaccactacctct

SEQ ID NO: 641700 - DNA, 25 bp, Rattus norvegicus
tggttcaggctctaccactacctct

SEQ ID NO: 641701 - DNA, 25 bp, Rattus norvegicus
tggttcagtaccagggagccttcaa

SEQ ID NO: 641702 - DNA, 25 bp, Rattus norvegicus
tggttcagtacctgggagccttcaa

SEQ ID NO: 641703 - DNA, 25 bp, Rattus norvegicus
tggttcataattcctaccttccaac

SEQ ID NO: 641704 - DNA, 25 bp, Rattus norvegicus
tggttcataattgctaccttccaac

SEQ ID NO: 641705 - DNA, 25 bp, Rattus norvegicus
tggttcatctgcctgtttgtggata

SEQ ID NO: 641706 - DNA, 25 bp, Rattus norvegicus
tggttcatctgcgtgtttgtggata

SEQ ID NO: 641707 - DNA, 25 bp, Rattus norvegicus
tggttcatggatactagccttgccc

SEQ ID NO: 641708 - DNA, 25 bp, Rattus norvegicus
tggttcatggattctagccttgccc

SEQ ID NO: 641709 - DNA, 25 bp, Rattus norvegicus
tggttccaaaccagatttcctgtga

SEQ ID NO: 641710 - DNA, 25 bp, Rattus norvegicus
tggttccaaacctgatttcctgtga

SEQ ID NO: 641711 - DNA, 25 bp, Rattus norvegicus
tggttccaagcactgggctaggata

SEQ ID NO: 641712 - DNA, 25 bp, Rattus norvegicus
tggttccaagcagtgggctaggata

SEQ ID NO: 641713 - DNA, 25 bp, Rattus norvegicus
tggttccacagaccctggacaacaa

SEQ ID NO: 641714 - DNA, 25 bp, Rattus norvegicus
tggttccacagagcctggacaacaa

SEQ ID NO: 641715 - DNA, 25 bp, Rattus norvegicus
tggttccacatcagtcagcttacaa

SEQ ID NO: 641716 - DNA, 25 bp, Rattus norvegicus
tggttccacatctgtcagcttacaa

SEQ ID NO: 641717 - DNA, 25 bp, Rattus norvegicus
tggttccaccagcaacggcgccgga

SEQ ID NO: 641718 - DNA, 25 bp, Rattus norvegicus
tggttccaccaggaacggcgccgga

SEQ ID NO: 641719 - DNA, 25 bp, Rattus norvegicus
tggttccaccgaaggacatgcctaa

SEQ ID NO: 641720 - DNA, 25 bp, Rattus norvegicus
tggttccaccgatggacatgcctaa

SEQ ID NO: 641721 - DNA, 25 bp, Rattus norvegicus
tggttccacctcagctaactataaa

SEQ ID NO: 641722 - DNA, 25 bp, Rattus norvegicus
tggttccacctctgctaactataaa

SEQ ID NO: 641723 - DNA, 25 bp, Rattus norvegicus
tggttccactgcctctggtgacagc

SEQ ID NO: 641724 - DNA, 25 bp, Rattus norvegicus
tggttccactgcgtctggtgacagc

SEQ ID NO: 641725 - DNA, 25 bp, Rattus norvegicus
tggttccagcacacgtctgtgatcc

SEQ ID NO: 641726 - DNA, 25 bp, Rattus norvegicus
tggttccagcactcgtctgtgatcc

SEQ ID NO: 641727 - DNA, 25 bp, Rattus norvegicus
tggttccagtaacatttgccaactg

SEQ ID NO: 641728 - DNA, 25 bp, Rattus norvegicus
tggttccagtaagatttgccaactg

SEQ ID NO: 641729 - DNA, 25 bp, Rattus norvegicus
tggttccatagcctaggtgtttctt

SEQ ID NO: 641730 - DNA, 25 bp, Rattus norvegicus
tggttccatagcgtaggtgtttctt

SEQ ID NO: 641731 - DNA, 25 bp, Rattus norvegicus
tggttccattccacagatgtgctga

SEQ ID NO: 641732 - DNA, 25 bp, Rattus norvegicus
tggttccattcctcagatgtgctga

SEQ ID NO: 641733 - DNA, 25 bp, Rattus norvegicus
tggttccattttcccgttcagatga

SEQ ID NO: 641734 - DNA, 25 bp, Rattus norvegicus
tggttccattttgccgttcagatga

SEQ ID NO: 641735 - DNA, 25 bp, Rattus norvegicus
tggttcccaccgctgtgcttgcctt

SEQ ID NO: 641736 - DNA, 25 bp, Rattus norvegicus
tggttcccaccggtgtgcttgcctt

SEQ ID NO: 641737 - DNA, 25 bp, Rattus norvegicus
tggttcccacggatctgatgccttc

SEQ ID NO: 641738 - DNA, 25 bp, Rattus norvegicus
tggttcccacggttctgatgccttc

SEQ ID NO: 641739 - DNA, 25 bp, Rattus norvegicus
tggttcccagaaccaccttggtcag

SEQ ID NO: 641740 - DNA, 25 bp, Rattus norvegicus
tggttcccagaagcaccttggtcag

SEQ ID NO: 641741 - DNA, 25 bp, Rattus norvegicus
tggttcccagatctcagacatcagt

SEQ ID NO: 641742 - DNA, 25 bp, Rattus norvegicus
tggttcccagatgtcagacatcagt

SEQ ID NO: 641743 - DNA, 25 bp, Rattus norvegicus
tggttcccaggtacatgatgctact

SEQ ID NO: 641744 - DNA, 25 bp, Rattus norvegicus
tggttcccaggttcatgatgctact

SEQ ID NO: 641745 - DNA, 25 bp, Rattus norvegicus
tggttcccagttcatcagaggtttg

SEQ ID NO: 641746 - DNA, 25 bp, Rattus norvegicus
tggttcccagttgatcagaggtttg

SEQ ID NO: 641747 - DNA, 25 bp, Rattus norvegicus
tggttcccatgcagcagtgttcaga

SEQ ID NO: 641748 - DNA, 25 bp, Rattus norvegicus
tggttcccatgctgcagtgttcaga

SEQ ID NO: 641749 - DNA, 25 bp, Rattus norvegicus
tggttccccattacacaacacatgg

SEQ ID NO: 641750 - DNA, 25 bp, Rattus norvegicus
tggttccccatttcacaacacatgg

SEQ ID NO: 641751 - DNA, 25 bp, Rattus norvegicus
tggttccccggcaagggttgctcga
